United States Patent 10,731,166 (OLIGONUCLEOTIDE PROBES AND USES THEREOF) - sequence listing, part 7

SEQ ID NO: 156023 - DNA, 38 bp, Artificial Sequence
  Synthetic oligonucleotide
tgcattgcccctactgcaccggccactttcctttctga

SEQ ID NO: 156024 - DNA, 37 bp, Artificial Sequence
  Synthetic oligonucleotide
gctcggggagggggcataggagaggacccggccgtga

SEQ ID NO: 156025 - DNA, 38 bp, Artificial Sequence
  Synthetic oligonucleotide
tgcaggggtgcggtggtggccaatggggaagggcgtga

SEQ ID NO: 156026 - DNA, 38 bp, Artificial Sequence
  Synthetic oligonucleotide
aatggagagggcgaggtggcggtggcgggagacattga

SEQ ID NO: 156027 - DNA, 38 bp, Artificial Sequence
  Synthetic oligonucleotide
tgctgcttagctataccgaagccaccccctttccttga

SEQ ID NO: 156028 - DNA, 38 bp, Artificial Sequence
  Synthetic oligonucleotide
tcaccgaggcagtgttaatattgccgccctcttcttga

SEQ ID NO: 156029 - DNA, 37 bp, Artificial Sequence
  Synthetic oligonucleotide
ttcacctccattgtcgtcacaggtaccccccgtttga

SEQ ID NO: 156030 - DNA, 35 bp, Artificial Sequence
  Synthetic oligonucleotide
gcacagcccatagctggacactctccttcattcta

SEQ ID NO: 156031 - DNA, 35 bp, Artificial Sequence
  Synthetic oligonucleotide
gcggggggtagggggagggaagatacagtcttcta

SEQ ID NO: 156032 - DNA, 35 bp, Artificial Sequence
  Synthetic oligonucleotide
gggtcaagtaaggggaagggttcaggcgggaatta

SEQ ID NO: 156033 - DNA, 36 bp, Artificial Sequence
  Synthetic oligonucleotide
accgatcctgccctgttcgaaagtatcacaccctta

SEQ ID NO: 156034 - DNA, 36 bp, Artificial Sequence
  Synthetic oligonucleotide
gcacacgctatatcttcccccgcgtacatgttctta

SEQ ID NO: 156035 - DNA, 35 bp, Artificial Sequence
  Synthetic oligonucleotide
ttgtgcgtccgcccttcctggtcttatccccgtta

SEQ ID NO: 156036 - DNA, 35 bp, Artificial Sequence
  Synthetic oligonucleotide
gaatgagctccatcgtgatacctggccccccaacc

SEQ ID NO: 156037 - DNA, 35 bp, Artificial Sequence
  Synthetic oligonucleotide
tcacgccccttctccagcgattattggcacacacc

SEQ ID NO: 156038 - DNA, 35 bp, Artificial Sequence
  Synthetic oligonucleotide
gtgcccccacgccctggtggccaactcgtaccccc

SEQ ID NO: 156039 - DNA, 32 bp, Artificial Sequence
  Synthetic oligonucleotide
gcacaccctccagcggtcgcatcgctctcccc

SEQ ID NO: 156040 - DNA, 35 bp, Artificial Sequence
  Synthetic oligonucleotide
ctcaccatctcgtctttacctcctactccgggtcc

SEQ ID NO: 156041 - DNA, 35 bp, Artificial Sequence
  Synthetic oligonucleotide
ggatccggcggtcgtaaacttgccgtctttcttcc

SEQ ID NO: 156042 - DNA, 35 bp, Artificial Sequence
  Synthetic oligonucleotide
gcgatgcaccggttgtaccatcctgctcttctagc

SEQ ID NO: 156043 - DNA, 35 bp, Artificial Sequence
  Synthetic oligonucleotide
aaacccctgactcgccctgaccgctccacacgcgc

SEQ ID NO: 156044 - DNA, 35 bp, Artificial Sequence
  Synthetic oligonucleotide
tgccacaccctgctgctttggtcctcccgataggc

SEQ ID NO: 156045 - DNA, 35 bp, Artificial Sequence
  Synthetic oligonucleotide
aaggggaagtcaagaaggttggagggcgggagggc

SEQ ID NO: 156046 - DNA, 35 bp, Artificial Sequence
  Synthetic oligonucleotide
accaggcgattagccgcgtacgccccacaccgtgc

SEQ ID NO: 156047 - DNA, 35 bp, Artificial Sequence
  Synthetic oligonucleotide
gtcgtgcccctgtccctgccttttacagtttgtgc

SEQ ID NO: 156048 - DNA, 35 bp, Artificial Sequence
  Synthetic oligonucleotide
atagccaccaccttcacggattaagttccgcttgc

SEQ ID NO: 156049 - DNA, 35 bp, Artificial Sequence
  Synthetic oligonucleotide
agatccaccccgtcactggcattcttccaatactc

SEQ ID NO: 156050 - DNA, 35 bp, Artificial Sequence
  Synthetic oligonucleotide
agctggagctccgattcacgccctccgacgtcctc

SEQ ID NO: 156051 - DNA, 35 bp, Artificial Sequence
  Synthetic oligonucleotide
aaactggacctcccccgctggcacgctacgctgtc

SEQ ID NO: 156052 - DNA, 35 bp, Artificial Sequence
  Synthetic oligonucleotide
atcccccccgcccacctgatgggcagtatcgcttc

SEQ ID NO: 156053 - DNA, 35 bp, Artificial Sequence
  Synthetic oligonucleotide
tattgaacgaaagacaagggggaggcggagggacg

SEQ ID NO: 156054 - DNA, 35 bp, Artificial Sequence
  Synthetic oligonucleotide
gtgcgtaacctcgcggcctgtaatatcctcccccg

SEQ ID NO: 156055 - DNA, 35 bp, Artificial Sequence
  Synthetic oligonucleotide
acgctccctgtccctgccgatcctaattttcttcg

SEQ ID NO: 156056 - DNA, 35 bp, Artificial Sequence
  Synthetic oligonucleotide
tgactcctcaacacggttacccctcgccgctaagg

SEQ ID NO: 156057 - DNA, 35 bp, Artificial Sequence
  Synthetic oligonucleotide
gccagtggggggggtggggaagtaactgaggcggg

SEQ ID NO: 156058 - DNA, 35 bp, Artificial Sequence
  Synthetic oligonucleotide
tggggtggtaggagaggattaagggagtcgagggg

SEQ ID NO: 156059 - DNA, 35 bp, Artificial Sequence
  Synthetic oligonucleotide
ttgctgctatgcatatctacttctccactccctgg

SEQ ID NO: 156060 - DNA, 35 bp, Artificial Sequence
  Synthetic oligonucleotide
catcctccgctgtgccgctcttaccaccactcgtg

SEQ ID NO: 156061 - DNA, 35 bp, Artificial Sequence
  Synthetic oligonucleotide
gtgacatcttgcgctgcccttcttcctcactgttg

SEQ ID NO: 156062 - DNA, 35 bp, Artificial Sequence
  Synthetic oligonucleotide
gcacggtcataccgcttatgagcccgtctccacct

SEQ ID NO: 156063 - DNA, 35 bp, Artificial Sequence
  Synthetic oligonucleotide
gagcgccagaggcgtgcctctactccccgtcccct

SEQ ID NO: 156064 - DNA, 35 bp, Artificial Sequence
  Synthetic oligonucleotide
acgaccctcacagcttaataaacgcatctgcctct

SEQ ID NO: 156065 - DNA, 35 bp, Artificial Sequence
  Synthetic oligonucleotide
gtgcatgctcctatccggctaacaggcacccttct

SEQ ID NO: 156066 - DNA, 35 bp, Artificial Sequence
  Synthetic oligonucleotide
gcaccaccattcgcatccacccgtgccctgtcggt

SEQ ID NO: 156067 - DNA, 35 bp, Artificial Sequence
  Synthetic oligonucleotide
tgagtccgccccctcctgcttacattctggaatgt

SEQ ID NO: 156068 - DNA, 35 bp, Artificial Sequence
  Synthetic oligonucleotide
gatgctaggcgtcccattcttaccacccatgtctt

SEQ ID NO: 156069 - DNA, 35 bp, Artificial Sequence
  Synthetic oligonucleotide
tgcccccagtccgcgccccgcattcgcgccaattt

SEQ ID NO: 156070 - DNA, 36 bp, Artificial Sequence
  Synthetic oligonucleotide
gcaagatggactaggtgaacacggggaagggggcaa

SEQ ID NO: 156071 - DNA, 34 bp, Artificial Sequence
  Synthetic oligonucleotide
gaccatgcgcccgagccccacgtgtcccccgtaa

SEQ ID NO: 156072 - DNA, 36 bp, Artificial Sequence
  Synthetic oligonucleotide
gtcatccatcaacagcgattaagccgcctccataca

SEQ ID NO: 156073 - DNA, 36 bp, Artificial Sequence
  Synthetic oligonucleotide
ttaccatcgcagttagtcattcccccgcggttacca

SEQ ID NO: 156074 - DNA, 36 bp, Artificial Sequence
  Synthetic oligonucleotide
accgcgaccactccccccacctgcgcccgtagccca

SEQ ID NO: 156075 - DNA, 35 bp, Artificial Sequence
  Synthetic oligonucleotide
gagacaggagctccgccgccacttttcccctcgca

SEQ ID NO: 156076 - DNA, 36 bp, Artificial Sequence
  Synthetic oligonucleotide
gtccctcaccttagttgttctagtttcgcctgttca

SEQ ID NO: 156077 - DNA, 37 bp, Artificial Sequence
  Synthetic oligonucleotide
ggggtaggaagcagaagggggggcaatcagagtcaga

SEQ ID NO: 156078 - DNA, 37 bp, Artificial Sequence
  Synthetic oligonucleotide
ggatccatctgcctgccgtattaccttgcctacgaga

SEQ ID NO: 156079 - DNA, 37 bp, Artificial Sequence
  Synthetic oligonucleotide
gcgaacaggggtggagcaaaaaaggttaggtgtgaga

SEQ ID NO: 156080 - DNA, 37 bp, Artificial Sequence
  Synthetic oligonucleotide
aacgacacgcgcctcgactctagcacccctcttccga

SEQ ID NO: 156081 - DNA, 37 bp, Artificial Sequence
  Synthetic oligonucleotide
tgaccgtgccacacgcgcgactatttccgcctctcga

SEQ ID NO: 156082 - DNA, 37 bp, Artificial Sequence
  Synthetic oligonucleotide
gtggggagggagaattgaaggggagacatgtggggga

SEQ ID NO: 156083 - DNA, 37 bp, Artificial Sequence
  Synthetic oligonucleotide
accaccaccccccgcacgtcccagctttatacatgga

SEQ ID NO: 156084 - DNA, 37 bp, Artificial Sequence
  Synthetic oligonucleotide
acgaaggccacaccggccccacgctactccacctgga

SEQ ID NO: 156085 - DNA, 37 bp, Artificial Sequence
  Synthetic oligonucleotide
gtcattccccatgctaacgtggcgcctcttccttgga

SEQ ID NO: 156086 - DNA, 37 bp, Artificial Sequence
  Synthetic oligonucleotide
ggggggaccgtagggggcaattgaggcgggaatatga

SEQ ID NO: 156087 - DNA, 36 bp, Artificial Sequence
  Synthetic oligonucleotide
gcgttagggggtggtggactatagggaagggggtga

SEQ ID NO: 156088 - DNA, 35 bp, Artificial Sequence
  Synthetic oligonucleotide
gacacgagtcgggtctcgcctgcacttctccttga

SEQ ID NO: 156089 - DNA, 37 bp, Artificial Sequence
  Synthetic oligonucleotide
tctgacccttgtccatgtctttcgcctgatttcttga

SEQ ID NO: 156090 - DNA, 37 bp, Artificial Sequence
  Synthetic oligonucleotide
tgtcgagaggcgcaggaggaggaagggtgattgttga

SEQ ID NO: 156091 - DNA, 35 bp, Artificial Sequence
  Synthetic oligonucleotide
tccatttgcctccactgaagtatactccagcccac

SEQ ID NO: 156092 - DNA, 35 bp, Artificial Sequence
  Synthetic oligonucleotide
gagacacttcgaagtctaccatgcttcacctccac

SEQ ID NO: 156093 - DNA, 35 bp, Artificial Sequence
  Synthetic oligonucleotide
actctcactcacggttctttaactctgacttccac

SEQ ID NO: 156094 - DNA, 35 bp, Artificial Sequence
  Synthetic oligonucleotide
gtcagtcgcccccgtacacgtttacctgcataacc

SEQ ID NO: 156095 - DNA, 35 bp, Artificial Sequence
  Synthetic oligonucleotide
gtcgtaccgctccaaccgcgaacgtgacattcacc

SEQ ID NO: 156096 - DNA, 34 bp, Artificial Sequence
  Synthetic oligonucleotide
gacactccgatcggacgctttaaaaccactcccc

SEQ ID NO: 156097 - DNA, 35 bp, Artificial Sequence
  Synthetic oligonucleotide
gcacataccccgccctctaccgcgtaatatcagcc

SEQ ID NO: 156098 - DNA, 35 bp, Artificial Sequence
  Synthetic oligonucleotide
taaccacagattcttcattgtgcctcgtttcctcc

SEQ ID NO: 156099 - DNA, 35 bp, Artificial Sequence
  Synthetic oligonucleotide
atagctgcagctgctcgaattcaccccctcgtcgc

SEQ ID NO: 156100 - DNA, 35 bp, Artificial Sequence
  Synthetic oligonucleotide
gggccccccctgctcactcctgtgctccgcccggc

SEQ ID NO: 156101 - DNA, 35 bp, Artificial Sequence
  Synthetic oligonucleotide
gtagccttctaagaccctcgctttataccccgtgc

SEQ ID NO: 156102 - DNA, 35 bp, Artificial Sequence
  Synthetic oligonucleotide
acgaagccattggcattgcttctcgttaccccatc

SEQ ID NO: 156103 - DNA, 35 bp, Artificial Sequence
  Synthetic oligonucleotide
gatcttcgcccaccatgcatagttaggccgccatc

SEQ ID NO: 156104 - DNA, 35 bp, Artificial Sequence
  Synthetic oligonucleotide
atgcacaactgacccgcagcccgtctccccctatc

SEQ ID NO: 156105 - DNA, 35 bp, Artificial Sequence
  Synthetic oligonucleotide
tgtctcgcccgtttccatgtagcagcatttaactc

SEQ ID NO: 156106 - DNA, 35 bp, Artificial Sequence
  Synthetic oligonucleotide
aactctccgcccaagaggatggccttccgtacctc

SEQ ID NO: 156107 - DNA, 35 bp, Artificial Sequence
  Synthetic oligonucleotide
taccacaccacccgtccacccggtgacagaccgtc

SEQ ID NO: 156108 - DNA, 35 bp, Artificial Sequence
  Synthetic oligonucleotide
tccagcaggctcatccctgagtaccccgccaattc

SEQ ID NO: 156109 - DNA, 35 bp, Artificial Sequence
  Synthetic oligonucleotide
ggacgtgaccgtcgcctttacgcccatatctgttc

SEQ ID NO: 156110 - DNA, 35 bp, Artificial Sequence
  Synthetic oligonucleotide
agaggaggggagaaaatggggtacaatgaggccag

SEQ ID NO: 156111 - DNA, 35 bp, Artificial Sequence
  Synthetic oligonucleotide
gcgatcacatgtacgctcgccacgccaccccaccg

SEQ ID NO: 156112 - DNA, 35 bp, Artificial Sequence
  Synthetic oligonucleotide
actgggcccacgacgagccctccgcccttttaccg

SEQ ID NO: 156113 - DNA, 35 bp, Artificial Sequence
  Synthetic oligonucleotide
ggggaacgcagcgcggggggggcccgtaaaagggg

SEQ ID NO: 156114 - DNA, 35 bp, Artificial Sequence
  Synthetic oligonucleotide
ttagcccaactcctctgtactattgctcccccctg

SEQ ID NO: 156115 - DNA, 35 bp, Artificial Sequence
  Synthetic oligonucleotide
tgtttaccactcttagcgtccgtctgtccctcctg

SEQ ID NO: 156116 - DNA, 35 bp, Artificial Sequence
  Synthetic oligonucleotide
tctggccccctctgttagctccaccccattccttg

SEQ ID NO: 156117 - DNA, 35 bp, Artificial Sequence
  Synthetic oligonucleotide
tcgcaaccacacctaagatgccgatcgcctccact

SEQ ID NO: 156118 - DNA, 35 bp, Artificial Sequence
  Synthetic oligonucleotide
tacgtccgctgccccggtactcagccattgctact

SEQ ID NO: 156119 - DNA, 35 bp, Artificial Sequence
  Synthetic oligonucleotide
gatactgtgtctcgatgcccgctccgcccgatcct

SEQ ID NO: 156120 - DNA, 35 bp, Artificial Sequence
  Synthetic oligonucleotide
taatggcaccaactgacctgtccctattcactgct

SEQ ID NO: 156121 - DNA, 35 bp, Artificial Sequence
  Synthetic oligonucleotide
tatgcgcctcgaccccgtgcatttttttgtcctct

SEQ ID NO: 156122 - DNA, 35 bp, Artificial Sequence
  Synthetic oligonucleotide
atgaccggcccacttcctttaaccgcgcgaacctt

SEQ ID NO: 156123 - DNA, 35 bp, Artificial Sequence
  Synthetic oligonucleotide
ttgacaaacgctattgcccgactccgccttccgtt

SEQ ID NO: 156124 - DNA, 34 bp, Artificial Sequence
  Synthetic oligonucleotide
tccacgtactatccctgccggcgcactccaacaa

SEQ ID NO: 156125 - DNA, 36 bp, Artificial Sequence
  Synthetic oligonucleotide
tccccccgactgcccgtgcagcctcacactattcaa

SEQ ID NO: 156126 - DNA, 36 bp, Artificial Sequence
  Synthetic oligonucleotide
gatcccgccggtcctgtccaatactctagcttaaca

SEQ ID NO: 156127 - DNA, 35 bp, Artificial Sequence
  Synthetic oligonucleotide
gtaccgcccgtaggatagatccgacccccacgcca

SEQ ID NO: 156128 - DNA, 36 bp, Artificial Sequence
  Synthetic oligonucleotide
acttcacgccgcccttatacggtttcgtcttcgcca

SEQ ID NO: 156129 - DNA, 35 bp, Artificial Sequence
  Synthetic oligonucleotide
gtgccggtcgcagtctttcgttatcgacccctcca

SEQ ID NO: 156130 - DNA, 36 bp, Artificial Sequence
  Synthetic oligonucleotide
gtcacagttcctcccaccgcagcgcccttgcgtgca

SEQ ID NO: 156131 - DNA, 36 bp, Artificial Sequence
  Synthetic oligonucleotide
tttaacgcccgccctcctatcgccgcttctgcctca

SEQ ID NO: 156132 - DNA, 36 bp, Artificial Sequence
  Synthetic oligonucleotide
gccgcccttgtacgtacacatccccctcccggttca

SEQ ID NO: 156133 - DNA, 37 bp, Artificial Sequence
  Synthetic oligonucleotide
tgggggggatgggagggttgcgagaatcagcgataga

SEQ ID NO: 156134 - DNA, 36 bp, Artificial Sequence
  Synthetic oligonucleotide
atcaccgtgattcctgccgcactgcccgccatccga

SEQ ID NO: 156135 - DNA, 36 bp, Artificial Sequence
  Synthetic oligonucleotide
atcctcctccgccatcatgggccttagacccctcga

SEQ ID NO: 156136 - DNA, 36 bp, Artificial Sequence
  Synthetic oligonucleotide
taccccccgcacctcacacgtcctctgggagacgga

SEQ ID NO: 156137 - DNA, 37 bp, Artificial Sequence
  Synthetic oligonucleotide
gttggggttaaccgcacagggaggggtagccggggga

SEQ ID NO: 156138 - DNA, 37 bp, Artificial Sequence
  Synthetic oligonucleotide
gccccaccgttcggtagccgctttcgtttccctggga

SEQ ID NO: 156139 - DNA, 37 bp, Artificial Sequence
  Synthetic oligonucleotide
gagggtgccttctggaggggcgataggggatagtgga

SEQ ID NO: 156140 - DNA, 38 bp, Artificial Sequence
  Synthetic oligonucleotide
gtcccccccctattgcgtaccgaacaggcattgcatga

SEQ ID NO: 156141 - DNA, 38 bp, Artificial Sequence
  Synthetic oligonucleotide
gttgcctcctcgtctatccggtacaccatttctactga

SEQ ID NO: 156142 - DNA, 38 bp, Artificial Sequence
  Synthetic oligonucleotide
tccagccccctgcgctcgagttctcttacccaccgtga

SEQ ID NO: 156143 - DNA, 37 bp, Artificial Sequence
  Synthetic oligonucleotide
agagagcggggggttggagcgaggcggggagcggtga

SEQ ID NO: 156144 - DNA, 38 bp, Artificial Sequence
  Synthetic oligonucleotide
acgaccacatccctgttccccccgtccattgttcttga

SEQ ID NO: 156145 - DNA, 37 bp, Artificial Sequence
  Synthetic oligonucleotide
tccgcatcagctctccgtattccatccatcacgttga

SEQ ID NO: 156146 - DNA, 37 bp, Artificial Sequence
  Synthetic oligonucleotide
accccataccgcctgaacgaccttagccattcgttga

SEQ ID NO: 156147 - DNA, 35 bp, Artificial Sequence
  Synthetic oligonucleotide
tcaacgccacctctgcctaagtccgtccgccgcta

SEQ ID NO: 156148 - DNA, 36 bp, Artificial Sequence
  Synthetic oligonucleotide
tgcgcccatttccacccgtccccgtttcgtttggta

SEQ ID NO: 156149 - DNA, 36 bp, Artificial Sequence
  Synthetic oligonucleotide
tacgcctccccaccatcttggcttgactgtcaatta

SEQ ID NO: 156150 - DNA, 36 bp, Artificial Sequence
  Synthetic oligonucleotide
acccgccccctagattgactgcttattgtcgcgtta

SEQ ID NO: 156151 - DNA, 35 bp, Artificial Sequence
  Synthetic oligonucleotide
gaccctcgcacggttgacctctaccctgtctcacc

SEQ ID NO: 156152 - DNA, 35 bp, Artificial Sequence
  Synthetic oligonucleotide
aacaccgagcaccagcgataatacgccacacaccc

SEQ ID NO: 156153 - DNA, 35 bp, Artificial Sequence
  Synthetic oligonucleotide
tacgcactcaccaaagccgtcggtcacaccacccc

SEQ ID NO: 156154 - DNA, 35 bp, Artificial Sequence
  Synthetic oligonucleotide
atcgaatcctcgcacctgcccttgcaccggtcccc

SEQ ID NO: 156155 - DNA, 35 bp, Artificial Sequence
  Synthetic oligonucleotide
tacagcacggttgtgcttatcgtacgtccttcccc

SEQ ID NO: 156156 - DNA, 35 bp, Artificial Sequence
  Synthetic oligonucleotide
gcccacgtcctcgccacacacctaccctcgcatcc

SEQ ID NO: 156157 - DNA, 35 bp, Artificial Sequence
  Synthetic oligonucleotide
gtgacgcgcctccgcttatgcctgtgccctgctcc

SEQ ID NO: 156158 - DNA, 35 bp, Artificial Sequence
  Synthetic oligonucleotide
tgctcgtcaaccgtcattgtacgcccccgttgtcc

SEQ ID NO: 156159 - DNA, 35 bp, Artificial Sequence
  Synthetic oligonucleotide
tcagcccgctgcttttatccgaccagctcctttcc

SEQ ID NO: 156160 - DNA, 35 bp, Artificial Sequence
  Synthetic oligonucleotide
ccacctgtcctcacttgccccttcctccgccgagc

SEQ ID NO: 156161 - DNA, 35 bp, Artificial Sequence
  Synthetic oligonucleotide
cacaccccctcgttatcacacactgactccttagc

SEQ ID NO: 156162 - DNA, 35 bp, Artificial Sequence
  Synthetic oligonucleotide
gcaggcgatcctgccccgccccgcattcttcgcgc

SEQ ID NO: 156163 - DNA, 35 bp, Artificial Sequence
  Synthetic oligonucleotide
cattgtcccacctgctggcgccgttcctgcccatc

SEQ ID NO: 156164 - DNA, 35 bp, Artificial Sequence
  Synthetic oligonucleotide
tcaccacatcacgcacctgctttagaccccccctc

SEQ ID NO: 156165 - DNA, 35 bp, Artificial Sequence
  Synthetic oligonucleotide
gtccaactctgtctattaggccacgcgctcccctc

SEQ ID NO: 156166 - DNA, 35 bp, Artificial Sequence
  Synthetic oligonucleotide
tgtgccctagcctcactggtatcactttcttcctc

SEQ ID NO: 156167 - DNA, 35 bp, Artificial Sequence
  Synthetic oligonucleotide
ccctgactcttctgtatgcccaaccctcaccgctc

SEQ ID NO: 156168 - DNA, 35 bp, Artificial Sequence
  Synthetic oligonucleotide
atccgaccatcacagctcctggggctccatatctc

SEQ ID NO: 156169 - DNA, 35 bp, Artificial Sequence
  Synthetic oligonucleotide
gccctgtcaccccttcccacagccgatttggtgtc

SEQ ID NO: 156170 - DNA, 35 bp, Artificial Sequence
  Synthetic oligonucleotide
tgactcaccctacgctcccgtatagccaccgattc

SEQ ID NO: 156171 - DNA, 35 bp, Artificial Sequence
  Synthetic oligonucleotide
gatgtggcgtggggggtaataccaaggaagggaag

SEQ ID NO: 156172 - DNA, 35 bp, Artificial Sequence
  Synthetic oligonucleotide
atcccaccttgcatcacttcaggccctgccccacg

SEQ ID NO: 156173 - DNA, 35 bp, Artificial Sequence
  Synthetic oligonucleotide
acatcgcctccgttctgacaccctcttaagtcacg

SEQ ID NO: 156174 - DNA, 35 bp, Artificial Sequence
  Synthetic oligonucleotide
gagcaccaacctatctgtgtcacgtatctactccg

SEQ ID NO: 156175 - DNA, 35 bp, Artificial Sequence
  Synthetic oligonucleotide
ttggccttccgaccgcccgtctccacttccgtccg

SEQ ID NO: 156176 - DNA, 35 bp, Artificial Sequence
  Synthetic oligonucleotide
gtccttgacacgttgacccccccctcgaccctgcg

SEQ ID NO: 156177 - DNA, 35 bp, Artificial Sequence
  Synthetic oligonucleotide
tccccacccggcttatgctttttgattgctcttcg

SEQ ID NO: 156178 - DNA, 35 bp, Artificial Sequence
  Synthetic oligonucleotide
tgttccctcctgtgccggccattaccctctgtatg

SEQ ID NO: 156179 - DNA, 35 bp, Artificial Sequence
  Synthetic oligonucleotide
tccccacctcccgaagaaccaacaaacgctccttg

SEQ ID NO: 156180 - DNA, 35 bp, Artificial Sequence
  Synthetic oligonucleotide
gttaactgtcgcgccctctcatctccgtctgttat

SEQ ID NO: 156181 - DNA, 35 bp, Artificial Sequence
  Synthetic oligonucleotide
gggtgtgcccgcccttatgcccttctacaggaact

SEQ ID NO: 156182 - DNA, 35 bp, Artificial Sequence
  Synthetic oligonucleotide
gtcccccagaaggtactaatgatttcccctctact

SEQ ID NO: 156183 - DNA, 35 bp, Artificial Sequence
  Synthetic oligonucleotide
acccgatgacatgattgccaggccccacctcccct

SEQ ID NO: 156184 - DNA, 35 bp, Artificial Sequence
  Synthetic oligonucleotide
ggacgcatctcctgcgcaccggtgttccgctccct

SEQ ID NO: 156185 - DNA, 35 bp, Artificial Sequence
  Synthetic oligonucleotide
acgtaagtgcagcattatatcaactgttctctcct

SEQ ID NO: 156186 - DNA, 35 bp, Artificial Sequence
  Synthetic oligonucleotide
ttgcacggactctttgcatgggcccttgatcctct

SEQ ID NO: 156187 - DNA, 35 bp, Artificial Sequence
  Synthetic oligonucleotide
gctgcacacgtttgcaccagccggttcccctctgt

SEQ ID NO: 156188 - DNA, 35 bp, Artificial Sequence
  Synthetic oligonucleotide
tcacctgcccccagccgataagctccttaggaatt

SEQ ID NO: 156189 - DNA, 35 bp, Artificial Sequence
  Synthetic oligonucleotide
taccccaccccgcacgtgccccatcagtcaacctt

SEQ ID NO: 156190 - DNA, 35 bp, Artificial Sequence
  Synthetic oligonucleotide
gtgtgacagtccagatcgccgccgcaaccgccttt

SEQ ID NO: 156191 - DNA, 35 bp, Artificial Sequence
  Synthetic oligonucleotide
gatcccactctcatatgatatgccctgttgtcttt

SEQ ID NO: 156192 - DNA, 36 bp, Artificial Sequence
  Synthetic oligonucleotide
gcgaagcacccggcttatgatccgaccaccctacaa

SEQ ID NO: 156193 - DNA, 36 bp, Artificial Sequence
  Synthetic oligonucleotide
aaaagggcgggcgacgggaggggaattcacgtagaa

SEQ ID NO: 156194 - DNA, 36 bp, Artificial Sequence
  Synthetic oligonucleotide
gccgtatccgcctctgacctctatactggattctaa

SEQ ID NO: 156195 - DNA, 36 bp, Artificial Sequence
  Synthetic oligonucleotide
tagggtcagcccgccaaatctgcctctgtcctttaa

SEQ ID NO: 156196 - DNA, 35 bp, Artificial Sequence
  Synthetic oligonucleotide
ggagccagaggatggtgggcgggtgggagctttaa

SEQ ID NO: 156197 - DNA, 36 bp, Artificial Sequence
  Synthetic oligonucleotide
attgccctctactgctgccccttagtggcttgacca

SEQ ID NO: 156198 - DNA, 35 bp, Artificial Sequence
  Synthetic oligonucleotide
acgacggccgttctcgtttgcccccgttgccccca

SEQ ID NO: 156199 - DNA, 36 bp, Artificial Sequence
  Synthetic oligonucleotide
acacccgaccccgctgcgtgcaccacctcgttccca

SEQ ID NO: 156200 - DNA, 36 bp, Artificial Sequence
  Synthetic oligonucleotide
ttgtcacgtctcgccccgtccgcaatctaccatcca

SEQ ID NO: 156201 - DNA, 36 bp, Artificial Sequence
  Synthetic oligonucleotide
atgcccgctgggactcccaccccatatgttgctcca

SEQ ID NO: 156202 - DNA, 35 bp, Artificial Sequence
  Synthetic oligonucleotide
tgcccccctcacctctgcgctttccctgacgtcca

SEQ ID NO: 156203 - DNA, 36 bp, Artificial Sequence
  Synthetic oligonucleotide
gttgctgtgcccgccccctctacggatcgcattcca

SEQ ID NO: 156204 - DNA, 36 bp, Artificial Sequence
  Synthetic oligonucleotide
taccagtccgcccgcaggtttcttagtccccagtca

SEQ ID NO: 156205 - DNA, 37 bp, Artificial Sequence
  Synthetic oligonucleotide
tgttgccgcctcatcatctctttggtcaaccgtacga

SEQ ID NO: 156206 - DNA, 35 bp, Artificial Sequence
  Synthetic oligonucleotide
tgctaaccaccggccttcaccattgcgtcctccga

SEQ ID NO: 156207 - DNA, 37 bp, Artificial Sequence
  Synthetic oligonucleotide
tcctcccctgttgctaattggaccattccatctccga

SEQ ID NO: 156208 - DNA, 38 bp, Artificial Sequence
  Synthetic oligonucleotide
atccccatagcgtcccccgtgccgcactcctatcctga

SEQ ID NO: 156209 - DNA, 38 bp, Artificial Sequence
  Synthetic oligonucleotide
gcgcacctccccggagtgatccgtccatgccctcctga

SEQ ID NO: 156210 - DNA, 36 bp, Artificial Sequence
  Synthetic oligonucleotide
attaccccccggccgttcacccatccgcccctctga

SEQ ID NO: 156211 - DNA, 37 bp, Artificial Sequence
  Synthetic oligonucleotide
aatccgcatccgtgcgcgcttcccctactctttctga

SEQ ID NO: 156212 - DNA, 38 bp, Artificial Sequence
  Synthetic oligonucleotide
gggggaggaccagagggggcaatcagggggaagagtga

SEQ ID NO: 156213 - DNA, 37 bp, Artificial Sequence
  Synthetic oligonucleotide
gcactgttagtcccccgctccgtccatctctccgtga

SEQ ID NO: 156214 - DNA, 37 bp, Artificial Sequence
  Synthetic oligonucleotide
agacggatggggtggtggagaaggaaggggtcggtga

SEQ ID NO: 156215 - DNA, 37 bp, Artificial Sequence
  Synthetic oligonucleotide
gcgagacggggaatggatggaggggcctgacgattga

SEQ ID NO: 156216 - DNA, 36 bp, Artificial Sequence
  Synthetic oligonucleotide
tttcgcccgccggcacagctcctttcaacgccgcta

SEQ ID NO: 156217 - DNA, 35 bp, Artificial Sequence
  Synthetic oligonucleotide
tacacggtcctggttacatcctcgccacgattcta

SEQ ID NO: 156218 - DNA, 35 bp, Artificial Sequence
  Synthetic oligonucleotide
atggtacatcgacgccgcccccgaacacagtatta

SEQ ID NO: 156219 - DNA, 35 bp, Artificial Sequence
  Synthetic oligonucleotide
gtccatcgcaccgccacgttacacctgtttgcacc

SEQ ID NO: 156220 - DNA, 35 bp, Artificial Sequence
  Synthetic oligonucleotide
tgtgcctccagccgcctgatttatcactctacccc

SEQ ID NO: 156221 - DNA, 34 bp, Artificial Sequence
  Synthetic oligonucleotide
tgttgccccttgtacttgtttggccactgttccc

SEQ ID NO: 156222 - DNA, 35 bp, Artificial Sequence
  Synthetic oligonucleotide
tatccaccacaggggagctatacctccattttgcc

SEQ ID NO: 156223 - DNA, 35 bp, Artificial Sequence
  Synthetic oligonucleotide
cctgtggagcccccagtttgcccccgtctacctcc

SEQ ID NO: 156224 - DNA, 35 bp, Artificial Sequence
  Synthetic oligonucleotide
ttgccgatctctgcgcactcctcagccactggtcc

SEQ ID NO: 156225 - DNA, 35 bp, Artificial Sequence
  Synthetic oligonucleotide
tgcgtactgcccctcgagcgtatcacatcctgtcc

SEQ ID NO: 156226 - DNA, 35 bp, Artificial Sequence
  Synthetic oligonucleotide
ttacgttccgccctcgcttgcccactgagccttcc

SEQ ID NO: 156227 - DNA, 35 bp, Artificial Sequence
  Synthetic oligonucleotide
gtctatcgtcactccgcgatcatacagctccttcc

SEQ ID NO: 156228 - DNA, 35 bp, Artificial Sequence
  Synthetic oligonucleotide
tgccctcgcttgcctatattgctatcgacttttcc

SEQ ID NO: 156229 - DNA, 35 bp, Artificial Sequence
  Synthetic oligonucleotide
tccaccgtcgtcttgccccattagacgctcatcgc

SEQ ID NO: 156230 - DNA, 35 bp, Artificial Sequence
  Synthetic oligonucleotide
tgccacacatcttccggcataattcgcttcttcgc

SEQ ID NO: 156231 - DNA, 35 bp, Artificial Sequence
  Synthetic oligonucleotide
gtagtcgttcgctctgccttctccctgtagcttgc

SEQ ID NO: 156232 - DNA, 35 bp, Artificial Sequence
  Synthetic oligonucleotide
tagcaacccgagtgtcaccgctcagtcgctacctc

SEQ ID NO: 156233 - DNA, 35 bp, Artificial Sequence
  Synthetic oligonucleotide
gaacccgacagcctgcattaaccgtcgttcgtttc

SEQ ID NO: 156234 - DNA, 35 bp, Artificial Sequence
  Synthetic oligonucleotide
gattgggaggtgggggagaagagattgcacaggag

SEQ ID NO: 156235 - DNA, 35 bp, Artificial Sequence
  Synthetic oligonucleotide
actgtagcaccaccccgccacctgaccttcagccg

SEQ ID NO: 156236 - DNA, 35 bp, Artificial Sequence
  Synthetic oligonucleotide
gaccgacctgtgctgctccctctccctagtttccg

SEQ ID NO: 156237 - DNA, 35 bp, Artificial Sequence
  Synthetic oligonucleotide
ggttggagacggacacagtggaaacggggggaagg

SEQ ID NO: 156238 - DNA, 35 bp, Artificial Sequence
  Synthetic oligonucleotide
tcctaccttcgccctcgtgccgtcccgcaatcggg

SEQ ID NO: 156239 - DNA, 35 bp, Artificial Sequence
  Synthetic oligonucleotide
aagctgacggaaatgatggacgtgggtgggtgggg

SEQ ID NO: 156240 - DNA, 35 bp, Artificial Sequence
  Synthetic oligonucleotide
gatgtgaggaagaggtgaagagggcgaggcgaatg

SEQ ID NO: 156241 - DNA, 35 bp, Artificial Sequence
  Synthetic oligonucleotide
tccggacacctcatttcatccctactgcctgcctg

SEQ ID NO: 156242 - DNA, 35 bp, Artificial Sequence
  Synthetic oligonucleotide
gactacccgcctcatttttatcctcgcacatgctg

SEQ ID NO: 156243 - DNA, 35 bp, Artificial Sequence
  Synthetic oligonucleotide
gtgctaacgaagaggttatttcgcgccacccccct

SEQ ID NO: 156244 - DNA, 35 bp, Artificial Sequence
  Synthetic oligonucleotide
gcccacccacgattttgcttgagctgtcgggccct

SEQ ID NO: 156245 - DNA, 35 bp, Artificial Sequence
  Synthetic oligonucleotide
atcaccgccaccatgcgccgcctacaaacctccct

SEQ ID NO: 156246 - DNA, 35 bp, Artificial Sequence
  Synthetic oligonucleotide
gacgccccgactctggtcccacggaccttctccct

SEQ ID NO: 156247 - DNA, 35 bp, Artificial Sequence
  Synthetic oligonucleotide
gtacgttcacatcactatacgtccccatttggcct

SEQ ID NO: 156248 - DNA, 35 bp, Artificial Sequence
  Synthetic oligonucleotide
acattggcctccgttccctggcctatctggatcct

SEQ ID NO: 156249 - DNA, 36 bp, Artificial Sequence
  Synthetic oligonucleotide
taccacgcactccatcctgtgcgacacccataatct

SEQ ID NO: 156250 - DNA, 35 bp, Artificial Sequence
  Synthetic oligonucleotide
agcccgaacgggtggtcttccccatgattctctct

SEQ ID NO: 156251 - DNA, 35 bp, Artificial Sequence
  Synthetic oligonucleotide
gcactcctccgcaccctccctgcctgtttaccagt

SEQ ID NO: 156252 - DNA, 35 bp, Artificial Sequence
  Synthetic oligonucleotide
gaatcactgccggcactaggcgtcccctgctctgt

SEQ ID NO: 156253 - DNA, 35 bp, Artificial Sequence
  Synthetic oligonucleotide
tgccaagagacagtcccgccccgtatcacccactt

SEQ ID NO: 156254 - DNA, 35 bp, Artificial Sequence
  Synthetic oligonucleotide
gacacagtctctgtaagttcgcccgccccatagtt

SEQ ID NO: 156255 - DNA, 36 bp, Artificial Sequence
  Synthetic oligonucleotide
acactgccgacccgcgctcgtttactgcccttaaaa

SEQ ID NO: 156256 - DNA, 35 bp, Artificial Sequence
  Synthetic oligonucleotide
ggataagggcgggaggggtctacttggggcacaaa

SEQ ID NO: 156257 - DNA, 36 bp, Artificial Sequence
  Synthetic oligonucleotide
gtatgggaagggaatgcaagggaaccgggggcccaa

SEQ ID NO: 156258 - DNA, 35 bp, Artificial Sequence
  Synthetic oligonucleotide
attgggagggccaccgggagggtagggcagagcaa

SEQ ID NO: 156259 - DNA, 36 bp, Artificial Sequence
  Synthetic oligonucleotide
acagcctggcccccattgtttttatactcttccgaa

SEQ ID NO: 156260 - DNA, 36 bp, Artificial Sequence
  Synthetic oligonucleotide
tagacccctcccatgtgcctcacgttacaccgctaa

SEQ ID NO: 156261 - DNA, 36 bp, Artificial Sequence
  Synthetic oligonucleotide
agctttgccctcaccgcactgttcctggtcttcaca

SEQ ID NO: 156262 - DNA, 36 bp, Artificial Sequence
  Synthetic oligonucleotide
agcaacttccaatcgtcggttccacctggcctccca

SEQ ID NO: 156263 - DNA, 36 bp, Artificial Sequence
  Synthetic oligonucleotide
tagactcaccagccggtctttccacttctgctctca

SEQ ID NO: 156264 - DNA, 35 bp, Artificial Sequence
  Synthetic oligonucleotide
gccggtgcccactgtaccccctctttcctacgaga

SEQ ID NO: 156265 - DNA, 36 bp, Artificial Sequence
  Synthetic oligonucleotide
gttgaggtgggagtggggataaaatgggtagggaga

SEQ ID NO: 156266 - DNA, 37 bp, Artificial Sequence
  Synthetic oligonucleotide
gactatgaggaggaggaggaaacggagcggagataga

SEQ ID NO: 156267 - DNA, 37 bp, Artificial Sequence
  Synthetic oligonucleotide
tcacccgattcccatgtcgtcctttgtcgccccgcga

SEQ ID NO: 156268 - DNA, 37 bp, Artificial Sequence
  Synthetic oligonucleotide
agtgaggggctcaggggttgaacggggcgtggaagga

SEQ ID NO: 156269 - DNA, 36 bp, Artificial Sequence
  Synthetic oligonucleotide
aatggggagggggggcatggtttaaggacacgagga

SEQ ID NO: 156270 - DNA, 37 bp, Artificial Sequence
  Synthetic oligonucleotide
ttcgcccctctcatgtcggtctttatccattttcgga

SEQ ID NO: 156271 - DNA, 37 bp, Artificial Sequence
  Synthetic oligonucleotide
tcgcaggaggggggcacaggtgaaggtacgggaggga

SEQ ID NO: 156272 - DNA, 37 bp, Artificial Sequence
  Synthetic oligonucleotide
agaccgggcggggctagggggtcattgcgacggggga

SEQ ID NO: 156273 - DNA, 37 bp, Artificial Sequence
  Synthetic oligonucleotide
aacagggggggaagaataacgggaaaagtgtgctgga

SEQ ID NO: 156274 - DNA, 38 bp, Artificial Sequence
  Synthetic oligonucleotide
tcccctcccccccctgtacgctcatcccttgggtatga

SEQ ID NO: 156275 - DNA, 38 bp, Artificial Sequence
  Synthetic oligonucleotide
tgctaaccccagcttgtcacttaccatcaacactctga

SEQ ID NO: 156276 - DNA, 38 bp, Artificial Sequence
  Synthetic oligonucleotide
acgctcctcccgcctacacgcgacttccattcctgtga

SEQ ID NO: 156277 - DNA, 37 bp, Artificial Sequence
  Synthetic oligonucleotide
gtcacgcctagtgatttcgcgtctgttccatctgtga

SEQ ID NO: 156278 - DNA, 38 bp, Artificial Sequence
  Synthetic oligonucleotide
tgtgctccccgctcgccatctcgccataccaggcttga

SEQ ID NO: 156279 - DNA, 37 bp, Artificial Sequence
  Synthetic oligonucleotide
acctccatccgttctgcactgtcaaagcttggcttga

SEQ ID NO: 156280 - DNA, 36 bp, Artificial Sequence
  Synthetic oligonucleotide
attcgactccacccatgtcttcgggacacccatata

SEQ ID NO: 156281 - DNA, 36 bp, Artificial Sequence
  Synthetic oligonucleotide
gagtacctcccttgtgatccaatgcccacactacta

SEQ ID NO: 156282 - DNA, 35 bp, Artificial Sequence
  Synthetic oligonucleotide
acccgcaagtagctcccagttccctcccttaatta

SEQ ID NO: 156283 - DNA, 35 bp, Artificial Sequence
  Synthetic oligonucleotide
gtaaccgccgccgcctatagccgtgcttaaataac

SEQ ID NO: 156284 - DNA, 35 bp, Artificial Sequence
  Synthetic oligonucleotide
gccaacaccgctatacgggacttcctgctatccac

SEQ ID NO: 156285 - DNA, 35 bp, Artificial Sequence
  Synthetic oligonucleotide
tacgatccgtctcctccattgctattcaacatcac

SEQ ID NO: 156286 - DNA, 35 bp, Artificial Sequence
  Synthetic oligonucleotide
gccatctttcatatccgctgttcatgttgcccacc

SEQ ID NO: 156287 - DNA, 35 bp, Artificial Sequence
  Synthetic oligonucleotide
ttagcacccacccgtaatgcttcatctgctagacc

SEQ ID NO: 156288 - DNA, 34 bp, Artificial Sequence
  Synthetic oligonucleotide
agacatcgttccatccgcaccgaccacctcaccc

SEQ ID NO: 156289 - DNA, 35 bp, Artificial Sequence
  Synthetic oligonucleotide
tgtgtgcctcgcctgattatccctgcgtcccttcc

SEQ ID NO: 156290 - DNA, 35 bp, Artificial Sequence
  Synthetic oligonucleotide
atgtgagcgcggccatccattgcgcccactgttcc

SEQ ID NO: 156291 - DNA, 35 bp, Artificial Sequence
  Synthetic oligonucleotide
gatattgccccccgcccgagacctagtgagcacgc

SEQ ID NO: 156292 - DNA, 35 bp, Artificial Sequence
  Synthetic oligonucleotide
gttggacacactcctctataaagcccctctcgcgc

SEQ ID NO: 156293 - DNA, 35 bp, Artificial Sequence
  Synthetic oligonucleotide
gccccgcccctccatccaaatagcactgaaatcgc

SEQ ID NO: 156294 - DNA, 35 bp, Artificial Sequence
  Synthetic oligonucleotide
agcgcactttcacgtgccgatttaccttcacctgc

SEQ ID NO: 156295 - DNA, 35 bp, Artificial Sequence
  Synthetic oligonucleotide
acaacacccgccatccgtgctcatcacgcacactc

SEQ ID NO: 156296 - DNA, 35 bp, Artificial Sequence
  Synthetic oligonucleotide
tacgcgctcgcctcatatcgccctttctgccactc

SEQ ID NO: 156297 - DNA, 35 bp, Artificial Sequence
  Synthetic oligonucleotide
tcccgccctcttcctctatattggaccgacccctc

SEQ ID NO: 156298 - DNA, 35 bp, Artificial Sequence
  Synthetic oligonucleotide
atcgccttcgtactattctgccctcaactgctgtc

SEQ ID NO: 156299 - DNA, 35 bp, Artificial Sequence
  Synthetic oligonucleotide
tcactacttcgattgttccatttgtcgctcacttc

SEQ ID NO: 156300 - DNA, 35 bp, Artificial Sequence
  Synthetic oligonucleotide
gatgggcgagagataaacaaaatagggggaacgag

SEQ ID NO: 156301 - DNA, 35 bp, Artificial Sequence
  Synthetic oligonucleotide
gcccacttccgcctaccacctcaggtttttttacg

SEQ ID NO: 156302 - DNA, 35 bp, Artificial Sequence
  Synthetic oligonucleotide
actccgactcctcatgacctccaatctacacctcg

SEQ ID NO: 156303 - DNA, 35 bp, Artificial Sequence
  Synthetic oligonucleotide
gtggggaggggcggacaattagctacggcgatcgg

SEQ ID NO: 156304 - DNA, 35 bp, Artificial Sequence
  Synthetic oligonucleotide
gttctccctccgatccccctcttacgctggcctgg

SEQ ID NO: 156305 - DNA, 35 bp, Artificial Sequence
  Synthetic oligonucleotide
tcgcccctcccgtattggtccctcgctttggaatg

SEQ ID NO: 156306 - DNA, 35 bp, Artificial Sequence
  Synthetic oligonucleotide
aaacgaggtgggcggtgtggagggttgaatgggtg

SEQ ID NO: 156307 - DNA, 35 bp, Artificial Sequence
  Synthetic oligonucleotide
tcgccgccatccgttcttgcccgcggttcctcgat

SEQ ID NO: 156308 - DNA, 35 bp, Artificial Sequence
  Synthetic oligonucleotide
gacatcccagcctcctattcccagcccaacgctat

SEQ ID NO: 156309 - DNA, 35 bp, Artificial Sequence
  Synthetic oligonucleotide
atcccccgcgcaccggccaaggaacaccgctacct

SEQ ID NO: 156310 - DNA, 35 bp, Artificial Sequence
  Synthetic oligonucleotide
tccgtgcatacacacccatagtcccgccacattct

SEQ ID NO: 156311 - DNA, 35 bp, Artificial Sequence
  Synthetic oligonucleotide
tcggggcgagtttccgtttggcccttctcttttgt

SEQ ID NO: 156312 - DNA, 35 bp, Artificial Sequence
  Synthetic oligonucleotide
ttcaacccgccctgccgtatttgcacccccccatt

SEQ ID NO: 156313 - DNA, 35 bp, Artificial Sequence
  Synthetic oligonucleotide
tcctagcccgggtgttctctactagccctctcctt

SEQ ID NO: 156314 - DNA, 35 bp, Artificial Sequence
  Synthetic oligonucleotide
acgtaccacactatatacgcctaacccgccccgtt

SEQ ID NO: 156315 - DNA, 35 bp, Artificial Sequence
  Synthetic oligonucleotide
atgcacgggcggtatgtgggtggtggtattgtgtt

SEQ ID NO: 156316 - DNA, 31 bp, Artificial Sequence
  Synthetic oligonucleotide
ggtgcccgcccttttgattcgacccaccttt

SEQ ID NO: 156317 - DNA, 36 bp, Artificial Sequence
  Synthetic oligonucleotide
gcccctccagccctcttcatcgttgagccttgtcaa

SEQ ID NO: 156318 - DNA, 36 bp, Artificial Sequence
  Synthetic oligonucleotide
attaccccccctctgctgttcgaccagggcacacca

SEQ ID NO: 156319 - DNA, 36 bp, Artificial Sequence
  Synthetic oligonucleotide
gcgctgaacggtcagctgtcattccgcgttacccca

SEQ ID NO: 156320 - DNA, 36 bp, Artificial Sequence
  Synthetic oligonucleotide
gtacgtgagtgtgccccttcactttgcccccgccca

SEQ ID NO: 156321 - DNA, 36 bp, Artificial Sequence
  Synthetic oligonucleotide
ggaacgcacgaagctcgctcatttagcccaccgcca

SEQ ID NO: 156322 - DNA, 35 bp, Artificial Sequence
  Synthetic oligonucleotide
accatgattacaggtgcctatagttcccccgtcca

SEQ ID NO: 156323 - DNA, 36 bp, Artificial Sequence
  Synthetic oligonucleotide
atccctaccccgctagtgcgtatcttgcgccccgca

SEQ ID NO: 156324 - DNA, 35 bp, Artificial Sequence
  Synthetic oligonucleotide
atccccccacaccttgcaccgagtcgtttggtgca

SEQ ID NO: 156325 - DNA, 36 bp, Artificial Sequence
  Synthetic oligonucleotide
acacccgcgttacatcctcgtatcccccgtagatca

SEQ ID NO: 156326 - DNA, 36 bp, Artificial Sequence
  Synthetic oligonucleotide
accctgccctactatgcgcaatcccttcatgattca

SEQ ID NO: 156327 - DNA, 36 bp, Artificial Sequence
  Synthetic oligonucleotide
gcgcaacagtgtccatgcgccgccccttccatcaga

SEQ ID NO: 156328 - DNA, 36 bp, Artificial Sequence
  Synthetic oligonucleotide
gagggccagggacgggagggtgggaaatataagaga

SEQ ID NO: 156329 - DNA, 37 bp, Artificial Sequence
  Synthetic oligonucleotide
ggaggggtgccggtgaggatgggtgggtgggtttaga

SEQ ID NO: 156330 - DNA, 38 bp, Artificial Sequence
  Synthetic oligonucleotide
gaggaaaggggcgtcgaggggcggagaggggaaaacga

SEQ ID NO: 156331 - DNA, 37 bp, Artificial Sequence
  Synthetic oligonucleotide
taacccgtgcccgtttgctccatccgccctttaccga

SEQ ID NO: 156332 - DNA, 37 bp, Artificial Sequence
  Synthetic oligonucleotide
atcagccgcaactctcaacactgtccaccccagccga

SEQ ID NO: 156333 - DNA, 37 bp, Artificial Sequence
  Synthetic oligonucleotide
ttgactcccccaccggtcgtatatgatgccctgccga

SEQ ID NO: 156334 - DNA, 36 bp, Artificial Sequence
  Synthetic oligonucleotide
tgaatcccgtcgaccgccctgaccaccgctccatga

SEQ ID NO: 156335 - DNA, 38 bp, Artificial Sequence
  Synthetic oligonucleotide
gagtgtggagtggaagggccgggatggacaatggatga

SEQ ID NO: 156336 - DNA, 38 bp, Artificial Sequence
  Synthetic oligonucleotide
tgagggcggagggaggggggtgtatttggacggtatga

SEQ ID NO: 156337 - DNA, 37 bp, Artificial Sequence
  Synthetic oligonucleotide
gttcgaccgagaccccgccctgttcccacgcccctga

SEQ ID NO: 156338 - DNA, 37 bp, Artificial Sequence
  Synthetic oligonucleotide
atagcacggcctggccccacacatacaccttccctga

SEQ ID NO: 156339 - DNA, 38 bp, Artificial Sequence
  Synthetic oligonucleotide
tatgtcccgcccattgttttgcgttatctcacacgtga

SEQ ID NO: 156340 - DNA, 36 bp, Artificial Sequence
  Synthetic oligonucleotide
tgctgcctgcatcatctctatcgcgatcacacttga

SEQ ID NO: 156341 - DNA, 38 bp, Artificial Sequence
  Synthetic oligonucleotide
ggtccccacggctctctatcaccgctggccatacttga

SEQ ID NO: 156342 - DNA, 37 bp, Artificial Sequence
  Synthetic oligonucleotide
gtgcccctgtgcccgactccatcatacactcccttga

SEQ ID NO: 156343 - DNA, 38 bp, Artificial Sequence
  Synthetic oligonucleotide
tgatcacaacatcgtgttcaagccccctccttccttga

SEQ ID NO: 156344 - DNA, 35 bp, Artificial Sequence
  Synthetic oligonucleotide
accgcaccatcttaattcggaccgtttcatgccta

SEQ ID NO: 156345 - DNA, 36 bp, Artificial Sequence
  Synthetic oligonucleotide
gtcacccatagccactaccgttttcctgccgccgta

SEQ ID NO: 156346 - DNA, 36 bp, Artificial Sequence
  Synthetic oligonucleotide
gcacccatcgttccagttctctgcaccccaacggta

SEQ ID NO: 156347 - DNA, 36 bp, Artificial Sequence
  Synthetic oligonucleotide
atcctcccccctcgaaagttagacaagtaccgtgta

SEQ ID NO: 156348 - DNA, 35 bp, Artificial Sequence
  Synthetic oligonucleotide
tcactcccatcacgggtacaacgccctgcatatta

SEQ ID NO: 156349 - DNA, 35 bp, Artificial Sequence
  Synthetic oligonucleotide
gaaggggggctcaaaatctggggtcggggttcaac

SEQ ID NO: 156350 - DNA, 35 bp, Artificial Sequence
  Synthetic oligonucleotide
tccctcatacccaactggatccatgtctggcccac

SEQ ID NO: 156351 - DNA, 35 bp, Artificial Sequence
  Synthetic oligonucleotide
tcacaacgttctctttgcgcacttcctcctctcac

SEQ ID NO: 156352 - DNA, 35 bp, Artificial Sequence
  Synthetic oligonucleotide
atgtgacgactccctgccctctctccgttgtagac

SEQ ID NO: 156353 - DNA, 35 bp, Artificial Sequence
  Synthetic oligonucleotide
tagtgccatcacccccccatatcatgtgcttaacc

SEQ ID NO: 156354 - DNA, 35 bp, Artificial Sequence
  Synthetic oligonucleotide
gtcccctccatggccactcactcagtcctcacgcc

SEQ ID NO: 156355 - DNA, 35 bp, Artificial Sequence
  Synthetic oligonucleotide
ccggaactactgtgacgtgccactcccgctccgcc

SEQ ID NO: 156356 - DNA, 35 bp, Artificial Sequence
  Synthetic oligonucleotide
acttaccacctccaacttgccgacgcgcactcgcc

SEQ ID NO: 156357 - DNA, 35 bp, Artificial Sequence
  Synthetic oligonucleotide
ttacctccgcactcacatccgccgttgccctcgcc

SEQ ID NO: 156358 - DNA, 35 bp, Artificial Sequence
  Synthetic oligonucleotide
tcaggcctcaatgtcgtccgttcccttgccattcc

SEQ ID NO: 156359 - DNA, 35 bp, Artificial Sequence
  Synthetic oligonucleotide
aacgcacacgccctctgctccggaccggggtacgc

SEQ ID NO: 156360 - DNA, 35 bp, Artificial Sequence
  Synthetic oligonucleotide
gtgccctaccactgtttcctccccggtcttccggc

SEQ ID NO: 156361 - DNA, 35 bp, Artificial Sequence
  Synthetic oligonucleotide
ttggacatctctcaccactgcacccccttttcggc

SEQ ID NO: 156362 - DNA, 35 bp, Artificial Sequence
  Synthetic oligonucleotide
agggtgggtttgtgtcgggcgggggaacaactatc

SEQ ID NO: 156363 - DNA, 35 bp, Artificial Sequence
  Synthetic oligonucleotide
atgcacccttgctgacgctacttagaaattgcctc

SEQ ID NO: 156364 - DNA, 35 bp, Artificial Sequence
  Synthetic oligonucleotide
gccaggtcaggtatccgtgctgtctttgccctctc

SEQ ID NO: 156365 - DNA, 35 bp, Artificial Sequence
  Synthetic oligonucleotide
tcgacgagtagcttgttgcccgttctctctctctc

SEQ ID NO: 156366 - DNA, 35 bp, Artificial Sequence
  Synthetic oligonucleotide
atccagagctgcgagcgcaccccgtccttgtcgtc

SEQ ID NO: 156367 - DNA, 35 bp, Artificial Sequence
  Synthetic oligonucleotide
gctcaccaccattcccacgtatacatgcttaggtc

SEQ ID NO: 156368 - DNA, 35 bp, Artificial Sequence
  Synthetic oligonucleotide
tcgttgcaccatccctttcttcctccctgtatgtc

SEQ ID NO: 156369 - DNA, 35 bp, Artificial Sequence
  Synthetic oligonucleotide
gcgctagtcctcagcttgcctccaacgttccattc

SEQ ID NO: 156370 - DNA, 35 bp, Artificial Sequence
  Synthetic oligonucleotide
tgtcacattggtgaagggggaaagggaaagtacag

SEQ ID NO: 156371 - DNA, 35 bp, Artificial Sequence
  Synthetic oligonucleotide
tcccgccatctctccaggtgcatccatgtccctag

SEQ ID NO: 156372 - DNA, 35 bp, Artificial Sequence
  Synthetic oligonucleotide
acaccctccggtgttgcctccctctcatgcttacg

SEQ ID NO: 156373 - DNA, 35 bp, Artificial Sequence
  Synthetic oligonucleotide
catcgacgccccgaatgtcacgctcccaatcctcg

SEQ ID NO: 156374 - DNA, 35 bp, Artificial Sequence
  Synthetic oligonucleotide
agtccacccatgttatcgccatctccccccggatg

SEQ ID NO: 156375 - DNA, 35 bp, Artificial Sequence
  Synthetic oligonucleotide
gtggagccccttttgcccctcagcccccatttttg

SEQ ID NO: 156376 - DNA, 35 bp, Artificial Sequence
  Synthetic oligonucleotide
gctcactaccgcctctgccttaagtcatgccccat

SEQ ID NO: 156377 - DNA, 35 bp, Artificial Sequence
  Synthetic oligonucleotide
tcgacatcaatcccgccgctgactctcctatcgct

SEQ ID NO: 156378 - DNA, 35 bp, Artificial Sequence
  Synthetic oligonucleotide
tcaaccacccccgacacatatatgttttcttcgct

SEQ ID NO: 156379 - DNA, 35 bp, Artificial Sequence
  Synthetic oligonucleotide
tgagtcagtgcttgctcatgttcgccgcccccagt

SEQ ID NO: 156380 - DNA, 35 bp, Artificial Sequence
  Synthetic oligonucleotide
agtcctccgtcgcaccctctgctccttacattggt

SEQ ID NO: 156381 - DNA, 35 bp, Artificial Sequence
  Synthetic oligonucleotide
gccagccatcccgcaagcactgaccctgcacctgt

SEQ ID NO: 156382 - DNA, 35 bp, Artificial Sequence
  Synthetic oligonucleotide
agactgtcgcctcgcttccttttgcgtctcacctt

SEQ ID NO: 156383 - DNA, 35 bp, Artificial Sequence
  Synthetic oligonucleotide
gaggccaggtaccatcgattatagtcacttctctt

SEQ ID NO: 156384 - DNA, 35 bp, Artificial Sequence
  Synthetic oligonucleotide
tgtgacccgtccccttgagtgcgccccttactttt

SEQ ID NO: 156385 - DNA, 35 bp, Artificial Sequence
  Synthetic oligonucleotide
atctgctgtgccttggtcgctcgctctgctctttt

SEQ ID NO: 156386 - DNA, 35 bp, Artificial Sequence
  Synthetic oligonucleotide
ggtaccggaggggcgggggggcttagtaagacaaa

SEQ ID NO: 156387 - DNA, 36 bp, Artificial Sequence
  Synthetic oligonucleotide
tagcgtggcacggggaaggtagggagggggcgagaa

SEQ ID NO: 156388 - DNA, 36 bp, Artificial Sequence
  Synthetic oligonucleotide
gtgatatggtggatagcaaggtgaggggcgggggaa

SEQ ID NO: 156389 - DNA, 36 bp, Artificial Sequence
  Synthetic oligonucleotide
aacacgcctccttggtactttgtctctacgttttaa

SEQ ID NO: 156390 - DNA, 35 bp, Artificial Sequence
  Synthetic oligonucleotide
accttgaccgcctcctcgagtacctcgacttaaca

SEQ ID NO: 156391 - DNA, 36 bp, Artificial Sequence
  Synthetic oligonucleotide
gacgcgtacaccctgccccctgccgacatgctacca

SEQ ID NO: 156392 - DNA, 36 bp, Artificial Sequence
  Synthetic oligonucleotide
attgcggaagggggcgggttggaggaggttgtcgca

SEQ ID NO: 156393 - DNA, 36 bp, Artificial Sequence
  Synthetic oligonucleotide
gtgtgtgtcaacctttatcacctgctcccttaggca

SEQ ID NO: 156394 - DNA, 35 bp, Artificial Sequence
  Synthetic oligonucleotide
tgcgacacgcggtctctttttcttcctggttgtca

SEQ ID NO: 156395 - DNA, 35 bp, Artificial Sequence
  Synthetic oligonucleotide
gcgcacgccgcctgctctatcttcgttccacttca

SEQ ID NO: 156396 - DNA, 36 bp, Artificial Sequence
  Synthetic oligonucleotide
accatcaccaccgtaactctacaatgtccttgttca

SEQ ID NO: 156397 - DNA, 35 bp, Artificial Sequence
  Synthetic oligonucleotide
gcctttgccccaccgctcacgcagtcctcctgaga

SEQ ID NO: 156398 - DNA, 37 bp, Artificial Sequence
  Synthetic oligonucleotide
tcgactcctcatgtgccgtctagaacccacctcccga

SEQ ID NO: 156399 - DNA, 35 bp, Artificial Sequence
  Synthetic oligonucleotide
taccatcgtccacgtcaccatccgcattgtcccga

SEQ ID NO: 156400 - DNA, 37 bp, Artificial Sequence
  Synthetic oligonucleotide
actccgcccccgttcctttcattgtttctgcatccga

SEQ ID NO: 156401 - DNA, 37 bp, Artificial Sequence
  Synthetic oligonucleotide
tccacctcccacggtaaacgacgccatacccacgcga

SEQ ID NO: 156402 - DNA, 37 bp, Artificial Sequence
  Synthetic oligonucleotide
tatcccactccatccctgcgacagccacttctgtcga

SEQ ID NO: 156403 - DNA, 37 bp, Artificial Sequence
  Synthetic oligonucleotide
tagcctgcgctccccgtctcccgcctccactcgcgga

SEQ ID NO: 156404 - DNA, 36 bp, Artificial Sequence
  Synthetic oligonucleotide
tgaatgacgatggcgtgggaggggctgaatgaggga

SEQ ID NO: 156405 - DNA, 37 bp, Artificial Sequence
  Synthetic oligonucleotide
gggttggtgaggagatctggaaggctgggggacggga

SEQ ID NO: 156406 - DNA, 37 bp, Artificial Sequence
  Synthetic oligonucleotide
ttgcgggtggtttgtgggtggtaggtggtggtcggga

SEQ ID NO: 156407 - DNA, 38 bp, Artificial Sequence
  Synthetic oligonucleotide
tggagtgggtgggggggggaggtgacacaacttaatga

SEQ ID NO: 156408 - DNA, 37 bp, Artificial Sequence
  Synthetic oligonucleotide
gcagatccaggggtatggggggtggtgggcaatatga

SEQ ID NO: 156409 - DNA, 38 bp, Artificial Sequence
  Synthetic oligonucleotide
tccacctccgactcatcactattacgccgtatccctga

SEQ ID NO: 156410 - DNA, 38 bp, Artificial Sequence
  Synthetic oligonucleotide
gtgcaccccgtgccatactattcaccatgccatcctga

SEQ ID NO: 156411 - DNA, 37 bp, Artificial Sequence
  Synthetic oligonucleotide
gtacacctcacccgctctttacgatccgttttagtga

SEQ ID NO: 156412 - DNA, 37 bp, Artificial Sequence
  Synthetic oligonucleotide
gatccccgtctcgctctccccgccgtgcctatcttga

SEQ ID NO: 156413 - DNA, 38 bp, Artificial Sequence
  Synthetic oligonucleotide
atgccgcaatgcgttgtacttcgccttcatcttcttga

SEQ ID NO: 156414 - DNA, 37 bp, Artificial Sequence
  Synthetic oligonucleotide
actccactcgttcgcccttttacctgccgtgctttga

SEQ ID NO: 156415 - DNA, 36 bp, Artificial Sequence
  Synthetic oligonucleotide
gcacaccccactcggcccccccacagttcctgacta

SEQ ID NO: 156416 - DNA, 36 bp, Artificial Sequence
  Synthetic oligonucleotide
tacgcctcatgatcgggcgcactttatccttcccta

SEQ ID NO: 156417 - DNA, 35 bp, Artificial Sequence
  Synthetic oligonucleotide
aacaccgcaatatccgctcgcgttcccgactccta

SEQ ID NO: 156418 - DNA, 36 bp, Artificial Sequence
  Synthetic oligonucleotide
atcgaggtgggagggaaaaggtggcgtgaaccggta

SEQ ID NO: 156419 - DNA, 36 bp, Artificial Sequence
  Synthetic oligonucleotide
gaatcacctcctccatgaaaggatacctagtatgta

SEQ ID NO: 156420 - DNA, 35 bp, Artificial Sequence
  Synthetic oligonucleotide
gttcgattccaatgcgtcacccaccccgcccctta

SEQ ID NO: 156421 - DNA, 36 bp, Artificial Sequence
  Synthetic oligonucleotide
ttcgactgcgatcgttacatccttgtccgcccgtta

SEQ ID NO: 156422 - DNA, 35 bp, Artificial Sequence
  Synthetic oligonucleotide
acgctcgcctacccgaaagtcttactggcctccac

SEQ ID NO: 156423 - DNA, 27 bp, Artificial Sequence
  Synthetic oligonucleotide
taccgaccccgttcaccaaaaccagac

SEQ ID NO: 156424 - DNA, 35 bp, Artificial Sequence
  Synthetic oligonucleotide
tgctatccctaccccccgatggaaacccaggttac

SEQ ID NO: 156425 - DNA, 35 bp, Artificial Sequence
  Synthetic oligonucleotide
gacatttcgccagctgctccgtaatgcactctacc

SEQ ID NO: 156426 - DNA, 35 bp, Artificial Sequence
  Synthetic oligonucleotide
tggaccccttaggttgttaccttcttgctccaccc

SEQ ID NO: 156427 - DNA, 35 bp, Artificial Sequence
  Synthetic oligonucleotide
tggttcagcctccctggccctccaacaaaccgccc

SEQ ID NO: 156428 - DNA, 35 bp, Artificial Sequence
  Synthetic oligonucleotide
cctgacaactgcaccatcgacacactcctggtccc

SEQ ID NO: 156429 - DNA, 35 bp, Artificial Sequence
  Synthetic oligonucleotide
gtgcatcgcacggcgccgttcgttgtctctgctcc

SEQ ID NO: 156430 - DNA, 35 bp, Artificial Sequence
  Synthetic oligonucleotide
tctgtgccgtagtgccttgtcgctcccttacgtcc

SEQ ID NO: 156431 - DNA, 35 bp, Artificial Sequence
  Synthetic oligonucleotide
tcccacctgcaataatgtcgagtggcgccctttcc

SEQ ID NO: 156432 - DNA, 35 bp, Artificial Sequence
  Synthetic oligonucleotide
tcctgacgccccccttaacactccgctacgagcgc

SEQ ID NO: 156433 - DNA, 35 bp, Artificial Sequence
  Synthetic oligonucleotide
aaacctcagtcacttttcgctcccgccctcacggc

SEQ ID NO: 156434 - DNA, 35 bp, Artificial Sequence
  Synthetic oligonucleotide
acatcacctgtacgccctcttggttgagcacaatc

SEQ ID NO: 156435 - DNA, 35 bp, Artificial Sequence
  Synthetic oligonucleotide
tcgtagaaccatctgctcccctgccaatctggctc

SEQ ID NO: 156436 - DNA, 35 bp, Artificial Sequence
  Synthetic oligonucleotide
tccatgaaccatccgagttttatggtcccactctc

SEQ ID NO: 156437 - DNA, 35 bp, Artificial Sequence
  Synthetic oligonucleotide
acaccacctgaaccccctctacagccaggagtctc

SEQ ID NO: 156438 - DNA, 35 bp, Artificial Sequence
  Synthetic oligonucleotide
tgtgatgtactcgtgttcctgtttttctccgtgtc

SEQ ID NO: 156439 - DNA, 35 bp, Artificial Sequence
  Synthetic oligonucleotide
gtttgcctagtgcgcctcatttctgctttcttgtc

SEQ ID NO: 156440 - DNA, 35 bp, Artificial Sequence
  Synthetic oligonucleotide
ttgcccgacctcgtctagcctctaccctatccttc

SEQ ID NO: 156441 - DNA, 35 bp, Artificial Sequence
  Synthetic oligonucleotide
tccaccccatgggcccgttcaggcgcctttgcttc

SEQ ID NO: 156442 - DNA, 35 bp, Artificial Sequence
  Synthetic oligonucleotide
atcactcgtatatgccaaccgccgcccgtttacag

SEQ ID NO: 156443 - DNA, 35 bp, Artificial Sequence
  Synthetic oligonucleotide
tctattaccccatgcgtccactgccttccctgccg

SEQ ID NO: 156444 - DNA, 35 bp, Artificial Sequence
  Synthetic oligonucleotide
cctactgcccctgcctactctgacgacccgttgcg

SEQ ID NO: 156445 - DNA, 35 bp, Artificial Sequence
  Synthetic oligonucleotide
tcgatgctagttctgccctgctcccccaatttgcg

SEQ ID NO: 156446 - DNA, 35 bp, Artificial Sequence
  Synthetic oligonucleotide
ttcaccgtgccacccccatgcgtccgtctttttcg

SEQ ID NO: 156447 - DNA, 35 bp, Artificial Sequence
  Synthetic oligonucleotide
tgtctccgccgcctcttgtttgcactccattcctg

SEQ ID NO: 156448 - DNA, 35 bp, Artificial Sequence
  Synthetic oligonucleotide
atcgaccgctgtatagcgctgtccttaccatctat

SEQ ID NO: 156449 - DNA, 35 bp, Artificial Sequence
  Synthetic oligonucleotide
actgccccatggcgattagtttcctctcattgtct

SEQ ID NO: 156450 - DNA, 35 bp, Artificial Sequence
  Synthetic oligonucleotide
gccggacaccactgtgcagctctcgttttccttct

SEQ ID NO: 156451 - DNA, 35 bp, Artificial Sequence
  Synthetic oligonucleotide
gccgtgggatgggaggtgcgggggaatgcttaggt

SEQ ID NO: 156452 - DNA, 35 bp, Artificial Sequence
  Synthetic oligonucleotide
taatcgccccgccccgtccaatcgtccctccatgt

SEQ ID NO: 156453 - DNA, 35 bp, Artificial Sequence
  Synthetic oligonucleotide
agtacccaccaacctgcttcctcggacattactgt

SEQ ID NO: 156454 - DNA, 35 bp, Artificial Sequence
  Synthetic oligonucleotide
gtactgctccctgaggctccaattcgatatcctgt

SEQ ID NO: 156455 - DNA, 35 bp, Artificial Sequence
  Synthetic oligonucleotide
gtgtgccatgccatcccagcactatcgcccttatt

SEQ ID NO: 156456 - DNA, 35 bp, Artificial Sequence
  Synthetic oligonucleotide
gaccaaccttcccatgtctatgcacccccttgctt

SEQ ID NO: 156457 - DNA, 35 bp, Artificial Sequence
  Synthetic oligonucleotide
atgtacagccggtcccgggacccctccgccaccaa

SEQ ID NO: 156458 - DNA, 34 bp, Artificial Sequence
  Synthetic oligonucleotide
tgcgacgcactcccattaactgtatgccccccaa

SEQ ID NO: 156459 - DNA, 36 bp, Artificial Sequence
  Synthetic oligonucleotide
tgagtggaaggggaggaatagggatcaaatcgttaa

SEQ ID NO: 156460 - DNA, 36 bp, Artificial Sequence
  Synthetic oligonucleotide
ataccgccccccagaccttactgaccctgcgtttaa

SEQ ID NO: 156461 - DNA, 35 bp, Artificial Sequence
  Synthetic oligonucleotide
tacccgcctatatcccgtgctctgaccacacatca

SEQ ID NO: 156462 - DNA, 37 bp, Artificial Sequence
  Synthetic oligonucleotide
aattgtgccgggatagcaggaggggtgaggggggaga

SEQ ID NO: 156463 - DNA, 37 bp, Artificial Sequence
  Synthetic oligonucleotide
atcgggctccccctcgttgctgctaccccttctacga

SEQ ID NO: 156464 - DNA, 37 bp, Artificial Sequence
  Synthetic oligonucleotide
gtcaccgctaatgcctttactactccgttatacccga

SEQ ID NO: 156465 - DNA, 36 bp, Artificial Sequence
  Synthetic oligonucleotide
acacaagctcgatcaaccgccatcgccccagcccga

SEQ ID NO: 156466 - DNA, 37 bp, Artificial Sequence
  Synthetic oligonucleotide
gagttggtccgcccttgttttccgtagtgcccctcga

SEQ ID NO: 156467 - DNA, 36 bp, Artificial Sequence
  Synthetic oligonucleotide
accccgtccgccgccaccgcaaatcgcctctctcga

SEQ ID NO: 156468 - DNA, 36 bp, Artificial Sequence
  Synthetic oligonucleotide
gacggggaacacgaatgggaatgggcgggacacgga

SEQ ID NO: 156469 - DNA, 37 bp, Artificial Sequence
  Synthetic oligonucleotide
gtgcgacttaacgtcgtctatcctcccatcccccgga

SEQ ID NO: 156470 - DNA, 37 bp, Artificial Sequence
  Synthetic oligonucleotide
gtggaatgagtagcagggaggttgagggaggttggga

SEQ ID NO: 156471 - DNA, 38 bp, Artificial Sequence
  Synthetic oligonucleotide
tgccactcacatacggatcaacaccacttccctcatga

SEQ ID NO: 156472 - DNA, 38 bp, Artificial Sequence
  Synthetic oligonucleotide
gaaggacagggggtggaatataggataaaaagggatga

SEQ ID NO: 156473 - DNA, 37 bp, Artificial Sequence
  Synthetic oligonucleotide
acgccagggtggtgggtgggacttgggtgggcggtga

SEQ ID NO: 156474 - DNA, 38 bp, Artificial Sequence
  Synthetic oligonucleotide
gacggggacaaaggacaatggaggggaagccggggtga

SEQ ID NO: 156475 - DNA, 38 bp, Artificial Sequence
  Synthetic oligonucleotide
tatggggtggagagggcgggtgagttgcaactgtgtga

SEQ ID NO: 156476 - DNA, 38 bp, Artificial Sequence
  Synthetic oligonucleotide
acccgcccccgacatctatgctattgcttcaaacttga

SEQ ID NO: 156477 - DNA, 37 bp, Artificial Sequence
  Synthetic oligonucleotide
gacgccacatgtccttgagctcctccggttcccttga

SEQ ID NO: 156478 - DNA, 38 bp, Artificial Sequence
  Synthetic oligonucleotide
agagtcgcacgaccgtttcccagcctacctccgcttga

SEQ ID NO: 156479 - DNA, 35 bp, Artificial Sequence
  Synthetic oligonucleotide
ttcgttgccccctcgttgacgctcttatcttttga

SEQ ID NO: 156480 - DNA, 36 bp, Artificial Sequence
  Synthetic oligonucleotide
tcgcgggttagctcctgtcccacgtttcccgccata

SEQ ID NO: 156481 - DNA, 35 bp, Artificial Sequence
  Synthetic oligonucleotide
tcccactgcttcattgtctcgttgtcccggtccta

SEQ ID NO: 156482 - DNA, 36 bp, Artificial Sequence
  Synthetic oligonucleotide
gccttcgcccgctttacaccagtccgcctccgggta

SEQ ID NO: 156483 - DNA, 36 bp, Artificial Sequence
  Synthetic oligonucleotide
tgaacgctggtcccccctctatgcctcgtttactta

SEQ ID NO: 156484 - DNA, 36 bp, Artificial Sequence
  Synthetic oligonucleotide
gcatgggcatctgattacgcctcgttcccctgttta

SEQ ID NO: 156485 - DNA, 35 bp, Artificial Sequence
  Synthetic oligonucleotide
accatgttcctgttctcgccacccgcctggtaaac

SEQ ID NO: 156486 - DNA, 35 bp, Artificial Sequence
  Synthetic oligonucleotide
aacatcgcactaccgttctcctgtttgttgcccac

SEQ ID NO: 156487 - DNA, 35 bp, Artificial Sequence
  Synthetic oligonucleotide
tgctacgtccttcctgtccgtccccagccgccgac

SEQ ID NO: 156488 - DNA, 35 bp, Artificial Sequence
  Synthetic oligonucleotide
gtagacccgccgcgcccaaggcccgccccgtaccc

SEQ ID NO: 156489 - DNA, 35 bp, Artificial Sequence
  Synthetic oligonucleotide
accagggcggtccccctgtcatgatgatttcgccc

SEQ ID NO: 156490 - DNA, 35 bp, Artificial Sequence
  Synthetic oligonucleotide
ggagcctcatgggtacctcgtcctgttaccctccc

SEQ ID NO: 156491 - DNA, 35 bp, Artificial Sequence
  Synthetic oligonucleotide
ggtatgcggccataccctggctacgttcccctccc

SEQ ID NO: 156492 - DNA, 35 bp, Artificial Sequence
  Synthetic oligonucleotide
gagccccctggacctattcattacattgccttgcc

SEQ ID NO: 156493 - DNA, 35 bp, Artificial Sequence
  Synthetic oligonucleotide
tgagtcatgcctcggtttagcacctccgaccctcc

SEQ ID NO: 156494 - DNA, 35 bp, Artificial Sequence
  Synthetic oligonucleotide
tgaacccctcgaccgcctcctgcgaccttctttcc

SEQ ID NO: 156495 - DNA, 35 bp, Artificial Sequence
  Synthetic oligonucleotide
acacatgcccctcctggtcgccgatgccaccccgc

SEQ ID NO: 156496 - DNA, 35 bp, Artificial Sequence
  Synthetic oligonucleotide
tgtagcgatcttgttcttgtccactccctacgcgc

SEQ ID NO: 156497 - DNA, 35 bp, Artificial Sequence
  Synthetic oligonucleotide
gcccctcgcattgtcccgcctcgagatcgtatctc

SEQ ID NO: 156498 - DNA, 35 bp, Artificial Sequence
  Synthetic oligonucleotide
tcatcggcgaccagacgatcacaccagctcccttc

SEQ ID NO: 156499 - DNA, 35 bp, Artificial Sequence
  Synthetic oligonucleotide
gccccctcctccatacagctgggcatagccttttc

SEQ ID NO: 156500 - DNA, 34 bp, Artificial Sequence
  Synthetic oligonucleotide
gaggaaatgccgaacaggtggagggggactgcag

SEQ ID NO: 156501 - DNA, 35 bp, Artificial Sequence
  Synthetic oligonucleotide
agatgggaggcggattggaacaatggggcggagag

SEQ ID NO: 156502 - DNA, 35 bp, Artificial Sequence
  Synthetic oligonucleotide
gcgcaggtacctcagccgcgccctttcccttgtcg

SEQ ID NO: 156503 - DNA, 35 bp, Artificial Sequence
  Synthetic oligonucleotide
ggttggggagggtggatagaattggacgtaggagg

SEQ ID NO: 156504 - DNA, 35 bp, Artificial Sequence
  Synthetic oligonucleotide
gaaggaaaagggtgaacagggaggtgtgcgatggg

SEQ ID NO: 156505 - DNA, 35 bp, Artificial Sequence
  Synthetic oligonucleotide
atctccatccgccctgtagtcgaggagactacatg

SEQ ID NO: 156506 - DNA, 35 bp, Artificial Sequence
  Synthetic oligonucleotide
tgctcggcccctgcaccctgtattcccttagtact

SEQ ID NO: 156507 - DNA, 35 bp, Artificial Sequence
  Synthetic oligonucleotide
tgtgcggtcctccttttgttcccgtgcgcatacct

SEQ ID NO: 156508 - DNA, 35 bp, Artificial Sequence
  Synthetic oligonucleotide
gttactccgtcacaagctttatgtacccttcgcct

SEQ ID NO: 156509 - DNA, 35 bp, Artificial Sequence
  Synthetic oligonucleotide
atgcaccgccgactgtcccggctatgttgaatcct

SEQ ID NO: 156510 - DNA, 35 bp, Artificial Sequence
  Synthetic oligonucleotide
tttcgacactgtcccctgcctcctatttccggtct

SEQ ID NO: 156511 - DNA, 35 bp, Artificial Sequence
  Synthetic oligonucleotide
aaactgcccattcagcgcgactcttcaccacttct

SEQ ID NO: 156512 - DNA, 35 bp, Artificial Sequence
  Synthetic oligonucleotide
gatgcctgttccgtgcttaaggccttcctacccgt

SEQ ID NO: 156513 - DNA, 35 bp, Artificial Sequence
  Synthetic oligonucleotide
atagaccccgcctacgcatatgccaatcgtccctt

SEQ ID NO: 156514 - DNA, 35 bp, Artificial Sequence
  Synthetic oligonucleotide
gtctgtatcaggcctgcccttgcccctcgccggtt

SEQ ID NO: 156515 - DNA, 35 bp, Artificial Sequence
  Synthetic oligonucleotide
gacataaccagcctcgtgacacctgctcctcgttt

SEQ ID NO: 156516 - DNA, 35 bp, Artificial Sequence
  Synthetic oligonucleotide
tgcgggggggtgattgggatgggccttacaatgaa

SEQ ID NO: 156517 - DNA, 35 bp, Artificial Sequence
  Synthetic oligonucleotide
aacatgtgtagagtgtctccgccccataacgccca

SEQ ID NO: 156518 - DNA, 35 bp, Artificial Sequence
  Synthetic oligonucleotide
gaatgccctcctcctggcgtaacgttgacgtccca

SEQ ID NO: 156519 - DNA, 36 bp, Artificial Sequence
  Synthetic oligonucleotide
gctgcccatcccccgccctggctttttagacagcca

SEQ ID NO: 156520 - DNA, 36 bp, Artificial Sequence
  Synthetic oligonucleotide
gcgcctcgctcccgacctatcttctggcctgttgca

SEQ ID NO: 156521 - DNA, 35 bp, Artificial Sequence
  Synthetic oligonucleotide
gcctgcacactgggtcattactcaccgctacatca

SEQ ID NO: 156522 - DNA, 35 bp, Artificial Sequence
  Synthetic oligonucleotide
gttgcccggcattctttttacaggtgcccctctca

SEQ ID NO: 156523 - DNA, 36 bp, Artificial Sequence
  Synthetic oligonucleotide
tgcgacgtcccaagatttttcgtaccaccgttctca

SEQ ID NO: 156524 - DNA, 35 bp, Artificial Sequence
  Synthetic oligonucleotide
tccctaccacccgatgctgacactttcagtctaga

SEQ ID NO: 156525 - DNA, 36 bp, Artificial Sequence
  Synthetic oligonucleotide
tccacagcctccgagcgcatccactagtaaccccga

SEQ ID NO: 156526 - DNA, 37 bp, Artificial Sequence
  Synthetic oligonucleotide
tgcgaccgccgcaccgttcccctcgccttctagccga

SEQ ID NO: 156527 - DNA, 37 bp, Artificial Sequence
  Synthetic oligonucleotide
tgctgatcctcttttctatgtgccttccccccgccga

SEQ ID NO: 156528 - DNA, 37 bp, Artificial Sequence
  Synthetic oligonucleotide
agttgcccccctctgtattctttcgatctgctgccga

SEQ ID NO: 156529 - DNA, 37 bp, Artificial Sequence
  Synthetic oligonucleotide
gccaccccttctcgatatgccacacagtcgcaatcga

SEQ ID NO: 156530 - DNA, 37 bp, Artificial Sequence
  Synthetic oligonucleotide
acctaccgccagagggcatcacgctacctatcctcga

SEQ ID NO: 156531 - DNA, 37 bp, Artificial Sequence
  Synthetic oligonucleotide
tacgcatctgtcctatcttgccctaccgctcccagga

SEQ ID NO: 156532 - DNA, 37 bp, Artificial Sequence
  Synthetic oligonucleotide
gacaccatgtcgtcactatgcctccccccgtgacgga

SEQ ID NO: 156533 - DNA, 37 bp, Artificial Sequence
  Synthetic oligonucleotide
tggggagtggctgtttccatcctagggcggtggggga

SEQ ID NO: 156534 - DNA, 37 bp, Artificial Sequence
  Synthetic oligonucleotide
gaagtcgaacggtggggagggggaggttacgctggga

SEQ ID NO: 156535 - DNA, 37 bp, Artificial Sequence
  Synthetic oligonucleotide
tatgcgccctctcgattaccgcccgcccgacattgga

SEQ ID NO: 156536 - DNA, 37 bp, Artificial Sequence
  Synthetic oligonucleotide
taccgccccctctgttgggtggaacaccttctactga

SEQ ID NO: 156537 - DNA, 38 bp, Artificial Sequence
  Synthetic oligonucleotide
tgagtcagacggctgctctgccctgctcattcacctga

SEQ ID NO: 156538 - DNA, 37 bp, Artificial Sequence
  Synthetic oligonucleotide
tgaaccatcctgaacctttatagcctgtgatccctga

SEQ ID NO: 156539 - DNA, 38 bp, Artificial Sequence
  Synthetic oligonucleotide
tgcaccctagctcgctccccgcccgcagactccgctga

SEQ ID NO: 156540 - DNA, 37 bp, Artificial Sequence
  Synthetic oligonucleotide
ccctccgtcaagccctccgatcccccgacgctcgtga

SEQ ID NO: 156541 - DNA, 36 bp, Artificial Sequence
  Synthetic oligonucleotide
tctcgccggatctctatctgctaacctatctccata

SEQ ID NO: 156542 - DNA, 36 bp, Artificial Sequence
  Synthetic oligonucleotide
gattcccgcctaagctgtcccatgtgcctgccccta

SEQ ID NO: 156543 - DNA, 35 bp, Artificial Sequence
  Synthetic oligonucleotide
gtctatccatctgcgcgtacgtcccaccgccgcta

SEQ ID NO: 156544 - DNA, 35 bp, Artificial Sequence
  Synthetic oligonucleotide
tgagtgtctcatctgcttacatcctcacgctctta

SEQ ID NO: 156545 - DNA, 35 bp, Artificial Sequence
  Synthetic oligonucleotide
atcgtccagggcagactcgattatgccgccactac

SEQ ID NO: 156546 - DNA, 34 bp, Artificial Sequence
  Synthetic oligonucleotide
gagcgggtccattgttactcctcaccactcttac

SEQ ID NO: 156547 - DNA, 35 bp, Artificial Sequence
  Synthetic oligonucleotide
aacacctccgcctgacatttggtgcaccaggcacc

SEQ ID NO: 156548 - DNA, 35 bp, Artificial Sequence
  Synthetic oligonucleotide
tacccggtgatcgcccccctgttcgcttaggcgcc

SEQ ID NO: 156549 - DNA, 35 bp, Artificial Sequence
  Synthetic oligonucleotide
gcctgtacggcgccttgataacgttctcgccctcc

SEQ ID NO: 156550 - DNA, 35 bp, Artificial Sequence
  Synthetic oligonucleotide
actctgcctacactgcatctccgctgagttcctcc

SEQ ID NO: 156551 - DNA, 35 bp, Artificial Sequence
  Synthetic oligonucleotide
gaaccccccgaacactactgccaccttgattgtcc

SEQ ID NO: 156552 - DNA, 35 bp, Artificial Sequence
  Synthetic oligonucleotide
gcctatgctcctgctgcttgccttccgtaccttcc

SEQ ID NO: 156553 - DNA, 35 bp, Artificial Sequence
  Synthetic oligonucleotide
tatccgccgcgcacgccttagaatcggctttttcc

SEQ ID NO: 156554 - DNA, 35 bp, Artificial Sequence
  Synthetic oligonucleotide
ttgccttgtccgcgttcgtgcttacctcctaccgc

SEQ ID NO: 156555 - DNA, 35 bp, Artificial Sequence
  Synthetic oligonucleotide
tgaggcccacagccttaattctctactgttcccgc

SEQ ID NO: 156556 - DNA, 35 bp, Artificial Sequence
  Synthetic oligonucleotide
gtggcttactccgctatgtgccgttcccctcttgc

SEQ ID NO: 156557 - DNA, 35 bp, Artificial Sequence
  Synthetic oligonucleotide
acacaccgatcgccttgactaaaccatcacaactc

SEQ ID NO: 156558 - DNA, 35 bp, Artificial Sequence
  Synthetic oligonucleotide
agcccgccccgcccacacctgtatggttccctgtc

SEQ ID NO: 156559 - DNA, 35 bp, Artificial Sequence
  Synthetic oligonucleotide
gatcggctccccgcctccctgaccttggatcgttc

SEQ ID NO: 156560 - DNA, 35 bp, Artificial Sequence
  Synthetic oligonucleotide
accgtccttctccatatggtctgccttcacctttc

SEQ ID NO: 156561 - DNA, 35 bp, Artificial Sequence
  Synthetic oligonucleotide
gaaggaaaggaggaggaaaagaacatttggttcag

SEQ ID NO: 156562 - DNA, 35 bp, Artificial Sequence
  Synthetic oligonucleotide
gattgacgcctctatctcaccacccagccacaccg

SEQ ID NO: 156563 - DNA, 34 bp, Artificial Sequence
  Synthetic oligonucleotide
gtcagagctaacgaactcgccccttgatccaccg

SEQ ID NO: 156564 - DNA, 26 bp, Artificial Sequence
  Synthetic oligonucleotide
ttggctgcccctgtactctcttcccg

SEQ ID NO: 156565 - DNA, 35 bp, Artificial Sequence
  Synthetic oligonucleotide
gctggggggacacgggggaaaagcgtactgcaagg

SEQ ID NO: 156566 - DNA, 35 bp, Artificial Sequence
  Synthetic oligonucleotide
gaccctcgcccgttctgcctctttgacgctctggg

SEQ ID NO: 156567 - DNA, 35 bp, Artificial Sequence
  Synthetic oligonucleotide
tcgatcggatcgaccttctcctcctcactgctgtg

SEQ ID NO: 156568 - DNA, 35 bp, Artificial Sequence
  Synthetic oligonucleotide
acgatactacacctgccgcctcctgggcctgacct

SEQ ID NO: 156569 - DNA, 35 bp, Artificial Sequence
  Synthetic oligonucleotide
tacatcagggcgttggctccttggtttttccccct

SEQ ID NO: 156570 - DNA, 35 bp, Artificial Sequence
  Synthetic oligonucleotide
gtcacactcgccaggtgctctgcctcattcctcct

SEQ ID NO: 156571 - DNA, 35 bp, Artificial Sequence
  Synthetic oligonucleotide
gtccgatgtaccggtccaccgcccgtccactcgct

SEQ ID NO: 156572 - DNA, 35 bp, Artificial Sequence
  Synthetic oligonucleotide
gcgagtgaggcgttctgtggttttctgctccatct

SEQ ID NO: 156573 - DNA, 35 bp, Artificial Sequence
  Synthetic oligonucleotide
acgcgatttacggccctgtactcgttgttcactct

SEQ ID NO: 156574 - DNA, 35 bp, Artificial Sequence
  Synthetic oligonucleotide
tccaagcgtacgatccccatcgctctccgcttcgt

SEQ ID NO: 156575 - DNA, 35 bp, Artificial Sequence
  Synthetic oligonucleotide
tgtccttcacaggttctgcccacacgttgctactt

SEQ ID NO: 156576 - DNA, 33 bp, Artificial Sequence
  Synthetic oligonucleotide
attgtgtacccaaccgcccgctattcgtctctt

SEQ ID NO: 156577 - DNA, 35 bp, Artificial Sequence
  Synthetic oligonucleotide
gagtcaccgcccacaagtcaacgccactttctgaa

SEQ ID NO: 156578 - DNA, 36 bp, Artificial Sequence
  Synthetic oligonucleotide
tgtccgtgcaacttgtccgtgcgccatctttttaca

SEQ ID NO: 156579 - DNA, 36 bp, Artificial Sequence
  Synthetic oligonucleotide
gtgcgctgcctctctccctttcagtttaagctccca

SEQ ID NO: 156580 - DNA, 36 bp, Artificial Sequence
  Synthetic oligonucleotide
ttgtagccgatccccccccataccgtgccgccgcca

SEQ ID NO: 156581 - DNA, 36 bp, Artificial Sequence
  Synthetic oligonucleotide
actgtccacccacatcgtcgccataaacctctgcca

SEQ ID NO: 156582 - DNA, 36 bp, Artificial Sequence
  Synthetic oligonucleotide
gaacgcattggctccgtcccgctccctgctctctca

SEQ ID NO: 156583 - DNA, 36 bp, Artificial Sequence
  Synthetic oligonucleotide
gcgaacgctgtcctctgtatttcgtcgctattctca

SEQ ID NO: 156584 - DNA, 35 bp, Artificial Sequence
  Synthetic oligonucleotide
gaaccttccgctttggtaaatttgtgcccttctca

SEQ ID NO: 156585 - DNA, 35 bp, Artificial Sequence
  Synthetic oligonucleotide
gacattaccttgatcctgccttaccgtgtccttca

SEQ ID NO: 156586 - DNA, 35 bp, Artificial Sequence
  Synthetic oligonucleotide
aaccgggcggggaacggtagcttagggagggttca

SEQ ID NO: 156587 - DNA, 37 bp, Artificial Sequence
  Synthetic oligonucleotide
tattgggaggagaggtggtggacggtaagggccaaga

SEQ ID NO: 156588 - DNA, 35 bp, Artificial Sequence
  Synthetic oligonucleotide
gcacctcccaccctgttatgccacccctctttaga

SEQ ID NO: 156589 - DNA, 37 bp, Artificial Sequence
  Synthetic oligonucleotide
aggggggaactacgggagggaggggggaccgggacga

SEQ ID NO: 156590 - DNA, 37 bp, Artificial Sequence
  Synthetic oligonucleotide
ttgccaccgtatattcttgccacgcgccctttcccga

SEQ ID NO: 156591 - DNA, 35 bp, Artificial Sequence
  Synthetic oligonucleotide
gtacgcctccctcgctccgaacaagtccgacagga

SEQ ID NO: 156592 - DNA, 37 bp, Artificial Sequence
  Synthetic oligonucleotide
tcgattggaatgaggtatacgggctgaggagggagga

SEQ ID NO: 156593 - DNA, 38 bp, Artificial Sequence
  Synthetic oligonucleotide
tcacgggcggggaggggtaacgggcaccgattgtagga

SEQ ID NO: 156594 - DNA, 37 bp, Artificial Sequence
  Synthetic oligonucleotide
ggtacacgaaagggctggggaagggggcgggaaggga

SEQ ID NO: 156595 - DNA, 37 bp, Artificial Sequence
  Synthetic oligonucleotide
tccgcaccccacaatataccgtacctcttcccgtgga

SEQ ID NO: 156596 - DNA, 37 bp, Artificial Sequence
  Synthetic oligonucleotide
attggacagtggcgggggagggggagctatgattgga

SEQ ID NO: 156597 - DNA, 37 bp, Artificial Sequence
  Synthetic oligonucleotide
gtaatgggcgggtgggttaaggaaataaggggaatga

SEQ ID NO: 156598 - DNA, 38 bp, Artificial Sequence
  Synthetic oligonucleotide
gagcgggaaaggtgggataaggggcggagagagtatga

SEQ ID NO: 156599 - DNA, 36 bp, Artificial Sequence
  Synthetic oligonucleotide
ggaggggcggggtggggtctcgggcttggagtatga

SEQ ID NO: 156600 - DNA, 37 bp, Artificial Sequence
  Synthetic oligonucleotide
tgcgtatagcctgccctccctcaccctcccggcctga

SEQ ID NO: 156601 - DNA, 38 bp, Artificial Sequence
  Synthetic oligonucleotide
tgtagagggtgggagggagtccaggtaggaaggggtga

SEQ ID NO: 156602 - DNA, 37 bp, Artificial Sequence
  Synthetic oligonucleotide
tggttacggtcttgtcttcccgcaccatccctattga

SEQ ID NO: 156603 - DNA, 38 bp, Artificial Sequence
  Synthetic oligonucleotide
gtgcggggggttgatggggcacacaggggcggtattga

SEQ ID NO: 156604 - DNA, 38 bp, Artificial Sequence
  Synthetic oligonucleotide
gttcacccgcacatattaagtcgtacattgccccttga

SEQ ID NO: 156605 - DNA, 36 bp, Artificial Sequence
  Synthetic oligonucleotide
ttcccgccccacgtacctattccctgcttggttata

SEQ ID NO: 156606 - DNA, 36 bp, Artificial Sequence
  Synthetic oligonucleotide
gagacgcctgctaccgtaatctgcctgttatttcta

SEQ ID NO: 156607 - DNA, 35 bp, Artificial Sequence
  Synthetic oligonucleotide
gcattctgccgccctcacctcatggttgatagtac

SEQ ID NO: 156608 - DNA, 35 bp, Artificial Sequence
  Synthetic oligonucleotide
atactatgcactcgcctccttgtgcatcatccacc

SEQ ID NO: 156609 - DNA, 35 bp, Artificial Sequence
  Synthetic oligonucleotide
accccaagggccaacgcctgccgactttccccccc

SEQ ID NO: 156610 - DNA, 35 bp, Artificial Sequence
  Synthetic oligonucleotide
gactcagccatatgcatcgcggaaagccgcccccc

SEQ ID NO: 156611 - DNA, 35 bp, Artificial Sequence
  Synthetic oligonucleotide
tgtactgccccatcacctgtcttctaacgccgccc

SEQ ID NO: 156612 - DNA, 35 bp, Artificial Sequence
  Synthetic oligonucleotide
gtaccatgcctgttttcttttgagcgttgcctccc

SEQ ID NO: 156613 - DNA, 35 bp, Artificial Sequence
  Synthetic oligonucleotide
gggaccgtcctcaccgtcattgccattgtcccgcc

SEQ ID NO: 156614 - DNA, 35 bp, Artificial Sequence
  Synthetic oligonucleotide
ggtccccgctctctcgcctaccgcatcgcgctgcc

SEQ ID NO: 156615 - DNA, 35 bp, Artificial Sequence
  Synthetic oligonucleotide
ttgcgggcacctcgtcctgttgactcgcctaatcc

SEQ ID NO: 156616 - DNA, 35 bp, Artificial Sequence
  Synthetic oligonucleotide
aaaccgccactacacgcttatctgacgccacatcc

SEQ ID NO: 156617 - DNA, 35 bp, Artificial Sequence
  Synthetic oligonucleotide
tatccctgttcatccgttgctgccttttgccatcc

SEQ ID NO: 156618 - DNA, 35 bp, Artificial Sequence
  Synthetic oligonucleotide
gtaacatcacggctacgatcctgccgatctactcc

SEQ ID NO: 156619 - DNA, 35 bp, Artificial Sequence
  Synthetic oligonucleotide
attgctcccagatgctccccgctacgtgcaattcc

SEQ ID NO: 156620 - DNA, 35 bp, Artificial Sequence
  Synthetic oligonucleotide
aaccacgcataggtacatttggccccccggattcc

SEQ ID NO: 156621 - DNA, 35 bp, Artificial Sequence
  Synthetic oligonucleotide
gtcgtccacgccgaattcgccacccatgcccccgc

SEQ ID NO: 156622 - DNA, 35 bp, Artificial Sequence
  Synthetic oligonucleotide
aaaatgaggggaatgggtacagggaagggtggcgc

SEQ ID NO: 156623 - DNA, 35 bp, Artificial Sequence
  Synthetic oligonucleotide
gcctccgacagtaacacctgcttcacagccctcgc

SEQ ID NO: 156624 - DNA, 35 bp, Artificial Sequence
  Synthetic oligonucleotide
tgtgcaacctccggcctgacgccgctgacccatgc

SEQ ID NO: 156625 - DNA, 35 bp, Artificial Sequence
  Synthetic oligonucleotide
accgtcactgtcgccccatcatctgctctgtctgc

SEQ ID NO: 156626 - DNA, 35 bp, Artificial Sequence
  Synthetic oligonucleotide
gccgtccgcctgcccccaacgctccgaaatacctc

SEQ ID NO: 156627 - DNA, 35 bp, Artificial Sequence
  Synthetic oligonucleotide
tactcgccttgtaaaccccgtcgggaattcccctc

SEQ ID NO: 156628 - DNA, 35 bp, Artificial Sequence
  Synthetic oligonucleotide
tatcccgccgtgtccctcctagttcgtgtttcctc

SEQ ID NO: 156629 - DNA, 35 bp, Artificial Sequence
  Synthetic oligonucleotide
accacagtcgtccgggccgctcttcacgcattttc

SEQ ID NO: 156630 - DNA, 35 bp, Artificial Sequence
  Synthetic oligonucleotide
gccgtttcacgccacccttcatgtactctttgccg

SEQ ID NO: 156631 - DNA, 35 bp, Artificial Sequence
  Synthetic oligonucleotide
tcagcatcaattgcttgttacaccatccacgtccg

SEQ ID NO: 156632 - DNA, 35 bp, Artificial Sequence
  Synthetic oligonucleotide
aaacgccttccggtacaatgtccgccttatcctcg

SEQ ID NO: 156633 - DNA, 35 bp, Artificial Sequence
  Synthetic oligonucleotide
gtacgcgataagagcaggggggcaggaaacggagg

SEQ ID NO: 156634 - DNA, 35 bp, Artificial Sequence
  Synthetic oligonucleotide
gtctcgagggagggaaagggacgtcgggtaatctg

SEQ ID NO: 156635 - DNA, 35 bp, Artificial Sequence
  Synthetic oligonucleotide
gtcccgcaagcgaatgggtgggtcagggggggaat

SEQ ID NO: 156636 - DNA, 35 bp, Artificial Sequence
  Synthetic oligonucleotide
agcacgttgaggtctggcctctctcctgctcccat

SEQ ID NO: 156637 - DNA, 35 bp, Artificial Sequence
  Synthetic oligonucleotide
gtagactcccacctggcctgttaagactactccat

SEQ ID NO: 156638 - DNA, 35 bp, Artificial Sequence
  Synthetic oligonucleotide
ggggggtaaagcaatgtgaaggtggtaacgggcat

SEQ ID NO: 156639 - DNA, 35 bp, Artificial Sequence
  Synthetic oligonucleotide
tgcgacccatactctgttttgaactgccgccctat

SEQ ID NO: 156640 - DNA, 35 bp, Artificial Sequence
  Synthetic oligonucleotide
tctgggcttgtcgtctcgttccctatggcctcact

SEQ ID NO: 156641 - DNA, 35 bp, Artificial Sequence
  Synthetic oligonucleotide
acacccaacatcattgtacacccatgcattttcct

SEQ ID NO: 156642 - DNA, 35 bp, Artificial Sequence
  Synthetic oligonucleotide
acccatgattacccgttgcgaaagtgccccacgct

SEQ ID NO: 156643 - DNA, 35 bp, Artificial Sequence
  Synthetic oligonucleotide
gttttgccccgtgtaccatcgttccagacctgtct

SEQ ID NO: 156644 - DNA, 35 bp, Artificial Sequence
  Synthetic oligonucleotide
aacccgtccttccccgcacccgtgacagcaatagt

SEQ ID NO: 156645 - DNA, 35 bp, Artificial Sequence
  Synthetic oligonucleotide
gccgacgcctcacactcaggcatatctcgctactt

SEQ ID NO: 156646 - DNA, 35 bp, Artificial Sequence
  Synthetic oligonucleotide
accatctgtgccgaattttaggctgttaccctctt

SEQ ID NO: 156647 - DNA, 35 bp, Artificial Sequence
  Synthetic oligonucleotide
tgtcgtcctcagtcggctctatcctcctctggttt

SEQ ID NO: 156648 - DNA, 36 bp, Artificial Sequence
  Synthetic oligonucleotide
ggaggacaggcaggaacggcacggaatcggggaaaa

SEQ ID NO: 156649 - DNA, 36 bp, Artificial Sequence
  Synthetic oligonucleotide
ggatcgactgggaggttggagggaggtgggcgcaaa

SEQ ID NO: 156650 - DNA, 36 bp, Artificial Sequence
  Synthetic oligonucleotide
ttgggctcggaccaatggcatttcacccctcctcaa

SEQ ID NO: 156651 - DNA, 35 bp, Artificial Sequence
  Synthetic oligonucleotide
acagacacccctgtttttcctgttcattgccttaa

SEQ ID NO: 156652 - DNA, 36 bp, Artificial Sequence
  Synthetic oligonucleotide
tacagcacgtgcgccgtttccgtgttatctcgccca

SEQ ID NO: 156653 - DNA, 36 bp, Artificial Sequence
  Synthetic oligonucleotide
accctccgtagaatgtccgtcgttttcctccagcca

SEQ ID NO: 156654 - DNA, 36 bp, Artificial Sequence
  Synthetic oligonucleotide
ccttatccgcccgctctcatctgctcccaccaggca

SEQ ID NO: 156655 - DNA, 36 bp, Artificial Sequence
  Synthetic oligonucleotide
aactgccctcaggcctatccccctcatacgtggtca

SEQ ID NO: 156656 - DNA, 36 bp, Artificial Sequence
  Synthetic oligonucleotide
tcgcgaggcccggcctgcttgtttcattcgttgtca

SEQ ID NO: 156657 - DNA, 37 bp, Artificial Sequence
  Synthetic oligonucleotide
atagtgggcgcgggagggacgggggcaagctggtaga

SEQ ID NO: 156658 - DNA, 36 bp, Artificial Sequence
  Synthetic oligonucleotide
gtctgccgcattgtggcctcttagtaccacctccga

SEQ ID NO: 156659 - DNA, 37 bp, Artificial Sequence
  Synthetic oligonucleotide
tagatgaggcaggtgaggccaggagggagggaagcga

SEQ ID NO: 156660 - DNA, 36 bp, Artificial Sequence
  Synthetic oligonucleotide
ggaggggcgaacagaaaggggtgggcatcggaggga

SEQ ID NO: 156661 - DNA, 37 bp, Artificial Sequence
  Synthetic oligonucleotide
tcccacccctcttagatgcccttcgtttttgtcatga

SEQ ID NO: 156662 - DNA, 38 bp, Artificial Sequence
  Synthetic oligonucleotide
ttcgactcggcatgattataaccctctctcgctcctga

SEQ ID NO: 156663 - DNA, 37 bp, Artificial Sequence
  Synthetic oligonucleotide
gcggtcgcctcgtgccctgttctgctttcccttgtga

SEQ ID NO: 156664 - DNA, 38 bp, Artificial Sequence
  Synthetic oligonucleotide
aaaccagcgacctcccccctcgccctgccgtccattga

SEQ ID NO: 156665 - DNA, 37 bp, Artificial Sequence
  Synthetic oligonucleotide
tacacctgccgttgttcctcgacctcgtccttattga

SEQ ID NO: 156666 - DNA, 36 bp, Artificial Sequence
  Synthetic oligonucleotide
ggggtacggacgtagcaggggcggggaggagggata

SEQ ID NO: 156667 - DNA, 35 bp, Artificial Sequence
  Synthetic oligonucleotide
gcctaagcgcgctgccatatccatgccttgcccta

SEQ ID NO: 156668 - DNA, 35 bp, Artificial Sequence
  Synthetic oligonucleotide
gtcgcccattatagtagcctcctgttccacgccta

SEQ ID NO: 156669 - DNA, 36 bp, Artificial Sequence
  Synthetic oligonucleotide
gtcgcgcacccttcacctagccgtaactggtctcta

SEQ ID NO: 156670 - DNA, 36 bp, Artificial Sequence
  Synthetic oligonucleotide
accctccctcggatactggatcctaccactgttcta

SEQ ID NO: 156671 - DNA, 36 bp, Artificial Sequence
  Synthetic oligonucleotide
agcgaagctgcatacgagagggggagggtgcgggta

SEQ ID NO: 156672 - DNA, 36 bp, Artificial Sequence
  Synthetic oligonucleotide
accgatctcgcatattcgtagctccatcctccgtta

SEQ ID NO: 156673 - DNA, 35 bp, Artificial Sequence
  Synthetic oligonucleotide
gtctcacccatacccctgcctccctgtagtagtac

SEQ ID NO: 156674 - DNA, 35 bp, Artificial Sequence
  Synthetic oligonucleotide
tcccttccaaccacctgtgtgtccctgacttgtac

SEQ ID NO: 156675 - DNA, 35 bp, Artificial Sequence
  Synthetic oligonucleotide
ggtcgcaccgcggatctacctcgactctttgcacc

SEQ ID NO: 156676 - DNA, 35 bp, Artificial Sequence
  Synthetic oligonucleotide
atgacgcatcccggccccgctcggtcccaagcccc

SEQ ID NO: 156677 - DNA, 35 bp, Artificial Sequence
  Synthetic oligonucleotide
ggatctccgccctccctgatgcaccacttagatcc

SEQ ID NO: 156678 - DNA, 35 bp, Artificial Sequence
  Synthetic oligonucleotide
atggatcgcgttgtcctgtgctgcatcacacctcc

SEQ ID NO: 156679 - DNA, 35 bp, Artificial Sequence
  Synthetic oligonucleotide
tagtgttgtctcgtcccgctccagtcccgctgtcc

SEQ ID NO: 156680 - DNA, 35 bp, Artificial Sequence
  Synthetic oligonucleotide
tacttcagcgtggccctcctcgtcttagttcttcc

SEQ ID NO: 156681 - DNA, 35 bp, Artificial Sequence
  Synthetic oligonucleotide
gtgggccccgacatgcggaggactcgccccgttcc

SEQ ID NO: 156682 - DNA, 35 bp, Artificial Sequence
  Synthetic oligonucleotide
gtgccaccctgctctcacctgccttttgtacacgc

SEQ ID NO: 156683 - DNA, 35 bp, Artificial Sequence
  Synthetic oligonucleotide
gctccgatctctgcccgaaggtcctcgcccctcgc

SEQ ID NO: 156684 - DNA, 35 bp, Artificial Sequence
  Synthetic oligonucleotide
tggagatgcccgccgaccatacccaccttccctag

SEQ ID NO: 156685 - DNA, 35 bp, Artificial Sequence
  Synthetic oligonucleotide
gtcgggaccgggtgggggggaaataaattgtttag

SEQ ID NO: 156686 - DNA, 35 bp, Artificial Sequence
  Synthetic oligonucleotide
gccgttcacgaggtcacccaggttttccccccccg

SEQ ID NO: 156687 - DNA, 35 bp, Artificial Sequence
  Synthetic oligonucleotide
tcgacaaactgccacacgcctagtacactcccccg

SEQ ID NO: 156688 - DNA, 35 bp, Artificial Sequence
  Synthetic oligonucleotide
ttgtacttccactgccttatcgacgcccctgcccg

SEQ ID NO: 156689 - DNA, 35 bp, Artificial Sequence
  Synthetic oligonucleotide
ttacgtccccgctcacttactcattgctctacgcg

SEQ ID NO: 156690 - DNA, 35 bp, Artificial Sequence
  Synthetic oligonucleotide
ttcgaccgtgcactcaccccgcccaatctttcgcg

SEQ ID NO: 156691 - DNA, 35 bp, Artificial Sequence
  Synthetic oligonucleotide
tgttcacactcaggctctctatcccagctcctgcg

SEQ ID NO: 156692 - DNA, 35 bp, Artificial Sequence
  Synthetic oligonucleotide
gtcaccgcacatttggtcctccgctaaccatttcg

SEQ ID NO: 156693 - DNA, 35 bp, Artificial Sequence
  Synthetic oligonucleotide
agcgaggccgcacccccgccatcatctgcatttcg

SEQ ID NO: 156694 - DNA, 35 bp, Artificial Sequence
  Synthetic oligonucleotide
acaagggagggggtgggaagcatcaggaatagggg

SEQ ID NO: 156695 - DNA, 35 bp, Artificial Sequence
  Synthetic oligonucleotide
tgagggttagggagggctgagggtgggagggttgg

SEQ ID NO: 156696 - DNA, 35 bp, Artificial Sequence
  Synthetic oligonucleotide
taagcgatcatcggaccccgcgcccctacaccctg

SEQ ID NO: 156697 - DNA, 35 bp, Artificial Sequence
  Synthetic oligonucleotide
acgccctcctccttgtcttacttacgatttatctg

SEQ ID NO: 156698 - DNA, 35 bp, Artificial Sequence
  Synthetic oligonucleotide
gtctaagttaggggggatatgagggtgggagtgtg

SEQ ID NO: 156699 - DNA, 35 bp, Artificial Sequence
  Synthetic oligonucleotide
acgaacacctctccacacacgggaccagcctaact

SEQ ID NO: 156700 - DNA, 35 bp, Artificial Sequence
  Synthetic oligonucleotide
acaccgcccctgctcgaactcgtacgtgttgcact

SEQ ID NO: 156701 - DNA, 35 bp, Artificial Sequence
  Synthetic oligonucleotide
tgagtcccatcacgtttatggtcgtctgttctcct

SEQ ID NO: 156702 - DNA, 35 bp, Artificial Sequence
  Synthetic oligonucleotide
gtctccccgccgaaacggtgttcttctcttccgct

SEQ ID NO: 156703 - DNA, 35 bp, Artificial Sequence
  Synthetic oligonucleotide
gttcccacccggagccgcccacttcatgtctagtt

SEQ ID NO: 156704 - DNA, 35 bp, Artificial Sequence
  Synthetic oligonucleotide
tagtgcttccgctggcctatcgctacccaccattt

SEQ ID NO: 156705 - DNA, 35 bp, Artificial Sequence
  Synthetic oligonucleotide
acagaggccctctgtgcgttcgatcttccaccttt

SEQ ID NO: 156706 - DNA, 36 bp, Artificial Sequence
  Synthetic oligonucleotide
tcccaaccccccagtgcctgtaggtcctctctcaaa

SEQ ID NO: 156707 - DNA, 36 bp, Artificial Sequence
  Synthetic oligonucleotide
aatcgccacgctcaccggtccatctcgcctccgaca

SEQ ID NO: 156708 - DNA, 36 bp, Artificial Sequence
  Synthetic oligonucleotide
atgtgcccacgcgataatggtattccccgtccccca

SEQ ID NO: 156709 - DNA, 36 bp, Artificial Sequence
  Synthetic oligonucleotide
gatttatccggcacactgcgtctactaatcgctcca

SEQ ID NO: 156710 - DNA, 35 bp, Artificial Sequence
  Synthetic oligonucleotide
tcctccctacatcgatgatgcccctcattggtcca

SEQ ID NO: 156711 - DNA, 36 bp, Artificial Sequence
  Synthetic oligonucleotide
tacactctcgatcccttttccccagtggcttgctca

SEQ ID NO: 156712 - DNA, 37 bp, Artificial Sequence
  Synthetic oligonucleotide
gagtgagggtggggttaactgaaggggggcattaaga

SEQ ID NO: 156713 - DNA, 36 bp, Artificial Sequence
  Synthetic oligonucleotide
gtatcccgcctccaccttcgcagtcagtcgtctaga

SEQ ID NO: 156714 - DNA, 37 bp, Artificial Sequence
  Synthetic oligonucleotide
acttccagggcggggagggggcaaacacgcgggacga

SEQ ID NO: 156715 - DNA, 37 bp, Artificial Sequence
  Synthetic oligonucleotide
tcctcgtcccagccgacgccgtatgccacccgcccga

SEQ ID NO: 156716 - DNA, 37 bp, Artificial Sequence
  Synthetic oligonucleotide
acatgaacgtgcctatgaccttccgcctccatatcga

SEQ ID NO: 156717 - DNA, 36 bp, Artificial Sequence
  Synthetic oligonucleotide
tgtgacaccctttagtgccttgttctgtcctctcga

SEQ ID NO: 156718 - DNA, 36 bp, Artificial Sequence
  Synthetic oligonucleotide
tcgtcacgcatgcatcctccccaccgtgccattcga

SEQ ID NO: 156719 - DNA, 35 bp, Artificial Sequence
  Synthetic oligonucleotide
tcccgcgcctgaccccccccacccacgccgcggga

SEQ ID NO: 156720 - DNA, 35 bp, Artificial Sequence
  Synthetic oligonucleotide
taggtggaatgagaggcgggaggcgagagtcggga

SEQ ID NO: 156721 - DNA, 38 bp, Artificial Sequence
  Synthetic oligonucleotide
gcagggacggttggtggggggagatggggctataatga

SEQ ID NO: 156722 - DNA, 38 bp, Artificial Sequence
  Synthetic oligonucleotide
accagtcacccgcagcaatgtttccgcttccatcatga

SEQ ID NO: 156723 - DNA, 38 bp, Artificial Sequence
  Synthetic oligonucleotide
tgcatgtctcctcctgatctatctgtggccttccctga

SEQ ID NO: 156724 - DNA, 35 bp, Artificial Sequence
  Synthetic oligonucleotide
tcatacgtcgtccattattccctgttgcttcctga

SEQ ID NO: 156725 - DNA, 38 bp, Artificial Sequence
  Synthetic oligonucleotide
acccgcactagcgtgtctcttacaccttctcttcctga

SEQ ID NO: 156726 - DNA, 37 bp, Artificial Sequence
  Synthetic oligonucleotide
ttccccccgtaccccccgtgcaccaccgccactctga

SEQ ID NO: 156727 - DNA, 38 bp, Artificial Sequence
  Synthetic oligonucleotide
ttgcgacgcctactgttagcctcccatttccctagtga

SEQ ID NO: 156728 - DNA, 38 bp, Artificial Sequence
  Synthetic oligonucleotide
gacccgctacctgctgtacatgatctcctgccacgtga

SEQ ID NO: 156729 - DNA, 38 bp, Artificial Sequence
  Synthetic oligonucleotide
tccgccctgcccgacttctaccgcacatctcgacgtga

SEQ ID NO: 156730 - DNA, 38 bp, Artificial Sequence
  Synthetic oligonucleotide
gatggggagggggaggattagaaccaagaggagcgtga

SEQ ID NO: 156731 - DNA, 36 bp, Artificial Sequence
  Synthetic oligonucleotide
ataaggacagggaaagagatgagcaggagggcgtga

SEQ ID NO: 156732 - DNA, 38 bp, Artificial Sequence
  Synthetic oligonucleotide
tgttgaaggaaagtgaagaggagggcgggcgggggtga

SEQ ID NO: 156733 - DNA, 37 bp, Artificial Sequence
  Synthetic oligonucleotide
gcgcctcccgccacttgcacccgggtacattttgtga

SEQ ID NO: 156734 - DNA, 36 bp, Artificial Sequence
  Synthetic oligonucleotide
aaagcggggggggatggaatggggccccgggaacta

SEQ ID NO: 156735 - DNA, 36 bp, Artificial Sequence
  Synthetic oligonucleotide
ttgcatccccccctatgattctgtcatgtcgcccta

SEQ ID NO: 156736 - DNA, 36 bp, Artificial Sequence
  Synthetic oligonucleotide
gggggcagttgctcgggtgggtctgcaatgggggta

SEQ ID NO: 156737 - DNA, 36 bp, Artificial Sequence
  Synthetic oligonucleotide
tcacgcctcattctgcccagaacctctacgcttgta

SEQ ID NO: 156738 - DNA, 35 bp, Artificial Sequence
  Synthetic oligonucleotide
gcagggtacacagggaaggggccgggatggggtta

SEQ ID NO: 156739 - DNA, 34 bp, Artificial Sequence
  Synthetic oligonucleotide
tagcccacatccctcagtcaccgccgaattccac

SEQ ID NO: 156740 - DNA, 35 bp, Artificial Sequence
  Synthetic oligonucleotide
agctgaccggagccgtcttaaggccccccccaacc

SEQ ID NO: 156741 - DNA, 35 bp, Artificial Sequence
  Synthetic oligonucleotide
ttgggccacccactgtgccttgtttgtcaatcacc

SEQ ID NO: 156742 - DNA, 35 bp, Artificial Sequence
  Synthetic oligonucleotide
acccagggtacaatcataggtccgccccccgaccc

SEQ ID NO: 156743 - DNA, 34 bp, Artificial Sequence
  Synthetic oligonucleotide
gtacctacttgtccactcgcactgccgtgacccc

SEQ ID NO: 156744 - DNA, 35 bp, Artificial Sequence
  Synthetic oligonucleotide
tacccccggccaaatttgggaataccaccgtcccc

SEQ ID NO: 156745 - DNA, 35 bp, Artificial Sequence
  Synthetic oligonucleotide
tcgctcacctcaatgcaagctgccctcccgttccc

SEQ ID NO: 156746 - DNA, 35 bp, Artificial Sequence
  Synthetic oligonucleotide
tgaccatatacgccgccctgagtggctcctccgcc

SEQ ID NO: 156747 - DNA, 35 bp, Artificial Sequence
  Synthetic oligonucleotide
tccacccggacccttatctgtcgttaaaacgatcc

SEQ ID NO: 156748 - DNA, 35 bp, Artificial Sequence
  Synthetic oligonucleotide
tagacgaagtcaggtccttccactatccatcttcc

SEQ ID NO: 156749 - DNA, 34 bp, Artificial Sequence
  Synthetic oligonucleotide
tacctagccactaatcactcgcagacctccacgc

SEQ ID NO: 156750 - DNA, 35 bp, Artificial Sequence
  Synthetic oligonucleotide
gttcgctccggggccgtcccgcatacttccctggc

SEQ ID NO: 156751 - DNA, 35 bp, Artificial Sequence
  Synthetic oligonucleotide
tttgtggcacccgaccctccctgtctctctgcatc

SEQ ID NO: 156752 - DNA, 35 bp, Artificial Sequence
  Synthetic oligonucleotide
ggtcaaaccaccggctcattcctgtctgttacctc

SEQ ID NO: 156753 - DNA, 35 bp, Artificial Sequence
  Synthetic oligonucleotide
ggctcatcccgctgctatcgtcgtcaatcagcctc

SEQ ID NO: 156754 - DNA, 35 bp, Artificial Sequence
  Synthetic oligonucleotide
gaacgctccagcctgtcttactcaacactacgctc

SEQ ID NO: 156755 - DNA, 35 bp, Artificial Sequence
  Synthetic oligonucleotide
atggaggaggaaagggcgtagggaggtcgggtctc

SEQ ID NO: 156756 - DNA, 35 bp, Artificial Sequence
  Synthetic oligonucleotide
agaccacctgttgactttgcttactcccgtgtctc

SEQ ID NO: 156757 - DNA, 35 bp, Artificial Sequence
  Synthetic oligonucleotide
gacgttgccccgagctccacgagtacctgtccttc

SEQ ID NO: 156758 - DNA, 35 bp, Artificial Sequence
  Synthetic oligonucleotide
atgtccgcctccgaccgttgaacgttgaccgcttc

SEQ ID NO: 156759 - DNA, 35 bp, Artificial Sequence
  Synthetic oligonucleotide
atttgctcgtgcctcgattccctttacgtgtcttc

SEQ ID NO: 156760 - DNA, 35 bp, Artificial Sequence
  Synthetic oligonucleotide
agtcaccctttcatctaccgtccactatgccgttc

SEQ ID NO: 156761 - DNA, 35 bp, Artificial Sequence
  Synthetic oligonucleotide
gtccatcttgcccgtgttccgtgtgcgtttccccg

SEQ ID NO: 156762 - DNA, 35 bp, Artificial Sequence
  Synthetic oligonucleotide
accgcccgttggggtccgcctcacatcctcgcccg

SEQ ID NO: 156763 - DNA, 35 bp, Artificial Sequence
  Synthetic oligonucleotide
ggagcgctacccgccgccactctacgccccgtccg

SEQ ID NO: 156764 - DNA, 35 bp, Artificial Sequence
  Synthetic oligonucleotide
agctgagccacacataaaccgtacatatccttccg

SEQ ID NO: 156765 - DNA, 34 bp, Artificial Sequence
  Synthetic oligonucleotide
tgagccctggccccaagtccgtttactacccgcg

SEQ ID NO: 156766 - DNA, 35 bp, Artificial Sequence
  Synthetic oligonucleotide
aagtgggtgaaaatgtcgcgggaagggaacgggcg

SEQ ID NO: 156767 - DNA, 35 bp, Artificial Sequence
  Synthetic oligonucleotide
gacccgctgtcttgcacctgttccaccatagatcg

SEQ ID NO: 156768 - DNA, 35 bp, Artificial Sequence
  Synthetic oligonucleotide
aggaccatacctctgacctccactacgcccactcg

SEQ ID NO: 156769 - DNA, 35 bp, Artificial Sequence
  Synthetic oligonucleotide
acgtgtccccgacaacatctacatcatgccattcg

SEQ ID NO: 156770 - DNA, 35 bp, Artificial Sequence
  Synthetic oligonucleotide
actggatggtgcgcgggattgggagggtatcaagg

SEQ ID NO: 156771 - DNA, 35 bp, Artificial Sequence
  Synthetic oligonucleotide
tgctgtgctctcctctacatgtgtctttccctcgg

SEQ ID NO: 156772 - DNA, 35 bp, Artificial Sequence
  Synthetic oligonucleotide
gtaccaagggcgggacgggttaggaaacaaaaggg

SEQ ID NO: 156773 - DNA, 35 bp, Artificial Sequence
  Synthetic oligonucleotide
gagcagggcggagggggcaggcgggtggttaaatg

SEQ ID NO: 156774 - DNA, 35 bp, Artificial Sequence
  Synthetic oligonucleotide
gaccccactcacgacgctccggatcactcattctg

SEQ ID NO: 156775 - DNA, 35 bp, Artificial Sequence
  Synthetic oligonucleotide
aaccccccgacgcattgacaggctgcccacacttg

SEQ ID NO: 156776 - DNA, 35 bp, Artificial Sequence
  Synthetic oligonucleotide
acattccccgcccctcaggagcatatgctcctaat

SEQ ID NO: 156777 - DNA, 34 bp, Artificial Sequence
  Synthetic oligonucleotide
gcgatcgtacttgcgtgaaagccgccacctccct

SEQ ID NO: 156778 - DNA, 35 bp, Artificial Sequence
  Synthetic oligonucleotide
gcgctcgactcctgagcctcacatcgccgtatcct

SEQ ID NO: 156779 - DNA, 35 bp, Artificial Sequence
  Synthetic oligonucleotide
acgaccggcttccagcgtatgtcccttgcccgtct

SEQ ID NO: 156780 - DNA, 35 bp, Artificial Sequence
  Synthetic oligonucleotide
aactgccaccacccaatcccgctcgccaggccagt

SEQ ID NO: 156781 - DNA, 35 bp, Artificial Sequence
  Synthetic oligonucleotide
tccgtcacagaccctgaccctacacttcctgccgt

SEQ ID NO: 156782 - DNA, 35 bp, Artificial Sequence
  Synthetic oligonucleotide
gcccatgtacgtttgtgggcttcaccttgttaatt

SEQ ID NO: 156783 - DNA, 36 bp, Artificial Sequence
  Synthetic oligonucleotide
gttacgcctatggccgcaagaataccacctaccgtt

SEQ ID NO: 156784 - DNA, 36 bp, Artificial Sequence
  Synthetic oligonucleotide
atgtccccgcttcctttaacatgtctcgccatttaa

SEQ ID NO: 156785 - DNA, 36 bp, Artificial Sequence
  Synthetic oligonucleotide
gccgcctcgagcgacccccctgctttcgcggtacca

SEQ ID NO: 156786 - DNA, 36 bp, Artificial Sequence
  Synthetic oligonucleotide
gccccgtctaggtcgcaccctctctttgccccatca

SEQ ID NO: 156787 - DNA, 36 bp, Artificial Sequence
  Synthetic oligonucleotide
gatccgtcgtaccgcttgttctctgctcgttcatca

SEQ ID NO: 156788 - DNA, 37 bp, Artificial Sequence
  Synthetic oligonucleotide
gagctggacgggggtggaggggactggtaggagtaga

SEQ ID NO: 156789 - DNA, 37 bp, Artificial Sequence
  Synthetic oligonucleotide
taagcgccgaatggcaaccgcacctccaccctgtaga

SEQ ID NO: 156790 - DNA, 37 bp, Artificial Sequence
  Synthetic oligonucleotide
accttccgcaccgactctgcctaccttgcgccgacga

SEQ ID NO: 156791 - DNA, 37 bp, Artificial Sequence
  Synthetic oligonucleotide
tcctacccctgcccagccccaaaggagcccgacccga

SEQ ID NO: 156792 - DNA, 37 bp, Artificial Sequence
  Synthetic oligonucleotide
gacatcccggtcgtccttcctgctactatcatcccga

SEQ ID NO: 156793 - DNA, 35 bp, Artificial Sequence
  Synthetic oligonucleotide
tgatctacccctgacctgctataatcggaatccga

SEQ ID NO: 156794 - DNA, 37 bp, Artificial Sequence
  Synthetic oligonucleotide
tcctgaccgagtccttcccgtgctcctcctgctccga

SEQ ID NO: 156795 - DNA, 35 bp, Artificial Sequence
  Synthetic oligonucleotide
gtccgctcccgttcactcataatagtaggttgcga

SEQ ID NO: 156796 - DNA, 37 bp, Artificial Sequence
  Synthetic oligonucleotide
gggtgagggtaagggaagggatcaattatagcaggga

SEQ ID NO: 156797 - DNA, 37 bp, Artificial Sequence
  Synthetic oligonucleotide
acacagctggggggaggaagggcaggcgcggcaggga

SEQ ID NO: 156798 - DNA, 36 bp, Artificial Sequence
  Synthetic oligonucleotide
ggactccacatctactgccacccctttccatcggga

SEQ ID NO: 156799 - DNA, 37 bp, Artificial Sequence
  Synthetic oligonucleotide
gactgacgagacgggaatgacggggagataaaatgga

SEQ ID NO: 156800 - DNA, 38 bp, Artificial Sequence
  Synthetic oligonucleotide
acccacccgaccgacacttactcacagtcagaccctga

SEQ ID NO: 156801 - DNA, 38 bp, Artificial Sequence
  Synthetic oligonucleotide
atgggcacgggcacctgacttttgttacacccccctga

SEQ ID NO: 156802 - DNA, 38 bp, Artificial Sequence
  Synthetic oligonucleotide
gacgcgcattcgcaattgtttttacgcctcgcccctga

SEQ ID NO: 156803 - DNA, 38 bp, Artificial Sequence
  Synthetic oligonucleotide
aacgttgtcgccccccccgtgcttggattatgccctga

SEQ ID NO: 156804 - DNA, 38 bp, Artificial Sequence
  Synthetic oligonucleotide
cactgccccgcccacatctgtaatttcctgtcgcctga

SEQ ID NO: 156805 - DNA, 38 bp, Artificial Sequence
  Synthetic oligonucleotide
gcccccatcgccccgactttgcttaacagtttcgctga

SEQ ID NO: 156806 - DNA, 38 bp, Artificial Sequence
  Synthetic oligonucleotide
agcccatagctgccatcgtctaagccgcccccccgtga

SEQ ID NO: 156807 - DNA, 38 bp, Artificial Sequence
  Synthetic oligonucleotide
aacgaagcagggtggccgagggggggcatacggattga

SEQ ID NO: 156808 - DNA, 38 bp, Artificial Sequence
  Synthetic oligonucleotide
ggtgtgggtggtggaaggtggaggcacagagagcttga

SEQ ID NO: 156809 - DNA, 37 bp, Artificial Sequence
  Synthetic oligonucleotide
gccacccccgctcgccgcacccgatatgtcgctttga

SEQ ID NO: 156810 - DNA, 36 bp, Artificial Sequence
  Synthetic oligonucleotide
agcaaaccgcctgcaatatcccgttctatgccccta

SEQ ID NO: 156811 - DNA, 35 bp, Artificial Sequence
  Synthetic oligonucleotide
ttggccgacgttctttctgtccccccgctgccgta

SEQ ID NO: 156812 - DNA, 36 bp, Artificial Sequence
  Synthetic oligonucleotide
accctgcgaccagaaatagggagggggggaaaggta

SEQ ID NO: 156813 - DNA, 36 bp, Artificial Sequence
  Synthetic oligonucleotide
tagggtctgggcgagagggggggtggtgctggggta

SEQ ID NO: 156814 - DNA, 36 bp, Artificial Sequence
  Synthetic oligonucleotide
gctaatccccagaagtccgccccctgtcctcctgta

SEQ ID NO: 156815 - DNA, 35 bp, Artificial Sequence
  Synthetic oligonucleotide
aaggacgggggggcggagatgggacgagtgcatta

SEQ ID NO: 156816 - DNA, 35 bp, Artificial Sequence
  Synthetic oligonucleotide
acacgacagatcacctctttgtctgccgattatac

SEQ ID NO: 156817 - DNA, 35 bp, Artificial Sequence
  Synthetic oligonucleotide
gacaacccctatccatgtaaaacacctcggatccc

SEQ ID NO: 156818 - DNA, 35 bp, Artificial Sequence
  Synthetic oligonucleotide
atatcacccgtgaggtctttcttaccggttctccc

SEQ ID NO: 156819 - DNA, 35 bp, Artificial Sequence
  Synthetic oligonucleotide
gtaccgcatagtgaacacgccctttaactccatcc

SEQ ID NO: 156820 - DNA, 35 bp, Artificial Sequence
  Synthetic oligonucleotide
ttccaggggcaccatcgtattccacttattcatcc

SEQ ID NO: 156821 - DNA, 35 bp, Artificial Sequence
  Synthetic oligonucleotide
atccgctttcctcagcccatgcttttggcatctcc

SEQ ID NO: 156822 - DNA, 35 bp, Artificial Sequence
  Synthetic oligonucleotide
tgacggttccgatggcttccccgtgcacaccgtcc

SEQ ID NO: 156823 - DNA, 35 bp, Artificial Sequence
  Synthetic oligonucleotide
acgtcggtcggcccgttaccgcactatgaacttcc

SEQ ID NO: 156824 - DNA, 35 bp, Artificial Sequence
  Synthetic oligonucleotide
gacctgctcggccgatctaccccagttttaccatc

SEQ ID NO: 156825 - DNA, 35 bp, Artificial Sequence
  Synthetic oligonucleotide
tagtgatgtcgcggactgtaactgccctccccctc

SEQ ID NO: 156826 - DNA, 35 bp, Artificial Sequence
  Synthetic oligonucleotide
ccaccctgagccaatatgcacaccactcacgcctc

SEQ ID NO: 156827 - DNA, 35 bp, Artificial Sequence
  Synthetic oligonucleotide
tcgcgctctccaccttaccgcacgcgtttcatctc

SEQ ID NO: 156828 - DNA, 35 bp, Artificial Sequence
  Synthetic oligonucleotide
taaccgccctcagctaataaaacgctcgacttctc

SEQ ID NO: 156829 - DNA, 35 bp, Artificial Sequence
  Synthetic oligonucleotide
tacgacccatcccgccggcccgatcgcccgtgttc

SEQ ID NO: 156830 - DNA, 35 bp, Artificial Sequence
  Synthetic oligonucleotide
gcatgtgcccacgcttgtaatctccacgtgctttc

SEQ ID NO: 156831 - DNA, 35 bp, Artificial Sequence
  Synthetic oligonucleotide
gagcggggtcggagttcgggacggtagggatgcag

SEQ ID NO: 156832 - DNA, 35 bp, Artificial Sequence
  Synthetic oligonucleotide
acacccccccgatcatgcacattggatatctcacg

SEQ ID NO: 156833 - DNA, 35 bp, Artificial Sequence
  Synthetic oligonucleotide
ccagcccccatagtcccaaccgccgcttccacccg

SEQ ID NO: 156834 - DNA, 35 bp, Artificial Sequence
  Synthetic oligonucleotide
gcccgccagatgccaccgccgcctcagctcgcccg

SEQ ID NO: 156835 - DNA, 35 bp, Artificial Sequence
  Synthetic oligonucleotide
aagcccccatccaaagtgctctatctgccatcgcg

SEQ ID NO: 156836 - DNA, 35 bp, Artificial Sequence
  Synthetic oligonucleotide
actggccaaaccgcgggccttaccatccttcttcg

SEQ ID NO: 156837 - DNA, 35 bp, Artificial Sequence
  Synthetic oligonucleotide
gcaggtgggaagcggcttcgggcggggggggagtg

SEQ ID NO: 156838 - DNA, 35 bp, Artificial Sequence
  Synthetic oligonucleotide
tcgcctcccatctgtcgctcaccttagtactcaat

SEQ ID NO: 156839 - DNA, 35 bp, Artificial Sequence
  Synthetic oligonucleotide
agtccactcctgcctctgttgctatatttccgcat

SEQ ID NO: 156840 - DNA, 35 bp, Artificial Sequence
  Synthetic oligonucleotide
ttgcaaagtggggagggtgcatacgggggagggat

SEQ ID NO: 156841 - DNA, 35 bp, Artificial Sequence
  Synthetic oligonucleotide
ttagtccccgactcccttcactggcctagagcact

SEQ ID NO: 156842 - DNA, 35 bp, Artificial Sequence
  Synthetic oligonucleotide
tacagcctcacctccttccctctgaggcgctgcct

SEQ ID NO: 156843 - DNA, 35 bp, Artificial Sequence
  Synthetic oligonucleotide
gtagacgtaatccgcctccgccactttaggtatct

SEQ ID NO: 156844 - DNA, 35 bp, Artificial Sequence
  Synthetic oligonucleotide
gacttgaagcgctcccatccgccccgtatgcctct

SEQ ID NO: 156845 - DNA, 35 bp, Artificial Sequence
  Synthetic oligonucleotide
atgacagtggtggggaggagggggtgaggatgtct

SEQ ID NO: 156846 - DNA, 35 bp, Artificial Sequence
  Synthetic oligonucleotide
ttcgccacccatcatccccgtttcatgcgccttct

SEQ ID NO: 156847 - DNA, 30 bp, Artificial Sequence
  Synthetic oligonucleotide
gacccccccgcccactaccagaacctttct

SEQ ID NO: 156848 - DNA, 35 bp, Artificial Sequence
  Synthetic oligonucleotide
tcaccatatcgcctccgtttgtcatcgaacacggt

SEQ ID NO: 156849 - DNA, 35 bp, Artificial Sequence
  Synthetic oligonucleotide
tgacttggcctgttgcgttttgttttgctgccctt

SEQ ID NO: 156850 - DNA, 35 bp, Artificial Sequence
  Synthetic oligonucleotide
gcactctccggtttttgctaacgtctgcctgcttt

SEQ ID NO: 156851 - DNA, 37 bp, Artificial Sequence
  Synthetic oligonucleotide
ggggaacgcaaggggagcgccgtgtgggtggggggaa

SEQ ID NO: 156852 - DNA, 38 bp, Artificial Sequence
  Synthetic oligonucleotide
gagcgagggacgcggtgggggggcacatggctaggtaa

SEQ ID NO: 156853 - DNA, 36 bp, Artificial Sequence
  Synthetic oligonucleotide
tccgcgcatcggactacctgacgtcaatcgccccca

SEQ ID NO: 156854 - DNA, 36 bp, Artificial Sequence
  Synthetic oligonucleotide
tccccgtactcaatgacgccttactccccgcggcca

SEQ ID NO: 156855 - DNA, 36 bp, Artificial Sequence
  Synthetic oligonucleotide
tgcttcccccctcgttgactgccttgtggactgcca

SEQ ID NO: 156856 - DNA, 36 bp, Artificial Sequence
  Synthetic oligonucleotide
atcgtccctcgatcgtcactcctagcctgcattcca

SEQ ID NO: 156857 - DNA, 36 bp, Artificial Sequence
  Synthetic oligonucleotide
tttgtgcatcggtcccacggttctatcccttttgca

SEQ ID NO: 156858 - DNA, 36 bp, Artificial Sequence
  Synthetic oligonucleotide
atccggtctccacatggccctttatccccgctatca

SEQ ID NO: 156859 - DNA, 36 bp, Artificial Sequence
  Synthetic oligonucleotide
gcagaggcctcaacatctgtctcgtaatccctgtca

SEQ ID NO: 156860 - DNA, 36 bp, Artificial Sequence
  Synthetic oligonucleotide
tgcggtgcccccttcacgtggaatacgccctgttca

SEQ ID NO: 156861 - DNA, 37 bp, Artificial Sequence
  Synthetic oligonucleotide
gtaagccaggagacataaaggaggggaggccgaaaga

SEQ ID NO: 156862 - DNA, 37 bp, Artificial Sequence
  Synthetic oligonucleotide
gccggggggaataataatacagggacgagggacaaga

SEQ ID NO: 156863 - DNA, 37 bp, Artificial Sequence
  Synthetic oligonucleotide
tgagaaagggagaagggactggcggattcaggggaga

SEQ ID NO: 156864 - DNA, 36 bp, Artificial Sequence
  Synthetic oligonucleotide
attcacccgctttttgccagacacccgtcccctaga

SEQ ID NO: 156865 - DNA, 37 bp, Artificial Sequence
  Synthetic oligonucleotide
ggatggagggggggttggggtcgaggggcttagccga

SEQ ID NO: 156866 - DNA, 37 bp, Artificial Sequence
  Synthetic oligonucleotide
gaacgctagttctgtcagggccttcatccttctccga

SEQ ID NO: 156867 - DNA, 36 bp, Artificial Sequence
  Synthetic oligonucleotide
gagccacaactatcgtctctctgtctcgctgtgcga

SEQ ID NO: 156868 - DNA, 36 bp, Artificial Sequence
  Synthetic oligonucleotide
ccacccctctgttcgccataccgcccagcctcggga

SEQ ID NO: 156869 - DNA, 37 bp, Artificial Sequence
  Synthetic oligonucleotide
ggaggaaccaaaggggaggggtgggcgtgaacatgga

SEQ ID NO: 156870 - DNA, 37 bp, Artificial Sequence
  Synthetic oligonucleotide
tcagccggaagggggatgtcaaattgggcggggtgga

SEQ ID NO: 156871 - DNA, 38 bp, Artificial Sequence
  Synthetic oligonucleotide
gcgcggcaaggggggtagggcgggagggcgctcaatga

SEQ ID NO: 156872 - DNA, 35 bp, Artificial Sequence
  Synthetic oligonucleotide
accaccctcgcctcacctcaatactcgctcggtga

SEQ ID NO: 156873 - DNA, 36 bp, Artificial Sequence
  Synthetic oligonucleotide
gaccacctcgtcgccctttaacgatcctcttattga

SEQ ID NO: 156874 - DNA, 38 bp, Artificial Sequence
  Synthetic oligonucleotide
ggtcagttcgccacatgtcgccgccgcaccacccttga

SEQ ID NO: 156875 - DNA, 37 bp, Artificial Sequence
  Synthetic oligonucleotide
tcgccgtcacccgtttatcgtttatcctgcactttga

SEQ ID NO: 156876 - DNA, 38 bp, Artificial Sequence
  Synthetic oligonucleotide
tttgggtgggtacgggtgggcatcgatactatctttga

SEQ ID NO: 156877 - DNA, 36 bp, Artificial Sequence
  Synthetic oligonucleotide
tgccggtcaacggctgcctctccgtccccagcaata

SEQ ID NO: 156878 - DNA, 35 bp, Artificial Sequence
  Synthetic oligonucleotide
agacacatctgactcctcccgtcttgtccaccata

SEQ ID NO: 156879 - DNA, 36 bp, Artificial Sequence
  Synthetic oligonucleotide
actagccccccgcatttggcactatggaacttccta

SEQ ID NO: 156880 - DNA, 35 bp, Artificial Sequence
  Synthetic oligonucleotide
gcgcctgggcgggacgggtgggtaaggaaagagta

SEQ ID NO: 156881 - DNA, 36 bp, Artificial Sequence
  Synthetic oligonucleotide
acgttgacgccccaccgttgttatacccagcccgta

SEQ ID NO: 156882 - DNA, 36 bp, Artificial Sequence
  Synthetic oligonucleotide
tgacacacgtcccatatatctcgttactgctcctta

SEQ ID NO: 156883 - DNA, 36 bp, Artificial Sequence
  Synthetic oligonucleotide
tactacgcgccctactcgaccggccaccattgctta

SEQ ID NO: 156884 - DNA, 34 bp, Artificial Sequence
  Synthetic oligonucleotide
ttgttgcaccaccgagtacttttggaccctctta

SEQ ID NO: 156885 - DNA, 35 bp, Artificial Sequence
  Synthetic oligonucleotide
attccacccccgctatcgtaacttgatcggagtta

SEQ ID NO: 156886 - DNA, 35 bp, Artificial Sequence
  Synthetic oligonucleotide
agaccatgtcaatgttggcctctatctccccccac

SEQ ID NO: 156887 - DNA, 35 bp, Artificial Sequence
  Synthetic oligonucleotide
gagtggcgccccggttccctctgttggtacacacc

SEQ ID NO: 156888 - DNA, 36 bp, Artificial Sequence
  Synthetic oligonucleotide
gcaattgccgtccatctgctttcttgcctaaccacc

SEQ ID NO: 156889 - DNA, 35 bp, Artificial Sequence
  Synthetic oligonucleotide
tacgctggcccgtgcgttacagcccacatctcacc

SEQ ID NO: 156890 - DNA, 35 bp, Artificial Sequence
  Synthetic oligonucleotide
atggacggatgcgttgcgcttcgacgtttcacccc

SEQ ID NO: 156891 - DNA, 35 bp, Artificial Sequence
  Synthetic oligonucleotide
tcgccgttgccaatctgccgtttacttccaatccc

SEQ ID NO: 156892 - DNA, 35 bp, Artificial Sequence
  Synthetic oligonucleotide
gaccaccccctgtattgttggttgtcccttatccc

SEQ ID NO: 156893 - DNA, 35 bp, Artificial Sequence
  Synthetic oligonucleotide
aggacgcagtctgtcctgtttggcgtgtccctccc

SEQ ID NO: 156894 - DNA, 35 bp, Artificial Sequence
  Synthetic oligonucleotide
gaccgccctcgccaccctggctcattattcatgcc

SEQ ID NO: 156895 - DNA, 35 bp, Artificial Sequence
  Synthetic oligonucleotide
tgccccgacaccgcttttgttttttcttcgatgcc

SEQ ID NO: 156896 - DNA, 35 bp, Artificial Sequence
  Synthetic oligonucleotide
tcgccttgttcgctttcaatactgctttccgtgcc

SEQ ID NO: 156897 - DNA, 35 bp, Artificial Sequence
  Synthetic oligonucleotide
acgatcggcctcatacactcgcggcgttttgctcc

SEQ ID NO: 156898 - DNA, 35 bp, Artificial Sequence
  Synthetic oligonucleotide
tcccgtttgctcccatgtttttgatccatcttagc

SEQ ID NO: 156899 - DNA, 35 bp, Artificial Sequence
  Synthetic oligonucleotide
gcagatcgcctcatttttgccctttgtctccccgc

SEQ ID NO: 156900 - DNA, 35 bp, Artificial Sequence
  Synthetic oligonucleotide
gtaaagagcgggtagtgatggtggaggagtggcgc

SEQ ID NO: 156901 - DNA, 35 bp, Artificial Sequence
  Synthetic oligonucleotide
tgttgtccactgcccctcctgaacgttacatgcgc

SEQ ID NO: 156902 - DNA, 35 bp, Artificial Sequence
  Synthetic oligonucleotide
attgatcagcacgtttttgcacgctcacccctcgc

SEQ ID NO: 156903 - DNA, 35 bp, Artificial Sequence
  Synthetic oligonucleotide
gtgacacctggctgctccgcccgattataaccggc

SEQ ID NO: 156904 - DNA, 35 bp, Artificial Sequence
  Synthetic oligonucleotide
ttgtcacagccacccgcgtaaacgttctttgctgc

SEQ ID NO: 156905 - DNA, 35 bp, Artificial Sequence
  Synthetic oligonucleotide
ttcatcaagccacatgttaactccctcctgtctgc

SEQ ID NO: 156906 - DNA, 35 bp, Artificial Sequence
  Synthetic oligonucleotide
tccgacttccccccggagttcctatagccgacatc

SEQ ID NO: 156907 - DNA, 35 bp, Artificial Sequence
  Synthetic oligonucleotide
accttccgcgttcgtccatgccagctatcctgctc

SEQ ID NO: 156908 - DNA, 35 bp, Artificial Sequence
  Synthetic oligonucleotide
atgcccctcaccatcctcccgtgactgccaatttc

SEQ ID NO: 156909 - DNA, 35 bp, Artificial Sequence
  Synthetic oligonucleotide
tatgggaaaggaggtggagacgagaggaacgtaag

SEQ ID NO: 156910 - DNA, 34 bp, Artificial Sequence
  Synthetic oligonucleotide
tcagttcgacctgccgttatttacctttttttag

SEQ ID NO: 156911 - DNA, 35 bp, Artificial Sequence
  Synthetic oligonucleotide
ttccgcccatacatatactggtccgccttccgacg

SEQ ID NO: 156912 - DNA, 35 bp, Artificial Sequence
  Synthetic oligonucleotide
gtaatcaccgacccgcccatatggctcctcgcccg

SEQ ID NO: 156913 - DNA, 35 bp, Artificial Sequence
  Synthetic oligonucleotide
aacgcccctgccctcccgatcgtaagcgcctcccg

SEQ ID NO: 156914 - DNA, 34 bp, Artificial Sequence
  Synthetic oligonucleotide
aacagcatccgcccacctgcactacatcaagccg

SEQ ID NO: 156915 - DNA, 35 bp, Artificial Sequence
  Synthetic oligonucleotide
tgtggggaggggatgtggggggtacgggcgagggg

SEQ ID NO: 156916 - DNA, 36 bp, Artificial Sequence
  Synthetic oligonucleotide
tgcagtgcctttcccgtgcttaatctcctcaccctg

SEQ ID NO: 156917 - DNA, 35 bp, Artificial Sequence
  Synthetic oligonucleotide
gtggagatgcgggtggaggcgggtgtagtggcttg

SEQ ID NO: 156918 - DNA, 35 bp, Artificial Sequence
  Synthetic oligonucleotide
ttccccgctctcgacccgcccgctcccgctgccat

SEQ ID NO: 156919 - DNA, 35 bp, Artificial Sequence
  Synthetic oligonucleotide
tgcccgctccagcgtacctggtctggtaccaccct

SEQ ID NO: 156920 - DNA, 35 bp, Artificial Sequence
  Synthetic oligonucleotide
tggaacgggccattcgctgtcctccgataattcct

SEQ ID NO: 156921 - DNA, 35 bp, Artificial Sequence
  Synthetic oligonucleotide
gtgacgagctgcaacacatccccttcgccctgtct

SEQ ID NO: 156922 - DNA, 35 bp, Artificial Sequence
  Synthetic oligonucleotide
tactgcccagcacccctgattccgaattgtctcgt

SEQ ID NO: 156923 - DNA, 35 bp, Artificial Sequence
  Synthetic oligonucleotide
gctcgtccacgccacattttccttgccttattggt

SEQ ID NO: 156924 - DNA, 35 bp, Artificial Sequence
  Synthetic oligonucleotide
tcatcgcacgagccgcattacccccgccgtagttt

SEQ ID NO: 156925 - DNA, 36 bp, Artificial Sequence
  Synthetic oligonucleotide
gccgcctcacatctcctgtcttatgcattgtttcaa

SEQ ID NO: 156926 - DNA, 36 bp, Artificial Sequence
  Synthetic oligonucleotide
gcccactcactattagctatgtccctcgttgacgaa

SEQ ID NO: 156927 - DNA, 36 bp, Artificial Sequence
  Synthetic oligonucleotide
gatcagggcaccaaaggggtaatgggagggcgggaa

SEQ ID NO: 156928 - DNA, 36 bp, Artificial Sequence
  Synthetic oligonucleotide
gccatcacgccctagctgtccttcaggccccaacca

SEQ ID NO: 156929 - DNA, 36 bp, Artificial Sequence
  Synthetic oligonucleotide
acacttcccgcgcagttgcgaaaacctacctcccca

SEQ ID NO: 156930 - DNA, 36 bp, Artificial Sequence
  Synthetic oligonucleotide
ttcagcccatacgccgcaatggttccctacttccca

SEQ ID NO: 156931 - DNA, 36 bp, Artificial Sequence
  Synthetic oligonucleotide
tccgcgacccatgctataccacctttgcgtactcca

SEQ ID NO: 156932 - DNA, 35 bp, Artificial Sequence
  Synthetic oligonucleotide
tcccccgcctaccacgctgtatcatgcctggtcca

SEQ ID NO: 156933 - DNA, 36 bp, Artificial Sequence
  Synthetic oligonucleotide
ttgccaccatcacgacccgactcgcatcccgacgca

SEQ ID NO: 156934 - DNA, 36 bp, Artificial Sequence
  Synthetic oligonucleotide
gtaggaaaacaatggggggaagggtgactgcgcgca

SEQ ID NO: 156935 - DNA, 35 bp, Artificial Sequence
  Synthetic oligonucleotide
actgatgggggctaaaggagggcgtaaggggggca

SEQ ID NO: 156936 - DNA, 35 bp, Artificial Sequence
  Synthetic oligonucleotide
tccacacgacaaacgcgtcttgctaacccttctca

SEQ ID NO: 156937 - DNA, 37 bp, Artificial Sequence
  Synthetic oligonucleotide
tttgggggggtcgggaataggtggtagggggtggaga

SEQ ID NO: 156938 - DNA, 36 bp, Artificial Sequence
  Synthetic oligonucleotide
gccctcgccagtttgctttccctctgcttgtaccga

SEQ ID NO: 156939 - DNA, 36 bp, Artificial Sequence
  Synthetic oligonucleotide
aagagcaacctcctgatcccttacctccgctatcga

SEQ ID NO: 156940 - DNA, 37 bp, Artificial Sequence
  Synthetic oligonucleotide
tgcatagccccatctcgccttcgaactttaggttcga

SEQ ID NO: 156941 - DNA, 36 bp, Artificial Sequence
  Synthetic oligonucleotide
actatgcctccatccaatcggacatcccccaccgga

SEQ ID NO: 156942 - DNA, 36 bp, Artificial Sequence
  Synthetic oligonucleotide
aaaatgggccggggtgaaacacgaacggggaaggga

SEQ ID NO: 156943 - DNA, 35 bp, Artificial Sequence
  Synthetic oligonucleotide
agagctgggcggggcgggttgcggtggtggcggga

SEQ ID NO: 156944 - DNA, 36 bp, Artificial Sequence
  Synthetic oligonucleotide
gaagatagaaagggatagagaggggacgaccgggga

SEQ ID NO: 156945 - DNA, 37 bp, Artificial Sequence
  Synthetic oligonucleotide
agctgcaggcggatgggggggatggtatagggctgga

SEQ ID NO: 156946 - DNA, 38 bp, Artificial Sequence
  Synthetic oligonucleotide
ggatggtggatggcggtggaggggggctcgcgacatga

SEQ ID NO: 156947 - DNA, 37 bp, Artificial Sequence
  Synthetic oligonucleotide
ttcgccccatcattccctgccgcgtatcctaacctga

SEQ ID NO: 156948 - DNA, 38 bp, Artificial Sequence
  Synthetic oligonucleotide
tcccactcaagatcctatatcgaaccccgtgcccctga

SEQ ID NO: 156949 - DNA, 38 bp, Artificial Sequence
  Synthetic oligonucleotide
gtacggagggcgggtgacgagggcgggttgcaatctga

SEQ ID NO: 156950 - DNA, 37 bp, Artificial Sequence
  Synthetic oligonucleotide
aaggggggatgacagtataggggcatgggacgggtga

SEQ ID NO: 156951 - DNA, 38 bp, Artificial Sequence
  Synthetic oligonucleotide
tgccatgagacaggggagtccgggaagcaggggggtga

SEQ ID NO: 156952 - DNA, 38 bp, Artificial Sequence
  Synthetic oligonucleotide
ttacgacggggggtgagggggtggaatatcggtggtga

SEQ ID NO: 156953 - DNA, 38 bp, Artificial Sequence
  Synthetic oligonucleotide
gccatcccttgacgttcgcccaccgagtccacccttga

SEQ ID NO: 156954 - DNA, 38 bp, Artificial Sequence
  Synthetic oligonucleotide
gccatcaccgatccgttcctcgtaccgtacacgcttga

SEQ ID NO: 156955 - DNA, 35 bp, Artificial Sequence
  Synthetic oligonucleotide
tgggtaggggcaagaggggaggtggtttggcagta

SEQ ID NO: 156956 - DNA, 35 bp, Artificial Sequence
  Synthetic oligonucleotide
accgactacgttcgcctgccctcaacagccccgta

SEQ ID NO: 156957 - DNA, 35 bp, Artificial Sequence
  Synthetic oligonucleotide
taccccgcagccgcaatgtcgccacccgccaatta

SEQ ID NO: 156958 - DNA, 36 bp, Artificial Sequence
  Synthetic oligonucleotide
tcgatcccaacgtgggtcatgtcttctcgcctttta

SEQ ID NO: 156959 - DNA, 35 bp, Artificial Sequence
  Synthetic oligonucleotide
gtctcgtatcgccccgccccttagcttagttgcac

SEQ ID NO: 156960 - DNA, 35 bp, Artificial Sequence
  Synthetic oligonucleotide
gacttgctctgctccacttcttcgacgtttactac

SEQ ID NO: 156961 - DNA, 35 bp, Artificial Sequence
  Synthetic oligonucleotide
tgtcccctgcctcttacattaatcatgcccagtac

SEQ ID NO: 156962 - DNA, 35 bp, Artificial Sequence
  Synthetic oligonucleotide
atgtgccttgcccgatccgcggtgcggtacccccc

SEQ ID NO: 156963 - DNA, 35 bp, Artificial Sequence
  Synthetic oligonucleotide
aggatcccgcagtccgttagtcctacacctccccc

SEQ ID NO: 156964 - DNA, 35 bp, Artificial Sequence
  Synthetic oligonucleotide
gccacttcccggcacatatccacggttcagtcccc

SEQ ID NO: 156965 - DNA, 35 bp, Artificial Sequence
  Synthetic oligonucleotide
tccgtttccgtttgcccgcatagccgactgtcccc

SEQ ID NO: 156966 - DNA, 35 bp, Artificial Sequence
  Synthetic oligonucleotide
gcaagcattcacgacccctgccctatccaaagccc

SEQ ID NO: 156967 - DNA, 35 bp, Artificial Sequence
  Synthetic oligonucleotide
gccgcccccacgcacacggtgaatgagcttcgccc

SEQ ID NO: 156968 - DNA, 35 bp, Artificial Sequence
  Synthetic oligonucleotide
tccgacccagggtctcacctcgccaccctctagcc

SEQ ID NO: 156969 - DNA, 35 bp, Artificial Sequence
  Synthetic oligonucleotide
tactgccgatcacctcgctttgtagctcctacgcc

SEQ ID NO: 156970 - DNA, 35 bp, Artificial Sequence
  Synthetic oligonucleotide
gcctcacagaacatgggtcatccccgtccactgcc

SEQ ID NO: 156971 - DNA, 35 bp, Artificial Sequence
  Synthetic oligonucleotide
gttcaccatccgtctcgtccacgccatctttatcc

SEQ ID NO: 156972 - DNA, 35 bp, Artificial Sequence
  Synthetic oligonucleotide
tgagaagttcgatcaatgtgccccccccaccgtcc

SEQ ID NO: 156973 - DNA, 35 bp, Artificial Sequence
  Synthetic oligonucleotide
tccggtcctcacagcttgcacacgattgcccccgc

SEQ ID NO: 156974 - DNA, 35 bp, Artificial Sequence
  Synthetic oligonucleotide
tctacccgctggaatggtacagttctcttcgccgc

SEQ ID NO: 156975 - DNA, 35 bp, Artificial Sequence
  Synthetic oligonucleotide
ttgctccgacgcttcggcctgcacccatcccgtgc

SEQ ID NO: 156976 - DNA, 35 bp, Artificial Sequence
  Synthetic oligonucleotide
acacacctccccttgactgagatcctacgccttgc

SEQ ID NO: 156977 - DNA, 35 bp, Artificial Sequence
  Synthetic oligonucleotide
acccgaagccgtgcaagcttttcctctcccccctc

SEQ ID NO: 156978 - DNA, 31 bp, Artificial Sequence
  Synthetic oligonucleotide
ttcgctccccgattcgcaattcacgggcctc

SEQ ID NO: 156979 - DNA, 35 bp, Artificial Sequence
  Synthetic oligonucleotide
gttgcaaccgcaattctcttatgccgtcccacttc

SEQ ID NO: 156980 - DNA, 35 bp, Artificial Sequence
  Synthetic oligonucleotide
gtagccctcgctgtcgtgtccttccgccgccctag

SEQ ID NO: 156981 - DNA, 35 bp, Artificial Sequence
  Synthetic oligonucleotide
ttggtccaccgcgcaatcaacatccctctcacacg

SEQ ID NO: 156982 - DNA, 35 bp, Artificial Sequence
  Synthetic oligonucleotide
gtccgtaccccgtatgcgtacttccaatcctttcg

SEQ ID NO: 156983 - DNA, 35 bp, Artificial Sequence
  Synthetic oligonucleotide
ggtaggagcagagaaggggtcggcaggtgacgggg

SEQ ID NO: 156984 - DNA, 35 bp, Artificial Sequence
  Synthetic oligonucleotide
gtcacacactagccatttatcccatcccgcacgat

SEQ ID NO: 156985 - DNA, 35 bp, Artificial Sequence
  Synthetic oligonucleotide
acacatctgcctccactgggcctacgaccgccact

SEQ ID NO: 156986 - DNA, 35 bp, Artificial Sequence
  Synthetic oligonucleotide
atgacgcctactgccctgtcctctcgatagatact

SEQ ID NO: 156987 - DNA, 35 bp, Artificial Sequence
  Synthetic oligonucleotide
tcgattgcccgcccaagcttctcgtgcctctacct

SEQ ID NO: 156988 - DNA, 35 bp, Artificial Sequence
  Synthetic oligonucleotide
ccgccccgaccgcgctacgtattgccccctgccct

SEQ ID NO: 156989 - DNA, 35 bp, Artificial Sequence
  Synthetic oligonucleotide
tcatccctggttccacccccccgcatccacgcgct

SEQ ID NO: 156990 - DNA, 35 bp, Artificial Sequence
  Synthetic oligonucleotide
actcgcccatgtgccccctcctaacgtcaattgct

SEQ ID NO: 156991 - DNA, 35 bp, Artificial Sequence
  Synthetic oligonucleotide
ttcggaccataacatcgttttatagcctcttctct

SEQ ID NO: 156992 - DNA, 35 bp, Artificial Sequence
  Synthetic oligonucleotide
attgcggtgggggcggggcatggatggtagggttt

SEQ ID NO: 156993 - DNA, 35 bp, Artificial Sequence
  Synthetic oligonucleotide
tcccgttcctcgtgctttccgtccttgtttctcaa

SEQ ID NO: 156994 - DNA, 35 bp, Artificial Sequence
  Synthetic oligonucleotide
gagtaggtagcataaccgtcgccgccccccgctaa

SEQ ID NO: 156995 - DNA, 36 bp, Artificial Sequence
  Synthetic oligonucleotide
tccctacctgcccgcttcttgcccttgtgcctcaca

SEQ ID NO: 156996 - DNA, 35 bp, Artificial Sequence
  Synthetic oligonucleotide
tatgcaggtcgcttggccccgcgcgctccacacca

SEQ ID NO: 156997 - DNA, 35 bp, Artificial Sequence
  Synthetic oligonucleotide
gtgcattctccccgctgcgagctctggcctcatca

SEQ ID NO: 156998 - DNA, 36 bp, Artificial Sequence
  Synthetic oligonucleotide
accccgctcccaatgccattgacccacctgctccga

SEQ ID NO: 156999 - DNA, 37 bp, Artificial Sequence
  Synthetic oligonucleotide
tctcccgtccatcattcccatactctccgattcgcga

SEQ ID NO: 157000 - DNA, 37 bp, Artificial Sequence
  Synthetic oligonucleotide
ttccccaccgggcctgatcgaccaacactctcccgga

SEQ ID NO: 157001 - DNA, 37 bp, Artificial Sequence
  Synthetic oligonucleotide
tgtgccccccgcccgctccctgttaaccttggtcgga

SEQ ID NO: 157002 - DNA, 37 bp, Artificial Sequence
  Synthetic oligonucleotide
actgtagttgaggaggaaggtagcaggttgggaggga

SEQ ID NO: 157003 - DNA, 37 bp, Artificial Sequence
  Synthetic oligonucleotide
ggggtggagatagggaggagataaacatggtggggga

SEQ ID NO: 157004 - DNA, 37 bp, Artificial Sequence
  Synthetic oligonucleotide
tcagccgtttacatctgcccgttttccgttctctgga

SEQ ID NO: 157005 - DNA, 37 bp, Artificial Sequence
  Synthetic oligonucleotide
accccgcctcctgagtaccatctagtaatgccttgga

SEQ ID NO: 157006 - DNA, 38 bp, Artificial Sequence
  Synthetic oligonucleotide
tcacctccacacgcaatgccccgcccaggctgacctga

SEQ ID NO: 157007 - DNA, 38 bp, Artificial Sequence
  Synthetic oligonucleotide
tgaggggggggggaggcggttacgtgacgggtggctga

SEQ ID NO: 157008 - DNA, 38 bp, Artificial Sequence
  Synthetic oligonucleotide
gggtgagggcgggggtaggggcgtaacgggggatctga

SEQ ID NO: 157009 - DNA, 38 bp, Artificial Sequence
  Synthetic oligonucleotide
atccgcccccgtctcctctgtttgcccgcaaagcgtga

SEQ ID NO: 157010 - DNA, 38 bp, Artificial Sequence
  Synthetic oligonucleotide
gtgggggtggagaggaaggggcgactctgggagggtga

SEQ ID NO: 157011 - DNA, 38 bp, Artificial Sequence
  Synthetic oligonucleotide
gtggaatgcggacgaaggggagggagcgcgagacttga

SEQ ID NO: 157012 - DNA, 38 bp, Artificial Sequence
  Synthetic oligonucleotide
gcctcccccgccataggccccaacgtgccacccgttga

SEQ ID NO: 157013 - DNA, 37 bp, Artificial Sequence
  Synthetic oligonucleotide
accttggtcgcacgccctcgcccactcacttctttga

SEQ ID NO: 157014 - DNA, 36 bp, Artificial Sequence
  Synthetic oligonucleotide
tgcgacctaacagcctgtgccctctctatttcaata

SEQ ID NO: 157015 - DNA, 36 bp, Artificial Sequence
  Synthetic oligonucleotide
gccccccccggttatcacgcctatacagtggaccta

SEQ ID NO: 157016 - DNA, 35 bp, Artificial Sequence
  Synthetic oligonucleotide
tctcaagctacaatcctataacgccgccctcgcta

SEQ ID NO: 157017 - DNA, 36 bp, Artificial Sequence
  Synthetic oligonucleotide
taggtctccccccatgttgctattcggtccctttta

SEQ ID NO: 157018 - DNA, 35 bp, Artificial Sequence
  Synthetic oligonucleotide
tccgacgcacctttccccgacgttttgggtcccac

SEQ ID NO: 157019 - DNA, 35 bp, Artificial Sequence
  Synthetic oligonucleotide
gccgacacctctttcacgctgttctacctgatcac

SEQ ID NO: 157020 - DNA, 34 bp, Artificial Sequence
  Synthetic oligonucleotide
accccactcctacccgggccgagattcggtaacc

SEQ ID NO: 157021 - DNA, 35 bp, Artificial Sequence
  Synthetic oligonucleotide
agtacgccacgcaatgggtccatagccctcccacc

SEQ ID NO: 157022 - DNA, 35 bp, Artificial Sequence
  Synthetic oligonucleotide
tactgccccacgttctgccgtgcattttaccgccc

SEQ ID NO: 157023 - DNA, 35 bp, Artificial Sequence
  Synthetic oligonucleotide
tacacaggtcctatcaatcccgaagccgccttgcc

SEQ ID NO: 157024 - DNA, 35 bp, Artificial Sequence
  Synthetic oligonucleotide
gaccttgcgcactcactgccgccatcgaaccttcc

SEQ ID NO: 157025 - DNA, 35 bp, Artificial Sequence
  Synthetic oligonucleotide
tccttgcagacgcgggccagcactacaccatttcc

SEQ ID NO: 157026 - DNA, 35 bp, Artificial Sequence
  Synthetic oligonucleotide
tcacaccatgctgcgtgtcctgccctacctccagc

SEQ ID NO: 157027 - DNA, 35 bp, Artificial Sequence
  Synthetic oligonucleotide
tcccgcccctggtggtactggtcccaattactagc

SEQ ID NO: 157028 - DNA, 35 bp, Artificial Sequence
  Synthetic oligonucleotide
tactgccttcacactttgctcacctttcttgtggc

SEQ ID NO: 157029 - DNA, 35 bp, Artificial Sequence
  Synthetic oligonucleotide
tttacgcgtcggcttatagtcgcatactccccatc

SEQ ID NO: 157030 - DNA, 35 bp, Artificial Sequence
  Synthetic oligonucleotide
gcatcgtccatcgacgcggttcgttcccctccatc

SEQ ID NO: 157031 - DNA, 35 bp, Artificial Sequence
  Synthetic oligonucleotide
tacgcttgatggtcatttgcatccaccccgctatc

SEQ ID NO: 157032 - DNA, 35 bp, Artificial Sequence
  Synthetic oligonucleotide
tccaacgtgccaactcgcgtgtcttattcctactc

SEQ ID NO: 157033 - DNA, 35 bp, Artificial Sequence
  Synthetic oligonucleotide
gatcagtagctactaaacgggtcactccactcctc

SEQ ID NO: 157034 - DNA, 35 bp, Artificial Sequence
  Synthetic oligonucleotide
tctcgtcggtcggatccgtctatcctgtccacgtc

SEQ ID NO: 157035 - DNA, 35 bp, Artificial Sequence
  Synthetic oligonucleotide
acacactcccaccagaggatcctgcttttcatgtc

SEQ ID NO: 157036 - DNA, 35 bp, Artificial Sequence
  Synthetic oligonucleotide
tgggtccagccccaaacctgatcttccaccttgtc

SEQ ID NO: 157037 - DNA, 35 bp, Artificial Sequence
  Synthetic oligonucleotide
gcagaccctgtctacagcagtaccacgccctcttc

SEQ ID NO: 157038 - DNA, 35 bp, Artificial Sequence
  Synthetic oligonucleotide
agtaagggaggatgggtggtttgataacgggggag

SEQ ID NO: 157039 - DNA, 35 bp, Artificial Sequence
  Synthetic oligonucleotide
tatccctgccacctttcttcgacacctgtccatag

SEQ ID NO: 157040 - DNA, 35 bp, Artificial Sequence
  Synthetic oligonucleotide
taggagccctgcccgttttgctctgcctcttaccg

SEQ ID NO: 157041 - DNA, 35 bp, Artificial Sequence
  Synthetic oligonucleotide
taaccacctgctctcatgctgacccccgccccccg

SEQ ID NO: 157042 - DNA, 35 bp, Artificial Sequence
  Synthetic oligonucleotide
gtaggggaaggtggtaaaaaagtggagaggggatg

SEQ ID NO: 157043 - DNA, 35 bp, Artificial Sequence
  Synthetic oligonucleotide
gccactcgcccacccctgtcgctttgtaacgtatg

SEQ ID NO: 157044 - DNA, 35 bp, Artificial Sequence
  Synthetic oligonucleotide
tgagtgacctgggcatcatctccatccatttcctg

SEQ ID NO: 157045 - DNA, 35 bp, Artificial Sequence
  Synthetic oligonucleotide
tgatctctgccagtgatatttgtcctttcctcgtg

SEQ ID NO: 157046 - DNA, 34 bp, Artificial Sequence
  Synthetic oligonucleotide
tcacgcatccctccgctggccaagccctttacat

SEQ ID NO: 157047 - DNA, 35 bp, Artificial Sequence
  Synthetic oligonucleotide
gtcaggccacgtgaacgccccttgtccgcatccat

SEQ ID NO: 157048 - DNA, 35 bp, Artificial Sequence
  Synthetic oligonucleotide
tgggccgcatatgcccgtctacctcgcacaccact

SEQ ID NO: 157049 - DNA, 35 bp, Artificial Sequence
  Synthetic oligonucleotide
gcccctatccctcggccccctgtgtcccggtcgct

SEQ ID NO: 157050 - DNA, 35 bp, Artificial Sequence
  Synthetic oligonucleotide
tctgggagtcccccgcagcccgttaacacgcctct

SEQ ID NO: 157051 - DNA, 35 bp, Artificial Sequence
  Synthetic oligonucleotide
tcagatcccggggccatgctattcgtaccgcctct

SEQ ID NO: 157052 - DNA, 35 bp, Artificial Sequence
  Synthetic oligonucleotide
ggtgggagggtaatagggaacgaggggtgacaatt

SEQ ID NO: 157053 - DNA, 35 bp, Artificial Sequence
  Synthetic oligonucleotide
ttccgccccatcttgtcccgccgtaaattatcctt

SEQ ID NO: 157054 - DNA, 35 bp, Artificial Sequence
  Synthetic oligonucleotide
ttataagccgcccgctgttctaccttctacccgtt

SEQ ID NO: 157055 - DNA, 34 bp, Artificial Sequence
  Synthetic oligonucleotide
gtatccacctcgccactctccctacgccgccgtt

SEQ ID NO: 157056 - DNA, 36 bp, Artificial Sequence
  Synthetic oligonucleotide
tcacccggtcggtcgcccgttcccttcttgtcacaa

SEQ ID NO: 157057 - DNA, 36 bp, Artificial Sequence
  Synthetic oligonucleotide
atggcctcgactcctggcttgaactccccacaccaa

SEQ ID NO: 157058 - DNA, 35 bp, Artificial Sequence
  Synthetic oligonucleotide
tcaaagggacatgagggcgtttcgggagggtggaa

SEQ ID NO: 157059 - DNA, 35 bp, Artificial Sequence
  Synthetic oligonucleotide
ataccgcccaccattgaattccgagttgactcaca

SEQ ID NO: 157060 - DNA, 35 bp, Artificial Sequence
  Synthetic oligonucleotide
acgtggtgagtgcggacacggacggggggaagaca

SEQ ID NO: 157061 - DNA, 35 bp, Artificial Sequence
  Synthetic oligonucleotide
ggatcacttgcccgacgttttccattgcttaacca

SEQ ID NO: 157062 - DNA, 36 bp, Artificial Sequence
  Synthetic oligonucleotide
ttcccatctgttgagtggttattgccgcccccacca

SEQ ID NO: 157063 - DNA, 35 bp, Artificial Sequence
  Synthetic oligonucleotide
aacactaccgccggtcctagggacacacactccca

SEQ ID NO: 157064 - DNA, 36 bp, Artificial Sequence
  Synthetic oligonucleotide
acctaggagagagagggggcgggagagcatgatgca

SEQ ID NO: 157065 - DNA, 36 bp, Artificial Sequence
  Synthetic oligonucleotide
ggggcccgtcgacgcgtaccgcattctcctcctgca

SEQ ID NO: 157066 - DNA, 35 bp, Artificial Sequence
  Synthetic oligonucleotide
tgtcccctctcgcccactggaaccagcccattgca

SEQ ID NO: 157067 - DNA, 35 bp, Artificial Sequence
  Synthetic oligonucleotide
tccccgttcgtgtacgttctccctcgttgtgctca

SEQ ID NO: 157068 - DNA, 37 bp, Artificial Sequence
  Synthetic oligonucleotide
gtgaatcacggaagtggaaaggggaggatggatgaga

SEQ ID NO: 157069 - DNA, 37 bp, Artificial Sequence
  Synthetic oligonucleotide
aagctagggaaggagggccgggatagggaacgtgaga

SEQ ID NO: 157070 - DNA, 37 bp, Artificial Sequence
  Synthetic oligonucleotide
gagatggttatggagggtaagggagggtgggactaga

SEQ ID NO: 157071 - DNA, 37 bp, Artificial Sequence
  Synthetic oligonucleotide
gagagggaacgagttgaggaggaagtaggcgcgacga

SEQ ID NO: 157072 - DNA, 36 bp, Artificial Sequence
  Synthetic oligonucleotide
ggagggacggtgggggggaaaccggacgggcaccga

SEQ ID NO: 157073 - DNA, 37 bp, Artificial Sequence
  Synthetic oligonucleotide
gccgccggcgcagagtatgtccccgtgcccctaccga

SEQ ID NO: 157074 - DNA, 37 bp, Artificial Sequence
  Synthetic oligonucleotide
agtctgtccaccattcttgtactatccgctgttgcga

SEQ ID NO: 157075 - DNA, 35 bp, Artificial Sequence
  Synthetic oligonucleotide
agaccatcccccgctctcgctgcactagctatcga

SEQ ID NO: 157076 - DNA, 34 bp, Artificial Sequence
  Synthetic oligonucleotide
tccacgcttatctattttgcgcccttccttagga

SEQ ID NO: 157077 - DNA, 37 bp, Artificial Sequence
  Synthetic oligonucleotide
tacagcgggggtggggagggaagcacgggcccacgga

SEQ ID NO: 157078 - DNA, 37 bp, Artificial Sequence
  Synthetic oligonucleotide
gtacagggacggaggtgtgggcggcggtggctacgga

SEQ ID NO: 157079 - DNA, 37 bp, Artificial Sequence
  Synthetic oligonucleotide
gtcatggacgggagggtactagcgtgggggtgcggga

SEQ ID NO: 157080 - DNA, 37 bp, Artificial Sequence
  Synthetic oligonucleotide
caccggacggagggggaaaaaggcgtacgggcgggga

SEQ ID NO: 157081 - DNA, 37 bp, Artificial Sequence
  Synthetic oligonucleotide
actatcccagcgcctcgcctctttgccccaacatgga

SEQ ID NO: 157082 - DNA, 37 bp, Artificial Sequence
  Synthetic oligonucleotide
gccctcctctgacctatcctatgtgtccccgcatgga

SEQ ID NO: 157083 - DNA, 37 bp, Artificial Sequence
  Synthetic oligonucleotide
tgacactgcagaccgccacgccgccgccctttcatga

SEQ ID NO: 157084 - DNA, 38 bp, Artificial Sequence
  Synthetic oligonucleotide
tgagggcggagggatgggggtggatttggacggtatga

SEQ ID NO: 157085 - DNA, 38 bp, Artificial Sequence
  Synthetic oligonucleotide
atcactacgcctcaccgttttcgccaacaggtccctga

SEQ ID NO: 157086 - DNA, 37 bp, Artificial Sequence
  Synthetic oligonucleotide
agtgaccccggtatgtaagcaccccactcttccctga

SEQ ID NO: 157087 - DNA, 36 bp, Artificial Sequence
  Synthetic oligonucleotide
tcccaccccacttttccttcctgtgtccgtttttga

SEQ ID NO: 157088 - DNA, 35 bp, Artificial Sequence
  Synthetic oligonucleotide
tcccgccgcctatcccgtgatcatgtccgcgacta

SEQ ID NO: 157089 - DNA, 35 bp, Artificial Sequence
  Synthetic oligonucleotide
ggaccaacggggggtgggcacttgagggggagcta

SEQ ID NO: 157090 - DNA, 36 bp, Artificial Sequence
  Synthetic oligonucleotide
tctgcccccttggatctattgtccgcaccatttcta

SEQ ID NO: 157091 - DNA, 35 bp, Artificial Sequence
  Synthetic oligonucleotide
gtgctgccaaatcggagcgtcactgctcttaccac

SEQ ID NO: 157092 - DNA, 35 bp, Artificial Sequence
  Synthetic oligonucleotide
tgttagctagcaacgtacgttctcccccgtcccac

SEQ ID NO: 157093 - DNA, 35 bp, Artificial Sequence
  Synthetic oligonucleotide
actcatctcccggttcgactggccctctcttcgac

SEQ ID NO: 157094 - DNA, 35 bp, Artificial Sequence
  Synthetic oligonucleotide
gtggaccatcagctaccccgtcccctcgactatac

SEQ ID NO: 157095 - DNA, 35 bp, Artificial Sequence
  Synthetic oligonucleotide
tccgatccacatcggatttccttcccccgtattac

SEQ ID NO: 157096 - DNA, 35 bp, Artificial Sequence
  Synthetic oligonucleotide
tgagccgtgcgaagaccctattcaccgcttctacc

SEQ ID NO: 157097 - DNA, 34 bp, Artificial Sequence
  Synthetic oligonucleotide
ttaggtacacgcccgtgtaactctttcgcccccc

SEQ ID NO: 157098 - DNA, 35 bp, Artificial Sequence
  Synthetic oligonucleotide
gttggcccacacgcttccacgagtatctctgcccc

SEQ ID NO: 157099 - DNA, 34 bp, Artificial Sequence
  Synthetic oligonucleotide
tactcaacatgcctgcttcacactccgccggccc

SEQ ID NO: 157100 - DNA, 35 bp, Artificial Sequence
  Synthetic oligonucleotide
gacttcagctacgtagcccacggtcgccacatccc

SEQ ID NO: 157101 - DNA, 35 bp, Artificial Sequence
  Synthetic oligonucleotide
ttcactcggcgccctggcgtaatgcccaccctccc

SEQ ID NO: 157102 - DNA, 35 bp, Artificial Sequence
  Synthetic oligonucleotide
gacccattcgcctctgtctcgtgcctctctgtccc

SEQ ID NO: 157103 - DNA, 35 bp, Artificial Sequence
  Synthetic oligonucleotide
ttagcccgccctctctcctgcctgtcccgaaggcc

SEQ ID NO: 157104 - DNA, 35 bp, Artificial Sequence
  Synthetic oligonucleotide
agccgggttcagcccatgctctcgccctttgtgcc

SEQ ID NO: 157105 - DNA, 35 bp, Artificial Sequence
  Synthetic oligonucleotide
tcattcccgcctctccgtgccgcctctgccaatgc

SEQ ID NO: 157106 - DNA, 35 bp, Artificial Sequence
  Synthetic oligonucleotide
tccctcaccgcgcctccaatctcgtggactctgtc

SEQ ID NO: 157107 - DNA, 35 bp, Artificial Sequence
  Synthetic oligonucleotide
cccaccgtggtcccccgctttacaagacccttgtc

SEQ ID NO: 157108 - DNA, 35 bp, Artificial Sequence
  Synthetic oligonucleotide
gatgccgcctccttcgcgtacaaatccggttcttc

SEQ ID NO: 157109 - DNA, 35 bp, Artificial Sequence
  Synthetic oligonucleotide
gtaggtaggggcagggaggggcggttttgcatcag

SEQ ID NO: 157110 - DNA, 35 bp, Artificial Sequence
  Synthetic oligonucleotide
gatcatgtcagtacgcgttccccctctctaccccg

SEQ ID NO: 157111 - DNA, 35 bp, Artificial Sequence
  Synthetic oligonucleotide
agactccctgtcaagccaacccgtccctgtccccg

SEQ ID NO: 157112 - DNA, 35 bp, Artificial Sequence
  Synthetic oligonucleotide
ttcaggacagtaggaaaagcggaaggagaggggcg

SEQ ID NO: 157113 - DNA, 35 bp, Artificial Sequence
  Synthetic oligonucleotide
gccgccagcttacgcttcacagttccgccccctcg

SEQ ID NO: 157114 - DNA, 35 bp, Artificial Sequence
  Synthetic oligonucleotide
tagtcccgccccctaatccaccacgtctgaacggg

SEQ ID NO: 157115 - DNA, 35 bp, Artificial Sequence
  Synthetic oligonucleotide
gtgtaggagagagggagagactgggggttaggggg

SEQ ID NO: 157116 - DNA, 35 bp, Artificial Sequence
  Synthetic oligonucleotide
gatgtgcatccatcccgtcccgcctactactactg

SEQ ID NO: 157117 - DNA, 35 bp, Artificial Sequence
  Synthetic oligonucleotide
atactccccgctgattccttagctatgttgacctg

SEQ ID NO: 157118 - DNA, 35 bp, Artificial Sequence
  Synthetic oligonucleotide
actagcatccagcctctttttacctacccgctctg

SEQ ID NO: 157119 - DNA, 35 bp, Artificial Sequence
  Synthetic oligonucleotide
actcacgtcgccgtcttccgtctctaggattccat

SEQ ID NO: 157120 - DNA, 35 bp, Artificial Sequence
  Synthetic oligonucleotide
tatcccgcccgacggcacttgtgcgatcatctcat

SEQ ID NO: 157121 - DNA, 35 bp, Artificial Sequence
  Synthetic oligonucleotide
agactaggagccctcacaccgtttatcgctctcat

SEQ ID NO: 157122 - DNA, 35 bp, Artificial Sequence
  Synthetic oligonucleotide
tgacaagatgttcagtcgctcccgttcccccatat

SEQ ID NO: 157123 - DNA, 35 bp, Artificial Sequence
  Synthetic oligonucleotide
ggtgcaacgtgctcatttcggtcgccccctttact

SEQ ID NO: 157124 - DNA, 35 bp, Artificial Sequence
  Synthetic oligonucleotide
agacgacgcattgtactcgaccgcctgtttcacct

SEQ ID NO: 157125 - DNA, 35 bp, Artificial Sequence
  Synthetic oligonucleotide
gccccccacgcttcaaagcgggattcttcgcccct

SEQ ID NO: 157126 - DNA, 35 bp, Artificial Sequence
  Synthetic oligonucleotide
gaaccaggtacgccacccgtcctccaatacccgct

SEQ ID NO: 157127 - DNA, 35 bp, Artificial Sequence
  Synthetic oligonucleotide
actcaatccatgctgtcagttcaatgtctctcgct

SEQ ID NO: 157128 - DNA, 35 bp, Artificial Sequence
  Synthetic oligonucleotide
gtcaccgccctaggcctacactcatattttcttgt

SEQ ID NO: 157129 - DNA, 35 bp, Artificial Sequence
  Synthetic oligonucleotide
agtacccgtcctgactcaccccgccgcctaccatt

SEQ ID NO: 157130 - DNA, 35 bp, Artificial Sequence
  Synthetic oligonucleotide
gtccctcatgtacaacttctacagcccccctgctt

SEQ ID NO: 157131 - DNA, 35 bp, Artificial Sequence
  Synthetic oligonucleotide
tgttcgaccggctttgatacccccgccgttttctt

SEQ ID NO: 157132 - DNA, 35 bp, Artificial Sequence
  Synthetic oligonucleotide
tgccggccggacgggccccccctatctccctcgtt

SEQ ID NO: 157133 - DNA, 35 bp, Artificial Sequence
  Synthetic oligonucleotide
tcacgttcaaccgcttagccgagtccctgccgttt

SEQ ID NO: 157134 - DNA, 36 bp, Artificial Sequence
  Synthetic oligonucleotide
tagggaaacggaaggcggggtattagcggggtggaa

SEQ ID NO: 157135 - DNA, 36 bp, Artificial Sequence
  Synthetic oligonucleotide
gaagccagcccacgctactgctcgctcccagcttaa

SEQ ID NO: 157136 - DNA, 36 bp, Artificial Sequence
  Synthetic oligonucleotide
actccgcctcttgcgtcccttgtttcccacacgcca

SEQ ID NO: 157137 - DNA, 36 bp, Artificial Sequence
  Synthetic oligonucleotide
gccacctccggtgaaacgataccaccctcgcctcca

SEQ ID NO: 157138 - DNA, 35 bp, Artificial Sequence
  Synthetic oligonucleotide
aggacccaccccccccggcgtcattagtgcctcca

SEQ ID NO: 157139 - DNA, 36 bp, Artificial Sequence
  Synthetic oligonucleotide
atcccgcaccctcattaactccttagtgttcacgca

SEQ ID NO: 157140 - DNA, 36 bp, Artificial Sequence
  Synthetic oligonucleotide
gtagactccagcgtgttctttgttgcccccgtttca

SEQ ID NO: 157141 - DNA, 37 bp, Artificial Sequence
  Synthetic oligonucleotide
gcgagaccgtacggggaggcgtgatagggaggggaga

SEQ ID NO: 157142 - DNA, 37 bp, Artificial Sequence
  Synthetic oligonucleotide
tgcacggggacggggaagaaaatagcggaggtataga

SEQ ID NO: 157143 - DNA, 37 bp, Artificial Sequence
  Synthetic oligonucleotide
accccctacgccctgccccaacgaacactttcgtaga

SEQ ID NO: 157144 - DNA, 37 bp, Artificial Sequence
  Synthetic oligonucleotide
agcccggcctcccaatgaatattgtactctttcccga

SEQ ID NO: 157145 - DNA, 35 bp, Artificial Sequence
  Synthetic oligonucleotide
gctcgccacgtttcttcgagtcccatcatttccga

SEQ ID NO: 157146 - DNA, 37 bp, Artificial Sequence
  Synthetic oligonucleotide
tcaaaagtcgccacccctgcccgcgcgccaccctcga

SEQ ID NO: 157147 - DNA, 37 bp, Artificial Sequence
  Synthetic oligonucleotide
tgcaccgcagttaaccacggcccctccgctccttcga

SEQ ID NO: 157148 - DNA, 37 bp, Artificial Sequence
  Synthetic oligonucleotide
acgatctcccaccccatgctatagcgcttctttcgga

SEQ ID NO: 157149 - DNA, 37 bp, Artificial Sequence
  Synthetic oligonucleotide
gggggtgccacatgggggagggaagtcgactcgggga

SEQ ID NO: 157150 - DNA, 37 bp, Artificial Sequence
  Synthetic oligonucleotide
aacaccaccaatgtatttcccgctccgttacctggga

SEQ ID NO: 157151 - DNA, 37 bp, Artificial Sequence
  Synthetic oligonucleotide
tcatgttggggcgagggggcggtgagaatgggtggga

SEQ ID NO: 157152 - DNA, 37 bp, Artificial Sequence
  Synthetic oligonucleotide
aacgaccccctcttgtacctgttgtgctttacctgga

SEQ ID NO: 157153 - DNA, 38 bp, Artificial Sequence
  Synthetic oligonucleotide
gcacgccatggcttatatccccgcacttcgcccgctga

SEQ ID NO: 157154 - DNA, 37 bp, Artificial Sequence
  Synthetic oligonucleotide
tgtacgcacacctctttcttagcaccagccatcgtga

SEQ ID NO: 157155 - DNA, 35 bp, Artificial Sequence
  Synthetic oligonucleotide
tcccgcagagcctgcccttgcccgatgccacttga

SEQ ID NO: 157156 - DNA, 38 bp, Artificial Sequence
  Synthetic oligonucleotide
tgacacgtactgacgcctcccgctgtccgcctatttga

SEQ ID NO: 157157 - DNA, 36 bp, Artificial Sequence
  Synthetic oligonucleotide
gtgtgcactggtgattccttggccctccttcccgta

SEQ ID NO: 157158 - DNA, 36 bp, Artificial Sequence
  Synthetic oligonucleotide
acgagcggcccgccgaccgcctgttatcccctcgta

SEQ ID NO: 157159 - DNA, 36 bp, Artificial Sequence
  Synthetic oligonucleotide
taacggtcactccgcataggcccccctttcattgta

SEQ ID NO: 157160 - DNA, 35 bp, Artificial Sequence
  Synthetic oligonucleotide
ccacattccgccatgctttatcttctgctccgaac

SEQ ID NO: 157161 - DNA, 35 bp, Artificial Sequence
  Synthetic oligonucleotide
taccatccctccgctgattatgtgctctgctgaac

SEQ ID NO: 157162 - DNA, 35 bp, Artificial Sequence
  Synthetic oligonucleotide
gcacgccctcctgcctgccgttcgagaatatgcac

SEQ ID NO: 157163 - DNA, 35 bp, Artificial Sequence
  Synthetic oligonucleotide
attgtccccttccaccgcctgccacatacgcttac

SEQ ID NO: 157164 - DNA, 35 bp, Artificial Sequence
  Synthetic oligonucleotide
tcaccgtacatgccggcacttcctgacctcgaccc

SEQ ID NO: 157165 - DNA, 35 bp, Artificial Sequence
  Synthetic oligonucleotide
gtgcaacaaccacaccgtccaggctctgtttcgcc

SEQ ID NO: 157166 - DNA, 35 bp, Artificial Sequence
  Synthetic oligonucleotide
ttccccgacggaacctgactcctgcgctgtactcc

SEQ ID NO: 157167 - DNA, 35 bp, Artificial Sequence
  Synthetic oligonucleotide
tctgaatcctccagcccgccgctttgatccattcc

SEQ ID NO: 157168 - DNA, 35 bp, Artificial Sequence
  Synthetic oligonucleotide
tcaccctgtccgttttcctcattacagcggattcc

SEQ ID NO: 157169 - DNA, 35 bp, Artificial Sequence
  Synthetic oligonucleotide
aacaggtacccctcgcgaccagttcccgttcttcc

SEQ ID NO: 157170 - DNA, 35 bp, Artificial Sequence
  Synthetic oligonucleotide
gcacgagcaccacggttcgatcagttctcttccgc

SEQ ID NO: 157171 - DNA, 35 bp, Artificial Sequence
  Synthetic oligonucleotide
ggtgggggggggagggtaggttgtggttctggggc

SEQ ID NO: 157172 - DNA, 35 bp, Artificial Sequence
  Synthetic oligonucleotide
tacaaggctcctctgttcctttcacctgctctatc

SEQ ID NO: 157173 - DNA, 35 bp, Artificial Sequence
  Synthetic oligonucleotide
tgcacggccgctgcgaagtggccaccccccttatc

SEQ ID NO: 157174 - DNA, 35 bp, Artificial Sequence
  Synthetic oligonucleotide
tcatcagggccggacgcctttccaacttcatcctc

SEQ ID NO: 157175 - DNA, 35 bp, Artificial Sequence
  Synthetic oligonucleotide
gccatccgtttgcggtgccctccgttgacctagtc

SEQ ID NO: 157176 - DNA, 35 bp, Artificial Sequence
  Synthetic oligonucleotide
gccaacaacgaatcgcctcctcaccgaccgccgtc

SEQ ID NO: 157177 - DNA, 35 bp, Artificial Sequence
  Synthetic oligonucleotide
tgctaccactatccttgcgtcaaactagtaccttc

SEQ ID NO: 157178 - DNA, 35 bp, Artificial Sequence
  Synthetic oligonucleotide
gctggaccttcctccgtccggttcactgttccttc

SEQ ID NO: 157179 - DNA, 35 bp, Artificial Sequence
  Synthetic oligonucleotide
tccaaccccaccgcctgtttgtgcgcttcttcttc

SEQ ID NO: 157180 - DNA, 34 bp, Artificial Sequence
  Synthetic oligonucleotide
ttgtcacctccacatgatttaccccgccctgttc

SEQ ID NO: 157181 - DNA, 35 bp, Artificial Sequence
  Synthetic oligonucleotide
gtttgctttcccagcgtcccctcgcactaccttag

SEQ ID NO: 157182 - DNA, 35 bp, Artificial Sequence
  Synthetic oligonucleotide
atgatgtgggcgggtgactggggagaggtggtacg

SEQ ID NO: 157183 - DNA, 35 bp, Artificial Sequence
  Synthetic oligonucleotide
gcaactccccccctgtcatccctcctccgtgcgcg

SEQ ID NO: 157184 - DNA, 35 bp, Artificial Sequence
  Synthetic oligonucleotide
tccagcacataacccacctcgtgcacaccctttgg

SEQ ID NO: 157185 - DNA, 35 bp, Artificial Sequence
  Synthetic oligonucleotide
gggtctacgttagggggagcggaggaaggggggtg

SEQ ID NO: 157186 - DNA, 35 bp, Artificial Sequence
  Synthetic oligonucleotide
atcattggcccgccttaattgtactatccatcttg

SEQ ID NO: 157187 - DNA, 35 bp, Artificial Sequence
  Synthetic oligonucleotide
tcctgcgttgcccaccgtacctcgcaccgtatcat

SEQ ID NO: 157188 - DNA, 34 bp, Artificial Sequence
  Synthetic oligonucleotide
gttatcccccccagtacgtatcatcgcaaatgat

SEQ ID NO: 157189 - DNA, 35 bp, Artificial Sequence
  Synthetic oligonucleotide
gacccatgggtcgtctcgcttaccccgtttccact

SEQ ID NO: 157190 - DNA, 35 bp, Artificial Sequence
  Synthetic oligonucleotide
tccaccgcagtaatcgcgtgtttcgctctgctcct

SEQ ID NO: 157191 - DNA, 35 bp, Artificial Sequence
  Synthetic oligonucleotide
tccactcatatctgatcaccgccaattgctactgt

SEQ ID NO: 157192 - DNA, 35 bp, Artificial Sequence
  Synthetic oligonucleotide
gcacgctgcatcttctggtgccctcttagttcatt

SEQ ID NO: 157193 - DNA, 35 bp, Artificial Sequence
  Synthetic oligonucleotide
tgatcccccgtatgctctgtcttcacatggtcctt

SEQ ID NO: 157194 - DNA, 35 bp, Artificial Sequence
  Synthetic oligonucleotide
tttgaccgtcctttgcccgcccccggttgattctt

SEQ ID NO: 157195 - DNA, 34 bp, Artificial Sequence
  Synthetic oligonucleotide
gcaccccgccctgttttttttggcccccgcagtt

SEQ ID NO: 157196 - DNA, 35 bp, Artificial Sequence
  Synthetic oligonucleotide
gcttcaccgcctcatgcaccatcggtcgctttttt

SEQ ID NO: 157197 - DNA, 36 bp, Artificial Sequence
  Synthetic oligonucleotide
taccaccgccctctgtgctgcccccatagttcgaaa

SEQ ID NO: 157198 - DNA, 35 bp, Artificial Sequence
  Synthetic oligonucleotide
ataccctgttcatgccggatttaacacctccacaa

SEQ ID NO: 157199 - DNA, 36 bp, Artificial Sequence
  Synthetic oligonucleotide
aataccgactccctctcgcctgtgctgttgttcgaa

SEQ ID NO: 157200 - DNA, 35 bp, Artificial Sequence
  Synthetic oligonucleotide
taatgctgccccgcccgtccctacgcaccgcataa

SEQ ID NO: 157201 - DNA, 36 bp, Artificial Sequence
  Synthetic oligonucleotide
gcatgccctgccccgtgattctcaaccagctaaaca

SEQ ID NO: 157202 - DNA, 35 bp, Artificial Sequence
  Synthetic oligonucleotide
gagcgagccaccaccttctatcgcgctactgcaca

SEQ ID NO: 157203 - DNA, 36 bp, Artificial Sequence
  Synthetic oligonucleotide
accgccgtaccatctgttgaggacctccccctcaca

SEQ ID NO: 157204 - DNA, 36 bp, Artificial Sequence
  Synthetic oligonucleotide
accacgacctcattatccctgtcgttctccctgaca

SEQ ID NO: 157205 - DNA, 34 bp, Artificial Sequence
  Synthetic oligonucleotide
gtccgccccttctttaatggtgccccaatctaca

SEQ ID NO: 157206 - DNA, 36 bp, Artificial Sequence
  Synthetic oligonucleotide
gtgacaactcttgccggtcttaagttcgctctccca

SEQ ID NO: 157207 - DNA, 36 bp, Artificial Sequence
  Synthetic oligonucleotide
aagtcacatcacgtggtcatccttcgcccccttcca

SEQ ID NO: 157208 - DNA, 35 bp, Artificial Sequence
  Synthetic oligonucleotide
gatcccgctcccacgctttcatttgacatacagca

SEQ ID NO: 157209 - DNA, 35 bp, Artificial Sequence
  Synthetic oligonucleotide
gtttgcagacttagccatgtgatcacctccacgca

SEQ ID NO: 157210 - DNA, 36 bp, Artificial Sequence
  Synthetic oligonucleotide
ttggggcggacaacgggaacgggggagtcggaatca

SEQ ID NO: 157211 - DNA, 36 bp, Artificial Sequence
  Synthetic oligonucleotide
tcaccgtagcccgtagctccaagatcccccgtctca

SEQ ID NO: 157212 - DNA, 35 bp, Artificial Sequence
  Synthetic oligonucleotide
gttgcgctaccaccggctgagctctttctttctca

SEQ ID NO: 157213 - DNA, 35 bp, Artificial Sequence
  Synthetic oligonucleotide
accccttcccatgcatctccagtagtgccatgtca

SEQ ID NO: 157214 - DNA, 36 bp, Artificial Sequence
  Synthetic oligonucleotide
acagaacgacgccctgcacaacacccggtaccttca

SEQ ID NO: 157215 - DNA, 37 bp, Artificial Sequence
  Synthetic oligonucleotide
gaccctctaccctctctcttgtgccacagttcgaaga

SEQ ID NO: 157216 - DNA, 36 bp, Artificial Sequence
  Synthetic oligonucleotide
atcaagtgacagtaacaaggattgggcgacgggaga

SEQ ID NO: 157217 - DNA, 37 bp, Artificial Sequence
  Synthetic oligonucleotide
atgtctccgctcgctgctgccctcctattcattacga

SEQ ID NO: 157218 - DNA, 37 bp, Artificial Sequence
  Synthetic oligonucleotide
atcgatcaccatttatcaagccaccctgccatgccga

SEQ ID NO: 157219 - DNA, 37 bp, Artificial Sequence
  Synthetic oligonucleotide
tcgctacctcccatggagcccgccttacttccttcga

SEQ ID NO: 157220 - DNA, 37 bp, Artificial Sequence
  Synthetic oligonucleotide
tatgaggtgactgggcggggagatacgggaggaagga

SEQ ID NO: 157221 - DNA, 37 bp, Artificial Sequence
  Synthetic oligonucleotide
accacgcatcccctgcctttgctattgccacccagga

SEQ ID NO: 157222 - DNA, 37 bp, Artificial Sequence
  Synthetic oligonucleotide
gacatccgcccaattttcgttccgccgcccgactgga

SEQ ID NO: 157223 - DNA, 37 bp, Artificial Sequence
  Synthetic oligonucleotide
gaccagcatagcctcccgtcctttcccgcctcactga

SEQ ID NO: 157224 - DNA, 37 bp, Artificial Sequence
  Synthetic oligonucleotide
gactcccgtcacccgccccctctatccggaggactga

SEQ ID NO: 157225 - DNA, 37 bp, Artificial Sequence
  Synthetic oligonucleotide
gatccgagcgtgctatgctgccctgttctcactctga

SEQ ID NO: 157226 - DNA, 38 bp, Artificial Sequence
  Synthetic oligonucleotide
gcccagggcggggataagggggggaaaacggtgcttga

SEQ ID NO: 157227 - DNA, 37 bp, Artificial Sequence
  Synthetic oligonucleotide
agccccgcccatctgttattacctgtgttctcgttga

SEQ ID NO: 157228 - DNA, 38 bp, Artificial Sequence
  Synthetic oligonucleotide
gatgcatagaagggcgggagggagtggtgcttctttga

SEQ ID NO: 157229 - DNA, 36 bp, Artificial Sequence
  Synthetic oligonucleotide
tccgatgtctccattgtttgattcttcactccgcta

SEQ ID NO: 157230 - DNA, 36 bp, Artificial Sequence
  Synthetic oligonucleotide
gccacatgtcgttcattgtctaatccccctccgcta

SEQ ID NO: 157231 - DNA, 36 bp, Artificial Sequence
  Synthetic oligonucleotide
agaagcctccgaagcccgcccgcacaactcgccgta

SEQ ID NO: 157232 - DNA, 35 bp, Artificial Sequence
  Synthetic oligonucleotide
tcgctaaccacatactgctttccatccttgccaac

SEQ ID NO: 157233 - DNA, 35 bp, Artificial Sequence
  Synthetic oligonucleotide
tacgtgtgggcaggcgggcgggggaggattcagac

SEQ ID NO: 157234 - DNA, 35 bp, Artificial Sequence
  Synthetic oligonucleotide
tgtacctcccgttccactacgtctatacccgcgac

SEQ ID NO: 157235 - DNA, 35 bp, Artificial Sequence
  Synthetic oligonucleotide
tcaacggtccagctgcggcccgcctcatccattac

SEQ ID NO: 157236 - DNA, 35 bp, Artificial Sequence
  Synthetic oligonucleotide
tcactcaccgcttcgagccattcgcgtctatcccc

SEQ ID NO: 157237 - DNA, 35 bp, Artificial Sequence
  Synthetic oligonucleotide
acactcattcctcagccttagcctgttaatctccc

SEQ ID NO: 157238 - DNA, 35 bp, Artificial Sequence
  Synthetic oligonucleotide
atcgggcaacacctgcggcatacatcgcacttccc

SEQ ID NO: 157239 - DNA, 31 bp, Artificial Sequence
  Synthetic oligonucleotide
atctctgccgtgccttcacctgctcgttccc

SEQ ID NO: 157240 - DNA, 35 bp, Artificial Sequence
  Synthetic oligonucleotide
gctccagccactcctccatgagcctaggcgcatcc

SEQ ID NO: 157241 - DNA, 35 bp, Artificial Sequence
  Synthetic oligonucleotide
gtcgcgccacgcatgacacgcacaatttgccctcc

SEQ ID NO: 157242 - DNA, 35 bp, Artificial Sequence
  Synthetic oligonucleotide
acgccggaccgtgtcctgttttgtttgttgcctcc

SEQ ID NO: 157243 - DNA, 35 bp, Artificial Sequence
  Synthetic oligonucleotide
actacttgccaccttttctgtttggctccacttcc

SEQ ID NO: 157244 - DNA, 35 bp, Artificial Sequence
  Synthetic oligonucleotide
gtagcacacctggcccttccttttagcggagttcc

SEQ ID NO: 157245 - DNA, 35 bp, Artificial Sequence
  Synthetic oligonucleotide
atggatgtgccgctccggtcgtgcttcccggttcc

SEQ ID NO: 157246 - DNA, 35 bp, Artificial Sequence
  Synthetic oligonucleotide
gactcgccgacggttttttcctcccttgtgcccgc

SEQ ID NO: 157247 - DNA, 35 bp, Artificial Sequence
  Synthetic oligonucleotide
atgtcaacctccatcgccgctacgccacctgccgc

SEQ ID NO: 157248 - DNA, 35 bp, Artificial Sequence
  Synthetic oligonucleotide
tgcaccccttctcgccgagaatgcactccctatgc

SEQ ID NO: 157249 - DNA, 35 bp, Artificial Sequence
  Synthetic oligonucleotide
aacatgtcaggcccgccgcagcaaccctttctatc

SEQ ID NO: 157250 - DNA, 35 bp, Artificial Sequence
  Synthetic oligonucleotide
acaggcaccatctgtcactacgcttacttccgctc

SEQ ID NO: 157251 - DNA, 35 bp, Artificial Sequence
  Synthetic oligonucleotide
gtctgcagggcctatacctctctcagctgcacttc

SEQ ID NO: 157252 - DNA, 35 bp, Artificial Sequence
  Synthetic oligonucleotide
tacaccgctctccgatcacctatagccctcttaag

SEQ ID NO: 157253 - DNA, 35 bp, Artificial Sequence
  Synthetic oligonucleotide
tgtcctactcaccttcctgcgttttctgtttcgcg

SEQ ID NO: 157254 - DNA, 35 bp, Artificial Sequence
  Synthetic oligonucleotide
gatgcgacactctgcgtcatccccgtccccattcg

SEQ ID NO: 157255 - DNA, 35 bp, Artificial Sequence
  Synthetic oligonucleotide
gggggaacagcagtatggcggcactcggggaaggg

SEQ ID NO: 157256 - DNA, 33 bp, Artificial Sequence
  Synthetic oligonucleotide
actccacccccgttcccttttgctcctgcatgg

SEQ ID NO: 157257 - DNA, 35 bp, Artificial Sequence
  Synthetic oligonucleotide
gactctacaccacttcaggagcccatgggtacctg

SEQ ID NO: 157258 - DNA, 35 bp, Artificial Sequence
  Synthetic oligonucleotide
tcgttgcggccaccccgtatgcatgcgcttcctct

SEQ ID NO: 157259 - DNA, 35 bp, Artificial Sequence
  Synthetic oligonucleotide
tcaggatccccgcactacgttaggccacttgctct

SEQ ID NO: 157260 - DNA, 35 bp, Artificial Sequence
  Synthetic oligonucleotide
gcaccgcctactacgtgtcgtattccatctttctt

SEQ ID NO: 157261 - DNA, 35 bp, Artificial Sequence
  Synthetic oligonucleotide
gactatgcccgtcccccagcctctcacactttgtt

SEQ ID NO: 157262 - DNA, 35 bp, Artificial Sequence
  Synthetic oligonucleotide
gcccccctcgggtgctaactttgcatcattttttt

SEQ ID NO: 157263 - DNA, 36 bp, Artificial Sequence
  Synthetic oligonucleotide
tccgccacccggcttattgcgctgacccaccttgaa

SEQ ID NO: 157264 - DNA, 36 bp, Artificial Sequence
  Synthetic oligonucleotide
agaccccgacacctgttggtctctgtcctgtcctaa

SEQ ID NO: 157265 - DNA, 35 bp, Artificial Sequence
  Synthetic oligonucleotide
tgacttgcctctgtctgttcagcccttttaccaca

SEQ ID NO: 157266 - DNA, 36 bp, Artificial Sequence
  Synthetic oligonucleotide
gtacctcacgcattgcactttgctccccgttaacca

SEQ ID NO: 157267 - DNA, 35 bp, Artificial Sequence
  Synthetic oligonucleotide
attgcaccgaccacgcacgccgatcagttctccca

SEQ ID NO: 157268 - DNA, 36 bp, Artificial Sequence
  Synthetic oligonucleotide
gactcttcccctctccgcacctgttgcctgtagcca

SEQ ID NO: 157269 - DNA, 36 bp, Artificial Sequence
  Synthetic oligonucleotide
tcaacgccctccacgtctatcttgcaatgatccgca

SEQ ID NO: 157270 - DNA, 36 bp, Artificial Sequence
  Synthetic oligonucleotide
atcagacacccactgctctcgcgacctattccatca

SEQ ID NO: 157271 - DNA, 36 bp, Artificial Sequence
  Synthetic oligonucleotide
gagacctggtcgaacggggagagattgcggcattca

SEQ ID NO: 157272 - DNA, 36 bp, Artificial Sequence
  Synthetic oligonucleotide
acgatcacagactccttgctattaccgttgttttca

SEQ ID NO: 157273 - DNA, 37 bp, Artificial Sequence
  Synthetic oligonucleotide
gaacgtggaggcggggcggtgaggggagtcggggaga

SEQ ID NO: 157274 - DNA, 37 bp, Artificial Sequence
  Synthetic oligonucleotide
gatgccccctgcctccatccctttatacggttcacga

SEQ ID NO: 157275 - DNA, 37 bp, Artificial Sequence
  Synthetic oligonucleotide
agtcgggtgggagggtgtgagggtgggactgggacga

SEQ ID NO: 157276 - DNA, 37 bp, Artificial Sequence
  Synthetic oligonucleotide
gtgaccgccccgttttttcagcatcgtatcgtaccga

SEQ ID NO: 157277 - DNA, 37 bp, Artificial Sequence
  Synthetic oligonucleotide
acgtgtgcccgtagtgcctacaataacctccccccga

SEQ ID NO: 157278 - DNA, 37 bp, Artificial Sequence
  Synthetic oligonucleotide
tatcccgtcggcttatttcgcctccatggttccccga

SEQ ID NO: 157279 - DNA, 37 bp, Artificial Sequence
  Synthetic oligonucleotide
tactgtccgcactttagccctgtcgccccattcccga

SEQ ID NO: 157280 - DNA, 37 bp, Artificial Sequence
  Synthetic oligonucleotide
acacaccttgtcctttacgcgttttacgtgacgccga

SEQ ID NO: 157281 - DNA, 35 bp, Artificial Sequence
  Synthetic oligonucleotide
gtgtccgctgcactccgttaagcctcgccatccga

SEQ ID NO: 157282 - DNA, 37 bp, Artificial Sequence
  Synthetic oligonucleotide
atccacgctgccactcttgctatcgataactctccga

SEQ ID NO: 157283 - DNA, 37 bp, Artificial Sequence
  Synthetic oligonucleotide
tccacggcgccgcctcataagtcatccaccctctcga

SEQ ID NO: 157284 - DNA, 37 bp, Artificial Sequence
  Synthetic oligonucleotide
ggtcggtagggggcggagggatcggaatggtagggga

SEQ ID NO: 157285 - DNA, 37 bp, Artificial Sequence
  Synthetic oligonucleotide
tcacgtaacatcctacacgtcgtcgtgccctgcatga

SEQ ID NO: 157286 - DNA, 37 bp, Artificial Sequence
  Synthetic oligonucleotide
actgggggtatgcttggggttcgttgggcggggatga

SEQ ID NO: 157287 - DNA, 38 bp, Artificial Sequence
  Synthetic oligonucleotide
tccgcacctatcacattaccccctcacccagtcactga

SEQ ID NO: 157288 - DNA, 38 bp, Artificial Sequence
  Synthetic oligonucleotide
gtgatcagcatccgctcccttctgttccgtctatctga

SEQ ID NO: 157289 - DNA, 37 bp, Artificial Sequence
  Synthetic oligonucleotide
gccctgtcctggtcttcgttcctctccttctgtgtga

SEQ ID NO: 157290 - DNA, 36 bp, Artificial Sequence
  Synthetic oligonucleotide
tccagacatacagccaccccctgtcccccctgttga

SEQ ID NO: 157291 - DNA, 37 bp, Artificial Sequence
  Synthetic oligonucleotide
acagggagggtgaggggggaatgctttcccttgttga

SEQ ID NO: 157292 - DNA, 37 bp, Artificial Sequence
  Synthetic oligonucleotide
tgcctgcccgcccgttcatcatctattcgcttgttga

SEQ ID NO: 157293 - DNA, 35 bp, Artificial Sequence
  Synthetic oligonucleotide
tagacctgcccgactcgctatctcttaacaccata

SEQ ID NO: 157294 - DNA, 36 bp, Artificial Sequence
  Synthetic oligonucleotide
tctgaacgcatgccttgaacacctccccctggtcta

SEQ ID NO: 157295 - DNA, 36 bp, Artificial Sequence
  Synthetic oligonucleotide
gttgtacttcctcctacccatcgccacctggtcgta

SEQ ID NO: 157296 - DNA, 35 bp, Artificial Sequence
  Synthetic oligonucleotide
tgagccggcgcccgctctgtcctgtccttcactta

SEQ ID NO: 157297 - DNA, 36 bp, Artificial Sequence
  Synthetic oligonucleotide
acgctcccacactacccctctaagaacagtctctta

SEQ ID NO: 157298 - DNA, 35 bp, Artificial Sequence
  Synthetic oligonucleotide
gttgccttgcgcattgaagttctcctcactcccac

SEQ ID NO: 157299 - DNA, 35 bp, Artificial Sequence
  Synthetic oligonucleotide
gccctcccgtccgccgaagcctcaatcttttcgac

SEQ ID NO: 157300 - DNA, 35 bp, Artificial Sequence
  Synthetic oligonucleotide
tcctgccgtgatacacctctccgtcacaaacctac

SEQ ID NO: 157301 - DNA, 35 bp, Artificial Sequence
  Synthetic oligonucleotide
gcttacccccttcctgcgtattttgggctcatacc

SEQ ID NO: 157302 - DNA, 35 bp, Artificial Sequence
  Synthetic oligonucleotide
gtccgcacgcttcactgtcctcttcatgccgtacc

SEQ ID NO: 157303 - DNA, 35 bp, Artificial Sequence
  Synthetic oligonucleotide
tcagctcgtactgatgccatatctcctgtcccgcc

SEQ ID NO: 157304 - DNA, 35 bp, Artificial Sequence
  Synthetic oligonucleotide
tctccatagcacagtgccgcctccgctggtccgcc

SEQ ID NO: 157305 - DNA, 35 bp, Artificial Sequence
  Synthetic oligonucleotide
ttccagcggaccatttctccccaacacggcgggcc

SEQ ID NO: 157306 - DNA, 35 bp, Artificial Sequence
  Synthetic oligonucleotide
gaccctgcccctggtctaacgctgggcccagtgcc

SEQ ID NO: 157307 - DNA, 35 bp, Artificial Sequence
  Synthetic oligonucleotide
gttactatcgtccgcccggctgttggttcttctcc

SEQ ID NO: 157308 - DNA, 35 bp, Artificial Sequence
  Synthetic oligonucleotide
tatacccactggcccgacttgccatccatctgtcc

SEQ ID NO: 157309 - DNA, 35 bp, Artificial Sequence
  Synthetic oligonucleotide
tcatccagtcttcggtccattgacgcgcatcttcc

SEQ ID NO: 157310 - DNA, 35 bp, Artificial Sequence
  Synthetic oligonucleotide
ggcctgggtcaactgcgctttccatcccccttcgc

SEQ ID NO: 157311 - DNA, 35 bp, Artificial Sequence
  Synthetic oligonucleotide
tgtcccgtctcgcgctcctccgcacctgcttcggc

SEQ ID NO: 157312 - DNA, 35 bp, Artificial Sequence
  Synthetic oligonucleotide
tagccagccccgttagaccttcctgcccctgttgc

SEQ ID NO: 157313 - DNA, 35 bp, Artificial Sequence
  Synthetic oligonucleotide
acgaccaccccttggtcctcgcccctttgaaaatc

SEQ ID NO: 157314 - DNA, 35 bp, Artificial Sequence
  Synthetic oligonucleotide
gatgatccaacgactgccctctgggtcttatcctc

SEQ ID NO: 157315 - DNA, 35 bp, Artificial Sequence
  Synthetic oligonucleotide
gcaccaccatgcatactgttcttgcgcctacgctc

SEQ ID NO: 157316 - DNA, 35 bp, Artificial Sequence
  Synthetic oligonucleotide
gtcgcaccgtgacgctctgatcgttccgcaccttc

SEQ ID NO: 157317 - DNA, 35 bp, Artificial Sequence
  Synthetic oligonucleotide
tattgcgctgtctcttatccagcagtttgcccttc

SEQ ID NO: 157318 - DNA, 35 bp, Artificial Sequence
  Synthetic oligonucleotide
tagtatttcccacccgctgcatgcccgtaacgttc

SEQ ID NO: 157319 - DNA, 35 bp, Artificial Sequence
  Synthetic oligonucleotide
tcattgcaccgctgtacttcgtctcgacactgttc

SEQ ID NO: 157320 - DNA, 35 bp, Artificial Sequence
  Synthetic oligonucleotide
tgacgttcaggggccttttgtctatcctgctgttc

SEQ ID NO: 157321 - DNA, 35 bp, Artificial Sequence
  Synthetic oligonucleotide
gtcgactgacaggagggtgggatgggtggttgttc

SEQ ID NO: 157322 - DNA, 35 bp, Artificial Sequence
  Synthetic oligonucleotide
tctccccctcgcttctgtaactcaatcatgcttag

SEQ ID NO: 157323 - DNA, 35 bp, Artificial Sequence
  Synthetic oligonucleotide
tataaataccgcgctctgctccttttcccgccccg

SEQ ID NO: 157324 - DNA, 35 bp, Artificial Sequence
  Synthetic oligonucleotide
tctacaggcgccgctttaacccttggtccccctcg

SEQ ID NO: 157325 - DNA, 35 bp, Artificial Sequence
  Synthetic oligonucleotide
gacgaagccagggggggaggatgaacgttacttcg

SEQ ID NO: 157326 - DNA, 35 bp, Artificial Sequence
  Synthetic oligonucleotide
gggtgggaggcgagtagggaaaatggcgaactagg

SEQ ID NO: 157327 - DNA, 35 bp, Artificial Sequence
  Synthetic oligonucleotide
tcgctccctctgtgcgccccaagctccgttactgg

SEQ ID NO: 157328 - DNA, 35 bp, Artificial Sequence
  Synthetic oligonucleotide
acaacagggaggcggggcaaaagcaggtcaggtgg

SEQ ID NO: 157329 - DNA, 34 bp, Artificial Sequence
  Synthetic oligonucleotide
gcacgccgtcctttgaaccctgacacctggcctg

SEQ ID NO: 157330 - DNA, 35 bp, Artificial Sequence
  Synthetic oligonucleotide
tcgaactggtcgccgcctacgtcccctccctcgat

SEQ ID NO: 157331 - DNA, 35 bp, Artificial Sequence
  Synthetic oligonucleotide
gacggtgcgcaccacccgcccgcttctccgaaact

SEQ ID NO: 157332 - DNA, 35 bp, Artificial Sequence
  Synthetic oligonucleotide
gaccttatgccgcctgtattcttttttggccacct

SEQ ID NO: 157333 - DNA, 35 bp, Artificial Sequence
  Synthetic oligonucleotide
aggccccgcgcagcctgcttccacgtcttccccct

SEQ ID NO: 157334 - DNA, 35 bp, Artificial Sequence
  Synthetic oligonucleotide
tgagcccagctttcaaggcgtaggtcctctctcct

SEQ ID NO: 157335 - DNA, 35 bp, Artificial Sequence
  Synthetic oligonucleotide
gggggggcaatgaagtcggggaacataggggtggt

SEQ ID NO: 157336 - DNA, 35 bp, Artificial Sequence
  Synthetic oligonucleotide
atgtgccacccgtctagctcactgacctgccctgt

SEQ ID NO: 157337 - DNA, 35 bp, Artificial Sequence
  Synthetic oligonucleotide
tacgtaaaggtcgcgcactcacctgtccttcctgt

SEQ ID NO: 157338 - DNA, 35 bp, Artificial Sequence
  Synthetic oligonucleotide
gcactccacctgtcgtttttttttgcttatacatt

SEQ ID NO: 157339 - DNA, 35 bp, Artificial Sequence
  Synthetic oligonucleotide
gtcgaacgcgtacgccctgccttcgcgcctctttt

SEQ ID NO: 157340 - DNA, 36 bp, Artificial Sequence
  Synthetic oligonucleotide
tccacggccctgttatcgttaaccctcccttaccaa

SEQ ID NO: 157341 - DNA, 36 bp, Artificial Sequence
  Synthetic oligonucleotide
gttcggtacattgttgcttaggtcgccgctccccca

SEQ ID NO: 157342 - DNA, 36 bp, Artificial Sequence
  Synthetic oligonucleotide
gcccctcggctcggcctctctccgccgtcccgccca

SEQ ID NO: 157343 - DNA, 36 bp, Artificial Sequence
  Synthetic oligonucleotide
tcagagcctcccatgtacaaatgttttctgcgccca

SEQ ID NO: 157344 - DNA, 36 bp, Artificial Sequence
  Synthetic oligonucleotide
gacaacgctcacataaaaaagcctaccccttcgcca

SEQ ID NO: 157345 - DNA, 36 bp, Artificial Sequence
  Synthetic oligonucleotide
tatgcgtgcctgcgtgtcgcccttctcctgatgcca

SEQ ID NO: 157346 - DNA, 36 bp, Artificial Sequence
  Synthetic oligonucleotide
tcacgctgccttgcgaatgggcccacctcccgtcca

SEQ ID NO: 157347 - DNA, 36 bp, Artificial Sequence
  Synthetic oligonucleotide
ttcatccctccgcacaagagatccgccgcccttcca

SEQ ID NO: 157348 - DNA, 36 bp, Artificial Sequence
  Synthetic oligonucleotide
acttcacacctgtccctggtacctattgctgtagca

SEQ ID NO: 157349 - DNA, 36 bp, Artificial Sequence
  Synthetic oligonucleotide
taccaccagagtgatttcgctctttcgcccctcgca

SEQ ID NO: 157350 - DNA, 36 bp, Artificial Sequence
  Synthetic oligonucleotide
tcgccattccacccgctattacctctgtactctgca

SEQ ID NO: 157351 - DNA, 35 bp, Artificial Sequence
  Synthetic oligonucleotide
tgagaccggattgtcgcgttcctgtttttccatca

SEQ ID NO: 157352 - DNA, 36 bp, Artificial Sequence
  Synthetic oligonucleotide
tacgcctgtacgtctccctgttcatttgttatatca

SEQ ID NO: 157353 - DNA, 36 bp, Artificial Sequence
  Synthetic oligonucleotide
gcgcaccctctccgttgactattgcgaatcccctca

SEQ ID NO: 157354 - DNA, 36 bp, Artificial Sequence
  Synthetic oligonucleotide
agcaaccgcgcgaagtccaccgtcaccctcgtctca

SEQ ID NO: 157355 - DNA, 37 bp, Artificial Sequence
  Synthetic oligonucleotide
acccggggcgggagggccaagggagcaggataggcga

SEQ ID NO: 157356 - DNA, 37 bp, Artificial Sequence
  Synthetic oligonucleotide
gccacacttgcccggcttgagcatactacctcctcga

SEQ ID NO: 157357 - DNA, 37 bp, Artificial Sequence
  Synthetic oligonucleotide
gggggtggtgcggaggtgaggtagctgtggggatgga

SEQ ID NO: 157358 - DNA, 36 bp, Artificial Sequence
  Synthetic oligonucleotide
tttccgccccgccaccttctgttataccgtgatgga

SEQ ID NO: 157359 - DNA, 37 bp, Artificial Sequence
  Synthetic oligonucleotide
tcccctgttccgcctgcatgctctcagtctacactga

SEQ ID NO: 157360 - DNA, 38 bp, Artificial Sequence
  Synthetic oligonucleotide
atcgcagagatgcactgccttagttcgcccctccctga

SEQ ID NO: 157361 - DNA, 36 bp, Artificial Sequence
  Synthetic oligonucleotide
atacacacccgtccctgttgcttacacgtatcctga

SEQ ID NO: 157362 - DNA, 36 bp, Artificial Sequence
  Synthetic oligonucleotide
tacccgcgtgtttcgcatgatcgcccctcctgctga

SEQ ID NO: 157363 - DNA, 38 bp, Artificial Sequence
  Synthetic oligonucleotide
gcgacctgggctctagatgggtgggggggacctcgtga

SEQ ID NO: 157364 - DNA, 37 bp, Artificial Sequence
  Synthetic oligonucleotide
gggcacaccgtgtaacgccgcctccactcctgattga

SEQ ID NO: 157365 - DNA, 38 bp, Artificial Sequence
  Synthetic oligonucleotide
atcccgcttcccgtgcgcgtgttatcgatccaccttga

SEQ ID NO: 157366 - DNA, 38 bp, Artificial Sequence
  Synthetic oligonucleotide
accatcgccctccctctctcctcctgaaggcagtttga

SEQ ID NO: 157367 - DNA, 36 bp, Artificial Sequence
  Synthetic oligonucleotide
atcccgcaggctcccttttgcttccattgtccgcta

SEQ ID NO: 157368 - DNA, 36 bp, Artificial Sequence
  Synthetic oligonucleotide
acacgcccttctttcctattgttgccgtttggatta

SEQ ID NO: 157369 - DNA, 36 bp, Artificial Sequence
  Synthetic oligonucleotide
gcgtcgcaccagaccgctactctgttccatctgtta

SEQ ID NO: 157370 - DNA, 36 bp, Artificial Sequence
  Synthetic oligonucleotide
gaacccactccacgaagtgtactcccacgttattta

SEQ ID NO: 157371 - DNA, 35 bp, Artificial Sequence
  Synthetic oligonucleotide
gtcgttagtgtgtttccgccctccccccttaacac

SEQ ID NO: 157372 - DNA, 35 bp, Artificial Sequence
  Synthetic oligonucleotide
gcactttgcccgccaccaccgtttcggatttcgac

SEQ ID NO: 157373 - DNA, 35 bp, Artificial Sequence
  Synthetic oligonucleotide
gacctgagccccctttcatgtctatgtcctattac

SEQ ID NO: 157374 - DNA, 35 bp, Artificial Sequence
  Synthetic oligonucleotide
accccccggcactactgacctagcgcttcttttac

SEQ ID NO: 157375 - DNA, 35 bp, Artificial Sequence
  Synthetic oligonucleotide
agcgaacccccgcatttagtgcccagctccaaacc

SEQ ID NO: 157376 - DNA, 35 bp, Artificial Sequence
  Synthetic oligonucleotide
tcactcgcttggatcattcattccggtacctcacc

SEQ ID NO: 157377 - DNA, 35 bp, Artificial Sequence
  Synthetic oligonucleotide
gcccgattgcttgattcttcgcctagtgccgtacc

SEQ ID NO: 157378 - DNA, 35 bp, Artificial Sequence
  Synthetic oligonucleotide
atcacccgcatccctctgacgctttagttccaccc

SEQ ID NO: 157379 - DNA, 35 bp, Artificial Sequence
  Synthetic oligonucleotide
agctcatgaaccttgtcgtccccgtgcccctgtcc

SEQ ID NO: 157380 - DNA, 35 bp, Artificial Sequence
  Synthetic oligonucleotide
ttccagtacagcctcttgctgaagccctcttttcc

SEQ ID NO: 157381 - DNA, 35 bp, Artificial Sequence
  Synthetic oligonucleotide
actagccccgattgttccggtgccttccttcacgc

SEQ ID NO: 157382 - DNA, 35 bp, Artificial Sequence
  Synthetic oligonucleotide
tcattgcgcggtgggtccgccctcattctctccgc

SEQ ID NO: 157383 - DNA, 35 bp, Artificial Sequence
  Synthetic oligonucleotide
gtggccctccgcacatgcttcacagaatcatactc

SEQ ID NO: 157384 - DNA, 35 bp, Artificial Sequence
  Synthetic oligonucleotide
taacgtgccgctcgctcccaccgcaaggttacctc

SEQ ID NO: 157385 - DNA, 35 bp, Artificial Sequence
  Synthetic oligonucleotide
tcgaacgcccgtccatccaggcccctgacctgctc

SEQ ID NO: 157386 - DNA, 35 bp, Artificial Sequence
  Synthetic oligonucleotide
tacacatgggcgtttggttcttcgccgttcctttc

SEQ ID NO: 157387 - DNA, 35 bp, Artificial Sequence
  Synthetic oligonucleotide
ttggtgcctactctttgcgttgaaaacactctttc

SEQ ID NO: 157388 - DNA, 35 bp, Artificial Sequence
  Synthetic oligonucleotide
atatacacctgccgcacgccctcctctttatgacg

SEQ ID NO: 157389 - DNA, 35 bp, Artificial Sequence
  Synthetic oligonucleotide
acgtcaccctcgccccaccgaccctactgtaaccg

SEQ ID NO: 157390 - DNA, 35 bp, Artificial Sequence
  Synthetic oligonucleotide
taaacgcgacggggacggaaggttgggaggagtgg

SEQ ID NO: 157391 - DNA, 35 bp, Artificial Sequence
  Synthetic oligonucleotide
tcgcattgcgggatgtgtcgtatcgttctcccctg

SEQ ID NO: 157392 - DNA, 35 bp, Artificial Sequence
  Synthetic oligonucleotide
gcccacccgatagatcccacctgacctgcacgcat

SEQ ID NO: 157393 - DNA, 35 bp, Artificial Sequence
  Synthetic oligonucleotide
tcgaacgctcgctccaccttcctttgtgttgctat

SEQ ID NO: 157394 - DNA, 35 bp, Artificial Sequence
  Synthetic oligonucleotide
tccgtctgccagctcttcggtactctgtccctgct

SEQ ID NO: 157395 - DNA, 35 bp, Artificial Sequence
  Synthetic oligonucleotide
ggaccaccatccccatttgtgacttcacctttgct

SEQ ID NO: 157396 - DNA, 35 bp, Artificial Sequence
  Synthetic oligonucleotide
atcacaggcgtcatcctttctgaatcctgtcctct

SEQ ID NO: 157397 - DNA, 35 bp, Artificial Sequence
  Synthetic oligonucleotide
aacaccaccgatcttttgtccgggaccacttgtct

SEQ ID NO: 157398 - DNA, 35 bp, Artificial Sequence
  Synthetic oligonucleotide
tagtaccaccccataccgcgagcccgggttcttct

SEQ ID NO: 157399 - DNA, 35 bp, Artificial Sequence
  Synthetic oligonucleotide
gtcatccatccgtctatctgcgtttttggtacctt

SEQ ID NO: 157400 - DNA, 35 bp, Artificial Sequence
  Synthetic oligonucleotide
gacctgcccacctctctagccatacagggtatctt

SEQ ID NO: 157401 - DNA, 35 bp, Artificial Sequence
  Synthetic oligonucleotide
tgttcccccctttcatgtcctttcgcgtacgagtt

SEQ ID NO: 157402 - DNA, 36 bp, Artificial Sequence
  Synthetic oligonucleotide
gagaatgacggaggtggtgaacaaagtggtggtaaa

SEQ ID NO: 157403 - DNA, 36 bp, Artificial Sequence
  Synthetic oligonucleotide
gtaccgcctcaaccatctctagctgtcgaacaggaa

SEQ ID NO: 157404 - DNA, 34 bp, Artificial Sequence
  Synthetic oligonucleotide
aacaaggccgggaggacggggggggcaaagggaa

SEQ ID NO: 157405 - DNA, 35 bp, Artificial Sequence
  Synthetic oligonucleotide
gggtgggaatgcagggcgtggagggggacggggaa

SEQ ID NO: 157406 - DNA, 34 bp, Artificial Sequence
  Synthetic oligonucleotide
ttcacccacgtccgccattgtcggtctatcctaa

SEQ ID NO: 157407 - DNA, 34 bp, Artificial Sequence
  Synthetic oligonucleotide
actcgcccctatgatcttcaggcgctgccttaca

SEQ ID NO: 157408 - DNA, 36 bp, Artificial Sequence
  Synthetic oligonucleotide
tctgtgcacgtatgcctggcaattctcctcgtccca

SEQ ID NO: 157409 - DNA, 36 bp, Artificial Sequence
  Synthetic oligonucleotide
agtcaccaccctgctccggcgatcgcgcactcgcca

SEQ ID NO: 157410 - DNA, 35 bp, Artificial Sequence
  Synthetic oligonucleotide
tcagcagaccagcctctcgtcctccgcttttggca

SEQ ID NO: 157411 - DNA, 36 bp, Artificial Sequence
  Synthetic oligonucleotide
accgccccacagctgcccccttgaacctgctcttca

SEQ ID NO: 157412 - DNA, 37 bp, Artificial Sequence
  Synthetic oligonucleotide
gaccccgctcactcatcgcctatttcacggtcacaga

SEQ ID NO: 157413 - DNA, 37 bp, Artificial Sequence
  Synthetic oligonucleotide
gtcaactctgcaatcctacacgccttgtcctcctaga

SEQ ID NO: 157414 - DNA, 37 bp, Artificial Sequence
  Synthetic oligonucleotide
accccactgccactcgtcgctcatttagcctgtccga

SEQ ID NO: 157415 - DNA, 37 bp, Artificial Sequence
  Synthetic oligonucleotide
ttgggctcctccctgtctttttacccgatccgttcga

SEQ ID NO: 157416 - DNA, 37 bp, Artificial Sequence
  Synthetic oligonucleotide
gtcacctgcgctgtctttctccgttcagccatttcga

SEQ ID NO: 157417 - DNA, 37 bp, Artificial Sequence
  Synthetic oligonucleotide
ggtggaaggagatgggggatggggcaagctaatagga

SEQ ID NO: 157418 - DNA, 37 bp, Artificial Sequence
  Synthetic oligonucleotide
aatgggaggaagggattgcttagggggaggaaacgga

SEQ ID NO: 157419 - DNA, 37 bp, Artificial Sequence
  Synthetic oligonucleotide
ttcatgcgtctggcgagggggggaaggggtgcacgga

SEQ ID NO: 157420 - DNA, 36 bp, Artificial Sequence
  Synthetic oligonucleotide
agagggaggggtgactatggggcgttagaggcggga

SEQ ID NO: 157421 - DNA, 37 bp, Artificial Sequence
  Synthetic oligonucleotide
ggggtcaagtggggatattgagcagtttgggcgggga

SEQ ID NO: 157422 - DNA, 35 bp, Artificial Sequence
  Synthetic oligonucleotide
tgccaactgggggggaacgggtgatgactcgggga

SEQ ID NO: 157423 - DNA, 37 bp, Artificial Sequence
  Synthetic oligonucleotide
actgatgaagggagtgggattgggggacataggggga

SEQ ID NO: 157424 - DNA, 37 bp, Artificial Sequence
  Synthetic oligonucleotide
gggacacaggagagaggaaaagggggaataatgatga

SEQ ID NO: 157425 - DNA, 38 bp, Artificial Sequence
  Synthetic oligonucleotide
tgcgcaccatcgatttcccctcgcacttcctttactga

SEQ ID NO: 157426 - DNA, 38 bp, Artificial Sequence
  Synthetic oligonucleotide
ctgaacgtggcggaggttggggatggagggtggattga

SEQ ID NO: 157427 - DNA, 37 bp, Artificial Sequence
  Synthetic oligonucleotide
gcgctgtgccgcaagcctttccccctgcctcacttga

SEQ ID NO: 157428 - DNA, 35 bp, Artificial Sequence
  Synthetic oligonucleotide
ttggcgcctcacactttgccgccaattgcctccta

SEQ ID NO: 157429 - DNA, 35 bp, Artificial Sequence
  Synthetic oligonucleotide
gcaccgcccgctcgccacaaggcctaccctaagta

SEQ ID NO: 157430 - DNA, 36 bp, Artificial Sequence
  Synthetic oligonucleotide
tcctatccacccctccccgcacagtaacgtcgtgta

SEQ ID NO: 157431 - DNA, 36 bp, Artificial Sequence
  Synthetic oligonucleotide
gacgccggagctagccgtcacaatccctgtccgtta

SEQ ID NO: 157432 - DNA, 36 bp, Artificial Sequence
  Synthetic oligonucleotide
tcttgcctcccttgttttcatcttgttggcacttta

SEQ ID NO: 157433 - DNA, 35 bp, Artificial Sequence
  Synthetic oligonucleotide
gcccctcccgctatggccgctttgctctttacaac

SEQ ID NO: 157434 - DNA, 34 bp, Artificial Sequence
  Synthetic oligonucleotide
gagcgccgtccccatgttcctttcctgtttccac

SEQ ID NO: 157435 - DNA, 35 bp, Artificial Sequence
  Synthetic oligonucleotide
tgtgaacggctgatcaatcttctcggcgcccctac

SEQ ID NO: 157436 - DNA, 35 bp, Artificial Sequence
  Synthetic oligonucleotide
tcccaccctctcgccgttaagggctactgccttac

SEQ ID NO: 157437 - DNA, 35 bp, Artificial Sequence
  Synthetic oligonucleotide
ttgtgccttccgccgtatactttattcgtccgacc

SEQ ID NO: 157438 - DNA, 36 bp, Artificial Sequence
  Synthetic oligonucleotide
tctcccccccccgccgatgccctatctccgcgaccc

SEQ ID NO: 157439 - DNA, 35 bp, Artificial Sequence
  Synthetic oligonucleotide
gagtgaccgccgccattctgagatgcgtccgcccc

SEQ ID NO: 157440 - DNA, 35 bp, Artificial Sequence
  Synthetic oligonucleotide
ccagtccgtcgttaaagccatctcgcctcccgccc

SEQ ID NO: 157441 - DNA, 35 bp, Artificial Sequence
  Synthetic oligonucleotide
gccagttccacgcgtacacccagtccactccgccc

SEQ ID NO: 157442 - DNA, 35 bp, Artificial Sequence
  Synthetic oligonucleotide
gacgacccactcccggacagcccacaatggcgccc

SEQ ID NO: 157443 - DNA, 35 bp, Artificial Sequence
  Synthetic oligonucleotide
aaacaacgcctcacgtttgcgcgcaccctatcgcc

SEQ ID NO: 157444 - DNA, 35 bp, Artificial Sequence
  Synthetic oligonucleotide
gcaaggagcgcgacttgataacactctcggcctcc

SEQ ID NO: 157445 - DNA, 35 bp, Artificial Sequence
  Synthetic oligonucleotide
acgcgctccgtgcccatgtacatacctcattccgc

SEQ ID NO: 157446 - DNA, 35 bp, Artificial Sequence
  Synthetic oligonucleotide
gcctccagctgactttcctttttgccgccccgcgc

SEQ ID NO: 157447 - DNA, 35 bp, Artificial Sequence
  Synthetic oligonucleotide
gagatccaccgctggctcataataccgccaacatc

SEQ ID NO: 157448 - DNA, 35 bp, Artificial Sequence
  Synthetic oligonucleotide
acacccctcctacaccgggattattggagcctatc

SEQ ID NO: 157449 - DNA, 35 bp, Artificial Sequence
  Synthetic oligonucleotide
acagtcggcgattaaggccgccccaccgttctatc

SEQ ID NO: 157450 - DNA, 35 bp, Artificial Sequence
  Synthetic oligonucleotide
gtgcctcgccgccgcatagaattggtcgccaactc

SEQ ID NO: 157451 - DNA, 35 bp, Artificial Sequence
  Synthetic oligonucleotide
acttcccccgtgcgtctgacctagtcaacttgctc

SEQ ID NO: 157452 - DNA, 35 bp, Artificial Sequence
  Synthetic oligonucleotide
gtcgcacgttcgcctcttttggtcctactctagtc

SEQ ID NO: 157453 - DNA, 35 bp, Artificial Sequence
  Synthetic oligonucleotide
tgtcttagccctccagcccgttgacccccgccttc

SEQ ID NO: 157454 - DNA, 35 bp, Artificial Sequence
  Synthetic oligonucleotide
cccccacgcccacatctcgcccattaatacgcttc

SEQ ID NO: 157455 - DNA, 35 bp, Artificial Sequence
  Synthetic oligonucleotide
tctcacctgatattctttgcgacatcccctcgttc

SEQ ID NO: 157456 - DNA, 35 bp, Artificial Sequence
  Synthetic oligonucleotide
aacacccgcacccttttttgcgcccgacgctgttc

SEQ ID NO: 157457 - DNA, 35 bp, Artificial Sequence
  Synthetic oligonucleotide
tgctgcccccccacttcggctcctggtgatctacg

SEQ ID NO: 157458 - DNA, 35 bp, Artificial Sequence
  Synthetic oligonucleotide
aaatcaggtcgggggagggagggcggacaataggg

SEQ ID NO: 157459 - DNA, 37 bp, Artificial Sequence
  Synthetic oligonucleotide
gcccccttcccctgtccccctgtttgagtgcaccctg

SEQ ID NO: 157460 - DNA, 35 bp, Artificial Sequence
  Synthetic oligonucleotide
aagcccgccacatactctccgcacatatataccat

SEQ ID NO: 157461 - DNA, 35 bp, Artificial Sequence
  Synthetic oligonucleotide
tgtcactacatggacctgtaccgtcactacctact

SEQ ID NO: 157462 - DNA, 35 bp, Artificial Sequence
  Synthetic oligonucleotide
ggtcctgacatctgccttccactctacagacccct

SEQ ID NO: 157463 - DNA, 35 bp, Artificial Sequence
  Synthetic oligonucleotide
gtgcctttcggtgacccatgcccctgtctcgccct

SEQ ID NO: 157464 - DNA, 35 bp, Artificial Sequence
  Synthetic oligonucleotide
tccgagcctgcccctctgttgttttgcttggcgct

SEQ ID NO: 157465 - DNA, 35 bp, Artificial Sequence
  Synthetic oligonucleotide
tccttccgcgcccacacgcgtcacttttgctcgct

SEQ ID NO: 157466 - DNA, 35 bp, Artificial Sequence
  Synthetic oligonucleotide
tcacgctctgccataacattttcccctgctttgct

SEQ ID NO: 157467 - DNA, 35 bp, Artificial Sequence
  Synthetic oligonucleotide
atcgccgcctcacgtcttccaacatcggacgctct

SEQ ID NO: 157468 - DNA, 35 bp, Artificial Sequence
  Synthetic oligonucleotide
gatgcacgcccgttatccaccgctccgttacctgt

SEQ ID NO: 157469 - DNA, 35 bp, Artificial Sequence
  Synthetic oligonucleotide
gttatcagccgtttgtgccgctttcgtacccctgt

SEQ ID NO: 157470 - DNA, 35 bp, Artificial Sequence
  Synthetic oligonucleotide
gccgtcctacggttccgatttttttccctcgcctt

SEQ ID NO: 157471 - DNA, 36 bp, Artificial Sequence
  Synthetic oligonucleotide
tcccaccacctgccctgttgttcttcgctcttgaaa

SEQ ID NO: 157472 - DNA, 36 bp, Artificial Sequence
  Synthetic oligonucleotide
accacaccttcgtatagctatacgaccgcccaccaa

SEQ ID NO: 157473 - DNA, 36 bp, Artificial Sequence
  Synthetic oligonucleotide
tgcatgtcaatggcttgccgggtccgtctctctcaa

SEQ ID NO: 157474 - DNA, 34 bp, Artificial Sequence
  Synthetic oligonucleotide
tccgaacccgccttgaccccaaactgatattcaa

SEQ ID NO: 157475 - DNA, 36 bp, Artificial Sequence
  Synthetic oligonucleotide
atgacgcagagggaggggggtcggattaggagagaa

SEQ ID NO: 157476 - DNA, 36 bp, Artificial Sequence
  Synthetic oligonucleotide
tacgtagcgcgtgggagggggcgagggacggaataa

SEQ ID NO: 157477 - DNA, 36 bp, Artificial Sequence
  Synthetic oligonucleotide
tccccgccccttccctgttgcctgtacgtatgcaca

SEQ ID NO: 157478 - DNA, 36 bp, Artificial Sequence
  Synthetic oligonucleotide
tccgacttgccccactacacgtttagttatgcccca

SEQ ID NO: 157479 - DNA, 35 bp, Artificial Sequence
  Synthetic oligonucleotide
tgaatgcttcaccgtatcgccccgtttcatgccca

SEQ ID NO: 157480 - DNA, 36 bp, Artificial Sequence
  Synthetic oligonucleotide
tacgccccttagcccccgtcctggttccggactcca

SEQ ID NO: 157481 - DNA, 36 bp, Artificial Sequence
  Synthetic oligonucleotide
atcgcccccagcaccacgtacattttagtccgtcca

SEQ ID NO: 157482 - DNA, 36 bp, Artificial Sequence
  Synthetic oligonucleotide
accatcaccccgtcccaccccggaaccgccgctgca

SEQ ID NO: 157483 - DNA, 36 bp, Artificial Sequence
  Synthetic oligonucleotide
tccctaccctatctgcattagcatactcactgttca

SEQ ID NO: 157484 - DNA, 37 bp, Artificial Sequence
  Synthetic oligonucleotide
tcgctacctcgccgggtttagtacccttccattccga

SEQ ID NO: 157485 - DNA, 37 bp, Artificial Sequence
  Synthetic oligonucleotide
gtgccctcttcagctcttgttcttcgttttcccgcga

SEQ ID NO: 157486 - DNA, 27 bp, Artificial Sequence
  Synthetic oligonucleotide
acatcccccacccaactatgctatcga

SEQ ID NO: 157487 - DNA, 37 bp, Artificial Sequence
  Synthetic oligonucleotide
aacgcggagggtggcctggcagtaaggaggggaggga

SEQ ID NO: 157488 - DNA, 37 bp, Artificial Sequence
  Synthetic oligonucleotide
actcccactgctccacctgaaattacagccatcggga

SEQ ID NO: 157489 - DNA, 37 bp, Artificial Sequence
  Synthetic oligonucleotide
accacgggcggggttgttttttgttggggagagggga

SEQ ID NO: 157490 - DNA, 37 bp, Artificial Sequence
  Synthetic oligonucleotide
gttgggtggggcaacaagtactggggttgttagggga

SEQ ID NO: 157491 - DNA, 36 bp, Artificial Sequence
  Synthetic oligonucleotide
acgggtcggggaaggtggaactagagggggtatgga

SEQ ID NO: 157492 - DNA, 36 bp, Artificial Sequence
  Synthetic oligonucleotide
acgccaacttcaccctcttatccagcgccccttgga

SEQ ID NO: 157493 - DNA, 38 bp, Artificial Sequence
  Synthetic oligonucleotide
gaccaaccgcacctgttgtaaccatcaccttttactga

SEQ ID NO: 157494 - DNA, 35 bp, Artificial Sequence
  Synthetic oligonucleotide
gtttccgcacccggaccaccgcttgacccacctga

SEQ ID NO: 157495 - DNA, 38 bp, Artificial Sequence
  Synthetic oligonucleotide
agccccaccgccaactgtgacacccctgcttaccgtga

SEQ ID NO: 157496 - DNA, 38 bp, Artificial Sequence
  Synthetic oligonucleotide
gaagggaggtgggatgagggaactgtgaaggcgtttga

SEQ ID NO: 157497 - DNA, 35 bp, Artificial Sequence
  Synthetic oligonucleotide
gagggaagacggagggaagcccagggaaacaaata

SEQ ID NO: 157498 - DNA, 36 bp, Artificial Sequence
  Synthetic oligonucleotide
agacactctgcccgcttatcccggttgccctatcta

SEQ ID NO: 157499 - DNA, 36 bp, Artificial Sequence
  Synthetic oligonucleotide
gtacgcctccgctgcactcgcatgaccttggctcta

SEQ ID NO: 157500 - DNA, 36 bp, Artificial Sequence
  Synthetic oligonucleotide
tcattcctgcatcccgattcctcccaccgctgagta

SEQ ID NO: 157501 - DNA, 35 bp, Artificial Sequence
  Synthetic oligonucleotide
acaacacaccccggcccctaagacacgcttgcgta

SEQ ID NO: 157502 - DNA, 36 bp, Artificial Sequence
  Synthetic oligonucleotide
gatcaaccttcacctgcttgccaacgtacctttgta

SEQ ID NO: 157503 - DNA, 36 bp, Artificial Sequence
  Synthetic oligonucleotide
tctgctactttccctgtctccggcctgttgctctta

SEQ ID NO: 157504 - DNA, 35 bp, Artificial Sequence
  Synthetic oligonucleotide
tcagcccgtcaccaaagctccgtggccccatgcac

SEQ ID NO: 157505 - DNA, 35 bp, Artificial Sequence
  Synthetic oligonucleotide
gcacaacttccgcccaccccccccagcgagcgtac

SEQ ID NO: 157506 - DNA, 35 bp, Artificial Sequence
  Synthetic oligonucleotide
tctccccccccacctgctcaacttgattacggtac

SEQ ID NO: 157507 - DNA, 35 bp, Artificial Sequence
  Synthetic oligonucleotide
gccacatcgctttgactatcctatgcatcgctacc

SEQ ID NO: 157508 - DNA, 35 bp, Artificial Sequence
  Synthetic oligonucleotide
tgtatgccagcccccggagtagaccgccgtgcccc

SEQ ID NO: 157509 - DNA, 34 bp, Artificial Sequence
  Synthetic oligonucleotide
tccgacccttataggctgttgactcggccctccc

SEQ ID NO: 157510 - DNA, 35 bp, Artificial Sequence
  Synthetic oligonucleotide
ttcgagcgcatgttctcttgttcctctttacggcc

SEQ ID NO: 157511 - DNA, 35 bp, Artificial Sequence
  Synthetic oligonucleotide
gtggaccccgaccaattcgctcgcttattacatcc

SEQ ID NO: 157512 - DNA, 35 bp, Artificial Sequence
  Synthetic oligonucleotide
ttcacctcctgttgtctctgtcccgtgctatctcc

SEQ ID NO: 157513 - DNA, 35 bp, Artificial Sequence
  Synthetic oligonucleotide
accccaatcgtttatgctgcactttcttgctctcc

SEQ ID NO: 157514 - DNA, 35 bp, Artificial Sequence
  Synthetic oligonucleotide
tcactgctttcactcgccttaagtcctgaaattcc

SEQ ID NO: 157515 - DNA, 35 bp, Artificial Sequence
  Synthetic oligonucleotide
gaacgcctctcgccgctggtgacgccgaaatttcc

SEQ ID NO: 157516 - DNA, 35 bp, Artificial Sequence
  Synthetic oligonucleotide
acaccgcagttgtcccgtacactaaataccgccgc

SEQ ID NO: 157517 - DNA, 35 bp, Artificial Sequence
  Synthetic oligonucleotide
tcccccctcccaaatttctcaccgtgttgtttcgc

SEQ ID NO: 157518 - DNA, 35 bp, Artificial Sequence
  Synthetic oligonucleotide
ttaagcaactcgattgctctgctcctctctctggc

SEQ ID NO: 157519 - DNA, 35 bp, Artificial Sequence
  Synthetic oligonucleotide
tcccggtccccggccgccgttcgcctcatctatgc

SEQ ID NO: 157520 - DNA, 35 bp, Artificial Sequence
  Synthetic oligonucleotide
tcatgcattgcgttgattccttgcacctcacctgc

SEQ ID NO: 157521 - DNA, 35 bp, Artificial Sequence
  Synthetic oligonucleotide
gtcccctgccagggatactcataatacaagccctc

SEQ ID NO: 157522 - DNA, 35 bp, Artificial Sequence
  Synthetic oligonucleotide
ttagtgccgtcggtccattcttgtcctgtcctctc

SEQ ID NO: 157523 - DNA, 35 bp, Artificial Sequence
  Synthetic oligonucleotide
ggggacacgcgcaggggtcgcatgggtggggagtc

SEQ ID NO: 157524 - DNA, 35 bp, Artificial Sequence
  Synthetic oligonucleotide
acccaacttcggacttgctccggcatacccacttc

SEQ ID NO: 157525 - DNA, 35 bp, Artificial Sequence
  Synthetic oligonucleotide
gttgcgcggcttataggtctgctttcctctcgttc

SEQ ID NO: 157526 - DNA, 35 bp, Artificial Sequence
  Synthetic oligonucleotide
gtcctgagcctccgtacttgagcgatccattgttc

SEQ ID NO: 157527 - DNA, 35 bp, Artificial Sequence
  Synthetic oligonucleotide
gcgcttagccggtgagggtgggagggatatgcgag

SEQ ID NO: 157528 - DNA, 35 bp, Artificial Sequence
  Synthetic oligonucleotide
tagacccgcccacgctatgcgatagcccctagacg

SEQ ID NO: 157529 - DNA, 35 bp, Artificial Sequence
  Synthetic oligonucleotide
ggcaaccacccgctatcttcagtcctcctgtcctg

SEQ ID NO: 157530 - DNA, 35 bp, Artificial Sequence
  Synthetic oligonucleotide
tcccccgctcagtcctacttgcgttctgctttttg

SEQ ID NO: 157531 - DNA, 35 bp, Artificial Sequence
  Synthetic oligonucleotide
ggtccggtatctgcacctcctatcccgcctgtact

SEQ ID NO: 157532 - DNA, 35 bp, Artificial Sequence
  Synthetic oligonucleotide
gtagccacgtctcccgccatccgtttctgttgcct

SEQ ID NO: 157533 - DNA, 35 bp, Artificial Sequence
  Synthetic oligonucleotide
gccgcacgactcacgcatacccctaacacccttct

SEQ ID NO: 157534 - DNA, 35 bp, Artificial Sequence
  Synthetic oligonucleotide
gccaagccgctgctcacgcctgtcattgtctttct

SEQ ID NO: 157535 - DNA, 35 bp, Artificial Sequence
  Synthetic oligonucleotide
gcatcctctgcctggcgccccccctgcttttttct

SEQ ID NO: 157536 - DNA, 35 bp, Artificial Sequence
  Synthetic oligonucleotide
tccgtaacctgctctactctccacctccgactggt

SEQ ID NO: 157537 - DNA, 35 bp, Artificial Sequence
  Synthetic oligonucleotide
ggtgggtggatgggaatgggaggagcatcgtgtgt

SEQ ID NO: 157538 - DNA, 35 bp, Artificial Sequence
  Synthetic oligonucleotide
gcccccctagctttgttttgatcgtcgaaccttgt

SEQ ID NO: 157539 - DNA, 35 bp, Artificial Sequence
  Synthetic oligonucleotide
tcttccgttccaccgtccgctaggtactactgctt

SEQ ID NO: 157540 - DNA, 35 bp, Artificial Sequence
  Synthetic oligonucleotide
tttgcccgcccttccatgtacgtagtggaaccttt

SEQ ID NO: 157541 - DNA, 35 bp, Artificial Sequence
  Synthetic oligonucleotide
gaacgcagaaagaaaaggaataacggagggcgcaa

SEQ ID NO: 157542 - DNA, 35 bp, Artificial Sequence
  Synthetic oligonucleotide
gcgaagtgggtacggggtgggatagggcgggggaa

SEQ ID NO: 157543 - DNA, 36 bp, Artificial Sequence
  Synthetic oligonucleotide
tgccaaccactcccgggtgctctctcgcttgcccca

SEQ ID NO: 157544 - DNA, 35 bp, Artificial Sequence
  Synthetic oligonucleotide
tgatcgactcgcccactaaccgccagacttcgcca

SEQ ID NO: 157545 - DNA, 35 bp, Artificial Sequence
  Synthetic oligonucleotide
aatacccgcactcgtaccgcagccatacctctcca

SEQ ID NO: 157546 - DNA, 36 bp, Artificial Sequence
  Synthetic oligonucleotide
accaccgccattccccaaagcgcttgtgactccgca

SEQ ID NO: 157547 - DNA, 36 bp, Artificial Sequence
  Synthetic oligonucleotide
gctccaacgcccagccctcgttctcgtacggactca

SEQ ID NO: 157548 - DNA, 35 bp, Artificial Sequence
  Synthetic oligonucleotide
tcaccaccgcgatgtgaccggtgccccgtccttca

SEQ ID NO: 157549 - DNA, 36 bp, Artificial Sequence
  Synthetic oligonucleotide
tgcccgtccgccttcccgtaatagtttcttgtcaga

SEQ ID NO: 157550 - DNA, 35 bp, Artificial Sequence
  Synthetic oligonucleotide
gagtcgtgggaaggtgccggtggagggggcggaga

SEQ ID NO: 157551 - DNA, 35 bp, Artificial Sequence
  Synthetic oligonucleotide
ggtaacaagaatagaggggagggactagggggaga

SEQ ID NO: 157552 - DNA, 37 bp, Artificial Sequence
  Synthetic oligonucleotide
gtgatcgcaggtcactgactcaccccgccttacccga

SEQ ID NO: 157553 - DNA, 37 bp, Artificial Sequence
  Synthetic oligonucleotide
gtcgccgcttcctcctggcttccgtatttgcccccga

SEQ ID NO: 157554 - DNA, 36 bp, Artificial Sequence
  Synthetic oligonucleotide
gccctcacttgagtttcgctgacacccacctcccga

SEQ ID NO: 157555 - DNA, 37 bp, Artificial Sequence
  Synthetic oligonucleotide
tccgcccaccagtagtgctatcccctgtgcctatcga

SEQ ID NO: 157556 - DNA, 37 bp, Artificial Sequence
  Synthetic oligonucleotide
tctgtcctcacctgttgccatggaaatcaccactcga

SEQ ID NO: 157557 - DNA, 38 bp, Artificial Sequence
  Synthetic oligonucleotide
gattccaccattagtctttcttgccaggtctccaatga

SEQ ID NO: 157558 - DNA, 37 bp, Artificial Sequence
  Synthetic oligonucleotide
aacggaagggtgggtggggtatgtaggggtgacctga

SEQ ID NO: 157559 - DNA, 38 bp, Artificial Sequence
  Synthetic oligonucleotide
attagcccgacacatactgcctcaccgccttccgctga

SEQ ID NO: 157560 - DNA, 37 bp, Artificial Sequence
  Synthetic oligonucleotide
ttgcggtgcaaggctagggggggaggaaagagtctga

SEQ ID NO: 157561 - DNA, 37 bp, Artificial Sequence
  Synthetic oligonucleotide
tgagtgtaaaagtgggtggagagaggtgagaacgtga

SEQ ID NO: 157562 - DNA, 38 bp, Artificial Sequence
  Synthetic oligonucleotide
gatcgccccctcgcccgtacgctctataccagtcgtga

SEQ ID NO: 157563 - DNA, 38 bp, Artificial Sequence
  Synthetic oligonucleotide
taagtaacgaagggggttatgggagggtggggaggtga

SEQ ID NO: 157564 - DNA, 38 bp, Artificial Sequence
  Synthetic oligonucleotide
taatgcgcactgtcccgtttacgcccccccgcctgtga

SEQ ID NO: 157565 - DNA, 38 bp, Artificial Sequence
  Synthetic oligonucleotide
tgcccgttcttcagcctcatgagccccccctgccttga

SEQ ID NO: 157566 - DNA, 36 bp, Artificial Sequence
  Synthetic oligonucleotide
tccctcgcccccacgataccgaagggtgacttacta

SEQ ID NO: 157567 - DNA, 36 bp, Artificial Sequence
  Synthetic oligonucleotide
taccccgttcctgttcagtctcgcagcatgccccta

SEQ ID NO: 157568 - DNA, 36 bp, Artificial Sequence
  Synthetic oligonucleotide
tccacatgccgtcctccttttgcgtccctcagccta

SEQ ID NO: 157569 - DNA, 31 bp, Artificial Sequence
  Synthetic oligonucleotide
gcaccttgcccgctgcctgttccacaacgta

SEQ ID NO: 157570 - DNA, 36 bp, Artificial Sequence
  Synthetic oligonucleotide
gggtgtggaggtgggagggtgttaggggggtcggta

SEQ ID NO: 157571 - DNA, 35 bp, Artificial Sequence
  Synthetic oligonucleotide
ccctgtgccaccccttgaccgcgcctaagagatta

SEQ ID NO: 157572 - DNA, 35 bp, Artificial Sequence
  Synthetic oligonucleotide
atggcgtagcacacgcgcgcccctgtcccttgaac

SEQ ID NO: 157573 - DNA, 35 bp, Artificial Sequence
  Synthetic oligonucleotide
gaggtttgcctgtcacatctgttccgcctcactac

SEQ ID NO: 157574 - DNA, 35 bp, Artificial Sequence
  Synthetic oligonucleotide
acactcacttcattttgccgtacttacgttcctac

SEQ ID NO: 157575 - DNA, 35 bp, Artificial Sequence
  Synthetic oligonucleotide
atggaggagcccatcgttcgcccactgtttgcacc

SEQ ID NO: 157576 - DNA, 35 bp, Artificial Sequence
  Synthetic oligonucleotide
tgaacaccccctctcttgtgcccatcccacggacc

SEQ ID NO: 157577 - DNA, 35 bp, Artificial Sequence
  Synthetic oligonucleotide
tcccgcccccccagctagatttacgctcctgcccc

SEQ ID NO: 157578 - DNA, 35 bp, Artificial Sequence
  Synthetic oligonucleotide
accgacgtctgaactccgttaggcccctaccgccc

SEQ ID NO: 157579 - DNA, 35 bp, Artificial Sequence
  Synthetic oligonucleotide
gccagtgccggtaattaatgcccgtgccctatgcc

SEQ ID NO: 157580 - DNA, 35 bp, Artificial Sequence
  Synthetic oligonucleotide
tagggcactcccatgtcactgccccccactctgcc

SEQ ID NO: 157581 - DNA, 35 bp, Artificial Sequence
  Synthetic oligonucleotide
gtcagatctgtgttccgtcccaagccatccgctcc

SEQ ID NO: 157582 - DNA, 35 bp, Artificial Sequence
  Synthetic oligonucleotide
tacgcaccccccgcgctgctccttacgttgtcatc

SEQ ID NO: 157583 - DNA, 35 bp, Artificial Sequence
  Synthetic oligonucleotide
acaacatccaccgcctccaggaggcataggcactc

SEQ ID NO: 157584 - DNA, 35 bp, Artificial Sequence
  Synthetic oligonucleotide
agagcctcctgtccttggtctcgcaactattactc

SEQ ID NO: 157585 - DNA, 35 bp, Artificial Sequence
  Synthetic oligonucleotide
tgcgtatcccgcttgttcgttaacataactccctc

SEQ ID NO: 157586 - DNA, 35 bp, Artificial Sequence
  Synthetic oligonucleotide
gcctccttggccgttattaatgctgtcgctccctc

SEQ ID NO: 157587 - DNA, 35 bp, Artificial Sequence
  Synthetic oligonucleotide
tatggtccggaccgcctcaagctcacacctgcctc

SEQ ID NO: 157588 - DNA, 35 bp, Artificial Sequence
  Synthetic oligonucleotide
tcacccgcctcggccgtttagttactccactgctc

SEQ ID NO: 157589 - DNA, 35 bp, Artificial Sequence
  Synthetic oligonucleotide
actggagcctgtgtgatcctctcgtgccttgtctc

SEQ ID NO: 157590 - DNA, 35 bp, Artificial Sequence
  Synthetic oligonucleotide
accaccgtcccatcctgtatcaccccctatctgtc

SEQ ID NO: 157591 - DNA, 35 bp, Artificial Sequence
  Synthetic oligonucleotide
actcgggcacttcccttatagcctgttgccttgtc

SEQ ID NO: 157592 - DNA, 35 bp, Artificial Sequence
  Synthetic oligonucleotide
gatcgcttacatccgcccatcgtgcttaactattc

SEQ ID NO: 157593 - DNA, 34 bp, Artificial Sequence
  Synthetic oligonucleotide
gcaaccgctattaccttagcttgcagtacccttc

SEQ ID NO: 157594 - DNA, 35 bp, Artificial Sequence
  Synthetic oligonucleotide
ttggcatcccctcacgttcacataccccgggcttc

SEQ ID NO: 157595 - DNA, 35 bp, Artificial Sequence
  Synthetic oligonucleotide
ttacgtgcccgttcatccctccgcttagtactttc

SEQ ID NO: 157596 - DNA, 35 bp, Artificial Sequence
  Synthetic oligonucleotide
tcatcatcaaccgtactaaccctgtccaccgcgcg

SEQ ID NO: 157597 - DNA, 35 bp, Artificial Sequence
  Synthetic oligonucleotide
agctcccgctcagcctcatttttctgtcaccgtcg

SEQ ID NO: 157598 - DNA, 35 bp, Artificial Sequence
  Synthetic oligonucleotide
cagttaccacctcgccagcccgccacaccgttatg

SEQ ID NO: 157599 - DNA, 35 bp, Artificial Sequence
  Synthetic oligonucleotide
aacatggtcggcctccaacgctcgcctctctcgat

SEQ ID NO: 157600 - DNA, 35 bp, Artificial Sequence
  Synthetic oligonucleotide
tgtgcccctgctgcatctgtcttccgtcgttacct

SEQ ID NO: 157601 - DNA, 35 bp, Artificial Sequence
  Synthetic oligonucleotide
gccacccccattcgaaaagtacgcgtgaccgccct

SEQ ID NO: 157602 - DNA, 35 bp, Artificial Sequence
  Synthetic oligonucleotide
ggtgtcccccgtcccaatggttttcttccgatcct

SEQ ID NO: 157603 - DNA, 35 bp, Artificial Sequence
  Synthetic oligonucleotide
accaccttctacaacgtgttagttctcccttggct

SEQ ID NO: 157604 - DNA, 35 bp, Artificial Sequence
  Synthetic oligonucleotide
tcgcgccccattgactccgactcgtgcagttatct

SEQ ID NO: 157605 - DNA, 35 bp, Artificial Sequence
  Synthetic oligonucleotide
atccacccctcgcttgttaagtacgcgctacctct

SEQ ID NO: 157606 - DNA, 35 bp, Artificial Sequence
  Synthetic oligonucleotide
tcatcctccgcccaagctccactgggatttcctct

SEQ ID NO: 157607 - DNA, 35 bp, Artificial Sequence
  Synthetic oligonucleotide
gtggtgggagggcggggcaagtttgaacgagccgt

SEQ ID NO: 157608 - DNA, 35 bp, Artificial Sequence
  Synthetic oligonucleotide
acgcgtcgccgttcgaatccacccttgctctccgt

SEQ ID NO: 157609 - DNA, 34 bp, Artificial Sequence
  Synthetic oligonucleotide
tcccccctgactatccctcctcgctttgtgtatt

SEQ ID NO: 157610 - DNA, 35 bp, Artificial Sequence
  Synthetic oligonucleotide
acctcacgcgcctctccgttgtttcattaactgtt

SEQ ID NO: 157611 - DNA, 36 bp, Artificial Sequence
  Synthetic oligonucleotide
gtcacgcagtcccgacctctcctttcgcgcctcaaa

SEQ ID NO: 157612 - DNA, 36 bp, Artificial Sequence
  Synthetic oligonucleotide
tgcgccccactgacttaccctcttgtgccaacaaca

SEQ ID NO: 157613 - DNA, 36 bp, Artificial Sequence
  Synthetic oligonucleotide
tcgcattccctgtctctctccagtgtccgtgccaca

SEQ ID NO: 157614 - DNA, 36 bp, Artificial Sequence
  Synthetic oligonucleotide
acagccatgccctagtagtgcgttaccgtgctgaca

SEQ ID NO: 157615 - DNA, 36 bp, Artificial Sequence
  Synthetic oligonucleotide
tagggagggaggggaatggtgtcgggtcgcgctaca

SEQ ID NO: 157616 - DNA, 36 bp, Artificial Sequence
  Synthetic oligonucleotide
gaccacccgcccgacgatgaaggtagtccaccccca

SEQ ID NO: 157617 - DNA, 36 bp, Artificial Sequence
  Synthetic oligonucleotide
tcttgacacccgtctccctacgtgctccctggtcca

SEQ ID NO: 157618 - DNA, 35 bp, Artificial Sequence
  Synthetic oligonucleotide
tgcacccgggatcgcccgccttctcgctacgctca

SEQ ID NO: 157619 - DNA, 35 bp, Artificial Sequence
  Synthetic oligonucleotide
tactgtcggatcagttttctcatcgccccctgtca

SEQ ID NO: 157620 - DNA, 36 bp, Artificial Sequence
  Synthetic oligonucleotide
tgagactcctcctgcttcgtatcatccgctaattca

SEQ ID NO: 157621 - DNA, 36 bp, Artificial Sequence
  Synthetic oligonucleotide
aaccggctcgcccttatgatcgttgcccgcccttca

SEQ ID NO: 157622 - DNA, 37 bp, Artificial Sequence
  Synthetic oligonucleotide
gttgggctgggtgggatccgggttatgaccgtataga

SEQ ID NO: 157623 - DNA, 37 bp, Artificial Sequence
  Synthetic oligonucleotide
tgcccacccccttgttctacgcggtttgtctctacga

SEQ ID NO: 157624 - DNA, 37 bp, Artificial Sequence
  Synthetic oligonucleotide
tcgctctcacctgaccctgtttttaaccgcactccga

SEQ ID NO: 157625 - DNA, 37 bp, Artificial Sequence
  Synthetic oligonucleotide
agcccttgacctgctttctcaccgtccgtaacctcga

SEQ ID NO: 157626 - DNA, 37 bp, Artificial Sequence
  Synthetic oligonucleotide
gagaggatgggcgtacggggaatcggggcaaggggga

SEQ ID NO: 157627 - DNA, 37 bp, Artificial Sequence
  Synthetic oligonucleotide
gttgggtgacaggaggcaagggagggatcgagatgga

SEQ ID NO: 157628 - DNA, 37 bp, Artificial Sequence
  Synthetic oligonucleotide
aacagttagacggacgaaggggtggtagggcggtgga

SEQ ID NO: 157629 - DNA, 37 bp, Artificial Sequence
  Synthetic oligonucleotide
aatcgctccatcttgtccgtttcaccctgcccttgga

SEQ ID NO: 157630 - DNA, 38 bp, Artificial Sequence
  Synthetic oligonucleotide
acttatctgcccccagtgatatcgtcacctcctcctga

SEQ ID NO: 157631 - DNA, 38 bp, Artificial Sequence
  Synthetic oligonucleotide
gttacaccacagtcgcgacttcgactgtcctcttttga

SEQ ID NO: 157632 - DNA, 36 bp, Artificial Sequence
  Synthetic oligonucleotide
gctatgcactcctccaatgcgcacttgctcttacta

SEQ ID NO: 157633 - DNA, 35 bp, Artificial Sequence
  Synthetic oligonucleotide
tcccacaacatctcgccattggattcaccactcta

SEQ ID NO: 157634 - DNA, 36 bp, Artificial Sequence
  Synthetic oligonucleotide
tgccaacctgatttgctgtcgtagtcctcttctcta

SEQ ID NO: 157635 - DNA, 36 bp, Artificial Sequence
  Synthetic oligonucleotide
actacgcaccccgttatgcccggccccatcttcgta

SEQ ID NO: 157636 - DNA, 35 bp, Artificial Sequence
  Synthetic oligonucleotide
tctgcacggacgcggggtgtttgggtggggtggta

SEQ ID NO: 157637 - DNA, 36 bp, Artificial Sequence
  Synthetic oligonucleotide
gcgtacgggtcgggaaaggagggtgggatcatgtta

SEQ ID NO: 157638 - DNA, 35 bp, Artificial Sequence
  Synthetic oligonucleotide
tccgcgcatccccttctgaccagtctcgtaccaac

SEQ ID NO: 157639 - DNA, 35 bp, Artificial Sequence
  Synthetic oligonucleotide
tatggactcgggctgtctccttggttccgttacac

SEQ ID NO: 157640 - DNA, 35 bp, Artificial Sequence
  Synthetic oligonucleotide
tcgtacgatccacctaataccgccagacccgcccc

SEQ ID NO: 157641 - DNA, 35 bp, Artificial Sequence
  Synthetic oligonucleotide
gtgtggcccatctcgactcatctgctggccttccc

SEQ ID NO: 157642 - DNA, 35 bp, Artificial Sequence
  Synthetic oligonucleotide
gcgctacctcactgctttccaatatcattcgggcc

SEQ ID NO: 157643 - DNA, 35 bp, Artificial Sequence
  Synthetic oligonucleotide
gtggccagttcagcccgaatatgccctctcatgcc

SEQ ID NO: 157644 - DNA, 35 bp, Artificial Sequence
  Synthetic oligonucleotide
gccgaactgcatgcagccccggttcttttattgcc

SEQ ID NO: 157645 - DNA, 35 bp, Artificial Sequence
  Synthetic oligonucleotide
tcctgcacacctctagccgtatacgttccccgtcc

SEQ ID NO: 157646 - DNA, 35 bp, Artificial Sequence
  Synthetic oligonucleotide
gcaccgcaccttgctctactactgagttacctagc

SEQ ID NO: 157647 - DNA, 35 bp, Artificial Sequence
  Synthetic oligonucleotide
tgaccacgatacccatacgtgatatttcatccatc

SEQ ID NO: 157648 - DNA, 35 bp, Artificial Sequence
  Synthetic oligonucleotide
gatacccgcaccgccagcttttatcctctccgatc

SEQ ID NO: 157649 - DNA, 35 bp, Artificial Sequence
  Synthetic oligonucleotide
acccaccgctgttatatcgtatgtctactcttatc

SEQ ID NO: 157650 - DNA, 35 bp, Artificial Sequence
  Synthetic oligonucleotide
acctgcgaacgttcccgaattgactctgacctctc

SEQ ID NO: 157651 - DNA, 35 bp, Artificial Sequence
  Synthetic oligonucleotide
gcggttagccccagcctgaaccactatgccctctc

SEQ ID NO: 157652 - DNA, 35 bp, Artificial Sequence
  Synthetic oligonucleotide
acacgccgcgccccttaccttgatccgctgaagtc

SEQ ID NO: 157653 - DNA, 35 bp, Artificial Sequence
  Synthetic oligonucleotide
gaagagtaagtggggcgggggaaatggcgtacgtc

SEQ ID NO: 157654 - DNA, 35 bp, Artificial Sequence
  Synthetic oligonucleotide
ttcaccccccgcctgtccgtcaacaccctggattc

SEQ ID NO: 157655 - DNA, 35 bp, Artificial Sequence
  Synthetic oligonucleotide
gcacgcgccccatcctccctggtccatacgctttc

SEQ ID NO: 157656 - DNA, 35 bp, Artificial Sequence
  Synthetic oligonucleotide
ttggcctttgcctctattgaccaccctcgtccccg

SEQ ID NO: 157657 - DNA, 35 bp, Artificial Sequence
  Synthetic oligonucleotide
tcccttgtcccccgtagcataacgtactttattcg

SEQ ID NO: 157658 - DNA, 35 bp, Artificial Sequence
  Synthetic oligonucleotide
aacgacactgcgaatgtgtagggggggggataggg

SEQ ID NO: 157659 - DNA, 35 bp, Artificial Sequence
  Synthetic oligonucleotide
gacgaatccagtgtcactgccgcccgtaacctctg

SEQ ID NO: 157660 - DNA, 35 bp, Artificial Sequence
  Synthetic oligonucleotide
atgacccgcatcaccgaaccctcttgaccctattg

SEQ ID NO: 157661 - DNA, 35 bp, Artificial Sequence
  Synthetic oligonucleotide
acctacccgccgtcttctctggccgaatttccttg

SEQ ID NO: 157662 - DNA, 35 bp, Artificial Sequence
  Synthetic oligonucleotide
accgctccttccgcttggaactgctccttgtcctt

SEQ ID NO: 157663 - DNA, 36 bp, Artificial Sequence
  Synthetic oligonucleotide
acccttgcatacgatcgtcgccccagcccgcccaaa

SEQ ID NO: 157664 - DNA, 35 bp, Artificial Sequence
  Synthetic oligonucleotide
gcctctcccctgtgatttttgctcccgctttgtaa

SEQ ID NO: 157665 - DNA, 35 bp, Artificial Sequence
  Synthetic oligonucleotide
gaccacgtgtcttgccccagctgcatttcaccaca

SEQ ID NO: 157666 - DNA, 36 bp, Artificial Sequence
  Synthetic oligonucleotide
atggtgcccatccttctctaacgttcagtctttaca

SEQ ID NO: 157667 - DNA, 36 bp, Artificial Sequence
  Synthetic oligonucleotide
gtccaccgccacattttaaaatgctcgttaccacca

SEQ ID NO: 157668 - DNA, 35 bp, Artificial Sequence
  Synthetic oligonucleotide
tacctcaacatcgggctgaaatgactcgcccacca

SEQ ID NO: 157669 - DNA, 35 bp, Artificial Sequence
  Synthetic oligonucleotide
tgccccccctgtaaatatcgtccgtaggctaccca

SEQ ID NO: 157670 - DNA, 36 bp, Artificial Sequence
  Synthetic oligonucleotide
ggtcatcctcccatcctctcgctagacgtctcgcca

SEQ ID NO: 157671 - DNA, 36 bp, Artificial Sequence
  Synthetic oligonucleotide
tgtccacgtactcatcctctgcaccatgagcctcca

SEQ ID NO: 157672 - DNA, 36 bp, Artificial Sequence
  Synthetic oligonucleotide
tacctagccacgatctatattcttggtccttctcca

SEQ ID NO: 157673 - DNA, 35 bp, Artificial Sequence
  Synthetic oligonucleotide
acacgttccatcctacacctctacgccatgttgca

SEQ ID NO: 157674 - DNA, 36 bp, Artificial Sequence
  Synthetic oligonucleotide
tacgctcagcgtaagcgttttctatcgtctctctca

SEQ ID NO: 157675 - DNA, 37 bp, Artificial Sequence
  Synthetic oligonucleotide
accttcgcattgctgcttacaaacccttcctacacga

SEQ ID NO: 157676 - DNA, 36 bp, Artificial Sequence
  Synthetic oligonucleotide
gagctagtcgggtgaggagggtgggtgttgctacga

SEQ ID NO: 157677 - DNA, 37 bp, Artificial Sequence
  Synthetic oligonucleotide
ttcaacgcagctttccctgaacccggctcaccaccga

SEQ ID NO: 157678 - DNA, 36 bp, Artificial Sequence
  Synthetic oligonucleotide
gtccccttccgtggcgttacttcaggcctctcccga

SEQ ID NO: 157679 - DNA, 37 bp, Artificial Sequence
  Synthetic oligonucleotide
gccctcttcccaatgctgcctcgccggtcctggccga

SEQ ID NO: 157680 - DNA, 37 bp, Artificial Sequence
  Synthetic oligonucleotide
actactcgtcgcccacgatcccgccttcgccccgcga

SEQ ID NO: 157681 - DNA, 37 bp, Artificial Sequence
  Synthetic oligonucleotide
tggggggagggtgggaggaggcattaaggtctcgcga

SEQ ID NO: 157682 - DNA, 37 bp, Artificial Sequence
  Synthetic oligonucleotide
tgttcctcctgacccccactgttcgacgttcgtgcga

SEQ ID NO: 157683 - DNA, 36 bp, Artificial Sequence
  Synthetic oligonucleotide
tagccgcatacagatctgcgcccctaaccccctcga

SEQ ID NO: 157684 - DNA, 37 bp, Artificial Sequence
  Synthetic oligonucleotide
acagtccgcaccgccggctacatcgtttcattccgga

SEQ ID NO: 157685 - DNA, 36 bp, Artificial Sequence
  Synthetic oligonucleotide
agtggggggggtggaccaaagttgacgtggtgcgga

SEQ ID NO: 157686 - DNA, 37 bp, Artificial Sequence
  Synthetic oligonucleotide
taggttaggggaggggagtatcggggccggaacggga

SEQ ID NO: 157687 - DNA, 38 bp, Artificial Sequence
  Synthetic oligonucleotide
tgcaccctccatggaatcatctccactctttaacatga

SEQ ID NO: 157688 - DNA, 37 bp, Artificial Sequence
  Synthetic oligonucleotide
atcttccgccacccgtgttatggctccatcccgctga

SEQ ID NO: 157689 - DNA, 35 bp, Artificial Sequence
  Synthetic oligonucleotide
tagtcatgtcccgtccctcttgcgttcgtctctga

SEQ ID NO: 157690 - DNA, 38 bp, Artificial Sequence
  Synthetic oligonucleotide
tgacacccatcccgatgtagttccccgctctcttctga

SEQ ID NO: 157691 - DNA, 38 bp, Artificial Sequence
  Synthetic oligonucleotide
tagacaccgtcccatttctttagttcctcttgccgtga

SEQ ID NO: 157692 - DNA, 37 bp, Artificial Sequence
  Synthetic oligonucleotide
gaatacccgcccccgtgacagctacagatcgaattga

SEQ ID NO: 157693 - DNA, 36 bp, Artificial Sequence
  Synthetic oligonucleotide
aacagtgcctgggggcgggagaaagggcggatttga

SEQ ID NO: 157694 - DNA, 36 bp, Artificial Sequence
  Synthetic oligonucleotide
gaagacatgggcggtgggtggaatggcgggcgcata

SEQ ID NO: 157695 - DNA, 35 bp, Artificial Sequence
  Synthetic oligonucleotide
gtagatcgccattgctccacctcttcctgtgccta

SEQ ID NO: 157696 - DNA, 36 bp, Artificial Sequence
  Synthetic oligonucleotide
cctcacccctcgtgcgttctctgaccccgcctccta

SEQ ID NO: 157697 - DNA, 36 bp, Artificial Sequence
  Synthetic oligonucleotide
taggggcgggctggaagacgagagggaaggcacgta

SEQ ID NO: 157698 - DNA, 36 bp, Artificial Sequence
  Synthetic oligonucleotide
gacgagtgccgggtggtaaaggcaatggatggcgta

SEQ ID NO: 157699 - DNA, 36 bp, Artificial Sequence
  Synthetic oligonucleotide
acttaccccgcctcattgttcccctaaggttcggta

SEQ ID NO: 157700 - DNA, 36 bp, Artificial Sequence
  Synthetic oligonucleotide
acgtccccccggcgttggcctcacactcgcccttta

SEQ ID NO: 157701 - DNA, 35 bp, Artificial Sequence
  Synthetic oligonucleotide
gatccactcgtccatagtcctgttttgcgcaatac

SEQ ID NO: 157702 - DNA, 35 bp, Artificial Sequence
  Synthetic oligonucleotide
gcgatagcctcattacatctcctcccgtctacacc

SEQ ID NO: 157703 - DNA, 35 bp, Artificial Sequence
  Synthetic oligonucleotide
gacgacctcgaagcgtaagcacctccctctacccc

SEQ ID NO: 157704 - DNA, 35 bp, Artificial Sequence
  Synthetic oligonucleotide
gttggccacctttcctgcgacgagcccatgtcccc

SEQ ID NO: 157705 - DNA, 35 bp, Artificial Sequence
  Synthetic oligonucleotide
acaccctggtcatccttccgcaacacgcaacgccc

SEQ ID NO: 157706 - DNA, 35 bp, Artificial Sequence
  Synthetic oligonucleotide
gaaacccgcgtaacgtgtccgtcatcatcctgccc

SEQ ID NO: 157707 - DNA, 35 bp, Artificial Sequence
  Synthetic oligonucleotide
tcttacaccgggcctgatacgccgaatgctctccc

SEQ ID NO: 157708 - DNA, 35 bp, Artificial Sequence
  Synthetic oligonucleotide
gtcgcctgtcgctgattatgcgctctattggtccc

SEQ ID NO: 157709 - DNA, 35 bp, Artificial Sequence
  Synthetic oligonucleotide
aactcgtcccaattgtctccgctctgattgccgcc

SEQ ID NO: 157710 - DNA, 35 bp, Artificial Sequence
  Synthetic oligonucleotide
tatgccgtccttggtgccctatcacaagttccgcc

SEQ ID NO: 157711 - DNA, 35 bp, Artificial Sequence
  Synthetic oligonucleotide
aagggaagtgccgcccgccccctcgatttctacgc

SEQ ID NO: 157712 - DNA, 35 bp, Artificial Sequence
  Synthetic oligonucleotide
gcgatcgcaagcttacatctgctctttggtttcgc

SEQ ID NO: 157713 - DNA, 35 bp, Artificial Sequence
  Synthetic oligonucleotide
acgctgcccacgtgacccaccgccgcccgccctgc

SEQ ID NO: 157714 - DNA, 35 bp, Artificial Sequence
  Synthetic oligonucleotide
tcctcaccccccttatggtcattctgggcctttgc

SEQ ID NO: 157715 - DNA, 35 bp, Artificial Sequence
  Synthetic oligonucleotide
agcagacagtaggggagggtgggcgtggtataatc

SEQ ID NO: 157716 - DNA, 35 bp, Artificial Sequence
  Synthetic oligonucleotide
accttccatgcccgagaactgcctcactccggatc

SEQ ID NO: 157717 - DNA, 35 bp, Artificial Sequence
  Synthetic oligonucleotide
tgcgaagtgatagccgtttgccgcccgtatttatc

SEQ ID NO: 157718 - DNA, 35 bp, Artificial Sequence
  Synthetic oligonucleotide
gttgcccaccggaccgtctcggaaaacctgccctc

SEQ ID NO: 157719 - DNA, 35 bp, Artificial Sequence
  Synthetic oligonucleotide
ttctgccacatgtacttacgcctaccacatgcctc

SEQ ID NO: 157720 - DNA, 35 bp, Artificial Sequence
  Synthetic oligonucleotide
tcccatgctcacgcactcgcattccggtaccgctc

SEQ ID NO: 157721 - DNA, 35 bp, Artificial Sequence
  Synthetic oligonucleotide
gggtgccttacactgtttctgcctttcaccggttc

SEQ ID NO: 157722 - DNA, 36 bp, Artificial Sequence
  Synthetic oligonucleotide
tgctgagcccttgtgtcccccatcgtatcttctttc

SEQ ID NO: 157723 - DNA, 35 bp, Artificial Sequence
  Synthetic oligonucleotide
gagcaatagaaagggcggagaggggctagcattag

SEQ ID NO: 157724 - DNA, 35 bp, Artificial Sequence
  Synthetic oligonucleotide
tgtaccctccacagcccgttggttcaatcaccccg

SEQ ID NO: 157725 - DNA, 35 bp, Artificial Sequence
  Synthetic oligonucleotide
atgtgtgtgcactcgtgggggggacgggaggtgcg

SEQ ID NO: 157726 - DNA, 35 bp, Artificial Sequence
  Synthetic oligonucleotide
tgtcccactgcctttactcatgtactcccgtactg

SEQ ID NO: 157727 - DNA, 35 bp, Artificial Sequence
  Synthetic oligonucleotide
gccgttcttgcttatgttcctggtcctcatccctg

SEQ ID NO: 157728 - DNA, 35 bp, Artificial Sequence
  Synthetic oligonucleotide
acacgtcactgcaatggtcacccgcttcttccctg

SEQ ID NO: 157729 - DNA, 35 bp, Artificial Sequence
  Synthetic oligonucleotide
tgtagccgtaatgtctagtccactccgcgcaccat

SEQ ID NO: 157730 - DNA, 35 bp, Artificial Sequence
  Synthetic oligonucleotide
agatcactgacagcgcgctagctgctctcgcccat

SEQ ID NO: 157731 - DNA, 35 bp, Artificial Sequence
  Synthetic oligonucleotide
gcgcacctcactcgaactgccgccctgtttctcat

SEQ ID NO: 157732 - DNA, 35 bp, Artificial Sequence
  Synthetic oligonucleotide
gtgccccgcccctgtgaccaccctatgagttaact

SEQ ID NO: 157733 - DNA, 35 bp, Artificial Sequence
  Synthetic oligonucleotide
tacctcgaccgactacggtgactgcacttatccct

SEQ ID NO: 157734 - DNA, 35 bp, Artificial Sequence
  Synthetic oligonucleotide
tagtgccgccaatgcacccggcattcctcgttcct

SEQ ID NO: 157735 - DNA, 35 bp, Artificial Sequence
  Synthetic oligonucleotide
tgtttctcagccccccgtacgtgctttgccccgct

SEQ ID NO: 157736 - DNA, 35 bp, Artificial Sequence
  Synthetic oligonucleotide
gtcaccgttccgctcgtatcaactcttacccggct

SEQ ID NO: 157737 - DNA, 35 bp, Artificial Sequence
  Synthetic oligonucleotide
aacccaccgaagtgctctgttctctcgtctctgct

SEQ ID NO: 157738 - DNA, 35 bp, Artificial Sequence
  Synthetic oligonucleotide
gtttcccaccaaccgccgctgccagcttttgctct

SEQ ID NO: 157739 - DNA, 35 bp, Artificial Sequence
  Synthetic oligonucleotide
gcgaaacgactcgcacgctccctcatgttcgttct

SEQ ID NO: 157740 - DNA, 36 bp, Artificial Sequence
  Synthetic oligonucleotide
atccccgtacctgggttcatatcacgtttcccccaa

SEQ ID NO: 157741 - DNA, 36 bp, Artificial Sequence
  Synthetic oligonucleotide
gaagggcgggtacatggggggaattcaggtcagcaa

SEQ ID NO: 157742 - DNA, 36 bp, Artificial Sequence
  Synthetic oligonucleotide
aaatccacacggacacgggtttgggagggagggcaa

SEQ ID NO: 157743 - DNA, 36 bp, Artificial Sequence
  Synthetic oligonucleotide
tgttcacggccgtttgttcactcccccgtcgctcaa

SEQ ID NO: 157744 - DNA, 36 bp, Artificial Sequence
  Synthetic oligonucleotide
taggaccgcgcacctgggctcaactcatcctctcaa

SEQ ID NO: 157745 - DNA, 36 bp, Artificial Sequence
  Synthetic oligonucleotide
gccctagtgcccgccccccgtagatcacatcacgaa

SEQ ID NO: 157746 - DNA, 36 bp, Artificial Sequence
  Synthetic oligonucleotide
gagaaggggcggtaaataaagggagcaactgaggaa

SEQ ID NO: 157747 - DNA, 35 bp, Artificial Sequence
  Synthetic oligonucleotide
acctccccagtccgctctttttttgctgggaccca

SEQ ID NO: 157748 - DNA, 36 bp, Artificial Sequence
  Synthetic oligonucleotide
gagacaccgcctataacaccttcgaagccgccgcca

SEQ ID NO: 157749 - DNA, 35 bp, Artificial Sequence
  Synthetic oligonucleotide
tgaccgccctttctgtcgaccccaacgtcttgcca

SEQ ID NO: 157750 - DNA, 35 bp, Artificial Sequence
  Synthetic oligonucleotide
gtttacgcctccctcctttgttggtgacttgtcca

SEQ ID NO: 157751 - DNA, 36 bp, Artificial Sequence
  Synthetic oligonucleotide
ggtcacgcctcctgcctcggcttattgatacccgca

SEQ ID NO: 157752 - DNA, 35 bp, Artificial Sequence
  Synthetic oligonucleotide
tatcacggacggctgcgaaaagctacacctcctca

SEQ ID NO: 157753 - DNA, 35 bp, Artificial Sequence
  Synthetic oligonucleotide
gccatctgcagtcccggtctttctcgttacgctca

SEQ ID NO: 157754 - DNA, 35 bp, Artificial Sequence
  Synthetic oligonucleotide
gccccctcgttacgccacgctcgacttccacaaga

SEQ ID NO: 157755 - DNA, 36 bp, Artificial Sequence
  Synthetic oligonucleotide
agtgcgccccgctcttcgtcctgcccctatatacga

SEQ ID NO: 157756 - DNA, 37 bp, Artificial Sequence
  Synthetic oligonucleotide
actacccgttgtcctctgctttattgccgcactccga

SEQ ID NO: 157757 - DNA, 36 bp, Artificial Sequence
  Synthetic oligonucleotide
tcctcccggcctctccgttgcgccctgttcaatcga

SEQ ID NO: 157758 - DNA, 36 bp, Artificial Sequence
  Synthetic oligonucleotide
gtgaaagggcgaggagaggaaacgctgaaataggga

SEQ ID NO: 157759 - DNA, 37 bp, Artificial Sequence
  Synthetic oligonucleotide
gcttacccgccctgcctatggtctattccccacggga

SEQ ID NO: 157760 - DNA, 37 bp, Artificial Sequence
  Synthetic oligonucleotide
gtggatagggcgatgaggaggccgagacggtcgggga

SEQ ID NO: 157761 - DNA, 37 bp, Artificial Sequence
  Synthetic oligonucleotide
gcgatctgtatagatggaaggggaggtgcggggggga

SEQ ID NO: 157762 - DNA, 35 bp, Artificial Sequence
  Synthetic oligonucleotide
tcatccccctagtgcattctgaaccatttcctgga

SEQ ID NO: 157763 - DNA, 36 bp, Artificial Sequence
  Synthetic oligonucleotide
aacccctcacaattggtttggtttcccttccttgga

SEQ ID NO: 157764 - DNA, 38 bp, Artificial Sequence
  Synthetic oligonucleotide
gcgatgggcgggagggagggtcgtggaagtagatatga

SEQ ID NO: 157765 - DNA, 37 bp, Artificial Sequence
  Synthetic oligonucleotide
tcccgaccccctcaccctgcatcaggcgtttctatga

SEQ ID NO: 157766 - DNA, 38 bp, Artificial Sequence
  Synthetic oligonucleotide
atgacatgtcgatggcctccactccctcccgtttatga

SEQ ID NO: 157767 - DNA, 38 bp, Artificial Sequence
  Synthetic oligonucleotide
gtcaagtggggaggacgaacaaaggaagagggaactga

SEQ ID NO: 157768 - DNA, 37 bp, Artificial Sequence
  Synthetic oligonucleotide
gccttggggcgggagggagggaattaagcggcactga

SEQ ID NO: 157769 - DNA, 35 bp, Artificial Sequence
  Synthetic oligonucleotide
ttcccttcatcgccaccgcctcgagcccatactga

SEQ ID NO: 157770 - DNA, 37 bp, Artificial Sequence
  Synthetic oligonucleotide
gcacccacgctcgcgactacgttcttttctgccctga

SEQ ID NO: 157771 - DNA, 38 bp, Artificial Sequence
  Synthetic oligonucleotide
gtgtgtcgccgtctagtacttttacctacctccgctga

SEQ ID NO: 157772 - DNA, 38 bp, Artificial Sequence
  Synthetic oligonucleotide
tcgcatccccgctcactgccttaagctcgcttctctga

SEQ ID NO: 157773 - DNA, 38 bp, Artificial Sequence
  Synthetic oligonucleotide
gtgaggaggaggggccaaggtagtcgggtacgtagtga

SEQ ID NO: 157774 - DNA, 37 bp, Artificial Sequence
  Synthetic oligonucleotide
gcggacgagtccgccgttctttctaacccccccgtga

SEQ ID NO: 157775 - DNA, 38 bp, Artificial Sequence
  Synthetic oligonucleotide
acttcgcatagcagtgtcgtttcgcacctcccctgtga

SEQ ID NO: 157776 - DNA, 38 bp, Artificial Sequence
  Synthetic oligonucleotide
gattcgcattgggggtggcggggtggaggtaggattga

SEQ ID NO: 157777 - DNA, 37 bp, Artificial Sequence
  Synthetic oligonucleotide
accgccggtcctaacataccacgccattcgctcttga

SEQ ID NO: 157778 - DNA, 35 bp, Artificial Sequence
  Synthetic oligonucleotide
gggggtgggcttcgggtagggaatgggaaagttga

SEQ ID NO: 157779 - DNA, 36 bp, Artificial Sequence
  Synthetic oligonucleotide
tcacccgtctacagctacctctaatgccccctttga

SEQ ID NO: 157780 - DNA, 37 bp, Artificial Sequence
  Synthetic oligonucleotide
aataggacagcctcgctccgccccgtacgccctttga

SEQ ID NO: 157781 - DNA, 35 bp, Artificial Sequence
  Synthetic oligonucleotide
gttggaacagtgggggagggaggtgggaactaata

SEQ ID NO: 157782 - DNA, 35 bp, Artificial Sequence
  Synthetic oligonucleotide
ttgacccacatcccccatctggcttgtagagcata

SEQ ID NO: 157783 - DNA, 36 bp, Artificial Sequence
  Synthetic oligonucleotide
ttcagcgcgctcatgcaccacgacctctcatgccta

SEQ ID NO: 157784 - DNA, 35 bp, Artificial Sequence
  Synthetic oligonucleotide
gtctccctctccgtacggtatcacgtggcttttta

SEQ ID NO: 157785 - DNA, 35 bp, Artificial Sequence
  Synthetic oligonucleotide
tagatgtgcacaccgttctcctgcctgtttcctac

SEQ ID NO: 157786 - DNA, 35 bp, Artificial Sequence
  Synthetic oligonucleotide
gtcgcgattgcctccgcctcccggtcttaagcacc

SEQ ID NO: 157787 - DNA, 35 bp, Artificial Sequence
  Synthetic oligonucleotide
tcaccgtgaccgtttactgcctatccgctccgacc

SEQ ID NO: 157788 - DNA, 29 bp, Artificial Sequence
  Synthetic oligonucleotide
gcccccgtcctcgtaagcatatccccccc

SEQ ID NO: 157789 - DNA, 35 bp, Artificial Sequence
  Synthetic oligonucleotide
gagcccggtgcaggtcgcccggttggccttctccc

SEQ ID NO: 157790 - DNA, 35 bp, Artificial Sequence
  Synthetic oligonucleotide
acaactacgcctttgcatacattacctgctgtccc

SEQ ID NO: 157791 - DNA, 35 bp, Artificial Sequence
  Synthetic oligonucleotide
atacgtcacgctgctatcggtgctcctgcctgtcc

SEQ ID NO: 157792 - DNA, 35 bp, Artificial Sequence
  Synthetic oligonucleotide
ggacgtcctacaggctctctcatgtttcaccttcc

SEQ ID NO: 157793 - DNA, 35 bp, Artificial Sequence
  Synthetic oligonucleotide
tctccagacacccccgctgcttacattctctgcgc

SEQ ID NO: 157794 - DNA, 35 bp, Artificial Sequence
  Synthetic oligonucleotide
gccaacctccatctctgtttacgctggcctaactc

SEQ ID NO: 157795 - DNA, 35 bp, Artificial Sequence
  Synthetic oligonucleotide
taccagtccccgtccccacggtatgaacgcgcctc

SEQ ID NO: 157796 - DNA, 35 bp, Artificial Sequence
  Synthetic oligonucleotide
gatcgtcacggcaccctcgtaattacggccctctc

SEQ ID NO: 157797 - DNA, 35 bp, Artificial Sequence
  Synthetic oligonucleotide
acgccttagcgtggcaagcggaaccttcgcccttc

SEQ ID NO: 157798 - DNA, 35 bp, Artificial Sequence
  Synthetic oligonucleotide
gtacgctccccttgcctgctgctccaacttatttc

SEQ ID NO: 157799 - DNA, 35 bp, Artificial Sequence
  Synthetic oligonucleotide
gtcaagaggggagattggaggtgttggtgatggag

SEQ ID NO: 157800 - DNA, 35 bp, Artificial Sequence
  Synthetic oligonucleotide
tcccaccgccccatctttgcatatgcccttccacg

SEQ ID NO: 157801 - DNA, 35 bp, Artificial Sequence
  Synthetic oligonucleotide
gacctcctgccacacatcttccatacgcccctccg

SEQ ID NO: 157802 - DNA, 35 bp, Artificial Sequence
  Synthetic oligonucleotide
atccctgtcgccgcccctcgcctacgcactttgcg

SEQ ID NO: 157803 - DNA, 35 bp, Artificial Sequence
  Synthetic oligonucleotide
gcccgggaggactgacggtttagagggagggcggg

SEQ ID NO: 157804 - DNA, 35 bp, Artificial Sequence
  Synthetic oligonucleotide
accacctccggccgtaaccgagttctattctattg

SEQ ID NO: 157805 - DNA, 35 bp, Artificial Sequence
  Synthetic oligonucleotide
tgtccccactcctcagcgttctttattttccgttg

SEQ ID NO: 157806 - DNA, 34 bp, Artificial Sequence
  Synthetic oligonucleotide
aggggcgggggacacgagcggagggtacggaaat

SEQ ID NO: 157807 - DNA, 35 bp, Artificial Sequence
  Synthetic oligonucleotide
ggtgttggggggaggaaaaacgaggaggagataat

SEQ ID NO: 157808 - DNA, 35 bp, Artificial Sequence
  Synthetic oligonucleotide
agtgtaaccgcgcgcaccacgttagtcttcaccat

SEQ ID NO: 157809 - DNA, 35 bp, Artificial Sequence
  Synthetic oligonucleotide
gtctggccacattcttcatttagagctcttcccat

SEQ ID NO: 157810 - DNA, 35 bp, Artificial Sequence
  Synthetic oligonucleotide
gatcgccgctcaaggctcgaatatgctcccttcat

SEQ ID NO: 157811 - DNA, 35 bp, Artificial Sequence
  Synthetic oligonucleotide
gtcgaggggtggaagtagagtgggctgggggcgat

SEQ ID NO: 157812 - DNA, 35 bp, Artificial Sequence
  Synthetic oligonucleotide
tgcttcaacgcgagtcgtcccactgattctaccct

SEQ ID NO: 157813 - DNA, 35 bp, Artificial Sequence
  Synthetic oligonucleotide
gcacctctctagcctccgttccctttcgcctagct

SEQ ID NO: 157814 - DNA, 35 bp, Artificial Sequence
  Synthetic oligonucleotide
gaccaacactcggtaggggtggaggaaggggggct

SEQ ID NO: 157815 - DNA, 35 bp, Artificial Sequence
  Synthetic oligonucleotide
gcctcgtaccggctgcggtacaatgcccgccctct

SEQ ID NO: 157816 - DNA, 35 bp, Artificial Sequence
  Synthetic oligonucleotide
agacgggtagggggcggggcttgggacggcctagt

SEQ ID NO: 157817 - DNA, 35 bp, Artificial Sequence
  Synthetic oligonucleotide
gcgctgccttcctatccgcccctcgctccgtgggt

SEQ ID NO: 157818 - DNA, 35 bp, Artificial Sequence
  Synthetic oligonucleotide
tgcaagtcgatcttgtccctgtcctgtccgccctt

SEQ ID NO: 157819 - DNA, 35 bp, Artificial Sequence
  Synthetic oligonucleotide
gccacactatcatgcccacgactcagtcccgcgtt

SEQ ID NO: 157820 - DNA, 35 bp, Artificial Sequence
  Synthetic oligonucleotide
agcgcacgctcccgcacattctcagttccgtcgtt

SEQ ID NO: 157821 - DNA, 35 bp, Artificial Sequence
  Synthetic oligonucleotide
tgccgcagggaggaacagaagggtggggggcgaaa

SEQ ID NO: 157822 - DNA, 36 bp, Artificial Sequence
  Synthetic oligonucleotide
gcccgggaggggagggacaacaaccgggttgatcaa

SEQ ID NO: 157823 - DNA, 36 bp, Artificial Sequence
  Synthetic oligonucleotide
gcctcctccccccatgttaaggaacgctgcacctaa

SEQ ID NO: 157824 - DNA, 36 bp, Artificial Sequence
  Synthetic oligonucleotide
acccccccagtccgcctgatctgtactccttgcaca

SEQ ID NO: 157825 - DNA, 36 bp, Artificial Sequence
  Synthetic oligonucleotide
actccgtagtacccgcccatgaccgcccgccggaca

SEQ ID NO: 157826 - DNA, 36 bp, Artificial Sequence
  Synthetic oligonucleotide
tcgccgatcctttggcatatcatacttactgctcca

SEQ ID NO: 157827 - DNA, 36 bp, Artificial Sequence
  Synthetic oligonucleotide
acgtatggaaggaggggctgggctggggggggagca

SEQ ID NO: 157828 - DNA, 35 bp, Artificial Sequence
  Synthetic oligonucleotide
gtgtccgcctgcctcctgcccttgatctttgcgca

SEQ ID NO: 157829 - DNA, 36 bp, Artificial Sequence
  Synthetic oligonucleotide
atctcgcgcacagaatcggttcttttcactccctca

SEQ ID NO: 157830 - DNA, 37 bp, Artificial Sequence
  Synthetic oligonucleotide
tcacacgcactgccccacggttctgccttccaccaga

SEQ ID NO: 157831 - DNA, 37 bp, Artificial Sequence
  Synthetic oligonucleotide
gcgcaggaggtggacgggtttgcgggggggtgtgaga

SEQ ID NO: 157832 - DNA, 36 bp, Artificial Sequence
  Synthetic oligonucleotide
gtatgcctccctcgcagccaagtcgtatccgatcga

SEQ ID NO: 157833 - DNA, 37 bp, Artificial Sequence
  Synthetic oligonucleotide
ttatctgccctgcactctcgttctgtacactcttcga

SEQ ID NO: 157834 - DNA, 37 bp, Artificial Sequence
  Synthetic oligonucleotide
tagcggggggtagggatcgtatggtggggaggtagga

SEQ ID NO: 157835 - DNA, 37 bp, Artificial Sequence
  Synthetic oligonucleotide
ggacacatccatattatcgaacacacccttcaccgga

SEQ ID NO: 157836 - DNA, 37 bp, Artificial Sequence
  Synthetic oligonucleotide
accccgcactgtacattctctgccaacctctccggga

SEQ ID NO: 157837 - DNA, 37 bp, Artificial Sequence
  Synthetic oligonucleotide
tgaacgcatagatctcgtgggcgggggggacgcggga

SEQ ID NO: 157838 - DNA, 37 bp, Artificial Sequence
  Synthetic oligonucleotide
acaacggggggcggggtaatcagcggtgagacgggga

SEQ ID NO: 157839 - DNA, 38 bp, Artificial Sequence
  Synthetic oligonucleotide
tgttgcaccgttcactctgccttcctgctttgctatga

SEQ ID NO: 157840 - DNA, 38 bp, Artificial Sequence
  Synthetic oligonucleotide
gcgactccgaccgctgccactatccgtcagtaccctga

SEQ ID NO: 157841 - DNA, 38 bp, Artificial Sequence
  Synthetic oligonucleotide
tgttaccccgcccacctgaaagtcatcgtgactcctga

SEQ ID NO: 157842 - DNA, 38 bp, Artificial Sequence
  Synthetic oligonucleotide
gtcaccgccccgtcacacccctcccgccaggtagctga

SEQ ID NO: 157843 - DNA, 37 bp, Artificial Sequence
  Synthetic oligonucleotide
ttagcctcgcagacatgtccgtcccccccgtctctga

SEQ ID NO: 157844 - DNA, 38 bp, Artificial Sequence
  Synthetic oligonucleotide
tgctcttcccctccatgccttgtcacagcccaacgtga

SEQ ID NO: 157845 - DNA, 38 bp, Artificial Sequence
  Synthetic oligonucleotide
atcgccgtgggaggaggaagtgggaggggaggttgtga

SEQ ID NO: 157846 - DNA, 38 bp, Artificial Sequence
  Synthetic oligonucleotide
tgtcataccatcacagcgttataaccccagttgattga

SEQ ID NO: 157847 - DNA, 38 bp, Artificial Sequence
  Synthetic oligonucleotide
gcaccgcccctccggttttcacgcactgtatctattga

SEQ ID NO: 157848 - DNA, 38 bp, Artificial Sequence
  Synthetic oligonucleotide
agacatccgccacaacgcccccctatatagacccttga

SEQ ID NO: 157849 - DNA, 38 bp, Artificial Sequence
  Synthetic oligonucleotide
gctcccttccgcttgcttgcctccgttcctgtcgttga

SEQ ID NO: 157850 - DNA, 38 bp, Artificial Sequence
  Synthetic oligonucleotide
tgctcctccgcttgctctacgctctggtccaaatttga

SEQ ID NO: 157851 - DNA, 36 bp, Artificial Sequence
  Synthetic oligonucleotide
gagccgttgcgtgctctaatacccctcctcctttga

SEQ ID NO: 157852 - DNA, 35 bp, Artificial Sequence
  Synthetic oligonucleotide
tccccactccctcttgcaataccgtatctttaata

SEQ ID NO: 157853 - DNA, 35 bp, Artificial Sequence
  Synthetic oligonucleotide
atccgatggcctgaccccccctgcatccgtgccta

SEQ ID NO: 157854 - DNA, 35 bp, Artificial Sequence
  Synthetic oligonucleotide
tccccacatccagctgattatctccgcgctaatta

SEQ ID NO: 157855 - DNA, 35 bp, Artificial Sequence
  Synthetic oligonucleotide
gccagatgcacatgctccccaactacccggcgtta

SEQ ID NO: 157856 - DNA, 35 bp, Artificial Sequence
  Synthetic oligonucleotide
taacaccacattggtccgccacctcccacccgaac

SEQ ID NO: 157857 - DNA, 35 bp, Artificial Sequence
  Synthetic oligonucleotide
gtgcacccactgccgtcctccggagagcttgccac

SEQ ID NO: 157858 - DNA, 35 bp, Artificial Sequence
  Synthetic oligonucleotide
atgtcactccacctctatagtttctgttgcgctac

SEQ ID NO: 157859 - DNA, 35 bp, Artificial Sequence
  Synthetic oligonucleotide
gaccctgatggctgcctgatcccttccctttgtac

SEQ ID NO: 157860 - DNA, 35 bp, Artificial Sequence
  Synthetic oligonucleotide
tgccgcttagggttgttctgcgtcacatctccacc

SEQ ID NO: 157861 - DNA, 35 bp, Artificial Sequence
  Synthetic oligonucleotide
tccatctccgcgattgttgctgcacctcatgcacc

SEQ ID NO: 157862 - DNA, 35 bp, Artificial Sequence
  Synthetic oligonucleotide
gctgcgaccgccgctacaaccttgatgccttcacc

SEQ ID NO: 157863 - DNA, 35 bp, Artificial Sequence
  Synthetic oligonucleotide
gttgctgtccttcctcactttttaagcagcctgcc

SEQ ID NO: 157864 - DNA, 35 bp, Artificial Sequence
  Synthetic oligonucleotide
acgaccacaatcaacccgcgcatcaatcacggtcc

SEQ ID NO: 157865 - DNA, 34 bp, Artificial Sequence
  Synthetic oligonucleotide
gtccgtcatggcgtacttcccactcgtgcgttcc

SEQ ID NO: 157866 - DNA, 35 bp, Artificial Sequence
  Synthetic oligonucleotide
acatgcccactgtaccatctttcgacttaataagc

SEQ ID NO: 157867 - DNA, 35 bp, Artificial Sequence
  Synthetic oligonucleotide
acgcaccgtccggccctatgattatgttcctccgc

SEQ ID NO: 157868 - DNA, 35 bp, Artificial Sequence
  Synthetic oligonucleotide
atctgacctcgctcgtacatatcatccccactggc

SEQ ID NO: 157869 - DNA, 35 bp, Artificial Sequence
  Synthetic oligonucleotide
gtacgcactgttccttaccctgtctaccatcgtgc

SEQ ID NO: 157870 - DNA, 35 bp, Artificial Sequence
  Synthetic oligonucleotide
tcacgcgcattcacttccttcccttttcgccttgc

SEQ ID NO: 157871 - DNA, 35 bp, Artificial Sequence
  Synthetic oligonucleotide
gtcgatcacgccctgatcatatctccctctatatc

SEQ ID NO: 157872 - DNA, 35 bp, Artificial Sequence
  Synthetic oligonucleotide
tccgcactcgctctgccgtttaccccacacccgtc

SEQ ID NO: 157873 - DNA, 35 bp, Artificial Sequence
  Synthetic oligonucleotide
gacttccgcccgtagtattctaacttctgagcttc

SEQ ID NO: 157874 - DNA, 35 bp, Artificial Sequence
  Synthetic oligonucleotide
ttcacctcctgcttactagcacatgatccaggttc

SEQ ID NO: 157875 - DNA, 35 bp, Artificial Sequence
  Synthetic oligonucleotide
gttataaggtgagaggagaggggatagcggggaag

SEQ ID NO: 157876 - DNA, 35 bp, Artificial Sequence
  Synthetic oligonucleotide
tgtggaagggaggagggggagtgggtacttgtaag

SEQ ID NO: 157877 - DNA, 35 bp, Artificial Sequence
  Synthetic oligonucleotide
atcgtaccctccacaagtcccagctttctacaccg

SEQ ID NO: 157878 - DNA, 35 bp, Artificial Sequence
  Synthetic oligonucleotide
tgcaaggctgctgttcgctccccgtccccgtaccg

SEQ ID NO: 157879 - DNA, 35 bp, Artificial Sequence
  Synthetic oligonucleotide
gctcgacactgcaaatgtttggcccaccccccgcg

SEQ ID NO: 157880 - DNA, 35 bp, Artificial Sequence
  Synthetic oligonucleotide
gtgccgttgcaaacgtatgtttccgcctcctcctg

SEQ ID NO: 157881 - DNA, 35 bp, Artificial Sequence
  Synthetic oligonucleotide
accccagccacaagtgccctcaaagtgttttcctg

SEQ ID NO: 157882 - DNA, 35 bp, Artificial Sequence
  Synthetic oligonucleotide
tatgcaccgccccttctcccacggactccctgctg

SEQ ID NO: 157883 - DNA, 35 bp, Artificial Sequence
  Synthetic oligonucleotide
taacaccttccaccatctttcactgcccgcacttg

SEQ ID NO: 157884 - DNA, 35 bp, Artificial Sequence
  Synthetic oligonucleotide
tgcgatgtcaagttctccgtccgcccaactccttg

SEQ ID NO: 157885 - DNA, 34 bp, Artificial Sequence
  Synthetic oligonucleotide
gatcttccccctgtccgcgacattgttcgctaat

SEQ ID NO: 157886 - DNA, 35 bp, Artificial Sequence
  Synthetic oligonucleotide
gccatccctgcccttgctgtcacttgacggctaat

SEQ ID NO: 157887 - DNA, 35 bp, Artificial Sequence
  Synthetic oligonucleotide
acttgcgggggtacggggggatgggctgggtttat

SEQ ID NO: 157888 - DNA, 35 bp, Artificial Sequence
  Synthetic oligonucleotide
tcccactctcccgacattaggtaacctcgcacact

SEQ ID NO: 157889 - DNA, 35 bp, Artificial Sequence
  Synthetic oligonucleotide
gtccgacccgcaccacctaggtaacatttttcact

SEQ ID NO: 157890 - DNA, 35 bp, Artificial Sequence
  Synthetic oligonucleotide
gccgtcatccggttggctccgcatcagtcgcccct

SEQ ID NO: 157891 - DNA, 35 bp, Artificial Sequence
  Synthetic oligonucleotide
tcagtccgcaggcacggtcctagctctacttcgct

SEQ ID NO: 157892 - DNA, 35 bp, Artificial Sequence
  Synthetic oligonucleotide
gcaaatgcgttggtctcgtcgccatcctatctgct

SEQ ID NO: 157893 - DNA, 35 bp, Artificial Sequence
  Synthetic oligonucleotide
gatcccacccgccgactgtctacgcctttcgatct

SEQ ID NO: 157894 - DNA, 35 bp, Artificial Sequence
  Synthetic oligonucleotide
gcgaaggaagagtcgctgctgcccgtcctctctct

SEQ ID NO: 157895 - DNA, 35 bp, Artificial Sequence
  Synthetic oligonucleotide
tcactgtaccgccggtaatggtacaacatccttct

SEQ ID NO: 157896 - DNA, 35 bp, Artificial Sequence
  Synthetic oligonucleotide
tagttccaccccagcggcaatttcatcctccccgt

SEQ ID NO: 157897 - DNA, 34 bp, Artificial Sequence
  Synthetic oligonucleotide
tccccccgtccctactattacgtcaatgcagttt

SEQ ID NO: 157898 - DNA, 36 bp, Artificial Sequence
  Synthetic oligonucleotide
tacctgccgggggggggtaaaatgctgggtagggaa

SEQ ID NO: 157899 - DNA, 36 bp, Artificial Sequence
  Synthetic oligonucleotide
gacccgcccgatttagctatgcgtgcccactttgaa

SEQ ID NO: 157900 - DNA, 36 bp, Artificial Sequence
  Synthetic oligonucleotide
ttccgccccaccgcccggtagactgagcccctttaa

SEQ ID NO: 157901 - DNA, 36 bp, Artificial Sequence
  Synthetic oligonucleotide
tccgaaccatcaggcctgggctattccatcacaaca

SEQ ID NO: 157902 - DNA, 36 bp, Artificial Sequence
  Synthetic oligonucleotide
gagctccgccgttcctgctgtcttaccctcgcgcca

SEQ ID NO: 157903 - DNA, 36 bp, Artificial Sequence
  Synthetic oligonucleotide
ggggcatggacatggggttgcgggggggatgggcca

SEQ ID NO: 157904 - DNA, 35 bp, Artificial Sequence
  Synthetic oligonucleotide
ttcacctccacgcacagggtactcatccaactcca

SEQ ID NO: 157905 - DNA, 36 bp, Artificial Sequence
  Synthetic oligonucleotide
tcacccccacattcacacacgccgcgagttgccgca

SEQ ID NO: 157906 - DNA, 37 bp, Artificial Sequence
  Synthetic oligonucleotide
tgcgcctccactaactttgggcccctcgctcatacga

SEQ ID NO: 157907 - DNA, 37 bp, Artificial Sequence
  Synthetic oligonucleotide
tccctaccgctctgacgcttgaattctaacgccccga

SEQ ID NO: 157908 - DNA, 37 bp, Artificial Sequence
  Synthetic oligonucleotide
atcgccgaccgacttccctcgccttcaagctgtgcga

SEQ ID NO: 157909 - DNA, 37 bp, Artificial Sequence
  Synthetic oligonucleotide
tacgatcgcaagcgttctatactcgccgccccatcga

SEQ ID NO: 157910 - DNA, 35 bp, Artificial Sequence
  Synthetic oligonucleotide
gccccgccacaggcccttgcacctttttttctcga

SEQ ID NO: 157911 - DNA, 36 bp, Artificial Sequence
  Synthetic oligonucleotide
gctcccgaattttatgccacctacccctttgccgga

SEQ ID NO: 157912 - DNA, 36 bp, Artificial Sequence
  Synthetic oligonucleotide
tacgaaggcggcggtggggaggctccgttgggcgga

SEQ ID NO: 157913 - DNA, 37 bp, Artificial Sequence
  Synthetic oligonucleotide
aactgggggcacattgggacaaactatcgggagggga

SEQ ID NO: 157914 - DNA, 37 bp, Artificial Sequence
  Synthetic oligonucleotide
gtaccaccctcactcggtgactgcagttccctgggga

SEQ ID NO: 157915 - DNA, 36 bp, Artificial Sequence
  Synthetic oligonucleotide
tcaggggggaagcgtagtcaacagggcgggttggga

SEQ ID NO: 157916 - DNA, 38 bp, Artificial Sequence
  Synthetic oligonucleotide
acgcatggtcaatcgattatctccaacgcctcccctga

SEQ ID NO: 157917 - DNA, 37 bp, Artificial Sequence
  Synthetic oligonucleotide
gatggtaggggggaaggacgagggagacgacagctga

SEQ ID NO: 157918 - DNA, 36 bp, Artificial Sequence
  Synthetic oligonucleotide
gcatcgcagcacggtgggcaaggggagggaaggtga

SEQ ID NO: 157919 - DNA, 37 bp, Artificial Sequence
  Synthetic oligonucleotide
aaccgacgtgtcggtattatcccctctcttccggtga

SEQ ID NO: 157920 - DNA, 38 bp, Artificial Sequence
  Synthetic oligonucleotide
tgacggagagggaggcggagaggggcggtccagggtga

SEQ ID NO: 157921 - DNA, 37 bp, Artificial Sequence
  Synthetic oligonucleotide
tcagatgccgtagaaagggggggggatgtagttgtga

SEQ ID NO: 157922 - DNA, 38 bp, Artificial Sequence
  Synthetic oligonucleotide
gcaatcatcccagctgtacgaccttagcgctcccttga

SEQ ID NO: 157923 - DNA, 38 bp, Artificial Sequence
  Synthetic oligonucleotide
tcccaccgccttgaccgcacgttaccgcacccctttga

SEQ ID NO: 157924 - DNA, 38 bp, Artificial Sequence
  Synthetic oligonucleotide
gggtggtgaaagggcgggggaggtcaggggccgtttga

SEQ ID NO: 157925 - DNA, 34 bp, Artificial Sequence
  Synthetic oligonucleotide
gacatcgctctttctgcttaaagcctctgcccta

SEQ ID NO: 157926 - DNA, 36 bp, Artificial Sequence
  Synthetic oligonucleotide
atgaccctctgccatcgacggtatcctgtaccctta

SEQ ID NO: 157927 - DNA, 36 bp, Artificial Sequence
  Synthetic oligonucleotide
agccccaccgcctacaatctttgcgaaccatgttta

SEQ ID NO: 157928 - DNA, 35 bp, Artificial Sequence
  Synthetic oligonucleotide
gcccttgctcgcttacatccccgtcctatcggaac

SEQ ID NO: 157929 - DNA, 35 bp, Artificial Sequence
  Synthetic oligonucleotide
acgcaacccgatttgatgttgcgctgttttctacc

SEQ ID NO: 157930 - DNA, 35 bp, Artificial Sequence
  Synthetic oligonucleotide
gcacgctccatccctgcttgtgactaccccgcccc

SEQ ID NO: 157931 - DNA, 34 bp, Artificial Sequence
  Synthetic oligonucleotide
tccgcctaaaatgcgcccgtgcactgttccgccc

SEQ ID NO: 157932 - DNA, 35 bp, Artificial Sequence
  Synthetic oligonucleotide
gactgctccgatagctttggctagacctcccatcc

SEQ ID NO: 157933 - DNA, 34 bp, Artificial Sequence
  Synthetic oligonucleotide
cctacatcagccgcctttcgtcgtttcctgttcc

SEQ ID NO: 157934 - DNA, 35 bp, Artificial Sequence
  Synthetic oligonucleotide
aacttccgcccagttccatatcccatgacttctgc

SEQ ID NO: 157935 - DNA, 35 bp, Artificial Sequence
  Synthetic oligonucleotide
tctgagggccaatctcctgctgtacttatccttgc

SEQ ID NO: 157936 - DNA, 35 bp, Artificial Sequence
  Synthetic oligonucleotide
ttatcgccctgcgcttcaatcgtctacctcccatc

SEQ ID NO: 157937 - DNA, 35 bp, Artificial Sequence
  Synthetic oligonucleotide
tcctgatcccagtctcgcattcactcgggcacctc

SEQ ID NO: 157938 - DNA, 35 bp, Artificial Sequence
  Synthetic oligonucleotide
tgcccacgtaggctccatttacgtatgacctcctc

SEQ ID NO: 157939 - DNA, 35 bp, Artificial Sequence
  Synthetic oligonucleotide
agagccatgtgccctctccgctacctgtctctgtc

SEQ ID NO: 157940 - DNA, 35 bp, Artificial Sequence
  Synthetic oligonucleotide
acgagagcccccgcatgccacatttgccgaccttc

SEQ ID NO: 157941 - DNA, 35 bp, Artificial Sequence
  Synthetic oligonucleotide
tgcccgccacatatcacgttccgctatcctccgcg

SEQ ID NO: 157942 - DNA, 35 bp, Artificial Sequence
  Synthetic oligonucleotide
acctcactcgtgaagccatctgttattgtccttcg

SEQ ID NO: 157943 - DNA, 35 bp, Artificial Sequence
  Synthetic oligonucleotide
tagcatgacccccctctactaccgctcttgtttcg

SEQ ID NO: 157944 - DNA, 35 bp, Artificial Sequence
  Synthetic oligonucleotide
ttggtggagagtgaagggggaatgggtttggacgg

SEQ ID NO: 157945 - DNA, 35 bp, Artificial Sequence
  Synthetic oligonucleotide
taccacctcttattgaacgcattcctctgccctgg

SEQ ID NO: 157946 - DNA, 35 bp, Artificial Sequence
  Synthetic oligonucleotide
gcctgactaagtcggcgggtgtggagggagggtgg

SEQ ID NO: 157947 - DNA, 35 bp, Artificial Sequence
  Synthetic oligonucleotide
gaaaaggtgaacgggggtgaggggtcgctggcatg

SEQ ID NO: 157948 - DNA, 35 bp, Artificial Sequence
  Synthetic oligonucleotide
ttccggtgcagttacgccgtttgatcaaccccctg

SEQ ID NO: 157949 - DNA, 35 bp, Artificial Sequence
  Synthetic oligonucleotide
gagttcccggccccgatcctgatttaccatccctg

SEQ ID NO: 157950 - DNA, 35 bp, Artificial Sequence
  Synthetic oligonucleotide
atcacccgtgtgcctctctgtcttatacccagctg

SEQ ID NO: 157951 - DNA, 34 bp, Artificial Sequence
  Synthetic oligonucleotide
gcgaactccacgcgtattagcgctctgtccccct

SEQ ID NO: 157952 - DNA, 35 bp, Artificial Sequence
  Synthetic oligonucleotide
tgcatccagccgagctatcgccgtccctccgccct

SEQ ID NO: 157953 - DNA, 35 bp, Artificial Sequence
  Synthetic oligonucleotide
tctgagcatggtccgactcactgcttcctctcgct

SEQ ID NO: 157954 - DNA, 35 bp, Artificial Sequence
  Synthetic oligonucleotide
tccttggtcctcccaccgacgtgtaccgaacctct

SEQ ID NO: 157955 - DNA, 35 bp, Artificial Sequence
  Synthetic oligonucleotide
actgaccccagatgacctttcttcccttgctttct

SEQ ID NO: 157956 - DNA, 35 bp, Artificial Sequence
  Synthetic oligonucleotide
gctcagtacggtcccttgtgtccaccatccttcgt

SEQ ID NO: 157957 - DNA, 35 bp, Artificial Sequence
  Synthetic oligonucleotide
acccttctcgtattgcttttgcctcgtacctctgt

SEQ ID NO: 157958 - DNA, 35 bp, Artificial Sequence
  Synthetic oligonucleotide
atgtgtacttgcaccgtgccttccgagctcccgtt

SEQ ID NO: 157959 - DNA, 36 bp, Artificial Sequence
  Synthetic oligonucleotide
tagcaaggagggggtacgcatggcaaggcgggaaaa

SEQ ID NO: 157960 - DNA, 35 bp, Artificial Sequence
  Synthetic oligonucleotide
gtcaccagtcccccctcgtcgctcaagccctcaaa

SEQ ID NO: 157961 - DNA, 36 bp, Artificial Sequence
  Synthetic oligonucleotide
ggaaccgcctcatcaggtaacaacctgccactccaa

SEQ ID NO: 157962 - DNA, 35 bp, Artificial Sequence
  Synthetic oligonucleotide
gtcgccactgcatcgcttttgttccactcacataa

SEQ ID NO: 157963 - DNA, 36 bp, Artificial Sequence
  Synthetic oligonucleotide
aacacccgcccaccttcgttagtgatcccccaaaca

SEQ ID NO: 157964 - DNA, 35 bp, Artificial Sequence
  Synthetic oligonucleotide
ttaccccccgctatccaggtctccaaaggaacaca

SEQ ID NO: 157965 - DNA, 36 bp, Artificial Sequence
  Synthetic oligonucleotide
atgcccatcctgataattgttcttcccatccgcaca

SEQ ID NO: 157966 - DNA, 36 bp, Artificial Sequence
  Synthetic oligonucleotide
ttgcgccccgtaatagccttggtagtcccttcccca

SEQ ID NO: 157967 - DNA, 35 bp, Artificial Sequence
  Synthetic oligonucleotide
tgccacagccctgttcatctgtcccccgtacgcca

SEQ ID NO: 157968 - DNA, 36 bp, Artificial Sequence
  Synthetic oligonucleotide
gcctgccatcgttaccgactctgcgagccccatcca

SEQ ID NO: 157969 - DNA, 36 bp, Artificial Sequence
  Synthetic oligonucleotide
tgcgatgcccgcctccgatggagtccatccattcca

SEQ ID NO: 157970 - DNA, 35 bp, Artificial Sequence
  Synthetic oligonucleotide
gtcctgcccccgccacgtagttttactcgcttcca

SEQ ID NO: 157971 - DNA, 36 bp, Artificial Sequence
  Synthetic oligonucleotide
gacgcattacaccctgcgcatttgaacttagttcca

SEQ ID NO: 157972 - DNA, 35 bp, Artificial Sequence
  Synthetic oligonucleotide
acaccacctcaccatctgtgcttcttaccctggca

SEQ ID NO: 157973 - DNA, 36 bp, Artificial Sequence
  Synthetic oligonucleotide
gatgatcgttgttgtcaccgccaccctgactcttca

SEQ ID NO: 157974 - DNA, 35 bp, Artificial Sequence
  Synthetic oligonucleotide
tcgccctctggatctgccacccataagcctgttca

SEQ ID NO: 157975 - DNA, 36 bp, Artificial Sequence
  Synthetic oligonucleotide
tgccctccccgccccgcatcaatcttggtccgaaga

SEQ ID NO: 157976 - DNA, 35 bp, Artificial Sequence
  Synthetic oligonucleotide
aacgaaatggcggaggggcgcaggaaagggtcaga

SEQ ID NO: 157977 - DNA, 37 bp, Artificial Sequence
  Synthetic oligonucleotide
gaggcgaggaggaaggaggatagaggaccaagggaga

SEQ ID NO: 157978 - DNA, 37 bp, Artificial Sequence
  Synthetic oligonucleotide
tgtcccttgtcctcactgtagcccgccccattaacga

SEQ ID NO: 157979 - DNA, 37 bp, Artificial Sequence
  Synthetic oligonucleotide
gcgcacacgagggggaggagaaaagaggaggggacga

SEQ ID NO: 157980 - DNA, 37 bp, Artificial Sequence
  Synthetic oligonucleotide
actgtagcgcgtagatattcacacacaccactctcga

SEQ ID NO: 157981 - DNA, 38 bp, Artificial Sequence
  Synthetic oligonucleotide
gaccccctcacatgacccgcgcttcataacccctatga

SEQ ID NO: 157982 - DNA, 38 bp, Artificial Sequence
  Synthetic oligonucleotide
tatccaacctcctgttaccctgaagccactgaccctga

SEQ ID NO: 157983 - DNA, 30 bp, Artificial Sequence
  Synthetic oligonucleotide
tcacctcaacaccaacgctttcgtgcctga

SEQ ID NO: 157984 - DNA, 36 bp, Artificial Sequence
  Synthetic oligonucleotide
gtctgcccccccctccgtgtatgtcgttctccgtga

SEQ ID NO: 157985 - DNA, 38 bp, Artificial Sequence
  Synthetic oligonucleotide
aggggcggggtggggcggagggacaaggaagggcgtga

SEQ ID NO: 157986 - DNA, 38 bp, Artificial Sequence
  Synthetic oligonucleotide
ggtggagggacgggggaatcgtacggggtcatgcgtga

SEQ ID NO: 157987 - DNA, 38 bp, Artificial Sequence
  Synthetic oligonucleotide
gccatccccctcttagcttttcgttgagacagcggtga

SEQ ID NO: 157988 - DNA, 38 bp, Artificial Sequence
  Synthetic oligonucleotide
gagccgagacagtaggtgtcggtgtaggggcggggtga

SEQ ID NO: 157989 - DNA, 36 bp, Artificial Sequence
  Synthetic oligonucleotide
gatgcggggattaggggcgggagggatgtcgattga

SEQ ID NO: 157990 - DNA, 38 bp, Artificial Sequence
  Synthetic oligonucleotide
acgcctggtccatctcgcccagtactatcccactttga

SEQ ID NO: 157991 - DNA, 35 bp, Artificial Sequence
  Synthetic oligonucleotide
ggacacgggtgggtagggcaaccgagggtacgata

SEQ ID NO: 157992 - DNA, 36 bp, Artificial Sequence
  Synthetic oligonucleotide
acagtataggtggtgggctgggagggtaacaggata

SEQ ID NO: 157993 - DNA, 35 bp, Artificial Sequence
  Synthetic oligonucleotide
gacgctccgtctaggctcgtatcccgcacctcgta

SEQ ID NO: 157994 - DNA, 36 bp, Artificial Sequence
  Synthetic oligonucleotide
ggggggggagggggataggattgcagggggatggta

SEQ ID NO: 157995 - DNA, 35 bp, Artificial Sequence
  Synthetic oligonucleotide
ttccctgcaccacccgattacaggcctccttcaac

SEQ ID NO: 157996 - DNA, 35 bp, Artificial Sequence
  Synthetic oligonucleotide
tagtcccccctgccagttgccccagcttgcataac

SEQ ID NO: 157997 - DNA, 35 bp, Artificial Sequence
  Synthetic oligonucleotide
tgtcatgacgtcccacgctcacccgtcatgcccac

SEQ ID NO: 157998 - DNA, 35 bp, Artificial Sequence
  Synthetic oligonucleotide
agcaaacaacacttgtcgcatatatcctggccccc

SEQ ID NO: 157999 - DNA, 35 bp, Artificial Sequence
  Synthetic oligonucleotide
tgggtggccccatgagccgttacttatacctcccc

SEQ ID NO: 158000 - DNA, 35 bp, Artificial Sequence
  Synthetic oligonucleotide
tgccgacgcagtagacgctggtcccgtcctatccc

SEQ ID NO: 158001 - DNA, 35 bp, Artificial Sequence
  Synthetic oligonucleotide
gcattgtctgccgtctcacttaccacatacccgcc

SEQ ID NO: 158002 - DNA, 35 bp, Artificial Sequence
  Synthetic oligonucleotide
ttggactacgtatttttgcatcacaaccgcccgcc

SEQ ID NO: 158003 - DNA, 35 bp, Artificial Sequence
  Synthetic oligonucleotide
gcatgtactccgccgtccccgctcctaccgtggcc

SEQ ID NO: 158004 - DNA, 35 bp, Artificial Sequence
  Synthetic oligonucleotide
gacactgccttcgttcatttcttgaagctcctgcc

SEQ ID NO: 158005 - DNA, 35 bp, Artificial Sequence
  Synthetic oligonucleotide
agttcatccccgatcacgcttataccgacacatcc

SEQ ID NO: 158006 - DNA, 35 bp, Artificial Sequence
  Synthetic oligonucleotide
tgttacgcccatccacctcgactacgcccccacgc

SEQ ID NO: 158007 - DNA, 35 bp, Artificial Sequence
  Synthetic oligonucleotide
gccctggtcgcgagtatcacccgtcatcatatcgc

SEQ ID NO: 158008 - DNA, 35 bp, Artificial Sequence
  Synthetic oligonucleotide
tctaccaccccgttctgcatcttggattgatctgc

SEQ ID NO: 158009 - DNA, 35 bp, Artificial Sequence
  Synthetic oligonucleotide
atcgtggacatgacctctgcgttcctcctgccctc

SEQ ID NO: 158010 - DNA, 35 bp, Artificial Sequence
  Synthetic oligonucleotide
ttaccgcgagctgattcgttttggtttcgttcctc

SEQ ID NO: 158011 - DNA, 35 bp, Artificial Sequence
  Synthetic oligonucleotide
gttacaacccgccacaccttctcggatcatgtctc

SEQ ID NO: 158012 - DNA, 35 bp, Artificial Sequence
  Synthetic oligonucleotide
tacccctgtcgttccttgcgatgcacaccctgttc

SEQ ID NO: 158013 - DNA, 35 bp, Artificial Sequence
  Synthetic oligonucleotide
tgtgccaacagccattcccgtcaggcactgctttc

SEQ ID NO: 158014 - DNA, 35 bp, Artificial Sequence
  Synthetic oligonucleotide
agcctattccctgcctctgccacagtctcgttttc

SEQ ID NO: 158015 - DNA, 35 bp, Artificial Sequence
  Synthetic oligonucleotide
tagacgtaacctcgccaccgctacatgcccttccg

SEQ ID NO: 158016 - DNA, 35 bp, Artificial Sequence
  Synthetic oligonucleotide
ggaaaagagcggacaggggtacacaaaagggaagg

SEQ ID NO: 158017 - DNA, 35 bp, Artificial Sequence
  Synthetic oligonucleotide
acccggctccccttcgctcacccctggcctcccgg

SEQ ID NO: 158018 - DNA, 35 bp, Artificial Sequence
  Synthetic oligonucleotide
gcgatggtggtggcggtgtggtaggagtgggcggg

SEQ ID NO: 158019 - DNA, 35 bp, Artificial Sequence
  Synthetic oligonucleotide
agtggggaatggtggtgggcgggtggacctattgg

SEQ ID NO: 158020 - DNA, 35 bp, Artificial Sequence
  Synthetic oligonucleotide
tcgccccggctttaattgctttcgttacgttcctg

SEQ ID NO: 158021 - DNA, 35 bp, Artificial Sequence
  Synthetic oligonucleotide
acccgccactttcccgcctgccgcgccctggcgtg

SEQ ID NO: 158022 - DNA, 35 bp, Artificial Sequence
  Synthetic oligonucleotide
atcctcccagtgcgtctcttacccattcgtgcttg

SEQ ID NO: 158023 - DNA, 35 bp, Artificial Sequence
  Synthetic oligonucleotide
tctccccccatgcagcatctcttgtaatcacccct

SEQ ID NO: 158024 - DNA, 35 bp, Artificial Sequence
  Synthetic oligonucleotide
gtacggacataccttcactgttcatttatttgcct

SEQ ID NO: 158025 - DNA, 35 bp, Artificial Sequence
  Synthetic oligonucleotide
tagccgccataggtctatcatctcacattgctcct

SEQ ID NO: 158026 - DNA, 35 bp, Artificial Sequence
  Synthetic oligonucleotide
ttgcggttgaggtctttgccctggtctgtcgttct

SEQ ID NO: 158027 - DNA, 35 bp, Artificial Sequence
  Synthetic oligonucleotide
tacgcattccggctgatcccgctcgttcctttagt

SEQ ID NO: 158028 - DNA, 35 bp, Artificial Sequence
  Synthetic oligonucleotide
tctcaaccttccacactgccccgctcgagcacatt

SEQ ID NO: 158029 - DNA, 35 bp, Artificial Sequence
  Synthetic oligonucleotide
atccccggcacccattgttcaatcacgtccccctt

SEQ ID NO: 158030 - DNA, 36 bp, Artificial Sequence
  Synthetic oligonucleotide
ggccaccacaccctgaccgttcccgagcctgcaaca

SEQ ID NO: 158031 - DNA, 36 bp, Artificial Sequence
  Synthetic oligonucleotide
tgacagggcacgctcccccccacgatgcgccaccca

SEQ ID NO: 158032 - DNA, 35 bp, Artificial Sequence
  Synthetic oligonucleotide
caccctctccgttgtatagccttcctcgttgccca

SEQ ID NO: 158033 - DNA, 36 bp, Artificial Sequence
  Synthetic oligonucleotide
acacccgaagagggtgcctttacactctaactccca

SEQ ID NO: 158034 - DNA, 35 bp, Artificial Sequence
  Synthetic oligonucleotide
tgttcatgactaccatgcatatgccacactttcca

SEQ ID NO: 158035 - DNA, 36 bp, Artificial Sequence
  Synthetic oligonucleotide
gttcagcctcaagacgtcatctcctgctcacgctca

SEQ ID NO: 158036 - DNA, 36 bp, Artificial Sequence
  Synthetic oligonucleotide
tcacccacgcgccacagccaccggctcgccctttca

SEQ ID NO: 158037 - DNA, 35 bp, Artificial Sequence
  Synthetic oligonucleotide
acccctcactcatcagttatatcgcgatcctttca

SEQ ID NO: 158038 - DNA, 37 bp, Artificial Sequence
  Synthetic oligonucleotide
ctggggatgtaggggccgcactctctgggaggggaga

SEQ ID NO: 158039 - DNA, 37 bp, Artificial Sequence
  Synthetic oligonucleotide
tcacatagcgcacacaacttttgacgcctccacccga

SEQ ID NO: 158040 - DNA, 37 bp, Artificial Sequence
  Synthetic oligonucleotide
taccgctctctgctccgctggtcatacccctctccga

SEQ ID NO: 158041 - DNA, 37 bp, Artificial Sequence
  Synthetic oligonucleotide
tccgaccacgttgggcttgctttatctcattctccga

SEQ ID NO: 158042 - DNA, 37 bp, Artificial Sequence
  Synthetic oligonucleotide
gcaggtcaccgcgcggacccatctcctccctcttcga

SEQ ID NO: 158043 - DNA, 37 bp, Artificial Sequence
  Synthetic oligonucleotide
gtgccaccagctaatccgcctagccccctccaccgga

SEQ ID NO: 158044 - DNA, 37 bp, Artificial Sequence
  Synthetic oligonucleotide
acagtccatccttgtcatccgtcccgcgcaccccgga

SEQ ID NO: 158045 - DNA, 35 bp, Artificial Sequence
  Synthetic oligonucleotide
actaccacctacatacgcgctactgaccttccgga

SEQ ID NO: 158046 - DNA, 36 bp, Artificial Sequence
  Synthetic oligonucleotide
aatggtaaagggagggggcggggtaaaaaaggggga

SEQ ID NO: 158047 - DNA, 37 bp, Artificial Sequence
  Synthetic oligonucleotide
acaagcaacgttctggaggggagggaatggtggggga

SEQ ID NO: 158048 - DNA, 37 bp, Artificial Sequence
  Synthetic oligonucleotide
ttgggggcgggagggcattgtagcacaacacttggga

SEQ ID NO: 158049 - DNA, 37 bp, Artificial Sequence
  Synthetic oligonucleotide
gcccgccctccgctcccaaggtacttggacatctgga

SEQ ID NO: 158050 - DNA, 38 bp, Artificial Sequence
  Synthetic oligonucleotide
aagtagggacaagaaggagagggtgacaaggggaatga

SEQ ID NO: 158051 - DNA, 38 bp, Artificial Sequence
  Synthetic oligonucleotide
tctagccccgctctctgctgtcccatctctccgcatga

SEQ ID NO: 158052 - DNA, 38 bp, Artificial Sequence
  Synthetic oligonucleotide
accgactaacgggtccaagggggggaggggagttatga

SEQ ID NO: 158053 - DNA, 37 bp, Artificial Sequence
  Synthetic oligonucleotide
aaggaccatccccgcctgcttatactcgacttcctga

SEQ ID NO: 158054 - DNA, 38 bp, Artificial Sequence
  Synthetic oligonucleotide
gactgggatggtaggtggggcaagggaaatgcgggtga

SEQ ID NO: 158055 - DNA, 38 bp, Artificial Sequence
  Synthetic oligonucleotide
gcccggggtcgtggaggaggggtaataacgggtggtga

SEQ ID NO: 158056 - DNA, 38 bp, Artificial Sequence
  Synthetic oligonucleotide
aacgagaacagtagaaggggagccgggatacgagttga

SEQ ID NO: 158057 - DNA, 38 bp, Artificial Sequence
  Synthetic oligonucleotide
gacactcctcgggatacgcccaaacctccgccctttga

SEQ ID NO: 158058 - DNA, 36 bp, Artificial Sequence
  Synthetic oligonucleotide
gccatgaactccaacgtccgatctgccgcccctata

SEQ ID NO: 158059 - DNA, 35 bp, Artificial Sequence
  Synthetic oligonucleotide
gaaggggggctcaaaatctgggggcggtgttcaac

SEQ ID NO: 158060 - DNA, 35 bp, Artificial Sequence
  Synthetic oligonucleotide
taggcctcacggtgtattttgcctcccgtccacac

SEQ ID NO: 158061 - DNA, 35 bp, Artificial Sequence
  Synthetic oligonucleotide
aacgatcccccacgcacacaatgtatttccatcac

SEQ ID NO: 158062 - DNA, 35 bp, Artificial Sequence
  Synthetic oligonucleotide
gcttccgctctcactgctaccccttgccccgcgac

SEQ ID NO: 158063 - DNA, 35 bp, Artificial Sequence
  Synthetic oligonucleotide
gccgtccctcatccttgcgccgatggtcacactac

SEQ ID NO: 158064 - DNA, 35 bp, Artificial Sequence
  Synthetic oligonucleotide
gcacacccccatgaaccggtgcctgtgcaattacc

SEQ ID NO: 158065 - DNA, 34 bp, Artificial Sequence
  Synthetic oligonucleotide
gttactggcccgcgtcataggatcgccccccccc

SEQ ID NO: 158066 - DNA, 35 bp, Artificial Sequence
  Synthetic oligonucleotide
tgttcgtacgtactcctctttcccgagcccgcccc

SEQ ID NO: 158067 - DNA, 35 bp, Artificial Sequence
  Synthetic oligonucleotide
gtgtccagcccctctttactatctctgcctgggcc

SEQ ID NO: 158068 - DNA, 35 bp, Artificial Sequence
  Synthetic oligonucleotide
tcatgtcccccgagcccacagcggcccagttctcc

SEQ ID NO: 158069 - DNA, 35 bp, Artificial Sequence
  Synthetic oligonucleotide
aaccgccgtccttaagtccatgatccgtgtcgtcc

SEQ ID NO: 158070 - DNA, 35 bp, Artificial Sequence
  Synthetic oligonucleotide
actgtcccgaccgtccgttcaagcccatccctagc

SEQ ID NO: 158071 - DNA, 35 bp, Artificial Sequence
  Synthetic oligonucleotide
gcacctgccccttaagcctatattgaacgtattgc

SEQ ID NO: 158072 - DNA, 35 bp, Artificial Sequence
  Synthetic oligonucleotide
gagtcggtccaccctccactccgttatgtacaatc

SEQ ID NO: 158073 - DNA, 35 bp, Artificial Sequence
  Synthetic oligonucleotide
tagcttgcccaggctgccggactcaattcaccctc

SEQ ID NO: 158074 - DNA, 35 bp, Artificial Sequence
  Synthetic oligonucleotide
gtcttggccataactgttcttccgtagctatgctc

SEQ ID NO: 158075 - DNA, 35 bp, Artificial Sequence
  Synthetic oligonucleotide
tgtcccgtatgtccgtcctcccatgtctggcagtc

SEQ ID NO: 158076 - DNA, 35 bp, Artificial Sequence
  Synthetic oligonucleotide
atcacggccccagctccaccctgctccacctggtc

SEQ ID NO: 158077 - DNA, 35 bp, Artificial Sequence
  Synthetic oligonucleotide
gcgatctgccttactctctctcgtaggagcctttc

SEQ ID NO: 158078 - DNA, 35 bp, Artificial Sequence
  Synthetic oligonucleotide
tgtccgcaggtccccgcatacccatccgttaaccg

SEQ ID NO: 158079 - DNA, 35 bp, Artificial Sequence
  Synthetic oligonucleotide
ttgcatcgaccgcccgttacacttgtgccgccccg

SEQ ID NO: 158080 - DNA, 35 bp, Artificial Sequence
  Synthetic oligonucleotide
gtgcccacatggtagcaaccacacactccttgccg

SEQ ID NO: 158081 - DNA, 35 bp, Artificial Sequence
  Synthetic oligonucleotide
tcctagccaccaactgcttaccctgctcctgctcg

SEQ ID NO: 158082 - DNA, 35 bp, Artificial Sequence
  Synthetic oligonucleotide
gaacacgtaatgtaccggcctcccaacttctctcg

SEQ ID NO: 158083 - DNA, 35 bp, Artificial Sequence
  Synthetic oligonucleotide
taagcccgctccctctgccatgtcgctcaccaagg

SEQ ID NO: 158084 - DNA, 35 bp, Artificial Sequence
  Synthetic oligonucleotide
tgagagggaaagggctcgggggtgggcggggcggg

SEQ ID NO: 158085 - DNA, 35 bp, Artificial Sequence
  Synthetic oligonucleotide
gtagctctgtcgcccgcttccctccttggcccatg

SEQ ID NO: 158086 - DNA, 35 bp, Artificial Sequence
  Synthetic oligonucleotide
gaccaggcctaccctccgcatgtctgctgccccat

SEQ ID NO: 158087 - DNA, 35 bp, Artificial Sequence
  Synthetic oligonucleotide
ttgagggccgtccgcgcctacgttgccctttacct

SEQ ID NO: 158088 - DNA, 35 bp, Artificial Sequence
  Synthetic oligonucleotide
gacgcctccgctagacacctaagcctggtacccct

SEQ ID NO: 158089 - DNA, 35 bp, Artificial Sequence
  Synthetic oligonucleotide
tcgacccgatcgcgctgcgcacgctccccccgcct

SEQ ID NO: 158090 - DNA, 35 bp, Artificial Sequence
  Synthetic oligonucleotide
cccccgggtcttgtgtcatcgcacctcttatacgt

SEQ ID NO: 158091 - DNA, 35 bp, Artificial Sequence
  Synthetic oligonucleotide
gctcatcagtatgtacgtccgcaccctgccctgtt

SEQ ID NO: 158092 - DNA, 35 bp, Artificial Sequence
  Synthetic oligonucleotide
ttcggacctccttctgttgttaacactctcctgtt

SEQ ID NO: 158093 - DNA, 35 bp, Artificial Sequence
  Synthetic oligonucleotide
gtagggtgggtggcggacggggcgatcgggaattt

SEQ ID NO: 158094 - DNA, 36 bp, Artificial Sequence
  Synthetic oligonucleotide
tctgaccccgatccatcgctatatgcaccgttgcaa

SEQ ID NO: 158095 - DNA, 36 bp, Artificial Sequence
  Synthetic oligonucleotide
tctgggccctactgctagtgctacttccccctcaca

SEQ ID NO: 158096 - DNA, 36 bp, Artificial Sequence
  Synthetic oligonucleotide
gaaccatcgtttatagtacttgccccttgcccccca

SEQ ID NO: 158097 - DNA, 35 bp, Artificial Sequence
  Synthetic oligonucleotide
aatcgactccctccgttagtgcttaccccgtgcca

SEQ ID NO: 158098 - DNA, 36 bp, Artificial Sequence
  Synthetic oligonucleotide
tcacgccgccccatctgcgaaccgacagcctgagca

SEQ ID NO: 158099 - DNA, 36 bp, Artificial Sequence
  Synthetic oligonucleotide
tgctctgcccccaacgcgcgtgacctgctatcatca

SEQ ID NO: 158100 - DNA, 35 bp, Artificial Sequence
  Synthetic oligonucleotide
tcgacctcttccacatgtccagcaacccgtgctca

SEQ ID NO: 158101 - DNA, 36 bp, Artificial Sequence
  Synthetic oligonucleotide
tagatccttccgctgctttcaccgtcctgtatctca

SEQ ID NO: 158102 - DNA, 37 bp, Artificial Sequence
  Synthetic oligonucleotide
gagaatgttggcgggtagtggggagggtaacgggaga

SEQ ID NO: 158103 - DNA, 37 bp, Artificial Sequence
  Synthetic oligonucleotide
ggaagggaggtaatgaggggggggaaagactagtaga

SEQ ID NO: 158104 - DNA, 37 bp, Artificial Sequence
  Synthetic oligonucleotide
gcacgcggtccccccgtcctccgtgccaaatctccga

SEQ ID NO: 158105 - DNA, 37 bp, Artificial Sequence
  Synthetic oligonucleotide
gcaggagccttcatcccttgcttttatgacctctcga

SEQ ID NO: 158106 - DNA, 36 bp, Artificial Sequence
  Synthetic oligonucleotide
ttcgctagcccctcctccgtcgaccatacagcagga

SEQ ID NO: 158107 - DNA, 37 bp, Artificial Sequence
  Synthetic oligonucleotide
ggtggtggaggtggggaataggggaccgcaagtcgga

SEQ ID NO: 158108 - DNA, 38 bp, Artificial Sequence
  Synthetic oligonucleotide
gtgggagggtgggcggttagtgtgatcccgatgaggga

SEQ ID NO: 158109 - DNA, 37 bp, Artificial Sequence
  Synthetic oligonucleotide
tccgacgccatgagcactgggtgggtacgggagggga

SEQ ID NO: 158110 - DNA, 36 bp, Artificial Sequence
  Synthetic oligonucleotide
atcaccctatcattgtcccctgtcagtgccgctgga

SEQ ID NO: 158111 - DNA, 36 bp, Artificial Sequence
  Synthetic oligonucleotide
acctcaccttcaccctggctaagacgcctttttgga

SEQ ID NO: 158112 - DNA, 36 bp, Artificial Sequence
  Synthetic oligonucleotide
gccacgcccacaattgtgccacattccgccgcatga

SEQ ID NO: 158113 - DNA, 37 bp, Artificial Sequence
  Synthetic oligonucleotide
gcagggaagtggggaatgtaggggggtgacgggatga

SEQ ID NO: 158114 - DNA, 37 bp, Artificial Sequence
  Synthetic oligonucleotide
cctcatgcccggctactcattctacgccccgaactga

SEQ ID NO: 158115 - DNA, 38 bp, Artificial Sequence
  Synthetic oligonucleotide
gtctgtccgccgcatggtcaacctgctcaatcacctga

SEQ ID NO: 158116 - DNA, 38 bp, Artificial Sequence
  Synthetic oligonucleotide
aagggccatccgctgctctgctactgaacttaccctga

SEQ ID NO: 158117 - DNA, 34 bp, Artificial Sequence
  Synthetic oligonucleotide
tcaaacatccgcgcccatgatataccgcccctga

SEQ ID NO: 158118 - DNA, 38 bp, Artificial Sequence
  Synthetic oligonucleotide
tatcgcacgcccgtcgatgcttctctctctcaccgtga

SEQ ID NO: 158119 - DNA, 38 bp, Artificial Sequence
  Synthetic oligonucleotide
tcaccttcctctatgggtcttgttcctctattggttga

SEQ ID NO: 158120 - DNA, 35 bp, Artificial Sequence
  Synthetic oligonucleotide
acgctcgtatgtgacccctcgccgtcgctacccta

SEQ ID NO: 158121 - DNA, 35 bp, Artificial Sequence
  Synthetic oligonucleotide
tgacgccctactcgctgcactatcggttttacgta

SEQ ID NO: 158122 - DNA, 36 bp, Artificial Sequence
  Synthetic oligonucleotide
acttggagccctccccgtgcgatgcccttccttgta

SEQ ID NO: 158123 - DNA, 38 bp, Artificial Sequence
  Synthetic oligonucleotide
tccgccgtacgcccactggggatcaactgccaccttta

SEQ ID NO: 158124 - DNA, 37 bp, Artificial Sequence
  Synthetic oligonucleotide
tcctacactcgcctcgtttgccacaacccgattttta

SEQ ID NO: 158125 - DNA, 35 bp, Artificial Sequence
  Synthetic oligonucleotide
gccccgttaacgggcctcctctcctacgcccacac

SEQ ID NO: 158126 - DNA, 35 bp, Artificial Sequence
  Synthetic oligonucleotide
gcaggcctgttccatgcctggtttcctccctacac

SEQ ID NO: 158127 - DNA, 35 bp, Artificial Sequence
  Synthetic oligonucleotide
atcccaccgtaagcgagcctacacttctaccgcac

SEQ ID NO: 158128 - DNA, 35 bp, Artificial Sequence
  Synthetic oligonucleotide
gaccgtaccggtgccagctcccccaccaccgtcac

SEQ ID NO: 158129 - DNA, 35 bp, Artificial Sequence
  Synthetic oligonucleotide
gaccagatagctccagcctcctataagtccccccc

SEQ ID NO: 158130 - DNA, 35 bp, Artificial Sequence
  Synthetic oligonucleotide
accgcttggcaactgcgtacgttctctggcgcccc

SEQ ID NO: 158131 - DNA, 35 bp, Artificial Sequence
  Synthetic oligonucleotide
tcgaggtacctcccgtgttttgatccccgttcgcc

SEQ ID NO: 158132 - DNA, 35 bp, Artificial Sequence
  Synthetic oligonucleotide
atcccggccctccctcggtcaatccctacggctcc

SEQ ID NO: 158133 - DNA, 35 bp, Artificial Sequence
  Synthetic oligonucleotide
gcgcaccggacaactggctggttagttctttctcc

SEQ ID NO: 158134 - DNA, 35 bp, Artificial Sequence
  Synthetic oligonucleotide
gccatgccggtgtgtgaataccgtgttccctccgc

SEQ ID NO: 158135 - DNA, 35 bp, Artificial Sequence
  Synthetic oligonucleotide
actacacctccccgcttgcccttaattacgggcgc

SEQ ID NO: 158136 - DNA, 35 bp, Artificial Sequence
  Synthetic oligonucleotide
gagggcgcatgcatctgtagctgtttccacctcgc

SEQ ID NO: 158137 - DNA, 35 bp, Artificial Sequence
  Synthetic oligonucleotide
gactccgcctcgtaactattacaccttgctttcgc

SEQ ID NO: 158138 - DNA, 35 bp, Artificial Sequence
  Synthetic oligonucleotide
gtgggctgggtgggaggatagaggtagagcagggc

SEQ ID NO: 158139 - DNA, 35 bp, Artificial Sequence
  Synthetic oligonucleotide
tgtgcccttcactcccctcttgtctccggccctgc

SEQ ID NO: 158140 - DNA, 35 bp, Artificial Sequence
  Synthetic oligonucleotide
tcatcacttcatcccccgggtttacgccctagtgc

SEQ ID NO: 158141 - DNA, 35 bp, Artificial Sequence
  Synthetic oligonucleotide
tgccctcgacgcgaacgcgtttacaaccccattgc

SEQ ID NO: 158142 - DNA, 36 bp, Artificial Sequence
  Synthetic oligonucleotide
ttcacccagcccttctatgtcttccaatggtcgatc

SEQ ID NO: 158143 - DNA, 35 bp, Artificial Sequence
  Synthetic oligonucleotide
tcatagcacccaaaggtattttcggctcccaactc

SEQ ID NO: 158144 - DNA, 35 bp, Artificial Sequence
  Synthetic oligonucleotide
actactcgcgccctcgtttttaggtcccgtgactc

SEQ ID NO: 158145 - DNA, 36 bp, Artificial Sequence
  Synthetic oligonucleotide
gtgtgcgcgactttgcaggttcacgtctccctcctc

SEQ ID NO: 158146 - DNA, 35 bp, Artificial Sequence
  Synthetic oligonucleotide
gtcgatctgccctctcacctatggcttttgtcctc

SEQ ID NO: 158147 - DNA, 35 bp, Artificial Sequence
  Synthetic oligonucleotide
gctcccaaacgccctgcataaccgactatctgctc

SEQ ID NO: 158148 - DNA, 35 bp, Artificial Sequence
  Synthetic oligonucleotide
gagccccaattgattaatgcgcactatccactctc

SEQ ID NO: 158149 - DNA, 30 bp, Artificial Sequence
  Synthetic oligonucleotide
gcacgccacttcgaacgcttctaccctctc

SEQ ID NO: 158150 - DNA, 35 bp, Artificial Sequence
  Synthetic oligonucleotide
agcaccgaatccatcactcccgtcggtccattgtc

SEQ ID NO: 158151 - DNA, 35 bp, Artificial Sequence
  Synthetic oligonucleotide
gaccgctaacgcccatcgaatgttctccccttgtc

SEQ ID NO: 158152 - DNA, 35 bp, Artificial Sequence
  Synthetic oligonucleotide
gccatcctctcctggggttatttattcttcttacg

SEQ ID NO: 158153 - DNA, 35 bp, Artificial Sequence
  Synthetic oligonucleotide
gttggcattagttgagagggggaaaaaggggaggg

SEQ ID NO: 158154 - DNA, 35 bp, Artificial Sequence
  Synthetic oligonucleotide
tgatgccggagtaagcggaggggatggagggtttg

SEQ ID NO: 158155 - DNA, 35 bp, Artificial Sequence
  Synthetic oligonucleotide
gttccaccggccccttgttcattcgtatgtcgaat

SEQ ID NO: 158156 - DNA, 35 bp, Artificial Sequence
  Synthetic oligonucleotide
gaagcccctctgtcgccgaatagatataccaccat

SEQ ID NO: 158157 - DNA, 35 bp, Artificial Sequence
  Synthetic oligonucleotide
gaaaaaggggacgggggtgatagggttcgtggcat

SEQ ID NO: 158158 - DNA, 35 bp, Artificial Sequence
  Synthetic oligonucleotide
gtcaaagccgcccccacggtagttttgtccctact

SEQ ID NO: 158159 - DNA, 35 bp, Artificial Sequence
  Synthetic oligonucleotide
tgctgataaccgcacatgctgccccatcttgtcct

SEQ ID NO: 158160 - DNA, 35 bp, Artificial Sequence
  Synthetic oligonucleotide
tcaccccatcgttcggactgctagcttccatatct

SEQ ID NO: 158161 - DNA, 35 bp, Artificial Sequence
  Synthetic oligonucleotide
gccaaagtgcatgccccccgtagtttctgtcctct

SEQ ID NO: 158162 - DNA, 35 bp, Artificial Sequence
  Synthetic oligonucleotide
gccgctctgccttgcctcgcccgcacatctctcgt

SEQ ID NO: 158163 - DNA, 35 bp, Artificial Sequence
  Synthetic oligonucleotide
taccgctaccctgagtattccctccttgctcttgt

SEQ ID NO: 158164 - DNA, 35 bp, Artificial Sequence
  Synthetic oligonucleotide
tcccaccttctgtcgtgtcttgcccgctcctttgt

SEQ ID NO: 158165 - DNA, 35 bp, Artificial Sequence
  Synthetic oligonucleotide
acccctgtccgccgcccagtcaacgaaagtacttt

SEQ ID NO: 158166 - DNA, 35 bp, Artificial Sequence
  Synthetic oligonucleotide
gctccctgcacagtgttttaccgccgactccgttt

SEQ ID NO: 158167 - DNA, 36 bp, Artificial Sequence
  Synthetic oligonucleotide
acaacgaggtgggtgggagcggagtgacggcggaaa

SEQ ID NO: 158168 - DNA, 36 bp, Artificial Sequence
  Synthetic oligonucleotide
atctgtcgccaccaaccgtaattatgacccctccaa

SEQ ID NO: 158169 - DNA, 36 bp, Artificial Sequence
  Synthetic oligonucleotide
tcaacatcctgacatccgtgtccccccgctccgcaa

SEQ ID NO: 158170 - DNA, 36 bp, Artificial Sequence
  Synthetic oligonucleotide
tctccaccgactcaggttcatctgcctttacttcaa

SEQ ID NO: 158171 - DNA, 36 bp, Artificial Sequence
  Synthetic oligonucleotide
taccgaatcgctcccatctgtctttgctgttgcgaa

SEQ ID NO: 158172 - DNA, 35 bp, Artificial Sequence
  Synthetic oligonucleotide
tccccgccacccctccatggcctctctatcttgaa

SEQ ID NO: 158173 - DNA, 36 bp, Artificial Sequence
  Synthetic oligonucleotide
atccccccgcccatctagtgtaagtggtgaaccaca

SEQ ID NO: 158174 - DNA, 36 bp, Artificial Sequence
  Synthetic oligonucleotide
tgggtcggtgtgggaagggagggaaggatgatgaca

SEQ ID NO: 158175 - DNA, 36 bp, Artificial Sequence
  Synthetic oligonucleotide
atggtaagcccccatgcatctagtatccctccacca

SEQ ID NO: 158176 - DNA, 36 bp, Artificial Sequence
  Synthetic oligonucleotide
tgtctgctctccgttgcgcccggccccaatccgcca

SEQ ID NO: 158177 - DNA, 36 bp, Artificial Sequence
  Synthetic oligonucleotide
gttcaccccccctctatattgcagatgcctgccgca

SEQ ID NO: 158178 - DNA, 36 bp, Artificial Sequence
  Synthetic oligonucleotide
gcacaggaggtgagaggaaaaacaagcgtcagcgca

SEQ ID NO: 158179 - DNA, 35 bp, Artificial Sequence
  Synthetic oligonucleotide
gctgcctgtctcgattcttttgttccttcgttgca

SEQ ID NO: 158180 - DNA, 36 bp, Artificial Sequence
  Synthetic oligonucleotide
gtcagtccgctcgtattcgcttattcttctgcttca

SEQ ID NO: 158181 - DNA, 36 bp, Artificial Sequence
  Synthetic oligonucleotide
gcgccctcttccctgcctgcgaatgtgcttctttca

SEQ ID NO: 158182 - DNA, 37 bp, Artificial Sequence
  Synthetic oligonucleotide
gtgcgatggggggctaaagggaggagtacggtaaaga

SEQ ID NO: 158183 - DNA, 37 bp, Artificial Sequence
  Synthetic oligonucleotide
gagagagagggggtaagacagaggggtgggctccaga

SEQ ID NO: 158184 - DNA, 37 bp, Artificial Sequence
  Synthetic oligonucleotide
acgttacacaccaccgttgcactctctccgtcctcga

SEQ ID NO: 158185 - DNA, 38 bp, Artificial Sequence
  Synthetic oligonucleotide
tagaccaggaaggtgggtggagggaggtaaattcatga

SEQ ID NO: 158186 - DNA, 35 bp, Artificial Sequence
  Synthetic oligonucleotide
gctcaactgagcatcggcccctcccctgaatctga

SEQ ID NO: 158187 - DNA, 38 bp, Artificial Sequence
  Synthetic oligonucleotide
atgctccccctgctccaactccgccaacacgtgtctga

SEQ ID NO: 158188 - DNA, 37 bp, Artificial Sequence
  Synthetic oligonucleotide
acacgtgcgaaagcggaggagggaggtaacagggtga

SEQ ID NO: 158189 - DNA, 38 bp, Artificial Sequence
  Synthetic oligonucleotide
tatcgccagtcctcccctcattggtgccgttcccttga

SEQ ID NO: 158190 - DNA, 38 bp, Artificial Sequence
  Synthetic oligonucleotide
tcgaagctgcctgcctcgatcttaacatgcctccttga

SEQ ID NO: 158191 - DNA, 38 bp, Artificial Sequence
  Synthetic oligonucleotide
accgcacccccgatccgatcgttccctgctgtagttga

SEQ ID NO: 158192 - DNA, 37 bp, Artificial Sequence
  Synthetic oligonucleotide
gctcgcatcatcccccgcactcgctcccgcacgttga

SEQ ID NO: 158193 - DNA, 32 bp, Artificial Sequence
  Synthetic oligonucleotide
acccacccacggttatccctacagtcacacta

SEQ ID NO: 158194 - DNA, 35 bp, Artificial Sequence
  Synthetic oligonucleotide
tgtgacccctcccgttgggccctcgattcactcta

SEQ ID NO: 158195 - DNA, 36 bp, Artificial Sequence
  Synthetic oligonucleotide
gcccccctatgccccagacccactgtttccccggta

SEQ ID NO: 158196 - DNA, 36 bp, Artificial Sequence
  Synthetic oligonucleotide
accagctgtgccgcccgcccccccgaacgagatgta

SEQ ID NO: 158197 - DNA, 36 bp, Artificial Sequence
  Synthetic oligonucleotide
gtgaccgtgccgacgcgtgacacactcgccccctta

SEQ ID NO: 158198 - DNA, 35 bp, Artificial Sequence
  Synthetic oligonucleotide
tcagagccccccgtacctccgttaatcacgcttta

SEQ ID NO: 158199 - DNA, 35 bp, Artificial Sequence
  Synthetic oligonucleotide
ttacctgcctgtatgtccgccgctgaactatcaac

SEQ ID NO: 158200 - DNA, 35 bp, Artificial Sequence
  Synthetic oligonucleotide
tcaggcaccggtaccgctcccacagcatgctacac

SEQ ID NO: 158201 - DNA, 35 bp, Artificial Sequence
  Synthetic oligonucleotide
gcaccgcttatatggccaccctgcctaccgcgcac

SEQ ID NO: 158202 - DNA, 35 bp, Artificial Sequence
  Synthetic oligonucleotide
gtctaacgcaagtgttaacggtccaacctcttcac

SEQ ID NO: 158203 - DNA, 35 bp, Artificial Sequence
  Synthetic oligonucleotide
gttggcgccgccgttctcatccccgtgcctttcac

SEQ ID NO: 158204 - DNA, 36 bp, Artificial Sequence
  Synthetic oligonucleotide
actgccttccgcacttattgcctttcgttgtacgac

SEQ ID NO: 158205 - DNA, 35 bp, Artificial Sequence
  Synthetic oligonucleotide
tcacgctcagcacttgcctgccggctcatcccgac

SEQ ID NO: 158206 - DNA, 35 bp, Artificial Sequence
  Synthetic oligonucleotide
tgcgacttgcatttgcgttcactccccgtgcttac

SEQ ID NO: 158207 - DNA, 35 bp, Artificial Sequence
  Synthetic oligonucleotide
gtagcagtgctcgttccacccgttactggctcacc

SEQ ID NO: 158208 - DNA, 35 bp, Artificial Sequence
  Synthetic oligonucleotide
tcagggcccttcccctcgctcatccctaccggccc

SEQ ID NO: 158209 - DNA, 35 bp, Artificial Sequence
  Synthetic oligonucleotide
gcccaccaccattgccgattccaagttaccttgcc

SEQ ID NO: 158210 - DNA, 35 bp, Artificial Sequence
  Synthetic oligonucleotide
gcattggacgttgcctcagtcgacttctcccctcc

SEQ ID NO: 158211 - DNA, 35 bp, Artificial Sequence
  Synthetic oligonucleotide
ggttgccgcgacccgtctcaccgcgaatggcctcc

SEQ ID NO: 158212 - DNA, 35 bp, Artificial Sequence
  Synthetic oligonucleotide
aagactgccgccgctatatcttagttctgctctcc

SEQ ID NO: 158213 - DNA, 35 bp, Artificial Sequence
  Synthetic oligonucleotide
gagtgccctttcaacctgtcaaaccgcccagttcc

SEQ ID NO: 158214 - DNA, 35 bp, Artificial Sequence
  Synthetic oligonucleotide
tcagcccttccgttagcccactacaactctctcgc

SEQ ID NO: 158215 - DNA, 35 bp, Artificial Sequence
  Synthetic oligonucleotide
gacgccgcagccagtccattttttcatctccgtgc

SEQ ID NO: 158216 - DNA, 36 bp, Artificial Sequence
  Synthetic oligonucleotide
gccccatcccatcagtaggctgcagtaacactcatc

SEQ ID NO: 158217 - DNA, 35 bp, Artificial Sequence
  Synthetic oligonucleotide
tagagcactgccccgcggtttgttacctcccgatc

SEQ ID NO: 158218 - DNA, 35 bp, Artificial Sequence
  Synthetic oligonucleotide
tgcaccccatcctaatattcatcagtggactgctc

SEQ ID NO: 158219 - DNA, 35 bp, Artificial Sequence
  Synthetic oligonucleotide
tcctcaccaccgttcacaggtcaacgatcccagtc

SEQ ID NO: 158220 - DNA, 35 bp, Artificial Sequence
  Synthetic oligonucleotide
acaccgctcactcacacgccgtttcccccgttgtc

SEQ ID NO: 158221 - DNA, 35 bp, Artificial Sequence
  Synthetic oligonucleotide
ggctgtgtgcagagtccgcgccacgtttgcccttc

SEQ ID NO: 158222 - DNA, 35 bp, Artificial Sequence
  Synthetic oligonucleotide
gaaatcgtcctcccattattagcccccgtaccccg

SEQ ID NO: 158223 - DNA, 35 bp, Artificial Sequence
  Synthetic oligonucleotide
gcctacctcaacgtgtcctaaacgtactctcatcg

SEQ ID NO: 158224 - DNA, 35 bp, Artificial Sequence
  Synthetic oligonucleotide
tcacaagcactgttacgcctatgtcacttccctcg

SEQ ID NO: 158225 - DNA, 35 bp, Artificial Sequence
  Synthetic oligonucleotide
tacgttgcccttgttccctttatgactcgcagtcg

SEQ ID NO: 158226 - DNA, 35 bp, Artificial Sequence
  Synthetic oligonucleotide
atgccttgactcgctgttcatcgacccttctcgtg

SEQ ID NO: 158227 - DNA, 35 bp, Artificial Sequence
  Synthetic oligonucleotide
tctatgccccttgtttcccgtctgacacatctttg

SEQ ID NO: 158228 - DNA, 35 bp, Artificial Sequence
  Synthetic oligonucleotide
atcccggtcagaaccgctcttctcacctgttcaat

SEQ ID NO: 158229 - DNA, 35 bp, Artificial Sequence
  Synthetic oligonucleotide
tcaacaccctccctgttattttttgactatctgat

SEQ ID NO: 158230 - DNA, 35 bp, Artificial Sequence
  Synthetic oligonucleotide
gtacgtccccactcgcgcaactccccgatccgtat

SEQ ID NO: 158231 - DNA, 35 bp, Artificial Sequence
  Synthetic oligonucleotide
cacaccgccggccacctcacgaactgcctctcact

SEQ ID NO: 158232 - DNA, 35 bp, Artificial Sequence
  Synthetic oligonucleotide
accccgcctaacttgctatctctctcgaggagact

SEQ ID NO: 158233 - DNA, 35 bp, Artificial Sequence
  Synthetic oligonucleotide
gtagacagcacgcacccggaactgccaccatctct

SEQ ID NO: 158234 - DNA, 35 bp, Artificial Sequence
  Synthetic oligonucleotide
aaacaacgcgtagatctcccatcccccgcatctct

SEQ ID NO: 158235 - DNA, 35 bp, Artificial Sequence
  Synthetic oligonucleotide
agcccacctgcccgttgaactagtctttcccgtct

SEQ ID NO: 158236 - DNA, 35 bp, Artificial Sequence
  Synthetic oligonucleotide
acatctcttcaaccgcctcctgtgacattctgtct

SEQ ID NO: 158237 - DNA, 35 bp, Artificial Sequence
  Synthetic oligonucleotide
tcaccacgcgtttctacgctttatcccgcccggtt

SEQ ID NO: 158238 - DNA, 35 bp, Artificial Sequence
  Synthetic oligonucleotide
acaccgcaccatcatttatccaattcctgtttgtt

SEQ ID NO: 158239 - DNA, 35 bp, Artificial Sequence
  Synthetic oligonucleotide
tcagtcacgcccccaaggcttcccccatcacattt

SEQ ID NO: 158240 - DNA, 35 bp, Artificial Sequence
  Synthetic oligonucleotide
acaccttacgccacatccctatgcgagctattttt

SEQ ID NO: 158241 - DNA, 36 bp, Artificial Sequence
  Synthetic oligonucleotide
tcagcacacgccaactacatctcgttcctgcttaaa

SEQ ID NO: 158242 - DNA, 35 bp, Artificial Sequence
  Synthetic oligonucleotide
accaggagccccagcagcctcgtgccactttccaa

SEQ ID NO: 158243 - DNA, 35 bp, Artificial Sequence
  Synthetic oligonucleotide
aacccgagagggcaagtatgagggcggggtggtaa

SEQ ID NO: 158244 - DNA, 36 bp, Artificial Sequence
  Synthetic oligonucleotide
gcgcgatagctcctgctcgcaatcctcctgtttaca

SEQ ID NO: 158245 - DNA, 36 bp, Artificial Sequence
  Synthetic oligonucleotide
gatcaccaccattattgaacgccggatccatcccca

SEQ ID NO: 158246 - DNA, 35 bp, Artificial Sequence
  Synthetic oligonucleotide
gcgcccccgcctcgtgtgcataccttctctcccca

SEQ ID NO: 158247 - DNA, 35 bp, Artificial Sequence
  Synthetic oligonucleotide
tctcccgcttatccatgtcgttcaatctcttccca

SEQ ID NO: 158248 - DNA, 36 bp, Artificial Sequence
  Synthetic oligonucleotide
tactcatctgccccgaacacctgtgtgccgttccca

SEQ ID NO: 158249 - DNA, 35 bp, Artificial Sequence
  Synthetic oligonucleotide
accccgacataactgtccttgagctttcctacgca

SEQ ID NO: 158250 - DNA, 36 bp, Artificial Sequence
  Synthetic oligonucleotide
tcatcgcccgcccccctggtgtgactttgagtcgca

SEQ ID NO: 158251 - DNA, 34 bp, Artificial Sequence
  Synthetic oligonucleotide
aatcaccagcccaacgtctgccgacccaccatca

SEQ ID NO: 158252 - DNA, 35 bp, Artificial Sequence
  Synthetic oligonucleotide
actgccctcgcctgctagtttgggcttcatcttca

SEQ ID NO: 158253 - DNA, 37 bp, Artificial Sequence
  Synthetic oligonucleotide
cacctctagtgccccctgtctgtgttacattcacaga

SEQ ID NO: 158254 - DNA, 36 bp, Artificial Sequence
  Synthetic oligonucleotide
tgatccaccctgcacttccatcgcccatccgttaga

SEQ ID NO: 158255 - DNA, 37 bp, Artificial Sequence
  Synthetic oligonucleotide
tcaaacttgccctccgttcgtatacgttcccgccgga

SEQ ID NO: 158256 - DNA, 37 bp, Artificial Sequence
  Synthetic oligonucleotide
gcactggggaggagtgggagtgcgcgggaactaggga

SEQ ID NO: 158257 - DNA, 37 bp, Artificial Sequence
  Synthetic oligonucleotide
tcatcaccccgcagccacctatctataccgctttgga

SEQ ID NO: 158258 - DNA, 38 bp, Artificial Sequence
  Synthetic oligonucleotide
accccttctgccctcttctgtatcaccctgctccatga

SEQ ID NO: 158259 - DNA, 38 bp, Artificial Sequence
  Synthetic oligonucleotide
gccccgcacctcccctctgttcacttgtaagtgcatga

SEQ ID NO: 158260 - DNA, 37 bp, Artificial Sequence
  Synthetic oligonucleotide
gtggaagggcgggcggaggagccgaagacagggatga

SEQ ID NO: 158261 - DNA, 37 bp, Artificial Sequence
  Synthetic oligonucleotide
agacgcctcgcccagcccgacgcacgcttttacctga

SEQ ID NO: 158262 - DNA, 36 bp, Artificial Sequence
  Synthetic oligonucleotide
tgcgccctcccggtacccatcacccgcataatctga

SEQ ID NO: 158263 - DNA, 38 bp, Artificial Sequence
  Synthetic oligonucleotide
tagcggggtagggggggggaaggccctgaggaaggtga

SEQ ID NO: 158264 - DNA, 38 bp, Artificial Sequence
  Synthetic oligonucleotide
gatggggagggaggagatcgacagatatgggggggtga

SEQ ID NO: 158265 - DNA, 38 bp, Artificial Sequence
  Synthetic oligonucleotide
tgcacccgctgccctgccatctccgttcattcgattga

SEQ ID NO: 158266 - DNA, 38 bp, Artificial Sequence
  Synthetic oligonucleotide
tcaagagggggggagtggggtgagttgacgcggcttga

SEQ ID NO: 158267 - DNA, 38 bp, Artificial Sequence
  Synthetic oligonucleotide
accgcacacattgtcttccgaacctccgccgtagttga

SEQ ID NO: 158268 - DNA, 35 bp, Artificial Sequence
  Synthetic oligonucleotide
ttcgttgcctcgctcggcctccccctccatttgac

SEQ ID NO: 158269 - DNA, 35 bp, Artificial Sequence
  Synthetic oligonucleotide
gatctcccatctcgccccgaccaatgcctgcaacc

SEQ ID NO: 158270 - DNA, 35 bp, Artificial Sequence
  Synthetic oligonucleotide
tgtgtagggccatctcactcgccacctttgccacc

SEQ ID NO: 158271 - DNA, 33 bp, Artificial Sequence
  Synthetic oligonucleotide
tactgtgccgttggtcgcgcacaacttatcacc

SEQ ID NO: 158272 - DNA, 35 bp, Artificial Sequence
  Synthetic oligonucleotide
gatcagggtcattctccggccttcgttcgtcaccc

SEQ ID NO: 158273 - DNA, 35 bp, Artificial Sequence
  Synthetic oligonucleotide
accgagcacccgatccttcgacctgcgcacacccc

SEQ ID NO: 158274 - DNA, 35 bp, Artificial Sequence
  Synthetic oligonucleotide
tgctgaaggcgcagtcttcgatacctagctccccc

SEQ ID NO: 158275 - DNA, 35 bp, Artificial Sequence
  Synthetic oligonucleotide
agatcggttccgccccatgctctactgagctcgcc

SEQ ID NO: 158276 - DNA, 35 bp, Artificial Sequence
  Synthetic oligonucleotide
tgctgtccgtatattgctctgtcccggcgacctcc

SEQ ID NO: 158277 - DNA, 35 bp, Artificial Sequence
  Synthetic oligonucleotide
tagtagcgctactccgactagcttgccccgcttcc

SEQ ID NO: 158278 - DNA, 35 bp, Artificial Sequence
  Synthetic oligonucleotide
gtgtacgccccatattttctccgttgcctacgggc

SEQ ID NO: 158279 - DNA, 35 bp, Artificial Sequence
  Synthetic oligonucleotide
acacgctcgcgcaggtccccccgaacgtgccaatc

SEQ ID NO: 158280 - DNA, 35 bp, Artificial Sequence
  Synthetic oligonucleotide
aaccagcacgtcctaatctttctttgccacccctc

SEQ ID NO: 158281 - DNA, 35 bp, Artificial Sequence
  Synthetic oligonucleotide
atcaccgccgtcaccatcgcactgcttacgtcctc

SEQ ID NO: 158282 - DNA, 35 bp, Artificial Sequence
  Synthetic oligonucleotide
acctctatgctccatgcttgtcgctctatctgctc

SEQ ID NO: 158283 - DNA, 35 bp, Artificial Sequence
  Synthetic oligonucleotide
gcccccccaccgcgtaggaacctcgtagctctctc

SEQ ID NO: 158284 - DNA, 35 bp, Artificial Sequence
  Synthetic oligonucleotide
tagtgggccctcacttgaataataccccttccgtc

SEQ ID NO: 158285 - DNA, 35 bp, Artificial Sequence
  Synthetic oligonucleotide
tgagtatctcccgacgtgttcgccctccgttattc

SEQ ID NO: 158286 - DNA, 35 bp, Artificial Sequence
  Synthetic oligonucleotide
tctgccacccgcctgagatctcgtgccttcccttc

SEQ ID NO: 158287 - DNA, 35 bp, Artificial Sequence
  Synthetic oligonucleotide
gtacccgggaggtccgccctccttttcccccgttc

SEQ ID NO: 158288 - DNA, 35 bp, Artificial Sequence
  Synthetic oligonucleotide
acataccgtgatcggctatgtccctttcgcctttc

SEQ ID NO: 158289 - DNA, 35 bp, Artificial Sequence
  Synthetic oligonucleotide
tcaccgctttgtgactatgttaacctccctgtttc

SEQ ID NO: 158290 - DNA, 35 bp, Artificial Sequence
  Synthetic oligonucleotide
tacctgcccaatgacccctcgcaactactttaacg

SEQ ID NO: 158291 - DNA, 35 bp, Artificial Sequence
  Synthetic oligonucleotide
tgaatcccacctgaaggtcttgcactctccccccg

SEQ ID NO: 158292 - DNA, 35 bp, Artificial Sequence
  Synthetic oligonucleotide
tccgccccgctccatgacctcgctatctcgttccg

SEQ ID NO: 158293 - DNA, 35 bp, Artificial Sequence
  Synthetic oligonucleotide
gtacgggtgggaggtagaggggcttgggcgtccgg

SEQ ID NO: 158294 - DNA, 35 bp, Artificial Sequence
  Synthetic oligonucleotide
gaacctccgtccacgcctcatgacccgccacgtgg

SEQ ID NO: 158295 - DNA, 35 bp, Artificial Sequence
  Synthetic oligonucleotide
tgtgactttcccctgccttcgccgttccgttaatg

SEQ ID NO: 158296 - DNA, 35 bp, Artificial Sequence
  Synthetic oligonucleotide
gtccgccgcctgggccgttatgtatttttatcctg

SEQ ID NO: 158297 - DNA, 35 bp, Artificial Sequence
  Synthetic oligonucleotide
atgctgccataagccccccttaatccctcctcctg

SEQ ID NO: 158298 - DNA, 35 bp, Artificial Sequence
  Synthetic oligonucleotide
agccgcacctaccgcctcttcgcgtcccttccgtg

SEQ ID NO: 158299 - DNA, 35 bp, Artificial Sequence
  Synthetic oligonucleotide
gtcactagcgatcacttcccctgcctaactgtcat

SEQ ID NO: 158300 - DNA, 35 bp, Artificial Sequence
  Synthetic oligonucleotide
ttcgcccggtcgatctatgctagcgcccttctact

SEQ ID NO: 158301 - DNA, 35 bp, Artificial Sequence
  Synthetic oligonucleotide
actgcccctccgagttattcccttgcaccgcccct

SEQ ID NO: 158302 - DNA, 35 bp, Artificial Sequence
  Synthetic oligonucleotide
aagccacaccgctggaacaggccattccgacctct

SEQ ID NO: 158303 - DNA, 35 bp, Artificial Sequence
  Synthetic oligonucleotide
gcctggctccgccgctctatgcaccccggccctct

SEQ ID NO: 158304 - DNA, 35 bp, Artificial Sequence
  Synthetic oligonucleotide
gccgtgccgaggttagcaccacctctctttgttct

SEQ ID NO: 158305 - DNA, 35 bp, Artificial Sequence
  Synthetic oligonucleotide
aaaatgggcgggcatcgagggagggggtcatacgt

SEQ ID NO: 158306 - DNA, 35 bp, Artificial Sequence
  Synthetic oligonucleotide
tcctactcagccgtagttcatcgccttgacccctt

SEQ ID NO: 158307 - DNA, 35 bp, Artificial Sequence
  Synthetic oligonucleotide
tcatcactacagccactctttatgcacagccgctt

SEQ ID NO: 158308 - DNA, 35 bp, Artificial Sequence
  Synthetic oligonucleotide
ccacgtacttgcggccacgttcctccgtcgttctt

SEQ ID NO: 158309 - DNA, 35 bp, Artificial Sequence
  Synthetic oligonucleotide
gctattcccccgatcctgtgcacccgcctcctgtt

SEQ ID NO: 158310 - DNA, 35 bp, Artificial Sequence
  Synthetic oligonucleotide
gtgctcccacctgcgcttcttcacctgctgcattt

SEQ ID NO: 158311 - DNA, 35 bp, Artificial Sequence
  Synthetic oligonucleotide
tcgctggttcatgttatccgtcggccacccccttt

SEQ ID NO: 158312 - DNA, 35 bp, Artificial Sequence
  Synthetic oligonucleotide
gatgtgcacggtacggtctcgcattattcctcttt

SEQ ID NO: 158313 - DNA, 35 bp, Artificial Sequence
  Synthetic oligonucleotide
gcatcgcaatagctgtcccgacctgccccttcttt

SEQ ID NO: 158314 - DNA, 36 bp, Artificial Sequence
  Synthetic oligonucleotide
gagcccctcacgccccgcctgctatttggttaacaa

SEQ ID NO: 158315 - DNA, 36 bp, Artificial Sequence
  Synthetic oligonucleotide
attgaccgccacagcccgcctcttgtcacaccacaa

SEQ ID NO: 158316 - DNA, 36 bp, Artificial Sequence
  Synthetic oligonucleotide
gccaccccccgcccccatcgagatggaaacttcgaa

SEQ ID NO: 158317 - DNA, 36 bp, Artificial Sequence
  Synthetic oligonucleotide
taccctctccgttgctcgtgccgtacgttctcgtaa

SEQ ID NO: 158318 - DNA, 36 bp, Artificial Sequence
  Synthetic oligonucleotide
gacaaaaagagggcggggggaaaggtaactgtgtaa

SEQ ID NO: 158319 - DNA, 36 bp, Artificial Sequence
  Synthetic oligonucleotide
acccactcagctgtccttatctggcatcatcgcaca

SEQ ID NO: 158320 - DNA, 35 bp, Artificial Sequence
  Synthetic oligonucleotide
atgacccgccgctgcccttaaacaggacgactaca

SEQ ID NO: 158321 - DNA, 36 bp, Artificial Sequence
  Synthetic oligonucleotide
tgggcgtccgtcaccatcctgttcatccgcgtacca

SEQ ID NO: 158322 - DNA, 36 bp, Artificial Sequence
  Synthetic oligonucleotide
gtctcacgcagggccacctccaccaggccatcccca

SEQ ID NO: 158323 - DNA, 35 bp, Artificial Sequence
  Synthetic oligonucleotide
tagatcgtagctgtcccgtctgttctcgtgctcca

SEQ ID NO: 158324 - DNA, 36 bp, Artificial Sequence
  Synthetic oligonucleotide
ggacggtccgggcgcgttcattagctacactctcca

SEQ ID NO: 158325 - DNA, 36 bp, Artificial Sequence
  Synthetic oligonucleotide
tcccccacctcccgatatgatttgcaccgcgcggca

SEQ ID NO: 158326 - DNA, 36 bp, Artificial Sequence
  Synthetic oligonucleotide
atcgacactcgcagttgttggtcgccttccttatca

SEQ ID NO: 158327 - DNA, 36 bp, Artificial Sequence
  Synthetic oligonucleotide
tatagcgttggattgcccccccgtcctcattgctca

SEQ ID NO: 158328 - DNA, 35 bp, Artificial Sequence
  Synthetic oligonucleotide
tctcacgacgctgttctttccccttcccagagtca

SEQ ID NO: 158329 - DNA, 37 bp, Artificial Sequence
  Synthetic oligonucleotide
agacgggcttgggggggaatagcatggggaacggaga

SEQ ID NO: 158330 - DNA, 36 bp, Artificial Sequence
  Synthetic oligonucleotide
aggtcagggtggggggcaaagggtgcgcggcggaga

SEQ ID NO: 158331 - DNA, 37 bp, Artificial Sequence
  Synthetic oligonucleotide
gtgagaggtgggtggggatggggccagtttagctaga

SEQ ID NO: 158332 - DNA, 37 bp, Artificial Sequence
  Synthetic oligonucleotide
aacagcccctcatgcctatccgaccattgtgctacga

SEQ ID NO: 158333 - DNA, 35 bp, Artificial Sequence
  Synthetic oligonucleotide
gttcatcatctcgtacatcatcgttgcctccccga

SEQ ID NO: 158334 - DNA, 37 bp, Artificial Sequence
  Synthetic oligonucleotide
tccacaccccattgtactcctcgcagttctagcccga

SEQ ID NO: 158335 - DNA, 35 bp, Artificial Sequence
  Synthetic oligonucleotide
tcagagcccccacttccttacgccccgctcctcga

SEQ ID NO: 158336 - DNA, 37 bp, Artificial Sequence
  Synthetic oligonucleotide
acctccgcccccttctctgagtcatcgtgcttttcga

SEQ ID NO: 158337 - DNA, 36 bp, Artificial Sequence
  Synthetic oligonucleotide
atgaaacatggaggaggggaagaaatgactggggga

SEQ ID NO: 158338 - DNA, 37 bp, Artificial Sequence
  Synthetic oligonucleotide
aggggcacgagtacgggctaggggaaatgactgggga

SEQ ID NO: 158339 - DNA, 36 bp, Artificial Sequence
  Synthetic oligonucleotide
taacgggatgggtgggggggcgacatactgtctgga

SEQ ID NO: 158340 - DNA, 36 bp, Artificial Sequence
  Synthetic oligonucleotide
gctgtaaggtggaggagaggaacgatagggattgga

SEQ ID NO: 158341 - DNA, 38 bp, Artificial Sequence
  Synthetic oligonucleotide
gccctcgccgactgtatcatttaactcgccccctatga

SEQ ID NO: 158342 - DNA, 38 bp, Artificial Sequence
  Synthetic oligonucleotide
tcgcccatctcgcctaggtacatttctgcccaccctga

SEQ ID NO: 158343 - DNA, 38 bp, Artificial Sequence
  Synthetic oligonucleotide
acaccgcgctccatatgcccgtgctctcgcctccctga

SEQ ID NO: 158344 - DNA, 38 bp, Artificial Sequence
  Synthetic oligonucleotide
atcgcccccgctgcatttgtttcgccccttcggcctga

SEQ ID NO: 158345 - DNA, 38 bp, Artificial Sequence
  Synthetic oligonucleotide
gccccgtacgagccacccagtacaccatccctgcctga

SEQ ID NO: 158346 - DNA, 38 bp, Artificial Sequence
  Synthetic oligonucleotide
tccgccttcctgcgtgactctcgcacttccactcctga

SEQ ID NO: 158347 - DNA, 36 bp, Artificial Sequence
  Synthetic oligonucleotide
gcgcactccccatgctttgacttctgtcccttctga

SEQ ID NO: 158348 - DNA, 38 bp, Artificial Sequence
  Synthetic oligonucleotide
atgggcggggtggggcggagggacaaggaagggagtga

SEQ ID NO: 158349 - DNA, 38 bp, Artificial Sequence
  Synthetic oligonucleotide
gttcccaccgttcctagttagtaatatcgctcccgtga

SEQ ID NO: 158350 - DNA, 37 bp, Artificial Sequence
  Synthetic oligonucleotide
gcggagggacggaatggctaaaagggaggcggggtga

SEQ ID NO: 158351 - DNA, 37 bp, Artificial Sequence
  Synthetic oligonucleotide
gacagagggaaacggtactatgggagtggggtggtga

SEQ ID NO: 158352 - DNA, 36 bp, Artificial Sequence
  Synthetic oligonucleotide
atcggaccacccttttttgtgctcatcgccccacta

SEQ ID NO: 158353 - DNA, 36 bp, Artificial Sequence
  Synthetic oligonucleotide
acggacccctctctgtaatgttcgcctccacaccta

SEQ ID NO: 158354 - DNA, 36 bp, Artificial Sequence
  Synthetic oligonucleotide
tagaactcgcccttctgttgtcttaatcccccggta

SEQ ID NO: 158355 - DNA, 35 bp, Artificial Sequence
  Synthetic oligonucleotide
gtctctgccacctgaccgttaatccagcaccgtta

SEQ ID NO: 158356 - DNA, 36 bp, Artificial Sequence
  Synthetic oligonucleotide
ttcgcttggccgacctgcttacccgactctccttta

SEQ ID NO: 158357 - DNA, 35 bp, Artificial Sequence
  Synthetic oligonucleotide
gtcctcgtccctctgtcttattctgtttccttgac

SEQ ID NO: 158358 - DNA, 35 bp, Artificial Sequence
  Synthetic oligonucleotide
ttccactccccagcgtaaaagctaccggctcaccc

SEQ ID NO: 158359 - DNA, 35 bp, Artificial Sequence
  Synthetic oligonucleotide
ccaccctgccctcacatttttctctttaatgcgcc

SEQ ID NO: 158360 - DNA, 35 bp, Artificial Sequence
  Synthetic oligonucleotide
tctaagccccacccattcgaccccctcactgcgcc

SEQ ID NO: 158361 - DNA, 35 bp, Artificial Sequence
  Synthetic oligonucleotide
ctcccgtacgcgctgccatctatattcctcgtgcc

SEQ ID NO: 158362 - DNA, 35 bp, Artificial Sequence
  Synthetic oligonucleotide
tccaacccgggttggcgattttgttcacgcttgcc

SEQ ID NO: 158363 - DNA, 35 bp, Artificial Sequence
  Synthetic oligonucleotide
tgggtggcctaactttctgctactggtcccgttcc

SEQ ID NO: 158364 - DNA, 35 bp, Artificial Sequence
  Synthetic oligonucleotide
acatccgccgtcgcgaccccagactaagctgttcc

SEQ ID NO: 158365 - DNA, 35 bp, Artificial Sequence
  Synthetic oligonucleotide
atccagcaacatccacagtctgccaaatcctttcc

SEQ ID NO: 158366 - DNA, 35 bp, Artificial Sequence
  Synthetic oligonucleotide
gttcactcgatttggttaccttgcctccgttttcc

SEQ ID NO: 158367 - DNA, 35 bp, Artificial Sequence
  Synthetic oligonucleotide
ttccacccctccattgccaacgttgcaggtcccgc

SEQ ID NO: 158368 - DNA, 35 bp, Artificial Sequence
  Synthetic oligonucleotide
agatgcccccactgccccttgagtggattctaatc

SEQ ID NO: 158369 - DNA, 35 bp, Artificial Sequence
  Synthetic oligonucleotide
tccacctgtcgaacttctgttacaaagctgccatc

SEQ ID NO: 158370 - DNA, 35 bp, Artificial Sequence
  Synthetic oligonucleotide
gtatacgactgccttcattccctgttccgccgatc

SEQ ID NO: 158371 - DNA, 35 bp, Artificial Sequence
  Synthetic oligonucleotide
atggaggcatttccccctgctgtttctgctaactc

SEQ ID NO: 158372 - DNA, 35 bp, Artificial Sequence
  Synthetic oligonucleotide
actggcccctccatcggtctattacaaattcactc

SEQ ID NO: 158373 - DNA, 35 bp, Artificial Sequence
  Synthetic oligonucleotide
gcatagttccccgtatgcgccccatgctccacctc

SEQ ID NO: 158374 - DNA, 35 bp, Artificial Sequence
  Synthetic oligonucleotide
acgcctcctcttgcccttgtatcgttgcgcgcctc

SEQ ID NO: 158375 - DNA, 35 bp, Artificial Sequence
  Synthetic oligonucleotide
gatggtggagaccagtgcgcgtcgcctcccttctc

SEQ ID NO: 158376 - DNA, 35 bp, Artificial Sequence
  Synthetic oligonucleotide
gagagcgatcactttttgcctgttctgtcgcgttc

SEQ ID NO: 158377 - DNA, 35 bp, Artificial Sequence
  Synthetic oligonucleotide
tgtcaatccgtaagcccccgccacccgcccaccag

SEQ ID NO: 158378 - DNA, 35 bp, Artificial Sequence
  Synthetic oligonucleotide
ttcacgcgagttccgcgcgtattaacacccctccg

SEQ ID NO: 158379 - DNA, 35 bp, Artificial Sequence
  Synthetic oligonucleotide
gtattccggcagtccacccgtaccttcctgctccg

SEQ ID NO: 158380 - DNA, 35 bp, Artificial Sequence
  Synthetic oligonucleotide
gttccatcctaaatctgttgacgacgcaccttccg

SEQ ID NO: 158381 - DNA, 35 bp, Artificial Sequence
  Synthetic oligonucleotide
gtcctctatcgccaatccacccgtgattcatctcg

SEQ ID NO: 158382 - DNA, 35 bp, Artificial Sequence
  Synthetic oligonucleotide
gcctagagcgacgtcgacgacccttcaccctctcg

SEQ ID NO: 158383 - DNA, 35 bp, Artificial Sequence
  Synthetic oligonucleotide
gttggggcgccacattcttttcccatttagtctcg

SEQ ID NO: 158384 - DNA, 35 bp, Artificial Sequence
  Synthetic oligonucleotide
gtcggttagggggctggaaaaagggagggagcggg

SEQ ID NO: 158385 - DNA, 35 bp, Artificial Sequence
  Synthetic oligonucleotide
tgccaccacctttatccacacactgctgaacttgg

SEQ ID NO: 158386 - DNA, 35 bp, Artificial Sequence
  Synthetic oligonucleotide
tcccgtcttgcacttctcaccctgcccctgccatg

SEQ ID NO: 158387 - DNA, 35 bp, Artificial Sequence
  Synthetic oligonucleotide
agtgatccgcacacatacacgtaccctctgtcctg

SEQ ID NO: 158388 - DNA, 35 bp, Artificial Sequence
  Synthetic oligonucleotide
atgccacgtggcacccgactccgccctaatcattg

SEQ ID NO: 158389 - DNA, 35 bp, Artificial Sequence
  Synthetic oligonucleotide
tctgcgtgtaccgctcattttgatcccttgccttg

SEQ ID NO: 158390 - DNA, 35 bp, Artificial Sequence
  Synthetic oligonucleotide
gtccggagcgccatgccggtctccattgtccccat

SEQ ID NO: 158391 - DNA, 35 bp, Artificial Sequence
  Synthetic oligonucleotide
gttcgcgctcccagctccacctgtcgattatcact

SEQ ID NO: 158392 - DNA, 35 bp, Artificial Sequence
  Synthetic oligonucleotide
gcacgtgtacattgccttctgttgcgttcttcact

SEQ ID NO: 158393 - DNA, 35 bp, Artificial Sequence
  Synthetic oligonucleotide
agatcgcctgccccttcaccctgctttggtatact

SEQ ID NO: 158394 - DNA, 35 bp, Artificial Sequence
  Synthetic oligonucleotide
gatgggtgtggtggggggcttggagaggggtccct

SEQ ID NO: 158395 - DNA, 35 bp, Artificial Sequence
  Synthetic oligonucleotide
tccagccttctgtcccgaccaggccatccctttct

SEQ ID NO: 158396 - DNA, 35 bp, Artificial Sequence
  Synthetic oligonucleotide
acagacgatggggggagaggggatgtcttacgggt

SEQ ID NO: 158397 - DNA, 35 bp, Artificial Sequence
  Synthetic oligonucleotide
taacccgggaggagaggggggggtcaacaatgggt

SEQ ID NO: 158398 - DNA, 35 bp, Artificial Sequence
  Synthetic oligonucleotide
tacccgcccccgttctcgaaacaaaccccatatgt

SEQ ID NO: 158399 - DNA, 35 bp, Artificial Sequence
  Synthetic oligonucleotide
gatccatccccttgctgcgacactccaatgcttgt

SEQ ID NO: 158400 - DNA, 35 bp, Artificial Sequence
  Synthetic oligonucleotide
tacttgcccttgcccctgttttggaatcatagatt

SEQ ID NO: 158401 - DNA, 35 bp, Artificial Sequence
  Synthetic oligonucleotide
tagagacacatgcgttcccaccgttccagcccctt

SEQ ID NO: 158402 - DNA, 35 bp, Artificial Sequence
  Synthetic oligonucleotide
tgagtaaccgcggcctcggttcatactctgccctt

SEQ ID NO: 158403 - DNA, 35 bp, Artificial Sequence
  Synthetic oligonucleotide
gttgtgccaatgtggtcgccaccccttcccctctt

SEQ ID NO: 158404 - DNA, 35 bp, Artificial Sequence
  Synthetic oligonucleotide
gcacgtttcgccatccatgtttgtatcgttctctt

SEQ ID NO: 158405 - DNA, 35 bp, Artificial Sequence
  Synthetic oligonucleotide
gcaccccgcttgtctggccgtgatctgttattctt

SEQ ID NO: 158406 - DNA, 35 bp, Artificial Sequence
  Synthetic oligonucleotide
tatgacgcagatgtccccgtttgccactacgcgtt

SEQ ID NO: 158407 - DNA, 36 bp, Artificial Sequence
  Synthetic oligonucleotide
acaccccggcccataaccctcgcacgtcctcgcaaa

SEQ ID NO: 158408 - DNA, 36 bp, Artificial Sequence
  Synthetic oligonucleotide
tcgccccaacatagcttacatgacacgcctctccaa

SEQ ID NO: 158409 - DNA, 35 bp, Artificial Sequence
  Synthetic oligonucleotide
aaccccactgatgcccacctcgaccctttattcaa

SEQ ID NO: 158410 - DNA, 35 bp, Artificial Sequence
  Synthetic oligonucleotide
gagaacggttagaaggggcgggaacatggtcggaa

SEQ ID NO: 158411 - DNA, 35 bp, Artificial Sequence
  Synthetic oligonucleotide
tcaacgcacacgcctacgctgcccatggatcctaa

SEQ ID NO: 158412 - DNA, 35 bp, Artificial Sequence
  Synthetic oligonucleotide
gtctacgcacccacagccccagcccacgcctgaca

SEQ ID NO: 158413 - DNA, 35 bp, Artificial Sequence
  Synthetic oligonucleotide
gtcaccctgctggagcacgccatgtctaccctaca

SEQ ID NO: 158414 - DNA, 36 bp, Artificial Sequence
  Synthetic oligonucleotide
gagccactccctctgttcaacctctgtggcatttca

SEQ ID NO: 158415 - DNA, 37 bp, Artificial Sequence
  Synthetic oligonucleotide
attgagtgagccaggggggaatggacgagggaacaga

SEQ ID NO: 158416 - DNA, 37 bp, Artificial Sequence
  Synthetic oligonucleotide
tgacacccgctgttctgcctctttcgctctaccccga

SEQ ID NO: 158417 - DNA, 37 bp, Artificial Sequence
  Synthetic oligonucleotide
tgcacccgtccactcgctagtcaccgccttttcccga

SEQ ID NO: 158418 - DNA, 37 bp, Artificial Sequence
  Synthetic oligonucleotide
tgtgcacagcttgtctggttcccctgttcacctccga

SEQ ID NO: 158419 - DNA, 37 bp, Artificial Sequence
  Synthetic oligonucleotide
tccgtacggtacgatatgcctctctcaccttcctcga

SEQ ID NO: 158420 - DNA, 37 bp, Artificial Sequence
  Synthetic oligonucleotide
gcgtacgctctgtagtccgccccccccgccctctcga

SEQ ID NO: 158421 - DNA, 37 bp, Artificial Sequence
  Synthetic oligonucleotide
gccccaccgcttttggttttgcttcagtcgccttcga

SEQ ID NO: 158422 - DNA, 37 bp, Artificial Sequence
  Synthetic oligonucleotide
acgaggccaaagggtgggaggacgagtgagaggagga

SEQ ID NO: 158423 - DNA, 36 bp, Artificial Sequence
  Synthetic oligonucleotide
gggtggtcgggtggggcgggatatacggaatacgga

SEQ ID NO: 158424 - DNA, 37 bp, Artificial Sequence
  Synthetic oligonucleotide
gactcacgtcattcttgatctttcgccccaccttgga

SEQ ID NO: 158425 - DNA, 37 bp, Artificial Sequence
  Synthetic oligonucleotide
gtctccgttagctggctcgacccacaatcctccctga

SEQ ID NO: 158426 - DNA, 37 bp, Artificial Sequence
  Synthetic oligonucleotide
gcggaagtcgcgcgttgttgctttccctccactctga

SEQ ID NO: 158427 - DNA, 38 bp, Artificial Sequence
  Synthetic oligonucleotide
ggggtgcaggggggcggaaatgcgggggaagcaagtga

SEQ ID NO: 158428 - DNA, 38 bp, Artificial Sequence
  Synthetic oligonucleotide
actgggtgggcgggaagggagggtgtctggcgaagtga

SEQ ID NO: 158429 - DNA, 38 bp, Artificial Sequence
  Synthetic oligonucleotide
tatcaccgcatgccccgtactaccagccccctaggtga

SEQ ID NO: 158430 - DNA, 38 bp, Artificial Sequence
  Synthetic oligonucleotide
aaacgaggtcgagggcgggggggaaaactggtctgtga

SEQ ID NO: 158431 - DNA, 37 bp, Artificial Sequence
  Synthetic oligonucleotide
aacgacacggggggggcgaccaaacacggggaattga

SEQ ID NO: 158432 - DNA, 38 bp, Artificial Sequence
  Synthetic oligonucleotide
gactccccctgaagctgctgcacagcctgtcaccttga

SEQ ID NO: 158433 - DNA, 38 bp, Artificial Sequence
  Synthetic oligonucleotide
gttggagggaggaagggaggcacgaagggtcaatttga

SEQ ID NO: 158434 - DNA, 38 bp, Artificial Sequence
  Synthetic oligonucleotide
gtccgccctcttctgtgccatacttccgacccttttga

SEQ ID NO: 158435 - DNA, 36 bp, Artificial Sequence
  Synthetic oligonucleotide
gaccctcccccgttcccccgttcatccgtagtgcta

SEQ ID NO: 158436 - DNA, 35 bp, Artificial Sequence
  Synthetic oligonucleotide
ttgttcccgtccatcccgttcgtaacctccgtcta

SEQ ID NO: 158437 - DNA, 36 bp, Artificial Sequence
  Synthetic oligonucleotide
ttacccgccctgtgttctttccgttggtcctttcta

SEQ ID NO: 158438 - DNA, 36 bp, Artificial Sequence
  Synthetic oligonucleotide
cccccaaccgccacacgtgtctccccggttttcgta

SEQ ID NO: 158439 - DNA, 36 bp, Artificial Sequence
  Synthetic oligonucleotide
ggaacactcacatatgcaccacctgtactggactta

SEQ ID NO: 158440 - DNA, 35 bp, Artificial Sequence
  Synthetic oligonucleotide
acatgcccatcgggcatactgtcctctccttgtta

SEQ ID NO: 158441 - DNA, 35 bp, Artificial Sequence
  Synthetic oligonucleotide
gctctcatgaacgcccgacgcgctaccacccttta

SEQ ID NO: 158442 - DNA, 35 bp, Artificial Sequence
  Synthetic oligonucleotide
gccgccttgccctccagcgtactgtagtactccac

SEQ ID NO: 158443 - DNA, 35 bp, Artificial Sequence
  Synthetic oligonucleotide
tttccactgccctgcccacttgcgcccccgtgcac

SEQ ID NO: 158444 - DNA, 35 bp, Artificial Sequence
  Synthetic oligonucleotide
gaccgtacacgttttaccccctcgtgcctgcttac

SEQ ID NO: 158445 - DNA, 35 bp, Artificial Sequence
  Synthetic oligonucleotide
tccacccgcccgccctccgaaaacattgatctacc

SEQ ID NO: 158446 - DNA, 35 bp, Artificial Sequence
  Synthetic oligonucleotide
gcctgcccaccagtgaagatctctgctctctgccc

SEQ ID NO: 158447 - DNA, 35 bp, Artificial Sequence
  Synthetic oligonucleotide
accacaggcccactggtggttataacgtttctccc

SEQ ID NO: 158448 - DNA, 35 bp, Artificial Sequence
  Synthetic oligonucleotide
tgcaccacttgagctactgcctcataccccccgcc

SEQ ID NO: 158449 - DNA, 35 bp, Artificial Sequence
  Synthetic oligonucleotide
aaccgtcgtctgccgacgttcaatctacctccgcc

SEQ ID NO: 158450 - DNA, 35 bp, Artificial Sequence
  Synthetic oligonucleotide
ttgttccgaactgctgaacttgtaccttcctggcc

SEQ ID NO: 158451 - DNA, 35 bp, Artificial Sequence
  Synthetic oligonucleotide
tatgcccggacgccttgccccttcgctatgaatcc

SEQ ID NO: 158452 - DNA, 35 bp, Artificial Sequence
  Synthetic oligonucleotide
ttcgatcgacacacggatctgtcactccattctcc

SEQ ID NO: 158453 - DNA, 35 bp, Artificial Sequence
  Synthetic oligonucleotide
gcgggcctcgttactattgcggtgcttacttctcc

SEQ ID NO: 158454 - DNA, 35 bp, Artificial Sequence
  Synthetic oligonucleotide
gagtacgcccctcgctgcatcaatatgcgctacgc

SEQ ID NO: 158455 - DNA, 35 bp, Artificial Sequence
  Synthetic oligonucleotide
tctgtcagcctatgtctcctcccgcttctctaggc

SEQ ID NO: 158456 - DNA, 35 bp, Artificial Sequence
  Synthetic oligonucleotide
tctaacatcacacatcttgtcatcacgaacactgc

SEQ ID NO: 158457 - DNA, 35 bp, Artificial Sequence
  Synthetic oligonucleotide
agcccagcactgctatccaccgtcgctctcactgc

SEQ ID NO: 158458 - DNA, 35 bp, Artificial Sequence
  Synthetic oligonucleotide
atcgtacgctcgcttcgggtacttacccccttctc

SEQ ID NO: 158459 - DNA, 35 bp, Artificial Sequence
  Synthetic oligonucleotide
gcctcccccgtgcctttttacagttccatccagtc

SEQ ID NO: 158460 - DNA, 35 bp, Artificial Sequence
  Synthetic oligonucleotide
gcgcccgtgccgccctgcccttttgtgtgtttgtc

SEQ ID NO: 158461 - DNA, 35 bp, Artificial Sequence
  Synthetic oligonucleotide
tgttacgctcccagcggtccttatgcccccgtttc

SEQ ID NO: 158462 - DNA, 35 bp, Artificial Sequence
  Synthetic oligonucleotide
tacttcgcctacaccgatctgtcattatgcttttc

SEQ ID NO: 158463 - DNA, 35 bp, Artificial Sequence
  Synthetic oligonucleotide
accaccagcaagcgtacactacgaccctcttaccg

SEQ ID NO: 158464 - DNA, 35 bp, Artificial Sequence
  Synthetic oligonucleotide
gtctcaaccgccgtcgcccatctaattttggtccg

SEQ ID NO: 158465 - DNA, 35 bp, Artificial Sequence
  Synthetic oligonucleotide
gtgtgttccctgccccttacgcgccattttgctcg

SEQ ID NO: 158466 - DNA, 35 bp, Artificial Sequence
  Synthetic oligonucleotide
ccactccgcctgggcactcccctccgaccccgtcg

SEQ ID NO: 158467 - DNA, 35 bp, Artificial Sequence
  Synthetic oligonucleotide
gccttgcccctgcctctttcctcgtatcaacgcgg

SEQ ID NO: 158468 - DNA, 35 bp, Artificial Sequence
  Synthetic oligonucleotide
gactcctctaatgccctgcccctgctacctggtgg

SEQ ID NO: 158469 - DNA, 35 bp, Artificial Sequence
  Synthetic oligonucleotide
gcggtgaaaacaggggggaaataggttgggtgtgg

SEQ ID NO: 158470 - DNA, 35 bp, Artificial Sequence
  Synthetic oligonucleotide
gtatagggcaaaagggaatgacggaggaagagatg

SEQ ID NO: 158471 - DNA, 35 bp, Artificial Sequence
  Synthetic oligonucleotide
gcgaataccaacgacctgcctggcctctttccctg

SEQ ID NO: 158472 - DNA, 35 bp, Artificial Sequence
  Synthetic oligonucleotide
ttgggcatgccctccgctaccatcatggtgttctg

SEQ ID NO: 158473 - DNA, 34 bp, Artificial Sequence
  Synthetic oligonucleotide
gcgtgccccctcgcttgttgccccatacccattg

SEQ ID NO: 158474 - DNA, 35 bp, Artificial Sequence
  Synthetic oligonucleotide
ttgcaccgaggtagggtgggggggaacgtagggat

SEQ ID NO: 158475 - DNA, 35 bp, Artificial Sequence
  Synthetic oligonucleotide
gatcgctccgacgtacacttgcgattcttacacct

SEQ ID NO: 158476 - DNA, 35 bp, Artificial Sequence
  Synthetic oligonucleotide
gagcccttctatcctgcgacgtccactctgttcct

SEQ ID NO: 158477 - DNA, 35 bp, Artificial Sequence
  Synthetic oligonucleotide
tgaccctcttcgaactgcacctggccctacgtgct

SEQ ID NO: 158478 - DNA, 35 bp, Artificial Sequence
  Synthetic oligonucleotide
atacaccgacagttcatcgcgtacacgtctcctct

SEQ ID NO: 158479 - DNA, 34 bp, Artificial Sequence
  Synthetic oligonucleotide
tcctacctccggagttgctgatacattatcttct

SEQ ID NO: 158480 - DNA, 35 bp, Artificial Sequence
  Synthetic oligonucleotide
agcaagccccattgcaagtaaccgttatctcccgt

SEQ ID NO: 158481 - DNA, 35 bp, Artificial Sequence
  Synthetic oligonucleotide
tagtctcccgtcgcctctgttaccttttatacctt

SEQ ID NO: 158482 - DNA, 35 bp, Artificial Sequence
  Synthetic oligonucleotide
aaatgcgggtcgcctcacgctttatctccatcctt

SEQ ID NO: 158483 - DNA, 35 bp, Artificial Sequence
  Synthetic oligonucleotide
accccctccacatgtgttgaatccttccctctctt

SEQ ID NO: 158484 - DNA, 35 bp, Artificial Sequence
  Synthetic oligonucleotide
tgcgagccgccgccatcgcatctgatacacctgtt

SEQ ID NO: 158485 - DNA, 36 bp, Artificial Sequence
  Synthetic oligonucleotide
gtgccactgccctggccctttaccttgagcctttaa

SEQ ID NO: 158486 - DNA, 35 bp, Artificial Sequence
  Synthetic oligonucleotide
gtttgcccccgttacctccaagaactgcccgtaca

SEQ ID NO: 158487 - DNA, 36 bp, Artificial Sequence
  Synthetic oligonucleotide
gccaccaccgccaaacttgtcgtacgcaaatcacca

SEQ ID NO: 158488 - DNA, 35 bp, Artificial Sequence
  Synthetic oligonucleotide
gtgcattcctccacttggctgtctcgttcctacca

SEQ ID NO: 158489 - DNA, 35 bp, Artificial Sequence
  Synthetic oligonucleotide
tcgcccccgcctcgtgtgcataccttcgctcccca

SEQ ID NO: 158490 - DNA, 36 bp, Artificial Sequence
  Synthetic oligonucleotide
tctccccgtgcctcatcattcgcccaacacaggcca

SEQ ID NO: 158491 - DNA, 36 bp, Artificial Sequence
  Synthetic oligonucleotide
gtgagagctgctgcaccccccgtactccgtgttcca

SEQ ID NO: 158492 - DNA, 36 bp, Artificial Sequence
  Synthetic oligonucleotide
ttgctgtccaggggcctttctcttccgtacttcgca

SEQ ID NO: 158493 - DNA, 35 bp, Artificial Sequence
  Synthetic oligonucleotide
accgtgcgcgctattcacccgttttactgtttgca

SEQ ID NO: 158494 - DNA, 36 bp, Artificial Sequence
  Synthetic oligonucleotide
tacatcacgagtgcccttccccactgtccgccatca

SEQ ID NO: 158495 - DNA, 37 bp, Artificial Sequence
  Synthetic oligonucleotide
cacccatcccccctgccctgttccgctcagtcagaga

SEQ ID NO: 158496 - DNA, 37 bp, Artificial Sequence
  Synthetic oligonucleotide
ccctacgtactctacattgcctgctcgccccatgcga

SEQ ID NO: 158497 - DNA, 36 bp, Artificial Sequence
  Synthetic oligonucleotide
gattttgcctcctgcctgtcgttcacgtccactcga

SEQ ID NO: 158498 - DNA, 37 bp, Artificial Sequence
  Synthetic oligonucleotide
ggtaaacggggggggatagaacggttcaggcaaagga

SEQ ID NO: 158499 - DNA, 35 bp, Artificial Sequence
  Synthetic oligonucleotide
tcgcaggggggggaggggcgggcgaagaactagga

SEQ ID NO: 158500 - DNA, 37 bp, Artificial Sequence
  Synthetic oligonucleotide
gcaaggaggtggattgggtgggctgtactggtgcgga

SEQ ID NO: 158501 - DNA, 37 bp, Artificial Sequence
  Synthetic oligonucleotide
gttccggtcggggttgtttggggtgtcgctctgggga

SEQ ID NO: 158502 - DNA, 37 bp, Artificial Sequence
  Synthetic oligonucleotide
ggggaagcctctgagtacattttagggaggggtggga

SEQ ID NO: 158503 - DNA, 37 bp, Artificial Sequence
  Synthetic oligonucleotide
gaggagccaggaagtaggacgggcggttgggaatgga

SEQ ID NO: 158504 - DNA, 37 bp, Artificial Sequence
  Synthetic oligonucleotide
gggagggaggtggaagggcgacaggaagtcaggtgga

SEQ ID NO: 158505 - DNA, 37 bp, Artificial Sequence
  Synthetic oligonucleotide
gtacgtgcgcctctgggtctgcttcacctcctttgga

SEQ ID NO: 158506 - DNA, 36 bp, Artificial Sequence
  Synthetic oligonucleotide
tgtccccccgccattccagacgcgcttacccaatga

SEQ ID NO: 158507 - DNA, 38 bp, Artificial Sequence
  Synthetic oligonucleotide
tagggccgctcccatctgcttccgacgctcctttatga

SEQ ID NO: 158508 - DNA, 35 bp, Artificial Sequence
  Synthetic oligonucleotide
gctcccctggcccaatcccgaatccgtcgccctga

SEQ ID NO: 158509 - DNA, 37 bp, Artificial Sequence
  Synthetic oligonucleotide
tgtcccaccgaaactcctctcgtccagtcacgcctga

SEQ ID NO: 158510 - DNA, 36 bp, Artificial Sequence
  Synthetic oligonucleotide
tcataccccccgcactggccctataaagtactctga

SEQ ID NO: 158511 - DNA, 38 bp, Artificial Sequence
  Synthetic oligonucleotide
tcacctgccatccatcgcgctctcctccccactcgtga

SEQ ID NO: 158512 - DNA, 38 bp, Artificial Sequence
  Synthetic oligonucleotide
tacggtcaggatgtatgatgggggtggtggggcggtga

SEQ ID NO: 158513 - DNA, 38 bp, Artificial Sequence
  Synthetic oligonucleotide
acttcactccgatcgccgccatgcctatctttcattga

SEQ ID NO: 158514 - DNA, 35 bp, Artificial Sequence
  Synthetic oligonucleotide
gaacaaggtgcaagccgtgcctccctcctcctata

SEQ ID NO: 158515 - DNA, 35 bp, Artificial Sequence
  Synthetic oligonucleotide
gcgatcccgcctgttcccccgggcccttcctccta

SEQ ID NO: 158516 - DNA, 36 bp, Artificial Sequence
  Synthetic oligonucleotide
acccttgccacactctgttacacatccctgttccta

SEQ ID NO: 158517 - DNA, 36 bp, Artificial Sequence
  Synthetic oligonucleotide
tccgtgcgcattactcatcgctcgtccactctcgta

SEQ ID NO: 158518 - DNA, 35 bp, Artificial Sequence
  Synthetic oligonucleotide
acttcgttgcccactgctctatctgacttggaccc

SEQ ID NO: 158519 - DNA, 35 bp, Artificial Sequence
  Synthetic oligonucleotide
gattggccctccgtgaatgcaggctctcgttcccc

SEQ ID NO: 158520 - DNA, 35 bp, Artificial Sequence
  Synthetic oligonucleotide
aattgcaacgcagcctcggcctgccccttttcccc

SEQ ID NO: 158521 - DNA, 35 bp, Artificial Sequence
  Synthetic oligonucleotide
gccttgagcccgaacttcgtgactgtttctcgccc

SEQ ID NO: 158522 - DNA, 35 bp, Artificial Sequence
  Synthetic oligonucleotide
tactctgcacctggcaccatcccactttgtctccc

SEQ ID NO: 158523 - DNA, 35 bp, Artificial Sequence
  Synthetic oligonucleotide
acaccttgccccattgttttttgatcggttctccc

SEQ ID NO: 158524 - DNA, 35 bp, Artificial Sequence
  Synthetic oligonucleotide
tgcgatcccccaggtgctgttcctcattctccgcc

SEQ ID NO: 158525 - DNA, 35 bp, Artificial Sequence
  Synthetic oligonucleotide
gattcgcggtcagatcataaaccacctcgcgcgcc

SEQ ID NO: 158526 - DNA, 35 bp, Artificial Sequence
  Synthetic oligonucleotide
gccgatgggtgggaagggagagtagcggaagggcc

SEQ ID NO: 158527 - DNA, 35 bp, Artificial Sequence
  Synthetic oligonucleotide
gtaccgcccttggcgtgagccactaatacccttcc

SEQ ID NO: 158528 - DNA, 35 bp, Artificial Sequence
  Synthetic oligonucleotide
tccccccagctcccagctctcatcttcccgccagc

SEQ ID NO: 158529 - DNA, 35 bp, Artificial Sequence
  Synthetic oligonucleotide
gatcccggcgtagctccacttcccctccctggcgc

SEQ ID NO: 158530 - DNA, 35 bp, Artificial Sequence
  Synthetic oligonucleotide
gcaacacgggaccacccctttctgtccgccttcgc

SEQ ID NO: 158531 - DNA, 35 bp, Artificial Sequence
  Synthetic oligonucleotide
ttttcacccgccgcttggctcccagagctgttcgc

SEQ ID NO: 158532 - DNA, 35 bp, Artificial Sequence
  Synthetic oligonucleotide
gcccgttatgtctcttcatccccacgcttccgggc

SEQ ID NO: 158533 - DNA, 35 bp, Artificial Sequence
  Synthetic oligonucleotide
atcgaaggcccacacatatgccgcaccatccatgc

SEQ ID NO: 158534 - DNA, 35 bp, Artificial Sequence
  Synthetic oligonucleotide
gcagactctgatcattccgactccatcgcccttgc

SEQ ID NO: 158535 - DNA, 35 bp, Artificial Sequence
  Synthetic oligonucleotide
acttgacccaccgtactcttcgggttgccgaactc

SEQ ID NO: 158536 - DNA, 35 bp, Artificial Sequence
  Synthetic oligonucleotide
gcctatccgcctttggttattcgaatggtccactc

SEQ ID NO: 158537 - DNA, 35 bp, Artificial Sequence
  Synthetic oligonucleotide
agactgagacctttgcgcattccctggtactactc

SEQ ID NO: 158538 - DNA, 35 bp, Artificial Sequence
  Synthetic oligonucleotide
taccatgcctgcgccccctgttgtcatccttggtc

SEQ ID NO: 158539 - DNA, 35 bp, Artificial Sequence
  Synthetic oligonucleotide
ggtcgccactggatctgccctcttgcatacttgtc

SEQ ID NO: 158540 - DNA, 35 bp, Artificial Sequence
  Synthetic oligonucleotide
gtcccgattgccgcattcccacccttcgttggttc

SEQ ID NO: 158541 - DNA, 34 bp, Artificial Sequence
  Synthetic oligonucleotide
gagcactccgccacttctatcgcgtacgtgtttc

SEQ ID NO: 158542 - DNA, 35 bp, Artificial Sequence
  Synthetic oligonucleotide
aggggaacgggcagggatggggctgagcggccgag

SEQ ID NO: 158543 - DNA, 35 bp, Artificial Sequence
  Synthetic oligonucleotide
gcactcatcacagctccccctccggctttgccacg

SEQ ID NO: 158544 - DNA, 35 bp, Artificial Sequence
  Synthetic oligonucleotide
tgaaccctctcggaatatccaccaactccctcacg

SEQ ID NO: 158545 - DNA, 35 bp, Artificial Sequence
  Synthetic oligonucleotide
gcatcgcatccgcctcggcacatttgcctcatccg

SEQ ID NO: 158546 - DNA, 35 bp, Artificial Sequence
  Synthetic oligonucleotide
gtgtccgccccatccacaatttagtctggtctccg

SEQ ID NO: 158547 - DNA, 35 bp, Artificial Sequence
  Synthetic oligonucleotide
acacggcttaggcataaatgggtgggtggtgaggg

SEQ ID NO: 158548 - DNA, 35 bp, Artificial Sequence
  Synthetic oligonucleotide
actgcacgcaagggacaggggcgaatggggtgggg

SEQ ID NO: 158549 - DNA, 35 bp, Artificial Sequence
  Synthetic oligonucleotide
atggtgtgggacgcaccactatgggtctgactatg

SEQ ID NO: 158550 - DNA, 34 bp, Artificial Sequence
  Synthetic oligonucleotide
gggctcacacctccaccatgtactcgctcgcctg

SEQ ID NO: 158551 - DNA, 35 bp, Artificial Sequence
  Synthetic oligonucleotide
tctccaatccccgttctgtacttggttcgcttttg

SEQ ID NO: 158552 - DNA, 35 bp, Artificial Sequence
  Synthetic oligonucleotide
acaagggtgtggcgggtattggggggtaatggaat

SEQ ID NO: 158553 - DNA, 35 bp, Artificial Sequence
  Synthetic oligonucleotide
tcacactcgatcctctaattagtcacgagccctct

SEQ ID NO: 158554 - DNA, 35 bp, Artificial Sequence
  Synthetic oligonucleotide
gaatacacgccggcctgttgtctaccatttctcgt

SEQ ID NO: 158555 - DNA, 35 bp, Artificial Sequence
  Synthetic oligonucleotide
tccgacggacgctctcctgcctccgcctctaatgt

SEQ ID NO: 158556 - DNA, 29 bp, Artificial Sequence
  Synthetic oligonucleotide
gaccactacaatgtttctttctcccttgt

SEQ ID NO: 158557 - DNA, 35 bp, Artificial Sequence
  Synthetic oligonucleotide
tcacacaccctgatcttcactgttccgtatcttgt

SEQ ID NO: 158558 - DNA, 35 bp, Artificial Sequence
  Synthetic oligonucleotide
gagcaacccccatacttgtgctttggtctcttatt

SEQ ID NO: 158559 - DNA, 35 bp, Artificial Sequence
  Synthetic oligonucleotide
gcatgcccggcgacctcccgtgcctacttatcgtt

SEQ ID NO: 158560 - DNA, 35 bp, Artificial Sequence
  Synthetic oligonucleotide
ttaggccggttattgctttttttgtgccttccttt

SEQ ID NO: 158561 - DNA, 35 bp, Artificial Sequence
  Synthetic oligonucleotide
aatcgctcactcgtcttcttcctccggccgggttt

SEQ ID NO: 158562 - DNA, 36 bp, Artificial Sequence
  Synthetic oligonucleotide
tcttgacaccgcgccctcatgcccgtcccctcccaa

SEQ ID NO: 158563 - DNA, 35 bp, Artificial Sequence
  Synthetic oligonucleotide
gaagtcggggaggcgggaggcgaaacagggatgaa

SEQ ID NO: 158564 - DNA, 36 bp, Artificial Sequence
  Synthetic oligonucleotide
tcccacccgcctctcctgtttcgtatagatgcataa

SEQ ID NO: 158565 - DNA, 35 bp, Artificial Sequence
  Synthetic oligonucleotide
gtgcccgccgagcgtgccttttactcgttcacaca

SEQ ID NO: 158566 - DNA, 36 bp, Artificial Sequence
  Synthetic oligonucleotide
gtgccgcgccttcaccgacccccgtgccctcctaca

SEQ ID NO: 158567 - DNA, 35 bp, Artificial Sequence
  Synthetic oligonucleotide
gtttcgccgatcccccgaatgccctaaccgctaca

SEQ ID NO: 158568 - DNA, 35 bp, Artificial Sequence
  Synthetic oligonucleotide
gaactcacagtgccgccttgctcgacgccgcccca

SEQ ID NO: 158569 - DNA, 36 bp, Artificial Sequence
  Synthetic oligonucleotide
ggagggcctcgttcctgtctcattagttgttcccca

SEQ ID NO: 158570 - DNA, 35 bp, Artificial Sequence
  Synthetic oligonucleotide
gtacgactaagcggcctcgtaatcgccccatccca

SEQ ID NO: 158571 - DNA, 36 bp, Artificial Sequence
  Synthetic oligonucleotide
tgcgcacccgccgtcatgggtctccaccccgctgca

SEQ ID NO: 158572 - DNA, 36 bp, Artificial Sequence
  Synthetic oligonucleotide
tccaacccgccgccctagcctgttacgatcgaacga

SEQ ID NO: 158573 - DNA, 37 bp, Artificial Sequence
  Synthetic oligonucleotide
acttcatcggcgagttggcctagtcccgccctcccga

SEQ ID NO: 158574 - DNA, 36 bp, Artificial Sequence
  Synthetic oligonucleotide
taccccgcgctctcgaatattagcgcactcctccga

SEQ ID NO: 158575 - DNA, 37 bp, Artificial Sequence
  Synthetic oligonucleotide
gctgccctctaccattgtgccagtgttccatctccga

SEQ ID NO: 158576 - DNA, 37 bp, Artificial Sequence
  Synthetic oligonucleotide
ggggggacgggcaggattggtggtggaagaagcgcga

SEQ ID NO: 158577 - DNA, 37 bp, Artificial Sequence
  Synthetic oligonucleotide
tgacgggggggacggtaatgctgatggtcggggagga

SEQ ID NO: 158578 - DNA, 37 bp, Artificial Sequence
  Synthetic oligonucleotide
taggggcaggacggcggatagggggggtgggtccgga

SEQ ID NO: 158579 - DNA, 37 bp, Artificial Sequence
  Synthetic oligonucleotide
gactccgcgcccgcctattccactccagtcttcggga

SEQ ID NO: 158580 - DNA, 37 bp, Artificial Sequence
  Synthetic oligonucleotide
tccagggggtaggaagttcgtgggggcgggttgggga

SEQ ID NO: 158581 - DNA, 37 bp, Artificial Sequence
  Synthetic oligonucleotide
gggaggggaggggagctatgtgacaggcaaggtggga

SEQ ID NO: 158582 - DNA, 37 bp, Artificial Sequence
  Synthetic oligonucleotide
gaccagaatgcccgttgttctacctctcactcctgga

SEQ ID NO: 158583 - DNA, 35 bp, Artificial Sequence
  Synthetic oligonucleotide
ccacccactcgcctagttacatagcttcctcctga

SEQ ID NO: 158584 - DNA, 38 bp, Artificial Sequence
  Synthetic oligonucleotide
ggacgtccccctgcctggcttcagtgtcttccttctga

SEQ ID NO: 158585 - DNA, 37 bp, Artificial Sequence
  Synthetic oligonucleotide
gacgacggagattgggttcgcgggggggaggaagtga

SEQ ID NO: 158586 - DNA, 38 bp, Artificial Sequence
  Synthetic oligonucleotide
tgtacccaccccccgacgcagacccgctccatacgtga

SEQ ID NO: 158587 - DNA, 37 bp, Artificial Sequence
  Synthetic oligonucleotide
agggaggtgggtgggggagcatgaagaaggtgcgtga

SEQ ID NO: 158588 - DNA, 38 bp, Artificial Sequence
  Synthetic oligonucleotide
gctcctagcacgggagaaggaagatagggggaaggtga

SEQ ID NO: 158589 - DNA, 37 bp, Artificial Sequence
  Synthetic oligonucleotide
atggttggggaggaaaggaaggcatgggtggagttga

SEQ ID NO: 158590 - DNA, 35 bp, Artificial Sequence
  Synthetic oligonucleotide
gtgtaagcggggaggggcttggggggcggcgaata

SEQ ID NO: 158591 - DNA, 35 bp, Artificial Sequence
  Synthetic oligonucleotide
tttgcgccccccagcactgttatcgggtccccata

SEQ ID NO: 158592 - DNA, 36 bp, Artificial Sequence
  Synthetic oligonucleotide
agagaacgaggaaaatgggaaaggaggttagagata

SEQ ID NO: 158593 - DNA, 35 bp, Artificial Sequence
  Synthetic oligonucleotide
gcccccctggttctgtctcgcctcttataaccgta

SEQ ID NO: 158594 - DNA, 35 bp, Artificial Sequence
  Synthetic oligonucleotide
tgtgacccttccccctcgaataagtagacgttgta

SEQ ID NO: 158595 - DNA, 35 bp, Artificial Sequence
  Synthetic oligonucleotide
tcccaacacacatgccgcattacctccgttgttta

SEQ ID NO: 158596 - DNA, 35 bp, Artificial Sequence
  Synthetic oligonucleotide
agccagtgccaactgcctagatcctccacaccaac

SEQ ID NO: 158597 - DNA, 35 bp, Artificial Sequence
  Synthetic oligonucleotide
ggagcacgaccgccctgctatctcgacccgtcaac

SEQ ID NO: 158598 - DNA, 35 bp, Artificial Sequence
  Synthetic oligonucleotide
tccacgcactaccctgttgctagcgcctatctaac

SEQ ID NO: 158599 - DNA, 35 bp, Artificial Sequence
  Synthetic oligonucleotide
gtacatccccgccccctgcaccgccgggtcatcac

SEQ ID NO: 158600 - DNA, 35 bp, Artificial Sequence
  Synthetic oligonucleotide
cctactcgcccccgattacgtatcgctttcctcac

SEQ ID NO: 158601 - DNA, 35 bp, Artificial Sequence
  Synthetic oligonucleotide
gttggaacccccggcctctaccccgccactgcacc

SEQ ID NO: 158602 - DNA, 35 bp, Artificial Sequence
  Synthetic oligonucleotide
gacttgtacgccccgcagcccgcaaaggtcccccc

SEQ ID NO: 158603 - DNA, 35 bp, Artificial Sequence
  Synthetic oligonucleotide
gcgcaatccaaagcagccccaccgacctgttcccc

SEQ ID NO: 158604 - DNA, 35 bp, Artificial Sequence
  Synthetic oligonucleotide
gaacccagctgtacctgtcttccgtaattttcccc

SEQ ID NO: 158605 - DNA, 35 bp, Artificial Sequence
  Synthetic oligonucleotide
tcactcacccatcctacttgtttcttaatagagcc

SEQ ID NO: 158606 - DNA, 35 bp, Artificial Sequence
  Synthetic oligonucleotide
gcgggacctacctcctctaccggcacgaacttgcc

SEQ ID NO: 158607 - DNA, 35 bp, Artificial Sequence
  Synthetic oligonucleotide
acgccgcccaggcccttggttcgcacaatccgtcc

SEQ ID NO: 158608 - DNA, 35 bp, Artificial Sequence
  Synthetic oligonucleotide
accacaccacgggctactcgacgccgcctcgacgc

SEQ ID NO: 158609 - DNA, 35 bp, Artificial Sequence
  Synthetic oligonucleotide
ttccaacgccttacatcaaattcccgtcgccccgc

SEQ ID NO: 158610 - DNA, 34 bp, Artificial Sequence
  Synthetic oligonucleotide
acacagtgggcagacgccttctttcccccacggc

SEQ ID NO: 158611 - DNA, 35 bp, Artificial Sequence
  Synthetic oligonucleotide
gcaccccttgccatagtatccgtcttccttgctgc

SEQ ID NO: 158612 - DNA, 35 bp, Artificial Sequence
  Synthetic oligonucleotide
gcgctagatgtgcttgtatgccccactccctctgc

SEQ ID NO: 158613 - DNA, 35 bp, Artificial Sequence
  Synthetic oligonucleotide
gacagtcccctaatgccgccccatgtgactcttgc

SEQ ID NO: 158614 - DNA, 35 bp, Artificial Sequence
  Synthetic oligonucleotide
gtggtccctcctcagcggccggtacctgccttctc

SEQ ID NO: 158615 - DNA, 35 bp, Artificial Sequence
  Synthetic oligonucleotide
ggtgtcgcaccatgcctctaatcgtcctcccgttc

SEQ ID NO: 158616 - DNA, 35 bp, Artificial Sequence
  Synthetic oligonucleotide
gtcgcttccttgcttcacgtcccccgctctggttc

SEQ ID NO: 158617 - DNA, 35 bp, Artificial Sequence
  Synthetic oligonucleotide
tacacgtcactagtgctgcgcccacctgctttttc

SEQ ID NO: 158618 - DNA, 35 bp, Artificial Sequence
  Synthetic oligonucleotide
gcagacaccaacattatatcaccgcccgtggctag

SEQ ID NO: 158619 - DNA, 35 bp, Artificial Sequence
  Synthetic oligonucleotide
atgccaagggaggaagaaataaggttaaagggtag

SEQ ID NO: 158620 - DNA, 35 bp, Artificial Sequence
  Synthetic oligonucleotide
atcccaccgctatcatacccggaaaccatccaccg

SEQ ID NO: 158621 - DNA, 35 bp, Artificial Sequence
  Synthetic oligonucleotide
tcatccacccactgctttttgtaattgtgccctcg

SEQ ID NO: 158622 - DNA, 35 bp, Artificial Sequence
  Synthetic oligonucleotide
gccttctcccattgtaggtcaaccgcccctgttcg

SEQ ID NO: 158623 - DNA, 35 bp, Artificial Sequence
  Synthetic oligonucleotide
gggacatcctccgctccacctatgcttgacatggg

SEQ ID NO: 158624 - DNA, 35 bp, Artificial Sequence
  Synthetic oligonucleotide
acgtcggaccgacgggcgtgtgctgggggggtggg

SEQ ID NO: 158625 - DNA, 35 bp, Artificial Sequence
  Synthetic oligonucleotide
atgcagcactgctcccataccgtctgtccacctgg

SEQ ID NO: 158626 - DNA, 35 bp, Artificial Sequence
  Synthetic oligonucleotide
atgaacctcgatccagccgtaagcttgcactcctg

SEQ ID NO: 158627 - DNA, 35 bp, Artificial Sequence
  Synthetic oligonucleotide
gggcgaggaagaaggcgctggggtaggaggggtat

SEQ ID NO: 158628 - DNA, 35 bp, Artificial Sequence
  Synthetic oligonucleotide
attgcctggttcttgctgtctcttccatcccacct

SEQ ID NO: 158629 - DNA, 35 bp, Artificial Sequence
  Synthetic oligonucleotide
ttccgcccggacgaatttgcccgcctttcatacct

SEQ ID NO: 158630 - DNA, 35 bp, Artificial Sequence
  Synthetic oligonucleotide
gtttcgcatcaatcgttccttcatgccaggtctct

SEQ ID NO: 158631 - DNA, 35 bp, Artificial Sequence
  Synthetic oligonucleotide
ggtcgaccacctctccgcgttatttctgggtctct

SEQ ID NO: 158632 - DNA, 35 bp, Artificial Sequence
  Synthetic oligonucleotide
agccccgccaggctacttaagctctccccctgtct

SEQ ID NO: 158633 - DNA, 35 bp, Artificial Sequence
  Synthetic oligonucleotide
tgtcaccggcacgaacgtcctccgcctccactagt

SEQ ID NO: 158634 - DNA, 35 bp, Artificial Sequence
  Synthetic oligonucleotide
ttcacccccgtaacactggatcgtcacaagccctt

SEQ ID NO: 158635 - DNA, 35 bp, Artificial Sequence
  Synthetic oligonucleotide
tcgccgccccgactctcttccctttgcttcacgtt

SEQ ID NO: 158636 - DNA, 35 bp, Artificial Sequence
  Synthetic oligonucleotide
gagatgacaaggtggaacggagcttgggggaaaaa

SEQ ID NO: 158637 - DNA, 36 bp, Artificial Sequence
  Synthetic oligonucleotide
accgcgccccgtacgcacttcgcttctatcgcctaa

SEQ ID NO: 158638 - DNA, 36 bp, Artificial Sequence
  Synthetic oligonucleotide
acatcccctcttggcccgcctccgattaacgccaca

SEQ ID NO: 158639 - DNA, 34 bp, Artificial Sequence
  Synthetic oligonucleotide
gccttaaccgcaggctgcacgtcctcgcccccca

SEQ ID NO: 158640 - DNA, 36 bp, Artificial Sequence
  Synthetic oligonucleotide
tacgtagtcgccccacggtccccgtttccggtccca

SEQ ID NO: 158641 - DNA, 36 bp, Artificial Sequence
  Synthetic oligonucleotide
aacctgtcccatcctgtctgcacgtattgtgcgcca

SEQ ID NO: 158642 - DNA, 34 bp, Artificial Sequence
  Synthetic oligonucleotide
gtactccctcccgcaggacttgcaacaacctcca

SEQ ID NO: 158643 - DNA, 35 bp, Artificial Sequence
  Synthetic oligonucleotide
agactcccacaggttttcgtgacccaccgccttca

SEQ ID NO: 158644 - DNA, 35 bp, Artificial Sequence
  Synthetic oligonucleotide
gtgcgaccgccttctccgcaaactgttacagttca

SEQ ID NO: 158645 - DNA, 37 bp, Artificial Sequence
  Synthetic oligonucleotide
tagtgtgggacaaaaggaaactgagagggggggaaga

SEQ ID NO: 158646 - DNA, 37 bp, Artificial Sequence
  Synthetic oligonucleotide
gtagtgggggggaagggaagttgtcaagggggagaga

SEQ ID NO: 158647 - DNA, 37 bp, Artificial Sequence
  Synthetic oligonucleotide
tcgaagactcatctcgctccaccgccgttttccccga

SEQ ID NO: 158648 - DNA, 36 bp, Artificial Sequence
  Synthetic oligonucleotide
tctccaccttctgacctgaagaccaccctctgccga

SEQ ID NO: 158649 - DNA, 37 bp, Artificial Sequence
  Synthetic oligonucleotide
tgtagtagtgggaggggttgtgggggacggtgagcga

SEQ ID NO: 158650 - DNA, 37 bp, Artificial Sequence
  Synthetic oligonucleotide
acctccccccgttgcccgtttagacattactgcgcga

SEQ ID NO: 158651 - DNA, 37 bp, Artificial Sequence
  Synthetic oligonucleotide
cgaagccgccctattcacctctctctgctccttgcga

SEQ ID NO: 158652 - DNA, 36 bp, Artificial Sequence
  Synthetic oligonucleotide
tacgccgctgctttccccatgagtgctacccctcga

SEQ ID NO: 158653 - DNA, 37 bp, Artificial Sequence
  Synthetic oligonucleotide
tgcaacccctatctttatgctgttctgtgcccctcga

SEQ ID NO: 158654 - DNA, 35 bp, Artificial Sequence
  Synthetic oligonucleotide
agccccccagcctcgtgccagccactcactctcga

SEQ ID NO: 158655 - DNA, 37 bp, Artificial Sequence
  Synthetic oligonucleotide
tcaggggatcggaaatgatgggcggggggaaagggga

SEQ ID NO: 158656 - DNA, 37 bp, Artificial Sequence
  Synthetic oligonucleotide
aagacggtcggcactgggatacaagggggagagggga

SEQ ID NO: 158657 - DNA, 37 bp, Artificial Sequence
  Synthetic oligonucleotide
attcatcccgcacatcttagccgaacctgccactgga

SEQ ID NO: 158658 - DNA, 38 bp, Artificial Sequence
  Synthetic oligonucleotide
gtgaaggagagaacggaggaggagcggtcataccatga

SEQ ID NO: 158659 - DNA, 38 bp, Artificial Sequence
  Synthetic oligonucleotide
acgtggacagacaggaggagcggtaggagaggtgatga

SEQ ID NO: 158660 - DNA, 38 bp, Artificial Sequence
  Synthetic oligonucleotide
gccgcagttgtcactcctgatatcactacctcctctga

SEQ ID NO: 158661 - DNA, 38 bp, Artificial Sequence
  Synthetic oligonucleotide
acatcacacgccacgcttttacgtcgaactctctctga

SEQ ID NO: 158662 - DNA, 37 bp, Artificial Sequence
  Synthetic oligonucleotide
tccgacgccctcacctctaatcgctttcatgtagtga

SEQ ID NO: 158663 - DNA, 38 bp, Artificial Sequence
  Synthetic oligonucleotide
tgcaccccttgatcccgtttttattgccgtgctgttga

SEQ ID NO: 158664 - DNA, 38 bp, Artificial Sequence
  Synthetic oligonucleotide
aacccgtctccgtgcatcgtaaccatcgccctttttga

SEQ ID NO: 158665 - DNA, 35 bp, Artificial Sequence
  Synthetic oligonucleotide
gctccccctcgtagttctattggccaccactaata

SEQ ID NO: 158666 - DNA, 37 bp, Artificial Sequence
  Synthetic oligonucleotide
tgagaccagcctagccctgtcaagctcgttccaccta

SEQ ID NO: 158667 - DNA, 35 bp, Artificial Sequence
  Synthetic oligonucleotide
tctcccgctctaccacgcgttctgcttccccccta

SEQ ID NO: 158668 - DNA, 36 bp, Artificial Sequence
  Synthetic oligonucleotide
gacaacccggagcctgttccctggaccgccatccta

SEQ ID NO: 158669 - DNA, 36 bp, Artificial Sequence
  Synthetic oligonucleotide
acctccgcctccccgctccaagtcagcccaaagcta

SEQ ID NO: 158670 - DNA, 35 bp, Artificial Sequence
  Synthetic oligonucleotide
gatatgcacccgccccccccgacgtaattgatgac

SEQ ID NO: 158671 - DNA, 35 bp, Artificial Sequence
  Synthetic oligonucleotide
ttggttccccgatccgtgccctattagctttatac

SEQ ID NO: 158672 - DNA, 35 bp, Artificial Sequence
  Synthetic oligonucleotide
ggatcctctcctcgccttgccccattcgttccacc

SEQ ID NO: 158673 - DNA, 35 bp, Artificial Sequence
  Synthetic oligonucleotide
tcccccacccctccattgcctctttcccttagacc

SEQ ID NO: 158674 - DNA, 35 bp, Artificial Sequence
  Synthetic oligonucleotide
actgtaacatccacgcctgttaatttcgctccccc

SEQ ID NO: 158675 - DNA, 35 bp, Artificial Sequence
  Synthetic oligonucleotide
gcacggaagctcccagtgtcgcttctcccatcccc

SEQ ID NO: 158676 - DNA, 34 bp, Artificial Sequence
  Synthetic oligonucleotide
actacaaggtacacgcctggccctcgctttgccc

SEQ ID NO: 158677 - DNA, 35 bp, Artificial Sequence
  Synthetic oligonucleotide
gttgcctattgttgtagcgcgatttccctactccc

SEQ ID NO: 158678 - DNA, 35 bp, Artificial Sequence
  Synthetic oligonucleotide
gtgtagccgagaagtccattctcacattgcctccc

SEQ ID NO: 158679 - DNA, 35 bp, Artificial Sequence
  Synthetic oligonucleotide
gtgcccttccccctggatcctttcccctgggtccc

SEQ ID NO: 158680 - DNA, 35 bp, Artificial Sequence
  Synthetic oligonucleotide
gggaccgtcttagttccctgtttcctgctgtggcc

SEQ ID NO: 158681 - DNA, 35 bp, Artificial Sequence
  Synthetic oligonucleotide
tgactctgccgatgtacattccatatctccctgcc

SEQ ID NO: 158682 - DNA, 35 bp, Artificial Sequence
  Synthetic oligonucleotide
gtgcgtggcgacgcctcctccactccccgtcctcc

SEQ ID NO: 158683 - DNA, 35 bp, Artificial Sequence
  Synthetic oligonucleotide
ttgccgtttgcactatgcacagaattcccttctcc

SEQ ID NO: 158684 - DNA, 35 bp, Artificial Sequence
  Synthetic oligonucleotide
gctccccgtgagagtgctcttccgcatcctcttcc

SEQ ID NO: 158685 - DNA, 35 bp, Artificial Sequence
  Synthetic oligonucleotide
gtgcaacccctcctactcacgggcccaaccatcgc

SEQ ID NO: 158686 - DNA, 35 bp, Artificial Sequence
  Synthetic oligonucleotide
tcactcgctcccgcatggggtacctcacacctcgc

SEQ ID NO: 158687 - DNA, 35 bp, Artificial Sequence
  Synthetic oligonucleotide
gtccgctcgtccgttcgtttttcgcgttacccggc

SEQ ID NO: 158688 - DNA, 35 bp, Artificial Sequence
  Synthetic oligonucleotide
gtcattggcacatgctcccctcaccctccattggc

SEQ ID NO: 158689 - DNA, 35 bp, Artificial Sequence
  Synthetic oligonucleotide
tccccgagccccctcattaataaattagccactgc

SEQ ID NO: 158690 - DNA, 35 bp, Artificial Sequence
  Synthetic oligonucleotide
tcccagccctgtcgcctcccagacgcagcacattc

SEQ ID NO: 158691 - DNA, 35 bp, Artificial Sequence
  Synthetic oligonucleotide
gcactcgggccttttgtttcgctctggtatttttc

SEQ ID NO: 158692 - DNA, 35 bp, Artificial Sequence
  Synthetic oligonucleotide
gtgggtgggatgtaagatgaggggaagggagtacg

SEQ ID NO: 158693 - DNA, 35 bp, Artificial Sequence
  Synthetic oligonucleotide
gtcctccgccacacgtgcaccgcttgagacgaccg

SEQ ID NO: 158694 - DNA, 35 bp, Artificial Sequence
  Synthetic oligonucleotide
agccgagctcccctaggtctccgccctctccgccg

SEQ ID NO: 158695 - DNA, 35 bp, Artificial Sequence
  Synthetic oligonucleotide
gccactgtatccatcgcctctctcgctcctgatcg

SEQ ID NO: 158696 - DNA, 35 bp, Artificial Sequence
  Synthetic oligonucleotide
ttgcccgtgcctgaccgttcgctgtcccttcctcg

SEQ ID NO: 158697 - DNA, 35 bp, Artificial Sequence
  Synthetic oligonucleotide
aagagggggaggtgagtaggtgccgcacgcagagg

SEQ ID NO: 158698 - DNA, 35 bp, Artificial Sequence
  Synthetic oligonucleotide
tgccaggtcgggtggattacgagtgggtgggaggg

SEQ ID NO: 158699 - DNA, 35 bp, Artificial Sequence
  Synthetic oligonucleotide
gggggaacggtggggaacttgaggatcgtgagggg

SEQ ID NO: 158700 - DNA, 35 bp, Artificial Sequence
  Synthetic oligonucleotide
gtatcaactcgcccagtcccctattctccgttctg

SEQ ID NO: 158701 - DNA, 35 bp, Artificial Sequence
  Synthetic oligonucleotide
agactacatccgttcccctgtccctcccagccgtg

SEQ ID NO: 158702 - DNA, 35 bp, Artificial Sequence
  Synthetic oligonucleotide
acccccccctcctcccctgtatagggcccgctact

SEQ ID NO: 158703 - DNA, 35 bp, Artificial Sequence
  Synthetic oligonucleotide
tcccctttcccgggacccccgttcaccttggtact

SEQ ID NO: 158704 - DNA, 35 bp, Artificial Sequence
  Synthetic oligonucleotide
tgtgttccgcaatttccatcatgagtctctcgcct

SEQ ID NO: 158705 - DNA, 35 bp, Artificial Sequence
  Synthetic oligonucleotide
acatcatcgcccaaatcactaactggacgcctcct

SEQ ID NO: 158706 - DNA, 35 bp, Artificial Sequence
  Synthetic oligonucleotide
gccgccggctcgacccctcctccctctgggctcct

SEQ ID NO: 158707 - DNA, 35 bp, Artificial Sequence
  Synthetic oligonucleotide
agcccccaccgacctagaacaaatgtcactccgct

SEQ ID NO: 158708 - DNA, 35 bp, Artificial Sequence
  Synthetic oligonucleotide
tgcactatgccactgccatcctattatcctcctgt

SEQ ID NO: 158709 - DNA, 35 bp, Artificial Sequence
  Synthetic oligonucleotide
taaggggaagaacaggaataggacgcgagggaaaa

SEQ ID NO: 158710 - DNA, 35 bp, Artificial Sequence
  Synthetic oligonucleotide
tcctcccgccattcgccggtctattaacaacataa

SEQ ID NO: 158711 - DNA, 35 bp, Artificial Sequence
  Synthetic oligonucleotide
ttcaccgctactgccatcacctatgccttctataa

SEQ ID NO: 158712 - DNA, 35 bp, Artificial Sequence
  Synthetic oligonucleotide
gtgtcatccagctctttgcccagtcccaggcttaa

SEQ ID NO: 158713 - DNA, 36 bp, Artificial Sequence
  Synthetic oligonucleotide
tgcggctcgctgctccacctcgctgtagtccatcca

SEQ ID NO: 158714 - DNA, 35 bp, Artificial Sequence
  Synthetic oligonucleotide
acccacgtcttctactcctatctcgtgcgtttcca

SEQ ID NO: 158715 - DNA, 36 bp, Artificial Sequence
  Synthetic oligonucleotide
tgtgtgcccccttacgtcccagacccctgtcttgca

SEQ ID NO: 158716 - DNA, 36 bp, Artificial Sequence
  Synthetic oligonucleotide
tgatactcacgtggccccatctgcaggtttccatca

SEQ ID NO: 158717 - DNA, 36 bp, Artificial Sequence
  Synthetic oligonucleotide
gatgatgggtactgagcaacgggcgggggggattca

SEQ ID NO: 158718 - DNA, 36 bp, Artificial Sequence
  Synthetic oligonucleotide
ggacacgggggggggtggaggtatggtcacggaaga

SEQ ID NO: 158719 - DNA, 37 bp, Artificial Sequence
  Synthetic oligonucleotide
tccccatctgctgtttctcactccgttctcctttaga

SEQ ID NO: 158720 - DNA, 37 bp, Artificial Sequence
  Synthetic oligonucleotide
gactgcggctctccatgctacacgccactcctcacga

SEQ ID NO: 158721 - DNA, 37 bp, Artificial Sequence
  Synthetic oligonucleotide
tccagcccgccccatgcacttttcctttatctgacga

SEQ ID NO: 158722 - DNA, 35 bp, Artificial Sequence
  Synthetic oligonucleotide
gatttccccctgatgtggtcctttttgcccaccga

SEQ ID NO: 158723 - DNA, 37 bp, Artificial Sequence
  Synthetic oligonucleotide
agtccacaactgcacgcacatcgcaacccttccccga

SEQ ID NO: 158724 - DNA, 37 bp, Artificial Sequence
  Synthetic oligonucleotide
gcaggagggggaaggaggtggtgtgcacaggtagcga

SEQ ID NO: 158725 - DNA, 37 bp, Artificial Sequence
  Synthetic oligonucleotide
acactccttcgtgtcatgccctggcccactatctcga

SEQ ID NO: 158726 - DNA, 37 bp, Artificial Sequence
  Synthetic oligonucleotide
tcacccacccgccacagtcctgcgtagtacaatagga

SEQ ID NO: 158727 - DNA, 36 bp, Artificial Sequence
  Synthetic oligonucleotide
tgcggactatgggagggatcggggactgaacgggga

SEQ ID NO: 158728 - DNA, 37 bp, Artificial Sequence
  Synthetic oligonucleotide
atgcgtctgggggcgggtggaaaggctcggaatggga

SEQ ID NO: 158729 - DNA, 36 bp, Artificial Sequence
  Synthetic oligonucleotide
gcaccgtcaccggcctgttcctctttgttgtactga

SEQ ID NO: 158730 - DNA, 38 bp, Artificial Sequence
  Synthetic oligonucleotide
tccgtccgtcgcaagcttccaccacctcccatcagtga

SEQ ID NO: 158731 - DNA, 38 bp, Artificial Sequence
  Synthetic oligonucleotide
ttacgggcggggccgttttggggcgatcctggggttga

SEQ ID NO: 158732 - DNA, 36 bp, Artificial Sequence
  Synthetic oligonucleotide
gtgagagacgacgaaacatgcggagtggagaagata

SEQ ID NO: 158733 - DNA, 36 bp, Artificial Sequence
  Synthetic oligonucleotide
tgcacccgcccttcccccgaagtctatctgaaacta

SEQ ID NO: 158734 - DNA, 36 bp, Artificial Sequence
  Synthetic oligonucleotide
gcccgtgtcatcccggatccgccgcccgtccttcta

SEQ ID NO: 158735 - DNA, 36 bp, Artificial Sequence
  Synthetic oligonucleotide
ttcgcgaactgagttgcctccgcccccatgcctgta

SEQ ID NO: 158736 - DNA, 36 bp, Artificial Sequence
  Synthetic oligonucleotide
gacgatcggtctggtgcatctgtttcgctcctctta

SEQ ID NO: 158737 - DNA, 35 bp, Artificial Sequence
  Synthetic oligonucleotide
aaaatgagggggagggggggctggataggtggaac

SEQ ID NO: 158738 - DNA, 34 bp, Artificial Sequence
  Synthetic oligonucleotide
agtgcgcttaaccccactccacccgctgtcccac

SEQ ID NO: 158739 - DNA, 35 bp, Artificial Sequence
  Synthetic oligonucleotide
gcaccactgcctcaggtcttgtcaccgtccatcac

SEQ ID NO: 158740 - DNA, 35 bp, Artificial Sequence
  Synthetic oligonucleotide
ttacccgccgggctattactgacccattttccgac

SEQ ID NO: 158741 - DNA, 35 bp, Artificial Sequence
  Synthetic oligonucleotide
aactcctgcaggatgcttcgtcctgcaccacatac

SEQ ID NO: 158742 - DNA, 35 bp, Artificial Sequence
  Synthetic oligonucleotide
tgcccccctcaaaattgatagatcacgcgcattac

SEQ ID NO: 158743 - DNA, 35 bp, Artificial Sequence
  Synthetic oligonucleotide
gtgcacgtgaaatcctatcattctgtccggtgccc

SEQ ID NO: 158744 - DNA, 35 bp, Artificial Sequence
  Synthetic oligonucleotide
tgagctaccaagcagatgtttgccacccttgtccc

SEQ ID NO: 158745 - DNA, 35 bp, Artificial Sequence
  Synthetic oligonucleotide
tcgcccaccatcctttgttgggttccgatattccc

SEQ ID NO: 158746 - DNA, 35 bp, Artificial Sequence
  Synthetic oligonucleotide
ccgacgcaccgcagccgattaaccgtccatccgcc

SEQ ID NO: 158747 - DNA, 35 bp, Artificial Sequence
  Synthetic oligonucleotide
gtcgacggagcgcacgcccggttttcgtttttgcc

SEQ ID NO: 158748 - DNA, 35 bp, Artificial Sequence
  Synthetic oligonucleotide
tcacccctgccgacctttcccaactacggaactcc

SEQ ID NO: 158749 - DNA, 35 bp, Artificial Sequence
  Synthetic oligonucleotide
agccgtccttccgcggtaacttgattctggcctcc

SEQ ID NO: 158750 - DNA, 35 bp, Artificial Sequence
  Synthetic oligonucleotide
gttaacggtccgaggagtttcatcacgccctgtcc

SEQ ID NO: 158751 - DNA, 35 bp, Artificial Sequence
  Synthetic oligonucleotide
actgccaaccgcccccttaccgttccagctacagc

SEQ ID NO: 158752 - DNA, 35 bp, Artificial Sequence
  Synthetic oligonucleotide
tgatgccctgactacggatacaccccctctcccgc

SEQ ID NO: 158753 - DNA, 35 bp, Artificial Sequence
  Synthetic oligonucleotide
ttggtgaccacacacttcatctaagccgacctcgc

SEQ ID NO: 158754 - DNA, 35 bp, Artificial Sequence
  Synthetic oligonucleotide
gtcagatcttctgcttccgtttgtcgttcacttgc

SEQ ID NO: 158755 - DNA, 35 bp, Artificial Sequence
  Synthetic oligonucleotide
gccctacttgcctgtatttcgcctgggtacgaatc

SEQ ID NO: 158756 - DNA, 35 bp, Artificial Sequence
  Synthetic oligonucleotide
aacgagtccgccacccttcggcctccttgtctatc

SEQ ID NO: 158757 - DNA, 35 bp, Artificial Sequence
  Synthetic oligonucleotide
gtctccctctgatactgctttacccccttcaactc

SEQ ID NO: 158758 - DNA, 35 bp, Artificial Sequence
  Synthetic oligonucleotide
acttccagtcgatgaatcgcctcccctattgcctc

SEQ ID NO: 158759 - DNA, 35 bp, Artificial Sequence
  Synthetic oligonucleotide
tgacgaacggtgtttcgttcccatggttgttcctc

SEQ ID NO: 158760 - DNA, 35 bp, Artificial Sequence
  Synthetic oligonucleotide
gccacactcctcttccgtactcagccttcacgctc

SEQ ID NO: 158761 - DNA, 35 bp, Artificial Sequence
  Synthetic oligonucleotide
tcaccgcgattctcgttattcacacatttatgctc

SEQ ID NO: 158762 - DNA, 35 bp, Artificial Sequence
  Synthetic oligonucleotide
gtggtgacgtttcggcgcttttattcgtacatctc

SEQ ID NO: 158763 - DNA, 35 bp, Artificial Sequence
  Synthetic oligonucleotide
gtggatcgcgggctgatcgcgatactccccttctc

SEQ ID NO: 158764 - DNA, 35 bp, Artificial Sequence
  Synthetic oligonucleotide
gcctcccctccgattagtcgcgttagctgccgttc

SEQ ID NO: 158765 - DNA, 35 bp, Artificial Sequence
  Synthetic oligonucleotide
gccaggggtgacggggggggtgctcgaagcgggag

SEQ ID NO: 158766 - DNA, 35 bp, Artificial Sequence
  Synthetic oligonucleotide
gggaggacgggggtcaatacaacgaaattggggag

SEQ ID NO: 158767 - DNA, 35 bp, Artificial Sequence
  Synthetic oligonucleotide
gtaaccacgcccctaccatgtgatgtctttttccg

SEQ ID NO: 158768 - DNA, 35 bp, Artificial Sequence
  Synthetic oligonucleotide
gccggggatattgggtgggagggacgcctatagcg

SEQ ID NO: 158769 - DNA, 35 bp, Artificial Sequence
  Synthetic oligonucleotide
gctcgtggcgttattccctcgttccttgcccctcg

SEQ ID NO: 158770 - DNA, 35 bp, Artificial Sequence
  Synthetic oligonucleotide
tcgcacatccgctacccccgtctcggccgaccggg

SEQ ID NO: 158771 - DNA, 35 bp, Artificial Sequence
  Synthetic oligonucleotide
acaaaccacctaacatgttcgccgttccgctcttg

SEQ ID NO: 158772 - DNA, 35 bp, Artificial Sequence
  Synthetic oligonucleotide
gtcaatgcaacggaactgtcttaccacctttacat

SEQ ID NO: 158773 - DNA, 35 bp, Artificial Sequence
  Synthetic oligonucleotide
taccacccccacagtgtgggtaatcaccaccccat

SEQ ID NO: 158774 - DNA, 35 bp, Artificial Sequence
  Synthetic oligonucleotide
ttagatcccgcccccgctccattccgttcgcccat

SEQ ID NO: 158775 - DNA, 35 bp, Artificial Sequence
  Synthetic oligonucleotide
gcgtccgccccacccaccgccagcaccttatgcat

SEQ ID NO: 158776 - DNA, 35 bp, Artificial Sequence
  Synthetic oligonucleotide
gtccacgatatgtcatcactccttcgccttgctat

SEQ ID NO: 158777 - DNA, 35 bp, Artificial Sequence
  Synthetic oligonucleotide
gccggtggctatctgtaccgctcttctcaattcct

SEQ ID NO: 158778 - DNA, 35 bp, Artificial Sequence
  Synthetic oligonucleotide
gccacccactgccctcccgtacttcaacaatgtct

SEQ ID NO: 158779 - DNA, 35 bp, Artificial Sequence
  Synthetic oligonucleotide
gcccccgccgcccctgtccacgactccggacatgt

SEQ ID NO: 158780 - DNA, 36 bp, Artificial Sequence
  Synthetic oligonucleotide
ttccacctacctgccaccgaaccaagactgtacctt

SEQ ID NO: 158781 - DNA, 35 bp, Artificial Sequence
  Synthetic oligonucleotide
ggttcaccacgcctcaacttgtcctcactacggtt

SEQ ID NO: 158782 - DNA, 35 bp, Artificial Sequence
  Synthetic oligonucleotide
gcttgggtgggacgggaagtgggcatacattgttt

SEQ ID NO: 158783 - DNA, 36 bp, Artificial Sequence
  Synthetic oligonucleotide
gcacggttaggggaggtggggtgggaatggataaaa

SEQ ID NO: 158784 - DNA, 36 bp, Artificial Sequence
  Synthetic oligonucleotide
atgaggggcaagaataggaggtagggacgggtgaaa

SEQ ID NO: 158785 - DNA, 35 bp, Artificial Sequence
  Synthetic oligonucleotide
tttgccccctgcttaatagcctcgttggctctcaa

SEQ ID NO: 158786 - DNA, 36 bp, Artificial Sequence
  Synthetic oligonucleotide
attccccgaactaattgttgtacagcccctctcgaa

SEQ ID NO: 158787 - DNA, 36 bp, Artificial Sequence
  Synthetic oligonucleotide
actctgtcgccacttcgtacccacttctgttcataa

SEQ ID NO: 158788 - DNA, 35 bp, Artificial Sequence
  Synthetic oligonucleotide
atcggagcccgccccgtttactatgattccgacca

SEQ ID NO: 158789 - DNA, 36 bp, Artificial Sequence
  Synthetic oligonucleotide
gcccccctgcccatgcatcctgttatccctgtacca

SEQ ID NO: 158790 - DNA, 36 bp, Artificial Sequence
  Synthetic oligonucleotide
cctcacacctctgtgaatacacgtttttgttcccca

SEQ ID NO: 158791 - DNA, 35 bp, Artificial Sequence
  Synthetic oligonucleotide
tccccacgcagactatagcctccttctccgatcca

SEQ ID NO: 158792 - DNA, 35 bp, Artificial Sequence
  Synthetic oligonucleotide
ttccccgagcgcttgtttccggccatttgtctcca

SEQ ID NO: 158793 - DNA, 36 bp, Artificial Sequence
  Synthetic oligonucleotide
taacgaccccgcggaacgtctcccttccctgccgca

SEQ ID NO: 158794 - DNA, 35 bp, Artificial Sequence
  Synthetic oligonucleotide
ttattcacgcccaccgcacacattccgtatccgca

SEQ ID NO: 158795 - DNA, 36 bp, Artificial Sequence
  Synthetic oligonucleotide
gccaggggttgtcggtcggggttttgcggtggatca

SEQ ID NO: 158796 - DNA, 36 bp, Artificial Sequence
  Synthetic oligonucleotide
atggactacgccaggtcatcttctcgtgcttcctca

SEQ ID NO: 158797 - DNA, 36 bp, Artificial Sequence
  Synthetic oligonucleotide
ttgggccatcaggattgtacctgccgcccgctttca

SEQ ID NO: 158798 - DNA, 36 bp, Artificial Sequence
  Synthetic oligonucleotide
tgcgacgatcctgcctttgacgctctgcccgtttca

SEQ ID NO: 158799 - DNA, 35 bp, Artificial Sequence
  Synthetic oligonucleotide
gggaaaggggagggatgggtcatgggggcgtttca

SEQ ID NO: 158800 - DNA, 37 bp, Artificial Sequence
  Synthetic oligonucleotide
atacgacgcttgtgggtaaaagggagggagggaaaga

SEQ ID NO: 158801 - DNA, 37 bp, Artificial Sequence
  Synthetic oligonucleotide
gttggggaccgagcctgatttgggggagggggggaga

SEQ ID NO: 158802 - DNA, 36 bp, Artificial Sequence
  Synthetic oligonucleotide
tctgatccccgtcgcttcctattccacttcgtgaga

SEQ ID NO: 158803 - DNA, 37 bp, Artificial Sequence
  Synthetic oligonucleotide
gtccgccccgtcgctgctaactggtaccgctctacga

SEQ ID NO: 158804 - DNA, 37 bp, Artificial Sequence
  Synthetic oligonucleotide
aattgcatccgcctccctggtccgtcgcgtcctccga

SEQ ID NO: 158805 - DNA, 37 bp, Artificial Sequence
  Synthetic oligonucleotide
gaagagaaggaaggtgaggaagtagaggagctttcga

SEQ ID NO: 158806 - DNA, 37 bp, Artificial Sequence
  Synthetic oligonucleotide
gcacgcgaaacggggagtggccgggcgggaggaagga

SEQ ID NO: 158807 - DNA, 37 bp, Artificial Sequence
  Synthetic oligonucleotide
tccggtgtcagcccttcatgcctccccgtttacgtga

SEQ ID NO: 158808 - DNA, 37 bp, Artificial Sequence
  Synthetic oligonucleotide
gtgtggagagagtggaacggtggggaaggatgggtga

SEQ ID NO: 158809 - DNA, 35 bp, Artificial Sequence
  Synthetic oligonucleotide
tccttcgcgcccctcgtccacttcacttgctgtga

SEQ ID NO: 158810 - DNA, 38 bp, Artificial Sequence
  Synthetic oligonucleotide
ttgcaccctccgggtccttctcatacgatccaccttga

SEQ ID NO: 158811 - DNA, 38 bp, Artificial Sequence
  Synthetic oligonucleotide
tcagggagggaagggacgagtaggggtagtcggcttga

SEQ ID NO: 158812 - DNA, 36 bp, Artificial Sequence
  Synthetic oligonucleotide
gctgagacactgtcctcttgctacgtttcttcccta

SEQ ID NO: 158813 - DNA, 35 bp, Artificial Sequence
  Synthetic oligonucleotide
accgtacccgtcccgttctgcccctacttcgttta

SEQ ID NO: 158814 - DNA, 35 bp, Artificial Sequence
  Synthetic oligonucleotide
tttcaaacgcctcctgagcctccacgcccttagac

SEQ ID NO: 158815 - DNA, 35 bp, Artificial Sequence
  Synthetic oligonucleotide
gcatgtgcagtgcccttacgttgcccaaccccacc

SEQ ID NO: 158816 - DNA, 35 bp, Artificial Sequence
  Synthetic oligonucleotide
gcaccgacggtgtccaaactacgttactgctcccc

SEQ ID NO: 158817 - DNA, 35 bp, Artificial Sequence
  Synthetic oligonucleotide
gttgcccacgatctcacccctcgttcttttagccc

SEQ ID NO: 158818 - DNA, 35 bp, Artificial Sequence
  Synthetic oligonucleotide
gttgcacggcctatttatgtcacccgcgtggtccc

SEQ ID NO: 158819 - DNA, 35 bp, Artificial Sequence
  Synthetic oligonucleotide
tcgtgcggccacattgtttttgcttagtccccgcc

SEQ ID NO: 158820 - DNA, 35 bp, Artificial Sequence
  Synthetic oligonucleotide
gcgccactagcacgattcttcaaccggtttcctcc

SEQ ID NO: 158821 - DNA, 35 bp, Artificial Sequence
  Synthetic oligonucleotide
accccaacgccaccgccataccgcgcattgttcgc

SEQ ID NO: 158822 - DNA, 35 bp, Artificial Sequence
  Synthetic oligonucleotide
taggtgccctgtctacccgccccgcctggtccggc

SEQ ID NO: 158823 - DNA, 35 bp, Artificial Sequence
  Synthetic oligonucleotide
gccccgtattctggttcgatctcgcatgcccctgc

SEQ ID NO: 158824 - DNA, 35 bp, Artificial Sequence
  Synthetic oligonucleotide
gatcgcacgattgttatttaatgtccatccccatc

SEQ ID NO: 158825 - DNA, 35 bp, Artificial Sequence
  Synthetic oligonucleotide
tcagcttggacgctgcctcccctacccgtttgatc

SEQ ID NO: 158826 - DNA, 34 bp, Artificial Sequence
  Synthetic oligonucleotide
gcacgcgagcgagccgctacaacttatacacctc

SEQ ID NO: 158827 - DNA, 35 bp, Artificial Sequence
  Synthetic oligonucleotide
tgtctatccctatcgtgcgatgccagcttgccctc

SEQ ID NO: 158828 - DNA, 35 bp, Artificial Sequence
  Synthetic oligonucleotide
gttcagctgtcccgcttgatcctgacaccgccgtc

SEQ ID NO: 158829 - DNA, 35 bp, Artificial Sequence
  Synthetic oligonucleotide
agccctgcctggtttggtctcgcgtgcctcctgtc

SEQ ID NO: 158830 - DNA, 36 bp, Artificial Sequence
  Synthetic oligonucleotide
acactagccacgcttgccccccgctttatagctgtc

SEQ ID NO: 158831 - DNA, 35 bp, Artificial Sequence
  Synthetic oligonucleotide
taacagcacaccgtcgccggcccctcctaggattc

SEQ ID NO: 158832 - DNA, 34 bp, Artificial Sequence
  Synthetic oligonucleotide
ttggtgatggggcggggaatctgggggcaaaaag

SEQ ID NO: 158833 - DNA, 35 bp, Artificial Sequence
  Synthetic oligonucleotide
aactgaggaaccaaggaaggcgaggggacactaag

SEQ ID NO: 158834 - DNA, 35 bp, Artificial Sequence
  Synthetic oligonucleotide
atcttagcccgcgcctgggccttgtcttccccccg

SEQ ID NO: 158835 - DNA, 35 bp, Artificial Sequence
  Synthetic oligonucleotide
atcacccctgccctccgagttcaggctatcccccg

SEQ ID NO: 158836 - DNA, 35 bp, Artificial Sequence
  Synthetic oligonucleotide
aatgcgcgtagggtgggatgggagcggaatctgcg

SEQ ID NO: 158837 - DNA, 35 bp, Artificial Sequence
  Synthetic oligonucleotide
taggtcgggatcaaagggggggaagggtgtaaagg

SEQ ID NO: 158838 - DNA, 35 bp, Artificial Sequence
  Synthetic oligonucleotide
tctgggaggccatacatgcgatggggtggggaggg

SEQ ID NO: 158839 - DNA, 35 bp, Artificial Sequence
  Synthetic oligonucleotide
tatggtagagggaaaaagggtcaagtagacggggg

SEQ ID NO: 158840 - DNA, 35 bp, Artificial Sequence
  Synthetic oligonucleotide
gattgcctggccgcccgctcactttctcttctatg

SEQ ID NO: 158841 - DNA, 35 bp, Artificial Sequence
  Synthetic oligonucleotide
attgcaccgtaaaatcgatgccctcgccctgcctg

SEQ ID NO: 158842 - DNA, 35 bp, Artificial Sequence
  Synthetic oligonucleotide
gggtaagagcggggggtggaggaatatggtgtgtg

SEQ ID NO: 158843 - DNA, 35 bp, Artificial Sequence
  Synthetic oligonucleotide
gcgatccttcctgtctcctctgttatgtgtctttg

SEQ ID NO: 158844 - DNA, 35 bp, Artificial Sequence
  Synthetic oligonucleotide
ggtcctacccgcctctcagaccttgattacatact

SEQ ID NO: 158845 - DNA, 35 bp, Artificial Sequence
  Synthetic oligonucleotide
tagttgaccgtccagattagtcttctccacccgct

SEQ ID NO: 158846 - DNA, 35 bp, Artificial Sequence
  Synthetic oligonucleotide
tctgcgtgttgcctccacgcacccacccttgctct

SEQ ID NO: 158847 - DNA, 35 bp, Artificial Sequence
  Synthetic oligonucleotide
attggagccgcctcccccgttcgtgcttatggtct

SEQ ID NO: 158848 - DNA, 35 bp, Artificial Sequence
  Synthetic oligonucleotide
tcctcaccctcgctcgcattgaattagcttatcgt

SEQ ID NO: 158849 - DNA, 35 bp, Artificial Sequence
  Synthetic oligonucleotide
tcccgccccagcttgtcccgccgtaaattatcctt

SEQ ID NO: 158850 - DNA, 35 bp, Artificial Sequence
  Synthetic oligonucleotide
gactcggctgtaatcgttaactgcctgctctcctt

SEQ ID NO: 158851 - DNA, 35 bp, Artificial Sequence
  Synthetic oligonucleotide
gtggagccctttgcccgcgccttgtccctcatctt

SEQ ID NO: 158852 - DNA, 35 bp, Artificial Sequence
  Synthetic oligonucleotide
tccgacctcgcatcccttcgtttccacatactctt

SEQ ID NO: 158853 - DNA, 36 bp, Artificial Sequence
  Synthetic oligonucleotide
acccgcccaaccatatgaagtctgtctctctcacaa

SEQ ID NO: 158854 - DNA, 36 bp, Artificial Sequence
  Synthetic oligonucleotide
acgttccgcacctggctctttcactgtcctttacaa

SEQ ID NO: 158855 - DNA, 35 bp, Artificial Sequence
  Synthetic oligonucleotide
ttctcacaggccgtctgtctgcccctcttgtccaa

SEQ ID NO: 158856 - DNA, 35 bp, Artificial Sequence
  Synthetic oligonucleotide
accaccgccgtcctctacctccgcgtactactcaa

SEQ ID NO: 158857 - DNA, 36 bp, Artificial Sequence
  Synthetic oligonucleotide
tccaggggggggaaggagggtgggctgggcaacgaa

SEQ ID NO: 158858 - DNA, 36 bp, Artificial Sequence
  Synthetic oligonucleotide
gtccccatgaaccgtttacgtgcccgtaccctttaa

SEQ ID NO: 158859 - DNA, 35 bp, Artificial Sequence
  Synthetic oligonucleotide
aacgttcgaacgctccctgaaactgccttgtgaca

SEQ ID NO: 158860 - DNA, 35 bp, Artificial Sequence
  Synthetic oligonucleotide
tgtttgctccaccatgacgtcacgcatcccagcca

SEQ ID NO: 158861 - DNA, 36 bp, Artificial Sequence
  Synthetic oligonucleotide
ggttgctgcccggctggccctctttttgtacctcca

SEQ ID NO: 158862 - DNA, 36 bp, Artificial Sequence
  Synthetic oligonucleotide
tgtggcggttcccatcgcttgctagtagtccctcca

SEQ ID NO: 158863 - DNA, 35 bp, Artificial Sequence
  Synthetic oligonucleotide
tcccccctgtccgtactggtcccagacattttgca

SEQ ID NO: 158864 - DNA, 35 bp, Artificial Sequence
  Synthetic oligonucleotide
actggggacggggtggggtctttgattggggatca

SEQ ID NO: 158865 - DNA, 35 bp, Artificial Sequence
  Synthetic oligonucleotide
tgcgtgttccgatctacattgccgttaccctctca

SEQ ID NO: 158866 - DNA, 35 bp, Artificial Sequence
  Synthetic oligonucleotide
tgttatcgccacaggtcttttctccccgtaggtca

SEQ ID NO: 158867 - DNA, 37 bp, Artificial Sequence
  Synthetic oligonucleotide
atacccacgcccactcctgcatcggtcacctcaccga

SEQ ID NO: 158868 - DNA, 37 bp, Artificial Sequence
  Synthetic oligonucleotide
tcccgccaatggtaacgcgcaccacaaccacctccga

SEQ ID NO: 158869 - DNA, 37 bp, Artificial Sequence
  Synthetic oligonucleotide
accaccgttgcagtactccaatctcctgtcccctcga

SEQ ID NO: 158870 - DNA, 37 bp, Artificial Sequence
  Synthetic oligonucleotide
tatgccgttagtctcaccaccccccctttggcccgga

SEQ ID NO: 158871 - DNA, 37 bp, Artificial Sequence
  Synthetic oligonucleotide
gctaggcaaaggaggggggcggttatggaccaaggga

SEQ ID NO: 158872 - DNA, 37 bp, Artificial Sequence
  Synthetic oligonucleotide
gctcaagcactcaggggcttacaacgggagggaggga

SEQ ID NO: 158873 - DNA, 37 bp, Artificial Sequence
  Synthetic oligonucleotide
ttacccccacatctcgttcgcataagaccactcatga

SEQ ID NO: 158874 - DNA, 38 bp, Artificial Sequence
  Synthetic oligonucleotide
tgccacccggtaatgccgccttcacacctccactatga

SEQ ID NO: 158875 - DNA, 37 bp, Artificial Sequence
  Synthetic oligonucleotide
acattgtaccccgcccgcccgtattccatcgctatga

SEQ ID NO: 158876 - DNA, 38 bp, Artificial Sequence
  Synthetic oligonucleotide
gagtcacgtcacctgcttcggaccttagccccacctga

SEQ ID NO: 158877 - DNA, 37 bp, Artificial Sequence
  Synthetic oligonucleotide
gcccagggcgcagggagggaagaagtaaaaggggtga

SEQ ID NO: 158878 - DNA, 38 bp, Artificial Sequence
  Synthetic oligonucleotide
gtgctccacctttgtattctcgcatcccctttctgtga

SEQ ID NO: 158879 - DNA, 38 bp, Artificial Sequence
  Synthetic oligonucleotide
gaccctctgccccccgctaatacagtacattctcttga

SEQ ID NO: 158880 - DNA, 38 bp, Artificial Sequence
  Synthetic oligonucleotide
gacgccccccgcgccatcgtcttatgcgccctctttga

SEQ ID NO: 158881 - DNA, 36 bp, Artificial Sequence
  Synthetic oligonucleotide
accccatgacctccacgacttactgagagcgctata

SEQ ID NO: 158882 - DNA, 36 bp, Artificial Sequence
  Synthetic oligonucleotide
tttgctccctgacctctcgcctaatgcccgttgcta

SEQ ID NO: 158883 - DNA, 36 bp, Artificial Sequence
  Synthetic oligonucleotide
gtttccagccccattgcatcaattcccagccttgta

SEQ ID NO: 158884 - DNA, 35 bp, Artificial Sequence
  Synthetic oligonucleotide
gtgccccctttgaggctaacttgaccgcccgctta

SEQ ID NO: 158885 - DNA, 36 bp, Artificial Sequence
  Synthetic oligonucleotide
agtcgagacatttgggcgggaagggggggtgattta

SEQ ID NO: 158886 - DNA, 35 bp, Artificial Sequence
  Synthetic oligonucleotide
tcacaacagttgtacggaagacgtctcacccttta

SEQ ID NO: 158887 - DNA, 36 bp, Artificial Sequence
  Synthetic oligonucleotide
gtggaccacttttgatattatctgccgctcgcttta

SEQ ID NO: 158888 - DNA, 35 bp, Artificial Sequence
  Synthetic oligonucleotide
tgaccctgccctcccacgattatcggcgaatttta

SEQ ID NO: 158889 - DNA, 35 bp, Artificial Sequence
  Synthetic oligonucleotide
gacaggaggcatgttcttccctgcaccaccttcac

SEQ ID NO: 158890 - DNA, 35 bp, Artificial Sequence
  Synthetic oligonucleotide
tcccgtaccatgttctgccgccagttctgtttccc

SEQ ID NO: 158891 - DNA, 35 bp, Artificial Sequence
  Synthetic oligonucleotide
ccacctcccctgttctttatgctggctgtacagcc

SEQ ID NO: 158892 - DNA, 35 bp, Artificial Sequence
  Synthetic oligonucleotide
gcttgcctcgccgtcaccccgtcacctctaacgcc

SEQ ID NO: 158893 - DNA, 35 bp, Artificial Sequence
  Synthetic oligonucleotide
acgatgccttgcgcgtcactcccctcaaactcgcc

SEQ ID NO: 158894 - DNA, 35 bp, Artificial Sequence
  Synthetic oligonucleotide
acaccacctcaacatctgtgcttcttaccctggcc

SEQ ID NO: 158895 - DNA, 35 bp, Artificial Sequence
  Synthetic oligonucleotide
tcacccccccgaccgtggcccctttaaccgactcc

SEQ ID NO: 158896 - DNA, 35 bp, Artificial Sequence
  Synthetic oligonucleotide
acaaaccggcaccgattgcgtccacatgtccttcc

SEQ ID NO: 158897 - DNA, 35 bp, Artificial Sequence
  Synthetic oligonucleotide
tgcacgtggttcccatcgttactgtcccttatcgc

SEQ ID NO: 158898 - DNA, 35 bp, Artificial Sequence
  Synthetic oligonucleotide
gatcgacctcctgttattagttttttcttcgttgc

SEQ ID NO: 158899 - DNA, 35 bp, Artificial Sequence
  Synthetic oligonucleotide
gcgagagcgctccccacttcgaccgtctcgtttgc

SEQ ID NO: 158900 - DNA, 35 bp, Artificial Sequence
  Synthetic oligonucleotide
gcataacacctgtggtcacacgccgccctccaatc

SEQ ID NO: 158901 - DNA, 35 bp, Artificial Sequence
  Synthetic oligonucleotide
ttcagtaggccagacacccgctatctcgtaccatc

SEQ ID NO: 158902 - DNA, 35 bp, Artificial Sequence
  Synthetic oligonucleotide
taccatgcccgccacgcgctctctcgtacttactc

SEQ ID NO: 158903 - DNA, 35 bp, Artificial Sequence
  Synthetic oligonucleotide
aaagcaccccacacacgcgtgtcacctgtcacctc

SEQ ID NO: 158904 - DNA, 35 bp, Artificial Sequence
  Synthetic oligonucleotide
tgccacggagcgtcctctcactcccatccttgctc

SEQ ID NO: 158905 - DNA, 35 bp, Artificial Sequence
  Synthetic oligonucleotide
tccacggttagcccgtttcgcctgtgcctcgtttc

SEQ ID NO: 158906 - DNA, 35 bp, Artificial Sequence
  Synthetic oligonucleotide
accctccccagacttttgtactccttccttgacag

SEQ ID NO: 158907 - DNA, 35 bp, Artificial Sequence
  Synthetic oligonucleotide
gcgaggggaggaaagtcggttaagaacgggtacag

SEQ ID NO: 158908 - DNA, 35 bp, Artificial Sequence
  Synthetic oligonucleotide
ggtaaataggggtggtacggaaggagtaggcggag

SEQ ID NO: 158909 - DNA, 35 bp, Artificial Sequence
  Synthetic oligonucleotide
acctcatgccccttctgactagcatatttgactag

SEQ ID NO: 158910 - DNA, 35 bp, Artificial Sequence
  Synthetic oligonucleotide
tcagccacccctatccccagtcctcgcattgaacg

SEQ ID NO: 158911 - DNA, 35 bp, Artificial Sequence
  Synthetic oligonucleotide
actcccaacgccccaccgaccgggtatgatctccg

SEQ ID NO: 158912 - DNA, 35 bp, Artificial Sequence
  Synthetic oligonucleotide
ttgaaccggctctcttgcgcgaccatcccgaatcg

SEQ ID NO: 158913 - DNA, 32 bp, Artificial Sequence
  Synthetic oligonucleotide
tccacgcatcgtgctctcccctgtctacccgg

SEQ ID NO: 158914 - DNA, 35 bp, Artificial Sequence
  Synthetic oligonucleotide
gaaatggggggaagaggaggaaatccgggcacatg

SEQ ID NO: 158915 - DNA, 35 bp, Artificial Sequence
  Synthetic oligonucleotide
atgcgtgcatccaacgccacttccccatgctattg

SEQ ID NO: 158916 - DNA, 35 bp, Artificial Sequence
  Synthetic oligonucleotide
tgtgcctccaccccagcgggccgccactcttattg

SEQ ID NO: 158917 - DNA, 35 bp, Artificial Sequence
  Synthetic oligonucleotide
tcccagtcaacttcgacctgtcatcattgttccat

SEQ ID NO: 158918 - DNA, 35 bp, Artificial Sequence
  Synthetic oligonucleotide
tgatcacctctatggctttctacgttctaacctat

SEQ ID NO: 158919 - DNA, 35 bp, Artificial Sequence
  Synthetic oligonucleotide
ttccccgcctccgcttaccacaggtccaaattact

SEQ ID NO: 158920 - DNA, 35 bp, Artificial Sequence
  Synthetic oligonucleotide
tccgcccactcaggcacacattactggtccttact

SEQ ID NO: 158921 - DNA, 35 bp, Artificial Sequence
  Synthetic oligonucleotide
acctccccggccccatctgtgccattactatcgct

SEQ ID NO: 158922 - DNA, 35 bp, Artificial Sequence
  Synthetic oligonucleotide
tccggacccatgtgaccttgacccagctcatctct

SEQ ID NO: 158923 - DNA, 35 bp, Artificial Sequence
  Synthetic oligonucleotide
ttccggacccactgtttcgcattcaggccctttct

SEQ ID NO: 158924 - DNA, 35 bp, Artificial Sequence
  Synthetic oligonucleotide
tgtgtggtgccaatgggggaagggtgtggttaggt

SEQ ID NO: 158925 - DNA, 35 bp, Artificial Sequence
  Synthetic oligonucleotide
gacaccctgattatgtaaccccgattccccttggt

SEQ ID NO: 158926 - DNA, 35 bp, Artificial Sequence
  Synthetic oligonucleotide
gtgatagctcacttccgcaccccccccatgcgctt

SEQ ID NO: 158927 - DNA, 35 bp, Artificial Sequence
  Synthetic oligonucleotide
tccgcaccaccgtttttgtccgcccccgcttcttt

SEQ ID NO: 158928 - DNA, 35 bp, Artificial Sequence
  Synthetic oligonucleotide
gtgggcgtggtagagtaggaggggtgggcgtcaaa

SEQ ID NO: 158929 - DNA, 36 bp, Artificial Sequence
  Synthetic oligonucleotide
tatgtcccccagaattcgtactgcattgccccataa

SEQ ID NO: 158930 - DNA, 35 bp, Artificial Sequence
  Synthetic oligonucleotide
tagacagcgctcgttcgtcgccactcctcctcaca

SEQ ID NO: 158931 - DNA, 35 bp, Artificial Sequence
  Synthetic oligonucleotide
gttgttcgcgtgcaggtcgttccgccccacctaca

SEQ ID NO: 158932 - DNA, 37 bp, Artificial Sequence
  Synthetic oligonucleotide
aagatgagtcggaaggaatcgggggagaacgaggaga

SEQ ID NO: 158933 - DNA, 37 bp, Artificial Sequence
  Synthetic oligonucleotide
gacacctcaccccgtctagccctatctcgcattgaga

SEQ ID NO: 158934 - DNA, 37 bp, Artificial Sequence
  Synthetic oligonucleotide
gacgcaagggccattgggggggtggagcagtagacga

SEQ ID NO: 158935 - DNA, 36 bp, Artificial Sequence
  Synthetic oligonucleotide
acgccccctcttgccctgctatttgatccctcccga

SEQ ID NO: 158936 - DNA, 37 bp, Artificial Sequence
  Synthetic oligonucleotide
gcgcatgcctcccgtaggtcactcttccgcttgccga

SEQ ID NO: 158937 - DNA, 37 bp, Artificial Sequence
  Synthetic oligonucleotide
ggacgaccgctcccccattgttaaatatgccttccga

SEQ ID NO: 158938 - DNA, 37 bp, Artificial Sequence
  Synthetic oligonucleotide
ttgtaactcgcccaatgcgcatctgcactcccttcga

SEQ ID NO: 158939 - DNA, 37 bp, Artificial Sequence
  Synthetic oligonucleotide
aacgaaggcgagtggatgggggagggtcgcgggagga

SEQ ID NO: 158940 - DNA, 36 bp, Artificial Sequence
  Synthetic oligonucleotide
gatggaggatgtggggagggggatgggagactagga

SEQ ID NO: 158941 - DNA, 36 bp, Artificial Sequence
  Synthetic oligonucleotide
ggggtgggcgcatgccataatatattgaaagaggga

SEQ ID NO: 158942 - DNA, 37 bp, Artificial Sequence
  Synthetic oligonucleotide
gaaaacgtgacgaagggaacggggcacgagggcggga

SEQ ID NO: 158943 - DNA, 37 bp, Artificial Sequence
  Synthetic oligonucleotide
gtcggtaccactgttcgcctcctccgtcccctgtgga

SEQ ID NO: 158944 - DNA, 37 bp, Artificial Sequence
  Synthetic oligonucleotide
gaccaccacgattgaatatttcgcccctcctgtatga

SEQ ID NO: 158945 - DNA, 37 bp, Artificial Sequence
  Synthetic oligonucleotide
gtgaagtccactcgccaagccacccgcccgtacctga

SEQ ID NO: 158946 - DNA, 38 bp, Artificial Sequence
  Synthetic oligonucleotide
gacccatcacgcgattagccgcccccaagtacccctga

SEQ ID NO: 158947 - DNA, 37 bp, Artificial Sequence
  Synthetic oligonucleotide
tcgaccgatcgcgcgatccatcatcttcctttgctga

SEQ ID NO: 158948 - DNA, 38 bp, Artificial Sequence
  Synthetic oligonucleotide
agcaacgtgagccgtccttccctcgcacctgcccgtga

SEQ ID NO: 158949 - DNA, 38 bp, Artificial Sequence
  Synthetic oligonucleotide
ggggtgggcgggtgttgggttttaaacgagaacggtga

SEQ ID NO: 158950 - DNA, 38 bp, Artificial Sequence
  Synthetic oligonucleotide
tcatgggaggggcacggggtaggagtgacagggggtga

SEQ ID NO: 158951 - DNA, 38 bp, Artificial Sequence
  Synthetic oligonucleotide
tccggagccaccacctgcagctggccattccccattga

SEQ ID NO: 158952 - DNA, 35 bp, Artificial Sequence
  Synthetic oligonucleotide
atccacccccacagcatgtacgtactctggcagta

SEQ ID NO: 158953 - DNA, 36 bp, Artificial Sequence
  Synthetic oligonucleotide
aaaggtggatggtggggcatgggagtgggtggggta

SEQ ID NO: 158954 - DNA, 35 bp, Artificial Sequence
  Synthetic oligonucleotide
gatgacgataaaaaggcggaggagtgatggggtta

SEQ ID NO: 158955 - DNA, 35 bp, Artificial Sequence
  Synthetic oligonucleotide
gtccctcccccagattcggctcacaccccggtaac

SEQ ID NO: 158956 - DNA, 35 bp, Artificial Sequence
  Synthetic oligonucleotide
ataccgccacgtttgttggttccttttcgtcctac

SEQ ID NO: 158957 - DNA, 35 bp, Artificial Sequence
  Synthetic oligonucleotide
tcccccccgcgataccttagtctaacttgcattac

SEQ ID NO: 158958 - DNA, 35 bp, Artificial Sequence
  Synthetic oligonucleotide
actgatcgcacaagtacttgatcacactcccttac

SEQ ID NO: 158959 - DNA, 35 bp, Artificial Sequence
  Synthetic oligonucleotide
gacccattccagcgaccatctttcgacgatccacc

SEQ ID NO: 158960 - DNA, 35 bp, Artificial Sequence
  Synthetic oligonucleotide
atggccagcatgcgtacgttctacacctccctacc

SEQ ID NO: 158961 - DNA, 35 bp, Artificial Sequence
  Synthetic oligonucleotide
gctctaccagccgctgcttctatttaattccgccc

SEQ ID NO: 158962 - DNA, 35 bp, Artificial Sequence
  Synthetic oligonucleotide
aagcgaccgtcgtacctccactcccgtcctaggcc

SEQ ID NO: 158963 - DNA, 35 bp, Artificial Sequence
  Synthetic oligonucleotide
tcacccaccacgtcgtctcctgagcaccattggcc

SEQ ID NO: 158964 - DNA, 35 bp, Artificial Sequence
  Synthetic oligonucleotide
tcgactcgctcgctggaaggcctcacccacaatcc

SEQ ID NO: 158965 - DNA, 35 bp, Artificial Sequence
  Synthetic oligonucleotide
aattgcttgcaccacgcctggccccccctaaccgc

SEQ ID NO: 158966 - DNA, 35 bp, Artificial Sequence
  Synthetic oligonucleotide
tgacgacggcaccctcgttacatctgcctccttgc

SEQ ID NO: 158967 - DNA, 35 bp, Artificial Sequence
  Synthetic oligonucleotide
acaccggtgccatcgatcctctgccgtacaaactc

SEQ ID NO: 158968 - DNA, 35 bp, Artificial Sequence
  Synthetic oligonucleotide
ttcgtccgagcgtgaccccttgcttcatacccgtc

SEQ ID NO: 158969 - DNA, 35 bp, Artificial Sequence
  Synthetic oligonucleotide
tagcccgatccgttccttgctaccagttcgttttc

SEQ ID NO: 158970 - DNA, 35 bp, Artificial Sequence
  Synthetic oligonucleotide
gtagactgggcgggagggttagccaagggcttaag

SEQ ID NO: 158971 - DNA, 35 bp, Artificial Sequence
  Synthetic oligonucleotide
gtagacgccgaatgacagtgggggaaggtaagcag

SEQ ID NO: 158972 - DNA, 35 bp, Artificial Sequence
  Synthetic oligonucleotide
atacttccgtccaccgcccatgtcatctccgtgag

SEQ ID NO: 158973 - DNA, 35 bp, Artificial Sequence
  Synthetic oligonucleotide
ggggggtagggggggatagagcggtacagctgtag

SEQ ID NO: 158974 - DNA, 35 bp, Artificial Sequence
  Synthetic oligonucleotide
tccaccacctcttaccggttccttacggatgaccg

SEQ ID NO: 158975 - DNA, 35 bp, Artificial Sequence
  Synthetic oligonucleotide
ttgggtcacgtcgtgctcgctatccctgccttccg

SEQ ID NO: 158976 - DNA, 35 bp, Artificial Sequence
  Synthetic oligonucleotide
accccaccgttcaccctgcgtcctcacagtgcagg

SEQ ID NO: 158977 - DNA, 35 bp, Artificial Sequence
  Synthetic oligonucleotide
taatacactgttcaccgccgcccggcctccgattg

SEQ ID NO: 158978 - DNA, 35 bp, Artificial Sequence
  Synthetic oligonucleotide
aactgacaccatccttctgcccgctggccgccaat

SEQ ID NO: 158979 - DNA, 35 bp, Artificial Sequence
  Synthetic oligonucleotide
gggatgagggcgggggtagtaagaagtgcgccaat

SEQ ID NO: 158980 - DNA, 35 bp, Artificial Sequence
  Synthetic oligonucleotide
ttcacggtccactgtttgcactgactccgccctat

SEQ ID NO: 158981 - DNA, 35 bp, Artificial Sequence
  Synthetic oligonucleotide
accgacccccatttgtacgacaccgagttccttat

SEQ ID NO: 158982 - DNA, 35 bp, Artificial Sequence
  Synthetic oligonucleotide
gacaacgattcacccccttacggcgcccctgccct

SEQ ID NO: 158983 - DNA, 35 bp, Artificial Sequence
  Synthetic oligonucleotide
tacaccccgaaatgcgccctgcccaatgctagcct

SEQ ID NO: 158984 - DNA, 35 bp, Artificial Sequence
  Synthetic oligonucleotide
actccccgaactgtcttgtcttcgttgctgtgcct

SEQ ID NO: 158985 - DNA, 35 bp, Artificial Sequence
  Synthetic oligonucleotide
ttacatccccacccgccgttgtactcccttggggt

SEQ ID NO: 158986 - DNA, 35 bp, Artificial Sequence
  Synthetic oligonucleotide
acgtccactctccgacacatttcggaccatcctgt

SEQ ID NO: 158987 - DNA, 34 bp, Artificial Sequence
  Synthetic oligonucleotide
gagagccgtgctctgttgatctatcaccctctgt

SEQ ID NO: 158988 - DNA, 35 bp, Artificial Sequence
  Synthetic oligonucleotide
acgtgacacgcgggggccctgtacttgccttcctt

SEQ ID NO: 158989 - DNA, 35 bp, Artificial Sequence
  Synthetic oligonucleotide
atcccgctaccttctggcgatgtctcaccccgctt

SEQ ID NO: 158990 - DNA, 35 bp, Artificial Sequence
  Synthetic oligonucleotide
tactgcctttgcctccccgcgtcgtcatacccttt

SEQ ID NO: 158991 - DNA, 35 bp, Artificial Sequence
  Synthetic oligonucleotide
gtgccccgcccatttccgcgttttggtccagcaaa

SEQ ID NO: 158992 - DNA, 35 bp, Artificial Sequence
  Synthetic oligonucleotide
gtgggcaacctcctctggctcttaccgttacgcaa

SEQ ID NO: 158993 - DNA, 36 bp, Artificial Sequence
  Synthetic oligonucleotide
ggggggccgagggatggggctgaagcttccggggaa

SEQ ID NO: 158994 - DNA, 36 bp, Artificial Sequence
  Synthetic oligonucleotide
agtacgcccccctgctgcctagtcccaccgcgctaa

SEQ ID NO: 158995 - DNA, 35 bp, Artificial Sequence
  Synthetic oligonucleotide
acctctgtcctgctgcaccatacgtgccttgttaa

SEQ ID NO: 158996 - DNA, 35 bp, Artificial Sequence
  Synthetic oligonucleotide
atggtggagggggagggagggacgggatagagaca

SEQ ID NO: 158997 - DNA, 35 bp, Artificial Sequence
  Synthetic oligonucleotide
aagagtgagcagggtgtggtggggtgggcgttaca

SEQ ID NO: 158998 - DNA, 36 bp, Artificial Sequence
  Synthetic oligonucleotide
aaccgcccactcgttgcgcccggaatcacagttcca

SEQ ID NO: 158999 - DNA, 36 bp, Artificial Sequence
  Synthetic oligonucleotide
ggacccacctgtctgctaatacttaatctgccctca

SEQ ID NO: 159000 - DNA, 36 bp, Artificial Sequence
  Synthetic oligonucleotide
taccccttgaccatgttttgaacgttctgtccctca

SEQ ID NO: 159001 - DNA, 36 bp, Artificial Sequence
  Synthetic oligonucleotide
agcacatccagcccccgacactgtccctatttctca

SEQ ID NO: 159002 - DNA, 35 bp, Artificial Sequence
  Synthetic oligonucleotide
ttgcctggttacatctgctaacggccctcatttca

SEQ ID NO: 159003 - DNA, 36 bp, Artificial Sequence
  Synthetic oligonucleotide
ccacacctgcgcactcgccccgtatggtccctttca

SEQ ID NO: 159004 - DNA, 37 bp, Artificial Sequence
  Synthetic oligonucleotide
gccgacgcccccacgatcgtctagcatcccctttaga

SEQ ID NO: 159005 - DNA, 37 bp, Artificial Sequence
  Synthetic oligonucleotide
agcaccacatggtaccccgcatccgctcgctgcccga

SEQ ID NO: 159006 - DNA, 34 bp, Artificial Sequence
  Synthetic oligonucleotide
tacctgtccaccatggtgataaccccatatccga

SEQ ID NO: 159007 - DNA, 37 bp, Artificial Sequence
  Synthetic oligonucleotide
gaccctgccatccgccgtctatccccagtcaccgcga

SEQ ID NO: 159008 - DNA, 37 bp, Artificial Sequence
  Synthetic oligonucleotide
cccatcggccctcttcccctgctgcctgccttatcga

SEQ ID NO: 159009 - DNA, 37 bp, Artificial Sequence
  Synthetic oligonucleotide
tagtcaccggcatagtacctgcctccgctatcttcga

SEQ ID NO: 159010 - DNA, 37 bp, Artificial Sequence
  Synthetic oligonucleotide
tatccacccactcatgcccgtataactcaacctagga

SEQ ID NO: 159011 - DNA, 36 bp, Artificial Sequence
  Synthetic oligonucleotide
gctcagtcgcgggactgggggggtgggcaccacgga

SEQ ID NO: 159012 - DNA, 37 bp, Artificial Sequence
  Synthetic oligonucleotide
agtgcggacgccagcgagggggacggggacggtcgga

SEQ ID NO: 159013 - DNA, 37 bp, Artificial Sequence
  Synthetic oligonucleotide
aacggagccgggaatgtaaaaatcgggctgggtggga

SEQ ID NO: 159014 - DNA, 37 bp, Artificial Sequence
  Synthetic oligonucleotide
tacatgcctatgcaccaccgggccttcctttcttgga

SEQ ID NO: 159015 - DNA, 37 bp, Artificial Sequence
  Synthetic oligonucleotide
gtgtgagtggtagagggctgatagaggggaaggatga

SEQ ID NO: 159016 - DNA, 38 bp, Artificial Sequence
  Synthetic oligonucleotide
gccacgccccaggtgttcaccgtttcagctcctcctga

SEQ ID NO: 159017 - DNA, 38 bp, Artificial Sequence
  Synthetic oligonucleotide
tcccgaccctctatgttcacgtcccgtactatccgtga

SEQ ID NO: 159018 - DNA, 38 bp, Artificial Sequence
  Synthetic oligonucleotide
acccccgcgcgctttcctcctccgccccatgtaggtga

SEQ ID NO: 159019 - DNA, 38 bp, Artificial Sequence
  Synthetic oligonucleotide
acacacctccccctcttgatccacctgcatcctggtga

SEQ ID NO: 159020 - DNA, 38 bp, Artificial Sequence
  Synthetic oligonucleotide
attgccccccccatgataggatccgcaccctgtattga

SEQ ID NO: 159021 - DNA, 36 bp, Artificial Sequence
  Synthetic oligonucleotide
attgccatggcgccgtcccttgtacttctcctttga

SEQ ID NO: 159022 - DNA, 33 bp, Artificial Sequence
  Synthetic oligonucleotide
tcattccatcccgcgccacaatcgcaaccgcta

SEQ ID NO: 159023 - DNA, 36 bp, Artificial Sequence
  Synthetic oligonucleotide
ttgtcacccctccctctttcgagcacatcgctgcta

SEQ ID NO: 159024 - DNA, 36 bp, Artificial Sequence
  Synthetic oligonucleotide
gctgagggccggggggaaagggttgactatgtggta

SEQ ID NO: 159025 - DNA, 36 bp, Artificial Sequence
  Synthetic oligonucleotide
ccacccccgtgccatctgccctattcacgacatgta

SEQ ID NO: 159026 - DNA, 36 bp, Artificial Sequence
  Synthetic oligonucleotide
gacactagcccatctcgtattgcccatatcttatta

SEQ ID NO: 159027 - DNA, 36 bp, Artificial Sequence
  Synthetic oligonucleotide
attgcccgccgatcgatcatttagttgctcctctta

SEQ ID NO: 159028 - DNA, 35 bp, Artificial Sequence
  Synthetic oligonucleotide
ttgtcctcggtctccctgcgcactttgacttacac

SEQ ID NO: 159029 - DNA, 35 bp, Artificial Sequence
  Synthetic oligonucleotide
gagagggtgtgagggtactcattgctccgggggac

SEQ ID NO: 159030 - DNA, 35 bp, Artificial Sequence
  Synthetic oligonucleotide
atgccacatgccctaccgtatcgcaaccgattacc

SEQ ID NO: 159031 - DNA, 35 bp, Artificial Sequence
  Synthetic oligonucleotide
tacagtcctgttgccgtattggtttccacttcccc

SEQ ID NO: 159032 - DNA, 35 bp, Artificial Sequence
  Synthetic oligonucleotide
gtacgccgcccctcatccggaaaagaaagtttccc

SEQ ID NO: 159033 - DNA, 35 bp, Artificial Sequence
  Synthetic oligonucleotide
acttcgcgcgatctacttatgtccaccttgccgcc

SEQ ID NO: 159034 - DNA, 35 bp, Artificial Sequence
  Synthetic oligonucleotide
tcatccttctgcccgcgaaaatctgcctacttgcc

SEQ ID NO: 159035 - DNA, 35 bp, Artificial Sequence
  Synthetic oligonucleotide
ttccggggccactattgttcgatttcgcttttgcc

SEQ ID NO: 159036 - DNA, 34 bp, Artificial Sequence
  Synthetic oligonucleotide
tgtaagacttctcgctcctgcatttgcaacctcc

SEQ ID NO: 159037 - DNA, 35 bp, Artificial Sequence
  Synthetic oligonucleotide
tgcgatccggccattttcctcgctttgggttttcc

SEQ ID NO: 159038 - DNA, 35 bp, Artificial Sequence
  Synthetic oligonucleotide
gtgaacacgcggaaatgggtgggggggacatacgc

SEQ ID NO: 159039 - DNA, 35 bp, Artificial Sequence
  Synthetic oligonucleotide
ttacaccccagccctaacgcccatgccccaaccgc

SEQ ID NO: 159040 - DNA, 35 bp, Artificial Sequence
  Synthetic oligonucleotide
tgcgtggtccgtcctttgctctgatttacgtactc

SEQ ID NO: 159041 - DNA, 35 bp, Artificial Sequence
  Synthetic oligonucleotide
gtgtcgggcgtgtcggccttcttgttttacacctc

SEQ ID NO: 159042 - DNA, 35 bp, Artificial Sequence
  Synthetic oligonucleotide
gcctcctagctggcccctttcctggaatgcccctc

SEQ ID NO: 159043 - DNA, 35 bp, Artificial Sequence
  Synthetic oligonucleotide
aacgctccccctgtcctgtgccatgcgatctgctc

SEQ ID NO: 159044 - DNA, 35 bp, Artificial Sequence
  Synthetic oligonucleotide
aacgcaccttgccccacgcccatcggcccctagtc

SEQ ID NO: 159045 - DNA, 35 bp, Artificial Sequence
  Synthetic oligonucleotide
taggcatacccctctcctgtgcctgtttctgggtc

SEQ ID NO: 159046 - DNA, 35 bp, Artificial Sequence
  Synthetic oligonucleotide
acctccgttccttcatcccgtgtaaactcattgtc

SEQ ID NO: 159047 - DNA, 35 bp, Artificial Sequence
  Synthetic oligonucleotide
gtccgccatacgcttctgcctatttccttcttgtc

SEQ ID NO: 159048 - DNA, 35 bp, Artificial Sequence
  Synthetic oligonucleotide
tatccaccacgtcgtaactcccgccgctgaactcg

SEQ ID NO: 159049 - DNA, 35 bp, Artificial Sequence
  Synthetic oligonucleotide
gtatccacccggctgtcctccaacgctctccaagg

SEQ ID NO: 159050 - DNA, 35 bp, Artificial Sequence
  Synthetic oligonucleotide
tgtaccgccccgccacacggtcacagtcttacagg

SEQ ID NO: 159051 - DNA, 35 bp, Artificial Sequence
  Synthetic oligonucleotide
tcaatgcatcgtcacctccgcttcccacctgctgg

SEQ ID NO: 159052 - DNA, 35 bp, Artificial Sequence
  Synthetic oligonucleotide
tcccagccgccacccatgatcttgctccttgtatg

SEQ ID NO: 159053 - DNA, 35 bp, Artificial Sequence
  Synthetic oligonucleotide
tccctccttgccgcccgcgccacccgcgcgcactg

SEQ ID NO: 159054 - DNA, 35 bp, Artificial Sequence
  Synthetic oligonucleotide
gtctgaccccctatccaaccgcctccacgagactg

SEQ ID NO: 159055 - DNA, 35 bp, Artificial Sequence
  Synthetic oligonucleotide
ttgcaccctgcctgtattccctgcccgtacacctg

SEQ ID NO: 159056 - DNA, 35 bp, Artificial Sequence
  Synthetic oligonucleotide
atcctgctacctgttcccatcctctttaggccgtg

SEQ ID NO: 159057 - DNA, 35 bp, Artificial Sequence
  Synthetic oligonucleotide
acacccaccccaatacaggtgtatcgcacctaact

SEQ ID NO: 159058 - DNA, 35 bp, Artificial Sequence
  Synthetic oligonucleotide
gttgttgtttcgccctcgtgcttgatcgcctcact

SEQ ID NO: 159059 - DNA, 35 bp, Artificial Sequence
  Synthetic oligonucleotide
gaaaggctgtacgcagcgctttttgatcacctact

SEQ ID NO: 159060 - DNA, 35 bp, Artificial Sequence
  Synthetic oligonucleotide
acataccaccccgctctacccgactttcgagagct

SEQ ID NO: 159061 - DNA, 35 bp, Artificial Sequence
  Synthetic oligonucleotide
gccacattcgctgccttaccttgaaggtgacttct

SEQ ID NO: 159062 - DNA, 35 bp, Artificial Sequence
  Synthetic oligonucleotide
gactccctcccagtcccgaaacccgcaacactcgt

SEQ ID NO: 159063 - DNA, 35 bp, Artificial Sequence
  Synthetic oligonucleotide
gccacacacgccatgttaccccgctatatacattt

SEQ ID NO: 159064 - DNA, 35 bp, Artificial Sequence
  Synthetic oligonucleotide
aacgctccgcccctgatggcttccgcgcaccattt

SEQ ID NO: 159065 - DNA, 35 bp, Artificial Sequence
  Synthetic oligonucleotide
ttcacgatgtgttcgtctgtttgatccgccacttt

SEQ ID NO: 159066 - DNA, 35 bp, Artificial Sequence
  Synthetic oligonucleotide
ttgcggcgggggggagcaagggaggatgatatcaa

SEQ ID NO: 159067 - DNA, 35 bp, Artificial Sequence
  Synthetic oligonucleotide
gatcagacacagtgggtgggtaagggggggcagaa

SEQ ID NO: 159068 - DNA, 36 bp, Artificial Sequence
  Synthetic oligonucleotide
tgcattcctccgctgggtacgctccgtaacatctaa

SEQ ID NO: 159069 - DNA, 36 bp, Artificial Sequence
  Synthetic oligonucleotide
tactacacccatgtcacctgtgcgtcccattacaca

SEQ ID NO: 159070 - DNA, 36 bp, Artificial Sequence
  Synthetic oligonucleotide
tccccctccacgattgtgctacgtattctggtcaca

SEQ ID NO: 159071 - DNA, 35 bp, Artificial Sequence
  Synthetic oligonucleotide
agctcgtccggaatcccgcctgctcctttgcccca

SEQ ID NO: 159072 - DNA, 36 bp, Artificial Sequence
  Synthetic oligonucleotide
gtcgccccccgacctctcaccgcccacactccgcca

SEQ ID NO: 159073 - DNA, 36 bp, Artificial Sequence
  Synthetic oligonucleotide
ttccatcccgtctctgtctcctagttcttctcggca

SEQ ID NO: 159074 - DNA, 35 bp, Artificial Sequence
  Synthetic oligonucleotide
gaagggggatggggcattaattagggaggttggca

SEQ ID NO: 159075 - DNA, 36 bp, Artificial Sequence
  Synthetic oligonucleotide
tgcatgacgctgtcccgtgaccactcgacctcctca

SEQ ID NO: 159076 - DNA, 36 bp, Artificial Sequence
  Synthetic oligonucleotide
gtccaccacaccgtttcagtacgtccctttttgtca

SEQ ID NO: 159077 - DNA, 37 bp, Artificial Sequence
  Synthetic oligonucleotide
taccgcctccactgccgccgcccgtgccaattcaaga

SEQ ID NO: 159078 - DNA, 37 bp, Artificial Sequence
  Synthetic oligonucleotide
tgcccctccagctatcacttggcctatcttctccaga

SEQ ID NO: 159079 - DNA, 37 bp, Artificial Sequence
  Synthetic oligonucleotide
gtgccccacgttattgctatcttataccccgtcccga

SEQ ID NO: 159080 - DNA, 37 bp, Artificial Sequence
  Synthetic oligonucleotide
gtcccacccacggatatcctgcctagtctttggccga

SEQ ID NO: 159081 - DNA, 37 bp, Artificial Sequence
  Synthetic oligonucleotide
ggagggcgacgcaaagggaactagggtagtggaggga

SEQ ID NO: 159082 - DNA, 37 bp, Artificial Sequence
  Synthetic oligonucleotide
tcacgatcccttggctgtctcctcttggtccgctgga

SEQ ID NO: 159083 - DNA, 36 bp, Artificial Sequence
  Synthetic oligonucleotide
tgagaacccgctgcacactcccgcccacctcgtgga

SEQ ID NO: 159084 - DNA, 37 bp, Artificial Sequence
  Synthetic oligonucleotide
atcctcccctgcgtgttccaacatgcctccctttgga

SEQ ID NO: 159085 - DNA, 34 bp, Artificial Sequence
  Synthetic oligonucleotide
tcacgcccccactcctaatatacacctggcatga

SEQ ID NO: 159086 - DNA, 37 bp, Artificial Sequence
  Synthetic oligonucleotide
gagggaaccgacgggtgggtggcgaggggcaggatga

SEQ ID NO: 159087 - DNA, 38 bp, Artificial Sequence
  Synthetic oligonucleotide
gtgcgcctccgaaggaccttgcctgttctcttttatga

SEQ ID NO: 159088 - DNA, 38 bp, Artificial Sequence
  Synthetic oligonucleotide
gtcgcaacagcttaatccgcgcccgtcccagtcactga

SEQ ID NO: 159089 - DNA, 37 bp, Artificial Sequence
  Synthetic oligonucleotide
tgcccccgcgtaggcgttctgaaacctccacccctga

SEQ ID NO: 159090 - DNA, 38 bp, Artificial Sequence
  Synthetic oligonucleotide
aaacgagcgtcacacgcgctctcgaccctgacccctga

SEQ ID NO: 159091 - DNA, 38 bp, Artificial Sequence
  Synthetic oligonucleotide
gtcaacttccaatcctgctcagcgcgccgggcccctga

SEQ ID NO: 159092 - DNA, 38 bp, Artificial Sequence
  Synthetic oligonucleotide
atcagcctctgccgacccctgccctgtacatctcctga

SEQ ID NO: 159093 - DNA, 36 bp, Artificial Sequence
  Synthetic oligonucleotide
ttacgctcccctgttatcgttttaattccctcgtga

SEQ ID NO: 159094 - DNA, 38 bp, Artificial Sequence
  Synthetic oligonucleotide
gtgcgcgcaaggaggggttagaacgggggggacggtga

SEQ ID NO: 159095 - DNA, 37 bp, Artificial Sequence
  Synthetic oligonucleotide
agagcgtaagcaggggctaagggtgatgggggggtga

SEQ ID NO: 159096 - DNA, 38 bp, Artificial Sequence
  Synthetic oligonucleotide
gtccacccctccgtcttgacatatgccactgtctgtga

SEQ ID NO: 159097 - DNA, 37 bp, Artificial Sequence
  Synthetic oligonucleotide
acgttactgcctccgacctcctgattcatactcttga

SEQ ID NO: 159098 - DNA, 37 bp, Artificial Sequence
  Synthetic oligonucleotide
gacgcatctcctcatcttgtccaagccgacctcttga

SEQ ID NO: 159099 - DNA, 38 bp, Artificial Sequence
  Synthetic oligonucleotide
gattcacgccgacgttaatttagttcctcccctgttga

SEQ ID NO: 159100 - DNA, 38 bp, Artificial Sequence
  Synthetic oligonucleotide
gaatgctccaccgctcggataggtcgctccatctttga

SEQ ID NO: 159101 - DNA, 38 bp, Artificial Sequence
  Synthetic oligonucleotide
gcacgccctcaccgcgtatactggtcccacctttttga

SEQ ID NO: 159102 - DNA, 36 bp, Artificial Sequence
  Synthetic oligonucleotide
attgtcccacccctcccaaggacagtagtaacgcta

SEQ ID NO: 159103 - DNA, 36 bp, Artificial Sequence
  Synthetic oligonucleotide
ttgctagcgctgcatcctgcgttccctcttcacgta

SEQ ID NO: 159104 - DNA, 35 bp, Artificial Sequence
  Synthetic oligonucleotide
agggagcaggggtgaaggtgtggggagtgtgggta

SEQ ID NO: 159105 - DNA, 36 bp, Artificial Sequence
  Synthetic oligonucleotide
tccaccccgcacatatggccgttagccccataatta

SEQ ID NO: 159106 - DNA, 36 bp, Artificial Sequence
  Synthetic oligonucleotide
tcgcctgcccatcctgccgatatacccctcgcctta

SEQ ID NO: 159107 - DNA, 35 bp, Artificial Sequence
  Synthetic oligonucleotide
tctcaagcctgaccgccgaggcccgtaccaaccac

SEQ ID NO: 159108 - DNA, 35 bp, Artificial Sequence
  Synthetic oligonucleotide
aatgtggaggggggaacgctgcggggaagacatac

SEQ ID NO: 159109 - DNA, 35 bp, Artificial Sequence
  Synthetic oligonucleotide
agtccctcgcatcctggctttgactatccaacacc

SEQ ID NO: 159110 - DNA, 35 bp, Artificial Sequence
  Synthetic oligonucleotide
tgatgacgttagtcacgcgtttcgctgcctccacc

SEQ ID NO: 159111 - DNA, 35 bp, Artificial Sequence
  Synthetic oligonucleotide
gtatcgatgctgtcttccacccgctgcctgtcacc

SEQ ID NO: 159112 - DNA, 35 bp, Artificial Sequence
  Synthetic oligonucleotide
gtctcacctgccgtaggtacatccccggtcaaccc

SEQ ID NO: 159113 - DNA, 35 bp, Artificial Sequence
  Synthetic oligonucleotide
gtctggtccttctctcaacgtgcgaggttccaccc

SEQ ID NO: 159114 - DNA, 35 bp, Artificial Sequence
  Synthetic oligonucleotide
tccccccggcccccctgagtgacaccgcctacccc

SEQ ID NO: 159115 - DNA, 35 bp, Artificial Sequence
  Synthetic oligonucleotide
tcgacgcgacctgtcctccgctgttggccgccccc

SEQ ID NO: 159116 - DNA, 35 bp, Artificial Sequence
  Synthetic oligonucleotide
tacatctggacccgctggatcgtccctaccgcccc

SEQ ID NO: 159117 - DNA, 35 bp, Artificial Sequence
  Synthetic oligonucleotide
gccccggcccggctcactttcttcgttgtcgcgcc

SEQ ID NO: 159118 - DNA, 35 bp, Artificial Sequence
  Synthetic oligonucleotide
ggagagctcgcacactcggtcttcgccccttcgcc

SEQ ID NO: 159119 - DNA, 35 bp, Artificial Sequence
  Synthetic oligonucleotide
atccgctccctcgctgggtgtatgtcctgttttcc

SEQ ID NO: 159120 - DNA, 35 bp, Artificial Sequence
  Synthetic oligonucleotide
gcaccttccctccggtgtgcagcccctcgccatgc

SEQ ID NO: 159121 - DNA, 35 bp, Artificial Sequence
  Synthetic oligonucleotide
gctcacgcccaatcccttgttccgctccccggtgc

SEQ ID NO: 159122 - DNA, 35 bp, Artificial Sequence
  Synthetic oligonucleotide
acatccgtatgctcctcgtatgtcattgctccatc

SEQ ID NO: 159123 - DNA, 35 bp, Artificial Sequence
  Synthetic oligonucleotide
tacgtgcatcatccccgactcgcatctgttccatc

SEQ ID NO: 159124 - DNA, 35 bp, Artificial Sequence
  Synthetic oligonucleotide
tccgcacccccgactttacttgctcgtgaccactc

SEQ ID NO: 159125 - DNA, 35 bp, Artificial Sequence
  Synthetic oligonucleotide
tctgctcaatccttatgcacctttgtaccggcctc

SEQ ID NO: 159126 - DNA, 35 bp, Artificial Sequence
  Synthetic oligonucleotide
tctcactgtaccactcggttatatctcgagtcctc

SEQ ID NO: 159127 - DNA, 35 bp, Artificial Sequence
  Synthetic oligonucleotide
gccgcgacatacacctttcatacgttcgctcgctc

SEQ ID NO: 159128 - DNA, 35 bp, Artificial Sequence
  Synthetic oligonucleotide
tgcctgtccgtcgcgacctcctgtaccccgtattc

SEQ ID NO: 159129 - DNA, 36 bp, Artificial Sequence
  Synthetic oligonucleotide
gctgacccgttcagtactctatataacctctcgttc

SEQ ID NO: 159130 - DNA, 35 bp, Artificial Sequence
  Synthetic oligonucleotide
ctgtccgctcgcgctttatttccactccctacgag

SEQ ID NO: 159131 - DNA, 35 bp, Artificial Sequence
  Synthetic oligonucleotide
gtcaacacgcccttgtccctacccaccatacctag

SEQ ID NO: 159132 - DNA, 35 bp, Artificial Sequence
  Synthetic oligonucleotide
gccacatagtctacctcgccttactcgaccagacg

SEQ ID NO: 159133 - DNA, 35 bp, Artificial Sequence
  Synthetic oligonucleotide
gcacctgaatagccgaccgtaccctcttttgcccg

SEQ ID NO: 159134 - DNA, 35 bp, Artificial Sequence
  Synthetic oligonucleotide
acagtctgtcagccaatcccgcgtctgttcctccg

SEQ ID NO: 159135 - DNA, 35 bp, Artificial Sequence
  Synthetic oligonucleotide
gagccccacccctgctctgtttactgtcatctgcg

SEQ ID NO: 159136 - DNA, 35 bp, Artificial Sequence
  Synthetic oligonucleotide
atgtgggggggcgaggtggcggctacgtcagcggg

SEQ ID NO: 159137 - DNA, 35 bp, Artificial Sequence
  Synthetic oligonucleotide
gactggtgcaagttggggaaggggtgggagtgatg

SEQ ID NO: 159138 - DNA, 35 bp, Artificial Sequence
  Synthetic oligonucleotide
gtgcgggtcgtccgccgttcctccctcagacactg

SEQ ID NO: 159139 - DNA, 35 bp, Artificial Sequence
  Synthetic oligonucleotide
gttgggtggggtgagggacgtggcttaagggcgtg

SEQ ID NO: 159140 - DNA, 35 bp, Artificial Sequence
  Synthetic oligonucleotide
ggaaccgggggcatgcagggaaaggggaaggggtg

SEQ ID NO: 159141 - DNA, 35 bp, Artificial Sequence
  Synthetic oligonucleotide
aaagggggctgcatgggtaacgggggaggcgtaat

SEQ ID NO: 159142 - DNA, 35 bp, Artificial Sequence
  Synthetic oligonucleotide
ggaacaaaaaagggacggaaggaagtgggtgggat

SEQ ID NO: 159143 - DNA, 35 bp, Artificial Sequence
  Synthetic oligonucleotide
aacatacgcctggcaggctctccgccgctatctat

SEQ ID NO: 159144 - DNA, 35 bp, Artificial Sequence
  Synthetic oligonucleotide
ggtgccacccttagcctcagcccttcgtcgtaact

SEQ ID NO: 159145 - DNA, 35 bp, Artificial Sequence
  Synthetic oligonucleotide
tccgtcgctatgttaatgccggccactgttctcct

SEQ ID NO: 159146 - DNA, 35 bp, Artificial Sequence
  Synthetic oligonucleotide
gttcatccgctcccctcccctaggtgagacaatct

SEQ ID NO: 159147 - DNA, 35 bp, Artificial Sequence
  Synthetic oligonucleotide
ttgatcctcgagcgtttttgtgcttccacccctct

SEQ ID NO: 159148 - DNA, 35 bp, Artificial Sequence
  Synthetic oligonucleotide
tcacacctcactggtccacccacaccccctctggt

SEQ ID NO: 159149 - DNA, 35 bp, Artificial Sequence
  Synthetic oligonucleotide
ttcgccatacatcagttctatcttgcccgtagctt

SEQ ID NO: 159150 - DNA, 35 bp, Artificial Sequence
  Synthetic oligonucleotide
gcctgcgttcgtatctctcgccgccactttcagtt

SEQ ID NO: 159151 - DNA, 35 bp, Artificial Sequence
  Synthetic oligonucleotide
ttgccaatgggaggggaaaaaagggatgtcgggtt

SEQ ID NO: 159152 - DNA, 35 bp, Artificial Sequence
  Synthetic oligonucleotide
gtgagtcgacctgccggattttgctcgccaccttt

SEQ ID NO: 159153 - DNA, 35 bp, Artificial Sequence
  Synthetic oligonucleotide
accatcccgtgtcgcagcgaatatccgcgctcttt

SEQ ID NO: 159154 - DNA, 34 bp, Artificial Sequence
  Synthetic oligonucleotide
gtctgacgcatcctccgcccacctgctcgagttt

SEQ ID NO: 159155 - DNA, 36 bp, Artificial Sequence
  Synthetic oligonucleotide
acttctgccggtgggttgggacagggaggggaacaa

SEQ ID NO: 159156 - DNA, 36 bp, Artificial Sequence
  Synthetic oligonucleotide
atcttggggtgggaagggttggatggatggggcgaa

SEQ ID NO: 159157 - DNA, 36 bp, Artificial Sequence
  Synthetic oligonucleotide
gccacccccccgtccgtggcagtcatcacacactaa

SEQ ID NO: 159158 - DNA, 35 bp, Artificial Sequence
  Synthetic oligonucleotide
gaccctccttcagcccccgccgtatacacgagtaa

SEQ ID NO: 159159 - DNA, 35 bp, Artificial Sequence
  Synthetic oligonucleotide
aacgtcaccctcactatcattagcttcactggaca

SEQ ID NO: 159160 - DNA, 36 bp, Artificial Sequence
  Synthetic oligonucleotide
gttacccaccgcgtgtaacacgttattacccttaca

SEQ ID NO: 159161 - DNA, 36 bp, Artificial Sequence
  Synthetic oligonucleotide
agcatcgcaaatcgtctttctcccggccttttacca

SEQ ID NO: 159162 - DNA, 36 bp, Artificial Sequence
  Synthetic oligonucleotide
gtccagtcccagtccgatcaccgacttcgcctccca

SEQ ID NO: 159163 - DNA, 36 bp, Artificial Sequence
  Synthetic oligonucleotide
gtgactcagccgaccctccccgcgccatcttgagca

SEQ ID NO: 159164 - DNA, 37 bp, Artificial Sequence
  Synthetic oligonucleotide
gacacgagtcagtacaccagccgtcccttctttagca

SEQ ID NO: 159165 - DNA, 35 bp, Artificial Sequence
  Synthetic oligonucleotide
gaagcgcataaggcccccttccctttctgctatca

SEQ ID NO: 159166 - DNA, 35 bp, Artificial Sequence
  Synthetic oligonucleotide
gtacgtggccgccgcgggtccgtgctcctacctca

SEQ ID NO: 159167 - DNA, 35 bp, Artificial Sequence
  Synthetic oligonucleotide
tgagtgccgataagatattgccctgttcaccctca

SEQ ID NO: 159168 - DNA, 36 bp, Artificial Sequence
  Synthetic oligonucleotide
tccggggggtggaacagggggtagaaaatagcgtca

SEQ ID NO: 159169 - DNA, 35 bp, Artificial Sequence
  Synthetic oligonucleotide
atcaacgccctgccccatcacgtttgcctaggtca

SEQ ID NO: 159170 - DNA, 37 bp, Artificial Sequence
  Synthetic oligonucleotide
tcttaggtgagggggagggagagaagggactagcaga

SEQ ID NO: 159171 - DNA, 36 bp, Artificial Sequence
  Synthetic oligonucleotide
agggaggggggacacggaaaagtggcaggaatcaga

SEQ ID NO: 159172 - DNA, 36 bp, Artificial Sequence
  Synthetic oligonucleotide
atgaggggtaggaggggggatcgcggtaaggtacga

SEQ ID NO: 159173 - DNA, 35 bp, Artificial Sequence
  Synthetic oligonucleotide
gccaccacccgcttaccactacctcgtactcagga

SEQ ID NO: 159174 - DNA, 37 bp, Artificial Sequence
  Synthetic oligonucleotide
taagggtggggcgtggggaatacgggtggaagtagga

SEQ ID NO: 159175 - DNA, 36 bp, Artificial Sequence
  Synthetic oligonucleotide
atgctccccccgtgtcgttccacccacttgcgcgga

SEQ ID NO: 159176 - DNA, 37 bp, Artificial Sequence
  Synthetic oligonucleotide
aatggaagagagagagtgaacacgcggagagagggga

SEQ ID NO: 159177 - DNA, 37 bp, Artificial Sequence
  Synthetic oligonucleotide
gagcactccgcctatttttcgttacttcctgattgga

SEQ ID NO: 159178 - DNA, 37 bp, Artificial Sequence
  Synthetic oligonucleotide
gtatccctccgacgctgctgcttgcctctcccttgga

SEQ ID NO: 159179 - DNA, 38 bp, Artificial Sequence
  Synthetic oligonucleotide
tgcccagaacagggggggaggcgggggttaacgggtga

SEQ ID NO: 159180 - DNA, 38 bp, Artificial Sequence
  Synthetic oligonucleotide
ttgatccgcccctatgcccataccccacactcgggtga

SEQ ID NO: 159181 - DNA, 38 bp, Artificial Sequence
  Synthetic oligonucleotide
taggtccgcccgacacccttagccgccattctcgttga

SEQ ID NO: 159182 - DNA, 35 bp, Artificial Sequence
  Synthetic oligonucleotide
tacctccagcttgcctgaactgccacctggaccta

SEQ ID NO: 159183 - DNA, 36 bp, Artificial Sequence
  Synthetic oligonucleotide
tagggagccactacacgtttatgccctcctgccgta

SEQ ID NO: 159184 - DNA, 36 bp, Artificial Sequence
  Synthetic oligonucleotide
gtgatgcggaagagaagtcgaaatggggggcaggta

SEQ ID NO: 159185 - DNA, 35 bp, Artificial Sequence
  Synthetic oligonucleotide
acacatagcccgctgcctccattcgcgatttggta

SEQ ID NO: 159186 - DNA, 36 bp, Artificial Sequence
  Synthetic oligonucleotide
agttgggtgggatgggtcagggcaatctatacctta

SEQ ID NO: 159187 - DNA, 35 bp, Artificial Sequence
  Synthetic oligonucleotide
gccgtgactgggtcggaggggggtcggggagttta

SEQ ID NO: 159188 - DNA, 35 bp, Artificial Sequence
  Synthetic oligonucleotide
gccctgatccagccttgatccctttcccccgttta

SEQ ID NO: 159189 - DNA, 35 bp, Artificial Sequence
  Synthetic oligonucleotide
tccttctcgctcccctatctggccctggttcaaac

SEQ ID NO: 159190 - DNA, 35 bp, Artificial Sequence
  Synthetic oligonucleotide
tctcggacaccatcgagcacccctccctctaccac

SEQ ID NO: 159191 - DNA, 35 bp, Artificial Sequence
  Synthetic oligonucleotide
gtaacagcgcgcaacggtcgaccccgctttaccac

SEQ ID NO: 159192 - DNA, 35 bp, Artificial Sequence
  Synthetic oligonucleotide
acctttccgccccgctgtccgtcacaggtagccac

SEQ ID NO: 159193 - DNA, 35 bp, Artificial Sequence
  Synthetic oligonucleotide
tatcggccgactctgacctgttcttcctgtctacc

SEQ ID NO: 159194 - DNA, 35 bp, Artificial Sequence
  Synthetic oligonucleotide
atgtcgacgttcatcctggcatccccctctttacc

SEQ ID NO: 159195 - DNA, 35 bp, Artificial Sequence
  Synthetic oligonucleotide
agtgtaccgcacaccagccgcctcccgccaatgcc

SEQ ID NO: 159196 - DNA, 35 bp, Artificial Sequence
  Synthetic oligonucleotide
tgcaatgcgaacacctgcgtcccctggaacaatcc

SEQ ID NO: 159197 - DNA, 35 bp, Artificial Sequence
  Synthetic oligonucleotide
tacgttccgaggaccatcagtgcccttccacctcc

SEQ ID NO: 159198 - DNA, 35 bp, Artificial Sequence
  Synthetic oligonucleotide
atagtccgggcctcactccttatgtggtaccttcc

SEQ ID NO: 159199 - DNA, 35 bp, Artificial Sequence
  Synthetic oligonucleotide
atccgcgtcgattcccccactcgctgccagcccgc

SEQ ID NO: 159200 - DNA, 35 bp, Artificial Sequence
  Synthetic oligonucleotide
gaccgacactctcccaatgccattatcaccctcgc

SEQ ID NO: 159201 - DNA, 35 bp, Artificial Sequence
  Synthetic oligonucleotide
acccagcacccgtggccgactaactgtgctgtatc

SEQ ID NO: 159202 - DNA, 35 bp, Artificial Sequence
  Synthetic oligonucleotide
gatgcccaccgggtgacttcgttcttccctttatc

SEQ ID NO: 159203 - DNA, 35 bp, Artificial Sequence
  Synthetic oligonucleotide
tagcctgacgacatttcactatctcgtgcccactc

SEQ ID NO: 159204 - DNA, 35 bp, Artificial Sequence
  Synthetic oligonucleotide
gcttcgcctctggttatcgttattcgcctttcttc

SEQ ID NO: 159205 - DNA, 35 bp, Artificial Sequence
  Synthetic oligonucleotide
tcgagtgcccgccgagtaatcctctcacccgtttc

SEQ ID NO: 159206 - DNA, 35 bp, Artificial Sequence
  Synthetic oligonucleotide
tcactcgaacgatcatagtacatcccctccgcgag

SEQ ID NO: 159207 - DNA, 35 bp, Artificial Sequence
  Synthetic oligonucleotide
acccagcccatattagctccactgcgagccccctg

SEQ ID NO: 159208 - DNA, 35 bp, Artificial Sequence
  Synthetic oligonucleotide
tagctgcgcttcatgtctctcttcctgcgcctctg

SEQ ID NO: 159209 - DNA, 35 bp, Artificial Sequence
  Synthetic oligonucleotide
gcctcgcgcctctactggtcctctcacgcccggtg

SEQ ID NO: 159210 - DNA, 34 bp, Artificial Sequence
  Synthetic oligonucleotide
gaaccccgtgccattgttctgcctgttccgcttg

SEQ ID NO: 159211 - DNA, 35 bp, Artificial Sequence
  Synthetic oligonucleotide
gcaacctccgggtgccgtgccatttgcccttccat

SEQ ID NO: 159212 - DNA, 35 bp, Artificial Sequence
  Synthetic oligonucleotide
gaacccgcccaaatgtctacggactcttccgctct

SEQ ID NO: 159213 - DNA, 35 bp, Artificial Sequence
  Synthetic oligonucleotide
acattcgggcccttgttaacatgatcacaccttct

SEQ ID NO: 159214 - DNA, 35 bp, Artificial Sequence
  Synthetic oligonucleotide
tgaagcatcgtatgtttttcccacctcgctcctgt

SEQ ID NO: 159215 - DNA, 35 bp, Artificial Sequence
  Synthetic oligonucleotide
gctccggcccatacctgtacgctgctccactactt

SEQ ID NO: 159216 - DNA, 35 bp, Artificial Sequence
  Synthetic oligonucleotide
tcaggtcactaccgacgcctcccttctacagagtt

SEQ ID NO: 159217 - DNA, 35 bp, Artificial Sequence
  Synthetic oligonucleotide
accatgggcgcctcgatctacactacccgtccgtt

SEQ ID NO: 159218 - DNA, 35 bp, Artificial Sequence
  Synthetic oligonucleotide
gtcgaccctctcctttgttttctacccaccgggtt

SEQ ID NO: 159219 - DNA, 35 bp, Artificial Sequence
  Synthetic oligonucleotide
gacatagtcgtcgacctccgctgtcctcgtgcttt

SEQ ID NO: 159220 - DNA, 35 bp, Artificial Sequence
  Synthetic oligonucleotide
tcgcaccatgtgcaaacatcttcactccgccgttt

SEQ ID NO: 159221 - DNA, 35 bp, Artificial Sequence
  Synthetic oligonucleotide
aatggggggtgccagggaggtcgagtagagggcaa

SEQ ID NO: 159222 - DNA, 36 bp, Artificial Sequence
  Synthetic oligonucleotide
atcgcaccctcgacctatctgttttctggttttgaa

SEQ ID NO: 159223 - DNA, 36 bp, Artificial Sequence
  Synthetic oligonucleotide
tccggggcgggagggagtggccgggctcgtgaaaca

SEQ ID NO: 159224 - DNA, 36 bp, Artificial Sequence
  Synthetic oligonucleotide
attgccagctttgaagctcttgttgtctcgccccca

SEQ ID NO: 159225 - DNA, 35 bp, Artificial Sequence
  Synthetic oligonucleotide
attggtccatgcttacctaagtcccgtgcctccca

SEQ ID NO: 159226 - DNA, 36 bp, Artificial Sequence
  Synthetic oligonucleotide
accccacgcatgatgaccccacccgatactaagcca

SEQ ID NO: 159227 - DNA, 36 bp, Artificial Sequence
  Synthetic oligonucleotide
tccgtaccccgcctttgcattccagagataacgcca

SEQ ID NO: 159228 - DNA, 35 bp, Artificial Sequence
  Synthetic oligonucleotide
tctcactccgacccctcctgtgatcactctaatca

SEQ ID NO: 159229 - DNA, 36 bp, Artificial Sequence
  Synthetic oligonucleotide
acctgacctcctcctgtcttagacacgtgttgatca

SEQ ID NO: 159230 - DNA, 35 bp, Artificial Sequence
  Synthetic oligonucleotide
gcgaagcgccccctcgaagagtccctctcctctca

SEQ ID NO: 159231 - DNA, 36 bp, Artificial Sequence
  Synthetic oligonucleotide
gacatcgcggtctcctgtagctgcgcccacccttca

SEQ ID NO: 159232 - DNA, 35 bp, Artificial Sequence
  Synthetic oligonucleotide
atgggcggtcacattctcctacgcggcacccttca

SEQ ID NO: 159233 - DNA, 36 bp, Artificial Sequence
  Synthetic oligonucleotide
acaaagcctccccctaggtacaacgctccatgttca

SEQ ID NO: 159234 - DNA, 36 bp, Artificial Sequence
  Synthetic oligonucleotide
tggaatgaacgtcggggcacgggggggacgggtaga

SEQ ID NO: 159235 - DNA, 37 bp, Artificial Sequence
  Synthetic oligonucleotide
tggttgctccttcatgcgccctgttcccgccccacga

SEQ ID NO: 159236 - DNA, 36 bp, Artificial Sequence
  Synthetic oligonucleotide
gcgccgacccacgcatctgaaatattacgccctcga

SEQ ID NO: 159237 - DNA, 37 bp, Artificial Sequence
  Synthetic oligonucleotide
gtgacgggacgaagaaaaatgggcgggagggtttcga

SEQ ID NO: 159238 - DNA, 37 bp, Artificial Sequence
  Synthetic oligonucleotide
gagagcagtagggtggagcggggacggtgagggagga

SEQ ID NO: 159239 - DNA, 37 bp, Artificial Sequence
  Synthetic oligonucleotide
tacgcgggcaggaactatgggaagggtgggatacgga

SEQ ID NO: 159240 - DNA, 37 bp, Artificial Sequence
  Synthetic oligonucleotide
gtgagctaatacaacggagggggggacggggtacgga

SEQ ID NO: 159241 - DNA, 37 bp, Artificial Sequence
  Synthetic oligonucleotide
gttgctgcgagaggaaatactggagggtagggaggga

SEQ ID NO: 159242 - DNA, 37 bp, Artificial Sequence
  Synthetic oligonucleotide
gacctctgctacccctgctttactgccaccactggga

SEQ ID NO: 159243 - DNA, 37 bp, Artificial Sequence
  Synthetic oligonucleotide
gtcacccgccgctccatactgcctgccgtccttggga

SEQ ID NO: 159244 - DNA, 36 bp, Artificial Sequence
  Synthetic oligonucleotide
acatcgccccccatttggcattttgtagtctttgga

SEQ ID NO: 159245 - DNA, 36 bp, Artificial Sequence
  Synthetic oligonucleotide
acgtatggggaacgggggggcaagggctggaaatga

SEQ ID NO: 159246 - DNA, 37 bp, Artificial Sequence
  Synthetic oligonucleotide
gacaccctgattttgcacccctcgcgtcccttcatga

SEQ ID NO: 159247 - DNA, 38 bp, Artificial Sequence
  Synthetic oligonucleotide
gacgcagggaacgggcgggggtttggatagatggatga

SEQ ID NO: 159248 - DNA, 37 bp, Artificial Sequence
  Synthetic oligonucleotide
gcccactgggtactgatccctttcgccctgcctatga

SEQ ID NO: 159249 - DNA, 38 bp, Artificial Sequence
  Synthetic oligonucleotide
gagagtagggcaaggggacgtgacacgggtgggactga

SEQ ID NO: 159250 - DNA, 38 bp, Artificial Sequence
  Synthetic oligonucleotide
aactgcctcattctgtcgcgtcacgttctccttgctga

SEQ ID NO: 159251 - DNA, 37 bp, Artificial Sequence
  Synthetic oligonucleotide
tcgatgagaaaggggggccaaggggaagaacgagtga

SEQ ID NO: 159252 - DNA, 38 bp, Artificial Sequence
  Synthetic oligonucleotide
gggcaaccggagggaggggagaaggggcgaaggcgtga

SEQ ID NO: 159253 - DNA, 38 bp, Artificial Sequence
  Synthetic oligonucleotide
ggggatcgaaaaatggggtccattggtgggaggggtga

SEQ ID NO: 159254 - DNA, 37 bp, Artificial Sequence
  Synthetic oligonucleotide
ttgcccgtgttccctgtccagctcgccttcaccttga

SEQ ID NO: 159255 - DNA, 38 bp, Artificial Sequence
  Synthetic oligonucleotide
atcaagcccgcgcactcttccgcccaccagatccttga

SEQ ID NO: 159256 - DNA, 35 bp, Artificial Sequence
  Synthetic oligonucleotide
gacccacctctccggatactcacatcatgcaccta

SEQ ID NO: 159257 - DNA, 36 bp, Artificial Sequence
  Synthetic oligonucleotide
actcgtagccctgttcctccctaaatcgcagcccta

SEQ ID NO: 159258 - DNA, 35 bp, Artificial Sequence
  Synthetic oligonucleotide
acactccactcacgtttgaatcgtctttagcccta

SEQ ID NO: 159259 - DNA, 36 bp, Artificial Sequence
  Synthetic oligonucleotide
tacctcctgcccctgctgcctttatcaaacgcccta

SEQ ID NO: 159260 - DNA, 36 bp, Artificial Sequence
  Synthetic oligonucleotide
tccttcaccgccattctcgttagctgggtcctccta

SEQ ID NO: 159261 - DNA, 36 bp, Artificial Sequence
  Synthetic oligonucleotide
gctgccacaccgtgacacccccctatcgtactcgta

SEQ ID NO: 159262 - DNA, 35 bp, Artificial Sequence
  Synthetic oligonucleotide
accgctcccgccccctctgtcatgtgaccttcgta

SEQ ID NO: 159263 - DNA, 36 bp, Artificial Sequence
  Synthetic oligonucleotide
ggtggaccctacaccgcacctgcctccgccctggta

SEQ ID NO: 159264 - DNA, 34 bp, Artificial Sequence
  Synthetic oligonucleotide
caccccgctccttgcttatttgtgctccctggta

SEQ ID NO: 159265 - DNA, 36 bp, Artificial Sequence
  Synthetic oligonucleotide
ttgaaccaacggagcgtactgccacccctctcgtta

SEQ ID NO: 159266 - DNA, 35 bp, Artificial Sequence
  Synthetic oligonucleotide
tcccgactcgcgccaaatctcctggaagcctgcac

SEQ ID NO: 159267 - DNA, 35 bp, Artificial Sequence
  Synthetic oligonucleotide
gtttgcttcccccccattcgtcacagggtacatac

SEQ ID NO: 159268 - DNA, 35 bp, Artificial Sequence
  Synthetic oligonucleotide
tcacatccctagacgttgaccctcgcttttgctac

SEQ ID NO: 159269 - DNA, 35 bp, Artificial Sequence
  Synthetic oligonucleotide
atgtcaccgtcgtcacttaacatccagcctcgtac

SEQ ID NO: 159270 - DNA, 34 bp, Artificial Sequence
  Synthetic oligonucleotide
tgatcctcctccgaattctttaggttgcctgtac

SEQ ID NO: 159271 - DNA, 35 bp, Artificial Sequence
  Synthetic oligonucleotide
tacgcgacacctgcaacccccctggctttaattac

SEQ ID NO: 159272 - DNA, 34 bp, Artificial Sequence
  Synthetic oligonucleotide
tcacacctattgtcgtctttgcgcgccacgcacc

SEQ ID NO: 159273 - DNA, 35 bp, Artificial Sequence
  Synthetic oligonucleotide
aacagtcctgcgcaagcctctgccacccattgacc

SEQ ID NO: 159274 - DNA, 35 bp, Artificial Sequence
  Synthetic oligonucleotide
tgacagagtccgccgctggcctccctatgcgcccc

SEQ ID NO: 159275 - DNA, 35 bp, Artificial Sequence
  Synthetic oligonucleotide
tacagggcctgctagctcctacgttcccactgccc

SEQ ID NO: 159276 - DNA, 35 bp, Artificial Sequence
  Synthetic oligonucleotide
acgtacgtcactggcgtcagaccctcgcgcgctcc

SEQ ID NO: 159277 - DNA, 35 bp, Artificial Sequence
  Synthetic oligonucleotide
tccccacgcagaattagctctatcgtttggcttcc

SEQ ID NO: 159278 - DNA, 34 bp, Artificial Sequence
  Synthetic oligonucleotide
gctgccgcaaacacctacctctgccccattacgc

SEQ ID NO: 159279 - DNA, 35 bp, Artificial Sequence
  Synthetic oligonucleotide
tcccttgcctgctgtgccttccggacctacgccgc

SEQ ID NO: 159280 - DNA, 35 bp, Artificial Sequence
  Synthetic oligonucleotide
gactccgccgcattatctggttaccgtcgacctgc

SEQ ID NO: 159281 - DNA, 35 bp, Artificial Sequence
  Synthetic oligonucleotide
tcccgcccctctttctgcaacagctccctccttgc

SEQ ID NO: 159282 - DNA, 30 bp, Artificial Sequence
  Synthetic oligonucleotide
gagtccacccatccaggtcgtcctaccatc

SEQ ID NO: 159283 - DNA, 35 bp, Artificial Sequence
  Synthetic oligonucleotide
tctccccgttctgcccgtacgcttgactcattatc

SEQ ID NO: 159284 - DNA, 35 bp, Artificial Sequence
  Synthetic oligonucleotide
atcgccgaatccgcggcggtcgatcctccactctc

SEQ ID NO: 159285 - DNA, 35 bp, Artificial Sequence
  Synthetic oligonucleotide
gtctcagacacctgccgtttcccgccatctcggtc

SEQ ID NO: 159286 - DNA, 35 bp, Artificial Sequence
  Synthetic oligonucleotide
gcccagtccagaattccccgttatgttaccacttc

SEQ ID NO: 159287 - DNA, 35 bp, Artificial Sequence
  Synthetic oligonucleotide
atagcccgccatcgaactcctgtgacccgtgtttc

SEQ ID NO: 159288 - DNA, 35 bp, Artificial Sequence
  Synthetic oligonucleotide
tgcgcggagttctgacgggtgcgggggggatggag

SEQ ID NO: 159289 - DNA, 35 bp, Artificial Sequence
  Synthetic oligonucleotide
tcccaccgccccatctttgcatatgacctgccacg

SEQ ID NO: 159290 - DNA, 35 bp, Artificial Sequence
  Synthetic oligonucleotide
acccatctcatgtctttttcttcagggctttctcg

SEQ ID NO: 159291 - DNA, 35 bp, Artificial Sequence
  Synthetic oligonucleotide
accccactctcggagactatatttttctcacttcg

SEQ ID NO: 159292 - DNA, 35 bp, Artificial Sequence
  Synthetic oligonucleotide
gaagggggaatgtcaaagagggacgaagggcaggg

SEQ ID NO: 159293 - DNA, 35 bp, Artificial Sequence
  Synthetic oligonucleotide
agaccaacagcacgaatccgcacaccaccccactg

SEQ ID NO: 159294 - DNA, 35 bp, Artificial Sequence
  Synthetic oligonucleotide
aaagcacggagggcggcgatgctggggggggagtg

SEQ ID NO: 159295 - DNA, 36 bp, Artificial Sequence
  Synthetic oligonucleotide
ggaggaggatcggagattatggtaggaggaagaaat

SEQ ID NO: 159296 - DNA, 35 bp, Artificial Sequence
  Synthetic oligonucleotide
gcactatccgccgtccatgatcccttatccttgat

SEQ ID NO: 159297 - DNA, 35 bp, Artificial Sequence
  Synthetic oligonucleotide
tgcgcaatcccaagccacttctccatcgccgcact

SEQ ID NO: 159298 - DNA, 35 bp, Artificial Sequence
  Synthetic oligonucleotide
tcgatgtcccccgtagttcaatgacccggttacct

SEQ ID NO: 159299 - DNA, 35 bp, Artificial Sequence
  Synthetic oligonucleotide
tgtccccgcttacttctgttcgaccaactgtgcct

SEQ ID NO: 159300 - DNA, 35 bp, Artificial Sequence
  Synthetic oligonucleotide
gtgaccgaggcctcttcttgtgacatcgccctcct

SEQ ID NO: 159301 - DNA, 35 bp, Artificial Sequence
  Synthetic oligonucleotide
accgatacctccgatcgtccttacgcacaattcct

SEQ ID NO: 159302 - DNA, 35 bp, Artificial Sequence
  Synthetic oligonucleotide
gccaccctcccgttgtatatccatctttgccatgt

SEQ ID NO: 159303 - DNA, 35 bp, Artificial Sequence
  Synthetic oligonucleotide
acgggacggaggggcggcggggtatgggatgttgt

SEQ ID NO: 159304 - DNA, 35 bp, Artificial Sequence
  Synthetic oligonucleotide
tcctgtccgtgcggtgttctctcatgccaccactt

SEQ ID NO: 159305 - DNA, 35 bp, Artificial Sequence
  Synthetic oligonucleotide
acgtcccgaccgacctcatcgtctagtgccccctt

SEQ ID NO: 159306 - DNA, 35 bp, Artificial Sequence
  Synthetic oligonucleotide
gtgccctcctatcccttgacgctggtagtgccctt

SEQ ID NO: 159307 - DNA, 35 bp, Artificial Sequence
  Synthetic oligonucleotide
tccagaccactattgccatacgaatcaacctcgtt

SEQ ID NO: 159308 - DNA, 35 bp, Artificial Sequence
  Synthetic oligonucleotide
gtgccccctctcccaatctgtgttcgtttcgcttt

SEQ ID NO: 159309 - DNA, 36 bp, Artificial Sequence
  Synthetic oligonucleotide
aacacctccgagctgcacggctcttacccacccgaa

SEQ ID NO: 159310 - DNA, 36 bp, Artificial Sequence
  Synthetic oligonucleotide
tacctgccgggggggggtaaaatgctggggatggaa

SEQ ID NO: 159311 - DNA, 36 bp, Artificial Sequence
  Synthetic oligonucleotide
acgccctgcctctcgaacgtgcgcacggtacctaca

SEQ ID NO: 159312 - DNA, 35 bp, Artificial Sequence
  Synthetic oligonucleotide
tgacactgttcccgaatcgtcgcctcgagccccca

SEQ ID NO: 159313 - DNA, 36 bp, Artificial Sequence
  Synthetic oligonucleotide
agcaacgccaagcctcgcgtctccccgaccattcca

SEQ ID NO: 159314 - DNA, 36 bp, Artificial Sequence
  Synthetic oligonucleotide
atctctacgccgtcacctgctccatatgcctgttca

SEQ ID NO: 159315 - DNA, 36 bp, Artificial Sequence
  Synthetic oligonucleotide
atgcgacacgcgcatgttacctatctaccgctttca

SEQ ID NO: 159316 - DNA, 37 bp, Artificial Sequence
  Synthetic oligonucleotide
gagaccacccacccgaagttacctcgtaccccgacga

SEQ ID NO: 159317 - DNA, 37 bp, Artificial Sequence
  Synthetic oligonucleotide
ggaaggaaggggaggaaaaacatcaggcacgggacga

SEQ ID NO: 159318 - DNA, 36 bp, Artificial Sequence
  Synthetic oligonucleotide
atgcacacaaccgcgccttccccgtacgatcctcga

SEQ ID NO: 159319 - DNA, 35 bp, Artificial Sequence
  Synthetic oligonucleotide
gtgcccgacctcagtaccccgagccacctctcgga

SEQ ID NO: 159320 - DNA, 37 bp, Artificial Sequence
  Synthetic oligonucleotide
gtgaaagagaggaggggaaggtaaacgccggagggga

SEQ ID NO: 159321 - DNA, 36 bp, Artificial Sequence
  Synthetic oligonucleotide
gcccccagcccccccccagcagtcatggcacgtgga

SEQ ID NO: 159322 - DNA, 38 bp, Artificial Sequence
  Synthetic oligonucleotide
acacctccgcccgatctcccagtacgtcacacgactga

SEQ ID NO: 159323 - DNA, 38 bp, Artificial Sequence
  Synthetic oligonucleotide
tagtgtgggaagggtgggacgacgacacgggagcctga

SEQ ID NO: 159324 - DNA, 38 bp, Artificial Sequence
  Synthetic oligonucleotide
acgacacccccctgtcctatctaatgtgcccgtcctga

SEQ ID NO: 159325 - DNA, 38 bp, Artificial Sequence
  Synthetic oligonucleotide
gaacccctcgaccctgctgtctccacctgtcatgctga

SEQ ID NO: 159326 - DNA, 36 bp, Artificial Sequence
  Synthetic oligonucleotide
gatgggagagcgtaagggggggaggttaggaattga

SEQ ID NO: 159327 - DNA, 38 bp, Artificial Sequence
  Synthetic oligonucleotide
gcccacctgcgcctagctagcctttgcctccctcttga

SEQ ID NO: 159328 - DNA, 35 bp, Artificial Sequence
  Synthetic oligonucleotide
acacccgcccggaccttctctgtttatttcacaac

SEQ ID NO: 159329 - DNA, 35 bp, Artificial Sequence
  Synthetic oligonucleotide
agccccacgcgtgcctacggtacctcctttttcac

SEQ ID NO: 159330 - DNA, 35 bp, Artificial Sequence
  Synthetic oligonucleotide
gagagtgtgggagggtactcattgctccgggggac

SEQ ID NO: 159331 - DNA, 35 bp, Artificial Sequence
  Synthetic oligonucleotide
taacacccaacatctttatgtgagtcgcccccccc

SEQ ID NO: 159332 - DNA, 35 bp, Artificial Sequence
  Synthetic oligonucleotide
ttcgctcccccacccgtcgtatctgccgagccccc

SEQ ID NO: 159333 - DNA, 35 bp, Artificial Sequence
  Synthetic oligonucleotide
atgtccacacacgccgttggctgctatctcgcccc

SEQ ID NO: 159334 - DNA, 33 bp, Artificial Sequence
  Synthetic oligonucleotide
tcacatactccatcctgtgtgcttctatgcccc

SEQ ID NO: 159335 - DNA, 35 bp, Artificial Sequence
  Synthetic oligonucleotide
gtgtggagccacaccgcccttctacatctacttcc

SEQ ID NO: 159336 - DNA, 35 bp, Artificial Sequence
  Synthetic oligonucleotide
atgcgcccgctcgccatcgaatcgctccctgttcc

SEQ ID NO: 159337 - DNA, 35 bp, Artificial Sequence
  Synthetic oligonucleotide
tgtggacgcgccccccttatgctgattttactggc

SEQ ID NO: 159338 - DNA, 35 bp, Artificial Sequence
  Synthetic oligonucleotide
tgcacatccaccgatctccacttgaatggtttctc

SEQ ID NO: 159339 - DNA, 35 bp, Artificial Sequence
  Synthetic oligonucleotide
atgcccgtttgctctcccgttgttccgttgcagtc

SEQ ID NO: 159340 - DNA, 35 bp, Artificial Sequence
  Synthetic oligonucleotide
gccatgccgtgcctcctttgttttgacgattagtc

SEQ ID NO: 159341 - DNA, 35 bp, Artificial Sequence
  Synthetic oligonucleotide
ttgggagctctgctatcccccgtcgcccacccaag

SEQ ID NO: 159342 - DNA, 35 bp, Artificial Sequence
  Synthetic oligonucleotide
gttaccccgttcaaccttcccgcatcatagcagag

SEQ ID NO: 159343 - DNA, 35 bp, Artificial Sequence
  Synthetic oligonucleotide
gcaatagacagggggatgtgggaggggtggttgag

SEQ ID NO: 159344 - DNA, 35 bp, Artificial Sequence
  Synthetic oligonucleotide
tgccctcctcgtcccccccgcccaccgttacaacg

SEQ ID NO: 159345 - DNA, 35 bp, Artificial Sequence
  Synthetic oligonucleotide
gaagcccctcatttctgtcctgcccgccctgtacg

SEQ ID NO: 159346 - DNA, 35 bp, Artificial Sequence
  Synthetic oligonucleotide
gtgcccgcgtcatgttcgccattcgcccccttacg

SEQ ID NO: 159347 - DNA, 35 bp, Artificial Sequence
  Synthetic oligonucleotide
tgtgccctttcacctccgccggtttgtatccccgg

SEQ ID NO: 159348 - DNA, 35 bp, Artificial Sequence
  Synthetic oligonucleotide
gctgacgggacgactttgggtcgagtaagggcggg

SEQ ID NO: 159349 - DNA, 35 bp, Artificial Sequence
  Synthetic oligonucleotide
gagagaaggtggagtgcgggcagactaggtgcggg

SEQ ID NO: 159350 - DNA, 35 bp, Artificial Sequence
  Synthetic oligonucleotide
acatgcgcctagtccaaccaccccccgtatggatg

SEQ ID NO: 159351 - DNA, 35 bp, Artificial Sequence
  Synthetic oligonucleotide
tcatcacctggttctatactcgcaccgctccactg

SEQ ID NO: 159352 - DNA, 34 bp, Artificial Sequence
  Synthetic oligonucleotide
tcgcacatccgcccgctccacacttcgcgagttg

SEQ ID NO: 159353 - DNA, 35 bp, Artificial Sequence
  Synthetic oligonucleotide
tcctacttcatatgcctccgccgagtctgctccat

SEQ ID NO: 159354 - DNA, 35 bp, Artificial Sequence
  Synthetic oligonucleotide
acaccactcccccagggctatgggccttgttccct

SEQ ID NO: 159355 - DNA, 35 bp, Artificial Sequence
  Synthetic oligonucleotide
gttcacaccctcttggtatcccacgacctattgct

SEQ ID NO: 159356 - DNA, 35 bp, Artificial Sequence
  Synthetic oligonucleotide
aactacctcagtgtggactctgctcccgcgcctct

SEQ ID NO: 159357 - DNA, 35 bp, Artificial Sequence
  Synthetic oligonucleotide
tgtttcccacctctgccaaccatgtgctcactggt

SEQ ID NO: 159358 - DNA, 36 bp, Artificial Sequence
  Synthetic oligonucleotide
acctgactcgcctgtcccattccccaccccgttggt

SEQ ID NO: 159359 - DNA, 35 bp, Artificial Sequence
  Synthetic oligonucleotide
gaaccgcctcgagtcttccctcctacccgttatgt

SEQ ID NO: 159360 - DNA, 35 bp, Artificial Sequence
  Synthetic oligonucleotide
gcacacgtaatgtcggacccgcccccttgaacctt

SEQ ID NO: 159361 - DNA, 36 bp, Artificial Sequence
  Synthetic oligonucleotide
gaccgggttgggtaggggggaaagacggttcgacaa

SEQ ID NO: 159362 - DNA, 36 bp, Artificial Sequence
  Synthetic oligonucleotide
gtagagtgaagtggagggtgcggggggtcggtcgaa

SEQ ID NO: 159363 - DNA, 36 bp, Artificial Sequence
  Synthetic oligonucleotide
tgcgagaggtctccccatgtgatcgccccaccaaca

SEQ ID NO: 159364 - DNA, 36 bp, Artificial Sequence
  Synthetic oligonucleotide
ggtcaccactgcttctactctcccgcgggttctaca

SEQ ID NO: 159365 - DNA, 36 bp, Artificial Sequence
  Synthetic oligonucleotide
aatcactccgccggggccttacagtacaacgttaca

SEQ ID NO: 159366 - DNA, 37 bp, Artificial Sequence
  Synthetic oligonucleotide
gaccctccctgtacacacgattcagccccgcggacca

SEQ ID NO: 159367 - DNA, 36 bp, Artificial Sequence
  Synthetic oligonucleotide
accgcgctcctccgcataacaccacgtgcgcgccca

SEQ ID NO: 159368 - DNA, 35 bp, Artificial Sequence
  Synthetic oligonucleotide
gttgctcagcctgccgcctcgttacacccactcca

SEQ ID NO: 159369 - DNA, 35 bp, Artificial Sequence
  Synthetic oligonucleotide
ttgcccccaccctctgtgtcctcctcgtttgtcca

SEQ ID NO: 159370 - DNA, 36 bp, Artificial Sequence
  Synthetic oligonucleotide
tgtgatgtgtgggctgagatttcgggggggtgggca

SEQ ID NO: 159371 - DNA, 36 bp, Artificial Sequence
  Synthetic oligonucleotide
aacctcatccgcgcatagcccccgcactgctttgca

SEQ ID NO: 159372 - DNA, 35 bp, Artificial Sequence
  Synthetic oligonucleotide
gcaagggcctccttggtagtatcacactccattca

SEQ ID NO: 159373 - DNA, 36 bp, Artificial Sequence
  Synthetic oligonucleotide
tgtccgcatccctttcagttctgcctaccactttca

SEQ ID NO: 159374 - DNA, 36 bp, Artificial Sequence
  Synthetic oligonucleotide
gtgtcgctcacgacccttttaccgcctcatctttca

SEQ ID NO: 159375 - DNA, 37 bp, Artificial Sequence
  Synthetic oligonucleotide
agacggagcggggcgacgggatgggtggggggcaaga

SEQ ID NO: 159376 - DNA, 36 bp, Artificial Sequence
  Synthetic oligonucleotide
gtcgacttcacatcgcgctctgttccatccttgaga

SEQ ID NO: 159377 - DNA, 34 bp, Artificial Sequence
  Synthetic oligonucleotide
actcaaatccgccccgttccaggccattgcccga

SEQ ID NO: 159378 - DNA, 37 bp, Artificial Sequence
  Synthetic oligonucleotide
tgaaacgcccagtgtagccacttccgcctgatcccga

SEQ ID NO: 159379 - DNA, 37 bp, Artificial Sequence
  Synthetic oligonucleotide
acctcgccaacaccagcgtattagtgccccgctccga

SEQ ID NO: 159380 - DNA, 37 bp, Artificial Sequence
  Synthetic oligonucleotide
tccacgccgccgtttgcgctctgtcgactatcagcga

SEQ ID NO: 159381 - DNA, 37 bp, Artificial Sequence
  Synthetic oligonucleotide
tgtcgcccccactattctcgcctctctgcccgggcga

SEQ ID NO: 159382 - DNA, 37 bp, Artificial Sequence
  Synthetic oligonucleotide
actaagcgcaggcctactaacgtaccatcccactcga

SEQ ID NO: 159383 - DNA, 37 bp, Artificial Sequence
  Synthetic oligonucleotide
tcccactacaggccggccttcgcgtacccactctcga

SEQ ID NO: 159384 - DNA, 37 bp, Artificial Sequence
  Synthetic oligonucleotide
gcaagtgaggggggataagggtaaggtggggacagga

SEQ ID NO: 159385 - DNA, 37 bp, Artificial Sequence
  Synthetic oligonucleotide
gccgaaggggggtgggtagggctccgccacaatagga

SEQ ID NO: 159386 - DNA, 36 bp, Artificial Sequence
  Synthetic oligonucleotide
aagccaggggggtggggtcattaggagaggagcgga

SEQ ID NO: 159387 - DNA, 36 bp, Artificial Sequence
  Synthetic oligonucleotide
gatgagttggaggaaggtaggaagtggcggggcgga

SEQ ID NO: 159388 - DNA, 35 bp, Artificial Sequence
  Synthetic oligonucleotide
taggtgtggagtagaaagggttgagtgggaaggga

SEQ ID NO: 159389 - DNA, 37 bp, Artificial Sequence
  Synthetic oligonucleotide
acagagagaagggcttgtggagaggatagggagggga

SEQ ID NO: 159390 - DNA, 37 bp, Artificial Sequence
  Synthetic oligonucleotide
acgacaagggttgagggttgcgggtgagggcggggga

SEQ ID NO: 159391 - DNA, 37 bp, Artificial Sequence
  Synthetic oligonucleotide
ttggatagtagatgagggtagggtgcgggagggtgga

SEQ ID NO: 159392 - DNA, 37 bp, Artificial Sequence
  Synthetic oligonucleotide
tgcgaaccatccgaccagtccgcccccaacctttgga

SEQ ID NO: 159393 - DNA, 36 bp, Artificial Sequence
  Synthetic oligonucleotide
gtcctcaccgcaccctcaaatttaccatggcaatga

SEQ ID NO: 159394 - DNA, 36 bp, Artificial Sequence
  Synthetic oligonucleotide
tgaatgtgggttgggagggaggggtcatcataatga

SEQ ID NO: 159395 - DNA, 38 bp, Artificial Sequence
  Synthetic oligonucleotide
gtgggaggggcggggggaccgggacctgttggtgatga

SEQ ID NO: 159396 - DNA, 37 bp, Artificial Sequence
  Synthetic oligonucleotide
gaccctgcctctcgaggaccattaccgacccttatga

SEQ ID NO: 159397 - DNA, 38 bp, Artificial Sequence
  Synthetic oligonucleotide
gcccctagcacgcacctgctcgccgttccttcccctga

SEQ ID NO: 159398 - DNA, 36 bp, Artificial Sequence
  Synthetic oligonucleotide
gtaccacgctccctgccaacaaccctacgttcctga

SEQ ID NO: 159399 - DNA, 38 bp, Artificial Sequence
  Synthetic oligonucleotide
gaagtggacacagggggagtagtaacgggggcgagtga

SEQ ID NO: 159400 - DNA, 38 bp, Artificial Sequence
  Synthetic oligonucleotide
ggggcgggaggcttaccgtgtaggcctggggttattga

SEQ ID NO: 159401 - DNA, 38 bp, Artificial Sequence
  Synthetic oligonucleotide
gtggtagggacaaaggggggaggatggctgagacttga

SEQ ID NO: 159402 - DNA, 37 bp, Artificial Sequence
  Synthetic oligonucleotide
tacggacctacgtcgtttccttggccccctcccttga

SEQ ID NO: 159403 - DNA, 38 bp, Artificial Sequence
  Synthetic oligonucleotide
gtatcccaccgccctccgcatccagttcgcttgcttga

SEQ ID NO: 159404 - DNA, 37 bp, Artificial Sequence
  Synthetic oligonucleotide
tcccgcaccactcgctatgtttgcccgtttttgttga

SEQ ID NO: 159405 - DNA, 35 bp, Artificial Sequence
  Synthetic oligonucleotide
ttttgcctgccccattgccccctgttcgttcacta

SEQ ID NO: 159406 - DNA, 36 bp, Artificial Sequence
  Synthetic oligonucleotide
tcgctcacccactcctttgtacttccgctcggacta

SEQ ID NO: 159407 - DNA, 36 bp, Artificial Sequence
  Synthetic oligonucleotide
ttgccctgccactccttgccgtaagctcccctcgta

SEQ ID NO: 159408 - DNA, 36 bp, Artificial Sequence
  Synthetic oligonucleotide
ggaacgatgtgtacttgcccgtccctgtccacctta

SEQ ID NO: 159409 - DNA, 35 bp, Artificial Sequence
  Synthetic oligonucleotide
tccccgagcgctctcatcgccccgccttggtgaac

SEQ ID NO: 159410 - DNA, 35 bp, Artificial Sequence
  Synthetic oligonucleotide
acctcgaagtcgcattcgcgtgaaccctagccccc

SEQ ID NO: 159411 - DNA, 35 bp, Artificial Sequence
  Synthetic oligonucleotide
gcacccatacgactcaagatatgtccgtccgcccc

SEQ ID NO: 159412 - DNA, 35 bp, Artificial Sequence
  Synthetic oligonucleotide
tctattcgcacgccggccctacggatcctgcctcc

SEQ ID NO: 159413 - DNA, 35 bp, Artificial Sequence
  Synthetic oligonucleotide
gtgagctcacaccactaggctccacctcgctttcc

SEQ ID NO: 159414 - DNA, 35 bp, Artificial Sequence
  Synthetic oligonucleotide
atacccccccctcgttgacagactgtagttgccgc

SEQ ID NO: 159415 - DNA, 35 bp, Artificial Sequence
  Synthetic oligonucleotide
tctcagtccctttcccagacgctctcccctgtcgc

SEQ ID NO: 159416 - DNA, 35 bp, Artificial Sequence
  Synthetic oligonucleotide
gccctagcctacgatcaatttccgccccatatggc

SEQ ID NO: 159417 - DNA, 35 bp, Artificial Sequence
  Synthetic oligonucleotide
tgtcctccaccgtatcctcctctgcttgtaacatc

SEQ ID NO: 159418 - DNA, 35 bp, Artificial Sequence
  Synthetic oligonucleotide
gtcgcgacttctccctggccctgttaatgtctatc

SEQ ID NO: 159419 - DNA, 35 bp, Artificial Sequence
  Synthetic oligonucleotide
ttgcccgccccgctccgtttgcttctgcctccctc

SEQ ID NO: 159420 - DNA, 35 bp, Artificial Sequence
  Synthetic oligonucleotide
agcttcaccctggtcgtctcagccacgtttgcctc

SEQ ID NO: 159421 - DNA, 35 bp, Artificial Sequence
  Synthetic oligonucleotide
gagtacaacccggcacctcgctgcccgacccgctc

SEQ ID NO: 159422 - DNA, 35 bp, Artificial Sequence
  Synthetic oligonucleotide
gaggtggtcgcatatcgtccttttgtctcttcgtc

SEQ ID NO: 159423 - DNA, 35 bp, Artificial Sequence
  Synthetic oligonucleotide
tccacgtcacccgttatgagtaccacaccaccttc

SEQ ID NO: 159424 - DNA, 35 bp, Artificial Sequence
  Synthetic oligonucleotide
ataggagagggacggtgaatcgggtacgagaggag

SEQ ID NO: 159425 - DNA, 35 bp, Artificial Sequence
  Synthetic oligonucleotide
gggggaggataatgggcgttcgaggcaggagggag

SEQ ID NO: 159426 - DNA, 34 bp, Artificial Sequence
  Synthetic oligonucleotide
ggttacatccccaatatgcattacgtggcccccg

SEQ ID NO: 159427 - DNA, 35 bp, Artificial Sequence
  Synthetic oligonucleotide
gaggggcgtatagtcaggaggggagtagtagggcg

SEQ ID NO: 159428 - DNA, 35 bp, Artificial Sequence
  Synthetic oligonucleotide
aatggtgtcagccggtggagggggggtcgtggagg

SEQ ID NO: 159429 - DNA, 35 bp, Artificial Sequence
  Synthetic oligonucleotide
taccacctctcacacccccgtcgactcgcccacgg

SEQ ID NO: 159430 - DNA, 35 bp, Artificial Sequence
  Synthetic oligonucleotide
gcacacaacgcgcgatgacatttactccctttcgg

SEQ ID NO: 159431 - DNA, 35 bp, Artificial Sequence
  Synthetic oligonucleotide
gggtgtagggggggaaagataacttaccgggaggg

SEQ ID NO: 159432 - DNA, 35 bp, Artificial Sequence
  Synthetic oligonucleotide
gtgggagcaggggagggatttgggtggcttggggg

SEQ ID NO: 159433 - DNA, 35 bp, Artificial Sequence
  Synthetic oligonucleotide
gccccaacacccccacattacgcgccagccttctg

SEQ ID NO: 159434 - DNA, 35 bp, Artificial Sequence
  Synthetic oligonucleotide
gccacatgtacaaaatgttccatccactttccttg

SEQ ID NO: 159435 - DNA, 35 bp, Artificial Sequence
  Synthetic oligonucleotide
tcccgttacgcctcgaatatacaccttcttaccat

SEQ ID NO: 159436 - DNA, 35 bp, Artificial Sequence
  Synthetic oligonucleotide
atccctggcccgtacgctctatccttgtccgctat

SEQ ID NO: 159437 - DNA, 35 bp, Artificial Sequence
  Synthetic oligonucleotide
gttgggcctcacgaatgtgatcgttactacttcct

SEQ ID NO: 159438 - DNA, 35 bp, Artificial Sequence
  Synthetic oligonucleotide
gactgttacagcccggcacactgaccctccctagt

SEQ ID NO: 159439 - DNA, 35 bp, Artificial Sequence
  Synthetic oligonucleotide
gggggtgggggccgatttgtgggtaggtaaagggt

SEQ ID NO: 159440 - DNA, 35 bp, Artificial Sequence
  Synthetic oligonucleotide
ttctgctcaacctgttagcctcccgttgtccactt

SEQ ID NO: 159441 - DNA, 35 bp, Artificial Sequence
  Synthetic oligonucleotide
actgcggtagtatcgccatgttaccatttgccctt

SEQ ID NO: 159442 - DNA, 35 bp, Artificial Sequence
  Synthetic oligonucleotide
tcgcacgtacacaatccttggtcaaacactgcctt

SEQ ID NO: 159443 - DNA, 35 bp, Artificial Sequence
  Synthetic oligonucleotide
tcgccccccgcctcatatctacacgggctcaattt

SEQ ID NO: 159444 - DNA, 35 bp, Artificial Sequence
  Synthetic oligonucleotide
acccccgccccgaggcttacattcccgagtccttt

SEQ ID NO: 159445 - DNA, 35 bp, Artificial Sequence
  Synthetic oligonucleotide
tgtaaccgccctacccctggccctctggtcgtttt

SEQ ID NO: 159446 - DNA, 34 bp, Artificial Sequence
  Synthetic oligonucleotide
gcatccctcgcgttaccgcactgagcccattttt

SEQ ID NO: 159447 - DNA, 35 bp, Artificial Sequence
  Synthetic oligonucleotide
tccgctccctcactcggtcgaaaactgtctccaaa

SEQ ID NO: 159448 - DNA, 36 bp, Artificial Sequence
  Synthetic oligonucleotide
ggacaggcccaatgacatcccgaccctccctgtaaa

SEQ ID NO: 159449 - DNA, 32 bp, Artificial Sequence
  Synthetic oligonucleotide
tgcccacccgcccctactccaatctgtgaaca

SEQ ID NO: 159450 - DNA, 35 bp, Artificial Sequence
  Synthetic oligonucleotide
ccctacgatccgctgccgttttccccgacttaaca

SEQ ID NO: 159451 - DNA, 35 bp, Artificial Sequence
  Synthetic oligonucleotide
gggtggggcgggcatggggggtaataattaagaca

SEQ ID NO: 159452 - DNA, 36 bp, Artificial Sequence
  Synthetic oligonucleotide
acccccccgcgaccactaagctacggaccccctaca

SEQ ID NO: 159453 - DNA, 35 bp, Artificial Sequence
  Synthetic oligonucleotide
gctcacctcctggccggacgccccctaggcaccca

SEQ ID NO: 159454 - DNA, 36 bp, Artificial Sequence
  Synthetic oligonucleotide
acgctcccgctgccttcgctcactctcgacatccca

SEQ ID NO: 159455 - DNA, 36 bp, Artificial Sequence
  Synthetic oligonucleotide
atcgacctccactctgcacttgccccttaaaaggca

SEQ ID NO: 159456 - DNA, 36 bp, Artificial Sequence
  Synthetic oligonucleotide
tttcatccgcgtagcagcccgcccccgatcacctca

SEQ ID NO: 159457 - DNA, 36 bp, Artificial Sequence
  Synthetic oligonucleotide
gaaacgcaccatgcatatgcgcccagcactacctca

SEQ ID NO: 159458 - DNA, 35 bp, Artificial Sequence
  Synthetic oligonucleotide
tgcccactccgcctctaacgaagaagtccttcaga

SEQ ID NO: 159459 - DNA, 36 bp, Artificial Sequence
  Synthetic oligonucleotide
tgcgaagagggatggggaggaatagtgagagagaga

SEQ ID NO: 159460 - DNA, 37 bp, Artificial Sequence
  Synthetic oligonucleotide
aaagacgagggaaggtagtaggtgggactaaggtaga

SEQ ID NO: 159461 - DNA, 37 bp, Artificial Sequence
  Synthetic oligonucleotide
tctagtgcctctgctgcccttctggtcttatctccga

SEQ ID NO: 159462 - DNA, 37 bp, Artificial Sequence
  Synthetic oligonucleotide
acactccgcaccaactcatgtactccatcttatgcga

SEQ ID NO: 159463 - DNA, 37 bp, Artificial Sequence
  Synthetic oligonucleotide
aaccatgacacaggtgagggggagggagggtttgcga

SEQ ID NO: 159464 - DNA, 37 bp, Artificial Sequence
  Synthetic oligonucleotide
tcggaagctcactttgtccctcgctgccctccttcga

SEQ ID NO: 159465 - DNA, 37 bp, Artificial Sequence
  Synthetic oligonucleotide
tcgcttccacattgggctacttcccgacttccttcga

SEQ ID NO: 159466 - DNA, 37 bp, Artificial Sequence
  Synthetic oligonucleotide
gcttgcactcctgctctctcctccacccgccgccgga

SEQ ID NO: 159467 - DNA, 36 bp, Artificial Sequence
  Synthetic oligonucleotide
agcgccccacgttccctatgttactcctccttcgga

SEQ ID NO: 159468 - DNA, 38 bp, Artificial Sequence
  Synthetic oligonucleotide
tccccggcccctgcgtcccactctcttgccaacagtga

SEQ ID NO: 159469 - DNA, 36 bp, Artificial Sequence
  Synthetic oligonucleotide
tcccgcccatccggtccagtacctctcttgcagtga

SEQ ID NO: 159470 - DNA, 38 bp, Artificial Sequence
  Synthetic oligonucleotide
gtgccatcccatccgccgcccagtcacatttctagtga

SEQ ID NO: 159471 - DNA, 35 bp, Artificial Sequence
  Synthetic oligonucleotide
gggtacggaggacgggcgggggtaaaaatgggtga

SEQ ID NO: 159472 - DNA, 38 bp, Artificial Sequence
  Synthetic oligonucleotide
gcgatgtcaaacgggggggggcggctagggcacgttga

SEQ ID NO: 159473 - DNA, 35 bp, Artificial Sequence
  Synthetic oligonucleotide
actgtcccgtgcctttgagcgccaccacccgccta

SEQ ID NO: 159474 - DNA, 36 bp, Artificial Sequence
  Synthetic oligonucleotide
gaacatcccgcccagcctcctaccgccatctggcta

SEQ ID NO: 159475 - DNA, 36 bp, Artificial Sequence
  Synthetic oligonucleotide
ttcgccaccgccctatgcccgcagcctcattatcta

SEQ ID NO: 159476 - DNA, 35 bp, Artificial Sequence
  Synthetic oligonucleotide
tcctcgcatccggagccttattattatcgcctcta

SEQ ID NO: 159477 - DNA, 35 bp, Artificial Sequence
  Synthetic oligonucleotide
tcactcgcgctcttctccgtttcaccgtgcattta

SEQ ID NO: 159478 - DNA, 35 bp, Artificial Sequence
  Synthetic oligonucleotide
gggagactcctcctgtgcttgctaccaaccttcac

SEQ ID NO: 159479 - DNA, 35 bp, Artificial Sequence
  Synthetic oligonucleotide
gcaagcccagttccatctagtcgagctcaaccacc

SEQ ID NO: 159480 - DNA, 35 bp, Artificial Sequence
  Synthetic oligonucleotide
gcgaaacacacgcggccttagttcctccgctgacc

SEQ ID NO: 159481 - DNA, 35 bp, Artificial Sequence
  Synthetic oligonucleotide
tgagtgccactcttatactcgctctacccgtgacc

SEQ ID NO: 159482 - DNA, 35 bp, Artificial Sequence
  Synthetic oligonucleotide
acgcggacggtcaaatggcctaactcacacccccc

SEQ ID NO: 159483 - DNA, 35 bp, Artificial Sequence
  Synthetic oligonucleotide
accacgatccacaactctcacaaaggcctcgcccc

SEQ ID NO: 159484 - DNA, 35 bp, Artificial Sequence
  Synthetic oligonucleotide
acaacccatctcggtgcgttccttggccgtatccc

SEQ ID NO: 159485 - DNA, 35 bp, Artificial Sequence
  Synthetic oligonucleotide
tgcctgccactctttgcgcaaattttactcgtgcc

SEQ ID NO: 159486 - DNA, 35 bp, Artificial Sequence
  Synthetic oligonucleotide
tgactaatcagcatctggcacgttcacgcccttcc

SEQ ID NO: 159487 - DNA, 35 bp, Artificial Sequence
  Synthetic oligonucleotide
ttcgcagtgattccgctcctgtccgctgcctttcc

SEQ ID NO: 159488 - DNA, 34 bp, Artificial Sequence
  Synthetic oligonucleotide
tttggctgctcataactccgctcacgcctaccgc

SEQ ID NO: 159489 - DNA, 35 bp, Artificial Sequence
  Synthetic oligonucleotide
tacaggacacctgtttcgaccctttttgcacatgc

SEQ ID NO: 159490 - DNA, 35 bp, Artificial Sequence
  Synthetic oligonucleotide
tgggggacggtccccagcgcattcgacacttcctc

SEQ ID NO: 159491 - DNA, 35 bp, Artificial Sequence
  Synthetic oligonucleotide
gtgaatccccgcgtgcaaccgcaagttctttcctc

SEQ ID NO: 159492 - DNA, 35 bp, Artificial Sequence
  Synthetic oligonucleotide
gcccatctgccattaacttaccgcaccgtctcttc

SEQ ID NO: 159493 - DNA, 35 bp, Artificial Sequence
  Synthetic oligonucleotide
tactttgccccctccaactgcctcagcgtgacacg

SEQ ID NO: 159494 - DNA, 35 bp, Artificial Sequence
  Synthetic oligonucleotide
accgcaatgtccgttgctcccttagttactatccg

SEQ ID NO: 159495 - DNA, 35 bp, Artificial Sequence
  Synthetic oligonucleotide
tgatcgtgcaccctgttctccagcatctcgctccg

SEQ ID NO: 159496 - DNA, 35 bp, Artificial Sequence
  Synthetic oligonucleotide
acttgcccacccccggttatcatcgacgcccctcg

SEQ ID NO: 159497 - DNA, 35 bp, Artificial Sequence
  Synthetic oligonucleotide
gtgggcggttgagggcaccgaggggaggagagagg

SEQ ID NO: 159498 - DNA, 35 bp, Artificial Sequence
  Synthetic oligonucleotide
acgtggggagacttgaagagggatgagggcgaggg

SEQ ID NO: 159499 - DNA, 35 bp, Artificial Sequence
  Synthetic oligonucleotide
ttgggtgagggggggcagggggtgtcaggctcggg

SEQ ID NO: 159500 - DNA, 35 bp, Artificial Sequence
  Synthetic oligonucleotide
aaggtagccggcgggtgagcggagggcgtgggggg

SEQ ID NO: 159501 - DNA, 35 bp, Artificial Sequence
  Synthetic oligonucleotide
tatacacgccgcatcgcttacctcggcctcccctg

SEQ ID NO: 159502 - DNA, 35 bp, Artificial Sequence
  Synthetic oligonucleotide
acctccgcggcgtactttcctgctaaaacgccctg

SEQ ID NO: 159503 - DNA, 35 bp, Artificial Sequence
  Synthetic oligonucleotide
accgcggtccgattatgctccacctctcccttctg

SEQ ID NO: 159504 - DNA, 35 bp, Artificial Sequence
  Synthetic oligonucleotide
gccgtatccgccgtatcccccattttccgctagtg

SEQ ID NO: 159505 - DNA, 35 bp, Artificial Sequence
  Synthetic oligonucleotide
tagacgggggtgggataaagggttgggtgtatact

SEQ ID NO: 159506 - DNA, 35 bp, Artificial Sequence
  Synthetic oligonucleotide
tcgccgtatggcaccaccacagtacatctccgcct

SEQ ID NO: 159507 - DNA, 35 bp, Artificial Sequence
  Synthetic oligonucleotide
tcccttcgtgggacgccccttccattctaatgcct

SEQ ID NO: 159508 - DNA, 35 bp, Artificial Sequence
  Synthetic oligonucleotide
gtcacactgctcctgtgtccctcacttccctttgt

SEQ ID NO: 159509 - DNA, 35 bp, Artificial Sequence
  Synthetic oligonucleotide
aaacaccgcactttgagaactccccgtcccgactt

SEQ ID NO: 159510 - DNA, 36 bp, Artificial Sequence
  Synthetic oligonucleotide
gaccccatcattgctgcccttgttccacgaccaaaa

SEQ ID NO: 159511 - DNA, 35 bp, Artificial Sequence
  Synthetic oligonucleotide
gcgccccccctctcacccgcctgtctcgagcccaa

SEQ ID NO: 159512 - DNA, 35 bp, Artificial Sequence
  Synthetic oligonucleotide
gtgtgcctccgccccctaatgtcgcgctacccgaa

SEQ ID NO: 159513 - DNA, 35 bp, Artificial Sequence
  Synthetic oligonucleotide
tgtccaccttagttcacaatgacccccctccggaa

SEQ ID NO: 159514 - DNA, 35 bp, Artificial Sequence
  Synthetic oligonucleotide
gacgggggaaggaaggagaggggaaggtggaggca

SEQ ID NO: 159515 - DNA, 36 bp, Artificial Sequence
  Synthetic oligonucleotide
tagttcgcattccctcgtctccctgcccgtgctgca

SEQ ID NO: 159516 - DNA, 36 bp, Artificial Sequence
  Synthetic oligonucleotide
gtcacgcgcattgccccatctgatacacgcggctca

SEQ ID NO: 159517 - DNA, 36 bp, Artificial Sequence
  Synthetic oligonucleotide
tagacatccacctgtacctccgcatacgctccttca

SEQ ID NO: 159518 - DNA, 36 bp, Artificial Sequence
  Synthetic oligonucleotide
tcagtctgggtgggggggcatggaccgggaggttca

SEQ ID NO: 159519 - DNA, 36 bp, Artificial Sequence
  Synthetic oligonucleotide
tgcacctcatgcaaccgtgcctcctccttggtttca

SEQ ID NO: 159520 - DNA, 35 bp, Artificial Sequence
  Synthetic oligonucleotide
gacttcatgggcgggggggatggtgggcatctaga

SEQ ID NO: 159521 - DNA, 37 bp, Artificial Sequence
  Synthetic oligonucleotide
gggtggaggggtggacggaggttagacaagaggacga

SEQ ID NO: 159522 - DNA, 37 bp, Artificial Sequence
  Synthetic oligonucleotide
agtagccgcctgcaccttcccgagttcacatcgccga

SEQ ID NO: 159523 - DNA, 37 bp, Artificial Sequence
  Synthetic oligonucleotide
atgtcgtccggtctattgcccctctctcgttattcga

SEQ ID NO: 159524 - DNA, 37 bp, Artificial Sequence
  Synthetic oligonucleotide
tcaaccgcatatctcaccgcccgcctcttcacacgga

SEQ ID NO: 159525 - DNA, 37 bp, Artificial Sequence
  Synthetic oligonucleotide
ggggcgggttttcattaggggtacagacccccgggga

SEQ ID NO: 159526 - DNA, 37 bp, Artificial Sequence
  Synthetic oligonucleotide
gcaaatgtcgtagaggggcaatgaggaggagggggga

SEQ ID NO: 159527 - DNA, 38 bp, Artificial Sequence
  Synthetic oligonucleotide
acacgggggagaaagaggaaggagcaaggtattaatga

SEQ ID NO: 159528 - DNA, 38 bp, Artificial Sequence
  Synthetic oligonucleotide
ttggcccacagtcccgtccgctctcactcccttgatga

SEQ ID NO: 159529 - DNA, 38 bp, Artificial Sequence
  Synthetic oligonucleotide
gaacggcacctgccgacccctgttccatcgctacctga

SEQ ID NO: 159530 - DNA, 38 bp, Artificial Sequence
  Synthetic oligonucleotide
tgttgcatcccacatactgcctcatgacctttgcctga

SEQ ID NO: 159531 - DNA, 37 bp, Artificial Sequence
  Synthetic oligonucleotide
tctcgccctctattgtaaccggtccttgcactcctga

SEQ ID NO: 159532 - DNA, 38 bp, Artificial Sequence
  Synthetic oligonucleotide
gggggacagtgcaagggggccaaggggggagcaggtga

SEQ ID NO: 159533 - DNA, 38 bp, Artificial Sequence
  Synthetic oligonucleotide
gtgccactgtctgtcgtcgttccctgctccctccttga

SEQ ID NO: 159534 - DNA, 38 bp, Artificial Sequence
  Synthetic oligonucleotide
actgcaccccaggggcaggagggggagggaaattttga

SEQ ID NO: 159535 - DNA, 36 bp, Artificial Sequence
  Synthetic oligonucleotide
atccggatcggtacccctgtcacttcctgctcccta

SEQ ID NO: 159536 - DNA, 28 bp, Artificial Sequence
  Synthetic oligonucleotide
ggaccactccattcctgcttatgatcta

SEQ ID NO: 159537 - DNA, 36 bp, Artificial Sequence
  Synthetic oligonucleotide
gctctcatccatgcccattgtcgactccccgttcta

SEQ ID NO: 159538 - DNA, 36 bp, Artificial Sequence
  Synthetic oligonucleotide
tcgttgccacggttttgcccatctagtcaccccgta

SEQ ID NO: 159539 - DNA, 36 bp, Artificial Sequence
  Synthetic oligonucleotide
gtttaaccccctcgcccccgcacctagtgcgccgta

SEQ ID NO: 159540 - DNA, 35 bp, Artificial Sequence
  Synthetic oligonucleotide
tagagcccacattggtccgccgtttctttctcgta

SEQ ID NO: 159541 - DNA, 35 bp, Artificial Sequence
  Synthetic oligonucleotide
tcagcaagcgcttccctgctgttcttcaaccatta

SEQ ID NO: 159542 - DNA, 35 bp, Artificial Sequence
  Synthetic oligonucleotide
atttcgccatctcatccgtgcttacgctttcacac

SEQ ID NO: 159543 - DNA, 35 bp, Artificial Sequence
  Synthetic oligonucleotide
gccccgagcctcctgctctttatcgtgccctctac

SEQ ID NO: 159544 - DNA, 35 bp, Artificial Sequence
  Synthetic oligonucleotide
gtctgtgcgcgttactcctattcgtttgctctacc

SEQ ID NO: 159545 - DNA, 35 bp, Artificial Sequence
  Synthetic oligonucleotide
gtgaatcgcatatggtcacgtcatcacctcgcccc

SEQ ID NO: 159546 - DNA, 35 bp, Artificial Sequence
  Synthetic oligonucleotide
gttgtcccccgtgctgatccgcacctcgcatggcc

SEQ ID NO: 159547 - DNA, 35 bp, Artificial Sequence
  Synthetic oligonucleotide
gttgtccccgctgttgcctcgctgtgcagcattcc

SEQ ID NO: 159548 - DNA, 35 bp, Artificial Sequence
  Synthetic oligonucleotide
gcgtgtctacggtcttcgttgtctcatattcttcc

SEQ ID NO: 159549 - DNA, 35 bp, Artificial Sequence
  Synthetic oligonucleotide
gaccacctcccttttgatacgtgcactgtccacgc

SEQ ID NO: 159550 - DNA, 35 bp, Artificial Sequence
  Synthetic oligonucleotide
gaccgtactacccgtcgctttatttcttatctcgc

SEQ ID NO: 159551 - DNA, 35 bp, Artificial Sequence
  Synthetic oligonucleotide
gcccaacgcctccacctttatacccatcatttcgc

SEQ ID NO: 159552 - DNA, 35 bp, Artificial Sequence
  Synthetic oligonucleotide
atccccatctggctcctgggtccacctttaccatc

SEQ ID NO: 159553 - DNA, 35 bp, Artificial Sequence
  Synthetic oligonucleotide
tcgaccctgactgctctcataggccttgacttatc

SEQ ID NO: 159554 - DNA, 35 bp, Artificial Sequence
  Synthetic oligonucleotide
atacgcagtaccggccacgccctcgcccaccgctc

SEQ ID NO: 159555 - DNA, 35 bp, Artificial Sequence
  Synthetic oligonucleotide
tccgaccatccctctgtcccttttgctactatgtc

SEQ ID NO: 159556 - DNA, 35 bp, Artificial Sequence
  Synthetic oligonucleotide
gcagattgtctgccccccccaagtcgctgccattc

SEQ ID NO: 159557 - DNA, 35 bp, Artificial Sequence
  Synthetic oligonucleotide
gcttaagcgcgagcgccctcccctgcctgatcttc

SEQ ID NO: 159558 - DNA, 35 bp, Artificial Sequence
  Synthetic oligonucleotide
gagcggtctctgctctccccgtattaccttttccg

SEQ ID NO: 159559 - DNA, 35 bp, Artificial Sequence
  Synthetic oligonucleotide
attatccacacctccctctcgttcccccaacgggg

SEQ ID NO: 159560 - DNA, 35 bp, Artificial Sequence
  Synthetic oligonucleotide
tgtgatgaagacggaattgtggtgggacggatggg

SEQ ID NO: 159561 - DNA, 35 bp, Artificial Sequence
  Synthetic oligonucleotide
actcaaccgccctagtttaccatcccattaagtgg

SEQ ID NO: 159562 - DNA, 35 bp, Artificial Sequence
  Synthetic oligonucleotide
gagagacaagggaagaagatggtgaggattaaatg

SEQ ID NO: 159563 - DNA, 35 bp, Artificial Sequence
  Synthetic oligonucleotide
tccggcccgcctcttacagcccgccccatcttatg

SEQ ID NO: 159564 - DNA, 35 bp, Artificial Sequence
  Synthetic oligonucleotide
tccggatcggtgccatgcgtttctcttctcctgtg

SEQ ID NO: 159565 - DNA, 35 bp, Artificial Sequence
  Synthetic oligonucleotide
gcctaacgccgggtttatgcgttcatctcaccttg

SEQ ID NO: 159566 - DNA, 35 bp, Artificial Sequence
  Synthetic oligonucleotide
atgtcccggcccccgtggcaaaatgtcctacccat

SEQ ID NO: 159567 - DNA, 35 bp, Artificial Sequence
  Synthetic oligonucleotide
gtgcccaggccgcctccaccgtcccagcctgcact

SEQ ID NO: 159568 - DNA, 35 bp, Artificial Sequence
  Synthetic oligonucleotide
tgccaatcaatctcctcagcgtcgtcctcctcact

SEQ ID NO: 159569 - DNA, 35 bp, Artificial Sequence
  Synthetic oligonucleotide
tcccccacgccgaggcccagccgagtctctgtact

SEQ ID NO: 159570 - DNA, 34 bp, Artificial Sequence
  Synthetic oligonucleotide
tgcctgagcgagcttgtcggccccttttctacct

SEQ ID NO: 159571 - DNA, 35 bp, Artificial Sequence
  Synthetic oligonucleotide
tgagtcctcgagtaccgcccacgtccctaccgcct

SEQ ID NO: 159572 - DNA, 35 bp, Artificial Sequence
  Synthetic oligonucleotide
ttgtgtatcatgtgccgccctcccatccatatcct

SEQ ID NO: 159573 - DNA, 35 bp, Artificial Sequence
  Synthetic oligonucleotide
gtctgtcgtcgacaccgattgcccgtcttcctcct

SEQ ID NO: 159574 - DNA, 35 bp, Artificial Sequence
  Synthetic oligonucleotide
tgacccccccgattcgtcctgctcgtcgctttgct

SEQ ID NO: 159575 - DNA, 35 bp, Artificial Sequence
  Synthetic oligonucleotide
aagcctcggagatgtctttcaacttcccttcctct

SEQ ID NO: 159576 - DNA, 35 bp, Artificial Sequence
  Synthetic oligonucleotide
gtaccgcctcgttgccccgtcattctgagctcctt

SEQ ID NO: 159577 - DNA, 35 bp, Artificial Sequence
  Synthetic oligonucleotide
agactgactccgccgttcgacatacaccctctctt

SEQ ID NO: 159578 - DNA, 35 bp, Artificial Sequence
  Synthetic oligonucleotide
tgatactaccgctgcattgccaaacgccttgtctt

SEQ ID NO: 159579 - DNA, 35 bp, Artificial Sequence
  Synthetic oligonucleotide
gatgggcggtgcgggggcgggtgctttctgttttt

SEQ ID NO: 159580 - DNA, 35 bp, Artificial Sequence
  Synthetic oligonucleotide
gagagtggaggacggaagaagctggtgacaagcaa

SEQ ID NO: 159581 - DNA, 36 bp, Artificial Sequence
  Synthetic oligonucleotide
gcgccccgccaccctacgcagcctggtatcccgcaa

SEQ ID NO: 159582 - DNA, 36 bp, Artificial Sequence
  Synthetic oligonucleotide
gatgcgagctatcctctgtttttgttgtctccctaa

SEQ ID NO: 159583 - DNA, 36 bp, Artificial Sequence
  Synthetic oligonucleotide
tccgcccacccatcgaatcgcagccaaccttgttaa

SEQ ID NO: 159584 - DNA, 32 bp, Artificial Sequence
  Synthetic oligonucleotide
tccgtatgccctctgtacccgccctcctaaca

SEQ ID NO: 159585 - DNA, 36 bp, Artificial Sequence
  Synthetic oligonucleotide
gactacacacatggttctttacatctgcttaccaca

SEQ ID NO: 159586 - DNA, 36 bp, Artificial Sequence
  Synthetic oligonucleotide
tcaacctgccctcgacgcttactatctgggccacca

SEQ ID NO: 159587 - DNA, 34 bp, Artificial Sequence
  Synthetic oligonucleotide
atacgggtgggtcgggatattcgggagggtacca

SEQ ID NO: 159588 - DNA, 35 bp, Artificial Sequence
  Synthetic oligonucleotide
tcacacccctctgacgctttcgaacactcttacca

SEQ ID NO: 159589 - DNA, 36 bp, Artificial Sequence
  Synthetic oligonucleotide
actccttcgcctgtttgcaagttcgaccatcctcca

SEQ ID NO: 159590 - DNA, 36 bp, Artificial Sequence
  Synthetic oligonucleotide
tccaccccgaaacgcctagatatgccatccatcgca

SEQ ID NO: 159591 - DNA, 35 bp, Artificial Sequence
  Synthetic oligonucleotide
gacctggccctccatgctcccatgcccacaaatca

SEQ ID NO: 159592 - DNA, 35 bp, Artificial Sequence
  Synthetic oligonucleotide
atgcaaggcgccccattccctgtcctattgcctca

SEQ ID NO: 159593 - DNA, 35 bp, Artificial Sequence
  Synthetic oligonucleotide
tacgcggtgcattgccgttggttacccctatctca

SEQ ID NO: 159594 - DNA, 36 bp, Artificial Sequence
  Synthetic oligonucleotide
atcgtacaccgcctcgaatcccctgtgcacctgtca

SEQ ID NO: 159595 - DNA, 36 bp, Artificial Sequence
  Synthetic oligonucleotide
tccacatgcccgtacgggtcgtgaacctccccttca

SEQ ID NO: 159596 - DNA, 37 bp, Artificial Sequence
  Synthetic oligonucleotide
gccggaggaccagggagagggtgagggcggggtccga

SEQ ID NO: 159597 - DNA, 36 bp, Artificial Sequence
  Synthetic oligonucleotide
ggaatgcggagcggggaaagtgcggtacggcatcga

SEQ ID NO: 159598 - DNA, 37 bp, Artificial Sequence
  Synthetic oligonucleotide
tccgccattcaccacgcgcgtgcccttctttgttcga

SEQ ID NO: 159599 - DNA, 37 bp, Artificial Sequence
  Synthetic oligonucleotide
tcacaccgccgcggtattgcccctcccctgcctagga

SEQ ID NO: 159600 - DNA, 37 bp, Artificial Sequence
  Synthetic oligonucleotide
gctcgcccctacttcatagcgcgttccctgtttagga

SEQ ID NO: 159601 - DNA, 37 bp, Artificial Sequence
  Synthetic oligonucleotide
accctgtaccatccacttcccgacagtctactccgga

SEQ ID NO: 159602 - DNA, 37 bp, Artificial Sequence
  Synthetic oligonucleotide
tagcgaagaaggagggagggcataagggtacggggga

SEQ ID NO: 159603 - DNA, 37 bp, Artificial Sequence
  Synthetic oligonucleotide
gtcaggggagagagcacggcgacgaggagagggggga

SEQ ID NO: 159604 - DNA, 38 bp, Artificial Sequence
  Synthetic oligonucleotide
tatcacgcccactcgcatactgaatcacactatcatga

SEQ ID NO: 159605 - DNA, 38 bp, Artificial Sequence
  Synthetic oligonucleotide
gccccgctcccaccgaggtttaccgttcactcacctga

SEQ ID NO: 159606 - DNA, 36 bp, Artificial Sequence
  Synthetic oligonucleotide
agactctcacaccttgcaccacgacacacctcctga

SEQ ID NO: 159607 - DNA, 38 bp, Artificial Sequence
  Synthetic oligonucleotide
aggacagggaggagcgggggggggagcgtaggctctga

SEQ ID NO: 159608 - DNA, 38 bp, Artificial Sequence
  Synthetic oligonucleotide
tcctccgcactgccctgtactttccatcccgtttctga

SEQ ID NO: 159609 - DNA, 38 bp, Artificial Sequence
  Synthetic oligonucleotide
gaaacccgcccgccctttgaaacccagacaggaagtga

SEQ ID NO: 159610 - DNA, 38 bp, Artificial Sequence
  Synthetic oligonucleotide
acacgccatcactgaattaactacccacctccacgtga

SEQ ID NO: 159611 - DNA, 38 bp, Artificial Sequence
  Synthetic oligonucleotide
gatgcaagggaaagagaggttgtgggcgggggtattga

SEQ ID NO: 159612 - DNA, 38 bp, Artificial Sequence
  Synthetic oligonucleotide
acgcctgggtggggtacggggtccaacattggggttga

SEQ ID NO: 159613 - DNA, 35 bp, Artificial Sequence
  Synthetic oligonucleotide
gtttgccacccacgataggccgtatcctcctttga

SEQ ID NO: 159614 - DNA, 34 bp, Artificial Sequence
  Synthetic oligonucleotide
tgccatctgccccctcacctcgtcgtttaaccta

SEQ ID NO: 159615 - DNA, 35 bp, Artificial Sequence
  Synthetic oligonucleotide
ttgggacaccgctgccgtattggttctcatctcta

SEQ ID NO: 159616 - DNA, 36 bp, Artificial Sequence
  Synthetic oligonucleotide
gcgtaggggggagggggcataattggggtgccagta

SEQ ID NO: 159617 - DNA, 35 bp, Artificial Sequence
  Synthetic oligonucleotide
gcctgccacacttgagttcctatccgtttcccgta

SEQ ID NO: 159618 - DNA, 35 bp, Artificial Sequence
  Synthetic oligonucleotide
tcagctcccagcccggccgtaccctagcctccgta

SEQ ID NO: 159619 - DNA, 35 bp, Artificial Sequence
  Synthetic oligonucleotide
tccgagggctcagcgcacatcatccgctccttgta

SEQ ID NO: 159620 - DNA, 37 bp, Artificial Sequence
  Synthetic oligonucleotide
acaactgccccgcgaaccgtctgcaccttccccgtta

SEQ ID NO: 159621 - DNA, 36 bp, Artificial Sequence
  Synthetic oligonucleotide
gtgctccttcccgactcccgctatgtacagcattta

SEQ ID NO: 159622 - DNA, 35 bp, Artificial Sequence
  Synthetic oligonucleotide
atcactccctccgattagtatcgtatgtaactcac

SEQ ID NO: 159623 - DNA, 35 bp, Artificial Sequence
  Synthetic oligonucleotide
ctgcccgcatacgtctctctgcgtctccacggacc

SEQ ID NO: 159624 - DNA, 35 bp, Artificial Sequence
  Synthetic oligonucleotide
tgtaccgccccatcacaccaacaattgaggccccc

SEQ ID NO: 159625 - DNA, 35 bp, Artificial Sequence
  Synthetic oligonucleotide
aaatgcgatccgtgctccctctaccaccccaggcc

SEQ ID NO: 159626 - DNA, 35 bp, Artificial Sequence
  Synthetic oligonucleotide
ccctagccgtcccgcgcaccactcccgaccatgcc

SEQ ID NO: 159627 - DNA, 35 bp, Artificial Sequence
  Synthetic oligonucleotide
gaaaaccctccagccactgtccgccgatcgctgcc

SEQ ID NO: 159628 - DNA, 35 bp, Artificial Sequence
  Synthetic oligonucleotide
gccccgcatgtgttcccgtcttgtcgcccattgcc

SEQ ID NO: 159629 - DNA, 35 bp, Artificial Sequence
  Synthetic oligonucleotide
gcatactacctctcgcatcattgcctggtgactcc

SEQ ID NO: 159630 - DNA, 35 bp, Artificial Sequence
  Synthetic oligonucleotide
gcgacccctttaatgccacctgagtctccgtctcc

SEQ ID NO: 159631 - DNA, 35 bp, Artificial Sequence
  Synthetic oligonucleotide
ttgcagggtccggatatccatattaccccctccgc

SEQ ID NO: 159632 - DNA, 35 bp, Artificial Sequence
  Synthetic oligonucleotide
atagtcacgccacgccgcatgggcaccttcttcgc

SEQ ID NO: 159633 - DNA, 35 bp, Artificial Sequence
  Synthetic oligonucleotide
ggtagacccttctgctttctgtccgctagccatgc

SEQ ID NO: 159634 - DNA, 35 bp, Artificial Sequence
  Synthetic oligonucleotide
tacactcccactaacccctgccccacctacggtgc

SEQ ID NO: 159635 - DNA, 35 bp, Artificial Sequence
  Synthetic oligonucleotide
aacaggcctcacccgacttccctgtgatccccatc

SEQ ID NO: 159636 - DNA, 35 bp, Artificial Sequence
  Synthetic oligonucleotide
tgacgccgccgccccgctattgcctgaacccgatc

SEQ ID NO: 159637 - DNA, 35 bp, Artificial Sequence
  Synthetic oligonucleotide
tacccaccccgaccctcgaatgctctacgatcctc

SEQ ID NO: 159638 - DNA, 35 bp, Artificial Sequence
  Synthetic oligonucleotide
gctcacccacgccagccgcccacgtgccatcgctc

SEQ ID NO: 159639 - DNA, 35 bp, Artificial Sequence
  Synthetic oligonucleotide
ttcgcgcccatctgttcctcgtcccgagccccgtc

SEQ ID NO: 159640 - DNA, 35 bp, Artificial Sequence
  Synthetic oligonucleotide
gtgacgtcggctcctataacgatccactcctcgtc

SEQ ID NO: 159641 - DNA, 35 bp, Artificial Sequence
  Synthetic oligonucleotide
ccactacctctgtcctcctgctccgtttgaaaacg

SEQ ID NO: 159642 - DNA, 35 bp, Artificial Sequence
  Synthetic oligonucleotide
tgcacgggagggtgggccgggccatacctttctcg

SEQ ID NO: 159643 - DNA, 34 bp, Artificial Sequence
  Synthetic oligonucleotide
gaacaacccccacgcatgcacgacaatcgagtcg

SEQ ID NO: 159644 - DNA, 35 bp, Artificial Sequence
  Synthetic oligonucleotide
gcgccccaatcgactgttatcatgttcttctttcg

SEQ ID NO: 159645 - DNA, 35 bp, Artificial Sequence
  Synthetic oligonucleotide
attccccttgtccgttcgtgtctttccatttgcgg

SEQ ID NO: 159646 - DNA, 35 bp, Artificial Sequence
  Synthetic oligonucleotide
tagtagacaagggtaactgaaggggaagggctggg

SEQ ID NO: 159647 - DNA, 35 bp, Artificial Sequence
  Synthetic oligonucleotide
tccatactcctgccggttccatgtcttctcaactg

SEQ ID NO: 159648 - DNA, 35 bp, Artificial Sequence
  Synthetic oligonucleotide
acaccccgtgtgcccccacttcctcacccgctctg

SEQ ID NO: 159649 - DNA, 35 bp, Artificial Sequence
  Synthetic oligonucleotide
gcccttgtcggtccctgttacttcctgcactatat

SEQ ID NO: 159650 - DNA, 35 bp, Artificial Sequence
  Synthetic oligonucleotide
gtgcaccactctaactgttcttggtccccgactat

SEQ ID NO: 159651 - DNA, 35 bp, Artificial Sequence
  Synthetic oligonucleotide
actcgcccttccgtgccttgaaggttttcctgact

SEQ ID NO: 159652 - DNA, 35 bp, Artificial Sequence
  Synthetic oligonucleotide
tgtagccgttggccagcaccaccgcttcacctact

SEQ ID NO: 159653 - DNA, 35 bp, Artificial Sequence
  Synthetic oligonucleotide
tggtcgacacagtcagtcgccttctacgtacccct

SEQ ID NO: 159654 - DNA, 36 bp, Artificial Sequence
  Synthetic oligonucleotide
gacatacttgtccgtatccaccgcgctcccccccct

SEQ ID NO: 159655 - DNA, 35 bp, Artificial Sequence
  Synthetic oligonucleotide
gccggttgcggtataagccccttcgccgtcgccct

SEQ ID NO: 159656 - DNA, 35 bp, Artificial Sequence
  Synthetic oligonucleotide
gcaacctccgggtgccgttccatttgcccttccct

SEQ ID NO: 159657 - DNA, 35 bp, Artificial Sequence
  Synthetic oligonucleotide
gtccgcatcggactatatctcgtcatcactcgcct

SEQ ID NO: 159658 - DNA, 35 bp, Artificial Sequence
  Synthetic oligonucleotide
agatcccacagcccgcgcatattacgcccactgct

SEQ ID NO: 159659 - DNA, 35 bp, Artificial Sequence
  Synthetic oligonucleotide
aacccccgtagctgtgcggcgtttcttccctatct

SEQ ID NO: 159660 - DNA, 35 bp, Artificial Sequence
  Synthetic oligonucleotide
tcccgggtctgacccgctccctactcctctgcatt

SEQ ID NO: 159661 - DNA, 35 bp, Artificial Sequence
  Synthetic oligonucleotide
tgcgtgccatacaacgttattcgccgcccttcatt

SEQ ID NO: 159662 - DNA, 36 bp, Artificial Sequence
  Synthetic oligonucleotide
tggtgtggaaggaaacgcagaggacggggggtaaca

SEQ ID NO: 159663 - DNA, 35 bp, Artificial Sequence
  Synthetic oligonucleotide
tagtacgttggtgcgccctcccttacgccttaaca

SEQ ID NO: 159664 - DNA, 35 bp, Artificial Sequence
  Synthetic oligonucleotide
gcccaccgctcgcatacacaccgattagctgcaca

SEQ ID NO: 159665 - DNA, 36 bp, Artificial Sequence
  Synthetic oligonucleotide
cccgcccgccccctctatccgtaccatggactgaca

SEQ ID NO: 159666 - DNA, 36 bp, Artificial Sequence
  Synthetic oligonucleotide
tcaagcactgcacaccatcagcctttccacgttaca

SEQ ID NO: 159667 - DNA, 35 bp, Artificial Sequence
  Synthetic oligonucleotide
tgtgccacattcctgcctttgtaaccgcaccacca

SEQ ID NO: 159668 - DNA, 36 bp, Artificial Sequence
  Synthetic oligonucleotide
accgtgcaaactgcttatgttgtctcgttctcccca

SEQ ID NO: 159669 - DNA, 36 bp, Artificial Sequence
  Synthetic oligonucleotide
ggacttcgcctactcgtaatgctcgctctcctgcca

SEQ ID NO: 159670 - DNA, 36 bp, Artificial Sequence
  Synthetic oligonucleotide
atctgagcatgggggggaggcagagagaaggaggca

SEQ ID NO: 159671 - DNA, 35 bp, Artificial Sequence
  Synthetic oligonucleotide
gcaggatgggcgggaggggcagaacgaatagggca

SEQ ID NO: 159672 - DNA, 35 bp, Artificial Sequence
  Synthetic oligonucleotide
tatgacgtaggccccgcatatcatcgcccctctca

SEQ ID NO: 159673 - DNA, 35 bp, Artificial Sequence
  Synthetic oligonucleotide
tgtggccactatctgcaccatctgttatcgtctca

SEQ ID NO: 159674 - DNA, 36 bp, Artificial Sequence
  Synthetic oligonucleotide
ttgtcccactgcatgaactctttgctcgacgtttca

SEQ ID NO: 159675 - DNA, 37 bp, Artificial Sequence
  Synthetic oligonucleotide
gttgcccctcccgaactagccgtgtctcagtccaaga

SEQ ID NO: 159676 - DNA, 36 bp, Artificial Sequence
  Synthetic oligonucleotide
aaaggagagaggggaggggactgcgggagtgggaga

SEQ ID NO: 159677 - DNA, 37 bp, Artificial Sequence
  Synthetic oligonucleotide
ggtctacggacggtgcaaggagggggagggggtacga

SEQ ID NO: 159678 - DNA, 35 bp, Artificial Sequence
  Synthetic oligonucleotide
tgtcccccaggctggcccataacactgattaccga

SEQ ID NO: 159679 - DNA, 37 bp, Artificial Sequence
  Synthetic oligonucleotide
accactccacaccatggtccacacaaagactttccga

SEQ ID NO: 159680 - DNA, 36 bp, Artificial Sequence
  Synthetic oligonucleotide
attgcgcccccgcgcatgccacgacctcccaccgga

SEQ ID NO: 159681 - DNA, 35 bp, Artificial Sequence
  Synthetic oligonucleotide
ttggggacgaacggtggggaagtgaggcaagcgga

SEQ ID NO: 159682 - DNA, 37 bp, Artificial Sequence
  Synthetic oligonucleotide
agaggatgacgggaggggttccatggggctacgggga

SEQ ID NO: 159683 - DNA, 35 bp, Artificial Sequence
  Synthetic oligonucleotide
gactgaagggcgggtacgggatcaagtgaatggga

SEQ ID NO: 159684 - DNA, 38 bp, Artificial Sequence
  Synthetic oligonucleotide
taatcgcgcgcccgacctatcctgccccgtcccaatga

SEQ ID NO: 159685 - DNA, 36 bp, Artificial Sequence
  Synthetic oligonucleotide
tccaccgtccccccagcgtcgtcaggatcagcatga

SEQ ID NO: 159686 - DNA, 38 bp, Artificial Sequence
  Synthetic oligonucleotide
tgcgccccgttcccagacttgttgcccctccctcatga

SEQ ID NO: 159687 - DNA, 37 bp, Artificial Sequence
  Synthetic oligonucleotide
tcgaactatcagaagggcagggaggggtgggtactga

SEQ ID NO: 159688 - DNA, 34 bp, Artificial Sequence
  Synthetic oligonucleotide
taggctcctcctcatcctcgctgcctgttactga

SEQ ID NO: 159689 - DNA, 38 bp, Artificial Sequence
  Synthetic oligonucleotide
acctgacgtcagctctttgttcccctgttttaccctga

SEQ ID NO: 159690 - DNA, 38 bp, Artificial Sequence
  Synthetic oligonucleotide
tgtaccgcaataccgtgctaacctcgaccccctgctga

SEQ ID NO: 159691 - DNA, 35 bp, Artificial Sequence
  Synthetic oligonucleotide
gagggggggggcaagcaaggacaacaggagggtga

SEQ ID NO: 159692 - DNA, 38 bp, Artificial Sequence
  Synthetic oligonucleotide
gcacaagtgccaggaaggtagggagggtaatggggtga

SEQ ID NO: 159693 - DNA, 38 bp, Artificial Sequence
  Synthetic oligonucleotide
acactcgcagttcgtatccccgttgcccccccgattga

SEQ ID NO: 159694 - DNA, 36 bp, Artificial Sequence
  Synthetic oligonucleotide
gtgtggacacgcctctcggatgcacgccccccttga

SEQ ID NO: 159695 - DNA, 38 bp, Artificial Sequence
  Synthetic oligonucleotide
tctcaccccttccagcatggattatgccattcccttga

SEQ ID NO: 159696 - DNA, 35 bp, Artificial Sequence
  Synthetic oligonucleotide
gccggtgctacacccgccctacctttaccaccgta

SEQ ID NO: 159697 - DNA, 36 bp, Artificial Sequence
  Synthetic oligonucleotide
aaggcccacgcctccgaccatcctgccgctactgta

SEQ ID NO: 159698 - DNA, 36 bp, Artificial Sequence
  Synthetic oligonucleotide
ttacccgcccctcgcttaagagcgacgcaacattta

SEQ ID NO: 159699 - DNA, 36 bp, Artificial Sequence
  Synthetic oligonucleotide
gacccaatccgacattcttgcctttcgtacagttta

SEQ ID NO: 159700 - DNA, 35 bp, Artificial Sequence
  Synthetic oligonucleotide
ttgacacccgcatctactccttgcgcacccgaaac

SEQ ID NO: 159701 - DNA, 35 bp, Artificial Sequence
  Synthetic oligonucleotide
agtccggacgtagttcgtcgttgtcctctgcccac

SEQ ID NO: 159702 - DNA, 35 bp, Artificial Sequence
  Synthetic oligonucleotide
gaactgacgctcactgcctcttaggtaccgcaacc

SEQ ID NO: 159703 - DNA, 35 bp, Artificial Sequence
  Synthetic oligonucleotide
actgtacccacctccgcaccaatgagcgttgcacc

SEQ ID NO: 159704 - DNA, 35 bp, Artificial Sequence
  Synthetic oligonucleotide
gatgctcatactgtggttctccgcccatgttcacc

SEQ ID NO: 159705 - DNA, 35 bp, Artificial Sequence
  Synthetic oligonucleotide
tccgcacccgcctcttgtatacccgcccccatacc

SEQ ID NO: 159706 - DNA, 34 bp, Artificial Sequence
  Synthetic oligonucleotide
tgatcaactcgttttcccagcccccgggtctacc

SEQ ID NO: 159707 - DNA, 35 bp, Artificial Sequence
  Synthetic oligonucleotide
gtgtcctgctccactctcatctcacgcgtccaccc

SEQ ID NO: 159708 - DNA, 34 bp, Artificial Sequence
  Synthetic oligonucleotide
aacgctctatccctccccactcgacgagggcccc

SEQ ID NO: 159709 - DNA, 35 bp, Artificial Sequence
  Synthetic oligonucleotide
gcatctgcttagtaccgccttgtcgctcactgccc

SEQ ID NO: 159710 - DNA, 36 bp, Artificial Sequence
  Synthetic oligonucleotide
aactcgcgtggttcgtatgccgaaacgccccttccc

SEQ ID NO: 159711 - DNA, 35 bp, Artificial Sequence
  Synthetic oligonucleotide
agcctcatctatagatcccgctccattccgccgcc

SEQ ID NO: 159712 - DNA, 35 bp, Artificial Sequence
  Synthetic oligonucleotide
aatgccccagaggtttctgcgttcttcccatgtcc

SEQ ID NO: 159713 - DNA, 35 bp, Artificial Sequence
  Synthetic oligonucleotide
tcaccgccccctgcaaacaggacatttggccacgc

SEQ ID NO: 159714 - DNA, 35 bp, Artificial Sequence
  Synthetic oligonucleotide
tcttagccgcccgttttgcgcgcattccccatggc

SEQ ID NO: 159715 - DNA, 36 bp, Artificial Sequence
  Synthetic oligonucleotide
gggacgaagggcgggggggtccgagtaaacgagtgc

SEQ ID NO: 159716 - DNA, 35 bp, Artificial Sequence
  Synthetic oligonucleotide
ttggtgaccgcccatcgtttccgcttaaattcatc

SEQ ID NO: 159717 - DNA, 35 bp, Artificial Sequence
  Synthetic oligonucleotide
atttggatcagatgacgctccctgttcgttcactc

SEQ ID NO: 159718 - DNA, 35 bp, Artificial Sequence
  Synthetic oligonucleotide
cacacagttgcgcgcgcaatccgtctcacttactc

SEQ ID NO: 159719 - DNA, 35 bp, Artificial Sequence
  Synthetic oligonucleotide
gtccaacagcctcggcccttgcccatttgcctctc

SEQ ID NO: 159720 - DNA, 35 bp, Artificial Sequence
  Synthetic oligonucleotide
gctgatctgtcggtattcctctctccttcgccgtc

SEQ ID NO: 159721 - DNA, 35 bp, Artificial Sequence
  Synthetic oligonucleotide
tctacgccctatcggttccgggttgtagccccttc

SEQ ID NO: 159722 - DNA, 36 bp, Artificial Sequence
  Synthetic oligonucleotide
ttgcccaccttcgcgctgcaagcccccaaaccgttc

SEQ ID NO: 159723 - DNA, 35 bp, Artificial Sequence
  Synthetic oligonucleotide
accccaccgctatgagttcccgttctggtcctttc

SEQ ID NO: 159724 - DNA, 35 bp, Artificial Sequence
  Synthetic oligonucleotide
gcgagcggaggtcccttccgcatccgccccttttc

SEQ ID NO: 159725 - DNA, 35 bp, Artificial Sequence
  Synthetic oligonucleotide
tacctacctcccaccgtccaatttagcaccgcaag

SEQ ID NO: 159726 - DNA, 35 bp, Artificial Sequence
  Synthetic oligonucleotide
ggtcgccccccgcctttgccactcgcgtcactgag

SEQ ID NO: 159727 - DNA, 35 bp, Artificial Sequence
  Synthetic oligonucleotide
gcgcacttcctgcacgatcctcgcctacccgtacg

SEQ ID NO: 159728 - DNA, 35 bp, Artificial Sequence
  Synthetic oligonucleotide
agatactccccgcactgtatgttcccatggtaccg

SEQ ID NO: 159729 - DNA, 35 bp, Artificial Sequence
  Synthetic oligonucleotide
atgtgcccgacatcaacccgtccctgtttttaccg

SEQ ID NO: 159730 - DNA, 35 bp, Artificial Sequence
  Synthetic oligonucleotide
ttggcctctccgcgtttccagtctggccactctcg

SEQ ID NO: 159731 - DNA, 35 bp, Artificial Sequence
  Synthetic oligonucleotide
tcgagatggaaaatggaaagaggtgaaggtaaggg

SEQ ID NO: 159732 - DNA, 35 bp, Artificial Sequence
  Synthetic oligonucleotide
actccaacctcccacgccacttgaatttggcacat

SEQ ID NO: 159733 - DNA, 35 bp, Artificial Sequence
  Synthetic oligonucleotide
gagtcgccctcacttaatcacacccccacgtatat

SEQ ID NO: 159734 - DNA, 35 bp, Artificial Sequence
  Synthetic oligonucleotide
tctagccggccctcggttgatttcctcttcactat

SEQ ID NO: 159735 - DNA, 35 bp, Artificial Sequence
  Synthetic oligonucleotide
accccagtgccccgctctcccgccttagtacgtat

SEQ ID NO: 159736 - DNA, 35 bp, Artificial Sequence
  Synthetic oligonucleotide
actgaactctgacctcgctatcctacaccctccgt

SEQ ID NO: 159737 - DNA, 35 bp, Artificial Sequence
  Synthetic oligonucleotide
tcaacacaccccttcacagtacgccccacaccggt

SEQ ID NO: 159738 - DNA, 35 bp, Artificial Sequence
  Synthetic oligonucleotide
accgcgtctaccgtacgccgtcgccccgttcctgt

SEQ ID NO: 159739 - DNA, 35 bp, Artificial Sequence
  Synthetic oligonucleotide
ttagtgcgacacatacgcccctgcccgctattaaa

SEQ ID NO: 159740 - DNA, 36 bp, Artificial Sequence
  Synthetic oligonucleotide
tcatcagcccgcctcagttccgtactattgcctcaa

SEQ ID NO: 159741 - DNA, 36 bp, Artificial Sequence
  Synthetic oligonucleotide
gccacggtgggtggagggataggattggggaacaca

SEQ ID NO: 159742 - DNA, 35 bp, Artificial Sequence
  Synthetic oligonucleotide
gtccatcagctgcacaactctctgctcctgctaca

SEQ ID NO: 159743 - DNA, 36 bp, Artificial Sequence
  Synthetic oligonucleotide
tgcctcaccccatctttgccctgggactcagttaca

SEQ ID NO: 159744 - DNA, 35 bp, Artificial Sequence
  Synthetic oligonucleotide
tatacaccatcagttgccaaatcatctgcccccca

SEQ ID NO: 159745 - DNA, 36 bp, Artificial Sequence
  Synthetic oligonucleotide
ggaggtggaagggggctgcaggggggtggaatccca

SEQ ID NO: 159746 - DNA, 36 bp, Artificial Sequence
  Synthetic oligonucleotide
agctgggacattacgtattcgcctcactgcctccca

SEQ ID NO: 159747 - DNA, 36 bp, Artificial Sequence
  Synthetic oligonucleotide
gatttgcctccaccgagttcgacctgcccccagcca

SEQ ID NO: 159748 - DNA, 36 bp, Artificial Sequence
  Synthetic oligonucleotide
atggcccccacagagctccccttcattagcatgcca

SEQ ID NO: 159749 - DNA, 35 bp, Artificial Sequence
  Synthetic oligonucleotide
gcacgttcccccgatcccacggccagactcacgca

SEQ ID NO: 159750 - DNA, 36 bp, Artificial Sequence
  Synthetic oligonucleotide
gccaggtccccattgttacatcaacgtttagccgca

SEQ ID NO: 159751 - DNA, 36 bp, Artificial Sequence
  Synthetic oligonucleotide
ttcatgccctatccactcatagctgtagctatcgca

SEQ ID NO: 159752 - DNA, 36 bp, Artificial Sequence
  Synthetic oligonucleotide
atggggtgggcgaggaagcggaggaaaagtaggtca

SEQ ID NO: 159753 - DNA, 37 bp, Artificial Sequence
  Synthetic oligonucleotide
gaagtggagggaaggacgatacatggggcgtcacaga

SEQ ID NO: 159754 - DNA, 37 bp, Artificial Sequence
  Synthetic oligonucleotide
aaagacaggaggtagcagaggggggggagtcgacaga

SEQ ID NO: 159755 - DNA, 37 bp, Artificial Sequence
  Synthetic oligonucleotide
agcatggtagagagaagaagagaggggagggaggcga

SEQ ID NO: 159756 - DNA, 35 bp, Artificial Sequence
  Synthetic oligonucleotide
aacgccgggcccctcctggttgtatcctccatcga

SEQ ID NO: 159757 - DNA, 35 bp, Artificial Sequence
  Synthetic oligonucleotide
aacgaacgggtggtgggaacaagacttgggaggga

SEQ ID NO: 159758 - DNA, 37 bp, Artificial Sequence
  Synthetic oligonucleotide
gccgtgtcgggaggaagggcgtacattgaggggggga

SEQ ID NO: 159759 - DNA, 36 bp, Artificial Sequence
  Synthetic oligonucleotide
tccgcccacctaaatccctgttctagccccactgga

SEQ ID NO: 159760 - DNA, 38 bp, Artificial Sequence
  Synthetic oligonucleotide
tcaaagggggaggaagggaagtagggcaaccgaactga

SEQ ID NO: 159761 - DNA, 38 bp, Artificial Sequence
  Synthetic oligonucleotide
gacatctacgacggttatttgctctcgtccacccctga

SEQ ID NO: 159762 - DNA, 38 bp, Artificial Sequence
  Synthetic oligonucleotide
gaaccccgccttcatgcgctttttgagccgtgccctga

SEQ ID NO: 159763 - DNA, 36 bp, Artificial Sequence
  Synthetic oligonucleotide
gtctcccccgccgcctcaagacccctgcctaagtga

SEQ ID NO: 159764 - DNA, 37 bp, Artificial Sequence
  Synthetic oligonucleotide
tatcccaccatccacatgtcacttagcttgacagtga

SEQ ID NO: 159765 - DNA, 38 bp, Artificial Sequence
  Synthetic oligonucleotide
tgagggggaacggagggctggggtccggagctacgtga

SEQ ID NO: 159766 - DNA, 38 bp, Artificial Sequence
  Synthetic oligonucleotide
tccgccacacatcgcaccagcctcgaaccctgccgtga

SEQ ID NO: 159767 - DNA, 38 bp, Artificial Sequence
  Synthetic oligonucleotide
gccacacccgccccgataattgtgccgtcttttcgtga

SEQ ID NO: 159768 - DNA, 38 bp, Artificial Sequence
  Synthetic oligonucleotide
gggagaggcggggggtggggttgtaggagtgggggtga

SEQ ID NO: 159769 - DNA, 36 bp, Artificial Sequence
  Synthetic oligonucleotide
acgcaagggtggagcaagggatcgagggtactgtga

SEQ ID NO: 159770 - DNA, 37 bp, Artificial Sequence
  Synthetic oligonucleotide
tgacctccacagcccttgttaatttcgccttacttga

SEQ ID NO: 159771 - DNA, 38 bp, Artificial Sequence
  Synthetic oligonucleotide
gatcccgccaatcctcgcccaaccaagatttatcttga

SEQ ID NO: 159772 - DNA, 38 bp, Artificial Sequence
  Synthetic oligonucleotide
tgcactcagttctgcatcccttcggcttcctctcttga

SEQ ID NO: 159773 - DNA, 38 bp, Artificial Sequence
  Synthetic oligonucleotide
tcaggcccgccatctttctcacgcctcgattccgttga

SEQ ID NO: 159774 - DNA, 38 bp, Artificial Sequence
  Synthetic oligonucleotide
tgccggtgcccaatgctccaactccctttccctgttga

SEQ ID NO: 159775 - DNA, 36 bp, Artificial Sequence
  Synthetic oligonucleotide
tccatcgctgtccctctcacttagtcagctctttga

SEQ ID NO: 159776 - DNA, 36 bp, Artificial Sequence
  Synthetic oligonucleotide
actggcacctttcgactattgtactacccgccctta

SEQ ID NO: 159777 - DNA, 35 bp, Artificial Sequence
  Synthetic oligonucleotide
gcttaccagcccctcaacttgatacttcgccgtta

SEQ ID NO: 159778 - DNA, 36 bp, Artificial Sequence
  Synthetic oligonucleotide
gctccacgcccttccatcgggattaaccttgtttta

SEQ ID NO: 159779 - DNA, 35 bp, Artificial Sequence
  Synthetic oligonucleotide
tccatgccggtgccctttgacccgggccccttaac

SEQ ID NO: 159780 - DNA, 35 bp, Artificial Sequence
  Synthetic oligonucleotide
tggggaaggggggggcgaaacgaacgtaggtacac

SEQ ID NO: 159781 - DNA, 35 bp, Artificial Sequence
  Synthetic oligonucleotide
agccctctcgacgttatccccgcaagattatccac

SEQ ID NO: 159782 - DNA, 35 bp, Artificial Sequence
  Synthetic oligonucleotide
tccaaagggggccttccttctctcgcgctttccac

SEQ ID NO: 159783 - DNA, 36 bp, Artificial Sequence
  Synthetic oligonucleotide
ttaccgtgcccgaggagtcgtggcgccctccctcac

SEQ ID NO: 159784 - DNA, 35 bp, Artificial Sequence
  Synthetic oligonucleotide
gcatagatcgtgttccccactgtgtcacgtccccc

SEQ ID NO: 159785 - DNA, 35 bp, Artificial Sequence
  Synthetic oligonucleotide
aggaagctcgcatactgttcattctgtcgccgccc

SEQ ID NO: 159786 - DNA, 35 bp, Artificial Sequence
  Synthetic oligonucleotide
accgtagatgcgacccccttagcgcgccctgctcc

SEQ ID NO: 159787 - DNA, 35 bp, Artificial Sequence
  Synthetic oligonucleotide
aacacaccaccccggcgaggggaccatggctctcc

SEQ ID NO: 159788 - DNA, 35 bp, Artificial Sequence
  Synthetic oligonucleotide
gcaaagcacggctgttttactcttcggtactttcc

SEQ ID NO: 159789 - DNA, 35 bp, Artificial Sequence
  Synthetic oligonucleotide
gtatcacccgcacttgtccatacgaaccctcccgc

SEQ ID NO: 159790 - DNA, 35 bp, Artificial Sequence
  Synthetic oligonucleotide
gccaccacgtgtcgttccgggcttctcaccaaatc

SEQ ID NO: 159791 - DNA, 35 bp, Artificial Sequence
  Synthetic oligonucleotide
acccccacttcttagccgccttaaggcagggcctc

SEQ ID NO: 159792 - DNA, 35 bp, Artificial Sequence
  Synthetic oligonucleotide
gtaccggtcctggctttccatctcacatcactgtc

SEQ ID NO: 159793 - DNA, 35 bp, Artificial Sequence
  Synthetic oligonucleotide
tgatgccccgctactaacaacggctcccttctgtc

SEQ ID NO: 159794 - DNA, 35 bp, Artificial Sequence
  Synthetic oligonucleotide
tcccaccactctctgtagccgcgctctcaactttc

SEQ ID NO: 159795 - DNA, 35 bp, Artificial Sequence
  Synthetic oligonucleotide
gacgcccctcatttctgtcatgcccgccctgtacg

SEQ ID NO: 159796 - DNA, 35 bp, Artificial Sequence
  Synthetic oligonucleotide
gccccatgccacccgttttctgctatacttgtacg

SEQ ID NO: 159797 - DNA, 35 bp, Artificial Sequence
  Synthetic oligonucleotide
aagccccgctgctcgctatttcgccatccctaccg

SEQ ID NO: 159798 - DNA, 35 bp, Artificial Sequence
  Synthetic oligonucleotide
aggttagccacatccttgtcccggttcctcacccg

SEQ ID NO: 159799 - DNA, 35 bp, Artificial Sequence
  Synthetic oligonucleotide
ttacgtcgtgccaaccaacgcctccatttgtcccg

SEQ ID NO: 159800 - DNA, 35 bp, Artificial Sequence
  Synthetic oligonucleotide
tcacccccataccgaacgccaatactgtttacgcg

SEQ ID NO: 159801 - DNA, 35 bp, Artificial Sequence
  Synthetic oligonucleotide
aacagcgctcgtatgatcttctgtccgttccctcg

SEQ ID NO: 159802 - DNA, 35 bp, Artificial Sequence
  Synthetic oligonucleotide
acttcgctcacggcaccccgcactgctaccttctg

SEQ ID NO: 159803 - DNA, 35 bp, Artificial Sequence
  Synthetic oligonucleotide
acacacaacctaacatgttcgccgttccgctcttg

SEQ ID NO: 159804 - DNA, 35 bp, Artificial Sequence
  Synthetic oligonucleotide
gagcgcagtccgcgtacggcgttaactctttccat

SEQ ID NO: 159805 - DNA, 35 bp, Artificial Sequence
  Synthetic oligonucleotide
gttgggccgccacacattcaccatctggctattat

SEQ ID NO: 159806 - DNA, 35 bp, Artificial Sequence
  Synthetic oligonucleotide
aacatagcgggtaggaggggtttggggggagttat

SEQ ID NO: 159807 - DNA, 35 bp, Artificial Sequence
  Synthetic oligonucleotide
gacccatcctctgaaaacccgtacctgttgttgct

SEQ ID NO: 159808 - DNA, 35 bp, Artificial Sequence
  Synthetic oligonucleotide
tccagacagcggcacgctctatccgtctacttggt

SEQ ID NO: 159809 - DNA, 35 bp, Artificial Sequence
  Synthetic oligonucleotide
tcccgcaacctccatacgcacggtcgccaccatgt

SEQ ID NO: 159810 - DNA, 35 bp, Artificial Sequence
  Synthetic oligonucleotide
acgccaagtgatccccgcggctccatccacactgt

SEQ ID NO: 159811 - DNA, 35 bp, Artificial Sequence
  Synthetic oligonucleotide
gcatccagaccacatgcctctttttgcccccctgt

SEQ ID NO: 159812 - DNA, 35 bp, Artificial Sequence
  Synthetic oligonucleotide
ggatctcgccgtcccaagcgaacccacacctctgt

SEQ ID NO: 159813 - DNA, 35 bp, Artificial Sequence
  Synthetic oligonucleotide
tgggcgccccccctgccctttagctacgcaccgtt

SEQ ID NO: 159814 - DNA, 35 bp, Artificial Sequence
  Synthetic oligonucleotide
gcacccaagtggttgccgcattcctgcccatgttt

SEQ ID NO: 159815 - DNA, 36 bp, Artificial Sequence
  Synthetic oligonucleotide
tcagcgacgcgctctccactccgcatcctgtaccaa

SEQ ID NO: 159816 - DNA, 35 bp, Artificial Sequence
  Synthetic oligonucleotide
gggatgcggaataggataaggggagaggggcggaa

SEQ ID NO: 159817 - DNA, 36 bp, Artificial Sequence
  Synthetic oligonucleotide
tccttcaacccgccaacatctctatcggtgccataa

SEQ ID NO: 159818 - DNA, 36 bp, Artificial Sequence
  Synthetic oligonucleotide
agcacccccacgcccaccgcccggtccgcctgaaca

SEQ ID NO: 159819 - DNA, 36 bp, Artificial Sequence
  Synthetic oligonucleotide
gcctgaccgcccgttatccgcagctcgttttccaca

SEQ ID NO: 159820 - DNA, 36 bp, Artificial Sequence
  Synthetic oligonucleotide
aagtgcgcaaatacgctcgccctccagcccctcaca

SEQ ID NO: 159821 - DNA, 35 bp, Artificial Sequence
  Synthetic oligonucleotide
ttcaccaccactttctccttacgtgtcatcttaca

SEQ ID NO: 159822 - DNA, 36 bp, Artificial Sequence
  Synthetic oligonucleotide
atacccaccccctgcgtcactctggcgctcgttaca

SEQ ID NO: 159823 - DNA, 36 bp, Artificial Sequence
  Synthetic oligonucleotide
atctgtcgcgcgcttcctctcattgctgttgcccca

SEQ ID NO: 159824 - DNA, 36 bp, Artificial Sequence
  Synthetic oligonucleotide
atcagagacaggagagtaggggttcaagggaggcca

SEQ ID NO: 159825 - DNA, 35 bp, Artificial Sequence
  Synthetic oligonucleotide
gatcgaacgggggggaatgtaggtggggtcacgca

SEQ ID NO: 159826 - DNA, 35 bp, Artificial Sequence
  Synthetic oligonucleotide
gcgccaccatcgcatcttttacctcagtctacgca

SEQ ID NO: 159827 - DNA, 36 bp, Artificial Sequence
  Synthetic oligonucleotide
gccccgacgtcctccactcccgcaatctagctggca

SEQ ID NO: 159828 - DNA, 35 bp, Artificial Sequence
  Synthetic oligonucleotide
gcgaacatccgatccctgccgttgacttactatca

SEQ ID NO: 159829 - DNA, 36 bp, Artificial Sequence
  Synthetic oligonucleotide
agttacccccagccgtctcctaggttcggtctatca

SEQ ID NO: 159830 - DNA, 36 bp, Artificial Sequence
  Synthetic oligonucleotide
gacatacgtccagtccagacctgcgcccttatctca

SEQ ID NO: 159831 - DNA, 36 bp, Artificial Sequence
  Synthetic oligonucleotide
acatccgtgtcactttccgtatacgcccctccgtca

SEQ ID NO: 159832 - DNA, 36 bp, Artificial Sequence
  Synthetic oligonucleotide
tcagagggggggcgcggatagggactgccagagaga

SEQ ID NO: 159833 - DNA, 37 bp, Artificial Sequence
  Synthetic oligonucleotide
gccgggggggagtggggcttggggaggctacgctaga

SEQ ID NO: 159834 - DNA, 37 bp, Artificial Sequence
  Synthetic oligonucleotide
accccgactccctcttggccttataccgtcccttaga

SEQ ID NO: 159835 - DNA, 37 bp, Artificial Sequence
  Synthetic oligonucleotide
gtcctgtcactccccatgatacatgccatcttcccga

SEQ ID NO: 159836 - DNA, 37 bp, Artificial Sequence
  Synthetic oligonucleotide
acacgccctccgcctcctacgccagacaatttgccga

SEQ ID NO: 159837 - DNA, 37 bp, Artificial Sequence
  Synthetic oligonucleotide
ttgtcaatcacatgctctagcgcatccccatctccga

SEQ ID NO: 159838 - DNA, 36 bp, Artificial Sequence
  Synthetic oligonucleotide
gtagaggggggcggggacagaacgggcgttaggcga

SEQ ID NO: 159839 - DNA, 37 bp, Artificial Sequence
  Synthetic oligonucleotide
tacgccgttgtctcccatctgcctaatcacgtttcga

SEQ ID NO: 159840 - DNA, 35 bp, Artificial Sequence
  Synthetic oligonucleotide
ttcggtcccaccgttccccgctctatctttttcga

SEQ ID NO: 159841 - DNA, 37 bp, Artificial Sequence
  Synthetic oligonucleotide
gacattgtggagatgcatggaaggggggcggaaagga

SEQ ID NO: 159842 - DNA, 37 bp, Artificial Sequence
  Synthetic oligonucleotide
tccaggaacaggagggcgaaaattggtgggggtagga

SEQ ID NO: 159843 - DNA, 36 bp, Artificial Sequence
  Synthetic oligonucleotide
atgccatccccactcgttctattgcttccccaggga

SEQ ID NO: 159844 - DNA, 37 bp, Artificial Sequence
  Synthetic oligonucleotide
agtgcacccccccctctgttcagcagtttcacttgga

SEQ ID NO: 159845 - DNA, 38 bp, Artificial Sequence
  Synthetic oligonucleotide
tacgtcccgcgctccacccccatggccatagtctatga

SEQ ID NO: 159846 - DNA, 35 bp, Artificial Sequence
  Synthetic oligonucleotide
gataccacgcccagtttttgtccctgcttctatga

SEQ ID NO: 159847 - DNA, 36 bp, Artificial Sequence
  Synthetic oligonucleotide
accgccatcccatcggcctcatccgcatcccgctga

SEQ ID NO: 159848 - DNA, 38 bp, Artificial Sequence
  Synthetic oligonucleotide
accaggcccgccgggttattcctgctccttcctcgtga

SEQ ID NO: 159849 - DNA, 38 bp, Artificial Sequence
  Synthetic oligonucleotide
gacagagcgggtggaggattgggtaggatagggggtga

SEQ ID NO: 159850 - DNA, 38 bp, Artificial Sequence
  Synthetic oligonucleotide
gcacgccttcgccgactcgatcctcctccccagtgtga

SEQ ID NO: 159851 - DNA, 37 bp, Artificial Sequence
  Synthetic oligonucleotide
gccacctgggccgtacacccgaaccttctctacttga

SEQ ID NO: 159852 - DNA, 38 bp, Artificial Sequence
  Synthetic oligonucleotide
tacgggggacgggaaggggtgagtgagagtcaggttga

SEQ ID NO: 159853 - DNA, 37 bp, Artificial Sequence
  Synthetic oligonucleotide
ttgggggtgggaggcagtaggcgaacagcagctttga

SEQ ID NO: 159854 - DNA, 36 bp, Artificial Sequence
  Synthetic oligonucleotide
atgtaccactctcccttgctatcggacgacctagta

SEQ ID NO: 159855 - DNA, 35 bp, Artificial Sequence
  Synthetic oligonucleotide
tcccatcccctacctctgcttgcacgcccgcatta

SEQ ID NO: 159856 - DNA, 35 bp, Artificial Sequence
  Synthetic oligonucleotide
gccctggcccaccctacttgcattgagcattacac

SEQ ID NO: 159857 - DNA, 35 bp, Artificial Sequence
  Synthetic oligonucleotide
ggacccttcattggctactcctcgtgtggttacac

SEQ ID NO: 159858 - DNA, 35 bp, Artificial Sequence
  Synthetic oligonucleotide
aacaaccgagtgatcgctccaactgcccaagccac

SEQ ID NO: 159859 - DNA, 35 bp, Artificial Sequence
  Synthetic oligonucleotide
gtagacggcccactttacaccacagctccgccgac

SEQ ID NO: 159860 - DNA, 35 bp, Artificial Sequence
  Synthetic oligonucleotide
atgcccaccctgtcgcaagtggtgctttgcctacc

SEQ ID NO: 159861 - DNA, 35 bp, Artificial Sequence
  Synthetic oligonucleotide
gagctacctcactgcacctctctcccgatcgtacc

SEQ ID NO: 159862 - DNA, 35 bp, Artificial Sequence
  Synthetic oligonucleotide
tgcgccccctccatagggtgtccgacatccgcccc

SEQ ID NO: 159863 - DNA, 35 bp, Artificial Sequence
  Synthetic oligonucleotide
gaacacgctacgtgcctatgtcggtgcacttcccc

SEQ ID NO: 159864 - DNA, 35 bp, Artificial Sequence
  Synthetic oligonucleotide
acttccccacccgccgcgattgacttcccttgccc

SEQ ID NO: 159865 - DNA, 35 bp, Artificial Sequence
  Synthetic oligonucleotide
tatgcgctgacggccttttccttgctgcctgtgcc

SEQ ID NO: 159866 - DNA, 35 bp, Artificial Sequence
  Synthetic oligonucleotide
tatagcgtagaccttctcagtgtcccggcccatcc

SEQ ID NO: 159867 - DNA, 35 bp, Artificial Sequence
  Synthetic oligonucleotide
ttcgcggtatgcgtctcttgtttcccgctttctcc

SEQ ID NO: 159868 - DNA, 35 bp, Artificial Sequence
  Synthetic oligonucleotide
gtggcatgacccatcagtctttcatccgccattcc

SEQ ID NO: 159869 - DNA, 35 bp, Artificial Sequence
  Synthetic oligonucleotide
atctgcgcactttttcgcatacgccgacgacttcc

SEQ ID NO: 159870 - DNA, 35 bp, Artificial Sequence
  Synthetic oligonucleotide
gccgctgatgccatccgatgaccccttccttgcgc

SEQ ID NO: 159871 - DNA, 35 bp, Artificial Sequence
  Synthetic oligonucleotide
tcatccgtcgcctggcttctccgttcgcatctggc

SEQ ID NO: 159872 - DNA, 35 bp, Artificial Sequence
  Synthetic oligonucleotide
gtcaacgcgatagactgactcagcgtcgcccctgc

SEQ ID NO: 159873 - DNA, 35 bp, Artificial Sequence
  Synthetic oligonucleotide
gctcgccccgcccgtcgttcacccgttactcttgc

SEQ ID NO: 159874 - DNA, 35 bp, Artificial Sequence
  Synthetic oligonucleotide
gtccacacctcgatacgcccctacttcttcgttgc

SEQ ID NO: 159875 - DNA, 35 bp, Artificial Sequence
  Synthetic oligonucleotide
gatcaatcttcacaatcgcgcaccctccgcacatc

SEQ ID NO: 159876 - DNA, 35 bp, Artificial Sequence
  Synthetic oligonucleotide
gttgcggcatctcgcgcctaactccgtcatccatc

SEQ ID NO: 159877 - DNA, 35 bp, Artificial Sequence
  Synthetic oligonucleotide
atgactcgccccagtgcatccggttttattcgatc

SEQ ID NO: 159878 - DNA, 35 bp, Artificial Sequence
  Synthetic oligonucleotide
tgtgcccccagcattggttctacgttcgccctatc

SEQ ID NO: 159879 - DNA, 35 bp, Artificial Sequence
  Synthetic oligonucleotide
agcccactctactgttgcccggcgtgctgcccctc

SEQ ID NO: 159880 - DNA, 34 bp, Artificial Sequence
  Synthetic oligonucleotide
tgtttcgccgtctcgctatattcctctgggcctc

SEQ ID NO: 159881 - DNA, 35 bp, Artificial Sequence
  Synthetic oligonucleotide
tgtacaccctctgctcgcttacacgtttcttgctc

SEQ ID NO: 159882 - DNA, 35 bp, Artificial Sequence
  Synthetic oligonucleotide
ggaacccccgcctcgaccgcttaccgactgtagtc

SEQ ID NO: 159883 - DNA, 35 bp, Artificial Sequence
  Synthetic oligonucleotide
gttgtctctcccatgttcgcacccttggccctgtc

SEQ ID NO: 159884 - DNA, 35 bp, Artificial Sequence
  Synthetic oligonucleotide
gctcaacgggacgggtggtggagggcggggctgtc

SEQ ID NO: 159885 - DNA, 35 bp, Artificial Sequence
  Synthetic oligonucleotide
gtgccgacccgccccccttgtagcttactagatag

SEQ ID NO: 159886 - DNA, 36 bp, Artificial Sequence
  Synthetic oligonucleotide
accatgccaacgagtgtgaccctcccaaaccctccg

SEQ ID NO: 159887 - DNA, 35 bp, Artificial Sequence
  Synthetic oligonucleotide
gtcctcccccttatccgatccctcccatgaaaggg

SEQ ID NO: 159888 - DNA, 35 bp, Artificial Sequence
  Synthetic oligonucleotide
gctggaatgtcaagggaagggggggttaggcgggg

SEQ ID NO: 159889 - DNA, 35 bp, Artificial Sequence
  Synthetic oligonucleotide
gcgccggttaccgccttccctatgcacatgaactg

SEQ ID NO: 159890 - DNA, 35 bp, Artificial Sequence
  Synthetic oligonucleotide
gatgccccacattgtactcgtgatctaccaccctg

SEQ ID NO: 159891 - DNA, 35 bp, Artificial Sequence
  Synthetic oligonucleotide
tactcatgcacagacgggtcccgccgctccatctg

SEQ ID NO: 159892 - DNA, 35 bp, Artificial Sequence
  Synthetic oligonucleotide
gccccgcccgctccattcacgaaactaggacacat

SEQ ID NO: 159893 - DNA, 35 bp, Artificial Sequence
  Synthetic oligonucleotide
accacacgtttctcccgtgattacttacctgccat

SEQ ID NO: 159894 - DNA, 35 bp, Artificial Sequence
  Synthetic oligonucleotide
tgctcaccccagactgcgctccttgatcactatat

SEQ ID NO: 159895 - DNA, 35 bp, Artificial Sequence
  Synthetic oligonucleotide
tccgaaccgtaccaccgccgtgctacactctcact

SEQ ID NO: 159896 - DNA, 35 bp, Artificial Sequence
  Synthetic oligonucleotide
gcctgagctttgcctaaatacactgatctccgcct

SEQ ID NO: 159897 - DNA, 35 bp, Artificial Sequence
  Synthetic oligonucleotide
gctggtcagccgcctcgtttgtgccgtcgtcgcct

SEQ ID NO: 159898 - DNA, 33 bp, Artificial Sequence
  Synthetic oligonucleotide
gtcgccatgccccggtcgtatctttggtgtcct

SEQ ID NO: 159899 - DNA, 35 bp, Artificial Sequence
  Synthetic oligonucleotide
tcaaattgcgccaaacgaccgtcctgctgcccgct

SEQ ID NO: 159900 - DNA, 35 bp, Artificial Sequence
  Synthetic oligonucleotide
ttgctagcttgtcacataagccgccccccccacgt

SEQ ID NO: 159901 - DNA, 35 bp, Artificial Sequence
  Synthetic oligonucleotide
agcccatctaccgaatcatgttagcttccgccctt

SEQ ID NO: 159902 - DNA, 35 bp, Artificial Sequence
  Synthetic oligonucleotide
gcctaccccctctacttgcatacgaggtgcctttt

SEQ ID NO: 159903 - DNA, 35 bp, Artificial Sequence
  Synthetic oligonucleotide
gccccctccccattacgcgtgttcgtggtcaccaa

SEQ ID NO: 159904 - DNA, 36 bp, Artificial Sequence
  Synthetic oligonucleotide
acgatagggagtgggggtatactgggaaagaagcaa

SEQ ID NO: 159905 - DNA, 35 bp, Artificial Sequence
  Synthetic oligonucleotide
tacggatgcacccgcacgccccctgagccccgcaa

SEQ ID NO: 159906 - DNA, 36 bp, Artificial Sequence
  Synthetic oligonucleotide
gcgatgctgcgctcgttccctgcccccccgtgttaa

SEQ ID NO: 159907 - DNA, 36 bp, Artificial Sequence
  Synthetic oligonucleotide
tcccctgcgcgcaacgataccccgctccatctttaa

SEQ ID NO: 159908 - DNA, 36 bp, Artificial Sequence
  Synthetic oligonucleotide
tcctgaccaccctcgtcttcgcctgcctatcggaca

SEQ ID NO: 159909 - DNA, 35 bp, Artificial Sequence
  Synthetic oligonucleotide
cctcacgcaggtgcctcaagctccacccaccgcca

SEQ ID NO: 159910 - DNA, 35 bp, Artificial Sequence
  Synthetic oligonucleotide
aactcccgctccatgcgtctcccagcccctctgca

SEQ ID NO: 159911 - DNA, 35 bp, Artificial Sequence
  Synthetic oligonucleotide
gtccgttcccgttccatcgacttcgcatcctctca

SEQ ID NO: 159912 - DNA, 35 bp, Artificial Sequence
  Synthetic oligonucleotide
tagatgggcggaataggtacgggggggtggctaga

SEQ ID NO: 159913 - DNA, 37 bp, Artificial Sequence
  Synthetic oligonucleotide
gccgccccttattggtcccccccgtacgcatgcacga

SEQ ID NO: 159914 - DNA, 37 bp, Artificial Sequence
  Synthetic oligonucleotide
ccaccaccccccactctcaacgggcctgctgtgccga

SEQ ID NO: 159915 - DNA, 36 bp, Artificial Sequence
  Synthetic oligonucleotide
tggggtggagcaggaagaagagtggtgcggcgtcga

SEQ ID NO: 159916 - DNA, 37 bp, Artificial Sequence
  Synthetic oligonucleotide
aagagagggttagcggggacggggggagaggggagga

SEQ ID NO: 159917 - DNA, 37 bp, Artificial Sequence
  Synthetic oligonucleotide
tcatggggggggaatgggctgagggtacagcaacgga

SEQ ID NO: 159918 - DNA, 37 bp, Artificial Sequence
  Synthetic oligonucleotide
gatgggaaaaggcagagagtgggggtagaaaaaggga

SEQ ID NO: 159919 - DNA, 37 bp, Artificial Sequence
  Synthetic oligonucleotide
accgccgtccctcgattcccgtcgtgtgccccctgga

SEQ ID NO: 159920 - DNA, 38 bp, Artificial Sequence
  Synthetic oligonucleotide
taagcaggcgggtaggcggggggggctcagtaggatga

SEQ ID NO: 159921 - DNA, 38 bp, Artificial Sequence
  Synthetic oligonucleotide
gacatccgcccgggatccccacggcccccgcaccctga

SEQ ID NO: 159922 - DNA, 38 bp, Artificial Sequence
  Synthetic oligonucleotide
gacactgcatcccgccaccgtctatattcaccctctga

SEQ ID NO: 159923 - DNA, 37 bp, Artificial Sequence
  Synthetic oligonucleotide
gcgagtcaccggcgagggggggggcatggttaagtga

SEQ ID NO: 159924 - DNA, 37 bp, Artificial Sequence
  Synthetic oligonucleotide
gtgcaaagagaggggtgtaacggcgcacagagagtga

SEQ ID NO: 159925 - DNA, 38 bp, Artificial Sequence
  Synthetic oligonucleotide
gagctgcccgcccgctgcttgtgcctgttctccattga

SEQ ID NO: 159926 - DNA, 37 bp, Artificial Sequence
  Synthetic oligonucleotide
ttcgcccagtacgcccgaatttagccttccttcttga

SEQ ID NO: 159927 - DNA, 38 bp, Artificial Sequence
  Synthetic oligonucleotide
gtacctgcgcgagcaggtcttgtttgccccatctttga

SEQ ID NO: 159928 - DNA, 38 bp, Artificial Sequence
  Synthetic oligonucleotide
gtcgttacatgccgcctgttcttcaccgccttctttga

SEQ ID NO: 159929 - DNA, 36 bp, Artificial Sequence
  Synthetic oligonucleotide
ttctgtgcctcagccgcacaactgaccactctacta

SEQ ID NO: 159930 - DNA, 36 bp, Artificial Sequence
  Synthetic oligonucleotide
aaggaggatgggtggtggaggagtgataggacggta

SEQ ID NO: 159931 - DNA, 35 bp, Artificial Sequence
  Synthetic oligonucleotide
tagacgcgctccatttgctcctttagttcgccccc

SEQ ID NO: 159932 - DNA, 35 bp, Artificial Sequence
  Synthetic oligonucleotide
gctgttagcgaagcagtactgttcttgtccgcccc

SEQ ID NO: 159933 - DNA, 35 bp, Artificial Sequence
  Synthetic oligonucleotide
gctgtacgttttcgactcttatgttcacctcgccc

SEQ ID NO: 159934 - DNA, 35 bp, Artificial Sequence
  Synthetic oligonucleotide
gtagcgcgctgtccacgtttcagcaacatctgccc

SEQ ID NO: 159935 - DNA, 35 bp, Artificial Sequence
  Synthetic oligonucleotide
tagctctttcaccaccctgtagttactgccttgcc

SEQ ID NO: 159936 - DNA, 35 bp, Artificial Sequence
  Synthetic oligonucleotide
tcacctccccgtgaaacctgcccgcgctggcatcc

SEQ ID NO: 159937 - DNA, 35 bp, Artificial Sequence
  Synthetic oligonucleotide
tgccagctgacgccctctacccagccgttctatcc

SEQ ID NO: 159938 - DNA, 35 bp, Artificial Sequence
  Synthetic oligonucleotide
tccgacaacctggtctccttatgctgattcgctgc

SEQ ID NO: 159939 - DNA, 34 bp, Artificial Sequence
  Synthetic oligonucleotide
tccgtctccggtcggacgcccccttgacccgtgc

SEQ ID NO: 159940 - DNA, 35 bp, Artificial Sequence
  Synthetic oligonucleotide
gtttgctccgaaatagcccatgctctccgccttgc

SEQ ID NO: 159941 - DNA, 35 bp, Artificial Sequence
  Synthetic oligonucleotide
tgacgaccgcccttttagcgtctgatacctccatc

SEQ ID NO: 159942 - DNA, 35 bp, Artificial Sequence
  Synthetic oligonucleotide
gcgacaacccctatgccaactgacctctctttctc

SEQ ID NO: 159943 - DNA, 35 bp, Artificial Sequence
  Synthetic oligonucleotide
agcactgtgagttacatgccgtcgccccttccccg

SEQ ID NO: 159944 - DNA, 35 bp, Artificial Sequence
  Synthetic oligonucleotide
acccaccctcatgaatcgacagaacgctcgttccg

SEQ ID NO: 159945 - DNA, 35 bp, Artificial Sequence
  Synthetic oligonucleotide
gtgtctgcccgttttcgttctcgtgcttcttctcg

SEQ ID NO: 159946 - DNA, 35 bp, Artificial Sequence
  Synthetic oligonucleotide
tgagttgtggaggggcgaggggaacggaagtgagg

SEQ ID NO: 159947 - DNA, 35 bp, Artificial Sequence
  Synthetic oligonucleotide
tagacggatgaagggcatggatggggccgatgggg

SEQ ID NO: 159948 - DNA, 35 bp, Artificial Sequence
  Synthetic oligonucleotide
aaagggaacgggaatttaaagggaaggggaatggg

SEQ ID NO: 159949 - DNA, 35 bp, Artificial Sequence
  Synthetic oligonucleotide
gataatcccgcctacccgcgcacacccccgccgtg

SEQ ID NO: 159950 - DNA, 35 bp, Artificial Sequence
  Synthetic oligonucleotide
gagccccagcccaccccgtgctttttcgccatgat

SEQ ID NO: 159951 - DNA, 35 bp, Artificial Sequence
  Synthetic oligonucleotide
gggagggaagttggggagggagggcccagctttat

SEQ ID NO: 159952 - DNA, 35 bp, Artificial Sequence
  Synthetic oligonucleotide
aaacacatcgcatcttcgttctacccgcctgtact

SEQ ID NO: 159953 - DNA, 34 bp, Artificial Sequence
  Synthetic oligonucleotide
tgttcatccctgccccaagtatagacctgcccct

SEQ ID NO: 159954 - DNA, 35 bp, Artificial Sequence
  Synthetic oligonucleotide
tgccatcagaccgactccttccgacactagctcct

SEQ ID NO: 159955 - DNA, 35 bp, Artificial Sequence
  Synthetic oligonucleotide
gatcacgccgatacacgttattgcctcccttagct

SEQ ID NO: 159956 - DNA, 35 bp, Artificial Sequence
  Synthetic oligonucleotide
gaccgatccgtgtcaatccctgagtccccttcgct

SEQ ID NO: 159957 - DNA, 35 bp, Artificial Sequence
  Synthetic oligonucleotide
gcgtttgagccccatctgttaactacgtcacctct

SEQ ID NO: 159958 - DNA, 35 bp, Artificial Sequence
  Synthetic oligonucleotide
acacgtgcgagaagcacgattccccactacgctct

SEQ ID NO: 159959 - DNA, 35 bp, Artificial Sequence
  Synthetic oligonucleotide
accgatgtctcgcctggtttcccaactacttctct

SEQ ID NO: 159960 - DNA, 35 bp, Artificial Sequence
  Synthetic oligonucleotide
agaggggcgggaagagaggctgcggcagcagaggt

SEQ ID NO: 159961 - DNA, 35 bp, Artificial Sequence
  Synthetic oligonucleotide
actccgtgcaagtcggtcaccaccctgccacctgt

SEQ ID NO: 159962 - DNA, 35 bp, Artificial Sequence
  Synthetic oligonucleotide
tgcgttccatcgtgatcatgaatatccctccttgt

SEQ ID NO: 159963 - DNA, 35 bp, Artificial Sequence
  Synthetic oligonucleotide
atcgccccgtctctgcgaaagctctatctggcctt

SEQ ID NO: 159964 - DNA, 35 bp, Artificial Sequence
  Synthetic oligonucleotide
acgatctccccggactgttcttagttaaatctctt

SEQ ID NO: 159965 - DNA, 35 bp, Artificial Sequence
  Synthetic oligonucleotide
accaccaccactcatgccaccgttacgcatgcttt

SEQ ID NO: 159966 - DNA, 34 bp, Artificial Sequence
  Synthetic oligonucleotide
ttagcgctagcccttccattcgccgcatgcccaa

SEQ ID NO: 159967 - DNA, 35 bp, Artificial Sequence
  Synthetic oligonucleotide
tcacacctcgctgtcttgccgttagccaattccaa

SEQ ID NO: 159968 - DNA, 35 bp, Artificial Sequence
  Synthetic oligonucleotide
tgatggcaaaaatgggaggcgagggggaggactaa

SEQ ID NO: 159969 - DNA, 36 bp, Artificial Sequence
  Synthetic oligonucleotide
accaaccgcgacccgtcccccactctcgacagtaca

SEQ ID NO: 159970 - DNA, 36 bp, Artificial Sequence
  Synthetic oligonucleotide
gacaccaccgtcgatcgctcttgttcatgtcacgca

SEQ ID NO: 159971 - DNA, 35 bp, Artificial Sequence
  Synthetic oligonucleotide
tacaccacacatgcacacgtagcttccgcctcgca

SEQ ID NO: 159972 - DNA, 34 bp, Artificial Sequence
  Synthetic oligonucleotide
tgtgtgtgggggggcaaaagcgggaagtgaggca

SEQ ID NO: 159973 - DNA, 36 bp, Artificial Sequence
  Synthetic oligonucleotide
aggggcaacccgactcccatgccgtttcgtacttca

SEQ ID NO: 159974 - DNA, 36 bp, Artificial Sequence
  Synthetic oligonucleotide
atcttcaccgcccaaagcctgccgaatcagttttca

SEQ ID NO: 159975 - DNA, 37 bp, Artificial Sequence
  Synthetic oligonucleotide
tcccctccccgatgctccttgtcggcccttttacaga

SEQ ID NO: 159976 - DNA, 35 bp, Artificial Sequence
  Synthetic oligonucleotide
gcgcgaggagggagatggagcacgggaaaaggaga

SEQ ID NO: 159977 - DNA, 37 bp, Artificial Sequence
  Synthetic oligonucleotide
agtagccgcaactcctgccgttcccatattgccccga

SEQ ID NO: 159978 - DNA, 36 bp, Artificial Sequence
  Synthetic oligonucleotide
tcaccagggcaaaagctttatggccaccctccccga

SEQ ID NO: 159979 - DNA, 37 bp, Artificial Sequence
  Synthetic oligonucleotide
gtccactcattccgtgcttttgcgcttgctatcccga

SEQ ID NO: 159980 - DNA, 37 bp, Artificial Sequence
  Synthetic oligonucleotide
aacggtcgccgtagaatcgccagcaacccccctccga

SEQ ID NO: 159981 - DNA, 36 bp, Artificial Sequence
  Synthetic oligonucleotide
atctcatgccctgtccgtggcgcctcccctactcga

SEQ ID NO: 159982 - DNA, 37 bp, Artificial Sequence
  Synthetic oligonucleotide
ggtcagacgcacgggtagggagcaaaaatgggaggga

SEQ ID NO: 159983 - DNA, 37 bp, Artificial Sequence
  Synthetic oligonucleotide
gcggagatagggcaagctggggatatcatgggcggga

SEQ ID NO: 159984 - DNA, 37 bp, Artificial Sequence
  Synthetic oligonucleotide
tcgcacttacacctgtgccttctgcccgtccctggga

SEQ ID NO: 159985 - DNA, 37 bp, Artificial Sequence
  Synthetic oligonucleotide
gtggggaaggtggaaattaacgagctgtggggatgga

SEQ ID NO: 159986 - DNA, 38 bp, Artificial Sequence
  Synthetic oligonucleotide
tcagtacttgccgcccgacgacctcttagctcccatga

SEQ ID NO: 159987 - DNA, 38 bp, Artificial Sequence
  Synthetic oligonucleotide
gccctacctcttgttcctgacgctactacagtccctga

SEQ ID NO: 159988 - DNA, 37 bp, Artificial Sequence
  Synthetic oligonucleotide
gacatagtgtcatcctctgtaccgcctcccctcctga

SEQ ID NO: 159989 - DNA, 36 bp, Artificial Sequence
  Synthetic oligonucleotide
ttcgcgcgatgcctgccggttatctctccttcgtga

SEQ ID NO: 159990 - DNA, 37 bp, Artificial Sequence
  Synthetic oligonucleotide
ttcagcgcggggcaaataggggtaaggggtggggtga

SEQ ID NO: 159991 - DNA, 38 bp, Artificial Sequence
  Synthetic oligonucleotide
ttttccccgccccccattttttgagccccagtcattga

SEQ ID NO: 159992 - DNA, 37 bp, Artificial Sequence
  Synthetic oligonucleotide
tcactgctatgcctcggttccttcgcctccttgttga

SEQ ID NO: 159993 - DNA, 36 bp, Artificial Sequence
  Synthetic oligonucleotide
gtcgagggggaagagatcgggtgtgggcgggtttga

SEQ ID NO: 159994 - DNA, 33 bp, Artificial Sequence
  Synthetic oligonucleotide
gacaacccctttcgatgagcgcctttttccata

SEQ ID NO: 159995 - DNA, 36 bp, Artificial Sequence
  Synthetic oligonucleotide
tcacctcgcttaccttcgtttctgtttttggcccta

SEQ ID NO: 159996 - DNA, 36 bp, Artificial Sequence
  Synthetic oligonucleotide
tgttgcctcccccgtatcggcttggacgttatccta

SEQ ID NO: 159997 - DNA, 36 bp, Artificial Sequence
  Synthetic oligonucleotide
ctgctgccacgaaatgtccgggcccttctctcgcta

SEQ ID NO: 159998 - DNA, 35 bp, Artificial Sequence
  Synthetic oligonucleotide
ggggaggggggatcggtgggtgaatcggacggcta

SEQ ID NO: 159999 - DNA, 35 bp, Artificial Sequence
  Synthetic oligonucleotide
tcccaatggcacctgcttgcccccgtaacacctta

SEQ ID NO: 160000 - DNA, 36 bp, Artificial Sequence
  Synthetic oligonucleotide
tcaacatccgactggttcgccacgtacccctgctta

SEQ ID NO: 160001 - DNA, 36 bp, Artificial Sequence
  Synthetic oligonucleotide
acgtgacgccgttccatcatgaagtttgccatctta

SEQ ID NO: 160002 - DNA, 35 bp, Artificial Sequence
  Synthetic oligonucleotide
acctcactgtctctgtctttttggtgcttccgtta

SEQ ID NO: 160003 - DNA, 35 bp, Artificial Sequence
  Synthetic oligonucleotide
agcccggacattgcttttacctacacgcctttaac

SEQ ID NO: 160004 - DNA, 35 bp, Artificial Sequence
  Synthetic oligonucleotide
gctctggggctcctccatttttcgctgtcccacac

SEQ ID NO: 160005 - DNA, 35 bp, Artificial Sequence
  Synthetic oligonucleotide
tagccaccacgagccgtacatacacgctacaatac

SEQ ID NO: 160006 - DNA, 35 bp, Artificial Sequence
  Synthetic oligonucleotide
gccccagggcgcctccccatctctgcgaactttac

SEQ ID NO: 160007 - DNA, 36 bp, Artificial Sequence
  Synthetic oligonucleotide
tatcccgccctacctcgcattatgtcggtccgaacc

SEQ ID NO: 160008 - DNA, 35 bp, Artificial Sequence
  Synthetic oligonucleotide
tctgaacacctgcattattcatgcgactctccccc

SEQ ID NO: 160009 - DNA, 35 bp, Artificial Sequence
  Synthetic oligonucleotide
atacgcgcattatggtagttggatcgcgcctcccc

SEQ ID NO: 160010 - DNA, 35 bp, Artificial Sequence
  Synthetic oligonucleotide
tacgccactgtaattgtacgatagctctgctcccc

SEQ ID NO: 160011 - DNA, 35 bp, Artificial Sequence
  Synthetic oligonucleotide
ggtcacataccctgctcgagagcccgcctaggccc

SEQ ID NO: 160012 - DNA, 34 bp, Artificial Sequence
  Synthetic oligonucleotide
accgcctccttgttggttgtccccgttacaagcc

SEQ ID NO: 160013 - DNA, 35 bp, Artificial Sequence
  Synthetic oligonucleotide
gttcgctctccccctgacggtgcttacgatcctcc

SEQ ID NO: 160014 - DNA, 35 bp, Artificial Sequence
  Synthetic oligonucleotide
tgccatgtcccccgttatgtccgcattttgtctcc

SEQ ID NO: 160015 - DNA, 35 bp, Artificial Sequence
  Synthetic oligonucleotide
gcaccgggtgggacgggcacgaatagggttagcgc

SEQ ID NO: 160016 - DNA, 35 bp, Artificial Sequence
  Synthetic oligonucleotide
gctcctatcctcacccgtacgctgccgccaatggc

SEQ ID NO: 160017 - DNA, 35 bp, Artificial Sequence
  Synthetic oligonucleotide
tgcaaccctcaaccctgtccgaccgcccacctggc

SEQ ID NO: 160018 - DNA, 35 bp, Artificial Sequence
  Synthetic oligonucleotide
tctaacattctcgcctgtcgcatcccggaccctgc

SEQ ID NO: 160019 - DNA, 35 bp, Artificial Sequence
  Synthetic oligonucleotide
aatccacgccctgtatagtgcccgttccatttatc

SEQ ID NO: 160020 - DNA, 35 bp, Artificial Sequence
  Synthetic oligonucleotide
ttacgacccgccacgctcgtatccgtattcatgtc

SEQ ID NO: 160021 - DNA, 35 bp, Artificial Sequence
  Synthetic oligonucleotide
tcgatacacgccatctctactacccacgtgcgttc

SEQ ID NO: 160022 - DNA, 35 bp, Artificial Sequence
  Synthetic oligonucleotide
ggaccccgcaacctgcctccgacacgctctcgttc

SEQ ID NO: 160023 - DNA, 35 bp, Artificial Sequence
  Synthetic oligonucleotide
tagtgcacgctggacttctgttagccccccatacg

SEQ ID NO: 160024 - DNA, 35 bp, Artificial Sequence
  Synthetic oligonucleotide
gacgcactagtggccccccgcttttgttactaccg

SEQ ID NO: 160025 - DNA, 35 bp, Artificial Sequence
  Synthetic oligonucleotide
tctcgtcccgcggccgcaccacccgttcgtttccg

SEQ ID NO: 160026 - DNA, 36 bp, Artificial Sequence
  Synthetic oligonucleotide
gagatgaacatgggagggaggggggcttagctcggg

SEQ ID NO: 160027 - DNA, 35 bp, Artificial Sequence
  Synthetic oligonucleotide
ggggggggaaggggtgttcggacggacgggcctgg

SEQ ID NO: 160028 - DNA, 35 bp, Artificial Sequence
  Synthetic oligonucleotide
tcatgcagttaccgtgccgtcatactatcctcctg

SEQ ID NO: 160029 - DNA, 35 bp, Artificial Sequence
  Synthetic oligonucleotide
acaccccgtgtgcccccacttccgcaccctctctg

SEQ ID NO: 160030 - DNA, 35 bp, Artificial Sequence
  Synthetic oligonucleotide
gaccgctgtactcatcttgtacgcctgaccaccat

SEQ ID NO: 160031 - DNA, 35 bp, Artificial Sequence
  Synthetic oligonucleotide
atcccgtgctccaccgttcaagccatactactcat

SEQ ID NO: 160032 - DNA, 35 bp, Artificial Sequence
  Synthetic oligonucleotide
tgactgccgttccgccctagcgccacatacctcct

SEQ ID NO: 160033 - DNA, 35 bp, Artificial Sequence
  Synthetic oligonucleotide
gctgaccgttcagatgttccccccccatcgcctct

SEQ ID NO: 160034 - DNA, 35 bp, Artificial Sequence
  Synthetic oligonucleotide
tgcacaaccgttacgcttatgaacctgccgattct

SEQ ID NO: 160035 - DNA, 35 bp, Artificial Sequence
  Synthetic oligonucleotide
gcctgcctcagttctttctacggctgtgctattct

SEQ ID NO: 160036 - DNA, 35 bp, Artificial Sequence
  Synthetic oligonucleotide
gccggtctgagccctccccgtccctttgaaactgt

SEQ ID NO: 160037 - DNA, 35 bp, Artificial Sequence
  Synthetic oligonucleotide
gccaggccctcattctaatgcatctgccacatctt

SEQ ID NO: 160038 - DNA, 36 bp, Artificial Sequence
  Synthetic oligonucleotide
ttccacccgccgtgacccccgctcctcttattgcaa

SEQ ID NO: 160039 - DNA, 36 bp, Artificial Sequence
  Synthetic oligonucleotide
tgcccactttgatctgcaattcacacccacggttaa

SEQ ID NO: 160040 - DNA, 36 bp, Artificial Sequence
  Synthetic oligonucleotide
agtgaaccgcctccccatgttgttgttgctctttaa

SEQ ID NO: 160041 - DNA, 35 bp, Artificial Sequence
  Synthetic oligonucleotide
cagtgaaatgggaatagggaagggaggggcaaaca

SEQ ID NO: 160042 - DNA, 35 bp, Artificial Sequence
  Synthetic oligonucleotide
ttgacccgcctcctgtctgcgaatgcctccttaca

SEQ ID NO: 160043 - DNA, 36 bp, Artificial Sequence
  Synthetic oligonucleotide
gcgggacaactccgccgtttctgaactgtccaccca

SEQ ID NO: 160044 - DNA, 35 bp, Artificial Sequence
  Synthetic oligonucleotide
caataccgccgcccgccgccctaatagtcccgcca

SEQ ID NO: 160045 - DNA, 36 bp, Artificial Sequence
  Synthetic oligonucleotide
gctgaccggtcccccctgctatatatacgttcgcca

SEQ ID NO: 160046 - DNA, 35 bp, Artificial Sequence
  Synthetic oligonucleotide
acacctgttccaccggtcaagatcatctttcgcca

SEQ ID NO: 160047 - DNA, 36 bp, Artificial Sequence
  Synthetic oligonucleotide
gtgcgccaccctgtcatcctagttacttatctgcca

SEQ ID NO: 160048 - DNA, 36 bp, Artificial Sequence
  Synthetic oligonucleotide
gttgtcgccttatccggtatcatgttcccaactcca

SEQ ID NO: 160049 - DNA, 35 bp, Artificial Sequence
  Synthetic oligonucleotide
taacgccacctgagctattgatcttctttcctcca

SEQ ID NO: 160050 - DNA, 35 bp, Artificial Sequence
  Synthetic oligonucleotide
atggggggagcaatggtgggtggggtaattgggca

SEQ ID NO: 160051 - DNA, 36 bp, Artificial Sequence
  Synthetic oligonucleotide
gtgccctcccagccgcctgtctccaactttctggca

SEQ ID NO: 160052 - DNA, 36 bp, Artificial Sequence
  Synthetic oligonucleotide
gtgattgcctccctttgccatgtaagtttccgtgca

SEQ ID NO: 160053 - DNA, 36 bp, Artificial Sequence
  Synthetic oligonucleotide
gatgaggaggaagagggaattgggacgaaaagatca

SEQ ID NO: 160054 - DNA, 36 bp, Artificial Sequence
  Synthetic oligonucleotide
acctggcacgcatgtcgctccccctacctaggctca

SEQ ID NO: 160055 - DNA, 36 bp, Artificial Sequence
  Synthetic oligonucleotide
tgccccgaccatccaacgttgcctccgctatgctca

SEQ ID NO: 160056 - DNA, 37 bp, Artificial Sequence
  Synthetic oligonucleotide
gatgacggaggagggagtagtagataagacggaaaga

SEQ ID NO: 160057 - DNA, 37 bp, Artificial Sequence
  Synthetic oligonucleotide
ttagggaggggggggtactaaaaatggagaggcgaga

SEQ ID NO: 160058 - DNA, 37 bp, Artificial Sequence
  Synthetic oligonucleotide
gtcgggacaaagggccggaaggagctgggggtggaga

SEQ ID NO: 160059 - DNA, 37 bp, Artificial Sequence
  Synthetic oligonucleotide
cccagcccgccgccccatctcgcactcagtcctgaga

SEQ ID NO: 160060 - DNA, 36 bp, Artificial Sequence
  Synthetic oligonucleotide
aaaaaacaacgggggcggggtggtgggtggaataga

SEQ ID NO: 160061 - DNA, 37 bp, Artificial Sequence
  Synthetic oligonucleotide
actacactctatctggttctgactgctcctccaccga

SEQ ID NO: 160062 - DNA, 36 bp, Artificial Sequence
  Synthetic oligonucleotide
tcagccggaccacgtttgttttgcgcgccatcccga

SEQ ID NO: 160063 - DNA, 37 bp, Artificial Sequence
  Synthetic oligonucleotide
gatgaatgacgggggttaggggtgggcgggtgagcga

SEQ ID NO: 160064 - DNA, 32 bp, Artificial Sequence
  Synthetic oligonucleotide
ttccaccgttcaccatgcaatcccgcccgcga

SEQ ID NO: 160065 - DNA, 37 bp, Artificial Sequence
  Synthetic oligonucleotide
tgaccgcccgaatggcgctgcccaccctcactatcga

SEQ ID NO: 160066 - DNA, 37 bp, Artificial Sequence
  Synthetic oligonucleotide
tagccaaccactgtacttggccatagtcccctctcga

SEQ ID NO: 160067 - DNA, 37 bp, Artificial Sequence
  Synthetic oligonucleotide
gtgccgggtaggggggaaggtgacggggaccgtagga

SEQ ID NO: 160068 - DNA, 35 bp, Artificial Sequence
  Synthetic oligonucleotide
ttaaggagcagggagaaaacgggacgggtacggga

SEQ ID NO: 160069 - DNA, 37 bp, Artificial Sequence
  Synthetic oligonucleotide
tactgccccatcattgctgcctgtgccctccattgga

SEQ ID NO: 160070 - DNA, 38 bp, Artificial Sequence
  Synthetic oligonucleotide
tcgacaacggcaatcccgccccacaccgccccctatga

SEQ ID NO: 160071 - DNA, 38 bp, Artificial Sequence
  Synthetic oligonucleotide
atcgagtggagggagggatggaagggatttggaactga

SEQ ID NO: 160072 - DNA, 38 bp, Artificial Sequence
  Synthetic oligonucleotide
tacgaaagggcgggtgtggcggggggattgctcactga

SEQ ID NO: 160073 - DNA, 37 bp, Artificial Sequence
  Synthetic oligonucleotide
tccccgccgtcccccacttggattatgcaccgcctga

SEQ ID NO: 160074 - DNA, 34 bp, Artificial Sequence
  Synthetic oligonucleotide
tagactacgcacggtaccaatgccgccctcctga

SEQ ID NO: 160075 - DNA, 35 bp, Artificial Sequence
  Synthetic oligonucleotide
gcctcatcccactggtcccagtagccatttgctga

SEQ ID NO: 160076 - DNA, 38 bp, Artificial Sequence
  Synthetic oligonucleotide
tgcgactcgacccatgctgcctactatcgatcctgtga

SEQ ID NO: 160077 - DNA, 38 bp, Artificial Sequence
  Synthetic oligonucleotide
atcgcaccgcttgccgtttttgccgtaccccattgtga

SEQ ID NO: 160078 - DNA, 38 bp, Artificial Sequence
  Synthetic oligonucleotide
tcagccctgtctcttgtcccccgaattgccaccattga

SEQ ID NO: 160079 - DNA, 38 bp, Artificial Sequence
  Synthetic oligonucleotide
accgaggggagattagtgggataggacagaaaagttga

SEQ ID NO: 160080 - DNA, 36 bp, Artificial Sequence
  Synthetic oligonucleotide
tcagggcaaaagtttggacggggaaggggggggata

SEQ ID NO: 160081 - DNA, 35 bp, Artificial Sequence
  Synthetic oligonucleotide
tccaccccctgtgcctgtatgcccgaccaatacta

SEQ ID NO: 160082 - DNA, 36 bp, Artificial Sequence
  Synthetic oligonucleotide
ttcgtgctgcaggttcatactacgcgccttttccta

SEQ ID NO: 160083 - DNA, 36 bp, Artificial Sequence
  Synthetic oligonucleotide
gcccctctccaaagttacaatgccatacctctgcta

SEQ ID NO: 160084 - DNA, 36 bp, Artificial Sequence
  Synthetic oligonucleotide
gagcaggtagcaagcgggaatcgggaggtgagggta

SEQ ID NO: 160085 - DNA, 36 bp, Artificial Sequence
  Synthetic oligonucleotide
ggacggtcgatagagggtgggaggcgaaggggtgta

SEQ ID NO: 160086 - DNA, 36 bp, Artificial Sequence
  Synthetic oligonucleotide
aacatccgccgcccctctgcctaaagttcgaaatta

SEQ ID NO: 160087 - DNA, 35 bp, Artificial Sequence
  Synthetic oligonucleotide
gacccatccgacgttcctgggcctaccagccgaac

SEQ ID NO: 160088 - DNA, 35 bp, Artificial Sequence
  Synthetic oligonucleotide
aaccatgcgggcattgatcaaaaccctgcttccac

SEQ ID NO: 160089 - DNA, 35 bp, Artificial Sequence
  Synthetic oligonucleotide
acgtatccccctcgctcacagagttgcaatagcac

SEQ ID NO: 160090 - DNA, 35 bp, Artificial Sequence
  Synthetic oligonucleotide
ttcatgcccactgcagtcccgtacggacctattac

SEQ ID NO: 160091 - DNA, 35 bp, Artificial Sequence
  Synthetic oligonucleotide
gacggtgacacgttcgccccccctcgatactcacc

SEQ ID NO: 160092 - DNA, 35 bp, Artificial Sequence
  Synthetic oligonucleotide
tagcacactcgcccatctaccctgctcgacgcccc

SEQ ID NO: 160093 - DNA, 35 bp, Artificial Sequence
  Synthetic oligonucleotide
aatggttccgccacttggtacatcatcttttagcc

SEQ ID NO: 160094 - DNA, 35 bp, Artificial Sequence
  Synthetic oligonucleotide
atccatccaccacgtatagtggagatttcctatcc

SEQ ID NO: 160095 - DNA, 35 bp, Artificial Sequence
  Synthetic oligonucleotide
atgtttgcatccccttagttgcgcgataaccctcc

SEQ ID NO: 160096 - DNA, 35 bp, Artificial Sequence
  Synthetic oligonucleotide
acaagccacaatcatccacgctccccggaccacgc

SEQ ID NO: 160097 - DNA, 35 bp, Artificial Sequence
  Synthetic oligonucleotide
atcctgccggcttctatttctgcttacattcctgc

SEQ ID NO: 160098 - DNA, 35 bp, Artificial Sequence
  Synthetic oligonucleotide
gctagctgcagtccctggttcggtgccgtccttgc

SEQ ID NO: 160099 - DNA, 35 bp, Artificial Sequence
  Synthetic oligonucleotide
tctgccactcccctcggtgcactgccatgatttgc

SEQ ID NO: 160100 - DNA, 35 bp, Artificial Sequence
  Synthetic oligonucleotide
agactaccccctagactgtctgacctccatccatc

SEQ ID NO: 160101 - DNA, 35 bp, Artificial Sequence
  Synthetic oligonucleotide
gtcgtgaaacgccgcccgccctatgtcacatcatc

SEQ ID NO: 160102 - DNA, 35 bp, Artificial Sequence
  Synthetic oligonucleotide
atcgtgccttcacacttgaaactggccaacccctc

SEQ ID NO: 160103 - DNA, 35 bp, Artificial Sequence
  Synthetic oligonucleotide
atgacacgaccctcggtgcactgattttctccctc

SEQ ID NO: 160104 - DNA, 35 bp, Artificial Sequence
  Synthetic oligonucleotide
cacgctgggtgggtgtggtctttgggtaatgcctc

SEQ ID NO: 160105 - DNA, 35 bp, Artificial Sequence
  Synthetic oligonucleotide
tccgccagagccttctttcgcccgcacggatcctc

SEQ ID NO: 160106 - DNA, 35 bp, Artificial Sequence
  Synthetic oligonucleotide
tctcccgttacatctgctcaagggcctgatttctc

SEQ ID NO: 160107 - DNA, 35 bp, Artificial Sequence
  Synthetic oligonucleotide
cctgacaccctcccatcagcacctgcacactggtc

SEQ ID NO: 160108 - DNA, 35 bp, Artificial Sequence
  Synthetic oligonucleotide
gcacaaacatgcggttcagcacctcccaacctgtc

SEQ ID NO: 160109 - DNA, 34 bp, Artificial Sequence
  Synthetic oligonucleotide
atgggggggagtgagacgggaaggggaagagaag

SEQ ID NO: 160110 - DNA, 35 bp, Artificial Sequence
  Synthetic oligonucleotide
gagggcggcactggggggggtacgggacggtacag

SEQ ID NO: 160111 - DNA, 34 bp, Artificial Sequence
  Synthetic oligonucleotide
tcagttgtcgccgttctctttacccttggtgcag

SEQ ID NO: 160112 - DNA, 35 bp, Artificial Sequence
  Synthetic oligonucleotide
aacgcccctgccctcccgatcggaagcgcctcccg

SEQ ID NO: 160113 - DNA, 35 bp, Artificial Sequence
  Synthetic oligonucleotide
gtcgagatgtctcacatgcttccttgccccctccg

SEQ ID NO: 160114 - DNA, 35 bp, Artificial Sequence
  Synthetic oligonucleotide
ggtacggggaacagcaagggtggaggaatagcgcg

SEQ ID NO: 160115 - DNA, 35 bp, Artificial Sequence
  Synthetic oligonucleotide
taggtcatccccggattcttcaccacgcactatcg

SEQ ID NO: 160116 - DNA, 35 bp, Artificial Sequence
  Synthetic oligonucleotide
tccatccatccgcctacatatgctatttacaaggg

SEQ ID NO: 160117 - DNA, 35 bp, Artificial Sequence
  Synthetic oligonucleotide
gtgaggacgggaaacgggggcgggattttgtcggg

SEQ ID NO: 160118 - DNA, 36 bp, Artificial Sequence
  Synthetic oligonucleotide
ttcctgccccgtccctcccaaaagcccctcgtagtg

SEQ ID NO: 160119 - DNA, 35 bp, Artificial Sequence
  Synthetic oligonucleotide
acacaccatctaacatgttcgccgttccgctcttg

SEQ ID NO: 160120 - DNA, 35 bp, Artificial Sequence
  Synthetic oligonucleotide
gagagcacaggaggagagagaattagggcaggttg

SEQ ID NO: 160121 - DNA, 34 bp, Artificial Sequence
  Synthetic oligonucleotide
gtccccgcccacgattgcttctattccctgtttg

SEQ ID NO: 160122 - DNA, 35 bp, Artificial Sequence
  Synthetic oligonucleotide
gttggagggggggcttggaagtagttaaggggcat

SEQ ID NO: 160123 - DNA, 35 bp, Artificial Sequence
  Synthetic oligonucleotide
tcagcgctgctgcacgtcccttctccaatcacgat

SEQ ID NO: 160124 - DNA, 35 bp, Artificial Sequence
  Synthetic oligonucleotide
gtgcacctggccctctcgcatgttggacaccacct

SEQ ID NO: 160125 - DNA, 36 bp, Artificial Sequence
  Synthetic oligonucleotide
accaccatgtccatcaactcgaccgcgctgcccgct

SEQ ID NO: 160126 - DNA, 35 bp, Artificial Sequence
  Synthetic oligonucleotide
gcgtacgcctcggcaccctggctccttcctccgct

SEQ ID NO: 160127 - DNA, 35 bp, Artificial Sequence
  Synthetic oligonucleotide
tccctcccccgtgtagcagcgcagttccgctctct

SEQ ID NO: 160128 - DNA, 35 bp, Artificial Sequence
  Synthetic oligonucleotide
aatgtaccctgtccgctttgaaatgcctatcttgt

SEQ ID NO: 160129 - DNA, 35 bp, Artificial Sequence
  Synthetic oligonucleotide
tgtaccacccctgacacatcacatacaacaccgtt

SEQ ID NO: 160130 - DNA, 35 bp, Artificial Sequence
  Synthetic oligonucleotide
tctggacatccattcgttgcgggaccaccactgtt

SEQ ID NO: 160131 - DNA, 35 bp, Artificial Sequence
  Synthetic oligonucleotide
gtcactacccacctgccgttttctgatgcccattt

SEQ ID NO: 160132 - DNA, 35 bp, Artificial Sequence
  Synthetic oligonucleotide
tacgacagtgtcgacgcctctctccgccgttattt

SEQ ID NO: 160133 - DNA, 35 bp, Artificial Sequence
  Synthetic oligonucleotide
tcagctacggcgctatctttgcttactgacccttt

SEQ ID NO: 160134 - DNA, 35 bp, Artificial Sequence
  Synthetic oligonucleotide
ttcccaccatctctcattcgggctcaagagctgaa

SEQ ID NO: 160135 - DNA, 36 bp, Artificial Sequence
  Synthetic oligonucleotide
ttcgatccggcctcccttgcaatcagccttcgttaa

SEQ ID NO: 160136 - DNA, 36 bp, Artificial Sequence
  Synthetic oligonucleotide
tgttcttcccgccacctccaggagctaccgcctaca

SEQ ID NO: 160137 - DNA, 36 bp, Artificial Sequence
  Synthetic oligonucleotide
tcctgcctcgttcttgctatctaacgcctcggtaca

SEQ ID NO: 160138 - DNA, 36 bp, Artificial Sequence
  Synthetic oligonucleotide
acagacccggacccgaatcgcccgccctagtttaca

SEQ ID NO: 160139 - DNA, 36 bp, Artificial Sequence
  Synthetic oligonucleotide
gcggaggggggggaggctgcgggtgagaagttgcca

SEQ ID NO: 160140 - DNA, 35 bp, Artificial Sequence
  Synthetic oligonucleotide
gctcgagcccctccgtaggattcaagcaccctcca

SEQ ID NO: 160141 - DNA, 35 bp, Artificial Sequence
  Synthetic oligonucleotide
gcgtgccgaccatcatcgttaattcgctacttcca

SEQ ID NO: 160142 - DNA, 36 bp, Artificial Sequence
  Synthetic oligonucleotide
gttaccgcacctccattcatttccagtgtctagtca

SEQ ID NO: 160143 - DNA, 36 bp, Artificial Sequence
  Synthetic oligonucleotide
attcgtcagacacctttagcccgtcctccatcgtca

SEQ ID NO: 160144 - DNA, 36 bp, Artificial Sequence
  Synthetic oligonucleotide
tccccgtctcgcgaaccgcctaatgtccacgcttca

SEQ ID NO: 160145 - DNA, 37 bp, Artificial Sequence
  Synthetic oligonucleotide
gccccgcccccctccttggattctagcactttgcaga

SEQ ID NO: 160146 - DNA, 37 bp, Artificial Sequence
  Synthetic oligonucleotide
gcaccgaatctcgctccccctctcacgcgctgaccga

SEQ ID NO: 160147 - DNA, 37 bp, Artificial Sequence
  Synthetic oligonucleotide
acctgccgtttcagccctccgcccccttggcatccga

SEQ ID NO: 160148 - DNA, 37 bp, Artificial Sequence
  Synthetic oligonucleotide
gcaccgctacatggcacctttccctctacctctccga

SEQ ID NO: 160149 - DNA, 36 bp, Artificial Sequence
  Synthetic oligonucleotide
aaccctacctcccgccgagcactgaatccgttagga

SEQ ID NO: 160150 - DNA, 34 bp, Artificial Sequence
  Synthetic oligonucleotide
gtcttccatcgcgcactaccctccattccaggga

SEQ ID NO: 160151 - DNA, 37 bp, Artificial Sequence
  Synthetic oligonucleotide
tgaggtcaccagtcttggcgggagggcgggaacggga

SEQ ID NO: 160152 - DNA, 35 bp, Artificial Sequence
  Synthetic oligonucleotide
gaacgccctgcctccctctccgttttggtccatga

SEQ ID NO: 160153 - DNA, 37 bp, Artificial Sequence
  Synthetic oligonucleotide
gtcacagtcccaccatgcccactctccgcaccactga

SEQ ID NO: 160154 - DNA, 38 bp, Artificial Sequence
  Synthetic oligonucleotide
tgtgacgtcgtccgcctcgtatactcgtccgtcactga

SEQ ID NO: 160155 - DNA, 37 bp, Artificial Sequence
  Synthetic oligonucleotide
gtcacccttccttgtacggccactcctcggttcctga

SEQ ID NO: 160156 - DNA, 38 bp, Artificial Sequence
  Synthetic oligonucleotide
tgttacgccgcccctcccgccgtctaaggaacagctga

SEQ ID NO: 160157 - DNA, 38 bp, Artificial Sequence
  Synthetic oligonucleotide
gttgcgcgctatgaagcttatgttgccctccccgctga

SEQ ID NO: 160158 - DNA, 38 bp, Artificial Sequence
  Synthetic oligonucleotide
tagctgtacgcccactggtttcggatcccactcgctga

SEQ ID NO: 160159 - DNA, 38 bp, Artificial Sequence
  Synthetic oligonucleotide
acgcgaccatcgccacccgtcccctccgcgctcgctga

SEQ ID NO: 160160 - DNA, 38 bp, Artificial Sequence
  Synthetic oligonucleotide
ggttcgttacatggtctgcccatccccgttccccgtga

SEQ ID NO: 160161 - DNA, 37 bp, Artificial Sequence
  Synthetic oligonucleotide
tgagtggagagggagtgaagcaaaagcgcgaaggtga

SEQ ID NO: 160162 - DNA, 38 bp, Artificial Sequence
  Synthetic oligonucleotide
agcgaggggagattcgggtattagggtggggagggtga

SEQ ID NO: 160163 - DNA, 38 bp, Artificial Sequence
  Synthetic oligonucleotide
tgtacgaacccagggaaggcgggggggtggacgggtga

SEQ ID NO: 160164 - DNA, 36 bp, Artificial Sequence
  Synthetic oligonucleotide
tcaaccatctgtctgctcccgtgacccccgtcttga

SEQ ID NO: 160165 - DNA, 38 bp, Artificial Sequence
  Synthetic oligonucleotide
gaaacagggtgagacaggagggggagactggattttga

SEQ ID NO: 160166 - DNA, 35 bp, Artificial Sequence
  Synthetic oligonucleotide
gtttgcatgccccattgccccctgttcgttcacta

SEQ ID NO: 160167 - DNA, 35 bp, Artificial Sequence
  Synthetic oligonucleotide
accctctctgctgtgaaacctgttaccgcacccta

SEQ ID NO: 160168 - DNA, 36 bp, Artificial Sequence
  Synthetic oligonucleotide
tcctcaccctctccacgcgaatattgatggcgccta

SEQ ID NO: 160169 - DNA, 36 bp, Artificial Sequence
  Synthetic oligonucleotide
tcctgccctcctccgtaccgcttcagctcgcaagta

SEQ ID NO: 160170 - DNA, 35 bp, Artificial Sequence
  Synthetic oligonucleotide
atttccccgtcacatatctctaccccgctgcagta

SEQ ID NO: 160171 - DNA, 36 bp, Artificial Sequence
  Synthetic oligonucleotide
attcgccgcatacatttgcgacctttcccttacgta

SEQ ID NO: 160172 - DNA, 35 bp, Artificial Sequence
  Synthetic oligonucleotide
actgctccctccgcagacgcttactccttgccaac

SEQ ID NO: 160173 - DNA, 35 bp, Artificial Sequence
  Synthetic oligonucleotide
tgcacggtgacgaccctgtttacctaccagcctac

SEQ ID NO: 160174 - DNA, 35 bp, Artificial Sequence
  Synthetic oligonucleotide
gaccgccccctcccgcttgcttaacccctacgtac

SEQ ID NO: 160175 - DNA, 35 bp, Artificial Sequence
  Synthetic oligonucleotide
atgtgcgactcgccatctcacccgcccttccttac

SEQ ID NO: 160176 - DNA, 35 bp, Artificial Sequence
  Synthetic oligonucleotide
tgaccactgaggtgcgttcctcctgctctggtacc

SEQ ID NO: 160177 - DNA, 34 bp, Artificial Sequence
  Synthetic oligonucleotide
acagacaatcgctttgtcccttgcctatacaccc

SEQ ID NO: 160178 - DNA, 34 bp, Artificial Sequence
  Synthetic oligonucleotide
atctggcgatcgatatctactcctccgttccccc

SEQ ID NO: 160179 - DNA, 35 bp, Artificial Sequence
  Synthetic oligonucleotide
agcgccactccagctgcttttcggaatccccgccc

SEQ ID NO: 160180 - DNA, 35 bp, Artificial Sequence
  Synthetic oligonucleotide
tccacagtcgcgccctgctatatacaccttcgccc

SEQ ID NO: 160181 - DNA, 35 bp, Artificial Sequence
  Synthetic oligonucleotide
taccgagcaggtccggtccgggttccgttcatccc

SEQ ID NO: 160182 - DNA, 35 bp, Artificial Sequence
  Synthetic oligonucleotide
gtactcgcccctagatttttttgaagtccactgcc

SEQ ID NO: 160183 - DNA, 35 bp, Artificial Sequence
  Synthetic oligonucleotide
aaccctgaccgtattcatagtccttggcccttgcc

SEQ ID NO: 160184 - DNA, 35 bp, Artificial Sequence
  Synthetic oligonucleotide
ttgaccgcccatttcacgaaccgtgatagttatcc

SEQ ID NO: 160185 - DNA, 35 bp, Artificial Sequence
  Synthetic oligonucleotide
ggaagccgcacctccccctcgacaaggtatcctcc

SEQ ID NO: 160186 - DNA, 35 bp, Artificial Sequence
  Synthetic oligonucleotide
tgcccactgtactctcatgatacgtctccagttcc

SEQ ID NO: 160187 - DNA, 35 bp, Artificial Sequence
  Synthetic oligonucleotide
tcacccgtacgaaagttcttatttgctcgctccgc

SEQ ID NO: 160188 - DNA, 35 bp, Artificial Sequence
  Synthetic oligonucleotide
atcaccgggcgtgcggccacattccacctccctgc

SEQ ID NO: 160189 - DNA, 35 bp, Artificial Sequence
  Synthetic oligonucleotide
atgcctgcctccattggtcaccccccgaatcttgc

SEQ ID NO: 160190 - DNA, 35 bp, Artificial Sequence
  Synthetic oligonucleotide
tgcctcccaccatacagcacgctccctgtacactc

SEQ ID NO: 160191 - DNA, 35 bp, Artificial Sequence
  Synthetic oligonucleotide
gatgtctccgtatcgctcttctgtcttgcttactc

SEQ ID NO: 160192 - DNA, 35 bp, Artificial Sequence
  Synthetic oligonucleotide
tcatgcacctcccgctgtgctctcctgaccccctc

SEQ ID NO: 160193 - DNA, 35 bp, Artificial Sequence
  Synthetic oligonucleotide
accgcctcagtgacattttacgtcgcgtcttcctc

SEQ ID NO: 160194 - DNA, 35 bp, Artificial Sequence
  Synthetic oligonucleotide
gacatcctacggttcttatcatagctctgtctttc

SEQ ID NO: 160195 - DNA, 35 bp, Artificial Sequence
  Synthetic oligonucleotide
taggacccgccctccgaagtctattatcttgcacg

SEQ ID NO: 160196 - DNA, 35 bp, Artificial Sequence
  Synthetic oligonucleotide
tttacgtccctcaacactgcccccaccccaggacg

SEQ ID NO: 160197 - DNA, 35 bp, Artificial Sequence
  Synthetic oligonucleotide
gagcctgcccactgtctactaacacattctcgccg

SEQ ID NO: 160198 - DNA, 33 bp, Artificial Sequence
  Synthetic oligonucleotide
taccctccctagcctatatgttttcccgatccg

SEQ ID NO: 160199 - DNA, 35 bp, Artificial Sequence
  Synthetic oligonucleotide
gtccccctcgagctatttcacctccgcactgtccg

SEQ ID NO: 160200 - DNA, 35 bp, Artificial Sequence
  Synthetic oligonucleotide
tgtaagcggtcgaattccccgtgccctcgtgtccg

SEQ ID NO: 160201 - DNA, 35 bp, Artificial Sequence
  Synthetic oligonucleotide
tgtgcgataggtggtgcaggggagagggggggtgg

SEQ ID NO: 160202 - DNA, 35 bp, Artificial Sequence
  Synthetic oligonucleotide
ttccccctccgttgaaccctgtgacgccttaaatg

SEQ ID NO: 160203 - DNA, 35 bp, Artificial Sequence
  Synthetic oligonucleotide
tcagcgacactaccgacaccctcctacaagtcctg

SEQ ID NO: 160204 - DNA, 35 bp, Artificial Sequence
  Synthetic oligonucleotide
tatccgcctatcgctcctctatattaacacccgtg

SEQ ID NO: 160205 - DNA, 35 bp, Artificial Sequence
  Synthetic oligonucleotide
actccaatccgccgcatttactctgggctcccttg

SEQ ID NO: 160206 - DNA, 35 bp, Artificial Sequence
  Synthetic oligonucleotide
tgactcccccccatgcggccgcgagtagcctctat

SEQ ID NO: 160207 - DNA, 35 bp, Artificial Sequence
  Synthetic oligonucleotide
ggtggacaatcgggcgaggggggtacagagggtat

SEQ ID NO: 160208 - DNA, 35 bp, Artificial Sequence
  Synthetic oligonucleotide
aacagcccccactgtaccggttaccccgctccact

SEQ ID NO: 160209 - DNA, 35 bp, Artificial Sequence
  Synthetic oligonucleotide
tcccgcgactatgacctgcatcactttccttccct

SEQ ID NO: 160210 - DNA, 35 bp, Artificial Sequence
  Synthetic oligonucleotide
tgtacacaactagttcctcgcgccactctggtcct

SEQ ID NO: 160211 - DNA, 35 bp, Artificial Sequence
  Synthetic oligonucleotide
acgaaccacgccgccggtcctacacatgaacagct

SEQ ID NO: 160212 - DNA, 35 bp, Artificial Sequence
  Synthetic oligonucleotide
gctcgcaacatcacccagtcccacccttcccgtgt

SEQ ID NO: 160213 - DNA, 35 bp, Artificial Sequence
  Synthetic oligonucleotide
ttgacccgcctgttgagttctcccttgtgttcatt

SEQ ID NO: 160214 - DNA, 35 bp, Artificial Sequence
  Synthetic oligonucleotide
tgggcctcgccactccccgaccctttgcgcttgtt

SEQ ID NO: 160215 - DNA, 35 bp, Artificial Sequence
  Synthetic oligonucleotide
gtccccgctgtttcccgatcgctagcccaggcttt

SEQ ID NO: 160216 - DNA, 35 bp, Artificial Sequence
  Synthetic oligonucleotide
gtccgaccgccattgtcccagactaccgctttttt

SEQ ID NO: 160217 - DNA, 35 bp, Artificial Sequence
  Synthetic oligonucleotide
atgacctaccgcacaatgtctaccactactctcaa

SEQ ID NO: 160218 - DNA, 36 bp, Artificial Sequence
  Synthetic oligonucleotide
gagtcgagaggtggcggagggcggtgggagtcgaca

SEQ ID NO: 160219 - DNA, 35 bp, Artificial Sequence
  Synthetic oligonucleotide
gacgggcatgggcgggaaactttgggatagataca

SEQ ID NO: 160220 - DNA, 36 bp, Artificial Sequence
  Synthetic oligonucleotide
tcctatgcgccccagacctccacctgtcgatttcca

SEQ ID NO: 160221 - DNA, 37 bp, Artificial Sequence
  Synthetic oligonucleotide
aacacgccgatcggtcttccgactgcttcatccccga

SEQ ID NO: 160222 - DNA, 37 bp, Artificial Sequence
  Synthetic oligonucleotide
atcccgtaccccccccagtgttgctttgcactgccga

SEQ ID NO: 160223 - DNA, 37 bp, Artificial Sequence
  Synthetic oligonucleotide
acggtgagggctgggggaggcacggaacggggggcga

SEQ ID NO: 160224 - DNA, 37 bp, Artificial Sequence
  Synthetic oligonucleotide
tcaccgaccgaccacccccccgagtctccgccacgga

SEQ ID NO: 160225 - DNA, 36 bp, Artificial Sequence
  Synthetic oligonucleotide
gaaaacacatgccgctttgccccccgtactgccgga

SEQ ID NO: 160226 - DNA, 35 bp, Artificial Sequence
  Synthetic oligonucleotide
tgggagggaagggagccgggaagtatgagcgcgga

SEQ ID NO: 160227 - DNA, 37 bp, Artificial Sequence
  Synthetic oligonucleotide
gacgcgcaactgagaaggggggtggtggtggttcgga

SEQ ID NO: 160228 - DNA, 37 bp, Artificial Sequence
  Synthetic oligonucleotide
tagttaccgccgcccccgaacacttcttcctcaggga

SEQ ID NO: 160229 - DNA, 37 bp, Artificial Sequence
  Synthetic oligonucleotide
gattaggggagatggggtcggggtttaatcttgggga

SEQ ID NO: 160230 - DNA, 37 bp, Artificial Sequence
  Synthetic oligonucleotide
tatggggcgataacagggggcgggaggcggatctgga

SEQ ID NO: 160231 - DNA, 38 bp, Artificial Sequence
  Synthetic oligonucleotide
gcagagacgggtagggtggggggaagttaggtcgatga

SEQ ID NO: 160232 - DNA, 37 bp, Artificial Sequence
  Synthetic oligonucleotide
tccagcccaattcctatcgccactctactcacactga

SEQ ID NO: 160233 - DNA, 38 bp, Artificial Sequence
  Synthetic oligonucleotide
tacatctcgccgcgatcccatgcaccccccgctcctga

SEQ ID NO: 160234 - DNA, 38 bp, Artificial Sequence
  Synthetic oligonucleotide
tcgcgtgcctccgttttatctgcttgcccatgtcctga

SEQ ID NO: 160235 - DNA, 38 bp, Artificial Sequence
  Synthetic oligonucleotide
tagcgggaggcagggcggagaggaggtccggggagtga

SEQ ID NO: 160236 - DNA, 37 bp, Artificial Sequence
  Synthetic oligonucleotide
ttgccactgcccccccctgagcctcgccttaacttga

SEQ ID NO: 160237 - DNA, 35 bp, Artificial Sequence
  Synthetic oligonucleotide
tccgacttcctcataggtatctttcccttcctata

SEQ ID NO: 160238 - DNA, 35 bp, Artificial Sequence
  Synthetic oligonucleotide
gttacatccatggtccctcgttgccattccgacta

SEQ ID NO: 160239 - DNA, 36 bp, Artificial Sequence
  Synthetic oligonucleotide
tacagcatacagctctctattttgtccctgccgcta

SEQ ID NO: 160240 - DNA, 36 bp, Artificial Sequence
  Synthetic oligonucleotide
acctctccaccgccgcccccatctgtacccccggta

SEQ ID NO: 160241 - DNA, 36 bp, Artificial Sequence
  Synthetic oligonucleotide
tcccatccacccgacacacattgcatcacaccctta

SEQ ID NO: 160242 - DNA, 36 bp, Artificial Sequence
  Synthetic oligonucleotide
tagcagtccgtcacccgcgtttttgtcactctttta

SEQ ID NO: 160243 - DNA, 35 bp, Artificial Sequence
  Synthetic oligonucleotide
gcgttccacgaccgtgccccttccgttttacacac

SEQ ID NO: 160244 - DNA, 35 bp, Artificial Sequence
  Synthetic oligonucleotide
gccacccggccctctgtctatcgaccccacgaacc

SEQ ID NO: 160245 - DNA, 35 bp, Artificial Sequence
  Synthetic oligonucleotide
tcacgccgcttagtatcttcatccatgttttcacc

SEQ ID NO: 160246 - DNA, 35 bp, Artificial Sequence
  Synthetic oligonucleotide
tgccctaccgctatgctccgcaggcccgaaacccc

SEQ ID NO: 160247 - DNA, 35 bp, Artificial Sequence
  Synthetic oligonucleotide
gacttggcgttgagctccgactttcgatcctgccc

SEQ ID NO: 160248 - DNA, 35 bp, Artificial Sequence
  Synthetic oligonucleotide
tgcttacacattcgcgccacaacagactcgctccc

SEQ ID NO: 160249 - DNA, 35 bp, Artificial Sequence
  Synthetic oligonucleotide
gccgacgtgggatagggagggggaggggtatggcc

SEQ ID NO: 160250 - DNA, 35 bp, Artificial Sequence
  Synthetic oligonucleotide
gagcagcaaccgcttctcgttttcctcgccgtgcc

SEQ ID NO: 160251 - DNA, 35 bp, Artificial Sequence
  Synthetic oligonucleotide
tgatctaccccgttgatgccctggccctatgctcc

SEQ ID NO: 160252 - DNA, 35 bp, Artificial Sequence
  Synthetic oligonucleotide
gcgggcaagtcactccatctgtttcccatacgtcc

SEQ ID NO: 160253 - DNA, 35 bp, Artificial Sequence
  Synthetic oligonucleotide
atgctcgatcgatccggctacccaattccctccgc

SEQ ID NO: 160254 - DNA, 35 bp, Artificial Sequence
  Synthetic oligonucleotide
gatgaagggagggggacggtcgagaggtaagtggc

SEQ ID NO: 160255 - DNA, 35 bp, Artificial Sequence
  Synthetic oligonucleotide
gtgcgcccttcttcaccgaactgtctactccttgc

SEQ ID NO: 160256 - DNA, 35 bp, Artificial Sequence
  Synthetic oligonucleotide
tcaccgtcccgttgcacaacgttctgtccctttgc

SEQ ID NO: 160257 - DNA, 35 bp, Artificial Sequence
  Synthetic oligonucleotide
gttagcccagatcaactgtcgtgccctcctcaatc

SEQ ID NO: 160258 - DNA, 35 bp, Artificial Sequence
  Synthetic oligonucleotide
tgtccagtgccagattgtcatagctttcctccatc

SEQ ID NO: 160259 - DNA, 35 bp, Artificial Sequence
  Synthetic oligonucleotide
tacgcatgcgctgacttatatcacatgtttctctc

SEQ ID NO: 160260 - DNA, 35 bp, Artificial Sequence
  Synthetic oligonucleotide
tgacctcgcccggttagtcctccctttggttcgag

SEQ ID NO: 160261 - DNA, 35 bp, Artificial Sequence
  Synthetic oligonucleotide
tcccaggtggcctgttgtctaatcttctacccccg

SEQ ID NO: 160262 - DNA, 35 bp, Artificial Sequence
  Synthetic oligonucleotide
gcgggtccagagttgctaaccccccatccctcccg

SEQ ID NO: 160263 - DNA, 35 bp, Artificial Sequence
  Synthetic oligonucleotide
gccctgcacctccctctgttcccctcattataggg

SEQ ID NO: 160264 - DNA, 35 bp, Artificial Sequence
  Synthetic oligonucleotide
taagagccagagggtcaaagtgaggtggagaatgg

SEQ ID NO: 160265 - DNA, 37 bp, Artificial Sequence
  Synthetic oligonucleotide
gaccgagcacactgtcgtatccttgtcttcacccatg

SEQ ID NO: 160266 - DNA, 35 bp, Artificial Sequence
  Synthetic oligonucleotide
tcaccggagtcgcattactctttgagtcacctcct

SEQ ID NO: 160267 - DNA, 35 bp, Artificial Sequence
  Synthetic oligonucleotide
acccccgtctaaactgttccgttcttcgtcttcct

SEQ ID NO: 160268 - DNA, 35 bp, Artificial Sequence
  Synthetic oligonucleotide
gtgcatctcttcaccgtaccgtcacgaatccttct

SEQ ID NO: 160269 - DNA, 35 bp, Artificial Sequence
  Synthetic oligonucleotide
ttttgcgcctaacacccgtcacgaactccccctgt

SEQ ID NO: 160270 - DNA, 35 bp, Artificial Sequence
  Synthetic oligonucleotide
atgccgcccccgtggtcaactcatcctttctactt

SEQ ID NO: 160271 - DNA, 35 bp, Artificial Sequence
  Synthetic oligonucleotide
agtgcgacgaggccttgtccgtactgttacacctt

SEQ ID NO: 160272 - DNA, 35 bp, Artificial Sequence
  Synthetic oligonucleotide
tagtagtcctcacccgtccgcgccgcctccagctt

SEQ ID NO: 160273 - DNA, 35 bp, Artificial Sequence
  Synthetic oligonucleotide
tgccccacccgcccttggtaacgcttcacgccttt

SEQ ID NO: 160274 - DNA, 35 bp, Artificial Sequence
  Synthetic oligonucleotide
acagtgtgtttcgtgcttggcctccctgtctgttt

SEQ ID NO: 160275 - DNA, 36 bp, Artificial Sequence
  Synthetic oligonucleotide
cacatcgccacgcttccacttgcatagatcctcgaa

SEQ ID NO: 160276 - DNA, 36 bp, Artificial Sequence
  Synthetic oligonucleotide
ggggcgggctatgtgaaggggtacaagggggcctaa

SEQ ID NO: 160277 - DNA, 36 bp, Artificial Sequence
  Synthetic oligonucleotide
acagggggacggggcaggctgggtgtagggggttaa

SEQ ID NO: 160278 - DNA, 35 bp, Artificial Sequence
  Synthetic oligonucleotide
aagggtggggaaggaacgggaaataagcgtacaca

SEQ ID NO: 160279 - DNA, 36 bp, Artificial Sequence
  Synthetic oligonucleotide
gaatagtcgtcgcgggagggagggggcgtggataca

SEQ ID NO: 160280 - DNA, 35 bp, Artificial Sequence
  Synthetic oligonucleotide
tcagtacgtgaggagggcagggggggcgttgtaca

SEQ ID NO: 160281 - DNA, 36 bp, Artificial Sequence
  Synthetic oligonucleotide
ggagacgccacaaccgaaatcagtcatctaccacca

SEQ ID NO: 160282 - DNA, 36 bp, Artificial Sequence
  Synthetic oligonucleotide
gccagtcctccctgctgccacccactggttcatcca

SEQ ID NO: 160283 - DNA, 35 bp, Artificial Sequence
  Synthetic oligonucleotide
agctagccgaactctttgtcgcccgttacgctcca

SEQ ID NO: 160284 - DNA, 36 bp, Artificial Sequence
  Synthetic oligonucleotide
ggactcttcctgcattcgtttccggtccaatctcca

SEQ ID NO: 160285 - DNA, 36 bp, Artificial Sequence
  Synthetic oligonucleotide
gatcgcagatactcgacgccaccgtactaccttcca

SEQ ID NO: 160286 - DNA, 36 bp, Artificial Sequence
  Synthetic oligonucleotide
tacacccctgttcgttgaaaccactgctctcgggca

SEQ ID NO: 160287 - DNA, 36 bp, Artificial Sequence
  Synthetic oligonucleotide
aactcatggcggaggagggggtcctgggtgttggca

SEQ ID NO: 160288 - DNA, 35 bp, Artificial Sequence
  Synthetic oligonucleotide
gccctacaccgcactagtccctacgcacacattca

SEQ ID NO: 160289 - DNA, 37 bp, Artificial Sequence
  Synthetic oligonucleotide
tcgaaccactgggggaaaggggaaaaggtgagacaga

SEQ ID NO: 160290 - DNA, 37 bp, Artificial Sequence
  Synthetic oligonucleotide
gattcaggagaggggttgggagggcaagggccgcaga

SEQ ID NO: 160291 - DNA, 36 bp, Artificial Sequence
  Synthetic oligonucleotide
gggggggccgattcgggatgagggcgcaggggacga

SEQ ID NO: 160292 - DNA, 36 bp, Artificial Sequence
  Synthetic oligonucleotide
aacagacagcccacctgcagttagctcatcctccga

SEQ ID NO: 160293 - DNA, 37 bp, Artificial Sequence
  Synthetic oligonucleotide
gcctcctccaggtacacgaccgtgctgtttcctccga

SEQ ID NO: 160294 - DNA, 37 bp, Artificial Sequence
  Synthetic oligonucleotide
tgagacacctctgtgtgcgtttattccatctgtccga

SEQ ID NO: 160295 - DNA, 35 bp, Artificial Sequence
  Synthetic oligonucleotide
tacgccgacctattttcatgcctccgccgttccga

SEQ ID NO: 160296 - DNA, 37 bp, Artificial Sequence
  Synthetic oligonucleotide
gacgcggccagggggaggagggggttgggacgacgga

SEQ ID NO: 160297 - DNA, 37 bp, Artificial Sequence
  Synthetic oligonucleotide
aacatggggggtcaggggggagggttcctgccgggga

SEQ ID NO: 160298 - DNA, 37 bp, Artificial Sequence
  Synthetic oligonucleotide
gtggaggacgggggggtccgagggatggttcggggga

SEQ ID NO: 160299 - DNA, 37 bp, Artificial Sequence
  Synthetic oligonucleotide
tccgcccaccccaagccgctacagctactctcactga

SEQ ID NO: 160300 - DNA, 38 bp, Artificial Sequence
  Synthetic oligonucleotide
gcaccgcttgtccagctcggcttcctccttgttcctga

SEQ ID NO: 160301 - DNA, 27 bp, Artificial Sequence
  Synthetic oligonucleotide
taccgcgttatttctccccccccgtga

SEQ ID NO: 160302 - DNA, 38 bp, Artificial Sequence
  Synthetic oligonucleotide
actacaccagcaggagggggggggggccattagggtga

SEQ ID NO: 160303 - DNA, 38 bp, Artificial Sequence
  Synthetic oligonucleotide
accacccgtcctccttccctgactctctgcctctgtga

SEQ ID NO: 160304 - DNA, 38 bp, Artificial Sequence
  Synthetic oligonucleotide
agtactgccattggcgcctaatcccgtcgttcccttga

SEQ ID NO: 160305 - DNA, 38 bp, Artificial Sequence
  Synthetic oligonucleotide
acagctcagcatctctcggatctccttgctcgccttga

SEQ ID NO: 160306 - DNA, 37 bp, Artificial Sequence
  Synthetic oligonucleotide
atctcgggctgtcccatgcatatcgctccatccttga

SEQ ID NO: 160307 - DNA, 37 bp, Artificial Sequence
  Synthetic oligonucleotide
agtagggggggaggggtatggtggtggttggggttga

SEQ ID NO: 160308 - DNA, 35 bp, Artificial Sequence
  Synthetic oligonucleotide
tccgacgctacgatcatccagctgttcttcgccta

SEQ ID NO: 160309 - DNA, 36 bp, Artificial Sequence
  Synthetic oligonucleotide
gacaccgctcaccgctcggtttttttgatcttccta

SEQ ID NO: 160310 - DNA, 35 bp, Artificial Sequence
  Synthetic oligonucleotide
acccccattccacatcgtgtttcaacccttagaac

SEQ ID NO: 160311 - DNA, 35 bp, Artificial Sequence
  Synthetic oligonucleotide
acgccctcactagttacccctccggcagttcccac

SEQ ID NO: 160312 - DNA, 35 bp, Artificial Sequence
  Synthetic oligonucleotide
ttaacctcccccggcgattcttgcctacgtgccac

SEQ ID NO: 160313 - DNA, 35 bp, Artificial Sequence
  Synthetic oligonucleotide
tatgacccgcacgaactgtaccttcgccaatccac

SEQ ID NO: 160314 - DNA, 35 bp, Artificial Sequence
  Synthetic oligonucleotide
tgacggccttcccccctctacgccagtattgcacc

SEQ ID NO: 160315 - DNA, 35 bp, Artificial Sequence
  Synthetic oligonucleotide
tcccctgctgcccgcacctctgtcgccatagtacc

SEQ ID NO: 160316 - DNA, 35 bp, Artificial Sequence
  Synthetic oligonucleotide
tatcacccttctgcttgctaagtcccatgcccccc

SEQ ID NO: 160317 - DNA, 35 bp, Artificial Sequence
  Synthetic oligonucleotide
tacacgccgctcgggacgaagtttcagtctccccc

SEQ ID NO: 160318 - DNA, 35 bp, Artificial Sequence
  Synthetic oligonucleotide
atcgtcacaaacgcctggtttcctgtcatcgcgcc

SEQ ID NO: 160319 - DNA, 35 bp, Artificial Sequence
  Synthetic oligonucleotide
acaccgtcaaaccatcctcttgccccagctcatcc

SEQ ID NO: 160320 - DNA, 35 bp, Artificial Sequence
  Synthetic oligonucleotide
tgctgtaccgtcctattatccccaagcctgattcc

SEQ ID NO: 160321 - DNA, 36 bp, Artificial Sequence
  Synthetic oligonucleotide
atcgcctctgtgcgcttactaatccgaactcgttcc

SEQ ID NO: 160322 - DNA, 35 bp, Artificial Sequence
  Synthetic oligonucleotide
tccgactccctgactgctccagcaccacctgttcc

SEQ ID NO: 160323 - DNA, 35 bp, Artificial Sequence
  Synthetic oligonucleotide
gtacccagtgccccgctcgcttgctatttttttcc

SEQ ID NO: 160324 - DNA, 35 bp, Artificial Sequence
  Synthetic oligonucleotide
tctgaccccctctgaccattttgttcaagccacgc

SEQ ID NO: 160325 - DNA, 35 bp, Artificial Sequence
  Synthetic oligonucleotide
atctacgccacctcacattctttccgcctggaggc

SEQ ID NO: 160326 - DNA, 35 bp, Artificial Sequence
  Synthetic oligonucleotide
aggtgccttcaccatctggtactcgtgcctccctc

SEQ ID NO: 160327 - DNA, 35 bp, Artificial Sequence
  Synthetic oligonucleotide
gtgaaccccaagccctgccctcaacgctgtccctc

SEQ ID NO: 160328 - DNA, 35 bp, Artificial Sequence
  Synthetic oligonucleotide
gaccaccggtggttccttattgtcccgcccccgag

SEQ ID NO: 160329 - DNA, 35 bp, Artificial Sequence
  Synthetic oligonucleotide
atcgaatcgctttccatgccacgctcccgtttacg

SEQ ID NO: 160330 - DNA, 35 bp, Artificial Sequence
  Synthetic oligonucleotide
tcatatcctgcaactacatcgtacgaccacacccg

SEQ ID NO: 160331 - DNA, 35 bp, Artificial Sequence
  Synthetic oligonucleotide
tccgtcctccgcaccttaataatcctcctgttgcg

SEQ ID NO: 160332 - DNA, 35 bp, Artificial Sequence
  Synthetic oligonucleotide
tgcctcatcccgttgccccccctgtatctatgtcg

SEQ ID NO: 160333 - DNA, 35 bp, Artificial Sequence
  Synthetic oligonucleotide
gccccatctctcaccgttgtgttctgttaatttcg

SEQ ID NO: 160334 - DNA, 35 bp, Artificial Sequence
  Synthetic oligonucleotide
atcaccaccctcgtgctgtccttatctcagcacgg

SEQ ID NO: 160335 - DNA, 35 bp, Artificial Sequence
  Synthetic oligonucleotide
tgcaagcgcttgcaatgatccatctcccctttcgg

SEQ ID NO: 160336 - DNA, 35 bp, Artificial Sequence
  Synthetic oligonucleotide
ttgggttcacagggggacgggcggatagggtaggg

SEQ ID NO: 160337 - DNA, 35 bp, Artificial Sequence
  Synthetic oligonucleotide
atcatctgctccagcccgtcattgtccttctcatg

SEQ ID NO: 160338 - DNA, 35 bp, Artificial Sequence
  Synthetic oligonucleotide
ttcctacacaccgttccagtacatttgctcccctg

SEQ ID NO: 160339 - DNA, 35 bp, Artificial Sequence
  Synthetic oligonucleotide
accgcccctttgtgttcctcttttccattttgctg

SEQ ID NO: 160340 - DNA, 35 bp, Artificial Sequence
  Synthetic oligonucleotide
ggggaaggcctggggatggggacggtgtgtgcgtg

SEQ ID NO: 160341 - DNA, 35 bp, Artificial Sequence
  Synthetic oligonucleotide
tagtcaccccctcaccttctccatgaccttggttg

SEQ ID NO: 160342 - DNA, 35 bp, Artificial Sequence
  Synthetic oligonucleotide
gcgatacgtacgaggggtgggaggcgtaggggaat

SEQ ID NO: 160343 - DNA, 35 bp, Artificial Sequence
  Synthetic oligonucleotide
tcccgtcccttgcctttcccgtcctgacccgccat

SEQ ID NO: 160344 - DNA, 35 bp, Artificial Sequence
  Synthetic oligonucleotide
acttgcgccgcctgcgagcgatcgccctctctact

SEQ ID NO: 160345 - DNA, 35 bp, Artificial Sequence
  Synthetic oligonucleotide
actccgtacgcccactcctggccgacctgcaacct

SEQ ID NO: 160346 - DNA, 35 bp, Artificial Sequence
  Synthetic oligonucleotide
tccgcaaaccttagacgaatgttagtcccgcccct

SEQ ID NO: 160347 - DNA, 35 bp, Artificial Sequence
  Synthetic oligonucleotide
tgcacccctgctagttccttgggcctcgaattcct

SEQ ID NO: 160348 - DNA, 35 bp, Artificial Sequence
  Synthetic oligonucleotide
aaaccaccggtgaccgacaagcccttcctctcgct

SEQ ID NO: 160349 - DNA, 35 bp, Artificial Sequence
  Synthetic oligonucleotide
accgccccgggttcacctgccgatgtttcctctct

SEQ ID NO: 160350 - DNA, 35 bp, Artificial Sequence
  Synthetic oligonucleotide
gtcgcgatgtaccactgcctaccttgcccatgtct

SEQ ID NO: 160351 - DNA, 34 bp, Artificial Sequence
  Synthetic oligonucleotide
ttagcccacccctgtcgttctgtcactgcattct

SEQ ID NO: 160352 - DNA, 35 bp, Artificial Sequence
  Synthetic oligonucleotide
ttgcccgcaccctccgcctaatgctgctggtttct

SEQ ID NO: 160353 - DNA, 35 bp, Artificial Sequence
  Synthetic oligonucleotide
actcagatccgtcgtgccatcatcttcccggttgt

SEQ ID NO: 160354 - DNA, 35 bp, Artificial Sequence
  Synthetic oligonucleotide
tgcccccgccggttagttcagttcccacggtcctt

SEQ ID NO: 160355 - DNA, 35 bp, Artificial Sequence
  Synthetic oligonucleotide
tgtcaccccccgctaggttacggtcgaaatctctt

SEQ ID NO: 160356 - DNA, 35 bp, Artificial Sequence
  Synthetic oligonucleotide
gacatacaccgcagcgatcgtgccctttgtttctt

SEQ ID NO: 160357 - DNA, 35 bp, Artificial Sequence
  Synthetic oligonucleotide
acgcccttggtccgttttcgtacctctcccctgtt

SEQ ID NO: 160358 - DNA, 35 bp, Artificial Sequence
  Synthetic oligonucleotide
aacgaggggaggggaagggagtatgaacatttgtt

SEQ ID NO: 160359 - DNA, 35 bp, Artificial Sequence
  Synthetic oligonucleotide
tgcccctcagcattccattcgccaccgccggtaaa

SEQ ID NO: 160360 - DNA, 36 bp, Artificial Sequence
  Synthetic oligonucleotide
gtctaccgccaatcacactggggctcccacttccaa

SEQ ID NO: 160361 - DNA, 35 bp, Artificial Sequence
  Synthetic oligonucleotide
gtatgctgggggcggaagagggagaatgggggtaa

SEQ ID NO: 160362 - DNA, 36 bp, Artificial Sequence
  Synthetic oligonucleotide
acacctcctatgacccaccgactcctggttagacca

SEQ ID NO: 160363 - DNA, 35 bp, Artificial Sequence
  Synthetic oligonucleotide
ttctcgcaacagctcgcttagcaccatctcaccca

SEQ ID NO: 160364 - DNA, 36 bp, Artificial Sequence
  Synthetic oligonucleotide
tgagtacgtcccgctactttatgctttgtccgccca

SEQ ID NO: 160365 - DNA, 34 bp, Artificial Sequence
  Synthetic oligonucleotide
gagccgccgtatcctgagccattccacccatcca

SEQ ID NO: 160366 - DNA, 36 bp, Artificial Sequence
  Synthetic oligonucleotide
taggacggggggaggagtgcagggaggacacaggca

SEQ ID NO: 160367 - DNA, 37 bp, Artificial Sequence
  Synthetic oligonucleotide
gcgggccgaggaggagaaggcgaaggggtcggggaga

SEQ ID NO: 160368 - DNA, 37 bp, Artificial Sequence
  Synthetic oligonucleotide
tgacggagagtgggggggatgaagcctgggatgtaga

SEQ ID NO: 160369 - DNA, 37 bp, Artificial Sequence
  Synthetic oligonucleotide
tgttcgccaccctgcactatcgacactcctccgacga

SEQ ID NO: 160370 - DNA, 37 bp, Artificial Sequence
  Synthetic oligonucleotide
acccacgtccccatttcacttctgtctccagccccga

SEQ ID NO: 160371 - DNA, 37 bp, Artificial Sequence
  Synthetic oligonucleotide
acctccacctgccgccatttctcgtgtcgcgatccga

SEQ ID NO: 160372 - DNA, 36 bp, Artificial Sequence
  Synthetic oligonucleotide
acacgaaccccagttggccccgccctcgcccctcga

SEQ ID NO: 160373 - DNA, 37 bp, Artificial Sequence
  Synthetic oligonucleotide
gtgaccaagaaggtaagggggggtaggagaagaagga

SEQ ID NO: 160374 - DNA, 35 bp, Artificial Sequence
  Synthetic oligonucleotide
aatacgcagggaaggtcgggggagggcactaagga

SEQ ID NO: 160375 - DNA, 37 bp, Artificial Sequence
  Synthetic oligonucleotide
gcctgccacccgatcataccgcgcgttccttatagga

SEQ ID NO: 160376 - DNA, 37 bp, Artificial Sequence
  Synthetic oligonucleotide
gactcggaggaggtggggatattcaggattggacgga

SEQ ID NO: 160377 - DNA, 37 bp, Artificial Sequence
  Synthetic oligonucleotide
gacagggcggagaggggaggttgaaatggataaggga

SEQ ID NO: 160378 - DNA, 37 bp, Artificial Sequence
  Synthetic oligonucleotide
tgcggtgtagggtgaggaaggcgggcagggtgcggga

SEQ ID NO: 160379 - DNA, 37 bp, Artificial Sequence
  Synthetic oligonucleotide
acgtatgggcggggtggtaaggggcgacagaagggga

SEQ ID NO: 160380 - DNA, 35 bp, Artificial Sequence
  Synthetic oligonucleotide
tctcatagccggaggggatcagggggggaggggga

SEQ ID NO: 160381 - DNA, 38 bp, Artificial Sequence
  Synthetic oligonucleotide
ttggaactcagcctgagtcccgattcccctccacctga

SEQ ID NO: 160382 - DNA, 36 bp, Artificial Sequence
  Synthetic oligonucleotide
tcccaagctgctctctcttcatctcgtccgccgtga

SEQ ID NO: 160383 - DNA, 38 bp, Artificial Sequence
  Synthetic oligonucleotide
gtcgttcgccccgccccttctcgacagacttactgtga

SEQ ID NO: 160384 - DNA, 38 bp, Artificial Sequence
  Synthetic oligonucleotide
agaccaccgcacggcgctccctcttcacctgcctgtga

SEQ ID NO: 160385 - DNA, 38 bp, Artificial Sequence
  Synthetic oligonucleotide
tcccgcggagccgtactcgccatccaacacaccattga

SEQ ID NO: 160386 - DNA, 36 bp, Artificial Sequence
  Synthetic oligonucleotide
gtagcaatccacgtatgtccctctgcgcctccttga

SEQ ID NO: 160387 - DNA, 38 bp, Artificial Sequence
  Synthetic oligonucleotide
gtaagagcatgtgtacacgccctgccttcccactttga

SEQ ID NO: 160388 - DNA, 36 bp, Artificial Sequence
  Synthetic oligonucleotide
tcccacctccgcgcacttaagtcccggtacttaata

SEQ ID NO: 160389 - DNA, 35 bp, Artificial Sequence
  Synthetic oligonucleotide
gcgtcgcacctgtccaacacatgtctcgcttccta

SEQ ID NO: 160390 - DNA, 35 bp, Artificial Sequence
  Synthetic oligonucleotide
aaagtccgccctgctgtacccaagccgactttcta

SEQ ID NO: 160391 - DNA, 35 bp, Artificial Sequence
  Synthetic oligonucleotide
atccacccacctgttcgcgcagtacctcctgcgta

SEQ ID NO: 160392 - DNA, 36 bp, Artificial Sequence
  Synthetic oligonucleotide
gtcatgacacgtcgcttctgttccctctttgcttta

SEQ ID NO: 160393 - DNA, 35 bp, Artificial Sequence
  Synthetic oligonucleotide
gccacccgcccgctatactgtaggttttgcgtaac

SEQ ID NO: 160394 - DNA, 35 bp, Artificial Sequence
  Synthetic oligonucleotide
gtcgccacctcccagtatcttatatcggcgccccc

SEQ ID NO: 160395 - DNA, 35 bp, Artificial Sequence
  Synthetic oligonucleotide
gtccactcaccccactatctaggtacctgagcccc

SEQ ID NO: 160396 - DNA, 35 bp, Artificial Sequence
  Synthetic oligonucleotide
gttccgacgtatcgctatttcactccactggcccc

SEQ ID NO: 160397 - DNA, 35 bp, Artificial Sequence
  Synthetic oligonucleotide
tcccaccccgtaattccgaactatctatgtgcgcc

SEQ ID NO: 160398 - DNA, 35 bp, Artificial Sequence
  Synthetic oligonucleotide
gatcccgaccgaatcttctacgcatcctccctgcc

SEQ ID NO: 160399 - DNA, 35 bp, Artificial Sequence
  Synthetic oligonucleotide
gccgtccgtctctcatctgaccatcattcgctgcc

SEQ ID NO: 160400 - DNA, 35 bp, Artificial Sequence
  Synthetic oligonucleotide
gacgacacccgtatactgcatcttatttttttgcc

SEQ ID NO: 160401 - DNA, 35 bp, Artificial Sequence
  Synthetic oligonucleotide
gaccctaccagccgggtacccctgccacaacatcc

SEQ ID NO: 160402 - DNA, 35 bp, Artificial Sequence
  Synthetic oligonucleotide
tacagcaccctggagcacgtcctcctctaccctcc

SEQ ID NO: 160403 - DNA, 35 bp, Artificial Sequence
  Synthetic oligonucleotide
tacccacattcggtagcccgctcctacccggttcc

SEQ ID NO: 160404 - DNA, 35 bp, Artificial Sequence
  Synthetic oligonucleotide
tcacgccatattctaccgtgcattccacttgccgc

SEQ ID NO: 160405 - DNA, 35 bp, Artificial Sequence
  Synthetic oligonucleotide
tctcgcatgacctccctttacggtttacacgactc

SEQ ID NO: 160406 - DNA, 35 bp, Artificial Sequence
  Synthetic oligonucleotide
agtgcgcagatcgccctctgcctacattgttactc

SEQ ID NO: 160407 - DNA, 34 bp, Artificial Sequence
  Synthetic oligonucleotide
gtcggaaatcgtgttgcctccactccgtaccctc

SEQ ID NO: 160408 - DNA, 35 bp, Artificial Sequence
  Synthetic oligonucleotide
gtggactttcgcccgtactgtatgtccgtcctctc

SEQ ID NO: 160409 - DNA, 35 bp, Artificial Sequence
  Synthetic oligonucleotide
gtagaggaacagggggtaggaaaggggcgaatgtc

SEQ ID NO: 160410 - DNA, 35 bp, Artificial Sequence
  Synthetic oligonucleotide
ttcaccaatcgcattcatagtgcaccccatctgtc

SEQ ID NO: 160411 - DNA, 35 bp, Artificial Sequence
  Synthetic oligonucleotide
gcccacctcgatggctcattatattgcccattgtc

SEQ ID NO: 160412 - DNA, 35 bp, Artificial Sequence
  Synthetic oligonucleotide
atgcccatacacgagtgtccgagcccctctgcttc

SEQ ID NO: 160413 - DNA, 35 bp, Artificial Sequence
  Synthetic oligonucleotide
gtcaaacacctgctctgccattttctaccacgttc

SEQ ID NO: 160414 - DNA, 35 bp, Artificial Sequence
  Synthetic oligonucleotide
tgcgactgccattgctgtgtgattttcttgctttc

SEQ ID NO: 160415 - DNA, 35 bp, Artificial Sequence
  Synthetic oligonucleotide
ggtcccgcccgctgctcccatcacccgcctcccag

SEQ ID NO: 160416 - DNA, 35 bp, Artificial Sequence
  Synthetic oligonucleotide
ggaagggccgtgggagtaaagggttgggcagtcag

SEQ ID NO: 160417 - DNA, 35 bp, Artificial Sequence
  Synthetic oligonucleotide
atccccggctcgcatagtctttgcccccctttacg

SEQ ID NO: 160418 - DNA, 35 bp, Artificial Sequence
  Synthetic oligonucleotide
tgcctcccagaccacccaatcgcccgatatacccg

SEQ ID NO: 160419 - DNA, 35 bp, Artificial Sequence
  Synthetic oligonucleotide
gcaacgccccccctgtcatccctcctccgtgagcg

SEQ ID NO: 160420 - DNA, 35 bp, Artificial Sequence
  Synthetic oligonucleotide
gggtggcgggggtgttttgcggatggcacatcgcg

SEQ ID NO: 160421 - DNA, 35 bp, Artificial Sequence
  Synthetic oligonucleotide
ttcacgtccccccgcttgtttattgttttcgtgcg

SEQ ID NO: 160422 - DNA, 35 bp, Artificial Sequence
  Synthetic oligonucleotide
gaatgggaagtgagaaggaaatggggtgtgttgcg

SEQ ID NO: 160423 - DNA, 35 bp, Artificial Sequence
  Synthetic oligonucleotide
agagggggtggtggatagttggggtctctggaagg

SEQ ID NO: 160424 - DNA, 35 bp, Artificial Sequence
  Synthetic oligonucleotide
gcaagggaaatgggagggtactgtatgagggaggg

SEQ ID NO: 160425 - DNA, 35 bp, Artificial Sequence
  Synthetic oligonucleotide
actgactgcctcacgacgctccccctttgttcttg

SEQ ID NO: 160426 - DNA, 35 bp, Artificial Sequence
  Synthetic oligonucleotide
gtgatagtccgcccgggtttttgtttcgttcctat

SEQ ID NO: 160427 - DNA, 35 bp, Artificial Sequence
  Synthetic oligonucleotide
gaatcctcactgataaaccatgccacgccctacgt

SEQ ID NO: 160428 - DNA, 36 bp, Artificial Sequence
  Synthetic oligonucleotide
tcgctccaccccccaacgataagtccggtctcgcaa

SEQ ID NO: 160429 - DNA, 35 bp, Artificial Sequence
  Synthetic oligonucleotide
accattgcccactgttgccgccgattactcctcaa

SEQ ID NO: 160430 - DNA, 36 bp, Artificial Sequence
  Synthetic oligonucleotide
acgaccaccctccacctgtacgagtgttcgaaataa

SEQ ID NO: 160431 - DNA, 35 bp, Artificial Sequence
  Synthetic oligonucleotide
tgcacgccatgatacaagctccatctacctcctaa

SEQ ID NO: 160432 - DNA, 36 bp, Artificial Sequence
  Synthetic oligonucleotide
gcgacccccggccactccattacatcgccagtctaa

SEQ ID NO: 160433 - DNA, 35 bp, Artificial Sequence
  Synthetic oligonucleotide
accacgccctccgctcgtagctccatcgagtttaa

SEQ ID NO: 160434 - DNA, 35 bp, Artificial Sequence
  Synthetic oligonucleotide
gccacgctgttacatggtatccccggcactcccca

SEQ ID NO: 160435 - DNA, 36 bp, Artificial Sequence
  Synthetic oligonucleotide
tgtcacaccgctgcttcgcttcctcctgtcaacgca

SEQ ID NO: 160436 - DNA, 36 bp, Artificial Sequence
  Synthetic oligonucleotide
tccgagagacaggggaaggctgctagggggaatgca

SEQ ID NO: 160437 - DNA, 37 bp, Artificial Sequence
  Synthetic oligonucleotide
gtggaagggacggggaacaaggcgagctcatgaaaga

SEQ ID NO: 160438 - DNA, 36 bp, Artificial Sequence
  Synthetic oligonucleotide
tagttgcccctccccagcccttccctgcactcaaga

SEQ ID NO: 160439 - DNA, 37 bp, Artificial Sequence
  Synthetic oligonucleotide
gcttgggaaggtaagggaattaggagaccgcggcaga

SEQ ID NO: 160440 - DNA, 37 bp, Artificial Sequence
  Synthetic oligonucleotide
gtgtgtgggggaaggttgaggggcggggagtggtaga

SEQ ID NO: 160441 - DNA, 37 bp, Artificial Sequence
  Synthetic oligonucleotide
gggaacggcattgcatcgagcgggggggagggaacga

SEQ ID NO: 160442 - DNA, 37 bp, Artificial Sequence
  Synthetic oligonucleotide
tccgccccatggtttcgtgttccaatatacccgccga

SEQ ID NO: 160443 - DNA, 37 bp, Artificial Sequence
  Synthetic oligonucleotide
gtgcccgtccaggtccctggttaaatctcctctccga

SEQ ID NO: 160444 - DNA, 37 bp, Artificial Sequence
  Synthetic oligonucleotide
gcacccgcctatctctttcccgccgctaaggactcga

SEQ ID NO: 160445 - DNA, 37 bp, Artificial Sequence
  Synthetic oligonucleotide
ggccaccacctttgcaaagccctgcctcacccctcga

SEQ ID NO: 160446 - DNA, 37 bp, Artificial Sequence
  Synthetic oligonucleotide
gcatggcacctctgtgcatcttacaccctctgttcga

SEQ ID NO: 160447 - DNA, 35 bp, Artificial Sequence
  Synthetic oligonucleotide
atgctcacacagtctcccctacccagccccacgga

SEQ ID NO: 160448 - DNA, 36 bp, Artificial Sequence
  Synthetic oligonucleotide
aagggtgtgggcgggggggagtatcaggtcgacgga

SEQ ID NO: 160449 - DNA, 37 bp, Artificial Sequence
  Synthetic oligonucleotide
ggggaggggggggtggtagcggtacaaggctagcgga

SEQ ID NO: 160450 - DNA, 36 bp, Artificial Sequence
  Synthetic oligonucleotide
taagggtggggaagtcaggggagcgggtccagggga

SEQ ID NO: 160451 - DNA, 37 bp, Artificial Sequence
  Synthetic oligonucleotide
aagtacatgcgaagcacgcgagggtggagtaggggga

SEQ ID NO: 160452 - DNA, 35 bp, Artificial Sequence
  Synthetic oligonucleotide
tactacccgcctcccaccattgttgttcctgggga

SEQ ID NO: 160453 - DNA, 38 bp, Artificial Sequence
  Synthetic oligonucleotide
agaccacgagggagtggggtaaatgggggggaaaatga

SEQ ID NO: 160454 - DNA, 38 bp, Artificial Sequence
  Synthetic oligonucleotide
gagggtgaaggcaaaaaggcgagtaagggatcgaatga

SEQ ID NO: 160455 - DNA, 37 bp, Artificial Sequence
  Synthetic oligonucleotide
tgacgccctctggccctttatggtcttcatccactga

SEQ ID NO: 160456 - DNA, 35 bp, Artificial Sequence
  Synthetic oligonucleotide
gacctgtatccaccgtggcttttactgccccctga

SEQ ID NO: 160457 - DNA, 38 bp, Artificial Sequence
  Synthetic oligonucleotide
ggacacgttagcgcctttgaccatccactttcccctga

SEQ ID NO: 160458 - DNA, 37 bp, Artificial Sequence
  Synthetic oligonucleotide
tctacgcgctgtcctccgctattctcgacccgcctga

SEQ ID NO: 160459 - DNA, 38 bp, Artificial Sequence
  Synthetic oligonucleotide
atgggaagggagggtagggtgaagattgggctatctga

SEQ ID NO: 160460 - DNA, 37 bp, Artificial Sequence
  Synthetic oligonucleotide
aatcgccccgcccccacgtaaactacttcgaacgtga

SEQ ID NO: 160461 - DNA, 36 bp, Artificial Sequence
  Synthetic oligonucleotide
aaccaccttcaaatgccccgccaccgtcccacgtga

SEQ ID NO: 160462 - DNA, 37 bp, Artificial Sequence
  Synthetic oligonucleotide
ttatcgcgccacacctcctgatccgtgcatcccgtga

SEQ ID NO: 160463 - DNA, 38 bp, Artificial Sequence
  Synthetic oligonucleotide
gcgtagacagggtggtagggtggatcgggagtgcgtga

SEQ ID NO: 160464 - DNA, 37 bp, Artificial Sequence
  Synthetic oligonucleotide
acgggggggacagtatgggaagggcacgaaggggtga

SEQ ID NO: 160465 - DNA, 37 bp, Artificial Sequence
  Synthetic oligonucleotide
ggggtgtctctgggtggggaaattcatgcgggggtga

SEQ ID NO: 160466 - DNA, 38 bp, Artificial Sequence
  Synthetic oligonucleotide
gcacgtggcacatgcctcctcgtccctgcctgaattga

SEQ ID NO: 160467 - DNA, 38 bp, Artificial Sequence
  Synthetic oligonucleotide
tcgacgtctgtgcaccgccgccccccccccgaggttga

SEQ ID NO: 160468 - DNA, 35 bp, Artificial Sequence
  Synthetic oligonucleotide
tgcaccaccaaatcgtacaccacccagtattttga

SEQ ID NO: 160469 - DNA, 35 bp, Artificial Sequence
  Synthetic oligonucleotide
gccccctcaatcttcaccgcctgttcacaacgata

SEQ ID NO: 160470 - DNA, 36 bp, Artificial Sequence
  Synthetic oligonucleotide
tccctctctgtctgccgcctcatttgcccttgccta

SEQ ID NO: 160471 - DNA, 36 bp, Artificial Sequence
  Synthetic oligonucleotide
tatccgacgttcggtccagttactgcccttttccta

SEQ ID NO: 160472 - DNA, 36 bp, Artificial Sequence
  Synthetic oligonucleotide
gcgaacccgccgccgtttacccgcccgatgtatcta

SEQ ID NO: 160473 - DNA, 36 bp, Artificial Sequence
  Synthetic oligonucleotide
actcccgccctccctcgagtatattcccaacttcta

SEQ ID NO: 160474 - DNA, 35 bp, Artificial Sequence
  Synthetic oligonucleotide
ccaccctccgttcctccaggtgtacgccccccgta

SEQ ID NO: 160475 - DNA, 36 bp, Artificial Sequence
  Synthetic oligonucleotide
gccgcctagtagttccctctcactgacctcgccgta

SEQ ID NO: 160476 - DNA, 35 bp, Artificial Sequence
  Synthetic oligonucleotide
accccacgtctggacgcgcctcctgacattatcac

SEQ ID NO: 160477 - DNA, 35 bp, Artificial Sequence
  Synthetic oligonucleotide
tcagcctccctgctactgttcgtcgtcccacatac

SEQ ID NO: 160478 - DNA, 35 bp, Artificial Sequence
  Synthetic oligonucleotide
gtcgacattgcgtctcccgactcgtaacatccacc

SEQ ID NO: 160479 - DNA, 35 bp, Artificial Sequence
  Synthetic oligonucleotide
accattgtagcgaatattgctccggcccttccacc

SEQ ID NO: 160480 - DNA, 35 bp, Artificial Sequence
  Synthetic oligonucleotide
atggccgccacctctccataactgctgtgatgccc

SEQ ID NO: 160481 - DNA, 35 bp, Artificial Sequence
  Synthetic oligonucleotide
tgcgagtgctccctgccatgtacagctcccttccc

SEQ ID NO: 160482 - DNA, 35 bp, Artificial Sequence
  Synthetic oligonucleotide
atcgatctccctgctgtaaactgtcctcatttccc

SEQ ID NO: 160483 - DNA, 35 bp, Artificial Sequence
  Synthetic oligonucleotide
gcgagatgcgtcctccacctcaccgtccctgcgcc

SEQ ID NO: 160484 - DNA, 35 bp, Artificial Sequence
  Synthetic oligonucleotide
acgtgagcgattagatgtccttcgtcctgccatcc

SEQ ID NO: 160485 - DNA, 35 bp, Artificial Sequence
  Synthetic oligonucleotide
tctcaaccccgtgcacttgcccacatagcaactcc

SEQ ID NO: 160486 - DNA, 35 bp, Artificial Sequence
  Synthetic oligonucleotide
gacgcgactgccgtcccaccgccccaagtcactcc

SEQ ID NO: 160487 - DNA, 35 bp, Artificial Sequence
  Synthetic oligonucleotide
gccgcggcctgcagctatactctttcttaccctcc

SEQ ID NO: 160488 - DNA, 35 bp, Artificial Sequence
  Synthetic oligonucleotide
tgcgatccccctctgctgttttttcttgctcctcc

SEQ ID NO: 160489 - DNA, 35 bp, Artificial Sequence
  Synthetic oligonucleotide
gtgacagagcagttacagtccgattctcccgctcc

SEQ ID NO: 160490 - DNA, 35 bp, Artificial Sequence
  Synthetic oligonucleotide
tcgccgcacacccatgtcaactatactttccgtcc

SEQ ID NO: 160491 - DNA, 35 bp, Artificial Sequence
  Synthetic oligonucleotide
gtctgccgatccgcctggcccttcccagatgttcc

SEQ ID NO: 160492 - DNA, 35 bp, Artificial Sequence
  Synthetic oligonucleotide
tgtgaaactgcgttctccgccgcccctcgtgttcc

SEQ ID NO: 160493 - DNA, 35 bp, Artificial Sequence
  Synthetic oligonucleotide
tcaccaaccggctgcattgcctacgtactcctcgc

SEQ ID NO: 160494 - DNA, 35 bp, Artificial Sequence
  Synthetic oligonucleotide
tatcacccccggccactgggcccgtattgtccatc

SEQ ID NO: 160495 - DNA, 35 bp, Artificial Sequence
  Synthetic oligonucleotide
tgcatcgaatgtacaccaccgacgcttaccacctc

SEQ ID NO: 160496 - DNA, 35 bp, Artificial Sequence
  Synthetic oligonucleotide
tagctccaccatatgcccccttagtgcccggcctc

SEQ ID NO: 160497 - DNA, 35 bp, Artificial Sequence
  Synthetic oligonucleotide
agccgccgctaccatcctaatcgtctgttctgctc

SEQ ID NO: 160498 - DNA, 35 bp, Artificial Sequence
  Synthetic oligonucleotide
gatcgcagggcgagccatctaacacactctctttc

SEQ ID NO: 160499 - DNA, 35 bp, Artificial Sequence
  Synthetic oligonucleotide
ttgttcccccagtaatgcttggctgaccgtttttc

SEQ ID NO: 160500 - DNA, 35 bp, Artificial Sequence
  Synthetic oligonucleotide
atcggtcatgtaccctccgcatcgcccttctgccg

SEQ ID NO: 160501 - DNA, 35 bp, Artificial Sequence
  Synthetic oligonucleotide
actacgtcaccttcccctgtgcccctccgagatcg

SEQ ID NO: 160502 - DNA, 35 bp, Artificial Sequence
  Synthetic oligonucleotide
gccgagcagtcacatttccatgacctctacattcg

SEQ ID NO: 160503 - DNA, 35 bp, Artificial Sequence
  Synthetic oligonucleotide
gtgtcgtacctgaatcttctcctccaccgagttcg

SEQ ID NO: 160504 - DNA, 35 bp, Artificial Sequence
  Synthetic oligonucleotide
aaacccacgcaccatccagcacctcactgccgagg

SEQ ID NO: 160505 - DNA, 35 bp, Artificial Sequence
  Synthetic oligonucleotide
tccgctccatagtacactgtcccttcatcccgcgg

SEQ ID NO: 160506 - DNA, 35 bp, Artificial Sequence
  Synthetic oligonucleotide
tccccgctacacgagctgtcgtcctccctcattgg

SEQ ID NO: 160507 - DNA, 35 bp, Artificial Sequence
  Synthetic oligonucleotide
tgtcgaccccgcactcctaggactgcccttcactg

SEQ ID NO: 160508 - DNA, 35 bp, Artificial Sequence
  Synthetic oligonucleotide
gcatccgcgtgggtccccgcaatccctcttctctg

SEQ ID NO: 160509 - DNA, 35 bp, Artificial Sequence
  Synthetic oligonucleotide
acacacctcctaacatgttcgccgttccgctcttg

SEQ ID NO: 160510 - DNA, 35 bp, Artificial Sequence
  Synthetic oligonucleotide
ttcacaagcttccgccgcatccccgcccctagttg

SEQ ID NO: 160511 - DNA, 35 bp, Artificial Sequence
  Synthetic oligonucleotide
gccgcgatcgcgttgttccccacctatgatcgttg

SEQ ID NO: 160512 - DNA, 35 bp, Artificial Sequence
  Synthetic oligonucleotide
actccgcaacgcaccgtttcccaccacgttgcact

SEQ ID NO: 160513 - DNA, 31 bp, Artificial Sequence
  Synthetic oligonucleotide
gaaaccgcagttgtccctgttcgcctgccct

SEQ ID NO: 160514 - DNA, 35 bp, Artificial Sequence
  Synthetic oligonucleotide
gaacaccccatattccacccgtttgccacaggtct

SEQ ID NO: 160515 - DNA, 35 bp, Artificial Sequence
  Synthetic oligonucleotide
gcaccatggctaccccttccacccgccccttgggt

SEQ ID NO: 160516 - DNA, 35 bp, Artificial Sequence
  Synthetic oligonucleotide
gttggcacgcaggtcacccgttgctctccttctgt

SEQ ID NO: 160517 - DNA, 35 bp, Artificial Sequence
  Synthetic oligonucleotide
ccagatcacgggaggggtaggagggaggggatatt

SEQ ID NO: 160518 - DNA, 35 bp, Artificial Sequence
  Synthetic oligonucleotide
gcccatcgccacagtttgcctttgtctcttaattt

SEQ ID NO: 160519 - DNA, 35 bp, Artificial Sequence
  Synthetic oligonucleotide
atcgccgccattttaggtgcgctacatctttcttt

SEQ ID NO: 160520 - DNA, 34 bp, Artificial Sequence
  Synthetic oligonucleotide
attacccaccgccccaccttcgatacgaatgttt

SEQ ID NO: 160521 - DNA, 36 bp, Artificial Sequence
  Synthetic oligonucleotide
taaggactagggtggggaagggtgagggtcgttcaa

SEQ ID NO: 160522 - DNA, 35 bp, Artificial Sequence
  Synthetic oligonucleotide
gttgggggggggttgcaggggaggggcgttgagaa

SEQ ID NO: 160523 - DNA, 35 bp, Artificial Sequence
  Synthetic oligonucleotide
tccctccccctccccgtgtcatctgagtgcgcgaa

SEQ ID NO: 160524 - DNA, 36 bp, Artificial Sequence
  Synthetic oligonucleotide
gctgacctcccttgcgagcgagccactctcctctaa

SEQ ID NO: 160525 - DNA, 36 bp, Artificial Sequence
  Synthetic oligonucleotide
tacgcatccagtgcgttgtgcccttccttcccccca

SEQ ID NO: 160526 - DNA, 35 bp, Artificial Sequence
  Synthetic oligonucleotide
gcattccccacgccttcgaccacaggtggtcttca

SEQ ID NO: 160527 - DNA, 37 bp, Artificial Sequence
  Synthetic oligonucleotide
tgagagggaggaggaggggcagtaaagttaccgcaga

SEQ ID NO: 160528 - DNA, 37 bp, Artificial Sequence
  Synthetic oligonucleotide
tgaaagtggggtgggcacggaggaactatggaggaga

SEQ ID NO: 160529 - DNA, 37 bp, Artificial Sequence
  Synthetic oligonucleotide
ggaaccagggggtgggatggggggaagtagcatgaga

SEQ ID NO: 160530 - DNA, 37 bp, Artificial Sequence
  Synthetic oligonucleotide
gggtgggacgggggggttaggagtgtgtgattctaga

SEQ ID NO: 160531 - DNA, 37 bp, Artificial Sequence
  Synthetic oligonucleotide
gcaccagacgcacgtcctcagcctgttcctcttacga

SEQ ID NO: 160532 - DNA, 37 bp, Artificial Sequence
  Synthetic oligonucleotide
gtgatcacccaatgtcgttttccactcactaccccga

SEQ ID NO: 160533 - DNA, 37 bp, Artificial Sequence
  Synthetic oligonucleotide
ccactgccagtgtcaaccgcctccgttctcctcccga

SEQ ID NO: 160534 - DNA, 37 bp, Artificial Sequence
  Synthetic oligonucleotide
gggaccacacctaggtattcttcgcccctgcctccga

SEQ ID NO: 160535 - DNA, 37 bp, Artificial Sequence
  Synthetic oligonucleotide
tgccctcctccggttttagtgcctccttcccaagcga

SEQ ID NO: 160536 - DNA, 37 bp, Artificial Sequence
  Synthetic oligonucleotide
gacaggaggaggtcgtacatcagggaaaggggggcga

SEQ ID NO: 160537 - DNA, 37 bp, Artificial Sequence
  Synthetic oligonucleotide
tcacccctccgtagtatctgctacagcacttgttcga

SEQ ID NO: 160538 - DNA, 37 bp, Artificial Sequence
  Synthetic oligonucleotide
ggggggggcgggcgaaagggattctcattaacaatga

SEQ ID NO: 160539 - DNA, 38 bp, Artificial Sequence
  Synthetic oligonucleotide
tgggaaggaggggggggtagtgggtgatccggcgatga

SEQ ID NO: 160540 - DNA, 38 bp, Artificial Sequence
  Synthetic oligonucleotide
gcaccgcgcctagcccgatcctcattgtccatccctga

SEQ ID NO: 160541 - DNA, 38 bp, Artificial Sequence
  Synthetic oligonucleotide
gacacccgtcgcgctgctgatctactgatgctccctga

SEQ ID NO: 160542 - DNA, 38 bp, Artificial Sequence
  Synthetic oligonucleotide
agtacgaccgtgctctttccgtccctgcttcactctga

SEQ ID NO: 160543 - DNA, 36 bp, Artificial Sequence
  Synthetic oligonucleotide
acagtgctcacggtcgccttctgtaaccccttctga

SEQ ID NO: 160544 - DNA, 38 bp, Artificial Sequence
  Synthetic oligonucleotide
aggaacgtgggaagggcgagtagaaagcgggagggtga

SEQ ID NO: 160545 - DNA, 38 bp, Artificial Sequence
  Synthetic oligonucleotide
tcccaccacactttttgttaacgacctttcttaattga

SEQ ID NO: 160546 - DNA, 38 bp, Artificial Sequence
  Synthetic oligonucleotide
ttgcactgcccactggagtcctcgacacacgcccttga

SEQ ID NO: 160547 - DNA, 37 bp, Artificial Sequence
  Synthetic oligonucleotide
tgcaggaaggagactgggtgggatcgggcagggttga

SEQ ID NO: 160548 - DNA, 38 bp, Artificial Sequence
  Synthetic oligonucleotide
gtgacttcacgccttgtaccctcccgtcaccctgttga

SEQ ID NO: 160549 - DNA, 36 bp, Artificial Sequence
  Synthetic oligonucleotide
gcaccacgttgcattctttctttgccgacccgccta

SEQ ID NO: 160550 - DNA, 36 bp, Artificial Sequence
  Synthetic oligonucleotide
gccctcccgcccctatatctgggtgagcccgcttta

SEQ ID NO: 160551 - DNA, 35 bp, Artificial Sequence
  Synthetic oligonucleotide
gtaccccgccaacccgctcttatccggaaaacacc

SEQ ID NO: 160552 - DNA, 35 bp, Artificial Sequence
  Synthetic oligonucleotide
acacacacctgacgtttgtaacttctttttgcacc

SEQ ID NO: 160553 - DNA, 35 bp, Artificial Sequence
  Synthetic oligonucleotide
accgcctccagccccatggtatggccctgtgcccc

SEQ ID NO: 160554 - DNA, 35 bp, Artificial Sequence
  Synthetic oligonucleotide
tgtcccaccagtgccaccatcaccagtccccgccc

SEQ ID NO: 160555 - DNA, 35 bp, Artificial Sequence
  Synthetic oligonucleotide
gatctgtaagacaccccgatacccgagcctcgccc

SEQ ID NO: 160556 - DNA, 35 bp, Artificial Sequence
  Synthetic oligonucleotide
tcccggtaccatttgttcctgtctgtcgttttccc

SEQ ID NO: 160557 - DNA, 36 bp, Artificial Sequence
  Synthetic oligonucleotide
acgctggcgccaggtccctctctgctcccgcccgcc

SEQ ID NO: 160558 - DNA, 35 bp, Artificial Sequence
  Synthetic oligonucleotide
ttgactcaacccgatgatcttattgtcccactgcc

SEQ ID NO: 160559 - DNA, 35 bp, Artificial Sequence
  Synthetic oligonucleotide
ggtggagggggggccgtggtgggcatcaggcaagc

SEQ ID NO: 160560 - DNA, 35 bp, Artificial Sequence
  Synthetic oligonucleotide
attgtcctcgatcttgtgcctcaagcctccccagc

SEQ ID NO: 160561 - DNA, 35 bp, Artificial Sequence
  Synthetic oligonucleotide
agacctatcaccactcgtgctaaccccgatcacgc

SEQ ID NO: 160562 - DNA, 35 bp, Artificial Sequence
  Synthetic oligonucleotide
accctgactaacccgccgcatactagctaccgcgc

SEQ ID NO: 160563 - DNA, 35 bp, Artificial Sequence
  Synthetic oligonucleotide
cccccaccgctcacccagcacgatagccgcctcgc

SEQ ID NO: 160564 - DNA, 35 bp, Artificial Sequence
  Synthetic oligonucleotide
gaaccggagaaggggggagccggggttggacgggc

SEQ ID NO: 160565 - DNA, 35 bp, Artificial Sequence
  Synthetic oligonucleotide
gccggtacatcatacctctctataccttgccatgc

SEQ ID NO: 160566 - DNA, 35 bp, Artificial Sequence
  Synthetic oligonucleotide
gaccgcccagcgatggtccgtactctcccccgtgc

SEQ ID NO: 160567 - DNA, 35 bp, Artificial Sequence
  Synthetic oligonucleotide
tatctcgtgcctaagtgtcgtaacaccatcccatc

SEQ ID NO: 160568 - DNA, 35 bp, Artificial Sequence
  Synthetic oligonucleotide
gctcgtgagccccgtttgagtggccctcccctctc

SEQ ID NO: 160569 - DNA, 35 bp, Artificial Sequence
  Synthetic oligonucleotide
gacacccgcacggagttccttatctgcccgctctc

SEQ ID NO: 160570 - DNA, 35 bp, Artificial Sequence
  Synthetic oligonucleotide
tagcggggtggggtgggcatgtggggaaacttgtc

SEQ ID NO: 160571 - DNA, 35 bp, Artificial Sequence
  Synthetic oligonucleotide
gagcctgccttcgtgctgccctaacccgaaacttc

SEQ ID NO: 160572 - DNA, 35 bp, Artificial Sequence
  Synthetic oligonucleotide
gactcggcgacgacgtacgcacatccgccccgttc

SEQ ID NO: 160573 - DNA, 35 bp, Artificial Sequence
  Synthetic oligonucleotide
gtgcctcccaacccgcacgtgtccgcttccgcacg

SEQ ID NO: 160574 - DNA, 35 bp, Artificial Sequence
  Synthetic oligonucleotide
tctaccgccaactctgttctggactcagacccccg

SEQ ID NO: 160575 - DNA, 35 bp, Artificial Sequence
  Synthetic oligonucleotide
tcacgtatccatcctgtaacttatgctctgccccg

SEQ ID NO: 160576 - DNA, 35 bp, Artificial Sequence
  Synthetic oligonucleotide
gaaggaagggggaggcgtaaattcaagaggggtcg

SEQ ID NO: 160577 - DNA, 35 bp, Artificial Sequence
  Synthetic oligonucleotide
gttacgtccttttcccctccgcgccatgaatttcg

SEQ ID NO: 160578 - DNA, 35 bp, Artificial Sequence
  Synthetic oligonucleotide
atgaccgtggggggataattagggtaagggtaagg

SEQ ID NO: 160579 - DNA, 35 bp, Artificial Sequence
  Synthetic oligonucleotide
acattcgtccgcgccgtctaccttatccctccatg

SEQ ID NO: 160580 - DNA, 34 bp, Artificial Sequence
  Synthetic oligonucleotide
acacgtgggggggggggcagggatacggtttatg

SEQ ID NO: 160581 - DNA, 35 bp, Artificial Sequence
  Synthetic oligonucleotide
tcccccacccaatactgcggtcgctgccccccctg

SEQ ID NO: 160582 - DNA, 35 bp, Artificial Sequence
  Synthetic oligonucleotide
acgccccactagctgcattccgtcgttcccttttg

SEQ ID NO: 160583 - DNA, 35 bp, Artificial Sequence
  Synthetic oligonucleotide
tactcttgcccatcgtgtccagttcccgcttacat

SEQ ID NO: 160584 - DNA, 35 bp, Artificial Sequence
  Synthetic oligonucleotide
tgcgtcgccgctgaactatcctttctcatccctat

SEQ ID NO: 160585 - DNA, 35 bp, Artificial Sequence
  Synthetic oligonucleotide
gtcctcctcacgtgtgtcttccttggccccttact

SEQ ID NO: 160586 - DNA, 35 bp, Artificial Sequence
  Synthetic oligonucleotide
gatcacactcgcactggcgagccctcgctgaccct

SEQ ID NO: 160587 - DNA, 35 bp, Artificial Sequence
  Synthetic oligonucleotide
gccatccgttgtcattcgcccgtacccgctagcct

SEQ ID NO: 160588 - DNA, 35 bp, Artificial Sequence
  Synthetic oligonucleotide
agcatgactgactaccctgtcgctccactacgcct

SEQ ID NO: 160589 - DNA, 35 bp, Artificial Sequence
  Synthetic oligonucleotide
accaagcgttaatgctttgtcgccgccgtattcct

SEQ ID NO: 160590 - DNA, 35 bp, Artificial Sequence
  Synthetic oligonucleotide
gagagatagccctccgccttttatgtgccccctct

SEQ ID NO: 160591 - DNA, 35 bp, Artificial Sequence
  Synthetic oligonucleotide
actctcacacatgtggccttttttcgttacgctct

SEQ ID NO: 160592 - DNA, 35 bp, Artificial Sequence
  Synthetic oligonucleotide
gttagcgcactgcattcataccgtcctactattct

SEQ ID NO: 160593 - DNA, 35 bp, Artificial Sequence
  Synthetic oligonucleotide
tcctgacccttcattatggcaccgttccatccggt

SEQ ID NO: 160594 - DNA, 36 bp, Artificial Sequence
  Synthetic oligonucleotide
tccacatgggtgcagtcccgccatcccgcccctgaa

SEQ ID NO: 160595 - DNA, 36 bp, Artificial Sequence
  Synthetic oligonucleotide
acctccgcacgcctacgcgctattatgccctaccca

SEQ ID NO: 160596 - DNA, 35 bp, Artificial Sequence
  Synthetic oligonucleotide
gtatccctcaccggttccgagcccaatccgtccca

SEQ ID NO: 160597 - DNA, 35 bp, Artificial Sequence
  Synthetic oligonucleotide
attcgctcaccgccaccgtttttaccactccgcca

SEQ ID NO: 160598 - DNA, 36 bp, Artificial Sequence
  Synthetic oligonucleotide
ggatgcgagacctgctccaactgcttccttctgcca

SEQ ID NO: 160599 - DNA, 36 bp, Artificial Sequence
  Synthetic oligonucleotide
gccccccatcggcgtcataatagtcccccgggtcca

SEQ ID NO: 160600 - DNA, 36 bp, Artificial Sequence
  Synthetic oligonucleotide
tccaacccctccccagcggctcggtctgcgaacgca

SEQ ID NO: 160601 - DNA, 36 bp, Artificial Sequence
  Synthetic oligonucleotide
gaacaccacccatcgtgagacatgcctccttgttca

SEQ ID NO: 160602 - DNA, 36 bp, Artificial Sequence
  Synthetic oligonucleotide
tcctggcccaccaatgctttccgcctctgtcaaaga

SEQ ID NO: 160603 - DNA, 37 bp, Artificial Sequence
  Synthetic oligonucleotide
gagaagaggctcgggggtcggggggaggagggcgaga

SEQ ID NO: 160604 - DNA, 37 bp, Artificial Sequence
  Synthetic oligonucleotide
gatcgcgcctgcaacccctgtaccttccctcgtgaga

SEQ ID NO: 160605 - DNA, 37 bp, Artificial Sequence
  Synthetic oligonucleotide
agggcgggtcactcttctgtcctccacttctagccga

SEQ ID NO: 160606 - DNA, 37 bp, Artificial Sequence
  Synthetic oligonucleotide
tccgtacgcgcgctagatccgcctaattcacctccga

SEQ ID NO: 160607 - DNA, 37 bp, Artificial Sequence
  Synthetic oligonucleotide
ttcacgcctgccccagatcccccggtatgccctccga

SEQ ID NO: 160608 - DNA, 37 bp, Artificial Sequence
  Synthetic oligonucleotide
gagagcggaaagggcggggtgggcgtagcaaaagcga

SEQ ID NO: 160609 - DNA, 37 bp, Artificial Sequence
  Synthetic oligonucleotide
tccgtaccccggccctctttttgaagcgaagcttcga

SEQ ID NO: 160610 - DNA, 37 bp, Artificial Sequence
  Synthetic oligonucleotide
gattgaggggcgtggtggggcaagggctagagacgga

SEQ ID NO: 160611 - DNA, 37 bp, Artificial Sequence
  Synthetic oligonucleotide
gaggggaagacggaggtaggaatacatggagaaggga

SEQ ID NO: 160612 - DNA, 37 bp, Artificial Sequence
  Synthetic oligonucleotide
gattcacccgtccgtcgcccatccacacgctcaggga

SEQ ID NO: 160613 - DNA, 37 bp, Artificial Sequence
  Synthetic oligonucleotide
atactgctggtcatacaatgggcgggagggataggga

SEQ ID NO: 160614 - DNA, 37 bp, Artificial Sequence
  Synthetic oligonucleotide
gagggggagggtaagagcaccgtgggcggagagggga

SEQ ID NO: 160615 - DNA, 37 bp, Artificial Sequence
  Synthetic oligonucleotide
acgaggagtaggggtcggcttaagcgggtggcgggga

SEQ ID NO: 160616 - DNA, 37 bp, Artificial Sequence
  Synthetic oligonucleotide
gccacctccgccacagccccgctctagtaccactgga

SEQ ID NO: 160617 - DNA, 38 bp, Artificial Sequence
  Synthetic oligonucleotide
ggagggcgggcgggtcaccaaggcgtaagggaaactga

SEQ ID NO: 160618 - DNA, 37 bp, Artificial Sequence
  Synthetic oligonucleotide
acacgaggtgagaggacgaacggacggagggaactga

SEQ ID NO: 160619 - DNA, 37 bp, Artificial Sequence
  Synthetic oligonucleotide
tacgcagtctcccctagctgttccaccgattccctga

SEQ ID NO: 160620 - DNA, 38 bp, Artificial Sequence
  Synthetic oligonucleotide
acatcgcctgctagtaccgccccattgcttactcctga

SEQ ID NO: 160621 - DNA, 37 bp, Artificial Sequence
  Synthetic oligonucleotide
actggtcccctctattgccctgtccatccgttcctga

SEQ ID NO: 160622 - DNA, 38 bp, Artificial Sequence
  Synthetic oligonucleotide
gcgtacgtcagtacgcgtcccttctctcttcgggctga

SEQ ID NO: 160623 - DNA, 36 bp, Artificial Sequence
  Synthetic oligonucleotide
agggagggttagggaggacggggagaacagatctga

SEQ ID NO: 160624 - DNA, 38 bp, Artificial Sequence
  Synthetic oligonucleotide
gggggaggaaacgatgggcagaggtgacggcgatgtga

SEQ ID NO: 160625 - DNA, 38 bp, Artificial Sequence
  Synthetic oligonucleotide
tccctagccccagatgccgtcctcacccttctcattga

SEQ ID NO: 160626 - DNA, 38 bp, Artificial Sequence
  Synthetic oligonucleotide
tcccatccactggttgctctccctctcatgctccttga

SEQ ID NO: 160627 - DNA, 38 bp, Artificial Sequence
  Synthetic oligonucleotide
tcatggtgtcggatgtgtgggcggaggtgggggcttga

SEQ ID NO: 160628 - DNA, 36 bp, Artificial Sequence
  Synthetic oligonucleotide
gcagtagcgcatctatccgggccgcacctctcttga

SEQ ID NO: 160629 - DNA, 38 bp, Artificial Sequence
  Synthetic oligonucleotide
tgtcaccctcagcggaagtccttcgcttccaccgttga

SEQ ID NO: 160630 - DNA, 36 bp, Artificial Sequence
  Synthetic oligonucleotide
gggggggacgggttggacgggggtgggcgaatttga

SEQ ID NO: 160631 - DNA, 36 bp, Artificial Sequence
  Synthetic oligonucleotide
acatgtccgttcgaccaataatcctgcctgttccta

SEQ ID NO: 160632 - DNA, 35 bp, Artificial Sequence
  Synthetic oligonucleotide
atggttgtagctcactgcctttcccgtttttccta

SEQ ID NO: 160633 - DNA, 36 bp, Artificial Sequence
  Synthetic oligonucleotide
tcccgcctttcagttcgctttattcggtccttgcta

SEQ ID NO: 160634 - DNA, 34 bp, Artificial Sequence
  Synthetic oligonucleotide
gatagcccgcccaggtctctgttctgccttcgta

SEQ ID NO: 160635 - DNA, 36 bp, Artificial Sequence
  Synthetic oligonucleotide
agttggagcgcggggtttggttcggggtgggtggta

SEQ ID NO: 160636 - DNA, 35 bp, Artificial Sequence
  Synthetic oligonucleotide
tgtatgtgccggtctgcatacgccttcattcatta

SEQ ID NO: 160637 - DNA, 36 bp, Artificial Sequence
  Synthetic oligonucleotide
taacaacctcctgccttgagcccgaccgcaccttta

SEQ ID NO: 160638 - DNA, 34 bp, Artificial Sequence
  Synthetic oligonucleotide
gaattgccgcacgccactccctatacgccttaac

SEQ ID NO: 160639 - DNA, 35 bp, Artificial Sequence
  Synthetic oligonucleotide
tccaccgcccagctttgctcctcaccatcacacac

SEQ ID NO: 160640 - DNA, 35 bp, Artificial Sequence
  Synthetic oligonucleotide
aaccctcctcgatagttaagctcttgtcccgttac

SEQ ID NO: 160641 - DNA, 35 bp, Artificial Sequence
  Synthetic oligonucleotide
tgcaggcccacccttctccgtactatctgtaaacc

SEQ ID NO: 160642 - DNA, 35 bp, Artificial Sequence
  Synthetic oligonucleotide
gatccaccgtcctgcgtatgcacgccacatccacc

SEQ ID NO: 160643 - DNA, 35 bp, Artificial Sequence
  Synthetic oligonucleotide
ggtcacccagggctgctccttgtcgacctcctacc

SEQ ID NO: 160644 - DNA, 35 bp, Artificial Sequence
  Synthetic oligonucleotide
tatgcgctcctggtcattcttcgcttctcgcaccc

SEQ ID NO: 160645 - DNA, 35 bp, Artificial Sequence
  Synthetic oligonucleotide
atgacgtgtcagtccgatgacgcacgtatcccccc

SEQ ID NO: 160646 - DNA, 35 bp, Artificial Sequence
  Synthetic oligonucleotide
gtgcaggtacccttgctcaccatcgaacggtcccc

SEQ ID NO: 160647 - DNA, 35 bp, Artificial Sequence
  Synthetic oligonucleotide
aagccccgccgacccaaacctatcttgacctgccc

SEQ ID NO: 160648 - DNA, 35 bp, Artificial Sequence
  Synthetic oligonucleotide
taggctcgcccacgttcgtatcgtcgttacccgcc

SEQ ID NO: 160649 - DNA, 35 bp, Artificial Sequence
  Synthetic oligonucleotide
atccactgcactgtacccatcacgacttcgcatcc

SEQ ID NO: 160650 - DNA, 35 bp, Artificial Sequence
  Synthetic oligonucleotide
accccgtcacccttttgaaattcgtacggcactcc

SEQ ID NO: 160651 - DNA, 35 bp, Artificial Sequence
  Synthetic oligonucleotide
atgtctgctatgcgcgctcgtccactgcctcctcc

SEQ ID NO: 160652 - DNA, 35 bp, Artificial Sequence
  Synthetic oligonucleotide
tccgcaagtcgtgctccttccacgcgttttcctcc

SEQ ID NO: 160653 - DNA, 35 bp, Artificial Sequence
  Synthetic oligonucleotide
aacgccaccaccacccgggaggagagcttgtctcc

SEQ ID NO: 160654 - DNA, 35 bp, Artificial Sequence
  Synthetic oligonucleotide
gaccgagtcgatggctctttctttctcgttggtcc

SEQ ID NO: 160655 - DNA, 35 bp, Artificial Sequence
  Synthetic oligonucleotide
gtctcaggggcttgcaccgttcttcccccctgtcc

SEQ ID NO: 160656 - DNA, 35 bp, Artificial Sequence
  Synthetic oligonucleotide
tgctgaccggtttacgccctcgccactaatgttcc

SEQ ID NO: 160657 - DNA, 35 bp, Artificial Sequence
  Synthetic oligonucleotide
gccacccggtcaccgctttggacgccttgcttcgc

SEQ ID NO: 160658 - DNA, 35 bp, Artificial Sequence
  Synthetic oligonucleotide
atgcaactcggaacccctccgcccctcctctcatc

SEQ ID NO: 160659 - DNA, 35 bp, Artificial Sequence
  Synthetic oligonucleotide
tactaaccggtcctatttcacgcctgcctgctatc

SEQ ID NO: 160660 - DNA, 35 bp, Artificial Sequence
  Synthetic oligonucleotide
tgtcacccacgcgatctcccctaccggcttacctc

SEQ ID NO: 160661 - DNA, 35 bp, Artificial Sequence
  Synthetic oligonucleotide
acattcgtcacccgaccctgacgtattgttccttc

SEQ ID NO: 160662 - DNA, 35 bp, Artificial Sequence
  Synthetic oligonucleotide
tgtgaccacctgtattccctctcacatgctgtttc

SEQ ID NO: 160663 - DNA, 35 bp, Artificial Sequence
  Synthetic oligonucleotide
ttaccttcacaccctctcggcctacattaggcacg

SEQ ID NO: 160664 - DNA, 35 bp, Artificial Sequence
  Synthetic oligonucleotide
gatccaggtcataaagctaacccgccctcttcacg

SEQ ID NO: 160665 - DNA, 35 bp, Artificial Sequence
  Synthetic oligonucleotide
actccgtcacaactcgatgagctcgcctttacccg

SEQ ID NO: 160666 - DNA, 35 bp, Artificial Sequence
  Synthetic oligonucleotide
gtacacgctttgatatgtcacccaccccttacgcg

SEQ ID NO: 160667 - DNA, 35 bp, Artificial Sequence
  Synthetic oligonucleotide
gattcaggcaaggggagggtcggggcgaaggtcgg

SEQ ID NO: 160668 - DNA, 35 bp, Artificial Sequence
  Synthetic oligonucleotide
gtatggtacggaacggaaggaataatgggatgggg

SEQ ID NO: 160669 - DNA, 35 bp, Artificial Sequence
  Synthetic oligonucleotide
ttgccaccatacctgctcattctacttgccttggg

SEQ ID NO: 160670 - DNA, 35 bp, Artificial Sequence
  Synthetic oligonucleotide
attcgccgtctggtgccgcctattacgttatcctg

SEQ ID NO: 160671 - DNA, 35 bp, Artificial Sequence
  Synthetic oligonucleotide
taatcgcgatccgcacgttaccggccctactgcat

SEQ ID NO: 160672 - DNA, 34 bp, Artificial Sequence
  Synthetic oligonucleotide
acgatcccgggccctccgctttcatttggaaact

SEQ ID NO: 160673 - DNA, 35 bp, Artificial Sequence
  Synthetic oligonucleotide
acaccaccgcctttgctccaacgatcatggtccct

SEQ ID NO: 160674 - DNA, 35 bp, Artificial Sequence
  Synthetic oligonucleotide
gtacaccttggccccgaatatcccgtttccgtgct

SEQ ID NO: 160675 - DNA, 35 bp, Artificial Sequence
  Synthetic oligonucleotide
tctgccaatcgcccatctcacccaagcagttatct

SEQ ID NO: 160676 - DNA, 35 bp, Artificial Sequence
  Synthetic oligonucleotide
agacagccgcctgctactcttacaagggcccctct

SEQ ID NO: 160677 - DNA, 35 bp, Artificial Sequence
  Synthetic oligonucleotide
gcgatcgcacctccgctcccatccttaagacttct

SEQ ID NO: 160678 - DNA, 35 bp, Artificial Sequence
  Synthetic oligonucleotide
gtaccgggggaaaggggtaggagtggggttgtcgt

SEQ ID NO: 160679 - DNA, 35 bp, Artificial Sequence
  Synthetic oligonucleotide
gcactcctccgcacccgccctgcctgtttaccatt

SEQ ID NO: 160680 - DNA, 35 bp, Artificial Sequence
  Synthetic oligonucleotide
acacccccatgtatgtttgcgtactttgattactt

SEQ ID NO: 160681 - DNA, 36 bp, Artificial Sequence
  Synthetic oligonucleotide
gccctcatcgcgttctccaccagtggccacaacctt

SEQ ID NO: 160682 - DNA, 35 bp, Artificial Sequence
  Synthetic oligonucleotide
gaccggaacctgcgctgtcagacctctcacgcctt

SEQ ID NO: 160683 - DNA, 35 bp, Artificial Sequence
  Synthetic oligonucleotide
tgtaccaacaccactcgcgtataaccgcggtattt

SEQ ID NO: 160684 - DNA, 35 bp, Artificial Sequence
  Synthetic oligonucleotide
acgccgttgccgccgcccgacacccccgataggaa

SEQ ID NO: 160685 - DNA, 36 bp, Artificial Sequence
  Synthetic oligonucleotide
accaccgatcgcatcgtgcttactcctgctttggaa

SEQ ID NO: 160686 - DNA, 36 bp, Artificial Sequence
  Synthetic oligonucleotide
atcctgccccttccattgtagccgtccgagccctaa

SEQ ID NO: 160687 - DNA, 36 bp, Artificial Sequence
  Synthetic oligonucleotide
aaaacagggtcgggggggtccaagggcaaggagtaa

SEQ ID NO: 160688 - DNA, 36 bp, Artificial Sequence
  Synthetic oligonucleotide
tagggcatgtctgcgctattccaccttgcttcacca

SEQ ID NO: 160689 - DNA, 35 bp, Artificial Sequence
  Synthetic oligonucleotide
gaggccccgaacacccccgtgaatcgcacctccca

SEQ ID NO: 160690 - DNA, 36 bp, Artificial Sequence
  Synthetic oligonucleotide
tacatgcccttcgcgatctactatgacacctacgca

SEQ ID NO: 160691 - DNA, 35 bp, Artificial Sequence
  Synthetic oligonucleotide
acaccgccctctggactatagcgccgctttcatca

SEQ ID NO: 160692 - DNA, 36 bp, Artificial Sequence
  Synthetic oligonucleotide
gtcgtctagccgggagggggggtacgggtggactca

SEQ ID NO: 160693 - DNA, 35 bp, Artificial Sequence
  Synthetic oligonucleotide
acagcctggtcccgtgctgtcgaacacttctctca

SEQ ID NO: 160694 - DNA, 36 bp, Artificial Sequence
  Synthetic oligonucleotide
acgtagacgcccaattggctcctccacctgtattca

SEQ ID NO: 160695 - DNA, 36 bp, Artificial Sequence
  Synthetic oligonucleotide
tgcgacccccggctttccgttactcggttcatttca

SEQ ID NO: 160696 - DNA, 37 bp, Artificial Sequence
  Synthetic oligonucleotide
gtgatgggacgatggaacggcggggatcaagaagaga

SEQ ID NO: 160697 - DNA, 37 bp, Artificial Sequence
  Synthetic oligonucleotide
gtccacgtgggaaagaggggcggaaaaggagaagaga

SEQ ID NO: 160698 - DNA, 37 bp, Artificial Sequence
  Synthetic oligonucleotide
atgtgcgctagccctatttaggccctgttccccccga

SEQ ID NO: 160699 - DNA, 35 bp, Artificial Sequence
  Synthetic oligonucleotide
aacgacatggggagggaaattggggaaacgcagga

SEQ ID NO: 160700 - DNA, 36 bp, Artificial Sequence
  Synthetic oligonucleotide
gtccccgcaccgcctgcaccctccctacccctggga

SEQ ID NO: 160701 - DNA, 37 bp, Artificial Sequence
  Synthetic oligonucleotide
gtagatgacaacggggggggaaagggactgacgtgga

SEQ ID NO: 160702 - DNA, 38 bp, Artificial Sequence
  Synthetic oligonucleotide
tccaccctccgcctgtcccgtgtccgcctagctagtga

SEQ ID NO: 160703 - DNA, 36 bp, Artificial Sequence
  Synthetic oligonucleotide
gttgacatctccgttccatacgttccttcaccgtga

SEQ ID NO: 160704 - DNA, 37 bp, Artificial Sequence
  Synthetic oligonucleotide
gtcagttccctctggtatcatccgcccgtgcccgtga

SEQ ID NO: 160705 - DNA, 38 bp, Artificial Sequence
  Synthetic oligonucleotide
atcaatcctcctgtcgttagtccaccgctctcccgtga

SEQ ID NO: 160706 - DNA, 38 bp, Artificial Sequence
  Synthetic oligonucleotide
agcccgcctcgctttatttgcccactcactttccgtga

SEQ ID NO: 160707 - DNA, 37 bp, Artificial Sequence
  Synthetic oligonucleotide
tgggtgccgtcgcgctcccgttctatcttcacattga

SEQ ID NO: 160708 - DNA, 38 bp, Artificial Sequence
  Synthetic oligonucleotide
tgaagcgctcggcatccgttgtcactcctccgccttga

SEQ ID NO: 160709 - DNA, 38 bp, Artificial Sequence
  Synthetic oligonucleotide
tcagtcgcgcacaccgttacgtccattctctctgttga

SEQ ID NO: 160710 - DNA, 38 bp, Artificial Sequence
  Synthetic oligonucleotide
tagaccgcgcctgcccgcccgcataacactccgtttga

SEQ ID NO: 160711 - DNA, 36 bp, Artificial Sequence
  Synthetic oligonucleotide
ttcaccgccctctatgaccataacattcacggccta

SEQ ID NO: 160712 - DNA, 35 bp, Artificial Sequence
  Synthetic oligonucleotide
atgcccacccctggccgtgcgctttttttctccta

SEQ ID NO: 160713 - DNA, 36 bp, Artificial Sequence
  Synthetic oligonucleotide
tcacacgcctccgccattttagcttgacttggtcta

SEQ ID NO: 160714 - DNA, 35 bp, Artificial Sequence
  Synthetic oligonucleotide
gccgtgagcctctatttgcaaaactcccttcggta

SEQ ID NO: 160715 - DNA, 36 bp, Artificial Sequence
  Synthetic oligonucleotide
tatcatcaccaccgcctcgtttcatgacagtcgtta

SEQ ID NO: 160716 - DNA, 36 bp, Artificial Sequence
  Synthetic oligonucleotide
tcccgccgcacaccaggcatctcgctcgaaccttta

SEQ ID NO: 160717 - DNA, 35 bp, Artificial Sequence
  Synthetic oligonucleotide
tgcacccccgcgtccatcgatcctgctcttgtaac

SEQ ID NO: 160718 - DNA, 35 bp, Artificial Sequence
  Synthetic oligonucleotide
tgctcccgcctctgaaccccaccttatgattacac

SEQ ID NO: 160719 - DNA, 35 bp, Artificial Sequence
  Synthetic oligonucleotide
gtccctcgccatatccgttgctttaatcacaatac

SEQ ID NO: 160720 - DNA, 35 bp, Artificial Sequence
  Synthetic oligonucleotide
tccgtgacggtccatatactgcctttcgtgaaacc

SEQ ID NO: 160721 - DNA, 35 bp, Artificial Sequence
  Synthetic oligonucleotide
atgcccgcctccaaccaggtttacccccttctacc

SEQ ID NO: 160722 - DNA, 35 bp, Artificial Sequence
  Synthetic oligonucleotide
atggacccgtacacgttagttaactgcttcacccc

SEQ ID NO: 160723 - DNA, 35 bp, Artificial Sequence
  Synthetic oligonucleotide
tcgctgggccctccgttctgtttcctcgtagcccc

SEQ ID NO: 160724 - DNA, 35 bp, Artificial Sequence
  Synthetic oligonucleotide
tagatccctgagcctcacccggttgctatgcgccc

SEQ ID NO: 160725 - DNA, 35 bp, Artificial Sequence
  Synthetic oligonucleotide
gtctcccgccaaattgctccctaggcctggttccc

SEQ ID NO: 160726 - DNA, 35 bp, Artificial Sequence
  Synthetic oligonucleotide
gtgacaccgctgccgcttttctccatgtttctgcc

SEQ ID NO: 160727 - DNA, 35 bp, Artificial Sequence
  Synthetic oligonucleotide
tctgccatctatcgctcttggttcctgtttcatcc

SEQ ID NO: 160728 - DNA, 35 bp, Artificial Sequence
  Synthetic oligonucleotide
ttcgcctcagagaagtatgccatctgcccgcctcc

SEQ ID NO: 160729 - DNA, 35 bp, Artificial Sequence
  Synthetic oligonucleotide
gatcactatccgggtacttgtagccccactcttcc

SEQ ID NO: 160730 - DNA, 35 bp, Artificial Sequence
  Synthetic oligonucleotide
ttaggagctgccccatccctgctatgttaagttcc

SEQ ID NO: 160731 - DNA, 35 bp, Artificial Sequence
  Synthetic oligonucleotide
gatacacgctcacagcatcccgatcattccgttcc

SEQ ID NO: 160732 - DNA, 35 bp, Artificial Sequence
  Synthetic oligonucleotide
taacccacgcctcacactccctgaagaagcacagc

SEQ ID NO: 160733 - DNA, 35 bp, Artificial Sequence
  Synthetic oligonucleotide
gtgggagtcgcgcttagctgctatcgttaccctgc

SEQ ID NO: 160734 - DNA, 35 bp, Artificial Sequence
  Synthetic oligonucleotide
aaccctgccggcaccttctcttctcatcaacgtgc

SEQ ID NO: 160735 - DNA, 35 bp, Artificial Sequence
  Synthetic oligonucleotide
gtccacctttccatggagtctatttagtcctcatc

SEQ ID NO: 160736 - DNA, 35 bp, Artificial Sequence
  Synthetic oligonucleotide
tctcccccaccctggcattgccggtattctcgatc

SEQ ID NO: 160737 - DNA, 35 bp, Artificial Sequence
  Synthetic oligonucleotide
gagtgcaccgttcgaacacctattcgcactgcctc

SEQ ID NO: 160738 - DNA, 35 bp, Artificial Sequence
  Synthetic oligonucleotide
gtgcaactcattgaaagcccgtgccgcacatcctc

SEQ ID NO: 160739 - DNA, 35 bp, Artificial Sequence
  Synthetic oligonucleotide
aatgcggtagcacaatgccgttgccttcctttgtc

SEQ ID NO: 160740 - DNA, 35 bp, Artificial Sequence
  Synthetic oligonucleotide
tgtggtcacctctgatcatcttttcaccctccgag

SEQ ID NO: 160741 - DNA, 35 bp, Artificial Sequence
  Synthetic oligonucleotide
tatgtccgtacaccgttctccctgtccaatcaacg

SEQ ID NO: 160742 - DNA, 35 bp, Artificial Sequence
  Synthetic oligonucleotide
tgcgcatgagtccatctcacgtgtccctccccccg

SEQ ID NO: 160743 - DNA, 35 bp, Artificial Sequence
  Synthetic oligonucleotide
tcatagcattcccactccgccgccatttaggcccg

SEQ ID NO: 160744 - DNA, 35 bp, Artificial Sequence
  Synthetic oligonucleotide
ttgacgcgcccgccactgcaataacaccgatcccg

SEQ ID NO: 160745 - DNA, 35 bp, Artificial Sequence
  Synthetic oligonucleotide
gcaacgccccccctgtcatccctcctccgttcgcg

SEQ ID NO: 160746 - DNA, 35 bp, Artificial Sequence
  Synthetic oligonucleotide
gccaccttcggccaattttaaacgcaaactcctcg

SEQ ID NO: 160747 - DNA, 35 bp, Artificial Sequence
  Synthetic oligonucleotide
taatcagtgtaagggggggggagaaatagcgaagg

SEQ ID NO: 160748 - DNA, 35 bp, Artificial Sequence
  Synthetic oligonucleotide
atgacggtacgggagggctggataacccgggtggg

SEQ ID NO: 160749 - DNA, 35 bp, Artificial Sequence
  Synthetic oligonucleotide
gatcctgtccacctctccgttcgaccactctgtgg

SEQ ID NO: 160750 - DNA, 35 bp, Artificial Sequence
  Synthetic oligonucleotide
tcgaaacgtactgccctgttatccgttccgttctg

SEQ ID NO: 160751 - DNA, 35 bp, Artificial Sequence
  Synthetic oligonucleotide
tgaagaggccgccaccccctcccgccactgtcact

SEQ ID NO: 160752 - DNA, 35 bp, Artificial Sequence
  Synthetic oligonucleotide
tgagcgaaagctctccgtaaacttcctgctgccct

SEQ ID NO: 160753 - DNA, 35 bp, Artificial Sequence
  Synthetic oligonucleotide
acgacgcatttgggcctaatccacccccgcctgct

SEQ ID NO: 160754 - DNA, 35 bp, Artificial Sequence
  Synthetic oligonucleotide
tgcacagtacccagcttccgtagccacattcatct

SEQ ID NO: 160755 - DNA, 35 bp, Artificial Sequence
  Synthetic oligonucleotide
tcagtcgaagtcacccgagtctgtctgtaccctct

SEQ ID NO: 160756 - DNA, 35 bp, Artificial Sequence
  Synthetic oligonucleotide
gacgtcactgcttggtaccctgattcccattgtct

SEQ ID NO: 160757 - DNA, 35 bp, Artificial Sequence
  Synthetic oligonucleotide
gacgggagtagaacgagggcaaaggtagctaatgt

SEQ ID NO: 160758 - DNA, 35 bp, Artificial Sequence
  Synthetic oligonucleotide
acgcctagcacggtgacacacgcctttccccctgt

SEQ ID NO: 160759 - DNA, 35 bp, Artificial Sequence
  Synthetic oligonucleotide
aacccttccgccccgtaacgcacatggccttgatt

SEQ ID NO: 160760 - DNA, 35 bp, Artificial Sequence
  Synthetic oligonucleotide
aagacgtccccaccgccctgtttctgtaccaactt

SEQ ID NO: 160761 - DNA, 35 bp, Artificial Sequence
  Synthetic oligonucleotide
tacgctccgccttgtgtcgtttcgctcacttattt

SEQ ID NO: 160762 - DNA, 36 bp, Artificial Sequence
  Synthetic oligonucleotide
tctctagcgcctttcccaccatttcgcgcctgtttt

SEQ ID NO: 160763 - DNA, 36 bp, Artificial Sequence
  Synthetic oligonucleotide
gcaacatctgccccccccgcttaagcacgacgcaaa

SEQ ID NO: 160764 - DNA, 36 bp, Artificial Sequence
  Synthetic oligonucleotide
gtccgccctctcctcggtcgctgtggtacccaccaa

SEQ ID NO: 160765 - DNA, 36 bp, Artificial Sequence
  Synthetic oligonucleotide
gttaccctcgccctccgtacctgctgaccgcagcaa

SEQ ID NO: 160766 - DNA, 35 bp, Artificial Sequence
  Synthetic oligonucleotide
ttgctcgcccaccaattagcacatcctctctgcaa

SEQ ID NO: 160767 - DNA, 36 bp, Artificial Sequence
  Synthetic oligonucleotide
gacagggtagggggggtaagcggatgtataatagaa

SEQ ID NO: 160768 - DNA, 28 bp, Artificial Sequence
  Synthetic oligonucleotide
accatccgactagctgctaacttccaca

SEQ ID NO: 160769 - DNA, 35 bp, Artificial Sequence
  Synthetic oligonucleotide
gtacccacccatgctgcaccacctcgctgggcaca

SEQ ID NO: 160770 - DNA, 35 bp, Artificial Sequence
  Synthetic oligonucleotide
tccccccctggtacctgccccgcccattatgtaca

SEQ ID NO: 160771 - DNA, 36 bp, Artificial Sequence
  Synthetic oligonucleotide
taggggtgaggggcggaggtcaacggaggctgtaca

SEQ ID NO: 160772 - DNA, 35 bp, Artificial Sequence
  Synthetic oligonucleotide
tgccaggtccgacgcgcttctttcctagtacccca

SEQ ID NO: 160773 - DNA, 35 bp, Artificial Sequence
  Synthetic oligonucleotide
acctcgtaggttgtagctcctgtctcccgcctcca

SEQ ID NO: 160774 - DNA, 36 bp, Artificial Sequence
  Synthetic oligonucleotide
gatcgctcccgtagtaataaacctcccgttctcgca

SEQ ID NO: 160775 - DNA, 36 bp, Artificial Sequence
  Synthetic oligonucleotide
gaagccctggcacgtatacgccgtcctccaatctca

SEQ ID NO: 160776 - DNA, 36 bp, Artificial Sequence
  Synthetic oligonucleotide
aacctgttcgcgccggcacctcctgccaccctttca

SEQ ID NO: 160777 - DNA, 35 bp, Artificial Sequence
  Synthetic oligonucleotide
ttcctgatcccccgccacgtactgcaccaagcaga

SEQ ID NO: 160778 - DNA, 37 bp, Artificial Sequence
  Synthetic oligonucleotide
aagccactacagatagcgccctcccatcccactacga

SEQ ID NO: 160779 - DNA, 36 bp, Artificial Sequence
  Synthetic oligonucleotide
aacgtccatcgtacttgttcgcgcgccctccaccga

SEQ ID NO: 160780 - DNA, 37 bp, Artificial Sequence
  Synthetic oligonucleotide
ggatgggtggggatggggagggtgtaatacgattcga

SEQ ID NO: 160781 - DNA, 37 bp, Artificial Sequence
  Synthetic oligonucleotide
gccacccctccggcccctacgatactcgcgacttcga

SEQ ID NO: 160782 - DNA, 37 bp, Artificial Sequence
  Synthetic oligonucleotide
gtgcgcgggtgggagagagggcgggtcaggagcagga

SEQ ID NO: 160783 - DNA, 37 bp, Artificial Sequence
  Synthetic oligonucleotide
tgggggagggagaacgggaaggtgacgagcaatagga

SEQ ID NO: 160784 - DNA, 37 bp, Artificial Sequence
  Synthetic oligonucleotide
accacgggcgtggttgtgttttgttggggagagggga

SEQ ID NO: 160785 - DNA, 37 bp, Artificial Sequence
  Synthetic oligonucleotide
accacatgcaagaggggaaacgggggtggaagatgga

SEQ ID NO: 160786 - DNA, 38 bp, Artificial Sequence
  Synthetic oligonucleotide
ttcgcctgggccatctttctgtatcctgcctcttatga

SEQ ID NO: 160787 - DNA, 38 bp, Artificial Sequence
  Synthetic oligonucleotide
gtcccacccgtctgctgtttcgcccctgccctgcctga

SEQ ID NO: 160788 - DNA, 38 bp, Artificial Sequence
  Synthetic oligonucleotide
accccccctgccctttaccgttgtgatctccgacgtga

SEQ ID NO: 160789 - DNA, 38 bp, Artificial Sequence
  Synthetic oligonucleotide
gttgcgaagggggcggctagaatcgggaggggacgtga

SEQ ID NO: 160790 - DNA, 38 bp, Artificial Sequence
  Synthetic oligonucleotide
tccttccccggcgtcccctgtacccgcgttctacgtga

SEQ ID NO: 160791 - DNA, 38 bp, Artificial Sequence
  Synthetic oligonucleotide
ggggacagttcgtgggggcggggtatgttggctggtga

SEQ ID NO: 160792 - DNA, 36 bp, Artificial Sequence
  Synthetic oligonucleotide
atccggtcgaggggagtatgggtgaaggggatgtga

SEQ ID NO: 160793 - DNA, 37 bp, Artificial Sequence
  Synthetic oligonucleotide
tctcccaaccacctgccctgaatttggcctttcttga

SEQ ID NO: 160794 - DNA, 36 bp, Artificial Sequence
  Synthetic oligonucleotide
gcatgtgccgtttgtttcttcctgctccgacgttga

SEQ ID NO: 160795 - DNA, 38 bp, Artificial Sequence
  Synthetic oligonucleotide
tatacgttagtgcgtccattccaccacccacctgttga

SEQ ID NO: 160796 - DNA, 38 bp, Artificial Sequence
  Synthetic oligonucleotide
tcccacgcaccacctggcacaaatagtcaacgctttga

SEQ ID NO: 160797 - DNA, 35 bp, Artificial Sequence
  Synthetic oligonucleotide
gccatcataacgtccgttcccgccctgcccagcta

SEQ ID NO: 160798 - DNA, 35 bp, Artificial Sequence
  Synthetic oligonucleotide
gttgtaacctcttattgcctccaccgagaccgcta

SEQ ID NO: 160799 - DNA, 36 bp, Artificial Sequence
  Synthetic oligonucleotide
ggagctaacccgctcctgctcctgaagtccaatcta

SEQ ID NO: 160800 - DNA, 36 bp, Artificial Sequence
  Synthetic oligonucleotide
gaaaccctgcctctacccgcgcatcgctccccggta

SEQ ID NO: 160801 - DNA, 35 bp, Artificial Sequence
  Synthetic oligonucleotide
tcccgggttgggagggcattctgggaccactatta

SEQ ID NO: 160802 - DNA, 38 bp, Artificial Sequence
  Synthetic oligonucleotide
tagatccaccgctgcctgcgttatgcccttggccgtta

SEQ ID NO: 160803 - DNA, 35 bp, Artificial Sequence
  Synthetic oligonucleotide
tcctagccgcctactttatggcttatcgtactaac

SEQ ID NO: 160804 - DNA, 35 bp, Artificial Sequence
  Synthetic oligonucleotide
tcagttcgatcgcacgcctcacttcacactgttac

SEQ ID NO: 160805 - DNA, 35 bp, Artificial Sequence
  Synthetic oligonucleotide
gatctccacattagcgttgctcggctacacacccc

SEQ ID NO: 160806 - DNA, 35 bp, Artificial Sequence
  Synthetic oligonucleotide
gaccacatctccgtgatatttttgtgccttcgccc

SEQ ID NO: 160807 - DNA, 35 bp, Artificial Sequence
  Synthetic oligonucleotide
atccaccgctatgccatcatttcctggacttcgcc

SEQ ID NO: 160808 - DNA, 35 bp, Artificial Sequence
  Synthetic oligonucleotide
gtacttcgctctatcctcaacgcaccggctttgcc

SEQ ID NO: 160809 - DNA, 33 bp, Artificial Sequence
  Synthetic oligonucleotide
gcgtcttgtccagcagttcgtccatccccatcc

SEQ ID NO: 160810 - DNA, 35 bp, Artificial Sequence
  Synthetic oligonucleotide
ttgacccgccgactggtagcggagcgaccctatcc

SEQ ID NO: 160811 - DNA, 35 bp, Artificial Sequence
  Synthetic oligonucleotide
tggacgaaacgcctggtccattccactgcacctcc

SEQ ID NO: 160812 - DNA, 35 bp, Artificial Sequence
  Synthetic oligonucleotide
acctgctcagcaaatgtagttcttcgccacgttcc

SEQ ID NO: 160813 - DNA, 35 bp, Artificial Sequence
  Synthetic oligonucleotide
ttccatacctcgtgcctgtttatgatctcgtccgc

SEQ ID NO: 160814 - DNA, 35 bp, Artificial Sequence
  Synthetic oligonucleotide
gatccaagcaccgcctgcctgttaccggttatcgc

SEQ ID NO: 160815 - DNA, 35 bp, Artificial Sequence
  Synthetic oligonucleotide
tgaagacttcaagccactagcgatcccgttccatc

SEQ ID NO: 160816 - DNA, 36 bp, Artificial Sequence
  Synthetic oligonucleotide
tccgcccttcatgtgcgaacctaccccctgcggatc

SEQ ID NO: 160817 - DNA, 35 bp, Artificial Sequence
  Synthetic oligonucleotide
attcgctgccttggcgtccttccctccccgtactc

SEQ ID NO: 160818 - DNA, 35 bp, Artificial Sequence
  Synthetic oligonucleotide
gcaagcaaccgcgcgccctttcttatcgccccctc

SEQ ID NO: 160819 - DNA, 35 bp, Artificial Sequence
  Synthetic oligonucleotide
gatcgtcaagtccccaccttttgttacgtcgcctc

SEQ ID NO: 160820 - DNA, 35 bp, Artificial Sequence
  Synthetic oligonucleotide
gctacactgtgtgtggcgtttcccccctgatcctc

SEQ ID NO: 160821 - DNA, 35 bp, Artificial Sequence
  Synthetic oligonucleotide
gacgaatccgcccatcttgtagaacctctgctctc

SEQ ID NO: 160822 - DNA, 35 bp, Artificial Sequence
  Synthetic oligonucleotide
aaacctaccgccgccctgggcccactgcacttctc

SEQ ID NO: 160823 - DNA, 35 bp, Artificial Sequence
  Synthetic oligonucleotide
gctgtccgttggagcgatcttccctggctttcttc

SEQ ID NO: 160824 - DNA, 34 bp, Artificial Sequence
  Synthetic oligonucleotide
accttgcccgatcacttacgctgccgcttccaag

SEQ ID NO: 160825 - DNA, 35 bp, Artificial Sequence
  Synthetic oligonucleotide
acatccagccttccccctaatgccgtgctcatacg

SEQ ID NO: 160826 - DNA, 34 bp, Artificial Sequence
  Synthetic oligonucleotide
acgcgcaggctcatgacattgttcacttcccccg

SEQ ID NO: 160827 - DNA, 35 bp, Artificial Sequence
  Synthetic oligonucleotide
gaccagtcccgacctgtgcgcccccttaacgctcg

SEQ ID NO: 160828 - DNA, 34 bp, Artificial Sequence
  Synthetic oligonucleotide
acaacctccggccagtcttccccgtttcccaagg

SEQ ID NO: 160829 - DNA, 35 bp, Artificial Sequence
  Synthetic oligonucleotide
gaaaggaagtgaacaggctgtaggagggagaaggg

SEQ ID NO: 160830 - DNA, 35 bp, Artificial Sequence
  Synthetic oligonucleotide
tcctccgtaccacttggtttcctataccactcctg

SEQ ID NO: 160831 - DNA, 35 bp, Artificial Sequence
  Synthetic oligonucleotide
taaccccttatgtctgatgcttcaccgttttcctg

SEQ ID NO: 160832 - DNA, 35 bp, Artificial Sequence
  Synthetic oligonucleotide
tagtcccgctctcccgatacttttatattccacct

SEQ ID NO: 160833 - DNA, 35 bp, Artificial Sequence
  Synthetic oligonucleotide
tgatctggccaggagtggtctgatcaactctccct

SEQ ID NO: 160834 - DNA, 35 bp, Artificial Sequence
  Synthetic oligonucleotide
tactacacccgcttgccgtcaattcttctgtccct

SEQ ID NO: 160835 - DNA, 36 bp, Artificial Sequence
  Synthetic oligonucleotide
tcccatccgacacaatatactggtctcgcggttcct

SEQ ID NO: 160836 - DNA, 35 bp, Artificial Sequence
  Synthetic oligonucleotide
gtgtggcctccccttaccccggtgcttttgttcct

SEQ ID NO: 160837 - DNA, 35 bp, Artificial Sequence
  Synthetic oligonucleotide
acattccgctcctctggtcttcgatttattcctct

SEQ ID NO: 160838 - DNA, 35 bp, Artificial Sequence
  Synthetic oligonucleotide
acgagtgccgtctcaccgcctaccacctgtgttct

SEQ ID NO: 160839 - DNA, 35 bp, Artificial Sequence
  Synthetic oligonucleotide
gactgcatccctctctaactgctctccctccgagt

SEQ ID NO: 160840 - DNA, 35 bp, Artificial Sequence
  Synthetic oligonucleotide
aggtcacgcccactgtctctccatcgctctgccgt

SEQ ID NO: 160841 - DNA, 35 bp, Artificial Sequence
  Synthetic oligonucleotide
gtgcgccttctttttgtcacgggtctgtcttccgt

SEQ ID NO: 160842 - DNA, 35 bp, Artificial Sequence
  Synthetic oligonucleotide
gaccaagggaagtggaagggagggctgtataatgt

SEQ ID NO: 160843 - DNA, 35 bp, Artificial Sequence
  Synthetic oligonucleotide
tagcacgcccttgtaccgaccgctgcatgtttttt

SEQ ID NO: 160844 - DNA, 36 bp, Artificial Sequence
  Synthetic oligonucleotide
gcatccctgcctccccagtttactaggtcccttaaa

SEQ ID NO: 160845 - DNA, 35 bp, Artificial Sequence
  Synthetic oligonucleotide
accccgccaccgcttaacttagttatacgtaacaa

SEQ ID NO: 160846 - DNA, 35 bp, Artificial Sequence
  Synthetic oligonucleotide
ttgccccccgcccacgccatcactgcccgttgaca

SEQ ID NO: 160847 - DNA, 36 bp, Artificial Sequence
  Synthetic oligonucleotide
gctggagcgtacccgttctcatatcgagcctcccca

SEQ ID NO: 160848 - DNA, 36 bp, Artificial Sequence
  Synthetic oligonucleotide
tgttcgcgcgtgccttttgtcgtcaactcgctccca

SEQ ID NO: 160849 - DNA, 36 bp, Artificial Sequence
  Synthetic oligonucleotide
tacccgtccgtactccgcgatacgtgccatactcca

SEQ ID NO: 160850 - DNA, 36 bp, Artificial Sequence
  Synthetic oligonucleotide
gaaccatcaggaacgtcacgagccacttgcgctcca

SEQ ID NO: 160851 - DNA, 35 bp, Artificial Sequence
  Synthetic oligonucleotide
acctgcagtccgctgataacccgctccttccgtca

SEQ ID NO: 160852 - DNA, 37 bp, Artificial Sequence
  Synthetic oligonucleotide
tgcgggagggccggagggttgggacgtaacataaaga

SEQ ID NO: 160853 - DNA, 37 bp, Artificial Sequence
  Synthetic oligonucleotide
gcatggaaaggtagggaaagggcagacaagacggaga

SEQ ID NO: 160854 - DNA, 37 bp, Artificial Sequence
  Synthetic oligonucleotide
acgtggggcgaggggattacgggggggatcatacgga

SEQ ID NO: 160855 - DNA, 37 bp, Artificial Sequence
  Synthetic oligonucleotide
tgtgggtgaggggggtacggggggggccttgtcggga

SEQ ID NO: 160856 - DNA, 37 bp, Artificial Sequence
  Synthetic oligonucleotide
gtgtacggaccaagggagagtaggagggggtaatgga

SEQ ID NO: 160857 - DNA, 37 bp, Artificial Sequence
  Synthetic oligonucleotide
tcaaccgcccttcgccacccatctcccacccgctgga

SEQ ID NO: 160858 - DNA, 37 bp, Artificial Sequence
  Synthetic oligonucleotide
ggggggagatagggcagaacgaggacagagggaatga

SEQ ID NO: 160859 - DNA, 38 bp, Artificial Sequence
  Synthetic oligonucleotide
tagctaccgggggtgggtaagggatgggaaatgaatga

SEQ ID NO: 160860 - DNA, 37 bp, Artificial Sequence
  Synthetic oligonucleotide
tgtgcgccgccctggtactttccgccccgataactga

SEQ ID NO: 160861 - DNA, 37 bp, Artificial Sequence
  Synthetic oligonucleotide
tcatcgaccgaaccgcttccgtgcctcttatacctga

SEQ ID NO: 160862 - DNA, 37 bp, Artificial Sequence
  Synthetic oligonucleotide
taccatgcctgttgctttcgtgttcctgctttcgtga

SEQ ID NO: 160863 - DNA, 38 bp, Artificial Sequence
  Synthetic oligonucleotide
aaccccccaccggttgcatgcctctcaccatagggtga

SEQ ID NO: 160864 - DNA, 36 bp, Artificial Sequence
  Synthetic oligonucleotide
atgccatccaggaccccgccaccaccgagggcttga

SEQ ID NO: 160865 - DNA, 37 bp, Artificial Sequence
  Synthetic oligonucleotide
gtaggtgcaccgccgatctatctttatgcttgcttga

SEQ ID NO: 160866 - DNA, 35 bp, Artificial Sequence
  Synthetic oligonucleotide
tgccaagcccgcccgactagtcgtcttcctacata

SEQ ID NO: 160867 - DNA, 33 bp, Artificial Sequence
  Synthetic oligonucleotide
acaatcgagccgccccgacgtccgtcccttata

SEQ ID NO: 160868 - DNA, 35 bp, Artificial Sequence
  Synthetic oligonucleotide
tgagagccactgagcctttgtccgttacctaccta

SEQ ID NO: 160869 - DNA, 35 bp, Artificial Sequence
  Synthetic oligonucleotide
tgaatccgtgcccctgctctttcagtcactccgta

SEQ ID NO: 160870 - DNA, 35 bp, Artificial Sequence
  Synthetic oligonucleotide
aacgagcagtcgacgagtgctcgccccccacatta

SEQ ID NO: 160871 - DNA, 35 bp, Artificial Sequence
  Synthetic oligonucleotide
acctccgccccccagcatgcctagcgcccccttta

SEQ ID NO: 160872 - DNA, 35 bp, Artificial Sequence
  Synthetic oligonucleotide
ggagacaccccgcacgctgccttacttggtcgcac

SEQ ID NO: 160873 - DNA, 35 bp, Artificial Sequence
  Synthetic oligonucleotide
atcccaacgcgtttgacctttgcccccctcactac

SEQ ID NO: 160874 - DNA, 35 bp, Artificial Sequence
  Synthetic oligonucleotide
tccccgagcctcctgctcgttatcgtgccctctac

SEQ ID NO: 160875 - DNA, 35 bp, Artificial Sequence
  Synthetic oligonucleotide
ttatacacctgtccccgtcgatcaagtccctgtac

SEQ ID NO: 160876 - DNA, 35 bp, Artificial Sequence
  Synthetic oligonucleotide
ttggccgctcgcctgcttgtacaccgtcgctaacc

SEQ ID NO: 160877 - DNA, 35 bp, Artificial Sequence
  Synthetic oligonucleotide
tgcacaatcaggaagtacatcctagccgtcccacc

SEQ ID NO: 160878 - DNA, 35 bp, Artificial Sequence
  Synthetic oligonucleotide
attgcctccctgtattccccatcaggcccctaccc

SEQ ID NO: 160879 - DNA, 35 bp, Artificial Sequence
  Synthetic oligonucleotide
ataccccgttgtgcccccgcttcgttctcaaagcc

SEQ ID NO: 160880 - DNA, 35 bp, Artificial Sequence
  Synthetic oligonucleotide
gccccatccggaccacgctcattcaccgctaagcc

SEQ ID NO: 160881 - DNA, 35 bp, Artificial Sequence
  Synthetic oligonucleotide
tgttacccgctgttccagtctgtgcgctttccgcc

SEQ ID NO: 160882 - DNA, 35 bp, Artificial Sequence
  Synthetic oligonucleotide
agaggcgcgactgtttactcgcctttacacctgcc

SEQ ID NO: 160883 - DNA, 35 bp, Artificial Sequence
  Synthetic oligonucleotide
tgccgacacgcccctacttactatcatcggttgcc

SEQ ID NO: 160884 - DNA, 35 bp, Artificial Sequence
  Synthetic oligonucleotide
taggatctgctgagccgttctatcctacccgatcc

SEQ ID NO: 160885 - DNA, 35 bp, Artificial Sequence
  Synthetic oligonucleotide
gcctccccgtccggtccttgtccatcagtcgctcc

SEQ ID NO: 160886 - DNA, 35 bp, Artificial Sequence
  Synthetic oligonucleotide
ccctcgccaagctgctcttgtaccgtgctccttcc

SEQ ID NO: 160887 - DNA, 35 bp, Artificial Sequence
  Synthetic oligonucleotide
gtcccttccgaagtttggccactttactctgttcc

SEQ ID NO: 160888 - DNA, 35 bp, Artificial Sequence
  Synthetic oligonucleotide
tcttgccctcctcctccacctgctgtttttgttcc

SEQ ID NO: 160889 - DNA, 35 bp, Artificial Sequence
  Synthetic oligonucleotide
cacagatccggtccttgtctgcctacgctccccgc

SEQ ID NO: 160890 - DNA, 35 bp, Artificial Sequence
  Synthetic oligonucleotide
gacacctcgccctcctgtttgtttagcgctttcgc

SEQ ID NO: 160891 - DNA, 35 bp, Artificial Sequence
  Synthetic oligonucleotide
tgtatacccgcccgctccagcaacgctccataatc

SEQ ID NO: 160892 - DNA, 35 bp, Artificial Sequence
  Synthetic oligonucleotide
gaaacggtgaccgtgccgttttaccacatactatc

SEQ ID NO: 160893 - DNA, 35 bp, Artificial Sequence
  Synthetic oligonucleotide
gcctcgttaccgtctacgcgctttagctgttcctc

SEQ ID NO: 160894 - DNA, 35 bp, Artificial Sequence
  Synthetic oligonucleotide
tcggaaccatgtccgtcaatgccgccgcctcgctc

SEQ ID NO: 160895 - DNA, 35 bp, Artificial Sequence
  Synthetic oligonucleotide
gtctgcctccccatatggcgtgttcactaattctc

SEQ ID NO: 160896 - DNA, 35 bp, Artificial Sequence
  Synthetic oligonucleotide
gtcatgggcgggagggtatttgtgtgggtaaggtc

SEQ ID NO: 160897 - DNA, 35 bp, Artificial Sequence
  Synthetic oligonucleotide
gccactttagcccgttttgcatccgcctagcattc

SEQ ID NO: 160898 - DNA, 35 bp, Artificial Sequence
  Synthetic oligonucleotide
gcttgacacccgctgattcgggattaccccccttc

SEQ ID NO: 160899 - DNA, 35 bp, Artificial Sequence
  Synthetic oligonucleotide
tacgcactatttcatccagcttgataaccgccttc

SEQ ID NO: 160900 - DNA, 35 bp, Artificial Sequence
  Synthetic oligonucleotide
tgctgccccgtctggtccctgttccatcttctttc

SEQ ID NO: 160901 - DNA, 35 bp, Artificial Sequence
  Synthetic oligonucleotide
tcacactcgcccacataatatcggcctgcttaccg

SEQ ID NO: 160902 - DNA, 35 bp, Artificial Sequence
  Synthetic oligonucleotide
gacctcgatctgcgggggtggtgcgggggaggagg

SEQ ID NO: 160903 - DNA, 35 bp, Artificial Sequence
  Synthetic oligonucleotide
agacgcgcgacgacgtttgcttctctccacctcgg

SEQ ID NO: 160904 - DNA, 35 bp, Artificial Sequence
  Synthetic oligonucleotide
gagggggaattggatggcgaaagggttcaggaggg

SEQ ID NO: 160905 - DNA, 35 bp, Artificial Sequence
  Synthetic oligonucleotide
ggggccggatttaatgggtctcaaaggggggcggg

SEQ ID NO: 160906 - DNA, 35 bp, Artificial Sequence
  Synthetic oligonucleotide
tcctgccgccgttcgaccccacctatacatgcctg

SEQ ID NO: 160907 - DNA, 35 bp, Artificial Sequence
  Synthetic oligonucleotide
tccacaatcctcacctggcgtactcggactctctg

SEQ ID NO: 160908 - DNA, 35 bp, Artificial Sequence
  Synthetic oligonucleotide
ggtgaggggaggcgggggggtgtgcagtcgaagtg

SEQ ID NO: 160909 - DNA, 35 bp, Artificial Sequence
  Synthetic oligonucleotide
taccatcccagcgcaatagcccccgtactctattg

SEQ ID NO: 160910 - DNA, 35 bp, Artificial Sequence
  Synthetic oligonucleotide
gacaccccataacggagttgctctacctgccacat

SEQ ID NO: 160911 - DNA, 35 bp, Artificial Sequence
  Synthetic oligonucleotide
taggcactgcactatccgtcctttgttccggctat

SEQ ID NO: 160912 - DNA, 35 bp, Artificial Sequence
  Synthetic oligonucleotide
gtgcacctcatctaccccgtgaggaccctaccact

SEQ ID NO: 160913 - DNA, 35 bp, Artificial Sequence
  Synthetic oligonucleotide
aaccctcgttcctgatccggcctgactgtcccact

SEQ ID NO: 160914 - DNA, 35 bp, Artificial Sequence
  Synthetic oligonucleotide
gacatgttgcatgcacccccaagccttttccgcct

SEQ ID NO: 160915 - DNA, 35 bp, Artificial Sequence
  Synthetic oligonucleotide
gccgacgtcattcgcccggcttatccattcttcct

SEQ ID NO: 160916 - DNA, 35 bp, Artificial Sequence
  Synthetic oligonucleotide
gtgatgggggtaggatagggaattaggagtgggct

SEQ ID NO: 160917 - DNA, 35 bp, Artificial Sequence
  Synthetic oligonucleotide
gcgcaaccctgcttcctctgctccatacgttggct

SEQ ID NO: 160918 - DNA, 35 bp, Artificial Sequence
  Synthetic oligonucleotide
tacacccgctacatggattgcgatatttccctgct

SEQ ID NO: 160919 - DNA, 35 bp, Artificial Sequence
  Synthetic oligonucleotide
atccgagagccccagctccgtcttcagaccactct

SEQ ID NO: 160920 - DNA, 35 bp, Artificial Sequence
  Synthetic oligonucleotide
atcgccaccccacccgagttggccaccccatctct

SEQ ID NO: 160921 - DNA, 35 bp, Artificial Sequence
  Synthetic oligonucleotide
gaccacatcgccccccatcagcccctgattattct

SEQ ID NO: 160922 - DNA, 35 bp, Artificial Sequence
  Synthetic oligonucleotide
ggatcagcagtttgtttctgcctccgctttcctgt

SEQ ID NO: 160923 - DNA, 35 bp, Artificial Sequence
  Synthetic oligonucleotide
tacatcctcctgcccagcacagtatcttcttttgt

SEQ ID NO: 160924 - DNA, 35 bp, Artificial Sequence
  Synthetic oligonucleotide
gtccccttgctccatcacgcttcctgcagtccctt

SEQ ID NO: 160925 - DNA, 35 bp, Artificial Sequence
  Synthetic oligonucleotide
aagccacccacctttccttcacccccaggtctgtt

SEQ ID NO: 160926 - DNA, 35 bp, Artificial Sequence
  Synthetic oligonucleotide
tagccccctaacacctgcattatcaagctacattt

SEQ ID NO: 160927 - DNA, 35 bp, Artificial Sequence
  Synthetic oligonucleotide
tccccatcgccgcatagttcgcgaatacctgcttt

SEQ ID NO: 160928 - DNA, 35 bp, Artificial Sequence
  Synthetic oligonucleotide
gcttgcactgtgttcgtccagtcccgcccatcttt

SEQ ID NO: 160929 - DNA, 35 bp, Artificial Sequence
  Synthetic oligonucleotide
ggggtgggtttgggtgggaaagtggagcttgaaaa

SEQ ID NO: 160930 - DNA, 35 bp, Artificial Sequence
  Synthetic oligonucleotide
gtacgagcccctctcgccccctttattgacacgaa

SEQ ID NO: 160931 - DNA, 35 bp, Artificial Sequence
  Synthetic oligonucleotide
tccccacgactctggcccaccttactagtttgtaa

SEQ ID NO: 160932 - DNA, 35 bp, Artificial Sequence
  Synthetic oligonucleotide
ggcctgaccacatcggcctaacaccttgctttaca

SEQ ID NO: 160933 - DNA, 36 bp, Artificial Sequence
  Synthetic oligonucleotide
tctgggcgggtggggttgggttacgaataacaacca

SEQ ID NO: 160934 - DNA, 36 bp, Artificial Sequence
  Synthetic oligonucleotide
gaccgccaaccacatgtttagtcccccgttgaacca

SEQ ID NO: 160935 - DNA, 36 bp, Artificial Sequence
  Synthetic oligonucleotide
gcggacatccattcgctgttaccgctaccacaccca

SEQ ID NO: 160936 - DNA, 35 bp, Artificial Sequence
  Synthetic oligonucleotide
tcggtactgccgctgccccgaatttccctccccca

SEQ ID NO: 160937 - DNA, 36 bp, Artificial Sequence
  Synthetic oligonucleotide
acgccattcgtcgtttccttttccgggcactctcca

SEQ ID NO: 160938 - DNA, 36 bp, Artificial Sequence
  Synthetic oligonucleotide
tcacactcttggcccgtaaatttcaacccgtgtcca

SEQ ID NO: 160939 - DNA, 36 bp, Artificial Sequence
  Synthetic oligonucleotide
acccctcactgttcgccctagggccctgccttagca

SEQ ID NO: 160940 - DNA, 36 bp, Artificial Sequence
  Synthetic oligonucleotide
tgtctcacgagggcggtaagggtgggctgggggaga

SEQ ID NO: 160941 - DNA, 36 bp, Artificial Sequence
  Synthetic oligonucleotide
gcattgccgtccgcccctcccccgccggatttgaga

SEQ ID NO: 160942 - DNA, 37 bp, Artificial Sequence
  Synthetic oligonucleotide
taagaggggccaaggaagagaccaagtggggagacga

SEQ ID NO: 160943 - DNA, 37 bp, Artificial Sequence
  Synthetic oligonucleotide
gcaagggttgggtgggtaagggatcgtatctgtacga

SEQ ID NO: 160944 - DNA, 37 bp, Artificial Sequence
  Synthetic oligonucleotide
ttcacccccccgagttcgtccgacagcgactattcga

SEQ ID NO: 160945 - DNA, 38 bp, Artificial Sequence
  Synthetic oligonucleotide
tgatgtacgcagtcgggaaggacgcgggggaatacgga

SEQ ID NO: 160946 - DNA, 35 bp, Artificial Sequence
  Synthetic oligonucleotide
tccgccccttgcacctgcgctaccttcctcccgga

SEQ ID NO: 160947 - DNA, 37 bp, Artificial Sequence
  Synthetic oligonucleotide
gcctccactcccaccccgttctagcccgcctatcgga

SEQ ID NO: 160948 - DNA, 37 bp, Artificial Sequence
  Synthetic oligonucleotide
gagggatcacaaaggaggaaacgtgggatatagggga

SEQ ID NO: 160949 - DNA, 37 bp, Artificial Sequence
  Synthetic oligonucleotide
ttccgccccccttgccctgtatccatccacatatgga

SEQ ID NO: 160950 - DNA, 38 bp, Artificial Sequence
  Synthetic oligonucleotide
ttggcgtccagggtggggtggagggttagccggcctga

SEQ ID NO: 160951 - DNA, 38 bp, Artificial Sequence
  Synthetic oligonucleotide
gcccactcgcatgatctggccaacatccactatcctga

SEQ ID NO: 160952 - DNA, 36 bp, Artificial Sequence
  Synthetic oligonucleotide
gtaaagcgcgcgcttctaactcccctcctgtgctga

SEQ ID NO: 160953 - DNA, 38 bp, Artificial Sequence
  Synthetic oligonucleotide
acatgccacaggttctgtaccacttgccaccttgctga

SEQ ID NO: 160954 - DNA, 38 bp, Artificial Sequence
  Synthetic oligonucleotide
tcacgaggggtctgtgtgtacttcgttccaccatctga

SEQ ID NO: 160955 - DNA, 38 bp, Artificial Sequence
  Synthetic oligonucleotide
acaaaggggaggggacgggcgggtatccaaagcagtga

SEQ ID NO: 160956 - DNA, 37 bp, Artificial Sequence
  Synthetic oligonucleotide
actggaggggggaggaggacctgggggtcaggcgtga

SEQ ID NO: 160957 - DNA, 35 bp, Artificial Sequence
  Synthetic oligonucleotide
agaaaggggattaggtgggctcggagagggggtga

SEQ ID NO: 160958 - DNA, 38 bp, Artificial Sequence
  Synthetic oligonucleotide
tccactcactcatccgccgccaagacaggccttggtga

SEQ ID NO: 160959 - DNA, 37 bp, Artificial Sequence
  Synthetic oligonucleotide
tgtcgggtggggcgggggagggtagagtaacctgtga

SEQ ID NO: 160960 - DNA, 38 bp, Artificial Sequence
  Synthetic oligonucleotide
gacacgcctcattcgggtccatccactttactctgtga

SEQ ID NO: 160961 - DNA, 37 bp, Artificial Sequence
  Synthetic oligonucleotide
gtgcgaggggctcagggaaaaaggggggctagattga

SEQ ID NO: 160962 - DNA, 37 bp, Artificial Sequence
  Synthetic oligonucleotide
gcgatgtgtagattatcccacctcgcctactccttga

SEQ ID NO: 160963 - DNA, 38 bp, Artificial Sequence
  Synthetic oligonucleotide
acccctgtccccagcccctatcagcagtcgtacgttga

SEQ ID NO: 160964 - DNA, 35 bp, Artificial Sequence
  Synthetic oligonucleotide
acccgcctctgcttcatccgttaggacctgccata

SEQ ID NO: 160965 - DNA, 36 bp, Artificial Sequence
  Synthetic oligonucleotide
tccttcccctctgcccatcattgtttcacgtccata

SEQ ID NO: 160966 - DNA, 36 bp, Artificial Sequence
  Synthetic oligonucleotide
atgtaattgcaccccgcccgctccgtactatcgcta

SEQ ID NO: 160967 - DNA, 35 bp, Artificial Sequence
  Synthetic oligonucleotide
accctcccgccatcggggttgaacttgctcccgta

SEQ ID NO: 160968 - DNA, 35 bp, Artificial Sequence
  Synthetic oligonucleotide
acccagcccttatctgtccgtaatattacgcccac

SEQ ID NO: 160969 - DNA, 35 bp, Artificial Sequence
  Synthetic oligonucleotide
tgttcctcacccgtcaagcatctatattcgcccac

SEQ ID NO: 160970 - DNA, 35 bp, Artificial Sequence
  Synthetic oligonucleotide
tccaacccgactagcccggccacatattcttccac

SEQ ID NO: 160971 - DNA, 35 bp, Artificial Sequence
  Synthetic oligonucleotide
gcacccgccgttgaccatccacctcagtcactgac

SEQ ID NO: 160972 - DNA, 35 bp, Artificial Sequence
  Synthetic oligonucleotide
gagcaccttgtcaagctcgccactccctgcctgac

SEQ ID NO: 160973 - DNA, 35 bp, Artificial Sequence
  Synthetic oligonucleotide
agcccacctcacgcattgcggcgataacctccccc

SEQ ID NO: 160974 - DNA, 35 bp, Artificial Sequence
  Synthetic oligonucleotide
ttacactcccgaggttatcgttcagtcaattcccc

SEQ ID NO: 160975 - DNA, 35 bp, Artificial Sequence
  Synthetic oligonucleotide
gtccccccccgtatccgttatcgttcgtagtgccc

SEQ ID NO: 160976 - DNA, 35 bp, Artificial Sequence
  Synthetic oligonucleotide
tgcccaactccactgatagaaccgataggtctccc

SEQ ID NO: 160977 - DNA, 35 bp, Artificial Sequence
  Synthetic oligonucleotide
gccgtaccgatcagaatctccctccttcattagcc

SEQ ID NO: 160978 - DNA, 35 bp, Artificial Sequence
  Synthetic oligonucleotide
accaactgccccacgacggtatgtcgctcaccgcc

SEQ ID NO: 160979 - DNA, 35 bp, Artificial Sequence
  Synthetic oligonucleotide
ttcgatcctcgcccacctgattaagcccctgtgcc

SEQ ID NO: 160980 - DNA, 35 bp, Artificial Sequence
  Synthetic oligonucleotide
tctattcaacgtgcacatcccttctatgcacctcc

SEQ ID NO: 160981 - DNA, 35 bp, Artificial Sequence
  Synthetic oligonucleotide
atcggaatcgatcgcggtggctgcttcccccgtcc

SEQ ID NO: 160982 - DNA, 35 bp, Artificial Sequence
  Synthetic oligonucleotide
tcaccctcccatgctcgcatagtctgcccctttcc

SEQ ID NO: 160983 - DNA, 35 bp, Artificial Sequence
  Synthetic oligonucleotide
ttacgacctgtgattctgcctctcctttgtccagc

SEQ ID NO: 160984 - DNA, 35 bp, Artificial Sequence
  Synthetic oligonucleotide
agtaactgcgcacaattagcttgaccccccatagc

SEQ ID NO: 160985 - DNA, 36 bp, Artificial Sequence
  Synthetic oligonucleotide
gcccgatccctcgcgtctatattgccccgtcctagc

SEQ ID NO: 160986 - DNA, 35 bp, Artificial Sequence
  Synthetic oligonucleotide
ttgggccctcctgtctcgctgcgaaagtcacccgc

SEQ ID NO: 160987 - DNA, 36 bp, Artificial Sequence
  Synthetic oligonucleotide
acgccgccacctctagccatgattaagcccccccgc

SEQ ID NO: 160988 - DNA, 35 bp, Artificial Sequence
  Synthetic oligonucleotide
accgggactcagcagtcttataccgtcctgctcgc

SEQ ID NO: 160989 - DNA, 35 bp, Artificial Sequence
  Synthetic oligonucleotide
cccatccccgcccaataaatatccgacggtcctgc

SEQ ID NO: 160990 - DNA, 35 bp, Artificial Sequence
  Synthetic oligonucleotide
tgcatccggtactacctctcgacctgtcaaggctc

SEQ ID NO: 160991 - DNA, 35 bp, Artificial Sequence
  Synthetic oligonucleotide
gccccccgatggtcatcgctccacccgcttggctc

SEQ ID NO: 160992 - DNA, 35 bp, Artificial Sequence
  Synthetic oligonucleotide
gcccgacgccggctccccttatgctctctttggtc

SEQ ID NO: 160993 - DNA, 35 bp, Artificial Sequence
  Synthetic oligonucleotide
gccgcgccctgctcacaccgcacttcacccgattc

SEQ ID NO: 160994 - DNA, 35 bp, Artificial Sequence
  Synthetic oligonucleotide
gcctccatcagcacggttaaatgcggtgcttcttc

SEQ ID NO: 160995 - DNA, 35 bp, Artificial Sequence
  Synthetic oligonucleotide
tagtgggtggtggggggaatgggtctgtgatacag

SEQ ID NO: 160996 - DNA, 35 bp, Artificial Sequence
  Synthetic oligonucleotide
tatcccaccgccacccagtagctgaccccaccgag

SEQ ID NO: 160997 - DNA, 35 bp, Artificial Sequence
  Synthetic oligonucleotide
atcaccccgtacgttgctctgatcctgtcataccg

SEQ ID NO: 160998 - DNA, 35 bp, Artificial Sequence
  Synthetic oligonucleotide
gatcagcacacttgcctcgtcccccgaatatgccg

SEQ ID NO: 160999 - DNA, 35 bp, Artificial Sequence
  Synthetic oligonucleotide
gcccatacgccaacccttagaatactcccctctcg

SEQ ID NO: 161000 - DNA, 35 bp, Artificial Sequence
  Synthetic oligonucleotide
gactagcactcacgccgacgccccccacatgcgtg

SEQ ID NO: 161001 - DNA, 35 bp, Artificial Sequence
  Synthetic oligonucleotide
tgccccctcagccctccccgacctgtggtttgttg

SEQ ID NO: 161002 - DNA, 35 bp, Artificial Sequence
  Synthetic oligonucleotide
gctccgacggacttgcaattgtccacttcttccat

SEQ ID NO: 161003 - DNA, 35 bp, Artificial Sequence
  Synthetic oligonucleotide
ttggtgcaacagcatcgatcccccgccacattcat

SEQ ID NO: 161004 - DNA, 33 bp, Artificial Sequence
  Synthetic oligonucleotide
acgtctccaacctctgtatcaccgttccctgat

SEQ ID NO: 161005 - DNA, 35 bp, Artificial Sequence
  Synthetic oligonucleotide
gaagtcaccttgcccccgtcctcattctgggtact

SEQ ID NO: 161006 - DNA, 35 bp, Artificial Sequence
  Synthetic oligonucleotide
aaacctccctctgcatctgaccgtcttcgtgccct

SEQ ID NO: 161007 - DNA, 35 bp, Artificial Sequence
  Synthetic oligonucleotide
gccacgcgtacatcaagactccccatccgcccgct

SEQ ID NO: 161008 - DNA, 35 bp, Artificial Sequence
  Synthetic oligonucleotide
ccaccctcacacccttcggtaccgcacctgctgct

SEQ ID NO: 161009 - DNA, 35 bp, Artificial Sequence
  Synthetic oligonucleotide
gacgcaaccttcattcgcctcgtcgttccgtctct

SEQ ID NO: 161010 - DNA, 35 bp, Artificial Sequence
  Synthetic oligonucleotide
tcaagcatcggggagggcgggccgggcaacctcgt

SEQ ID NO: 161011 - DNA, 35 bp, Artificial Sequence
  Synthetic oligonucleotide
ttgccaacacccctagccatcgttcatcccgcggt

SEQ ID NO: 161012 - DNA, 35 bp, Artificial Sequence
  Synthetic oligonucleotide
accccctcgcaccttgcacaaggacagcacttggt

SEQ ID NO: 161013 - DNA, 35 bp, Artificial Sequence
  Synthetic oligonucleotide
tacctcacgagtcgccgttttcgtccgtctccttt

SEQ ID NO: 161014 - DNA, 35 bp, Artificial Sequence
  Synthetic oligonucleotide
gacatcccagcgcgatacctttagtttggtccttt

SEQ ID NO: 161015 - DNA, 35 bp, Artificial Sequence
  Synthetic oligonucleotide
gcgacacctcaaacggaggtctttcaccactcttt

SEQ ID NO: 161016 - DNA, 35 bp, Artificial Sequence
  Synthetic oligonucleotide
gtcaactctactctgcatacagcgccccccccaaa

SEQ ID NO: 161017 - DNA, 36 bp, Artificial Sequence
  Synthetic oligonucleotide
ttcgcctcccttcctttatcgctgtacccctgcgaa

SEQ ID NO: 161018 - DNA, 36 bp, Artificial Sequence
  Synthetic oligonucleotide
atcctcaccccttgcacagacactgctttccccaca

SEQ ID NO: 161019 - DNA, 35 bp, Artificial Sequence
  Synthetic oligonucleotide
gcgactggggtccgggtgggtagggaagctataca

SEQ ID NO: 161020 - DNA, 36 bp, Artificial Sequence
  Synthetic oligonucleotide
tacctgccagcctggagctgccccttgagtccccca

SEQ ID NO: 161021 - DNA, 36 bp, Artificial Sequence
  Synthetic oligonucleotide
agcagccctcccgcatcccggtctgcctcctgccca

SEQ ID NO: 161022 - DNA, 36 bp, Artificial Sequence
  Synthetic oligonucleotide
ttctgtcccactgactcacatgtccatgccttccca

SEQ ID NO: 161023 - DNA, 36 bp, Artificial Sequence
  Synthetic oligonucleotide
gtcgtaccatcgttcggctttccgcttcgccctcca

SEQ ID NO: 161024 - DNA, 36 bp, Artificial Sequence
  Synthetic oligonucleotide
ggtcccgccctgctaccccccacagaacaatacgca

SEQ ID NO: 161025 - DNA, 35 bp, Artificial Sequence
  Synthetic oligonucleotide
tagccggcctcctcaattgtttttacccgtccgca

SEQ ID NO: 161026 - DNA, 36 bp, Artificial Sequence
  Synthetic oligonucleotide
tccagcgcgcggcactctgactctcttctcgcctca

SEQ ID NO: 161027 - DNA, 36 bp, Artificial Sequence
  Synthetic oligonucleotide
gctcaccccccgcgctgaagtacacctggttattca

SEQ ID NO: 161028 - DNA, 35 bp, Artificial Sequence
  Synthetic oligonucleotide
ttccccgccacctggtttgaacctcttatcgaaga

SEQ ID NO: 161029 - DNA, 37 bp, Artificial Sequence
  Synthetic oligonucleotide
gttgcctcgctgtagctatcatttcttcctcttgaga

SEQ ID NO: 161030 - DNA, 36 bp, Artificial Sequence
  Synthetic oligonucleotide
tgtgtccgtcccgccagaatgtttgcccccccgcga

SEQ ID NO: 161031 - DNA, 37 bp, Artificial Sequence
  Synthetic oligonucleotide
tcctagcctgtagctgcccttgctcccgacgcctcga

SEQ ID NO: 161032 - DNA, 37 bp, Artificial Sequence
  Synthetic oligonucleotide
tgcctcgtcagaaacccgcccccctcaacgcgctcga

SEQ ID NO: 161033 - DNA, 36 bp, Artificial Sequence
  Synthetic oligonucleotide
tgtgctcgacactgaccttcgctcactccttccgga

SEQ ID NO: 161034 - DNA, 35 bp, Artificial Sequence
  Synthetic oligonucleotide
ggggaaaggttaaggaatgataggtgtgggcggga

SEQ ID NO: 161035 - DNA, 37 bp, Artificial Sequence
  Synthetic oligonucleotide
gcctcctttcgatctccaagccttccactccaatgga

SEQ ID NO: 161036 - DNA, 37 bp, Artificial Sequence
  Synthetic oligonucleotide
ttgcgcccaacagctttctgagctcctccgccctgga

SEQ ID NO: 161037 - DNA, 37 bp, Artificial Sequence
  Synthetic oligonucleotide
tccgccacccccccagctttcttcacagtttggatga

SEQ ID NO: 161038 - DNA, 38 bp, Artificial Sequence
  Synthetic oligonucleotide
atgcaaaccaggggagggataaggggtgatgggactga

SEQ ID NO: 161039 - DNA, 38 bp, Artificial Sequence
  Synthetic oligonucleotide
tagcgacggccactgtcctcgtacccttcatttgctga

SEQ ID NO: 161040 - DNA, 36 bp, Artificial Sequence
  Synthetic oligonucleotide
gatggtggtggggaagggtcggcgggtaagtattga

SEQ ID NO: 161041 - DNA, 38 bp, Artificial Sequence
  Synthetic oligonucleotide
gtgtacccgcccaagagtcgatagacccccacacttga

SEQ ID NO: 161042 - DNA, 38 bp, Artificial Sequence
  Synthetic oligonucleotide
gtgatgccctatgccgctccattacactgcccacttga

SEQ ID NO: 161043 - DNA, 38 bp, Artificial Sequence
  Synthetic oligonucleotide
gcatcgccctggcccctctatcgtgtccttccccttga

SEQ ID NO: 161044 - DNA, 38 bp, Artificial Sequence
  Synthetic oligonucleotide
actcgcctccatcctgcactagtaattgtatctgttga

SEQ ID NO: 161045 - DNA, 37 bp, Artificial Sequence
  Synthetic oligonucleotide
tgtgggcggggggggcgttcggagggtcttgatttga

SEQ ID NO: 161046 - DNA, 35 bp, Artificial Sequence
  Synthetic oligonucleotide
gttgcattgcgcacaccttcaccatcccggtcata

SEQ ID NO: 161047 - DNA, 36 bp, Artificial Sequence
  Synthetic oligonucleotide
gatgcgctgtcctgaacttatcacttcccggtccta

SEQ ID NO: 161048 - DNA, 35 bp, Artificial Sequence
  Synthetic oligonucleotide
gcgcccagagctccgttgccttgtctatattcgta

SEQ ID NO: 161049 - DNA, 36 bp, Artificial Sequence
  Synthetic oligonucleotide
agcggagaggccgccgcccctattcatccgccctta

SEQ ID NO: 161050 - DNA, 36 bp, Artificial Sequence
  Synthetic oligonucleotide
tatgtattccaccgtcctgctgccattccccgctta

SEQ ID NO: 161051 - DNA, 36 bp, Artificial Sequence
  Synthetic oligonucleotide
accccccccacatggtccacggcgcattacctttta

SEQ ID NO: 161052 - DNA, 35 bp, Artificial Sequence
  Synthetic oligonucleotide
gatcaccccgtttgtcccttgatacctctgaaaac

SEQ ID NO: 161053 - DNA, 35 bp, Artificial Sequence
  Synthetic oligonucleotide
tcgacccccgcaacactcgtgctacatcttgaaac

SEQ ID NO: 161054 - DNA, 35 bp, Artificial Sequence
  Synthetic oligonucleotide
tcacaccactcgggtcctgttgcatggtccgcaac

SEQ ID NO: 161055 - DNA, 35 bp, Artificial Sequence
  Synthetic oligonucleotide
acccacaacaatcatcttgcctatgtgagctacac

SEQ ID NO: 161056 - DNA, 35 bp, Artificial Sequence
  Synthetic oligonucleotide
tgactccctttgccgttaaattccgtcgctagcac

SEQ ID NO: 161057 - DNA, 35 bp, Artificial Sequence
  Synthetic oligonucleotide
gctcgtagctccgtagcattattgttccgccgcac

SEQ ID NO: 161058 - DNA, 35 bp, Artificial Sequence
  Synthetic oligonucleotide
atgctcccacgccgattaacatgtctaccgctcac

SEQ ID NO: 161059 - DNA, 35 bp, Artificial Sequence
  Synthetic oligonucleotide
gccctatagcccggtattgttttcgctcccactac

SEQ ID NO: 161060 - DNA, 35 bp, Artificial Sequence
  Synthetic oligonucleotide
gaccctgcacctgactcagcccccgcacatgttac

SEQ ID NO: 161061 - DNA, 35 bp, Artificial Sequence
  Synthetic oligonucleotide
cacaccactgccttcccgaactgccttcttgttac

SEQ ID NO: 161062 - DNA, 35 bp, Artificial Sequence
  Synthetic oligonucleotide
caacaccccccccctgccacggacgcggtctttac

SEQ ID NO: 161063 - DNA, 35 bp, Artificial Sequence
  Synthetic oligonucleotide
tctacctcggcgcattttgcctcccagtcttcacc

SEQ ID NO: 161064 - DNA, 35 bp, Artificial Sequence
  Synthetic oligonucleotide
ggaattgctacctgcctgttgcctacatgtacccc

SEQ ID NO: 161065 - DNA, 35 bp, Artificial Sequence
  Synthetic oligonucleotide
gtctcgcgagcgtagtgtatcgcccctccaccccc

SEQ ID NO: 161066 - DNA, 35 bp, Artificial Sequence
  Synthetic oligonucleotide
gtcccgtatcacgttgtctgcagttcctggccccc

SEQ ID NO: 161067 - DNA, 35 bp, Artificial Sequence
  Synthetic oligonucleotide
acgcgaacattgttgcccgaccgttgcgccctccc

SEQ ID NO: 161068 - DNA, 35 bp, Artificial Sequence
  Synthetic oligonucleotide
atcctccaccattccctgtcgttaagtgaaacgcc

SEQ ID NO: 161069 - DNA, 35 bp, Artificial Sequence
  Synthetic oligonucleotide
ttcgtcctcggccactatgcttcgcccccgactcc

SEQ ID NO: 161070 - DNA, 35 bp, Artificial Sequence
  Synthetic oligonucleotide
tgcaacatgcttgtgcgttctgccttctccgtagc

SEQ ID NO: 161071 - DNA, 35 bp, Artificial Sequence
  Synthetic oligonucleotide
aatgcacgcattatgtcgcgcctccctctccacgc

SEQ ID NO: 161072 - DNA, 35 bp, Artificial Sequence
  Synthetic oligonucleotide
gaatcgcccctgtacccgcctataccactagtatc

SEQ ID NO: 161073 - DNA, 35 bp, Artificial Sequence
  Synthetic oligonucleotide
agtccctgtccccgcaagtttggccctccaccctc

SEQ ID NO: 161074 - DNA, 35 bp, Artificial Sequence
  Synthetic oligonucleotide
gcagatcaatgtaccgtacttgcccctgacccctc

SEQ ID NO: 161075 - DNA, 35 bp, Artificial Sequence
  Synthetic oligonucleotide
ttgaacgggtcatccttcgccgctccacgcccctc

SEQ ID NO: 161076 - DNA, 35 bp, Artificial Sequence
  Synthetic oligonucleotide
gttggccagcttacaattccgtactccgggccctc

SEQ ID NO: 161077 - DNA, 35 bp, Artificial Sequence
  Synthetic oligonucleotide
acactagccgccactcctcgaatgttcttgcgctc

SEQ ID NO: 161078 - DNA, 35 bp, Artificial Sequence
  Synthetic oligonucleotide
acattgttccgcgatgctgactcgccctttcgctc

SEQ ID NO: 161079 - DNA, 35 bp, Artificial Sequence
  Synthetic oligonucleotide
tcccaccgcctagtctctttgcacctcgatcggtc

SEQ ID NO: 161080 - DNA, 35 bp, Artificial Sequence
  Synthetic oligonucleotide
ttagtcgcaccgccgcccataaatgcttcccattc

SEQ ID NO: 161081 - DNA, 35 bp, Artificial Sequence
  Synthetic oligonucleotide
tttgcgccgtcagtgactttcctacctttccattc

SEQ ID NO: 161082 - DNA, 35 bp, Artificial Sequence
  Synthetic oligonucleotide
gcccgcttgaccgccgatgcactcatcctcacttc

SEQ ID NO: 161083 - DNA, 35 bp, Artificial Sequence
  Synthetic oligonucleotide
gccagtgcctgcttccaaatcgttcgtcacgcttc

SEQ ID NO: 161084 - DNA, 35 bp, Artificial Sequence
  Synthetic oligonucleotide
tccgtccccacagtatcggcaagccactcctcttc

SEQ ID NO: 161085 - DNA, 35 bp, Artificial Sequence
  Synthetic oligonucleotide
tacccgcgaaccgccgcactttttatttgttcttc

SEQ ID NO: 161086 - DNA, 35 bp, Artificial Sequence
  Synthetic oligonucleotide
atcgccggcccctcgtttacccgaattttacgttc

SEQ ID NO: 161087 - DNA, 35 bp, Artificial Sequence
  Synthetic oligonucleotide
attgtccccctcctgttctacgagcgttagcgttc

SEQ ID NO: 161088 - DNA, 35 bp, Artificial Sequence
  Synthetic oligonucleotide
acccatccctctgctccatcgtcgtacctgcctag

SEQ ID NO: 161089 - DNA, 35 bp, Artificial Sequence
  Synthetic oligonucleotide
ggcgcccagccccgcccgctccatctgcaagcacg

SEQ ID NO: 161090 - DNA, 35 bp, Artificial Sequence
  Synthetic oligonucleotide
tacctctgcggactgcgtctactatctaccccccg

SEQ ID NO: 161091 - DNA, 35 bp, Artificial Sequence
  Synthetic oligonucleotide
tcaacagccgccctgacgtcccacttgcccatccg

SEQ ID NO: 161092 - DNA, 35 bp, Artificial Sequence
  Synthetic oligonucleotide
tccacgtcgatctcgtactctccaacttttcgcgg

SEQ ID NO: 161093 - DNA, 35 bp, Artificial Sequence
  Synthetic oligonucleotide
tcgaatggtggggagggtagacgtagggcataggg

SEQ ID NO: 161094 - DNA, 35 bp, Artificial Sequence
  Synthetic oligonucleotide
acagtggacacttggggcagtcgggacgggagggg

SEQ ID NO: 161095 - DNA, 35 bp, Artificial Sequence
  Synthetic oligonucleotide
tctgccccgatcccgaacaaatgccaacccgcctg

SEQ ID NO: 161096 - DNA, 35 bp, Artificial Sequence
  Synthetic oligonucleotide
accggacaccgtccaaccgattaccgcccgccgtg

SEQ ID NO: 161097 - DNA, 35 bp, Artificial Sequence
  Synthetic oligonucleotide
atgaccacccgcacccacctgactatgcacgacat

SEQ ID NO: 161098 - DNA, 35 bp, Artificial Sequence
  Synthetic oligonucleotide
tccccgattgctactctgttgtacctctgccccat

SEQ ID NO: 161099 - DNA, 35 bp, Artificial Sequence
  Synthetic oligonucleotide
tcccatcctcatcagtgtcataccttgcctacgat

SEQ ID NO: 161100 - DNA, 35 bp, Artificial Sequence
  Synthetic oligonucleotide
tgagccaaggcctcaacgtcgcgctcctaaaccct

SEQ ID NO: 161101 - DNA, 35 bp, Artificial Sequence
  Synthetic oligonucleotide
agtaggtcgatcgcagccgcacttccctttggcct

SEQ ID NO: 161102 - DNA, 35 bp, Artificial Sequence
  Synthetic oligonucleotide
agaccaagcatgcagagcggacggagggggggggt

SEQ ID NO: 161103 - DNA, 35 bp, Artificial Sequence
  Synthetic oligonucleotide
tcttgccactccgaaccattgccgtcgcttgcctt

SEQ ID NO: 161104 - DNA, 35 bp, Artificial Sequence
  Synthetic oligonucleotide
tgacacgacgatcacatcactctccccattccttt

SEQ ID NO: 161105 - DNA, 35 bp, Artificial Sequence
  Synthetic oligonucleotide
tcacgttcgtcgcctttcccacgtttcacatgttt

SEQ ID NO: 161106 - DNA, 35 bp, Artificial Sequence
  Synthetic oligonucleotide
tagacactccgctccccccgccagtcattggaaaa

SEQ ID NO: 161107 - DNA, 36 bp, Artificial Sequence
  Synthetic oligonucleotide
tgccgccctcttgatctgacctccccgggttaccaa

SEQ ID NO: 161108 - DNA, 35 bp, Artificial Sequence
  Synthetic oligonucleotide
ttcgctcatcctctcgttacgcctaaatgcacaca

SEQ ID NO: 161109 - DNA, 35 bp, Artificial Sequence
  Synthetic oligonucleotide
tggagcttcacaggaccttgcccatcgcccttcca

SEQ ID NO: 161110 - DNA, 36 bp, Artificial Sequence
  Synthetic oligonucleotide
gttgagccacctgcgttgcctgccttcttcttgtca

SEQ ID NO: 161111 - DNA, 37 bp, Artificial Sequence
  Synthetic oligonucleotide
gaggggagggacggtctggaaggaggggcgacacaga

SEQ ID NO: 161112 - DNA, 37 bp, Artificial Sequence
  Synthetic oligonucleotide
ggcgggcgggtcggggtagggaggcaaaggggccaga

SEQ ID NO: 161113 - DNA, 37 bp, Artificial Sequence
  Synthetic oligonucleotide
aacacgccctctagcttaagccctgattctcgtgaga

SEQ ID NO: 161114 - DNA, 36 bp, Artificial Sequence
  Synthetic oligonucleotide
gtgacctgttatcgttatgccttccgtcttcaccga

SEQ ID NO: 161115 - DNA, 37 bp, Artificial Sequence
  Synthetic oligonucleotide
ggacacgccgttgcagcatcgcccatatctccgccga

SEQ ID NO: 161116 - DNA, 37 bp, Artificial Sequence
  Synthetic oligonucleotide
tgtatgccgcaggtgctcgccgctcccctatgtccga

SEQ ID NO: 161117 - DNA, 37 bp, Artificial Sequence
  Synthetic oligonucleotide
aagcggaacgggcggggtgctgggcatgttaggggga

SEQ ID NO: 161118 - DNA, 37 bp, Artificial Sequence
  Synthetic oligonucleotide
atcaagtgaagggcgggagggagatagaatcatggga

SEQ ID NO: 161119 - DNA, 37 bp, Artificial Sequence
  Synthetic oligonucleotide
gattggaacgatagggggagggtgggccaggatggga

SEQ ID NO: 161120 - DNA, 37 bp, Artificial Sequence
  Synthetic oligonucleotide
atgggcgagatgagggagggagcagaaaggactggga

SEQ ID NO: 161121 - DNA, 37 bp, Artificial Sequence
  Synthetic oligonucleotide
accattccctgttgtttacgcacccctctaacttgga

SEQ ID NO: 161122 - DNA, 37 bp, Artificial Sequence
  Synthetic oligonucleotide
accaccctgccctcccgtaacactgtggtgttaatga

SEQ ID NO: 161123 - DNA, 38 bp, Artificial Sequence
  Synthetic oligonucleotide
agccccacccgccgtttttccttgacacgtagttatga

SEQ ID NO: 161124 - DNA, 37 bp, Artificial Sequence
  Synthetic oligonucleotide
gtcgccacctcctgtattgctaccgcgacactactga

SEQ ID NO: 161125 - DNA, 37 bp, Artificial Sequence
  Synthetic oligonucleotide
tcatgggggccggtggggatggaggatggtcacctga

SEQ ID NO: 161126 - DNA, 38 bp, Artificial Sequence
  Synthetic oligonucleotide
acttacggtcagccccgatcgcccctgccacgccctga

SEQ ID NO: 161127 - DNA, 37 bp, Artificial Sequence
  Synthetic oligonucleotide
gctcgcgtgtgggccgccactcactttcctctgctga

SEQ ID NO: 161128 - DNA, 38 bp, Artificial Sequence
  Synthetic oligonucleotide
gcccccacccagtgctgactcccctccctcacgtgtga

SEQ ID NO: 161129 - DNA, 38 bp, Artificial Sequence
  Synthetic oligonucleotide
taccccctgccactttgccttccgttaggatcccttga

SEQ ID NO: 161130 - DNA, 37 bp, Artificial Sequence
  Synthetic oligonucleotide
acgcaagtccctccgccgatttttcgtcccgccttga

SEQ ID NO: 161131 - DNA, 38 bp, Artificial Sequence
  Synthetic oligonucleotide
tatcagcacgctgcctatagtttcgctcccccgcttga

SEQ ID NO: 161132 - DNA, 35 bp, Artificial Sequence
  Synthetic oligonucleotide
tacccgcaccccgttagtgacctatccctgctgta

SEQ ID NO: 161133 - DNA, 36 bp, Artificial Sequence
  Synthetic oligonucleotide
gatgtcagttgccgccctcatactctccgttactta

SEQ ID NO: 161134 - DNA, 36 bp, Artificial Sequence
  Synthetic oligonucleotide
ttgcaccttcgttccagcctgtccattgtcgcttta

SEQ ID NO: 161135 - DNA, 35 bp, Artificial Sequence
  Synthetic oligonucleotide
agtgtcaacgcatatcgtaggccgcccgcttttta

SEQ ID NO: 161136 - DNA, 35 bp, Artificial Sequence
  Synthetic oligonucleotide
gatgtcctcggtctgtaacggtgcccttctttcac

SEQ ID NO: 161137 - DNA, 35 bp, Artificial Sequence
  Synthetic oligonucleotide
tgtttgcaccagcattccctcgatccacttacacc

SEQ ID NO: 161138 - DNA, 35 bp, Artificial Sequence
  Synthetic oligonucleotide
tcacctctcacacattgcgggaccacgcctccacc

SEQ ID NO: 161139 - DNA, 35 bp, Artificial Sequence
  Synthetic oligonucleotide
tcactgcacacacacctagtgcactagaccaaccc

SEQ ID NO: 161140 - DNA, 35 bp, Artificial Sequence
  Synthetic oligonucleotide
taacttggccccgatagcggtcgcttgcccccccc

SEQ ID NO: 161141 - DNA, 35 bp, Artificial Sequence
  Synthetic oligonucleotide
ttcctcacaccgctctcgatgcgcacatggctccc

SEQ ID NO: 161142 - DNA, 35 bp, Artificial Sequence
  Synthetic oligonucleotide
accgggacgaatgggagggcgggaaacacctagcc

SEQ ID NO: 161143 - DNA, 35 bp, Artificial Sequence
  Synthetic oligonucleotide
tttccatgtgcctcttgcattacctgtgctctgcc

SEQ ID NO: 161144 - DNA, 35 bp, Artificial Sequence
  Synthetic oligonucleotide
tccccatgctcccggagctccacactttttttgcc

SEQ ID NO: 161145 - DNA, 35 bp, Artificial Sequence
  Synthetic oligonucleotide
tgctgtgaatcagactgtaacacctcttctcctcc

SEQ ID NO: 161146 - DNA, 35 bp, Artificial Sequence
  Synthetic oligonucleotide
tgacgacccccaatcgttgtgcctgccccatctcc

SEQ ID NO: 161147 - DNA, 35 bp, Artificial Sequence
  Synthetic oligonucleotide
agcatgccacgctctttcctggttctgtacattcc

SEQ ID NO: 161148 - DNA, 35 bp, Artificial Sequence
  Synthetic oligonucleotide
aacagccaccgtacggcctatctcatgctttgcgc

SEQ ID NO: 161149 - DNA, 36 bp, Artificial Sequence
  Synthetic oligonucleotide
tgcctgtctagcgctcccccccgtgactatccctgc

SEQ ID NO: 161150 - DNA, 35 bp, Artificial Sequence
  Synthetic oligonucleotide
tccacgcttatctccctgggtatccccttgcctgc

SEQ ID NO: 161151 - DNA, 35 bp, Artificial Sequence
  Synthetic oligonucleotide
tcagcggatactgtccatgccgtgtctctcttgtc

SEQ ID NO: 161152 - DNA, 35 bp, Artificial Sequence
  Synthetic oligonucleotide
gatcctgtgtacagcggtcccaaggcccctccttc

SEQ ID NO: 161153 - DNA, 35 bp, Artificial Sequence
  Synthetic oligonucleotide
tcctccacgccgtttcaccctttttactgcgctag

SEQ ID NO: 161154 - DNA, 35 bp, Artificial Sequence
  Synthetic oligonucleotide
agcacggtggggatcgagggatgggggggtattag

SEQ ID NO: 161155 - DNA, 35 bp, Artificial Sequence
  Synthetic oligonucleotide
tctgcgtagcccgcaaagtctcatcgccacttccg

SEQ ID NO: 161156 - DNA, 35 bp, Artificial Sequence
  Synthetic oligonucleotide
tgtcttagcctgtctcgccctaaatacacctctcg

SEQ ID NO: 161157 - DNA, 35 bp, Artificial Sequence
  Synthetic oligonucleotide
aacgcaaccaccccctccgctctgacgctacccgg

SEQ ID NO: 161158 - DNA, 35 bp, Artificial Sequence
  Synthetic oligonucleotide
tctttgccaccgctaatcgtactctcgggcccttg

SEQ ID NO: 161159 - DNA, 35 bp, Artificial Sequence
  Synthetic oligonucleotide
agctacgtgccactcctgtctatacccctgttcat

SEQ ID NO: 161160 - DNA, 35 bp, Artificial Sequence
  Synthetic oligonucleotide
accgtccggctgggcttccctgtcttcaccgcact

SEQ ID NO: 161161 - DNA, 35 bp, Artificial Sequence
  Synthetic oligonucleotide
tgtaacatctgctcggcttggtcgctccgcatcct

SEQ ID NO: 161162 - DNA, 35 bp, Artificial Sequence
  Synthetic oligonucleotide
tccggtccctcgccgccctgtctctgactgctcct

SEQ ID NO: 161163 - DNA, 35 bp, Artificial Sequence
  Synthetic oligonucleotide
tagttaccccgtgcctcacatcgttagctccatct

SEQ ID NO: 161164 - DNA, 35 bp, Artificial Sequence
  Synthetic oligonucleotide
atacgtcggggctccaggcgctccctacacactct

SEQ ID NO: 161165 - DNA, 35 bp, Artificial Sequence
  Synthetic oligonucleotide
gatccaccgcctacatttagttagcgtcaatttct

SEQ ID NO: 161166 - DNA, 35 bp, Artificial Sequence
  Synthetic oligonucleotide
tccccggagccgatctgcaccctgccttccccagt

SEQ ID NO: 161167 - DNA, 35 bp, Artificial Sequence
  Synthetic oligonucleotide
aaagggggaaatgcggggcaagggctaggggtagt

SEQ ID NO: 161168 - DNA, 35 bp, Artificial Sequence
  Synthetic oligonucleotide
tcacatccatgtcgcctgagcctgtccttctctgt

SEQ ID NO: 161169 - DNA, 35 bp, Artificial Sequence
  Synthetic oligonucleotide
ggacttgccgctgtcctccccctcgttgcgcttgt

SEQ ID NO: 161170 - DNA, 33 bp, Artificial Sequence
  Synthetic oligonucleotide
gtagcaccgctggtgcccctcctcttaacactt

SEQ ID NO: 161171 - DNA, 35 bp, Artificial Sequence
  Synthetic oligonucleotide
taccgccccggcgcataatgctaatcttactcctt

SEQ ID NO: 161172 - DNA, 35 bp, Artificial Sequence
  Synthetic oligonucleotide
gatgtgtgttcaccgctcatcccgcctcttgtctt

SEQ ID NO: 161173 - DNA, 35 bp, Artificial Sequence
  Synthetic oligonucleotide
ttgcccgacctctgttaacagtctcccctcttgtt

SEQ ID NO: 161174 - DNA, 35 bp, Artificial Sequence
  Synthetic oligonucleotide
gccatgacccccacaagacgccccgtgcccgattt

SEQ ID NO: 161175 - DNA, 35 bp, Artificial Sequence
  Synthetic oligonucleotide
gacccggcgtcgttcattccgccacacgtaccttt

SEQ ID NO: 161176 - DNA, 35 bp, Artificial Sequence
  Synthetic oligonucleotide
tacccagccaccttatattcgtgttccaccgcttt

SEQ ID NO: 161177 - DNA, 36 bp, Artificial Sequence
  Synthetic oligonucleotide
ttcaacgggcgggtgggggtggactaggtttcccaa

SEQ ID NO: 161178 - DNA, 36 bp, Artificial Sequence
  Synthetic oligonucleotide
tgagacgccactccgccgtttgtgtacccttacaca

SEQ ID NO: 161179 - DNA, 36 bp, Artificial Sequence
  Synthetic oligonucleotide
atgggatgcgcactgcatcggaccctcctgcccaca

SEQ ID NO: 161180 - DNA, 36 bp, Artificial Sequence
  Synthetic oligonucleotide
acgcgccctgccgctctcgtagttcttgaattcaca

SEQ ID NO: 161181 - DNA, 35 bp, Artificial Sequence
  Synthetic oligonucleotide
tttgacgaccgttcatacgttaatgctccacacca

SEQ ID NO: 161182 - DNA, 36 bp, Artificial Sequence
  Synthetic oligonucleotide
acaaccaccgtgttctgttaccactgtcctccacca

SEQ ID NO: 161183 - DNA, 36 bp, Artificial Sequence
  Synthetic oligonucleotide
tccccgtgccatcgagttcgtttttccagtctacca

SEQ ID NO: 161184 - DNA, 36 bp, Artificial Sequence
  Synthetic oligonucleotide
tccatgttgacgcgtatggccgggccccatttacca

SEQ ID NO: 161185 - DNA, 36 bp, Artificial Sequence
  Synthetic oligonucleotide
ttccgcccctccgattttaatatgttgttcattgca

SEQ ID NO: 161186 - DNA, 35 bp, Artificial Sequence
  Synthetic oligonucleotide
gccgcctctctcgatcctatcccggccaggactca

SEQ ID NO: 161187 - DNA, 36 bp, Artificial Sequence
  Synthetic oligonucleotide
gaaggggggaaaggaggagcgtggcagaagagttca

SEQ ID NO: 161188 - DNA, 36 bp, Artificial Sequence
  Synthetic oligonucleotide
attcacccgggaggacggggggggaggaggagttca

SEQ ID NO: 161189 - DNA, 36 bp, Artificial Sequence
  Synthetic oligonucleotide
atcgtccatgacctatagataacccgcccctgttca

SEQ ID NO: 161190 - DNA, 36 bp, Artificial Sequence
  Synthetic oligonucleotide
tcaaaggcggggacggaaggggcatgaggttgcaga

SEQ ID NO: 161191 - DNA, 37 bp, Artificial Sequence
  Synthetic oligonucleotide
aaagagaggggggaatggagtagttcaaaggcagaga

SEQ ID NO: 161192 - DNA, 36 bp, Artificial Sequence
  Synthetic oligonucleotide
tcgctgggggtggaagggggaggggctctgtgacga

SEQ ID NO: 161193 - DNA, 37 bp, Artificial Sequence
  Synthetic oligonucleotide
cacacgcctattcgtctttggcccatctactcaccga

SEQ ID NO: 161194 - DNA, 37 bp, Artificial Sequence
  Synthetic oligonucleotide
acatgtcacagcgcattagcccccttcgttcctccga

SEQ ID NO: 161195 - DNA, 37 bp, Artificial Sequence
  Synthetic oligonucleotide
ggggagtgcggtggggtgggcaagaaaatggaggcga

SEQ ID NO: 161196 - DNA, 36 bp, Artificial Sequence
  Synthetic oligonucleotide
gccaccatcacaccgtccgcccgagtccattctcga

SEQ ID NO: 161197 - DNA, 36 bp, Artificial Sequence
  Synthetic oligonucleotide
ttcccgcggagggtgatcaacggagggctgggagga

SEQ ID NO: 161198 - DNA, 37 bp, Artificial Sequence
  Synthetic oligonucleotide
gatcgttgcctcacattgttcccccctctgactagga

SEQ ID NO: 161199 - DNA, 37 bp, Artificial Sequence
  Synthetic oligonucleotide
tgcacccaacctccactgtatccccctgtctgtcgga

SEQ ID NO: 161200 - DNA, 37 bp, Artificial Sequence
  Synthetic oligonucleotide
tagacgggggggtggtaagaaagttaggggcaaggga

SEQ ID NO: 161201 - DNA, 37 bp, Artificial Sequence
  Synthetic oligonucleotide
ttactaggggcggaacgggaaggaagcgggtaaggga

SEQ ID NO: 161202 - DNA, 36 bp, Artificial Sequence
  Synthetic oligonucleotide
gggaggggtagagacaagaaaacaaggggctgggga

SEQ ID NO: 161203 - DNA, 36 bp, Artificial Sequence
  Synthetic oligonucleotide
gggtagggaggacgtggataggtggagcgaatggga

SEQ ID NO: 161204 - DNA, 37 bp, Artificial Sequence
  Synthetic oligonucleotide
tccactccgcaacaccaccgcctacgtcattagtgga

SEQ ID NO: 161205 - DNA, 37 bp, Artificial Sequence
  Synthetic oligonucleotide
tatgccccgccctgcccggatacaacccttacgatga

SEQ ID NO: 161206 - DNA, 38 bp, Artificial Sequence
  Synthetic oligonucleotide
ggggacgggaaggacgggaaccaggggcggcgctatga

SEQ ID NO: 161207 - DNA, 38 bp, Artificial Sequence
  Synthetic oligonucleotide
ttgccctcgccttcccgtactagtattgttcccgctga

SEQ ID NO: 161208 - DNA, 38 bp, Artificial Sequence
  Synthetic oligonucleotide
tccatccgcaccacgccgctcttttcacgactctctga

SEQ ID NO: 161209 - DNA, 37 bp, Artificial Sequence
  Synthetic oligonucleotide
aatgccctccgcaatttctgtccctgtccaccattga

SEQ ID NO: 161210 - DNA, 37 bp, Artificial Sequence
  Synthetic oligonucleotide
gttcgactccgggctgtaacccatcatcctctcttga

SEQ ID NO: 161211 - DNA, 38 bp, Artificial Sequence
  Synthetic oligonucleotide
gaatgagtgtcggaaggggagggaggtttgggggttga

SEQ ID NO: 161212 - DNA, 38 bp, Artificial Sequence
  Synthetic oligonucleotide
ggtgagcacggggaggcgggaagcatggcagtatttga

SEQ ID NO: 161213 - DNA, 38 bp, Artificial Sequence
  Synthetic oligonucleotide
ttccacctgctcccattggtacgtgtcgctccttttga

SEQ ID NO: 161214 - DNA, 36 bp, Artificial Sequence
  Synthetic oligonucleotide
tacccgcgcgcccccctccgctacggttacaggata

SEQ ID NO: 161215 - DNA, 35 bp, Artificial Sequence
  Synthetic oligonucleotide
tagatgtacgtcctatctgctatgcacacctccta

SEQ ID NO: 161216 - DNA, 36 bp, Artificial Sequence
  Synthetic oligonucleotide
agtgcatgccctgccggccgccctgcctttcccgta

SEQ ID NO: 161217 - DNA, 36 bp, Artificial Sequence
  Synthetic oligonucleotide
gccagactgtccatactgcctcccgttcttcactta

SEQ ID NO: 161218 - DNA, 35 bp, Artificial Sequence
  Synthetic oligonucleotide
tgttacaccagcgtgagtattccccgcccgcctta

SEQ ID NO: 161219 - DNA, 35 bp, Artificial Sequence
  Synthetic oligonucleotide
atccccgccttggtgacctaactggttgcacttta

SEQ ID NO: 161220 - DNA, 36 bp, Artificial Sequence
  Synthetic oligonucleotide
gccgaagccggcactacgcccctttgcttatcttta

SEQ ID NO: 161221 - DNA, 35 bp, Artificial Sequence
  Synthetic oligonucleotide
gctcgccgttgtaccggacccttgctattacccac

SEQ ID NO: 161222 - DNA, 35 bp, Artificial Sequence
  Synthetic oligonucleotide
gtgtccccccaggttccgagaacgcccctagccac

SEQ ID NO: 161223 - DNA, 35 bp, Artificial Sequence
  Synthetic oligonucleotide
gcctccacgccccggatctaaataccgtgtgccac

SEQ ID NO: 161224 - DNA, 35 bp, Artificial Sequence
  Synthetic oligonucleotide
tacacactgcggtatttctcctcggacgcaccacc

SEQ ID NO: 161225 - DNA, 35 bp, Artificial Sequence
  Synthetic oligonucleotide
atgacccgcccccaaatgtcatacatgactccacc

SEQ ID NO: 161226 - DNA, 35 bp, Artificial Sequence
  Synthetic oligonucleotide
tccgacggagagcacgcgcttaggaatagcccccc

SEQ ID NO: 161227 - DNA, 35 bp, Artificial Sequence
  Synthetic oligonucleotide
gcgtgtgacgttatgtttcaccagcccccgtcccc

SEQ ID NO: 161228 - DNA, 35 bp, Artificial Sequence
  Synthetic oligonucleotide
gacccatgtgctatgttatagcttcattattcccc

SEQ ID NO: 161229 - DNA, 35 bp, Artificial Sequence
  Synthetic oligonucleotide
gactgtgcgatgactgtcgcgttctcatcttgccc

SEQ ID NO: 161230 - DNA, 35 bp, Artificial Sequence
  Synthetic oligonucleotide
aagtgacacacggcaccattttgttcgacccatcc

SEQ ID NO: 161231 - DNA, 35 bp, Artificial Sequence
  Synthetic oligonucleotide
atacacgccctcccatcctagtccggtacaattcc

SEQ ID NO: 161232 - DNA, 35 bp, Artificial Sequence
  Synthetic oligonucleotide
gtccacccgtcttgcgaacaatttagcccaccagc

SEQ ID NO: 161233 - DNA, 35 bp, Artificial Sequence
  Synthetic oligonucleotide
tgtccccagcattgaaccgcggcctcctatcttgc

SEQ ID NO: 161234 - DNA, 35 bp, Artificial Sequence
  Synthetic oligonucleotide
gaacgcagtactgtcttccctgtatgcctaccatc

SEQ ID NO: 161235 - DNA, 35 bp, Artificial Sequence
  Synthetic oligonucleotide
acttctcatccctcgcttctgtacaaccgtacctc

SEQ ID NO: 161236 - DNA, 35 bp, Artificial Sequence
  Synthetic oligonucleotide
tcgatgcgccacgtgcagccttaatgttcttcctc

SEQ ID NO: 161237 - DNA, 35 bp, Artificial Sequence
  Synthetic oligonucleotide
acttcaaccagttcgtcacctctgctcctctagtc

SEQ ID NO: 161238 - DNA, 35 bp, Artificial Sequence
  Synthetic oligonucleotide
tacatgtgctttccattgattatgcgcccccattc

SEQ ID NO: 161239 - DNA, 35 bp, Artificial Sequence
  Synthetic oligonucleotide
gcaatcccgcccctcacccctctgtttagtattag

SEQ ID NO: 161240 - DNA, 35 bp, Artificial Sequence
  Synthetic oligonucleotide
tccgtcgttgtcgctctcccttggtctatgtcccg

SEQ ID NO: 161241 - DNA, 35 bp, Artificial Sequence
  Synthetic oligonucleotide
tacggagacgcgcgcacggctctaccactcctccg

SEQ ID NO: 161242 - DNA, 35 bp, Artificial Sequence
  Synthetic oligonucleotide
gacatctcccgctactcttacccttcctggttggg

SEQ ID NO: 161243 - DNA, 35 bp, Artificial Sequence
  Synthetic oligonucleotide
tctgaccgactccccacttcccggtttccaacctg

SEQ ID NO: 161244 - DNA, 35 bp, Artificial Sequence
  Synthetic oligonucleotide
tacgtcccgcttccatcgctaccgtcaaagccctg

SEQ ID NO: 161245 - DNA, 35 bp, Artificial Sequence
  Synthetic oligonucleotide
gctcagctccccttcgttcacaacgtccctccttg

SEQ ID NO: 161246 - DNA, 35 bp, Artificial Sequence
  Synthetic oligonucleotide
gtcatggcctgtttgtcgccgctatctaacaccat

SEQ ID NO: 161247 - DNA, 35 bp, Artificial Sequence
  Synthetic oligonucleotide
acttgccttcctcctcttcgcctcggtctggccat

SEQ ID NO: 161248 - DNA, 35 bp, Artificial Sequence
  Synthetic oligonucleotide
gacgtagagagcgggggggtatacgggtgctggat

SEQ ID NO: 161249 - DNA, 35 bp, Artificial Sequence
  Synthetic oligonucleotide
accgtgatcgccagcgcccgtcccttccgacccgt

SEQ ID NO: 161250 - DNA, 35 bp, Artificial Sequence
  Synthetic oligonucleotide
acccccctcctccggtatccgtacggaccttgggt

SEQ ID NO: 161251 - DNA, 35 bp, Artificial Sequence
  Synthetic oligonucleotide
tcgcatgtccattctcacttgcgttttccaccatt

SEQ ID NO: 161252 - DNA, 35 bp, Artificial Sequence
  Synthetic oligonucleotide
tcacgcccacctcacccttgggttttccaagtatt

SEQ ID NO: 161253 - DNA, 35 bp, Artificial Sequence
  Synthetic oligonucleotide
gccatcctccccattcgcgacgcgcacacaccgtt

SEQ ID NO: 161254 - DNA, 35 bp, Artificial Sequence
  Synthetic oligonucleotide
tacgtgagaaggaggagcatgttgagagggaggtt

SEQ ID NO: 161255 - DNA, 35 bp, Artificial Sequence
  Synthetic oligonucleotide
acgacgaagaggcgtacggcgccatctaccctttt

SEQ ID NO: 161256 - DNA, 35 bp, Artificial Sequence
  Synthetic oligonucleotide
tagaccagccacttcaccatgctctaggctcccaa

SEQ ID NO: 161257 - DNA, 36 bp, Artificial Sequence
  Synthetic oligonucleotide
tacgctgggccccatatacttttcgctctgtcccaa

SEQ ID NO: 161258 - DNA, 36 bp, Artificial Sequence
  Synthetic oligonucleotide
tacctcccgggggggggtaaaatgctggggagggaa

SEQ ID NO: 161259 - DNA, 35 bp, Artificial Sequence
  Synthetic oligonucleotide
gaacctccgcctcttgattgccgtgcatggtacca

SEQ ID NO: 161260 - DNA, 35 bp, Artificial Sequence
  Synthetic oligonucleotide
ttgtgcaccggtctgcgattcccttattcacgcca

SEQ ID NO: 161261 - DNA, 35 bp, Artificial Sequence
  Synthetic oligonucleotide
cctccagtaccccacgcaccgacccatcgccgcca

SEQ ID NO: 161262 - DNA, 36 bp, Artificial Sequence
  Synthetic oligonucleotide
acccaggtccatacactgcctcgtgcctctgtgcca

SEQ ID NO: 161263 - DNA, 36 bp, Artificial Sequence
  Synthetic oligonucleotide
gtcactcacacgttccttagttctcatcggtatcca

SEQ ID NO: 161264 - DNA, 35 bp, Artificial Sequence
  Synthetic oligonucleotide
agtcacaggagagggggcaaaagataagacgagca

SEQ ID NO: 161265 - DNA, 35 bp, Artificial Sequence
  Synthetic oligonucleotide
accctccctggtcgtgtgcttccatttagctctca

SEQ ID NO: 161266 - DNA, 37 bp, Artificial Sequence
  Synthetic oligonucleotide
gtagagcaagaagggtggtgtgagggaatacgtcaga

SEQ ID NO: 161267 - DNA, 37 bp, Artificial Sequence
  Synthetic oligonucleotide
atgcaactcgttgtcaatctcgctcccttgttatcga

SEQ ID NO: 161268 - DNA, 37 bp, Artificial Sequence
  Synthetic oligonucleotide
ggtaaacgggggggagtgaaatggaaaactgagggga

SEQ ID NO: 161269 - DNA, 37 bp, Artificial Sequence
  Synthetic oligonucleotide
taagggggtccagtgtgggcgggtggcgatgggggga

SEQ ID NO: 161270 - DNA, 38 bp, Artificial Sequence
  Synthetic oligonucleotide
ttggggtgttctgtaggggatggggtttggggtaatga

SEQ ID NO: 161271 - DNA, 38 bp, Artificial Sequence
  Synthetic oligonucleotide
aacacggtggaggtggggcaggaggggggaagagatga

SEQ ID NO: 161272 - DNA, 37 bp, Artificial Sequence
  Synthetic oligonucleotide
tgttgcggctcctttcgtgtcactttgctccatctga

SEQ ID NO: 161273 - DNA, 38 bp, Artificial Sequence
  Synthetic oligonucleotide
aagggacaggatggcgggggacaagggggagccggtga

SEQ ID NO: 161274 - DNA, 38 bp, Artificial Sequence
  Synthetic oligonucleotide
tcccaccggcatctttctgcacttccccatccgtgtga

SEQ ID NO: 161275 - DNA, 29 bp, Artificial Sequence
  Synthetic oligonucleotide
tccacggatcttccgccattcacacttga

SEQ ID NO: 161276 - DNA, 37 bp, Artificial Sequence
  Synthetic oligonucleotide
ttcgtctaactcatctcgcgtactgccctgcccttga

SEQ ID NO: 161277 - DNA, 38 bp, Artificial Sequence
  Synthetic oligonucleotide
tagtcgccctccctcacccgccggcgtggcctccttga

SEQ ID NO: 161278 - DNA, 38 bp, Artificial Sequence
  Synthetic oligonucleotide
tcgacgcctcccgggtttagtttaccctctgcctttga

SEQ ID NO: 161279 - DNA, 37 bp, Artificial Sequence
  Synthetic oligonucleotide
atcccacgacccccgccccgtgtccgtattcttttga

SEQ ID NO: 161280 - DNA, 36 bp, Artificial Sequence
  Synthetic oligonucleotide
ttgcgcataccgagtttttttggccattcatcacta

SEQ ID NO: 161281 - DNA, 36 bp, Artificial Sequence
  Synthetic oligonucleotide
ttcgggcctgactcctcttcgtatctagcctactta

SEQ ID NO: 161282 - DNA, 36 bp, Artificial Sequence
  Synthetic oligonucleotide
agcataccgcatacgtttcccaagtcctcgttctta

SEQ ID NO: 161283 - DNA, 35 bp, Artificial Sequence
  Synthetic oligonucleotide
acagacgctccatcgcatttctcgggctaaccaac

SEQ ID NO: 161284 - DNA, 35 bp, Artificial Sequence
  Synthetic oligonucleotide
tgcgccccggtttgggaaaagggcgggtggggaac

SEQ ID NO: 161285 - DNA, 35 bp, Artificial Sequence
  Synthetic oligonucleotide
ttggacttccgcaggctgccattgcccgactacac

SEQ ID NO: 161286 - DNA, 34 bp, Artificial Sequence
  Synthetic oligonucleotide
ttcacgtgcgtacattcctgttttctcgtcctac

SEQ ID NO: 161287 - DNA, 35 bp, Artificial Sequence
  Synthetic oligonucleotide
gctaccctctacccccattgttacgctacagcacc

SEQ ID NO: 161288 - DNA, 35 bp, Artificial Sequence
  Synthetic oligonucleotide
acgcccgttggtcgccaaattgctcactgtttacc

SEQ ID NO: 161289 - DNA, 35 bp, Artificial Sequence
  Synthetic oligonucleotide
acattcaccgcccccattggatctgtctcgcaccc

SEQ ID NO: 161290 - DNA, 35 bp, Artificial Sequence
  Synthetic oligonucleotide
tctctccgtgacgaactgtccggtccctacgcccc

SEQ ID NO: 161291 - DNA, 35 bp, Artificial Sequence
  Synthetic oligonucleotide
acttccacaacgtgtacgttacccccgccgagccc

SEQ ID NO: 161292 - DNA, 35 bp, Artificial Sequence
  Synthetic oligonucleotide
gtcctgaccgtccatcctgatctgtctctgtgccc

SEQ ID NO: 161293 - DNA, 35 bp, Artificial Sequence
  Synthetic oligonucleotide
gtcgccacgagcctgttccactgatatgattgccc

SEQ ID NO: 161294 - DNA, 36 bp, Artificial Sequence
  Synthetic oligonucleotide
acagatggccgacgccgccttcccgtcctattgccc

SEQ ID NO: 161295 - DNA, 35 bp, Artificial Sequence
  Synthetic oligonucleotide
tgtagaactctccgtgagaacgaaccacgcctccc

SEQ ID NO: 161296 - DNA, 35 bp, Artificial Sequence
  Synthetic oligonucleotide
gttgccctcggcctcgcaatcaattccaggctccc

SEQ ID NO: 161297 - DNA, 35 bp, Artificial Sequence
  Synthetic oligonucleotide
acatcaacactctgcctttctatggggaatgtccc

SEQ ID NO: 161298 - DNA, 34 bp, Artificial Sequence
  Synthetic oligonucleotide
atccgtgaaaaccagtgcccttcgtcgacccgcc

SEQ ID NO: 161299 - DNA, 35 bp, Artificial Sequence
  Synthetic oligonucleotide
gccgccttcgtcttacgttacacgtagtccctgcc

SEQ ID NO: 161300 - DNA, 34 bp, Artificial Sequence
  Synthetic oligonucleotide
gaacgcgcgtatcgcggtaattttcatcttctcc

SEQ ID NO: 161301 - DNA, 35 bp, Artificial Sequence
  Synthetic oligonucleotide
tatggcccacacctgtctgtattccttggtgccgc

SEQ ID NO: 161302 - DNA, 35 bp, Artificial Sequence
  Synthetic oligonucleotide
tgtggcgtaaatcgaagtctgtccactcccgcctc

SEQ ID NO: 161303 - DNA, 35 bp, Artificial Sequence
  Synthetic oligonucleotide
tcaccgccctgtctttgttctcagcccacctgctc

SEQ ID NO: 161304 - DNA, 35 bp, Artificial Sequence
  Synthetic oligonucleotide
gccgccccacaacttccgccccacacctggtagtc

SEQ ID NO: 161305 - DNA, 35 bp, Artificial Sequence
  Synthetic oligonucleotide
gtcccctcacccttaccttcgtgaactgcctggtc

SEQ ID NO: 161306 - DNA, 35 bp, Artificial Sequence
  Synthetic oligonucleotide
gccgtcccgtggactccccattacatcctttcttc

SEQ ID NO: 161307 - DNA, 35 bp, Artificial Sequence
  Synthetic oligonucleotide
gattggtcccacattgttctcatgtcatcttgttc

SEQ ID NO: 161308 - DNA, 35 bp, Artificial Sequence
  Synthetic oligonucleotide
gcgcaacaagcagggagaaaaagggtgggacgaag

SEQ ID NO: 161309 - DNA, 35 bp, Artificial Sequence
  Synthetic oligonucleotide
tcgccgttctctactcgcctatttgcctcgcctag

SEQ ID NO: 161310 - DNA, 35 bp, Artificial Sequence
  Synthetic oligonucleotide
gtcgtccgtccttttcctgcagctacccgtcgccg

SEQ ID NO: 161311 - DNA, 35 bp, Artificial Sequence
  Synthetic oligonucleotide
atggggatgggagggaggagagttgtggcctggcg

SEQ ID NO: 161312 - DNA, 35 bp, Artificial Sequence
  Synthetic oligonucleotide
gtttgaggggcacggggatagagggaactgatggg

SEQ ID NO: 161313 - DNA, 35 bp, Artificial Sequence
  Synthetic oligonucleotide
ggaaaagggggagtagaggtgggaatgtggctggg

SEQ ID NO: 161314 - DNA, 35 bp, Artificial Sequence
  Synthetic oligonucleotide
tccctacgccctccgaactcctctactatgctggg

SEQ ID NO: 161315 - DNA, 35 bp, Artificial Sequence
  Synthetic oligonucleotide
tctatgatccgaccgccgctccatccaatttcatg

SEQ ID NO: 161316 - DNA, 35 bp, Artificial Sequence
  Synthetic oligonucleotide
gctcccccacaagtttgcttgtttagcccaccctg

SEQ ID NO: 161317 - DNA, 35 bp, Artificial Sequence
  Synthetic oligonucleotide
acgaacggccaggctttatttctttggtctccctg

SEQ ID NO: 161318 - DNA, 35 bp, Artificial Sequence
  Synthetic oligonucleotide
ttacatttacgccctcgtgtttcttccgccctctg

SEQ ID NO: 161319 - DNA, 35 bp, Artificial Sequence
  Synthetic oligonucleotide
aactccccgtctgggtgctggtcgccatccctcct

SEQ ID NO: 161320 - DNA, 35 bp, Artificial Sequence
  Synthetic oligonucleotide
tccccatctatctgcaggtctttacgctacttgct

SEQ ID NO: 161321 - DNA, 35 bp, Artificial Sequence
  Synthetic oligonucleotide
actgatgtgggggggaaagggctaaggatacgagt

SEQ ID NO: 161322 - DNA, 34 bp, Artificial Sequence
  Synthetic oligonucleotide
gaacaagttacgggaggtgcgggcgggaagacgt

SEQ ID NO: 161323 - DNA, 35 bp, Artificial Sequence
  Synthetic oligonucleotide
gaacgcgcgtgcttatgttccctatccccttccgt

SEQ ID NO: 161324 - DNA, 35 bp, Artificial Sequence
  Synthetic oligonucleotide
taagtgcgcgtcgtccacctgccgccctttcgtgt

SEQ ID NO: 161325 - DNA, 32 bp, Artificial Sequence
  Synthetic oligonucleotide
agtactcctccgctctgttttgccaccttatt

SEQ ID NO: 161326 - DNA, 35 bp, Artificial Sequence
  Synthetic oligonucleotide
tcgacgtgccttttcctgtaattcgccctttactt

SEQ ID NO: 161327 - DNA, 35 bp, Artificial Sequence
  Synthetic oligonucleotide
gcagtgtattgggtagggcggggtgggcggtattt

SEQ ID NO: 161328 - DNA, 35 bp, Artificial Sequence
  Synthetic oligonucleotide
ttcgaggcgactccttgtcttttgcccttttgttt

SEQ ID NO: 161329 - DNA, 36 bp, Artificial Sequence
  Synthetic oligonucleotide
aatgggggaggaggcgggaaggggggtcggggagaa

SEQ ID NO: 161330 - DNA, 36 bp, Artificial Sequence
  Synthetic oligonucleotide
tcagtagtaggaggagagggggcaataagtgtgaca

SEQ ID NO: 161331 - DNA, 36 bp, Artificial Sequence
  Synthetic oligonucleotide
ttgacatgcacgcgttttttttatggtcacccccca

SEQ ID NO: 161332 - DNA, 36 bp, Artificial Sequence
  Synthetic oligonucleotide
tgccctggcccccggttctctcttctgcagtcccca

SEQ ID NO: 161333 - DNA, 35 bp, Artificial Sequence
  Synthetic oligonucleotide
tgacacggcgatcggcatcgtactacccttcgcca

SEQ ID NO: 161334 - DNA, 35 bp, Artificial Sequence
  Synthetic oligonucleotide
tcagcacgcaccatctaagtctaccgcgtatgcca

SEQ ID NO: 161335 - DNA, 36 bp, Artificial Sequence
  Synthetic oligonucleotide
agccctgcccctgccttagactatccataccatcca

SEQ ID NO: 161336 - DNA, 36 bp, Artificial Sequence
  Synthetic oligonucleotide
tcgaggccactccacgccggttccatcaatagtcca

SEQ ID NO: 161337 - DNA, 35 bp, Artificial Sequence
  Synthetic oligonucleotide
gcacgccacgaggcccatctggttgctccattcca

SEQ ID NO: 161338 - DNA, 36 bp, Artificial Sequence
  Synthetic oligonucleotide
gtagccgctccatctgctgttcccttcgagtgcgca

SEQ ID NO: 161339 - DNA, 36 bp, Artificial Sequence
  Synthetic oligonucleotide
gtgtccacaggcaatgctcagtctcccatccgctca

SEQ ID NO: 161340 - DNA, 37 bp, Artificial Sequence
  Synthetic oligonucleotide
gacacggggagccagcaggagcagcaaggacgggaga

SEQ ID NO: 161341 - DNA, 37 bp, Artificial Sequence
  Synthetic oligonucleotide
tgcatttccccaccgttgctctattcctgttctacga

SEQ ID NO: 161342 - DNA, 37 bp, Artificial Sequence
  Synthetic oligonucleotide
agccacgtttgctctcgtttacccgcatacctcccga

SEQ ID NO: 161343 - DNA, 37 bp, Artificial Sequence
  Synthetic oligonucleotide
tcctgccctctgccatattcgttctctgatgctccga

SEQ ID NO: 161344 - DNA, 37 bp, Artificial Sequence
  Synthetic oligonucleotide
gacgcgtagtccaccgtagccgcctccctgatctcga

SEQ ID NO: 161345 - DNA, 37 bp, Artificial Sequence
  Synthetic oligonucleotide
ggaccatagggaggacgggtggggtggagccatcgga

SEQ ID NO: 161346 - DNA, 37 bp, Artificial Sequence
  Synthetic oligonucleotide
gacatgtctgtgaggggtgggtactctgatgcgggga

SEQ ID NO: 161347 - DNA, 37 bp, Artificial Sequence
  Synthetic oligonucleotide
gttgtaggagaggatgaagggaggggcagagatggga

SEQ ID NO: 161348 - DNA, 37 bp, Artificial Sequence
  Synthetic oligonucleotide
gacgttgggagggaggggcccaccataacttgtggga

SEQ ID NO: 161349 - DNA, 36 bp, Artificial Sequence
  Synthetic oligonucleotide
atccacccgcacacctgttcacttcgcactactgga

SEQ ID NO: 161350 - DNA, 37 bp, Artificial Sequence
  Synthetic oligonucleotide
tgtccactccgacatctaaccctgctgcccttcctga

SEQ ID NO: 161351 - DNA, 38 bp, Artificial Sequence
  Synthetic oligonucleotide
gccaagctcaccctgtccaatcttgtcgcctttcctga

SEQ ID NO: 161352 - DNA, 38 bp, Artificial Sequence
  Synthetic oligonucleotide
gaaggggagtggagggggtgaggacgacttggtattga

SEQ ID NO: 161353 - DNA, 38 bp, Artificial Sequence
  Synthetic oligonucleotide
gtcgattgttcccatgtttccgttgctcgttcccttga

SEQ ID NO: 161354 - DNA, 38 bp, Artificial Sequence
  Synthetic oligonucleotide
gagcaaccctatgagtgtagtccctccgcccttcttga

SEQ ID NO: 161355 - DNA, 37 bp, Artificial Sequence
  Synthetic oligonucleotide
aacacgctacctgtggcttcactcacctctccgttga

SEQ ID NO: 161356 - DNA, 36 bp, Artificial Sequence
  Synthetic oligonucleotide
tccccacctcagccatattctaccgcctagtgttga

SEQ ID NO: 161357 - DNA, 38 bp, Artificial Sequence
  Synthetic oligonucleotide
tgtctacgccccgaccctctctatctgagtccttttga

SEQ ID NO: 161358 - DNA, 36 bp, Artificial Sequence
  Synthetic oligonucleotide
ttgcacccacatgtacaacccaccctacctgccata

SEQ ID NO: 161359 - DNA, 36 bp, Artificial Sequence
  Synthetic oligonucleotide
ggtcaaccggggagggcgggcagaggctgggcacta

SEQ ID NO: 161360 - DNA, 36 bp, Artificial Sequence
  Synthetic oligonucleotide
acccatccgcccgaggtgcctcgaccttctggccta

SEQ ID NO: 161361 - DNA, 36 bp, Artificial Sequence
  Synthetic oligonucleotide
actacaccttctggactgacaccataccgatcgcta

SEQ ID NO: 161362 - DNA, 36 bp, Artificial Sequence
  Synthetic oligonucleotide
tccgccttaccccgcccgtgaggtctattccatgta

SEQ ID NO: 161363 - DNA, 36 bp, Artificial Sequence
  Synthetic oligonucleotide
ttcaaccatctgcctgctcgacacataaatccgtta

SEQ ID NO: 161364 - DNA, 35 bp, Artificial Sequence
  Synthetic oligonucleotide
gcctcccctcccacgcggcccaggccatgttcaac

SEQ ID NO: 161365 - DNA, 35 bp, Artificial Sequence
  Synthetic oligonucleotide
gtgccatcactcttcgtcagggtttaccgccccac

SEQ ID NO: 161366 - DNA, 35 bp, Artificial Sequence
  Synthetic oligonucleotide
tgttccccggatgcatcttcacacacactgcgcac

SEQ ID NO: 161367 - DNA, 35 bp, Artificial Sequence
  Synthetic oligonucleotide
tactgccgctcccatggcctttccctgatgtgcac

SEQ ID NO: 161368 - DNA, 35 bp, Artificial Sequence
  Synthetic oligonucleotide
ttcgtccccgaccattcatatgcccgttttccacc

SEQ ID NO: 161369 - DNA, 35 bp, Artificial Sequence
  Synthetic oligonucleotide
tcatcacccgccccaccgttctgggatcaggcccc

SEQ ID NO: 161370 - DNA, 35 bp, Artificial Sequence
  Synthetic oligonucleotide
tgctgaccatctagccgcctaccctgggagatccc

SEQ ID NO: 161371 - DNA, 35 bp, Artificial Sequence
  Synthetic oligonucleotide
tatgccgtctatcttcggttcgagcaccacctccc

SEQ ID NO: 161372 - DNA, 35 bp, Artificial Sequence
  Synthetic oligonucleotide
tgaccgctccccatcgtcattcagccgcacccgcc

SEQ ID NO: 161373 - DNA, 35 bp, Artificial Sequence
  Synthetic oligonucleotide
tcacacaacaccgctcccgacgctgatatcccgcc

SEQ ID NO: 161374 - DNA, 35 bp, Artificial Sequence
  Synthetic oligonucleotide
gaattgcgcattgcaacgaacccccctttcatgcc

SEQ ID NO: 161375 - DNA, 35 bp, Artificial Sequence
  Synthetic oligonucleotide
gcgcaaggctgtctatccgcttataatcccttgcc

SEQ ID NO: 161376 - DNA, 35 bp, Artificial Sequence
  Synthetic oligonucleotide
ttaccttccacggcgatgcttacccgctcgtttcc

SEQ ID NO: 161377 - DNA, 35 bp, Artificial Sequence
  Synthetic oligonucleotide
tcgtatggcctcgcatctcgctcattaagttttcc

SEQ ID NO: 161378 - DNA, 35 bp, Artificial Sequence
  Synthetic oligonucleotide
gccatagactctatgcttatagctctccgttttcc

SEQ ID NO: 161379 - DNA, 35 bp, Artificial Sequence
  Synthetic oligonucleotide
acatcgcgccactcccctatatatgatcacaccgc

SEQ ID NO: 161380 - DNA, 35 bp, Artificial Sequence
  Synthetic oligonucleotide
tctactcacgtcccgccggccacgtttttcaccgc

SEQ ID NO: 161381 - DNA, 34 bp, Artificial Sequence
  Synthetic oligonucleotide
tggggcctcccccgccccgctgttcacctccggc

SEQ ID NO: 161382 - DNA, 35 bp, Artificial Sequence
  Synthetic oligonucleotide
tcagtctctcgcccgtccttgcgatctcttcatgc

SEQ ID NO: 161383 - DNA, 35 bp, Artificial Sequence
  Synthetic oligonucleotide
ggccctcgcgatgcctctgtccacacccgccctgc

SEQ ID NO: 161384 - DNA, 35 bp, Artificial Sequence
  Synthetic oligonucleotide
tcattcctccgtgcgctcacctctccacctcgatc

SEQ ID NO: 161385 - DNA, 35 bp, Artificial Sequence
  Synthetic oligonucleotide
acctcccgtcgactggcccccgaggtaaggccctc

SEQ ID NO: 161386 - DNA, 35 bp, Artificial Sequence
  Synthetic oligonucleotide
gacggccatcaactatccgttattcagtctcgctc

SEQ ID NO: 161387 - DNA, 35 bp, Artificial Sequence
  Synthetic oligonucleotide
gtctagtctgtcgccccgttcccttaatgcccgtc

SEQ ID NO: 161388 - DNA, 35 bp, Artificial Sequence
  Synthetic oligonucleotide
tgcccgggccaagtgcatctccgctcaatcatgtc

SEQ ID NO: 161389 - DNA, 35 bp, Artificial Sequence
  Synthetic oligonucleotide
gactgcgcaccttgctgctccccgaatccgccttc

SEQ ID NO: 161390 - DNA, 35 bp, Artificial Sequence
  Synthetic oligonucleotide
tataacggcccctctcaattgtcccacttcccccg

SEQ ID NO: 161391 - DNA, 35 bp, Artificial Sequence
  Synthetic oligonucleotide
acgacgccaccaatacccgcaggcccccgccgccg

SEQ ID NO: 161392 - DNA, 35 bp, Artificial Sequence
  Synthetic oligonucleotide
tcatgggcgggtcgggttgatgtaggggaaggtcg

SEQ ID NO: 161393 - DNA, 35 bp, Artificial Sequence
  Synthetic oligonucleotide
gtgacaacgcgcctcccatcccttaccaggccagg

SEQ ID NO: 161394 - DNA, 35 bp, Artificial Sequence
  Synthetic oligonucleotide
tcccatccctgcgactaccgttccgatatcccctg

SEQ ID NO: 161395 - DNA, 35 bp, Artificial Sequence
  Synthetic oligonucleotide
agacggcccccttcgctcgttctttgccccagctg

SEQ ID NO: 161396 - DNA, 35 bp, Artificial Sequence
  Synthetic oligonucleotide
ggagagggaggggacgggtcgataccgattaagtg

SEQ ID NO: 161397 - DNA, 35 bp, Artificial Sequence
  Synthetic oligonucleotide
ggacaagccggctggattctatgtcccctctcgtg

SEQ ID NO: 161398 - DNA, 35 bp, Artificial Sequence
  Synthetic oligonucleotide
cccaccccgtcccagttcgctaatgcactccacat

SEQ ID NO: 161399 - DNA, 35 bp, Artificial Sequence
  Synthetic oligonucleotide
gttgtgcgtgcccctcgttgtcctctatttgcact

SEQ ID NO: 161400 - DNA, 35 bp, Artificial Sequence
  Synthetic oligonucleotide
gactagtcagacacacgcgcctccacatctcccct

SEQ ID NO: 161401 - DNA, 35 bp, Artificial Sequence
  Synthetic oligonucleotide
tgcaccatcaacggtggtagcttgtaattttccct

SEQ ID NO: 161402 - DNA, 35 bp, Artificial Sequence
  Synthetic oligonucleotide
agcgtatcatcacctctgtaagccgctccacttct

SEQ ID NO: 161403 - DNA, 35 bp, Artificial Sequence
  Synthetic oligonucleotide
tcctacccttcctccggccttgttaccgactccgt

SEQ ID NO: 161404 - DNA, 35 bp, Artificial Sequence
  Synthetic oligonucleotide
atcgtccgccccacgactcttcctccgaactcggt

SEQ ID NO: 161405 - DNA, 35 bp, Artificial Sequence
  Synthetic oligonucleotide
gccgtaaccccgcatccgcccgctgcgctacctgt

SEQ ID NO: 161406 - DNA, 35 bp, Artificial Sequence
  Synthetic oligonucleotide
acccccgggtctttcgtatcttgggcacctcctgt

SEQ ID NO: 161407 - DNA, 35 bp, Artificial Sequence
  Synthetic oligonucleotide
tccaatgtccgtgtcgccctaccctttcttcttgt

SEQ ID NO: 161408 - DNA, 32 bp, Artificial Sequence
  Synthetic oligonucleotide
gagcagaactcctgccccgctactaatccctt

SEQ ID NO: 161409 - DNA, 35 bp, Artificial Sequence
  Synthetic oligonucleotide
gcctgtccctatatgtcgtcgccccccgtctcctt

SEQ ID NO: 161410 - DNA, 35 bp, Artificial Sequence
  Synthetic oligonucleotide
gagccgttcctgctacacgccttcgcaaccttgtt

SEQ ID NO: 161411 - DNA, 36 bp, Artificial Sequence
  Synthetic oligonucleotide
gcacatcccaccccgttgtactactaatggttccaa

SEQ ID NO: 161412 - DNA, 36 bp, Artificial Sequence
  Synthetic oligonucleotide
gtttatggccccactgcggttcgcacccccgattaa

SEQ ID NO: 161413 - DNA, 36 bp, Artificial Sequence
  Synthetic oligonucleotide
acccgcagcccaccatctccggagtccccctacaca

SEQ ID NO: 161414 - DNA, 35 bp, Artificial Sequence
  Synthetic oligonucleotide
gcctcaacctatctgtactttacgactctgctaca

SEQ ID NO: 161415 - DNA, 36 bp, Artificial Sequence
  Synthetic oligonucleotide
atacgagtgctcagttgtctgtctcacccgccccca

SEQ ID NO: 161416 - DNA, 36 bp, Artificial Sequence
  Synthetic oligonucleotide
aagtaggcccgcagatctccccccgctaggttcgca

SEQ ID NO: 161417 - DNA, 35 bp, Artificial Sequence
  Synthetic oligonucleotide
ggtatgcacggcgctatagggggaggaggagggca

SEQ ID NO: 161418 - DNA, 36 bp, Artificial Sequence
  Synthetic oligonucleotide
gactaccgcttatgcacgccgcttcctcccactgca

SEQ ID NO: 161419 - DNA, 35 bp, Artificial Sequence
  Synthetic oligonucleotide
ccactcacctcctgctctggatacccgtttactca

SEQ ID NO: 161420 - DNA, 36 bp, Artificial Sequence
  Synthetic oligonucleotide
tccggaccggcccgtgctttcatcttacccttttca

SEQ ID NO: 161421 - DNA, 35 bp, Artificial Sequence
  Synthetic oligonucleotide
actgctgcggactccttgcgccccctgtcttttca

SEQ ID NO: 161422 - DNA, 37 bp, Artificial Sequence
  Synthetic oligonucleotide
gactcctctgctaccctactgcgtgaccccttccaga

SEQ ID NO: 161423 - DNA, 37 bp, Artificial Sequence
  Synthetic oligonucleotide
gctgacagccgcggttcccacacccctcctcctgaga

SEQ ID NO: 161424 - DNA, 37 bp, Artificial Sequence
  Synthetic oligonucleotide
ggggagaagaggagatattggggggtgaagtagacga

SEQ ID NO: 161425 - DNA, 36 bp, Artificial Sequence
  Synthetic oligonucleotide
tccacaggtcccataccctgctatcaacactcccga

SEQ ID NO: 161426 - DNA, 36 bp, Artificial Sequence
  Synthetic oligonucleotide
gagtggtagggggcgggctggggtgggctgcaagga

SEQ ID NO: 161427 - DNA, 37 bp, Artificial Sequence
  Synthetic oligonucleotide
gcgagtcgcgccgcccctattccaccccccagtagga

SEQ ID NO: 161428 - DNA, 37 bp, Artificial Sequence
  Synthetic oligonucleotide
tgggggtgtcaggggtaatcacttggggacagaggga

SEQ ID NO: 161429 - DNA, 36 bp, Artificial Sequence
  Synthetic oligonucleotide
ttgatacgggcggtagaaggaaagggcggggaggga

SEQ ID NO: 161430 - DNA, 37 bp, Artificial Sequence
  Synthetic oligonucleotide
ttgggtcaagcgagggggagggaatgtctggccggga

SEQ ID NO: 161431 - DNA, 37 bp, Artificial Sequence
  Synthetic oligonucleotide
gcgaagtgtatattttggaaaaggggctgggggggga

SEQ ID NO: 161432 - DNA, 37 bp, Artificial Sequence
  Synthetic oligonucleotide
tgagggtgggtagggggccttatacgtgcgtggggga

SEQ ID NO: 161433 - DNA, 37 bp, Artificial Sequence
  Synthetic oligonucleotide
aatgccacagggagtgaggggtaaggggaatgtggga

SEQ ID NO: 161434 - DNA, 38 bp, Artificial Sequence
  Synthetic oligonucleotide
tacgaaggagagggggaaggaagctcacgggacactga

SEQ ID NO: 161435 - DNA, 36 bp, Artificial Sequence
  Synthetic oligonucleotide
acctccccgttcaaacgtcttgctccgccgccctga

SEQ ID NO: 161436 - DNA, 38 bp, Artificial Sequence
  Synthetic oligonucleotide
ggactcgcccatcgtcctctcttcgtgccctgttctga

SEQ ID NO: 161437 - DNA, 38 bp, Artificial Sequence
  Synthetic oligonucleotide
agtagggggagggtgggcgaagcaggcccagacggtga

SEQ ID NO: 161438 - DNA, 37 bp, Artificial Sequence
  Synthetic oligonucleotide
attggtgagcggggagggggggaggcaggggatgtga

SEQ ID NO: 161439 - DNA, 38 bp, Artificial Sequence
  Synthetic oligonucleotide
gtactctccgccggcccaactgccccactcccctgtga

SEQ ID NO: 161440 - DNA, 38 bp, Artificial Sequence
  Synthetic oligonucleotide
tcacgtcaagcccttattcgtccggccaacctccttga

SEQ ID NO: 161441 - DNA, 38 bp, Artificial Sequence
  Synthetic oligonucleotide
tgggaacgtcacttatctgtctgctgccctttccttga

SEQ ID NO: 161442 - DNA, 38 bp, Artificial Sequence
  Synthetic oligonucleotide
gacgatgcgtcccccgtgcctagtcctcccgcttttga

SEQ ID NO: 161443 - DNA, 36 bp, Artificial Sequence
  Synthetic oligonucleotide
tcgaggggactgagggcgggaggaactgcaagtata

SEQ ID NO: 161444 - DNA, 36 bp, Artificial Sequence
  Synthetic oligonucleotide
acccgacgacacctggacattccttccgcttaccta

SEQ ID NO: 161445 - DNA, 35 bp, Artificial Sequence
  Synthetic oligonucleotide
acatcctcactcgtgcggcctcgccactcacccta

SEQ ID NO: 161446 - DNA, 35 bp, Artificial Sequence
  Synthetic oligonucleotide
gacaggcctgtccgcttctaagttttagcctccta

SEQ ID NO: 161447 - DNA, 36 bp, Artificial Sequence
  Synthetic oligonucleotide
gcgacctgggcacggtggaggggaaaggaaaagcta

SEQ ID NO: 161448 - DNA, 35 bp, Artificial Sequence
  Synthetic oligonucleotide
agccgctcagccctgctcggaatgccatccatcta

SEQ ID NO: 161449 - DNA, 36 bp, Artificial Sequence
  Synthetic oligonucleotide
ggtgccgcatggtaaccacgccctctttcccaagta

SEQ ID NO: 161450 - DNA, 36 bp, Artificial Sequence
  Synthetic oligonucleotide
cacctgtgtcgccccctagatgcctttccctgctta

SEQ ID NO: 161451 - DNA, 35 bp, Artificial Sequence
  Synthetic oligonucleotide
accagcaccgctttttcgccccattgcctaggtta

SEQ ID NO: 161452 - DNA, 35 bp, Artificial Sequence
  Synthetic oligonucleotide
tcgcgcccatcctgttatgcccttaggtcctttta

SEQ ID NO: 161453 - DNA, 35 bp, Artificial Sequence
  Synthetic oligonucleotide
gagctaggcctctgctcgtaatccacctgctaaac

SEQ ID NO: 161454 - DNA, 35 bp, Artificial Sequence
  Synthetic oligonucleotide
gcaatcggaactgtccccacgctagcgcctcctac

SEQ ID NO: 161455 - DNA, 35 bp, Artificial Sequence
  Synthetic oligonucleotide
atggaatcagaccgtcgtgcttcgcccacgccccc

SEQ ID NO: 161456 - DNA, 35 bp, Artificial Sequence
  Synthetic oligonucleotide
gaccccgctcatcacatttatccgcatcgcgcccc

SEQ ID NO: 161457 - DNA, 35 bp, Artificial Sequence
  Synthetic oligonucleotide
accacccgtccgtcttatccgactcaccgcatccc

SEQ ID NO: 161458 - DNA, 34 bp, Artificial Sequence
  Synthetic oligonucleotide
tagctatgccctttctccgctcgtgcttcgcgcc

SEQ ID NO: 161459 - DNA, 35 bp, Artificial Sequence
  Synthetic oligonucleotide
acccactcgcttttgctttacccagaacacctgcc

SEQ ID NO: 161460 - DNA, 35 bp, Artificial Sequence
  Synthetic oligonucleotide
tcctgagatccggcgtcatttaccgcgacccctcc

SEQ ID NO: 161461 - DNA, 35 bp, Artificial Sequence
  Synthetic oligonucleotide
tgccgatgcacggcgcatactgtacttattcctcc

SEQ ID NO: 161462 - DNA, 35 bp, Artificial Sequence
  Synthetic oligonucleotide
tcaccgctccccgtgaagtaacgctctttttgtcc

SEQ ID NO: 161463 - DNA, 35 bp, Artificial Sequence
  Synthetic oligonucleotide
tgtcaccgctgctcttacccaacatcagcgtccgc

SEQ ID NO: 161464 - DNA, 35 bp, Artificial Sequence
  Synthetic oligonucleotide
tatgaccctccgataggatttctcgctcccatcgc

SEQ ID NO: 161465 - DNA, 35 bp, Artificial Sequence
  Synthetic oligonucleotide
tatctaccgcctgtttcgtcctccatatagtggtc

SEQ ID NO: 161466 - DNA, 35 bp, Artificial Sequence
  Synthetic oligonucleotide
acagccatcgcatgcgtagtctctgctctttggtc

SEQ ID NO: 161467 - DNA, 35 bp, Artificial Sequence
  Synthetic oligonucleotide
gaactcgcaggggtacaggggggagggaacaggag

SEQ ID NO: 161468 - DNA, 35 bp, Artificial Sequence
  Synthetic oligonucleotide
aactaggacggaggggggagttgaaggcaggggag

SEQ ID NO: 161469 - DNA, 35 bp, Artificial Sequence
  Synthetic oligonucleotide
gttaacacgacctctgccactgcgccacaccttag

SEQ ID NO: 161470 - DNA, 35 bp, Artificial Sequence
  Synthetic oligonucleotide
gtatgagagtaggtggtggagtagagcggggttag

SEQ ID NO: 161471 - DNA, 35 bp, Artificial Sequence
  Synthetic oligonucleotide
gcctgcccttaatggtttttcttcgcaaacttccg

SEQ ID NO: 161472 - DNA, 35 bp, Artificial Sequence
  Synthetic oligonucleotide
gcaagccaccgcccctgcatccgctcttatcttgg

SEQ ID NO: 161473 - DNA, 35 bp, Artificial Sequence
  Synthetic oligonucleotide
tgtgtagcgtgtacgactgtccaaccttccccctg

SEQ ID NO: 161474 - DNA, 35 bp, Artificial Sequence
  Synthetic oligonucleotide
atgtccgcggtcagtcgctgactttcctccccgtg

SEQ ID NO: 161475 - DNA, 35 bp, Artificial Sequence
  Synthetic oligonucleotide
gggtaaggggagcaggtgggacggggaaaaaggtg

SEQ ID NO: 161476 - DNA, 35 bp, Artificial Sequence
  Synthetic oligonucleotide
gctccgccgcccagcccggttcctattatccaaat

SEQ ID NO: 161477 - DNA, 34 bp, Artificial Sequence
  Synthetic oligonucleotide
tgcctgggtcagctcaatcccatcgcgcaccact

SEQ ID NO: 161478 - DNA, 35 bp, Artificial Sequence
  Synthetic oligonucleotide
actacacgccgccccctgtgtcaaatcaaatcact

SEQ ID NO: 161479 - DNA, 35 bp, Artificial Sequence
  Synthetic oligonucleotide
gtcaccatccccagagtcacaccactgacggccct

SEQ ID NO: 161480 - DNA, 35 bp, Artificial Sequence
  Synthetic oligonucleotide
acctgctctgaagcacacctttccacccgccccgt

SEQ ID NO: 161481 - DNA, 35 bp, Artificial Sequence
  Synthetic oligonucleotide
gtatgctagccgtcacgactacctttcccttccgt

SEQ ID NO: 161482 - DNA, 35 bp, Artificial Sequence
  Synthetic oligonucleotide
gttggacctcccactttccatgccttccgtacggt

SEQ ID NO: 161483 - DNA, 35 bp, Artificial Sequence
  Synthetic oligonucleotide
gcaatcctacccacgcgccgcccgcagacacatgt

SEQ ID NO: 161484 - DNA, 35 bp, Artificial Sequence
  Synthetic oligonucleotide
gcccgccccccaattcctgtgtgtcgcattttatt

SEQ ID NO: 161485 - DNA, 35 bp, Artificial Sequence
  Synthetic oligonucleotide
atccaccaccgcctgaccgcgccgagaccccgctt

SEQ ID NO: 161486 - DNA, 35 bp, Artificial Sequence
  Synthetic oligonucleotide
acgcaaccacgttcttgccacttcatgcttcgctt

SEQ ID NO: 161487 - DNA, 35 bp, Artificial Sequence
  Synthetic oligonucleotide
tccactcgcccctgcatctccgacgttttgaagtt

SEQ ID NO: 161488 - DNA, 36 bp, Artificial Sequence
  Synthetic oligonucleotide
acacgtcgtgatcatcgttccttgcccgtcccccaa

SEQ ID NO: 161489 - DNA, 35 bp, Artificial Sequence
  Synthetic oligonucleotide
gccacccatgccttgcccgacccctcatgcgcgaa

SEQ ID NO: 161490 - DNA, 36 bp, Artificial Sequence
  Synthetic oligonucleotide
gtacctcatctgctcccctgccgtccttgcctaaca

SEQ ID NO: 161491 - DNA, 35 bp, Artificial Sequence
  Synthetic oligonucleotide
cccacccaccgatcgcatctccccgccagagcaca

SEQ ID NO: 161492 - DNA, 35 bp, Artificial Sequence
  Synthetic oligonucleotide
aactatgcctcaatgcttcctccctggatccgcca

SEQ ID NO: 161493 - DNA, 36 bp, Artificial Sequence
  Synthetic oligonucleotide
ttgagggcggtgaacgcgggggaaaggacgggtgca

SEQ ID NO: 161494 - DNA, 35 bp, Artificial Sequence
  Synthetic oligonucleotide
tcttcctcctgtccgccgttgcatgacaacattca

SEQ ID NO: 161495 - DNA, 31 bp, Artificial Sequence
  Synthetic oligonucleotide
acctagaacgccccacttgatcgtctattca

SEQ ID NO: 161496 - DNA, 37 bp, Artificial Sequence
  Synthetic oligonucleotide
tacagggagggtgaagaagcgaccgggaggagggaga

SEQ ID NO: 161497 - DNA, 36 bp, Artificial Sequence
  Synthetic oligonucleotide
ggtaacaggggagaggaaaatgggaggaaggtgaga

SEQ ID NO: 161498 - DNA, 37 bp, Artificial Sequence
  Synthetic oligonucleotide
agacatgtgggaacaataggacgggaaggggaacgga

SEQ ID NO: 161499 - DNA, 37 bp, Artificial Sequence
  Synthetic oligonucleotide
gtagcgtggggccgggatagatagggcgggcgacgga

SEQ ID NO: 161500 - DNA, 36 bp, Artificial Sequence
  Synthetic oligonucleotide
aacggggaagttacggggggggaggcctatgaggga

SEQ ID NO: 161501 - DNA, 35 bp, Artificial Sequence
  Synthetic oligonucleotide
actgggatggtcggtatgggtggggttgagcggga

SEQ ID NO: 161502 - DNA, 37 bp, Artificial Sequence
  Synthetic oligonucleotide
tgtcatcgggggtagaagggggacgggatgacgggga

SEQ ID NO: 161503 - DNA, 36 bp, Artificial Sequence
  Synthetic oligonucleotide
gaagagaggagagataaaaggcatgaggcatgggga

SEQ ID NO: 161504 - DNA, 38 bp, Artificial Sequence
  Synthetic oligonucleotide
gcagggacggaagccgggggaggggcgatgaaccatga

SEQ ID NO: 161505 - DNA, 35 bp, Artificial Sequence
  Synthetic oligonucleotide
gcgacgggcacactattgtctccacccccccctga

SEQ ID NO: 161506 - DNA, 37 bp, Artificial Sequence
  Synthetic oligonucleotide
ggagtgtcgccggattaagcccccgttctcgccctga

SEQ ID NO: 161507 - DNA, 37 bp, Artificial Sequence
  Synthetic oligonucleotide
aaaactgcggcgagtccctgtcctgctaccctcctga

SEQ ID NO: 161508 - DNA, 36 bp, Artificial Sequence
  Synthetic oligonucleotide
gactccgaccgaccatcgtaggccatccccccgtga

SEQ ID NO: 161509 - DNA, 38 bp, Artificial Sequence
  Synthetic oligonucleotide
gggagaagcgaggggtgatggcaggagggtggaggtga

SEQ ID NO: 161510 - DNA, 37 bp, Artificial Sequence
  Synthetic oligonucleotide
attccgcgccactgctttcccccgtctccatatgtga

SEQ ID NO: 161511 - DNA, 38 bp, Artificial Sequence
  Synthetic oligonucleotide
gtgccgtcctggttcaccccgacttccgtgccacttga

SEQ ID NO: 161512 - DNA, 38 bp, Artificial Sequence
  Synthetic oligonucleotide
ggacctcctgccatatgcgaatcgctcgatcctcttga

SEQ ID NO: 161513 - DNA, 38 bp, Artificial Sequence
  Synthetic oligonucleotide
ttcgagctgcaacgggtgaggagggcgggtggtgttga

SEQ ID NO: 161514 - DNA, 37 bp, Artificial Sequence
  Synthetic oligonucleotide
ttccatcctcgacgttagtcatacaccatctctttga

SEQ ID NO: 161515 - DNA, 38 bp, Artificial Sequence
  Synthetic oligonucleotide
ttattccacctcaatcgctgtaccgccacagtctttga

SEQ ID NO: 161516 - DNA, 36 bp, Artificial Sequence
  Synthetic oligonucleotide
gcgaaagccacctgccctctcgccttaatgttttga

SEQ ID NO: 161517 - DNA, 35 bp, Artificial Sequence
  Synthetic oligonucleotide
tgtcgccacccccccatgtagttcgttttcccgta

SEQ ID NO: 161518 - DNA, 36 bp, Artificial Sequence
  Synthetic oligonucleotide
tgagagcttcgatccccgcccacgcttcccccggta

SEQ ID NO: 161519 - DNA, 35 bp, Artificial Sequence
  Synthetic oligonucleotide
gcgagaggcatccatgcacattcccattgtcccac

SEQ ID NO: 161520 - DNA, 35 bp, Artificial Sequence
  Synthetic oligonucleotide
tacattcgcgcccttgctatctgcctgccaaatac

SEQ ID NO: 161521 - DNA, 35 bp, Artificial Sequence
  Synthetic oligonucleotide
tctccacctccccgtccttagcgattgtaccgtac

SEQ ID NO: 161522 - DNA, 35 bp, Artificial Sequence
  Synthetic oligonucleotide
gacagaagcggggtgggtggatcagtgggataacc

SEQ ID NO: 161523 - DNA, 35 bp, Artificial Sequence
  Synthetic oligonucleotide
tcatacacctccgcctgccccacgttgttctaccc

SEQ ID NO: 161524 - DNA, 35 bp, Artificial Sequence
  Synthetic oligonucleotide
tgctcgtacccttgttgctttgctcgccattaccc

SEQ ID NO: 161525 - DNA, 30 bp, Artificial Sequence
  Synthetic oligonucleotide
gagtcaccatgtaagctccctgtccagccc

SEQ ID NO: 161526 - DNA, 35 bp, Artificial Sequence
  Synthetic oligonucleotide
tcctcacctccacgcattcttagccgacctcgccc

SEQ ID NO: 161527 - DNA, 35 bp, Artificial Sequence
  Synthetic oligonucleotide
tcacccacctcctgtttttgctctgcaagtggccc

SEQ ID NO: 161528 - DNA, 35 bp, Artificial Sequence
  Synthetic oligonucleotide
tagctgtgattagttaccgccgctcccacgatccc

SEQ ID NO: 161529 - DNA, 35 bp, Artificial Sequence
  Synthetic oligonucleotide
tcccgaagccccctgcctaccactcgtactgtgcc

SEQ ID NO: 161530 - DNA, 35 bp, Artificial Sequence
  Synthetic oligonucleotide
ttgcctcgccactctgccgctgtccacgctttgcc

SEQ ID NO: 161531 - DNA, 35 bp, Artificial Sequence
  Synthetic oligonucleotide
taaaacgcctccttggttttgcccctgccggttcc

SEQ ID NO: 161532 - DNA, 35 bp, Artificial Sequence
  Synthetic oligonucleotide
gatccccgttcgtctctcacccctgtagtgcccgc

SEQ ID NO: 161533 - DNA, 35 bp, Artificial Sequence
  Synthetic oligonucleotide
acagcccgctcgcacactgttccaccgccctccgc

SEQ ID NO: 161534 - DNA, 35 bp, Artificial Sequence
  Synthetic oligonucleotide
ttacatccctagtaacggcgcgtggccctcactgc

SEQ ID NO: 161535 - DNA, 35 bp, Artificial Sequence
  Synthetic oligonucleotide
gcaccccgttcactatcattgtcatatcttgttgc

SEQ ID NO: 161536 - DNA, 35 bp, Artificial Sequence
  Synthetic oligonucleotide
taccccacgcacactcaagcctttaggagtccatc

SEQ ID NO: 161537 - DNA, 35 bp, Artificial Sequence
  Synthetic oligonucleotide
gtcggatcaactgatggcctaccgctgtccttctc

SEQ ID NO: 161538 - DNA, 35 bp, Artificial Sequence
  Synthetic oligonucleotide
acccacaaccatgtgtcccctcgatcacgcccgtc

SEQ ID NO: 161539 - DNA, 35 bp, Artificial Sequence
  Synthetic oligonucleotide
gactgttctccactcgtcgtatccatgtcttattc

SEQ ID NO: 161540 - DNA, 35 bp, Artificial Sequence
  Synthetic oligonucleotide
accgcccccattctgccagagcttgccaccttttc

SEQ ID NO: 161541 - DNA, 34 bp, Artificial Sequence
  Synthetic oligonucleotide
gcgggatgggacgggggggagtgaggcatacaag

SEQ ID NO: 161542 - DNA, 35 bp, Artificial Sequence
  Synthetic oligonucleotide
acgcaaggaaactaagaaggggaacataggggaag

SEQ ID NO: 161543 - DNA, 35 bp, Artificial Sequence
  Synthetic oligonucleotide
tcagccccacaagtaaaagccgccatccacctcag

SEQ ID NO: 161544 - DNA, 35 bp, Artificial Sequence
  Synthetic oligonucleotide
acttgggcgggttgggagggtggttattattctag

SEQ ID NO: 161545 - DNA, 35 bp, Artificial Sequence
  Synthetic oligonucleotide
atagcaccactgaccccggggaccatatcataacg

SEQ ID NO: 161546 - DNA, 35 bp, Artificial Sequence
  Synthetic oligonucleotide
actgacccgccccccattgttctccgtcacacacg

SEQ ID NO: 161547 - DNA, 35 bp, Artificial Sequence
  Synthetic oligonucleotide
tcacgctgctgccgcacccccagatcaggcctccg

SEQ ID NO: 161548 - DNA, 35 bp, Artificial Sequence
  Synthetic oligonucleotide
actgacctcgcgtcccgaattttagccccgctccg

SEQ ID NO: 161549 - DNA, 36 bp, Artificial Sequence
  Synthetic oligonucleotide
atccctcttgcatgcccgttgcgttaccattctccg

SEQ ID NO: 161550 - DNA, 35 bp, Artificial Sequence
  Synthetic oligonucleotide
ttgggaagggtgggagaatatgggcgctctggtcg

SEQ ID NO: 161551 - DNA, 35 bp, Artificial Sequence
  Synthetic oligonucleotide
gggtccgtcggtctgctccactcttcactgtttcg

SEQ ID NO: 161552 - DNA, 35 bp, Artificial Sequence
  Synthetic oligonucleotide
gtggtgatgaggtggtactagggtaggacggccgg

SEQ ID NO: 161553 - DNA, 35 bp, Artificial Sequence
  Synthetic oligonucleotide
gttacatcagacgtaatctcgctctctatcacctg

SEQ ID NO: 161554 - DNA, 35 bp, Artificial Sequence
  Synthetic oligonucleotide
tgtgtcactcccaggcccctccatcctgatctttg

SEQ ID NO: 161555 - DNA, 35 bp, Artificial Sequence
  Synthetic oligonucleotide
tctcccgccccattacggctatacacaacattaat

SEQ ID NO: 161556 - DNA, 35 bp, Artificial Sequence
  Synthetic oligonucleotide
gcacctccgctggttaaaatttctcccgtttcgat

SEQ ID NO: 161557 - DNA, 35 bp, Artificial Sequence
  Synthetic oligonucleotide
gacccgcgacggttagatctcacacccgcccctat

SEQ ID NO: 161558 - DNA, 35 bp, Artificial Sequence
  Synthetic oligonucleotide
gattgacaatgtctcacagacacctgctctccact

SEQ ID NO: 161559 - DNA, 35 bp, Artificial Sequence
  Synthetic oligonucleotide
ggttaagcctcgagccacccatgtacacacctcct

SEQ ID NO: 161560 - DNA, 35 bp, Artificial Sequence
  Synthetic oligonucleotide
gtccctaaacgcaccgttgcctacagcccccctgt

SEQ ID NO: 161561 - DNA, 35 bp, Artificial Sequence
  Synthetic oligonucleotide
gattccgccgtacttgttctcctccaaccgttatt

SEQ ID NO: 161562 - DNA, 35 bp, Artificial Sequence
  Synthetic oligonucleotide
atctgccttccgacacatcgtaacgtacccaattt

SEQ ID NO: 161563 - DNA, 35 bp, Artificial Sequence
  Synthetic oligonucleotide
gtcgcgacttccttggtacctccgttcttgccttt

SEQ ID NO: 161564 - DNA, 35 bp, Artificial Sequence
  Synthetic oligonucleotide
tccatccgcctcaccctactagcccccccatgttt

SEQ ID NO: 161565 - DNA, 35 bp, Artificial Sequence
  Synthetic oligonucleotide
gcctaccgcgatgttactgtttctcacccgtgttt

SEQ ID NO: 161566 - DNA, 35 bp, Artificial Sequence
  Synthetic oligonucleotide
gtacacctccctctctggcttaacgggcccaccaa

SEQ ID NO: 161567 - DNA, 35 bp, Artificial Sequence
  Synthetic oligonucleotide
acacgcaacatccctggtggcgtttggactaccaa

SEQ ID NO: 161568 - DNA, 36 bp, Artificial Sequence
  Synthetic oligonucleotide
agggtcgggaaagggacgggtgaggaggcgcgggaa

SEQ ID NO: 161569 - DNA, 35 bp, Artificial Sequence
  Synthetic oligonucleotide
accccctcgtactactcaagcactttccttcgtaa

SEQ ID NO: 161570 - DNA, 35 bp, Artificial Sequence
  Synthetic oligonucleotide
acccgctgccccttcttcgtgagtaacgtatcaca

SEQ ID NO: 161571 - DNA, 35 bp, Artificial Sequence
  Synthetic oligonucleotide
acgtttgcccgcccggccttcactcatagcataca

SEQ ID NO: 161572 - DNA, 33 bp, Artificial Sequence
  Synthetic oligonucleotide
atctcacgcgctttctctaacaactgctcacca

SEQ ID NO: 161573 - DNA, 36 bp, Artificial Sequence
  Synthetic oligonucleotide
aatactcgccccccatttccgatgtcgcatttgcca

SEQ ID NO: 161574 - DNA, 35 bp, Artificial Sequence
  Synthetic oligonucleotide
acctacgggctgggtagaaaaggaatgggtgggca

SEQ ID NO: 161575 - DNA, 35 bp, Artificial Sequence
  Synthetic oligonucleotide
tgacgcaccactatccgggttaccgcctccctgca

SEQ ID NO: 161576 - DNA, 36 bp, Artificial Sequence
  Synthetic oligonucleotide
caatggacaggaggaaggggtggcggcggtaaatca

SEQ ID NO: 161577 - DNA, 35 bp, Artificial Sequence
  Synthetic oligonucleotide
taccctgtcagcacctcgctctcgtttgtctctca

SEQ ID NO: 161578 - DNA, 35 bp, Artificial Sequence
  Synthetic oligonucleotide
tgccaccgtttttcgtcgttttctctcacatttca

SEQ ID NO: 161579 - DNA, 37 bp, Artificial Sequence
  Synthetic oligonucleotide
gaccgggagaggcgggtagggactatttcggtagaga

SEQ ID NO: 161580 - DNA, 37 bp, Artificial Sequence
  Synthetic oligonucleotide
tgcattgctcctacgctcccccccacccgcctaacga

SEQ ID NO: 161581 - DNA, 37 bp, Artificial Sequence
  Synthetic oligonucleotide
atccgccctgcatccactccacatacgctctgcacga

SEQ ID NO: 161582 - DNA, 36 bp, Artificial Sequence
  Synthetic oligonucleotide
tggactgaacctcaccatctgttaccgcctcctcga

SEQ ID NO: 161583 - DNA, 37 bp, Artificial Sequence
  Synthetic oligonucleotide
gaggacggggacgagtcaaggggaagggattgcagga

SEQ ID NO: 161584 - DNA, 37 bp, Artificial Sequence
  Synthetic oligonucleotide
gcacactgcgccctcagccgaccacccaccacacgga

SEQ ID NO: 161585 - DNA, 37 bp, Artificial Sequence
  Synthetic oligonucleotide
aaacagggcaatgggcgggtgagagagatcagaggga

SEQ ID NO: 161586 - DNA, 37 bp, Artificial Sequence
  Synthetic oligonucleotide
gaggatgaggcacttgtgggtgaagcggtgggaggga

SEQ ID NO: 161587 - DNA, 37 bp, Artificial Sequence
  Synthetic oligonucleotide
gtgcctccatccgacgttacatcacccgcttacggga

SEQ ID NO: 161588 - DNA, 35 bp, Artificial Sequence
  Synthetic oligonucleotide
gggtgagaaaatggtaggggtggataggacgggga

SEQ ID NO: 161589 - DNA, 37 bp, Artificial Sequence
  Synthetic oligonucleotide
tggggaaagaccagggcggtggacgtctcttggggga

SEQ ID NO: 161590 - DNA, 37 bp, Artificial Sequence
  Synthetic oligonucleotide
gccggacggaaggttattggtggtgggggtggatgga

SEQ ID NO: 161591 - DNA, 37 bp, Artificial Sequence
  Synthetic oligonucleotide
gctggggtggggcgggtaagggcctaaacattctgga

SEQ ID NO: 161592 - DNA, 38 bp, Artificial Sequence
  Synthetic oligonucleotide
tgaaggtggtagagatagagggagaacacgggcgatga

SEQ ID NO: 161593 - DNA, 37 bp, Artificial Sequence
  Synthetic oligonucleotide
gtccacgcaccctgagctcctttctgttacgacctga

SEQ ID NO: 161594 - DNA, 36 bp, Artificial Sequence
  Synthetic oligonucleotide
gcctcgcgaacagattgtcatccactcccttcctga

SEQ ID NO: 161595 - DNA, 38 bp, Artificial Sequence
  Synthetic oligonucleotide
taccaatcgcatcctgtccgctcctctcgtcctgctga

SEQ ID NO: 161596 - DNA, 37 bp, Artificial Sequence
  Synthetic oligonucleotide
gccacaggctgcttttcgcccatcgtcttcctgctga

SEQ ID NO: 161597 - DNA, 35 bp, Artificial Sequence
  Synthetic oligonucleotide
ttggccctgcccccatgttacatgcttgcctctga

SEQ ID NO: 161598 - DNA, 38 bp, Artificial Sequence
  Synthetic oligonucleotide
gccatatccgtcctgctcagcctcccgataccttgtga

SEQ ID NO: 161599 - DNA, 37 bp, Artificial Sequence
  Synthetic oligonucleotide
gcatgcctgcattcattgttcctgctttcactattga

SEQ ID NO: 161600 - DNA, 37 bp, Artificial Sequence
  Synthetic oligonucleotide
tcgcatccatctgccgagcgccctccctaacacttga

SEQ ID NO: 161601 - DNA, 37 bp, Artificial Sequence
  Synthetic oligonucleotide
acgtacacatcgccctcgctgcgcctcccgccgttga

SEQ ID NO: 161602 - DNA, 35 bp, Artificial Sequence
  Synthetic oligonucleotide
tgtggccgtcgatatttcgacctccccccctttga

SEQ ID NO: 161603 - DNA, 36 bp, Artificial Sequence
  Synthetic oligonucleotide
tcccgcccctttcctacgccctgcgaggcatgccta

SEQ ID NO: 161604 - DNA, 36 bp, Artificial Sequence
  Synthetic oligonucleotide
gtgtcaagcccgttgtgctccacgctgttctatcta

SEQ ID NO: 161605 - DNA, 35 bp, Artificial Sequence
  Synthetic oligonucleotide
tgatcagcccccctgcatgccgtccctcgctcgta

SEQ ID NO: 161606 - DNA, 35 bp, Artificial Sequence
  Synthetic oligonucleotide
tgctcgcccggagtccgttcctcgccacgtgcaac

SEQ ID NO: 161607 - DNA, 35 bp, Artificial Sequence
  Synthetic oligonucleotide
gcacatgcgcgcctagcacatcgtacacattacac

SEQ ID NO: 161608 - DNA, 35 bp, Artificial Sequence
  Synthetic oligonucleotide
tgaatgcctatgcgcactcgctaccttgccaccac

SEQ ID NO: 161609 - DNA, 35 bp, Artificial Sequence
  Synthetic oligonucleotide
tcccatcctcgacgttttgcccccgccgccggcac

SEQ ID NO: 161610 - DNA, 35 bp, Artificial Sequence
  Synthetic oligonucleotide
ttgggtcgggtcgggtgggaggctaaggtcatgac

SEQ ID NO: 161611 - DNA, 35 bp, Artificial Sequence
  Synthetic oligonucleotide
aacccacctacattgtgatcttcctcctctgttac

SEQ ID NO: 161612 - DNA, 35 bp, Artificial Sequence
  Synthetic oligonucleotide
tcgccccatcgccgcacataattattcctcttacc

SEQ ID NO: 161613 - DNA, 35 bp, Artificial Sequence
  Synthetic oligonucleotide
tgcccagcgcacccacatatgcgccagtgctcccc

SEQ ID NO: 161614 - DNA, 35 bp, Artificial Sequence
  Synthetic oligonucleotide
tcttgcccgccccttcccagatccagggtcaagcc

SEQ ID NO: 161615 - DNA, 35 bp, Artificial Sequence
  Synthetic oligonucleotide
agggggcccctgcccattgaactgacctctccgcc

SEQ ID NO: 161616 - DNA, 35 bp, Artificial Sequence
  Synthetic oligonucleotide
tgctaacatcgcggggtttatctttcgcctactcc

SEQ ID NO: 161617 - DNA, 35 bp, Artificial Sequence
  Synthetic oligonucleotide
aatgccgctctagaatgccaagccccccaccctcc

SEQ ID NO: 161618 - DNA, 35 bp, Artificial Sequence
  Synthetic oligonucleotide
acacctgtgcctcctctcgacccggttaactgtcc

SEQ ID NO: 161619 - DNA, 35 bp, Artificial Sequence
  Synthetic oligonucleotide
aagcctgcctcaagcgcactccgcctccccgccgc

SEQ ID NO: 161620 - DNA, 35 bp, Artificial Sequence
  Synthetic oligonucleotide
gcgcatcaccggccgtaccatcctcccctcccatc

SEQ ID NO: 161621 - DNA, 35 bp, Artificial Sequence
  Synthetic oligonucleotide
ttccaccgcaccgtacagttcctgcttcagccatc

SEQ ID NO: 161622 - DNA, 35 bp, Artificial Sequence
  Synthetic oligonucleotide
gaatacgccccactcatgtactacatggctaactc

SEQ ID NO: 161623 - DNA, 35 bp, Artificial Sequence
  Synthetic oligonucleotide
agcgaagctcgaaaagtcataacacccccggcctc

SEQ ID NO: 161624 - DNA, 35 bp, Artificial Sequence
  Synthetic oligonucleotide
tgctgggcccttcgcagactatctagccgctcctc

SEQ ID NO: 161625 - DNA, 35 bp, Artificial Sequence
  Synthetic oligonucleotide
tttgatcactgcctggctctctcttgcgattcctc

SEQ ID NO: 161626 - DNA, 35 bp, Artificial Sequence
  Synthetic oligonucleotide
atggtcgacagccctgctcgcctacttctacgctc

SEQ ID NO: 161627 - DNA, 35 bp, Artificial Sequence
  Synthetic oligonucleotide
gctgttaccctcatgccctgttcctcagcactctc

SEQ ID NO: 161628 - DNA, 35 bp, Artificial Sequence
  Synthetic oligonucleotide
ttgcggcccacccgcagtcgtcgaaccctctcttc

SEQ ID NO: 161629 - DNA, 35 bp, Artificial Sequence
  Synthetic oligonucleotide
aaagactgccccagtgcgtcaccatatactcgttc

SEQ ID NO: 161630 - DNA, 35 bp, Artificial Sequence
  Synthetic oligonucleotide
gccgttcaatatccgccgcttcctcccgcccgtag

SEQ ID NO: 161631 - DNA, 35 bp, Artificial Sequence
  Synthetic oligonucleotide
tgtcaccacgccacctttcgtatttcgcctgcccg

SEQ ID NO: 161632 - DNA, 35 bp, Artificial Sequence
  Synthetic oligonucleotide
tgtgcgatattccgtcgagcacgtcctcctctccg

SEQ ID NO: 161633 - DNA, 35 bp, Artificial Sequence
  Synthetic oligonucleotide
tgccccctccgccaccactcgcgacgttaggcgcg

SEQ ID NO: 161634 - DNA, 35 bp, Artificial Sequence
  Synthetic oligonucleotide
atcgcctgttccccagttctgccatcacgtgacgg

SEQ ID NO: 161635 - DNA, 35 bp, Artificial Sequence
  Synthetic oligonucleotide
gctgtgccccaagtttttatccttgactcctcatg

SEQ ID NO: 161636 - DNA, 34 bp, Artificial Sequence
  Synthetic oligonucleotide
aatgctaccccgcctgctagtctcccatcttctg

SEQ ID NO: 161637 - DNA, 35 bp, Artificial Sequence
  Synthetic oligonucleotide
tttgccccgccctagtctccatagaactcactact

SEQ ID NO: 161638 - DNA, 35 bp, Artificial Sequence
  Synthetic oligonucleotide
gagccaagtctggctcgaccgctgaccctcctact

SEQ ID NO: 161639 - DNA, 35 bp, Artificial Sequence
  Synthetic oligonucleotide
gccacctggccacgctcttcgactcccattttgct

SEQ ID NO: 161640 - DNA, 35 bp, Artificial Sequence
  Synthetic oligonucleotide
gtacgtcgaagccccgtccgtctgaaactctatct

SEQ ID NO: 161641 - DNA, 35 bp, Artificial Sequence
  Synthetic oligonucleotide
gcacgtctgcacgggtctggctccaatacacctct

SEQ ID NO: 161642 - DNA, 35 bp, Artificial Sequence
  Synthetic oligonucleotide
tcacagagccctattcgcccgatcgtcctacgtct

SEQ ID NO: 161643 - DNA, 35 bp, Artificial Sequence
  Synthetic oligonucleotide
atgacgaagtggtcgggaagggggcaaaaggtagt

SEQ ID NO: 161644 - DNA, 35 bp, Artificial Sequence
  Synthetic oligonucleotide
gtgcacgtttgtcaactcccatggtccttcgctgt

SEQ ID NO: 161645 - DNA, 35 bp, Artificial Sequence
  Synthetic oligonucleotide
tcctccccacacaacgctataaggagttcttcatt

SEQ ID NO: 161646 - DNA, 35 bp, Artificial Sequence
  Synthetic oligonucleotide
gcacccgtcgcccggtatatattacgccgcctctt

SEQ ID NO: 161647 - DNA, 35 bp, Artificial Sequence
  Synthetic oligonucleotide
aacgccaagcccccacgctccatcaccaggacgtt

SEQ ID NO: 161648 - DNA, 35 bp, Artificial Sequence
  Synthetic oligonucleotide
gacaccccgtccactagccggcctctcgccgtttt

SEQ ID NO: 161649 - DNA, 36 bp, Artificial Sequence
  Synthetic oligonucleotide
gcctacccccaattctgcatatctgagccccgacaa

SEQ ID NO: 161650 - DNA, 36 bp, Artificial Sequence
  Synthetic oligonucleotide
agaaagcaggaggggaacaagcggtggggtagagaa

SEQ ID NO: 161651 - DNA, 35 bp, Artificial Sequence
  Synthetic oligonucleotide
tgttgtgtacgtaaaggtaggggggacggaaggaa

SEQ ID NO: 161652 - DNA, 36 bp, Artificial Sequence
  Synthetic oligonucleotide
gcctctcgtccggcacctgttcaatacctgtacaca

SEQ ID NO: 161653 - DNA, 36 bp, Artificial Sequence
  Synthetic oligonucleotide
gccccgttccctctggcgacactgaaagccttgaca

SEQ ID NO: 161654 - DNA, 36 bp, Artificial Sequence
  Synthetic oligonucleotide
taagggaagatcgcccacccgcctttccgatcacca

SEQ ID NO: 161655 - DNA, 35 bp, Artificial Sequence
  Synthetic oligonucleotide
gtatccacttgctgatcgtagcctgcccccaccca

SEQ ID NO: 161656 - DNA, 36 bp, Artificial Sequence
  Synthetic oligonucleotide
gtacaccgtaatctggcattcgcaccctccttccca

SEQ ID NO: 161657 - DNA, 36 bp, Artificial Sequence
  Synthetic oligonucleotide
ttttcgcccctctcgcctggtactccattgacgcca

SEQ ID NO: 161658 - DNA, 36 bp, Artificial Sequence
  Synthetic oligonucleotide
atatgccccacgctttacaaggaccacccctcgcca

SEQ ID NO: 161659 - DNA, 36 bp, Artificial Sequence
  Synthetic oligonucleotide
attctcccccgccagtctgagcgcgctcccgctcca

SEQ ID NO: 161660 - DNA, 36 bp, Artificial Sequence
  Synthetic oligonucleotide
tacgacccgtgcactgagcctgcatctttttctcca

SEQ ID NO: 161661 - DNA, 36 bp, Artificial Sequence
  Synthetic oligonucleotide
tgtggtgacaacaaagggaaacaaggaagtacggca

SEQ ID NO: 161662 - DNA, 35 bp, Artificial Sequence
  Synthetic oligonucleotide
gccatccctacctcttccgcgttcccgtcttggca

SEQ ID NO: 161663 - DNA, 28 bp, Artificial Sequence
  Synthetic oligonucleotide
tttacaacactgtccgccccccgcctca

SEQ ID NO: 161664 - DNA, 36 bp, Artificial Sequence
  Synthetic oligonucleotide
gccttcctcccactgaagcgtatatcgtctctctca

SEQ ID NO: 161665 - DNA, 37 bp, Artificial Sequence
  Synthetic oligonucleotide
agtgaaggtgtgaggggggtacggtaatggacgaaga

SEQ ID NO: 161666 - DNA, 36 bp, Artificial Sequence
  Synthetic oligonucleotide
gaccggaaaggcaggggtggaagggcactgaagaga

SEQ ID NO: 161667 - DNA, 37 bp, Artificial Sequence
  Synthetic oligonucleotide
gactgatagaggagggtcggggaaggaaagggtgaga

SEQ ID NO: 161668 - DNA, 37 bp, Artificial Sequence
  Synthetic oligonucleotide
gcccgcacctgcccctcggtacacatctacattgaga

SEQ ID NO: 161669 - DNA, 37 bp, Artificial Sequence
  Synthetic oligonucleotide
acgactccgagcgctgttatcgccttccctgcctaga

SEQ ID NO: 161670 - DNA, 37 bp, Artificial Sequence
  Synthetic oligonucleotide
gcacgggagggggttggaactataggagcgaggacga

SEQ ID NO: 161671 - DNA, 35 bp, Artificial Sequence
  Synthetic oligonucleotide
tgcactactccacctccgacgtttaattcgcccga

SEQ ID NO: 161672 - DNA, 36 bp, Artificial Sequence
  Synthetic oligonucleotide
tgatcccacttgttacctcgccaggtttactgccga

SEQ ID NO: 161673 - DNA, 37 bp, Artificial Sequence
  Synthetic oligonucleotide
tacttcaccggttttggcctgtccttctatttctcga

SEQ ID NO: 161674 - DNA, 37 bp, Artificial Sequence
  Synthetic oligonucleotide
gcgcaaccttccccctgcatgtccccggctccttcga

SEQ ID NO: 161675 - DNA, 35 bp, Artificial Sequence
  Synthetic oligonucleotide
gatgtggcaaagtaaggggatcgaatggaggagga

SEQ ID NO: 161676 - DNA, 37 bp, Artificial Sequence
  Synthetic oligonucleotide
gtgcaccgcccgcctcccccgctcgatcgatcacgga

SEQ ID NO: 161677 - DNA, 37 bp, Artificial Sequence
  Synthetic oligonucleotide
attccgggcggggtcgtgtggggtaaaatcatgggga

SEQ ID NO: 161678 - DNA, 37 bp, Artificial Sequence
  Synthetic oligonucleotide
actcccgcccccagcccgcctactagcttgccttgga

SEQ ID NO: 161679 - DNA, 38 bp, Artificial Sequence
  Synthetic oligonucleotide
ggtgagcaaaggtgggaaaaggggttggcgggtaatga

SEQ ID NO: 161680 - DNA, 38 bp, Artificial Sequence
  Synthetic oligonucleotide
aaggtcagaggggggaaggagggcaaatggaaggatga

SEQ ID NO: 161681 - DNA, 38 bp, Artificial Sequence
  Synthetic oligonucleotide
gatgcacagggaagggtgccagggaatggcggtgatga

SEQ ID NO: 161682 - DNA, 38 bp, Artificial Sequence
  Synthetic oligonucleotide
tcaaccatcgcccgagttctcaacgccatctatcctga

SEQ ID NO: 161683 - DNA, 37 bp, Artificial Sequence
  Synthetic oligonucleotide
gtccaccgcagtggtcttacttcagcaatcctcctga

SEQ ID NO: 161684 - DNA, 37 bp, Artificial Sequence
  Synthetic oligonucleotide
gccatctgactcatttgtgtgctcactacctctctga

SEQ ID NO: 161685 - DNA, 37 bp, Artificial Sequence
  Synthetic oligonucleotide
gcacccgccaccttacttgtcttaactgatctcgtga

SEQ ID NO: 161686 - DNA, 38 bp, Artificial Sequence
  Synthetic oligonucleotide
ttgccaatgcccgctgttcttacgcctctcctgtgtga

SEQ ID NO: 161687 - DNA, 38 bp, Artificial Sequence
  Synthetic oligonucleotide
accatcagtcagttagcggcccgttctccttcccttga

SEQ ID NO: 161688 - DNA, 38 bp, Artificial Sequence
  Synthetic oligonucleotide
gaagggcgtcgcgggaactaggagggggggggtgttga

SEQ ID NO: 161689 - DNA, 37 bp, Artificial Sequence
  Synthetic oligonucleotide
ggaggggaccggggagaacaagggagataaaaagcta

SEQ ID NO: 161690 - DNA, 36 bp, Artificial Sequence
  Synthetic oligonucleotide
acatccccagtctcccagcatacgccttcgacgcta

SEQ ID NO: 161691 - DNA, 36 bp, Artificial Sequence
  Synthetic oligonucleotide
tacagtgccctcccggtcgtcagagcccaccccgta

SEQ ID NO: 161692 - DNA, 36 bp, Artificial Sequence
  Synthetic oligonucleotide
gtcacctccgccacatcgacgctaggacagacatta

SEQ ID NO: 161693 - DNA, 36 bp, Artificial Sequence
  Synthetic oligonucleotide
atgggtgtggagggggggcagacagtgctctcatta

SEQ ID NO: 161694 - DNA, 35 bp, Artificial Sequence
  Synthetic oligonucleotide
ttccccgcaagtgtacattggcgcctattccctta

SEQ ID NO: 161695 - DNA, 35 bp, Artificial Sequence
  Synthetic oligonucleotide
tcacacctcttgtccgcgaatacatatccgctcac

SEQ ID NO: 161696 - DNA, 30 bp, Artificial Sequence
  Synthetic oligonucleotide
ggacgtggggggcgggtcgaatagggtcac

SEQ ID NO: 161697 - DNA, 35 bp, Artificial Sequence
  Synthetic oligonucleotide
tgccgatatcactcgtgccatactccggatcctac

SEQ ID NO: 161698 - DNA, 35 bp, Artificial Sequence
  Synthetic oligonucleotide
gccatgcctcggtgcatggtccctttgcctaaccc

SEQ ID NO: 161699 - DNA, 34 bp, Artificial Sequence
  Synthetic oligonucleotide
ttccaccccactgcctcagtaaccttgacgcgcc

SEQ ID NO: 161700 - DNA, 35 bp, Artificial Sequence
  Synthetic oligonucleotide
gcaagcggtcttgttcccccgccccgaattcatcc

SEQ ID NO: 161701 - DNA, 35 bp, Artificial Sequence
  Synthetic oligonucleotide
gttcacgcacatttgcttttctcattattacgtcc

SEQ ID NO: 161702 - DNA, 35 bp, Artificial Sequence
  Synthetic oligonucleotide
gtgtacgcaaactgctacgcggacaaaacctttcc

SEQ ID NO: 161703 - DNA, 35 bp, Artificial Sequence
  Synthetic oligonucleotide
cccgtaccacaagctgtatgccacaactcctccgc

SEQ ID NO: 161704 - DNA, 35 bp, Artificial Sequence
  Synthetic oligonucleotide
tagtcaacacctacactccgccgtgctccgttcgc

SEQ ID NO: 161705 - DNA, 35 bp, Artificial Sequence
  Synthetic oligonucleotide
tgcctcgtccacttctcttccacactgatccgtgc

SEQ ID NO: 161706 - DNA, 35 bp, Artificial Sequence
  Synthetic oligonucleotide
attgcgttccggtctcgatatatcactcgtccatc

SEQ ID NO: 161707 - DNA, 35 bp, Artificial Sequence
  Synthetic oligonucleotide
acaaccgtcactgccctcgctccgccctcacagtc

SEQ ID NO: 161708 - DNA, 35 bp, Artificial Sequence
  Synthetic oligonucleotide
aagatccacctcctgtccgctatttgtctctggtc

SEQ ID NO: 161709 - DNA, 35 bp, Artificial Sequence
  Synthetic oligonucleotide
gggtgagaggtaaaggtgggttaaggagggatacg

SEQ ID NO: 161710 - DNA, 35 bp, Artificial Sequence
  Synthetic oligonucleotide
gtcactgttcccttccatgcccgaagccgccaccg

SEQ ID NO: 161711 - DNA, 35 bp, Artificial Sequence
  Synthetic oligonucleotide
ggaccggatcgctatcaccctgcactctatctccg

SEQ ID NO: 161712 - DNA, 35 bp, Artificial Sequence
  Synthetic oligonucleotide
aggatgacggtgggagggctaagtcagggcgcagg

SEQ ID NO: 161713 - DNA, 35 bp, Artificial Sequence
  Synthetic oligonucleotide
tgctacgcccgctctacttgcccttcccacatagg

SEQ ID NO: 161714 - DNA, 34 bp, Artificial Sequence
  Synthetic oligonucleotide
tctcactccaggatcctgctatcgttcctccggg

SEQ ID NO: 161715 - DNA, 35 bp, Artificial Sequence
  Synthetic oligonucleotide
aaccaccccatcatccctttcagtcatcacacctg

SEQ ID NO: 161716 - DNA, 35 bp, Artificial Sequence
  Synthetic oligonucleotide
gaagctgcgccacgatcgcgttcgccaccctcctg

SEQ ID NO: 161717 - DNA, 35 bp, Artificial Sequence
  Synthetic oligonucleotide
tgatcaccccggccttcactgcgatgtccctcgtg

SEQ ID NO: 161718 - DNA, 35 bp, Artificial Sequence
  Synthetic oligonucleotide
gcatctcacgtcatcttccgcactcgttccgccat

SEQ ID NO: 161719 - DNA, 35 bp, Artificial Sequence
  Synthetic oligonucleotide
gatagggacatttgggagggggcgggaacgaatat

SEQ ID NO: 161720 - DNA, 35 bp, Artificial Sequence
  Synthetic oligonucleotide
acaggagggttagggtggtgagttgggggctgtat

SEQ ID NO: 161721 - DNA, 35 bp, Artificial Sequence
  Synthetic oligonucleotide
tttcaggccgccactattatagtccccgcccccct

SEQ ID NO: 161722 - DNA, 35 bp, Artificial Sequence
  Synthetic oligonucleotide
tcaccctactctgcgctacccggttcgttacgcct

SEQ ID NO: 161723 - DNA, 35 bp, Artificial Sequence
  Synthetic oligonucleotide
gaccccctcccatcagtaagccgccctcgggtcct

SEQ ID NO: 161724 - DNA, 35 bp, Artificial Sequence
  Synthetic oligonucleotide
acacccttccgtccgacgttgctccctcgtttcct

SEQ ID NO: 161725 - DNA, 35 bp, Artificial Sequence
  Synthetic oligonucleotide
tcagcccgttctcctaagacccccgtttccgtgct

SEQ ID NO: 161726 - DNA, 35 bp, Artificial Sequence
  Synthetic oligonucleotide
atgacagatggctcgtctgttcctctctttcatct

SEQ ID NO: 161727 - DNA, 35 bp, Artificial Sequence
  Synthetic oligonucleotide
gcactcctccgcaaccgccctgcctgtttaccagt

SEQ ID NO: 161728 - DNA, 35 bp, Artificial Sequence
  Synthetic oligonucleotide
tgcaccagccactcgccgtccgcttcttaacttgt

SEQ ID NO: 161729 - DNA, 35 bp, Artificial Sequence
  Synthetic oligonucleotide
gacagtctccgaagacgtccgtcccacctctgctt

SEQ ID NO: 161730 - DNA, 35 bp, Artificial Sequence
  Synthetic oligonucleotide
gtctacgtccaacatctgtcggtccctcgcctctt

SEQ ID NO: 161731 - DNA, 35 bp, Artificial Sequence
  Synthetic oligonucleotide
actctgccacctttacgccgaaattagtccccgtt

SEQ ID NO: 161732 - DNA, 35 bp, Artificial Sequence
  Synthetic oligonucleotide
gcccacccccgcacagtatcagtcgtactgtcttt

SEQ ID NO: 161733 - DNA, 36 bp, Artificial Sequence
  Synthetic oligonucleotide
aaccgctgccccaaccatctcatccgttcgcctcaa

SEQ ID NO: 161734 - DNA, 35 bp, Artificial Sequence
  Synthetic oligonucleotide
cccacccctccgcctgtccgtccatgtcgtttcaa

SEQ ID NO: 161735 - DNA, 36 bp, Artificial Sequence
  Synthetic oligonucleotide
gagtcggtctaagtctgggaacggagggagggggaa

SEQ ID NO: 161736 - DNA, 36 bp, Artificial Sequence
  Synthetic oligonucleotide
tcatcccaccgcttctcagctcttcgcagttacaca

SEQ ID NO: 161737 - DNA, 36 bp, Artificial Sequence
  Synthetic oligonucleotide
ttaagcgtgccgattccgatttgccccctcgccaca

SEQ ID NO: 161738 - DNA, 36 bp, Artificial Sequence
  Synthetic oligonucleotide
atcctacgaccacgctcttcgccaccgcgtgccaca

SEQ ID NO: 161739 - DNA, 36 bp, Artificial Sequence
  Synthetic oligonucleotide
gaatgggggggggcgaaggctcaaaggcacgagaca

SEQ ID NO: 161740 - DNA, 36 bp, Artificial Sequence
  Synthetic oligonucleotide
accgccccgagccacagcacgcctgccaccccgaca

SEQ ID NO: 161741 - DNA, 36 bp, Artificial Sequence
  Synthetic oligonucleotide
ggactgcccacagactcccaacctgtccatccacca

SEQ ID NO: 161742 - DNA, 36 bp, Artificial Sequence
  Synthetic oligonucleotide
tcctggcaacccacaccctggtatagcttttcccca

SEQ ID NO: 161743 - DNA, 36 bp, Artificial Sequence
  Synthetic oligonucleotide
gatcaccccaggcagtgctacttttgccacatgcca

SEQ ID NO: 161744 - DNA, 35 bp, Artificial Sequence
  Synthetic oligonucleotide
gccaacccctcgatatcaatgatgtccctctatca

SEQ ID NO: 161745 - DNA, 35 bp, Artificial Sequence
  Synthetic oligonucleotide
acctcgttgcctccgtccattcctctatctgctca

SEQ ID NO: 161746 - DNA, 36 bp, Artificial Sequence
  Synthetic oligonucleotide
gggtcaacccccccgccgagtattgctacaacttca

SEQ ID NO: 161747 - DNA, 35 bp, Artificial Sequence
  Synthetic oligonucleotide
atgcactcgtcgtagtccactctgagtcctcttca

SEQ ID NO: 161748 - DNA, 35 bp, Artificial Sequence
  Synthetic oligonucleotide
taggaaagccctctgcccgtaccatcccctggaga

SEQ ID NO: 161749 - DNA, 35 bp, Artificial Sequence
  Synthetic oligonucleotide
tgctccccgcccgatactatgcgtcttcttagcga

SEQ ID NO: 161750 - DNA, 37 bp, Artificial Sequence
  Synthetic oligonucleotide
ttgcatgccgcccccgttcgttatcaatgttactcga

SEQ ID NO: 161751 - DNA, 35 bp, Artificial Sequence
  Synthetic oligonucleotide
tcacgtttcagctgcccttcgccacccacattcga

SEQ ID NO: 161752 - DNA, 37 bp, Artificial Sequence
  Synthetic oligonucleotide
gacgatgctcagccccagcccccgccgattttttcga

SEQ ID NO: 161753 - DNA, 36 bp, Artificial Sequence
  Synthetic oligonucleotide
gaagggcgggcggatcgtgggtagggtaaagacgga

SEQ ID NO: 161754 - DNA, 37 bp, Artificial Sequence
  Synthetic oligonucleotide
tatgtcaggagggagggcgtggtgggagttatccgga

SEQ ID NO: 161755 - DNA, 37 bp, Artificial Sequence
  Synthetic oligonucleotide
gtagatgaagaagagtgctggagagggacgagaggga

SEQ ID NO: 161756 - DNA, 37 bp, Artificial Sequence
  Synthetic oligonucleotide
gtggggcgggaggaagatgggcggggcaggattggga

SEQ ID NO: 161757 - DNA, 37 bp, Artificial Sequence
  Synthetic oligonucleotide
acgacactcgcctcatcccttgtaactgcattactga

SEQ ID NO: 161758 - DNA, 38 bp, Artificial Sequence
  Synthetic oligonucleotide
gtacttgcctccgttgcgttggcctcccgttaccctga

SEQ ID NO: 161759 - DNA, 37 bp, Artificial Sequence
  Synthetic oligonucleotide
aacgtgcccggtccatcacatcagcgttccgccctga

SEQ ID NO: 161760 - DNA, 38 bp, Artificial Sequence
  Synthetic oligonucleotide
gggagacggcgaagagaggggtgggttgggaaggctga

SEQ ID NO: 161761 - DNA, 38 bp, Artificial Sequence
  Synthetic oligonucleotide
gcacgcccgcccatctcgatccttccactaggtagtga

SEQ ID NO: 161762 - DNA, 38 bp, Artificial Sequence
  Synthetic oligonucleotide
ttgcgctcccccgtcgttacctgcacttcacagcgtga

SEQ ID NO: 161763 - DNA, 38 bp, Artificial Sequence
  Synthetic oligonucleotide
gcggataacgcaagagggccgggagggggggggtgtga

SEQ ID NO: 161764 - DNA, 38 bp, Artificial Sequence
  Synthetic oligonucleotide
gacgtagtggaggaaaggcatgaacggcggagggttga

SEQ ID NO: 161765 - DNA, 38 bp, Artificial Sequence
  Synthetic oligonucleotide
acccgcgccgtgagtttgccttccctttacgctgttga

SEQ ID NO: 161766 - DNA, 37 bp, Artificial Sequence
  Synthetic oligonucleotide
acccccccccacgctgtgtcaagccatcgctatttga

SEQ ID NO: 161767 - DNA, 37 bp, Artificial Sequence
  Synthetic oligonucleotide
gtcgaccccctgaactgcgagtttacatcctttttga

SEQ ID NO: 161768 - DNA, 36 bp, Artificial Sequence
  Synthetic oligonucleotide
ttgccactgtcctccacgatgatcccacccgccata

SEQ ID NO: 161769 - DNA, 36 bp, Artificial Sequence
  Synthetic oligonucleotide
gcctcacgcctctcatgtcttcctgcctgcccggta

SEQ ID NO: 161770 - DNA, 35 bp, Artificial Sequence
  Synthetic oligonucleotide
ggccaacgctccatggtccgcccgtccttctgtta

SEQ ID NO: 161771 - DNA, 36 bp, Artificial Sequence
  Synthetic oligonucleotide
tgttccgcaccatgctccgttttattctcgccttta

SEQ ID NO: 161772 - DNA, 36 bp, Artificial Sequence
  Synthetic oligonucleotide
tccagcccacccctgtcatatatcactgttttttta

SEQ ID NO: 161773 - DNA, 35 bp, Artificial Sequence
  Synthetic oligonucleotide
agtacgggagggggggtccatagcgctagggaaac

SEQ ID NO: 161774 - DNA, 35 bp, Artificial Sequence
  Synthetic oligonucleotide
tcacgcctccgctacgctggtctgtatcgcaccac

SEQ ID NO: 161775 - DNA, 35 bp, Artificial Sequence
  Synthetic oligonucleotide
gtttgcactggacttgttcgtcgaccttccttcac

SEQ ID NO: 161776 - DNA, 35 bp, Artificial Sequence
  Synthetic oligonucleotide
atctgaacgacggaaggggggggaagtagtgggac

SEQ ID NO: 161777 - DNA, 34 bp, Artificial Sequence
  Synthetic oligonucleotide
aaccgccatcctgccgctccaacgtaatatttac

SEQ ID NO: 161778 - DNA, 35 bp, Artificial Sequence
  Synthetic oligonucleotide
gctaccgccacgggataatcccctctgttccagcc

SEQ ID NO: 161779 - DNA, 35 bp, Artificial Sequence
  Synthetic oligonucleotide
atacagcacgcagccgcccgcatcgttttcgcgcc

SEQ ID NO: 161780 - DNA, 35 bp, Artificial Sequence
  Synthetic oligonucleotide
ttgcgggcaccacgcaatgctccgtttctctggcc

SEQ ID NO: 161781 - DNA, 35 bp, Artificial Sequence
  Synthetic oligonucleotide
gattacctccgattaactagctatctgaccctgcc

SEQ ID NO: 161782 - DNA, 35 bp, Artificial Sequence
  Synthetic oligonucleotide
gccgaagatgtcttgcccacgtacctgctcgctcc

SEQ ID NO: 161783 - DNA, 35 bp, Artificial Sequence
  Synthetic oligonucleotide
tacgtccccgtcgcctagtttcttatcgcctgtcc

SEQ ID NO: 161784 - DNA, 35 bp, Artificial Sequence
  Synthetic oligonucleotide
acgatgcactcgcctatctgttctggtgcccttcc

SEQ ID NO: 161785 - DNA, 35 bp, Artificial Sequence
  Synthetic oligonucleotide
gacgcgcgcgcattcgtctaacttatcccagccgc

SEQ ID NO: 161786 - DNA, 35 bp, Artificial Sequence
  Synthetic oligonucleotide
ttaaccgcaccttctattggcctttcatgcgccgc

SEQ ID NO: 161787 - DNA, 35 bp, Artificial Sequence
  Synthetic oligonucleotide
tccccacactccagtttcagcccacgaacgtcggc

SEQ ID NO: 161788 - DNA, 35 bp, Artificial Sequence
  Synthetic oligonucleotide
gccaccgcctacactctctcccatcaggacagggc

SEQ ID NO: 161789 - DNA, 35 bp, Artificial Sequence
  Synthetic oligonucleotide
atgaagtaagcgaatacggagagggaggggggggc

SEQ ID NO: 161790 - DNA, 35 bp, Artificial Sequence
  Synthetic oligonucleotide
tgcctacccctgctacccatagcccaccggtttgc

SEQ ID NO: 161791 - DNA, 35 bp, Artificial Sequence
  Synthetic oligonucleotide
gtcaatttccgaactgtactaccttaccgctactc

SEQ ID NO: 161792 - DNA, 35 bp, Artificial Sequence
  Synthetic oligonucleotide
gatgtccggtcactattcaatcacagtatcttctc

SEQ ID NO: 161793 - DNA, 36 bp, Artificial Sequence
  Synthetic oligonucleotide
gcctgggtgtcagcttgcacttctcctcttgccgtc

SEQ ID NO: 161794 - DNA, 35 bp, Artificial Sequence
  Synthetic oligonucleotide
agtaccccacccgtcttacgtacttccccaagttc

SEQ ID NO: 161795 - DNA, 35 bp, Artificial Sequence
  Synthetic oligonucleotide
acccccaggaccatctgtatttgcccctctcgttc

SEQ ID NO: 161796 - DNA, 35 bp, Artificial Sequence
  Synthetic oligonucleotide
acgacgtcttgtccgcctgatcgctcctccgcccg

SEQ ID NO: 161797 - DNA, 35 bp, Artificial Sequence
  Synthetic oligonucleotide
gcgtgtcaacttgccatccgtgtgcctgtcttccg

SEQ ID NO: 161798 - DNA, 35 bp, Artificial Sequence
  Synthetic oligonucleotide
accttcgtgcctcaatctccacccgccgtgctggg

SEQ ID NO: 161799 - DNA, 35 bp, Artificial Sequence
  Synthetic oligonucleotide
gcccacccacgtccctacgacactgcccgagcgtg

SEQ ID NO: 161800 - DNA, 35 bp, Artificial Sequence
  Synthetic oligonucleotide
gtgcccttacatatgtctccggctccccaccattg

SEQ ID NO: 161801 - DNA, 35 bp, Artificial Sequence
  Synthetic oligonucleotide
ttcgactcgcgcccatctttacacgcctaacacat

SEQ ID NO: 161802 - DNA, 35 bp, Artificial Sequence
  Synthetic oligonucleotide
tccaccatccaccctcttgctgcgacggaccatat

SEQ ID NO: 161803 - DNA, 35 bp, Artificial Sequence
  Synthetic oligonucleotide
tcaccatccgctcgctgtccatctcggtctactat

SEQ ID NO: 161804 - DNA, 35 bp, Artificial Sequence
  Synthetic oligonucleotide
acacctgccgttcgcaagttctttcggtttactat

SEQ ID NO: 161805 - DNA, 35 bp, Artificial Sequence
  Synthetic oligonucleotide
tcacccgcgtgatagcctcctacgtctccacctat

SEQ ID NO: 161806 - DNA, 35 bp, Artificial Sequence
  Synthetic oligonucleotide
tgcccgttccagcgcgctgctctatttcgcctact

SEQ ID NO: 161807 - DNA, 35 bp, Artificial Sequence
  Synthetic oligonucleotide
gtaccgccacctatcctggccgcttttcttgacct

SEQ ID NO: 161808 - DNA, 30 bp, Artificial Sequence
  Synthetic oligonucleotide
gtcgtgggggggtaaaaggggcgggaggct

SEQ ID NO: 161809 - DNA, 35 bp, Artificial Sequence
  Synthetic oligonucleotide
aaacaaggaacagggggcaagaggcaaggtgtggt

SEQ ID NO: 161810 - DNA, 35 bp, Artificial Sequence
  Synthetic oligonucleotide
gagcccgtacgtcgcgtttcctcgttttcttttgt

SEQ ID NO: 161811 - DNA, 35 bp, Artificial Sequence
  Synthetic oligonucleotide
taagccgccatcacgcctgctcacacacatggatt

SEQ ID NO: 161812 - DNA, 35 bp, Artificial Sequence
  Synthetic oligonucleotide
ggtagccccggcctcgttaccatcgttctgccctt

SEQ ID NO: 161813 - DNA, 35 bp, Artificial Sequence
  Synthetic oligonucleotide
ttcgcggcccatcactgaaccagcgttcccttctt

SEQ ID NO: 161814 - DNA, 35 bp, Artificial Sequence
  Synthetic oligonucleotide
ggccgccgggccgccgatccacacccatgcttctt

SEQ ID NO: 161815 - DNA, 35 bp, Artificial Sequence
  Synthetic oligonucleotide
gtgacacactgccttgcttcctatggccaattttt

SEQ ID NO: 161816 - DNA, 35 bp, Artificial Sequence
  Synthetic oligonucleotide
gacggttgaagccgggggagaatgaagaaggaaaa

SEQ ID NO: 161817 - DNA, 35 bp, Artificial Sequence
  Synthetic oligonucleotide
gttggaggaacggggggagggtagggcgcaacaaa

SEQ ID NO: 161818 - DNA, 36 bp, Artificial Sequence
  Synthetic oligonucleotide
tgaggggggaagaatagaaggtaggggcggttcaaa

SEQ ID NO: 161819 - DNA, 36 bp, Artificial Sequence
  Synthetic oligonucleotide
tacctgccggggggtggtaaaatgctggggagggaa

SEQ ID NO: 161820 - DNA, 36 bp, Artificial Sequence
  Synthetic oligonucleotide
acgcgaggtgaagggggggggcgtggcagtagataa

SEQ ID NO: 161821 - DNA, 35 bp, Artificial Sequence
  Synthetic oligonucleotide
gcccgcccctcgttgtccgacatctttactcttaa

SEQ ID NO: 161822 - DNA, 36 bp, Artificial Sequence
  Synthetic oligonucleotide
ttgggcgcaccgtgcatcgtcgctcgtctctcttaa

SEQ ID NO: 161823 - DNA, 35 bp, Artificial Sequence
  Synthetic oligonucleotide
acgatcgcccccatggttttctcttcccctgcaca

SEQ ID NO: 161824 - DNA, 36 bp, Artificial Sequence
  Synthetic oligonucleotide
gtcatcctctacccgcgcgcatccgttactttcaca

SEQ ID NO: 161825 - DNA, 36 bp, Artificial Sequence
  Synthetic oligonucleotide
aaccgctgtatcagcctgccgtaacgtcctgcacca

SEQ ID NO: 161826 - DNA, 36 bp, Artificial Sequence
  Synthetic oligonucleotide
tgcccatcccctgctgggctgtccctttactagcca

SEQ ID NO: 161827 - DNA, 36 bp, Artificial Sequence
  Synthetic oligonucleotide
atgtgccgcataggcgcatggccactttcctgtcca

SEQ ID NO: 161828 - DNA, 36 bp, Artificial Sequence
  Synthetic oligonucleotide
actgtgggagggacgagctgatgagaggagggagca

SEQ ID NO: 161829 - DNA, 36 bp, Artificial Sequence
  Synthetic oligonucleotide
agccgtgagggagggaggggttcaaaaaaatgggca

SEQ ID NO: 161830 - DNA, 36 bp, Artificial Sequence
  Synthetic oligonucleotide
tcacgctcctctgttttccgcgcgctttgttctgca

SEQ ID NO: 161831 - DNA, 35 bp, Artificial Sequence
  Synthetic oligonucleotide
gttcaggacgtcattcttgcaacccttcaccttca

SEQ ID NO: 161832 - DNA, 36 bp, Artificial Sequence
  Synthetic oligonucleotide
atcgatacctgccgccaacgtagcaccccctgttca

SEQ ID NO: 161833 - DNA, 38 bp, Artificial Sequence
  Synthetic oligonucleotide
ggatagagcagggggacgaaagggagatgaaggggaga

SEQ ID NO: 161834 - DNA, 37 bp, Artificial Sequence
  Synthetic oligonucleotide
gaagggaagggacggagggagcaagattagccgtaga

SEQ ID NO: 161835 - DNA, 36 bp, Artificial Sequence
  Synthetic oligonucleotide
tgtgtcggaggaagggggataggtgggagagagcga

SEQ ID NO: 161836 - DNA, 37 bp, Artificial Sequence
  Synthetic oligonucleotide
agcacagctgcacccttgatcccagcgtcctcctcga

SEQ ID NO: 161837 - DNA, 36 bp, Artificial Sequence
  Synthetic oligonucleotide
gagggaggggcataggggtggatagtcgtgggtcga

SEQ ID NO: 161838 - DNA, 35 bp, Artificial Sequence
  Synthetic oligonucleotide
ttggggtgtaggtgggagtaggcgcgggccgggga

SEQ ID NO: 161839 - DNA, 37 bp, Artificial Sequence
  Synthetic oligonucleotide
gagggggagggaatggagttatcatggaataggggga

SEQ ID NO: 161840 - DNA, 37 bp, Artificial Sequence
  Synthetic oligonucleotide
tggggagtggcggtttacatcctagggcggtggggga

SEQ ID NO: 161841 - DNA, 33 bp, Artificial Sequence
  Synthetic oligonucleotide
taggagagggggggggtcacgggctagtgtgga

SEQ ID NO: 161842 - DNA, 38 bp, Artificial Sequence
  Synthetic oligonucleotide
tctatggccaggagggagggaaagggatcggcggatga

SEQ ID NO: 161843 - DNA, 37 bp, Artificial Sequence
  Synthetic oligonucleotide
tcatgacgcaaacacatgtattcctgcctgcttatga

SEQ ID NO: 161844 - DNA, 38 bp, Artificial Sequence
  Synthetic oligonucleotide
ggaccgtatcccagtgtctccgcccctcacccacctga

SEQ ID NO: 161845 - DNA, 37 bp, Artificial Sequence
  Synthetic oligonucleotide
tagacacgcgctcgatacttggtccgccccaccctga

SEQ ID NO: 161846 - DNA, 37 bp, Artificial Sequence
  Synthetic oligonucleotide
tgccactgtgtgtcaacctcagcgctttccttcctga

SEQ ID NO: 161847 - DNA, 38 bp, Artificial Sequence
  Synthetic oligonucleotide
tgtcctcgggtgggtggcgagagggtcataacatctga

SEQ ID NO: 161848 - DNA, 38 bp, Artificial Sequence
  Synthetic oligonucleotide
gacctcacgatcgctgttatccgcctccctcattctga

SEQ ID NO: 161849 - DNA, 37 bp, Artificial Sequence
  Synthetic oligonucleotide
atcggggggaggtgagagctaaggagggcataggtga

SEQ ID NO: 161850 - DNA, 38 bp, Artificial Sequence
  Synthetic oligonucleotide
atgtaccgcaaggggggggagaagagtgcagaatgtga

SEQ ID NO: 161851 - DNA, 38 bp, Artificial Sequence
  Synthetic oligonucleotide
tctaccccgcgcccatgcctcaccgataacccctgtga

SEQ ID NO: 161852 - DNA, 37 bp, Artificial Sequence
  Synthetic oligonucleotide
accccccatccctcgcatagtgagaaatctgccttga

SEQ ID NO: 161853 - DNA, 37 bp, Artificial Sequence
  Synthetic oligonucleotide
tctgcccacatgtcttagtccgcgctcactatcttga

SEQ ID NO: 161854 - DNA, 35 bp, Artificial Sequence
  Synthetic oligonucleotide
atcgcatagcccactgtttaccctcgtacgtttga

SEQ ID NO: 161855 - DNA, 38 bp, Artificial Sequence
  Synthetic oligonucleotide
aaccctcaccgtgcactgcaattttcgccttgttttga

SEQ ID NO: 161856 - DNA, 36 bp, Artificial Sequence
  Synthetic oligonucleotide
ttgccacctttcgaccgtcctcctacgagcccaata

SEQ ID NO: 161857 - DNA, 36 bp, Artificial Sequence
  Synthetic oligonucleotide
gatagggagaggaaccagaagaggatgaagggaata

SEQ ID NO: 161858 - DNA, 36 bp, Artificial Sequence
  Synthetic oligonucleotide
tgatgcgctatcctgatccgcctgtgctacctaata

SEQ ID NO: 161859 - DNA, 36 bp, Artificial Sequence
  Synthetic oligonucleotide
acaccgtatccccgttatgccctttagccgcccata

SEQ ID NO: 161860 - DNA, 35 bp, Artificial Sequence
  Synthetic oligonucleotide
agtacccccccctcacgtgtctagcaccatcgcta

SEQ ID NO: 161861 - DNA, 35 bp, Artificial Sequence
  Synthetic oligonucleotide
gctccaccctcacgtggctgccacttatcataaac

SEQ ID NO: 161862 - DNA, 35 bp, Artificial Sequence
  Synthetic oligonucleotide
gacgtggccaccaaccttctgctaatccgccgacc

SEQ ID NO: 161863 - DNA, 35 bp, Artificial Sequence
  Synthetic oligonucleotide
cccacctccctgtatagatgcctctcgtccatacc

SEQ ID NO: 161864 - DNA, 35 bp, Artificial Sequence
  Synthetic oligonucleotide
tctcccccccctccgatgccctatctccgcgaccc

SEQ ID NO: 161865 - DNA, 35 bp, Artificial Sequence
  Synthetic oligonucleotide
ggacaccaccacagcgtccaaccgctcaaacgccc

SEQ ID NO: 161866 - DNA, 35 bp, Artificial Sequence
  Synthetic oligonucleotide
aaggcacccgacgattggtccccggcgctcctccc

SEQ ID NO: 161867 - DNA, 35 bp, Artificial Sequence
  Synthetic oligonucleotide
attggacagcgcttctgccatactcttgtcgtccc

SEQ ID NO: 161868 - DNA, 35 bp, Artificial Sequence
  Synthetic oligonucleotide
ggtgtcctccgcccaccatgattgacgctaccgcc

SEQ ID NO: 161869 - DNA, 35 bp, Artificial Sequence
  Synthetic oligonucleotide
gccagcccaatgatccgtctcgcggccgcctcgcc

SEQ ID NO: 161870 - DNA, 35 bp, Artificial Sequence
  Synthetic oligonucleotide
acgtacgtagccgcaccccaacatatgccattgcc

SEQ ID NO: 161871 - DNA, 35 bp, Artificial Sequence
  Synthetic oligonucleotide
gccgatgactccccgatgacttctttctttttgcc

SEQ ID NO: 161872 - DNA, 35 bp, Artificial Sequence
  Synthetic oligonucleotide
agcgatgcctcactgacttttcttagttgctgtcc

SEQ ID NO: 161873 - DNA, 35 bp, Artificial Sequence
  Synthetic oligonucleotide
agcatgcccacttgccctcgtcactcctggcttcc

SEQ ID NO: 161874 - DNA, 35 bp, Artificial Sequence
  Synthetic oligonucleotide
ttgaccctggatctgctcgcctgtattccatttcc

SEQ ID NO: 161875 - DNA, 35 bp, Artificial Sequence
  Synthetic oligonucleotide
gccatcccacattgacttatgaactccaatccagc

SEQ ID NO: 161876 - DNA, 35 bp, Artificial Sequence
  Synthetic oligonucleotide
gatcacaatcatcgtgcgtcattacgaaaccccgc

SEQ ID NO: 161877 - DNA, 35 bp, Artificial Sequence
  Synthetic oligonucleotide
tgtccgcaaggaagcagttgtcgtccgcaccccgc

SEQ ID NO: 161878 - DNA, 35 bp, Artificial Sequence
  Synthetic oligonucleotide
agatgtcacccgggccttgttgtctctttccgtgc

SEQ ID NO: 161879 - DNA, 35 bp, Artificial Sequence
  Synthetic oligonucleotide
gcctatccgcactgtccactatcacgacgcctatc

SEQ ID NO: 161880 - DNA, 35 bp, Artificial Sequence
  Synthetic oligonucleotide
ttgacagcccgatgcgcgtgcatccttactccctc

SEQ ID NO: 161881 - DNA, 35 bp, Artificial Sequence
  Synthetic oligonucleotide
ggtaaccgcccgagacgctagtccgtttcatcctc

SEQ ID NO: 161882 - DNA, 35 bp, Artificial Sequence
  Synthetic oligonucleotide
tgtgacaacacactgctggttttcgccctatcctc

SEQ ID NO: 161883 - DNA, 35 bp, Artificial Sequence
  Synthetic oligonucleotide
tgagacgggggggaaggcttgggcgttaggagcag

SEQ ID NO: 161884 - DNA, 35 bp, Artificial Sequence
  Synthetic oligonucleotide
aaggatggtacggggggttacactaggatggggag

SEQ ID NO: 161885 - DNA, 35 bp, Artificial Sequence
  Synthetic oligonucleotide
gattcgtatcgtgcgccagagtccaccaccccccg

SEQ ID NO: 161886 - DNA, 35 bp, Artificial Sequence
  Synthetic oligonucleotide
tcatcaacctccgcccgtgattagctccctccatg

SEQ ID NO: 161887 - DNA, 35 bp, Artificial Sequence
  Synthetic oligonucleotide
gaacgaaacggggggaaggatgacgaccacagatg

SEQ ID NO: 161888 - DNA, 35 bp, Artificial Sequence
  Synthetic oligonucleotide
tgggcccaatcgttttgtacatcctctccactctg

SEQ ID NO: 161889 - DNA, 35 bp, Artificial Sequence
  Synthetic oligonucleotide
tcccgccgtcgcctatccctgtcgcctctgccttg

SEQ ID NO: 161890 - DNA, 35 bp, Artificial Sequence
  Synthetic oligonucleotide
tccgtcacttccacactgtactgcgcccctccttg

SEQ ID NO: 161891 - DNA, 35 bp, Artificial Sequence
  Synthetic oligonucleotide
tgtgacatctcggtcgccacacacccttcattttg

SEQ ID NO: 161892 - DNA, 35 bp, Artificial Sequence
  Synthetic oligonucleotide
ttgcaccatatcctatgtatcgtcctcttcgccat

SEQ ID NO: 161893 - DNA, 35 bp, Artificial Sequence
  Synthetic oligonucleotide
tcatcgcgcacattgctcttctgtcaattatctat

SEQ ID NO: 161894 - DNA, 35 bp, Artificial Sequence
  Synthetic oligonucleotide
ggtgttgacgcgggcaagggtgggtgggttgacct

SEQ ID NO: 161895 - DNA, 35 bp, Artificial Sequence
  Synthetic oligonucleotide
tcaccaggtacacgattgccctgttctgcctacct

SEQ ID NO: 161896 - DNA, 35 bp, Artificial Sequence
  Synthetic oligonucleotide
atcagcaggctatacccacggtccccacgctccct

SEQ ID NO: 161897 - DNA, 35 bp, Artificial Sequence
  Synthetic oligonucleotide
gacacatctccgcgaacgtggcctggcccccatct

SEQ ID NO: 161898 - DNA, 35 bp, Artificial Sequence
  Synthetic oligonucleotide
aggtcgaacagtcgcgttccttctgcacccactct

SEQ ID NO: 161899 - DNA, 35 bp, Artificial Sequence
  Synthetic oligonucleotide
gcaacaagccgtctccccatgtaatatcaccgtct

SEQ ID NO: 161900 - DNA, 35 bp, Artificial Sequence
  Synthetic oligonucleotide
tcaaggccacccgtccaccgcccgagcactattct

SEQ ID NO: 161901 - DNA, 35 bp, Artificial Sequence
  Synthetic oligonucleotide
tctccatcacgccgaccctcatttctcgtcccggt

SEQ ID NO: 161902 - DNA, 35 bp, Artificial Sequence
  Synthetic oligonucleotide
tcctggctcaggctcccgttcccttgatggctctt

SEQ ID NO: 161903 - DNA, 35 bp, Artificial Sequence
  Synthetic oligonucleotide
gatgcagcacaccccccgcgtcttacttcgtcgtt

SEQ ID NO: 161904 - DNA, 35 bp, Artificial Sequence
  Synthetic oligonucleotide
tcacgggctctggctccaccttctcggttcccttt

SEQ ID NO: 161905 - DNA, 28 bp, Artificial Sequence
  Synthetic oligonucleotide
gaccctcatgcccggactcccattgttt

SEQ ID NO: 161906 - DNA, 36 bp, Artificial Sequence
  Synthetic oligonucleotide
tgcaacccctaccgtgtttatctgtctcggctccaa

SEQ ID NO: 161907 - DNA, 35 bp, Artificial Sequence
  Synthetic oligonucleotide
cccactccgcaccaccgattagcgatagcccctaa

SEQ ID NO: 161908 - DNA, 36 bp, Artificial Sequence
  Synthetic oligonucleotide
gcgctccgccacatggttgtgctcccctattcgtaa

SEQ ID NO: 161909 - DNA, 36 bp, Artificial Sequence
  Synthetic oligonucleotide
tcaatgggaggggttggggagtagggggttacgaca

SEQ ID NO: 161910 - DNA, 36 bp, Artificial Sequence
  Synthetic oligonucleotide
acggtcacgcctcgctttccctctaacgacccccca

SEQ ID NO: 161911 - DNA, 35 bp, Artificial Sequence
  Synthetic oligonucleotide
gctcccccgcctcgtgtgcataccttcgctcccca

SEQ ID NO: 161912 - DNA, 36 bp, Artificial Sequence
  Synthetic oligonucleotide
agaccacacgccccgatagcgcttcacctatgccca

SEQ ID NO: 161913 - DNA, 35 bp, Artificial Sequence
  Synthetic oligonucleotide
tccgcgaatcccgcagtttccgccgcctatatcca

SEQ ID NO: 161914 - DNA, 35 bp, Artificial Sequence
  Synthetic oligonucleotide
ttcagccacactcgcccgagagcatgcactctcca

SEQ ID NO: 161915 - DNA, 36 bp, Artificial Sequence
  Synthetic oligonucleotide
tccatcatgcccttcgattataacagctccaacgca

SEQ ID NO: 161916 - DNA, 32 bp, Artificial Sequence
  Synthetic oligonucleotide
actcaattggtgttcccccctccgcccgtgca

SEQ ID NO: 161917 - DNA, 35 bp, Artificial Sequence
  Synthetic oligonucleotide
accccccgcatcggccccgtctattaccttcatca

SEQ ID NO: 161918 - DNA, 36 bp, Artificial Sequence
  Synthetic oligonucleotide
tctagccctgtcctccgtgcggcccccttccacaga

SEQ ID NO: 161919 - DNA, 35 bp, Artificial Sequence
  Synthetic oligonucleotide
tcacgaccccgtacgttcccaactccattctgaga

SEQ ID NO: 161920 - DNA, 37 bp, Artificial Sequence
  Synthetic oligonucleotide
ttcacaccgcccgccctctcgagttcgacctagccga

SEQ ID NO: 161921 - DNA, 37 bp, Artificial Sequence
  Synthetic oligonucleotide
ttgagaggggaacagcgaaatgggaagggctgggcga

SEQ ID NO: 161922 - DNA, 37 bp, Artificial Sequence
  Synthetic oligonucleotide
gactgcctcacgagcatttacgccccctcgctatcga

SEQ ID NO: 161923 - DNA, 37 bp, Artificial Sequence
  Synthetic oligonucleotide
taggtgagtgggtgcaagttgggggggtgagactcga

SEQ ID NO: 161924 - DNA, 37 bp, Artificial Sequence
  Synthetic oligonucleotide
gcgaacctccaactgggccattgctctgctccttcga

SEQ ID NO: 161925 - DNA, 37 bp, Artificial Sequence
  Synthetic oligonucleotide
attagggagggggggaaatgggacacgggctgcagga

SEQ ID NO: 161926 - DNA, 36 bp, Artificial Sequence
  Synthetic oligonucleotide
cactccaccgtccagctctaccgcctttctctcgga

SEQ ID NO: 161927 - DNA, 36 bp, Artificial Sequence
  Synthetic oligonucleotide
gccgggtggggtgcttggggttgtgacttcagggga

SEQ ID NO: 161928 - DNA, 36 bp, Artificial Sequence
  Synthetic oligonucleotide
tttcccccctcctggtctttacacacgctctctgga

SEQ ID NO: 161929 - DNA, 37 bp, Artificial Sequence
  Synthetic oligonucleotide
acatcccactgaccgctttggtacctgactttctgga

SEQ ID NO: 161930 - DNA, 35 bp, Artificial Sequence
  Synthetic oligonucleotide
tgagggaggggggggtaagtaatactctaggtgga

SEQ ID NO: 161931 - DNA, 38 bp, Artificial Sequence
  Synthetic oligonucleotide
tcacgtcgctgtcgcttatacgcccgcccttcttatga

SEQ ID NO: 161932 - DNA, 37 bp, Artificial Sequence
  Synthetic oligonucleotide
gggagacaggaggggagggtgacagatcgataactga

SEQ ID NO: 161933 - DNA, 37 bp, Artificial Sequence
  Synthetic oligonucleotide
atcgacccctccgttcgcaatattagctcactcctga

SEQ ID NO: 161934 - DNA, 38 bp, Artificial Sequence
  Synthetic oligonucleotide
aacgtcactgcccaaccttagcgccactctctcgctga

SEQ ID NO: 161935 - DNA, 37 bp, Artificial Sequence
  Synthetic oligonucleotide
gcccccctctgcccgatttaatagctccaacctctga

SEQ ID NO: 161936 - DNA, 37 bp, Artificial Sequence
  Synthetic oligonucleotide
agccaaagggagggggaggactcgacagggcaagtga

SEQ ID NO: 161937 - DNA, 38 bp, Artificial Sequence
  Synthetic oligonucleotide
ttaccccgcacatcgtcccgcgccccacaataccgtga

SEQ ID NO: 161938 - DNA, 37 bp, Artificial Sequence
  Synthetic oligonucleotide
ggacggggggggtgccaacaatgggaaaactcggtga

SEQ ID NO: 161939 - DNA, 37 bp, Artificial Sequence
  Synthetic oligonucleotide
gcactccgccctgcgtcactcacccgttcttacttga

SEQ ID NO: 161940 - DNA, 38 bp, Artificial Sequence
  Synthetic oligonucleotide
gcccatcgtccgactccgtccctgtcctcgttacttga

SEQ ID NO: 161941 - DNA, 36 bp, Artificial Sequence
  Synthetic oligonucleotide
gcccccgtcctgccctccactgctctaaaggacata

SEQ ID NO: 161942 - DNA, 36 bp, Artificial Sequence
  Synthetic oligonucleotide
actcggagggagtaggatcggggccaagggggggta

SEQ ID NO: 161943 - DNA, 36 bp, Artificial Sequence
  Synthetic oligonucleotide
tccggtacctgatgtcggtctcgttccttctctgta

SEQ ID NO: 161944 - DNA, 35 bp, Artificial Sequence
  Synthetic oligonucleotide
ccccacccccgacccgtaccgtggctcgctactta

SEQ ID NO: 161945 - DNA, 35 bp, Artificial Sequence
  Synthetic oligonucleotide
acttcacgcattctctcgcctgctgttctccctta

SEQ ID NO: 161946 - DNA, 36 bp, Artificial Sequence
  Synthetic oligonucleotide
agaacacccccatcgtttgtttcgtatcatgcctta

SEQ ID NO: 161947 - DNA, 35 bp, Artificial Sequence
  Synthetic oligonucleotide
tcatgacactcgactcctctatcacgcacactaac

SEQ ID NO: 161948 - DNA, 35 bp, Artificial Sequence
  Synthetic oligonucleotide
tgggtgggaggggttagagcaaggcagggaaccac

SEQ ID NO: 161949 - DNA, 35 bp, Artificial Sequence
  Synthetic oligonucleotide
ttgccgttgtgtcttgtattccccgttctgctcac

SEQ ID NO: 161950 - DNA, 35 bp, Artificial Sequence
  Synthetic oligonucleotide
tctgtacctgtactgttcctctccacctgtgatac

SEQ ID NO: 161951 - DNA, 35 bp, Artificial Sequence
  Synthetic oligonucleotide
ttgtcccccccgctccatgccaccttgtgtcgtac

SEQ ID NO: 161952 - DNA, 35 bp, Artificial Sequence
  Synthetic oligonucleotide
tccacatactcctgacgatccagatacctgcttac

SEQ ID NO: 161953 - DNA, 35 bp, Artificial Sequence
  Synthetic oligonucleotide
tcagcactgttgctgtcttggccactgccaccccc

SEQ ID NO: 161954 - DNA, 35 bp, Artificial Sequence
  Synthetic oligonucleotide
acgctcgcgcggtaatgtctgccgttgcctctccc

SEQ ID NO: 161955 - DNA, 35 bp, Artificial Sequence
  Synthetic oligonucleotide
accaccgaacctttgccaccctaacgccaggtccc

SEQ ID NO: 161956 - DNA, 35 bp, Artificial Sequence
  Synthetic oligonucleotide
ttccgttcctgcctcgtttgtaccccgactgtccc

SEQ ID NO: 161957 - DNA, 35 bp, Artificial Sequence
  Synthetic oligonucleotide
acacgcccctcaccaagttacccagatcttaggcc

SEQ ID NO: 161958 - DNA, 35 bp, Artificial Sequence
  Synthetic oligonucleotide
tcccccgaccttatacaccgccggggtatccatcc

SEQ ID NO: 161959 - DNA, 35 bp, Artificial Sequence
  Synthetic oligonucleotide
tacgcccttcatttatcgcgccgcctggtgcctcc

SEQ ID NO: 161960 - DNA, 35 bp, Artificial Sequence
  Synthetic oligonucleotide
accctgcgcggtcctcactataaccagctttttcc

SEQ ID NO: 161961 - DNA, 35 bp, Artificial Sequence
  Synthetic oligonucleotide
tcgtaaccgtcttcccgtttgctttctcttgctgc

SEQ ID NO: 161962 - DNA, 35 bp, Artificial Sequence
  Synthetic oligonucleotide
gtgccgccatgcggttccgccttttccactcactc

SEQ ID NO: 161963 - DNA, 35 bp, Artificial Sequence
  Synthetic oligonucleotide
tagtagctcacccacccaggtattatacgctcctc

SEQ ID NO: 161964 - DNA, 35 bp, Artificial Sequence
  Synthetic oligonucleotide
gcgtagctacacctccatttaggccccatgtcgtc

SEQ ID NO: 161965 - DNA, 35 bp, Artificial Sequence
  Synthetic oligonucleotide
ctcgagcgaaacgcagagagtttctgttccttgtc

SEQ ID NO: 161966 - DNA, 35 bp, Artificial Sequence
  Synthetic oligonucleotide
gacaacctctgccgatatccccaagcaacatctag

SEQ ID NO: 161967 - DNA, 35 bp, Artificial Sequence
  Synthetic oligonucleotide
aagagggggaactgtaggcgtacgggaacgggtag

SEQ ID NO: 161968 - DNA, 34 bp, Artificial Sequence
  Synthetic oligonucleotide
atcgatctgtccggtctgcctgccccatttgccg

SEQ ID NO: 161969 - DNA, 35 bp, Artificial Sequence
  Synthetic oligonucleotide
tccacaccttagttggccttcccctctgttcctcg

SEQ ID NO: 161970 - DNA, 35 bp, Artificial Sequence
  Synthetic oligonucleotide
acatcaacgcactgggttcccagtctgccctctcg

SEQ ID NO: 161971 - DNA, 35 bp, Artificial Sequence
  Synthetic oligonucleotide
tgggatgtacccagtctcatcttgctccctgttcg

SEQ ID NO: 161972 - DNA, 35 bp, Artificial Sequence
  Synthetic oligonucleotide
agcaagcgatggggggtggtcggggtacggaaagg

SEQ ID NO: 161973 - DNA, 35 bp, Artificial Sequence
  Synthetic oligonucleotide
ggtccctgcccgtacttggtcatttcacatcactg

SEQ ID NO: 161974 - DNA, 33 bp, Artificial Sequence
  Synthetic oligonucleotide
gcatccatccgcgctttttacttctgcctcgtg

SEQ ID NO: 161975 - DNA, 35 bp, Artificial Sequence
  Synthetic oligonucleotide
tcacccacccgtacccttctgtttacaccacattg

SEQ ID NO: 161976 - DNA, 35 bp, Artificial Sequence
  Synthetic oligonucleotide
tatgctgtgcattgccgttctacatttccatacat

SEQ ID NO: 161977 - DNA, 36 bp, Artificial Sequence
  Synthetic oligonucleotide
aaactcccgctcgctgtgctctttcaccggccctat

SEQ ID NO: 161978 - DNA, 35 bp, Artificial Sequence
  Synthetic oligonucleotide
acacccgccatcagccctgtactattaaagttcct

SEQ ID NO: 161979 - DNA, 35 bp, Artificial Sequence
  Synthetic oligonucleotide
tacgtgttgcgtctcacgctgctgatcaccactct

SEQ ID NO: 161980 - DNA, 35 bp, Artificial Sequence
  Synthetic oligonucleotide
atttagcccacgacgtggctggttttctactctct

SEQ ID NO: 161981 - DNA, 35 bp, Artificial Sequence
  Synthetic oligonucleotide
tgccctcgcctcatttatcgcgtcgctatcattct

SEQ ID NO: 161982 - DNA, 35 bp, Artificial Sequence
  Synthetic oligonucleotide
tagacccctcggtgctccatcccggaatgtcttct

SEQ ID NO: 161983 - DNA, 35 bp, Artificial Sequence
  Synthetic oligonucleotide
tcgctctcgtcacttgtcctccctcagcactttct

SEQ ID NO: 161984 - DNA, 35 bp, Artificial Sequence
  Synthetic oligonucleotide
taggacggggggtggggagcaagacaagggaaagt

SEQ ID NO: 161985 - DNA, 35 bp, Artificial Sequence
  Synthetic oligonucleotide
gtccccttctgcgtgccccatcatccggcctacgt

SEQ ID NO: 161986 - DNA, 35 bp, Artificial Sequence
  Synthetic oligonucleotide
actcccccaatgccacccgtacccataacatcggt

SEQ ID NO: 161987 - DNA, 35 bp, Artificial Sequence
  Synthetic oligonucleotide
attcgcaccttttcctgtctcttcgcacagtttgt

SEQ ID NO: 161988 - DNA, 35 bp, Artificial Sequence
  Synthetic oligonucleotide
gaagcctagcccagtccctcgacgcatttcctctt

SEQ ID NO: 161989 - DNA, 34 bp, Artificial Sequence
  Synthetic oligonucleotide
gccggccccttttatctgcaccgcctgctttgtt

SEQ ID NO: 161990 - DNA, 36 bp, Artificial Sequence
  Synthetic oligonucleotide
aacgggcgggggggtattcagtatcggtgggtgaaa

SEQ ID NO: 161991 - DNA, 36 bp, Artificial Sequence
  Synthetic oligonucleotide
aacgggagcgggcgggtggagtgggaacgggctcaa

SEQ ID NO: 161992 - DNA, 36 bp, Artificial Sequence
  Synthetic oligonucleotide
tactgcccaactttgcgttcttttcgaccctgccca

SEQ ID NO: 161993 - DNA, 36 bp, Artificial Sequence
  Synthetic oligonucleotide
gcacacacagctccaatacactctctctgcccgcca

SEQ ID NO: 161994 - DNA, 36 bp, Artificial Sequence
  Synthetic oligonucleotide
atcctatgcccccccgcctctgttttttgaaccgca

SEQ ID NO: 161995 - DNA, 35 bp, Artificial Sequence
  Synthetic oligonucleotide
tcccttgaatcgcaccctccccacgtgcctctgca

SEQ ID NO: 161996 - DNA, 36 bp, Artificial Sequence
  Synthetic oligonucleotide
tccactccatgtgtttctgcctttaagcttccctca

SEQ ID NO: 161997 - DNA, 36 bp, Artificial Sequence
  Synthetic oligonucleotide
tctaatgctgactgccgtttatcgtacacctcctca

SEQ ID NO: 161998 - DNA, 35 bp, Artificial Sequence
  Synthetic oligonucleotide
tcaaccctccgcctgacgatcaagatccccgttca

SEQ ID NO: 161999 - DNA, 37 bp, Artificial Sequence
  Synthetic oligonucleotide
gaggacaggaagtaaggcagggaggaaaccggtaaga

SEQ ID NO: 162000 - DNA, 37 bp, Artificial Sequence
  Synthetic oligonucleotide
aatggggggaataggtgaaagggtacaagggagacga

SEQ ID NO: 162001 - DNA, 36 bp, Artificial Sequence
  Synthetic oligonucleotide
tcccttccctcattgtctctatttgcgcttaaccga

SEQ ID NO: 162002 - DNA, 36 bp, Artificial Sequence
  Synthetic oligonucleotide
accgctcgtcatccgcctgacccagcctactaccga

SEQ ID NO: 162003 - DNA, 36 bp, Artificial Sequence
  Synthetic oligonucleotide
actcacctgaggcactgtctatcgcttcccgcccga

SEQ ID NO: 162004 - DNA, 37 bp, Artificial Sequence
  Synthetic oligonucleotide
ttatcccctcacagtagtacacccctccgcctgccga

SEQ ID NO: 162005 - DNA, 35 bp, Artificial Sequence
  Synthetic oligonucleotide
tgccaacctctgccggccaacacgcccattgccga

SEQ ID NO: 162006 - DNA, 36 bp, Artificial Sequence
  Synthetic oligonucleotide
tccctgacacgctttgttcatcgcttcacactccga

SEQ ID NO: 162007 - DNA, 37 bp, Artificial Sequence
  Synthetic oligonucleotide
gcctgcttcagcagatcttccctctcttgctttgcga

SEQ ID NO: 162008 - DNA, 36 bp, Artificial Sequence
  Synthetic oligonucleotide
tatccaccccttcagctgttttccccgggcgttcga

SEQ ID NO: 162009 - DNA, 37 bp, Artificial Sequence
  Synthetic oligonucleotide
tatgtcaccggctggtgcatcccccatctctgttcga

SEQ ID NO: 162010 - DNA, 35 bp, Artificial Sequence
  Synthetic oligonucleotide
gcaacacgggacgtgcattacagggtggggaggga

SEQ ID NO: 162011 - DNA, 36 bp, Artificial Sequence
  Synthetic oligonucleotide
tctcaacgggttggaggttggtttgggtgggaggga

SEQ ID NO: 162012 - DNA, 38 bp, Artificial Sequence
  Synthetic oligonucleotide
gactgggcaatacggaaagacgagagggaggggtatga

SEQ ID NO: 162013 - DNA, 38 bp, Artificial Sequence
  Synthetic oligonucleotide
tgctgtcttccgctacgatttagctgttcctcccctga

SEQ ID NO: 162014 - DNA, 38 bp, Artificial Sequence
  Synthetic oligonucleotide
atccccgcctcatctcgtctgcaatatctattccctga

SEQ ID NO: 162015 - DNA, 38 bp, Artificial Sequence
  Synthetic oligonucleotide
ttgccgccacatgcttcgaccttaacacacttccctga

SEQ ID NO: 162016 - DNA, 38 bp, Artificial Sequence
  Synthetic oligonucleotide
accccacccggtttactaagacccgttcccattcctga

SEQ ID NO: 162017 - DNA, 35 bp, Artificial Sequence
  Synthetic oligonucleotide
gtcacatcttgggcgtttaccctcctgtttcctga

SEQ ID NO: 162018 - DNA, 38 bp, Artificial Sequence
  Synthetic oligonucleotide
ggagtcgtagtggaggctagagaggaggggcggggtga

SEQ ID NO: 162019 - DNA, 38 bp, Artificial Sequence
  Synthetic oligonucleotide
tcaactgcccccacatctatgagtcaccgacaccttga

SEQ ID NO: 162020 - DNA, 35 bp, Artificial Sequence
  Synthetic oligonucleotide
tgcctcagcgtcttcttttcctgtgcccccgttga

SEQ ID NO: 162021 - DNA, 38 bp, Artificial Sequence
  Synthetic oligonucleotide
acccccctcgcatgtgcatgccagcactcactatttga

SEQ ID NO: 162022 - DNA, 36 bp, Artificial Sequence
  Synthetic oligonucleotide
ttaagcgcagtcctagtttttgtccccccttgcata

SEQ ID NO: 162023 - DNA, 34 bp, Artificial Sequence
  Synthetic oligonucleotide
gggatggggggatggaggcatgggggactttata

SEQ ID NO: 162024 - DNA, 35 bp, Artificial Sequence
  Synthetic oligonucleotide
aaagtgcgctgtccccacgtaccttcatgccacta

SEQ ID NO: 162025 - DNA, 36 bp, Artificial Sequence
  Synthetic oligonucleotide
ttgttccactctctgccattcacatagctgacgcta

SEQ ID NO: 162026 - DNA, 36 bp, Artificial Sequence
  Synthetic oligonucleotide
tcgctctttcacgcccccgatcctggttagtttcta

SEQ ID NO: 162027 - DNA, 35 bp, Artificial Sequence
  Synthetic oligonucleotide
gtacgactccccccacccatcgttgttgcctggta

SEQ ID NO: 162028 - DNA, 35 bp, Artificial Sequence
  Synthetic oligonucleotide
gacactcccgtcgaagacgcacctggctactccac

SEQ ID NO: 162029 - DNA, 35 bp, Artificial Sequence
  Synthetic oligonucleotide
tttggcccccctctgttgcctcacccgctatgtac

SEQ ID NO: 162030 - DNA, 35 bp, Artificial Sequence
  Synthetic oligonucleotide
ttccgaccctctccgagcgtaataggtccccgccc

SEQ ID NO: 162031 - DNA, 35 bp, Artificial Sequence
  Synthetic oligonucleotide
atcgcacggacacacccggaccatccaccgatccc

SEQ ID NO: 162032 - DNA, 35 bp, Artificial Sequence
  Synthetic oligonucleotide
gtttccagccagaatccgctcccgtcaatcttccc

SEQ ID NO: 162033 - DNA, 35 bp, Artificial Sequence
  Synthetic oligonucleotide
gcctctcaaacagtatagcccttcccccgaacgcc

SEQ ID NO: 162034 - DNA, 35 bp, Artificial Sequence
  Synthetic oligonucleotide
gacttcgccctaggtactagcaccgctctgccgcc

SEQ ID NO: 162035 - DNA, 35 bp, Artificial Sequence
  Synthetic oligonucleotide
gcaacgctcatcacgcgcaaaccctgtacactgcc

SEQ ID NO: 162036 - DNA, 35 bp, Artificial Sequence
  Synthetic oligonucleotide
tctagtatcggccttcctctgtctctctgcctgcc

SEQ ID NO: 162037 - DNA, 35 bp, Artificial Sequence
  Synthetic oligonucleotide
gtagcgtccgtccgcttagttcgccttgccttgcc

SEQ ID NO: 162038 - DNA, 35 bp, Artificial Sequence
  Synthetic oligonucleotide
gcgcacatcgttgtcttatttagtctgctcgatcc

SEQ ID NO: 162039 - DNA, 35 bp, Artificial Sequence
  Synthetic oligonucleotide
tgacgccctcccttgctttaccatctgcgtagtcc

SEQ ID NO: 162040 - DNA, 35 bp, Artificial Sequence
  Synthetic oligonucleotide
gaccccgctctatcattgttctgaggcttctgtcc

SEQ ID NO: 162041 - DNA, 35 bp, Artificial Sequence
  Synthetic oligonucleotide
acactgtgtccctgctgccgcacttaggattttcc

SEQ ID NO: 162042 - DNA, 35 bp, Artificial Sequence
  Synthetic oligonucleotide
gtaagcttaccaactgccgtctctccgcctaccgc

SEQ ID NO: 162043 - DNA, 35 bp, Artificial Sequence
  Synthetic oligonucleotide
atgtacatactgctgtttcctacactcgcctccgc

SEQ ID NO: 162044 - DNA, 35 bp, Artificial Sequence
  Synthetic oligonucleotide
gttgaccattcgctggattctatggccccccctgc

SEQ ID NO: 162045 - DNA, 35 bp, Artificial Sequence
  Synthetic oligonucleotide
acctacctccatcggggatggtgttccttccactc

SEQ ID NO: 162046 - DNA, 35 bp, Artificial Sequence
  Synthetic oligonucleotide
acgccctctgcccgtgcactttctcagctacgctc

SEQ ID NO: 162047 - DNA, 35 bp, Artificial Sequence
  Synthetic oligonucleotide
tcagtgcctccgcctattcgctagttaaaaccgtc

SEQ ID NO: 162048 - DNA, 35 bp, Artificial Sequence
  Synthetic oligonucleotide
actacgcacctctatcgccgccttaacatcgggtc

SEQ ID NO: 162049 - DNA, 35 bp, Artificial Sequence
  Synthetic oligonucleotide
gttgcagggtcatttccacctgccgtgttcgggtc

SEQ ID NO: 162050 - DNA, 35 bp, Artificial Sequence
  Synthetic oligonucleotide
gttcatcgtctgctccctctccatggttggctgtc

SEQ ID NO: 162051 - DNA, 35 bp, Artificial Sequence
  Synthetic oligonucleotide
gaaaccgcctcgctctcgacccccccatatgattc

SEQ ID NO: 162052 - DNA, 35 bp, Artificial Sequence
  Synthetic oligonucleotide
attcccagtcccgctcgcatttgcaggcatacttc

SEQ ID NO: 162053 - DNA, 35 bp, Artificial Sequence
  Synthetic oligonucleotide
tccgtgcgcgtgacccttccatgctcctttggttc

SEQ ID NO: 162054 - DNA, 35 bp, Artificial Sequence
  Synthetic oligonucleotide
gccgctccattccacgtcctgccaccgcctcgccg

SEQ ID NO: 162055 - DNA, 35 bp, Artificial Sequence
  Synthetic oligonucleotide
acgcctctcaggctcattagtttcttgtctcgccg

SEQ ID NO: 162056 - DNA, 35 bp, Artificial Sequence
  Synthetic oligonucleotide
tgccgatccggtctgggttcgcatctttctctccg

SEQ ID NO: 162057 - DNA, 35 bp, Artificial Sequence
  Synthetic oligonucleotide
gaaatgtcgaggcggggtctagggggggcatgagg

SEQ ID NO: 162058 - DNA, 35 bp, Artificial Sequence
  Synthetic oligonucleotide
tatccggaccctaccgcctccgtaccttgctaggg

SEQ ID NO: 162059 - DNA, 35 bp, Artificial Sequence
  Synthetic oligonucleotide
tccggtggtcaacttgcccttatgcctgccaactg

SEQ ID NO: 162060 - DNA, 35 bp, Artificial Sequence
  Synthetic oligonucleotide
aacacctgcctaatcttcgacatatgtcctccctg

SEQ ID NO: 162061 - DNA, 35 bp, Artificial Sequence
  Synthetic oligonucleotide
tacttctcgctcgcctgacgttcatccctatcctg

SEQ ID NO: 162062 - DNA, 35 bp, Artificial Sequence
  Synthetic oligonucleotide
attgcccttcctgctgagtacttccttaaaacgtg

SEQ ID NO: 162063 - DNA, 35 bp, Artificial Sequence
  Synthetic oligonucleotide
ggtgtgaggtggatagaccagaaggcgggggggtg

SEQ ID NO: 162064 - DNA, 35 bp, Artificial Sequence
  Synthetic oligonucleotide
acacaccaactaacatgttcgccgttccgctcttg

SEQ ID NO: 162065 - DNA, 35 bp, Artificial Sequence
  Synthetic oligonucleotide
gatttcaccgcccttcccctgtggccattgttttg

SEQ ID NO: 162066 - DNA, 35 bp, Artificial Sequence
  Synthetic oligonucleotide
accaagtcgcctcgccctgcaatcagcctctccat

SEQ ID NO: 162067 - DNA, 35 bp, Artificial Sequence
  Synthetic oligonucleotide
gcaccgcgcggtgggctctttctcggctccctcat

SEQ ID NO: 162068 - DNA, 35 bp, Artificial Sequence
  Synthetic oligonucleotide
tcacattctgctccggtccgttattctagcgcact

SEQ ID NO: 162069 - DNA, 35 bp, Artificial Sequence
  Synthetic oligonucleotide
gacgtaccatcatcctgaatcttattgggagccct

SEQ ID NO: 162070 - DNA, 35 bp, Artificial Sequence
  Synthetic oligonucleotide
gtacccgaccatctgatttttgcgccactcccgct

SEQ ID NO: 162071 - DNA, 35 bp, Artificial Sequence
  Synthetic oligonucleotide
ttatcgcaggcggaccaagctgcccccctgtctct

SEQ ID NO: 162072 - DNA, 35 bp, Artificial Sequence
  Synthetic oligonucleotide
gcccctcgattcccttccacagatcactgcggtct

SEQ ID NO: 162073 - DNA, 35 bp, Artificial Sequence
  Synthetic oligonucleotide
gctccgcccatcggtaactctgacttcacaccggt

SEQ ID NO: 162074 - DNA, 35 bp, Artificial Sequence
  Synthetic oligonucleotide
gttacccacatcctaccgtccccttctttggcggt

SEQ ID NO: 162075 - DNA, 35 bp, Artificial Sequence
  Synthetic oligonucleotide
agcggtggacggggtgatgaggggcttttggtggt

SEQ ID NO: 162076 - DNA, 35 bp, Artificial Sequence
  Synthetic oligonucleotide
aaccgcacggtcgccgattagcttgcctccactgt

SEQ ID NO: 162077 - DNA, 35 bp, Artificial Sequence
  Synthetic oligonucleotide
aagacgcgccctcgcctagtgcctctacaagcctt

SEQ ID NO: 162078 - DNA, 35 bp, Artificial Sequence
  Synthetic oligonucleotide
gcgtgtgccgcatgttccgtcttacgttccctttt

SEQ ID NO: 162079 - DNA, 35 bp, Artificial Sequence
  Synthetic oligonucleotide
gttaccccctcccatgccaagcgcccccagttttt

SEQ ID NO: 162080 - DNA, 35 bp, Artificial Sequence
  Synthetic oligonucleotide
gtgtaggggttgtcggtagggaggggactgggaaa

SEQ ID NO: 162081 - DNA, 35 bp, Artificial Sequence
  Synthetic oligonucleotide
tcagcctccctccgccctgtcgttcgcctcgtaaa

SEQ ID NO: 162082 - DNA, 35 bp, Artificial Sequence
  Synthetic oligonucleotide
tccatgtcacagcccgctactttccccactgtaaa

SEQ ID NO: 162083 - DNA, 36 bp, Artificial Sequence
  Synthetic oligonucleotide
gtgtgatcaccacccccccgccaggtacctgccgaa

SEQ ID NO: 162084 - DNA, 35 bp, Artificial Sequence
  Synthetic oligonucleotide
gtggttggtcctgttctcctgtctgcctcctcgaa

SEQ ID NO: 162085 - DNA, 35 bp, Artificial Sequence
  Synthetic oligonucleotide
tccacaccgcccatattcttactgccccgtcataa

SEQ ID NO: 162086 - DNA, 35 bp, Artificial Sequence
  Synthetic oligonucleotide
ttgaccaccatcagttttactatctattgccaaca

SEQ ID NO: 162087 - DNA, 35 bp, Artificial Sequence
  Synthetic oligonucleotide
attgcccgtttccagcgttctactccgtgcccaca

SEQ ID NO: 162088 - DNA, 35 bp, Artificial Sequence
  Synthetic oligonucleotide
tctgccatatcgtaacctgttcgctcgctcctaca

SEQ ID NO: 162089 - DNA, 35 bp, Artificial Sequence
  Synthetic oligonucleotide
gacacagttccgcagcctcattcgcttctatacca

SEQ ID NO: 162090 - DNA, 34 bp, Artificial Sequence
  Synthetic oligonucleotide
gtcccctcatgtctttatacacaacctttaccca

SEQ ID NO: 162091 - DNA, 36 bp, Artificial Sequence
  Synthetic oligonucleotide
gtgcaacacctgtcttacacgtcctcccgctacgca

SEQ ID NO: 162092 - DNA, 36 bp, Artificial Sequence
  Synthetic oligonucleotide
gcacgccactatttcttgtgctccccctgctccgca

SEQ ID NO: 162093 - DNA, 36 bp, Artificial Sequence
  Synthetic oligonucleotide
gattaccagcggctctggttcccgcccccactatca

SEQ ID NO: 162094 - DNA, 36 bp, Artificial Sequence
  Synthetic oligonucleotide
gccacacccagtcctgtgtactatccacctggctca

SEQ ID NO: 162095 - DNA, 35 bp, Artificial Sequence
  Synthetic oligonucleotide
atgtactcgcacaccgcctgccaccctgaaattca

SEQ ID NO: 162096 - DNA, 36 bp, Artificial Sequence
  Synthetic oligonucleotide
tgcagaatgcatccatcgttatcgcacccactttca

SEQ ID NO: 162097 - DNA, 36 bp, Artificial Sequence
  Synthetic oligonucleotide
agtgccaccgcccgacctcctaatgccaacgtttca

SEQ ID NO: 162098 - DNA, 37 bp, Artificial Sequence
  Synthetic oligonucleotide
tccgaactctcctctgctgttgtaatcccacctaaga

SEQ ID NO: 162099 - DNA, 36 bp, Artificial Sequence
  Synthetic oligonucleotide
taggaacggtaggtaggggaggggcaatcaaacaga

SEQ ID NO: 162100 - DNA, 36 bp, Artificial Sequence
  Synthetic oligonucleotide
gttagctcccccacctgtcccgcttgtcctgttaga

SEQ ID NO: 162101 - DNA, 37 bp, Artificial Sequence
  Synthetic oligonucleotide
tacgtagcccacatcctccgcacttcagaactgccga

SEQ ID NO: 162102 - DNA, 36 bp, Artificial Sequence
  Synthetic oligonucleotide
gcctcccccgcagactttcctagccttgtccctcga

SEQ ID NO: 162103 - DNA, 37 bp, Artificial Sequence
  Synthetic oligonucleotide
gggaaaggggtgaagttaaaggggggctaagagggga

SEQ ID NO: 162104 - DNA, 37 bp, Artificial Sequence
  Synthetic oligonucleotide
aatgacccacctcagctgataactcgcttcccatgga

SEQ ID NO: 162105 - DNA, 35 bp, Artificial Sequence
  Synthetic oligonucleotide
atcgcccccccgcccctttttgttattgccatgga

SEQ ID NO: 162106 - DNA, 37 bp, Artificial Sequence
  Synthetic oligonucleotide
gttggggaggggaaggggatagagtaagaccggtgga

SEQ ID NO: 162107 - DNA, 38 bp, Artificial Sequence
  Synthetic oligonucleotide
gctggtccccgatcacgctgttcctcccatcccaatga

SEQ ID NO: 162108 - DNA, 37 bp, Artificial Sequence
  Synthetic oligonucleotide
agtggggacgagagggagatagggaggtcggttatga

SEQ ID NO: 162109 - DNA, 36 bp, Artificial Sequence
  Synthetic oligonucleotide
gtcgtcgttcgctgttccttcttgctcgcgccctga

SEQ ID NO: 162110 - DNA, 38 bp, Artificial Sequence
  Synthetic oligonucleotide
tcgccatgccatttgtctcaagttttctctcctcctga

SEQ ID NO: 162111 - DNA, 38 bp, Artificial Sequence
  Synthetic oligonucleotide
gcgtcccgttctgttcctgccgtcgcctcgtttcctga

SEQ ID NO: 162112 - DNA, 38 bp, Artificial Sequence
  Synthetic oligonucleotide
gtacgcaggtgcacgggggtgggcgtggggtgggctga

SEQ ID NO: 162113 - DNA, 37 bp, Artificial Sequence
  Synthetic oligonucleotide
tgatgagtcgcattgaaaccgcccctccctcacgtga

SEQ ID NO: 162114 - DNA, 37 bp, Artificial Sequence
  Synthetic oligonucleotide
agtgaagggttgatgggggaaggctgggagcgggtga

SEQ ID NO: 162115 - DNA, 37 bp, Artificial Sequence
  Synthetic oligonucleotide
tatcacatgccctctcatctgtcttgacgcctgttga

SEQ ID NO: 162116 - DNA, 36 bp, Artificial Sequence
  Synthetic oligonucleotide
gaccacttgcctgctgcccgcattcttcaacgaata

SEQ ID NO: 162117 - DNA, 35 bp, Artificial Sequence
  Synthetic oligonucleotide
gatcacagtcccccgcccatcccgtgcactggcta

SEQ ID NO: 162118 - DNA, 35 bp, Artificial Sequence
  Synthetic oligonucleotide
ttacccccgctcacgattatactctcgcccctcta

SEQ ID NO: 162119 - DNA, 35 bp, Artificial Sequence
  Synthetic oligonucleotide
agatacctactcgtgcataacgtccatctcctcta

SEQ ID NO: 162120 - DNA, 35 bp, Artificial Sequence
  Synthetic oligonucleotide
gccggtgctctccctttgtctgtcctataccgaac

SEQ ID NO: 162121 - DNA, 35 bp, Artificial Sequence
  Synthetic oligonucleotide
aaccgccaacacggacctccccaactgggccccac

SEQ ID NO: 162122 - DNA, 35 bp, Artificial Sequence
  Synthetic oligonucleotide
atgacatacgtaacgcgctttctgcccctccctac

SEQ ID NO: 162123 - DNA, 35 bp, Artificial Sequence
  Synthetic oligonucleotide
gcctctcaccaggcccaggtacggaccccgccacc

SEQ ID NO: 162124 - DNA, 35 bp, Artificial Sequence
  Synthetic oligonucleotide
ttcatacccctctctgctctcaccttgggtggacc

SEQ ID NO: 162125 - DNA, 35 bp, Artificial Sequence
  Synthetic oligonucleotide
tacgccggtatgctgttcttcttcgcacctctacc

SEQ ID NO: 162126 - DNA, 35 bp, Artificial Sequence
  Synthetic oligonucleotide
tgcgacgcagccgttccctcgtcgttcacattacc

SEQ ID NO: 162127 - DNA, 35 bp, Artificial Sequence
  Synthetic oligonucleotide
gaacctggtcgaatgtgacttgcgccccctccccc

SEQ ID NO: 162128 - DNA, 35 bp, Artificial Sequence
  Synthetic oligonucleotide
aagccgcctcccggtacgctgcttgatccctgccc

SEQ ID NO: 162129 - DNA, 35 bp, Artificial Sequence
  Synthetic oligonucleotide
acacccggcctccgatccgcaaattagctcctccc

SEQ ID NO: 162130 - DNA, 35 bp, Artificial Sequence
  Synthetic oligonucleotide
atgcagaccatggtcgtcaaacctccgccgtagcc

SEQ ID NO: 162131 - DNA, 35 bp, Artificial Sequence
  Synthetic oligonucleotide
cccgacccagctctctgtaagcgcccccgttatcc

SEQ ID NO: 162132 - DNA, 34 bp, Artificial Sequence
  Synthetic oligonucleotide
gacatgacatgagcaacgttggagcccctcttcc

SEQ ID NO: 162133 - DNA, 35 bp, Artificial Sequence
  Synthetic oligonucleotide
tgccactgccacgcacccttgatctgcagggttcc

SEQ ID NO: 162134 - DNA, 33 bp, Artificial Sequence
  Synthetic oligonucleotide
ttggtcccaccctcctggattgtaattgcccgc

SEQ ID NO: 162135 - DNA, 36 bp, Artificial Sequence
  Synthetic oligonucleotide
ccccaccacgtcaccctccatcgtcgtcaggtccgc

SEQ ID NO: 162136 - DNA, 35 bp, Artificial Sequence
  Synthetic oligonucleotide
gtacaccccatgcattgttgtttaggccctctcgc

SEQ ID NO: 162137 - DNA, 35 bp, Artificial Sequence
  Synthetic oligonucleotide
tgcacactgctctatctcttggcaccatgactggc

SEQ ID NO: 162138 - DNA, 35 bp, Artificial Sequence
  Synthetic oligonucleotide
aaggggggtgggtaggggaaagaaccagtggtggc

SEQ ID NO: 162139 - DNA, 35 bp, Artificial Sequence
  Synthetic oligonucleotide
tctggcgctgctcctacgtccacattaaccgctgc

SEQ ID NO: 162140 - DNA, 35 bp, Artificial Sequence
  Synthetic oligonucleotide
acctggtacgatgcctattttttcccgacccttgc

SEQ ID NO: 162141 - DNA, 35 bp, Artificial Sequence
  Synthetic oligonucleotide
tgcgggcgacgcggcctccaacccgaacacacctc

SEQ ID NO: 162142 - DNA, 35 bp, Artificial Sequence
  Synthetic oligonucleotide
tgccaccgtgtggtgttcctgccctatgttacctc

SEQ ID NO: 162143 - DNA, 35 bp, Artificial Sequence
  Synthetic oligonucleotide
gcgaagctccgtaccccgttactcctttgcgcctc

SEQ ID NO: 162144 - DNA, 35 bp, Artificial Sequence
  Synthetic oligonucleotide
tgaagtcggcctacgttctgctttacggtctcctc

SEQ ID NO: 162145 - DNA, 35 bp, Artificial Sequence
  Synthetic oligonucleotide
ttccccgtccagcgcatgatttcgcgccccccgtc

SEQ ID NO: 162146 - DNA, 35 bp, Artificial Sequence
  Synthetic oligonucleotide
ttcgacacccttccttgttccaggggcaacacttc

SEQ ID NO: 162147 - DNA, 35 bp, Artificial Sequence
  Synthetic oligonucleotide
gaacgggcgtacgggggggtaagtaaagggctttc

SEQ ID NO: 162148 - DNA, 35 bp, Artificial Sequence
  Synthetic oligonucleotide
gcttgcgaaccatgcccccctgttcaccgttgacg

SEQ ID NO: 162149 - DNA, 35 bp, Artificial Sequence
  Synthetic oligonucleotide
accgccctccctttaacccagtgacgcctttgacg

SEQ ID NO: 162150 - DNA, 35 bp, Artificial Sequence
  Synthetic oligonucleotide
tgcccccattcacccgatttgcaactgttcttgcg

SEQ ID NO: 162151 - DNA, 35 bp, Artificial Sequence
  Synthetic oligonucleotide
gtgaccctcccgccttctttggcaattgcccatcg

SEQ ID NO: 162152 - DNA, 35 bp, Artificial Sequence
  Synthetic oligonucleotide
acgcactgggcggggcaaggggggagagatgtagg

SEQ ID NO: 162153 - DNA, 35 bp, Artificial Sequence
  Synthetic oligonucleotide
gatagggatgggagggaagttacaaagggaaaatg

SEQ ID NO: 162154 - DNA, 35 bp, Artificial Sequence
  Synthetic oligonucleotide
tttgtgccaccgtgctttcttctatcatcgctatg

SEQ ID NO: 162155 - DNA, 35 bp, Artificial Sequence
  Synthetic oligonucleotide
tcgcggtccacgctgactatctccccacattcctg

SEQ ID NO: 162156 - DNA, 35 bp, Artificial Sequence
  Synthetic oligonucleotide
tatcccgcccccgctggttaataccacccgttgtg

SEQ ID NO: 162157 - DNA, 36 bp, Artificial Sequence
  Synthetic oligonucleotide
cttatctcctgtcccctctctattgtgacacccttg

SEQ ID NO: 162158 - DNA, 35 bp, Artificial Sequence
  Synthetic oligonucleotide
acgtcaagcatccttaccgccccccgccctctttg

SEQ ID NO: 162159 - DNA, 35 bp, Artificial Sequence
  Synthetic oligonucleotide
atcgtgcacctcattcccctccgcccaacgcacat

SEQ ID NO: 162160 - DNA, 35 bp, Artificial Sequence
  Synthetic oligonucleotide
gccttgtcccgcccctcggcactttaatgttccat

SEQ ID NO: 162161 - DNA, 35 bp, Artificial Sequence
  Synthetic oligonucleotide
gatgtcagctcactcctaattgcctgtgcccacct

SEQ ID NO: 162162 - DNA, 35 bp, Artificial Sequence
  Synthetic oligonucleotide
aggggggctgggcaaggagggcggggagtgacgct

SEQ ID NO: 162163 - DNA, 35 bp, Artificial Sequence
  Synthetic oligonucleotide
aaggcgaacgcccgccccctgccgccctctgctct

SEQ ID NO: 162164 - DNA, 35 bp, Artificial Sequence
  Synthetic oligonucleotide
gagcacgcagacctcggcccgacgtatacctctct

SEQ ID NO: 162165 - DNA, 35 bp, Artificial Sequence
  Synthetic oligonucleotide
gtgcccgacgacccgcccgttatagctcgctgtct

SEQ ID NO: 162166 - DNA, 35 bp, Artificial Sequence
  Synthetic oligonucleotide
tagacacctccgatagccttctctgtaatcgttct

SEQ ID NO: 162167 - DNA, 35 bp, Artificial Sequence
  Synthetic oligonucleotide
gtcccagttcccccgctctagacgacgttgctagt

SEQ ID NO: 162168 - DNA, 35 bp, Artificial Sequence
  Synthetic oligonucleotide
gtagcctcggcctcctgttcgtagttgtctcccgt

SEQ ID NO: 162169 - DNA, 35 bp, Artificial Sequence
  Synthetic oligonucleotide
tccaccttccgctctctttgttttgtgatcctcgt

SEQ ID NO: 162170 - DNA, 35 bp, Artificial Sequence
  Synthetic oligonucleotide
ggtacaccctccgccgttttgcttatcgagctcgt

SEQ ID NO: 162171 - DNA, 35 bp, Artificial Sequence
  Synthetic oligonucleotide
tgcaacacctcccgctgctactagctcttttaggt

SEQ ID NO: 162172 - DNA, 35 bp, Artificial Sequence
  Synthetic oligonucleotide
acgatagaggaagcggagggggcattcggggcggt

SEQ ID NO: 162173 - DNA, 35 bp, Artificial Sequence
  Synthetic oligonucleotide
tagccatggtcgcactgttttcgcaatttgccctt

SEQ ID NO: 162174 - DNA, 35 bp, Artificial Sequence
  Synthetic oligonucleotide
aaccagataagcgggagagtgggttcgggcgggtt

SEQ ID NO: 162175 - DNA, 36 bp, Artificial Sequence
  Synthetic oligonucleotide
atggtgggggaaggaaatggctcgagggagagtcaa

SEQ ID NO: 162176 - DNA, 35 bp, Artificial Sequence
  Synthetic oligonucleotide
gtggaagaagggaggaagggggatagggaatagaa

SEQ ID NO: 162177 - DNA, 35 bp, Artificial Sequence
  Synthetic oligonucleotide
actacatccccagggcttactcttgtgacttttaa

SEQ ID NO: 162178 - DNA, 36 bp, Artificial Sequence
  Synthetic oligonucleotide
ttgacgtcacccgtcccctgacatctgctcctcaca

SEQ ID NO: 162179 - DNA, 36 bp, Artificial Sequence
  Synthetic oligonucleotide
ttgctaactccaatgtctttcgtactgttacctcca

SEQ ID NO: 162180 - DNA, 36 bp, Artificial Sequence
  Synthetic oligonucleotide
tttcgtgcctttgtccattctatacgtttcgctcca

SEQ ID NO: 162181 - DNA, 36 bp, Artificial Sequence
  Synthetic oligonucleotide
gtgcccttcgttcgttagataacgctgtcctctcca

SEQ ID NO: 162182 - DNA, 36 bp, Artificial Sequence
  Synthetic oligonucleotide
gctaggtgggcagggtgggagggctcaagggaggca

SEQ ID NO: 162183 - DNA, 36 bp, Artificial Sequence
  Synthetic oligonucleotide
tccctcctgctgacatcctttcgaaacggccattca

SEQ ID NO: 162184 - DNA, 36 bp, Artificial Sequence
  Synthetic oligonucleotide
ttcctccacctgctgattcgacatgttcttccttca

SEQ ID NO: 162185 - DNA, 35 bp, Artificial Sequence
  Synthetic oligonucleotide
acgccaagctcgctaaccatgttctcaccgcttca

SEQ ID NO: 162186 - DNA, 36 bp, Artificial Sequence
  Synthetic oligonucleotide
tgtgggagttggaggagaggcgggaggcatggtaga

SEQ ID NO: 162187 - DNA, 38 bp, Artificial Sequence
  Synthetic oligonucleotide
agcgagggcgaaggcgggacggtagcaggttagaacga

SEQ ID NO: 162188 - DNA, 35 bp, Artificial Sequence
  Synthetic oligonucleotide
ggaaggagccgagaaaatagggtgggggcgagcga

SEQ ID NO: 162189 - DNA, 37 bp, Artificial Sequence
  Synthetic oligonucleotide
gccatgctatctttgcacgttctatccagttcttcga

SEQ ID NO: 162190 - DNA, 36 bp, Artificial Sequence
  Synthetic oligonucleotide
gtgaccgccgttccgtagtctatcttcttcccagga

SEQ ID NO: 162191 - DNA, 35 bp, Artificial Sequence
  Synthetic oligonucleotide
atcacacccgcgcccagccgtcatcatctgcagga

SEQ ID NO: 162192 - DNA, 35 bp, Artificial Sequence
  Synthetic oligonucleotide
tcctagcaacggtgggaaacggagcgggcggggga

SEQ ID NO: 162193 - DNA, 37 bp, Artificial Sequence
  Synthetic oligonucleotide
atgggtgacgggcgggtatagggctgatagagtggga

SEQ ID NO: 162194 - DNA, 37 bp, Artificial Sequence
  Synthetic oligonucleotide
tgcaatgtgcctcgccaccccactccttcgaactgga

SEQ ID NO: 162195 - DNA, 38 bp, Artificial Sequence
  Synthetic oligonucleotide
gaacctccccgccatcatgttgaaattgcccccactga

SEQ ID NO: 162196 - DNA, 38 bp, Artificial Sequence
  Synthetic oligonucleotide
tccctcatcacatgtctttccccactcggacaacctga

SEQ ID NO: 162197 - DNA, 37 bp, Artificial Sequence
  Synthetic oligonucleotide
taggcgcacactccgaccactgccctcctagccctga

SEQ ID NO: 162198 - DNA, 38 bp, Artificial Sequence
  Synthetic oligonucleotide
taacccactcgctatgtctcttcgccgttcataattga

SEQ ID NO: 162199 - DNA, 37 bp, Artificial Sequence
  Synthetic oligonucleotide
accccgccgcacattttgaaagcgcttctacacttga

SEQ ID NO: 162200 - DNA, 37 bp, Artificial Sequence
  Synthetic oligonucleotide
tctcaccctactggggtcctatgccctcacaccttga

SEQ ID NO: 162201 - DNA, 37 bp, Artificial Sequence
  Synthetic oligonucleotide
tgcaccttcgcatgccagtatctctctaccaccttga

SEQ ID NO: 162202 - DNA, 38 bp, Artificial Sequence
  Synthetic oligonucleotide
atgaccgcagattcgaccctcttccaccgtacccttga

SEQ ID NO: 162203 - DNA, 36 bp, Artificial Sequence
  Synthetic oligonucleotide
tgtccccttcttcatgctagaagcccttcctcttga

SEQ ID NO: 162204 - DNA, 38 bp, Artificial Sequence
  Synthetic oligonucleotide
gcaacccgcacttccgctatgcctccgacgccctttga

SEQ ID NO: 162205 - DNA, 35 bp, Artificial Sequence
  Synthetic oligonucleotide
tactgcccgcccctctattctcctccgttcgtata

SEQ ID NO: 162206 - DNA, 36 bp, Artificial Sequence
  Synthetic oligonucleotide
agcaccgcccgccccccgctgcggctaaatagccta

SEQ ID NO: 162207 - DNA, 36 bp, Artificial Sequence
  Synthetic oligonucleotide
gctgacacccctccgtgcgcaacgagaaccgccgta

SEQ ID NO: 162208 - DNA, 35 bp, Artificial Sequence
  Synthetic oligonucleotide
tccgatcctagccccatttgcccgttgtagggtta

SEQ ID NO: 162209 - DNA, 35 bp, Artificial Sequence
  Synthetic oligonucleotide
tgtaacccaccgctctcttcgtccggcacttgtta

SEQ ID NO: 162210 - DNA, 35 bp, Artificial Sequence
  Synthetic oligonucleotide
gctgaccggccatatcgttaccatcggctcccaac

SEQ ID NO: 162211 - DNA, 35 bp, Artificial Sequence
  Synthetic oligonucleotide
ttcagcatagaacctgtctctccgtctccgcacac

SEQ ID NO: 162212 - DNA, 35 bp, Artificial Sequence
  Synthetic oligonucleotide
ttggggggcgggagggtagcacgagttggggccac

SEQ ID NO: 162213 - DNA, 35 bp, Artificial Sequence
  Synthetic oligonucleotide
ttacccatcgcccgtccagcttaagcaatccatac

SEQ ID NO: 162214 - DNA, 35 bp, Artificial Sequence
  Synthetic oligonucleotide
ttccaccccgttgcctgtatcacgctcccaccacc

SEQ ID NO: 162215 - DNA, 35 bp, Artificial Sequence
  Synthetic oligonucleotide
atgcatacttgcttggtctcctgcctcctgctacc

SEQ ID NO: 162216 - DNA, 35 bp, Artificial Sequence
  Synthetic oligonucleotide
gatcaatgacgcatgtcgccccatataaccgcccc

SEQ ID NO: 162217 - DNA, 35 bp, Artificial Sequence
  Synthetic oligonucleotide
gcctgatagattgatacgttcctcgcccgctcccc

SEQ ID NO: 162218 - DNA, 35 bp, Artificial Sequence
  Synthetic oligonucleotide
aacgtaccgaccgttctacacctacctggacgccc

SEQ ID NO: 162219 - DNA, 35 bp, Artificial Sequence
  Synthetic oligonucleotide
aaccgcccaacgcacatgcctgattcttcgctccc

SEQ ID NO: 162220 - DNA, 35 bp, Artificial Sequence
  Synthetic oligonucleotide
ttggcctcccttatgcggtcctacttttcattgcc

SEQ ID NO: 162221 - DNA, 35 bp, Artificial Sequence
  Synthetic oligonucleotide
aatccatcgcctcaatctggtacccaggcccctcc

SEQ ID NO: 162222 - DNA, 35 bp, Artificial Sequence
  Synthetic oligonucleotide
tctggagtcgccccggtggtcgcgcaacttattcc

SEQ ID NO: 162223 - DNA, 35 bp, Artificial Sequence
  Synthetic oligonucleotide
aggtcaaacgcaacggttttctcctccgaacttcc

SEQ ID NO: 162224 - DNA, 35 bp, Artificial Sequence
  Synthetic oligonucleotide
ttcccgatctcctgtgcttacggcatcctatccgc

SEQ ID NO: 162225 - DNA, 35 bp, Artificial Sequence
  Synthetic oligonucleotide
tcgcatacctcctgatgcctactcttttcacgcgc

SEQ ID NO: 162226 - DNA, 32 bp, Artificial Sequence
  Synthetic oligonucleotide
ttccccctcatccttcatgttgctctggttgc

SEQ ID NO: 162227 - DNA, 35 bp, Artificial Sequence
  Synthetic oligonucleotide
gtatggtggggccactgttacaccccctgtatctc

SEQ ID NO: 162228 - DNA, 35 bp, Artificial Sequence
  Synthetic oligonucleotide
tacgtatccccgcgccatcgcacgtttccgttgtc

SEQ ID NO: 162229 - DNA, 35 bp, Artificial Sequence
  Synthetic oligonucleotide
tcccgcaccactcagcacagaatacactgcacttc

SEQ ID NO: 162230 - DNA, 35 bp, Artificial Sequence
  Synthetic oligonucleotide
tcagcacacctattgtttcctccatcaaaccgttc

SEQ ID NO: 162231 - DNA, 35 bp, Artificial Sequence
  Synthetic oligonucleotide
ttctgtggcccgcctttattgtactgctgccgttc

SEQ ID NO: 162232 - DNA, 35 bp, Artificial Sequence
  Synthetic oligonucleotide
taggcaatcctcacagtctcccgccaacccgcacg

SEQ ID NO: 162233 - DNA, 35 bp, Artificial Sequence
  Synthetic oligonucleotide
agctcgacctggttttcacgtccccctctccgacg

SEQ ID NO: 162234 - DNA, 36 bp, Artificial Sequence
  Synthetic oligonucleotide
tccgatggacggctcgatctaccccccgcctctacg

SEQ ID NO: 162235 - DNA, 35 bp, Artificial Sequence
  Synthetic oligonucleotide
atcatccctggcgcctaagcgaatctccctgcccg

SEQ ID NO: 162236 - DNA, 35 bp, Artificial Sequence
  Synthetic oligonucleotide
gatttcgcgtcctctttttgttatcctaccctccg

SEQ ID NO: 162237 - DNA, 35 bp, Artificial Sequence
  Synthetic oligonucleotide
gcgctcgcccggcttcgtaattctgtccctagtcg

SEQ ID NO: 162238 - DNA, 35 bp, Artificial Sequence
  Synthetic oligonucleotide
gtagggggggactgctatgggagcgggctttacgg

SEQ ID NO: 162239 - DNA, 35 bp, Artificial Sequence
  Synthetic oligonucleotide
gatggcggggaaacggagaggtggtgggtctaggg

SEQ ID NO: 162240 - DNA, 35 bp, Artificial Sequence
  Synthetic oligonucleotide
tccgtttccacatctggcttatatacccgctttgg

SEQ ID NO: 162241 - DNA, 35 bp, Artificial Sequence
  Synthetic oligonucleotide
ttcatagcaaccctcctgaagtctctacgtgccat

SEQ ID NO: 162242 - DNA, 33 bp, Artificial Sequence
  Synthetic oligonucleotide
tcccgggccctaccccgctccattgtccatcat

SEQ ID NO: 162243 - DNA, 35 bp, Artificial Sequence
  Synthetic oligonucleotide
tctcgtaccccgcccccatgatctgctactgccct

SEQ ID NO: 162244 - DNA, 35 bp, Artificial Sequence
  Synthetic oligonucleotide
gtccactggactggcgcacaactgcacctatccct

SEQ ID NO: 162245 - DNA, 35 bp, Artificial Sequence
  Synthetic oligonucleotide
gttcgtgtccagtgttctacttggcactcctccct

SEQ ID NO: 162246 - DNA, 35 bp, Artificial Sequence
  Synthetic oligonucleotide
accccgcgtgatacagaattcccctgcccgttcct

SEQ ID NO: 162247 - DNA, 35 bp, Artificial Sequence
  Synthetic oligonucleotide
acatgacccgttctgcaaatcgccccgtgacatct

SEQ ID NO: 162248 - DNA, 35 bp, Artificial Sequence
  Synthetic oligonucleotide
acgtgtcccacccgaacagttatgcccatacctct

SEQ ID NO: 162249 - DNA, 35 bp, Artificial Sequence
  Synthetic oligonucleotide
agatgcctcctaggcgttatacctgcacctgttct

SEQ ID NO: 162250 - DNA, 35 bp, Artificial Sequence
  Synthetic oligonucleotide
tctgcctctctcattgcctcccgtgactacgtagt

SEQ ID NO: 162251 - DNA, 32 bp, Artificial Sequence
  Synthetic oligonucleotide
tccacgcatcgtgctcgcccctgtctacccgt

SEQ ID NO: 162252 - DNA, 35 bp, Artificial Sequence
  Synthetic oligonucleotide
tccgcatcagtggtcctcggtactcatcccctcgt

SEQ ID NO: 162253 - DNA, 35 bp, Artificial Sequence
  Synthetic oligonucleotide
gttcccctcacatgtccctgctgtacgtgcccggt

SEQ ID NO: 162254 - DNA, 35 bp, Artificial Sequence
  Synthetic oligonucleotide
tgaaccccaatacacgcatgacgcacttaccctgt

SEQ ID NO: 162255 - DNA, 35 bp, Artificial Sequence
  Synthetic oligonucleotide
ggagcgcccgcataagcatactccccgctcccctt

SEQ ID NO: 162256 - DNA, 35 bp, Artificial Sequence
  Synthetic oligonucleotide
tccatgaatccccctgccgtgtggtcacctccctt

SEQ ID NO: 162257 - DNA, 35 bp, Artificial Sequence
  Synthetic oligonucleotide
acccaacttgagtttgtctacgcctgtactctctt

SEQ ID NO: 162258 - DNA, 35 bp, Artificial Sequence
  Synthetic oligonucleotide
ttgaccttcccactacgatcgttatgtgcctcgtt

SEQ ID NO: 162259 - DNA, 35 bp, Artificial Sequence
  Synthetic oligonucleotide
gttccatcccacctgccttcttgattggttctgtt

SEQ ID NO: 162260 - DNA, 35 bp, Artificial Sequence
  Synthetic oligonucleotide
gtgcgtggtcatcgcctattagctccctcttgaaa

SEQ ID NO: 162261 - DNA, 36 bp, Artificial Sequence
  Synthetic oligonucleotide
gaggccactgctccgatctgtcactcctggcccaca

SEQ ID NO: 162262 - DNA, 35 bp, Artificial Sequence
  Synthetic oligonucleotide
accatcaagcctgtgctaactttccctcctcgcca

SEQ ID NO: 162263 - DNA, 36 bp, Artificial Sequence
  Synthetic oligonucleotide
tccgtcacaacgagtccatttcctcccgcctgcgca

SEQ ID NO: 162264 - DNA, 35 bp, Artificial Sequence
  Synthetic oligonucleotide
gtgtgccgatatggcccgacttccttccctgtgca

SEQ ID NO: 162265 - DNA, 36 bp, Artificial Sequence
  Synthetic oligonucleotide
gtgccgcctgacctgggccttctaatttccgtctca

SEQ ID NO: 162266 - DNA, 36 bp, Artificial Sequence
  Synthetic oligonucleotide
tacgacacgctcccagtgaacattgccatcccttca

SEQ ID NO: 162267 - DNA, 35 bp, Artificial Sequence
  Synthetic oligonucleotide
ttacccgcctagggtagctcagcctctccacccga

SEQ ID NO: 162268 - DNA, 37 bp, Artificial Sequence
  Synthetic oligonucleotide
tacgcaggtcccatgccatactatcacccttgtccga

SEQ ID NO: 162269 - DNA, 35 bp, Artificial Sequence
  Synthetic oligonucleotide
acataccacgcccatgtagctctccgggccttcga

SEQ ID NO: 162270 - DNA, 37 bp, Artificial Sequence
  Synthetic oligonucleotide
gtggtggggaaaggggaggggtgacaatcaaatagga

SEQ ID NO: 162271 - DNA, 37 bp, Artificial Sequence
  Synthetic oligonucleotide
gccgtctgacccgcgaatccaccttgcctcccccgga

SEQ ID NO: 162272 - DNA, 37 bp, Artificial Sequence
  Synthetic oligonucleotide
aggatgcaggaggtcagggggaggatgcggcatcgga

SEQ ID NO: 162273 - DNA, 37 bp, Artificial Sequence
  Synthetic oligonucleotide
ggtgtgtgggggtttttccaggggcgggccaagggga

SEQ ID NO: 162274 - DNA, 37 bp, Artificial Sequence
  Synthetic oligonucleotide
gaagtgagagggaagtggtctagggtggggccgggga

SEQ ID NO: 162275 - DNA, 37 bp, Artificial Sequence
  Synthetic oligonucleotide
tgaccaggtatccgggtgaagagttgggaggggggga

SEQ ID NO: 162276 - DNA, 37 bp, Artificial Sequence
  Synthetic oligonucleotide
ccaccatccgttacccgaccccacaatccgtctggga

SEQ ID NO: 162277 - DNA, 36 bp, Artificial Sequence
  Synthetic oligonucleotide
tccagtggtgggggcggaacggaaggggaatatgga

SEQ ID NO: 162278 - DNA, 37 bp, Artificial Sequence
  Synthetic oligonucleotide
tccccaccccttcaacgtgccgtagtgtcttcctgga

SEQ ID NO: 162279 - DNA, 37 bp, Artificial Sequence
  Synthetic oligonucleotide
gtgaagggctagggtgggttggggcaaagttgtatga

SEQ ID NO: 162280 - DNA, 37 bp, Artificial Sequence
  Synthetic oligonucleotide
tccctcccgcacagtaaagcacctcgccctgttatga

SEQ ID NO: 162281 - DNA, 38 bp, Artificial Sequence
  Synthetic oligonucleotide
tattccgcctcctgatctgcttttccgttacttactga

SEQ ID NO: 162282 - DNA, 38 bp, Artificial Sequence
  Synthetic oligonucleotide
gactgggccgaatatgggtgggggggtcagcagagtga

SEQ ID NO: 162283 - DNA, 36 bp, Artificial Sequence
  Synthetic oligonucleotide
atcgcgctgctttctttcctgccgcccatcttgtga

SEQ ID NO: 162284 - DNA, 38 bp, Artificial Sequence
  Synthetic oligonucleotide
gtgaggaagacgtgggggcggaaatagggcatgcttga

SEQ ID NO: 162285 - DNA, 36 bp, Artificial Sequence
  Synthetic oligonucleotide
tcccgaccgcaccacgatcccccctcgccctgacta

SEQ ID NO: 162286 - DNA, 36 bp, Artificial Sequence
  Synthetic oligonucleotide
gtgccgctgccttcatattgacgctgtccctaccta

SEQ ID NO: 162287 - DNA, 36 bp, Artificial Sequence
  Synthetic oligonucleotide
accacaccgctacacattggcccgcatcctgcccta

SEQ ID NO: 162288 - DNA, 36 bp, Artificial Sequence
  Synthetic oligonucleotide
tggattaaccgtcacacccttgtcccccccccgcta

SEQ ID NO: 162289 - DNA, 36 bp, Artificial Sequence
  Synthetic oligonucleotide
atctacgcgaccttggtcatggttctgcctccctta

SEQ ID NO: 162290 - DNA, 35 bp, Artificial Sequence
  Synthetic oligonucleotide
gtaacgcgacaccggcacttatctccccgctttta

SEQ ID NO: 162291 - DNA, 35 bp, Artificial Sequence
  Synthetic oligonucleotide
actactacgccctcatattgctttcatagctcgac

SEQ ID NO: 162292 - DNA, 35 bp, Artificial Sequence
  Synthetic oligonucleotide
tgcacctcccatcctcatggacctcgccgatatac

SEQ ID NO: 162293 - DNA, 35 bp, Artificial Sequence
  Synthetic oligonucleotide
gtcgtaggggtccggtatgggcgggtggggcgtac

SEQ ID NO: 162294 - DNA, 35 bp, Artificial Sequence
  Synthetic oligonucleotide
tcattgccgctcactggttctaatttatctgcccc

SEQ ID NO: 162295 - DNA, 36 bp, Artificial Sequence
  Synthetic oligonucleotide
atgtcaggtcccttcacagtgcctttctcgctcccc

SEQ ID NO: 162296 - DNA, 35 bp, Artificial Sequence
  Synthetic oligonucleotide
gacacacccgcttctcatgtgaccgcttctgtccc

SEQ ID NO: 162297 - DNA, 35 bp, Artificial Sequence
  Synthetic oligonucleotide
agcgggtcaggcctgcagatcccacctcccccgcc

SEQ ID NO: 162298 - DNA, 35 bp, Artificial Sequence
  Synthetic oligonucleotide
accccaccgcccgactctacacagccatccaggcc

SEQ ID NO: 162299 - DNA, 35 bp, Artificial Sequence
  Synthetic oligonucleotide
ttgactccacttctctaggcctgttggtcccccgc

SEQ ID NO: 162300 - DNA, 35 bp, Artificial Sequence
  Synthetic oligonucleotide
ttgcacttccccgactccctgcatagtgctcactc

SEQ ID NO: 162301 - DNA, 35 bp, Artificial Sequence
  Synthetic oligonucleotide
gtacatccgttctctatactggacccgtgtccctc

SEQ ID NO: 162302 - DNA, 34 bp, Artificial Sequence
  Synthetic oligonucleotide
gacaatgcgctgtccgaatccgtccccggtcctc

SEQ ID NO: 162303 - DNA, 35 bp, Artificial Sequence
  Synthetic oligonucleotide
gtccacaccattcagcagcatacacagtcaccttc

SEQ ID NO: 162304 - DNA, 35 bp, Artificial Sequence
  Synthetic oligonucleotide
ttcatgccgcatagcaggtatgccgtactctcttc

SEQ ID NO: 162305 - DNA, 35 bp, Artificial Sequence
  Synthetic oligonucleotide
atcgagcctccccaccatgtccccacagtgtgttc

SEQ ID NO: 162306 - DNA, 35 bp, Artificial Sequence
  Synthetic oligonucleotide
tccctctctcgccgtatcctgtaatacacgtcccg

SEQ ID NO: 162307 - DNA, 35 bp, Artificial Sequence
  Synthetic oligonucleotide
tcaatcgccggttttgtatcgtctatcctccgccg

SEQ ID NO: 162308 - DNA, 35 bp, Artificial Sequence
  Synthetic oligonucleotide
actaacctcactatcatctcgcccccgtccacgcg

SEQ ID NO: 162309 - DNA, 35 bp, Artificial Sequence
  Synthetic oligonucleotide
acaccctctcgcccgtagaacccacgcaaatggcg

SEQ ID NO: 162310 - DNA, 35 bp, Artificial Sequence
  Synthetic oligonucleotide
atccgcactttcatgtcttcccccgctcttaaagg

SEQ ID NO: 162311 - DNA, 35 bp, Artificial Sequence
  Synthetic oligonucleotide
gacatggggcaaggggagtaaggtgagggaagggg

SEQ ID NO: 162312 - DNA, 35 bp, Artificial Sequence
  Synthetic oligonucleotide
tctggagccctccatcacccacgcccatacctatg

SEQ ID NO: 162313 - DNA, 35 bp, Artificial Sequence
  Synthetic oligonucleotide
gcctctccactgacgctagctgcttccttggccat

SEQ ID NO: 162314 - DNA, 35 bp, Artificial Sequence
  Synthetic oligonucleotide
tacgcgtactaggggggaggacgggtgggactgat

SEQ ID NO: 162315 - DNA, 35 bp, Artificial Sequence
  Synthetic oligonucleotide
atccaccccgctaatttatcgctccgattacatat

SEQ ID NO: 162316 - DNA, 35 bp, Artificial Sequence
  Synthetic oligonucleotide
atgcgccgaccctccgtcgactcccttgggcctat

SEQ ID NO: 162317 - DNA, 35 bp, Artificial Sequence
  Synthetic oligonucleotide
ttgagcgaactcggtcgcattatccatctttgcct

SEQ ID NO: 162318 - DNA, 35 bp, Artificial Sequence
  Synthetic oligonucleotide
gcaacccatactatgccctactcgtcctagcccgt

SEQ ID NO: 162319 - DNA, 35 bp, Artificial Sequence
  Synthetic oligonucleotide
gcccagtttccgccgcccccaacctgtatcgtggt

SEQ ID NO: 162320 - DNA, 35 bp, Artificial Sequence
  Synthetic oligonucleotide
agcccacagaccccatttgatcgctcttcgccctt

SEQ ID NO: 162321 - DNA, 35 bp, Artificial Sequence
  Synthetic oligonucleotide
gtccctgtatccgaccgtggatttctctctgcctt

SEQ ID NO: 162322 - DNA, 35 bp, Artificial Sequence
  Synthetic oligonucleotide
gtacaggggccgggatagggaacggcgaaaaggtt

SEQ ID NO: 162323 - DNA, 35 bp, Artificial Sequence
  Synthetic oligonucleotide
atggtctcgctgatccttgtctcggtcccttgttt

SEQ ID NO: 162324 - DNA, 35 bp, Artificial Sequence
  Synthetic oligonucleotide
gatcccagaccctgcttgcgacccctcagcatttt

SEQ ID NO: 162325 - DNA, 36 bp, Artificial Sequence
  Synthetic oligonucleotide
tccatctcagccgctcacattatgaccaccgcgcaa

SEQ ID NO: 162326 - DNA, 35 bp, Artificial Sequence
  Synthetic oligonucleotide
tgaatgtcctagcccgtggtcagctcctccccaca

SEQ ID NO: 162327 - DNA, 35 bp, Artificial Sequence
  Synthetic oligonucleotide
atactccccctctcagcctccgccgttacgctaca

SEQ ID NO: 162328 - DNA, 36 bp, Artificial Sequence
  Synthetic oligonucleotide
gccgcccagccccactgccaccgagctacataacca

SEQ ID NO: 162329 - DNA, 35 bp, Artificial Sequence
  Synthetic oligonucleotide
atggcgtcacacccctgatcacctctgcgtaccca

SEQ ID NO: 162330 - DNA, 36 bp, Artificial Sequence
  Synthetic oligonucleotide
gccgacctccgacctgttttacattacgcccggcca

SEQ ID NO: 162331 - DNA, 35 bp, Artificial Sequence
  Synthetic oligonucleotide
ttgcacctcaagtcttgccttgtagccctactcca

SEQ ID NO: 162332 - DNA, 36 bp, Artificial Sequence
  Synthetic oligonucleotide
gtccgctcgccgcacgtgctcccgcgatttgctcca

SEQ ID NO: 162333 - DNA, 35 bp, Artificial Sequence
  Synthetic oligonucleotide
tgaccggctctccctgttatttcctcgcgggtcca

SEQ ID NO: 162334 - DNA, 36 bp, Artificial Sequence
  Synthetic oligonucleotide
accacacacatcggttccattttagcccggtttcca

SEQ ID NO: 162335 - DNA, 36 bp, Artificial Sequence
  Synthetic oligonucleotide
acccgcctccctcctctggacagaccctacgtcgca

SEQ ID NO: 162336 - DNA, 36 bp, Artificial Sequence
  Synthetic oligonucleotide
gcacagtgcctagtgctcaaatgctcccccgctgca

SEQ ID NO: 162337 - DNA, 36 bp, Artificial Sequence
  Synthetic oligonucleotide
tccgcccccctcacccatccgcatgccgagaaatca

SEQ ID NO: 162338 - DNA, 36 bp, Artificial Sequence
  Synthetic oligonucleotide
ttagtggcggccgggtctatcgtccttccctcctca

SEQ ID NO: 162339 - DNA, 35 bp, Artificial Sequence
  Synthetic oligonucleotide
tcaccaaaccttctgccgggtcgccaccccgctca

SEQ ID NO: 162340 - DNA, 36 bp, Artificial Sequence
  Synthetic oligonucleotide
ttccatcctctgcctgccctgaacgtctaccgttca

SEQ ID NO: 162341 - DNA, 37 bp, Artificial Sequence
  Synthetic oligonucleotide
gcatgagccatcagcccatctgctccacccttacaga

SEQ ID NO: 162342 - DNA, 37 bp, Artificial Sequence
  Synthetic oligonucleotide
tggaactacgggatgggggggcgcggacgggaaacga

SEQ ID NO: 162343 - DNA, 37 bp, Artificial Sequence
  Synthetic oligonucleotide
gaggatgcggggggcggagaggcacgacgaaagacga

SEQ ID NO: 162344 - DNA, 35 bp, Artificial Sequence
  Synthetic oligonucleotide
gtaactgcccttgcctcttgtacactcctcaccga

SEQ ID NO: 162345 - DNA, 37 bp, Artificial Sequence
  Synthetic oligonucleotide
tacgcatcaactcttctccgcctgcccttctaagcga

SEQ ID NO: 162346 - DNA, 37 bp, Artificial Sequence
  Synthetic oligonucleotide
tcctcgcccatttaccatcaacagctcccccatcgga

SEQ ID NO: 162347 - DNA, 37 bp, Artificial Sequence
  Synthetic oligonucleotide
gtgatggcaccaagggaggaaggaccgggaggaggga

SEQ ID NO: 162348 - DNA, 36 bp, Artificial Sequence
  Synthetic oligonucleotide
ggtgcggttggagctagggtaggtcgggcggaggga

SEQ ID NO: 162349 - DNA, 37 bp, Artificial Sequence
  Synthetic oligonucleotide
gaaggggggcggggagggtgaaatgccgcttgaggga

SEQ ID NO: 162350 - DNA, 37 bp, Artificial Sequence
  Synthetic oligonucleotide
atgtgggcatatgtacgggggggcgctccttcgggga

SEQ ID NO: 162351 - DNA, 37 bp, Artificial Sequence
  Synthetic oligonucleotide
gatgaggtcgggggtggcggggcgttgaatgggggga

SEQ ID NO: 162352 - DNA, 37 bp, Artificial Sequence
  Synthetic oligonucleotide
gttccgggcggggttgtttgggttgtcgctctgggga

SEQ ID NO: 162353 - DNA, 37 bp, Artificial Sequence
  Synthetic oligonucleotide
gatcacgtacacccatactatcacctctcccctggga

SEQ ID NO: 162354 - DNA, 36 bp, Artificial Sequence
  Synthetic oligonucleotide
aattgggaaagggagaaggaggggacgaaacgtgga

SEQ ID NO: 162355 - DNA, 38 bp, Artificial Sequence
  Synthetic oligonucleotide
tgccttcgccctggtctttcacactttctcatcgctga

SEQ ID NO: 162356 - DNA, 38 bp, Artificial Sequence
  Synthetic oligonucleotide
gcccctgtcgcaggtcgaattgcccctctcacctctga

SEQ ID NO: 162357 - DNA, 38 bp, Artificial Sequence
  Synthetic oligonucleotide
ttcccgtaccgccttgtctgtcttatcactatccttga

SEQ ID NO: 162358 - DNA, 37 bp, Artificial Sequence
  Synthetic oligonucleotide
ttgaccgcggccgctctgtcctatcgcccactcttga

SEQ ID NO: 162359 - DNA, 38 bp, Artificial Sequence
  Synthetic oligonucleotide
gtgccccctcgattatttgttatgttccccaccgttga

SEQ ID NO: 162360 - DNA, 38 bp, Artificial Sequence
  Synthetic oligonucleotide
tatttcaccctctgctgatctcagtgcctgccctttga

SEQ ID NO: 162361 - DNA, 38 bp, Artificial Sequence
  Synthetic oligonucleotide
cccacaccccgcctcgttcgcgacccccgtccttttga

SEQ ID NO: 162362 - DNA, 36 bp, Artificial Sequence
  Synthetic oligonucleotide
gtccgccgttcaaggcgtcatcccgccactactcta

SEQ ID NO: 162363 - DNA, 36 bp, Artificial Sequence
  Synthetic oligonucleotide
gctgccccgcccctacaccgtccttctatgctagta

SEQ ID NO: 162364 - DNA, 35 bp, Artificial Sequence
  Synthetic oligonucleotide
gtggagcccagagcagttgagggggggcgatgtta

SEQ ID NO: 162365 - DNA, 35 bp, Artificial Sequence
  Synthetic oligonucleotide
accgttgcagaggccacatatacactgcacaccac

SEQ ID NO: 162366 - DNA, 35 bp, Artificial Sequence
  Synthetic oligonucleotide
acccccctgtcctccatgcgcgacgacgacaggac

SEQ ID NO: 162367 - DNA, 35 bp, Artificial Sequence
  Synthetic oligonucleotide
acataagtaccgccccacgcagagcttcgcacccc

SEQ ID NO: 162368 - DNA, 35 bp, Artificial Sequence
  Synthetic oligonucleotide
tcactagaacctgtccgccgtatctctgtctcccc

SEQ ID NO: 162369 - DNA, 35 bp, Artificial Sequence
  Synthetic oligonucleotide
gaccccgccggctcataccacatagcgcttatccc

SEQ ID NO: 162370 - DNA, 35 bp, Artificial Sequence
  Synthetic oligonucleotide
tcacccagagtagtgccgccagtagtctccctccc

SEQ ID NO: 162371 - DNA, 35 bp, Artificial Sequence
  Synthetic oligonucleotide
agcatcacgtgtcggcaccatgattttgccatgcc

SEQ ID NO: 162372 - DNA, 35 bp, Artificial Sequence
  Synthetic oligonucleotide
actctatgccacccgagccacagcaatcgtactcc

SEQ ID NO: 162373 - DNA, 35 bp, Artificial Sequence
  Synthetic oligonucleotide
tcaccgagggttggtgttgtgtcccttccttctcc

SEQ ID NO: 162374 - DNA, 35 bp, Artificial Sequence
  Synthetic oligonucleotide
gactccttccgttcgcattttttgtatgcccttcc

SEQ ID NO: 162375 - DNA, 35 bp, Artificial Sequence
  Synthetic oligonucleotide
acaccgcccgtattgccctgctcgttggctcttcc

SEQ ID NO: 162376 - DNA, 35 bp, Artificial Sequence
  Synthetic oligonucleotide
gcgataaccctgtcgcatcttaagtgcacccccgc

SEQ ID NO: 162377 - DNA, 35 bp, Artificial Sequence
  Synthetic oligonucleotide
taagccccgccatttcacagctagcccgccttcgc

SEQ ID NO: 162378 - DNA, 35 bp, Artificial Sequence
  Synthetic oligonucleotide
acgtctgtccttgtccttcgatcctgcctgttcgc

SEQ ID NO: 162379 - DNA, 35 bp, Artificial Sequence
  Synthetic oligonucleotide
agcacgcccccttcgcccgcaagaccccatccggc

SEQ ID NO: 162380 - DNA, 35 bp, Artificial Sequence
  Synthetic oligonucleotide
tgaggcgccctcttggttcctatctactctttggc

SEQ ID NO: 162381 - DNA, 35 bp, Artificial Sequence
  Synthetic oligonucleotide
tctatcgccgccctggtactcacagtatcacctgc

SEQ ID NO: 162382 - DNA, 35 bp, Artificial Sequence
  Synthetic oligonucleotide
aaccgcttggctcagccctgttcgccacaccctgc

SEQ ID NO: 162383 - DNA, 35 bp, Artificial Sequence
  Synthetic oligonucleotide
aatgggcacgtattcgcggtctcaacatcatctgc

SEQ ID NO: 162384 - DNA, 36 bp, Artificial Sequence
  Synthetic oligonucleotide
atacgtcacgggcgccgatcccccttggcctccatc

SEQ ID NO: 162385 - DNA, 35 bp, Artificial Sequence
  Synthetic oligonucleotide
tcccaattatgatccctgtgctttgacgttccctc

SEQ ID NO: 162386 - DNA, 35 bp, Artificial Sequence
  Synthetic oligonucleotide
gtccccccctgtgctggagccttccattttccctc

SEQ ID NO: 162387 - DNA, 35 bp, Artificial Sequence
  Synthetic oligonucleotide
aagcatcccctcggttcccgcgtaaagctcttctc

SEQ ID NO: 162388 - DNA, 35 bp, Artificial Sequence
  Synthetic oligonucleotide
tctgcaacctcaaattcttgtgaacaacgtgcttc

SEQ ID NO: 162389 - DNA, 35 bp, Artificial Sequence
  Synthetic oligonucleotide
accaacggggttgagggttaaatgggggggacacg

SEQ ID NO: 162390 - DNA, 35 bp, Artificial Sequence
  Synthetic oligonucleotide
tcccccgtccggtctgcgatcattctgccggcacg

SEQ ID NO: 162391 - DNA, 35 bp, Artificial Sequence
  Synthetic oligonucleotide
ttggtacccactcgttgcacccccgtaatcatacg

SEQ ID NO: 162392 - DNA, 35 bp, Artificial Sequence
  Synthetic oligonucleotide
acccctgcctctgacccctctttccaccctcaagg

SEQ ID NO: 162393 - DNA, 35 bp, Artificial Sequence
  Synthetic oligonucleotide
atgcgcaccttcccccaccgctccaatagggacgg

SEQ ID NO: 162394 - DNA, 35 bp, Artificial Sequence
  Synthetic oligonucleotide
acagacagaagaagggacgagatgggagcatatgg

SEQ ID NO: 162395 - DNA, 35 bp, Artificial Sequence
  Synthetic oligonucleotide
tgtagtgcgcgcccctgaccatgctcccttcttgg

SEQ ID NO: 162396 - DNA, 35 bp, Artificial Sequence
  Synthetic oligonucleotide
gtccttaccgtccccccgctgttcacctgcccctg

SEQ ID NO: 162397 - DNA, 35 bp, Artificial Sequence
  Synthetic oligonucleotide
gccgcaggcccccagcgcctcaatcagtgcctctg

SEQ ID NO: 162398 - DNA, 35 bp, Artificial Sequence
  Synthetic oligonucleotide
atggccggacaccgtctagctccccgccttactat

SEQ ID NO: 162399 - DNA, 35 bp, Artificial Sequence
  Synthetic oligonucleotide
taggacacgtacaatcccaccagtctttcgcctat

SEQ ID NO: 162400 - DNA, 35 bp, Artificial Sequence
  Synthetic oligonucleotide
tccgcctgccacgtctcgactgattatctcctgct

SEQ ID NO: 162401 - DNA, 35 bp, Artificial Sequence
  Synthetic oligonucleotide
ggtcaccttctgcccccccttaatgctcctgccgt

SEQ ID NO: 162402 - DNA, 34 bp, Artificial Sequence
  Synthetic oligonucleotide
gtctccgcatgccttatctagccactgtcttcgt

SEQ ID NO: 162403 - DNA, 35 bp, Artificial Sequence
  Synthetic oligonucleotide
gcactcgctttcttgctgcccgccgctcactaatt

SEQ ID NO: 162404 - DNA, 35 bp, Artificial Sequence
  Synthetic oligonucleotide
accccacgtcgcttttctaccgttattgtcgcatt

SEQ ID NO: 162405 - DNA, 35 bp, Artificial Sequence
  Synthetic oligonucleotide
actggctgtgcaccatgttgccaactacacccctt

SEQ ID NO: 162406 - DNA, 34 bp, Artificial Sequence
  Synthetic oligonucleotide
ttccaccgcattcctcgcacacagtcactcgttt

SEQ ID NO: 162407 - DNA, 35 bp, Artificial Sequence
  Synthetic oligonucleotide
gttgtgcctctccatctgatcttcgtccacttaaa

SEQ ID NO: 162408 - DNA, 35 bp, Artificial Sequence
  Synthetic oligonucleotide
taaacagggcgggacgaagcgggatagggagcgaa

SEQ ID NO: 162409 - DNA, 36 bp, Artificial Sequence
  Synthetic oligonucleotide
gtcacagcagaagccctcccgagcctcccttttgaa

SEQ ID NO: 162410 - DNA, 35 bp, Artificial Sequence
  Synthetic oligonucleotide
ttgccacccaatctgttgtatcacattttcgcaca

SEQ ID NO: 162411 - DNA, 36 bp, Artificial Sequence
  Synthetic oligonucleotide
gtcgccacgatcccccctttactttgcgtgccacca

SEQ ID NO: 162412 - DNA, 35 bp, Artificial Sequence
  Synthetic oligonucleotide
gtcatcccacctcccgctgtttccccacgggacca

SEQ ID NO: 162413 - DNA, 36 bp, Artificial Sequence
  Synthetic oligonucleotide
tgccatgcgtggacgtacataacgttgctcctccca

SEQ ID NO: 162414 - DNA, 36 bp, Artificial Sequence
  Synthetic oligonucleotide
gtcgccatggcgctgagccgtttttgcttacttcca

SEQ ID NO: 162415 - DNA, 31 bp, Artificial Sequence
  Synthetic oligonucleotide
tccatcccgcgccttcccacggggccccgca

SEQ ID NO: 162416 - DNA, 36 bp, Artificial Sequence
  Synthetic oligonucleotide
atcgcggagttgctgtatccccctgccctttcatca

SEQ ID NO: 162417 - DNA, 35 bp, Artificial Sequence
  Synthetic oligonucleotide
tgcgaccgccctccaatgcttgcccgagagcctca

SEQ ID NO: 162418 - DNA, 36 bp, Artificial Sequence
  Synthetic oligonucleotide
tgtccccacgccgccgtttgttcctgtcgcggttca

SEQ ID NO: 162419 - DNA, 37 bp, Artificial Sequence
  Synthetic oligonucleotide
gatcggtcgggtggacgggggttgagatggggcgaga

SEQ ID NO: 162420 - DNA, 36 bp, Artificial Sequence
  Synthetic oligonucleotide
tgtaccacctattgtcatccagctttcgcctttaga

SEQ ID NO: 162421 - DNA, 37 bp, Artificial Sequence
  Synthetic oligonucleotide
atgtccccgcactaccccgcattggtgaccttttaga

SEQ ID NO: 162422 - DNA, 36 bp, Artificial Sequence
  Synthetic oligonucleotide
accactccgacctctttatgcacctgtctcacccga

SEQ ID NO: 162423 - DNA, 37 bp, Artificial Sequence
  Synthetic oligonucleotide
gcataccacccacccacgttctgccgtttattgtcga

SEQ ID NO: 162424 - DNA, 37 bp, Artificial Sequence
  Synthetic oligonucleotide
gtatgcgcccgctatctctgccccgttactccttcga

SEQ ID NO: 162425 - DNA, 37 bp, Artificial Sequence
  Synthetic oligonucleotide
tcagtgggagagagtgggggatcgggggagtacagga

SEQ ID NO: 162426 - DNA, 37 bp, Artificial Sequence
  Synthetic oligonucleotide
gagagtggggatggaaacggcaggaccaggaatagga

SEQ ID NO: 162427 - DNA, 35 bp, Artificial Sequence
  Synthetic oligonucleotide
acgcaatactcagagcggggtgggaagggcaggga

SEQ ID NO: 162428 - DNA, 37 bp, Artificial Sequence
  Synthetic oligonucleotide
tatcgccccaattgcccagcctgctttccatcaggga

SEQ ID NO: 162429 - DNA, 37 bp, Artificial Sequence
  Synthetic oligonucleotide
tccggatcccgcccttctattcccgacccccccggga

SEQ ID NO: 162430 - DNA, 37 bp, Artificial Sequence
  Synthetic oligonucleotide
gacaggggtgggcgcattggggctcaaaaatggggga

SEQ ID NO: 162431 - DNA, 37 bp, Artificial Sequence
  Synthetic oligonucleotide
tgtcggagtggggggagtggggagtagagactatgga

SEQ ID NO: 162432 - DNA, 36 bp, Artificial Sequence
  Synthetic oligonucleotide
gtgcctgccacatcctcgctttacctgacctatgga

SEQ ID NO: 162433 - DNA, 37 bp, Artificial Sequence
  Synthetic oligonucleotide
tccactgcccacgatctttccgcccggacacacatga

SEQ ID NO: 162434 - DNA, 38 bp, Artificial Sequence
  Synthetic oligonucleotide
gcaccacgagtcatatcaccctgttcacgctccactga

SEQ ID NO: 162435 - DNA, 37 bp, Artificial Sequence
  Synthetic oligonucleotide
ggtgccacagtccttttggatcatcacatcatcctga

SEQ ID NO: 162436 - DNA, 37 bp, Artificial Sequence
  Synthetic oligonucleotide
tattaccgcctccgatcggccaccatgcccctcctga

SEQ ID NO: 162437 - DNA, 38 bp, Artificial Sequence
  Synthetic oligonucleotide
gaccccgcacgcatgccgcccatccacagtgctcctga

SEQ ID NO: 162438 - DNA, 37 bp, Artificial Sequence
  Synthetic oligonucleotide
gtggggaacgaggaaagggtagtacagatgggagtga

SEQ ID NO: 162439 - DNA, 38 bp, Artificial Sequence
  Synthetic oligonucleotide
tagatagggtgggaaaaagaataggggcgagggggtga

SEQ ID NO: 162440 - DNA, 37 bp, Artificial Sequence
  Synthetic oligonucleotide
tggggacggtgagaaagttgggtagggcggggggtga

SEQ ID NO: 162441 - DNA, 38 bp, Artificial Sequence
  Synthetic oligonucleotide
atcgagccactcgatgcgctcacctcaacccgccttga

SEQ ID NO: 162442 - DNA, 36 bp, Artificial Sequence
  Synthetic oligonucleotide
taacgccatcccgctgccatctctgctctgcatcta

SEQ ID NO: 162443 - DNA, 35 bp, Artificial Sequence
  Synthetic oligonucleotide
gaccgatgggccggggataggagggaaaacaagta

SEQ ID NO: 162444 - DNA, 36 bp, Artificial Sequence
  Synthetic oligonucleotide
tgcaccccctgttgtctccttttcccatgctgagta

SEQ ID NO: 162445 - DNA, 35 bp, Artificial Sequence
  Synthetic oligonucleotide
gtacgtccccctgcctgttctctctgtttcgcgta

SEQ ID NO: 162446 - DNA, 35 bp, Artificial Sequence
  Synthetic oligonucleotide
gcatcgctcccttctccaaactgccccatctggta

SEQ ID NO: 162447 - DNA, 35 bp, Artificial Sequence
  Synthetic oligonucleotide
acactcccgtgtcgctttcatgcctttgtctctta

SEQ ID NO: 162448 - DNA, 36 bp, Artificial Sequence
  Synthetic oligonucleotide
acttgcccccccgactcgattgatcgcgtaacgtta

SEQ ID NO: 162449 - DNA, 36 bp, Artificial Sequence
  Synthetic oligonucleotide
acatccattcccgctgagtgttcctacactaattta

SEQ ID NO: 162450 - DNA, 35 bp, Artificial Sequence
  Synthetic oligonucleotide
acccactgccctcggactctctcacgtgaccccac

SEQ ID NO: 162451 - DNA, 35 bp, Artificial Sequence
  Synthetic oligonucleotide
gagggacgccaccgtactcgttgcctgacctctac

SEQ ID NO: 162452 - DNA, 35 bp, Artificial Sequence
  Synthetic oligonucleotide
gacacccctcctgcctttgcggtccaagccggtac

SEQ ID NO: 162453 - DNA, 35 bp, Artificial Sequence
  Synthetic oligonucleotide
gccccacccgtgccctgaatagcgtatcgcgttac

SEQ ID NO: 162454 - DNA, 35 bp, Artificial Sequence
  Synthetic oligonucleotide
atccacctgctatcatcacctttatggttgacacc

SEQ ID NO: 162455 - DNA, 35 bp, Artificial Sequence
  Synthetic oligonucleotide
accgccattcatcaccgtcttccggtcgactcacc

SEQ ID NO: 162456 - DNA, 35 bp, Artificial Sequence
  Synthetic oligonucleotide
atctgttcgtgacgcctttgtactcgtcttgcccc

SEQ ID NO: 162457 - DNA, 35 bp, Artificial Sequence
  Synthetic oligonucleotide
ttacgaagccatttgcccgccccagcctatagccc

SEQ ID NO: 162458 - DNA, 35 bp, Artificial Sequence
  Synthetic oligonucleotide
tgcgacgacagatatccattacgacccctccgccc

SEQ ID NO: 162459 - DNA, 35 bp, Artificial Sequence
  Synthetic oligonucleotide
gtttgtccctgtgtgttttcgtcctttcctgtgcc

SEQ ID NO: 162460 - DNA, 35 bp, Artificial Sequence
  Synthetic oligonucleotide
gtgcgctcccgccccaatgactcatttcaggctcc

SEQ ID NO: 162461 - DNA, 35 bp, Artificial Sequence
  Synthetic oligonucleotide
tccctaccgcggtatcctgactcatcagtctctcc

SEQ ID NO: 162462 - DNA, 35 bp, Artificial Sequence
  Synthetic oligonucleotide
gcatgcccattgcatcggagtgccccccccccagc

SEQ ID NO: 162463 - DNA, 35 bp, Artificial Sequence
  Synthetic oligonucleotide
ttcaccacccgccgactctggctccctgctccagc

SEQ ID NO: 162464 - DNA, 35 bp, Artificial Sequence
  Synthetic oligonucleotide
tgtcccctccgatcatgcccgtactccgccaacgc

SEQ ID NO: 162465 - DNA, 35 bp, Artificial Sequence
  Synthetic oligonucleotide
accccaaatcgccccagcctcccctgacgccacgc

SEQ ID NO: 162466 - DNA, 35 bp, Artificial Sequence
  Synthetic oligonucleotide
atgcaatcagtgttgctccatcgcatctataccgc

SEQ ID NO: 162467 - DNA, 35 bp, Artificial Sequence
  Synthetic oligonucleotide
tcaggccgtccactcctctgacgccgctgtcccgc

SEQ ID NO: 162468 - DNA, 35 bp, Artificial Sequence
  Synthetic oligonucleotide
gtccccgcatatctctctccccacagcctgctcgc

SEQ ID NO: 162469 - DNA, 35 bp, Artificial Sequence
  Synthetic oligonucleotide
acacgctcgtcacacgtatacttactctccccggc

SEQ ID NO: 162470 - DNA, 35 bp, Artificial Sequence
  Synthetic oligonucleotide
tcagctacaacttcacacatcactgtccttccggc

SEQ ID NO: 162471 - DNA, 35 bp, Artificial Sequence
  Synthetic oligonucleotide
agtccggccccacccttcttgactcgacctatggc

SEQ ID NO: 162472 - DNA, 35 bp, Artificial Sequence
  Synthetic oligonucleotide
acagaacacctgcgctatgcttcgcgaacccctgc

SEQ ID NO: 162473 - DNA, 35 bp, Artificial Sequence
  Synthetic oligonucleotide
gaacttccacgtcgccctttatgcctgctcccatc

SEQ ID NO: 162474 - DNA, 35 bp, Artificial Sequence
  Synthetic oligonucleotide
tcctagcccatcacactccagcgaccgtccgcatc

SEQ ID NO: 162475 - DNA, 35 bp, Artificial Sequence
  Synthetic oligonucleotide
gccatgctaccgccgtatactccttccactcgatc

SEQ ID NO: 162476 - DNA, 35 bp, Artificial Sequence
  Synthetic oligonucleotide
gacccgtgagtatcacgtacccgtttccccccctc

SEQ ID NO: 162477 - DNA, 35 bp, Artificial Sequence
  Synthetic oligonucleotide
gtagacccccggtgtcatcgcgcgctacgcccctc

SEQ ID NO: 162478 - DNA, 35 bp, Artificial Sequence
  Synthetic oligonucleotide
gacgattagcgtgacccgctgttgccttattcctc

SEQ ID NO: 162479 - DNA, 35 bp, Artificial Sequence
  Synthetic oligonucleotide
gttcatgccacccgggcttagacaacatacatctc

SEQ ID NO: 162480 - DNA, 35 bp, Artificial Sequence
  Synthetic oligonucleotide
gacacagttcacagcatgaccgtcagccacctctc

SEQ ID NO: 162481 - DNA, 35 bp, Artificial Sequence
  Synthetic oligonucleotide
tgagctctccggccgtctttttcttagcgcttctc

SEQ ID NO: 162482 - DNA, 35 bp, Artificial Sequence
  Synthetic oligonucleotide
tgtcaatggacccctggctgtctcctccatccttc

SEQ ID NO: 162483 - DNA, 35 bp, Artificial Sequence
  Synthetic oligonucleotide
gccggggccccgcatgttctccttggtactgcttc

SEQ ID NO: 162484 - DNA, 35 bp, Artificial Sequence
  Synthetic oligonucleotide
ttgtgtccctgtccactcccgcggtccatcatttc

SEQ ID NO: 162485 - DNA, 35 bp, Artificial Sequence
  Synthetic oligonucleotide
gtacggggggggaagtgagtgggatgatgtaccag

SEQ ID NO: 162486 - DNA, 35 bp, Artificial Sequence
  Synthetic oligonucleotide
ttcgttcaccgcacttggtcctgttcgacaacccg

SEQ ID NO: 162487 - DNA, 35 bp, Artificial Sequence
  Synthetic oligonucleotide
gacgacgcacacatctatcattgcacaatcttccg

SEQ ID NO: 162488 - DNA, 35 bp, Artificial Sequence
  Synthetic oligonucleotide
tcgctgcatgcactgcatccttactaaccctctcg

SEQ ID NO: 162489 - DNA, 35 bp, Artificial Sequence
  Synthetic oligonucleotide
ccgatccgacctcagatccccatcctggccccctg

SEQ ID NO: 162490 - DNA, 35 bp, Artificial Sequence
  Synthetic oligonucleotide
tacgcgggcatcacctcaccagcgacttactcctg

SEQ ID NO: 162491 - DNA, 35 bp, Artificial Sequence
  Synthetic oligonucleotide
aggacacttcacgacgcctcgatctgccccaatat

SEQ ID NO: 162492 - DNA, 35 bp, Artificial Sequence
  Synthetic oligonucleotide
gacaccgtccaccgtaatcatcggcgtacctccct

SEQ ID NO: 162493 - DNA, 35 bp, Artificial Sequence
  Synthetic oligonucleotide
tgtacgctcctgccgcattacattcccccgtggct

SEQ ID NO: 162494 - DNA, 35 bp, Artificial Sequence
  Synthetic oligonucleotide
aacacctcggtgttcgtatctcttcctttattatt

SEQ ID NO: 162495 - DNA, 35 bp, Artificial Sequence
  Synthetic oligonucleotide
gacaccccctcagccaatattcgtaagtaaccctt

SEQ ID NO: 162496 - DNA, 35 bp, Artificial Sequence
  Synthetic oligonucleotide
acctgagatcacatccctattgaagttgccctgtt

SEQ ID NO: 162497 - DNA, 35 bp, Artificial Sequence
  Synthetic oligonucleotide
gtggccggtcagttgactccaccgttatcaccttt

SEQ ID NO: 162498 - DNA, 35 bp, Artificial Sequence
  Synthetic oligonucleotide
gtctgcatggcctcctgctatcatgactatccttt

SEQ ID NO: 162499 - DNA, 35 bp, Artificial Sequence
  Synthetic oligonucleotide
gtcgccggacacatttgccaagccccgtttctttt

SEQ ID NO: 162500 - DNA, 36 bp, Artificial Sequence
  Synthetic oligonucleotide
tagatcgttggtgagggtaggggcagggggtggaaa

SEQ ID NO: 162501 - DNA, 36 bp, Artificial Sequence
  Synthetic oligonucleotide
ttgcttggggaaggggtcgggaggggtctaacggaa

SEQ ID NO: 162502 - DNA, 36 bp, Artificial Sequence
  Synthetic oligonucleotide
atgccgtgtgtgcatatcgtcccgtgccctcccaca

SEQ ID NO: 162503 - DNA, 35 bp, Artificial Sequence
  Synthetic oligonucleotide
gcccccccttccgcccgtctcttcaggccaggaca

SEQ ID NO: 162504 - DNA, 36 bp, Artificial Sequence
  Synthetic oligonucleotide
tcgtacccccgctcataaaactgtacctgcctgaca

SEQ ID NO: 162505 - DNA, 35 bp, Artificial Sequence
  Synthetic oligonucleotide
tcccccaaccctcagtttactcgaacctcctgaca

SEQ ID NO: 162506 - DNA, 36 bp, Artificial Sequence
  Synthetic oligonucleotide
atgcgacgaccccccgacttgttcaatgtgcgccca

SEQ ID NO: 162507 - DNA, 36 bp, Artificial Sequence
  Synthetic oligonucleotide
aagccgtgccttgccttctatccgttccctatagca

SEQ ID NO: 162508 - DNA, 36 bp, Artificial Sequence
  Synthetic oligonucleotide
tcccacgccaaagaacacaccgcctttcccccggca

SEQ ID NO: 162509 - DNA, 36 bp, Artificial Sequence
  Synthetic oligonucleotide
gagccagatccgtgtcccccgctcgctccgcactca

SEQ ID NO: 162510 - DNA, 31 bp, Artificial Sequence
  Synthetic oligonucleotide
tattccccggcgatacggttgcccgctctca

SEQ ID NO: 162511 - DNA, 37 bp, Artificial Sequence
  Synthetic oligonucleotide
tccacccgccccccgatggctacacttattaaccaga

SEQ ID NO: 162512 - DNA, 37 bp, Artificial Sequence
  Synthetic oligonucleotide
gatgcctcccgcccactcgagcttactacccgcgaga

SEQ ID NO: 162513 - DNA, 37 bp, Artificial Sequence
  Synthetic oligonucleotide
atccagggggtccggcgacaagggggaggtggggaga

SEQ ID NO: 162514 - DNA, 37 bp, Artificial Sequence
  Synthetic oligonucleotide
aaccctggtctgtctcttctgcccgcctctccgacga

SEQ ID NO: 162515 - DNA, 37 bp, Artificial Sequence
  Synthetic oligonucleotide
tgccaagctctgacacttcctcttatgcgcccaccga

SEQ ID NO: 162516 - DNA, 37 bp, Artificial Sequence
  Synthetic oligonucleotide
agaccggaggtggcggggatggatgggtggaatccga

SEQ ID NO: 162517 - DNA, 35 bp, Artificial Sequence
  Synthetic oligonucleotide
aagccaggtttccgttcttgcccacacctctccga

SEQ ID NO: 162518 - DNA, 36 bp, Artificial Sequence
  Synthetic oligonucleotide
gatcacctgttgccgtctcttttgcccatgttccga

SEQ ID NO: 162519 - DNA, 37 bp, Artificial Sequence
  Synthetic oligonucleotide
ttcatagcaaggaaagggaggaggaggacgaggtcga

SEQ ID NO: 162520 - DNA, 37 bp, Artificial Sequence
  Synthetic oligonucleotide
tgctgcgacgattggctccccttcttccctggttcga

SEQ ID NO: 162521 - DNA, 37 bp, Artificial Sequence
  Synthetic oligonucleotide
ggtatggtgtagtatgggaagggggtggtgagaggga

SEQ ID NO: 162522 - DNA, 37 bp, Artificial Sequence
  Synthetic oligonucleotide
tagagggaaagggacgggcaggtgaggggagacggga

SEQ ID NO: 162523 - DNA, 37 bp, Artificial Sequence
  Synthetic oligonucleotide
atgatgtagggagaagaaggatagggcggactgggga

SEQ ID NO: 162524 - DNA, 37 bp, Artificial Sequence
  Synthetic oligonucleotide
attggacccgagtagggtgggtggggtagggcctgga

SEQ ID NO: 162525 - DNA, 36 bp, Artificial Sequence
  Synthetic oligonucleotide
accctcgatcatgctctcctcggcccccactctgga

SEQ ID NO: 162526 - DNA, 35 bp, Artificial Sequence
  Synthetic oligonucleotide
tccatcccgtcctgccgtagccttagatatactga

SEQ ID NO: 162527 - DNA, 37 bp, Artificial Sequence
  Synthetic oligonucleotide
gtgtccccgtcctcgtttctttttgtccttgtcctga

SEQ ID NO: 162528 - DNA, 37 bp, Artificial Sequence
  Synthetic oligonucleotide
tggggggccttgatgggcgggaggggtactggtctga

SEQ ID NO: 162529 - DNA, 37 bp, Artificial Sequence
  Synthetic oligonucleotide
acagtcgcgcatagctacacccctcaccttcacgtga

SEQ ID NO: 162530 - DNA, 37 bp, Artificial Sequence
  Synthetic oligonucleotide
ttgcgtaatgcggagcggggtaggggtagggcggtga

SEQ ID NO: 162531 - DNA, 38 bp, Artificial Sequence
  Synthetic oligonucleotide
ttcctccccgcccttcgtataacccgtgtccttggtga

SEQ ID NO: 162532 - DNA, 36 bp, Artificial Sequence
  Synthetic oligonucleotide
tccaatcgcccagttcctgcctctctcatttattga

SEQ ID NO: 162533 - DNA, 38 bp, Artificial Sequence
  Synthetic oligonucleotide
gtgagacacgggggggtacgtgagcggacggtggttga

SEQ ID NO: 162534 - DNA, 38 bp, Artificial Sequence
  Synthetic oligonucleotide
agtcatcctccctgttgcatttgtcctgtcgctgttga

SEQ ID NO: 162535 - DNA, 37 bp, Artificial Sequence
  Synthetic oligonucleotide
gttgaccttgccctctgatcaccgtgcctacctttga

SEQ ID NO: 162536 - DNA, 36 bp, Artificial Sequence
  Synthetic oligonucleotide
gctcccgtcgcacggcccacaccccacttcgcgata

SEQ ID NO: 162537 - DNA, 36 bp, Artificial Sequence
  Synthetic oligonucleotide
gcccaccactctcaggaaccgagtatcctccgccta

SEQ ID NO: 162538 - DNA, 36 bp, Artificial Sequence
  Synthetic oligonucleotide
ttcaccacttggtgctttattcgttcacacactcta

SEQ ID NO: 162539 - DNA, 36 bp, Artificial Sequence
  Synthetic oligonucleotide
tgaccaccgccccgttactcgcagggagcctttcta

SEQ ID NO: 162540 - DNA, 36 bp, Artificial Sequence
  Synthetic oligonucleotide
gactaggcggtgaaaaatggaggggtggaggcggta

SEQ ID NO: 162541 - DNA, 36 bp, Artificial Sequence
  Synthetic oligonucleotide
tccacccttgcacatgccgacatttttcttctggta

SEQ ID NO: 162542 - DNA, 35 bp, Artificial Sequence
  Synthetic oligonucleotide
atgccatccatcaacccagtgtcccactacttgta

SEQ ID NO: 162543 - DNA, 36 bp, Artificial Sequence
  Synthetic oligonucleotide
accgctcccttccagtactgcacgagtcacgcctta

SEQ ID NO: 162544 - DNA, 35 bp, Artificial Sequence
  Synthetic oligonucleotide
gtccattgccatgcccgcgtttcccgtttcgcaac

SEQ ID NO: 162545 - DNA, 35 bp, Artificial Sequence
  Synthetic oligonucleotide
tgcacccagtccacagaaccttcgctacgtttcac

SEQ ID NO: 162546 - DNA, 35 bp, Artificial Sequence
  Synthetic oligonucleotide
aacccggggatgggccgggggggaacggtgatacc

SEQ ID NO: 162547 - DNA, 35 bp, Artificial Sequence
  Synthetic oligonucleotide
ttctggatggcgccggcttagtcctgtcacctacc

SEQ ID NO: 162548 - DNA, 35 bp, Artificial Sequence
  Synthetic oligonucleotide
ttagccaagcccgccctccttgtacagtacgtccc

SEQ ID NO: 162549 - DNA, 35 bp, Artificial Sequence
  Synthetic oligonucleotide
acgcgcacaccttccctgattttgcttcatttccc

SEQ ID NO: 162550 - DNA, 35 bp, Artificial Sequence
  Synthetic oligonucleotide
actgccccacagcctacgcctcccgttgtaccgcc

SEQ ID NO: 162551 - DNA, 35 bp, Artificial Sequence
  Synthetic oligonucleotide
accgcccacacttgttttaccggaacctccgcgcc

SEQ ID NO: 162552 - DNA, 35 bp, Artificial Sequence
  Synthetic oligonucleotide
taccatcatcaggcctcctgcacaccggtccttcc

SEQ ID NO: 162553 - DNA, 35 bp, Artificial Sequence
  Synthetic oligonucleotide
gcccattgctgctaccttagctcctacacatccgc

SEQ ID NO: 162554 - DNA, 34 bp, Artificial Sequence
  Synthetic oligonucleotide
gaaacaacggagggattaacaaaggggggtgggc

SEQ ID NO: 162555 - DNA, 35 bp, Artificial Sequence
  Synthetic oligonucleotide
aacacctcattcgcttctgtatcagctactgctgc

SEQ ID NO: 162556 - DNA, 35 bp, Artificial Sequence
  Synthetic oligonucleotide
tgttgtgacacgctcagtgccgctctatcgccatc

SEQ ID NO: 162557 - DNA, 35 bp, Artificial Sequence
  Synthetic oligonucleotide
tccaacaccatctgactgttttgcgccttatcatc

SEQ ID NO: 162558 - DNA, 35 bp, Artificial Sequence
  Synthetic oligonucleotide
atcgccctgacccgtaactattacgccagttcatc

SEQ ID NO: 162559 - DNA, 35 bp, Artificial Sequence
  Synthetic oligonucleotide
tttgcgctgacagtgcctcccgtcgaatgccactc

SEQ ID NO: 162560 - DNA, 35 bp, Artificial Sequence
  Synthetic oligonucleotide
tcccccgcctgtacagcactagccagggactactc

SEQ ID NO: 162561 - DNA, 35 bp, Artificial Sequence
  Synthetic oligonucleotide
gaacgaccgctatggttccctccgtgttgctcctc

SEQ ID NO: 162562 - DNA, 35 bp, Artificial Sequence
  Synthetic oligonucleotide
gagcactcaccttgcctgttcgttcaaaattcctc

SEQ ID NO: 162563 - DNA, 35 bp, Artificial Sequence
  Synthetic oligonucleotide
gttccggtcttgcctgcattagcaaccatcctctc

SEQ ID NO: 162564 - DNA, 35 bp, Artificial Sequence
  Synthetic oligonucleotide
atctaccatcgccaccgctgcgctatgctccagtc

SEQ ID NO: 162565 - DNA, 35 bp, Artificial Sequence
  Synthetic oligonucleotide
atcccagctccagttacctcttacacactctggtc

SEQ ID NO: 162566 - DNA, 35 bp, Artificial Sequence
  Synthetic oligonucleotide
attggagcaggtgggggggggaaaaggggttggtc

SEQ ID NO: 162567 - DNA, 35 bp, Artificial Sequence
  Synthetic oligonucleotide
aactgacgctccacaagttccttcgtgacaacttc

SEQ ID NO: 162568 - DNA, 35 bp, Artificial Sequence
  Synthetic oligonucleotide
tatcatagcgtacgacgcccctacgaatgcccttc

SEQ ID NO: 162569 - DNA, 35 bp, Artificial Sequence
  Synthetic oligonucleotide
tggagccctgccgcttccctccgttgacctataag

SEQ ID NO: 162570 - DNA, 35 bp, Artificial Sequence
  Synthetic oligonucleotide
tccccatgtcagctccccccgccgtttgtcctaag

SEQ ID NO: 162571 - DNA, 35 bp, Artificial Sequence
  Synthetic oligonucleotide
gtgactcaagggtgtgtagggtgggggggttaacg

SEQ ID NO: 162572 - DNA, 35 bp, Artificial Sequence
  Synthetic oligonucleotide
tccttgcgacagacaccgcccgcttactcctcacg

SEQ ID NO: 162573 - DNA, 35 bp, Artificial Sequence
  Synthetic oligonucleotide
tcgtccaccctcggcctgctcatcaagttaacccg

SEQ ID NO: 162574 - DNA, 35 bp, Artificial Sequence
  Synthetic oligonucleotide
gacgcgtgcagtatcatgactcacaccaccgcccg

SEQ ID NO: 162575 - DNA, 35 bp, Artificial Sequence
  Synthetic oligonucleotide
acttcgccaccctttgctattcttcctgacagccg

SEQ ID NO: 162576 - DNA, 35 bp, Artificial Sequence
  Synthetic oligonucleotide
tcatgtcccgctcatagtgcccttgtctcatcgcg

SEQ ID NO: 162577 - DNA, 35 bp, Artificial Sequence
  Synthetic oligonucleotide
tatcgagagggattggaatacgagcgggtgggggg

SEQ ID NO: 162578 - DNA, 35 bp, Artificial Sequence
  Synthetic oligonucleotide
attaccctgcacgccagatcctccgtcgccccgtg

SEQ ID NO: 162579 - DNA, 35 bp, Artificial Sequence
  Synthetic oligonucleotide
tccgccccttgtcaacgccgtccccccgaatattg

SEQ ID NO: 162580 - DNA, 35 bp, Artificial Sequence
  Synthetic oligonucleotide
aagtcgcccacccgtatcgccgcccccaccgcttg

SEQ ID NO: 162581 - DNA, 36 bp, Artificial Sequence
  Synthetic oligonucleotide
tcacacgaccggtccttctatttccccaggatctat

SEQ ID NO: 162582 - DNA, 33 bp, Artificial Sequence
  Synthetic oligonucleotide
accccccccggcatctgcccttggcccgccgct

SEQ ID NO: 162583 - DNA, 35 bp, Artificial Sequence
  Synthetic oligonucleotide
acgcgctcatctgcccctcgccgccagccatggct

SEQ ID NO: 162584 - DNA, 35 bp, Artificial Sequence
  Synthetic oligonucleotide
gtacgcgttcagccccccgcgcttaggtcattgct

SEQ ID NO: 162585 - DNA, 35 bp, Artificial Sequence
  Synthetic oligonucleotide
gactcccccccattcgcctcaaggactgagaaggt

SEQ ID NO: 162586 - DNA, 35 bp, Artificial Sequence
  Synthetic oligonucleotide
tgtagcccgtctttcctttatggcccgtccccttt

SEQ ID NO: 162587 - DNA, 35 bp, Artificial Sequence
  Synthetic oligonucleotide
agtaccaccagccatcaacgcgtccccagtctttt

SEQ ID NO: 162588 - DNA, 35 bp, Artificial Sequence
  Synthetic oligonucleotide
tgttgtgccacaccccttgtccccgattcgccgaa

SEQ ID NO: 162589 - DNA, 36 bp, Artificial Sequence
  Synthetic oligonucleotide
attcagagggaacgcggggggggagggactttcgaa

SEQ ID NO: 162590 - DNA, 36 bp, Artificial Sequence
  Synthetic oligonucleotide
tccacccccatatttgcacttccgcggccactcaca

SEQ ID NO: 162591 - DNA, 36 bp, Artificial Sequence
  Synthetic oligonucleotide
acgcactcacgcatttgctccatcccactcctcaca

SEQ ID NO: 162592 - DNA, 33 bp, Artificial Sequence
  Synthetic oligonucleotide
gcctcatcgtactacctgccggcggtacctaca

SEQ ID NO: 162593 - DNA, 36 bp, Artificial Sequence
  Synthetic oligonucleotide
acgtgcctaagtgccatccctctgtcgtccattaca

SEQ ID NO: 162594 - DNA, 35 bp, Artificial Sequence
  Synthetic oligonucleotide
tcaccggccaagcactggcctatctcttccctcca

SEQ ID NO: 162595 - DNA, 32 bp, Artificial Sequence
  Synthetic oligonucleotide
agcgcataccacccgtagtttatttctgtcca

SEQ ID NO: 162596 - DNA, 35 bp, Artificial Sequence
  Synthetic oligonucleotide
acccgatccatcttggttttgtacagttgcacgca

SEQ ID NO: 162597 - DNA, 36 bp, Artificial Sequence
  Synthetic oligonucleotide
tccagtgcgcccatgttccaccttaaggaccccgca

SEQ ID NO: 162598 - DNA, 35 bp, Artificial Sequence
  Synthetic oligonucleotide
gcacacacacacgctccagagacccctcacctgca

SEQ ID NO: 162599 - DNA, 36 bp, Artificial Sequence
  Synthetic oligonucleotide
ttacgcgacctgagtagccctccctttcctgttgca

SEQ ID NO: 162600 - DNA, 36 bp, Artificial Sequence
  Synthetic oligonucleotide
gcacctcctggctgcgggcggttactcccttgctca

SEQ ID NO: 162601 - DNA, 36 bp, Artificial Sequence
  Synthetic oligonucleotide
tggacttgccccccgacacctcgtggtaccctctca

SEQ ID NO: 162602 - DNA, 37 bp, Artificial Sequence
  Synthetic oligonucleotide
ttatcgcagggggaacagggaagggcgggaacggaga

SEQ ID NO: 162603 - DNA, 37 bp, Artificial Sequence
  Synthetic oligonucleotide
agaatagtgaggcgaggagaagagggggtgggtgaga

SEQ ID NO: 162604 - DNA, 37 bp, Artificial Sequence
  Synthetic oligonucleotide
tgattgaacatggtggaggagaggaggagaaaataga

SEQ ID NO: 162605 - DNA, 37 bp, Artificial Sequence
  Synthetic oligonucleotide
acacatcccaaatgctgccctgttgcccacacttcga

SEQ ID NO: 162606 - DNA, 37 bp, Artificial Sequence
  Synthetic oligonucleotide
aatgggcgaggaacggggagagttacgcgtgggggga

SEQ ID NO: 162607 - DNA, 37 bp, Artificial Sequence
  Synthetic oligonucleotide
gtggacaataacaggtggggcgtgggtggggcatgga

SEQ ID NO: 162608 - DNA, 37 bp, Artificial Sequence
  Synthetic oligonucleotide
ttgcatccttgcctcacgacacacacacccccctgga

SEQ ID NO: 162609 - DNA, 38 bp, Artificial Sequence
  Synthetic oligonucleotide
aactccatcgccccaccatgcaatttctgacaccatga

SEQ ID NO: 162610 - DNA, 38 bp, Artificial Sequence
  Synthetic oligonucleotide
tgtcacgtacaggttgtaccgccccgttgcctccatga

SEQ ID NO: 162611 - DNA, 38 bp, Artificial Sequence
  Synthetic oligonucleotide
gctcaccggtcagcctatatccccgacccctgtactga

SEQ ID NO: 162612 - DNA, 36 bp, Artificial Sequence
  Synthetic oligonucleotide
agccacccgccggtcggtcttactatcacaacctga

SEQ ID NO: 162613 - DNA, 38 bp, Artificial Sequence
  Synthetic oligonucleotide
acttgtgggccctgttttgcatatcgcctcctacctga

SEQ ID NO: 162614 - DNA, 38 bp, Artificial Sequence
  Synthetic oligonucleotide
gtcagggccatttgtttctgctgccatcctgcctctga

SEQ ID NO: 162615 - DNA, 37 bp, Artificial Sequence
  Synthetic oligonucleotide
tcccaccgctaccgacttgccctcactttaccggtga

SEQ ID NO: 162616 - DNA, 37 bp, Artificial Sequence
  Synthetic oligonucleotide
gcacactgttgtcccagccttaccctcccgccggtga

SEQ ID NO: 162617 - DNA, 38 bp, Artificial Sequence
  Synthetic oligonucleotide
gcctacgccggaaacgcaaagttgcgctcgcccattga

SEQ ID NO: 162618 - DNA, 37 bp, Artificial Sequence
  Synthetic oligonucleotide
gtcagtccccgccgccattgcccctgatatcccttga

SEQ ID NO: 162619 - DNA, 37 bp, Artificial Sequence
  Synthetic oligonucleotide
gatgccggacctacctccatcccgtacgctctcttga

SEQ ID NO: 162620 - DNA, 38 bp, Artificial Sequence
  Synthetic oligonucleotide
atccgctcctgcccgcctatccagttgatcacatttga

SEQ ID NO: 162621 - DNA, 36 bp, Artificial Sequence
  Synthetic oligonucleotide
atcaggccatcacgtgcacggctccctccctttgta

SEQ ID NO: 162622 - DNA, 36 bp, Artificial Sequence
  Synthetic oligonucleotide
tcaaccgcccccaagttatcgcaacgctgcacttta

SEQ ID NO: 162623 - DNA, 35 bp, Artificial Sequence
  Synthetic oligonucleotide
tcctacctcgctcttgggaccccgtacccacacac

SEQ ID NO: 162624 - DNA, 35 bp, Artificial Sequence
  Synthetic oligonucleotide
gatggatgcagatatttttttgtttcggccttcac

SEQ ID NO: 162625 - DNA, 35 bp, Artificial Sequence
  Synthetic oligonucleotide
atcatcctgagggagggcggggagggcactcggac

SEQ ID NO: 162626 - DNA, 35 bp, Artificial Sequence
  Synthetic oligonucleotide
aaccctcccgccacatcccagttagacgcctttac

SEQ ID NO: 162627 - DNA, 35 bp, Artificial Sequence
  Synthetic oligonucleotide
gttgagaggggggagaggggcgacaacaggaaacc

SEQ ID NO: 162628 - DNA, 35 bp, Artificial Sequence
  Synthetic oligonucleotide
tcacgcaacctctgactatatttgtaccgcccacc

SEQ ID NO: 162629 - DNA, 35 bp, Artificial Sequence
  Synthetic oligonucleotide
taccaaccgcccacatccacacgagttacccgccc

SEQ ID NO: 162630 - DNA, 35 bp, Artificial Sequence
  Synthetic oligonucleotide
actgtccgagaagctattgttacttgccctgtccc

SEQ ID NO: 162631 - DNA, 35 bp, Artificial Sequence
  Synthetic oligonucleotide
acgcaccaacctgtctttcaggctcccccttcgcc

SEQ ID NO: 162632 - DNA, 35 bp, Artificial Sequence
  Synthetic oligonucleotide
gtctgccccccgacggttgctattctgttccatcc

SEQ ID NO: 162633 - DNA, 35 bp, Artificial Sequence
  Synthetic oligonucleotide
acgctcagagccgcatgtatgccccgcccaagtcc

SEQ ID NO: 162634 - DNA, 35 bp, Artificial Sequence
  Synthetic oligonucleotide
tacgtagcccaactgcgctctatccactcctgtcc

SEQ ID NO: 162635 - DNA, 34 bp, Artificial Sequence
  Synthetic oligonucleotide
tccgataacccctcttgagcctagaatattgtcc

SEQ ID NO: 162636 - DNA, 35 bp, Artificial Sequence
  Synthetic oligonucleotide
agtccccgtacaccttccgctatcccacgactagc

SEQ ID NO: 162637 - DNA, 35 bp, Artificial Sequence
  Synthetic oligonucleotide
ttccgacccagcgtactacacctgaatgcgcccgc

SEQ ID NO: 162638 - DNA, 35 bp, Artificial Sequence
  Synthetic oligonucleotide
tccaggtccacacgtcttgtccactcgctccttgc

SEQ ID NO: 162639 - DNA, 35 bp, Artificial Sequence
  Synthetic oligonucleotide
gcttgtatcgcctggccccttatctgtttgacctc

SEQ ID NO: 162640 - DNA, 35 bp, Artificial Sequence
  Synthetic oligonucleotide
tcaaccgccgaaattgtgtcccgccctgtaccctc

SEQ ID NO: 162641 - DNA, 35 bp, Artificial Sequence
  Synthetic oligonucleotide
tcaccccacttagctgtagttgcctttaacttctc

SEQ ID NO: 162642 - DNA, 35 bp, Artificial Sequence
  Synthetic oligonucleotide
gtgcgactcggttatttaggccgtagctacctttc

SEQ ID NO: 162643 - DNA, 35 bp, Artificial Sequence
  Synthetic oligonucleotide
tgccaccccccgccgccgagaacgcgccccccaag

SEQ ID NO: 162644 - DNA, 35 bp, Artificial Sequence
  Synthetic oligonucleotide
actaagacaaggagagacggcggtaggagggggag

SEQ ID NO: 162645 - DNA, 35 bp, Artificial Sequence
  Synthetic oligonucleotide
gcctcgcccccgcgatcctgtgatttccctgaccg

SEQ ID NO: 162646 - DNA, 35 bp, Artificial Sequence
  Synthetic oligonucleotide
cgcagctcatcgtcctccttcagtatctgaatccg

SEQ ID NO: 162647 - DNA, 35 bp, Artificial Sequence
  Synthetic oligonucleotide
agagtacagtgccgggggggagataggtgctaggg

SEQ ID NO: 162648 - DNA, 35 bp, Artificial Sequence
  Synthetic oligonucleotide
tagcggcccctcaccatacacatctagccatcctg

SEQ ID NO: 162649 - DNA, 35 bp, Artificial Sequence
  Synthetic oligonucleotide
gttttgcggcccgttccatctgtcgtcgcgccttg

SEQ ID NO: 162650 - DNA, 35 bp, Artificial Sequence
  Synthetic oligonucleotide
gcctgctccccacactatgcccgtatggtccccat

SEQ ID NO: 162651 - DNA, 35 bp, Artificial Sequence
  Synthetic oligonucleotide
gttctcacccctcttacctgtgtctgccggaacct

SEQ ID NO: 162652 - DNA, 35 bp, Artificial Sequence
  Synthetic oligonucleotide
tgcaactaacgtcgatctctcatccccccgtacct

SEQ ID NO: 162653 - DNA, 35 bp, Artificial Sequence
  Synthetic oligonucleotide
ttcgcccgaccattagcttgcaaccttcatcgcct

SEQ ID NO: 162654 - DNA, 35 bp, Artificial Sequence
  Synthetic oligonucleotide
gtcacccgcctttcgtggctacacaaatatgctct

SEQ ID NO: 162655 - DNA, 35 bp, Artificial Sequence
  Synthetic oligonucleotide
gtgaggaatgggcgggtgggaggccctgtgggagt

SEQ ID NO: 162656 - DNA, 35 bp, Artificial Sequence
  Synthetic oligonucleotide
acacgtccctttgcctcgcctctgccccctctggt

SEQ ID NO: 162657 - DNA, 35 bp, Artificial Sequence
  Synthetic oligonucleotide
gtctacgacgcccttcgccccccctcagtgatatt

SEQ ID NO: 162658 - DNA, 35 bp, Artificial Sequence
  Synthetic oligonucleotide
aactccacctccgatgtatacttctgtcatttttt

SEQ ID NO: 162659 - DNA, 36 bp, Artificial Sequence
  Synthetic oligonucleotide
gcaccctccctcccgagtgttgtacccggttctaaa

SEQ ID NO: 162660 - DNA, 36 bp, Artificial Sequence
  Synthetic oligonucleotide
tctgcccctatgcttattgtttgtgtcgccccccaa

SEQ ID NO: 162661 - DNA, 36 bp, Artificial Sequence
  Synthetic oligonucleotide
gtacacggtcctgacattcctcgttctcacctgaca

SEQ ID NO: 162662 - DNA, 36 bp, Artificial Sequence
  Synthetic oligonucleotide
tcccattccgacgggcttctcgccactgcttttaca

SEQ ID NO: 162663 - DNA, 35 bp, Artificial Sequence
  Synthetic oligonucleotide
tcccctgatcgcttccttttatgcctgggtgacca

SEQ ID NO: 162664 - DNA, 35 bp, Artificial Sequence
  Synthetic oligonucleotide
agatcagccccttactctatagacgccttctccca

SEQ ID NO: 162665 - DNA, 36 bp, Artificial Sequence
  Synthetic oligonucleotide
acaccatcattcgtgcttacctatcaagtcactcca

SEQ ID NO: 162666 - DNA, 35 bp, Artificial Sequence
  Synthetic oligonucleotide
gtcaatcagcgccattttgatctccacctgctcca

SEQ ID NO: 162667 - DNA, 36 bp, Artificial Sequence
  Synthetic oligonucleotide
ttcgccttcccagttttggccctcccacacgctgca

SEQ ID NO: 162668 - DNA, 35 bp, Artificial Sequence
  Synthetic oligonucleotide
gtccgaatccacgttgtcgtcctctaccggtttca

SEQ ID NO: 162669 - DNA, 37 bp, Artificial Sequence
  Synthetic oligonucleotide
tatgcacgtctcctgcgctattctgccccttccgaga

SEQ ID NO: 162670 - DNA, 37 bp, Artificial Sequence
  Synthetic oligonucleotide
gttccatcaaacgcctgccgccgcccccaactggaga

SEQ ID NO: 162671 - DNA, 37 bp, Artificial Sequence
  Synthetic oligonucleotide
gatcgggagggtacggatagcggggagttgggtgaga

SEQ ID NO: 162672 - DNA, 37 bp, Artificial Sequence
  Synthetic oligonucleotide
tacacccacccggccgttcgcgttttcttctcgtaga

SEQ ID NO: 162673 - DNA, 36 bp, Artificial Sequence
  Synthetic oligonucleotide
gattggcgaccgcccgctctcacctcccccccacga

SEQ ID NO: 162674 - DNA, 36 bp, Artificial Sequence
  Synthetic oligonucleotide
tccactgtcctgcccggtgcttactccctttgacga

SEQ ID NO: 162675 - DNA, 36 bp, Artificial Sequence
  Synthetic oligonucleotide
atcccatcgcgtggcatcccgcccccacatacccga

SEQ ID NO: 162676 - DNA, 37 bp, Artificial Sequence
  Synthetic oligonucleotide
acgtccagcactcacctacgctacctcagcccgccga

SEQ ID NO: 162677 - DNA, 37 bp, Artificial Sequence
  Synthetic oligonucleotide
gacgccagtccccaccgtctctgctgatgcccgccga

SEQ ID NO: 162678 - DNA, 37 bp, Artificial Sequence
  Synthetic oligonucleotide
tccggtccccaccttgccccgttcattgcctctccga

SEQ ID NO: 162679 - DNA, 36 bp, Artificial Sequence
  Synthetic oligonucleotide
tcctccccgtctgtgcccccacctcccgtcgtgcga

SEQ ID NO: 162680 - DNA, 36 bp, Artificial Sequence
  Synthetic oligonucleotide
gctacatcggtcacgttttccctcccctccagcgga

SEQ ID NO: 162681 - DNA, 37 bp, Artificial Sequence
  Synthetic oligonucleotide
ttgtaccacccagacctcactcataggctccccggga

SEQ ID NO: 162682 - DNA, 37 bp, Artificial Sequence
  Synthetic oligonucleotide
gaagaaggggtaacgataaaggaagcagggaggggga

SEQ ID NO: 162683 - DNA, 37 bp, Artificial Sequence
  Synthetic oligonucleotide
gaccacccacaggagccctgccatccttcctcctgga

SEQ ID NO: 162684 - DNA, 38 bp, Artificial Sequence
  Synthetic oligonucleotide
tcccccgcctcggttctgcttccttcgctcatgtatga

SEQ ID NO: 162685 - DNA, 38 bp, Artificial Sequence
  Synthetic oligonucleotide
tgacatgccgcgccctctcacgccttccccttgcctga

SEQ ID NO: 162686 - DNA, 37 bp, Artificial Sequence
  Synthetic oligonucleotide
gtacccgccgcgcgccttctcagcacaaccctcctga

SEQ ID NO: 162687 - DNA, 38 bp, Artificial Sequence
  Synthetic oligonucleotide
atgcgcgaacgagctgctcctcttacttcctccgctga

SEQ ID NO: 162688 - DNA, 37 bp, Artificial Sequence
  Synthetic oligonucleotide
gacccgatccccgtgttatattccttccatgccgtga

SEQ ID NO: 162689 - DNA, 38 bp, Artificial Sequence
  Synthetic oligonucleotide
tccacccacactgtgatttgcgtgcttccacctcgtga

SEQ ID NO: 162690 - DNA, 37 bp, Artificial Sequence
  Synthetic oligonucleotide
atgtacaggagggcgatcgagggggaggtagaggtga

SEQ ID NO: 162691 - DNA, 38 bp, Artificial Sequence
  Synthetic oligonucleotide
atcaagaaggatagaacgaggggaagagcagatggtga

SEQ ID NO: 162692 - DNA, 37 bp, Artificial Sequence
  Synthetic oligonucleotide
tgcatcctactgcatctcctgggcctgactatcttga

SEQ ID NO: 162693 - DNA, 36 bp, Artificial Sequence
  Synthetic oligonucleotide
gagcatcatcaccgtccccccgctacaaccgtttga

SEQ ID NO: 162694 - DNA, 36 bp, Artificial Sequence
  Synthetic oligonucleotide
gtcaaccacttctctgcatgcatatcaccatttata

SEQ ID NO: 162695 - DNA, 36 bp, Artificial Sequence
  Synthetic oligonucleotide
gtttaccccgcccttgcccttttatggttataccta

SEQ ID NO: 162696 - DNA, 35 bp, Artificial Sequence
  Synthetic oligonucleotide
acacccctagcctatttgtcctgttgccattatta

SEQ ID NO: 162697 - DNA, 36 bp, Artificial Sequence
  Synthetic oligonucleotide
acctcaccctcctctcgaatagagagcatattttta

SEQ ID NO: 162698 - DNA, 35 bp, Artificial Sequence
  Synthetic oligonucleotide
gtggctcgactcccatctgcttaccgcttcaccac

SEQ ID NO: 162699 - DNA, 35 bp, Artificial Sequence
  Synthetic oligonucleotide
ggtgcgcaggttcctggtaaacttcacgcctccac

SEQ ID NO: 162700 - DNA, 35 bp, Artificial Sequence
  Synthetic oligonucleotide
gctcacccgtcctacgccttttacacccactgcac

SEQ ID NO: 162701 - DNA, 35 bp, Artificial Sequence
  Synthetic oligonucleotide
tctagctgtgcccccactccccgccttgacgtgac

SEQ ID NO: 162702 - DNA, 35 bp, Artificial Sequence
  Synthetic oligonucleotide
gagctccatccggtcgaactaagccctcactcccc

SEQ ID NO: 162703 - DNA, 35 bp, Artificial Sequence
  Synthetic oligonucleotide
ccaccacctgtccccgcctgtgacccggcttcccc

SEQ ID NO: 162704 - DNA, 35 bp, Artificial Sequence
  Synthetic oligonucleotide
tctcgcccaccccgattgctcaggtctccgctccc

SEQ ID NO: 162705 - DNA, 35 bp, Artificial Sequence
  Synthetic oligonucleotide
gtccgttccgttcccgcctgccttcatagcgtccc

SEQ ID NO: 162706 - DNA, 35 bp, Artificial Sequence
  Synthetic oligonucleotide
acccacacgcaacgcttaactacgacggttccgcc

SEQ ID NO: 162707 - DNA, 35 bp, Artificial Sequence
  Synthetic oligonucleotide
agtcactgcctatactcagaggtcaacctgctgcc

SEQ ID NO: 162708 - DNA, 35 bp, Artificial Sequence
  Synthetic oligonucleotide
acacaccgccattctctttgatccttgctgttgcc

SEQ ID NO: 162709 - DNA, 35 bp, Artificial Sequence
  Synthetic oligonucleotide
tcaggttgttcgttgcctgacccctattgttctcc

SEQ ID NO: 162710 - DNA, 35 bp, Artificial Sequence
  Synthetic oligonucleotide
agccacatcaatcagtcctgattcacaccctttcc

SEQ ID NO: 162711 - DNA, 35 bp, Artificial Sequence
  Synthetic oligonucleotide
tccgaacgccccccaccgcccattattgtgttagc

SEQ ID NO: 162712 - DNA, 35 bp, Artificial Sequence
  Synthetic oligonucleotide
gagcccactgacatcatcgcctccccgttatacgc

SEQ ID NO: 162713 - DNA, 35 bp, Artificial Sequence
  Synthetic oligonucleotide
tcatcccttcgctcgtatcgcccaatggttcatgc

SEQ ID NO: 162714 - DNA, 35 bp, Artificial Sequence
  Synthetic oligonucleotide
accccccccagtctagagtggcgtagtatccctgc

SEQ ID NO: 162715 - DNA, 35 bp, Artificial Sequence
  Synthetic oligonucleotide
gagtgacccaggtcaccgctacattgctctcctgc

SEQ ID NO: 162716 - DNA, 35 bp, Artificial Sequence
  Synthetic oligonucleotide
atcccccccggctcgatagcccctgtcacttttgc

SEQ ID NO: 162717 - DNA, 35 bp, Artificial Sequence
  Synthetic oligonucleotide
ggttgcctcatgaccgtccacatgcccatcccctc

SEQ ID NO: 162718 - DNA, 35 bp, Artificial Sequence
  Synthetic oligonucleotide
ttcgcccccgccccgtctcgagtacgctctccgtc

SEQ ID NO: 162719 - DNA, 35 bp, Artificial Sequence
  Synthetic oligonucleotide
taggcactccatgtcttacgttccctagcttcgtc

SEQ ID NO: 162720 - DNA, 35 bp, Artificial Sequence
  Synthetic oligonucleotide
tcgacagatcattagccttgtcttcccagccgttc

SEQ ID NO: 162721 - DNA, 35 bp, Artificial Sequence
  Synthetic oligonucleotide
acggggaggggggggagagggaggcatttgcggag

SEQ ID NO: 162722 - DNA, 35 bp, Artificial Sequence
  Synthetic oligonucleotide
gccctcccctcgagtatggcggtgcctacctcccg

SEQ ID NO: 162723 - DNA, 35 bp, Artificial Sequence
  Synthetic oligonucleotide
aatcccacgccgcttgaatccatgttaccgtatcg

SEQ ID NO: 162724 - DNA, 35 bp, Artificial Sequence
  Synthetic oligonucleotide
gcccgtgccttccgcctgatctttgcctactctcg

SEQ ID NO: 162725 - DNA, 35 bp, Artificial Sequence
  Synthetic oligonucleotide
tcgacacgcaggctatcacaacctcctatctgtcg

SEQ ID NO: 162726 - DNA, 35 bp, Artificial Sequence
  Synthetic oligonucleotide
agtgcggatggagcggggggtacgggaaggcttcg

SEQ ID NO: 162727 - DNA, 35 bp, Artificial Sequence
  Synthetic oligonucleotide
ttcaaccacaggtctgcctctttgtcctctctcgg

SEQ ID NO: 162728 - DNA, 35 bp, Artificial Sequence
  Synthetic oligonucleotide
ttgtgcctcggcaagcaccctatgttcaccacctg

SEQ ID NO: 162729 - DNA, 35 bp, Artificial Sequence
  Synthetic oligonucleotide
tcaattgatctgtcgcctagcccgctttccccctg

SEQ ID NO: 162730 - DNA, 35 bp, Artificial Sequence
  Synthetic oligonucleotide
actcgtcccccgtattgccgccctttcagcaagat

SEQ ID NO: 162731 - DNA, 35 bp, Artificial Sequence
  Synthetic oligonucleotide
gccaagccaccgcacggactcctgctccactctat

SEQ ID NO: 162732 - DNA, 35 bp, Artificial Sequence
  Synthetic oligonucleotide
gttgtcgacccatactgcatatcgatatcaccact

SEQ ID NO: 162733 - DNA, 35 bp, Artificial Sequence
  Synthetic oligonucleotide
agttgggggcggctagtgggtgggtttgcatacct

SEQ ID NO: 162734 - DNA, 35 bp, Artificial Sequence
  Synthetic oligonucleotide
tgagagcctcccattcagatctagtcttcccccct

SEQ ID NO: 162735 - DNA, 35 bp, Artificial Sequence
  Synthetic oligonucleotide
ttgtcacccaccatccggtgccaagttaatcccct

SEQ ID NO: 162736 - DNA, 35 bp, Artificial Sequence
  Synthetic oligonucleotide
gggaagaccgtcgcggtcgctcaccctttcttcct

SEQ ID NO: 162737 - DNA, 35 bp, Artificial Sequence
  Synthetic oligonucleotide
tgcgggagggcggggatatggaagggggaggatct

SEQ ID NO: 162738 - DNA, 35 bp, Artificial Sequence
  Synthetic oligonucleotide
agacaacgcagacccgtttctccgatattcgctct

SEQ ID NO: 162739 - DNA, 35 bp, Artificial Sequence
  Synthetic oligonucleotide
gcttccgcctcatccacgccacgctacacatctct

SEQ ID NO: 162740 - DNA, 35 bp, Artificial Sequence
  Synthetic oligonucleotide
gctcgcacttccgccccactttagccccccgtagt

SEQ ID NO: 162741 - DNA, 35 bp, Artificial Sequence
  Synthetic oligonucleotide
acttgaccgttcccatgtgcgttgttgtctgcctt

SEQ ID NO: 162742 - DNA, 35 bp, Artificial Sequence
  Synthetic oligonucleotide
actccaaccgcaacacatattacactcccatggtt

SEQ ID NO: 162743 - DNA, 35 bp, Artificial Sequence
  Synthetic oligonucleotide
gtgcctccgctaccaccgtccaccggaccgtattt

SEQ ID NO: 162744 - DNA, 35 bp, Artificial Sequence
  Synthetic oligonucleotide
tgctgccactcctcgattctcccgctccttgtgaa

SEQ ID NO: 162745 - DNA, 35 bp, Artificial Sequence
  Synthetic oligonucleotide
aactccccggcacccgccttcacgggcctcccaca

SEQ ID NO: 162746 - DNA, 36 bp, Artificial Sequence
  Synthetic oligonucleotide
tcgcgaaccgcgaccagttaaccccactgcttcaca

SEQ ID NO: 162747 - DNA, 36 bp, Artificial Sequence
  Synthetic oligonucleotide
ggaccgctctcctgtactccccccacttggttacca

SEQ ID NO: 162748 - DNA, 35 bp, Artificial Sequence
  Synthetic oligonucleotide
atctgccccagcacagctggatcccttgttgccca

SEQ ID NO: 162749 - DNA, 35 bp, Artificial Sequence
  Synthetic oligonucleotide
gttgtcaccccgtcccatagtttccggtcgctcca

SEQ ID NO: 162750 - DNA, 35 bp, Artificial Sequence
  Synthetic oligonucleotide
tcacgatgcaatgcatctttctctacactcttcca

SEQ ID NO: 162751 - DNA, 35 bp, Artificial Sequence
  Synthetic oligonucleotide
ttagtcccgcgttcaccgttctttattacaccgca

SEQ ID NO: 162752 - DNA, 36 bp, Artificial Sequence
  Synthetic oligonucleotide
gtgccgccctcaccgtcctttcacctgcatgctgca

SEQ ID NO: 162753 - DNA, 36 bp, Artificial Sequence
  Synthetic oligonucleotide
acccgatggcctccacctgtagtgctcctttgtgca

SEQ ID NO: 162754 - DNA, 36 bp, Artificial Sequence
  Synthetic oligonucleotide
tctgagacgatcgccctctacccactgtaccttgca

SEQ ID NO: 162755 - DNA, 36 bp, Artificial Sequence
  Synthetic oligonucleotide
tctatccgtcggccttggcaaacaggtctcccatca

SEQ ID NO: 162756 - DNA, 36 bp, Artificial Sequence
  Synthetic oligonucleotide
aacagcctcgtcaatcccgaacgcctcgccccttca

SEQ ID NO: 162757 - DNA, 37 bp, Artificial Sequence
  Synthetic oligonucleotide
agcgggggcctatatggaggtattggggcgggggaga

SEQ ID NO: 162758 - DNA, 34 bp, Artificial Sequence
  Synthetic oligonucleotide
atgtctcgccctctgccgtccccgaccttcacga

SEQ ID NO: 162759 - DNA, 37 bp, Artificial Sequence
  Synthetic oligonucleotide
ttcccctccggtgtaccgaccgccccgtatacgccga

SEQ ID NO: 162760 - DNA, 36 bp, Artificial Sequence
  Synthetic oligonucleotide
gggtacgccccaccttgccctgatctccgttgccga

SEQ ID NO: 162761 - DNA, 37 bp, Artificial Sequence
  Synthetic oligonucleotide
gcgagtgggaggggtgacggggctgacaggtgtgcga

SEQ ID NO: 162762 - DNA, 37 bp, Artificial Sequence
  Synthetic oligonucleotide
gtcaagcccgcccggatcgtcccaattttcgcctcga

SEQ ID NO: 162763 - DNA, 36 bp, Artificial Sequence
  Synthetic oligonucleotide
tacagcccgccgatccccttgccctggagtcctcga

SEQ ID NO: 162764 - DNA, 37 bp, Artificial Sequence
  Synthetic oligonucleotide
actccctgtcctccgttcctgtagcagtgcttgtcga

SEQ ID NO: 162765 - DNA, 37 bp, Artificial Sequence
  Synthetic oligonucleotide
gcaacgcccccccttcagatccgcgccccccatagga

SEQ ID NO: 162766 - DNA, 37 bp, Artificial Sequence
  Synthetic oligonucleotide
gagacaggcggaagggtcacgggagggggcgaaggga

SEQ ID NO: 162767 - DNA, 37 bp, Artificial Sequence
  Synthetic oligonucleotide
gggaggagcagaggggacctgatagtgaagggcggga

SEQ ID NO: 162768 - DNA, 37 bp, Artificial Sequence
  Synthetic oligonucleotide
gtggggcgtgtcggggacgctttatgtagggagggga

SEQ ID NO: 162769 - DNA, 36 bp, Artificial Sequence
  Synthetic oligonucleotide
gcgaagagggattggggaaatgggggccgaaatgga

SEQ ID NO: 162770 - DNA, 36 bp, Artificial Sequence
  Synthetic oligonucleotide
gccctgtacctcccatgtcaaatctgtccggatgga

SEQ ID NO: 162771 - DNA, 35 bp, Artificial Sequence
  Synthetic oligonucleotide
tcacatgcactatcctcgcgttacctgctccatga

SEQ ID NO: 162772 - DNA, 38 bp, Artificial Sequence
  Synthetic oligonucleotide
tgacttacgccacgtttgaacccatagcctcgccctga

SEQ ID NO: 162773 - DNA, 37 bp, Artificial Sequence
  Synthetic oligonucleotide
gtcctgtccatctgtcatactgttccttacctgctga

SEQ ID NO: 162774 - DNA, 37 bp, Artificial Sequence
  Synthetic oligonucleotide
gtatgtcgcctgtccctgttacaccactcctgcgtga

SEQ ID NO: 162775 - DNA, 38 bp, Artificial Sequence
  Synthetic oligonucleotide
gaatagtgaggagggaacggcgagtagacaggtcgtga

SEQ ID NO: 162776 - DNA, 38 bp, Artificial Sequence
  Synthetic oligonucleotide
gggtgaaggggcgaggaaggaggggatgaggtgtgtga

SEQ ID NO: 162777 - DNA, 35 bp, Artificial Sequence
  Synthetic oligonucleotide
gtaacctcgctccgccactcgcaacctctcattga

SEQ ID NO: 162778 - DNA, 38 bp, Artificial Sequence
  Synthetic oligonucleotide
gtaccgcaccgccctgtcttatctactccctaccttga

SEQ ID NO: 162779 - DNA, 38 bp, Artificial Sequence
  Synthetic oligonucleotide
gtcacgggagtatgttgggtgggtagggcgagccttga

SEQ ID NO: 162780 - DNA, 38 bp, Artificial Sequence
  Synthetic oligonucleotide
attcgacccacccactgtgtccatccaccctctgttga

SEQ ID NO: 162781 - DNA, 35 bp, Artificial Sequence
  Synthetic oligonucleotide
tcaatactacgctctgcactgttccatcttccata

SEQ ID NO: 162782 - DNA, 35 bp, Artificial Sequence
  Synthetic oligonucleotide
tccacgccccagcttaccgttaaacttcccggata

SEQ ID NO: 162783 - DNA, 36 bp, Artificial Sequence
  Synthetic oligonucleotide
cccacccggcccctgcttgttattcaacccttacta

SEQ ID NO: 162784 - DNA, 35 bp, Artificial Sequence
  Synthetic oligonucleotide
acggagggggagtaggggggtcgggctaggtggta

SEQ ID NO: 162785 - DNA, 36 bp, Artificial Sequence
  Synthetic oligonucleotide
gtccactccgttacaattattgccactacctctgta

SEQ ID NO: 162786 - DNA, 35 bp, Artificial Sequence
  Synthetic oligonucleotide
agcccctgccccaaagcccgaatccaggtacatta

SEQ ID NO: 162787 - DNA, 36 bp, Artificial Sequence
  Synthetic oligonucleotide
gttgtgccctccgattcctgtctctggtttaactta

SEQ ID NO: 162788 - DNA, 36 bp, Artificial Sequence
  Synthetic oligonucleotide
gaccccccagaccctgccgtacggcctctgccttta

SEQ ID NO: 162789 - DNA, 35 bp, Artificial Sequence
  Synthetic oligonucleotide
gggacacctctcgttcgcctgattttcgtttttta

SEQ ID NO: 162790 - DNA, 35 bp, Artificial Sequence
  Synthetic oligonucleotide
acaatgagggggagggggggatggataggtggaac

SEQ ID NO: 162791 - DNA, 35 bp, Artificial Sequence
  Synthetic oligonucleotide
gcacacccaactgccccacgcggttacacggtaac

SEQ ID NO: 162792 - DNA, 35 bp, Artificial Sequence
  Synthetic oligonucleotide
gtggccactgcctcccattgttcatccatgccgac

SEQ ID NO: 162793 - DNA, 35 bp, Artificial Sequence
  Synthetic oligonucleotide
gagagggtgggaggttactcattgctccgggggac

SEQ ID NO: 162794 - DNA, 35 bp, Artificial Sequence
  Synthetic oligonucleotide
tgccttcgcatcctttccatattaagccacgcacc

SEQ ID NO: 162795 - DNA, 35 bp, Artificial Sequence
  Synthetic oligonucleotide
ggacacggttcactgctctctttcttcgttatacc

SEQ ID NO: 162796 - DNA, 36 bp, Artificial Sequence
  Synthetic oligonucleotide
tgacagattccacgccgctttactgagtcctcaccc

SEQ ID NO: 162797 - DNA, 35 bp, Artificial Sequence
  Synthetic oligonucleotide
gtccgccgtagccaatttaacagcgcgaccgcccc

SEQ ID NO: 162798 - DNA, 35 bp, Artificial Sequence
  Synthetic oligonucleotide
acactccacattgtatccccttggttgctgccgcc

SEQ ID NO: 162799 - DNA, 35 bp, Artificial Sequence
  Synthetic oligonucleotide
acccaccctcctctccgtaaggattcgcccgatcc

SEQ ID NO: 162800 - DNA, 35 bp, Artificial Sequence
  Synthetic oligonucleotide
acatacagcacccgcaattgttccgtttcaactcc

SEQ ID NO: 162801 - DNA, 35 bp, Artificial Sequence
  Synthetic oligonucleotide
tactacgccccttggcaggtctcggttttacctcc

SEQ ID NO: 162802 - DNA, 35 bp, Artificial Sequence
  Synthetic oligonucleotide
gttcgctacagtatcattgccttagtgtgccttcc

SEQ ID NO: 162803 - DNA, 35 bp, Artificial Sequence
  Synthetic oligonucleotide
tacacgccgctgaactgtcatcgcctccccagagc

SEQ ID NO: 162804 - DNA, 35 bp, Artificial Sequence
  Synthetic oligonucleotide
tgcccaccccttgtccacatcgtatcaaccaccgc

SEQ ID NO: 162805 - DNA, 35 bp, Artificial Sequence
  Synthetic oligonucleotide
gttatccagccgtgttctccgtcgttcatacccgc

SEQ ID NO: 162806 - DNA, 35 bp, Artificial Sequence
  Synthetic oligonucleotide
gtcgcactattcgtttgcccgcctggtctccccgc

SEQ ID NO: 162807 - DNA, 35 bp, Artificial Sequence
  Synthetic oligonucleotide
agacgcccgccgtaaccgtctccttcaccatgggc

SEQ ID NO: 162808 - DNA, 35 bp, Artificial Sequence
  Synthetic oligonucleotide
tcccgcccatcccagaccttctatgacccggaatc

SEQ ID NO: 162809 - DNA, 35 bp, Artificial Sequence
  Synthetic oligonucleotide
ttccccgcaacagtgtggcgcgtgcaccccctatc

SEQ ID NO: 162810 - DNA, 35 bp, Artificial Sequence
  Synthetic oligonucleotide
acacacctttcgatgcccacaacgctcacatactc

SEQ ID NO: 162811 - DNA, 35 bp, Artificial Sequence
  Synthetic oligonucleotide
tcacagtcctatcaccccgttacctgccctggctc

SEQ ID NO: 162812 - DNA, 35 bp, Artificial Sequence
  Synthetic oligonucleotide
gcctgtcccgtgcgctgcggattagtccgcctctc

SEQ ID NO: 162813 - DNA, 35 bp, Artificial Sequence
  Synthetic oligonucleotide
acctccacccgccaactgcctgcatcttgtgagtc

SEQ ID NO: 162814 - DNA, 35 bp, Artificial Sequence
  Synthetic oligonucleotide
ggacatccgtccgcagaccacgcctcactgccgtc

SEQ ID NO: 162815 - DNA, 35 bp, Artificial Sequence
  Synthetic oligonucleotide
gtacggggtcaccgcctatgttcaccctcctcttc

SEQ ID NO: 162816 - DNA, 35 bp, Artificial Sequence
  Synthetic oligonucleotide
ggtccatccccgcgcgggcctctcgctatttcttc

SEQ ID NO: 162817 - DNA, 35 bp, Artificial Sequence
  Synthetic oligonucleotide
aacctccctgatgattctggtccccctctccgttc

SEQ ID NO: 162818 - DNA, 35 bp, Artificial Sequence
  Synthetic oligonucleotide
ttgccaagtctgcacgtcttcggtcccccttgttc

SEQ ID NO: 162819 - DNA, 35 bp, Artificial Sequence
  Synthetic oligonucleotide
gaaatagcccttctccgtcagatgctcccctaccg

SEQ ID NO: 162820 - DNA, 35 bp, Artificial Sequence
  Synthetic oligonucleotide
aacccatcgctgagccttaatggtccccccatccg

SEQ ID NO: 162821 - DNA, 35 bp, Artificial Sequence
  Synthetic oligonucleotide
tcacggccctatcacgccctctgcccaaccctgcg

SEQ ID NO: 162822 - DNA, 35 bp, Artificial Sequence
  Synthetic oligonucleotide
gggggtcgtggagggcggatcgggcgacgaagagg

SEQ ID NO: 162823 - DNA, 35 bp, Artificial Sequence
  Synthetic oligonucleotide
agcgggaagtgacagtgggggggtagattgagagg

SEQ ID NO: 162824 - DNA, 36 bp, Artificial Sequence
  Synthetic oligonucleotide
atcgacaggagtgaaacggaatgagagggtaggggg

SEQ ID NO: 162825 - DNA, 35 bp, Artificial Sequence
  Synthetic oligonucleotide
atccccacctctcgcctgctcccccgtgcaagatg

SEQ ID NO: 162826 - DNA, 35 bp, Artificial Sequence
  Synthetic oligonucleotide
aggaggggtggagcgacgggggaagatcaatgatg

SEQ ID NO: 162827 - DNA, 35 bp, Artificial Sequence
  Synthetic oligonucleotide
tcaccggtcgctcggtaaactcgccactcccactg

SEQ ID NO: 162828 - DNA, 35 bp, Artificial Sequence
  Synthetic oligonucleotide
tgacgtaagcgcaccttttgtcccatctccacaat

SEQ ID NO: 162829 - DNA, 35 bp, Artificial Sequence
  Synthetic oligonucleotide
gtaccatgcttgcccccacgtgatttacccatact

SEQ ID NO: 162830 - DNA, 35 bp, Artificial Sequence
  Synthetic oligonucleotide
acccacctccccttccagcctgtgcgtggcttact

SEQ ID NO: 162831 - DNA, 31 bp, Artificial Sequence
  Synthetic oligonucleotide
gttgcccctgagccacgcgatacacattcct

SEQ ID NO: 162832 - DNA, 35 bp, Artificial Sequence
  Synthetic oligonucleotide
ttctcggacccagccgtaccaccttgtcttcatct

SEQ ID NO: 162833 - DNA, 35 bp, Artificial Sequence
  Synthetic oligonucleotide
tcgatatcgcccaaatctgctgcgcgtcgccctct

SEQ ID NO: 162834 - DNA, 35 bp, Artificial Sequence
  Synthetic oligonucleotide
tcagcgccctggtatgccgtttgctaacttcctct

SEQ ID NO: 162835 - DNA, 35 bp, Artificial Sequence
  Synthetic oligonucleotide
ggtgaacaaatggggggtaagtgagaagggcgggt

SEQ ID NO: 162836 - DNA, 35 bp, Artificial Sequence
  Synthetic oligonucleotide
ggtgcagaagacaaggtagaagggggaggtgctgt

SEQ ID NO: 162837 - DNA, 35 bp, Artificial Sequence
  Synthetic oligonucleotide
tgtgttcacccacaaacagcggtattgctcccatt

SEQ ID NO: 162838 - DNA, 34 bp, Artificial Sequence
  Synthetic oligonucleotide
aacgcccaccatgcatgatatagtccaacctgtt

SEQ ID NO: 162839 - DNA, 35 bp, Artificial Sequence
  Synthetic oligonucleotide
aaccgctaggtctggttcgcttccgcccctttcaa

SEQ ID NO: 162840 - DNA, 36 bp, Artificial Sequence
  Synthetic oligonucleotide
tgtcgcaaagggaaggggcgaattttacggagggaa

SEQ ID NO: 162841 - DNA, 35 bp, Artificial Sequence
  Synthetic oligonucleotide
gaagcaggaaaacaaagggtttgagggaagggaca

SEQ ID NO: 162842 - DNA, 35 bp, Artificial Sequence
  Synthetic oligonucleotide
gtccacccgtgtgggaatcccatctctgtactaca

SEQ ID NO: 162843 - DNA, 36 bp, Artificial Sequence
  Synthetic oligonucleotide
tatcgcccgcccctcttctggtttttaaacattaca

SEQ ID NO: 162844 - DNA, 36 bp, Artificial Sequence
  Synthetic oligonucleotide
gttatcctcgaatcgctgtaccgtgcgccccgccca

SEQ ID NO: 162845 - DNA, 36 bp, Artificial Sequence
  Synthetic oligonucleotide
atcccaggccaatccgggataaatgccacatgccca

SEQ ID NO: 162846 - DNA, 36 bp, Artificial Sequence
  Synthetic oligonucleotide
aaccgtcgccgacatccctgctcgttagtcctccca

SEQ ID NO: 162847 - DNA, 36 bp, Artificial Sequence
  Synthetic oligonucleotide
gattggcacccggcttgtcatcccttttcgctccca

SEQ ID NO: 162848 - DNA, 33 bp, Artificial Sequence
  Synthetic oligonucleotide
tcctgacccccctcgatcgtgcaccaaacgcca

SEQ ID NO: 162849 - DNA, 36 bp, Artificial Sequence
  Synthetic oligonucleotide
gcttcgcgcgcagtctactccctttgtcacttgcca

SEQ ID NO: 162850 - DNA, 35 bp, Artificial Sequence
  Synthetic oligonucleotide
caaacgggacgtggagtgggggggggaggagggca

SEQ ID NO: 162851 - DNA, 36 bp, Artificial Sequence
  Synthetic oligonucleotide
tgaaagagggggaggtgaagggggcaagtctgccga

SEQ ID NO: 162852 - DNA, 37 bp, Artificial Sequence
  Synthetic oligonucleotide
ttcccgctcccttcaaatgccgtccattaacttccga

SEQ ID NO: 162853 - DNA, 37 bp, Artificial Sequence
  Synthetic oligonucleotide
aagaacgggccgggaggggaagtatagaccggggcga

SEQ ID NO: 162854 - DNA, 37 bp, Artificial Sequence
  Synthetic oligonucleotide
tccatcccacacgtaaacatcttagttctgtcctcga

SEQ ID NO: 162855 - DNA, 37 bp, Artificial Sequence
  Synthetic oligonucleotide
gctctgcctcctccttgccctccgttccgctgttcga

SEQ ID NO: 162856 - DNA, 37 bp, Artificial Sequence
  Synthetic oligonucleotide
ggacagagcctggacggaagggggtgagttggaagga

SEQ ID NO: 162857 - DNA, 36 bp, Artificial Sequence
  Synthetic oligonucleotide
gcgaaggacggggggtgggagctgatgaaccgagga

SEQ ID NO: 162858 - DNA, 37 bp, Artificial Sequence
  Synthetic oligonucleotide
ggttgggggaggaacggggtgaaactgacagtgagga

SEQ ID NO: 162859 - DNA, 37 bp, Artificial Sequence
  Synthetic oligonucleotide
aacggtggggtgggaagtagaatagacatgggaggga

SEQ ID NO: 162860 - DNA, 37 bp, Artificial Sequence
  Synthetic oligonucleotide
gcatgcatagccatggtggatggggcgggttacggga

SEQ ID NO: 162861 - DNA, 37 bp, Artificial Sequence
  Synthetic oligonucleotide
gtgcaagaggtaaggggagaactgagcggcatgggga

SEQ ID NO: 162862 - DNA, 36 bp, Artificial Sequence
  Synthetic oligonucleotide
aaggacacaagggggaatcggggtgagggactggga

SEQ ID NO: 162863 - DNA, 38 bp, Artificial Sequence
  Synthetic oligonucleotide
tacgacttgcagccgctttgccgcccgaaccaccatga

SEQ ID NO: 162864 - DNA, 38 bp, Artificial Sequence
  Synthetic oligonucleotide
gcgccgggccgctgcgatacaactaccatcatccctga

SEQ ID NO: 162865 - DNA, 38 bp, Artificial Sequence
  Synthetic oligonucleotide
gtcataccatcagcgtagtttgccgcccgccctcctga

SEQ ID NO: 162866 - DNA, 36 bp, Artificial Sequence
  Synthetic oligonucleotide
ttgcctacccgccttacattttgaccataacgctga

SEQ ID NO: 162867 - DNA, 38 bp, Artificial Sequence
  Synthetic oligonucleotide
acccgccgcaccacaaatccgtattcctgtcccgctga

SEQ ID NO: 162868 - DNA, 37 bp, Artificial Sequence
  Synthetic oligonucleotide
gagttgggaagggcggtgggggtgttacgcggcgtga

SEQ ID NO: 162869 - DNA, 37 bp, Artificial Sequence
  Synthetic oligonucleotide
aatgccctgccttccgccctccttcacccgccggtga

SEQ ID NO: 162870 - DNA, 38 bp, Artificial Sequence
  Synthetic oligonucleotide
tcacgaacccgccttcacctcgacggtcattcatgtga

SEQ ID NO: 162871 - DNA, 38 bp, Artificial Sequence
  Synthetic oligonucleotide
tgagagagaggaagggaaggatacggttgtaggattga

SEQ ID NO: 162872 - DNA, 37 bp, Artificial Sequence
  Synthetic oligonucleotide
tgagctccggaacagttttattctccaccgcccttga

SEQ ID NO: 162873 - DNA, 36 bp, Artificial Sequence
  Synthetic oligonucleotide
atcctccacccttctgaccgacgatccatatggata

SEQ ID NO: 162874 - DNA, 35 bp, Artificial Sequence
  Synthetic oligonucleotide
tcacctgctgatccctcgtttttccccccagccta

SEQ ID NO: 162875 - DNA, 36 bp, Artificial Sequence
  Synthetic oligonucleotide
gtcacatccttgcgtaataccctgtactcttactta

SEQ ID NO: 162876 - DNA, 36 bp, Artificial Sequence
  Synthetic oligonucleotide
gtcccgctacgtggcccatgaccctaccattcgtta

SEQ ID NO: 162877 - DNA, 35 bp, Artificial Sequence
  Synthetic oligonucleotide
acctgtccccgttcctgtagtgtacgcttaaccac

SEQ ID NO: 162878 - DNA, 35 bp, Artificial Sequence
  Synthetic oligonucleotide
tgcgctctcgctacaccatctccccggcctggcac

SEQ ID NO: 162879 - DNA, 35 bp, Artificial Sequence
  Synthetic oligonucleotide
gacctcggccctgcctgtatcatcctcgaagtcac

SEQ ID NO: 162880 - DNA, 35 bp, Artificial Sequence
  Synthetic oligonucleotide
acttcgaacggccacatatcctctgcccggtaccc

SEQ ID NO: 162881 - DNA, 35 bp, Artificial Sequence
  Synthetic oligonucleotide
aggagccacaagccacctaaggtccattcctcccc

SEQ ID NO: 162882 - DNA, 35 bp, Artificial Sequence
  Synthetic oligonucleotide
gcaccggtctggcccgcttgagctttttctctccc

SEQ ID NO: 162883 - DNA, 35 bp, Artificial Sequence
  Synthetic oligonucleotide
gtagcctctacacggctccgtactcctttaccgcc

SEQ ID NO: 162884 - DNA, 35 bp, Artificial Sequence
  Synthetic oligonucleotide
gttgccccctttaagcctgccaccttcaccgcgcc

SEQ ID NO: 162885 - DNA, 35 bp, Artificial Sequence
  Synthetic oligonucleotide
tcacagtcgccgccctgatccattcacccttgtcc

SEQ ID NO: 162886 - DNA, 35 bp, Artificial Sequence
  Synthetic oligonucleotide
gacgtaccgtccagattccatcgcccttacaacgc

SEQ ID NO: 162887 - DNA, 35 bp, Artificial Sequence
  Synthetic oligonucleotide
tgtgacgacaccaggtactaccccacgccttccgc

SEQ ID NO: 162888 - DNA, 35 bp, Artificial Sequence
  Synthetic oligonucleotide
tagcgagagtagggggtaggggggggacgttgcgc

SEQ ID NO: 162889 - DNA, 35 bp, Artificial Sequence
  Synthetic oligonucleotide
acagatgctgcccttcggtcccctttcgcgatcgc

SEQ ID NO: 162890 - DNA, 35 bp, Artificial Sequence
  Synthetic oligonucleotide
cccatcgcacctcacatcggtttcttcttcactgc

SEQ ID NO: 162891 - DNA, 35 bp, Artificial Sequence
  Synthetic oligonucleotide
atccgccctgttcgttcgttccatgaactgaaatc

SEQ ID NO: 162892 - DNA, 35 bp, Artificial Sequence
  Synthetic oligonucleotide
gtgtcaccccgcacccacccggagggtcccaactc

SEQ ID NO: 162893 - DNA, 34 bp, Artificial Sequence
  Synthetic oligonucleotide
gctgcactcagatctatatctccccgtacccgtc

SEQ ID NO: 162894 - DNA, 35 bp, Artificial Sequence
  Synthetic oligonucleotide
accgctgcctaaggtcctgatcatgcatccccgtc

SEQ ID NO: 162895 - DNA, 35 bp, Artificial Sequence
  Synthetic oligonucleotide
gccaacagacccctcctattgagccaatacctgtc

SEQ ID NO: 162896 - DNA, 35 bp, Artificial Sequence
  Synthetic oligonucleotide
tttgccgtccccgaatacatcctcgtgccatcacg

SEQ ID NO: 162897 - DNA, 35 bp, Artificial Sequence
  Synthetic oligonucleotide
tccccacaacacattctgctctatgcctccctccg

SEQ ID NO: 162898 - DNA, 35 bp, Artificial Sequence
  Synthetic oligonucleotide
atccgacctgctgcatctgcgtcaaacaccctgcg

SEQ ID NO: 162899 - DNA, 36 bp, Artificial Sequence
  Synthetic oligonucleotide
agtgagaaggatcgaaaaggggctgaagagaaacgg

SEQ ID NO: 162900 - DNA, 35 bp, Artificial Sequence
  Synthetic oligonucleotide
tcaccactcagcacctcttcccctcaacgcgcggg

SEQ ID NO: 162901 - DNA, 35 bp, Artificial Sequence
  Synthetic oligonucleotide
gccccacacgccgctatactcgctttcctcattgg

SEQ ID NO: 162902 - DNA, 35 bp, Artificial Sequence
  Synthetic oligonucleotide
tgagtccacgcctcttgttttatcctattgcttgg

SEQ ID NO: 162903 - DNA, 35 bp, Artificial Sequence
  Synthetic oligonucleotide
gtgccccacccgccgctttaacaaattgaacaatg

SEQ ID NO: 162904 - DNA, 35 bp, Artificial Sequence
  Synthetic oligonucleotide
cccgaacgtcaccttctgtctctgggttctttctg

SEQ ID NO: 162905 - DNA, 35 bp, Artificial Sequence
  Synthetic oligonucleotide
cacgcctgaccttcccgttcgtttcccggtcgact

SEQ ID NO: 162906 - DNA, 35 bp, Artificial Sequence
  Synthetic oligonucleotide
tcccggaccatcggccaattcgccccatccttact

SEQ ID NO: 162907 - DNA, 35 bp, Artificial Sequence
  Synthetic oligonucleotide
gtcccgtgcctgcagtgctcccggccttaatatct

SEQ ID NO: 162908 - DNA, 34 bp, Artificial Sequence
  Synthetic oligonucleotide
agcatcccgccgctcgctcgtaagaccctgcagt

SEQ ID NO: 162909 - DNA, 36 bp, Artificial Sequence
  Synthetic oligonucleotide
agaccccgcccgtattaccaccacgatacaccccgt

SEQ ID NO: 162910 - DNA, 35 bp, Artificial Sequence
  Synthetic oligonucleotide
tgtccctttccgccccccccgtgcacaaccgtcgt

SEQ ID NO: 162911 - DNA, 35 bp, Artificial Sequence
  Synthetic oligonucleotide
gtaaccggccacttttgccatcccagacatcatgt

SEQ ID NO: 162912 - DNA, 35 bp, Artificial Sequence
  Synthetic oligonucleotide
ggctgtcccacgcgctatatactgcccacccttgt

SEQ ID NO: 162913 - DNA, 35 bp, Artificial Sequence
  Synthetic oligonucleotide
gtccccgccgacccccaaagctatatcgctatatt

SEQ ID NO: 162914 - DNA, 35 bp, Artificial Sequence
  Synthetic oligonucleotide
ggtacgcactctacccggaatcgcccgcccctgtt

SEQ ID NO: 162915 - DNA, 35 bp, Artificial Sequence
  Synthetic oligonucleotide
gagcggaggcgcagcgggagggggtggtgcgtgtt

SEQ ID NO: 162916 - DNA, 35 bp, Artificial Sequence
  Synthetic oligonucleotide
accgtggaccgcccctcaatatcacgcacaccttt

SEQ ID NO: 162917 - DNA, 35 bp, Artificial Sequence
  Synthetic oligonucleotide
accccccgcaatcggtatcccgtctccccgcagaa

SEQ ID NO: 162918 - DNA, 35 bp, Artificial Sequence
  Synthetic oligonucleotide
ggggtagagctgcaggggcatactaggggcgggaa

SEQ ID NO: 162919 - DNA, 35 bp, Artificial Sequence
  Synthetic oligonucleotide
tccctcccctcggactttttttttgtgactaaaca

SEQ ID NO: 162920 - DNA, 35 bp, Artificial Sequence
  Synthetic oligonucleotide
ttgacccgcctcctgtcttcgaacgcctccttaca

SEQ ID NO: 162921 - DNA, 36 bp, Artificial Sequence
  Synthetic oligonucleotide
gcctcctacatcgtatacccgcgtctctcacgccca

SEQ ID NO: 162922 - DNA, 36 bp, Artificial Sequence
  Synthetic oligonucleotide
tcccgcacatccggcatcagccactcccgttgccca

SEQ ID NO: 162923 - DNA, 35 bp, Artificial Sequence
  Synthetic oligonucleotide
gaagcccacattatacaagcgttcctgcactccca

SEQ ID NO: 162924 - DNA, 36 bp, Artificial Sequence
  Synthetic oligonucleotide
tcagcatgtgcccgccgtatactcacccacttccca

SEQ ID NO: 162925 - DNA, 36 bp, Artificial Sequence
  Synthetic oligonucleotide
gcgctatgctactcgccacccgtatcgttccatgca

SEQ ID NO: 162926 - DNA, 37 bp, Artificial Sequence
  Synthetic oligonucleotide
aaatgaaccgcgaagggtagaaggggaggaaatcaga

SEQ ID NO: 162927 - DNA, 37 bp, Artificial Sequence
  Synthetic oligonucleotide
gagtggggaaaggagttactagccgaggaggaggaga

SEQ ID NO: 162928 - DNA, 37 bp, Artificial Sequence
  Synthetic oligonucleotide
atgcccgcccgccctgttatgatctccgggttaacga

SEQ ID NO: 162929 - DNA, 37 bp, Artificial Sequence
  Synthetic oligonucleotide
tcagtaggccgtctactgagccatcatcctcccccga

SEQ ID NO: 162930 - DNA, 37 bp, Artificial Sequence
  Synthetic oligonucleotide
gcctaagcaggcctatttcaccttccccgttgttcga

SEQ ID NO: 162931 - DNA, 37 bp, Artificial Sequence
  Synthetic oligonucleotide
taggggatcgtgacgcgcggtggagggggtaggagga

SEQ ID NO: 162932 - DNA, 35 bp, Artificial Sequence
  Synthetic oligonucleotide
agaagaagggacaagtggtgggctagttggtagga

SEQ ID NO: 162933 - DNA, 37 bp, Artificial Sequence
  Synthetic oligonucleotide
taatggggaaagggggtggagggcgacgtctttagga

SEQ ID NO: 162934 - DNA, 37 bp, Artificial Sequence
  Synthetic oligonucleotide
gcacgagagggaggcgacgaaaagaaggaaggccgga

SEQ ID NO: 162935 - DNA, 37 bp, Artificial Sequence
  Synthetic oligonucleotide
gggaaagagggaaggggtgttggtacggttcggtgga

SEQ ID NO: 162936 - DNA, 37 bp, Artificial Sequence
  Synthetic oligonucleotide
gcgaggggaggagtaatgatggcgggggaaggaatga

SEQ ID NO: 162937 - DNA, 38 bp, Artificial Sequence
  Synthetic oligonucleotide
ttggaacccgccaactcgctttcttgtactgtacctga

SEQ ID NO: 162938 - DNA, 37 bp, Artificial Sequence
  Synthetic oligonucleotide
gcgccccaaccgtttatgcgcgtgttatccctcctga

SEQ ID NO: 162939 - DNA, 37 bp, Artificial Sequence
  Synthetic oligonucleotide
gaaggggcgggcgtaatgcggggtggcggggtagtga

SEQ ID NO: 162940 - DNA, 37 bp, Artificial Sequence
  Synthetic oligonucleotide
gtgcgcaagattctttgccatcccccgtactccgtga

SEQ ID NO: 162941 - DNA, 36 bp, Artificial Sequence
  Synthetic oligonucleotide
gtacgtaccctctgctctccagttcacccttcgtga

SEQ ID NO: 162942 - DNA, 36 bp, Artificial Sequence
  Synthetic oligonucleotide
gtcacccttccctgctccactggtggcattacttta

SEQ ID NO: 162943 - DNA, 35 bp, Artificial Sequence
  Synthetic oligonucleotide
gcctccgccacactccatgctggagattttccaac

SEQ ID NO: 162944 - DNA, 35 bp, Artificial Sequence
  Synthetic oligonucleotide
gaactcacccgccacttgcccttaagccttttgac

SEQ ID NO: 162945 - DNA, 35 bp, Artificial Sequence
  Synthetic oligonucleotide
acgaggtcagaatgctccgtccccggcccccatac

SEQ ID NO: 162946 - DNA, 35 bp, Artificial Sequence
  Synthetic oligonucleotide
gatgtgtgctcgctgcctaaaaaccccactcctac

SEQ ID NO: 162947 - DNA, 35 bp, Artificial Sequence
  Synthetic oligonucleotide
tccatccgcaatatgttccaagctcccttcccacc

SEQ ID NO: 162948 - DNA, 35 bp, Artificial Sequence
  Synthetic oligonucleotide
taccgcccatacctagactgcccctgacggccacc

SEQ ID NO: 162949 - DNA, 35 bp, Artificial Sequence
  Synthetic oligonucleotide
tcaacaagcgcggtgcctccgtcgcccatatcacc

SEQ ID NO: 162950 - DNA, 35 bp, Artificial Sequence
  Synthetic oligonucleotide
tactatgtccctctttatggaaccgcggtactacc

SEQ ID NO: 162951 - DNA, 35 bp, Artificial Sequence
  Synthetic oligonucleotide
tagtccaacaaggttgtgacggccatatactcccc

SEQ ID NO: 162952 - DNA, 35 bp, Artificial Sequence
  Synthetic oligonucleotide
agcctacatctgcagtattcacaccatcacggccc

SEQ ID NO: 162953 - DNA, 35 bp, Artificial Sequence
  Synthetic oligonucleotide
cacgtcatacccctctgccggtcgtactacctccc

SEQ ID NO: 162954 - DNA, 33 bp, Artificial Sequence
  Synthetic oligonucleotide
tacacagcctccacactaatcgactcagccgcc

SEQ ID NO: 162955 - DNA, 35 bp, Artificial Sequence
  Synthetic oligonucleotide
tgtgctgatgtccaagttgctccgtgcctgctgcc

SEQ ID NO: 162956 - DNA, 35 bp, Artificial Sequence
  Synthetic oligonucleotide
aatactccgcgcctcgcaggtcctccgctgactcc

SEQ ID NO: 162957 - DNA, 35 bp, Artificial Sequence
  Synthetic oligonucleotide
gtccgcacccctcacactgtctaattagctattcc

SEQ ID NO: 162958 - DNA, 35 bp, Artificial Sequence
  Synthetic oligonucleotide
acatgtcgttttgctgaacgcgtcaccccacttcc

SEQ ID NO: 162959 - DNA, 35 bp, Artificial Sequence
  Synthetic oligonucleotide
actggcccagctcaacgcgagtctttcaaccttcc

SEQ ID NO: 162960 - DNA, 35 bp, Artificial Sequence
  Synthetic oligonucleotide
gaccgcacggctgggtgtgggtgggagggctacgc

SEQ ID NO: 162961 - DNA, 35 bp, Artificial Sequence
  Synthetic oligonucleotide
tatgccctgccctaatcctatgtcttcccgcccgc

SEQ ID NO: 162962 - DNA, 35 bp, Artificial Sequence
  Synthetic oligonucleotide
actgtccggctttaatgcagtttcctccgctcatc

SEQ ID NO: 162963 - DNA, 35 bp, Artificial Sequence
  Synthetic oligonucleotide
acagccacacatgctaccatcgcctcccgcctatc

SEQ ID NO: 162964 - DNA, 35 bp, Artificial Sequence
  Synthetic oligonucleotide
tctccctcccgcttcagccgctgttcgggcctatc

SEQ ID NO: 162965 - DNA, 35 bp, Artificial Sequence
  Synthetic oligonucleotide
ataggccataccgtccattcccctccgaccgcctc

SEQ ID NO: 162966 - DNA, 34 bp, Artificial Sequence
  Synthetic oligonucleotide
gttgattcgccgctcgcttccttctaacccggtc

SEQ ID NO: 162967 - DNA, 35 bp, Artificial Sequence
  Synthetic oligonucleotide
tactacgatcgccgctggaaccccctaaccttgtc

SEQ ID NO: 162968 - DNA, 35 bp, Artificial Sequence
  Synthetic oligonucleotide
acttgcgcccacctcatactgctctcgggcttttc

SEQ ID NO: 162969 - DNA, 34 bp, Artificial Sequence
  Synthetic oligonucleotide
gtctacccgatccgtcactatttccactgtaccg

SEQ ID NO: 162970 - DNA, 35 bp, Artificial Sequence
  Synthetic oligonucleotide
gttgcacccccaacctatgctgcatcaaactctcg

SEQ ID NO: 162971 - DNA, 35 bp, Artificial Sequence
  Synthetic oligonucleotide
tacaagtggtgaccagggggggaagtcaaaggggg

SEQ ID NO: 162972 - DNA, 35 bp, Artificial Sequence
  Synthetic oligonucleotide
tacgccagtatcacccagttgtatcaccctacctg

SEQ ID NO: 162973 - DNA, 35 bp, Artificial Sequence
  Synthetic oligonucleotide
atcaatgggacgggcgatgggagggaacgtgagtg

SEQ ID NO: 162974 - DNA, 35 bp, Artificial Sequence
  Synthetic oligonucleotide
atcccatctctctgccttagtattccgccaccgtg

SEQ ID NO: 162975 - DNA, 35 bp, Artificial Sequence
  Synthetic oligonucleotide
gcccatcctctgctttcgtcccctttcactctgtg

SEQ ID NO: 162976 - DNA, 35 bp, Artificial Sequence
  Synthetic oligonucleotide
ttcgtgccccccctctgaaacttatatcctcgcat

SEQ ID NO: 162977 - DNA, 35 bp, Artificial Sequence
  Synthetic oligonucleotide
gccacgtgaccttgcccttgcgtattcccctctat

SEQ ID NO: 162978 - DNA, 35 bp, Artificial Sequence
  Synthetic oligonucleotide
accctccagcatgatctcgttaatattcgccccct

SEQ ID NO: 162979 - DNA, 26 bp, Artificial Sequence
  Synthetic oligonucleotide
gaccccccaacctgcctagctggcct

SEQ ID NO: 162980 - DNA, 35 bp, Artificial Sequence
  Synthetic oligonucleotide
gtaccgcctccgagacaacgactcacgaactctct

SEQ ID NO: 162981 - DNA, 35 bp, Artificial Sequence
  Synthetic oligonucleotide
gacacacgccctgtgtatcactcctatgtttctct

SEQ ID NO: 162982 - DNA, 35 bp, Artificial Sequence
  Synthetic oligonucleotide
gcctcctgccccccagcccttggcccgacgtcctt

SEQ ID NO: 162983 - DNA, 35 bp, Artificial Sequence
  Synthetic oligonucleotide
tcacactcatgccctctcctgtgaacaacggattt

SEQ ID NO: 162984 - DNA, 35 bp, Artificial Sequence
  Synthetic oligonucleotide
agacgtccccgtatggcctccctttcaacaccttt

SEQ ID NO: 162985 - DNA, 36 bp, Artificial Sequence
  Synthetic oligonucleotide
gatagaggaggggcaagtggttgcaggcgggtaaaa

SEQ ID NO: 162986 - DNA, 36 bp, Artificial Sequence
  Synthetic oligonucleotide
tcactgctcctccgctttctattcccatgcaggcaa

SEQ ID NO: 162987 - DNA, 35 bp, Artificial Sequence
  Synthetic oligonucleotide
acataggtgaagaggggagcaacaacacggacgaa

SEQ ID NO: 162988 - DNA, 35 bp, Artificial Sequence
  Synthetic oligonucleotide
tattcgacaccgcatccccgccgctctcctgggaa

SEQ ID NO: 162989 - DNA, 36 bp, Artificial Sequence
  Synthetic oligonucleotide
ttcccatcctccccgtacttttaacagttagtggaa

SEQ ID NO: 162990 - DNA, 35 bp, Artificial Sequence
  Synthetic oligonucleotide
gacaacaatcttgtatctgccctgttcgtaccaca

SEQ ID NO: 162991 - DNA, 35 bp, Artificial Sequence
  Synthetic oligonucleotide
gccccccgccactaattgcgccgcttatcaaacca

SEQ ID NO: 162992 - DNA, 36 bp, Artificial Sequence
  Synthetic oligonucleotide
atcaccgaggtttgcgttatgcaccatctccgccca

SEQ ID NO: 162993 - DNA, 35 bp, Artificial Sequence
  Synthetic oligonucleotide
gatgcccgagccatgactccccgaaaacgcctcca

SEQ ID NO: 162994 - DNA, 35 bp, Artificial Sequence
  Synthetic oligonucleotide
tcaagcaactccctgcccctttctgttccatcgca

SEQ ID NO: 162995 - DNA, 35 bp, Artificial Sequence
  Synthetic oligonucleotide
gaaaccgctgatcatcttcctcccacgtccctgca

SEQ ID NO: 162996 - DNA, 36 bp, Artificial Sequence
  Synthetic oligonucleotide
gtccaccgccctatcgcactttcctgaagaggatca

SEQ ID NO: 162997 - DNA, 36 bp, Artificial Sequence
  Synthetic oligonucleotide
atcaccccatccgctcattgggcattcttcgcttca

SEQ ID NO: 162998 - DNA, 37 bp, Artificial Sequence
  Synthetic oligonucleotide
gtagcgggaaggcggggggagctggagctaacgcaga

SEQ ID NO: 162999 - DNA, 37 bp, Artificial Sequence
  Synthetic oligonucleotide
cccacatcacactgcccttagcctcgttcacacacga

SEQ ID NO: 163000 - DNA, 37 bp, Artificial Sequence
  Synthetic oligonucleotide
acacaccctcttgctgttttgcctttgccgcaagcga

SEQ ID NO: 163001 - DNA, 37 bp, Artificial Sequence
  Synthetic oligonucleotide
gtggtgggggggcgggatataatggaagagatggcga

SEQ ID NO: 163002 - DNA, 34 bp, Artificial Sequence
  Synthetic oligonucleotide
tcgagcttcctgttctgccctccccactatgcga

SEQ ID NO: 163003 - DNA, 37 bp, Artificial Sequence
  Synthetic oligonucleotide
acgtgttgccgtatctgccctgtgccctcttttgcga

SEQ ID NO: 163004 - DNA, 35 bp, Artificial Sequence
  Synthetic oligonucleotide
gccccctcctaagccctcgtaactcgtagtatcga

SEQ ID NO: 163005 - DNA, 37 bp, Artificial Sequence
  Synthetic oligonucleotide
gcccccactcccgcccctgtgaggcccgttctctcga

SEQ ID NO: 163006 - DNA, 37 bp, Artificial Sequence
  Synthetic oligonucleotide
tcaatgccccggcaatgtctgtccttcgcccgttcga

SEQ ID NO: 163007 - DNA, 37 bp, Artificial Sequence
  Synthetic oligonucleotide
tcaccccggtgatggccctcccctgttctcatttcga

SEQ ID NO: 163008 - DNA, 36 bp, Artificial Sequence
  Synthetic oligonucleotide
gggggggggagggcgggcttggtaagcaagggagga

SEQ ID NO: 163009 - DNA, 37 bp, Artificial Sequence
  Synthetic oligonucleotide
gctacgctgcccctcgcctcaacaacaacctgccgga

SEQ ID NO: 163010 - DNA, 37 bp, Artificial Sequence
  Synthetic oligonucleotide
aaatggcgggaatggaagggtgtgcgggggttcggga

SEQ ID NO: 163011 - DNA, 37 bp, Artificial Sequence
  Synthetic oligonucleotide
ggaaccgggaggggttcgaaaggttcaacggggggga

SEQ ID NO: 163012 - DNA, 37 bp, Artificial Sequence
  Synthetic oligonucleotide
tgtctccctcatggcaccccttctgcacagtctggga

SEQ ID NO: 163013 - DNA, 37 bp, Artificial Sequence
  Synthetic oligonucleotide
gaggtggtgaaggtggaaattaaagtagttgggtgga

SEQ ID NO: 163014 - DNA, 36 bp, Artificial Sequence
  Synthetic oligonucleotide
gaacgctatccgccgcccgtttcgtgccttacatga

SEQ ID NO: 163015 - DNA, 38 bp, Artificial Sequence
  Synthetic oligonucleotide
aacctccgccttcccgtcccgcgttgtacactccatga

SEQ ID NO: 163016 - DNA, 38 bp, Artificial Sequence
  Synthetic oligonucleotide
gtgccaccctctgtccgcttgtgaacgcgttttcctga

SEQ ID NO: 163017 - DNA, 38 bp, Artificial Sequence
  Synthetic oligonucleotide
taactgccgccatttcctatctacgccccacgcgctga

SEQ ID NO: 163018 - DNA, 38 bp, Artificial Sequence
  Synthetic oligonucleotide
aaccccgcccacccctgagctgaaatccagatctctga

SEQ ID NO: 163019 - DNA, 37 bp, Artificial Sequence
  Synthetic oligonucleotide
gtggagggggcaggggggtaggggtgtggctccgtga

SEQ ID NO: 163020 - DNA, 37 bp, Artificial Sequence
  Synthetic oligonucleotide
aacatgtgcaggcgagaggaggggcggcggtatgtga

SEQ ID NO: 163021 - DNA, 38 bp, Artificial Sequence
  Synthetic oligonucleotide
tcagaatgtcacttggcccctcgctcgcccctgcttga

SEQ ID NO: 163022 - DNA, 36 bp, Artificial Sequence
  Synthetic oligonucleotide
gtaccagcctcaaccccctgacttcctgtggccata

SEQ ID NO: 163023 - DNA, 35 bp, Artificial Sequence
  Synthetic oligonucleotide
ttctagccgccccgcttgccgcttcatcgcatcta

SEQ ID NO: 163024 - DNA, 36 bp, Artificial Sequence
  Synthetic oligonucleotide
tgtccactccgcctctgccgccgcacagtagttcta

SEQ ID NO: 163025 - DNA, 36 bp, Artificial Sequence
  Synthetic oligonucleotide
tgggccccccgcctacgatgtgatcccgccgccgta

SEQ ID NO: 163026 - DNA, 37 bp, Artificial Sequence
  Synthetic oligonucleotide
gacccgccgccacatgcctcctacccctccgagcgta

SEQ ID NO: 163027 - DNA, 35 bp, Artificial Sequence
  Synthetic oligonucleotide
tcacaaatcgaatgaagggggggagggagacgaac

SEQ ID NO: 163028 - DNA, 35 bp, Artificial Sequence
  Synthetic oligonucleotide
gcacattgccacatgggcccagctttaaattccac

SEQ ID NO: 163029 - DNA, 34 bp, Artificial Sequence
  Synthetic oligonucleotide
gcccctcctgtcccaatggaaccgtcctgctgac

SEQ ID NO: 163030 - DNA, 35 bp, Artificial Sequence
  Synthetic oligonucleotide
gccgctcgtacatattctggaatcccccgccatac

SEQ ID NO: 163031 - DNA, 35 bp, Artificial Sequence
  Synthetic oligonucleotide
tcgcacgcaccttactgtactcatgctgctcgtac

SEQ ID NO: 163032 - DNA, 35 bp, Artificial Sequence
  Synthetic oligonucleotide
actacgccccctcactgcggataccccgatcttac

SEQ ID NO: 163033 - DNA, 35 bp, Artificial Sequence
  Synthetic oligonucleotide
acccgacttctaccgacgtttcgttttgatacccc

SEQ ID NO: 163034 - DNA, 35 bp, Artificial Sequence
  Synthetic oligonucleotide
tcgcgaccgtgaagcgaaccatacagtagcccccc

SEQ ID NO: 163035 - DNA, 35 bp, Artificial Sequence
  Synthetic oligonucleotide
ggcgccctccgccgtttgttcatagcgcatccccc

SEQ ID NO: 163036 - DNA, 35 bp, Artificial Sequence
  Synthetic oligonucleotide
taatgcaccttccgccagaccgtcatctagtcgcc

SEQ ID NO: 163037 - DNA, 35 bp, Artificial Sequence
  Synthetic oligonucleotide
ggtgtatcgcttatcttcttccgtccgggccctcc

SEQ ID NO: 163038 - DNA, 35 bp, Artificial Sequence
  Synthetic oligonucleotide
gccgcctgggtcacgaaagtccctactgtccttcc

SEQ ID NO: 163039 - DNA, 35 bp, Artificial Sequence
  Synthetic oligonucleotide
atcactcggatcctcgtctcgcgactactctttcc

SEQ ID NO: 163040 - DNA, 35 bp, Artificial Sequence
  Synthetic oligonucleotide
gctgacattgggtcatcgcgccttcgaaccatcgc

SEQ ID NO: 163041 - DNA, 35 bp, Artificial Sequence
  Synthetic oligonucleotide
attgacaccggaactgctttcgctctaccacatgc

SEQ ID NO: 163042 - DNA, 35 bp, Artificial Sequence
  Synthetic oligonucleotide
accaccatggtttctcttcgaccccgtttacatgc

SEQ ID NO: 163043 - DNA, 35 bp, Artificial Sequence
  Synthetic oligonucleotide
atgcctctccgtcgtttccgtcccatccgctatgc

SEQ ID NO: 163044 - DNA, 35 bp, Artificial Sequence
  Synthetic oligonucleotide
gtcccgtcccgctgccaccgctcgtctcgccttgc

SEQ ID NO: 163045 - DNA, 35 bp, Artificial Sequence
  Synthetic oligonucleotide
aacgcgcacccctccccgtacaccttccgtatatc

SEQ ID NO: 163046 - DNA, 35 bp, Artificial Sequence
  Synthetic oligonucleotide
atcaccggtctcgctcgtccctaacctccgacctc

SEQ ID NO: 163047 - DNA, 35 bp, Artificial Sequence
  Synthetic oligonucleotide
gcgacacgtgtcattcccccggccacctctgcctc

SEQ ID NO: 163048 - DNA, 35 bp, Artificial Sequence
  Synthetic oligonucleotide
tgtccagcctcttcctgttctcttgcccaacgctc

SEQ ID NO: 163049 - DNA, 35 bp, Artificial Sequence
  Synthetic oligonucleotide
accacgcccacttatgttccctggtcccctgtctc

SEQ ID NO: 163050 - DNA, 35 bp, Artificial Sequence
  Synthetic oligonucleotide
attgtcacactccgctcgcagccgcctcctacacg

SEQ ID NO: 163051 - DNA, 35 bp, Artificial Sequence
  Synthetic oligonucleotide
gccgcccccggacgggcctacccctgcctttgacg

SEQ ID NO: 163052 - DNA, 35 bp, Artificial Sequence
  Synthetic oligonucleotide
accatcaccgcgtatgtaatctatttttgcctccg

SEQ ID NO: 163053 - DNA, 35 bp, Artificial Sequence
  Synthetic oligonucleotide
ggaccgtgagggcagtgggggcaagggtgagagcg

SEQ ID NO: 163054 - DNA, 35 bp, Artificial Sequence
  Synthetic oligonucleotide
atcctacgctccccattgtttgccatttaatctcg

SEQ ID NO: 163055 - DNA, 35 bp, Artificial Sequence
  Synthetic oligonucleotide
tacgcaggggggccgggtggggcggtttgaagggg

SEQ ID NO: 163056 - DNA, 35 bp, Artificial Sequence
  Synthetic oligonucleotide
gactcctttcaggtcccatcgccccactattcatg

SEQ ID NO: 163057 - DNA, 35 bp, Artificial Sequence
  Synthetic oligonucleotide
atacgtctagccctccgtgttacgtctcctctctg

SEQ ID NO: 163058 - DNA, 35 bp, Artificial Sequence
  Synthetic oligonucleotide
atgtctccaccagccctgtttccagtttttccttg

SEQ ID NO: 163059 - DNA, 35 bp, Artificial Sequence
  Synthetic oligonucleotide
agcctgggcagggtggggagggtcgacgggataat

SEQ ID NO: 163060 - DNA, 35 bp, Artificial Sequence
  Synthetic oligonucleotide
gatccagggagagagggggagggagtcggcgacat

SEQ ID NO: 163061 - DNA, 35 bp, Artificial Sequence
  Synthetic oligonucleotide
tccctgccacatcgcacgtctgtagctctctacat

SEQ ID NO: 163062 - DNA, 35 bp, Artificial Sequence
  Synthetic oligonucleotide
gggacagcctggttccgtgcgccccatcttttact

SEQ ID NO: 163063 - DNA, 35 bp, Artificial Sequence
  Synthetic oligonucleotide
tgtgcccggacgtccagcccctttacgcttaccct

SEQ ID NO: 163064 - DNA, 35 bp, Artificial Sequence
  Synthetic oligonucleotide
acgctgtacctgccacctagcgtcgccattcccct

SEQ ID NO: 163065 - DNA, 35 bp, Artificial Sequence
  Synthetic oligonucleotide
aatggtccgctcgtcagctcatgcccggtcgccct

SEQ ID NO: 163066 - DNA, 35 bp, Artificial Sequence
  Synthetic oligonucleotide
gttgtgccacacatcttttgcttccttattcgcct

SEQ ID NO: 163067 - DNA, 35 bp, Artificial Sequence
  Synthetic oligonucleotide
accccggatcggcggccagctattatcctccctct

SEQ ID NO: 163068 - DNA, 35 bp, Artificial Sequence
  Synthetic oligonucleotide
acctgtaccagttagttctgtaccacttcgcctct

SEQ ID NO: 163069 - DNA, 35 bp, Artificial Sequence
  Synthetic oligonucleotide
tgaagcgggcacgtacggcggagagggggaggagt

SEQ ID NO: 163070 - DNA, 35 bp, Artificial Sequence
  Synthetic oligonucleotide
gtggcgtcctgaccactcactccttctgcctccgt

SEQ ID NO: 163071 - DNA, 36 bp, Artificial Sequence
  Synthetic oligonucleotide
ggtcctgtccgacgcctcagcacgccgcttccctgt

SEQ ID NO: 163072 - DNA, 35 bp, Artificial Sequence
  Synthetic oligonucleotide
aacagaacctgtccttatatggtttgctccacctt

SEQ ID NO: 163073 - DNA, 35 bp, Artificial Sequence
  Synthetic oligonucleotide
aaagccgtactgccaatcctcgcccctttcaggtt

SEQ ID NO: 163074 - DNA, 35 bp, Artificial Sequence
  Synthetic oligonucleotide
ggaccctcggacgctggtgctttcttctctttgtt

SEQ ID NO: 163075 - DNA, 36 bp, Artificial Sequence
  Synthetic oligonucleotide
gcgatggatggggaaaagggggcaagtaagtgacaa

SEQ ID NO: 163076 - DNA, 36 bp, Artificial Sequence
  Synthetic oligonucleotide
agccacctccggactcccactcgcatcttcgacgaa

SEQ ID NO: 163077 - DNA, 35 bp, Artificial Sequence
  Synthetic oligonucleotide
gataggggtaggaggtgagtgggatctgggatgaa

SEQ ID NO: 163078 - DNA, 35 bp, Artificial Sequence
  Synthetic oligonucleotide
tatcagcccctgatacctttcttggcctctcttaa

SEQ ID NO: 163079 - DNA, 36 bp, Artificial Sequence
  Synthetic oligonucleotide
tcaggatgggggaggggaatgaaggatgttaacaca

SEQ ID NO: 163080 - DNA, 36 bp, Artificial Sequence
  Synthetic oligonucleotide
atcgcccccacccacagatgccgccccattcacaca

SEQ ID NO: 163081 - DNA, 36 bp, Artificial Sequence
  Synthetic oligonucleotide
aaccccgcaccccctcacgtatacccacccggcaca

SEQ ID NO: 163082 - DNA, 36 bp, Artificial Sequence
  Synthetic oligonucleotide
gaacaggtgataggggataccgggaggggaggtaca

SEQ ID NO: 163083 - DNA, 36 bp, Artificial Sequence
  Synthetic oligonucleotide
tcatcgggcggcctccctctctttttgcgcgttaca

SEQ ID NO: 163084 - DNA, 36 bp, Artificial Sequence
  Synthetic oligonucleotide
aactcaccatcacgctgtcgtcactctatccaacca

SEQ ID NO: 163085 - DNA, 36 bp, Artificial Sequence
  Synthetic oligonucleotide
tccaacatcctgctcctgatcctagcaccctaacca

SEQ ID NO: 163086 - DNA, 36 bp, Artificial Sequence
  Synthetic oligonucleotide
ttcagcagtgttatcccctcttccgtgtcgccgcca

SEQ ID NO: 163087 - DNA, 35 bp, Artificial Sequence
  Synthetic oligonucleotide
gtgcccctcctccggccaaaggcttttttttgcca

SEQ ID NO: 163088 - DNA, 36 bp, Artificial Sequence
  Synthetic oligonucleotide
aactcatggaggaggagggggtcctgggtggtggca

SEQ ID NO: 163089 - DNA, 36 bp, Artificial Sequence
  Synthetic oligonucleotide
gcacctctggctttagcgcctgtttcacccgcctca

SEQ ID NO: 163090 - DNA, 36 bp, Artificial Sequence
  Synthetic oligonucleotide
tgcgctcacgcaccacccgcaaggaactccggctca

SEQ ID NO: 163091 - DNA, 36 bp, Artificial Sequence
  Synthetic oligonucleotide
atccgtcactgcccggcccctgattgcccttgctca

SEQ ID NO: 163092 - DNA, 32 bp, Artificial Sequence
  Synthetic oligonucleotide
gccccccctctgatcagggccccttgcattca

SEQ ID NO: 163093 - DNA, 36 bp, Artificial Sequence
  Synthetic oligonucleotide
tttggacttcgccgccgatcctgatttgctccttca

SEQ ID NO: 163094 - DNA, 37 bp, Artificial Sequence
  Synthetic oligonucleotide
gttgcgccggagaaaaaagggggtcggaggaaggaga

SEQ ID NO: 163095 - DNA, 37 bp, Artificial Sequence
  Synthetic oligonucleotide
aatcaacatcggacgtgctaccccatctccatcccga

SEQ ID NO: 163096 - DNA, 37 bp, Artificial Sequence
  Synthetic oligonucleotide
gcccctccccttcccaccgtttcctacgtcgtcccga

SEQ ID NO: 163097 - DNA, 37 bp, Artificial Sequence
  Synthetic oligonucleotide
gatcctgcgaccaacctgcatgcacaccatctgccga

SEQ ID NO: 163098 - DNA, 37 bp, Artificial Sequence
  Synthetic oligonucleotide
acgctactcacctcgtccatccccttgcttttagcga

SEQ ID NO: 163099 - DNA, 37 bp, Artificial Sequence
  Synthetic oligonucleotide
atcagtcgctgtgcagtactactgttctccttggcga

SEQ ID NO: 163100 - DNA, 34 bp, Artificial Sequence
  Synthetic oligonucleotide
tcgcctccattcagccaacgttatgcaccatcga

SEQ ID NO: 163101 - DNA, 36 bp, Artificial Sequence
  Synthetic oligonucleotide
gtccaacatctgcccaccttcctgcgggttcctcga

SEQ ID NO: 163102 - DNA, 37 bp, Artificial Sequence
  Synthetic oligonucleotide
tcaaccccgtccttgcttctatccctggacgtctcga

SEQ ID NO: 163103 - DNA, 37 bp, Artificial Sequence
  Synthetic oligonucleotide
ggtgaagaggcgaaaggtggtggatagggtgcgtcga

SEQ ID NO: 163104 - DNA, 37 bp, Artificial Sequence
  Synthetic oligonucleotide
tgtactgcgcacctcacaagccaccatcttcccagga

SEQ ID NO: 163105 - DNA, 37 bp, Artificial Sequence
  Synthetic oligonucleotide
aatggagcaagaggacggagtgagaggagtgggcgga

SEQ ID NO: 163106 - DNA, 37 bp, Artificial Sequence
  Synthetic oligonucleotide
acgaaggggagtgacgggttcagttggcgagggggga

SEQ ID NO: 163107 - DNA, 35 bp, Artificial Sequence
  Synthetic oligonucleotide
aacgaggggtacgggggggtatgagagtgttggga

SEQ ID NO: 163108 - DNA, 37 bp, Artificial Sequence
  Synthetic oligonucleotide
gtgattcgcctcctctatatgctctcgccctcctgga

SEQ ID NO: 163109 - DNA, 36 bp, Artificial Sequence
  Synthetic oligonucleotide
tcgccgccctctactccttcttcgtgctctgctgga

SEQ ID NO: 163110 - DNA, 37 bp, Artificial Sequence
  Synthetic oligonucleotide
ttagccccacctccccactgtacacaggcattttgga

SEQ ID NO: 163111 - DNA, 36 bp, Artificial Sequence
  Synthetic oligonucleotide
ttactacccgtgccatcctgacatgcgagagcatga

SEQ ID NO: 163112 - DNA, 37 bp, Artificial Sequence
  Synthetic oligonucleotide
tccgctccatcacttttgttcaggtagcccctcatga

SEQ ID NO: 163113 - DNA, 38 bp, Artificial Sequence
  Synthetic oligonucleotide
gacggacgttgggcggtaggggagggaaccatagatga

SEQ ID NO: 163114 - DNA, 37 bp, Artificial Sequence
  Synthetic oligonucleotide
gccgggacgaaaatgtgatgggtgggtctgggtatga

SEQ ID NO: 163115 - DNA, 33 bp, Artificial Sequence
  Synthetic oligonucleotide
atccccggcacaccgcttttgcctctcttatga

SEQ ID NO: 163116 - DNA, 38 bp, Artificial Sequence
  Synthetic oligonucleotide
tccgcacggttcacggtcttatctcccgtcctttatga

SEQ ID NO: 163117 - DNA, 37 bp, Artificial Sequence
  Synthetic oligonucleotide
ttcagcccgctgttacctccgcaatctatgcccctga

SEQ ID NO: 163118 - DNA, 38 bp, Artificial Sequence
  Synthetic oligonucleotide
ttgccaccatgccacatctgttttgcttagtttgctga

SEQ ID NO: 163119 - DNA, 37 bp, Artificial Sequence
  Synthetic oligonucleotide
aactgcggccgggggggtatatgggtgggagaattga

SEQ ID NO: 163120 - DNA, 38 bp, Artificial Sequence
  Synthetic oligonucleotide
atccccgtcccgccgttctgcaatgcatcagccattga

SEQ ID NO: 163121 - DNA, 38 bp, Artificial Sequence
  Synthetic oligonucleotide
atgacccccgcctgcttacagcttagtggccaccttga

SEQ ID NO: 163122 - DNA, 38 bp, Artificial Sequence
  Synthetic oligonucleotide
gtcgacgccctcattggcatcggttctatccatcttga

SEQ ID NO: 163123 - DNA, 38 bp, Artificial Sequence
  Synthetic oligonucleotide
acctcatccccccaggttctatggatcccgccctttga

SEQ ID NO: 163124 - DNA, 34 bp, Artificial Sequence
  Synthetic oligonucleotide
ggtgccccgccaacctgccccatagaaatccata

SEQ ID NO: 163125 - DNA, 36 bp, Artificial Sequence
  Synthetic oligonucleotide
tcaacgcaagtccccacgctgccatgtccaatccta

SEQ ID NO: 163126 - DNA, 36 bp, Artificial Sequence
  Synthetic oligonucleotide
cccggccacccagcttttcgttacggtcctacgcta

SEQ ID NO: 163127 - DNA, 36 bp, Artificial Sequence
  Synthetic oligonucleotide
tagcccaccagacccgactttcaaggtgcctctcta

SEQ ID NO: 163128 - DNA, 36 bp, Artificial Sequence
  Synthetic oligonucleotide
tcccaacctctcgatacggctatgctgctgcactta

SEQ ID NO: 163129 - DNA, 35 bp, Artificial Sequence
  Synthetic oligonucleotide
atttgccgccctgctgatttttgctatcttgtaac

SEQ ID NO: 163130 - DNA, 35 bp, Artificial Sequence
  Synthetic oligonucleotide
acttgcacaggtgccccttcgctctcgccacatac

SEQ ID NO: 163131 - DNA, 35 bp, Artificial Sequence
  Synthetic oligonucleotide
atccctggttccgctgaccagccccctgatcctac

SEQ ID NO: 163132 - DNA, 35 bp, Artificial Sequence
  Synthetic oligonucleotide
atctgcatcctagctgcctactatagtttccaacc

SEQ ID NO: 163133 - DNA, 35 bp, Artificial Sequence
  Synthetic oligonucleotide
tctcctcatcctgttgcagtagagccttctcaccc

SEQ ID NO: 163134 - DNA, 35 bp, Artificial Sequence
  Synthetic oligonucleotide
tgtgcatgattcgtgaccacacagccgcccgcccc

SEQ ID NO: 163135 - DNA, 35 bp, Artificial Sequence
  Synthetic oligonucleotide
acgcccacctggtgataccgcccttgtacccgccc

SEQ ID NO: 163136 - DNA, 34 bp, Artificial Sequence
  Synthetic oligonucleotide
gagggggtaacggaatacagggagggcggggccc

SEQ ID NO: 163137 - DNA, 35 bp, Artificial Sequence
  Synthetic oligonucleotide
ttacaaccccgcggaatgtgccaacttacctgccc

SEQ ID NO: 163138 - DNA, 35 bp, Artificial Sequence
  Synthetic oligonucleotide
gcccgagttggtcggtcgtttcacttcacttgccc

SEQ ID NO: 163139 - DNA, 35 bp, Artificial Sequence
  Synthetic oligonucleotide
ttcgcgaataactgatatgctccgtgcctttgccc

SEQ ID NO: 163140 - DNA, 35 bp, Artificial Sequence
  Synthetic oligonucleotide
gagtgcggacacacgaatcatcccccaccttggcc

SEQ ID NO: 163141 - DNA, 35 bp, Artificial Sequence
  Synthetic oligonucleotide
acaccgccgcactcgcgtaccccgccacgtattcc

SEQ ID NO: 163142 - DNA, 35 bp, Artificial Sequence
  Synthetic oligonucleotide
atcgcggcctctgctccagaatcgtaccaccatgc

SEQ ID NO: 163143 - DNA, 35 bp, Artificial Sequence
  Synthetic oligonucleotide
gccgcacggtctagtacctttctctttctccttgc

SEQ ID NO: 163144 - DNA, 35 bp, Artificial Sequence
  Synthetic oligonucleotide
gaattcggctcatcctgttgcccacactcaccatc

SEQ ID NO: 163145 - DNA, 35 bp, Artificial Sequence
  Synthetic oligonucleotide
gggtgggtgggcgacgtcgacaggacgggggactc

SEQ ID NO: 163146 - DNA, 35 bp, Artificial Sequence
  Synthetic oligonucleotide
tactgccacgatcgaaaccctggtcaacccgcctc

SEQ ID NO: 163147 - DNA, 35 bp, Artificial Sequence
  Synthetic oligonucleotide
acacgccgtttctgccgctttggtttctgcttctc

SEQ ID NO: 163148 - DNA, 35 bp, Artificial Sequence
  Synthetic oligonucleotide
atttgggggcgtgggtggggaggtgggcgtgcgtc

SEQ ID NO: 163149 - DNA, 35 bp, Artificial Sequence
  Synthetic oligonucleotide
gtgggtcctccctccctttccatcgggcctatgtc

SEQ ID NO: 163150 - DNA, 34 bp, Artificial Sequence
  Synthetic oligonucleotide
gtcgcagtgctgccgtaataccgttcgaccattc

SEQ ID NO: 163151 - DNA, 35 bp, Artificial Sequence
  Synthetic oligonucleotide
accacgcaccatctttccctgtagtaatcgccttc

SEQ ID NO: 163152 - DNA, 35 bp, Artificial Sequence
  Synthetic oligonucleotide
tcgagcccacttcccattcgcatcgatccggtttc

SEQ ID NO: 163153 - DNA, 35 bp, Artificial Sequence
  Synthetic oligonucleotide
gcaagaaggggaggagcatgggggatacagctaag

SEQ ID NO: 163154 - DNA, 35 bp, Artificial Sequence
  Synthetic oligonucleotide
gtcgccattcccccgtctctacgaacacacgtgag

SEQ ID NO: 163155 - DNA, 35 bp, Artificial Sequence
  Synthetic oligonucleotide
gttgacataagccgcctctagaccaccgccatccg

SEQ ID NO: 163156 - DNA, 35 bp, Artificial Sequence
  Synthetic oligonucleotide
tcaaccgccccctttgtgctctcatgcttcactcg

SEQ ID NO: 163157 - DNA, 35 bp, Artificial Sequence
  Synthetic oligonucleotide
ggaggcaagtcgatccgcctcgttccccactttcg

SEQ ID NO: 163158 - DNA, 35 bp, Artificial Sequence
  Synthetic oligonucleotide
tagggggggagtacggggaggtggggtgttcaggg

SEQ ID NO: 163159 - DNA, 34 bp, Artificial Sequence
  Synthetic oligonucleotide
actgtgcgcctgcacgttccagctttgcttccat

SEQ ID NO: 163160 - DNA, 35 bp, Artificial Sequence
  Synthetic oligonucleotide
ggtgctatccggctcttttgttcgtcccggccact

SEQ ID NO: 163161 - DNA, 35 bp, Artificial Sequence
  Synthetic oligonucleotide
tgtggcaaaggggggagggaggagtaaggtgcact

SEQ ID NO: 163162 - DNA, 35 bp, Artificial Sequence
  Synthetic oligonucleotide
atgtcgcgtactgcacccatcgccgccaaactact

SEQ ID NO: 163163 - DNA, 35 bp, Artificial Sequence
  Synthetic oligonucleotide
acactccgaccgcctgtgatcttttacttcgccct

SEQ ID NO: 163164 - DNA, 34 bp, Artificial Sequence
  Synthetic oligonucleotide
tctcggtagtgcgccatatccgcccactttccct

SEQ ID NO: 163165 - DNA, 35 bp, Artificial Sequence
  Synthetic oligonucleotide
gtcacaacgctttgcgcatcgctacttttttccct

SEQ ID NO: 163166 - DNA, 35 bp, Artificial Sequence
  Synthetic oligonucleotide
gctcgctgaccgccgcctttcaccgactacacgct

SEQ ID NO: 163167 - DNA, 35 bp, Artificial Sequence
  Synthetic oligonucleotide
gctgtcccctaccgtgcactacctgctatgctgct

SEQ ID NO: 163168 - DNA, 34 bp, Artificial Sequence
  Synthetic oligonucleotide
gtccgcctacgaccccgctaaacccgcactgtct

SEQ ID NO: 163169 - DNA, 35 bp, Artificial Sequence
  Synthetic oligonucleotide
gatcgacccgcccgtctttctcatgtccattcatt

SEQ ID NO: 163170 - DNA, 35 bp, Artificial Sequence
  Synthetic oligonucleotide
gtccactccagcatttgctttcttgtaaaactctt

SEQ ID NO: 163171 - DNA, 35 bp, Artificial Sequence
  Synthetic oligonucleotide
gtccagccggttagccttttcgcattagttccgtt

SEQ ID NO: 163172 - DNA, 35 bp, Artificial Sequence
  Synthetic oligonucleotide
tcagcgccgcgctcacgcctctgcccccatgattt

SEQ ID NO: 163173 - DNA, 35 bp, Artificial Sequence
  Synthetic oligonucleotide
acacttgcccacggatgtcgccacacgctcccttt

SEQ ID NO: 163174 - DNA, 36 bp, Artificial Sequence
  Synthetic oligonucleotide
tgatgggggaccaaagctggggtgggagggagtaaa

SEQ ID NO: 163175 - DNA, 36 bp, Artificial Sequence
  Synthetic oligonucleotide
actgtcccaccgatcgttcttgcacttggcgtaaca

SEQ ID NO: 163176 - DNA, 36 bp, Artificial Sequence
  Synthetic oligonucleotide
aacgacccagcagtatcctcccccgctgacttacca

SEQ ID NO: 163177 - DNA, 36 bp, Artificial Sequence
  Synthetic oligonucleotide
atggtcaccgtgccctcattgtactaaaccgtccca

SEQ ID NO: 163178 - DNA, 36 bp, Artificial Sequence
  Synthetic oligonucleotide
tgcatactcctcagccccccgcgatcctttgtccca

SEQ ID NO: 163179 - DNA, 35 bp, Artificial Sequence
  Synthetic oligonucleotide
gcacacatcgccgtctatggtcctccttcggtcca

SEQ ID NO: 163180 - DNA, 36 bp, Artificial Sequence
  Synthetic oligonucleotide
gcccccgggtcaggccctgtcttgctgccatttcca

SEQ ID NO: 163181 - DNA, 35 bp, Artificial Sequence
  Synthetic oligonucleotide
acaacaaccgtacgtactatcctccaccctcgaga

SEQ ID NO: 163182 - DNA, 37 bp, Artificial Sequence
  Synthetic oligonucleotide
ttgccccttactactgcattgctttgaccctcaccga

SEQ ID NO: 163183 - DNA, 37 bp, Artificial Sequence
  Synthetic oligonucleotide
gtgcgcccccactcatgcacagctcctgtttccccga

SEQ ID NO: 163184 - DNA, 37 bp, Artificial Sequence
  Synthetic oligonucleotide
gcaggggaggttcaggaactacaggggaggagggcga

SEQ ID NO: 163185 - DNA, 37 bp, Artificial Sequence
  Synthetic oligonucleotide
ttcctccgaagaccgcgtttgacgacccccctctcga

SEQ ID NO: 163186 - DNA, 37 bp, Artificial Sequence
  Synthetic oligonucleotide
gtccttgcctgttgggtcctactttcccctccttcga

SEQ ID NO: 163187 - DNA, 37 bp, Artificial Sequence
  Synthetic oligonucleotide
tctcgggccggggggaggaaatggggccaaggtagga

SEQ ID NO: 163188 - DNA, 37 bp, Artificial Sequence
  Synthetic oligonucleotide
acgtgatccatcaggggtgtgcaaagggcgggaggga

SEQ ID NO: 163189 - DNA, 37 bp, Artificial Sequence
  Synthetic oligonucleotide
gatccacgcccttcgttccaagttaccttgctctgga

SEQ ID NO: 163190 - DNA, 38 bp, Artificial Sequence
  Synthetic oligonucleotide
tttgctccagatgtttccaccgcacgcatcccacctga

SEQ ID NO: 163191 - DNA, 35 bp, Artificial Sequence
  Synthetic oligonucleotide
gccccttgttaccgcccttcaccgttcgtcgctga

SEQ ID NO: 163192 - DNA, 35 bp, Artificial Sequence
  Synthetic oligonucleotide
accgcctgtagagcctatatcgtcccgtcctctga

SEQ ID NO: 163193 - DNA, 38 bp, Artificial Sequence
  Synthetic oligonucleotide
gtcacccccctcttggcattataagctgtcctccgtga

SEQ ID NO: 163194 - DNA, 38 bp, Artificial Sequence
  Synthetic oligonucleotide
ggaggataggggaaggggagatagactgaaggaggtga

SEQ ID NO: 163195 - DNA, 38 bp, Artificial Sequence
  Synthetic oligonucleotide
gtcaatcgaccaaggaatcgggtggaggaggggggtga

SEQ ID NO: 163196 - DNA, 37 bp, Artificial Sequence
  Synthetic oligonucleotide
aaccgaccacccctcatatgactgtgccatctgttga

SEQ ID NO: 163197 - DNA, 37 bp, Artificial Sequence
  Synthetic oligonucleotide
acaccccatcgccttaccgctacagttcttcgtttga

SEQ ID NO: 163198 - DNA, 36 bp, Artificial Sequence
  Synthetic oligonucleotide
tccctttgtccacactgtagccgaccccttaccgta

SEQ ID NO: 163199 - DNA, 35 bp, Artificial Sequence
  Synthetic oligonucleotide
gacgagtgtagtgcctcgagtttcgcccccctgta

SEQ ID NO: 163200 - DNA, 35 bp, Artificial Sequence
  Synthetic oligonucleotide
accgccgttagacgcgcctatccgtcatagcccac

SEQ ID NO: 163201 - DNA, 35 bp, Artificial Sequence
  Synthetic oligonucleotide
tcgacccccacttttgtttgatccggaccctccac

SEQ ID NO: 163202 - DNA, 35 bp, Artificial Sequence
  Synthetic oligonucleotide
tagcgcatccccgtcccgctgcaactgttctccac

SEQ ID NO: 163203 - DNA, 35 bp, Artificial Sequence
  Synthetic oligonucleotide
acccttcgcctcccgttcagtcatcgttccatcac

SEQ ID NO: 163204 - DNA, 35 bp, Artificial Sequence
  Synthetic oligonucleotide
tgagagacttcgggggggtgggggagtggtgtacc

SEQ ID NO: 163205 - DNA, 35 bp, Artificial Sequence
  Synthetic oligonucleotide
actccccgtagtgccctccaagacgcgctctggcc

SEQ ID NO: 163206 - DNA, 35 bp, Artificial Sequence
  Synthetic oligonucleotide
tttggcacccccatgttcgttcatccaactttgcc

SEQ ID NO: 163207 - DNA, 34 bp, Artificial Sequence
  Synthetic oligonucleotide
cccacctctctgctctgcacgccaagttttatcc

SEQ ID NO: 163208 - DNA, 35 bp, Artificial Sequence
  Synthetic oligonucleotide
gcaaacttgcgcacgcgtcgaatccgctactctcc

SEQ ID NO: 163209 - DNA, 34 bp, Artificial Sequence
  Synthetic oligonucleotide
ttgcgtgtcgttccatacctacccccgccttggc

SEQ ID NO: 163210 - DNA, 35 bp, Artificial Sequence
  Synthetic oligonucleotide
tgtcaccttcgatcgggatttccccctgtccgtgc

SEQ ID NO: 163211 - DNA, 35 bp, Artificial Sequence
  Synthetic oligonucleotide
gtgcccccgaccatggttcatctttgtctcgttgc

SEQ ID NO: 163212 - DNA, 35 bp, Artificial Sequence
  Synthetic oligonucleotide
tatggctgtgtagacttcctcgcgccaccttttgc

SEQ ID NO: 163213 - DNA, 34 bp, Artificial Sequence
  Synthetic oligonucleotide
tgctccggaatccgctgctgcttctttatcgctc

SEQ ID NO: 163214 - DNA, 34 bp, Artificial Sequence
  Synthetic oligonucleotide
agacagtccgccagccccgttcactgcacctctc

SEQ ID NO: 163215 - DNA, 36 bp, Artificial Sequence
  Synthetic oligonucleotide
gcgcacgagcattgatttccccgcccgtctcaagtc

SEQ ID NO: 163216 - DNA, 35 bp, Artificial Sequence
  Synthetic oligonucleotide
tgttccccacccgatgtgccagtctcatacacgtc

SEQ ID NO: 163217 - DNA, 35 bp, Artificial Sequence
  Synthetic oligonucleotide
gccacctatcaccagtcatggttcattcgaccttc

SEQ ID NO: 163218 - DNA, 35 bp, Artificial Sequence
  Synthetic oligonucleotide
gccgacccccgccgcctcgcatctctcaaccgttc

SEQ ID NO: 163219 - DNA, 35 bp, Artificial Sequence
  Synthetic oligonucleotide
gataccgccgcacaccccactgggcctcctttttc

SEQ ID NO: 163220 - DNA, 35 bp, Artificial Sequence
  Synthetic oligonucleotide
gttgcctccatccccttctcctacattacgcgaag

SEQ ID NO: 163221 - DNA, 35 bp, Artificial Sequence
  Synthetic oligonucleotide
tcaatggcgtctccccgtcaagtcgatactccccg

SEQ ID NO: 163222 - DNA, 35 bp, Artificial Sequence
  Synthetic oligonucleotide
gaggcctccgcccgactcttaaaaggtttctctcg

SEQ ID NO: 163223 - DNA, 35 bp, Artificial Sequence
  Synthetic oligonucleotide
atcgtcttgggtgggagggggtagagggttgactg

SEQ ID NO: 163224 - DNA, 35 bp, Artificial Sequence
  Synthetic oligonucleotide
gacccaccgccaccttattcttcaaccgatgcctg

SEQ ID NO: 163225 - DNA, 35 bp, Artificial Sequence
  Synthetic oligonucleotide
tctcggactcccctcctggctacagcaatatcctg

SEQ ID NO: 163226 - DNA, 35 bp, Artificial Sequence
  Synthetic oligonucleotide
gacggtaccattgttcgtttcttatgtctcttctg

SEQ ID NO: 163227 - DNA, 35 bp, Artificial Sequence
  Synthetic oligonucleotide
ttccaccctgccatccggtaccctaccctctcgtg

SEQ ID NO: 163228 - DNA, 35 bp, Artificial Sequence
  Synthetic oligonucleotide
ggtgagaacacgggcgattaggaaggcggggggtg

SEQ ID NO: 163229 - DNA, 35 bp, Artificial Sequence
  Synthetic oligonucleotide
ttcgcaacccaccgacctttccgtaactggcacat

SEQ ID NO: 163230 - DNA, 35 bp, Artificial Sequence
  Synthetic oligonucleotide
gtctacctcctgccacatgctcaagtatcgcccat

SEQ ID NO: 163231 - DNA, 35 bp, Artificial Sequence
  Synthetic oligonucleotide
gcagaaaggggagagggggtggagagtgagtagat

SEQ ID NO: 163232 - DNA, 35 bp, Artificial Sequence
  Synthetic oligonucleotide
gggggaaaatcgggcgaggggggtacagagggtat

SEQ ID NO: 163233 - DNA, 34 bp, Artificial Sequence
  Synthetic oligonucleotide
gcatggcacactaatctgcagtaatcacccccct

SEQ ID NO: 163234 - DNA, 35 bp, Artificial Sequence
  Synthetic oligonucleotide
tccgctcaccatatcgtatcatacccacgctccct

SEQ ID NO: 163235 - DNA, 35 bp, Artificial Sequence
  Synthetic oligonucleotide
gccgacgcgctttgtctcttggtccactccctcct

SEQ ID NO: 163236 - DNA, 35 bp, Artificial Sequence
  Synthetic oligonucleotide
acagcccttgcgcacgtaatgcactcacccacgct

SEQ ID NO: 163237 - DNA, 35 bp, Artificial Sequence
  Synthetic oligonucleotide
tcctgcgcccgctcaagaatcgccaccgctccgct

SEQ ID NO: 163238 - DNA, 35 bp, Artificial Sequence
  Synthetic oligonucleotide
gtcattgcccagcgtattttcactctattctcgct

SEQ ID NO: 163239 - DNA, 35 bp, Artificial Sequence
  Synthetic oligonucleotide
acgacatccgcactgtagccttcgcgtcaacctct

SEQ ID NO: 163240 - DNA, 35 bp, Artificial Sequence
  Synthetic oligonucleotide
tgacataaggtaagaggggagtaatgggagggggt

SEQ ID NO: 163241 - DNA, 35 bp, Artificial Sequence
  Synthetic oligonucleotide
gaacacgatagcacatggggggacggggaaaatgt

SEQ ID NO: 163242 - DNA, 35 bp, Artificial Sequence
  Synthetic oligonucleotide
ggctccccactgttatttagccttcctttcctgtt

SEQ ID NO: 163243 - DNA, 35 bp, Artificial Sequence
  Synthetic oligonucleotide
gtgccccttgcgatctacccttgttcactctgttt

SEQ ID NO: 163244 - DNA, 35 bp, Artificial Sequence
  Synthetic oligonucleotide
tatgtacgcccctgctctttctttgtgatgctttt

SEQ ID NO: 163245 - DNA, 36 bp, Artificial Sequence
  Synthetic oligonucleotide
tcagcaccgccgtcgccctgtcttattccatctgaa

SEQ ID NO: 163246 - DNA, 36 bp, Artificial Sequence
  Synthetic oligonucleotide
gcactacccgcccatcgttgttcattgtctttataa

SEQ ID NO: 163247 - DNA, 35 bp, Artificial Sequence
  Synthetic oligonucleotide
gagcctcacctcatgccctttgttggcctgcctaa

SEQ ID NO: 163248 - DNA, 36 bp, Artificial Sequence
  Synthetic oligonucleotide
tacccctgccatcaactgcgtcagctcgcccgttaa

SEQ ID NO: 163249 - DNA, 36 bp, Artificial Sequence
  Synthetic oligonucleotide
acccgttcgcctcctatagccatccgcttgtgcaca

SEQ ID NO: 163250 - DNA, 36 bp, Artificial Sequence
  Synthetic oligonucleotide
gcgcccgcatttatgcgctttcgacccttcacacca

SEQ ID NO: 163251 - DNA, 36 bp, Artificial Sequence
  Synthetic oligonucleotide
actcacccgcctgtacggtttatcgattcccgccca

SEQ ID NO: 163252 - DNA, 36 bp, Artificial Sequence
  Synthetic oligonucleotide
aacatcctcggccggtatatagcatccgcgctgcca

SEQ ID NO: 163253 - DNA, 35 bp, Artificial Sequence
  Synthetic oligonucleotide
aaagggggagggatcgggtaggaattgagcaagca

SEQ ID NO: 163254 - DNA, 36 bp, Artificial Sequence
  Synthetic oligonucleotide
gagtgaggaagagtgggggaaggagcaagggttgca

SEQ ID NO: 163255 - DNA, 36 bp, Artificial Sequence
  Synthetic oligonucleotide
aattgccaccgcactcgtgttgcatttcctctatca

SEQ ID NO: 163256 - DNA, 36 bp, Artificial Sequence
  Synthetic oligonucleotide
tgtaccccggcgtcagctccccggcctacctgctca

SEQ ID NO: 163257 - DNA, 36 bp, Artificial Sequence
  Synthetic oligonucleotide
ttccacccccgcaaacgttccaacccagtccggtca

SEQ ID NO: 163258 - DNA, 35 bp, Artificial Sequence
  Synthetic oligonucleotide
accgtacctcggtgccgatacttcttgcttgttca

SEQ ID NO: 163259 - DNA, 37 bp, Artificial Sequence
  Synthetic oligonucleotide
ggggaagggcaaggtggaaaactgcggtgtggcaaga

SEQ ID NO: 163260 - DNA, 37 bp, Artificial Sequence
  Synthetic oligonucleotide
accacgctctgctgcatagctccctcgtccattacga

SEQ ID NO: 163261 - DNA, 37 bp, Artificial Sequence
  Synthetic oligonucleotide
accgagtgggagggtcgggagggtcggcggaagccga

SEQ ID NO: 163262 - DNA, 37 bp, Artificial Sequence
  Synthetic oligonucleotide
ttcgggatgggaagtcgcgagagggggagggggagga

SEQ ID NO: 163263 - DNA, 37 bp, Artificial Sequence
  Synthetic oligonucleotide
atctcatgagaaggggtgtagtaatggtgggagggga

SEQ ID NO: 163264 - DNA, 36 bp, Artificial Sequence
  Synthetic oligonucleotide
tctacatgcctcctgctcgtccttcaccgtatggga

SEQ ID NO: 163265 - DNA, 37 bp, Artificial Sequence
  Synthetic oligonucleotide
gtagtggaggggggggtgaggcagacgaatcctggga

SEQ ID NO: 163266 - DNA, 37 bp, Artificial Sequence
  Synthetic oligonucleotide
agcgggcgggggcggaagggaggcgctcggcactgga

SEQ ID NO: 163267 - DNA, 37 bp, Artificial Sequence
  Synthetic oligonucleotide
tgcgaactgcccacactgcggattacaccctcttgga

SEQ ID NO: 163268 - DNA, 38 bp, Artificial Sequence
  Synthetic oligonucleotide
gtctcgcccacccgctccccaagcacagctctaaatga

SEQ ID NO: 163269 - DNA, 36 bp, Artificial Sequence
  Synthetic oligonucleotide
taatgacggatgggggtggggaggaggctggcatga

SEQ ID NO: 163270 - DNA, 38 bp, Artificial Sequence
  Synthetic oligonucleotide
tctcgagcctcgcgctgctttgctcctctcacacctga

SEQ ID NO: 163271 - DNA, 35 bp, Artificial Sequence
  Synthetic oligonucleotide
tgtaccttcgcgctggcccccgctattctgcctga

SEQ ID NO: 163272 - DNA, 35 bp, Artificial Sequence
  Synthetic oligonucleotide
gccctgacaaacgttatatcgccatcccacgctga

SEQ ID NO: 163273 - DNA, 38 bp, Artificial Sequence
  Synthetic oligonucleotide
tgatcacctcgcctttcataattacgcgccacccgtga

SEQ ID NO: 163274 - DNA, 38 bp, Artificial Sequence
  Synthetic oligonucleotide
tcccgtacagggatgctgtcccgccctgcccttcgtga

SEQ ID NO: 163275 - DNA, 38 bp, Artificial Sequence
  Synthetic oligonucleotide
agtgggctgagggggcggggggggacagaatgaggtga

SEQ ID NO: 163276 - DNA, 34 bp, Artificial Sequence
  Synthetic oligonucleotide
gttcctcgcgcccctcgatcctgtaccctggtga

SEQ ID NO: 163277 - DNA, 35 bp, Artificial Sequence
  Synthetic oligonucleotide
ttcccccgcaattcgtactctatctccccgattga

SEQ ID NO: 163278 - DNA, 38 bp, Artificial Sequence
  Synthetic oligonucleotide
tcccaaccacctgtcctgctctttccgtctcttcttga

SEQ ID NO: 163279 - DNA, 36 bp, Artificial Sequence
  Synthetic oligonucleotide
atgaggaggggggtggacggggctttagtacgaata

SEQ ID NO: 163280 - DNA, 36 bp, Artificial Sequence
  Synthetic oligonucleotide
gcgccgcagacctccgctttccatcctcgcttgcta

SEQ ID NO: 163281 - DNA, 30 bp, Artificial Sequence
  Synthetic oligonucleotide
gacgcatcacattcgctcgtttgcctggta

SEQ ID NO: 163282 - DNA, 36 bp, Artificial Sequence
  Synthetic oligonucleotide
tgcgactccagacgctcgattcacacatctgcctta

SEQ ID NO: 163283 - DNA, 36 bp, Artificial Sequence
  Synthetic oligonucleotide
tccacacacgccccatcgctacatagtctgacgtta

SEQ ID NO: 163284 - DNA, 36 bp, Artificial Sequence
  Synthetic oligonucleotide
acccccgccctgagttctccagccgtgtttctgtta

SEQ ID NO: 163285 - DNA, 36 bp, Artificial Sequence
  Synthetic oligonucleotide
gttcctcccacaaattgtcttcgcacctgctgttta

SEQ ID NO: 163286 - DNA, 35 bp, Artificial Sequence
  Synthetic oligonucleotide
atgctcacgctccaccacgtccttctcgtaaccac

SEQ ID NO: 163287 - DNA, 35 bp, Artificial Sequence
  Synthetic oligonucleotide
ttgcaccggtcggtcccctcgtccttttgaccacc

SEQ ID NO: 163288 - DNA, 35 bp, Artificial Sequence
  Synthetic oligonucleotide
gatcgcatacacccttttcccccagccgtgatacc

SEQ ID NO: 163289 - DNA, 35 bp, Artificial Sequence
  Synthetic oligonucleotide
ataccgctgagccccaatgcggtcactttacaccc

SEQ ID NO: 163290 - DNA, 35 bp, Artificial Sequence
  Synthetic oligonucleotide
ggtgtcctgtagcattggcgtcctgccctcccccc

SEQ ID NO: 163291 - DNA, 35 bp, Artificial Sequence
  Synthetic oligonucleotide
tcaccctgccagcccattacctccgacaatgcccc

SEQ ID NO: 163292 - DNA, 35 bp, Artificial Sequence
  Synthetic oligonucleotide
ttgcagtcatacaatatggccacgtactgctcccc

SEQ ID NO: 163293 - DNA, 35 bp, Artificial Sequence
  Synthetic oligonucleotide
acacacccttcgtcgaccatacctgttacccgccc

SEQ ID NO: 163294 - DNA, 35 bp, Artificial Sequence
  Synthetic oligonucleotide
ttgttccatctgcccgttggtattagccactgccc

SEQ ID NO: 163295 - DNA, 35 bp, Artificial Sequence
  Synthetic oligonucleotide
gtacgttgatccgtgttacctgtgccctctctccc

SEQ ID NO: 163296 - DNA, 35 bp, Artificial Sequence
  Synthetic oligonucleotide
tgtccacccgctgttcggtttcgatttccgttccc

SEQ ID NO: 163297 - DNA, 35 bp, Artificial Sequence
  Synthetic oligonucleotide
gccgtcgccgggtcacacattatacgcccctcgcc

SEQ ID NO: 163298 - DNA, 35 bp, Artificial Sequence
  Synthetic oligonucleotide
gacgatctgtccggcctctcccagcttctctggcc

SEQ ID NO: 163299 - DNA, 36 bp, Artificial Sequence
  Synthetic oligonucleotide
aacatagcccctgttcacccaccgcatccgtgtgcc

SEQ ID NO: 163300 - DNA, 35 bp, Artificial Sequence
  Synthetic oligonucleotide
tcctcaaccctgccctctgtaccaggactcaatcc

SEQ ID NO: 163301 - DNA, 35 bp, Artificial Sequence
  Synthetic oligonucleotide
gttctaacgccacccgttaacactgtcctttctgc

SEQ ID NO: 163302 - DNA, 35 bp, Artificial Sequence
  Synthetic oligonucleotide
aagttcaacctctgggtgggcgggaacagggcatc

SEQ ID NO: 163303 - DNA, 35 bp, Artificial Sequence
  Synthetic oligonucleotide
tcattcctccgtgagctcacctctccaccgcgatc

SEQ ID NO: 163304 - DNA, 35 bp, Artificial Sequence
  Synthetic oligonucleotide
gtggaaggcgcactatctcgcttacatcctgtatc

SEQ ID NO: 163305 - DNA, 35 bp, Artificial Sequence
  Synthetic oligonucleotide
tctaggctccattcacatcgccggtcggtccactc

SEQ ID NO: 163306 - DNA, 35 bp, Artificial Sequence
  Synthetic oligonucleotide
acctcacgtctgactcttaatggcctctaatcctc

SEQ ID NO: 163307 - DNA, 35 bp, Artificial Sequence
  Synthetic oligonucleotide
tatccgaccctccatgtagggggcttgtacctctc

SEQ ID NO: 163308 - DNA, 35 bp, Artificial Sequence
  Synthetic oligonucleotide
aaacgtacgtctctgtgcccctacactccctggtc

SEQ ID NO: 163309 - DNA, 35 bp, Artificial Sequence
  Synthetic oligonucleotide
tgacggtccacattcccttccggatcctgtccttc

SEQ ID NO: 163310 - DNA, 35 bp, Artificial Sequence
  Synthetic oligonucleotide
ggatgcctgccacttgcctacaactctattgcttc

SEQ ID NO: 163311 - DNA, 35 bp, Artificial Sequence
  Synthetic oligonucleotide
tgacgggttacgtgtcgtcacccataccatctttc

SEQ ID NO: 163312 - DNA, 34 bp, Artificial Sequence
  Synthetic oligonucleotide
gcaatgccaggctccctagctccacctttacaag

SEQ ID NO: 163313 - DNA, 35 bp, Artificial Sequence
  Synthetic oligonucleotide
ggacgggaggggggggtggtaggattgttaaaacg

SEQ ID NO: 163314 - DNA, 35 bp, Artificial Sequence
  Synthetic oligonucleotide
accccttcggcccggccggtcatttttccctcccg

SEQ ID NO: 163315 - DNA, 35 bp, Artificial Sequence
  Synthetic oligonucleotide
aatcgctaccgccactggttatttcacttgttccg

SEQ ID NO: 163316 - DNA, 35 bp, Artificial Sequence
  Synthetic oligonucleotide
attgggagagcagaggtaacgggtgggtggaaagg

SEQ ID NO: 163317 - DNA, 35 bp, Artificial Sequence
  Synthetic oligonucleotide
acacgctgatgtctcgtgctcttttgactttcctg

SEQ ID NO: 163318 - DNA, 35 bp, Artificial Sequence
  Synthetic oligonucleotide
tcacctctcggaactctgcctctatcccagctctg

SEQ ID NO: 163319 - DNA, 35 bp, Artificial Sequence
  Synthetic oligonucleotide
tcaccgtcgtggttacccgcccacctagtttccct

SEQ ID NO: 163320 - DNA, 35 bp, Artificial Sequence
  Synthetic oligonucleotide
gtggtctgttgccttgtagcgaccccccctctcct

SEQ ID NO: 163321 - DNA, 35 bp, Artificial Sequence
  Synthetic oligonucleotide
gcaaagcaggtcggcctcagtagcgcttctctcct

SEQ ID NO: 163322 - DNA, 35 bp, Artificial Sequence
  Synthetic oligonucleotide
ttcaccattgcgccttggccagccgacgctcttct

SEQ ID NO: 163323 - DNA, 35 bp, Artificial Sequence
  Synthetic oligonucleotide
gcgagggatgggacggagtgtagggggattgaggt

SEQ ID NO: 163324 - DNA, 35 bp, Artificial Sequence
  Synthetic oligonucleotide
gcatacgcatatcgtttcgcctattgaccccttgt

SEQ ID NO: 163325 - DNA, 35 bp, Artificial Sequence
  Synthetic oligonucleotide
ttcggtccccccgccactgttaggtgaaaccgatt

SEQ ID NO: 163326 - DNA, 35 bp, Artificial Sequence
  Synthetic oligonucleotide
gtaataccctgcctccgctgtccttgtctcgcgtt

SEQ ID NO: 163327 - DNA, 35 bp, Artificial Sequence
  Synthetic oligonucleotide
aacaggacgaaagaggcggcaaaaagggaggcgtt

SEQ ID NO: 163328 - DNA, 35 bp, Artificial Sequence
  Synthetic oligonucleotide
tgctatccacccgtgacacccccatccggcctgtt

SEQ ID NO: 163329 - DNA, 35 bp, Artificial Sequence
  Synthetic oligonucleotide
attgcaatctccgcccgctaccctgtccgacgttt

SEQ ID NO: 163330 - DNA, 35 bp, Artificial Sequence
  Synthetic oligonucleotide
ccagtcatttcccgccctagtgtgccatccctcaa

SEQ ID NO: 163331 - DNA, 36 bp, Artificial Sequence
  Synthetic oligonucleotide
aaccccagctttcactgctccttggtcctagttcaa

SEQ ID NO: 163332 - DNA, 36 bp, Artificial Sequence
  Synthetic oligonucleotide
tcagttacagggcaagggaaacgggtatggggggaa

SEQ ID NO: 163333 - DNA, 35 bp, Artificial Sequence
  Synthetic oligonucleotide
tgcaccatcaatccttcggcttcgctccgccataa

SEQ ID NO: 163334 - DNA, 36 bp, Artificial Sequence
  Synthetic oligonucleotide
tcctccacccgctattgtcctaaggctaaaatttaa

SEQ ID NO: 163335 - DNA, 36 bp, Artificial Sequence
  Synthetic oligonucleotide
gcaagcgcacatcccagtctgttcccttcgcgcaca

SEQ ID NO: 163336 - DNA, 36 bp, Artificial Sequence
  Synthetic oligonucleotide
accaataggagtgaggggtggaactgcggagagaca

SEQ ID NO: 163337 - DNA, 36 bp, Artificial Sequence
  Synthetic oligonucleotide
gccaaccccgcttctgcgttcttctttcctgaccca

SEQ ID NO: 163338 - DNA, 36 bp, Artificial Sequence
  Synthetic oligonucleotide
gtattcaacgccagccgctcgtacacccgcccgcca

SEQ ID NO: 163339 - DNA, 36 bp, Artificial Sequence
  Synthetic oligonucleotide
gctcccccgccggtttatatgacccccacgaatcca

SEQ ID NO: 163340 - DNA, 35 bp, Artificial Sequence
  Synthetic oligonucleotide
tccatcctcgcgacaggccttgcgagcttcatcca

SEQ ID NO: 163341 - DNA, 36 bp, Artificial Sequence
  Synthetic oligonucleotide
tacacccatggcatacagtgcatctgatctcctcca

SEQ ID NO: 163342 - DNA, 35 bp, Artificial Sequence
  Synthetic oligonucleotide
gagtgccatcccagtttctccgccgtacatgggca

SEQ ID NO: 163343 - DNA, 35 bp, Artificial Sequence
  Synthetic oligonucleotide
atgaccaccgtttggttctaatccgttccactgca

SEQ ID NO: 163344 - DNA, 36 bp, Artificial Sequence
  Synthetic oligonucleotide
tcctccaaccatgtccgcctcgctctcgtacgctca

SEQ ID NO: 163345 - DNA, 36 bp, Artificial Sequence
  Synthetic oligonucleotide
ggagaaggaagtaaggtgcgaggaaagcagcacaga

SEQ ID NO: 163346 - DNA, 37 bp, Artificial Sequence
  Synthetic oligonucleotide
atgtgcgggagagaggattggacggggaattggcaga

SEQ ID NO: 163347 - DNA, 37 bp, Artificial Sequence
  Synthetic oligonucleotide
acctctacgtacactcttcccgccggcctttacccga

SEQ ID NO: 163348 - DNA, 37 bp, Artificial Sequence
  Synthetic oligonucleotide
tagtgcgcgatattctgccccttacctgttcttccga

SEQ ID NO: 163349 - DNA, 37 bp, Artificial Sequence
  Synthetic oligonucleotide
tcaaccgcactcacacctccgccagtacactcagcga

SEQ ID NO: 163350 - DNA, 36 bp, Artificial Sequence
  Synthetic oligonucleotide
aaggggaggataggtgtggaattatgtggtgggcga

SEQ ID NO: 163351 - DNA, 35 bp, Artificial Sequence
  Synthetic oligonucleotide
agtgctgggagtgggggggtcgggtgaagaaagga

SEQ ID NO: 163352 - DNA, 37 bp, Artificial Sequence
  Synthetic oligonucleotide
gccgatgtgggagggtgaggacggggacgtgtaagga

SEQ ID NO: 163353 - DNA, 36 bp, Artificial Sequence
  Synthetic oligonucleotide
tgcgtagcggcatgggagtaattgggcgggagggga

SEQ ID NO: 163354 - DNA, 37 bp, Artificial Sequence
  Synthetic oligonucleotide
tcacgtgtgaaggggacgggaaggggcttatcgggga

SEQ ID NO: 163355 - DNA, 37 bp, Artificial Sequence
  Synthetic oligonucleotide
attggttaccaggtggggtggtaaatgaaggggggga

SEQ ID NO: 163356 - DNA, 37 bp, Artificial Sequence
  Synthetic oligonucleotide
acgcgggaggtcgggggcaaagcaaggggcggtggga

SEQ ID NO: 163357 - DNA, 37 bp, Artificial Sequence
  Synthetic oligonucleotide
ttttccccccgccttggtgccgtatttccctgtggga

SEQ ID NO: 163358 - DNA, 37 bp, Artificial Sequence
  Synthetic oligonucleotide
gtacccatcacacctgcctccatgattgccccgctga

SEQ ID NO: 163359 - DNA, 38 bp, Artificial Sequence
  Synthetic oligonucleotide
atggaggggcgattgaagaagggagttcggggcggtga

SEQ ID NO: 163360 - DNA, 37 bp, Artificial Sequence
  Synthetic oligonucleotide
gggtctacgacgggtggaatggtgcgggggggggtga

SEQ ID NO: 163361 - DNA, 38 bp, Artificial Sequence
  Synthetic oligonucleotide
gacgggggaacaaggaagaaaggcggctaacagtgtga

SEQ ID NO: 163362 - DNA, 37 bp, Artificial Sequence
  Synthetic oligonucleotide
accggtgtgagggacgagcggggggaggaggcattga

SEQ ID NO: 163363 - DNA, 37 bp, Artificial Sequence
  Synthetic oligonucleotide
tctgtgatcggccattccattagtaccctcgccttga

SEQ ID NO: 163364 - DNA, 37 bp, Artificial Sequence
  Synthetic oligonucleotide
gtcccgctcctggtaattgtctctcttagctccttga

SEQ ID NO: 163365 - DNA, 36 bp, Artificial Sequence
  Synthetic oligonucleotide
tccacctcaccccctccgccgtgctacagtgcttga

SEQ ID NO: 163366 - DNA, 38 bp, Artificial Sequence
  Synthetic oligonucleotide
tctgtagcccaactgcgacgaacgttccccccctttga

SEQ ID NO: 163367 - DNA, 35 bp, Artificial Sequence
  Synthetic oligonucleotide
ggaaaggtggcggagggcaagggcagagaatcata

SEQ ID NO: 163368 - DNA, 35 bp, Artificial Sequence
  Synthetic oligonucleotide
gcatcccccccggtgatccgacaacctaccgccta

SEQ ID NO: 163369 - DNA, 36 bp, Artificial Sequence
  Synthetic oligonucleotide
ccgggcgggcgtagggtcgggttaatgtgtgcagta

SEQ ID NO: 163370 - DNA, 35 bp, Artificial Sequence
  Synthetic oligonucleotide
acccctaccgccctccaaagcgactgctctcagta

SEQ ID NO: 163371 - DNA, 36 bp, Artificial Sequence
  Synthetic oligonucleotide
gaagtggggtggggcggggtaagtaacctgaacgta

SEQ ID NO: 163372 - DNA, 36 bp, Artificial Sequence
  Synthetic oligonucleotide
gtctctgcccgcgcccctccctagtccacctgcgta

SEQ ID NO: 163373 - DNA, 36 bp, Artificial Sequence
  Synthetic oligonucleotide
ggacgatgtatcggaggggaggggcggacacaggta

SEQ ID NO: 163374 - DNA, 36 bp, Artificial Sequence
  Synthetic oligonucleotide
ttagatgttcgcccatctgtattcttagctccttta

SEQ ID NO: 163375 - DNA, 35 bp, Artificial Sequence
  Synthetic oligonucleotide
tcccctcgccagattccatcattgagcccatccac

SEQ ID NO: 163376 - DNA, 35 bp, Artificial Sequence
  Synthetic oligonucleotide
tgcgaaccgcatactcaatgtgcctgttcttccac

SEQ ID NO: 163377 - DNA, 35 bp, Artificial Sequence
  Synthetic oligonucleotide
acgtcgtaccatcccgttgacgagacctccctgac

SEQ ID NO: 163378 - DNA, 35 bp, Artificial Sequence
  Synthetic oligonucleotide
gcttactgcctgtgcaccatctttctacggtctac

SEQ ID NO: 163379 - DNA, 35 bp, Artificial Sequence
  Synthetic oligonucleotide
acgccccacctggtctctcacgtcggctgaacccc

SEQ ID NO: 163380 - DNA, 35 bp, Artificial Sequence
  Synthetic oligonucleotide
tccagaccctgggtgaatcgttacatcacctcccc

SEQ ID NO: 163381 - DNA, 35 bp, Artificial Sequence
  Synthetic oligonucleotide
gactcgctgaaccgataacataggctctattcccc

SEQ ID NO: 163382 - DNA, 35 bp, Artificial Sequence
  Synthetic oligonucleotide
tgcacaattgcccaaatgtcctgcggtactatccc

SEQ ID NO: 163383 - DNA, 35 bp, Artificial Sequence
  Synthetic oligonucleotide
acagttcctgcccgcagtttaatctattcctgtcc

SEQ ID NO: 163384 - DNA, 35 bp, Artificial Sequence
  Synthetic oligonucleotide
tgtgtccccgccgtggtcgcgcacttctcacttcc

SEQ ID NO: 163385 - DNA, 35 bp, Artificial Sequence
  Synthetic oligonucleotide
agtactccgccgtcccgccgcctccattgcacagc

SEQ ID NO: 163386 - DNA, 35 bp, Artificial Sequence
  Synthetic oligonucleotide
gccttcactcaccaattttgctatatgcaccccgc

SEQ ID NO: 163387 - DNA, 35 bp, Artificial Sequence
  Synthetic oligonucleotide
tccgacccaacgcctacgctgatcaccgctcccgc

SEQ ID NO: 163388 - DNA, 35 bp, Artificial Sequence
  Synthetic oligonucleotide
tacaccgagcgcctcatgtcatcccatagtcttgc

SEQ ID NO: 163389 - DNA, 35 bp, Artificial Sequence
  Synthetic oligonucleotide
tacgccccaggtttactctgccccgataatatatc

SEQ ID NO: 163390 - DNA, 35 bp, Artificial Sequence
  Synthetic oligonucleotide
atcccacacacatgatctcacgacctgtcctgctc

SEQ ID NO: 163391 - DNA, 35 bp, Artificial Sequence
  Synthetic oligonucleotide
tttcaccaccgatcgtcttcacctggccttttctc

SEQ ID NO: 163392 - DNA, 35 bp, Artificial Sequence
  Synthetic oligonucleotide
gggatcgctaacttcctcgttctcgccccttggtc

SEQ ID NO: 163393 - DNA, 35 bp, Artificial Sequence
  Synthetic oligonucleotide
tagcctcaccacttgcgcctcaaaggtctcgattc

SEQ ID NO: 163394 - DNA, 35 bp, Artificial Sequence
  Synthetic oligonucleotide
gtccactctggcgctcctaagccgactttatattc

SEQ ID NO: 163395 - DNA, 35 bp, Artificial Sequence
  Synthetic oligonucleotide
acaccatcgccgccatttctgttcctgccaccgag

SEQ ID NO: 163396 - DNA, 35 bp, Artificial Sequence
  Synthetic oligonucleotide
tagggtaggaaggggaaaaggtagatcgagtgacg

SEQ ID NO: 163397 - DNA, 35 bp, Artificial Sequence
  Synthetic oligonucleotide
attcagccgccgcttttggtccctattattatccg

SEQ ID NO: 163398 - DNA, 35 bp, Artificial Sequence
  Synthetic oligonucleotide
gccctcgataaaatgcttcaaggccttcacctccg

SEQ ID NO: 163399 - DNA, 35 bp, Artificial Sequence
  Synthetic oligonucleotide
gccagccgccctctcatccgccagaaagacctccg

SEQ ID NO: 163400 - DNA, 35 bp, Artificial Sequence
  Synthetic oligonucleotide
acatagcagaggaggcctccaccatctgtcccctg

SEQ ID NO: 163401 - DNA, 35 bp, Artificial Sequence
  Synthetic oligonucleotide
acccccgagagtattaaacgcacctaccttccctg

SEQ ID NO: 163402 - DNA, 35 bp, Artificial Sequence
  Synthetic oligonucleotide
tcatgcaggaatcgatcgtagccaccttactcctg

SEQ ID NO: 163403 - DNA, 35 bp, Artificial Sequence
  Synthetic oligonucleotide
ttcgacctccaccgaccttcctagttccaaatgtg

SEQ ID NO: 163404 - DNA, 35 bp, Artificial Sequence
  Synthetic oligonucleotide
aaaacgcacgggggaacaaggaacaatgcggcaat

SEQ ID NO: 163405 - DNA, 35 bp, Artificial Sequence
  Synthetic oligonucleotide
tcgccgcccgcacgtcgactggactcctttttcat

SEQ ID NO: 163406 - DNA, 35 bp, Artificial Sequence
  Synthetic oligonucleotide
aagtcccccccggctccctgctggtactcctacct

SEQ ID NO: 163407 - DNA, 35 bp, Artificial Sequence
  Synthetic oligonucleotide
tacggagctccggagcctcactgcgccttctgcct

SEQ ID NO: 163408 - DNA, 35 bp, Artificial Sequence
  Synthetic oligonucleotide
actggatctccgccaactgacgttaccaacttcct

SEQ ID NO: 163409 - DNA, 35 bp, Artificial Sequence
  Synthetic oligonucleotide
tggtggagatggggtcggggtggtacggtggcagt

SEQ ID NO: 163410 - DNA, 35 bp, Artificial Sequence
  Synthetic oligonucleotide
gtgcgctgatccggcctggcttcttccttctcatt

SEQ ID NO: 163411 - DNA, 35 bp, Artificial Sequence
  Synthetic oligonucleotide
ggtgcactacccgccaaggtttattctcctgcctt

SEQ ID NO: 163412 - DNA, 35 bp, Artificial Sequence
  Synthetic oligonucleotide
attgcattcgttcctagcgttactacctcgtcctt

SEQ ID NO: 163413 - DNA, 35 bp, Artificial Sequence
  Synthetic oligonucleotide
tgccgtgtatgatcctgctcccttatcgatcgttt

SEQ ID NO: 163414 - DNA, 36 bp, Artificial Sequence
  Synthetic oligonucleotide
tcatcatccctcccgtgcgcatttcgaattggaaaa

SEQ ID NO: 163415 - DNA, 35 bp, Artificial Sequence
  Synthetic oligonucleotide
agaggtgagtgggaaagggggggattcggcgacaa

SEQ ID NO: 163416 - DNA, 36 bp, Artificial Sequence
  Synthetic oligonucleotide
acctcgttcctaactgtatccacgtccctgctctaa

SEQ ID NO: 163417 - DNA, 35 bp, Artificial Sequence
  Synthetic oligonucleotide
ggtgctcgcaaccacatgcgctgccacatcttaca

SEQ ID NO: 163418 - DNA, 36 bp, Artificial Sequence
  Synthetic oligonucleotide
ggaggaaaggcagaagagcgggggtagtcagcagca

SEQ ID NO: 163419 - DNA, 36 bp, Artificial Sequence
  Synthetic oligonucleotide
tacgcccatgtctcggctcttcacgctccccacgca

SEQ ID NO: 163420 - DNA, 36 bp, Artificial Sequence
  Synthetic oligonucleotide
tgccctatcacacatgttttcagctcttcttgttca

SEQ ID NO: 163421 - DNA, 36 bp, Artificial Sequence
  Synthetic oligonucleotide
gacgtggcgctcgctcccccccgccgatggttccga

SEQ ID NO: 163422 - DNA, 37 bp, Artificial Sequence
  Synthetic oligonucleotide
tgacgccacttgcaccggtatccttccccatttccga

SEQ ID NO: 163423 - DNA, 37 bp, Artificial Sequence
  Synthetic oligonucleotide
gccaacgtcactttggccctttttcaccctccttcga

SEQ ID NO: 163424 - DNA, 37 bp, Artificial Sequence
  Synthetic oligonucleotide
tgccatccccaatcgttatttctcctttgtgcacgga

SEQ ID NO: 163425 - DNA, 37 bp, Artificial Sequence
  Synthetic oligonucleotide
agcaaacgggggggcgagggacgtcaatcctacggga

SEQ ID NO: 163426 - DNA, 36 bp, Artificial Sequence
  Synthetic oligonucleotide
gatgtgggaatgggggggaggctgccggcacgggga

SEQ ID NO: 163427 - DNA, 36 bp, Artificial Sequence
  Synthetic oligonucleotide
tgaggagaggagggtttacatgggcgaactggggga

SEQ ID NO: 163428 - DNA, 37 bp, Artificial Sequence
  Synthetic oligonucleotide
ggagtgtcgagcgggcggaaaatgatggaactgggga

SEQ ID NO: 163429 - DNA, 37 bp, Artificial Sequence
  Synthetic oligonucleotide
tcagtacgggagggtgggtgtctgtaccagcctggga

SEQ ID NO: 163430 - DNA, 37 bp, Artificial Sequence
  Synthetic oligonucleotide
tgccgcacccgccctgaaccgattagttgcccatgga

SEQ ID NO: 163431 - DNA, 34 bp, Artificial Sequence
  Synthetic oligonucleotide
tacaacccattcccctattcatgccgcccactga

SEQ ID NO: 163432 - DNA, 38 bp, Artificial Sequence
  Synthetic oligonucleotide
tcccctcccacgcccgtttttacaagtcgacaacctga

SEQ ID NO: 163433 - DNA, 38 bp, Artificial Sequence
  Synthetic oligonucleotide
tccgcacgtcctatcatttcgacccttgcttccgctga

SEQ ID NO: 163434 - DNA, 37 bp, Artificial Sequence
  Synthetic oligonucleotide
acgctcccccgttgcccattgtatactgccctgctga

SEQ ID NO: 163435 - DNA, 38 bp, Artificial Sequence
  Synthetic oligonucleotide
gagtccccgcaaatagtaacgtaatcctgcccttctga

SEQ ID NO: 163436 - DNA, 38 bp, Artificial Sequence
  Synthetic oligonucleotide
gtgaacctgcaagaaggtgggggggggaggggacgtga

SEQ ID NO: 163437 - DNA, 36 bp, Artificial Sequence
  Synthetic oligonucleotide
tcaaccctgccccatcgtttaccccgcttatggata

SEQ ID NO: 163438 - DNA, 35 bp, Artificial Sequence
  Synthetic oligonucleotide
tctcaccatcactctcgctagccgccgcgccccta

SEQ ID NO: 163439 - DNA, 35 bp, Artificial Sequence
  Synthetic oligonucleotide
gcacctcctgtttacgccggactgcccccgtccta

SEQ ID NO: 163440 - DNA, 36 bp, Artificial Sequence
  Synthetic oligonucleotide
gacgcactaccattcggtgctgtttccttcgatcta

SEQ ID NO: 163441 - DNA, 36 bp, Artificial Sequence
  Synthetic oligonucleotide
actttgaccgcacctgtccccgcctccgatcctgta

SEQ ID NO: 163442 - DNA, 36 bp, Artificial Sequence
  Synthetic oligonucleotide
tcacctgcccctgctctggtcgtcccagatccatta

SEQ ID NO: 163443 - DNA, 36 bp, Artificial Sequence
  Synthetic oligonucleotide
atgtgtaacgccgccccatgcttgaactgtccttta

SEQ ID NO: 163444 - DNA, 36 bp, Artificial Sequence
  Synthetic oligonucleotide
ggtacacccgcagcccttgccattctcaatttttta

SEQ ID NO: 163445 - DNA, 35 bp, Artificial Sequence
  Synthetic oligonucleotide
ttgcgccgcccgtcccaagcgtcttctgctaacac

SEQ ID NO: 163446 - DNA, 35 bp, Artificial Sequence
  Synthetic oligonucleotide
gaccagcatacattctcgttgcgttgaccctgcac

SEQ ID NO: 163447 - DNA, 35 bp, Artificial Sequence
  Synthetic oligonucleotide
ttgatgcgtgcgttacttgtcctttcgcgtttcac

SEQ ID NO: 163448 - DNA, 35 bp, Artificial Sequence
  Synthetic oligonucleotide
tagccaccccaatctgccccttgttggattcgtac

SEQ ID NO: 163449 - DNA, 35 bp, Artificial Sequence
  Synthetic oligonucleotide
gacgcatcaccccatggccactatctgctctttac

SEQ ID NO: 163450 - DNA, 35 bp, Artificial Sequence
  Synthetic oligonucleotide
gcaggccacgccgctgcgattgccgccacgctacc

SEQ ID NO: 163451 - DNA, 35 bp, Artificial Sequence
  Synthetic oligonucleotide
gctctcctcctgaaatggcttgctgtacctgcccc

SEQ ID NO: 163452 - DNA, 35 bp, Artificial Sequence
  Synthetic oligonucleotide
tgctcggccgagatgatcgtctgttccgctgcccc

SEQ ID NO: 163453 - DNA, 35 bp, Artificial Sequence
  Synthetic oligonucleotide
gatccatacgctcacaggttacacgttccccgccc

SEQ ID NO: 163454 - DNA, 33 bp, Artificial Sequence
  Synthetic oligonucleotide
gtccctcccctcccgacgaaggatccactgccc

SEQ ID NO: 163455 - DNA, 35 bp, Artificial Sequence
  Synthetic oligonucleotide
ttcgtcaacgcaataccctcccatggccgcttccc

SEQ ID NO: 163456 - DNA, 35 bp, Artificial Sequence
  Synthetic oligonucleotide
gtacccacatgttcctgatcgcatattttcgcgcc

SEQ ID NO: 163457 - DNA, 35 bp, Artificial Sequence
  Synthetic oligonucleotide
gacactcatctgcacaccacggtctccaaacgtcc

SEQ ID NO: 163458 - DNA, 35 bp, Artificial Sequence
  Synthetic oligonucleotide
ggggtccctcacctatccatgagccactgctttcc

SEQ ID NO: 163459 - DNA, 35 bp, Artificial Sequence
  Synthetic oligonucleotide
acgcgcacttggtctgtctccccttaacctcacgc

SEQ ID NO: 163460 - DNA, 35 bp, Artificial Sequence
  Synthetic oligonucleotide
tagctgggagggtgggctgcaagggagggtagcgc

SEQ ID NO: 163461 - DNA, 35 bp, Artificial Sequence
  Synthetic oligonucleotide
tgtaacgtacctaagactatttgttccgtccctgc

SEQ ID NO: 163462 - DNA, 35 bp, Artificial Sequence
  Synthetic oligonucleotide
atccagacctcttggtacggtttaattctcccatc

SEQ ID NO: 163463 - DNA, 35 bp, Artificial Sequence
  Synthetic oligonucleotide
gaccgggcctgcctaccacatccgtccattccatc

SEQ ID NO: 163464 - DNA, 35 bp, Artificial Sequence
  Synthetic oligonucleotide
gacatgtgatgctatttcgccctctgttctaactc

SEQ ID NO: 163465 - DNA, 35 bp, Artificial Sequence
  Synthetic oligonucleotide
gtaggacacgtttcaagcagtcgccccaacacctc

SEQ ID NO: 163466 - DNA, 35 bp, Artificial Sequence
  Synthetic oligonucleotide
acccacctggccctgccatccagttgccgctcctc

SEQ ID NO: 163467 - DNA, 35 bp, Artificial Sequence
  Synthetic oligonucleotide
gcgacctccgacccgctgtccacaataccaatctc

SEQ ID NO: 163468 - DNA, 35 bp, Artificial Sequence
  Synthetic oligonucleotide
tcaaccacgctgttctcgtcccgtccgtccctgtc

SEQ ID NO: 163469 - DNA, 35 bp, Artificial Sequence
  Synthetic oligonucleotide
tgacgtctcactttgattatcttttcagtcctgtc

SEQ ID NO: 163470 - DNA, 35 bp, Artificial Sequence
  Synthetic oligonucleotide
gccttgatcctccgacccttgaatttagccggttc

SEQ ID NO: 163471 - DNA, 34 bp, Artificial Sequence
  Synthetic oligonucleotide
actctgggtacactgctcgcgcttattgcctttc

SEQ ID NO: 163472 - DNA, 35 bp, Artificial Sequence
  Synthetic oligonucleotide
gatcagctaactcgtcgtaagcccgccgttctttc

SEQ ID NO: 163473 - DNA, 35 bp, Artificial Sequence
  Synthetic oligonucleotide
gtttgggtccgagaggggatgggaaaggtgtggag

SEQ ID NO: 163474 - DNA, 35 bp, Artificial Sequence
  Synthetic oligonucleotide
tctagcccaaccgcatcttcacctactactgtacg

SEQ ID NO: 163475 - DNA, 35 bp, Artificial Sequence
  Synthetic oligonucleotide
agccccgagccgatgaagccgtcccgaacctcccg

SEQ ID NO: 163476 - DNA, 35 bp, Artificial Sequence
  Synthetic oligonucleotide
gtgcgcttccgttgttccagtttctcctcacagcg

SEQ ID NO: 163477 - DNA, 35 bp, Artificial Sequence
  Synthetic oligonucleotide
gggtggcggggggtttttgcggatggcacatcgcg

SEQ ID NO: 163478 - DNA, 36 bp, Artificial Sequence
  Synthetic oligonucleotide
tgcatccccgcggcttcggagtacttcccccctgcg

SEQ ID NO: 163479 - DNA, 35 bp, Artificial Sequence
  Synthetic oligonucleotide
tcaacaccaacccgtgcgaataacatcaccgtgcg

SEQ ID NO: 163480 - DNA, 35 bp, Artificial Sequence
  Synthetic oligonucleotide
gtctgtgctggtcactaagccttctcccctattcg

SEQ ID NO: 163481 - DNA, 35 bp, Artificial Sequence
  Synthetic oligonucleotide
gcgtgatgcgctatgacggagggaggggaaaaagg

SEQ ID NO: 163482 - DNA, 35 bp, Artificial Sequence
  Synthetic oligonucleotide
ttgccacccgctatactcgtcgacctgccgctggg

SEQ ID NO: 163483 - DNA, 35 bp, Artificial Sequence
  Synthetic oligonucleotide
gttgagagcaaaggtggacgggtagataggattgg

SEQ ID NO: 163484 - DNA, 35 bp, Artificial Sequence
  Synthetic oligonucleotide
acccaggccatcgactaccccgccgtactaccatg

SEQ ID NO: 163485 - DNA, 35 bp, Artificial Sequence
  Synthetic oligonucleotide
tagatctcctgccgcagctccaccagcctgccctg

SEQ ID NO: 163486 - DNA, 35 bp, Artificial Sequence
  Synthetic oligonucleotide
aggggggggaggggcgggtacgaggcagggggcat

SEQ ID NO: 163487 - DNA, 35 bp, Artificial Sequence
  Synthetic oligonucleotide
actacgcatggttggcctcccctctgttcattgct

SEQ ID NO: 163488 - DNA, 35 bp, Artificial Sequence
  Synthetic oligonucleotide
gcgtgccccacacccttgccctggttctttccagt

SEQ ID NO: 163489 - DNA, 35 bp, Artificial Sequence
  Synthetic oligonucleotide
tgcgggtgagagggcgggggagcacttgggtgagt

SEQ ID NO: 163490 - DNA, 35 bp, Artificial Sequence
  Synthetic oligonucleotide
gaatcaccggcggggggaggagaggagtagtctgt

SEQ ID NO: 163491 - DNA, 35 bp, Artificial Sequence
  Synthetic oligonucleotide
acctgcccggaccctgtcgtactcactttcgattt

SEQ ID NO: 163492 - DNA, 35 bp, Artificial Sequence
  Synthetic oligonucleotide
gatacgcctatatgcgcaacacaacctacgccttt

SEQ ID NO: 163493 - DNA, 36 bp, Artificial Sequence
  Synthetic oligonucleotide
tcaccggagagggatcaggtagggattggggaaaaa

SEQ ID NO: 163494 - DNA, 36 bp, Artificial Sequence
  Synthetic oligonucleotide
tgatagcatgctgatggccgccacacctccgccaaa

SEQ ID NO: 163495 - DNA, 36 bp, Artificial Sequence
  Synthetic oligonucleotide
ggtgcgggaagggggggaaaaacatgggttaagaaa

SEQ ID NO: 163496 - DNA, 35 bp, Artificial Sequence
  Synthetic oligonucleotide
aggaaacggggtagaattggggcaaggggtggcaa

SEQ ID NO: 163497 - DNA, 35 bp, Artificial Sequence
  Synthetic oligonucleotide
tgagcaggagccaagggagggaagagggggaataa

SEQ ID NO: 163498 - DNA, 36 bp, Artificial Sequence
  Synthetic oligonucleotide
agatggccatgcccgtactgccgaccctatttcaca

SEQ ID NO: 163499 - DNA, 36 bp, Artificial Sequence
  Synthetic oligonucleotide
atcccaccccccgcggtttcttctgtccgttaacca

SEQ ID NO: 163500 - DNA, 36 bp, Artificial Sequence
  Synthetic oligonucleotide
acattgcacagatgaaccacacgaacccctgcccca

SEQ ID NO: 163501 - DNA, 35 bp, Artificial Sequence
  Synthetic oligonucleotide
ttcaacagtgacccctgccaggactgccctcccca

SEQ ID NO: 163502 - DNA, 35 bp, Artificial Sequence
  Synthetic oligonucleotide
gtatcttgcgcatgttctgctacttccccactcca

SEQ ID NO: 163503 - DNA, 36 bp, Artificial Sequence
  Synthetic oligonucleotide
gtctatgccatcccggtgcggaaaacactccctcca

SEQ ID NO: 163504 - DNA, 36 bp, Artificial Sequence
  Synthetic oligonucleotide
gtgtgtggtgtggtgtataaagggcgggggagggca

SEQ ID NO: 163505 - DNA, 36 bp, Artificial Sequence
  Synthetic oligonucleotide
agcaccgcaagtcctccaacctcagccgtaccatca

SEQ ID NO: 163506 - DNA, 36 bp, Artificial Sequence
  Synthetic oligonucleotide
aggaagagaggagggaggaggttagggacgtgatca

SEQ ID NO: 163507 - DNA, 36 bp, Artificial Sequence
  Synthetic oligonucleotide
acgccttccccagtcgacttgacgctgcatccctca

SEQ ID NO: 163508 - DNA, 36 bp, Artificial Sequence
  Synthetic oligonucleotide
atcacctaacagattatcgttacgcaccacctctca

SEQ ID NO: 163509 - DNA, 37 bp, Artificial Sequence
  Synthetic oligonucleotide
atagtgtcggggaggattacggcgggggggacacaga

SEQ ID NO: 163510 - DNA, 35 bp, Artificial Sequence
  Synthetic oligonucleotide
actgggagacgggagagggccgaaccagggggaga

SEQ ID NO: 163511 - DNA, 37 bp, Artificial Sequence
  Synthetic oligonucleotide
gtgcccgcccccgtgccttgtccctcagtcgcgacga

SEQ ID NO: 163512 - DNA, 37 bp, Artificial Sequence
  Synthetic oligonucleotide
tcaccacccttctcccatgagatcgtatccgttacga

SEQ ID NO: 163513 - DNA, 37 bp, Artificial Sequence
  Synthetic oligonucleotide
tccagtcacattgcctcgtacgtacattcccacccga

SEQ ID NO: 163514 - DNA, 37 bp, Artificial Sequence
  Synthetic oligonucleotide
tgcctactgccacccatattagcccgcatgtccccga

SEQ ID NO: 163515 - DNA, 37 bp, Artificial Sequence
  Synthetic oligonucleotide
acgcccgcacctgtcctctggtcacgccccctgccga

SEQ ID NO: 163516 - DNA, 37 bp, Artificial Sequence
  Synthetic oligonucleotide
tgcacctcgccctctgcgctcttacagtatcccgcga

SEQ ID NO: 163517 - DNA, 35 bp, Artificial Sequence
  Synthetic oligonucleotide
gaatagggggcgtataaggtgtgaagggcgggcga

SEQ ID NO: 163518 - DNA, 37 bp, Artificial Sequence
  Synthetic oligonucleotide
ttgagaggtcgaaaagggggggggagagaacgtgcga

SEQ ID NO: 163519 - DNA, 36 bp, Artificial Sequence
  Synthetic oligonucleotide
acatccgcacctcctcaccgctgaaacctcactcga

SEQ ID NO: 163520 - DNA, 37 bp, Artificial Sequence
  Synthetic oligonucleotide
tttgtccgcctcgctccctctcgtgttatcaagcgga

SEQ ID NO: 163521 - DNA, 38 bp, Artificial Sequence
  Synthetic oligonucleotide
aatttgggcgggggggaacttgaagagcctgaacggga

SEQ ID NO: 163522 - DNA, 37 bp, Artificial Sequence
  Synthetic oligonucleotide
ttaaggcctgcctccgcccgttcagcctcctccggga

SEQ ID NO: 163523 - DNA, 37 bp, Artificial Sequence
  Synthetic oligonucleotide
ggagaggggctcgttatgggaatggggaacgggtgga

SEQ ID NO: 163524 - DNA, 37 bp, Artificial Sequence
  Synthetic oligonucleotide
agggacgggcactcgcggtggatagggggggggtgga

SEQ ID NO: 163525 - DNA, 36 bp, Artificial Sequence
  Synthetic oligonucleotide
tccctggtctcccacaccaacgtactgtcttgatga

SEQ ID NO: 163526 - DNA, 38 bp, Artificial Sequence
  Synthetic oligonucleotide
gaaagaccggggcaggaggataaacggggtgggtatga

SEQ ID NO: 163527 - DNA, 38 bp, Artificial Sequence
  Synthetic oligonucleotide
agaagggcggggaggggtctacagggtccgacagctga

SEQ ID NO: 163528 - DNA, 38 bp, Artificial Sequence
  Synthetic oligonucleotide
gacatcccagacgtcatgctccgtctttttccatctga

SEQ ID NO: 163529 - DNA, 37 bp, Artificial Sequence
  Synthetic oligonucleotide
gccacggagggtggggggggcggtataatgagtctga

SEQ ID NO: 163530 - DNA, 38 bp, Artificial Sequence
  Synthetic oligonucleotide
aacgggcaagagcgggacggtgggtgggcttggggtga

SEQ ID NO: 163531 - DNA, 35 bp, Artificial Sequence
  Synthetic oligonucleotide
aaggggggtggagaagggagagcgtaggcttgtga

SEQ ID NO: 163532 - DNA, 36 bp, Artificial Sequence
  Synthetic oligonucleotide
tccgctacttgcccctgcctatttcgcgccgccata

SEQ ID NO: 163533 - DNA, 35 bp, Artificial Sequence
  Synthetic oligonucleotide
atcccctgctccggtaatcacgccgaaccctagta

SEQ ID NO: 163534 - DNA, 35 bp, Artificial Sequence
  Synthetic oligonucleotide
tgtcccccacaccccgcccggcgcttgtaaccgta

SEQ ID NO: 163535 - DNA, 36 bp, Artificial Sequence
  Synthetic oligonucleotide
gccttcgccgggctgcctatgaacatccaatccgta

SEQ ID NO: 163536 - DNA, 35 bp, Artificial Sequence
  Synthetic oligonucleotide
gcctgaccccattggcaccttagtaatagttttta

SEQ ID NO: 163537 - DNA, 35 bp, Artificial Sequence
  Synthetic oligonucleotide
ggtagagtaccccgcaccgtcgccgttagcaccac

SEQ ID NO: 163538 - DNA, 36 bp, Artificial Sequence
  Synthetic oligonucleotide
gcccccctgcaagggatgagcacactcccgacccac

SEQ ID NO: 163539 - DNA, 35 bp, Artificial Sequence
  Synthetic oligonucleotide
tttaccgtaccatcatctctcacggcactagtgac

SEQ ID NO: 163540 - DNA, 35 bp, Artificial Sequence
  Synthetic oligonucleotide
acccgcaaggcgcgcccgttatttttcatcactac

SEQ ID NO: 163541 - DNA, 35 bp, Artificial Sequence
  Synthetic oligonucleotide
tgttcgccctccgcactcagtcggccccaccaacc

SEQ ID NO: 163542 - DNA, 35 bp, Artificial Sequence
  Synthetic oligonucleotide
accattgcgtgcattttccttcccttgcgtgaacc

SEQ ID NO: 163543 - DNA, 35 bp, Artificial Sequence
  Synthetic oligonucleotide
tactcctgtgcgtgtcgatctctacggctttcccc

SEQ ID NO: 163544 - DNA, 35 bp, Artificial Sequence
  Synthetic oligonucleotide
tcatgacgcaagcattgaatccagccgccctgccc

SEQ ID NO: 163545 - DNA, 35 bp, Artificial Sequence
  Synthetic oligonucleotide
gacctatatccccccgagtctacgcgacctgtccc

SEQ ID NO: 163546 - DNA, 35 bp, Artificial Sequence
  Synthetic oligonucleotide
gggtccgcctcgcgcctcacctatctccgtttccc

SEQ ID NO: 163547 - DNA, 35 bp, Artificial Sequence
  Synthetic oligonucleotide
agctggcatctcgtccgccgccccgcctcacagcc

SEQ ID NO: 163548 - DNA, 35 bp, Artificial Sequence
  Synthetic oligonucleotide
attaccacgttcgagcctcatctccagttctcgcc

SEQ ID NO: 163549 - DNA, 35 bp, Artificial Sequence
  Synthetic oligonucleotide
ggagccaccgctctccatttctactcgaggtcgcc

SEQ ID NO: 163550 - DNA, 35 bp, Artificial Sequence
  Synthetic oligonucleotide
ggaccctccaacctagatcttcagttccatctgcc

SEQ ID NO: 163551 - DNA, 35 bp, Artificial Sequence
  Synthetic oligonucleotide
atcttcctccgcttccgtatgggcgagccccttcc

SEQ ID NO: 163552 - DNA, 34 bp, Artificial Sequence
  Synthetic oligonucleotide
ttcgccgccccattgctttttccatccgtcttcc

SEQ ID NO: 163553 - DNA, 35 bp, Artificial Sequence
  Synthetic oligonucleotide
gagtccaagcctgatgggcccccaccctccgttcc

SEQ ID NO: 163554 - DNA, 35 bp, Artificial Sequence
  Synthetic oligonucleotide
aagctctgccactcacccattgccgttccacacgc

SEQ ID NO: 163555 - DNA, 35 bp, Artificial Sequence
  Synthetic oligonucleotide
tagtccgacgtccctcttctcgactaccatgccgc

SEQ ID NO: 163556 - DNA, 35 bp, Artificial Sequence
  Synthetic oligonucleotide
gccagccccctttccccatgtagagccgtttccgc

SEQ ID NO: 163557 - DNA, 35 bp, Artificial Sequence
  Synthetic oligonucleotide
agtgcctaaagcctacatgcccctcgaccccctgc

SEQ ID NO: 163558 - DNA, 35 bp, Artificial Sequence
  Synthetic oligonucleotide
ggaccattcatgccctgcttagcccaggcccgtgc

SEQ ID NO: 163559 - DNA, 34 bp, Artificial Sequence
  Synthetic oligonucleotide
tagcaaacatcggtccactccctcgatccattgc

SEQ ID NO: 163560 - DNA, 35 bp, Artificial Sequence
  Synthetic oligonucleotide
tgtgtactgcccccgcctccatgactggaaacatc

SEQ ID NO: 163561 - DNA, 35 bp, Artificial Sequence
  Synthetic oligonucleotide
gctgactaaccgtagcgtgcacatctgcctacatc

SEQ ID NO: 163562 - DNA, 35 bp, Artificial Sequence
  Synthetic oligonucleotide
tccgacaccgcttgcatgtctttgaattcctactc

SEQ ID NO: 163563 - DNA, 35 bp, Artificial Sequence
  Synthetic oligonucleotide
gttgcggaccattctcagctgccccgtggcccctc

SEQ ID NO: 163564 - DNA, 35 bp, Artificial Sequence
  Synthetic oligonucleotide
gcccacatgttgtacatgcctatacattgatcctc

SEQ ID NO: 163565 - DNA, 35 bp, Artificial Sequence
  Synthetic oligonucleotide
gcgtgctccagccctctgttcgctcattactcctc

SEQ ID NO: 163566 - DNA, 35 bp, Artificial Sequence
  Synthetic oligonucleotide
gccatttgtcggtctttaatcgctcccatctggtc

SEQ ID NO: 163567 - DNA, 35 bp, Artificial Sequence
  Synthetic oligonucleotide
gtcacaactccctgcccgtaaacctggtgccattc

SEQ ID NO: 163568 - DNA, 35 bp, Artificial Sequence
  Synthetic oligonucleotide
gcatacccagtcgctgctcgccaccctgtgacttc

SEQ ID NO: 163569 - DNA, 35 bp, Artificial Sequence
  Synthetic oligonucleotide
attgccgcagcctatcctaagcgcgctctttcttc

SEQ ID NO: 163570 - DNA, 35 bp, Artificial Sequence
  Synthetic oligonucleotide
tcccatgcgcacatctcctgttctttccgtggttc

SEQ ID NO: 163571 - DNA, 35 bp, Artificial Sequence
  Synthetic oligonucleotide
gccatctgtcctgtttcccgtgacgtcctcatttc

SEQ ID NO: 163572 - DNA, 35 bp, Artificial Sequence
  Synthetic oligonucleotide
gctcacgtcggtcatcgtttttctacccccgtaag

SEQ ID NO: 163573 - DNA, 35 bp, Artificial Sequence
  Synthetic oligonucleotide
tacctgagcccacattgcacccctagccaaactag

SEQ ID NO: 163574 - DNA, 35 bp, Artificial Sequence
  Synthetic oligonucleotide
gtcacactggcccgctccccctcgtcaccacgtag

SEQ ID NO: 163575 - DNA, 35 bp, Artificial Sequence
  Synthetic oligonucleotide
acgaggggaggcccggaatggggagacggggtacg

SEQ ID NO: 163576 - DNA, 35 bp, Artificial Sequence
  Synthetic oligonucleotide
tgaccatcgtcccatttgcactccatgtccctccg

SEQ ID NO: 163577 - DNA, 35 bp, Artificial Sequence
  Synthetic oligonucleotide
acccgacgcaccttcccactctgcacactctgtgg

SEQ ID NO: 163578 - DNA, 35 bp, Artificial Sequence
  Synthetic oligonucleotide
gacaccacccctctgctaattgttaccacaacttg

SEQ ID NO: 163579 - DNA, 35 bp, Artificial Sequence
  Synthetic oligonucleotide
acctccaccgctgtatcgattacaccctgcccaat

SEQ ID NO: 163580 - DNA, 35 bp, Artificial Sequence
  Synthetic oligonucleotide
acgcccggccctctacctcgtttgccgtgttccat

SEQ ID NO: 163581 - DNA, 35 bp, Artificial Sequence
  Synthetic oligonucleotide
aaaaccgccccctgcaatccgtgttctcccgatat

SEQ ID NO: 163582 - DNA, 35 bp, Artificial Sequence
  Synthetic oligonucleotide
gcgcctccacctggtaactaaaacccgctcccact

SEQ ID NO: 163583 - DNA, 35 bp, Artificial Sequence
  Synthetic oligonucleotide
acaccctgcgcctatatcataggggctctgttcct

SEQ ID NO: 163584 - DNA, 35 bp, Artificial Sequence
  Synthetic oligonucleotide
gaaccatcgggccgcattttacctcgctccacggt

SEQ ID NO: 163585 - DNA, 35 bp, Artificial Sequence
  Synthetic oligonucleotide
gactccatccacccagccggtacccatctaattgt

SEQ ID NO: 163586 - DNA, 35 bp, Artificial Sequence
  Synthetic oligonucleotide
gttgacgggcgctatgcagttctccccatttcctt

SEQ ID NO: 163587 - DNA, 36 bp, Artificial Sequence
  Synthetic oligonucleotide
ttccactcgttgtgctcacctgtccatcccgcaaaa

SEQ ID NO: 163588 - DNA, 35 bp, Artificial Sequence
  Synthetic oligonucleotide
acttcacgtcctgcccgtctttttccatcctcaaa

SEQ ID NO: 163589 - DNA, 36 bp, Artificial Sequence
  Synthetic oligonucleotide
atgatggggtagaggggctgcagacagggcgtcgaa

SEQ ID NO: 163590 - DNA, 35 bp, Artificial Sequence
  Synthetic oligonucleotide
agtgcctgcaacaccgtccaatgcccatctacaca

SEQ ID NO: 163591 - DNA, 34 bp, Artificial Sequence
  Synthetic oligonucleotide
tacgccgttgcatccacatgttctttatccgcca

SEQ ID NO: 163592 - DNA, 36 bp, Artificial Sequence
  Synthetic oligonucleotide
tgcgcacttaaccgcccagctaccgttctacctgca

SEQ ID NO: 163593 - DNA, 36 bp, Artificial Sequence
  Synthetic oligonucleotide
gccggaccctttcattggctaacaaggcctctctca

SEQ ID NO: 163594 - DNA, 36 bp, Artificial Sequence
  Synthetic oligonucleotide
aacaccaacgcccgaatcactcttcaacaccgttca

SEQ ID NO: 163595 - DNA, 37 bp, Artificial Sequence
  Synthetic oligonucleotide
gtgtggaaaaatggtgaagtaggaggagaggcagaga

SEQ ID NO: 163596 - DNA, 37 bp, Artificial Sequence
  Synthetic oligonucleotide
tgtacgggtcatcgcgggcgggggggagcttaggaga

SEQ ID NO: 163597 - DNA, 37 bp, Artificial Sequence
  Synthetic oligonucleotide
aatggcgacgaaccgggaaggggaaatgggtcggaga

SEQ ID NO: 163598 - DNA, 37 bp, Artificial Sequence
  Synthetic oligonucleotide
gtgagcgtggacaagtgggtgggaggctagagggaga

SEQ ID NO: 163599 - DNA, 36 bp, Artificial Sequence
  Synthetic oligonucleotide
aatccacccgcctctatgccgtcgcggtccctgaga

SEQ ID NO: 163600 - DNA, 35 bp, Artificial Sequence
  Synthetic oligonucleotide
gcacgtatcattctctgtcttgttcttgtcgccga

SEQ ID NO: 163601 - DNA, 37 bp, Artificial Sequence
  Synthetic oligonucleotide
tgaagctgccctccttgattttgcctcgattccgcga

SEQ ID NO: 163602 - DNA, 37 bp, Artificial Sequence
  Synthetic oligonucleotide
taagcccacatcgcctggtatcactctagctcctcga

SEQ ID NO: 163603 - DNA, 37 bp, Artificial Sequence
  Synthetic oligonucleotide
tcccgtcctttgcctgccctgccgaccgctttttcga

SEQ ID NO: 163604 - DNA, 37 bp, Artificial Sequence
  Synthetic oligonucleotide
actacacaccaccgctccattctataagtttcccgga

SEQ ID NO: 163605 - DNA, 37 bp, Artificial Sequence
  Synthetic oligonucleotide
atgaagcggcattaagataggaggggggtggcgcgga

SEQ ID NO: 163606 - DNA, 36 bp, Artificial Sequence
  Synthetic oligonucleotide
gactgacatagcgacgggttagggggggttaaggga

SEQ ID NO: 163607 - DNA, 38 bp, Artificial Sequence
  Synthetic oligonucleotide
gaaggggggtacaaagggagcggggcaaaggacaatga

SEQ ID NO: 163608 - DNA, 37 bp, Artificial Sequence
  Synthetic oligonucleotide
aagcgggggaacagagcgggcattggggtcaggatga

SEQ ID NO: 163609 - DNA, 38 bp, Artificial Sequence
  Synthetic oligonucleotide
gttatgggggcgagggcgggagggggcattaatactga

SEQ ID NO: 163610 - DNA, 37 bp, Artificial Sequence
  Synthetic oligonucleotide
gtgaccctcatagtacataaacgctacccttccctga

SEQ ID NO: 163611 - DNA, 38 bp, Artificial Sequence
  Synthetic oligonucleotide
gcatctggccaccgcttatccagtccctccgctcctga

SEQ ID NO: 163612 - DNA, 38 bp, Artificial Sequence
  Synthetic oligonucleotide
gtgggaagggcgggcggggtgtaacaggggagagctga

SEQ ID NO: 163613 - DNA, 36 bp, Artificial Sequence
  Synthetic oligonucleotide
taacacgagggggaggggcgtaaccgagggtcgtga

SEQ ID NO: 163614 - DNA, 38 bp, Artificial Sequence
  Synthetic oligonucleotide
gatagttacatgaggagggggacgagggaggtaggtga

SEQ ID NO: 163615 - DNA, 38 bp, Artificial Sequence
  Synthetic oligonucleotide
actgaccccgcctcatcttccgacccgctcatgggtga

SEQ ID NO: 163616 - DNA, 38 bp, Artificial Sequence
  Synthetic oligonucleotide
gttaccgacgccccacccgcccacagacacaggtttga

SEQ ID NO: 163617 - DNA, 35 bp, Artificial Sequence
  Synthetic oligonucleotide
tatgtctcacccccggcccgctcacgtttccgcta

SEQ ID NO: 163618 - DNA, 35 bp, Artificial Sequence
  Synthetic oligonucleotide
acgttgccacacttctccccacgactggtattcta

SEQ ID NO: 163619 - DNA, 36 bp, Artificial Sequence
  Synthetic oligonucleotide
tgcctcctccgttgaaacttttcccgtacttgagta

SEQ ID NO: 163620 - DNA, 36 bp, Artificial Sequence
  Synthetic oligonucleotide
acagccagtcttccgttgccaaccgtcaccgccgta

SEQ ID NO: 163621 - DNA, 35 bp, Artificial Sequence
  Synthetic oligonucleotide
agtaactccccctggtttaagcctatctctccgta

SEQ ID NO: 163622 - DNA, 35 bp, Artificial Sequence
  Synthetic oligonucleotide
aacatggacccgctagaataaccgccccgcacacc

SEQ ID NO: 163623 - DNA, 35 bp, Artificial Sequence
  Synthetic oligonucleotide
gcattcctgagcagtgcgtcctgtccatccctacc

SEQ ID NO: 163624 - DNA, 35 bp, Artificial Sequence
  Synthetic oligonucleotide
gtacgtcaggcactacccacgggccccttttcccc

SEQ ID NO: 163625 - DNA, 35 bp, Artificial Sequence
  Synthetic oligonucleotide
gccttcaccccattcccgcgctatgctggcaagcc

SEQ ID NO: 163626 - DNA, 35 bp, Artificial Sequence
  Synthetic oligonucleotide
atctctagccgccacatcagccgtcctactctgcc

SEQ ID NO: 163627 - DNA, 35 bp, Artificial Sequence
  Synthetic oligonucleotide
accaatgccgctttgtagctccctctcgctaatcc

SEQ ID NO: 163628 - DNA, 35 bp, Artificial Sequence
  Synthetic oligonucleotide
gtcgaccgtcagccacactccaaacccgccactcc

SEQ ID NO: 163629 - DNA, 35 bp, Artificial Sequence
  Synthetic oligonucleotide
tcacccccatccttatgcgcccaaggcatcgctcc

SEQ ID NO: 163630 - DNA, 35 bp, Artificial Sequence
  Synthetic oligonucleotide
tcccaaccctcttatatagcttccagggaatctcc

SEQ ID NO: 163631 - DNA, 35 bp, Artificial Sequence
  Synthetic oligonucleotide
gaccttccccgccctgcccgcgcgcgctctggtcc

SEQ ID NO: 163632 - DNA, 34 bp, Artificial Sequence
  Synthetic oligonucleotide
acccgctctgacgcagtcagaatacaccgattcc

SEQ ID NO: 163633 - DNA, 35 bp, Artificial Sequence
  Synthetic oligonucleotide
attggcaagctgcccctcacactctcttccggcgc

SEQ ID NO: 163634 - DNA, 35 bp, Artificial Sequence
  Synthetic oligonucleotide
tcacacccctctgtccacccttcgccttacggggc

SEQ ID NO: 163635 - DNA, 35 bp, Artificial Sequence
  Synthetic oligonucleotide
tagactccggacatttgtcacctaataccacctgc

SEQ ID NO: 163636 - DNA, 35 bp, Artificial Sequence
  Synthetic oligonucleotide
gccctgcccgctcccgtccctatggtttcgtgtgc

SEQ ID NO: 163637 - DNA, 35 bp, Artificial Sequence
  Synthetic oligonucleotide
gagctgcacgacacccggcgtcctaactgctcctc

SEQ ID NO: 163638 - DNA, 35 bp, Artificial Sequence
  Synthetic oligonucleotide
taatcctccgtggtaccggtctgtgactctcgctc

SEQ ID NO: 163639 - DNA, 36 bp, Artificial Sequence
  Synthetic oligonucleotide
aaaggggcgccgatcgttccgctcctgatcctgctc

SEQ ID NO: 163640 - DNA, 35 bp, Artificial Sequence
  Synthetic oligonucleotide
gttccctccgcctaaattgatgcccagggtctctc

SEQ ID NO: 163641 - DNA, 35 bp, Artificial Sequence
  Synthetic oligonucleotide
gcacctgcttcgcctgcttcccgtggctccacgtc

SEQ ID NO: 163642 - DNA, 35 bp, Artificial Sequence
  Synthetic oligonucleotide
atgtgtgccggtccgttcttccatgcctccttgtc

SEQ ID NO: 163643 - DNA, 35 bp, Artificial Sequence
  Synthetic oligonucleotide
agaccattcgccctgaaactactctcgttccattc

SEQ ID NO: 163644 - DNA, 35 bp, Artificial Sequence
  Synthetic oligonucleotide
tatcgtgccccactgaaccccaatgttgtcctacg

SEQ ID NO: 163645 - DNA, 35 bp, Artificial Sequence
  Synthetic oligonucleotide
gccgaatgccgtactcccccttcctgcttgaaccg

SEQ ID NO: 163646 - DNA, 35 bp, Artificial Sequence
  Synthetic oligonucleotide
tgtatgcgcaatgtatccccccgtcgtcaaccgcg

SEQ ID NO: 163647 - DNA, 35 bp, Artificial Sequence
  Synthetic oligonucleotide
agtgtataccgggaaatgtgcgggaagggggggcg

SEQ ID NO: 163648 - DNA, 35 bp, Artificial Sequence
  Synthetic oligonucleotide
gaggggcaagaggtgggtaggggggaccttgcagg

SEQ ID NO: 163649 - DNA, 35 bp, Artificial Sequence
  Synthetic oligonucleotide
gacatctcgttgcaacatcctcccccgcgctgtgg

SEQ ID NO: 163650 - DNA, 35 bp, Artificial Sequence
  Synthetic oligonucleotide
acattcctcgcagtgcgaaatgcccacccatcctg

SEQ ID NO: 163651 - DNA, 35 bp, Artificial Sequence
  Synthetic oligonucleotide
atgttcctcacgcctacaggaccgccccacacgtg

SEQ ID NO: 163652 - DNA, 35 bp, Artificial Sequence; identical to SEQ ID NO: 92670
  Synthetic oligonucleotide

SEQ ID NO: 163653 - DNA, 35 bp, Artificial Sequence
  Synthetic oligonucleotide
tcacttggccggatcggtctttcttctctcgccat

SEQ ID NO: 163654 - DNA, 35 bp, Artificial Sequence
  Synthetic oligonucleotide
gttgacccacctatccgttgtcctagaagccctat

SEQ ID NO: 163655 - DNA, 35 bp, Artificial Sequence
  Synthetic oligonucleotide
gtacacacccggcctcagggcattgctttttacct

SEQ ID NO: 163656 - DNA, 34 bp, Artificial Sequence
  Synthetic oligonucleotide
tttgcgccacgactatacatgtcctgcgaacctt

SEQ ID NO: 163657 - DNA, 35 bp, Artificial Sequence
  Synthetic oligonucleotide
taccctccccggccgatcaagcagttcttgtcctt

SEQ ID NO: 163658 - DNA, 35 bp, Artificial Sequence
  Synthetic oligonucleotide
tccactccacgatttgtgatcccccgccacccgtt

SEQ ID NO: 163659 - DNA, 35 bp, Artificial Sequence
  Synthetic oligonucleotide
tacgccccccggcattcgttatatagctctctgtt

SEQ ID NO: 163660 - DNA, 35 bp, Artificial Sequence
  Synthetic oligonucleotide
gccccattggcccctcaggctccttcgcaccattt

SEQ ID NO: 163661 - DNA, 36 bp, Artificial Sequence
  Synthetic oligonucleotide
atctgtccctcagcatatccgtttccctcgcccaaa

SEQ ID NO: 163662 - DNA, 36 bp, Artificial Sequence
  Synthetic oligonucleotide
gatccgccccttctgtgactgcttcgtatcccacaa

SEQ ID NO: 163663 - DNA, 36 bp, Artificial Sequence
  Synthetic oligonucleotide
aagggaagatggcgctggcagaaggacggggggcaa

SEQ ID NO: 163664 - DNA, 36 bp, Artificial Sequence
  Synthetic oligonucleotide
gacgggcatgagggagttcgtggaggggggagggaa

SEQ ID NO: 163665 - DNA, 35 bp, Artificial Sequence
  Synthetic oligonucleotide
aacgtcccgggagggggggtagttttgggaagtaa

SEQ ID NO: 163666 - DNA, 36 bp, Artificial Sequence
  Synthetic oligonucleotide
ttcgacccgttgtttactttttcgtgccactaccca

SEQ ID NO: 163667 - DNA, 34 bp, Artificial Sequence
  Synthetic oligonucleotide
aacaccatcttggactatcgactcttgactgcca

SEQ ID NO: 163668 - DNA, 36 bp, Artificial Sequence
  Synthetic oligonucleotide
ttgcaagggtagctgtcctcctattccgtcctgcca

SEQ ID NO: 163669 - DNA, 36 bp, Artificial Sequence
  Synthetic oligonucleotide
gtcgaccactgagtttccgttcccccgcaggttgca

SEQ ID NO: 163670 - DNA, 36 bp, Artificial Sequence
  Synthetic oligonucleotide
tacaccgcgccgggccgatcataccgctgtccatca

SEQ ID NO: 163671 - DNA, 35 bp, Artificial Sequence
  Synthetic oligonucleotide
tgaaagcgccaagccgtccccgttccgcccgatca

SEQ ID NO: 163672 - DNA, 36 bp, Artificial Sequence
  Synthetic oligonucleotide
atccgccacaactctgatttccctctgccctccaga

SEQ ID NO: 163673 - DNA, 37 bp, Artificial Sequence
  Synthetic oligonucleotide
gcacgtacgttctgttccatgcaaccatcctacccga

SEQ ID NO: 163674 - DNA, 37 bp, Artificial Sequence
  Synthetic oligonucleotide
ccgcccatccgcttgtcctatcgtcttcactcgccga

SEQ ID NO: 163675 - DNA, 37 bp, Artificial Sequence
  Synthetic oligonucleotide
ggggacggagtggcgggaggcttgacgaggaaggcga

SEQ ID NO: 163676 - DNA, 37 bp, Artificial Sequence
  Synthetic oligonucleotide
atccctgccacctattatatcgtcatcagctatgcga

SEQ ID NO: 163677 - DNA, 37 bp, Artificial Sequence
  Synthetic oligonucleotide
gccatgttgacgtgctgccttacttgcccctgttcga

SEQ ID NO: 163678 - DNA, 37 bp, Artificial Sequence
  Synthetic oligonucleotide
gtcacagtgacatacagcggatacggaggggggagga

SEQ ID NO: 163679 - DNA, 37 bp, Artificial Sequence
  Synthetic oligonucleotide
tcgtgaacggcaacagggaaggcgggggtgaaaggga

SEQ ID NO: 163680 - DNA, 37 bp, Artificial Sequence
  Synthetic oligonucleotide
gaccgccctcttgtgcttttgcccctatccatttgga

SEQ ID NO: 163681 - DNA, 35 bp, Artificial Sequence
  Synthetic oligonucleotide
tacgcggcaacacatcccctcccccgctggtatga

SEQ ID NO: 163682 - DNA, 37 bp, Artificial Sequence
  Synthetic oligonucleotide
agtgtctccgctatgtctctccgccggcctatcctga

SEQ ID NO: 163683 - DNA, 38 bp, Artificial Sequence
  Synthetic oligonucleotide
gaacagccgccccatttttattacccctgcgttcctga

SEQ ID NO: 163684 - DNA, 37 bp, Artificial Sequence
  Synthetic oligonucleotide
ttgtgaacgggccatggggggggaagggttaagctga

SEQ ID NO: 163685 - DNA, 38 bp, Artificial Sequence
  Synthetic oligonucleotide
tagcccgccccctttgcatccgatcagcaggacgctga

SEQ ID NO: 163686 - DNA, 38 bp, Artificial Sequence
  Synthetic oligonucleotide
agtagacagggggacataggagaagggtgagcacgtga

SEQ ID NO: 163687 - DNA, 38 bp, Artificial Sequence
  Synthetic oligonucleotide
atggacgaggagggcaggaagggaataacggtacgtga

SEQ ID NO: 163688 - DNA, 37 bp, Artificial Sequence
  Synthetic oligonucleotide
tgttcgccagttcttttttttcgccccaccatcgtga

SEQ ID NO: 163689 - DNA, 37 bp, Artificial Sequence
  Synthetic oligonucleotide
ttacccaccgccgcctcttacagcaaccaaacggtga

SEQ ID NO: 163690 - DNA, 37 bp, Artificial Sequence
  Synthetic oligonucleotide
gtggcctaaccgcctctctgctatatcacactggtga

SEQ ID NO: 163691 - DNA, 38 bp, Artificial Sequence
  Synthetic oligonucleotide
ggtcccccgccgccctccgtccgcaatcggttccttga

SEQ ID NO: 163692 - DNA, 36 bp, Artificial Sequence
  Synthetic oligonucleotide
actccccgtctagccctccctggaccccctagttga

SEQ ID NO: 163693 - DNA, 38 bp, Artificial Sequence
  Synthetic oligonucleotide
agtccctgccgctgccttccaggccttccacccgttga

SEQ ID NO: 163694 - DNA, 38 bp, Artificial Sequence
  Synthetic oligonucleotide
acccccccctcacattggctcttacatctccttgttga

SEQ ID NO: 163695 - DNA, 36 bp, Artificial Sequence
  Synthetic oligonucleotide
atgtccgtgacgacgtgcactgcccttccacacata

SEQ ID NO: 163696 - DNA, 36 bp, Artificial Sequence
  Synthetic oligonucleotide
ttccacctccgtctctcctttgcgctgtgtatccta

SEQ ID NO: 163697 - DNA, 35 bp, Artificial Sequence
  Synthetic oligonucleotide
gtcgccaccccttttcctccgatgggctatctcta

SEQ ID NO: 163698 - DNA, 35 bp, Artificial Sequence
  Synthetic oligonucleotide
tatccacccctgtgacttccacgtacgtttaagta

SEQ ID NO: 163699 - DNA, 36 bp, Artificial Sequence
  Synthetic oligonucleotide
tagccacaatgctaccgacgctcctcctgccccgta

SEQ ID NO: 163700 - DNA, 35 bp, Artificial Sequence
  Synthetic oligonucleotide
ttccgaaccccttcatctgagtaacgcgaaactta

SEQ ID NO: 163701 - DNA, 35 bp, Artificial Sequence
  Synthetic oligonucleotide
gccgcaccgagtacaccacacccagagcttaccac

SEQ ID NO: 163702 - DNA, 35 bp, Artificial Sequence
  Synthetic oligonucleotide
gctcaccccttcatgctccatatattgcgcgccac

SEQ ID NO: 163703 - DNA, 35 bp, Artificial Sequence
  Synthetic oligonucleotide
gtacgtcatcgagtttcccacacaagtccgtccac

SEQ ID NO: 163704 - DNA, 35 bp, Artificial Sequence
  Synthetic oligonucleotide
gtaaactgccgatgcgtcttctgccgtttcttcac

SEQ ID NO: 163705 - DNA, 35 bp, Artificial Sequence
  Synthetic oligonucleotide
gccgtccaggcgcatcattctgtaatttctcttac

SEQ ID NO: 163706 - DNA, 35 bp, Artificial Sequence
  Synthetic oligonucleotide
tgcgttcctaccgatcggtctgacttcacctcacc

SEQ ID NO: 163707 - DNA, 35 bp, Artificial Sequence
  Synthetic oligonucleotide
gccgacacccatcacctgcttgtatcacatctacc

SEQ ID NO: 163708 - DNA, 35 bp, Artificial Sequence
  Synthetic oligonucleotide
tccggactttccttgatatttggtacctcgctccc

SEQ ID NO: 163709 - DNA, 35 bp, Artificial Sequence
  Synthetic oligonucleotide
tgactcgttgtccttgtgccgtgcctactaccgcc

SEQ ID NO: 163710 - DNA, 35 bp, Artificial Sequence
  Synthetic oligonucleotide
ggtgtcatccgccatcgcctcgtctattcccgtcc

SEQ ID NO: 163711 - DNA, 34 bp, Artificial Sequence
  Synthetic oligonucleotide
tccatcgcgcccggctagggttttcactccgtcc

SEQ ID NO: 163712 - DNA, 35 bp, Artificial Sequence
  Synthetic oligonucleotide
taccacctccgattcgcccctgctgtttccctcgc

SEQ ID NO: 163713 - DNA, 35 bp, Artificial Sequence
  Synthetic oligonucleotide
aacaccgatacgttctgtttccatcccccccctgc

SEQ ID NO: 163714 - DNA, 35 bp, Artificial Sequence
  Synthetic oligonucleotide
tctgtccgccggactatatgacaactcttctctgc

SEQ ID NO: 163715 - DNA, 35 bp, Artificial Sequence
  Synthetic oligonucleotide
tgggcgcgtgctccctgttttatcggtcttacatc

SEQ ID NO: 163716 - DNA, 35 bp, Artificial Sequence
  Synthetic oligonucleotide
tgacggttcaacgcccgtacgcctctgactccatc

SEQ ID NO: 163717 - DNA, 35 bp, Artificial Sequence
  Synthetic oligonucleotide
gacatagttcacctcgttttcaaagcccactactc

SEQ ID NO: 163718 - DNA, 35 bp, Artificial Sequence
  Synthetic oligonucleotide
tgccccccactcacctaacgccgtaacgcgcgctc

SEQ ID NO: 163719 - DNA, 35 bp, Artificial Sequence
  Synthetic oligonucleotide
agttacgccccatgactaagcacgtctcatcgctc

SEQ ID NO: 163720 - DNA, 26 bp, Artificial Sequence
  Synthetic oligonucleotide
acatgtccgttccttttgctcctgtc

SEQ ID NO: 163721 - DNA, 35 bp, Artificial Sequence
  Synthetic oligonucleotide
atacacctcatgtggcgctccttaccctcgagttc

SEQ ID NO: 163722 - DNA, 35 bp, Artificial Sequence
  Synthetic oligonucleotide
tgagggtccagtagggcgtcattaatcctccgttc

SEQ ID NO: 163723 - DNA, 35 bp, Artificial Sequence
  Synthetic oligonucleotide
gacggcccctcgtattcctgcctcgatctccgttc

SEQ ID NO: 163724 - DNA, 35 bp, Artificial Sequence
  Synthetic oligonucleotide
tacccctccgtatggaccaagtgtccttctcgttc

SEQ ID NO: 163725 - DNA, 35 bp, Artificial Sequence
  Synthetic oligonucleotide
gcttacgtactggcctcactcgctcttgctccaag

SEQ ID NO: 163726 - DNA, 35 bp, Artificial Sequence
  Synthetic oligonucleotide
agttcgtcagtcggggtaagggggaggggggttag

SEQ ID NO: 163727 - DNA, 35 bp, Artificial Sequence
  Synthetic oligonucleotide
gccgccttccccctgttgccgcgttgggccctccg

SEQ ID NO: 163728 - DNA, 35 bp, Artificial Sequence
  Synthetic oligonucleotide
gacaaaataggtggtgaatagttgagggaggagcg

SEQ ID NO: 163729 - DNA, 35 bp, Artificial Sequence
  Synthetic oligonucleotide
tccgcccccccatcatcgtttaagcattcccggcg

SEQ ID NO: 163730 - DNA, 35 bp, Artificial Sequence
  Synthetic oligonucleotide
tagcccctcttgtgcgcttcagatcgtccctctcg

SEQ ID NO: 163731 - DNA, 35 bp, Artificial Sequence
  Synthetic oligonucleotide
agtgtacgcgagggtaaagggcggtgttgggaagg

SEQ ID NO: 163732 - DNA, 35 bp, Artificial Sequence
  Synthetic oligonucleotide
tccatccaatgctgatccacaaacctcgtacactg

SEQ ID NO: 163733 - DNA, 35 bp, Artificial Sequence
  Synthetic oligonucleotide
gcacaggcattttccgccgttgcccccccacccat

SEQ ID NO: 163734 - DNA, 35 bp, Artificial Sequence
  Synthetic oligonucleotide
gtgggtgggatagggggtgggggtcgaagttagat

SEQ ID NO: 163735 - DNA, 35 bp, Artificial Sequence
  Synthetic oligonucleotide
acacgcccatccgcgttattaagcccgccccgtat

SEQ ID NO: 163736 - DNA, 35 bp, Artificial Sequence
  Synthetic oligonucleotide
gtgccccaccatttctgacatccggttcgagtact

SEQ ID NO: 163737 - DNA, 35 bp, Artificial Sequence
  Synthetic oligonucleotide
gtccggccctctccgcattggctattagccgccct

SEQ ID NO: 163738 - DNA, 35 bp, Artificial Sequence
  Synthetic oligonucleotide
gtagcccatgaccgattaatctttgcctcctgcct

SEQ ID NO: 163739 - DNA, 35 bp, Artificial Sequence
  Synthetic oligonucleotide
tgcaatagcagtacatgctgaccccctctctgcct

SEQ ID NO: 163740 - DNA, 35 bp, Artificial Sequence
  Synthetic oligonucleotide
tagagcactccgtaactcgcccgtttatgaatcct

SEQ ID NO: 163741 - DNA, 35 bp, Artificial Sequence
  Synthetic oligonucleotide
atcgccctatcgcaatttcgtctcctatcgctcct

SEQ ID NO: 163742 - DNA, 35 bp, Artificial Sequence
  Synthetic oligonucleotide
aagtacgggtgggggggttgggactagcgccttct

SEQ ID NO: 163743 - DNA, 34 bp, Artificial Sequence
  Synthetic oligonucleotide
gtgcccgcacgatcgttacacacctcccccccgt

SEQ ID NO: 163744 - DNA, 35 bp, Artificial Sequence
  Synthetic oligonucleotide
atgagcggtgggggtgaacggttaggaggggtggt

SEQ ID NO: 163745 - DNA, 35 bp, Artificial Sequence
  Synthetic oligonucleotide
tcattgcccgtaggacaacttacctccctccatgt

SEQ ID NO: 163746 - DNA, 35 bp, Artificial Sequence
  Synthetic oligonucleotide
tccacccgctcacactcgattttaaacacggttgt

SEQ ID NO: 163747 - DNA, 33 bp, Artificial Sequence
  Synthetic oligonucleotide
gcaccattcatctgatctctagccgcctccatt

SEQ ID NO: 163748 - DNA, 35 bp, Artificial Sequence
  Synthetic oligonucleotide
ttcacacctgagcgaatgtatcttttggcgccctt

SEQ ID NO: 163749 - DNA, 35 bp, Artificial Sequence
  Synthetic oligonucleotide
tgggaccactcacacctcacccaagacctggcctt

SEQ ID NO: 163750 - DNA, 35 bp, Artificial Sequence
  Synthetic oligonucleotide
gtgatgagctgttgtcgtgccgccccaccccgttt

SEQ ID NO: 163751 - DNA, 36 bp, Artificial Sequence
  Synthetic oligonucleotide
tacgcccttccctagccgtgacggagccttttccaa

SEQ ID NO: 163752 - DNA, 36 bp, Artificial Sequence
  Synthetic oligonucleotide
atcctccacgccaatctcgttcggaatacctactaa

SEQ ID NO: 163753 - DNA, 35 bp, Artificial Sequence
  Synthetic oligonucleotide
gcgacgtagcattgcccccgtctttttcgcccaca

SEQ ID NO: 163754 - DNA, 36 bp, Artificial Sequence
  Synthetic oligonucleotide
acactaccgccgacctgggctcaacggaacactaca

SEQ ID NO: 163755 - DNA, 36 bp, Artificial Sequence
  Synthetic oligonucleotide
tgcctacccccctgcgagctgtgccgttaacgccca

SEQ ID NO: 163756 - DNA, 36 bp, Artificial Sequence
  Synthetic oligonucleotide
tgtctccctctcgtgtcttaatttcacctcatccca

SEQ ID NO: 163757 - DNA, 36 bp, Artificial Sequence
  Synthetic oligonucleotide
tagttcgtcggccccccttagctacaatgcacctca

SEQ ID NO: 163758 - DNA, 36 bp, Artificial Sequence
  Synthetic oligonucleotide
acccacaactagactccgcgtttaagcgtgccctca

SEQ ID NO: 163759 - DNA, 35 bp, Artificial Sequence
  Synthetic oligonucleotide
acttctgcgggtctcgcctgggtctctcgttgtca

SEQ ID NO: 163760 - DNA, 35 bp, Artificial Sequence
  Synthetic oligonucleotide
gacacgtctaacgtcccccttctgccacgacttca

SEQ ID NO: 163761 - DNA, 37 bp, Artificial Sequence
  Synthetic oligonucleotide
gtctgcggggggagtggaggaaggtaagcagggaaga

SEQ ID NO: 163762 - DNA, 37 bp, Artificial Sequence
  Synthetic oligonucleotide
gacctgggaatggggttaagggtgagggtggtgaaga

SEQ ID NO: 163763 - DNA, 36 bp, Artificial Sequence
  Synthetic oligonucleotide
gcgtagggtgggggggggttatgccgggcggtaaga

SEQ ID NO: 163764 - DNA, 37 bp, Artificial Sequence
  Synthetic oligonucleotide
taggggaggggacgggaggagggtatgcaataccaga

SEQ ID NO: 163765 - DNA, 36 bp, Artificial Sequence
  Synthetic oligonucleotide
attggtcggggacagtgagagggggatgggtcgaga

SEQ ID NO: 163766 - DNA, 37 bp, Artificial Sequence
  Synthetic oligonucleotide
gaaggggcctcggtgagaaggaagaacgggagggaga

SEQ ID NO: 163767 - DNA, 37 bp, Artificial Sequence
  Synthetic oligonucleotide
gggtggacggacgaggcatagggcggcggtatgtaga

SEQ ID NO: 163768 - DNA, 37 bp, Artificial Sequence
  Synthetic oligonucleotide
gacgccccttccgcgcctatcctccccgatcccacga

SEQ ID NO: 163769 - DNA, 37 bp, Artificial Sequence
  Synthetic oligonucleotide
agctcgcactccgccatcctcactcgccattgtacga

SEQ ID NO: 163770 - DNA, 37 bp, Artificial Sequence
  Synthetic oligonucleotide
acaacactccgatctagggccaccgtctttcacccga

SEQ ID NO: 163771 - DNA, 37 bp, Artificial Sequence
  Synthetic oligonucleotide
acatccgtgctccacccccgcgcccctaggctcccga

SEQ ID NO: 163772 - DNA, 37 bp, Artificial Sequence
  Synthetic oligonucleotide
tcccgaaccgtcctcacttgcatgcactctgttccga

SEQ ID NO: 163773 - DNA, 37 bp, Artificial Sequence
  Synthetic oligonucleotide
gccccctcattccccgcgtaactccacccttggtcga

SEQ ID NO: 163774 - DNA, 37 bp, Artificial Sequence
  Synthetic oligonucleotide
agtcgccccttccatctctcgtatttctgccttagga

SEQ ID NO: 163775 - DNA, 37 bp, Artificial Sequence
  Synthetic oligonucleotide
acggaggaggagggacacatgggcgggcgttcaggga

SEQ ID NO: 163776 - DNA, 37 bp, Artificial Sequence
  Synthetic oligonucleotide
gaatgagggaggtggtggatgagcgaagttggaggga

SEQ ID NO: 163777 - DNA, 36 bp, Artificial Sequence
  Synthetic oligonucleotide
actggtagctgatcacgggagggaggggacctggga

SEQ ID NO: 163778 - DNA, 37 bp, Artificial Sequence
  Synthetic oligonucleotide
gtcgcccccctcatccgcctctgctcctgtcctggga

SEQ ID NO: 163779 - DNA, 37 bp, Artificial Sequence
  Synthetic oligonucleotide
taggggcatggaggggcggggaacttgacaagtggga

SEQ ID NO: 163780 - DNA, 36 bp, Artificial Sequence
  Synthetic oligonucleotide
acagccgcacgcctgttctcaccgatcccttatgga

SEQ ID NO: 163781 - DNA, 37 bp, Artificial Sequence
  Synthetic oligonucleotide
gcacgaccctcgccgtcgaacactccccatccttgga

SEQ ID NO: 163782 - DNA, 38 bp, Artificial Sequence
  Synthetic oligonucleotide
gatcagccacgctgcttcttcctgccaccgccccatga

SEQ ID NO: 163783 - DNA, 38 bp, Artificial Sequence
  Synthetic oligonucleotide
tgtgcaccaccgctacatcgccctagcctacccgctga

SEQ ID NO: 163784 - DNA, 36 bp, Artificial Sequence
  Synthetic oligonucleotide
gcgcccacgccctatcggtctttttggttcctctga

SEQ ID NO: 163785 - DNA, 38 bp, Artificial Sequence
  Synthetic oligonucleotide
gtcaacatcaggggagcaatagggcaggagggacgtga

SEQ ID NO: 163786 - DNA, 37 bp, Artificial Sequence
  Synthetic oligonucleotide
tggtgagacactgtgtaccctgccccccaccgattga

SEQ ID NO: 163787 - DNA, 37 bp, Artificial Sequence
  Synthetic oligonucleotide
tgagcgcctgtacctatctcgcccgccgcacccttga

SEQ ID NO: 163788 - DNA, 38 bp, Artificial Sequence
  Synthetic oligonucleotide
ttgacctggcctgctgtgacttgccattcctcccttga

SEQ ID NO: 163789 - DNA, 38 bp, Artificial Sequence
  Synthetic oligonucleotide
agaccggtgaaggggggaggattggaggccggggttga

SEQ ID NO: 163790 - DNA, 36 bp, Artificial Sequence
  Synthetic oligonucleotide
ttgtacccccctcctgtattaggcctatttgtttga

SEQ ID NO: 163791 - DNA, 36 bp, Artificial Sequence
  Synthetic oligonucleotide
accgtgtacggctgcacgattatttcgcccactcta

SEQ ID NO: 163792 - DNA, 35 bp, Artificial Sequence
  Synthetic oligonucleotide
tacgcacctagagctcatttcgcctgggcccacac

SEQ ID NO: 163793 - DNA, 35 bp, Artificial Sequence
  Synthetic oligonucleotide
gcacaccacatccccactagccgggcctggaccac

SEQ ID NO: 163794 - DNA, 35 bp, Artificial Sequence
  Synthetic oligonucleotide
tgagaccatactacatcgtgacaacacggctccac

SEQ ID NO: 163795 - DNA, 35 bp, Artificial Sequence
  Synthetic oligonucleotide
gttcccctgcccccgactagttgactcctgggcac

SEQ ID NO: 163796 - DNA, 35 bp, Artificial Sequence
  Synthetic oligonucleotide
acctcgccatctgatgcgctttcgattttctgcac

SEQ ID NO: 163797 - DNA, 35 bp, Artificial Sequence
  Synthetic oligonucleotide
gtggagggcgtaccagtctttcattatgtccaccc

SEQ ID NO: 163798 - DNA, 35 bp, Artificial Sequence
  Synthetic oligonucleotide
gccacactggtgtcttagattacgcgcacctaccc

SEQ ID NO: 163799 - DNA, 35 bp, Artificial Sequence
  Synthetic oligonucleotide
gcccccaccagtgcccacccggatcccacgggccc

SEQ ID NO: 163800 - DNA, 35 bp, Artificial Sequence
  Synthetic oligonucleotide
agcagtgccccgctgtagtcccatacctatctccc

SEQ ID NO: 163801 - DNA, 35 bp, Artificial Sequence
  Synthetic oligonucleotide
tcttgcccctcgctccggcggatcgcaccctcgcc

SEQ ID NO: 163802 - DNA, 35 bp, Artificial Sequence
  Synthetic oligonucleotide
acaccctgcacactcctcgtcaaaaccgacaccgc

SEQ ID NO: 163803 - DNA, 35 bp, Artificial Sequence
  Synthetic oligonucleotide
caaccggcacattgtcccatcgctatcctgttcgc

SEQ ID NO: 163804 - DNA, 35 bp, Artificial Sequence
  Synthetic oligonucleotide
gatccgccctttcgctattcataccttcctccggc

SEQ ID NO: 163805 - DNA, 35 bp, Artificial Sequence
  Synthetic oligonucleotide
tcgctcccacctctagccgctaaacataacagctc

SEQ ID NO: 163806 - DNA, 35 bp, Artificial Sequence
  Synthetic oligonucleotide
tccgtcactgctactccttagtggaccatttgctc

SEQ ID NO: 163807 - DNA, 35 bp, Artificial Sequence
  Synthetic oligonucleotide
tatgtcacgcgcgctatctctgcacgaaatctctc

SEQ ID NO: 163808 - DNA, 35 bp, Artificial Sequence
  Synthetic oligonucleotide
tacgcgcctcccgccgatttcagactcacgccttc

SEQ ID NO: 163809 - DNA, 36 bp, Artificial Sequence
  Synthetic oligonucleotide
tccaaccaaggagcgggtaaggggaagagttgggag

SEQ ID NO: 163810 - DNA, 35 bp, Artificial Sequence
  Synthetic oligonucleotide
gagcgtgcttcccccgtgctctccatatgcccccg

SEQ ID NO: 163811 - DNA, 35 bp, Artificial Sequence
  Synthetic oligonucleotide
gtaggctgtgactgtcctcgttacccgcctgtccg

SEQ ID NO: 163812 - DNA, 35 bp, Artificial Sequence
  Synthetic oligonucleotide
gggtggcgggggggttttgcggatggcacatagcg

SEQ ID NO: 163813 - DNA, 35 bp, Artificial Sequence
  Synthetic oligonucleotide
tgggggaaggtggacaaggtgggaggactacgagg

SEQ ID NO: 163814 - DNA, 35 bp, Artificial Sequence
  Synthetic oligonucleotide
gctttgcatgctcgccctcctacgctccctttagg

SEQ ID NO: 163815 - DNA, 35 bp, Artificial Sequence
  Synthetic oligonucleotide
agtactgaccatgaacgggatgggggggaataggg

SEQ ID NO: 163816 - DNA, 35 bp, Artificial Sequence
  Synthetic oligonucleotide
tcaccaagacagaacgagaggggaaggatgcttgg

SEQ ID NO: 163817 - DNA, 35 bp, Artificial Sequence
  Synthetic oligonucleotide
gaggggcctagtaagggctaggagggggaattatg

SEQ ID NO: 163818 - DNA, 35 bp, Artificial Sequence
  Synthetic oligonucleotide
gcctatctttgcggtcagatcctagttacctcctg

SEQ ID NO: 163819 - DNA, 35 bp, Artificial Sequence
  Synthetic oligonucleotide
tggggggccgtaggaatagggaattggagtgggtg

SEQ ID NO: 163820 - DNA, 35 bp, Artificial Sequence
  Synthetic oligonucleotide
ggatgggagggagaaatcatagcagacagggattg

SEQ ID NO: 163821 - DNA, 35 bp, Artificial Sequence
  Synthetic oligonucleotide
gaagcatccgtgtcattttctctctcccgtcgttg

SEQ ID NO: 163822 - DNA, 35 bp, Artificial Sequence
  Synthetic oligonucleotide
gcgaccccgatccgttcttgagttctacctttttg

SEQ ID NO: 163823 - DNA, 34 bp, Artificial Sequence
  Synthetic oligonucleotide
gccccatgatcccattttctacgcccgctcgaat

SEQ ID NO: 163824 - DNA, 35 bp, Artificial Sequence
  Synthetic oligonucleotide
tgtccgttccgtcttgtccggtttctcgtactcct

SEQ ID NO: 163825 - DNA, 35 bp, Artificial Sequence
  Synthetic oligonucleotide
gatccaccccccggtcaccttcatgtgccaatgct

SEQ ID NO: 163826 - DNA, 35 bp, Artificial Sequence
  Synthetic oligonucleotide
tgtcgagtgacgcacgcgctttaattgccacctct

SEQ ID NO: 163827 - DNA, 35 bp, Artificial Sequence
  Synthetic oligonucleotide
gtactcactggacctccatcgcttgatgcacctct

SEQ ID NO: 163828 - DNA, 35 bp, Artificial Sequence
  Synthetic oligonucleotide
tcccgcctggtcaactacacagtctagctcgttct

SEQ ID NO: 163829 - DNA, 35 bp, Artificial Sequence
  Synthetic oligonucleotide
gtgttcgcgccatcccatctaactgctttttgcgt

SEQ ID NO: 163830 - DNA, 35 bp, Artificial Sequence
  Synthetic oligonucleotide
gggaacgtcacgtggtccatcaccgttctgtctgt

SEQ ID NO: 163831 - DNA, 35 bp, Artificial Sequence
  Synthetic oligonucleotide
tgttgccccgggccaccgttctgccacctttttgt

SEQ ID NO: 163832 - DNA, 35 bp, Artificial Sequence
  Synthetic oligonucleotide
cctatgtgccaccgccgcctctgatccccttgctt

SEQ ID NO: 163833 - DNA, 35 bp, Artificial Sequence
  Synthetic oligonucleotide
tagagtaagcgccactttgcccctcatgtctcttt

SEQ ID NO: 163834 - DNA, 36 bp, Artificial Sequence
  Synthetic oligonucleotide
taaggctgcctcgacgcgtcctccccctcatccaaa

SEQ ID NO: 163835 - DNA, 36 bp, Artificial Sequence
  Synthetic oligonucleotide
tgttgccctatgttccgcccccgttttcgccgccaa

SEQ ID NO: 163836 - DNA, 35 bp, Artificial Sequence
  Synthetic oligonucleotide
tgaagacctacaccgccgtgttccaccctgtttaa

SEQ ID NO: 163837 - DNA, 37 bp, Artificial Sequence
  Synthetic oligonucleotide
gtgaccgacgcactttctttattactcatgcacacca

SEQ ID NO: 163838 - DNA, 35 bp, Artificial Sequence
  Synthetic oligonucleotide
agacacccctccattggtcttttagcttgctccca

SEQ ID NO: 163839 - DNA, 35 bp, Artificial Sequence
  Synthetic oligonucleotide
gaagtgcagccgcactgcaaagcccgactccgcca

SEQ ID NO: 163840 - DNA, 36 bp, Artificial Sequence
  Synthetic oligonucleotide
tctcgtcccgagctctttgacccccctgcatacgca

SEQ ID NO: 163841 - DNA, 36 bp, Artificial Sequence
  Synthetic oligonucleotide
tcccgccccttctccagtcgtttgctgttccccgca

SEQ ID NO: 163842 - DNA, 35 bp, Artificial Sequence
  Synthetic oligonucleotide
tcgatcgctgagcttctttgcccgcccctttatca

SEQ ID NO: 163843 - DNA, 36 bp, Artificial Sequence
  Synthetic oligonucleotide
gagaggtcagatccgccttgtttgtttatttcgtca

SEQ ID NO: 163844 - DNA, 37 bp, Artificial Sequence
  Synthetic oligonucleotide
ggatgggggggactgctgggacaagggtagggtaaga

SEQ ID NO: 163845 - DNA, 36 bp, Artificial Sequence
  Synthetic oligonucleotide
tgttgaatcgctaagggggaggagagggatgggaga

SEQ ID NO: 163846 - DNA, 37 bp, Artificial Sequence
  Synthetic oligonucleotide
tggtatcccctccgcccgcccgttgttcgttaaccga

SEQ ID NO: 163847 - DNA, 37 bp, Artificial Sequence
  Synthetic oligonucleotide
ttcacatctggtcctgtctcgtgcccgtttcctccga

SEQ ID NO: 163848 - DNA, 37 bp, Artificial Sequence
  Synthetic oligonucleotide
gcaccgacgcatccacttacactcctcgcttgtgcga

SEQ ID NO: 163849 - DNA, 36 bp, Artificial Sequence
  Synthetic oligonucleotide
tcctgccctcaacgccccccaacagcccaaactcga

SEQ ID NO: 163850 - DNA, 37 bp, Artificial Sequence
  Synthetic oligonucleotide
atgggggaggagggaaagagaccctcgggggaaagga

SEQ ID NO: 163851 - DNA, 37 bp, Artificial Sequence
  Synthetic oligonucleotide
tacgtaggaagtagggggacgggaagaagatgtggga

SEQ ID NO: 163852 - DNA, 38 bp, Artificial Sequence
  Synthetic oligonucleotide
gttaccgcgtgaccccagcgctcctgttccacccatga

SEQ ID NO: 163853 - DNA, 38 bp, Artificial Sequence
  Synthetic oligonucleotide
actccgcctcaccacttctataatcacctgggctatga

SEQ ID NO: 163854 - DNA, 35 bp, Artificial Sequence
  Synthetic oligonucleotide
attacgctcctccgctcgcttttttgactctatga

SEQ ID NO: 163855 - DNA, 38 bp, Artificial Sequence
  Synthetic oligonucleotide
ttgctgagggggagggggttatgaggggaatgtactga

SEQ ID NO: 163856 - DNA, 38 bp, Artificial Sequence
  Synthetic oligonucleotide
gcctcacgccgcgtgttcaacgtcctctacacacctga

SEQ ID NO: 163857 - DNA, 38 bp, Artificial Sequence
  Synthetic oligonucleotide
agactcagcgcttcggtctatcccctgcctatccctga

SEQ ID NO: 163858 - DNA, 37 bp, Artificial Sequence
  Synthetic oligonucleotide
tcccccttcggcaccactctccgccctgacctgctga

SEQ ID NO: 163859 - DNA, 35 bp, Artificial Sequence
  Synthetic oligonucleotide
gagccccccccggctaggttaacctctttttctga

SEQ ID NO: 163860 - DNA, 37 bp, Artificial Sequence
  Synthetic oligonucleotide
gctcgggatagggcaagcagagggggccgaagggtga

SEQ ID NO: 163861 - DNA, 38 bp, Artificial Sequence
  Synthetic oligonucleotide
atatccacccctgtttggttccccttcagtccttgtga

SEQ ID NO: 163862 - DNA, 38 bp, Artificial Sequence
  Synthetic oligonucleotide
actgcaccccactgcgcctccgttcctatcaaggttga

SEQ ID NO: 163863 - DNA, 36 bp, Artificial Sequence
  Synthetic oligonucleotide
gccccaccgagaaggtgaatccccgtcgctttacta

SEQ ID NO: 163864 - DNA, 35 bp, Artificial Sequence
  Synthetic oligonucleotide
gttaggaggacggaggggactcggctgtggaggta

SEQ ID NO: 163865 - DNA, 36 bp, Artificial Sequence
  Synthetic oligonucleotide
ggagaacgaatgggaggggaattatagggtggggta

SEQ ID NO: 163866 - DNA, 36 bp, Artificial Sequence
  Synthetic oligonucleotide
acctgctgccccctttattcgcacacgtcatcctta

SEQ ID NO: 163867 - DNA, 35 bp, Artificial Sequence
  Synthetic oligonucleotide
actgagcccgtttctatagtcatcaccgcccacac

SEQ ID NO: 163868 - DNA, 35 bp, Artificial Sequence
  Synthetic oligonucleotide
gttgagtatcagccgcaccgcctcccttttcacac

SEQ ID NO: 163869 - DNA, 35 bp, Artificial Sequence
  Synthetic oligonucleotide
tcactcgaacgcctgccatcgcgttcccaacccac

SEQ ID NO: 163870 - DNA, 34 bp, Artificial Sequence
  Synthetic oligonucleotide
atgggagggtgagggaagtacaagggtaagaacc

SEQ ID NO: 163871 - DNA, 35 bp, Artificial Sequence
  Synthetic oligonucleotide
gcccccctgtaggtatgcctcaccgccccgtgacc

SEQ ID NO: 163872 - DNA, 35 bp, Artificial Sequence
  Synthetic oligonucleotide
gatctacgccacgatttcggcgcctgaagccctcc

SEQ ID NO: 163873 - DNA, 35 bp, Artificial Sequence
  Synthetic oligonucleotide
ctactcgccgcatggtcgattaatggtttcggtcc

SEQ ID NO: 163874 - DNA, 35 bp, Artificial Sequence
  Synthetic oligonucleotide
tgctaacgcaccctcatctatctagaactgtttcc

SEQ ID NO: 163875 - DNA, 35 bp, Artificial Sequence
  Synthetic oligonucleotide
gtgccatccgtaatcgcgtatcatgatgtccccgc

SEQ ID NO: 163876 - DNA, 35 bp, Artificial Sequence
  Synthetic oligonucleotide
actcaccgcaggtggccctggaatacctcgcccgc

SEQ ID NO: 163877 - DNA, 35 bp, Artificial Sequence
  Synthetic oligonucleotide
aactccgtctcaccgggctgtgcccccaccctcgc

SEQ ID NO: 163878 - DNA, 36 bp, Artificial Sequence
  Synthetic oligonucleotide
actgatgcacacgccccattgcccgactatcactgc

SEQ ID NO: 163879 - DNA, 34 bp, Artificial Sequence
  Synthetic oligonucleotide
tcgatcaccaccatggctcaccgcttatccctgc

SEQ ID NO: 163880 - DNA, 35 bp, Artificial Sequence
  Synthetic oligonucleotide
acgctccaccactctccatgagccagtctcgaatc

SEQ ID NO: 163881 - DNA, 35 bp, Artificial Sequence
  Synthetic oligonucleotide
gcatgacccgcacgccgacgcgcactgaattcatc

SEQ ID NO: 163882 - DNA, 35 bp, Artificial Sequence
  Synthetic oligonucleotide
acatcacgcggtcgccggccctcctcctgttcatc

SEQ ID NO: 163883 - DNA, 35 bp, Artificial Sequence
  Synthetic oligonucleotide
gactaccggcaatcttgatctactgcctggctatc

SEQ ID NO: 163884 - DNA, 35 bp, Artificial Sequence
  Synthetic oligonucleotide
ggaatgtcacgcctcccctgtgtaccctgtccctc

SEQ ID NO: 163885 - DNA, 35 bp, Artificial Sequence
  Synthetic oligonucleotide
tgcccacagcgtgctggcttcgtcccccctgagtc

SEQ ID NO: 163886 - DNA, 35 bp, Artificial Sequence
  Synthetic oligonucleotide
acgccatctcgcctaacctacgcgctcacttcgtc

SEQ ID NO: 163887 - DNA, 35 bp, Artificial Sequence
  Synthetic oligonucleotide
gatgacgtcaccacttgccttctgtcgaacgattc

SEQ ID NO: 163888 - DNA, 35 bp, Artificial Sequence
  Synthetic oligonucleotide
tccgccttcctcctcttccaagcgcccgaagcttc

SEQ ID NO: 163889 - DNA, 35 bp, Artificial Sequence
  Synthetic oligonucleotide
acactatgctgcccgccgccctctgttcgccgttc

SEQ ID NO: 163890 - DNA, 35 bp, Artificial Sequence
  Synthetic oligonucleotide
gaccccctcgcaatctaccattaagctccctgttc

SEQ ID NO: 163891 - DNA, 35 bp, Artificial Sequence
  Synthetic oligonucleotide
tacccgccttactgatgcccctctccgcgttcgag

SEQ ID NO: 163892 - DNA, 35 bp, Artificial Sequence
  Synthetic oligonucleotide
gttgacgcgccaccatagatcactcgaccccctag

SEQ ID NO: 163893 - DNA, 35 bp, Artificial Sequence
  Synthetic oligonucleotide
tactccgcccgtacccggtcctccctaaccctacg

SEQ ID NO: 163894 - DNA, 35 bp, Artificial Sequence
  Synthetic oligonucleotide
aatccgggaggggtgggggggagagaagggttcgg

SEQ ID NO: 163895 - DNA, 35 bp, Artificial Sequence
  Synthetic oligonucleotide
accgtgctggggggaaggtggggaggaaagttatg

SEQ ID NO: 163896 - DNA, 35 bp, Artificial Sequence
  Synthetic oligonucleotide
agagggaggaaatgagtgcttcgggggaagggttg

SEQ ID NO: 163897 - DNA, 35 bp, Artificial Sequence
  Synthetic oligonucleotide
gcccccttgcgctgtcaccccctacacgtctccat

SEQ ID NO: 163898 - DNA, 35 bp, Artificial Sequence
  Synthetic oligonucleotide
tagccccaccgcagatcctgttctcatcctggcat

SEQ ID NO: 163899 - DNA, 35 bp, Artificial Sequence
  Synthetic oligonucleotide
tatgcccccccagtgtttcgtcatctctttgggat

SEQ ID NO: 163900 - DNA, 35 bp, Artificial Sequence
  Synthetic oligonucleotide
aaacgcccctcccgtacctagtgctgtcttttact

SEQ ID NO: 163901 - DNA, 35 bp, Artificial Sequence
  Synthetic oligonucleotide
accgtccagtgccccgtatgcccccgcgtaaccct

SEQ ID NO: 163902 - DNA, 35 bp, Artificial Sequence
  Synthetic oligonucleotide
tccggatgcgtcctggtcctcacgtacccgcccct

SEQ ID NO: 163903 - DNA, 35 bp, Artificial Sequence
  Synthetic oligonucleotide
tcatactatgccagcctgtgatccgcctctcgcct

SEQ ID NO: 163904 - DNA, 35 bp, Artificial Sequence
  Synthetic oligonucleotide
acacctggattccccgccacctttgctgtgctcct

SEQ ID NO: 163905 - DNA, 35 bp, Artificial Sequence
  Synthetic oligonucleotide
gatacccactcatgtttcctagaacaaacgttcct

SEQ ID NO: 163906 - DNA, 35 bp, Artificial Sequence
  Synthetic oligonucleotide
aacgtcacatcctactttccacatccccgcgctgt

SEQ ID NO: 163907 - DNA, 36 bp, Artificial Sequence
  Synthetic oligonucleotide
tttaccaccctcacccagttcattcataactgtaaa

SEQ ID NO: 163908 - DNA, 34 bp, Artificial Sequence
  Synthetic oligonucleotide
tcactgcccctcccgttgcattcagacgactcaa

SEQ ID NO: 163909 - DNA, 36 bp, Artificial Sequence
  Synthetic oligonucleotide
atatctgcggcagtcccttatttcgcgccacctcaa

SEQ ID NO: 163910 - DNA, 36 bp, Artificial Sequence
  Synthetic oligonucleotide
gtgcgggtgcagggggggagggccactcgcatataa

SEQ ID NO: 163911 - DNA, 36 bp, Artificial Sequence
  Synthetic oligonucleotide
atagcacgcgctcacctagcctctcttcgaccacca

SEQ ID NO: 163912 - DNA, 35 bp, Artificial Sequence
  Synthetic oligonucleotide
atctgcccatgattactacaaagctcccactccca

SEQ ID NO: 163913 - DNA, 35 bp, Artificial Sequence
  Synthetic oligonucleotide
gtacgccatgatgccgcccctgataccccaatcca

SEQ ID NO: 163914 - DNA, 36 bp, Artificial Sequence
  Synthetic oligonucleotide
gatcctcctcgcaaacgatctgtaatcgtaccatca

SEQ ID NO: 163915 - DNA, 37 bp, Artificial Sequence
  Synthetic oligonucleotide
ggtagagaaggaaaagatagagcgggcacgggataga

SEQ ID NO: 163916 - DNA, 37 bp, Artificial Sequence
  Synthetic oligonucleotide
gccacccttcttgaccgcgtgtactgtcacccgccga

SEQ ID NO: 163917 - DNA, 37 bp, Artificial Sequence
  Synthetic oligonucleotide
agaccatcagccgtagctcccattcacgacccgccga

SEQ ID NO: 163918 - DNA, 37 bp, Artificial Sequence
  Synthetic oligonucleotide
gcactgagtcagcccttgcgcccccccatagtttcga

SEQ ID NO: 163919 - DNA, 37 bp, Artificial Sequence
  Synthetic oligonucleotide
ggcggtgcccagttcttgcatcccctcgcctcccgga

SEQ ID NO: 163920 - DNA, 37 bp, Artificial Sequence
  Synthetic oligonucleotide
gctgcggagggggaaagcgcggcaaagattaacggga

SEQ ID NO: 163921 - DNA, 36 bp, Artificial Sequence
  Synthetic oligonucleotide
tgcgtagcactgcgggtgggtgtgagatgggtggga

SEQ ID NO: 163922 - DNA, 37 bp, Artificial Sequence
  Synthetic oligonucleotide
gaggaggtgtgagggcgtaaggggcgatcatgtggga

SEQ ID NO: 163923 - DNA, 37 bp, Artificial Sequence
  Synthetic oligonucleotide
tcgtggggtgggtgggaactttcgccgggggcctgga

SEQ ID NO: 163924 - DNA, 36 bp, Artificial Sequence
  Synthetic oligonucleotide
atgcgacacaccgcccacgcaccgtgcccttctgga

SEQ ID NO: 163925 - DNA, 36 bp, Artificial Sequence
  Synthetic oligonucleotide
tgttgagcacggtggctggaggtaaggggaggtgga

SEQ ID NO: 163926 - DNA, 37 bp, Artificial Sequence
  Synthetic oligonucleotide
tccgccctctcttcctttgccgtactgtgcaccatga

SEQ ID NO: 163927 - DNA, 37 bp, Artificial Sequence
  Synthetic oligonucleotide
gtgcgcgactcccctgttaatgccttctatcccatga

SEQ ID NO: 163928 - DNA, 37 bp, Artificial Sequence
  Synthetic oligonucleotide
gacccgccgttctctgtactctcttgccctccgatga

SEQ ID NO: 163929 - DNA, 37 bp, Artificial Sequence
  Synthetic oligonucleotide
tcccaccgctgtggctccgcctataatacctcactga

SEQ ID NO: 163930 - DNA, 37 bp, Artificial Sequence
  Synthetic oligonucleotide
tctcgcccttcccgacggattgccgcccctcacctga

SEQ ID NO: 163931 - DNA, 36 bp, Artificial Sequence
  Synthetic oligonucleotide
atcccgccaacctcccccggactggacttcccctga

SEQ ID NO: 163932 - DNA, 38 bp, Artificial Sequence
  Synthetic oligonucleotide
tgtgtggcggaggtgattctccctgttcgttcccctga

SEQ ID NO: 163933 - DNA, 37 bp, Artificial Sequence
  Synthetic oligonucleotide
tcaccacctaacatgctacagtattcggcctccctga

SEQ ID NO: 163934 - DNA, 36 bp, Artificial Sequence
  Synthetic oligonucleotide
gcacggggagagggggggtatggtgccgttgcctga

SEQ ID NO: 163935 - DNA, 38 bp, Artificial Sequence
  Synthetic oligonucleotide
tccgactactcattgactagatgagccacacctcctga

SEQ ID NO: 163936 - DNA, 38 bp, Artificial Sequence
  Synthetic oligonucleotide
tgtcccatcccgccacctctgcgttatactaccgctga

SEQ ID NO: 163937 - DNA, 36 bp, Artificial Sequence
  Synthetic oligonucleotide
tccacgttgacttccttatctagccatccccgctga

SEQ ID NO: 163938 - DNA, 38 bp, Artificial Sequence
  Synthetic oligonucleotide
acacaccacaaatgtcattcttccactcgccctagtga

SEQ ID NO: 163939 - DNA, 38 bp, Artificial Sequence
  Synthetic oligonucleotide
ttgtgctccccgcctggttggatcctttgcctccgtga

SEQ ID NO: 163940 - DNA, 37 bp, Artificial Sequence
  Synthetic oligonucleotide
gcgactgtcagccgatcccctactcgcctttccgtga

SEQ ID NO: 163941 - DNA, 38 bp, Artificial Sequence
  Synthetic oligonucleotide
cgtacccactccgctgttaaggcccttgttcctgttga

SEQ ID NO: 163942 - DNA, 35 bp, Artificial Sequence
  Synthetic oligonucleotide
gagatgcacgcctcccctggctccttccagtttga

SEQ ID NO: 163943 - DNA, 36 bp, Artificial Sequence
  Synthetic oligonucleotide
gacaagggagcaggggggtggaagggaggggaaata

SEQ ID NO: 163944 - DNA, 36 bp, Artificial Sequence
  Synthetic oligonucleotide
aacgacgtacccccccgcactgtatcgtgtacagta

SEQ ID NO: 163945 - DNA, 36 bp, Artificial Sequence
  Synthetic oligonucleotide
gtccaccacccaccgcagacactggtctgacctgta

SEQ ID NO: 163946 - DNA, 35 bp, Artificial Sequence
  Synthetic oligonucleotide
ttgacaagccagagcctctgcgtccttccctgtta

SEQ ID NO: 163947 - DNA, 36 bp, Artificial Sequence
  Synthetic oligonucleotide
tccacccgcctcctgttgagaaattccccaagttta

SEQ ID NO: 163948 - DNA, 35 bp, Artificial Sequence
  Synthetic oligonucleotide
gtttccgaccccccgagcttttggccatgcaccac

SEQ ID NO: 163949 - DNA, 35 bp, Artificial Sequence
  Synthetic oligonucleotide
acgattccgccacgaaactactacccgtacacacc

SEQ ID NO: 163950 - DNA, 35 bp, Artificial Sequence
  Synthetic oligonucleotide
gacgtggcaactttgcttctgtctacgcttacacc

SEQ ID NO: 163951 - DNA, 35 bp, Artificial Sequence
  Synthetic oligonucleotide
tcccgcgctatctggagcctatcagttcttctacc

SEQ ID NO: 163952 - DNA, 32 bp, Artificial Sequence
  Synthetic oligonucleotide
tgttaggtgcctccgcctaccaagtacccccc

SEQ ID NO: 163953 - DNA, 35 bp, Artificial Sequence
  Synthetic oligonucleotide
gtcctaaaaagtgataacgccctgcccgccccccc

SEQ ID NO: 163954 - DNA, 35 bp, Artificial Sequence
  Synthetic oligonucleotide
gacatccgccgaccgttcactcttccgtgcccccc

SEQ ID NO: 163955 - DNA, 35 bp, Artificial Sequence
  Synthetic oligonucleotide
gcaacccaagcgttatccggttctccttcagcccc

SEQ ID NO: 163956 - DNA, 35 bp, Artificial Sequence
  Synthetic oligonucleotide
tgttactacgccatacccaccaatgaacctgtccc

SEQ ID NO: 163957 - DNA, 35 bp, Artificial Sequence
  Synthetic oligonucleotide
tccccggtcctccgccctcaccgccttaataggcc

SEQ ID NO: 163958 - DNA, 35 bp, Artificial Sequence
  Synthetic oligonucleotide
tgtctgtgtgcaaagccccgccccctgccttatcc

SEQ ID NO: 163959 - DNA, 35 bp, Artificial Sequence
  Synthetic oligonucleotide
tggtcacactacgattcgttatgtcccgcttatcc

SEQ ID NO: 163960 - DNA, 35 bp, Artificial Sequence
  Synthetic oligonucleotide
aaacacacgcctctggtcgcgcaatatgccgttcc

SEQ ID NO: 163961 - DNA, 36 bp, Artificial Sequence
  Synthetic oligonucleotide
gtcgctgccacgcattcccattggtctgaacgccgc

SEQ ID NO: 163962 - DNA, 34 bp, Artificial Sequence
  Synthetic oligonucleotide
cccttgggcctccagcttattatcccgtgctcgc

SEQ ID NO: 163963 - DNA, 35 bp, Artificial Sequence
  Synthetic oligonucleotide
tcccgcaatcgcctctcaccctttatggacttggc

SEQ ID NO: 163964 - DNA, 35 bp, Artificial Sequence
  Synthetic oligonucleotide
agctgctcccacctctccgctgtccatatgcatgc

SEQ ID NO: 163965 - DNA, 35 bp, Artificial Sequence
  Synthetic oligonucleotide
tgcgagccgcctcctgtcccccccggttccattgc

SEQ ID NO: 163966 - DNA, 35 bp, Artificial Sequence
  Synthetic oligonucleotide
agccacgttgcctgcggtatcctccccgtcccatc

SEQ ID NO: 163967 - DNA, 35 bp, Artificial Sequence
  Synthetic oligonucleotide
ttgccccacacttccctgcccagcatgtatgactc

SEQ ID NO: 163968 - DNA, 35 bp, Artificial Sequence
  Synthetic oligonucleotide
gtctacgctggtccatcctgggcgacttactactc

SEQ ID NO: 163969 - DNA, 35 bp, Artificial Sequence
  Synthetic oligonucleotide
actagcgccggcacaagtggcaacctttctacctc

SEQ ID NO: 163970 - DNA, 35 bp, Artificial Sequence
  Synthetic oligonucleotide
agcattacaccgttcaccgagtccccccactagtc

SEQ ID NO: 163971 - DNA, 35 bp, Artificial Sequence
  Synthetic oligonucleotide
ggccccccccatcgttgccccacacccatatggtc

SEQ ID NO: 163972 - DNA, 35 bp, Artificial Sequence
  Synthetic oligonucleotide
gcacctctccaccatacaggcccccgctgcagttc

SEQ ID NO: 163973 - DNA, 35 bp, Artificial Sequence
  Synthetic oligonucleotide
aatggcccaaccccactagtgtctgctactctttc

SEQ ID NO: 163974 - DNA, 35 bp, Artificial Sequence
  Synthetic oligonucleotide
attgctgggagggactcgataggggtagggaatag

SEQ ID NO: 163975 - DNA, 35 bp, Artificial Sequence
  Synthetic oligonucleotide
atgccaccagccgcagtcgttatccccgccagccg

SEQ ID NO: 163976 - DNA, 35 bp, Artificial Sequence
  Synthetic oligonucleotide
acacatccaacctcatgtcaagcctatcgactccg

SEQ ID NO: 163977 - DNA, 35 bp, Artificial Sequence
  Synthetic oligonucleotide
tcccctcccgcctccatccgcccaatctttcggcg

SEQ ID NO: 163978 - DNA, 35 bp, Artificial Sequence
  Synthetic oligonucleotide
ttctcgccccataggttatgtttctgccatcatcg

SEQ ID NO: 163979 - DNA, 35 bp, Artificial Sequence
  Synthetic oligonucleotide
gttaacatgccgttgtcctcctccaccgccgccgg

SEQ ID NO: 163980 - DNA, 35 bp, Artificial Sequence
  Synthetic oligonucleotide
ttcccgcgcacatacgcacatatccctgcttccgg

SEQ ID NO: 163981 - DNA, 35 bp, Artificial Sequence
  Synthetic oligonucleotide
gtccggaaagtcgtggggcggtgggtggggatggg

SEQ ID NO: 163982 - DNA, 35 bp, Artificial Sequence
  Synthetic oligonucleotide
agtagtgcagctgggcttctccctctatcctcgtg

SEQ ID NO: 163983 - DNA, 35 bp, Artificial Sequence
  Synthetic oligonucleotide
agtggccaccgccctcatcttaacctcctctgtat

SEQ ID NO: 163984 - DNA, 35 bp, Artificial Sequence
  Synthetic oligonucleotide
ttgtccacccgtgacgttcggcctcccactactct

SEQ ID NO: 163985 - DNA, 35 bp, Artificial Sequence
  Synthetic oligonucleotide
gcgggatgacgtgggggaggtgggagggccgaagt

SEQ ID NO: 163986 - DNA, 35 bp, Artificial Sequence
  Synthetic oligonucleotide
acgccggttgcctgccgctaacacatcttttgctt

SEQ ID NO: 163987 - DNA, 35 bp, Artificial Sequence
  Synthetic oligonucleotide
tcgctccctcccagtgatgaggccctcgctatttt

SEQ ID NO: 163988 - DNA, 35 bp, Artificial Sequence
  Synthetic oligonucleotide
gctctccgggccgtttcgaaccttttgtctctttt

SEQ ID NO: 163989 - DNA, 35 bp, Artificial Sequence
  Synthetic oligonucleotide
aagagacagacagggaaatagtggggaaggagaaa

SEQ ID NO: 163990 - DNA, 34 bp, Artificial Sequence
  Synthetic oligonucleotide
agaccacagaatcgcctgctgctccctgttccaa

SEQ ID NO: 163991 - DNA, 35 bp, Artificial Sequence
  Synthetic oligonucleotide
ttcaccaccctcgtatgcctttctttcgttactaa

SEQ ID NO: 163992 - DNA, 35 bp, Artificial Sequence
  Synthetic oligonucleotide
gccaccaggagggggtggacaatgagggtgggtaa

SEQ ID NO: 163993 - DNA, 35 bp, Artificial Sequence
  Synthetic oligonucleotide
ttcaatggtccgcccctgatcataccccgcccaca

SEQ ID NO: 163994 - DNA, 36 bp, Artificial Sequence
  Synthetic oligonucleotide
gccggtcatccttgccgctttacttcatgtacccca

SEQ ID NO: 163995 - DNA, 35 bp, Artificial Sequence
  Synthetic oligonucleotide
agctcgtgcgctttctttgccgtgactccgcccca

SEQ ID NO: 163996 - DNA, 36 bp, Artificial Sequence
  Synthetic oligonucleotide
gccgaactccgcatcaccctgctttccaatagccca

SEQ ID NO: 163997 - DNA, 36 bp, Artificial Sequence
  Synthetic oligonucleotide
tcaatctgctccctgccggccaatttccaggtccca

SEQ ID NO: 163998 - DNA, 36 bp, Artificial Sequence
  Synthetic oligonucleotide
tccgcgtgtcgctcagtataccttctttcaccgcca

SEQ ID NO: 163999 - DNA, 36 bp, Artificial Sequence
  Synthetic oligonucleotide
tgccatagcctcgccctcgtacctgactcttcgcca

SEQ ID NO: 164000 - DNA, 36 bp, Artificial Sequence
  Synthetic oligonucleotide
atgccccccgttgcttcccgttaccgccctgtgcca

SEQ ID NO: 164001 - DNA, 36 bp, Artificial Sequence
  Synthetic oligonucleotide
acccgccaatcgtacctgtgctccctgctccatcca

SEQ ID NO: 164002 - DNA, 36 bp, Artificial Sequence
  Synthetic oligonucleotide
taccccgtttcgcctcgcccgttacctatctgtgca

SEQ ID NO: 164003 - DNA, 36 bp, Artificial Sequence
  Synthetic oligonucleotide
gggtcacgctacgtcccattcgccccgcccattgca

SEQ ID NO: 164004 - DNA, 36 bp, Artificial Sequence
  Synthetic oligonucleotide
cccaccatcgcgactggtcatccctgctctccttca

SEQ ID NO: 164005 - DNA, 37 bp, Artificial Sequence
  Synthetic oligonucleotide
gagaaggatggaagcaaggggataatggagaaccaga

SEQ ID NO: 164006 - DNA, 35 bp, Artificial Sequence
  Synthetic oligonucleotide
actccccatgcgcttggctgaacgcacctctacga

SEQ ID NO: 164007 - DNA, 36 bp, Artificial Sequence
  Synthetic oligonucleotide
actgatccgcaccctctcaattcgttacacgaccga

SEQ ID NO: 164008 - DNA, 35 bp, Artificial Sequence
  Synthetic oligonucleotide
gcaccgacgcaccttcttcgtgccaacttacccga

SEQ ID NO: 164009 - DNA, 37 bp, Artificial Sequence
  Synthetic oligonucleotide
tcgctttccctctgtgatcacgccatccacctcccga

SEQ ID NO: 164010 - DNA, 37 bp, Artificial Sequence
  Synthetic oligonucleotide
tacactggcaatcgttaaagcacccctctcgttccga

SEQ ID NO: 164011 - DNA, 36 bp, Artificial Sequence
  Synthetic oligonucleotide
aaagaaatgggggaggtggggagttggttggccgga

SEQ ID NO: 164012 - DNA, 37 bp, Artificial Sequence
  Synthetic oligonucleotide
ggggaaggggggggagtgggtaaagacaacccgcgga

SEQ ID NO: 164013 - DNA, 35 bp, Artificial Sequence
  Synthetic oligonucleotide
tcatgtgccttccatccgctcacctgtctttcgga

SEQ ID NO: 164014 - DNA, 36 bp, Artificial Sequence
  Synthetic oligonucleotide
atgatccatcgggggcgggagggcaatgtacgggga

SEQ ID NO: 164015 - DNA, 37 bp, Artificial Sequence
  Synthetic oligonucleotide
tagggttcgggagtcgggagaaaagggcggggaatga

SEQ ID NO: 164016 - DNA, 37 bp, Artificial Sequence
  Synthetic oligonucleotide
tcacgcccgattcggctaacttccatccttcacatga

SEQ ID NO: 164017 - DNA, 38 bp, Artificial Sequence
  Synthetic oligonucleotide
ggaggaaaggcaggcgggcaaagggggggttgatatga

SEQ ID NO: 164018 - DNA, 38 bp, Artificial Sequence
  Synthetic oligonucleotide
attccacccgcaatactgttgggccacctctctactga

SEQ ID NO: 164019 - DNA, 36 bp, Artificial Sequence
  Synthetic oligonucleotide
tgtaccgcagggttgctcgcctgcttcctcacctga

SEQ ID NO: 164020 - DNA, 34 bp, Artificial Sequence
  Synthetic oligonucleotide
gcttcccagcccgacctcgcaaccatttacctga

SEQ ID NO: 164021 - DNA, 37 bp, Artificial Sequence
  Synthetic oligonucleotide
actgcccttctgccagccaactgccgtactttcctga

SEQ ID NO: 164022 - DNA, 38 bp, Artificial Sequence
  Synthetic oligonucleotide
accaccaccgatgtgctgcaaattttgccccccgctga

SEQ ID NO: 164023 - DNA, 38 bp, Artificial Sequence
  Synthetic oligonucleotide
gtcgacgcccatgtccagttctcgcgccattcctctga

SEQ ID NO: 164024 - DNA, 38 bp, Artificial Sequence
  Synthetic oligonucleotide
gtccgtaccaactccatctgccaagcagccctccgtga

SEQ ID NO: 164025 - DNA, 38 bp, Artificial Sequence
  Synthetic oligonucleotide
ggagaggtggtgtagtggggagatcgcggaggaggtga

SEQ ID NO: 164026 - DNA, 38 bp, Artificial Sequence
  Synthetic oligonucleotide
gccccccgttctatcgcacccgttgtcactttcggtga

SEQ ID NO: 164027 - DNA, 37 bp, Artificial Sequence
  Synthetic oligonucleotide
tgaggaaggtggggcggagggacacaggtcaggttga

SEQ ID NO: 164028 - DNA, 36 bp, Artificial Sequence
  Synthetic oligonucleotide
gcctccgcgcccatctcgccttaattgtctctttga

SEQ ID NO: 164029 - DNA, 37 bp, Artificial Sequence
  Synthetic oligonucleotide
ccccgcccaccttgcttcccgtgcacacctcttttga

SEQ ID NO: 164030 - DNA, 35 bp, Artificial Sequence
  Synthetic oligonucleotide
atgtgtccgcctctcgttacttcgtttatggtcta

SEQ ID NO: 164031 - DNA, 34 bp, Artificial Sequence
  Synthetic oligonucleotide
gtaccccctgcgctaactgtttcatcgctcctta

SEQ ID NO: 164032 - DNA, 36 bp, Artificial Sequence
  Synthetic oligonucleotide
acgctgccctctctttgctcgaagtctcgcccttta

SEQ ID NO: 164033 - DNA, 35 bp, Artificial Sequence
  Synthetic oligonucleotide
ttgggcgccacctctgcttcattttgatctaacac

SEQ ID NO: 164034 - DNA, 35 bp, Artificial Sequence
  Synthetic oligonucleotide
ccctccaccactcctagccacaggtcacgaagcac

SEQ ID NO: 164035 - DNA, 35 bp, Artificial Sequence
  Synthetic oligonucleotide
gatcaccgcaattgttgcaaaccgcttgtcccgac

SEQ ID NO: 164036 - DNA, 35 bp, Artificial Sequence
  Synthetic oligonucleotide
accccctgcctttatttttcacgcctggaataacc

SEQ ID NO: 164037 - DNA, 35 bp, Artificial Sequence
  Synthetic oligonucleotide
aaccctgttcccccctaggtgccatttcagtgccc

SEQ ID NO: 164038 - DNA, 35 bp, Artificial Sequence
  Synthetic oligonucleotide
gtagccagtcgcagcatactttatctttgtactcc

SEQ ID NO: 164039 - DNA, 35 bp, Artificial Sequence
  Synthetic oligonucleotide
tagtaatgcccagcacggtcacacccccatggtcc

SEQ ID NO: 164040 - DNA, 35 bp, Artificial Sequence
  Synthetic oligonucleotide
tatgctccaccctactcggcagttacgggcccagc

SEQ ID NO: 164041 - DNA, 35 bp, Artificial Sequence
  Synthetic oligonucleotide
gccgtgtaaccgccaatgattagactctcccccgc

SEQ ID NO: 164042 - DNA, 35 bp, Artificial Sequence
  Synthetic oligonucleotide
tccaacaccgcacttgaatcgaggcatcccctcgc

SEQ ID NO: 164043 - DNA, 35 bp, Artificial Sequence
  Synthetic oligonucleotide
acctccgtacccccaccttctggttgacagcttgc

SEQ ID NO: 164044 - DNA, 35 bp, Artificial Sequence
  Synthetic oligonucleotide
actgcaaggctcactgtccgtaatcgtttccaatc

SEQ ID NO: 164045 - DNA, 35 bp, Artificial Sequence
  Synthetic oligonucleotide
tgccccaggctcgctaaactgcctacgctcccatc

SEQ ID NO: 164046 - DNA, 35 bp, Artificial Sequence
  Synthetic oligonucleotide
acctccccagtgttaaatcttacttgcgatccatc

SEQ ID NO: 164047 - DNA, 35 bp, Artificial Sequence
  Synthetic oligonucleotide
tctggttccgccactgttacctgcacgccctactc

SEQ ID NO: 164048 - DNA, 35 bp, Artificial Sequence
  Synthetic oligonucleotide
accggagcctcgttttaccatgcacacatcgcctc

SEQ ID NO: 164049 - DNA, 36 bp, Artificial Sequence
  Synthetic oligonucleotide
gacatcatcctgcctcgtttttacgaccgtactgtc

SEQ ID NO: 164050 - DNA, 35 bp, Artificial Sequence
  Synthetic oligonucleotide
gccacagttcgtctcttggcctggtcccatttgtc

SEQ ID NO: 164051 - DNA, 35 bp, Artificial Sequence
  Synthetic oligonucleotide
tgacactctatctggatcgccccaaccagcacttc

SEQ ID NO: 164052 - DNA, 35 bp, Artificial Sequence
  Synthetic oligonucleotide
agtccactaccctcttgctataccgactgtgcttc

SEQ ID NO: 164053 - DNA, 35 bp, Artificial Sequence
  Synthetic oligonucleotide
gtccatgtagttgcgtggtccgaccgcttttcttc

SEQ ID NO: 164054 - DNA, 35 bp, Artificial Sequence
  Synthetic oligonucleotide
gatgtcatctgctgtcttttccggtgcacgtgttc

SEQ ID NO: 164055 - DNA, 35 bp, Artificial Sequence
  Synthetic oligonucleotide
tctcactgtccccgcgtgagctcaaccattctttc

SEQ ID NO: 164056 - DNA, 35 bp, Artificial Sequence
  Synthetic oligonucleotide
actcgcgaacgatccaccctcacctatcctgcacg

SEQ ID NO: 164057 - DNA, 35 bp, Artificial Sequence
  Synthetic oligonucleotide
ggtgctctacgcctgttcgccctcgcctgactccg

SEQ ID NO: 164058 - DNA, 35 bp, Artificial Sequence
  Synthetic oligonucleotide
tgcctcaccccggtccgtcctcgatctctcttgcg

SEQ ID NO: 164059 - DNA, 35 bp, Artificial Sequence
  Synthetic oligonucleotide
tgagcacctccccttgacatgatctacgcccgctg

SEQ ID NO: 164060 - DNA, 35 bp, Artificial Sequence
  Synthetic oligonucleotide
aacattccctcgccaatcgacaccctcctctggtg

SEQ ID NO: 164061 - DNA, 33 bp, Artificial Sequence
  Synthetic oligonucleotide
agagccagttcgttgccgttcctccctgcattg

SEQ ID NO: 164062 - DNA, 35 bp, Artificial Sequence
  Synthetic oligonucleotide
gtccacccgcccacacgctgttcattgccagcaat

SEQ ID NO: 164063 - DNA, 35 bp, Artificial Sequence
  Synthetic oligonucleotide
gttgccctcatttccacctgtcctgctttctggat

SEQ ID NO: 164064 - DNA, 35 bp, Artificial Sequence
  Synthetic oligonucleotide
gatcagtccccgcatgagcggtcatgccacctact

SEQ ID NO: 164065 - DNA, 36 bp, Artificial Sequence
  Synthetic oligonucleotide
gacggagcccaaaccgctgcttattgccctcgccct

SEQ ID NO: 164066 - DNA, 35 bp, Artificial Sequence
  Synthetic oligonucleotide
tgattacgcccctacgttcgtgccatatctcgcct

SEQ ID NO: 164067 - DNA, 35 bp, Artificial Sequence
  Synthetic oligonucleotide
tcccccaacgttgatcaacatcccgctgcctcgct

SEQ ID NO: 164068 - DNA, 35 bp, Artificial Sequence
  Synthetic oligonucleotide
gcacggttcattcgttgcccttatattcgttgtct

SEQ ID NO: 164069 - DNA, 35 bp, Artificial Sequence
  Synthetic oligonucleotide
tcaacccccatggtatcttagtccctgcacttagt

SEQ ID NO: 164070 - DNA, 35 bp, Artificial Sequence
  Synthetic oligonucleotide
aagccgggcagaccacatatcgcgtttcatccatt

SEQ ID NO: 164071 - DNA, 35 bp, Artificial Sequence
  Synthetic oligonucleotide
tgtttgcaccctccttatgctcattcgtcctcatt

SEQ ID NO: 164072 - DNA, 35 bp, Artificial Sequence
  Synthetic oligonucleotide
tcctagccgacacataccttttttcgcccatgctt

SEQ ID NO: 164073 - DNA, 35 bp, Artificial Sequence
  Synthetic oligonucleotide
gatcgccacccctcactgaaattaccgaacgcttt

SEQ ID NO: 164074 - DNA, 36 bp, Artificial Sequence
  Synthetic oligonucleotide
taacacccgcaaggtgtggcgctgacccctgcccaa

SEQ ID NO: 164075 - DNA, 35 bp, Artificial Sequence
  Synthetic oligonucleotide
gagagggtgggagggtactcattgctccgggggaa

SEQ ID NO: 164076 - DNA, 36 bp, Artificial Sequence
  Synthetic oligonucleotide
gtccagcgatttccgtccatccgtgcaccttccaca

SEQ ID NO: 164077 - DNA, 36 bp, Artificial Sequence
  Synthetic oligonucleotide
gtcgacgcgcctcctcgtcccttgccttctttcaca

SEQ ID NO: 164078 - DNA, 35 bp, Artificial Sequence
  Synthetic oligonucleotide
accagcccagtaagctcgttcccgcccctcagaca

SEQ ID NO: 164079 - DNA, 35 bp, Artificial Sequence
  Synthetic oligonucleotide
tgttgtcgtccgccctcagtactccgttcacccca

SEQ ID NO: 164080 - DNA, 35 bp, Artificial Sequence
  Synthetic oligonucleotide
ggatagaccccggttatgctctaagccgcccccca

SEQ ID NO: 164081 - DNA, 36 bp, Artificial Sequence
  Synthetic oligonucleotide
gccgctcgatgtactttggtccgcttcattttccca

SEQ ID NO: 164082 - DNA, 36 bp, Artificial Sequence
  Synthetic oligonucleotide
atacacagccgactgttgtctacacctacccatcca

SEQ ID NO: 164083 - DNA, 35 bp, Artificial Sequence
  Synthetic oligonucleotide
ttagtcgaggcaactggtctcttctccccattcca

SEQ ID NO: 164084 - DNA, 36 bp, Artificial Sequence
  Synthetic oligonucleotide
tggaagagaggaaggacagggagagggttagcagca

SEQ ID NO: 164085 - DNA, 36 bp, Artificial Sequence
  Synthetic oligonucleotide
gcccgcgagctcctgccctatctgctactctgcgca

SEQ ID NO: 164086 - DNA, 34 bp, Artificial Sequence
  Synthetic oligonucleotide
gctgacgcctatctcgatccagccgttccttgca

SEQ ID NO: 164087 - DNA, 36 bp, Artificial Sequence
  Synthetic oligonucleotide
ataccccgcctccatgccgagttctcaagagttgca

SEQ ID NO: 164088 - DNA, 36 bp, Artificial Sequence
  Synthetic oligonucleotide
tctcgccgtatacatgagtgtcccagcccttcctca

SEQ ID NO: 164089 - DNA, 34 bp, Artificial Sequence
  Synthetic oligonucleotide
acatcctcccatcaggttcgctcgcctacgttca

SEQ ID NO: 164090 - DNA, 36 bp, Artificial Sequence
  Synthetic oligonucleotide
acgccactccgagtcgcgctaccacacacattttca

SEQ ID NO: 164091 - DNA, 37 bp, Artificial Sequence
  Synthetic oligonucleotide
atgggcagggatagggggggtagtgatgatcagaaga

SEQ ID NO: 164092 - DNA, 37 bp, Artificial Sequence
  Synthetic oligonucleotide
agcccccatcgccacgtttactgttccctgccccaga

SEQ ID NO: 164093 - DNA, 37 bp, Artificial Sequence
  Synthetic oligonucleotide
gaggggcgggggaattacttggggcgggtgacgacga

SEQ ID NO: 164094 - DNA, 35 bp, Artificial Sequence
  Synthetic oligonucleotide
tgtaccttgccccatatttcctgcgactccgccga

SEQ ID NO: 164095 - DNA, 36 bp, Artificial Sequence
  Synthetic oligonucleotide
aatccgcgccctttcccctgtttattgcgtcgccga

SEQ ID NO: 164096 - DNA, 36 bp, Artificial Sequence
  Synthetic oligonucleotide
gtcagtccacgtgttgccccctcttcccactgccga

SEQ ID NO: 164097 - DNA, 36 bp, Artificial Sequence
  Synthetic oligonucleotide
agtgtccctcagttgtcctgatctcgccccttccga

SEQ ID NO: 164098 - DNA, 35 bp, Artificial Sequence
  Synthetic oligonucleotide
acacctcccttgtatatgttactcccttcgcgcga

SEQ ID NO: 164099 - DNA, 36 bp, Artificial Sequence
  Synthetic oligonucleotide
attgtgcccactgcctgatttatcctagtctctcga

SEQ ID NO: 164100 - DNA, 37 bp, Artificial Sequence
  Synthetic oligonucleotide
tctccatccgctggctatcgaacgcgtgcttcttcga

SEQ ID NO: 164101 - DNA, 37 bp, Artificial Sequence
  Synthetic oligonucleotide
gtatggagagggtgataggtggcgagaggaaaaagga

SEQ ID NO: 164102 - DNA, 37 bp, Artificial Sequence
  Synthetic oligonucleotide
agccggggagaaggcgcgtatggaaggtgaagaagga

SEQ ID NO: 164103 - DNA, 36 bp, Artificial Sequence
  Synthetic oligonucleotide
ggaggggggagggcgggcttggtaagcaagggagga

SEQ ID NO: 164104 - DNA, 36 bp, Artificial Sequence
  Synthetic oligonucleotide
gcagggaagccgggaaggggcaaggggtggggcgga

SEQ ID NO: 164105 - DNA, 37 bp, Artificial Sequence
  Synthetic oligonucleotide
acacgagccgtagagggggggcgggctgaccgtggga

SEQ ID NO: 164106 - DNA, 37 bp, Artificial Sequence
  Synthetic oligonucleotide
ttaacaaggggggtagaaaaggcgacggaggacatga

SEQ ID NO: 164107 - DNA, 38 bp, Artificial Sequence
  Synthetic oligonucleotide
tacagctccgtccttctccatccttgttcccgtcatga

SEQ ID NO: 164108 - DNA, 38 bp, Artificial Sequence
  Synthetic oligonucleotide
gatgcacgtagcacccgttaccacccacagttctatga

SEQ ID NO: 164109 - DNA, 33 bp, Artificial Sequence
  Synthetic oligonucleotide
gacgattggggccgggggggataagccgtatga

SEQ ID NO: 164110 - DNA, 38 bp, Artificial Sequence
  Synthetic oligonucleotide
tccgcactcctctcgggccgccggtttcctactcctga

SEQ ID NO: 164111 - DNA, 38 bp, Artificial Sequence
  Synthetic oligonucleotide
tccgacccacactcaggctcgtccgaaccacttcctga

SEQ ID NO: 164112 - DNA, 36 bp, Artificial Sequence
  Synthetic oligonucleotide
atccatacccgctgtggtcttcccaactctcgctga

SEQ ID NO: 164113 - DNA, 38 bp, Artificial Sequence
  Synthetic oligonucleotide
gatcttacgcccccgatgtctctctaatccacacgtga

SEQ ID NO: 164114 - DNA, 36 bp, Artificial Sequence
  Synthetic oligonucleotide
gaccccctccggatgtaatgcttctgctgcccgtga

SEQ ID NO: 164115 - DNA, 38 bp, Artificial Sequence
  Synthetic oligonucleotide
gcaatcgggaggctggaggggatggatggagggtgtga

SEQ ID NO: 164116 - DNA, 38 bp, Artificial Sequence
  Synthetic oligonucleotide
tgtgtctgccccacccgttacatgctcggctctattga

SEQ ID NO: 164117 - DNA, 37 bp, Artificial Sequence
  Synthetic oligonucleotide
ttacatgcatcatttcgtccgttcttgctgcccttga

SEQ ID NO: 164118 - DNA, 36 bp, Artificial Sequence
  Synthetic oligonucleotide
acgtgccttaccgcgcttcagccgctcccctcttga

SEQ ID NO: 164119 - DNA, 36 bp, Artificial Sequence
  Synthetic oligonucleotide
gtgcacgtacaaatgccccttcccctccccatttga

SEQ ID NO: 164120 - DNA, 36 bp, Artificial Sequence
  Synthetic oligonucleotide
agccactaccgacccatcccgcctggcctcatttga

SEQ ID NO: 164121 - DNA, 35 bp, Artificial Sequence
  Synthetic oligonucleotide
attgctacccgcccttcagacgtccctgaacccta

SEQ ID NO: 164122 - DNA, 36 bp, Artificial Sequence
  Synthetic oligonucleotide
aaacgccctgtctgtcccttgatccacactctgcta

SEQ ID NO: 164123 - DNA, 32 bp, Artificial Sequence
  Synthetic oligonucleotide
attcaccctcctatccagcccgcttgcccgta

SEQ ID NO: 164124 - DNA, 36 bp, Artificial Sequence
  Synthetic oligonucleotide
accctgtcccccctaccccactactcgtgaccggta

SEQ ID NO: 164125 - DNA, 35 bp, Artificial Sequence
  Synthetic oligonucleotide
tccacccctggtcctacttattgtattttacgtta

SEQ ID NO: 164126 - DNA, 36 bp, Artificial Sequence
  Synthetic oligonucleotide
gagttgccagcccgactctgcatcccgttcctttta

SEQ ID NO: 164127 - DNA, 35 bp, Artificial Sequence
  Synthetic oligonucleotide
tatgcctgacctcgcggttcgctccctcgtttaac

SEQ ID NO: 164128 - DNA, 35 bp, Artificial Sequence
  Synthetic oligonucleotide
tgacgacccctcccttcactaggtttttggtacac

SEQ ID NO: 164129 - DNA, 35 bp, Artificial Sequence
  Synthetic oligonucleotide
actagcaaccggcctcccagtccattatcctgcac

SEQ ID NO: 164130 - DNA, 35 bp, Artificial Sequence
  Synthetic oligonucleotide
gtgaacgctcacccggcaatcagcacttgatctac

SEQ ID NO: 164131 - DNA, 35 bp, Artificial Sequence
  Synthetic oligonucleotide
gatcctcgctgcccccaccgcgcccaggggcttac

SEQ ID NO: 164132 - DNA, 35 bp, Artificial Sequence
  Synthetic oligonucleotide
taacgccggccgtgatatttcacactgtcaccccc

SEQ ID NO: 164133 - DNA, 35 bp, Artificial Sequence
  Synthetic oligonucleotide
tgttgtcaacccgcggctctgtcattccacccccc

SEQ ID NO: 164134 - DNA, 35 bp, Artificial Sequence
  Synthetic oligonucleotide
gaacaggcctcttgcagtatcttgtcgccgccccc

SEQ ID NO: 164135 - DNA, 35 bp, Artificial Sequence
  Synthetic oligonucleotide
tagccacacctccataagcggctccaaatcgcccc

SEQ ID NO: 164136 - DNA, 35 bp, Artificial Sequence
  Synthetic oligonucleotide
taccgagcgcagcacgcccttttccggtatcgccc

SEQ ID NO: 164137 - DNA, 35 bp, Artificial Sequence
  Synthetic oligonucleotide
ttaacctaaccgcgccggaagtctttttgctgccc

SEQ ID NO: 164138 - DNA, 35 bp, Artificial Sequence
  Synthetic oligonucleotide
acatcgctccaggttacttcatgttgcccttgccc

SEQ ID NO: 164139 - DNA, 35 bp, Artificial Sequence
  Synthetic oligonucleotide
gccccgattcccagcccatatccgacctgcctccc

SEQ ID NO: 164140 - DNA, 35 bp, Artificial Sequence
  Synthetic oligonucleotide
gcccgacttcagagccgcccgccattatctgtccc

SEQ ID NO: 164141 - DNA, 35 bp, Artificial Sequence
  Synthetic oligonucleotide
tcctcgcctcactctccgtgcaagcacacaccgcc

SEQ ID NO: 164142 - DNA, 35 bp, Artificial Sequence
  Synthetic oligonucleotide
tcgaccacaagttctaccatcgttagtcgacctcc

SEQ ID NO: 164143 - DNA, 35 bp, Artificial Sequence
  Synthetic oligonucleotide
tcagtagacgtcacggagcccacccagcctagtcc

SEQ ID NO: 164144 - DNA, 35 bp, Artificial Sequence
  Synthetic oligonucleotide
acacctacggttcatgttctggtcaccttcggtcc

SEQ ID NO: 164145 - DNA, 35 bp, Artificial Sequence
  Synthetic oligonucleotide
gacgttagctgtaatatcccctggctctcccttcc

SEQ ID NO: 164146 - DNA, 35 bp, Artificial Sequence
  Synthetic oligonucleotide
aaattgtgccatcccgtcttgcgccacgtgcttcc

SEQ ID NO: 164147 - DNA, 35 bp, Artificial Sequence
  Synthetic oligonucleotide
ggagtgtcaccgctcttactagccattctcccagc

SEQ ID NO: 164148 - DNA, 35 bp, Artificial Sequence
  Synthetic oligonucleotide
accctagacgtcagctctctcactgcctagcccgc

SEQ ID NO: 164149 - DNA, 35 bp, Artificial Sequence
  Synthetic oligonucleotide
tccagagactaccttccgctctttccacgtgccgc

SEQ ID NO: 164150 - DNA, 35 bp, Artificial Sequence
  Synthetic oligonucleotide
taaagggaaggggcgtgaggagaataacggagcgc

SEQ ID NO: 164151 - DNA, 35 bp, Artificial Sequence
  Synthetic oligonucleotide
gtgactctgactttttttgatgcccgcctcctcgc

SEQ ID NO: 164152 - DNA, 35 bp, Artificial Sequence
  Synthetic oligonucleotide
tccttcaaccactcctgctcgtatgcctggctcgc

SEQ ID NO: 164153 - DNA, 35 bp, Artificial Sequence
  Synthetic oligonucleotide
tccgggagggccatgttatatgagagggaaagggc

SEQ ID NO: 164154 - DNA, 35 bp, Artificial Sequence
  Synthetic oligonucleotide
gttcgctcaccgcacttacccgccaccctggctgc

SEQ ID NO: 164155 - DNA, 35 bp, Artificial Sequence
  Synthetic oligonucleotide
atcgccgccctcctgtttttttctgctatctgtgc

SEQ ID NO: 164156 - DNA, 35 bp, Artificial Sequence
  Synthetic oligonucleotide
tcactgcaatgcctatttctgtccaccgtggcctc

SEQ ID NO: 164157 - DNA, 35 bp, Artificial Sequence
  Synthetic oligonucleotide
aatgctgtcgcatgcggtcgttccctctgtgcctc

SEQ ID NO: 164158 - DNA, 35 bp, Artificial Sequence
  Synthetic oligonucleotide
gactaccatcgactacgcagccaatgcatttcctc

SEQ ID NO: 164159 - DNA, 33 bp, Artificial Sequence
  Synthetic oligonucleotide
aactacgcacccgccaacaaccctggtgctctc

SEQ ID NO: 164160 - DNA, 35 bp, Artificial Sequence
  Synthetic oligonucleotide
accacgtcagctgttcgtccgctcccccttttctc

SEQ ID NO: 164161 - DNA, 35 bp, Artificial Sequence
  Synthetic oligonucleotide
gtggaaccgcctttcgtcaccatccaatgcctgtc

SEQ ID NO: 164162 - DNA, 35 bp, Artificial Sequence
  Synthetic oligonucleotide
tctgcccaccccagcatgttgtacactgtcaattc

SEQ ID NO: 164163 - DNA, 35 bp, Artificial Sequence
  Synthetic oligonucleotide
gcccgattcgtagtttttggttcccccccgtattc

SEQ ID NO: 164164 - DNA, 35 bp, Artificial Sequence
  Synthetic oligonucleotide
ggtaaagtatcccccaccctcgtccccgcacgttc

SEQ ID NO: 164165 - DNA, 35 bp, Artificial Sequence
  Synthetic oligonucleotide
gtgacgccaccgggtacttagctcccaccctgttc

SEQ ID NO: 164166 - DNA, 35 bp, Artificial Sequence
  Synthetic oligonucleotide
gtttgagaggtgggaagatagaggagtaagagggg

SEQ ID NO: 164167 - DNA, 35 bp, Artificial Sequence
  Synthetic oligonucleotide
tcactgcacccggccttcaacagtatcttccttgg

SEQ ID NO: 164168 - DNA, 35 bp, Artificial Sequence
  Synthetic oligonucleotide
gtgcccacccctctgtaccttcatataagccgatg

SEQ ID NO: 164169 - DNA, 35 bp, Artificial Sequence
  Synthetic oligonucleotide
gcgcggtccgccgatcctacatgttttcacccctg

SEQ ID NO: 164170 - DNA, 35 bp, Artificial Sequence
  Synthetic oligonucleotide
tgtgctttcacagcctttaccatctgcttttcctg

SEQ ID NO: 164171 - DNA, 35 bp, Artificial Sequence
  Synthetic oligonucleotide
agcacatcccaccatcgacgttcctgactaccgtg

SEQ ID NO: 164172 - DNA, 35 bp, Artificial Sequence
  Synthetic oligonucleotide
tgtacgatcgcactacgccactccatgttccaact

SEQ ID NO: 164173 - DNA, 35 bp, Artificial Sequence
  Synthetic oligonucleotide
gcatctagcttccccccgcgttttgtctgcccact

SEQ ID NO: 164174 - DNA, 35 bp, Artificial Sequence
  Synthetic oligonucleotide
tgtgcccccaggtactagtaccagcacccccgact

SEQ ID NO: 164175 - DNA, 35 bp, Artificial Sequence
  Synthetic oligonucleotide
ggattgcctcgaatgtaactccttgtccaccctct

SEQ ID NO: 164176 - DNA, 35 bp, Artificial Sequence
  Synthetic oligonucleotide
gactcaccgaccttcctgatcatagtctgtattct

SEQ ID NO: 164177 - DNA, 35 bp, Artificial Sequence
  Synthetic oligonucleotide
gcacctgagccccttcctcatccgccgcacccagt

SEQ ID NO: 164178 - DNA, 29 bp, Artificial Sequence
  Synthetic oligonucleotide
tagtcttggacccccccccgtcctgcctt

SEQ ID NO: 164179 - DNA, 35 bp, Artificial Sequence
  Synthetic oligonucleotide
attaccgcaccttgtcccgtccgctctacacgaaa

SEQ ID NO: 164180 - DNA, 36 bp, Artificial Sequence
  Synthetic oligonucleotide
gaatgcgagcctttctgcgtacctcgttacttccaa

SEQ ID NO: 164181 - DNA, 35 bp, Artificial Sequence
  Synthetic oligonucleotide
acctactacggcctccctgctgccagccccctcaa

SEQ ID NO: 164182 - DNA, 35 bp, Artificial Sequence
  Synthetic oligonucleotide
gtagatgcgggtggtcgaaacgggggggtcgggaa

SEQ ID NO: 164183 - DNA, 36 bp, Artificial Sequence
  Synthetic oligonucleotide
gctcatccccgtggtgattgataccctccccattaa

SEQ ID NO: 164184 - DNA, 35 bp, Artificial Sequence
  Synthetic oligonucleotide
atgtcgaccccgtcctcctcgttatggcgcttaca

SEQ ID NO: 164185 - DNA, 36 bp, Artificial Sequence
  Synthetic oligonucleotide
tccgggctgtattccgcgcacgttatccctccgcca

SEQ ID NO: 164186 - DNA, 36 bp, Artificial Sequence
  Synthetic oligonucleotide
attcgcccccatgcgcttacagtggcattctatcca

SEQ ID NO: 164187 - DNA, 36 bp, Artificial Sequence
  Synthetic oligonucleotide
gcccccgcgcatccctcgttgattaaccccagcgca

SEQ ID NO: 164188 - DNA, 36 bp, Artificial Sequence
  Synthetic oligonucleotide
gaacctcacagaaagcagggagggatggggagggca

SEQ ID NO: 164189 - DNA, 36 bp, Artificial Sequence
  Synthetic oligonucleotide
acagatcgcccagtccgttgttttcaccttgctgca

SEQ ID NO: 164190 - DNA, 35 bp, Artificial Sequence
  Synthetic oligonucleotide
gcctactactgtactgatcgaccgtacacccctca

SEQ ID NO: 164191 - DNA, 36 bp, Artificial Sequence
  Synthetic oligonucleotide
atgacccaagcggcctccctgcacactctctgttca

SEQ ID NO: 164192 - DNA, 37 bp, Artificial Sequence
  Synthetic oligonucleotide
gtgatgggccaaggggggaaagtacgcggccgcaaga

SEQ ID NO: 164193 - DNA, 37 bp, Artificial Sequence
  Synthetic oligonucleotide
aatgggacggggggtgcgggtattaggaatggagaga

SEQ ID NO: 164194 - DNA, 37 bp, Artificial Sequence
  Synthetic oligonucleotide
gacccattccccgatcgccgcccactggtcttgtaga

SEQ ID NO: 164195 - DNA, 37 bp, Artificial Sequence
  Synthetic oligonucleotide
gcaaaaggggggctcgaggaaggtagggggcaggcga

SEQ ID NO: 164196 - DNA, 37 bp, Artificial Sequence
  Synthetic oligonucleotide
tccaagggggggagggtggtggatttcgcgcaatcga

SEQ ID NO: 164197 - DNA, 35 bp, Artificial Sequence
  Synthetic oligonucleotide
ttagccacctctcggtttactatactctttctcga

SEQ ID NO: 164198 - DNA, 37 bp, Artificial Sequence
  Synthetic oligonucleotide
gcgggtaggttacgtagggcaaggggcatggggagga

SEQ ID NO: 164199 - DNA, 37 bp, Artificial Sequence
  Synthetic oligonucleotide
gtaggaacggacgacaaggagggggcggctgcaggga

SEQ ID NO: 164200 - DNA, 37 bp, Artificial Sequence
  Synthetic oligonucleotide
tcgtgatgggcgtgtgttggggcggcggggcgaggga

SEQ ID NO: 164201 - DNA, 37 bp, Artificial Sequence
  Synthetic oligonucleotide
gtgagcgcaggggctgaggggttggaagggctaggga

SEQ ID NO: 164202 - DNA, 37 bp, Artificial Sequence
  Synthetic oligonucleotide
gtacagagaaaggggggagataggcgtgagtgcggga

SEQ ID NO: 164203 - DNA, 37 bp, Artificial Sequence
  Synthetic oligonucleotide
gggggtgtggcctaaaactgtactagggaggagggga

SEQ ID NO: 164204 - DNA, 37 bp, Artificial Sequence
  Synthetic oligonucleotide
aaccatgaggtaaggggaattagagcggagaggggga

SEQ ID NO: 164205 - DNA, 35 bp, Artificial Sequence
  Synthetic oligonucleotide
tccggtgtcaaggggcggggaactgtgggtgggga

SEQ ID NO: 164206 - DNA, 37 bp, Artificial Sequence
  Synthetic oligonucleotide
tcactgacgtgaggggtgggaggagagttcggtggga

SEQ ID NO: 164207 - DNA, 38 bp, Artificial Sequence
  Synthetic oligonucleotide
ctgacccccgccccctcgcgctctgtccccctgaatga

SEQ ID NO: 164208 - DNA, 38 bp, Artificial Sequence
  Synthetic oligonucleotide
tccaacgctgcgcgcttcgttcccttccttgcccatga

SEQ ID NO: 164209 - DNA, 38 bp, Artificial Sequence
  Synthetic oligonucleotide
ggagactgcagggggggacggtaagagggatgacctga

SEQ ID NO: 164210 - DNA, 37 bp, Artificial Sequence
  Synthetic oligonucleotide
actggaccgcgcatcccagtttcacgttccaccctga

SEQ ID NO: 164211 - DNA, 37 bp, Artificial Sequence
  Synthetic oligonucleotide
tatgacgcacctccatctttaggccacacaaccgtga

SEQ ID NO: 164212 - DNA, 35 bp, Artificial Sequence
  Synthetic oligonucleotide
tcgacgcccttctgcgccctacccaccacccgtga

SEQ ID NO: 164213 - DNA, 38 bp, Artificial Sequence
  Synthetic oligonucleotide
aacgcggggcttaaggggtaaactacgggaaggggtga

SEQ ID NO: 164214 - DNA, 38 bp, Artificial Sequence
  Synthetic oligonucleotide
gtggagggggagcgcggacaataatgggcaccggttga

SEQ ID NO: 164215 - DNA, 38 bp, Artificial Sequence
  Synthetic oligonucleotide
gcatgtacctgctgctttcgttacgttctccgggttga

SEQ ID NO: 164216 - DNA, 36 bp, Artificial Sequence
  Synthetic oligonucleotide
tgaaccctccgcacacgcgccacctcccacttgcta

SEQ ID NO: 164217 - DNA, 35 bp, Artificial Sequence
  Synthetic oligonucleotide
accagggaaccgtccagtgctatctgctccctcta

SEQ ID NO: 164218 - DNA, 36 bp, Artificial Sequence
  Synthetic oligonucleotide
taggtgagggaaagggacgggatcgggggggtagta

SEQ ID NO: 164219 - DNA, 36 bp, Artificial Sequence
  Synthetic oligonucleotide
tgcaccagccgcggtctcgtcccccatgcccctgta

SEQ ID NO: 164220 - DNA, 36 bp, Artificial Sequence
  Synthetic oligonucleotide
gtgtgcccgacttttgcattattactgccgccttta

SEQ ID NO: 164221 - DNA, 35 bp, Artificial Sequence
  Synthetic oligonucleotide
gcgatggtcccagctatccttattgttgcctacac

SEQ ID NO: 164222 - DNA, 35 bp, Artificial Sequence
  Synthetic oligonucleotide
gaggtcgcagctgaattgatcttcgcgcctaccac

SEQ ID NO: 164223 - DNA, 35 bp, Artificial Sequence
  Synthetic oligonucleotide
ttctcgctccggcacgtatgttgctcggctcccac

SEQ ID NO: 164224 - DNA, 35 bp, Artificial Sequence
  Synthetic oligonucleotide
acacttcgcccgttggcatcccctttttatgtcac

SEQ ID NO: 164225 - DNA, 35 bp, Artificial Sequence
  Synthetic oligonucleotide
gaaagcggcttcattgctctcctgtcgcccgctac

SEQ ID NO: 164226 - DNA, 35 bp, Artificial Sequence
  Synthetic oligonucleotide
gagtcgcctcgaccgtttcacctgtaaatccgtac

SEQ ID NO: 164227 - DNA, 35 bp, Artificial Sequence
  Synthetic oligonucleotide
tcagtgtgtaactccgcctcgtggcccgcatgtac

SEQ ID NO: 164228 - DNA, 35 bp, Artificial Sequence
  Synthetic oligonucleotide
accgcctgtacggaccttcgcggatttccacaccc

SEQ ID NO: 164229 - DNA, 35 bp, Artificial Sequence
  Synthetic oligonucleotide
gagccctctgagccatagccatgacgactcgcccc

SEQ ID NO: 164230 - DNA, 35 bp, Artificial Sequence
  Synthetic oligonucleotide
gagctctccgcccgagacggatcgccttcctcccc

SEQ ID NO: 164231 - DNA, 35 bp, Artificial Sequence
  Synthetic oligonucleotide
aaagtgcccattcgtccgagccccttccagtgccc

SEQ ID NO: 164232 - DNA, 35 bp, Artificial Sequence
  Synthetic oligonucleotide
gatcgtcgctcctgacccctttccagttcaaagcc

SEQ ID NO: 164233 - DNA, 35 bp, Artificial Sequence
  Synthetic oligonucleotide
tcagcttgccccaaatctgcccatgttcactcgcc

SEQ ID NO: 164234 - DNA, 35 bp, Artificial Sequence
  Synthetic oligonucleotide
ttcccgcccagtagatctcccgccgcgtttgggcc

SEQ ID NO: 164235 - DNA, 35 bp, Artificial Sequence
  Synthetic oligonucleotide
atgcttgcctctacatcccgcggcctgcccctgcc

SEQ ID NO: 164236 - DNA, 35 bp, Artificial Sequence
  Synthetic oligonucleotide
tgcatgtcgccccctatgatctcacatactgctcc

SEQ ID NO: 164237 - DNA, 35 bp, Artificial Sequence
  Synthetic oligonucleotide
tgtgcacccccacctatgccctagccctgccttcc

SEQ ID NO: 164238 - DNA, 35 bp, Artificial Sequence
  Synthetic oligonucleotide
gtcccccacgcgttatgctcccatgctctatcagc

SEQ ID NO: 164239 - DNA, 35 bp, Artificial Sequence
  Synthetic oligonucleotide
tgttgccaccactcttcgatcatcaagccctacgc

SEQ ID NO: 164240 - DNA, 35 bp, Artificial Sequence
  Synthetic oligonucleotide
gctgccgcccgcccttgatgcacgtcgatacccgc

SEQ ID NO: 164241 - DNA, 35 bp, Artificial Sequence
  Synthetic oligonucleotide
gacccgtctattccctgcccgcgccaacgtcccgc

SEQ ID NO: 164242 - DNA, 35 bp, Artificial Sequence
  Synthetic oligonucleotide
acgatctacaagcggtgctacttcaccatcctcgc

SEQ ID NO: 164243 - DNA, 35 bp, Artificial Sequence
  Synthetic oligonucleotide
gccgctcatgtcctattcattattcccgcgctcgc

SEQ ID NO: 164244 - DNA, 35 bp, Artificial Sequence
  Synthetic oligonucleotide
tgtcacctcacgcttcccgttatgttccatctatc

SEQ ID NO: 164245 - DNA, 35 bp, Artificial Sequence
  Synthetic oligonucleotide
gtaagtccccgcagcccgttatttctcatcgtatc

SEQ ID NO: 164246 - DNA, 35 bp, Artificial Sequence
  Synthetic oligonucleotide
tcaccaccctctccgactcgtgatcgtttacactc

SEQ ID NO: 164247 - DNA, 35 bp, Artificial Sequence
  Synthetic oligonucleotide
tgggggaacgggggggtggtacgggccaaggagtc

SEQ ID NO: 164248 - DNA, 35 bp, Artificial Sequence
  Synthetic oligonucleotide
tactctgccccccacccagtggatttgtccatgtc

SEQ ID NO: 164249 - DNA, 35 bp, Artificial Sequence
  Synthetic oligonucleotide
tatccgtgaccatcgttatgtcatgctctccattc

SEQ ID NO: 164250 - DNA, 35 bp, Artificial Sequence
  Synthetic oligonucleotide
gcatcccgaacccccagctgcttacccgatcgttc

SEQ ID NO: 164251 - DNA, 35 bp, Artificial Sequence
  Synthetic oligonucleotide
acgtctccccgcattttatacgatcccaccgtttc

SEQ ID NO: 164252 - DNA, 35 bp, Artificial Sequence
  Synthetic oligonucleotide
gtcggaatggaggtgaagcgggagttatggagcag

SEQ ID NO: 164253 - DNA, 35 bp, Artificial Sequence
  Synthetic oligonucleotide
gctcatctgccctgttaccataaatcacgccttcg

SEQ ID NO: 164254 - DNA, 35 bp, Artificial Sequence
  Synthetic oligonucleotide
gccggataaaatgggagtgcgggtgcggggagggg

SEQ ID NO: 164255 - DNA, 35 bp, Artificial Sequence
  Synthetic oligonucleotide
taaagctctgcacctatctgctaagtcccgttcct

SEQ ID NO: 164256 - DNA, 35 bp, Artificial Sequence
  Synthetic oligonucleotide
gtgaccgcctggctgcctattcgaactcaatctct

SEQ ID NO: 164257 - DNA, 35 bp, Artificial Sequence
  Synthetic oligonucleotide
ggttagcagggagggagaaggggattttgctacgt

SEQ ID NO: 164258 - DNA, 35 bp, Artificial Sequence
  Synthetic oligonucleotide
gtgcgcctcgtcttctcttcccgctttacttccgt

SEQ ID NO: 164259 - DNA, 35 bp, Artificial Sequence
  Synthetic oligonucleotide
agcgaccgaccctcagtgtttgtccctccctttgt

SEQ ID NO: 164260 - DNA, 35 bp, Artificial Sequence
  Synthetic oligonucleotide
gattgtcctccgtaacatgtcttccatcaacactt

SEQ ID NO: 164261 - DNA, 35 bp, Artificial Sequence
  Synthetic oligonucleotide
tgccctgctacaccactgctgcccgatgccccgtt

SEQ ID NO: 164262 - DNA, 35 bp, Artificial Sequence
  Synthetic oligonucleotide
tgctgcactttggctccgggtcgcccgctctcgtt

SEQ ID NO: 164263 - DNA, 35 bp, Artificial Sequence
  Synthetic oligonucleotide
acctccatccgaccgcctccccatagttcggggtt

SEQ ID NO: 164264 - DNA, 35 bp, Artificial Sequence
  Synthetic oligonucleotide
gtcgctaacacatgcgacgtatccaccccttgaaa

SEQ ID NO: 164265 - DNA, 36 bp, Artificial Sequence
  Synthetic oligonucleotide
gatcccaccccgttctgcactttcgtgtttactcaa

SEQ ID NO: 164266 - DNA, 36 bp, Artificial Sequence
  Synthetic oligonucleotide
gcaccttctctgctgctcattgcaacccttgttcaa

SEQ ID NO: 164267 - DNA, 35 bp, Artificial Sequence
  Synthetic oligonucleotide
tgactcgttcgcctgctttgtccctatctccctaa

SEQ ID NO: 164268 - DNA, 35 bp, Artificial Sequence
  Synthetic oligonucleotide
ggaccgcagcccgctctcacatccgtcttcccaca

SEQ ID NO: 164269 - DNA, 36 bp, Artificial Sequence
  Synthetic oligonucleotide
attgcacccgccacccgccgaaaactcgaacgcaca

SEQ ID NO: 164270 - DNA, 36 bp, Artificial Sequence
  Synthetic oligonucleotide
gccctccctcccgattttgttgtaaaacaaatgaca

SEQ ID NO: 164271 - DNA, 36 bp, Artificial Sequence
  Synthetic oligonucleotide
gatcagtcaccgccctcttaccttcgtgctacacca

SEQ ID NO: 164272 - DNA, 36 bp, Artificial Sequence
  Synthetic oligonucleotide
gactcctctcattagtttgccctggtttccaagcca

SEQ ID NO: 164273 - DNA, 36 bp, Artificial Sequence
  Synthetic oligonucleotide
gtacctcgcccaccagttacccttcactcatgtgca

SEQ ID NO: 164274 - DNA, 36 bp, Artificial Sequence
  Synthetic oligonucleotide
gtcgacccacgtcttgtccatctcgcgaatctctca

SEQ ID NO: 164275 - DNA, 36 bp, Artificial Sequence
  Synthetic oligonucleotide
tcgcaatcgcccccgtaacatcgaagacccccgtca

SEQ ID NO: 164276 - DNA, 35 bp, Artificial Sequence
  Synthetic oligonucleotide
gccgaaccccgtctgttctttgctcatttagttca

SEQ ID NO: 164277 - DNA, 36 bp, Artificial Sequence
  Synthetic oligonucleotide
tacccggttccgctcgttcactctgccatatgttca

SEQ ID NO: 164278 - DNA, 37 bp, Artificial Sequence
  Synthetic oligonucleotide
ttgagagaggaggaggcaatgaacggggggtaggaga

SEQ ID NO: 164279 - DNA, 35 bp, Artificial Sequence
  Synthetic oligonucleotide
tattcgcctctctgacttgctccgcccatcaccga

SEQ ID NO: 164280 - DNA, 37 bp, Artificial Sequence
  Synthetic oligonucleotide
tcaccggtcataaacattttgctgcccatccccccga

SEQ ID NO: 164281 - DNA, 37 bp, Artificial Sequence
  Synthetic oligonucleotide
gcccgtgcctacattgccttgttagtgtccatcccga

SEQ ID NO: 164282 - DNA, 37 bp, Artificial Sequence
  Synthetic oligonucleotide
acctccatccacaagcagtcaagacacccttctccga

SEQ ID NO: 164283 - DNA, 36 bp, Artificial Sequence
  Synthetic oligonucleotide
gcgatgtaccgcccttgattcgttctcttctatcga

SEQ ID NO: 164284 - DNA, 36 bp, Artificial Sequence
  Synthetic oligonucleotide
ttaccgttgccagcgtgatcgccactctaccctcga

SEQ ID NO: 164285 - DNA, 37 bp, Artificial Sequence
  Synthetic oligonucleotide
atccggggaaagggaggggtggggtcaaagttcagga

SEQ ID NO: 164286 - DNA, 36 bp, Artificial Sequence
  Synthetic oligonucleotide
tagacagtgaggggtggaggaactaaaatcggcgga

SEQ ID NO: 164287 - DNA, 35 bp, Artificial Sequence
  Synthetic oligonucleotide
taaacacggggggggggggaacaaaggacaaggga

SEQ ID NO: 164288 - DNA, 38 bp, Artificial Sequence
  Synthetic oligonucleotide
gagccttccgcaccctgtgactccgtgcctcctaatga

SEQ ID NO: 164289 - DNA, 36 bp, Artificial Sequence
  Synthetic oligonucleotide
agaccccaccccctgccctgtattggtcaaccctga

SEQ ID NO: 164290 - DNA, 37 bp, Artificial Sequence
  Synthetic oligonucleotide
gcacaccacgcgtttcttctacgttctgtctccctga

SEQ ID NO: 164291 - DNA, 38 bp, Artificial Sequence
  Synthetic oligonucleotide
ttccaggcgcagtcccattcgcgctatccattccctga

SEQ ID NO: 164292 - DNA, 38 bp, Artificial Sequence
  Synthetic oligonucleotide
gcccgcccccattttccccctcagtcaacgtaagctga

SEQ ID NO: 164293 - DNA, 38 bp, Artificial Sequence
  Synthetic oligonucleotide
agaggggggggacaggaggtaaattaggcggcccgtga

SEQ ID NO: 164294 - DNA, 37 bp, Artificial Sequence
  Synthetic oligonucleotide
gtgcaggtcacacgcgctggttctctcttttcattga

SEQ ID NO: 164295 - DNA, 38 bp, Artificial Sequence
  Synthetic oligonucleotide
accggggagggtgggcatgaattggcaacgggccttga

SEQ ID NO: 164296 - DNA, 37 bp, Artificial Sequence
  Synthetic oligonucleotide
atgaaagacggaccagggggagggagataggagttga

SEQ ID NO: 164297 - DNA, 36 bp, Artificial Sequence
  Synthetic oligonucleotide
gtccgcattgatcagctttccccgtggcctcgttga

SEQ ID NO: 164298 - DNA, 37 bp, Artificial Sequence
  Synthetic oligonucleotide
gacccagacgcctgccttctctcatacccccctttga

SEQ ID NO: 164299 - DNA, 36 bp, Artificial Sequence
  Synthetic oligonucleotide
aacgcccatctccgagccaacgcctcctgtctccta

SEQ ID NO: 164300 - DNA, 36 bp, Artificial Sequence
  Synthetic oligonucleotide
tagatcaggccccattcatacatctgtccctcgcta

SEQ ID NO: 164301 - DNA, 37 bp, Artificial Sequence
  Synthetic oligonucleotide
accacgggcggggttgtgttttgttggggagagggta

SEQ ID NO: 164302 - DNA, 36 bp, Artificial Sequence
  Synthetic oligonucleotide
gatgtcgcgccctttccgtttcttagtctccattta

SEQ ID NO: 164303 - DNA, 35 bp, Artificial Sequence
  Synthetic oligonucleotide
tgcctgtcacattgcccccgttggtactccgttta

SEQ ID NO: 164304 - DNA, 35 bp, Artificial Sequence
  Synthetic oligonucleotide
attcgggacatcgttgggcgggaggggtggtttta

SEQ ID NO: 164305 - DNA, 35 bp, Artificial Sequence
  Synthetic oligonucleotide
accgacctccctgccctcgcgcgtaattggtttta

SEQ ID NO: 164306 - DNA, 35 bp, Artificial Sequence
  Synthetic oligonucleotide
gcatacaccgcggttcttcgctattgccgtaccac

SEQ ID NO: 164307 - DNA, 35 bp, Artificial Sequence
  Synthetic oligonucleotide
tcgacgccccgggcgaatcatctcgtggtccccac

SEQ ID NO: 164308 - DNA, 35 bp, Artificial Sequence
  Synthetic oligonucleotide
gtgacgggtgagtacggagggagggtgagatggac

SEQ ID NO: 164309 - DNA, 34 bp, Artificial Sequence
  Synthetic oligonucleotide
acccatccctgttcgcccccgggcctacctcacc

SEQ ID NO: 164310 - DNA, 35 bp, Artificial Sequence
  Synthetic oligonucleotide
gtacgaccatccgaaccattgctggattgcccccc

SEQ ID NO: 164311 - DNA, 35 bp, Artificial Sequence
  Synthetic oligonucleotide
ggagctgccagttgttccatcgttagccttccccc

SEQ ID NO: 164312 - DNA, 35 bp, Artificial Sequence
  Synthetic oligonucleotide
atgtgcagtagccatcgttcattagtctgtttccc

SEQ ID NO: 164313 - DNA, 34 bp, Artificial Sequence
  Synthetic oligonucleotide
gatcttcctcggccccacgcgtagcctttccgcc

SEQ ID NO: 164314 - DNA, 36 bp, Artificial Sequence
  Synthetic oligonucleotide
gtacaactcagcttgccctagcgcccctacttcgcc

SEQ ID NO: 164315 - DNA, 35 bp, Artificial Sequence
  Synthetic oligonucleotide
ggaacaaaccccccgctggttgacgctgccctgcc

SEQ ID NO: 164316 - DNA, 36 bp, Artificial Sequence
  Synthetic oligonucleotide
gttcgctcctggtgtccatagtctcgtcctagctcc

SEQ ID NO: 164317 - DNA, 35 bp, Artificial Sequence
  Synthetic oligonucleotide
tgcctatctcgtggttctatgctacgccttgctcc

SEQ ID NO: 164318 - DNA, 35 bp, Artificial Sequence
  Synthetic oligonucleotide
gaacgcgcgcaatagcctccagccgcaacctacgc

SEQ ID NO: 164319 - DNA, 35 bp, Artificial Sequence
  Synthetic oligonucleotide
tagtagctcaacatcttttgtacacgctcgcccgc

SEQ ID NO: 164320 - DNA, 35 bp, Artificial Sequence
  Synthetic oligonucleotide
tcacttcgcccgaaccagtggcctcgcttcatcgc

SEQ ID NO: 164321 - DNA, 34 bp, Artificial Sequence
  Synthetic oligonucleotide
gcccaagcttgggaggggatgtatgggcgggggc

SEQ ID NO: 164322 - DNA, 35 bp, Artificial Sequence
  Synthetic oligonucleotide
actcgggtgggggggcagggtctccttttgatggc

SEQ ID NO: 164323 - DNA, 35 bp, Artificial Sequence
  Synthetic oligonucleotide
taaacgcccatgttcctgacgcccctccgccctgc

SEQ ID NO: 164324 - DNA, 35 bp, Artificial Sequence
  Synthetic oligonucleotide
actaaatgcgccaacccccctccacttggtcgtgc

SEQ ID NO: 164325 - DNA, 35 bp, Artificial Sequence
  Synthetic oligonucleotide
ccgaactccgcctccactgttatgcccctacgatc

SEQ ID NO: 164326 - DNA, 35 bp, Artificial Sequence
  Synthetic oligonucleotide
ataccgacctcatccctgtgccagtaaacttactc

SEQ ID NO: 164327 - DNA, 35 bp, Artificial Sequence
  Synthetic oligonucleotide
gtggtgcaggatattcgggccccctctctactctc

SEQ ID NO: 164328 - DNA, 35 bp, Artificial Sequence
  Synthetic oligonucleotide
tagccatccatctgcctacgatcttacctcctgtc

SEQ ID NO: 164329 - DNA, 35 bp, Artificial Sequence
  Synthetic oligonucleotide
atcgcatgcaggcaaattctggtctctcctccacg

SEQ ID NO: 164330 - DNA, 35 bp, Artificial Sequence
  Synthetic oligonucleotide
tcacggggcaacctgcatcaccatcatcctcaccg

SEQ ID NO: 164331 - DNA, 35 bp, Artificial Sequence
  Synthetic oligonucleotide
tctagagctgcgagctgcccatctacaccctaccg

SEQ ID NO: 164332 - DNA, 35 bp, Artificial Sequence
  Synthetic oligonucleotide
agtccgcccgcaattgcgctactgccactactccg

SEQ ID NO: 164333 - DNA, 35 bp, Artificial Sequence
  Synthetic oligonucleotide
agggggggaggggtttggggagaagcacacatgcg

SEQ ID NO: 164334 - DNA, 35 bp, Artificial Sequence
  Synthetic oligonucleotide
acactccgccgagcagcccctcccgcgttttgagg

SEQ ID NO: 164335 - DNA, 35 bp, Artificial Sequence
  Synthetic oligonucleotide
actcatcctcacttcggtccgatacctgccaccgg

SEQ ID NO: 164336 - DNA, 35 bp, Artificial Sequence
  Synthetic oligonucleotide
ggtggagtggaagcaaaggcaccggggcaaagggg

SEQ ID NO: 164337 - DNA, 35 bp, Artificial Sequence
  Synthetic oligonucleotide
cacgatcgtgatcggggtggaggaaaggggagggg

SEQ ID NO: 164338 - DNA, 35 bp, Artificial Sequence
  Synthetic oligonucleotide
gaggcgggacagggggagaaggggttaaagggtgg

SEQ ID NO: 164339 - DNA, 35 bp, Artificial Sequence
  Synthetic oligonucleotide
gacacgtgcatagagtagtgggtggggggggttgg

SEQ ID NO: 164340 - DNA, 29 bp, Artificial Sequence
  Synthetic oligonucleotide
tatgaggaggaaaaagtggaggggcgatg

SEQ ID NO: 164341 - DNA, 35 bp, Artificial Sequence
  Synthetic oligonucleotide
gctgcctccctccaacgacgcgcttcgactccaat

SEQ ID NO: 164342 - DNA, 35 bp, Artificial Sequence
  Synthetic oligonucleotide
acagatgaggctcacttccttaggtccccgcttat

SEQ ID NO: 164343 - DNA, 35 bp, Artificial Sequence
  Synthetic oligonucleotide
tcaaccctgcccgtgactctaccgacaataaacct

SEQ ID NO: 164344 - DNA, 35 bp, Artificial Sequence
  Synthetic oligonucleotide
tcagcgcgtactttgttggtcttcgtgtcacccct

SEQ ID NO: 164345 - DNA, 35 bp, Artificial Sequence
  Synthetic oligonucleotide
ttgtgtgtacctgtccgcggtgcctaacgccccct

SEQ ID NO: 164346 - DNA, 35 bp, Artificial Sequence
  Synthetic oligonucleotide
acggtccccacatctgtaagcctatccaccggtct

SEQ ID NO: 164347 - DNA, 35 bp, Artificial Sequence
  Synthetic oligonucleotide
gatgatggtgggggtgacgctgtgacgacggcagt

SEQ ID NO: 164348 - DNA, 35 bp, Artificial Sequence
  Synthetic oligonucleotide
gtacctctaccgtttcctgccccactgaatatcgt

SEQ ID NO: 164349 - DNA, 35 bp, Artificial Sequence
  Synthetic oligonucleotide
agacccacagtccagctgctgtttccttccgcctt

SEQ ID NO: 164350 - DNA, 35 bp, Artificial Sequence
  Synthetic oligonucleotide
gttgactacccgcgcctccatttattagtgtcctt

SEQ ID NO: 164351 - DNA, 35 bp, Artificial Sequence
  Synthetic oligonucleotide
ggacacacgatgtgccctcctacactcaacccgtt

SEQ ID NO: 164352 - DNA, 35 bp, Artificial Sequence
  Synthetic oligonucleotide
acatgtgacgtcctctatctccctccggccttgtt

SEQ ID NO: 164353 - DNA, 35 bp, Artificial Sequence
  Synthetic oligonucleotide
tatccctgtcccgccccttgtccgcagagactttt

SEQ ID NO: 164354 - DNA, 36 bp, Artificial Sequence
  Synthetic oligonucleotide
gtgacccaacctgtccctgtcgatcttcgatcccaa

SEQ ID NO: 164355 - DNA, 36 bp, Artificial Sequence
  Synthetic oligonucleotide
acgcacgctccgccatacccgtgtcttccgcccgaa

SEQ ID NO: 164356 - DNA, 36 bp, Artificial Sequence
  Synthetic oligonucleotide
aagtagaggggggtggtgtagcaaaggtgattggaa

SEQ ID NO: 164357 - DNA, 36 bp, Artificial Sequence
  Synthetic oligonucleotide
agagatggagagggtaagcagggtggaacgtggaca

SEQ ID NO: 164358 - DNA, 36 bp, Artificial Sequence
  Synthetic oligonucleotide
gacgcccctccccctgttgattttctcgttctgaca

SEQ ID NO: 164359 - DNA, 36 bp, Artificial Sequence
  Synthetic oligonucleotide
tgccgcctgcacgactgcctcccttcgacctctaca

SEQ ID NO: 164360 - DNA, 35 bp, Artificial Sequence
  Synthetic oligonucleotide
atatccgcaccaatgcctcaagtcgactcgcacca

SEQ ID NO: 164361 - DNA, 36 bp, Artificial Sequence
  Synthetic oligonucleotide
agattgcaatctgcccccaccgagtaccccggccca

SEQ ID NO: 164362 - DNA, 36 bp, Artificial Sequence
  Synthetic oligonucleotide
accagcctccccgcttgccgtatatccaccccgcca

SEQ ID NO: 164363 - DNA, 36 bp, Artificial Sequence
  Synthetic oligonucleotide
gctaaccgtacggttagtctaggttcaccttctcca

SEQ ID NO: 164364 - DNA, 35 bp, Artificial Sequence
  Synthetic oligonucleotide
tgtacgtccctcagccttttaactcagccccggca

SEQ ID NO: 164365 - DNA, 36 bp, Artificial Sequence
  Synthetic oligonucleotide
tccattggcctcttttcctacgcctgtccgtttgca

SEQ ID NO: 164366 - DNA, 36 bp, Artificial Sequence
  Synthetic oligonucleotide
gtcatccccctgcctgcgcctataaccgatcattca

SEQ ID NO: 164367 - DNA, 37 bp, Artificial Sequence
  Synthetic oligonucleotide
gcggacggatgggggtgggggaggagtgaccagcaga

SEQ ID NO: 164368 - DNA, 37 bp, Artificial Sequence
  Synthetic oligonucleotide
ggtggcaggggtgggggaggaagggcgctaaatgaga

SEQ ID NO: 164369 - DNA, 34 bp, Artificial Sequence
  Synthetic oligonucleotide
acccccttacgccctgacctcgcctatacctaga

SEQ ID NO: 164370 - DNA, 37 bp, Artificial Sequence
  Synthetic oligonucleotide
ttgcccctaacaagcgtctaggaccccatccctccga

SEQ ID NO: 164371 - DNA, 37 bp, Artificial Sequence
  Synthetic oligonucleotide
tgtcgagacgcacagtgcgctttccttccgcctccga

SEQ ID NO: 164372 - DNA, 37 bp, Artificial Sequence
  Synthetic oligonucleotide
accctcccgagtgttctatatccgtccttcttatcga

SEQ ID NO: 164373 - DNA, 36 bp, Artificial Sequence
  Synthetic oligonucleotide
aatcaccacacctgtatcgccaccgtacctctagga

SEQ ID NO: 164374 - DNA, 36 bp, Artificial Sequence
  Synthetic oligonucleotide
acccggggtgcatggaaatggggggaggaagacgga

SEQ ID NO: 164375 - DNA, 37 bp, Artificial Sequence
  Synthetic oligonucleotide
taggtgcgtcaccactccctctacgctgctccccgga

SEQ ID NO: 164376 - DNA, 37 bp, Artificial Sequence
  Synthetic oligonucleotide
tttccactcacggtatccttcgctgccctctcgcgga

SEQ ID NO: 164377 - DNA, 36 bp, Artificial Sequence
  Synthetic oligonucleotide
atggagtggggaggttggcataggcggcttggggga

SEQ ID NO: 164378 - DNA, 36 bp, Artificial Sequence
  Synthetic oligonucleotide
gtctcgtggaggtggggtatctaggggtggggtgga

SEQ ID NO: 164379 - DNA, 38 bp, Artificial Sequence
  Synthetic oligonucleotide
tgcccacgctctgctttaacctctggctccacccatga

SEQ ID NO: 164380 - DNA, 35 bp, Artificial Sequence
  Synthetic oligonucleotide
tgagcaagaagggaggtaagggagaggggcgctga

SEQ ID NO: 164381 - DNA, 37 bp, Artificial Sequence
  Synthetic oligonucleotide
ggggtggtgggtcttagacacgggagtgtggggctga

SEQ ID NO: 164382 - DNA, 38 bp, Artificial Sequence
  Synthetic oligonucleotide
gcgcaccctctctgatgtcaccgcacaccttctgctga

SEQ ID NO: 164383 - DNA, 35 bp, Artificial Sequence
  Synthetic oligonucleotide
tgcgggccattattccgtactctctcgcttgctga

SEQ ID NO: 164384 - DNA, 37 bp, Artificial Sequence
  Synthetic oligonucleotide
tacgccaacctgccgtttgtcttcaaccaccctctga

SEQ ID NO: 164385 - DNA, 37 bp, Artificial Sequence
  Synthetic oligonucleotide
gcctccaccctcgcccctgtagttcttttcagagtga

SEQ ID NO: 164386 - DNA, 38 bp, Artificial Sequence
  Synthetic oligonucleotide
gacgaaagcaggaggggggctgaatacagcaggagtga

SEQ ID NO: 164387 - DNA, 38 bp, Artificial Sequence
  Synthetic oligonucleotide
agacgccgtaccactgcctcctctcgttttctccgtga

SEQ ID NO: 164388 - DNA, 37 bp, Artificial Sequence
  Synthetic oligonucleotide
gtcaagccatggggagttagagggaggatgggcgtga

SEQ ID NO: 164389 - DNA, 37 bp, Artificial Sequence
  Synthetic oligonucleotide
tgggggggtaaatggggaagaactgaggggccggtga

SEQ ID NO: 164390 - DNA, 38 bp, Artificial Sequence
  Synthetic oligonucleotide
agagggtggggcggaattttcggggtaaagcggggtga

SEQ ID NO: 164391 - DNA, 38 bp, Artificial Sequence
  Synthetic oligonucleotide
gcatcccgcccctgcccccatcacagttattcatgtga

SEQ ID NO: 164392 - DNA, 38 bp, Artificial Sequence
  Synthetic oligonucleotide
aaaggtagggagggggataggacacggaagagatgtga

SEQ ID NO: 164393 - DNA, 37 bp, Artificial Sequence
  Synthetic oligonucleotide
tgatacgccccatctttctgcactcgtccaccgttga

SEQ ID NO: 164394 - DNA, 35 bp, Artificial Sequence
  Synthetic oligonucleotide
acccctccttcatctgcctcgcttataccgcgata

SEQ ID NO: 164395 - DNA, 36 bp, Artificial Sequence
  Synthetic oligonucleotide
gtcgcccttgccctcaaaaccatctgtatcacacta

SEQ ID NO: 164396 - DNA, 36 bp, Artificial Sequence
  Synthetic oligonucleotide
actccccgccgtacgctacaacccccgacatcgcta

SEQ ID NO: 164397 - DNA, 36 bp, Artificial Sequence
  Synthetic oligonucleotide
gtcgagaagagggccggaggtggggaagcgtaggta

SEQ ID NO: 164398 - DNA, 36 bp, Artificial Sequence
  Synthetic oligonucleotide
gatcgcccctagctatctaacgccccactgttctta

SEQ ID NO: 164399 - DNA, 36 bp, Artificial Sequence
  Synthetic oligonucleotide
gtggggaggggtggggcaagggtgtcctcgtagtta

SEQ ID NO: 164400 - DNA, 35 bp, Artificial Sequence
  Synthetic oligonucleotide
agtcccctgccacctgtattcgttcttgccgcaac

SEQ ID NO: 164401 - DNA, 35 bp, Artificial Sequence
  Synthetic oligonucleotide
tcactgctctccatcctgatatcgcgcctcaacac

SEQ ID NO: 164402 - DNA, 35 bp, Artificial Sequence
  Synthetic oligonucleotide
gatccccatatttcgaagccctgtccgttccgcac

SEQ ID NO: 164403 - DNA, 35 bp, Artificial Sequence
  Synthetic oligonucleotide
gtctgcacattgacgcgctctcccctgttaactac

SEQ ID NO: 164404 - DNA, 35 bp, Artificial Sequence
  Synthetic oligonucleotide
ggatgcccatgctacgactcagccgccctgactac

SEQ ID NO: 164405 - DNA, 35 bp, Artificial Sequence
  Synthetic oligonucleotide
tgtgaccgctatgcctctgtatcgcttccttgtac

SEQ ID NO: 164406 - DNA, 35 bp, Artificial Sequence
  Synthetic oligonucleotide
ttgcaagcttcttgtcgccgtgccctggctccccc

SEQ ID NO: 164407 - DNA, 35 bp, Artificial Sequence
  Synthetic oligonucleotide
gtgcggactgcaggttatttctgatcctcctcccc

SEQ ID NO: 164408 - DNA, 35 bp, Artificial Sequence
  Synthetic oligonucleotide
tcacggttggctcttcatcgccctgcctggttccc

SEQ ID NO: 164409 - DNA, 35 bp, Artificial Sequence
  Synthetic oligonucleotide
acgttcgtgccatccccgccgcccgggacttcgcc

SEQ ID NO: 164410 - DNA, 35 bp, Artificial Sequence
  Synthetic oligonucleotide
gtgcaatctctgtaaattcgtcgccgatgcatgcc

SEQ ID NO: 164411 - DNA, 35 bp, Artificial Sequence
  Synthetic oligonucleotide
tgtactcaagagctctccgtccacctctgggtgcc

SEQ ID NO: 164412 - DNA, 35 bp, Artificial Sequence
  Synthetic oligonucleotide
tacgtctcaacatactgcgttccgtaccacttgcc

SEQ ID NO: 164413 - DNA, 35 bp, Artificial Sequence
  Synthetic oligonucleotide
gcctgcattgctcctctaattgtgccgtccttgcc

SEQ ID NO: 164414 - DNA, 35 bp, Artificial Sequence
  Synthetic oligonucleotide
tcgtgggccctttgtgtctgatcaccgctctctcc

SEQ ID NO: 164415 - DNA, 36 bp, Artificial Sequence
  Synthetic oligonucleotide
agcccccatcctgttcgttctaacctgtctgagtcc

SEQ ID NO: 164416 - DNA, 35 bp, Artificial Sequence
  Synthetic oligonucleotide
acttcacgcccctgttgacctttagtcgctaatgc

SEQ ID NO: 164417 - DNA, 35 bp, Artificial Sequence
  Synthetic oligonucleotide
acccacccacgtgtatttaaactccattatcgtgc

SEQ ID NO: 164418 - DNA, 35 bp, Artificial Sequence
  Synthetic oligonucleotide
tgccgccttcgtaattacggcgttcctctccttgc

SEQ ID NO: 164419 - DNA, 35 bp, Artificial Sequence
  Synthetic oligonucleotide
tgcactccgtactctcgctgctttcctcgcttatc

SEQ ID NO: 164420 - DNA, 35 bp, Artificial Sequence
  Synthetic oligonucleotide
tacagccccagacgttcctcttttggtctgttatc

SEQ ID NO: 164421 - DNA, 35 bp, Artificial Sequence
  Synthetic oligonucleotide
gagtgtgtcatccccgccattagtggtcgcctctc

SEQ ID NO: 164422 - DNA, 34 bp, Artificial Sequence
  Synthetic oligonucleotide
gcacgacagagcgtaggctccaatctatcctctc

SEQ ID NO: 164423 - DNA, 35 bp, Artificial Sequence
  Synthetic oligonucleotide
tgtggcggtccacaagttctttcctgctcccggtc

SEQ ID NO: 164424 - DNA, 35 bp, Artificial Sequence
  Synthetic oligonucleotide
tcaaccaccgtgccttcctccctgcacctcctgtc

SEQ ID NO: 164425 - DNA, 35 bp, Artificial Sequence
  Synthetic oligonucleotide
actccttgcactacccaactgtatctgccaccttc

SEQ ID NO: 164426 - DNA, 35 bp, Artificial Sequence
  Synthetic oligonucleotide
gttgccccgactctaatgacttcccgattggtccg

SEQ ID NO: 164427 - DNA, 35 bp, Artificial Sequence
  Synthetic oligonucleotide
acgggtgggagggctgggatcaaaagcatgaacgg

SEQ ID NO: 164428 - DNA, 35 bp, Artificial Sequence
  Synthetic oligonucleotide
atgcgcattagtcctccgttccccctgtactccgg

SEQ ID NO: 164429 - DNA, 35 bp, Artificial Sequence
  Synthetic oligonucleotide
gtgggtacaggaggaggaagaaaactggtgagatg

SEQ ID NO: 164430 - DNA, 35 bp, Artificial Sequence
  Synthetic oligonucleotide
tttcccccgaagcacctgtctatacaaacgaactg

SEQ ID NO: 164431 - DNA, 35 bp, Artificial Sequence
  Synthetic oligonucleotide
accctccctcctcttcacgaactgcattacgcctg

SEQ ID NO: 164432 - DNA, 35 bp, Artificial Sequence
  Synthetic oligonucleotide
atggtcgcagaggaggaaggtggttagtgagggtg

SEQ ID NO: 164433 - DNA, 35 bp, Artificial Sequence
  Synthetic oligonucleotide
taggtagaagtcgggctaggggggaaggggctgtg

SEQ ID NO: 164434 - DNA, 35 bp, Artificial Sequence
  Synthetic oligonucleotide
actccctcaactcgcctcgcaatatggaagtattg

SEQ ID NO: 164435 - DNA, 35 bp, Artificial Sequence
  Synthetic oligonucleotide
tgcggagcacatgcccccctcctgctctgcgcttg

SEQ ID NO: 164436 - DNA, 35 bp, Artificial Sequence
  Synthetic oligonucleotide
gaaccgctgatcgtaagcccccccgcttgtttttg

SEQ ID NO: 164437 - DNA, 35 bp, Artificial Sequence
  Synthetic oligonucleotide
tcctgatcctcccgcccctgacgcttggcttgtat

SEQ ID NO: 164438 - DNA, 35 bp, Artificial Sequence
  Synthetic oligonucleotide
gcttacgcccttctgctcattgtacatcattttat

SEQ ID NO: 164439 - DNA, 35 bp, Artificial Sequence
  Synthetic oligonucleotide
gctccaaccgcctgccccctggtttcatcgaccct

SEQ ID NO: 164440 - DNA, 35 bp, Artificial Sequence
  Synthetic oligonucleotide
ggaggacacatgcacgcgcactaagcccccttcct

SEQ ID NO: 164441 - DNA, 35 bp, Artificial Sequence
  Synthetic oligonucleotide
gttacacccgcctgaacgcgctaatccattgcgct

SEQ ID NO: 164442 - DNA, 35 bp, Artificial Sequence
  Synthetic oligonucleotide
agcagacaggggtggagaggaggggagtgtatagt

SEQ ID NO: 164443 - DNA, 33 bp, Artificial Sequence
  Synthetic oligonucleotide
gaccatccgcaggcccttatgtaacatccccgt

SEQ ID NO: 164444 - DNA, 35 bp, Artificial Sequence
  Synthetic oligonucleotide
ggaaaccgccccacaacgctgcgtaccacccttgt

SEQ ID NO: 164445 - DNA, 35 bp, Artificial Sequence
  Synthetic oligonucleotide
gaccaccgtttccgcgaccggccttgacatgcctt

SEQ ID NO: 164446 - DNA, 35 bp, Artificial Sequence
  Synthetic oligonucleotide
gtcacctcgcccgtccgcacccggttctagctctt

SEQ ID NO: 164447 - DNA, 35 bp, Artificial Sequence
  Synthetic oligonucleotide
ggtccacgggcgtatgtcgtcgttccccgtttctt

SEQ ID NO: 164448 - DNA, 35 bp, Artificial Sequence
  Synthetic oligonucleotide
tcctaccaccccctgttggccttcaacgttcgttt

SEQ ID NO: 164449 - DNA, 36 bp, Artificial Sequence
  Synthetic oligonucleotide
agtggggggggtgggggggaaaataggctggataaa

SEQ ID NO: 164450 - DNA, 35 bp, Artificial Sequence
  Synthetic oligonucleotide
gccgtcccccctcaatcgcgtcaatttgcgctcaa

SEQ ID NO: 164451 - DNA, 36 bp, Artificial Sequence
  Synthetic oligonucleotide
tgcacacttgcgacttcccccccgcgcccgttcgaa

SEQ ID NO: 164452 - DNA, 35 bp, Artificial Sequence
  Synthetic oligonucleotide
tcgttcgtgcccataatgtcggcttccacctctaa

SEQ ID NO: 164453 - DNA, 36 bp, Artificial Sequence
  Synthetic oligonucleotide
gaccgacgactcagtattcccacacccccgcacaca

SEQ ID NO: 164454 - DNA, 36 bp, Artificial Sequence
  Synthetic oligonucleotide
tggaggacgccatttggttcatcctgtctccaccca

SEQ ID NO: 164455 - DNA, 36 bp, Artificial Sequence
  Synthetic oligonucleotide
tgcctcacctcagcccgtttcatttccgtggcgcca

SEQ ID NO: 164456 - DNA, 35 bp, Artificial Sequence
  Synthetic oligonucleotide
gtgccgtccttccccactccggcgtcgggtctcca

SEQ ID NO: 164457 - DNA, 36 bp, Artificial Sequence
  Synthetic oligonucleotide
gccttcacgccctcaccctcggatcagccgtttcca

SEQ ID NO: 164458 - DNA, 36 bp, Artificial Sequence
  Synthetic oligonucleotide
tgttcactcgcccttgactgtccagctatcccagca

SEQ ID NO: 164459 - DNA, 36 bp, Artificial Sequence
  Synthetic oligonucleotide
ttccggggctccctctgcttgtagcatttcccatca

SEQ ID NO: 164460 - DNA, 36 bp, Artificial Sequence
  Synthetic oligonucleotide
agacaccccgccctcagactcatcgcagtcttttca

SEQ ID NO: 164461 - DNA, 35 bp, Artificial Sequence
  Synthetic oligonucleotide
gtgggctgagggaaggggggagaatgctaaccaga

SEQ ID NO: 164462 - DNA, 37 bp, Artificial Sequence
  Synthetic oligonucleotide
gggacgctactgccttccttctgcctcctcttcgaga

SEQ ID NO: 164463 - DNA, 36 bp, Artificial Sequence
  Synthetic oligonucleotide
gtaatgggcgggacaggtgagggagggttggaccga

SEQ ID NO: 164464 - DNA, 37 bp, Artificial Sequence
  Synthetic oligonucleotide
agtgctcacgcaacacgtcttaactctgctcccccga

SEQ ID NO: 164465 - DNA, 36 bp, Artificial Sequence
  Synthetic oligonucleotide
tcccagtcttcacgcacccctaccgttatggcccga

SEQ ID NO: 164466 - DNA, 37 bp, Artificial Sequence
  Synthetic oligonucleotide
gctaggtgaggggaggatggatgaacggatgggtcga

SEQ ID NO: 164467 - DNA, 37 bp, Artificial Sequence
  Synthetic oligonucleotide
ttacacatccccccgccgttccgactcgtccgaagga

SEQ ID NO: 164468 - DNA, 36 bp, Artificial Sequence
  Synthetic oligonucleotide
acaagaatggggattgggtacaaaggggggcacgga

SEQ ID NO: 164469 - DNA, 37 bp, Artificial Sequence
  Synthetic oligonucleotide
gcgacatagagaagatagcaatggacggggggcggga

SEQ ID NO: 164470 - DNA, 36 bp, Artificial Sequence
  Synthetic oligonucleotide
gcattgaagggtcaaggggggtagggtaaatgggga

SEQ ID NO: 164471 - DNA, 37 bp, Artificial Sequence
  Synthetic oligonucleotide
gcactcagtctctcaacacctccgccacacctatgga

SEQ ID NO: 164472 - DNA, 36 bp, Artificial Sequence
  Synthetic oligonucleotide
atgtccccctctccgtgctaagccttaacgtaatga

SEQ ID NO: 164473 - DNA, 38 bp, Artificial Sequence
  Synthetic oligonucleotide
ttacgcaccggcccccttctcccgcaacaccgcactga

SEQ ID NO: 164474 - DNA, 38 bp, Artificial Sequence
  Synthetic oligonucleotide
aacgccaccacacttggtttttctcatccccgcactga

SEQ ID NO: 164475 - DNA, 38 bp, Artificial Sequence
  Synthetic oligonucleotide
ggatccgaagggtggaaggggccgaggaggacacgtga

SEQ ID NO: 164476 - DNA, 38 bp, Artificial Sequence
  Synthetic oligonucleotide
taggagtggggaaagagcagtgcaggaggacagggtga

SEQ ID NO: 164477 - DNA, 38 bp, Artificial Sequence
  Synthetic oligonucleotide
gggtggtgcggggggtgagtggggtaggtggtgggtga

SEQ ID NO: 164478 - DNA, 38 bp, Artificial Sequence
  Synthetic oligonucleotide
tagggggccggagcaggaggagtctggttgcgttgtga

SEQ ID NO: 164479 - DNA, 37 bp, Artificial Sequence
  Synthetic oligonucleotide
atcacaccggcatggtcccgccgcccttccttattga

SEQ ID NO: 164480 - DNA, 38 bp, Artificial Sequence
  Synthetic oligonucleotide
tgtcgcctccctcaatcacaccgtgccaggccccttga

SEQ ID NO: 164481 - DNA, 35 bp, Artificial Sequence
  Synthetic oligonucleotide
gaacgcggagggggctgggctaatgggggacggta

SEQ ID NO: 164482 - DNA, 35 bp, Artificial Sequence
  Synthetic oligonucleotide
tcgagtggccatccggggtctcttctctacactta

SEQ ID NO: 164483 - DNA, 36 bp, Artificial Sequence
  Synthetic oligonucleotide
gaccaccacgcacgacgcgccccactacttttgtta

SEQ ID NO: 164484 - DNA, 35 bp, Artificial Sequence
  Synthetic oligonucleotide
aacactgcctcgcttgtatccaccttccctgtaac

SEQ ID NO: 164485 - DNA, 35 bp, Artificial Sequence
  Synthetic oligonucleotide
tactccgcctgagcgctaattgtcccccgtaccac

SEQ ID NO: 164486 - DNA, 35 bp, Artificial Sequence
  Synthetic oligonucleotide
gccgctactgccatgataattcacttttgttccac

SEQ ID NO: 164487 - DNA, 35 bp, Artificial Sequence
  Synthetic oligonucleotide
gagacactggactgatccccttcgcacgctagcac

SEQ ID NO: 164488 - DNA, 35 bp, Artificial Sequence
  Synthetic oligonucleotide
tcacgcaccactgatgtccttctgttccacccgac

SEQ ID NO: 164489 - DNA, 35 bp, Artificial Sequence
  Synthetic oligonucleotide
ttcgcacccccattcgtgctctcttacctccttac

SEQ ID NO: 164490 - DNA, 35 bp, Artificial Sequence
  Synthetic oligonucleotide
tagtggtcaagcctcccttctcgctcgctcgttac

SEQ ID NO: 164491 - DNA, 35 bp, Artificial Sequence
  Synthetic oligonucleotide
acgtcctgtcctcagcacctatccaacgatcgacc

SEQ ID NO: 164492 - DNA, 35 bp, Artificial Sequence
  Synthetic oligonucleotide
acacggacgcccttgacacatttggcccctcaccc

SEQ ID NO: 164493 - DNA, 35 bp, Artificial Sequence
  Synthetic oligonucleotide
gtctgctacccgcgggcaccccagtccacaccccc

SEQ ID NO: 164494 - DNA, 34 bp, Artificial Sequence
  Synthetic oligonucleotide
tacccacagccgccggcccttcgacgtacgcccc

SEQ ID NO: 164495 - DNA, 35 bp, Artificial Sequence
  Synthetic oligonucleotide
taagtccagctagtccgcaacatcgacccacgccc

SEQ ID NO: 164496 - DNA, 35 bp, Artificial Sequence
  Synthetic oligonucleotide
gcgtcgtctctgtcttgatctcccttcgctccgcc

SEQ ID NO: 164497 - DNA, 35 bp, Artificial Sequence
  Synthetic oligonucleotide
attcaccggcctgaatcttttcccggctcatcgcc

SEQ ID NO: 164498 - DNA, 35 bp, Artificial Sequence
  Synthetic oligonucleotide
ttcccccacccatcaccgtgcctcagaacgctgcc

SEQ ID NO: 164499 - DNA, 35 bp, Artificial Sequence
  Synthetic oligonucleotide
tgtaacccctgtttgccacacctactgtgtcatcc

SEQ ID NO: 164500 - DNA, 35 bp, Artificial Sequence
  Synthetic oligonucleotide
acgactatcagcgcacgcaagttaacctccactcc

SEQ ID NO: 164501 - DNA, 35 bp, Artificial Sequence
  Synthetic oligonucleotide
ttcgtcctccggccgtctcccttatgttactctcc

SEQ ID NO: 164502 - DNA, 35 bp, Artificial Sequence
  Synthetic oligonucleotide
aaccaccctgttggtgagctccgaacacactccgc

SEQ ID NO: 164503 - DNA, 35 bp, Artificial Sequence
  Synthetic oligonucleotide
gtgagcacgttcccttggttgttctactgctgatc

SEQ ID NO: 164504 - DNA, 35 bp, Artificial Sequence
  Synthetic oligonucleotide
tcactgcatcctttggctttctcgtttcgcacctc

SEQ ID NO: 164505 - DNA, 35 bp, Artificial Sequence
  Synthetic oligonucleotide
acactgtaacggtacgaacagggttgcccccgctc

SEQ ID NO: 164506 - DNA, 35 bp, Artificial Sequence
  Synthetic oligonucleotide
agcccgccccgcccacacctggatgtttccctgtc

SEQ ID NO: 164507 - DNA, 34 bp, Artificial Sequence
  Synthetic oligonucleotide
aagtcgcctgtccccgcagcatttcccctttgtc

SEQ ID NO: 164508 - DNA, 36 bp, Artificial Sequence
  Synthetic oligonucleotide
tagctccacctggttttttcatctatgaccgccttc

SEQ ID NO: 164509 - DNA, 35 bp, Artificial Sequence
  Synthetic oligonucleotide
gttgcggtaccatcactattgggctacattccttc

SEQ ID NO: 164510 - DNA, 35 bp, Artificial Sequence
  Synthetic oligonucleotide
agcactcgtggtcccccttgctgtttcctctcacg

SEQ ID NO: 164511 - DNA, 35 bp, Artificial Sequence
  Synthetic oligonucleotide
tctgactccccatatctttccgtttcctgccgccg

SEQ ID NO: 164512 - DNA, 35 bp, Artificial Sequence
  Synthetic oligonucleotide
acctcccgctaggccgtccactcgcttacatcagg

SEQ ID NO: 164513 - DNA, 35 bp, Artificial Sequence
  Synthetic oligonucleotide
gatcgccaccctattactaccacccctatcgagtg

SEQ ID NO: 164514 - DNA, 35 bp, Artificial Sequence
  Synthetic oligonucleotide
accgcgagaggaggggggggtgctatgggcgccat

SEQ ID NO: 164515 - DNA, 33 bp, Artificial Sequence
  Synthetic oligonucleotide
gctgcccgtgcccccgttgtcgttctccatcat

SEQ ID NO: 164516 - DNA, 35 bp, Artificial Sequence
  Synthetic oligonucleotide
tagcctgggtaggacggtgggggtgtggacggtat

SEQ ID NO: 164517 - DNA, 35 bp, Artificial Sequence
  Synthetic oligonucleotide
gcccgaatcaccccgctccaccggcctaacgcact

SEQ ID NO: 164518 - DNA, 35 bp, Artificial Sequence
  Synthetic oligonucleotide
atccaccccctcccgatgtccatctttgtcgtact

SEQ ID NO: 164519 - DNA, 35 bp, Artificial Sequence
  Synthetic oligonucleotide
gcctactcacatgcaaatatttaactgccgtacct

SEQ ID NO: 164520 - DNA, 35 bp, Artificial Sequence
  Synthetic oligonucleotide
tgaagagcaggactcgttcactccccgtacaccct

SEQ ID NO: 164521 - DNA, 35 bp, Artificial Sequence
  Synthetic oligonucleotide
atcgacaagcaacgcgcttacatgctcgcttccct

SEQ ID NO: 164522 - DNA, 35 bp, Artificial Sequence
  Synthetic oligonucleotide
acattccaggccctatccaccgccgcgccgcatct

SEQ ID NO: 164523 - DNA, 35 bp, Artificial Sequence
  Synthetic oligonucleotide
ttattaccgcatgcctcggccccccccagttatct

SEQ ID NO: 164524 - DNA, 35 bp, Artificial Sequence
  Synthetic oligonucleotide
acctagccgccctgttgcccaaaaccctccgctct

SEQ ID NO: 164525 - DNA, 35 bp, Artificial Sequence
  Synthetic oligonucleotide
acctcatccccagaatcaattagctcacttgttct

SEQ ID NO: 164526 - DNA, 35 bp, Artificial Sequence
  Synthetic oligonucleotide
gcaccctccccactgtcgctcccgtccctgcgagt

SEQ ID NO: 164527 - DNA, 35 bp, Artificial Sequence
  Synthetic oligonucleotide
gcgaagggtagggcggaagtgagttggggggtcgt

SEQ ID NO: 164528 - DNA, 35 bp, Artificial Sequence
  Synthetic oligonucleotide
atagcacgccccttgctcgccattcgcatttctgt

SEQ ID NO: 164529 - DNA, 35 bp, Artificial Sequence
  Synthetic oligonucleotide
cccacccagaatggcctccccgccaccccccttgt

SEQ ID NO: 164530 - DNA, 35 bp, Artificial Sequence
  Synthetic oligonucleotide
tacgacccacccgccccatggactctggcgacctt

SEQ ID NO: 164531 - DNA, 35 bp, Artificial Sequence
  Synthetic oligonucleotide
aacgttcgctcccacctgccttaatgacgccagtt

SEQ ID NO: 164532 - DNA, 35 bp, Artificial Sequence
  Synthetic oligonucleotide
atcacgccactgcctacggttctaggattcgcttt

SEQ ID NO: 164533 - DNA, 35 bp, Artificial Sequence
  Synthetic oligonucleotide
tcctcgcttgtcacctatttaacgccgccctgttt

SEQ ID NO: 164534 - DNA, 36 bp, Artificial Sequence
  Synthetic oligonucleotide
tgacttgagcgaggggagggactctggagagggaaa

SEQ ID NO: 164535 - DNA, 36 bp, Artificial Sequence
  Synthetic oligonucleotide
agtcaggggtgaggggggtaacaaggtgatgtgcaa

SEQ ID NO: 164536 - DNA, 36 bp, Artificial Sequence
  Synthetic oligonucleotide
tacgccgagtcgtcaccgccgccttttatcttgcaa

SEQ ID NO: 164537 - DNA, 36 bp, Artificial Sequence
  Synthetic oligonucleotide
agcaacctgcctgctacctgaaatgaaccgctctaa

SEQ ID NO: 164538 - DNA, 35 bp, Artificial Sequence
  Synthetic oligonucleotide
gaagaacagggggagttggggaatagcacgcgtaa

SEQ ID NO: 164539 - DNA, 36 bp, Artificial Sequence
  Synthetic oligonucleotide
ggaagcataggcggagggaagtggggggcgaggtaa

SEQ ID NO: 164540 - DNA, 36 bp, Artificial Sequence
  Synthetic oligonucleotide
accaccaaccgccaggttttgattggtcttctttaa

SEQ ID NO: 164541 - DNA, 35 bp, Artificial Sequence
  Synthetic oligonucleotide
gaacgccccccccagtgctatatctttgcgtaaca

SEQ ID NO: 164542 - DNA, 35 bp, Artificial Sequence
  Synthetic oligonucleotide
gccgatggaaggaggaggttagggcaaagatgaca

SEQ ID NO: 164543 - DNA, 36 bp, Artificial Sequence
  Synthetic oligonucleotide
actgtcctcgccacgttttctcacgcacgttataca

SEQ ID NO: 164544 - DNA, 36 bp, Artificial Sequence
  Synthetic oligonucleotide
atgtgtacacgagcgtcactcttagtctccgcccca

SEQ ID NO: 164545 - DNA, 36 bp, Artificial Sequence
  Synthetic oligonucleotide
gaccacccccagttcccatatattgcccggcccgca

SEQ ID NO: 164546 - DNA, 36 bp, Artificial Sequence
  Synthetic oligonucleotide
tcgactcccttggtttaattcgccggtcctttatca

SEQ ID NO: 164547 - DNA, 35 bp, Artificial Sequence
  Synthetic oligonucleotide
gtgctgcctcacccggcgagtcgcaagccctctca

SEQ ID NO: 164548 - DNA, 35 bp, Artificial Sequence
  Synthetic oligonucleotide
tctagcattcatcctacccgcgcacacccgcttca

SEQ ID NO: 164549 - DNA, 35 bp, Artificial Sequence
  Synthetic oligonucleotide
gcgcccccgtccccataatccatcgcacgtgttca

SEQ ID NO: 164550 - DNA, 37 bp, Artificial Sequence
  Synthetic oligonucleotide
gatagcatagggggaggcacgacggggatacgggaga

SEQ ID NO: 164551 - DNA, 37 bp, Artificial Sequence
  Synthetic oligonucleotide
gacccacatgaatgcgcactgctaacccgctccacga

SEQ ID NO: 164552 - DNA, 37 bp, Artificial Sequence
  Synthetic oligonucleotide
tggataggacggaggaagagttaggggagatggacga

SEQ ID NO: 164553 - DNA, 37 bp, Artificial Sequence
  Synthetic oligonucleotide
gtccgtctcaattcagcctatatgtccgcctccccga

SEQ ID NO: 164554 - DNA, 35 bp, Artificial Sequence
  Synthetic oligonucleotide
acaccgtccgccccatagcttaccgttccatccga

SEQ ID NO: 164555 - DNA, 37 bp, Artificial Sequence
  Synthetic oligonucleotide
ttagggccatcttgccccctccccagtacccttccga

SEQ ID NO: 164556 - DNA, 36 bp, Artificial Sequence
  Synthetic oligonucleotide
gtcatctcgtagcccttcgccctcctgcctccgcga

SEQ ID NO: 164557 - DNA, 33 bp, Artificial Sequence
  Synthetic oligonucleotide
tcaatcaccacactatcgcagccacattcgcga

SEQ ID NO: 164558 - DNA, 37 bp, Artificial Sequence
  Synthetic oligonucleotide
atccccaccgctctatgccgcttcaactgaaactcga

SEQ ID NO: 164559 - DNA, 36 bp, Artificial Sequence
  Synthetic oligonucleotide
gagtatgagagtgtgtggggagcaaaggggaaagga

SEQ ID NO: 164560 - DNA, 37 bp, Artificial Sequence
  Synthetic oligonucleotide
aaccgaccgaagtggaaggtagtgaaggaagggagga

SEQ ID NO: 164561 - DNA, 36 bp, Artificial Sequence
  Synthetic oligonucleotide
gagttagggatgggagtagcggtgggcgggcacgga

SEQ ID NO: 164562 - DNA, 37 bp, Artificial Sequence
  Synthetic oligonucleotide
aagaccgcgagaagtgtgggagagcgggagggcggga

SEQ ID NO: 164563 - DNA, 37 bp, Artificial Sequence
  Synthetic oligonucleotide
ttcaagcctcgcttcgtagccttccaccttctcggga

SEQ ID NO: 164564 - DNA, 37 bp, Artificial Sequence
  Synthetic oligonucleotide
gtagggcgggtgggcaggcgacgagacgataaatgga

SEQ ID NO: 164565 - DNA, 37 bp, Artificial Sequence
  Synthetic oligonucleotide
ttccgccccatcttgaattgggtcctcccatcctgga

SEQ ID NO: 164566 - DNA, 38 bp, Artificial Sequence
  Synthetic oligonucleotide
ggtccccactcccatctgtagctattgccgtgccatga

SEQ ID NO: 164567 - DNA, 35 bp, Artificial Sequence
  Synthetic oligonucleotide
gcaaccctacacgctaagctcagccatccccctga

SEQ ID NO: 164568 - DNA, 36 bp, Artificial Sequence
  Synthetic oligonucleotide
ttgagcccattcagctgactctttctacgcccctga

SEQ ID NO: 164569 - DNA, 38 bp, Artificial Sequence
  Synthetic oligonucleotide
acacacagccctcctgacgccctactgatccatcgtga

SEQ ID NO: 164570 - DNA, 38 bp, Artificial Sequence
  Synthetic oligonucleotide
aatggcggggaattggggaggggcacaccgggacttga

SEQ ID NO: 164571 - DNA, 38 bp, Artificial Sequence
  Synthetic oligonucleotide
ttgtatcagatggtgcccttgtccgtgccctctcttga

SEQ ID NO: 164572 - DNA, 37 bp, Artificial Sequence
  Synthetic oligonucleotide
ggaggtggtggggtggacttatgtcggtacctgttga

SEQ ID NO: 164573 - DNA, 36 bp, Artificial Sequence
  Synthetic oligonucleotide
agcaaccggaaattcgatcctgccttgtcctgccta

SEQ ID NO: 164574 - DNA, 34 bp, Artificial Sequence
  Synthetic oligonucleotide
ttcgacgtccccggtagcgattgtcccctgtcta

SEQ ID NO: 164575 - DNA, 35 bp, Artificial Sequence
  Synthetic oligonucleotide
acctgcgcctacggtccatacttacgactccacac

SEQ ID NO: 164576 - DNA, 35 bp, Artificial Sequence
  Synthetic oligonucleotide
gaccaccacattcttcgttggacgatctcctccac

SEQ ID NO: 164577 - DNA, 35 bp, Artificial Sequence
  Synthetic oligonucleotide
tatgcgcaatctatcaacggatttgtgccttttac

SEQ ID NO: 164578 - DNA, 35 bp, Artificial Sequence
  Synthetic oligonucleotide
tctctagcccccgctgttctccctgctgcccgacc

SEQ ID NO: 164579 - DNA, 35 bp, Artificial Sequence
  Synthetic oligonucleotide
cacgcacctgcctgcccttatactgattccgaccc

SEQ ID NO: 164580 - DNA, 35 bp, Artificial Sequence
  Synthetic oligonucleotide
gccattggctcagggtacattcgttactgctcccc

SEQ ID NO: 164581 - DNA, 35 bp, Artificial Sequence
  Synthetic oligonucleotide
acaacaatcgcctccacatttatatttaggttccc

SEQ ID NO: 164582 - DNA, 35 bp, Artificial Sequence
  Synthetic oligonucleotide
aactcatcagtggcataattcgttccatctttgcc

SEQ ID NO: 164583 - DNA, 35 bp, Artificial Sequence
  Synthetic oligonucleotide
acagctgccccccgtcgttaacgcccctcgattcc

SEQ ID NO: 164584 - DNA, 35 bp, Artificial Sequence
  Synthetic oligonucleotide
atcgtcgcattgtactttctcttacgctgtcttcc

SEQ ID NO: 164585 - DNA, 35 bp, Artificial Sequence
  Synthetic oligonucleotide
tccccgcgatgggtgaacatccacgctatttttcc

SEQ ID NO: 164586 - DNA, 35 bp, Artificial Sequence
  Synthetic oligonucleotide
atcctccatccggcccctatgacacgccgaaccgc

SEQ ID NO: 164587 - DNA, 32 bp, Artificial Sequence
  Synthetic oligonucleotide
gttgatctcgacccacccgctctgcgagccgc

SEQ ID NO: 164588 - DNA, 35 bp, Artificial Sequence
  Synthetic oligonucleotide
gtaccagatcgcactgcaacatacctctgctccgc

SEQ ID NO: 164589 - DNA, 35 bp, Artificial Sequence
  Synthetic oligonucleotide
tcgagggcctgggagggtgggatatgcgatggtgc

SEQ ID NO: 164590 - DNA, 34 bp, Artificial Sequence
  Synthetic oligonucleotide
gaaactgcgcccctcgtgcaatttccctgtaatc

SEQ ID NO: 164591 - DNA, 35 bp, Artificial Sequence
  Synthetic oligonucleotide
tcaccgcggcatagtttggttatcgcccccccctc

SEQ ID NO: 164592 - DNA, 35 bp, Artificial Sequence
  Synthetic oligonucleotide
tgtctgccccgtccagcattcgattcccttttctc

SEQ ID NO: 164593 - DNA, 35 bp, Artificial Sequence
  Synthetic oligonucleotide
agaccaccaaccggctgaccttaagtccacttgtc

SEQ ID NO: 164594 - DNA, 34 bp, Artificial Sequence
  Synthetic oligonucleotide
tccgcaccttctgccccctcgccgaactgagttc

SEQ ID NO: 164595 - DNA, 35 bp, Artificial Sequence
  Synthetic oligonucleotide
tcgcactacgccatactccactccctcttcctacg

SEQ ID NO: 164596 - DNA, 35 bp, Artificial Sequence
  Synthetic oligonucleotide
atgtgagtaacgtcaccacccgtgccccctccgcg

SEQ ID NO: 164597 - DNA, 35 bp, Artificial Sequence
  Synthetic oligonucleotide
ccacgacctcgccgctttcccttgtcgctttctcg

SEQ ID NO: 164598 - DNA, 35 bp, Artificial Sequence
  Synthetic oligonucleotide
aacgacaagacggggtaagataggggaggcgagtg

SEQ ID NO: 164599 - DNA, 35 bp, Artificial Sequence
  Synthetic oligonucleotide
agcgcgttgcctgtgcccgtttctcacaaatattg

SEQ ID NO: 164600 - DNA, 35 bp, Artificial Sequence
  Synthetic oligonucleotide
gagctgtctccaccgccgccgttctctcgcctttg

SEQ ID NO: 164601 - DNA, 35 bp, Artificial Sequence
  Synthetic oligonucleotide
ttgcaccatccttccgaagcatcatgtttcttcat

SEQ ID NO: 164602 - DNA, 35 bp, Artificial Sequence
  Synthetic oligonucleotide
gaacgagcagcgcttccatgtctcttcacctctat

SEQ ID NO: 164603 - DNA, 35 bp, Artificial Sequence
  Synthetic oligonucleotide
gtgccggacctcgatccttcgcaccgttccccact

SEQ ID NO: 164604 - DNA, 35 bp, Artificial Sequence
  Synthetic oligonucleotide
accccatcggccggacctctgcatggcaacctact

SEQ ID NO: 164605 - DNA, 35 bp, Artificial Sequence
  Synthetic oligonucleotide
gtgatcactcatactatcttatgtcgacgacccct

SEQ ID NO: 164606 - DNA, 35 bp, Artificial Sequence
  Synthetic oligonucleotide
gcgcgatcctgcaacatcctccctcgctctggcct

SEQ ID NO: 164607 - DNA, 35 bp, Artificial Sequence
  Synthetic oligonucleotide
gaccacgctcccgcctttcaccaggttactgggct

SEQ ID NO: 164608 - DNA, 35 bp, Artificial Sequence
  Synthetic oligonucleotide
tcactcctcgcagtaggttccatacgcgtgcctct

SEQ ID NO: 164609 - DNA, 35 bp, Artificial Sequence
  Synthetic oligonucleotide
actaccacatgtgccgatatttgcgctcgacttct

SEQ ID NO: 164610 - DNA, 35 bp, Artificial Sequence
  Synthetic oligonucleotide
gactaccgtctctctgtctttgcacctttccgagt

SEQ ID NO: 164611 - DNA, 35 bp, Artificial Sequence
  Synthetic oligonucleotide
acctcgccgaccccccccatgtgcgttgccgatgt

SEQ ID NO: 164612 - DNA, 35 bp, Artificial Sequence
  Synthetic oligonucleotide
tgactgttcgctgtttggccattcgaaccaccctt

SEQ ID NO: 164613 - DNA, 35 bp, Artificial Sequence
  Synthetic oligonucleotide
tacatctcctccgctcgagccacaagtacctgttt

SEQ ID NO: 164614 - DNA, 36 bp, Artificial Sequence
  Synthetic oligonucleotide
gtggtagggaggactggcgggggtgacagtgtaaaa

SEQ ID NO: 164615 - DNA, 35 bp, Artificial Sequence
  Synthetic oligonucleotide
tcaccacctgattctgatcacctcatgcttgccaa

SEQ ID NO: 164616 - DNA, 35 bp, Artificial Sequence
  Synthetic oligonucleotide
tgttgcgtgggttgtaatgggagggaggggatcaa

SEQ ID NO: 164617 - DNA, 35 bp, Artificial Sequence
  Synthetic oligonucleotide
tgcccttctcccctggtatctggtcttggtacgaa

SEQ ID NO: 164618 - DNA, 36 bp, Artificial Sequence
  Synthetic oligonucleotide
acgaggcgggagggtggatgggcgggataatcctaa

SEQ ID NO: 164619 - DNA, 35 bp, Artificial Sequence
  Synthetic oligonucleotide
gcccactgcccgctacctgtaagctacccgcccca

SEQ ID NO: 164620 - DNA, 36 bp, Artificial Sequence
  Synthetic oligonucleotide
gagcgccggtcgtgaccctgtttactccccgcccca

SEQ ID NO: 164621 - DNA, 35 bp, Artificial Sequence
  Synthetic oligonucleotide
ttaccacccaactgccgtaattattcactgtccca

SEQ ID NO: 164622 - DNA, 35 bp, Artificial Sequence
  Synthetic oligonucleotide
tcaaggtgccaccttgacgcttacatcccctcgca

SEQ ID NO: 164623 - DNA, 36 bp, Artificial Sequence
  Synthetic oligonucleotide
tgttaacccctcagtcgatttgcccttctccgtgca

SEQ ID NO: 164624 - DNA, 36 bp, Artificial Sequence
  Synthetic oligonucleotide
gctgactccacacgcaccctccctgtcttccgtgca

SEQ ID NO: 164625 - DNA, 35 bp, Artificial Sequence
  Synthetic oligonucleotide
taagatagccgcccgcctctgcctctgacgttgca

SEQ ID NO: 164626 - DNA, 35 bp, Artificial Sequence
  Synthetic oligonucleotide
ggttcgcacccgtctccgctccacctatggggtca

SEQ ID NO: 164627 - DNA, 37 bp, Artificial Sequence
  Synthetic oligonucleotide
gttctcagccggtattagctctcctcctgttctcaga

SEQ ID NO: 164628 - DNA, 37 bp, Artificial Sequence
  Synthetic oligonucleotide
aaacgcatcgccgccccttagccgtccgtccccacga

SEQ ID NO: 164629 - DNA, 35 bp, Artificial Sequence
  Synthetic oligonucleotide
gccgacgccctatcctagcccaccctttgccacga

SEQ ID NO: 164630 - DNA, 37 bp, Artificial Sequence
  Synthetic oligonucleotide
atgctcgggtgggcgtattgggcagggaaccggacga

SEQ ID NO: 164631 - DNA, 36 bp, Artificial Sequence
  Synthetic oligonucleotide
acaccgccgacgccacaacgattcttacctccgcga

SEQ ID NO: 164632 - DNA, 37 bp, Artificial Sequence
  Synthetic oligonucleotide
gcaccacctcagtcccgccgccgccgactcctcgcga

SEQ ID NO: 164633 - DNA, 37 bp, Artificial Sequence
  Synthetic oligonucleotide
gaggagggacgcagcaataattgggggtaggaaggga

SEQ ID NO: 164634 - DNA, 37 bp, Artificial Sequence
  Synthetic oligonucleotide
tgaagaggacgggggcgggtgcgggcacgtggaggga

SEQ ID NO: 164635 - DNA, 37 bp, Artificial Sequence
  Synthetic oligonucleotide
gctaaggggtgggtagatgtatggggactttagggga

SEQ ID NO: 164636 - DNA, 37 bp, Artificial Sequence
  Synthetic oligonucleotide
aaatgcgggtgggtggtaactaatgtacgggatggga

SEQ ID NO: 164637 - DNA, 35 bp, Artificial Sequence
  Synthetic oligonucleotide
gcccacctgctatattatcacacatactcctggga

SEQ ID NO: 164638 - DNA, 38 bp, Artificial Sequence
  Synthetic oligonucleotide
ttcgcaacgaaccttcctgctttgcgccatatccatga

SEQ ID NO: 164639 - DNA, 35 bp, Artificial Sequence
  Synthetic oligonucleotide
atgctactccccgctccattttacgtgtcccctga

SEQ ID NO: 164640 - DNA, 38 bp, Artificial Sequence
  Synthetic oligonucleotide
aacctccccacccccccagctgtgactgccatccctga

SEQ ID NO: 164641 - DNA, 38 bp, Artificial Sequence
  Synthetic oligonucleotide
gaccgactcgagcaaagggagggcaagggggggcgtga

SEQ ID NO: 164642 - DNA, 38 bp, Artificial Sequence
  Synthetic oligonucleotide
atggagggccacgataaatgggagggagggtgcggtga

SEQ ID NO: 164643 - DNA, 36 bp, Artificial Sequence
  Synthetic oligonucleotide
gatgtagccggggggtgtggcggcgaacgggggtga

SEQ ID NO: 164644 - DNA, 38 bp, Artificial Sequence
  Synthetic oligonucleotide
gttgctcgtcctgccgttcccattgagctcccctgtga

SEQ ID NO: 164645 - DNA, 38 bp, Artificial Sequence
  Synthetic oligonucleotide
atcacgtgagatacgatgcccgccccctctctgcttga

SEQ ID NO: 164646 - DNA, 35 bp, Artificial Sequence
  Synthetic oligonucleotide
tcacgagcctcgtgaccctccgagccattcctata

SEQ ID NO: 164647 - DNA, 34 bp, Artificial Sequence
  Synthetic oligonucleotide
gagatccaacccgcacctcgcctttacggacgta

SEQ ID NO: 164648 - DNA, 36 bp, Artificial Sequence
  Synthetic oligonucleotide
caacgtagttgctcaccttctgtccactttctcgta

SEQ ID NO: 164649 - DNA, 36 bp, Artificial Sequence
  Synthetic oligonucleotide
atcatcccgctccaccgtcccattatataccaggta

SEQ ID NO: 164650 - DNA, 36 bp, Artificial Sequence
  Synthetic oligonucleotide
ggaaggagggggggcgtaaataaagcgtggccggta

SEQ ID NO: 164651 - DNA, 36 bp, Artificial Sequence
  Synthetic oligonucleotide
gcaaccgccgtgctctgtcttctatttttcacctta

SEQ ID NO: 164652 - DNA, 36 bp, Artificial Sequence
  Synthetic oligonucleotide
agacctcccgtccgcccgtatctatctgttggctta

SEQ ID NO: 164653 - DNA, 34 bp, Artificial Sequence
  Synthetic oligonucleotide
tggaccgtccgtcccgcacgccacgtttttctta

SEQ ID NO: 164654 - DNA, 35 bp, Artificial Sequence
  Synthetic oligonucleotide
tgttcccctgtgcctttcgccgcccgtacaggtta

SEQ ID NO: 164655 - DNA, 35 bp, Artificial Sequence
  Synthetic oligonucleotide
acataccgccttggttttttcgtacgcttccttta

SEQ ID NO: 164656 - DNA, 35 bp, Artificial Sequence
  Synthetic oligonucleotide
ttagccgttcaacgtcccgccctgacgatttccac

SEQ ID NO: 164657 - DNA, 35 bp, Artificial Sequence
  Synthetic oligonucleotide
gccgatctgtctcatgagccctttgccatcctcac

SEQ ID NO: 164658 - DNA, 35 bp, Artificial Sequence
  Synthetic oligonucleotide
gtacgttcgctacatgtctcccacaatctgttcac

SEQ ID NO: 164659 - DNA, 35 bp, Artificial Sequence
  Synthetic oligonucleotide
gatactccatctgcttacaccccgactcgtgttac

SEQ ID NO: 164660 - DNA, 35 bp, Artificial Sequence
  Synthetic oligonucleotide
tagaccacggatggccactctccgcgtatcccacc

SEQ ID NO: 164661 - DNA, 35 bp, Artificial Sequence
  Synthetic oligonucleotide
ttacggcccctccctgtctcgaagttggcattacc

SEQ ID NO: 164662 - DNA, 34 bp, Artificial Sequence
  Synthetic oligonucleotide
gagcaggcctcctgacgacgcccagccccccccc

SEQ ID NO: 164663 - DNA, 35 bp, Artificial Sequence
  Synthetic oligonucleotide
ttgaccgtcacgcctccatcgataacgaccctccc

SEQ ID NO: 164664 - DNA, 35 bp, Artificial Sequence
  Synthetic oligonucleotide
acatccacgtcccactcactatggctccatgtccc

SEQ ID NO: 164665 - DNA, 35 bp, Artificial Sequence
  Synthetic oligonucleotide
ttcaccctcgcatgatgcctccagcccgtaccgcc

SEQ ID NO: 164666 - DNA, 35 bp, Artificial Sequence
  Synthetic oligonucleotide
gtgatccgaacctcatagtttattgccccaactcc

SEQ ID NO: 164667 - DNA, 36 bp, Artificial Sequence
  Synthetic oligonucleotide
ggactgccccagaggttgtctcgttgctctcactcc

SEQ ID NO: 164668 - DNA, 35 bp, Artificial Sequence
  Synthetic oligonucleotide
tcacgtcatatccggatcacgtactccctcgctcc

SEQ ID NO: 164669 - DNA, 35 bp, Artificial Sequence
  Synthetic oligonucleotide
tccaccgctcggcctggacataccgtacttcgtcc

SEQ ID NO: 164670 - DNA, 35 bp, Artificial Sequence
  Synthetic oligonucleotide
aattgccctccccagtgagattcgtctccacttcc

SEQ ID NO: 164671 - DNA, 35 bp, Artificial Sequence
  Synthetic oligonucleotide
atgaagcataaccgccgtgttactgtaccccccgc

SEQ ID NO: 164672 - DNA, 35 bp, Artificial Sequence
  Synthetic oligonucleotide
tctctttgcaccggcccatctcagacccccgccgc

SEQ ID NO: 164673 - DNA, 35 bp, Artificial Sequence
  Synthetic oligonucleotide
agctcacaacatccatcgcgctccccttcagtcgc

SEQ ID NO: 164674 - DNA, 35 bp, Artificial Sequence
  Synthetic oligonucleotide
accgcatgcttacgtcaaccacttgttccgcctgc

SEQ ID NO: 164675 - DNA, 35 bp, Artificial Sequence
  Synthetic oligonucleotide
ttccccaccggaggctgttccatcgactcttctgc

SEQ ID NO: 164676 - DNA, 36 bp, Artificial Sequence
  Synthetic oligonucleotide
accgtcgcccttcgtaccagaccttctatgcccatc

SEQ ID NO: 164677 - DNA, 35 bp, Artificial Sequence
  Synthetic oligonucleotide
atgcctccgcccacaccgttttatctgccttcctc

SEQ ID NO: 164678 - DNA, 35 bp, Artificial Sequence
  Synthetic oligonucleotide
gcgaagtgcgcgacgccgatttcccttagcctttc

SEQ ID NO: 164679 - DNA, 35 bp, Artificial Sequence
  Synthetic oligonucleotide
tccgactccgacccctgtgcttgcatgtttaccag

SEQ ID NO: 164680 - DNA, 35 bp, Artificial Sequence
  Synthetic oligonucleotide
atgcactcctcccttctccgcgtggtactcacgcg

SEQ ID NO: 164681 - DNA, 35 bp, Artificial Sequence
  Synthetic oligonucleotide
tgccctccgcgtggccgccgactactcaccccgcg

SEQ ID NO: 164682 - DNA, 35 bp, Artificial Sequence
  Synthetic oligonucleotide
actccggccccaggttctgttcactccgttttgcg

SEQ ID NO: 164683 - DNA, 35 bp, Artificial Sequence
  Synthetic oligonucleotide
gtccacgatgcatgttgtcccctgggctttcctcg

SEQ ID NO: 164684 - DNA, 35 bp, Artificial Sequence
  Synthetic oligonucleotide
tgtgttacgctcgacatccctcccgccctggctcg

SEQ ID NO: 164685 - DNA, 35 bp, Artificial Sequence
  Synthetic oligonucleotide
tgccacgcctcgtactttttcacccaatccgcagg

SEQ ID NO: 164686 - DNA, 35 bp, Artificial Sequence
  Synthetic oligonucleotide
atagccaggaatgggaaggcggatggggagatagg

SEQ ID NO: 164687 - DNA, 35 bp, Artificial Sequence
  Synthetic oligonucleotide
gactgggaggatcgagtgtgaacaacgtgggcggg

SEQ ID NO: 164688 - DNA, 35 bp, Artificial Sequence
  Synthetic oligonucleotide
gtggttaagggggggaatgggagatgcacggtggg

SEQ ID NO: 164689 - DNA, 34 bp, Artificial Sequence
  Synthetic oligonucleotide
tccaccacgcctcttgtcaattatactctaatgg

SEQ ID NO: 164690 - DNA, 35 bp, Artificial Sequence
  Synthetic oligonucleotide
acgccccacgtaaatgtcttctccgaccctacctg

SEQ ID NO: 164691 - DNA, 35 bp, Artificial Sequence
  Synthetic oligonucleotide
ttggggggatgggaagcgggaagggtcgcgccctg

SEQ ID NO: 164692 - DNA, 35 bp, Artificial Sequence
  Synthetic oligonucleotide
ttgcatcgagtccatcaaccccccctcgcctcctg

SEQ ID NO: 164693 - DNA, 35 bp, Artificial Sequence
  Synthetic oligonucleotide
aacgacgagtaggtggtatcggggggggtagtgtg

SEQ ID NO: 164694 - DNA, 35 bp, Artificial Sequence
  Synthetic oligonucleotide
tgaggagaagaggctaagggagggagcgacgtgtg

SEQ ID NO: 164695 - DNA, 35 bp, Artificial Sequence
  Synthetic oligonucleotide
gtacaaccgtggtcttctctcgcctcacctacttg

SEQ ID NO: 164696 - DNA, 35 bp, Artificial Sequence
  Synthetic oligonucleotide
aaacaccacctaacatgttcgccgttccgctcttg

SEQ ID NO: 164697 - DNA, 35 bp, Artificial Sequence
  Synthetic oligonucleotide
acacaccacctgacatgttcgccgttccgctcttg

SEQ ID NO: 164698 - DNA, 35 bp, Artificial Sequence
  Synthetic oligonucleotide
tgaccacaatcatcctccgcatactcctcctgaat

SEQ ID NO: 164699 - DNA, 35 bp, Artificial Sequence
  Synthetic oligonucleotide
ggggtgaacgggtgaagagagcgtgagcaggccat

SEQ ID NO: 164700 - DNA, 35 bp, Artificial Sequence
  Synthetic oligonucleotide
tggggccacataggtcggaacggaggaggggggat

SEQ ID NO: 164701 - DNA, 35 bp, Artificial Sequence
  Synthetic oligonucleotide
accgtcccgcctttcctcgactgctcatgtcccct

SEQ ID NO: 164702 - DNA, 35 bp, Artificial Sequence
  Synthetic oligonucleotide
acatgacacccgacgccctgccgcacaatacgcct

SEQ ID NO: 164703 - DNA, 35 bp, Artificial Sequence
  Synthetic oligonucleotide
gggtactgcccctgttgcttcgtttcgcccctcct

SEQ ID NO: 164704 - DNA, 36 bp, Artificial Sequence
  Synthetic oligonucleotide
tctcccaccgtatatgcatcgagcccgtcccttgct

SEQ ID NO: 164705 - DNA, 35 bp, Artificial Sequence
  Synthetic oligonucleotide
accgaatcgcctattgtgacctacgcccttcttct

SEQ ID NO: 164706 - DNA, 35 bp, Artificial Sequence
  Synthetic oligonucleotide
atccagacgttaagttctaccctccccgcttttgt

SEQ ID NO: 164707 - DNA, 35 bp, Artificial Sequence
  Synthetic oligonucleotide
gcactgacgctcgcgaacacctggtcatccacctt

SEQ ID NO: 164708 - DNA, 29 bp, Artificial Sequence
  Synthetic oligonucleotide
tagtcgtggaccccccccagtcctgcctt

SEQ ID NO: 164709 - DNA, 35 bp, Artificial Sequence
  Synthetic oligonucleotide
gcaacgtgcgcatcgtttatttttctcgttctgtt

SEQ ID NO: 164710 - DNA, 35 bp, Artificial Sequence
  Synthetic oligonucleotide
gacgtagccaggtacccgacccttctctgtgcttt

SEQ ID NO: 164711 - DNA, 36 bp, Artificial Sequence
  Synthetic oligonucleotide
accctgcccactgtctacctgcatcttcaatccaaa

SEQ ID NO: 164712 - DNA, 36 bp, Artificial Sequence
  Synthetic oligonucleotide
gttcaccccgcaaaagggctatccatccattcacaa

SEQ ID NO: 164713 - DNA, 35 bp, Artificial Sequence
  Synthetic oligonucleotide
tcactgcgccgatcccgcaccgtagtttccatcaa

SEQ ID NO: 164714 - DNA, 35 bp, Artificial Sequence
  Synthetic oligonucleotide
tgctgccccccggccccccctcatgctgaggtgaa

SEQ ID NO: 164715 - DNA, 36 bp, Artificial Sequence
  Synthetic oligonucleotide
accactccgccagatatacataacctcccgtcctaa

SEQ ID NO: 164716 - DNA, 36 bp, Artificial Sequence
  Synthetic oligonucleotide
gacatccctgctcctcctctacaaccgtacagcaca

SEQ ID NO: 164717 - DNA, 36 bp, Artificial Sequence
  Synthetic oligonucleotide
gcgggaaaaggggggggtcatagaggaggtgggaca

SEQ ID NO: 164718 - DNA, 36 bp, Artificial Sequence
  Synthetic oligonucleotide
aatgccggtctgttgtaccaccgtcgaactccacca

SEQ ID NO: 164719 - DNA, 35 bp, Artificial Sequence
  Synthetic oligonucleotide
ttgagaaccgccccatatccatcccgcgaggccca

SEQ ID NO: 164720 - DNA, 36 bp, Artificial Sequence
  Synthetic oligonucleotide
accccaatccgctaccagttcccgttaatagctcca

SEQ ID NO: 164721 - DNA, 35 bp, Artificial Sequence
  Synthetic oligonucleotide
gtgcacctctccgcgccttaccgttggtcgccgca

SEQ ID NO: 164722 - DNA, 36 bp, Artificial Sequence
  Synthetic oligonucleotide
tctgccaaaggagggggggaggaagtaggctaggca

SEQ ID NO: 164723 - DNA, 36 bp, Artificial Sequence
  Synthetic oligonucleotide
tacaaatggggtaggggcacggtgggggacatggca

SEQ ID NO: 164724 - DNA, 35 bp, Artificial Sequence
  Synthetic oligonucleotide
tgcttccgccacacatcactctctgccacctggca

SEQ ID NO: 164725 - DNA, 36 bp, Artificial Sequence
  Synthetic oligonucleotide
actctggctccacctccgcccttttagccgctatca

SEQ ID NO: 164726 - DNA, 37 bp, Artificial Sequence
  Synthetic oligonucleotide
gtccgactgcctgctatgatccacctcacccccaaga

SEQ ID NO: 164727 - DNA, 37 bp, Artificial Sequence
  Synthetic oligonucleotide
tgaacatgggagggtgggagggggaacgatcgaacga

SEQ ID NO: 164728 - DNA, 37 bp, Artificial Sequence
  Synthetic oligonucleotide
gggggaaaggaagggagttatgtagggtgggttacga

SEQ ID NO: 164729 - DNA, 37 bp, Artificial Sequence
  Synthetic oligonucleotide
aaagccacccgctgctcccgtttcttagttttaccga

SEQ ID NO: 164730 - DNA, 37 bp, Artificial Sequence
  Synthetic oligonucleotide
gcctacgcgagatctagttccttttccaccctcccga

SEQ ID NO: 164731 - DNA, 37 bp, Artificial Sequence
  Synthetic oligonucleotide
tgtgtaggggtgggcgagggaggggtgctcttccgga

SEQ ID NO: 164732 - DNA, 37 bp, Artificial Sequence
  Synthetic oligonucleotide
gctcaccaccatcgtattaccttctcgttgcccggga

SEQ ID NO: 164733 - DNA, 37 bp, Artificial Sequence
  Synthetic oligonucleotide
acgaacccccccacacctgatgccaacccggccatga

SEQ ID NO: 164734 - DNA, 38 bp, Artificial Sequence
  Synthetic oligonucleotide
tcaggatcatcgtttggggggggaagggaagggtatga

SEQ ID NO: 164735 - DNA, 37 bp, Artificial Sequence
  Synthetic oligonucleotide
gatctacccccatgactcgtttgagccttttcactga

SEQ ID NO: 164736 - DNA, 38 bp, Artificial Sequence
  Synthetic oligonucleotide
tcgtacccacgtcctcactatggctccccgctccctga

SEQ ID NO: 164737 - DNA, 36 bp, Artificial Sequence
  Synthetic oligonucleotide
tgcgccctctcaatccgctcccttccacgtccctga

SEQ ID NO: 164738 - DNA, 38 bp, Artificial Sequence
  Synthetic oligonucleotide
ccaactcagattgcgcacactcacctccccctgcctga

SEQ ID NO: 164739 - DNA, 36 bp, Artificial Sequence
  Synthetic oligonucleotide
tcacccaccgatgaccctccgtccagctccacttga

SEQ ID NO: 164740 - DNA, 38 bp, Artificial Sequence
  Synthetic oligonucleotide
ttgcccaaccccctcatgctataggtttctcgccttga

SEQ ID NO: 164741 - DNA, 38 bp, Artificial Sequence
  Synthetic oligonucleotide
tcgactgcccaataccgcgaacctgtacccccgcttga

SEQ ID NO: 164742 - DNA, 38 bp, Artificial Sequence
  Synthetic oligonucleotide
gaacctcccgctgcctgtccctccagtttcgttcttga

SEQ ID NO: 164743 - DNA, 38 bp, Artificial Sequence
  Synthetic oligonucleotide
atgcccgccaacggcccatgagccaccatctactttga

SEQ ID NO: 164744 - DNA, 37 bp, Artificial Sequence
  Synthetic oligonucleotide
tcctatgcaccccacttgcaattttcctgtcctttga

SEQ ID NO: 164745 - DNA, 35 bp, Artificial Sequence
  Synthetic oligonucleotide
atctcgcctacccccagctgactttccctctttga

SEQ ID NO: 164746 - DNA, 36 bp, Artificial Sequence
  Synthetic oligonucleotide
tgcaccccgccatttacctgatccgcctgacccata

SEQ ID NO: 164747 - DNA, 36 bp, Artificial Sequence
  Synthetic oligonucleotide
gagtgcgcacgcgttcataccccccgttcccttata

SEQ ID NO: 164748 - DNA, 36 bp, Artificial Sequence
  Synthetic oligonucleotide
aaccatgcaccatcgcctgtcgttaaatccccagta

SEQ ID NO: 164749 - DNA, 35 bp, Artificial Sequence
  Synthetic oligonucleotide
ctacctgccgcccgtccgctccctcgaacatgaac

SEQ ID NO: 164750 - DNA, 35 bp, Artificial Sequence
  Synthetic oligonucleotide
tgggactccgccgccgcattgccatcttgtaccac

SEQ ID NO: 164751 - DNA, 35 bp, Artificial Sequence
  Synthetic oligonucleotide
ggtatcacacgtctatccctgctgccgcctgccac

SEQ ID NO: 164752 - DNA, 35 bp, Artificial Sequence
  Synthetic oligonucleotide
gtaggtgctcaccccccgctatgactcgctgccac

SEQ ID NO: 164753 - DNA, 35 bp, Artificial Sequence
  Synthetic oligonucleotide
agcccgccgagcttactatggcgtctgcctacacc

SEQ ID NO: 164754 - DNA, 35 bp, Artificial Sequence
  Synthetic oligonucleotide
ttgcccctgctcctaaccttatagtacggcatacc

SEQ ID NO: 164755 - DNA, 35 bp, Artificial Sequence
  Synthetic oligonucleotide
gcgcgtgccaccgtttactcctcgtcacagtaccc

SEQ ID NO: 164756 - DNA, 35 bp, Artificial Sequence
  Synthetic oligonucleotide
gcatgcactaggaggcctgcttgcccttaaccccc

SEQ ID NO: 164757 - DNA, 34 bp, Artificial Sequence
  Synthetic oligonucleotide
taacagacgcaagtagttttgctccaatgccccc

SEQ ID NO: 164758 - DNA, 35 bp, Artificial Sequence
  Synthetic oligonucleotide
gctctccgaacaacgtactatcacaacgctacgcc

SEQ ID NO: 164759 - DNA, 35 bp, Artificial Sequence
  Synthetic oligonucleotide
ttcatgaccgtcagatctatcttgcttcgtggtcc

SEQ ID NO: 164760 - DNA, 35 bp, Artificial Sequence
  Synthetic oligonucleotide
tcacaatggctatccgtgcacaatacaccttgtcc

SEQ ID NO: 164761 - DNA, 35 bp, Artificial Sequence
  Synthetic oligonucleotide
gattcaagccacacatctaagctccaccgccccgc

SEQ ID NO: 164762 - DNA, 35 bp, Artificial Sequence
  Synthetic oligonucleotide
ggatgactttagtcgtgcccgttcctccttcctgc

SEQ ID NO: 164763 - DNA, 35 bp, Artificial Sequence
  Synthetic oligonucleotide
aggacagcccccagttcctagccgtcttctccatc

SEQ ID NO: 164764 - DNA, 35 bp, Artificial Sequence
  Synthetic oligonucleotide
tcagtccctcccaacttgtgctcttttagcgtatc

SEQ ID NO: 164765 - DNA, 35 bp, Artificial Sequence
  Synthetic oligonucleotide
tgcatcccatccactagttcttgatctcgccactc

SEQ ID NO: 164766 - DNA, 35 bp, Artificial Sequence
  Synthetic oligonucleotide
gccactcgtgagatccagctacccccttgcccctc

SEQ ID NO: 164767 - DNA, 35 bp, Artificial Sequence
  Synthetic oligonucleotide
ttgtggatcgattgatcggccgattcccttccctc

SEQ ID NO: 164768 - DNA, 35 bp, Artificial Sequence
  Synthetic oligonucleotide
ttctggcccctatcgagttccttttaagccgcctc

SEQ ID NO: 164769 - DNA, 35 bp, Artificial Sequence
  Synthetic oligonucleotide
gttgccaaccggtccgaatctgacttctccagctc

SEQ ID NO: 164770 - DNA, 35 bp, Artificial Sequence
  Synthetic oligonucleotide
gactcatccaatgcacactcatcccatgcgctctc

SEQ ID NO: 164771 - DNA, 35 bp, Artificial Sequence
  Synthetic oligonucleotide
acccaactgcatgggatcgttacctctcctccttc

SEQ ID NO: 164772 - DNA, 35 bp, Artificial Sequence
  Synthetic oligonucleotide
tgtcaagtaccggcttagatctttccgtctcgttc

SEQ ID NO: 164773 - DNA, 35 bp, Artificial Sequence
  Synthetic oligonucleotide
atggtaagccacgcgcctcttccgacccttgtttc

SEQ ID NO: 164774 - DNA, 35 bp, Artificial Sequence
  Synthetic oligonucleotide
aacttccgcctcgtgacccgactactcttctttag

SEQ ID NO: 164775 - DNA, 35 bp, Artificial Sequence
  Synthetic oligonucleotide
gttacacgatatacccaacgccgcccccgtgaccg

SEQ ID NO: 164776 - DNA, 35 bp, Artificial Sequence
  Synthetic oligonucleotide
actccaccctctattgatgagcttataatctcgcg

SEQ ID NO: 164777 - DNA, 35 bp, Artificial Sequence
  Synthetic oligonucleotide
acaatggagggaggtggtgggagctggcgctgcgg

SEQ ID NO: 164778 - DNA, 35 bp, Artificial Sequence
  Synthetic oligonucleotide
gctagagtggttatatatgggaggggggggaaggg

SEQ ID NO: 164779 - DNA, 35 bp, Artificial Sequence
  Synthetic oligonucleotide
gattaaggaggaggggtatgatggggttgtgaggg

SEQ ID NO: 164780 - DNA, 35 bp, Artificial Sequence
  Synthetic oligonucleotide
gagtgatcgtcgctctgttaccacctcttctcctg

SEQ ID NO: 164781 - DNA, 35 bp, Artificial Sequence
  Synthetic oligonucleotide
ttcggagggggtgggccgcgaatgagaagggagtg

SEQ ID NO: 164782 - DNA, 35 bp, Artificial Sequence
  Synthetic oligonucleotide
tcctcccccaatggtctccgcctgtgctcgtattg

SEQ ID NO: 164783 - DNA, 34 bp, Artificial Sequence
  Synthetic oligonucleotide
tcaccaaccgccactgcgccccgcatctgacttg

SEQ ID NO: 164784 - DNA, 35 bp, Artificial Sequence
  Synthetic oligonucleotide
tgagtgggcgtctactctgccctgtcacttccttg

SEQ ID NO: 164785 - DNA, 35 bp, Artificial Sequence
  Synthetic oligonucleotide
atccttggggtaggggtgtggttggttggggcttg

SEQ ID NO: 164786 - DNA, 35 bp, Artificial Sequence
  Synthetic oligonucleotide
gtctccgccgtctctccgcacacagttctagtcgt

SEQ ID NO: 164787 - DNA, 35 bp, Artificial Sequence
  Synthetic oligonucleotide
tgtactcgccatctcaatccgccctcttcgtcggt

SEQ ID NO: 164788 - DNA, 35 bp, Artificial Sequence
  Synthetic oligonucleotide
tcacgtccactcacgccctcgcccctcaaccgggt

SEQ ID NO: 164789 - DNA, 35 bp, Artificial Sequence
  Synthetic oligonucleotide
gtttagcacgcccttttgctcgtccttcgtacatt

SEQ ID NO: 164790 - DNA, 35 bp, Artificial Sequence
  Synthetic oligonucleotide
acacccaccacagtttccagccaccgcaaaccatt

SEQ ID NO: 164791 - DNA, 35 bp, Artificial Sequence
  Synthetic oligonucleotide
ttccccgccgcagcccacgtccccttgctttcatt

SEQ ID NO: 164792 - DNA, 35 bp, Artificial Sequence
  Synthetic oligonucleotide
ttgtacctcccgcacacttcgaacagactattctt

SEQ ID NO: 164793 - DNA, 35 bp, Artificial Sequence
  Synthetic oligonucleotide
ttacacacttccgatcctgccatcgctctcccgtt

SEQ ID NO: 164794 - DNA, 34 bp, Artificial Sequence
  Synthetic oligonucleotide
acgcactacagcactcacctccgctgccccgttt

SEQ ID NO: 164795 - DNA, 36 bp, Artificial Sequence
  Synthetic oligonucleotide
gtcaagccgccggccgtcgcaatccaacgccaccaa

SEQ ID NO: 164796 - DNA, 35 bp, Artificial Sequence
  Synthetic oligonucleotide
tccagctgccccgcctcgtgtgcacccccggccaa

SEQ ID NO: 164797 - DNA, 36 bp, Artificial Sequence
  Synthetic oligonucleotide
gtcgctcccgtcccgcgttattccatgccatttcaa

SEQ ID NO: 164798 - DNA, 36 bp, Artificial Sequence
  Synthetic oligonucleotide
atggaaggagaggtgggggtgagggcggtttcagaa

SEQ ID NO: 164799 - DNA, 36 bp, Artificial Sequence
  Synthetic oligonucleotide
gcaacctgtgcctcaccttcctgtttcttgtccgaa

SEQ ID NO: 164800 - DNA, 36 bp, Artificial Sequence
  Synthetic oligonucleotide
agtgcattcacgggaagggacgggaagggctgataa

SEQ ID NO: 164801 - DNA, 35 bp, Artificial Sequence
  Synthetic oligonucleotide
gcccacggtgcagggtgcccttcctcccggcctaa

SEQ ID NO: 164802 - DNA, 35 bp, Artificial Sequence
  Synthetic oligonucleotide
agtctccctgcatactatcttgctcccagttctaa

SEQ ID NO: 164803 - DNA, 34 bp, Artificial Sequence
  Synthetic oligonucleotide
ggaacagggcggacgaagggggatggtacgttaa

SEQ ID NO: 164804 - DNA, 36 bp, Artificial Sequence
  Synthetic oligonucleotide
gtgaccctcaatcgttaatcgccctctatgtctaca

SEQ ID NO: 164805 - DNA, 35 bp, Artificial Sequence
  Synthetic oligonucleotide
caagccccttccatgctttggcccctcgccgccca

SEQ ID NO: 164806 - DNA, 36 bp, Artificial Sequence
  Synthetic oligonucleotide
gattccacaacaccctctgctcttcgctattgagca

SEQ ID NO: 164807 - DNA, 36 bp, Artificial Sequence
  Synthetic oligonucleotide
gagtggggagtaggaagtaggggctgggatagtgca

SEQ ID NO: 164808 - DNA, 35 bp, Artificial Sequence
  Synthetic oligonucleotide
atcacccatgcacccgtgcatctgacgctccatca

SEQ ID NO: 164809 - DNA, 36 bp, Artificial Sequence
  Synthetic oligonucleotide
aatccgggggaggggcaagggagcggacaagtatca

SEQ ID NO: 164810 - DNA, 36 bp, Artificial Sequence
  Synthetic oligonucleotide
agcacggccttcatgttgtttcccgtcacctactca

SEQ ID NO: 164811 - DNA, 36 bp, Artificial Sequence
  Synthetic oligonucleotide
tcctgacaagcggtcgacggtctcacgcctttctca

SEQ ID NO: 164812 - DNA, 37 bp, Artificial Sequence
  Synthetic oligonucleotide
tgctggtgcgcccagatggcttaccctgcccgcttca

SEQ ID NO: 164813 - DNA, 36 bp, Artificial Sequence
  Synthetic oligonucleotide
gatgaggcgctcatgtctagtcaactcctgtcttca

SEQ ID NO: 164814 - DNA, 37 bp, Artificial Sequence
  Synthetic oligonucleotide
agcaaagggaaggggcagggagggggaattacaaaga

SEQ ID NO: 164815 - DNA, 37 bp, Artificial Sequence
  Synthetic oligonucleotide
tgtaccatccgctatagtcccaagccgccatccaaga

SEQ ID NO: 164816 - DNA, 37 bp, Artificial Sequence
  Synthetic oligonucleotide
gtcgctgggcggggaaagtgggagtggaggacgcaga

SEQ ID NO: 164817 - DNA, 35 bp, Artificial Sequence
  Synthetic oligonucleotide
accgccccctcgatttccccctgcgaccattgaga

SEQ ID NO: 164818 - DNA, 37 bp, Artificial Sequence
  Synthetic oligonucleotide
gttacccacgtccttatgcttccgatcatccgcccga

SEQ ID NO: 164819 - DNA, 37 bp, Artificial Sequence
  Synthetic oligonucleotide
tacactcccccaatggctacctaaccctgtccgccga

SEQ ID NO: 164820 - DNA, 37 bp, Artificial Sequence
  Synthetic oligonucleotide
gtcgccgccccccgcatccacgtgtgcaaattgccga

SEQ ID NO: 164821 - DNA, 36 bp, Artificial Sequence
  Synthetic oligonucleotide
tttgagtcgacacgatttgcacaccctccccatcga

SEQ ID NO: 164822 - DNA, 37 bp, Artificial Sequence
  Synthetic oligonucleotide
tcccccgcgcctggcctactacctgtttcggtttcga

SEQ ID NO: 164823 - DNA, 37 bp, Artificial Sequence
  Synthetic oligonucleotide
gtcgcccactccgccgcgcaccaccgataattccgga

SEQ ID NO: 164824 - DNA, 37 bp, Artificial Sequence
  Synthetic oligonucleotide
gtgattggcgggggtaaggcggagggaagtggcggga

SEQ ID NO: 164825 - DNA, 36 bp, Artificial Sequence
  Synthetic oligonucleotide
gatcatttctagggtgggtagagtatagggagggga

SEQ ID NO: 164826 - DNA, 37 bp, Artificial Sequence
  Synthetic oligonucleotide
gaagggaagggggtggggtgggccgtcgactggggga

SEQ ID NO: 164827 - DNA, 36 bp, Artificial Sequence
  Synthetic oligonucleotide
taggccgggtgtgaggttgggggccgagggatggga

SEQ ID NO: 164828 - DNA, 37 bp, Artificial Sequence
  Synthetic oligonucleotide
gacaggcgaggggcaacgaagaaggggaggtttggga

SEQ ID NO: 164829 - DNA, 37 bp, Artificial Sequence
  Synthetic oligonucleotide
atgacatgggatggggaggggggaatgcgaaagtgga

SEQ ID NO: 164830 - DNA, 37 bp, Artificial Sequence
  Synthetic oligonucleotide
atccgcgcggctagcccccgccccccctgcccaatga

SEQ ID NO: 164831 - DNA, 37 bp, Artificial Sequence
  Synthetic oligonucleotide
tctgagcccgatctgtctcctttttccgcctgtatga

SEQ ID NO: 164832 - DNA, 37 bp, Artificial Sequence
  Synthetic oligonucleotide
atgacccctcaactgctgcaaccctcgtccaaactga

SEQ ID NO: 164833 - DNA, 38 bp, Artificial Sequence
  Synthetic oligonucleotide
gtctccctccgcccactgtaccggtatgttcctactga

SEQ ID NO: 164834 - DNA, 37 bp, Artificial Sequence
  Synthetic oligonucleotide
gcaccggtccccagcttccacggaaccctctctctga

SEQ ID NO: 164835 - DNA, 36 bp, Artificial Sequence
  Synthetic oligonucleotide
taacaggcgcattacgctctccgccccattttctga

SEQ ID NO: 164836 - DNA, 38 bp, Artificial Sequence
  Synthetic oligonucleotide
agtttgggtgggagggggcgagagtggtaagggggtga

SEQ ID NO: 164837 - DNA, 38 bp, Artificial Sequence
  Synthetic oligonucleotide
gttggcccactgtatgcaccatccttcttttcatgtga

SEQ ID NO: 164838 - DNA, 37 bp, Artificial Sequence
  Synthetic oligonucleotide
tcgttacctccgcttatcacgaagtcctcatacttga

SEQ ID NO: 164839 - DNA, 35 bp, Artificial Sequence
  Synthetic oligonucleotide
tatcgctcccctgcaatacgcaacccacgccttga

SEQ ID NO: 164840 - DNA, 37 bp, Artificial Sequence
  Synthetic oligonucleotide
gagcgcagtcggtgtcacttcacccatccctgcttga

SEQ ID NO: 164841 - DNA, 38 bp, Artificial Sequence
  Synthetic oligonucleotide
gcagttggaaaggggggaacaaggaaagaaggagttga

SEQ ID NO: 164842 - DNA, 38 bp, Artificial Sequence
  Synthetic oligonucleotide
ttgttacgctccggccctgtttatcgcccatgctttga

SEQ ID NO: 164843 - DNA, 36 bp, Artificial Sequence
  Synthetic oligonucleotide
actgacacccgcaggagttaacgccctcttccctta

SEQ ID NO: 164844 - DNA, 35 bp, Artificial Sequence
  Synthetic oligonucleotide
ttacacgatcgttcgtccgccttttcgtccgccac

SEQ ID NO: 164845 - DNA, 35 bp, Artificial Sequence
  Synthetic oligonucleotide
atgtggccactcatccgctcttgtccgaattccac

SEQ ID NO: 164846 - DNA, 35 bp, Artificial Sequence
  Synthetic oligonucleotide
taccccgcaattcctcctccgcttgtacgttggac

SEQ ID NO: 164847 - DNA, 35 bp, Artificial Sequence
  Synthetic oligonucleotide
atcttcactcccgtacagctgcctaccatcactac

SEQ ID NO: 164848 - DNA, 35 bp, Artificial Sequence
  Synthetic oligonucleotide
atgagatgcagccccacaccctgcgcccactgtac

SEQ ID NO: 164849 - DNA, 35 bp, Artificial Sequence
  Synthetic oligonucleotide
gctcggagcggccacttccctgccgtatctgttac

SEQ ID NO: 164850 - DNA, 35 bp, Artificial Sequence
  Synthetic oligonucleotide
cctccataccgccgatctgcgctccgctctatacc

SEQ ID NO: 164851 - DNA, 35 bp, Artificial Sequence
  Synthetic oligonucleotide
tcagtgtgctgtacccggttgtctttgtccccccc

SEQ ID NO: 164852 - DNA, 35 bp, Artificial Sequence
  Synthetic oligonucleotide
tgtgtcccacccgccacctgcccctgtgcggcccc

SEQ ID NO: 164853 - DNA, 35 bp, Artificial Sequence
  Synthetic oligonucleotide
gaccacgcccacattccattctagcacactgcccc

SEQ ID NO: 164854 - DNA, 35 bp, Artificial Sequence
  Synthetic oligonucleotide
tttgttgtagcatctatcccctgtttcgtccgccc

SEQ ID NO: 164855 - DNA, 35 bp, Artificial Sequence
  Synthetic oligonucleotide
gaccccgcccctctctttcgtctcacaggtcgccc

SEQ ID NO: 164856 - DNA, 35 bp, Artificial Sequence
  Synthetic oligonucleotide
tagcgatgctcacgtaccactgattcaccatgccc

SEQ ID NO: 164857 - DNA, 35 bp, Artificial Sequence
  Synthetic oligonucleotide
tgtacaactccccccatgctttgcacagtaatccc

SEQ ID NO: 164858 - DNA, 35 bp, Artificial Sequence
  Synthetic oligonucleotide
gtgctcggtctgtgcgtccttagtctgtccctgcc

SEQ ID NO: 164859 - DNA, 35 bp, Artificial Sequence
  Synthetic oligonucleotide
tgaacgtccacccttccttgtctgaatatcttgcc

SEQ ID NO: 164860 - DNA, 35 bp, Artificial Sequence
  Synthetic oligonucleotide
tccttccgccacgagttcctatgatctctatatcc

SEQ ID NO: 164861 - DNA, 35 bp, Artificial Sequence
  Synthetic oligonucleotide
atcgagcggtccatcagtctagcgcaccagcctcc

SEQ ID NO: 164862 - DNA, 35 bp, Artificial Sequence
  Synthetic oligonucleotide
ggtccgtacgtaagtctttaacacctatctgctcc

SEQ ID NO: 164863 - DNA, 35 bp, Artificial Sequence
  Synthetic oligonucleotide
tgactgccccatcccggggtcctagccaccaccgc

SEQ ID NO: 164864 - DNA, 35 bp, Artificial Sequence
  Synthetic oligonucleotide
tcagacaacatgcctctccacctatgccttcaggc

SEQ ID NO: 164865 - DNA, 36 bp, Artificial Sequence
  Synthetic oligonucleotide
gggagggctggggagggaggagcaatggttacctgc

SEQ ID NO: 164866 - DNA, 35 bp, Artificial Sequence
  Synthetic oligonucleotide
acctccctcactcggaatctttgggctcgctactc

SEQ ID NO: 164867 - DNA, 35 bp, Artificial Sequence
  Synthetic oligonucleotide
gcgtcatcctcctgtctttagccacgtgtctcctc

SEQ ID NO: 164868 - DNA, 35 bp, Artificial Sequence
  Synthetic oligonucleotide
acttgtcccactatatcttcgactgccctctgctc

SEQ ID NO: 164869 - DNA, 35 bp, Artificial Sequence
  Synthetic oligonucleotide
acccgtacccgctatgtacttcgagctaacctttc

SEQ ID NO: 164870 - DNA, 35 bp, Artificial Sequence
  Synthetic oligonucleotide
ggactggatggaggatacggaggggcggcacgtag

SEQ ID NO: 164871 - DNA, 35 bp, Artificial Sequence
  Synthetic oligonucleotide
gtcatgccttgccacccctctcctctcgtacgtag

SEQ ID NO: 164872 - DNA, 35 bp, Artificial Sequence
  Synthetic oligonucleotide
atagcccgatccccggtaggcctccccctagaccg

SEQ ID NO: 164873 - DNA, 35 bp, Artificial Sequence
  Synthetic oligonucleotide
gtccccacccccgactccgaggtccattcatcccg

SEQ ID NO: 164874 - DNA, 35 bp, Artificial Sequence
  Synthetic oligonucleotide
tctcaatgtacctaagcccactcgtgctccttccg

SEQ ID NO: 164875 - DNA, 35 bp, Artificial Sequence
  Synthetic oligonucleotide
tgtccccaattgtcccccccgctcagctcaaccgg

SEQ ID NO: 164876 - DNA, 35 bp, Artificial Sequence
  Synthetic oligonucleotide
gaaccgaagtatagtagatgggggggggtgtgcgg

SEQ ID NO: 164877 - DNA, 35 bp, Artificial Sequence
  Synthetic oligonucleotide
gagtacacagaacaggggcggggggggatttaggg

SEQ ID NO: 164878 - DNA, 35 bp, Artificial Sequence
  Synthetic oligonucleotide
atcgcaccacgcaaccttaccgcttttcacacgtg

SEQ ID NO: 164879 - DNA, 35 bp, Artificial Sequence
  Synthetic oligonucleotide
ggttgcacgagctcatgtacctttttcgccccttg

SEQ ID NO: 164880 - DNA, 35 bp, Artificial Sequence
  Synthetic oligonucleotide
tttgcccgagacgtgtactatccacccctcgcttg

SEQ ID NO: 164881 - DNA, 35 bp, Artificial Sequence
  Synthetic oligonucleotide
gcactatacaccgttcatctctctgacgcctcttg

SEQ ID NO: 164882 - DNA, 35 bp, Artificial Sequence
  Synthetic oligonucleotide
ttcgtcccggtaacccgctcatcacccgccctgat

SEQ ID NO: 164883 - DNA, 35 bp, Artificial Sequence
  Synthetic oligonucleotide
tccaccacttcatcgatttctacagtttaacgcct

SEQ ID NO: 164884 - DNA, 35 bp, Artificial Sequence
  Synthetic oligonucleotide
tagcccgtgtccccttatcgcgtccaggctactct

SEQ ID NO: 164885 - DNA, 35 bp, Artificial Sequence
  Synthetic oligonucleotide
agcccaccctcccatgggtcctccccctatagatt

SEQ ID NO: 164886 - DNA, 35 bp, Artificial Sequence
  Synthetic oligonucleotide
aacaccgacctgaccaaccctggcctcgatccctt

SEQ ID NO: 164887 - DNA, 35 bp, Artificial Sequence
  Synthetic oligonucleotide
ttcacccagttccgtccacctgggtactcctcctt

SEQ ID NO: 164888 - DNA, 35 bp, Artificial Sequence
  Synthetic oligonucleotide
gccacaacatcttgtccggttcacctttcactgtt

SEQ ID NO: 164889 - DNA, 35 bp, Artificial Sequence
  Synthetic oligonucleotide
gctgggctgctctgccggtctcctcgtactcattt

SEQ ID NO: 164890 - DNA, 35 bp, Artificial Sequence
  Synthetic oligonucleotide
gaactgatgccttagctgcctactcccgaaccttt

SEQ ID NO: 164891 - DNA, 35 bp, Artificial Sequence
  Synthetic oligonucleotide
gtgacattgcctgccttccctgtatcgcgtgtttt

SEQ ID NO: 164892 - DNA, 35 bp, Artificial Sequence
  Synthetic oligonucleotide
tggaacggaaacaagggagaggctgagtggggaaa

SEQ ID NO: 164893 - DNA, 36 bp, Artificial Sequence
  Synthetic oligonucleotide
tcctcccaccctgtccgtcgacacgccatcctgaaa

SEQ ID NO: 164894 - DNA, 36 bp, Artificial Sequence
  Synthetic oligonucleotide
tcccgatgtccccgcgatgccttcttccgccttgaa

SEQ ID NO: 164895 - DNA, 35 bp, Artificial Sequence
  Synthetic oligonucleotide
atggtggagggggagggagggacggtctagagaca

SEQ ID NO: 164896 - DNA, 36 bp, Artificial Sequence
  Synthetic oligonucleotide
gcccgctgcccccacaggtcaaatttgccacgtaca

SEQ ID NO: 164897 - DNA, 35 bp, Artificial Sequence
  Synthetic oligonucleotide
tgttggcacccaacctggtctatctcacgtttaca

SEQ ID NO: 164898 - DNA, 30 bp, Artificial Sequence
  Synthetic oligonucleotide
ttacacaccacacatcaactcgtgttacca

SEQ ID NO: 164899 - DNA, 36 bp, Artificial Sequence
  Synthetic oligonucleotide
tgcccgccctaccacgttgtgcgtagccacccccca

SEQ ID NO: 164900 - DNA, 36 bp, Artificial Sequence
  Synthetic oligonucleotide
tcctgcaggtccgccgccccagtacattcgttcgca

SEQ ID NO: 164901 - DNA, 36 bp, Artificial Sequence
  Synthetic oligonucleotide
aactcatggcggaggatggggtcctgggtggtggca

SEQ ID NO: 164902 - DNA, 36 bp, Artificial Sequence
  Synthetic oligonucleotide
gctgacgccactgcgccgctgccccgccctgtatca

SEQ ID NO: 164903 - DNA, 36 bp, Artificial Sequence
  Synthetic oligonucleotide
gcctatcccccgcgttccttccagccacccgcgtca

SEQ ID NO: 164904 - DNA, 36 bp, Artificial Sequence
  Synthetic oligonucleotide
tggacatgctctaggattctccctgctccatcttca

SEQ ID NO: 164905 - DNA, 37 bp, Artificial Sequence
  Synthetic oligonucleotide
acagggggggagagtaacaaacgggtgaggaaaaaga

SEQ ID NO: 164906 - DNA, 37 bp, Artificial Sequence
  Synthetic oligonucleotide
gtctaaggtgagaacaggggggggacagtggaggaga

SEQ ID NO: 164907 - DNA, 36 bp, Artificial Sequence
  Synthetic oligonucleotide
tgcaagtagggaaggataatgggggcgggctcacga

SEQ ID NO: 164908 - DNA, 36 bp, Artificial Sequence
  Synthetic oligonucleotide
tccaccatgccactggaacctgacccacattcccga

SEQ ID NO: 164909 - DNA, 37 bp, Artificial Sequence
  Synthetic oligonucleotide
tctgtcgccgcccgtgatatgtacctggtctcgtcga

SEQ ID NO: 164910 - DNA, 37 bp, Artificial Sequence
  Synthetic oligonucleotide
ggggatggagggatcaaaatgcaaacagggggaggga

SEQ ID NO: 164911 - DNA, 36 bp, Artificial Sequence
  Synthetic oligonucleotide
gctcctccatccatcgtacgttaagctcttcttgga

SEQ ID NO: 164912 - DNA, 38 bp, Artificial Sequence
  Synthetic oligonucleotide
gagtgacaggttggcgtacggggggggagtagaaatga

SEQ ID NO: 164913 - DNA, 38 bp, Artificial Sequence
  Synthetic oligonucleotide
tcccccatgcctccctctcagtcgctattttgacatga

SEQ ID NO: 164914 - DNA, 36 bp, Artificial Sequence
  Synthetic oligonucleotide
atgaccggagagggtgggtacgttagggcgtcatga

SEQ ID NO: 164915 - DNA, 37 bp, Artificial Sequence
  Synthetic oligonucleotide
gaacggggcagaagatacgggttgtagggggggatga

SEQ ID NO: 164916 - DNA, 38 bp, Artificial Sequence
  Synthetic oligonucleotide
gcagacccagtgctgcccggcatccacctaacccctga

SEQ ID NO: 164917 - DNA, 38 bp, Artificial Sequence
  Synthetic oligonucleotide
tggggggagggttaggggttacgtattggggtccctga

SEQ ID NO: 164918 - DNA, 38 bp, Artificial Sequence
  Synthetic oligonucleotide
gccgccgtgcacatcttaggacctctcatactgcctga

SEQ ID NO: 164919 - DNA, 35 bp, Artificial Sequence
  Synthetic oligonucleotide
gccccagcgggcccgctccccgtctcctccattga

SEQ ID NO: 164920 - DNA, 37 bp, Artificial Sequence
  Synthetic oligonucleotide
gtgccgactgtattggcggcactcactctctacttga

SEQ ID NO: 164921 - DNA, 37 bp, Artificial Sequence
  Synthetic oligonucleotide
tcgcaccacgcctacgtacaccgccccctatgtttga

SEQ ID NO: 164922 - DNA, 36 bp, Artificial Sequence
  Synthetic oligonucleotide
ttccaccctctgattggcaagctgccggccccacta

SEQ ID NO: 164923 - DNA, 36 bp, Artificial Sequence
  Synthetic oligonucleotide
gaccgtacagctttgcccgttatatccacgcctcta

SEQ ID NO: 164924 - DNA, 35 bp, Artificial Sequence
  Synthetic oligonucleotide
gcttgcatctcgtactgctttccgacactgctcta

SEQ ID NO: 164925 - DNA, 36 bp, Artificial Sequence
  Synthetic oligonucleotide
tgttcggtagtgctgtctagttcgtccacctctcta

SEQ ID NO: 164926 - DNA, 36 bp, Artificial Sequence
  Synthetic oligonucleotide
tcaggtcgtccgtcgcacgtctcccgtctctccgta

SEQ ID NO: 164927 - DNA, 36 bp, Artificial Sequence
  Synthetic oligonucleotide
gagaggagggaaatggggatgcgtgcgggattggta

SEQ ID NO: 164928 - DNA, 36 bp, Artificial Sequence
  Synthetic oligonucleotide
gacgccacgctctagcctatctcactgctcacgtta

SEQ ID NO: 164929 - DNA, 36 bp, Artificial Sequence
  Synthetic oligonucleotide
ggtcctccgccacccaatgtcgaattgccctgttta

SEQ ID NO: 164930 - DNA, 35 bp, Artificial Sequence
  Synthetic oligonucleotide
ccctaccactgacgccccgagccctgacaagccac

SEQ ID NO: 164931 - DNA, 35 bp, Artificial Sequence
  Synthetic oligonucleotide
gtctgcccgcccagactccatacccacgcttcgac

SEQ ID NO: 164932 - DNA, 35 bp, Artificial Sequence
  Synthetic oligonucleotide
tcgcgcaccccgccttttatatcggccttctggac

SEQ ID NO: 164933 - DNA, 35 bp, Artificial Sequence
  Synthetic oligonucleotide
ttaggcggtatacccaggtgggggaggaggtggac

SEQ ID NO: 164934 - DNA, 35 bp, Artificial Sequence
  Synthetic oligonucleotide
gagacgcccctctttgcatagctgaaacgctgtac

SEQ ID NO: 164935 - DNA, 35 bp, Artificial Sequence
  Synthetic oligonucleotide
gcacaacccactatgtcgttgcaccctcccctacc

SEQ ID NO: 164936 - DNA, 35 bp, Artificial Sequence
  Synthetic oligonucleotide
tcacagttgctattcctgctgcatgttcatctacc

SEQ ID NO: 164937 - DNA, 35 bp, Artificial Sequence
  Synthetic oligonucleotide
tgaccaggttgcgtcacataggacccgcccctccc

SEQ ID NO: 164938 - DNA, 35 bp, Artificial Sequence
  Synthetic oligonucleotide
atcaatcgtgagtcgcaccgcctgctttatccgcc

SEQ ID NO: 164939 - DNA, 35 bp, Artificial Sequence
  Synthetic oligonucleotide
gcacaccgcctccaggtgctcctgcttcctccgcc

SEQ ID NO: 164940 - DNA, 35 bp, Artificial Sequence
  Synthetic oligonucleotide
tccatcaaaggcaccacctgctccctgcgcctgcc

SEQ ID NO: 164941 - DNA, 35 bp, Artificial Sequence
  Synthetic oligonucleotide
tcgctgtgggccgtccccgtttgctgtcctcatcc

SEQ ID NO: 164942 - DNA, 35 bp, Artificial Sequence
  Synthetic oligonucleotide
agggtcacctccgctccatcgaagttttcagttcc

SEQ ID NO: 164943 - DNA, 35 bp, Artificial Sequence
  Synthetic oligonucleotide
gcatgtcaatcctgccctcgttcggaacaaatcgc

SEQ ID NO: 164944 - DNA, 35 bp, Artificial Sequence
  Synthetic oligonucleotide
ataacgcacaatgcggtttcttccttgccctcggc

SEQ ID NO: 164945 - DNA, 35 bp, Artificial Sequence
  Synthetic oligonucleotide
attgcgcatccagcagtccaccgctaactcacatc

SEQ ID NO: 164946 - DNA, 35 bp, Artificial Sequence
  Synthetic oligonucleotide
tgttgctgttgcctgcgcacctcttaatcttggtc

SEQ ID NO: 164947 - DNA, 35 bp, Artificial Sequence
  Synthetic oligonucleotide
gtagatcgcgccgcccgtcctctttggtacatgtc

SEQ ID NO: 164948 - DNA, 35 bp, Artificial Sequence
  Synthetic oligonucleotide
tccttcaccgctattcgtttgcttctgaccttttc

SEQ ID NO: 164949 - DNA, 35 bp, Artificial Sequence
  Synthetic oligonucleotide
tacctccatccacgcgattgcaacacggagttttc

SEQ ID NO: 164950 - DNA, 35 bp, Artificial Sequence
  Synthetic oligonucleotide
atcccaagggcctcagtccgcatcctcgttttttc

SEQ ID NO: 164951 - DNA, 33 bp, Artificial Sequence
  Synthetic oligonucleotide
cccccctcccaaccctcctgtcgaattgcgtag

SEQ ID NO: 164952 - DNA, 35 bp, Artificial Sequence
  Synthetic oligonucleotide
gcttccgctccacgacctgactatgaccccgcccg

SEQ ID NO: 164953 - DNA, 35 bp, Artificial Sequence
  Synthetic oligonucleotide
gaacgcctggcacttctcgttttgttatccctccg

SEQ ID NO: 164954 - DNA, 35 bp, Artificial Sequence
  Synthetic oligonucleotide
tctacaacatccttgtctgcgcttattcttctccg

SEQ ID NO: 164955 - DNA, 35 bp, Artificial Sequence
  Synthetic oligonucleotide
ggtccggcctacccctctcatttcgcgctgcttcg

SEQ ID NO: 164956 - DNA, 35 bp, Artificial Sequence
  Synthetic oligonucleotide
atagcctgccgccccctttcagccttattcccatg

SEQ ID NO: 164957 - DNA, 35 bp, Artificial Sequence
  Synthetic oligonucleotide
gtcagtagcgcgctttcgtcttatcccattacctg

SEQ ID NO: 164958 - DNA, 35 bp, Artificial Sequence
  Synthetic oligonucleotide
tccgtgggctcttaccactccgccatgacatcctg

SEQ ID NO: 164959 - DNA, 35 bp, Artificial Sequence
  Synthetic oligonucleotide
gcacctgcagtacttgcgcccgtcctcttgctctg

SEQ ID NO: 164960 - DNA, 35 bp, Artificial Sequence
  Synthetic oligonucleotide
tactgatccagttctgtgctccatcattttccgtg

SEQ ID NO: 164961 - DNA, 35 bp, Artificial Sequence
  Synthetic oligonucleotide
taacctgcctccgtgactccctgctcccatcattg

SEQ ID NO: 164962 - DNA, 35 bp, Artificial Sequence
  Synthetic oligonucleotide
atgaaaggggagaaagggttgaagggagttgattg

SEQ ID NO: 164963 - DNA, 35 bp, Artificial Sequence
  Synthetic oligonucleotide
gtatcgccgctgcctcgttccgacgcttctttcat

SEQ ID NO: 164964 - DNA, 35 bp, Artificial Sequence
  Synthetic oligonucleotide
gacccttccccctcaggcgtaaagccgcccaccct

SEQ ID NO: 164965 - DNA, 35 bp, Artificial Sequence
  Synthetic oligonucleotide
gcccacagcgtctgcactccccgtctcccgcatgt

SEQ ID NO: 164966 - DNA, 35 bp, Artificial Sequence
  Synthetic oligonucleotide
gtatcgagggggggaggaggaaagcatctgggatt

SEQ ID NO: 164967 - DNA, 35 bp, Artificial Sequence
  Synthetic oligonucleotide
aaccgccccgcctttactataaccactaggtactt

SEQ ID NO: 164968 - DNA, 35 bp, Artificial Sequence
  Synthetic oligonucleotide
tcagcgagaacccgcctgccagcccagtcctcctt

SEQ ID NO: 164969 - DNA, 35 bp, Artificial Sequence
  Synthetic oligonucleotide
gacgacgggaggggggtttacagttgataggtgtt

SEQ ID NO: 164970 - DNA, 35 bp, Artificial Sequence
  Synthetic oligonucleotide
tatcaccccacattttgctcttcaagaggtacttt

SEQ ID NO: 164971 - DNA, 35 bp, Artificial Sequence
  Synthetic oligonucleotide
tcccatgcccgtgttcgcttcacttatgctgtttt

SEQ ID NO: 164972 - DNA, 36 bp, Artificial Sequence
  Synthetic oligonucleotide
gagggggtaatgagggtggaaaactgtgagggaaaa

SEQ ID NO: 164973 - DNA, 35 bp, Artificial Sequence
  Synthetic oligonucleotide
aatggggaaaagcgggatgggggggtgtgaagcaa

SEQ ID NO: 164974 - DNA, 35 bp, Artificial Sequence
  Synthetic oligonucleotide
gatgtgctggctcccccgtccaccccattgggtaa

SEQ ID NO: 164975 - DNA, 35 bp, Artificial Sequence
  Synthetic oligonucleotide
ttacaccggccgcccctctgatccccctcttaaca

SEQ ID NO: 164976 - DNA, 36 bp, Artificial Sequence
  Synthetic oligonucleotide
gagcccatgcccctcctccgaccacgactcgggaca

SEQ ID NO: 164977 - DNA, 35 bp, Artificial Sequence
  Synthetic oligonucleotide
tacatgttacgccgccttctccactcgtccgacca

SEQ ID NO: 164978 - DNA, 35 bp, Artificial Sequence
  Synthetic oligonucleotide
gcagctcacacattgtctttccctgctagctccca

SEQ ID NO: 164979 - DNA, 36 bp, Artificial Sequence
  Synthetic oligonucleotide
gcgccccctgccccccctgtatacaggtcctgtcca

SEQ ID NO: 164980 - DNA, 36 bp, Artificial Sequence
  Synthetic oligonucleotide
ttgccctcctctatgctttgatccatgctacgcgca

SEQ ID NO: 164981 - DNA, 35 bp, Artificial Sequence
  Synthetic oligonucleotide
cccaaaccagatctgttatccgcccctcccttgca

SEQ ID NO: 164982 - DNA, 36 bp, Artificial Sequence
  Synthetic oligonucleotide
acttccaccatcggacccccctcttcacctgtctca

SEQ ID NO: 164983 - DNA, 35 bp, Artificial Sequence
  Synthetic oligonucleotide
aattgaggggggagcaggaagtggggaacgacaga

SEQ ID NO: 164984 - DNA, 37 bp, Artificial Sequence
  Synthetic oligonucleotide
attgcaggggtgagcagagggaggacaaagtggcaga

SEQ ID NO: 164985 - DNA, 37 bp, Artificial Sequence
  Synthetic oligonucleotide
acatcacataccctgccacgctccctctcacgagaga

SEQ ID NO: 164986 - DNA, 36 bp, Artificial Sequence
  Synthetic oligonucleotide
ggtggggatggggcgggttgtcaaagaagggttaga

SEQ ID NO: 164987 - DNA, 36 bp, Artificial Sequence
  Synthetic oligonucleotide
gatcgctgtcccgaggacgtaccacccgtttttcga

SEQ ID NO: 164988 - DNA, 37 bp, Artificial Sequence
  Synthetic oligonucleotide
accgccgatctcgacacccctccccctccgtcaagga

SEQ ID NO: 164989 - DNA, 37 bp, Artificial Sequence
  Synthetic oligonucleotide
ggaaatggaagggggaggaaaatagaactcaggagga

SEQ ID NO: 164990 - DNA, 37 bp, Artificial Sequence
  Synthetic oligonucleotide
tcaaactgcgggaaaggagcatgggaacggcaaggga

SEQ ID NO: 164991 - DNA, 37 bp, Artificial Sequence
  Synthetic oligonucleotide
aggacagagggcggatcggaaggaggggcgctgggga

SEQ ID NO: 164992 - DNA, 35 bp, Artificial Sequence
  Synthetic oligonucleotide
gggtgggggtacacaatgggggactctgttgggga

SEQ ID NO: 164993 - DNA, 37 bp, Artificial Sequence
  Synthetic oligonucleotide
tgtttgcccatatcgctaacgccctccttcaactgga

SEQ ID NO: 164994 - DNA, 37 bp, Artificial Sequence
  Synthetic oligonucleotide
tccactgccctagatatgctcgccacacgcacctgga

SEQ ID NO: 164995 - DNA, 36 bp, Artificial Sequence
  Synthetic oligonucleotide
ttccgctcgcccgccgcgttatcctgccttattgga

SEQ ID NO: 164996 - DNA, 38 bp, Artificial Sequence
  Synthetic oligonucleotide
tggatcgcatgatctgcacctctcaaccgtacccatga

SEQ ID NO: 164997 - DNA, 38 bp, Artificial Sequence
  Synthetic oligonucleotide
accattcgccttcctgccgttgtaaccgtactctatga

SEQ ID NO: 164998 - DNA, 37 bp, Artificial Sequence
  Synthetic oligonucleotide
tctgctaccctcagcgccgcaacgccacatccactga

SEQ ID NO: 164999 - DNA, 36 bp, Artificial Sequence
  Synthetic oligonucleotide
gccggtgggcctatcagctccgtttcgttcccctga

SEQ ID NO: 165000 - DNA, 38 bp, Artificial Sequence
  Synthetic oligonucleotide
atccctgtccctgcttgctgttcccagtcatgacgtga

SEQ ID NO: 165001 - DNA, 37 bp, Artificial Sequence
  Synthetic oligonucleotide
tgccattgcagaacactgcctaaaagcccccccgtga

SEQ ID NO: 165002 - DNA, 38 bp, Artificial Sequence
  Synthetic oligonucleotide
agtcgacagggggttaggagcagggggaggcggcgtga

SEQ ID NO: 165003 - DNA, 37 bp, Artificial Sequence
  Synthetic oligonucleotide
acataagcaggggtggtgggaatggctaggcgggtga

SEQ ID NO: 165004 - DNA, 38 bp, Artificial Sequence
  Synthetic oligonucleotide
gattcgcgggaggggtccgggaggggggaggcgattga

SEQ ID NO: 165005 - DNA, 38 bp, Artificial Sequence
  Synthetic oligonucleotide
tccacgcgcaccaaacgaacctgttccaccctgcttga

SEQ ID NO: 165006 - DNA, 36 bp, Artificial Sequence
  Synthetic oligonucleotide
tatggaaacggtgagggggttcgggagggtcgaata

SEQ ID NO: 165007 - DNA, 36 bp, Artificial Sequence
  Synthetic oligonucleotide
gatcactgtcggccgtcgggtaccatcgtctcacta

SEQ ID NO: 165008 - DNA, 36 bp, Artificial Sequence
  Synthetic oligonucleotide
gtccaccgcacatgttgacgtctccgccatccccta

SEQ ID NO: 165009 - DNA, 35 bp, Artificial Sequence
  Synthetic oligonucleotide
attgtccccctgccccgcggagccctaaatgccta

SEQ ID NO: 165010 - DNA, 35 bp, Artificial Sequence
  Synthetic oligonucleotide
agttgcacgtggcgccctgttcaccctgattccta

SEQ ID NO: 165011 - DNA, 36 bp, Artificial Sequence
  Synthetic oligonucleotide
ccatcccacggcaccagtcgcctcaccctttcgcta

SEQ ID NO: 165012 - DNA, 36 bp, Artificial Sequence
  Synthetic oligonucleotide
tgcctccgctgtctttccctctccgtcctgttagta

SEQ ID NO: 165013 - DNA, 38 bp, Artificial Sequence
  Synthetic oligonucleotide
tccatcaaacgtgctatcttccctgctgcctttgctta

SEQ ID NO: 165014 - DNA, 36 bp, Artificial Sequence
  Synthetic oligonucleotide
tgcacacctgtccgttggcaccccccgtttgattta

SEQ ID NO: 165015 - DNA, 35 bp, Artificial Sequence
  Synthetic oligonucleotide
ggcccgccccatgcctacccgttgatctcgaccac

SEQ ID NO: 165016 - DNA, 35 bp, Artificial Sequence
  Synthetic oligonucleotide
tgtggtgcctccatgaccttacttacaccatcgac

SEQ ID NO: 165017 - DNA, 36 bp, Artificial Sequence
  Synthetic oligonucleotide
ggacgccgacatagcgttgcacttcctctctttgac

SEQ ID NO: 165018 - DNA, 35 bp, Artificial Sequence
  Synthetic oligonucleotide
acgttccaccacagcgtgatacgcacgtacactac

SEQ ID NO: 165019 - DNA, 35 bp, Artificial Sequence
  Synthetic oligonucleotide
tcccctggcgctcgttagtctcatctgcgtcctac

SEQ ID NO: 165020 - DNA, 35 bp, Artificial Sequence
  Synthetic oligonucleotide
agtacggcctccgctccactatgtcccgatcgtac

SEQ ID NO: 165021 - DNA, 35 bp, Artificial Sequence
  Synthetic oligonucleotide
tcctccatcctgggccttattcctgctccggtacc

SEQ ID NO: 165022 - DNA, 35 bp, Artificial Sequence
  Synthetic oligonucleotide
atgcccgacggtatgctatcaattactactccccc

SEQ ID NO: 165023 - DNA, 35 bp, Artificial Sequence
  Synthetic oligonucleotide
tatcgccactcatatctgccgtgcttcttttcccc

SEQ ID NO: 165024 - DNA, 35 bp, Artificial Sequence
  Synthetic oligonucleotide
tgccactatccgggcgggaggggagcttgggtccc

SEQ ID NO: 165025 - DNA, 35 bp, Artificial Sequence
  Synthetic oligonucleotide
agtgggcgcctactctgcttccttctgatcttccc

SEQ ID NO: 165026 - DNA, 35 bp, Artificial Sequence
  Synthetic oligonucleotide
tgaagcccccactacgccgccaacacgctacggcc

SEQ ID NO: 165027 - DNA, 35 bp, Artificial Sequence
  Synthetic oligonucleotide
tccttgcccacacacctcgttctgcccgcgaatcc

SEQ ID NO: 165028 - DNA, 35 bp, Artificial Sequence
  Synthetic oligonucleotide
gccgccccgtccgttccttgtccatcagtcgctcc

SEQ ID NO: 165029 - DNA, 35 bp, Artificial Sequence
  Synthetic oligonucleotide
tgtgtccaacacttgtggttacatttcgcctttcc

SEQ ID NO: 165030 - DNA, 35 bp, Artificial Sequence
  Synthetic oligonucleotide
gccaccccgcgttaggttacacgcctgaattttcc

SEQ ID NO: 165031 - DNA, 35 bp, Artificial Sequence
  Synthetic oligonucleotide
tgctctcgcccccattgccacctccgctctgtagc

SEQ ID NO: 165032 - DNA, 35 bp, Artificial Sequence
  Synthetic oligonucleotide
atcctgctcccccgggtaacgcccgctcgcctcgc

SEQ ID NO: 165033 - DNA, 35 bp, Artificial Sequence
  Synthetic oligonucleotide
tagtgcaatcatatatcaccccctccccccgtggc

SEQ ID NO: 165034 - DNA, 35 bp, Artificial Sequence
  Synthetic oligonucleotide
gtgatctcccccgaattgcctaggcactcttttgc

SEQ ID NO: 165035 - DNA, 35 bp, Artificial Sequence
  Synthetic oligonucleotide
gcccccgtcgacccccagtttgtagcacacgtatc

SEQ ID NO: 165036 - DNA, 35 bp, Artificial Sequence
  Synthetic oligonucleotide
gcaccgacttgcctctgtcgcccacaacgagcctc

SEQ ID NO: 165037 - DNA, 35 bp, Artificial Sequence
  Synthetic oligonucleotide
aacacggctggcctctacgcttttgggccctcctc

SEQ ID NO: 165038 - DNA, 35 bp, Artificial Sequence
  Synthetic oligonucleotide
tcaatggcgttcacattcaccgccctcctactctc

SEQ ID NO: 165039 - DNA, 35 bp, Artificial Sequence
  Synthetic oligonucleotide
gagtcagacctgttttgccagtccgcctgcctctc

SEQ ID NO: 165040 - DNA, 35 bp, Artificial Sequence
  Synthetic oligonucleotide
cacacctgagtgttcgtttctggtccactgttctc

SEQ ID NO: 165041 - DNA, 35 bp, Artificial Sequence
  Synthetic oligonucleotide
tgcttcaatcgccctgcccctccctggacttcttc

SEQ ID NO: 165042 - DNA, 35 bp, Artificial Sequence
  Synthetic oligonucleotide
agtccacttgcagcagttgttctgggccctctttc

SEQ ID NO: 165043 - DNA, 35 bp, Artificial Sequence
  Synthetic oligonucleotide
tctatccgcccatcgagccctgactttcagccacg

SEQ ID NO: 165044 - DNA, 35 bp, Artificial Sequence
  Synthetic oligonucleotide
atcgcgccactctctatcggttcagcccacccccg

SEQ ID NO: 165045 - DNA, 35 bp, Artificial Sequence
  Synthetic oligonucleotide
tccccacgcacaatattgcatcccaccgaaacgcg

SEQ ID NO: 165046 - DNA, 35 bp, Artificial Sequence
  Synthetic oligonucleotide
gcgttcccatccctctgctaagcgtcaccgccgcg

SEQ ID NO: 165047 - DNA, 35 bp, Artificial Sequence
  Synthetic oligonucleotide
agagatgtggcgggaggaagtggaggtgaaggtcg

SEQ ID NO: 165048 - DNA, 35 bp, Artificial Sequence
  Synthetic oligonucleotide
acacctccgcccacattagaataccgcgaatgtcg

SEQ ID NO: 165049 - DNA, 35 bp, Artificial Sequence
  Synthetic oligonucleotide
accacaccggcccggtagctataggccctccactg

SEQ ID NO: 165050 - DNA, 35 bp, Artificial Sequence
  Synthetic oligonucleotide
actcgaggaagagggtagaggcggggtaacgactg

SEQ ID NO: 165051 - DNA, 35 bp, Artificial Sequence
  Synthetic oligonucleotide
aattgccccgctcactctcgatttgccggattaat

SEQ ID NO: 165052 - DNA, 35 bp, Artificial Sequence
  Synthetic oligonucleotide
gtgctatcgcctactgacgttcctccgctctctat

SEQ ID NO: 165053 - DNA, 35 bp, Artificial Sequence
  Synthetic oligonucleotide
gcgcacttccctcacattgtctcgcatggcatact

SEQ ID NO: 165054 - DNA, 35 bp, Artificial Sequence
  Synthetic oligonucleotide
tgttcaagcccaccattgaacccgtattaatacct

SEQ ID NO: 165055 - DNA, 35 bp, Artificial Sequence
  Synthetic oligonucleotide
ttacgaatcacctctgaccgtggctcttcccccct

SEQ ID NO: 165056 - DNA, 35 bp, Artificial Sequence
  Synthetic oligonucleotide
tcttgcctctcagaattgcccgtctcccgtgccct

SEQ ID NO: 165057 - DNA, 35 bp, Artificial Sequence
  Synthetic oligonucleotide
gtgccgtcgcccctgccgtccacattctcgttcct

SEQ ID NO: 165058 - DNA, 34 bp, Artificial Sequence
  Synthetic oligonucleotide
tcacgtacgcccgtccactcatcctaaagtcgct

SEQ ID NO: 165059 - DNA, 35 bp, Artificial Sequence
  Synthetic oligonucleotide
attccagctgcgaccatcctttctgcggtctgtct

SEQ ID NO: 165060 - DNA, 35 bp, Artificial Sequence
  Synthetic oligonucleotide
gtgacaccccgcagcaatacgccaatatgacccgt

SEQ ID NO: 165061 - DNA, 35 bp, Artificial Sequence
  Synthetic oligonucleotide
ttccttgcccgccctccctttgttaccgtttttgt

SEQ ID NO: 165062 - DNA, 35 bp, Artificial Sequence
  Synthetic oligonucleotide
tcactctaggctccccctgctaccagtaaacggtt

SEQ ID NO: 165063 - DNA, 35 bp, Artificial Sequence
  Synthetic oligonucleotide
acagatcgcagccgtgtccgcctcctgcttcggtt

SEQ ID NO: 165064 - DNA, 35 bp, Artificial Sequence
  Synthetic oligonucleotide
gcctaaccgctcgccttccccctggtacaacattt

SEQ ID NO: 165065 - DNA, 36 bp, Artificial Sequence
  Synthetic oligonucleotide
gacaccgctccaccatgactcaggctgattcctaaa

SEQ ID NO: 165066 - DNA, 36 bp, Artificial Sequence
  Synthetic oligonucleotide
acccgcttcacatccgtccttttacattcagcgcaa

SEQ ID NO: 165067 - DNA, 36 bp, Artificial Sequence
  Synthetic oligonucleotide
agcgctgtgcacggtcttcggttctgctccctctaa

SEQ ID NO: 165068 - DNA, 35 bp, Artificial Sequence
  Synthetic oligonucleotide
actccatcaattcgatatgcttcaccgacttcaca

SEQ ID NO: 165069 - DNA, 36 bp, Artificial Sequence
  Synthetic oligonucleotide
atgatgcgcattgccttttacaagttcgttgcccca

SEQ ID NO: 165070 - DNA, 36 bp, Artificial Sequence
  Synthetic oligonucleotide
tccagacctcggcgccttcttaacgtacgccctcca

SEQ ID NO: 165071 - DNA, 35 bp, Artificial Sequence
  Synthetic oligonucleotide
atgccgaaagcaagaggaagacatggggaacggca

SEQ ID NO: 165072 - DNA, 34 bp, Artificial Sequence
  Synthetic oligonucleotide
ctccacctatggtttccagttcacctgcctatca

SEQ ID NO: 165073 - DNA, 36 bp, Artificial Sequence
  Synthetic oligonucleotide
ttcacccgcccgcaccggactaatgtctgtcactca

SEQ ID NO: 165074 - DNA, 36 bp, Artificial Sequence
  Synthetic oligonucleotide
actccaccatcgcccttaataggcttgaccgcctca

SEQ ID NO: 165075 - DNA, 35 bp, Artificial Sequence
  Synthetic oligonucleotide
gtggatcagtgcgcttagttcttcctgctttctca

SEQ ID NO: 165076 - DNA, 36 bp, Artificial Sequence
  Synthetic oligonucleotide
tccttgccctggtctgagttccgctttcctccgtca

SEQ ID NO: 165077 - DNA, 36 bp, Artificial Sequence
  Synthetic oligonucleotide
gacacacctatccgataaggcgcccttccgtggtca

SEQ ID NO: 165078 - DNA, 36 bp, Artificial Sequence
  Synthetic oligonucleotide
atgaccatccgcctgccttatcgcacatcatccaga

SEQ ID NO: 165079 - DNA, 37 bp, Artificial Sequence
  Synthetic oligonucleotide
gatgagggtaggatgtggtggaggggcatcatccaga

SEQ ID NO: 165080 - DNA, 37 bp, Artificial Sequence
  Synthetic oligonucleotide
agtggtggaaggggtgttgaaggggcgtgagcttaga

SEQ ID NO: 165081 - DNA, 37 bp, Artificial Sequence
  Synthetic oligonucleotide
tagaatgggatgctaggaaggaagagggaaaggacga

SEQ ID NO: 165082 - DNA, 36 bp, Artificial Sequence
  Synthetic oligonucleotide
gccacacatgcctgaatactaacctgccccaaccga

SEQ ID NO: 165083 - DNA, 37 bp, Artificial Sequence
  Synthetic oligonucleotide
aacgcccacacaccaagcggatacacccgccctccga

SEQ ID NO: 165084 - DNA, 36 bp, Artificial Sequence
  Synthetic oligonucleotide
atttgcggcggcacttatgtctgtttcttcctccga

SEQ ID NO: 165085 - DNA, 37 bp, Artificial Sequence
  Synthetic oligonucleotide
gcccaacaggggtgtcgtttgcctcgttcccttccga

SEQ ID NO: 165086 - DNA, 35 bp, Artificial Sequence
  Synthetic oligonucleotide
tccatgggccagacgggggggtacgggcttcgcga

SEQ ID NO: 165087 - DNA, 37 bp, Artificial Sequence
  Synthetic oligonucleotide
atacccctccagcccgaccgttcactatcgtcttcga

SEQ ID NO: 165088 - DNA, 36 bp, Artificial Sequence
  Synthetic oligonucleotide
gaccccctcgactgcctgctgtacttaaccgttcga

SEQ ID NO: 165089 - DNA, 37 bp, Artificial Sequence
  Synthetic oligonucleotide
gagtgggatgaagaaccttgttgaagggcgggaggga

SEQ ID NO: 165090 - DNA, 36 bp, Artificial Sequence
  Synthetic oligonucleotide
taggggtggagtaatagtggcgggggaacatcggga

SEQ ID NO: 165091 - DNA, 37 bp, Artificial Sequence
  Synthetic oligonucleotide
gtggagccaggtaatggggggaagaaagctgcgggga

SEQ ID NO: 165092 - DNA, 37 bp, Artificial Sequence
  Synthetic oligonucleotide
gaaccgagaccggttatatgtaggggacgggggggga

SEQ ID NO: 165093 - DNA, 37 bp, Artificial Sequence
  Synthetic oligonucleotide
actctgccaccccaggtgccgcttatcccattttgga

SEQ ID NO: 165094 - DNA, 38 bp, Artificial Sequence
  Synthetic oligonucleotide
tgcacccccatgtgattacctttgccccccccaaatga

SEQ ID NO: 165095 - DNA, 38 bp, Artificial Sequence
  Synthetic oligonucleotide
tcccgcgcccccatgccattttcgatcggatcccatga

SEQ ID NO: 165096 - DNA, 37 bp, Artificial Sequence
  Synthetic oligonucleotide
ttgctgacacctgctgaacacctctgaccacttatga

SEQ ID NO: 165097 - DNA, 38 bp, Artificial Sequence
  Synthetic oligonucleotide
ggatcggtggtggggtgggaagggcttggacaaactga

SEQ ID NO: 165098 - DNA, 38 bp, Artificial Sequence
  Synthetic oligonucleotide
gacaccatctccggcgctatcttcagtgttccacctga

SEQ ID NO: 165099 - DNA, 38 bp, Artificial Sequence
  Synthetic oligonucleotide
tgactcgaccctcgcgtactcgaatcatcctaccctga

SEQ ID NO: 165100 - DNA, 37 bp, Artificial Sequence
  Synthetic oligonucleotide
atgcattgccacccgcccgccacacaaacctcgctga

SEQ ID NO: 165101 - DNA, 38 bp, Artificial Sequence
  Synthetic oligonucleotide
tgatgcggtcacaatgctgggccccccgttccttctga

SEQ ID NO: 165102 - DNA, 37 bp, Artificial Sequence
  Synthetic oligonucleotide
tgtacccccctctggccacatcaagagtcccacgtga

SEQ ID NO: 165103 - DNA, 38 bp, Artificial Sequence
  Synthetic oligonucleotide
gtagggggacgggaattacggcagagagggaggcgtga

SEQ ID NO: 165104 - DNA, 38 bp, Artificial Sequence
  Synthetic oligonucleotide
tcaccccctcttaccatatgttcccgtcccttaggtga

SEQ ID NO: 165105 - DNA, 38 bp, Artificial Sequence
  Synthetic oligonucleotide
gagaagggctcgaagcaacgggtggccggggggggtga

SEQ ID NO: 165106 - DNA, 37 bp, Artificial Sequence
  Synthetic oligonucleotide
gaggaggaatcactggggcgaggggggacagcattga

SEQ ID NO: 165107 - DNA, 38 bp, Artificial Sequence
  Synthetic oligonucleotide
gaggggcgaatgggtgatcgggggttagctgggtttga

SEQ ID NO: 165108 - DNA, 35 bp, Artificial Sequence
  Synthetic oligonucleotide
acgccccattctccaacgctgtgctgtgccctata

SEQ ID NO: 165109 - DNA, 36 bp, Artificial Sequence
  Synthetic oligonucleotide
gatgtcctccgttgcatggccctgactctaccacta

SEQ ID NO: 165110 - DNA, 36 bp, Artificial Sequence
  Synthetic oligonucleotide
tgaccatcaaccactttgctactgactgcctggcta

SEQ ID NO: 165111 - DNA, 36 bp, Artificial Sequence
  Synthetic oligonucleotide
gttgggatggggacggtggctcaggcgaagggggta

SEQ ID NO: 165112 - DNA, 36 bp, Artificial Sequence
  Synthetic oligonucleotide
tccacccattgcgccctctcgaggttcgagcctgta

SEQ ID NO: 165113 - DNA, 35 bp, Artificial Sequence
  Synthetic oligonucleotide
gcgaacacctcacgctgttcatttgtcacacctta

SEQ ID NO: 165114 - DNA, 36 bp, Artificial Sequence
  Synthetic oligonucleotide
gtcccaaccacgatattgcgaaaactgcacccctta

SEQ ID NO: 165115 - DNA, 35 bp, Artificial Sequence
  Synthetic oligonucleotide
gttgccccccgtagattcttcagcggatctccaac

SEQ ID NO: 165116 - DNA, 35 bp, Artificial Sequence
  Synthetic oligonucleotide
tctgtgctcggttcccatgtagccctcctttgcac

SEQ ID NO: 165117 - DNA, 35 bp, Artificial Sequence
  Synthetic oligonucleotide
ttgcccccccgtcaccgaatccccgtgccaacacc

SEQ ID NO: 165118 - DNA, 35 bp, Artificial Sequence
  Synthetic oligonucleotide
ggttcagccgtcccacgcccaccttgtccagtacc

SEQ ID NO: 165119 - DNA, 35 bp, Artificial Sequence
  Synthetic oligonucleotide
aaggacgtgcgcccacagccccctcacacgttacc

SEQ ID NO: 165120 - DNA, 35 bp, Artificial Sequence
  Synthetic oligonucleotide
acatgactagcgtgcctcttttcattggctccccc

SEQ ID NO: 165121 - DNA, 35 bp, Artificial Sequence
  Synthetic oligonucleotide
ggagccccgtggttaacccctatccgacttgcccc

SEQ ID NO: 165122 - DNA, 35 bp, Artificial Sequence
  Synthetic oligonucleotide
acgtgccccctttgctcaacctgctactcgatccc

SEQ ID NO: 165123 - DNA, 35 bp, Artificial Sequence
  Synthetic oligonucleotide
taacggacctctgaactgtttcccgattatctccc

SEQ ID NO: 165124 - DNA, 35 bp, Artificial Sequence
  Synthetic oligonucleotide
gtccccccccgtatccgttatcgttcgtaggtccc

SEQ ID NO: 165125 - DNA, 35 bp, Artificial Sequence
  Synthetic oligonucleotide
gggaggccaaagaaaggggagggtgggtcgtggcc

SEQ ID NO: 165126 - DNA, 35 bp, Artificial Sequence
  Synthetic oligonucleotide
gactcctcgctctggcttcccgcactattccctcc

SEQ ID NO: 165127 - DNA, 35 bp, Artificial Sequence
  Synthetic oligonucleotide
ttacaccttccggacgtcagacgcgctaggcctcc

SEQ ID NO: 165128 - DNA, 35 bp, Artificial Sequence
  Synthetic oligonucleotide
tccgccctgaccctctgcgatactccatgttctcc

SEQ ID NO: 165129 - DNA, 35 bp, Artificial Sequence
  Synthetic oligonucleotide
atagtgcacctcctcatgcctcaccagagaggtcc

SEQ ID NO: 165130 - DNA, 35 bp, Artificial Sequence
  Synthetic oligonucleotide
gatcatcgctccccttccgttcggttggtttgtcc

SEQ ID NO: 165131 - DNA, 35 bp, Artificial Sequence
  Synthetic oligonucleotide
tctgcgcgcgaattggtaacccgctgttgtcttcc

SEQ ID NO: 165132 - DNA, 35 bp, Artificial Sequence
  Synthetic oligonucleotide
tcatcccactggtggtaaaaccccgcgatcctcgc

SEQ ID NO: 165133 - DNA, 35 bp, Artificial Sequence
  Synthetic oligonucleotide
gcgaacatccgcggtctcgcctcacatcctttcgc

SEQ ID NO: 165134 - DNA, 35 bp, Artificial Sequence
  Synthetic oligonucleotide
tgacctgtcccacgtgcacccaccctccgcccggc

SEQ ID NO: 165135 - DNA, 35 bp, Artificial Sequence
  Synthetic oligonucleotide
tctccaccctactgcctttactatagcacgcttgc

SEQ ID NO: 165136 - DNA, 35 bp, Artificial Sequence
  Synthetic oligonucleotide
acgcattacagtccggcgtgcgcctcttctgcctc

SEQ ID NO: 165137 - DNA, 35 bp, Artificial Sequence
  Synthetic oligonucleotide
actgtcatgctgtccttgccgtccacgccactgtc

SEQ ID NO: 165138 - DNA, 35 bp, Artificial Sequence
  Synthetic oligonucleotide
gacgtcccacgagcccctttcgttcctgacttgtc

SEQ ID NO: 165139 - DNA, 35 bp, Artificial Sequence
  Synthetic oligonucleotide
gcccacgatgcttggatccctcgcctccctcattc

SEQ ID NO: 165140 - DNA, 35 bp, Artificial Sequence
  Synthetic oligonucleotide
gtgaggggaaaggaaggggtgaaggagaatgagag

SEQ ID NO: 165141 - DNA, 35 bp, Artificial Sequence
  Synthetic oligonucleotide
tgtgtcaacggtcgcttcctttcgtctttcccacg

SEQ ID NO: 165142 - DNA, 35 bp, Artificial Sequence
  Synthetic oligonucleotide
ccgacccccgtgctcacagccgccgctagtgcacg

SEQ ID NO: 165143 - DNA, 35 bp, Artificial Sequence
  Synthetic oligonucleotide
gtcgctagagcaggtgtacgtactaccctccgccg

SEQ ID NO: 165144 - DNA, 35 bp, Artificial Sequence
  Synthetic oligonucleotide
gagcgctagcctccttatttcctgccatctcgccg

SEQ ID NO: 165145 - DNA, 35 bp, Artificial Sequence
  Synthetic oligonucleotide
tttggcgcacgaaatgcgggtgtggggggtgaggg

SEQ ID NO: 165146 - DNA, 34 bp, Artificial Sequence
  Synthetic oligonucleotide
gagggggcggggacatggcaaccggcggctaggg

SEQ ID NO: 165147 - DNA, 34 bp, Artificial Sequence
  Synthetic oligonucleotide
gaccatgacactggttcacttctctcagcccctg

SEQ ID NO: 165148 - DNA, 35 bp, Artificial Sequence
  Synthetic oligonucleotide
gccacatcacgagcaggtcttcttgatatctcctg

SEQ ID NO: 165149 - DNA, 35 bp, Artificial Sequence
  Synthetic oligonucleotide
gcccccgttccccttgatcccgttcctactcgttg

SEQ ID NO: 165150 - DNA, 35 bp, Artificial Sequence
  Synthetic oligonucleotide
accctcatccgtacctcctgttatttgtctattat

SEQ ID NO: 165151 - DNA, 35 bp, Artificial Sequence
  Synthetic oligonucleotide
tacgtgtcatgccatctggcgcgtaactatcacct

SEQ ID NO: 165152 - DNA, 35 bp, Artificial Sequence
  Synthetic oligonucleotide
ttggcgtccggtcacctcccacattccctgcgcct

SEQ ID NO: 165153 - DNA, 35 bp, Artificial Sequence
  Synthetic oligonucleotide
gcactcctccgaacccgccctgcctgtttaccagt

SEQ ID NO: 165154 - DNA, 35 bp, Artificial Sequence
  Synthetic oligonucleotide
tcatgttagacctgtccgtccctcgtcgttcccgt

SEQ ID NO: 165155 - DNA, 35 bp, Artificial Sequence
  Synthetic oligonucleotide
gtcacaggccgaatctatgaggttgccccccttgt

SEQ ID NO: 165156 - DNA, 35 bp, Artificial Sequence; identical to SEQ ID NO: 68214
  Synthetic oligonucleotide

SEQ ID NO: 165157 - DNA, 35 bp, Artificial Sequence
  Synthetic oligonucleotide
acaaatcgcccacaggccccgcgctctcgttcctt

SEQ ID NO: 165158 - DNA, 35 bp, Artificial Sequence
  Synthetic oligonucleotide
gtcccatccgttgtctccctgttttccgtaggctt

SEQ ID NO: 165159 - DNA, 35 bp, Artificial Sequence
  Synthetic oligonucleotide
gcccacacactgtcacttgttcgctgtccttggtt

SEQ ID NO: 165160 - DNA, 35 bp, Artificial Sequence
  Synthetic oligonucleotide
gatggactcacccccatcctgttacttttgccttt

SEQ ID NO: 165161 - DNA, 35 bp, Artificial Sequence
  Synthetic oligonucleotide
gcctacacctcattccgtctacttgatactgcttt

SEQ ID NO: 165162 - DNA, 35 bp, Artificial Sequence
  Synthetic oligonucleotide
tgaggtcagtaccgccttcgctacccgctcccaaa

SEQ ID NO: 165163 - DNA, 36 bp, Artificial Sequence
  Synthetic oligonucleotide
tcgagggggagcgaggacaatgagatggaggtagaa

SEQ ID NO: 165164 - DNA, 36 bp, Artificial Sequence
  Synthetic oligonucleotide
accaccatccggtgcaattttctgttttttgcttaa

SEQ ID NO: 165165 - DNA, 36 bp, Artificial Sequence
  Synthetic oligonucleotide
tcgagagctggcagatcttcttgatccatcttcaca

SEQ ID NO: 165166 - DNA, 35 bp, Artificial Sequence
  Synthetic oligonucleotide
gtccccgctatcataatgcgatttaggcctctaca

SEQ ID NO: 165167 - DNA, 35 bp, Artificial Sequence
  Synthetic oligonucleotide
gtcgcgaaagtgctatataccacccgaccctccca

SEQ ID NO: 165168 - DNA, 36 bp, Artificial Sequence
  Synthetic oligonucleotide
tacgcatctttttcgccaccgctgtcttttacgcca

SEQ ID NO: 165169 - DNA, 36 bp, Artificial Sequence
  Synthetic oligonucleotide
tacgcgccgtaacaggtcgcaccttcatcaccgcca

SEQ ID NO: 165170 - DNA, 36 bp, Artificial Sequence
  Synthetic oligonucleotide
tgtgcaatgcccgctattttctttgttccccgtcca

SEQ ID NO: 165171 - DNA, 36 bp, Artificial Sequence
  Synthetic oligonucleotide
gcaagcggcaatcagtacttgttgtccgcccttcca

SEQ ID NO: 165172 - DNA, 36 bp, Artificial Sequence
  Synthetic oligonucleotide
agcacttccccgcttggtctttttgcctgccttcca

SEQ ID NO: 165173 - DNA, 35 bp, Artificial Sequence
  Synthetic oligonucleotide
tcagtaccacgcactgttctcttcgatttgccgca

SEQ ID NO: 165174 - DNA, 35 bp, Artificial Sequence
  Synthetic oligonucleotide
tcctcacttcgatgctctgcgcaatcctctcctca

SEQ ID NO: 165175 - DNA, 36 bp, Artificial Sequence
  Synthetic oligonucleotide
atccacatcatgccctcgcttcaagaactgtgctca

SEQ ID NO: 165176 - DNA, 37 bp, Artificial Sequence
  Synthetic oligonucleotide
gtagcggtgggggtgaagggaggagagggctgaaaga

SEQ ID NO: 165177 - DNA, 37 bp, Artificial Sequence
  Synthetic oligonucleotide
gcgcattgcgcccccctctgttcgtccgtgcttaaga

SEQ ID NO: 165178 - DNA, 35 bp, Artificial Sequence
  Synthetic oligonucleotide
gtgttgccgctccacctttatcatgcacttgcaga

SEQ ID NO: 165179 - DNA, 37 bp, Artificial Sequence
  Synthetic oligonucleotide
tgagttgtgtcgcctgttctccgccaccgtcccccga

SEQ ID NO: 165180 - DNA, 36 bp, Artificial Sequence
  Synthetic oligonucleotide
gtgttcttcgcgctgtcccccgtcctcattcgccga

SEQ ID NO: 165181 - DNA, 37 bp, Artificial Sequence
  Synthetic oligonucleotide
atccacctccatctccggacgcgtttacaaatcgcga

SEQ ID NO: 165182 - DNA, 37 bp, Artificial Sequence
  Synthetic oligonucleotide
taagcgaacgaggggaacagctaggggaaggaggcga

SEQ ID NO: 165183 - DNA, 37 bp, Artificial Sequence
  Synthetic oligonucleotide
tcagtcatctgctcgcttctatgcctttcctgttcga

SEQ ID NO: 165184 - DNA, 37 bp, Artificial Sequence
  Synthetic oligonucleotide
aatcgggtgggagtgggcataaaaaggggcaaacgga

SEQ ID NO: 165185 - DNA, 37 bp, Artificial Sequence
  Synthetic oligonucleotide
tagcacccccattgtcgctccgtgtctcccccccgga

SEQ ID NO: 165186 - DNA, 37 bp, Artificial Sequence
  Synthetic oligonucleotide
aaccaccatcgaggcgcaatgctctgttacctccgga

SEQ ID NO: 165187 - DNA, 37 bp, Artificial Sequence
  Synthetic oligonucleotide
agtgggatagggtggggcttaggtaacaatggaggga

SEQ ID NO: 165188 - DNA, 37 bp, Artificial Sequence
  Synthetic oligonucleotide
gtggggttcgaggagggacgaagcaggggatccggga

SEQ ID NO: 165189 - DNA, 37 bp, Artificial Sequence
  Synthetic oligonucleotide
gtaccagagggaggacggttggcgggtaggggcggga

SEQ ID NO: 165190 - DNA, 36 bp, Artificial Sequence
  Synthetic oligonucleotide
tcaggggcggggcgggtctaaaccaagggacgggga

SEQ ID NO: 165191 - DNA, 38 bp, Artificial Sequence
  Synthetic oligonucleotide
gcaggcctcccaattgtacttgcccccatgccccatga

SEQ ID NO: 165192 - DNA, 38 bp, Artificial Sequence
  Synthetic oligonucleotide
gattccccccccactgcttatagtccgaccgttactga

SEQ ID NO: 165193 - DNA, 37 bp, Artificial Sequence
  Synthetic oligonucleotide
aaggggggggtcggtgtaatggggagagggcagctga

SEQ ID NO: 165194 - DNA, 37 bp, Artificial Sequence
  Synthetic oligonucleotide
ttagctaagcgccgccgcctacgttcctcctgtctga

SEQ ID NO: 165195 - DNA, 38 bp, Artificial Sequence
  Synthetic oligonucleotide
gaaccggaaggaacaggcgggaaggggagggtaagtga

SEQ ID NO: 165196 - DNA, 38 bp, Artificial Sequence
  Synthetic oligonucleotide
aacacccccgccaacggaccctccccactaagtggtga

SEQ ID NO: 165197 - DNA, 38 bp, Artificial Sequence
  Synthetic oligonucleotide
gactgtccgggaggggggagcgagggtaataacattga

SEQ ID NO: 165198 - DNA, 37 bp, Artificial Sequence
  Synthetic oligonucleotide
tgccgacgccgccttacccagctccctcgctgattga

SEQ ID NO: 165199 - DNA, 38 bp, Artificial Sequence
  Synthetic oligonucleotide
tgagcaaccgccccaccgtaacttgccctcattattga

SEQ ID NO: 165200 - DNA, 36 bp, Artificial Sequence
  Synthetic oligonucleotide
accatccatcctgtttaaatctggccttcttattga

SEQ ID NO: 165201 - DNA, 38 bp, Artificial Sequence
  Synthetic oligonucleotide
tctgctagccccagccgcctctaataactgcctcttga

SEQ ID NO: 165202 - DNA, 38 bp, Artificial Sequence
  Synthetic oligonucleotide
gacgccccgtgcgtatactccccttcgtatgttcttga

SEQ ID NO: 165203 - DNA, 35 bp, Artificial Sequence
  Synthetic oligonucleotide
gcatgaggggggtagttgaaagtgaggagcgttga

SEQ ID NO: 165204 - DNA, 37 bp, Artificial Sequence
  Synthetic oligonucleotide
aaactgcagggcaagggacgggatggatgggctttga

SEQ ID NO: 165205 - DNA, 37 bp, Artificial Sequence
  Synthetic oligonucleotide
tccagcggcgctcatctccctccctgctccggtttga

SEQ ID NO: 165206 - DNA, 35 bp, Artificial Sequence
  Synthetic oligonucleotide
actcgggtccccctcgccctccgtttttcacgata

SEQ ID NO: 165207 - DNA, 36 bp, Artificial Sequence
  Synthetic oligonucleotide
gtggaggaggaagcgagcggagcggagacatgagta

SEQ ID NO: 165208 - DNA, 36 bp, Artificial Sequence
  Synthetic oligonucleotide
gacaacagagggaaagtgaagatggaggtgaaggta

SEQ ID NO: 165209 - DNA, 36 bp, Artificial Sequence
  Synthetic oligonucleotide
gagaggggacggagggatatatatcatttgatggta

SEQ ID NO: 165210 - DNA, 36 bp, Artificial Sequence
  Synthetic oligonucleotide
agccccgcccgtgacctcagctgaccttaccgttta

SEQ ID NO: 165211 - DNA, 35 bp, Artificial Sequence
  Synthetic oligonucleotide
gcccgacctcatatttgcaccattccccagtttta

SEQ ID NO: 165212 - DNA, 35 bp, Artificial Sequence
  Synthetic oligonucleotide
tccaaaccattgcagagtgctcccaccgctaacac

SEQ ID NO: 165213 - DNA, 35 bp, Artificial Sequence
  Synthetic oligonucleotide
acctccactgtccactcacaatcacctttgtagac

SEQ ID NO: 165214 - DNA, 35 bp, Artificial Sequence
  Synthetic oligonucleotide
acggaacaccccgccacatacttgaaccccctgac

SEQ ID NO: 165215 - DNA, 35 bp, Artificial Sequence
  Synthetic oligonucleotide
tcctcattgcctgggatatcgaccccctcctctac

SEQ ID NO: 165216 - DNA, 35 bp, Artificial Sequence
  Synthetic oligonucleotide
ggtccccgaccggttgcttggcacttcgcaccacc

SEQ ID NO: 165217 - DNA, 35 bp, Artificial Sequence
  Synthetic oligonucleotide
tccactcccattgccccgacgtggcctagtgcccc

SEQ ID NO: 165218 - DNA, 35 bp, Artificial Sequence
  Synthetic oligonucleotide
ttgccgttcgcctccattttagtgcacaatgtccc

SEQ ID NO: 165219 - DNA, 35 bp, Artificial Sequence
  Synthetic oligonucleotide
gctgcttattgagcctgttccccctcctgcccgcc

SEQ ID NO: 165220 - DNA, 35 bp, Artificial Sequence
  Synthetic oligonucleotide
tcctgctgaagccgtcaaggctgctttttcccgcc

SEQ ID NO: 165221 - DNA, 35 bp, Artificial Sequence
  Synthetic oligonucleotide
gatatagcctgccctcttttaccgttctaggtgcc

SEQ ID NO: 165222 - DNA, 35 bp, Artificial Sequence
  Synthetic oligonucleotide
tctgacgcacgttggtcaatagccccctcatccgc

SEQ ID NO: 165223 - DNA, 35 bp, Artificial Sequence
  Synthetic oligonucleotide
gtttcgcgccgttcctcccaatcctctgaccatgc

SEQ ID NO: 165224 - DNA, 35 bp, Artificial Sequence
  Synthetic oligonucleotide
tgtcgtgccacatctgggcccatttcgatccttgc

SEQ ID NO: 165225 - DNA, 37 bp, Artificial Sequence
  Synthetic oligonucleotide
gtcccatctccgccaccgtgccgtttctttcctgatc

SEQ ID NO: 165226 - DNA, 35 bp, Artificial Sequence
  Synthetic oligonucleotide
accctcattcgccccattacggagttccgtgtatc

SEQ ID NO: 165227 - DNA, 35 bp, Artificial Sequence
  Synthetic oligonucleotide
taggagcgacaaggtcgccgttacagccccccctc

SEQ ID NO: 165228 - DNA, 35 bp, Artificial Sequence
  Synthetic oligonucleotide
gtcacttcagcggaaaacttcatctgcctgccctc

SEQ ID NO: 165229 - DNA, 35 bp, Artificial Sequence
  Synthetic oligonucleotide
gatcacaccgttacaatgccttgccgcccccgctc

SEQ ID NO: 165230 - DNA, 35 bp, Artificial Sequence
  Synthetic oligonucleotide
tccgccccttactgccgacgtttcgatccttggtc

SEQ ID NO: 165231 - DNA, 35 bp, Artificial Sequence
  Synthetic oligonucleotide
agcccgcgccatccaaagcgtgtcgatccctgttc

SEQ ID NO: 165232 - DNA, 35 bp, Artificial Sequence
  Synthetic oligonucleotide
tcgcacacgcgcggcgcgagctattttgcctgttc

SEQ ID NO: 165233 - DNA, 35 bp, Artificial Sequence
  Synthetic oligonucleotide
gacccccgaagtaaccctcgttgacctctgccacg

SEQ ID NO: 165234 - DNA, 35 bp, Artificial Sequence
  Synthetic oligonucleotide
tatccttccaccctctgaacgcctccacttcgacg

SEQ ID NO: 165235 - DNA, 35 bp, Artificial Sequence
  Synthetic oligonucleotide
tattgcacgtcccggccttgaacgttctacctacg

SEQ ID NO: 165236 - DNA, 35 bp, Artificial Sequence
  Synthetic oligonucleotide
tcatgtacgcagtataccatattcacccctttccg

SEQ ID NO: 165237 - DNA, 35 bp, Artificial Sequence
  Synthetic oligonucleotide
ggtatacgcccactaggttaggtccctcgctctcg

SEQ ID NO: 165238 - DNA, 35 bp, Artificial Sequence
  Synthetic oligonucleotide
acgtactctgccctcacacaatgctctatcctctg

SEQ ID NO: 165239 - DNA, 35 bp, Artificial Sequence
  Synthetic oligonucleotide
tgtcgtaccacccgatccatttgtccaccgttttg

SEQ ID NO: 165240 - DNA, 35 bp, Artificial Sequence
  Synthetic oligonucleotide
tcacattgtgccgtcacccttcaaccgcgtgccat

SEQ ID NO: 165241 - DNA, 35 bp, Artificial Sequence
  Synthetic oligonucleotide
acgaaaggtggaggaaggggctaacacggaactat

SEQ ID NO: 165242 - DNA, 35 bp, Artificial Sequence
  Synthetic oligonucleotide
gtgtcctccgctgactaccgctttaattactcact

SEQ ID NO: 165243 - DNA, 35 bp, Artificial Sequence
  Synthetic oligonucleotide
acgcggttctcatcatctgttccacctacgtcact

SEQ ID NO: 165244 - DNA, 35 bp, Artificial Sequence
  Synthetic oligonucleotide
atgttactatgccgccttcacatctggccccacct

SEQ ID NO: 165245 - DNA, 35 bp, Artificial Sequence
  Synthetic oligonucleotide
gccaggcaaattctgtaacaccccgtccctgccct

SEQ ID NO: 165246 - DNA, 35 bp, Artificial Sequence
  Synthetic oligonucleotide
tagcagtcagtgtgggcctgtactcgtccctccct

SEQ ID NO: 165247 - DNA, 35 bp, Artificial Sequence
  Synthetic oligonucleotide
tcaggacagcgctctcgccgtcctaagttttccct

SEQ ID NO: 165248 - DNA, 35 bp, Artificial Sequence
  Synthetic oligonucleotide
tcgtcccacctacgaagtgccctgtccgaacgcct

SEQ ID NO: 165249 - DNA, 35 bp, Artificial Sequence
  Synthetic oligonucleotide
gtgtgtccacgcccctacccgttcgtcttcgtcct

SEQ ID NO: 165250 - DNA, 35 bp, Artificial Sequence
  Synthetic oligonucleotide
ttgcctctgtgcacgtacatgcaggccttttctct

SEQ ID NO: 165251 - DNA, 35 bp, Artificial Sequence
  Synthetic oligonucleotide
tgccagccgggctcggccccggttcttgcccttct

SEQ ID NO: 165252 - DNA, 35 bp, Artificial Sequence
  Synthetic oligonucleotide
gctggcacacgcacacatagctacacactcgttct

SEQ ID NO: 165253 - DNA, 35 bp, Artificial Sequence
  Synthetic oligonucleotide
ttacggggtggacgggtgggagaagcacgcgtagt

SEQ ID NO: 165254 - DNA, 35 bp, Artificial Sequence
  Synthetic oligonucleotide
actcctgcacctgtcacggaacccacacctcccgt

SEQ ID NO: 165255 - DNA, 35 bp, Artificial Sequence
  Synthetic oligonucleotide
tcacccctcaccctcgcggaccagccagccgcggt

SEQ ID NO: 165256 - DNA, 35 bp, Artificial Sequence
  Synthetic oligonucleotide
gggtggtaaaatgcaagggaggcggtaggaggtgt

SEQ ID NO: 165257 - DNA, 35 bp, Artificial Sequence
  Synthetic oligonucleotide
tcaactccctctgcctgtcgattactcgttccatt

SEQ ID NO: 165258 - DNA, 35 bp, Artificial Sequence
  Synthetic oligonucleotide
gtgtcgccaactcctctccgataacgggtgccctt

SEQ ID NO: 165259 - DNA, 35 bp, Artificial Sequence
  Synthetic oligonucleotide
gcgcttccctctgccacaccccctcctgctcggtt

SEQ ID NO: 165260 - DNA, 35 bp, Artificial Sequence
  Synthetic oligonucleotide
accgagccctccctttttgccatagaacacgggtt

SEQ ID NO: 165261 - DNA, 35 bp, Artificial Sequence
  Synthetic oligonucleotide
ttgctttgccgcaccctttcctgcatttccctgtt

SEQ ID NO: 165262 - DNA, 35 bp, Artificial Sequence
  Synthetic oligonucleotide
gtcatcgctcctctgcggttgttccctactgtttt

SEQ ID NO: 165263 - DNA, 34 bp, Artificial Sequence
  Synthetic oligonucleotide
agtgggggacagggggagttgcgggaggactaaa

SEQ ID NO: 165264 - DNA, 36 bp, Artificial Sequence
  Synthetic oligonucleotide
tccgcccgcccccccgtcttatttttcagccggtaa

SEQ ID NO: 165265 - DNA, 35 bp, Artificial Sequence
  Synthetic oligonucleotide
gtgctgctcgccgttactgtctgcactctttttaa

SEQ ID NO: 165266 - DNA, 35 bp, Artificial Sequence
  Synthetic oligonucleotide
atcgcattcacccgccccgccaactggttgacaca

SEQ ID NO: 165267 - DNA, 35 bp, Artificial Sequence
  Synthetic oligonucleotide
gtccagcctcccgcatctcttgctaccatgaccca

SEQ ID NO: 165268 - DNA, 35 bp, Artificial Sequence
  Synthetic oligonucleotide
gcatccttcgtccgtattctttttagtccccccca

SEQ ID NO: 165269 - DNA, 35 bp, Artificial Sequence
  Synthetic oligonucleotide
ggggagtcgcctcgattcatttcctcttcgcccca

SEQ ID NO: 165270 - DNA, 36 bp, Artificial Sequence
  Synthetic oligonucleotide
gtctgccatcacctttctttgtgccactggtcccca

SEQ ID NO: 165271 - DNA, 36 bp, Artificial Sequence
  Synthetic oligonucleotide
gagccacccatcggtcccaggcgtatatctccgcca

SEQ ID NO: 165272 - DNA, 35 bp, Artificial Sequence
  Synthetic oligonucleotide
gcctttgcccccgagtggactgctcacctttgcca

SEQ ID NO: 165273 - DNA, 36 bp, Artificial Sequence
  Synthetic oligonucleotide
atttgcggcactgtacattcgttgcccgtacctcca

SEQ ID NO: 165274 - DNA, 35 bp, Artificial Sequence
  Synthetic oligonucleotide
gcaaccgcacatcatagcaaccccatcacccatca

SEQ ID NO: 165275 - DNA, 36 bp, Artificial Sequence
  Synthetic oligonucleotide
tcccgcgtctgttctctccccccctgttccgcatca

SEQ ID NO: 165276 - DNA, 35 bp, Artificial Sequence
  Synthetic oligonucleotide
ttgcccagcactccagaacgcacgatcgcccctca

SEQ ID NO: 165277 - DNA, 36 bp, Artificial Sequence
  Synthetic oligonucleotide
acagacctctggcgtcatcagacgtcctcgccctca

SEQ ID NO: 165278 - DNA, 35 bp, Artificial Sequence
  Synthetic oligonucleotide
ggttccactccctgattactgtcgccatttgctca

SEQ ID NO: 165279 - DNA, 35 bp, Artificial Sequence
  Synthetic oligonucleotide
gtgtatgctgtaccttccctgtcctgccgagttca

SEQ ID NO: 165280 - DNA, 37 bp, Artificial Sequence
  Synthetic oligonucleotide
accacgcgcgaacactccgttgcttttgtaccaccga

SEQ ID NO: 165281 - DNA, 37 bp, Artificial Sequence
  Synthetic oligonucleotide
gacccttgccacattctgattatcacacgttccccga

SEQ ID NO: 165282 - DNA, 37 bp, Artificial Sequence
  Synthetic oligonucleotide
gtgatggggtggggggataggtgaggtctttcggcga

SEQ ID NO: 165283 - DNA, 37 bp, Artificial Sequence
  Synthetic oligonucleotide
tagtaacagtgggacgggtggggggaactgggaggga

SEQ ID NO: 165284 - DNA, 36 bp, Artificial Sequence
  Synthetic oligonucleotide
gtagacgctccgtcccccctgttcctgttcgtatga

SEQ ID NO: 165285 - DNA, 37 bp, Artificial Sequence
  Synthetic oligonucleotide
gccccactctatccgcgtaaagggctcacccacctga

SEQ ID NO: 165286 - DNA, 36 bp, Artificial Sequence
  Synthetic oligonucleotide
tagtattcgctgacgttgttacgccccaccccctga

SEQ ID NO: 165287 - DNA, 38 bp, Artificial Sequence
  Synthetic oligonucleotide
gcaccctcacaccttattgcactggactgtgcccctga

SEQ ID NO: 165288 - DNA, 37 bp, Artificial Sequence
  Synthetic oligonucleotide
atgcacccgtggaacgtccccatcccaccttccctga

SEQ ID NO: 165289 - DNA, 35 bp, Artificial Sequence
  Synthetic oligonucleotide
gtgcccactatccgccggtcccagacttatcctga

SEQ ID NO: 165290 - DNA, 38 bp, Artificial Sequence
  Synthetic oligonucleotide
acactcccgcattcctgtatctcctgcccgcacgctga

SEQ ID NO: 165291 - DNA, 38 bp, Artificial Sequence
  Synthetic oligonucleotide
gccgtgggggggttaggagagggagccagaaaacgtga

SEQ ID NO: 165292 - DNA, 38 bp, Artificial Sequence
  Synthetic oligonucleotide
tcccactcagcgcccgcaccgccaccagctccacgtga

SEQ ID NO: 165293 - DNA, 36 bp, Artificial Sequence
  Synthetic oligonucleotide
tcgcatcctcctccgtgtccgtgcattaccgcgtga

SEQ ID NO: 165294 - DNA, 38 bp, Artificial Sequence
  Synthetic oligonucleotide
gaggtgagttcgagaggtaggggggacggtggaggtga

SEQ ID NO: 165295 - DNA, 38 bp, Artificial Sequence
  Synthetic oligonucleotide
agcggacgggcgggtgggggcaggtggatctacggtga

SEQ ID NO: 165296 - DNA, 36 bp, Artificial Sequence
  Synthetic oligonucleotide
tacccgttacccttagctgcctcccaccatcggtga

SEQ ID NO: 165297 - DNA, 38 bp, Artificial Sequence
  Synthetic oligonucleotide
gattaaacgtcagggggaggggtgacggaggatggtga

SEQ ID NO: 165298 - DNA, 38 bp, Artificial Sequence
  Synthetic oligonucleotide
tctacccgtcagctgccttgcatgcctgccccttgtga

SEQ ID NO: 165299 - DNA, 38 bp, Artificial Sequence
  Synthetic oligonucleotide
tcacgtcgcacgctccccagagggccactctaccttga

SEQ ID NO: 165300 - DNA, 37 bp, Artificial Sequence
  Synthetic oligonucleotide
gacgcccatcacttctgtctcaattctgccatcttga

SEQ ID NO: 165301 - DNA, 36 bp, Artificial Sequence
  Synthetic oligonucleotide
tggtcaccggcctcagttcaacccgtcaccccccta

SEQ ID NO: 165302 - DNA, 35 bp, Artificial Sequence
  Synthetic oligonucleotide
gacccaccgtattattatgcccatcacgatcccta

SEQ ID NO: 165303 - DNA, 35 bp, Artificial Sequence
  Synthetic oligonucleotide
gatcctatgcctccatcccgtcccgcgatagccta

SEQ ID NO: 165304 - DNA, 36 bp, Artificial Sequence
  Synthetic oligonucleotide
tacgcctctacccgcagttttattttatcacctcta

SEQ ID NO: 165305 - DNA, 36 bp, Artificial Sequence
  Synthetic oligonucleotide
ggtctacgggcggagggggaggaccggggggcggta

SEQ ID NO: 165306 - DNA, 35 bp, Artificial Sequence
  Synthetic oligonucleotide
gggagggtgttcgggtgggaggtagaaatgcggta

SEQ ID NO: 165307 - DNA, 36 bp, Artificial Sequence
  Synthetic oligonucleotide
gtccgccccgcatcctcctgaacgttgctactggta

SEQ ID NO: 165308 - DNA, 36 bp, Artificial Sequence
  Synthetic oligonucleotide
ttcaggcgcctttaagtgccttccgccttcccctta

SEQ ID NO: 165309 - DNA, 36 bp, Artificial Sequence
  Synthetic oligonucleotide
gtacaccatcggctccctacttccagctcaccgtta

SEQ ID NO: 165310 - DNA, 35 bp, Artificial Sequence
  Synthetic oligonucleotide
gcctcgggtccacctcgatcttccccccgtcgcac

SEQ ID NO: 165311 - DNA, 35 bp, Artificial Sequence
  Synthetic oligonucleotide
gcacccacttagcgtcgacaccgctcctttgtcac

SEQ ID NO: 165312 - DNA, 35 bp, Artificial Sequence
  Synthetic oligonucleotide
caaacgccattgttcgccccagtcctctcgcctac

SEQ ID NO: 165313 - DNA, 35 bp, Artificial Sequence
  Synthetic oligonucleotide
tttggcaggcccgatccctccctgtcttccgaacc

SEQ ID NO: 165314 - DNA, 35 bp, Artificial Sequence
  Synthetic oligonucleotide
tttccacgcaccctccctcacgcagtcgcaatacc

SEQ ID NO: 165315 - DNA, 35 bp, Artificial Sequence
  Synthetic oligonucleotide
aggacgtccctggctcttgaggcccgcgcccaccc

SEQ ID NO: 165316 - DNA, 35 bp, Artificial Sequence
  Synthetic oligonucleotide
accccatgcgtaccggtctatcgccaccgtgcccc

SEQ ID NO: 165317 - DNA, 35 bp, Artificial Sequence
  Synthetic oligonucleotide
gaaagcacccaggaatgtctcctcctgccgtcccc

SEQ ID NO: 165318 - DNA, 35 bp, Artificial Sequence
  Synthetic oligonucleotide
ttgtacatcatcacactgccgcaatggccccgccc

SEQ ID NO: 165319 - DNA, 35 bp, Artificial Sequence
  Synthetic oligonucleotide
tgtcgggagtccatctgccatctatatgcctgccc

SEQ ID NO: 165320 - DNA, 35 bp, Artificial Sequence
  Synthetic oligonucleotide
atttcagcgcttgttcccttttccgttacgtgccc

SEQ ID NO: 165321 - DNA, 35 bp, Artificial Sequence
  Synthetic oligonucleotide
agttcacctcccccctgtggacggcctgcttgccc

SEQ ID NO: 165322 - DNA, 35 bp, Artificial Sequence
  Synthetic oligonucleotide
agagctgcagagttgcttactccccgccatccgcc

SEQ ID NO: 165323 - DNA, 35 bp, Artificial Sequence
  Synthetic oligonucleotide
agatgcaccgtaccagacccaccccttattctgcc

SEQ ID NO: 165324 - DNA, 35 bp, Artificial Sequence
  Synthetic oligonucleotide
ttcagtgccccgctctatcccagatttcactatcc

SEQ ID NO: 165325 - DNA, 35 bp, Artificial Sequence
  Synthetic oligonucleotide
aatggtacatgcaccggccattgctacttccgtcc

SEQ ID NO: 165326 - DNA, 35 bp, Artificial Sequence
  Synthetic oligonucleotide
acgacggcgctcccgttctgcatcaccagtggtcc

SEQ ID NO: 165327 - DNA, 35 bp, Artificial Sequence
  Synthetic oligonucleotide
tcgttcctccctcgatccgttttagtgctatgtcc

SEQ ID NO: 165328 - DNA, 35 bp, Artificial Sequence
  Synthetic oligonucleotide
gtaagctcatccagaagtttccctgctccttgtcc

SEQ ID NO: 165329 - DNA, 35 bp, Artificial Sequence
  Synthetic oligonucleotide
gccgttcagcactctcgccccgccttgcgccgcgc

SEQ ID NO: 165330 - DNA, 35 bp, Artificial Sequence
  Synthetic oligonucleotide
gccctacgtcagatccaatgcctccaccggttcgc

SEQ ID NO: 165331 - DNA, 35 bp, Artificial Sequence
  Synthetic oligonucleotide
aacacctgctacaccaaccagtcctcagtctctgc

SEQ ID NO: 165332 - DNA, 35 bp, Artificial Sequence
  Synthetic oligonucleotide
gatcaaccccgacgtataggccgttatgcccaatc

SEQ ID NO: 165333 - DNA, 35 bp, Artificial Sequence
  Synthetic oligonucleotide
tagcgccgacctcggttctccatcgcgagtccctc

SEQ ID NO: 165334 - DNA, 35 bp, Artificial Sequence
  Synthetic oligonucleotide
tgacacactcctgtcatgaaggtcgatcgcctctc

SEQ ID NO: 165335 - DNA, 35 bp, Artificial Sequence
  Synthetic oligonucleotide
gcccagtcagtgtttgcctgcttcccaatcgcgtc

SEQ ID NO: 165336 - DNA, 35 bp, Artificial Sequence
  Synthetic oligonucleotide
gtgtcccccaccgattcacacgcgcatgttccttc

SEQ ID NO: 165337 - DNA, 35 bp, Artificial Sequence
  Synthetic oligonucleotide
gacgccggtccccgctccacctttaatagcttttc

SEQ ID NO: 165338 - DNA, 35 bp, Artificial Sequence
  Synthetic oligonucleotide
ttggagcatccccgttctgttcgcacctcccttag

SEQ ID NO: 165339 - DNA, 35 bp, Artificial Sequence
  Synthetic oligonucleotide
acctcagtccctccctcccgccacctggcccaccg

SEQ ID NO: 165340 - DNA, 35 bp, Artificial Sequence
  Synthetic oligonucleotide
atccccgccaacacatcgcttaacccacctatccg

SEQ ID NO: 165341 - DNA, 35 bp, Artificial Sequence
  Synthetic oligonucleotide
atggacgggataaaggcggattagacaagggaggg

SEQ ID NO: 165342 - DNA, 35 bp, Artificial Sequence
  Synthetic oligonucleotide
gtgaggggagggtacaggggattaacactggaatg

SEQ ID NO: 165343 - DNA, 35 bp, Artificial Sequence
  Synthetic oligonucleotide
tctcaaactcctccatgtcccgcgcacttgtcgtg

SEQ ID NO: 165344 - DNA, 35 bp, Artificial Sequence
  Synthetic oligonucleotide
attcctctcgcgcacctctgttggttccccttttg

SEQ ID NO: 165345 - DNA, 35 bp, Artificial Sequence
  Synthetic oligonucleotide
tgttctaccctcctgagttgcgcatactatttcat

SEQ ID NO: 165346 - DNA, 35 bp, Artificial Sequence
  Synthetic oligonucleotide
acttgacgcctctttgcttgttcctcgatgccgat

SEQ ID NO: 165347 - DNA, 35 bp, Artificial Sequence
  Synthetic oligonucleotide
aacacgtagattctgctacggtacacctcttctat

SEQ ID NO: 165348 - DNA, 35 bp, Artificial Sequence
  Synthetic oligonucleotide
atctgccccgggcgtcactactcctctcatgaact

SEQ ID NO: 165349 - DNA, 35 bp, Artificial Sequence
  Synthetic oligonucleotide
gactttgcctcatctaggtcctcatgctacacact

SEQ ID NO: 165350 - DNA, 35 bp, Artificial Sequence
  Synthetic oligonucleotide
gtcgtgccgtttagttgcagttttcgtccgcccct

SEQ ID NO: 165351 - DNA, 35 bp, Artificial Sequence
  Synthetic oligonucleotide
gacattggcgtcggtgtcttctgtctcccgcttct

SEQ ID NO: 165352 - DNA, 35 bp, Artificial Sequence
  Synthetic oligonucleotide
ttgcacatcccattaagtctgcgctccttttttct

SEQ ID NO: 165353 - DNA, 35 bp, Artificial Sequence
  Synthetic oligonucleotide
tttgcccgcagtccgccgttacttcttgcatttgt

SEQ ID NO: 165354 - DNA, 35 bp, Artificial Sequence
  Synthetic oligonucleotide
gtgtgaccgcaatgttttgccaccttttcactatt

SEQ ID NO: 165355 - DNA, 35 bp, Artificial Sequence
  Synthetic oligonucleotide
tcaggagcacgctaccgacctcttgatctcacctt

SEQ ID NO: 165356 - DNA, 35 bp, Artificial Sequence
  Synthetic oligonucleotide
actatccacctccaccctggtttggccttttccaa

SEQ ID NO: 165357 - DNA, 35 bp, Artificial Sequence
  Synthetic oligonucleotide
gtgctatggaggaggaacggtgatatggtgggcaa

SEQ ID NO: 165358 - DNA, 35 bp, Artificial Sequence
  Synthetic oligonucleotide
agcgggagacgaagggtggtgcggtggatttggaa

SEQ ID NO: 165359 - DNA, 36 bp, Artificial Sequence
  Synthetic oligonucleotide
atgccaggcccatcgctcccccctccgcaccatgaa

SEQ ID NO: 165360 - DNA, 35 bp, Artificial Sequence
  Synthetic oligonucleotide
atgcttaggggggaaagggcagggggaaaggataa

SEQ ID NO: 165361 - DNA, 36 bp, Artificial Sequence
  Synthetic oligonucleotide
gactccgcccgagtatgcctcatccgtcgtttctaa

SEQ ID NO: 165362 - DNA, 35 bp, Artificial Sequence
  Synthetic oligonucleotide
gcctccccagcccctatgtttgtacccccccttaa

SEQ ID NO: 165363 - DNA, 36 bp, Artificial Sequence
  Synthetic oligonucleotide
acgtccactcgcaagtataccgttctggcctccaca

SEQ ID NO: 165364 - DNA, 34 bp, Artificial Sequence
  Synthetic oligonucleotide
tctcccctccgtttggcactaccccggtcgtaca

SEQ ID NO: 165365 - DNA, 36 bp, Artificial Sequence
  Synthetic oligonucleotide
aatccgcccgccaccactactaatccgacgccccca

SEQ ID NO: 165366 - DNA, 35 bp, Artificial Sequence
  Synthetic oligonucleotide
acgatgcacctagcgtgccctggatccctgcccca

SEQ ID NO: 165367 - DNA, 36 bp, Artificial Sequence
  Synthetic oligonucleotide
tcccccatgttggccactcggtgctacccgatccca

SEQ ID NO: 165368 - DNA, 37 bp, Artificial Sequence
  Synthetic oligonucleotide
tagcaccacaactcgcctgcctgcccgtgcttcgcca

SEQ ID NO: 165369 - DNA, 36 bp, Artificial Sequence
  Synthetic oligonucleotide
gccttctgccacatacccgtgataaatcactctcca

SEQ ID NO: 165370 - DNA, 36 bp, Artificial Sequence
  Synthetic oligonucleotide
tcccttccccgtccactttcgcatgtgctctaggca

SEQ ID NO: 165371 - DNA, 36 bp, Artificial Sequence
  Synthetic oligonucleotide
tgcttaccaccgcaacttgggttgttcctcttctca

SEQ ID NO: 165372 - DNA, 36 bp, Artificial Sequence
  Synthetic oligonucleotide
gaagcaacgtctgccttttactcctccgtcgtttca

SEQ ID NO: 165373 - DNA, 37 bp, Artificial Sequence
  Synthetic oligonucleotide
gtgcatatggggggagggcggagcgaacacggaacga

SEQ ID NO: 165374 - DNA, 37 bp, Artificial Sequence
  Synthetic oligonucleotide
tagccgccaacatcccggctacccctctgttacccga

SEQ ID NO: 165375 - DNA, 37 bp, Artificial Sequence
  Synthetic oligonucleotide
acgtctgcccgcctgcttcggtacattatcgccccga

SEQ ID NO: 165376 - DNA, 37 bp, Artificial Sequence
  Synthetic oligonucleotide
acccccgcccccagccccacagtatcgagcatgccga

SEQ ID NO: 165377 - DNA, 37 bp, Artificial Sequence
  Synthetic oligonucleotide
gacacagtcctctttccttccctctttggcgatccga

SEQ ID NO: 165378 - DNA, 37 bp, Artificial Sequence
  Synthetic oligonucleotide
gagcatgaagaggtgtgtgacgggaggagagaggcga

SEQ ID NO: 165379 - DNA, 36 bp, Artificial Sequence
  Synthetic oligonucleotide
agtgtgacggggcagggggggaaaggggctatagga

SEQ ID NO: 165380 - DNA, 36 bp, Artificial Sequence
  Synthetic oligonucleotide
ggaaccgccgctcgtaccaccctcgctcctttagga

SEQ ID NO: 165381 - DNA, 37 bp, Artificial Sequence
  Synthetic oligonucleotide
gagggcgggaagggcaacgtctcataaagaaaaggga

SEQ ID NO: 165382 - DNA, 37 bp, Artificial Sequence
  Synthetic oligonucleotide
gagaacgttgggaggaagcaattcgaagggtggggga

SEQ ID NO: 165383 - DNA, 37 bp, Artificial Sequence
  Synthetic oligonucleotide
gtgtatgtagggggggtgtatcaatgggggcatggga

SEQ ID NO: 165384 - DNA, 37 bp, Artificial Sequence
  Synthetic oligonucleotide
tcagtggagtcgtgaggggaagggctatcggatggga

SEQ ID NO: 165385 - DNA, 37 bp, Artificial Sequence
  Synthetic oligonucleotide
gatggggccggaagggagggtgaaaaggggcgtggga

SEQ ID NO: 165386 - DNA, 37 bp, Artificial Sequence
  Synthetic oligonucleotide
gaccaccaaccccggactttcattctcgagacatgga

SEQ ID NO: 165387 - DNA, 37 bp, Artificial Sequence
  Synthetic oligonucleotide
aagctgggggcgggggtaaaaaatcagggcggctgga

SEQ ID NO: 165388 - DNA, 35 bp, Artificial Sequence
  Synthetic oligonucleotide
gccggaggtaaacgggaaagggagggggtattgga

SEQ ID NO: 165389 - DNA, 37 bp, Artificial Sequence
  Synthetic oligonucleotide
accacaaccctgaggtatgttctgcttcacccttgga

SEQ ID NO: 165390 - DNA, 37 bp, Artificial Sequence
  Synthetic oligonucleotide
gtgcgccccagtgatccgtagctacccctccttatga

SEQ ID NO: 165391 - DNA, 38 bp, Artificial Sequence
  Synthetic oligonucleotide
cacgccctacatccgatgttctcctaccctcctactga

SEQ ID NO: 165392 - DNA, 38 bp, Artificial Sequence
  Synthetic oligonucleotide
gacatgatctagccggtcctaggccctgtccaccctga

SEQ ID NO: 165393 - DNA, 37 bp, Artificial Sequence
  Synthetic oligonucleotide
tccgaaccatgtgaagcgtctcctgttccctctctga

SEQ ID NO: 165394 - DNA, 38 bp, Artificial Sequence
  Synthetic oligonucleotide
aaacgagagggagaaggggcggtcgaaccactaagtga

SEQ ID NO: 165395 - DNA, 37 bp, Artificial Sequence
  Synthetic oligonucleotide
tagggagagagggaaagctttaagttggggtgggtga

SEQ ID NO: 165396 - DNA, 38 bp, Artificial Sequence
  Synthetic oligonucleotide
accggggggggcggggtagggcttacttggtcatgtga

SEQ ID NO: 165397 - DNA, 35 bp, Artificial Sequence
  Synthetic oligonucleotide
gtgcatgcacggtcactatccccaacgccccttga

SEQ ID NO: 165398 - DNA, 37 bp, Artificial Sequence
  Synthetic oligonucleotide
gccaccgcacgcacttagttatggcactcccgcttga

SEQ ID NO: 165399 - DNA, 35 bp, Artificial Sequence
  Synthetic oligonucleotide
aatccctgcccagctcttctggccccccctcttga

SEQ ID NO: 165400 - DNA, 38 bp, Artificial Sequence
  Synthetic oligonucleotide
gagggtgggccgaagggagcataggggtacttagttga

SEQ ID NO: 165401 - DNA, 36 bp, Artificial Sequence
  Synthetic oligonucleotide
tatgtgcccaccgtcctgcttgcccgactactcata

SEQ ID NO: 165402 - DNA, 35 bp, Artificial Sequence
  Synthetic oligonucleotide
gaggccgggtggggggggtggcgaggacggagcta

SEQ ID NO: 165403 - DNA, 35 bp, Artificial Sequence
  Synthetic oligonucleotide
acgctttgccccgacgttgctcgccgacttatcta

SEQ ID NO: 165404 - DNA, 36 bp, Artificial Sequence
  Synthetic oligonucleotide
tctcggtgcacgcctcatcctgcttcacaatctcta

SEQ ID NO: 165405 - DNA, 35 bp, Artificial Sequence
  Synthetic oligonucleotide
ttcaaccacctatcgcatacagtaacgggagtcta

SEQ ID NO: 165406 - DNA, 36 bp, Artificial Sequence
  Synthetic oligonucleotide
agtcagtggcgatcgtgatgcccttctgcccccgta

SEQ ID NO: 165407 - DNA, 36 bp, Artificial Sequence
  Synthetic oligonucleotide
ttgtcgccttggtcttgaaaatgctctctctccgta

SEQ ID NO: 165408 - DNA, 35 bp, Artificial Sequence
  Synthetic oligonucleotide
gcctgcgcattagtcttttttctaccctactcgta

SEQ ID NO: 165409 - DNA, 35 bp, Artificial Sequence
  Synthetic oligonucleotide
gctacaggaggggttgagggactcaagggggggta

SEQ ID NO: 165410 - DNA, 35 bp, Artificial Sequence
  Synthetic oligonucleotide
gccgtgttacacgtccttacccggttttctttcac

SEQ ID NO: 165411 - DNA, 35 bp, Artificial Sequence
  Synthetic oligonucleotide
ggaggtgaggtagggggcctggaacagggtgcgac

SEQ ID NO: 165412 - DNA, 35 bp, Artificial Sequence
  Synthetic oligonucleotide
accaaccaacagttgggcattttcaccctttgacc

SEQ ID NO: 165413 - DNA, 35 bp, Artificial Sequence
  Synthetic oligonucleotide
ttgagccttgcccggaccatgtctgctcttcaccc

SEQ ID NO: 165414 - DNA, 35 bp, Artificial Sequence
  Synthetic oligonucleotide
tcctcgcaggccaagattcagcctcctaccccccc

SEQ ID NO: 165415 - DNA, 35 bp, Artificial Sequence
  Synthetic oligonucleotide
ccagtccactgaccttactaagctgccttctcccc

SEQ ID NO: 165416 - DNA, 35 bp, Artificial Sequence
  Synthetic oligonucleotide
ttagtaagcctcgcatcccactcttgcgcccgccc

SEQ ID NO: 165417 - DNA, 35 bp, Artificial Sequence
  Synthetic oligonucleotide
cacgcgacccttctgcgttatcgaatcccgctccc

SEQ ID NO: 165418 - DNA, 35 bp, Artificial Sequence
  Synthetic oligonucleotide
tctccaacgcacccatcactggttattctgctccc

SEQ ID NO: 165419 - DNA, 35 bp, Artificial Sequence
  Synthetic oligonucleotide
aacccttggcccgcgtacacctctcttgcgaatcc

SEQ ID NO: 165420 - DNA, 35 bp, Artificial Sequence
  Synthetic oligonucleotide
tccgccccaactgttttactgggaaccatccatcc

SEQ ID NO: 165421 - DNA, 35 bp, Artificial Sequence
  Synthetic oligonucleotide
ggttacgctcccttccgtgtttcttaatcccctcc

SEQ ID NO: 165422 - DNA, 35 bp, Artificial Sequence
  Synthetic oligonucleotide
ggtccaggcctgatgttcttgaacccacgtcctcc

SEQ ID NO: 165423 - DNA, 35 bp, Artificial Sequence
  Synthetic oligonucleotide
cccgatgcatcccatcttttgtttcccacgtacgc

SEQ ID NO: 165424 - DNA, 35 bp, Artificial Sequence
  Synthetic oligonucleotide
gcactttcccccactgtggtgtcgttcgccctcgc

SEQ ID NO: 165425 - DNA, 35 bp, Artificial Sequence
  Synthetic oligonucleotide
tactcccgcttggacccgcctgcactgcgagcatc

SEQ ID NO: 165426 - DNA, 35 bp, Artificial Sequence
  Synthetic oligonucleotide
caacaccctccacgtgccctactcatctgcatatc

SEQ ID NO: 165427 - DNA, 35 bp, Artificial Sequence
  Synthetic oligonucleotide
gactcagccatacctgtccatctccgtgaacactc

SEQ ID NO: 165428 - DNA, 35 bp, Artificial Sequence
  Synthetic oligonucleotide
agtcaccacccgcattgcctcttctgtcaatcctc

SEQ ID NO: 165429 - DNA, 35 bp, Artificial Sequence
  Synthetic oligonucleotide
tcacacgaccccgcgtagttgaccactgatttttc

SEQ ID NO: 165430 - DNA, 35 bp, Artificial Sequence
  Synthetic oligonucleotide
ttaccaccccgctctcgtaatatgcacaatcgaag

SEQ ID NO: 165431 - DNA, 35 bp, Artificial Sequence
  Synthetic oligonucleotide
gctatgagacgggggggagtatggtgggtttggag

SEQ ID NO: 165432 - DNA, 35 bp, Artificial Sequence
  Synthetic oligonucleotide
tgcccgcacccctcactggcccgtgttttttttag

SEQ ID NO: 165433 - DNA, 33 bp, Artificial Sequence
  Synthetic oligonucleotide
gccgatcgaaccttctttatgctttacccaacg

SEQ ID NO: 165434 - DNA, 35 bp, Artificial Sequence
  Synthetic oligonucleotide
tgccttcccgccactgttctctatcactttgaacg

SEQ ID NO: 165435 - DNA, 35 bp, Artificial Sequence
  Synthetic oligonucleotide
accaccctcccgatcggatttacgcccgacgtacg

SEQ ID NO: 165436 - DNA, 35 bp, Artificial Sequence
  Synthetic oligonucleotide
gattcgcccccaccatacacgagacgctccacccg

SEQ ID NO: 165437 - DNA, 35 bp, Artificial Sequence
  Synthetic oligonucleotide
aagcgagttgatctataccccggccccccttttcg

SEQ ID NO: 165438 - DNA, 34 bp, Artificial Sequence
  Synthetic oligonucleotide
tagtcagcccacccgataattccccccatccagg

SEQ ID NO: 165439 - DNA, 35 bp, Artificial Sequence
  Synthetic oligonucleotide
agttcgaagaggggggacggaagcgcggggaaggg

SEQ ID NO: 165440 - DNA, 35 bp, Artificial Sequence
  Synthetic oligonucleotide
gacatatgggtatgggaaggattggaacgggaggg

SEQ ID NO: 165441 - DNA, 35 bp, Artificial Sequence
  Synthetic oligonucleotide
tactaccacgaaactgatccaccgctcgagccctg

SEQ ID NO: 165442 - DNA, 35 bp, Artificial Sequence
  Synthetic oligonucleotide
aaccgcgccctcacccatctaagggcaaacaccat

SEQ ID NO: 165443 - DNA, 35 bp, Artificial Sequence
  Synthetic oligonucleotide
tcacccccgccccacgctcctgtactgaaattcat

SEQ ID NO: 165444 - DNA, 36 bp, Artificial Sequence
  Synthetic oligonucleotide
gtgtcgctcccgatccgcatgaagcatcttcctact

SEQ ID NO: 165445 - DNA, 35 bp, Artificial Sequence
  Synthetic oligonucleotide
gcgttttgcccctatgcgccgtttatccaccccct

SEQ ID NO: 165446 - DNA, 35 bp, Artificial Sequence
  Synthetic oligonucleotide
tgtcacgttaatatccttgcacgactgccgcccct

SEQ ID NO: 165447 - DNA, 35 bp, Artificial Sequence
  Synthetic oligonucleotide
gatgccccgtagcttgggcgatatacgtcctccct

SEQ ID NO: 165448 - DNA, 35 bp, Artificial Sequence
  Synthetic oligonucleotide
tattgcgccgagttctccaccattgtctatttcct

SEQ ID NO: 165449 - DNA, 35 bp, Artificial Sequence
  Synthetic oligonucleotide
ttaccacccggcgtcaattttcctacgcatccggt

SEQ ID NO: 165450 - DNA, 35 bp, Artificial Sequence
  Synthetic oligonucleotide
gcgaatccttccatccaagtgaatactgctccctt

SEQ ID NO: 165451 - DNA, 35 bp, Artificial Sequence
  Synthetic oligonucleotide
gccatgggccggtgcccccatggttaattttcctt

SEQ ID NO: 165452 - DNA, 35 bp, Artificial Sequence
  Synthetic oligonucleotide
gagaggggaggaaacggttatgagaaggatttaaa

SEQ ID NO: 165453 - DNA, 36 bp, Artificial Sequence
  Synthetic oligonucleotide
ttaagggggggaggactgaagggcgggtttgaataa

SEQ ID NO: 165454 - DNA, 35 bp, Artificial Sequence
  Synthetic oligonucleotide
ccccgctaactcctccgtccgccacggggccgtaa

SEQ ID NO: 165455 - DNA, 36 bp, Artificial Sequence
  Synthetic oligonucleotide
ttttcccgaccgccgctgcaattccccgtgcctaca

SEQ ID NO: 165456 - DNA, 36 bp, Artificial Sequence
  Synthetic oligonucleotide
gccgccaaggtcagcacacgcctcccgctccgacca

SEQ ID NO: 165457 - DNA, 35 bp, Artificial Sequence
  Synthetic oligonucleotide
gaccataactgtcactcgagtctgccccaccccca

SEQ ID NO: 165458 - DNA, 36 bp, Artificial Sequence
  Synthetic oligonucleotide
gtcctgccctctgagtcctcttatgcacgaatgcca

SEQ ID NO: 165459 - DNA, 35 bp, Artificial Sequence
  Synthetic oligonucleotide
atcggtacccccgattgttcttcttgttctgtcca

SEQ ID NO: 165460 - DNA, 35 bp, Artificial Sequence
  Synthetic oligonucleotide
gccctcaccatcaacacttcgcgcgtgcttttcca

SEQ ID NO: 165461 - DNA, 36 bp, Artificial Sequence
  Synthetic oligonucleotide
gatgccgatccgaagcacccttgctttttctctgca

SEQ ID NO: 165462 - DNA, 36 bp, Artificial Sequence
  Synthetic oligonucleotide
gttgttccgcgcgttcctccgcctggttatgtctca

SEQ ID NO: 165463 - DNA, 35 bp, Artificial Sequence
  Synthetic oligonucleotide
agatgactcagttcgcccttcccagcccgccttca

SEQ ID NO: 165464 - DNA, 35 bp, Artificial Sequence
  Synthetic oligonucleotide
tcccccggtgcaccgctcactcgtactattcttca

SEQ ID NO: 165465 - DNA, 35 bp, Artificial Sequence
  Synthetic oligonucleotide
gacgcattgcgccgtatcctcctactccgcaccga

SEQ ID NO: 165466 - DNA, 37 bp, Artificial Sequence
  Synthetic oligonucleotide
tgatgccaccctgacacctcctcgagtccatctccga

SEQ ID NO: 165467 - DNA, 37 bp, Artificial Sequence
  Synthetic oligonucleotide
tggagacgaagggggggtgagtagggtgaacggtcga

SEQ ID NO: 165468 - DNA, 37 bp, Artificial Sequence
  Synthetic oligonucleotide
gaatgatcgtggtggggtagctgagaggggggaagga

SEQ ID NO: 165469 - DNA, 37 bp, Artificial Sequence
  Synthetic oligonucleotide
agtacgcccttctacaccctgctgctgatccgtagga

SEQ ID NO: 165470 - DNA, 37 bp, Artificial Sequence
  Synthetic oligonucleotide
gtgggagggggggtgtggaggtgccggtgtgcacgga

SEQ ID NO: 165471 - DNA, 37 bp, Artificial Sequence
  Synthetic oligonucleotide
tgcacttcccgccatcctcgtgcctccccatgccgga

SEQ ID NO: 165472 - DNA, 35 bp, Artificial Sequence
  Synthetic oligonucleotide
gacaatggaagggtgtcggcggggaatgaacggga

SEQ ID NO: 165473 - DNA, 36 bp, Artificial Sequence
  Synthetic oligonucleotide
gagggcgggagggtggcgcatcgaggttacagggga

SEQ ID NO: 165474 - DNA, 37 bp, Artificial Sequence
  Synthetic oligonucleotide
gatgcccgaaaagacggaacggaaggggtacggggga

SEQ ID NO: 165475 - DNA, 36 bp, Artificial Sequence
  Synthetic oligonucleotide
atcccccccatactgtataccgcaaccctccctgga

SEQ ID NO: 165476 - DNA, 37 bp, Artificial Sequence
  Synthetic oligonucleotide
ggggccgacgccgctttcttatccttgaccctctgga

SEQ ID NO: 165477 - DNA, 38 bp, Artificial Sequence
  Synthetic oligonucleotide
tcccacctcgtagtccccgtgcactcctacttaaatga

SEQ ID NO: 165478 - DNA, 37 bp, Artificial Sequence
  Synthetic oligonucleotide
gtggacgtcaggaggaggaggtaggggatttggatga

SEQ ID NO: 165479 - DNA, 38 bp, Artificial Sequence
  Synthetic oligonucleotide
tgatggcggagggaggggggtggatttggacggtatga

SEQ ID NO: 165480 - DNA, 38 bp, Artificial Sequence
  Synthetic oligonucleotide
tcaccggctcccgcatgtccgcccgttccttaacctga

SEQ ID NO: 165481 - DNA, 37 bp, Artificial Sequence
  Synthetic oligonucleotide
gacactgagcaccgcgactgttctcgtttcaccctga

SEQ ID NO: 165482 - DNA, 37 bp, Artificial Sequence
  Synthetic oligonucleotide
acctcgcctccagtttgcgtctcccatccccagctga

SEQ ID NO: 165483 - DNA, 37 bp, Artificial Sequence
  Synthetic oligonucleotide
tcaggccggccatccccgtctgcacattacatcgtga

SEQ ID NO: 165484 - DNA, 38 bp, Artificial Sequence
  Synthetic oligonucleotide
ttcactgccgccctcatcgctgcagcctattccattga

SEQ ID NO: 165485 - DNA, 37 bp, Artificial Sequence
  Synthetic oligonucleotide
acgttgggaaggcggtgaagggagggtgcggtattga

SEQ ID NO: 165486 - DNA, 38 bp, Artificial Sequence
  Synthetic oligonucleotide
gcactaccctgctgctgtgacctctacccagcccttga

SEQ ID NO: 165487 - DNA, 36 bp, Artificial Sequence
  Synthetic oligonucleotide
gatgacgcacatcccgccgttagcgcccttcgttga

SEQ ID NO: 165488 - DNA, 38 bp, Artificial Sequence
  Synthetic oligonucleotide
taccgcgctcctcctgctccctgtcccttatgggttga

SEQ ID NO: 165489 - DNA, 38 bp, Artificial Sequence
  Synthetic oligonucleotide
gtttccgcacatccgctattgcctggccctctatttga

SEQ ID NO: 165490 - DNA, 38 bp, Artificial Sequence
  Synthetic oligonucleotide
agtcgggccagccgtgtcgcctatccacccgcttttga

SEQ ID NO: 165491 - DNA, 35 bp, Artificial Sequence
  Synthetic oligonucleotide
gtaggtgggtcacgcctcctcgtcactaattcata

SEQ ID NO: 165492 - DNA, 35 bp, Artificial Sequence
  Synthetic oligonucleotide
accaccccgccagtccttcctttggtcccaccgta

SEQ ID NO: 165493 - DNA, 36 bp, Artificial Sequence
  Synthetic oligonucleotide
tttctagcccgatctgctcttctcctacgcctggta

SEQ ID NO: 165494 - DNA, 35 bp, Artificial Sequence
  Synthetic oligonucleotide
acctcaccgcactgctgacttcgcacaatcctgta

SEQ ID NO: 165495 - DNA, 36 bp, Artificial Sequence
  Synthetic oligonucleotide
acccgcctcagacctccgtccggccacttgaactta

SEQ ID NO: 165496 - DNA, 36 bp, Artificial Sequence
  Synthetic oligonucleotide
gcgaggtagtcagcccgtttgcaccaccaatcctta

SEQ ID NO: 165497 - DNA, 35 bp, Artificial Sequence
  Synthetic oligonucleotide
gctcccccatgatctgactccaacgcactgtcaac

SEQ ID NO: 165498 - DNA, 35 bp, Artificial Sequence
  Synthetic oligonucleotide
tcacgcctcgccctttgactatgacctgccctacc

SEQ ID NO: 165499 - DNA, 35 bp, Artificial Sequence
  Synthetic oligonucleotide
tgcacgacctccccccctaatgctgctcgtttacc

SEQ ID NO: 165500 - DNA, 35 bp, Artificial Sequence
  Synthetic oligonucleotide
agatctgtcgcggtcatttgcatctgcgcgccccc

SEQ ID NO: 165501 - DNA, 35 bp, Artificial Sequence
  Synthetic oligonucleotide
gcgccccactcgcattgcatgtggtttttctgccc

SEQ ID NO: 165502 - DNA, 35 bp, Artificial Sequence
  Synthetic oligonucleotide
atcctgagaactcagccctcacattgcttacatcc

SEQ ID NO: 165503 - DNA, 35 bp, Artificial Sequence
  Synthetic oligonucleotide
aacacgtacaatgctctcgccttacacctggatcc

SEQ ID NO: 165504 - DNA, 35 bp, Artificial Sequence
  Synthetic oligonucleotide
gtccacgccccaagcctcccggatgatcatcttcc

SEQ ID NO: 165505 - DNA, 35 bp, Artificial Sequence
  Synthetic oligonucleotide
gccccctcctacggtctgccattacgcgtgctcgc

SEQ ID NO: 165506 - DNA, 36 bp, Artificial Sequence
  Synthetic oligonucleotide
tcgcccctctgccgtttccaagcccgtctgcttcgc

SEQ ID NO: 165507 - DNA, 35 bp, Artificial Sequence
  Synthetic oligonucleotide
gccaacaacattagccgctgtacacctcacttggc

SEQ ID NO: 165508 - DNA, 35 bp, Artificial Sequence
  Synthetic oligonucleotide
tgctccggtccccgattctgctcttctgaagtctc

SEQ ID NO: 165509 - DNA, 35 bp, Artificial Sequence
  Synthetic oligonucleotide
agccaaggggatgggcgggacgggacccacaagtc

SEQ ID NO: 165510 - DNA, 35 bp, Artificial Sequence
  Synthetic oligonucleotide
tcaacccccgtttctgagcttgtttctttgccttc

SEQ ID NO: 165511 - DNA, 35 bp, Artificial Sequence
  Synthetic oligonucleotide
taatgcgcctgtcacccgtgtccgttatgccgttc

SEQ ID NO: 165512 - DNA, 35 bp, Artificial Sequence
  Synthetic oligonucleotide
tcgcaagtagccgtacgcctgggctgccctttttc

SEQ ID NO: 165513 - DNA, 35 bp, Artificial Sequence
  Synthetic oligonucleotide
ttcagtctcggtgcgtcgcggcccacacgtttttc

SEQ ID NO: 165514 - DNA, 35 bp, Artificial Sequence
  Synthetic oligonucleotide
gaggggcggggactagggtagaatacgggtgaaag

SEQ ID NO: 165515 - DNA, 35 bp, Artificial Sequence
  Synthetic oligonucleotide
actgactcccgccactactattagaactatccaag

SEQ ID NO: 165516 - DNA, 35 bp, Artificial Sequence
  Synthetic oligonucleotide
agcacgggggggagccaagtatagaatggggaccg

SEQ ID NO: 165517 - DNA, 35 bp, Artificial Sequence
  Synthetic oligonucleotide
gccccacggttccgtgtactttccacccatctccg

SEQ ID NO: 165518 - DNA, 35 bp, Artificial Sequence
  Synthetic oligonucleotide
gtccatccagtttacagtcctctgccctcttagcg

SEQ ID NO: 165519 - DNA, 35 bp, Artificial Sequence
  Synthetic oligonucleotide
tatgccaccgatcctgccgcctacttgtcgactcg

SEQ ID NO: 165520 - DNA, 35 bp, Artificial Sequence
  Synthetic oligonucleotide
gtgggcggtataaaaaaaggagaggagggtcgagg

SEQ ID NO: 165521 - DNA, 35 bp, Artificial Sequence
  Synthetic oligonucleotide
tctactgaccacatttctgttattttgctccttat

SEQ ID NO: 165522 - DNA, 35 bp, Artificial Sequence
  Synthetic oligonucleotide
tgcccacagccctgcctttccctttctccttcact

SEQ ID NO: 165523 - DNA, 35 bp, Artificial Sequence
  Synthetic oligonucleotide
acgcctaactacatgcttgtggtaccccgttccct

SEQ ID NO: 165524 - DNA, 35 bp, Artificial Sequence
  Synthetic oligonucleotide
gtcctgccctcggctatttgaactgccccatctct

SEQ ID NO: 165525 - DNA, 35 bp, Artificial Sequence
  Synthetic oligonucleotide
tccacccacaccttgtcaggcttttgcctcgacgt

SEQ ID NO: 165526 - DNA, 35 bp, Artificial Sequence
  Synthetic oligonucleotide
tagtactgccagatctccgaccgctatctatccgt

SEQ ID NO: 165527 - DNA, 35 bp, Artificial Sequence
  Synthetic oligonucleotide
gattcggtgggatgacggagggggggtgctagggt

SEQ ID NO: 165528 - DNA, 35 bp, Artificial Sequence
  Synthetic oligonucleotide
acaccatgtaacacctccacgctttgctagcttgt

SEQ ID NO: 165529 - DNA, 35 bp, Artificial Sequence
  Synthetic oligonucleotide
tgcaacttgcgactctgcttacatccggtcccctt

SEQ ID NO: 165530 - DNA, 35 bp, Artificial Sequence
  Synthetic oligonucleotide
tccatcaccatctcccgtcccgcctggtccggctt

SEQ ID NO: 165531 - DNA, 35 bp, Artificial Sequence
  Synthetic oligonucleotide
gtgcgcccctcggacgggcgggagggtaagggctt

SEQ ID NO: 165532 - DNA, 35 bp, Artificial Sequence
  Synthetic oligonucleotide
atcccttcaccctcgtcacactttcggagtgtgtt

SEQ ID NO: 165533 - DNA, 35 bp, Artificial Sequence
  Synthetic oligonucleotide
gtacccttcgtccacacgtggtattctgttccttt

SEQ ID NO: 165534 - DNA, 36 bp, Artificial Sequence
  Synthetic oligonucleotide
ttgcacccgcccgctagcccctctataccaccgaaa

SEQ ID NO: 165535 - DNA, 36 bp, Artificial Sequence
  Synthetic oligonucleotide
cctcaccgcacgaagtatctgccccttctattacaa

SEQ ID NO: 165536 - DNA, 36 bp, Artificial Sequence
  Synthetic oligonucleotide
tcccacgcaatggaactccaccccgctcgcctccaa

SEQ ID NO: 165537 - DNA, 35 bp, Artificial Sequence
  Synthetic oligonucleotide
tcccacttcgtctgccacccacccacctttcgcaa

SEQ ID NO: 165538 - DNA, 35 bp, Artificial Sequence
  Synthetic oligonucleotide
agtccccgctggacccgtaccggactttctctcaa

SEQ ID NO: 165539 - DNA, 35 bp, Artificial Sequence
  Synthetic oligonucleotide
gcaacccctctccgcgttacactgcccgtgtcaca

SEQ ID NO: 165540 - DNA, 36 bp, Artificial Sequence
  Synthetic oligonucleotide
ggaccagccctcacctttgttcatcactggcctcca

SEQ ID NO: 165541 - DNA, 36 bp, Artificial Sequence
  Synthetic oligonucleotide
acttcccatccgtacccgcattgcgacaaccttcca

SEQ ID NO: 165542 - DNA, 36 bp, Artificial Sequence
  Synthetic oligonucleotide
acccccgttccgattttcgttgatccgccttccgca

SEQ ID NO: 165543 - DNA, 36 bp, Artificial Sequence
  Synthetic oligonucleotide
aagagtcggtggatggcggggacgggggtactggca

SEQ ID NO: 165544 - DNA, 36 bp, Artificial Sequence
  Synthetic oligonucleotide
tatcccgcccccagttatgtgtcagcgcgcctatca

SEQ ID NO: 165545 - DNA, 35 bp, Artificial Sequence
  Synthetic oligonucleotide
gtcactcagctattgtaacgtcattcctctcgtca

SEQ ID NO: 165546 - DNA, 35 bp, Artificial Sequence
  Synthetic oligonucleotide
tcccgccttctcggtgcataggccaatcaccttca

SEQ ID NO: 165547 - DNA, 36 bp, Artificial Sequence
  Synthetic oligonucleotide
tcccgtcaaagttgtccccttgctcgtcattcttca

SEQ ID NO: 165548 - DNA, 37 bp, Artificial Sequence
  Synthetic oligonucleotide
ttagagaggtggggcgatataggggggagggcaaaga

SEQ ID NO: 165549 - DNA, 37 bp, Artificial Sequence
  Synthetic oligonucleotide
gagccgggtgggtgggttgaacttcagggcacgcaga

SEQ ID NO: 165550 - DNA, 36 bp, Artificial Sequence
  Synthetic oligonucleotide
atcgcccacgccgctccccccaaccggcccctcaga

SEQ ID NO: 165551 - DNA, 37 bp, Artificial Sequence
  Synthetic oligonucleotide
tggtgcggtgcacagggggcggggacgggggaggaga

SEQ ID NO: 165552 - DNA, 37 bp, Artificial Sequence
  Synthetic oligonucleotide
tccctgacacacctgttagcctcgcccttcattgaga

SEQ ID NO: 165553 - DNA, 37 bp, Artificial Sequence
  Synthetic oligonucleotide
tgtcacgccccgtttttgcctatcgcctcgttttaga

SEQ ID NO: 165554 - DNA, 37 bp, Artificial Sequence
  Synthetic oligonucleotide
gacaccctctccagctacaacggtcacaccctaacga

SEQ ID NO: 165555 - DNA, 37 bp, Artificial Sequence
  Synthetic oligonucleotide
gactgtcccaccctatcatcgtgctccctctccacga

SEQ ID NO: 165556 - DNA, 37 bp, Artificial Sequence
  Synthetic oligonucleotide
tccgcctctttccctggtttattttgtgatcacccga

SEQ ID NO: 165557 - DNA, 37 bp, Artificial Sequence
  Synthetic oligonucleotide
atcgtcgacgtctcgtgcactacctccgattccccga

SEQ ID NO: 165558 - DNA, 37 bp, Artificial Sequence
  Synthetic oligonucleotide
acggtcgacagaccggacttctactgcccccccgcga

SEQ ID NO: 165559 - DNA, 37 bp, Artificial Sequence
  Synthetic oligonucleotide
tctcccgtcaatcattcccatactctccgattcgcga

SEQ ID NO: 165560 - DNA, 37 bp, Artificial Sequence
  Synthetic oligonucleotide
acgcctaccctgttcgcttttctatgtcgcccatcga

SEQ ID NO: 165561 - DNA, 37 bp, Artificial Sequence
  Synthetic oligonucleotide
gacctcagcgtggtttctgtctcgcactccttctcga

SEQ ID NO: 165562 - DNA, 37 bp, Artificial Sequence
  Synthetic oligonucleotide
cccccaacgcccaggtatctttagtgttaccccagga

SEQ ID NO: 165563 - DNA, 35 bp, Artificial Sequence
  Synthetic oligonucleotide
acgcgggggggaggggatggtattaaaaatcggga

SEQ ID NO: 165564 - DNA, 37 bp, Artificial Sequence
  Synthetic oligonucleotide
aagagtagggggctagagaccggtaagggaaagggga

SEQ ID NO: 165565 - DNA, 37 bp, Artificial Sequence
  Synthetic oligonucleotide
gggtaagtcgggtggggggcaatgggcggcatcatga

SEQ ID NO: 165566 - DNA, 35 bp, Artificial Sequence
  Synthetic oligonucleotide
tgtgtccccccctccgttactctacaagtagatga

SEQ ID NO: 165567 - DNA, 38 bp, Artificial Sequence
  Synthetic oligonucleotide
gcacacccgccctcgctcaggaccgtaacccgccctga

SEQ ID NO: 165568 - DNA, 37 bp, Artificial Sequence
  Synthetic oligonucleotide
gacgacaggagattgggccatgggagggggggcctga

SEQ ID NO: 165569 - DNA, 37 bp, Artificial Sequence
  Synthetic oligonucleotide
tacgaacgctggaggggacatgggggggcatacgtga

SEQ ID NO: 165570 - DNA, 38 bp, Artificial Sequence
  Synthetic oligonucleotide
tgacatgtaagggggttcgaggcgaggatgggaggtga

SEQ ID NO: 165571 - DNA, 37 bp, Artificial Sequence
  Synthetic oligonucleotide
tgccgtccctgttcaccgacctctcttctaattgtga

SEQ ID NO: 165572 - DNA, 38 bp, Artificial Sequence
  Synthetic oligonucleotide
tgagccgacgtcgttcgttcgcctcacctgctctttga

SEQ ID NO: 165573 - DNA, 38 bp, Artificial Sequence
  Synthetic oligonucleotide
gcctcgctcccgcctttgtccgacgcttactgttttga

SEQ ID NO: 165574 - DNA, 35 bp, Artificial Sequence
  Synthetic oligonucleotide
tatgacgggcaaaggcagggaaacggggggcaata

SEQ ID NO: 165575 - DNA, 35 bp, Artificial Sequence
  Synthetic oligonucleotide
atcacccacgcctccctgattttctggtttttata

SEQ ID NO: 165576 - DNA, 36 bp, Artificial Sequence
  Synthetic oligonucleotide
tacacgcgcccgtttcgaccctgcgactttattcta

SEQ ID NO: 165577 - DNA, 35 bp, Artificial Sequence
  Synthetic oligonucleotide
acgcccgtgttaatcccgtgctcgcccccttcgta

SEQ ID NO: 165578 - DNA, 35 bp, Artificial Sequence
  Synthetic oligonucleotide
tgccgtatgtcgcccatgtctgcctgagtccctta

SEQ ID NO: 165579 - DNA, 36 bp, Artificial Sequence
  Synthetic oligonucleotide
ggtacgccaaactgctccaactccctgtcgtcgtta

SEQ ID NO: 165580 - DNA, 36 bp, Artificial Sequence
  Synthetic oligonucleotide
acgccgtaagcatggtcttccggctcccttctttta

SEQ ID NO: 165581 - DNA, 35 bp, Artificial Sequence
  Synthetic oligonucleotide
tgtcgtcccatctcttcatagcaacagcgcccaac

SEQ ID NO: 165582 - DNA, 35 bp, Artificial Sequence
  Synthetic oligonucleotide
tgtcatgactccgcacgttcttgctccttttcgac

SEQ ID NO: 165583 - DNA, 35 bp, Artificial Sequence
  Synthetic oligonucleotide
ttagcccccgaccatctgcatataccgttgtaacc

SEQ ID NO: 165584 - DNA, 35 bp, Artificial Sequence
  Synthetic oligonucleotide
gtctgccactgaagccttcacttggttcttgcacc

SEQ ID NO: 165585 - DNA, 35 bp, Artificial Sequence
  Synthetic oligonucleotide
gtggcgaactcgccgtaactgacttttcgtacccc

SEQ ID NO: 165586 - DNA, 35 bp, Artificial Sequence
  Synthetic oligonucleotide
gctcgagccgctgccccacggtcttggtaacgccc

SEQ ID NO: 165587 - DNA, 35 bp, Artificial Sequence
  Synthetic oligonucleotide
aaccaccatccacatcctgatgcgcttcactgccc

SEQ ID NO: 165588 - DNA, 35 bp, Artificial Sequence
  Synthetic oligonucleotide
tgtagctacgccaccccatcctgatcagccatccc

SEQ ID NO: 165589 - DNA, 35 bp, Artificial Sequence
  Synthetic oligonucleotide
tcacgcgctcgtgggtagttttgtgcctccgtccc

SEQ ID NO: 165590 - DNA, 35 bp, Artificial Sequence
  Synthetic oligonucleotide
gccctgtcccaacgtacaattgatctaccccagcc

SEQ ID NO: 165591 - DNA, 35 bp, Artificial Sequence
  Synthetic oligonucleotide
tgcccgacttgcaggctcccacctccgcgaacgcc

SEQ ID NO: 165592 - DNA, 35 bp, Artificial Sequence
  Synthetic oligonucleotide
ctctcgatccgccatgtcactatgcctattttgcc

SEQ ID NO: 165593 - DNA, 35 bp, Artificial Sequence
  Synthetic oligonucleotide
ggtgaccttgcctcccccacgctatccgggtatcc

SEQ ID NO: 165594 - DNA, 35 bp, Artificial Sequence
  Synthetic oligonucleotide
gagctgccttcgcgagcggtcttagcttccactcc

SEQ ID NO: 165595 - DNA, 35 bp, Artificial Sequence
  Synthetic oligonucleotide
tgtccccgcccttaatatccaacgttttggcctcc

SEQ ID NO: 165596 - DNA, 35 bp, Artificial Sequence
  Synthetic oligonucleotide
accagatcctcattatttgctacagttctcgctcc

SEQ ID NO: 165597 - DNA, 35 bp, Artificial Sequence
  Synthetic oligonucleotide
tccgtcgcctctgtgcttctttcccttcctcgtcc

SEQ ID NO: 165598 - DNA, 35 bp, Artificial Sequence
  Synthetic oligonucleotide
ttctgcctcccctgcacgagcttaatctgtctagc

SEQ ID NO: 165599 - DNA, 36 bp, Artificial Sequence
  Synthetic oligonucleotide
ataacaccgcttgctgccgagccatcatcacgccgc

SEQ ID NO: 165600 - DNA, 35 bp, Artificial Sequence
  Synthetic oligonucleotide
gttccgaaggacacgatgtacaccctctctcctgc

SEQ ID NO: 165601 - DNA, 35 bp, Artificial Sequence
  Synthetic oligonucleotide
ggacgacaccggcctgcttttgagcccaacacatc

SEQ ID NO: 165602 - DNA, 35 bp, Artificial Sequence
  Synthetic oligonucleotide
tcctgcggccttaggtttcctgccccaccagcctc

SEQ ID NO: 165603 - DNA, 35 bp, Artificial Sequence
  Synthetic oligonucleotide
gcacacagttgcttgattccgcacatccgtacttc

SEQ ID NO: 165604 - DNA, 35 bp, Artificial Sequence
  Synthetic oligonucleotide
tcacacccgccacctagctatcagcgttatccttc

SEQ ID NO: 165605 - DNA, 35 bp, Artificial Sequence
  Synthetic oligonucleotide
gccgccccgcttctctgtcgttattgttttccttc

SEQ ID NO: 165606 - DNA, 35 bp, Artificial Sequence
  Synthetic oligonucleotide
gtccggacaccccgcccttcgactctgcctgcttc

SEQ ID NO: 165607 - DNA, 35 bp, Artificial Sequence
  Synthetic oligonucleotide
gtcgccgccggattcacccaccgcccgccattttc

SEQ ID NO: 165608 - DNA, 35 bp, Artificial Sequence
  Synthetic oligonucleotide
gaacggtgagaaggggcggaaagaagccatgagag

SEQ ID NO: 165609 - DNA, 35 bp, Artificial Sequence
  Synthetic oligonucleotide
tgaaggtggtgggggaaggatggatcgacgtttag

SEQ ID NO: 165610 - DNA, 35 bp, Artificial Sequence
  Synthetic oligonucleotide
acacacccgtacctccctcgttctattgaccaacg

SEQ ID NO: 165611 - DNA, 35 bp, Artificial Sequence
  Synthetic oligonucleotide
acaccagagtcattcgttatgctcacttccccacg

SEQ ID NO: 165612 - DNA, 35 bp, Artificial Sequence
  Synthetic oligonucleotide
gcccgacacgctaccctacactgacgctctcctcg

SEQ ID NO: 165613 - DNA, 35 bp, Artificial Sequence
  Synthetic oligonucleotide
actgagggaatggaggcaagatgacggaatggggg

SEQ ID NO: 165614 - DNA, 35 bp, Artificial Sequence
  Synthetic oligonucleotide
tgaaaagagggacgggtaaggttggggacgaggtg

SEQ ID NO: 165615 - DNA, 35 bp, Artificial Sequence
  Synthetic oligonucleotide
acacaccacctaacatgttcgccgttctgctcttg

SEQ ID NO: 165616 - DNA, 35 bp, Artificial Sequence
  Synthetic oligonucleotide
tacttccgccctcaccgcttattacgcaatgtaat

SEQ ID NO: 165617 - DNA, 35 bp, Artificial Sequence
  Synthetic oligonucleotide
tagatccccccaacgtgctttgcttactccagact

SEQ ID NO: 165618 - DNA, 35 bp, Artificial Sequence
  Synthetic oligonucleotide
gtggctccgtaccccgaattgcgccccgactgcct

SEQ ID NO: 165619 - DNA, 35 bp, Artificial Sequence
  Synthetic oligonucleotide
gacgtttcccgtccactttgatacaccgtcctcct

SEQ ID NO: 165620 - DNA, 35 bp, Artificial Sequence
  Synthetic oligonucleotide
atacccaaccccgcggcatcactaccctgtttgct

SEQ ID NO: 165621 - DNA, 35 bp, Artificial Sequence
  Synthetic oligonucleotide
tttatccgtgcccatgtctttaacctatccttggt

SEQ ID NO: 165622 - DNA, 34 bp, Artificial Sequence
  Synthetic oligonucleotide
gagaggaaggaataatggggtggagggtgacatt

SEQ ID NO: 165623 - DNA, 35 bp, Artificial Sequence
  Synthetic oligonucleotide
atcaccctccactctggacaagtttcaactttatt

SEQ ID NO: 165624 - DNA, 35 bp, Artificial Sequence
  Synthetic oligonucleotide
actcgtccgagcatagcttccccccgggctcactt

SEQ ID NO: 165625 - DNA, 35 bp, Artificial Sequence
  Synthetic oligonucleotide
gcaatgtcccccttttctacctaccgctgtcgctt

SEQ ID NO: 165626 - DNA, 35 bp, Artificial Sequence
  Synthetic oligonucleotide
gagtggacgtgaggaggaggtgtgggaggtggaaa

SEQ ID NO: 165627 - DNA, 36 bp, Artificial Sequence
  Synthetic oligonucleotide
ggaggaggatagaaacgagggaaagaatagactgaa

SEQ ID NO: 165628 - DNA, 35 bp, Artificial Sequence
  Synthetic oligonucleotide
tgaagccctccaggactcgtcttttctcccacaca

SEQ ID NO: 165629 - DNA, 35 bp, Artificial Sequence
  Synthetic oligonucleotide
atcccgccatcaccgcgttacatagtaccaccaca

SEQ ID NO: 165630 - DNA, 36 bp, Artificial Sequence
  Synthetic oligonucleotide
atccctgccacattgttctcggctatctttcgtaca

SEQ ID NO: 165631 - DNA, 36 bp, Artificial Sequence
  Synthetic oligonucleotide
gtggaggcacacactcccctgcgcatataccgccca

SEQ ID NO: 165632 - DNA, 36 bp, Artificial Sequence
  Synthetic oligonucleotide
agacctccagttgcttatgccctattcctgtcgcca

SEQ ID NO: 165633 - DNA, 36 bp, Artificial Sequence
  Synthetic oligonucleotide
gatactcgcccttttgtctcctcgcctttgcccgca

SEQ ID NO: 165634 - DNA, 36 bp, Artificial Sequence
  Synthetic oligonucleotide
tgttgcccggcccgcttttcgatctgtccctccgca

SEQ ID NO: 165635 - DNA, 35 bp, Artificial Sequence
  Synthetic oligonucleotide
gagtctatccgcggcctgcccttcgtccctggtca

SEQ ID NO: 165636 - DNA, 36 bp, Artificial Sequence
  Synthetic oligonucleotide
acagctggtgtaggattgggagggtaaggggaaaga

SEQ ID NO: 165637 - DNA, 37 bp, Artificial Sequence
  Synthetic oligonucleotide
acgagttagagaggaagaagggggaaggggccgcaga

SEQ ID NO: 165638 - DNA, 37 bp, Artificial Sequence
  Synthetic oligonucleotide
gagaagcgtgcggggcggcggagggatagggaagaga

SEQ ID NO: 165639 - DNA, 37 bp, Artificial Sequence
  Synthetic oligonucleotide
aagggtagccgggaggtagaacggagggtaggttaga

SEQ ID NO: 165640 - DNA, 37 bp, Artificial Sequence
  Synthetic oligonucleotide
tcgaggatcggggggggtagcgggtcgggcggtacga

SEQ ID NO: 165641 - DNA, 35 bp, Artificial Sequence
  Synthetic oligonucleotide
acaaccacaactggatctgcgataacgacccccga

SEQ ID NO: 165642 - DNA, 37 bp, Artificial Sequence
  Synthetic oligonucleotide
tcctgcccccgcacttcctgtaaacaactcacgccga

SEQ ID NO: 165643 - DNA, 37 bp, Artificial Sequence
  Synthetic oligonucleotide
acacgctcgtcccctcgtcccctagtcatgtttccga

SEQ ID NO: 165644 - DNA, 37 bp, Artificial Sequence
  Synthetic oligonucleotide
tcactccctccacaagtctcgctcccgctcaaggcga

SEQ ID NO: 165645 - DNA, 37 bp, Artificial Sequence
  Synthetic oligonucleotide
gtgtgggacggaactgaaatgaggcggacggggggga

SEQ ID NO: 165646 - DNA, 37 bp, Artificial Sequence
  Synthetic oligonucleotide
gaaaggggcattcgtttgggaggggagggagtgggga

SEQ ID NO: 165647 - DNA, 37 bp, Artificial Sequence
  Synthetic oligonucleotide
gacagacagatagaagcaggaggaaggtatgtgtgga

SEQ ID NO: 165648 - DNA, 37 bp, Artificial Sequence
  Synthetic oligonucleotide
gacgtactcatgcctttgcctgcccgacccatttgga

SEQ ID NO: 165649 - DNA, 38 bp, Artificial Sequence
  Synthetic oligonucleotide
ttagggcggagggaggggggtggatttggacggtatga

SEQ ID NO: 165650 - DNA, 35 bp, Artificial Sequence
  Synthetic oligonucleotide
tcaaccaccttctccacgtcgtaaaccaatcctga

SEQ ID NO: 165651 - DNA, 38 bp, Artificial Sequence
  Synthetic oligonucleotide
gcgccctcccgctggacttaacacccatgccctcctga

SEQ ID NO: 165652 - DNA, 35 bp, Artificial Sequence
  Synthetic oligonucleotide
gagcactgtgccacatccgcccggttacttcctga

SEQ ID NO: 165653 - DNA, 36 bp, Artificial Sequence
  Synthetic oligonucleotide
taggagagagggtagggcaagtacgggtgggtgtga

SEQ ID NO: 165654 - DNA, 37 bp, Artificial Sequence
  Synthetic oligonucleotide
accggaccgctttgcactgcttcatcgctctccttga

SEQ ID NO: 165655 - DNA, 38 bp, Artificial Sequence
  Synthetic oligonucleotide
ggaggggaggggggtacggagaggcacgctaaagttga

SEQ ID NO: 165656 - DNA, 36 bp, Artificial Sequence
  Synthetic oligonucleotide
tcacacctcccaccgctgcacttggttcccgctata

SEQ ID NO: 165657 - DNA, 35 bp, Artificial Sequence
  Synthetic oligonucleotide
aatttgccgccgcctccttccgctttgggacacta

SEQ ID NO: 165658 - DNA, 35 bp, Artificial Sequence
  Synthetic oligonucleotide
gcatccaccgaaccgccattgctatttcaacccta

SEQ ID NO: 165659 - DNA, 36 bp, Artificial Sequence
  Synthetic oligonucleotide
ttgcgcccctctttgtactggtaatacggcctccta

SEQ ID NO: 165660 - DNA, 36 bp, Artificial Sequence
  Synthetic oligonucleotide
tttcgcccctccgtgcctgtactcatttccgacgta

SEQ ID NO: 165661 - DNA, 36 bp, Artificial Sequence
  Synthetic oligonucleotide
aaccccgccgactcttatcccctgcagtcacccgta

SEQ ID NO: 165662 - DNA, 36 bp, Artificial Sequence
  Synthetic oligonucleotide
tccgtgccccactcctcgcccatttcctgtggcgta

SEQ ID NO: 165663 - DNA, 35 bp, Artificial Sequence
  Synthetic oligonucleotide
gatgcacctcccatacggttactactcgcttcgta

SEQ ID NO: 165664 - DNA, 36 bp, Artificial Sequence
  Synthetic oligonucleotide
gtcttgcccgatcgcccgttccaacccccctttgta

SEQ ID NO: 165665 - DNA, 36 bp, Artificial Sequence
  Synthetic oligonucleotide
gacacgtatccatgagcctcccccccggacgtgtta

SEQ ID NO: 165666 - DNA, 36 bp, Artificial Sequence
  Synthetic oligonucleotide
tgtgcctccgaaatgcatgctgccctctctatttta

SEQ ID NO: 165667 - DNA, 35 bp, Artificial Sequence
  Synthetic oligonucleotide
acacgccacattcagtcggagcgccctacttgcac

SEQ ID NO: 165668 - DNA, 35 bp, Artificial Sequence
  Synthetic oligonucleotide
tgctcatatctgcattggtcatcttccgcccttac

SEQ ID NO: 165669 - DNA, 35 bp, Artificial Sequence
  Synthetic oligonucleotide
ggacacgaccgtggcccagcccctttgctttaccc

SEQ ID NO: 165670 - DNA, 34 bp, Artificial Sequence
  Synthetic oligonucleotide
acccttggaggtcagccacactcgcctgcacccc

SEQ ID NO: 165671 - DNA, 35 bp, Artificial Sequence
  Synthetic oligonucleotide
tggacaccatccagcgatggccgcattacctcccc

SEQ ID NO: 165672 - DNA, 35 bp, Artificial Sequence
  Synthetic oligonucleotide
ggggcgatgtcctttgtttgtgcctgtctgtcccc

SEQ ID NO: 165673 - DNA, 35 bp, Artificial Sequence
  Synthetic oligonucleotide
atctgacgcctgctcgcggcccccgccctattccc

SEQ ID NO: 165674 - DNA, 35 bp, Artificial Sequence
  Synthetic oligonucleotide
taaggccaggtcaccccctcggtattcctttcgcc

SEQ ID NO: 165675 - DNA, 36 bp, Artificial Sequence
  Synthetic oligonucleotide
tgtgacgtctcttcactaggccgtttttgccctgcc

SEQ ID NO: 165676 - DNA, 35 bp, Artificial Sequence
  Synthetic oligonucleotide
tgtccatccgcaaactaaatgtgctccactctgcc

SEQ ID NO: 165677 - DNA, 35 bp, Artificial Sequence
  Synthetic oligonucleotide
ttcgaggccacactgcgatcgtgttccgcccatcc

SEQ ID NO: 165678 - DNA, 35 bp, Artificial Sequence
  Synthetic oligonucleotide
gctccggtcactgaatggttcactactccttctcc

SEQ ID NO: 165679 - DNA, 35 bp, Artificial Sequence
  Synthetic oligonucleotide
gtgccccatacagaccgctatcatttaatccgtcc

SEQ ID NO: 165680 - DNA, 35 bp, Artificial Sequence
  Synthetic oligonucleotide
acccccatgtttgacttttatctgaagcctggtcc

SEQ ID NO: 165681 - DNA, 35 bp, Artificial Sequence
  Synthetic oligonucleotide
atgtgcctcctttcgtaccacaggcaagccaccgc

SEQ ID NO: 165682 - DNA, 35 bp, Artificial Sequence
  Synthetic oligonucleotide
ttcggtcagtgtattggttccgtttctcccctggc

SEQ ID NO: 165683 - DNA, 35 bp, Artificial Sequence
  Synthetic oligonucleotide
attcgccccctcacttcaccttgttagaatcgtgc

SEQ ID NO: 165684 - DNA, 35 bp, Artificial Sequence
  Synthetic oligonucleotide
tgcccttcctcgcatgtaacctcgcgtcttcttgc

SEQ ID NO: 165685 - DNA, 33 bp, Artificial Sequence
  Synthetic oligonucleotide
tacctgctgccacaatctgagtattgtcctatc

SEQ ID NO: 165686 - DNA, 35 bp, Artificial Sequence
  Synthetic oligonucleotide
acccccggttagtcatcgtccgcctattctccgtc

SEQ ID NO: 165687 - DNA, 35 bp, Artificial Sequence
  Synthetic oligonucleotide
acgacaatctgacggctccctactcctgcccggtc

SEQ ID NO: 165688 - DNA, 35 bp, Artificial Sequence
  Synthetic oligonucleotide
gatgagcgcccggtcatagctccaccgttttattc

SEQ ID NO: 165689 - DNA, 35 bp, Artificial Sequence
  Synthetic oligonucleotide
gatcaaccacaatactcctgtgccacgttgacttc

SEQ ID NO: 165690 - DNA, 35 bp, Artificial Sequence
  Synthetic oligonucleotide
tgtgcactgtttcatccgccgtacccgcccgtttc

SEQ ID NO: 165691 - DNA, 35 bp, Artificial Sequence
  Synthetic oligonucleotide
tcagcgctcgctcgtcttatgacccgcttcgtttc

SEQ ID NO: 165692 - DNA, 35 bp, Artificial Sequence
  Synthetic oligonucleotide
gtgcacacgcaagcaacatcccacgcgacatcccg

SEQ ID NO: 165693 - DNA, 35 bp, Artificial Sequence
  Synthetic oligonucleotide
tctcacccccatctttaatgttgtgtcaccctccg

SEQ ID NO: 165694 - DNA, 35 bp, Artificial Sequence
  Synthetic oligonucleotide
tctcctttagcacccgcctgtatctcatttcctcg

SEQ ID NO: 165695 - DNA, 35 bp, Artificial Sequence
  Synthetic oligonucleotide
tacagacggcgagcactttccgcttcctccattcg

SEQ ID NO: 165696 - DNA, 35 bp, Artificial Sequence
  Synthetic oligonucleotide
tccatgtccagaggaggaaggaggggacgaagagg

SEQ ID NO: 165697 - DNA, 35 bp, Artificial Sequence
  Synthetic oligonucleotide
acccacgctctctggccgtctttctctccattagg

SEQ ID NO: 165698 - DNA, 35 bp, Artificial Sequence
  Synthetic oligonucleotide
atgcgctctccattagtacttttccctgttttcgg

SEQ ID NO: 165699 - DNA, 35 bp, Artificial Sequence
  Synthetic oligonucleotide
tatttccacctcacgccttctaagcccaccgttgg

SEQ ID NO: 165700 - DNA, 35 bp, Artificial Sequence
  Synthetic oligonucleotide
tgccaccccgaatacatcccacgaccctacacctg

SEQ ID NO: 165701 - DNA, 35 bp, Artificial Sequence
  Synthetic oligonucleotide
gagagagcgccatccgtatctttgtccaccccctg

SEQ ID NO: 165702 - DNA, 35 bp, Artificial Sequence
  Synthetic oligonucleotide
tccgaccacctcccatgtttcacacccccgccctg

SEQ ID NO: 165703 - DNA, 35 bp, Artificial Sequence
  Synthetic oligonucleotide
gagcaacgggccactccacccatttacgccttctg

SEQ ID NO: 165704 - DNA, 35 bp, Artificial Sequence
  Synthetic oligonucleotide
tcgtgctgcctcctcgggcctccccacgcactttg

SEQ ID NO: 165705 - DNA, 35 bp, Artificial Sequence
  Synthetic oligonucleotide
tcttgccccaacccccgtgtgaccattgtactttg

SEQ ID NO: 165706 - DNA, 35 bp, Artificial Sequence
  Synthetic oligonucleotide
gtgatgtgaaggtgatggagcgggcatcggggaat

SEQ ID NO: 165707 - DNA, 35 bp, Artificial Sequence
  Synthetic oligonucleotide
tccccaccctcgatgggaggaacatcgctccacat

SEQ ID NO: 165708 - DNA, 35 bp, Artificial Sequence
  Synthetic oligonucleotide
gtgccatcttgcggattgcctaccgtgccacccat

SEQ ID NO: 165709 - DNA, 35 bp, Artificial Sequence
  Synthetic oligonucleotide
gccgtgcacccccgttgccaatgtttcaactaact

SEQ ID NO: 165710 - DNA, 35 bp, Artificial Sequence
  Synthetic oligonucleotide
gactgtaacatcctccccgtagcacagactttcct

SEQ ID NO: 165711 - DNA, 35 bp, Artificial Sequence
  Synthetic oligonucleotide
aaccatcccattcgatctgtgcagaccctgcctct

SEQ ID NO: 165712 - DNA, 35 bp, Artificial Sequence
  Synthetic oligonucleotide
tagttcaccgtctccccattcgcgatcgcctacgt

SEQ ID NO: 165713 - DNA, 35 bp, Artificial Sequence
  Synthetic oligonucleotide
gaatctccccatgaataggacactcccattttcgt

SEQ ID NO: 165714 - DNA, 35 bp, Artificial Sequence
  Synthetic oligonucleotide
gagcctcctcacgttttaggttccatcaacttggt

SEQ ID NO: 165715 - DNA, 35 bp, Artificial Sequence
  Synthetic oligonucleotide
tacgtacgggggagatgggggaagtcggcggatgt

SEQ ID NO: 165716 - DNA, 35 bp, Artificial Sequence
  Synthetic oligonucleotide
gatgcggggagggaagaggggagccccgggattgt

SEQ ID NO: 165717 - DNA, 35 bp, Artificial Sequence
  Synthetic oligonucleotide
gaaaagtacgggaggcgggtaggggactggtttgt

SEQ ID NO: 165718 - DNA, 34 bp, Artificial Sequence
  Synthetic oligonucleotide
gtctccccctccctgcattgttagctttcacctt

SEQ ID NO: 165719 - DNA, 35 bp, Artificial Sequence
  Synthetic oligonucleotide
tgccccatagccccgctgatattccctgtttggtt

SEQ ID NO: 165720 - DNA, 35 bp, Artificial Sequence
  Synthetic oligonucleotide
tacccccgcacggagtatcgtcccacctggcgttt

SEQ ID NO: 165721 - DNA, 35 bp, Artificial Sequence
  Synthetic oligonucleotide
gcccctctacgcctattgttaatactccttggttt

SEQ ID NO: 165722 - DNA, 35 bp, Artificial Sequence
  Synthetic oligonucleotide
aacgatcgcgtcatacgttcttcccgccgctgttt

SEQ ID NO: 165723 - DNA, 36 bp, Artificial Sequence
  Synthetic oligonucleotide
ttcctgccctcactcgtcatacttggcccgtaacaa

SEQ ID NO: 165724 - DNA, 36 bp, Artificial Sequence
  Synthetic oligonucleotide
aaagccatcagccagccccccgcccagcgccctcaa

SEQ ID NO: 165725 - DNA, 36 bp, Artificial Sequence
  Synthetic oligonucleotide
acccgccgcaatcggttattcccactcaccatcgaa

SEQ ID NO: 165726 - DNA, 35 bp, Artificial Sequence
  Synthetic oligonucleotide
tgttcccccgcgtcccacgctcccccgccactgaa

SEQ ID NO: 165727 - DNA, 36 bp, Artificial Sequence
  Synthetic oligonucleotide
ttccccctccatcccgccgcatccaatgtttttaca

SEQ ID NO: 165728 - DNA, 35 bp, Artificial Sequence
  Synthetic oligonucleotide
tcccactaccccccttccgcgctgttaattcgcca

SEQ ID NO: 165729 - DNA, 35 bp, Artificial Sequence
  Synthetic oligonucleotide
agaccacgacgtcctccttctgcgccgccttgcca

SEQ ID NO: 165730 - DNA, 35 bp, Artificial Sequence
  Synthetic oligonucleotide
acacgctcgccttcatctgttaccggttttatcca

SEQ ID NO: 165731 - DNA, 36 bp, Artificial Sequence
  Synthetic oligonucleotide
actcccgatcccgcccgcatagagacaagttaagca

SEQ ID NO: 165732 - DNA, 36 bp, Artificial Sequence
  Synthetic oligonucleotide
atctgtcagcatgtgccacgttcccgccaatccgca

SEQ ID NO: 165733 - DNA, 36 bp, Artificial Sequence
  Synthetic oligonucleotide
gcacattaagagggaggaacaagggcgggggcatca

SEQ ID NO: 165734 - DNA, 36 bp, Artificial Sequence
  Synthetic oligonucleotide
acgaatcccaccgcactgtccgtagtcgctatctca

SEQ ID NO: 165735 - DNA, 35 bp, Artificial Sequence
  Synthetic oligonucleotide
tgcacgccaccactttctgcacgaacccgtattca

SEQ ID NO: 165736 - DNA, 35 bp, Artificial Sequence
  Synthetic oligonucleotide
gctcaccatccgggtccccagattccttacgttca

SEQ ID NO: 165737 - DNA, 35 bp, Artificial Sequence
  Synthetic oligonucleotide
gaccaacaccgctccccttttgttacaccgtttca

SEQ ID NO: 165738 - DNA, 37 bp, Artificial Sequence
  Synthetic oligonucleotide
gacgcccctccagtgcctccttttatctcatgcaaga

SEQ ID NO: 165739 - DNA, 36 bp, Artificial Sequence
  Synthetic oligonucleotide
gtacgtagagccgggggtaaagcggaggaacgaaga

SEQ ID NO: 165740 - DNA, 37 bp, Artificial Sequence
  Synthetic oligonucleotide
tgctgcaacccttgtccattaacttccgcctcaccga

SEQ ID NO: 165741 - DNA, 37 bp, Artificial Sequence
  Synthetic oligonucleotide
atgccacctgtcctggcaccgcttgctcttcacccga

SEQ ID NO: 165742 - DNA, 35 bp, Artificial Sequence
  Synthetic oligonucleotide
actgttgggcagtgatgtcacccgcctatccccga

SEQ ID NO: 165743 - DNA, 37 bp, Artificial Sequence
  Synthetic oligonucleotide
tcatccgcctcccgcattgagtaccccctttactcga

SEQ ID NO: 165744 - DNA, 35 bp, Artificial Sequence
  Synthetic oligonucleotide
ttctacacgtcactctcccatttgacccacctcga

SEQ ID NO: 165745 - DNA, 37 bp, Artificial Sequence
  Synthetic oligonucleotide
ttgctgtggcacacttcgtttcatcgccctctctcga

SEQ ID NO: 165746 - DNA, 36 bp, Artificial Sequence
  Synthetic oligonucleotide
gtccacatcacactacactatttcatcctgtctcga

SEQ ID NO: 165747 - DNA, 37 bp, Artificial Sequence
  Synthetic oligonucleotide
gaacacaacgggagggagttgaaactgggtggaagga

SEQ ID NO: 165748 - DNA, 37 bp, Artificial Sequence
  Synthetic oligonucleotide
aaagatggagagagtgaggagtaatggaggcggagga

SEQ ID NO: 165749 - DNA, 35 bp, Artificial Sequence
  Synthetic oligonucleotide
tcccccccgtgtccgtcctaccccactcctgagga

SEQ ID NO: 165750 - DNA, 36 bp, Artificial Sequence
  Synthetic oligonucleotide
tagtagtgcggagggtctataggtagttggggcgga

SEQ ID NO: 165751 - DNA, 37 bp, Artificial Sequence
  Synthetic oligonucleotide
taggatagctggtccgggcgggggagggaatcaggga

SEQ ID NO: 165752 - DNA, 37 bp, Artificial Sequence
  Synthetic oligonucleotide
tacggaagggttgggtcgggatagggtggctagggga

SEQ ID NO: 165753 - DNA, 36 bp, Artificial Sequence
  Synthetic oligonucleotide
gtgggggcaaggtagggcgcgggtaatgagcgggga

SEQ ID NO: 165754 - DNA, 37 bp, Artificial Sequence
  Synthetic oligonucleotide
cctgggggttagtgatgtgttaccgggggaggtggga

SEQ ID NO: 165755 - DNA, 37 bp, Artificial Sequence
  Synthetic oligonucleotide
gaggggaggggcgcgcttgagggaagtcggggatgga

SEQ ID NO: 165756 - DNA, 37 bp, Artificial Sequence
  Synthetic oligonucleotide
gcgtatccgcactgttccgtgctaccgtttccctgga

SEQ ID NO: 165757 - DNA, 37 bp, Artificial Sequence
  Synthetic oligonucleotide
tgttgcattcagaccgctctccaccgccgcatttgga

SEQ ID NO: 165758 - DNA, 37 bp, Artificial Sequence
  Synthetic oligonucleotide
gccgcccacctgcacggtctagtctatcccatcatga

SEQ ID NO: 165759 - DNA, 38 bp, Artificial Sequence
  Synthetic oligonucleotide
gagtgggtgcggtgggaggggatcacgtaggtgtatga

SEQ ID NO: 165760 - DNA, 35 bp, Artificial Sequence
  Synthetic oligonucleotide
acaccgcccccatcctgcaaccgaggccaccctga

SEQ ID NO: 165761 - DNA, 37 bp, Artificial Sequence
  Synthetic oligonucleotide
gcccgctccgcgccgtccttttgaactctccgcctga

SEQ ID NO: 165762 - DNA, 38 bp, Artificial Sequence
  Synthetic oligonucleotide
aacccctgccacacagatcgcaactgccccctcgctga

SEQ ID NO: 165763 - DNA, 38 bp, Artificial Sequence
  Synthetic oligonucleotide
acacccatatgatatgccatccgcccgccacgcagtga

SEQ ID NO: 165764 - DNA, 38 bp, Artificial Sequence
  Synthetic oligonucleotide
gttcgctcgctcgtgtacatcccgttcctcccccgtga

SEQ ID NO: 165765 - DNA, 38 bp, Artificial Sequence
  Synthetic oligonucleotide
gaggtgcgcgagacaggatagggtgggggcaaaggtga

SEQ ID NO: 165766 - DNA, 37 bp, Artificial Sequence
  Synthetic oligonucleotide
aaccgcagtgacagggagaagggctgcggggtggtga

SEQ ID NO: 165767 - DNA, 38 bp, Artificial Sequence
  Synthetic oligonucleotide
gataacgtctgctctcgctcctcgccctgtccgtgtga

SEQ ID NO: 165768 - DNA, 36 bp, Artificial Sequence
  Synthetic oligonucleotide
tcccctcgtcgactaatggcgacctccctctattga

SEQ ID NO: 165769 - DNA, 37 bp, Artificial Sequence
  Synthetic oligonucleotide
gagcccccgctcacgccatcatccgcttactccttga

SEQ ID NO: 165770 - DNA, 38 bp, Artificial Sequence
  Synthetic oligonucleotide
tcgcgccactgattcgatcttagtcccccgctccttga

SEQ ID NO: 165771 - DNA, 37 bp, Artificial Sequence
  Synthetic oligonucleotide
acaccccccctcggtgtcatcgccttgtcacctttga

SEQ ID NO: 165772 - DNA, 36 bp, Artificial Sequence
  Synthetic oligonucleotide
ttcgccctcctgcgtactacttttctgcactacata

SEQ ID NO: 165773 - DNA, 36 bp, Artificial Sequence
  Synthetic oligonucleotide
ttatcccaccacgagcgcccgacgaccgccttccta

SEQ ID NO: 165774 - DNA, 35 bp, Artificial Sequence
  Synthetic oligonucleotide
gttgcatcagccctcgccattcccgcccatgtcta

SEQ ID NO: 165775 - DNA, 36 bp, Artificial Sequence
  Synthetic oligonucleotide
acctgcacccctgcccctcattcgtgccaccccgta

SEQ ID NO: 165776 - DNA, 34 bp, Artificial Sequence
  Synthetic oligonucleotide
ttcactgtgcctatttatcctgttccagcccgta

SEQ ID NO: 165777 - DNA, 36 bp, Artificial Sequence
  Synthetic oligonucleotide
actcgctcccgaccctgtgaaagccactcctcggta

SEQ ID NO: 165778 - DNA, 35 bp, Artificial Sequence
  Synthetic oligonucleotide
tttgatcgcctcatcctgcctatctgtggccacac

SEQ ID NO: 165779 - DNA, 35 bp, Artificial Sequence
  Synthetic oligonucleotide
gttggctacccatcttactgtctaattctgtcacc

SEQ ID NO: 165780 - DNA, 35 bp, Artificial Sequence
  Synthetic oligonucleotide
gcaccattcttgcccttccgatgctgattttcacc

SEQ ID NO: 165781 - DNA, 35 bp, Artificial Sequence
  Synthetic oligonucleotide
accgagtcccccgtgatttttcccgccccctgacc

SEQ ID NO: 165782 - DNA, 35 bp, Artificial Sequence
  Synthetic oligonucleotide
tccgcccgtaaacttctgcttggtccgtggctacc

SEQ ID NO: 165783 - DNA, 35 bp, Artificial Sequence
  Synthetic oligonucleotide
atcctaccttccatgtgccccattacggactaccc

SEQ ID NO: 165784 - DNA, 35 bp, Artificial Sequence
  Synthetic oligonucleotide
gaataacacgcgcccaccacgcgtctcactgcccc

SEQ ID NO: 165785 - DNA, 35 bp, Artificial Sequence
  Synthetic oligonucleotide
tctcgcccctctcgaatgtctccgaccccgctccc

SEQ ID NO: 165786 - DNA, 35 bp, Artificial Sequence
  Synthetic oligonucleotide
gtggacctccgcacacatactactggctaaaagcc

SEQ ID NO: 165787 - DNA, 35 bp, Artificial Sequence
  Synthetic oligonucleotide
tctccctcaccaaatcatggtgtatttcctctgcc

SEQ ID NO: 165788 - DNA, 35 bp, Artificial Sequence
  Synthetic oligonucleotide
tagtgcgaccggtctgccccgcacaagaatcctcc

SEQ ID NO: 165789 - DNA, 35 bp, Artificial Sequence
  Synthetic oligonucleotide
gtgtctatcgcgccacctctttgcctatttagtcc

SEQ ID NO: 165790 - DNA, 35 bp, Artificial Sequence
  Synthetic oligonucleotide
gatcggccatcagtttccttcatgctgccgggtcc

SEQ ID NO: 165791 - DNA, 35 bp, Artificial Sequence
  Synthetic oligonucleotide
tttgaccgccgttgttgccgattctctggcgttcc

SEQ ID NO: 165792 - DNA, 35 bp, Artificial Sequence
  Synthetic oligonucleotide
gtacaggacgcatgatatgagtccgtaattgttcc

SEQ ID NO: 165793 - DNA, 35 bp, Artificial Sequence
  Synthetic oligonucleotide
ccctccgcgctctactacggcaccctggtctttcc

SEQ ID NO: 165794 - DNA, 35 bp, Artificial Sequence
  Synthetic oligonucleotide
ggaccacgtgccatccctcgtaaatttgcttttcc

SEQ ID NO: 165795 - DNA, 35 bp, Artificial Sequence
  Synthetic oligonucleotide
gccactctcgcccccctagtaagactgtaccaggc

SEQ ID NO: 165796 - DNA, 35 bp, Artificial Sequence
  Synthetic oligonucleotide
tgccacgaagtctacttgctccttcacctgccggc

SEQ ID NO: 165797 - DNA, 35 bp, Artificial Sequence
  Synthetic oligonucleotide
gaatgcgctcacccattacacctcccatcatcggc

SEQ ID NO: 165798 - DNA, 35 bp, Artificial Sequence
  Synthetic oligonucleotide
gcaacgcggtttgccacccccgcgatctctaatgc

SEQ ID NO: 165799 - DNA, 35 bp, Artificial Sequence
  Synthetic oligonucleotide
tgacatagctcgcactgttctcctctcgctggtgc

SEQ ID NO: 165800 - DNA, 35 bp, Artificial Sequence
  Synthetic oligonucleotide
acacctcacccgtccacggctccagttgcaattgc

SEQ ID NO: 165801 - DNA, 35 bp, Artificial Sequence
  Synthetic oligonucleotide
gtctcagctttccatgccgcatacaaccgtctctc

SEQ ID NO: 165802 - DNA, 35 bp, Artificial Sequence
  Synthetic oligonucleotide
taccactgcgcatatgtgtctcgtgctgccttctc

SEQ ID NO: 165803 - DNA, 35 bp, Artificial Sequence
  Synthetic oligonucleotide
acagcccctacttgtctctttacatgcgctccgtc

SEQ ID NO: 165804 - DNA, 35 bp, Artificial Sequence
  Synthetic oligonucleotide
gacccatcaccttcttcctggccccccagtatgag

SEQ ID NO: 165805 - DNA, 35 bp, Artificial Sequence
  Synthetic oligonucleotide
atcacttcaccactcacgcccgtacacctatgacg

SEQ ID NO: 165806 - DNA, 35 bp, Artificial Sequence
  Synthetic oligonucleotide
gacccgtcagttgactcctctctcatgaccccccg

SEQ ID NO: 165807 - DNA, 35 bp, Artificial Sequence
  Synthetic oligonucleotide
tgtgctgtccgctagttgccttaacccccccctcg

SEQ ID NO: 165808 - DNA, 35 bp, Artificial Sequence
  Synthetic oligonucleotide
gtcatccgcccttttgtaatcgctctcgttagtcg

SEQ ID NO: 165809 - DNA, 35 bp, Artificial Sequence
  Synthetic oligonucleotide
gcacgtggggaggtgaggtactcggggagatgggg

SEQ ID NO: 165810 - DNA, 35 bp, Artificial Sequence
  Synthetic oligonucleotide
cccactcgcacgtttctcggctcccctactcttgg

SEQ ID NO: 165811 - DNA, 35 bp, Artificial Sequence
  Synthetic oligonucleotide
gatcgggtggacggattgggaggagataagggatg

SEQ ID NO: 165812 - DNA, 35 bp, Artificial Sequence
  Synthetic oligonucleotide
atgcttccgtacgttgcccactcttaccctttctg

SEQ ID NO: 165813 - DNA, 35 bp, Artificial Sequence
  Synthetic oligonucleotide
tcacctcctagctgcccctcgactcccgcaccttg

SEQ ID NO: 165814 - DNA, 35 bp, Artificial Sequence
  Synthetic oligonucleotide
tcgacaccccgcactcattcacaacctcacgtttg

SEQ ID NO: 165815 - DNA, 35 bp, Artificial Sequence
  Synthetic oligonucleotide
tccgagctgattcggctcagttcccacgctttact

SEQ ID NO: 165816 - DNA, 35 bp, Artificial Sequence
  Synthetic oligonucleotide
tcagttgggccatccggtgtttgtcccgctttact

SEQ ID NO: 165817 - DNA, 35 bp, Artificial Sequence
  Synthetic oligonucleotide
gccgctgcgcatgttccgttcaatcatagcgccct

SEQ ID NO: 165818 - DNA, 35 bp, Artificial Sequence
  Synthetic oligonucleotide
ccgtgcgagctctatggcctcagtttctttgccct

SEQ ID NO: 165819 - DNA, 35 bp, Artificial Sequence
  Synthetic oligonucleotide
gtgatcatacggaccacccccccggttccctccct

SEQ ID NO: 165820 - DNA, 34 bp, Artificial Sequence
  Synthetic oligonucleotide
tcgccatcactctgccagccttgtcctaccgcct

SEQ ID NO: 165821 - DNA, 35 bp, Artificial Sequence
  Synthetic oligonucleotide
tcacgaccgttatcgctcccgcttgcatccatcct

SEQ ID NO: 165822 - DNA, 35 bp, Artificial Sequence
  Synthetic oligonucleotide
acctactccagccttctaacgcgggtcgctctcct

SEQ ID NO: 165823 - DNA, 35 bp, Artificial Sequence
  Synthetic oligonucleotide
gccccgcgctgtcataatactacgttctcccggct

SEQ ID NO: 165824 - DNA, 35 bp, Artificial Sequence
  Synthetic oligonucleotide
tcagtccggcgcagggttcatcaatttctgtctct

SEQ ID NO: 165825 - DNA, 35 bp, Artificial Sequence
  Synthetic oligonucleotide
tagaacccgctacctgcctgctatcgttctacctt

SEQ ID NO: 165826 - DNA, 35 bp, Artificial Sequence
  Synthetic oligonucleotide
ggcacccgcctatcgtcctggcctttccccacgtt

SEQ ID NO: 165827 - DNA, 35 bp, Artificial Sequence
  Synthetic oligonucleotide
atcttctccacgcacgcgccatcgtccgcctcgtt

SEQ ID NO: 165828 - DNA, 35 bp, Artificial Sequence
  Synthetic oligonucleotide
tcagatggggtaggccgcccttccgaatatccttt

SEQ ID NO: 165829 - DNA, 37 bp, Artificial Sequence
  Synthetic oligonucleotide
gagacggggacgagacggggtctgcggggatggaaaa

SEQ ID NO: 165830 - DNA, 35 bp, Artificial Sequence
  Synthetic oligonucleotide
ttccgccccctgtcgctacattgttcgacgctaaa

SEQ ID NO: 165831 - DNA, 35 bp, Artificial Sequence
  Synthetic oligonucleotide
agacggtggggggggggagagggatgtgagcacaa

SEQ ID NO: 165832 - DNA, 35 bp, Artificial Sequence
  Synthetic oligonucleotide
tgcggaactcactgctttatctaccctgcacgcaa

SEQ ID NO: 165833 - DNA, 36 bp, Artificial Sequence
  Synthetic oligonucleotide
atcgtcatgtcctgcttggcatattccacccatcaa

SEQ ID NO: 165834 - DNA, 36 bp, Artificial Sequence
  Synthetic oligonucleotide
tcagagctggcggataagggggggtggcgggaataa

SEQ ID NO: 165835 - DNA, 36 bp, Artificial Sequence
  Synthetic oligonucleotide
gaccgatgctcgcttgttgagccacacctctcttaa

SEQ ID NO: 165836 - DNA, 35 bp, Artificial Sequence
  Synthetic oligonucleotide
tcacgacgtcagtcagtcctcccttttatcgcaca

SEQ ID NO: 165837 - DNA, 36 bp, Artificial Sequence
  Synthetic oligonucleotide
gcccagccgcatgaattcatcgagcctcccattaca

SEQ ID NO: 165838 - DNA, 36 bp, Artificial Sequence
  Synthetic oligonucleotide
gatgcgtgtctgcgctaccatccacctcacgttaca

SEQ ID NO: 165839 - DNA, 36 bp, Artificial Sequence
  Synthetic oligonucleotide
tcctaccccgacttctgccgccggaactttgttaca

SEQ ID NO: 165840 - DNA, 36 bp, Artificial Sequence
  Synthetic oligonucleotide
gtgcacgtataggccgtcccttctgcccgcgaccca

SEQ ID NO: 165841 - DNA, 36 bp, Artificial Sequence
  Synthetic oligonucleotide
tccgatacgcttatgcagaccacaaccatctaccca

SEQ ID NO: 165842 - DNA, 35 bp, Artificial Sequence
  Synthetic oligonucleotide
aagccgcgatcagtcacaaccccttcccccctcca

SEQ ID NO: 165843 - DNA, 35 bp, Artificial Sequence
  Synthetic oligonucleotide
ttgaccccgcccgctcccaatcttgtgaacagtca

SEQ ID NO: 165844 - DNA, 36 bp, Artificial Sequence
  Synthetic oligonucleotide
ggacaccttcacttacacgccctcgctctcgcttca

SEQ ID NO: 165845 - DNA, 35 bp, Artificial Sequence
  Synthetic oligonucleotide
tctcccccgacgctactatgttggttcctggttca

SEQ ID NO: 165846 - DNA, 35 bp, Artificial Sequence
  Synthetic oligonucleotide
agagggagggggggaggtgtacaacgggcgtttca

SEQ ID NO: 165847 - DNA, 37 bp, Artificial Sequence
  Synthetic oligonucleotide
gcaccaccacctgttgattcggcacccctgacccaga

SEQ ID NO: 165848 - DNA, 35 bp, Artificial Sequence
  Synthetic oligonucleotide
acattcctctgatcgcctcctccacacattgtaga

SEQ ID NO: 165849 - DNA, 37 bp, Artificial Sequence
  Synthetic oligonucleotide
ggatggggtggggtggagggctccgggggattaacga

SEQ ID NO: 165850 - DNA, 36 bp, Artificial Sequence
  Synthetic oligonucleotide
acgcgcctacgtaattgtcactcactccccacccga

SEQ ID NO: 165851 - DNA, 37 bp, Artificial Sequence
  Synthetic oligonucleotide
gacgccgaccgtggccaatattcagcctctcccccga

SEQ ID NO: 165852 - DNA, 37 bp, Artificial Sequence
  Synthetic oligonucleotide
tgactcgcccgcaactatgtatcggcctctacctcga

SEQ ID NO: 165853 - DNA, 37 bp, Artificial Sequence
  Synthetic oligonucleotide
tcctcccgcccaacactggctgatcttccttccagga

SEQ ID NO: 165854 - DNA, 37 bp, Artificial Sequence
  Synthetic oligonucleotide
acacgggccacagctggggatacggggttaagaggga

SEQ ID NO: 165855 - DNA, 36 bp, Artificial Sequence
  Synthetic oligonucleotide
ccactcttccatccgcgctcttgctattgtacggga

SEQ ID NO: 165856 - DNA, 37 bp, Artificial Sequence
  Synthetic oligonucleotide
aacgtcgtaacagtgagggcaaaggtggaggagtgga

SEQ ID NO: 165857 - DNA, 37 bp, Artificial Sequence
  Synthetic oligonucleotide
gccgggagttgagacatgaaaaaggggggggagtgga

SEQ ID NO: 165858 - DNA, 38 bp, Artificial Sequence
  Synthetic oligonucleotide
gtcctccgccctggccttaaatcaccatcacacaatga

SEQ ID NO: 165859 - DNA, 37 bp, Artificial Sequence
  Synthetic oligonucleotide
accaccctctctgcacacgtcgcgcctcttcccatga

SEQ ID NO: 165860 - DNA, 38 bp, Artificial Sequence
  Synthetic oligonucleotide
tcaccccccacatcccacataagagaccgggggtatga

SEQ ID NO: 165861 - DNA, 37 bp, Artificial Sequence
  Synthetic oligonucleotide
gcctcgtagtcccgctccttcccgtcctgcttcctga

SEQ ID NO: 165862 - DNA, 38 bp, Artificial Sequence
  Synthetic oligonucleotide
accgacgtcggtcgtcgttacgttccccgatttgctga

SEQ ID NO: 165863 - DNA, 37 bp, Artificial Sequence
  Synthetic oligonucleotide
tgtcgacgaaacggggtgggagggacgggctccgtga

SEQ ID NO: 165864 - DNA, 38 bp, Artificial Sequence
  Synthetic oligonucleotide
tgttcctcgcccccgcccatctgttgcagttcacttga

SEQ ID NO: 165865 - DNA, 38 bp, Artificial Sequence
  Synthetic oligonucleotide
tcccacccggccacggttgttaacctctttacccttga

SEQ ID NO: 165866 - DNA, 36 bp, Artificial Sequence
  Synthetic oligonucleotide
tctgatggggaggggcatagcatgagagggggttga

SEQ ID NO: 165867 - DNA, 36 bp, Artificial Sequence
  Synthetic oligonucleotide
actgcccaacctatgctgccatcattccaggacgta

SEQ ID NO: 165868 - DNA, 36 bp, Artificial Sequence
  Synthetic oligonucleotide
ggggcaacagggagggggggagtaacctatacggta

SEQ ID NO: 165869 - DNA, 35 bp, Artificial Sequence
  Synthetic oligonucleotide
gtgggggggcggaaggggacacctactggtcggta

SEQ ID NO: 165870 - DNA, 35 bp, Artificial Sequence
  Synthetic oligonucleotide
tgcctcctgcccccatcgctatgcctacttcgtta

SEQ ID NO: 165871 - DNA, 36 bp, Artificial Sequence
  Synthetic oligonucleotide
tgttgcaccttcggtcgtactacctcgttgccttta

SEQ ID NO: 165872 - DNA, 35 bp, Artificial Sequence
  Synthetic oligonucleotide
accgctagtgttctgctctcttcttaggccctaac

SEQ ID NO: 165873 - DNA, 32 bp, Artificial Sequence
  Synthetic oligonucleotide
acgaccctcctgaccgcacccctgacgctcac

SEQ ID NO: 165874 - DNA, 34 bp, Artificial Sequence
  Synthetic oligonucleotide
tcacctatggtatttgtgccgtgcttgcctttac

SEQ ID NO: 165875 - DNA, 35 bp, Artificial Sequence
  Synthetic oligonucleotide
gccaccgccgtagaccctgactccctcactaaacc

SEQ ID NO: 165876 - DNA, 35 bp, Artificial Sequence
  Synthetic oligonucleotide
tgaaccccccattgcttctcaagtcctgcgggacc

SEQ ID NO: 165877 - DNA, 35 bp, Artificial Sequence
  Synthetic oligonucleotide
gattggaagcgcaccatcctgtccgccctgttacc

SEQ ID NO: 165878 - DNA, 35 bp, Artificial Sequence
  Synthetic oligonucleotide
atctgaccctccgccgtcttaggactacacgaccc

SEQ ID NO: 165879 - DNA, 35 bp, Artificial Sequence
  Synthetic oligonucleotide
tagtattgccgtgcccagttatgattcgcctcccc

SEQ ID NO: 165880 - DNA, 35 bp, Artificial Sequence
  Synthetic oligonucleotide
actttctcctcggctgccataacagtcctgctccc

SEQ ID NO: 165881 - DNA, 35 bp, Artificial Sequence
  Synthetic oligonucleotide
gtaacactcacgtatgtgcgcattcatcctttccc

SEQ ID NO: 165882 - DNA, 35 bp, Artificial Sequence
  Synthetic oligonucleotide
aactcccgctccatgcgtctcccatcccctctgcc

SEQ ID NO: 165883 - DNA, 35 bp, Artificial Sequence
  Synthetic oligonucleotide
gtaacgccattgtctacggcccttcgcttcttgcc

SEQ ID NO: 165884 - DNA, 35 bp, Artificial Sequence
  Synthetic oligonucleotide
gttgcgttggctatggctcctacgctggtacctcc

SEQ ID NO: 165885 - DNA, 34 bp, Artificial Sequence
  Synthetic oligonucleotide
atgtacgtgcgcaaccatctccttgcacccctcc

SEQ ID NO: 165886 - DNA, 35 bp, Artificial Sequence
  Synthetic oligonucleotide
gaagagacgcagattccgtacaacccgtcgcctcc

SEQ ID NO: 165887 - DNA, 35 bp, Artificial Sequence
  Synthetic oligonucleotide
acttgcgaagtccgctcgacgagtaactgtcctcc

SEQ ID NO: 165888 - DNA, 35 bp, Artificial Sequence
  Synthetic oligonucleotide
ggttgtcagccggccctgtcgccatctgtacttcc

SEQ ID NO: 165889 - DNA, 35 bp, Artificial Sequence
  Synthetic oligonucleotide
agtccgcgcgacgttggccgtccgccttgccttcc

SEQ ID NO: 165890 - DNA, 35 bp, Artificial Sequence
  Synthetic oligonucleotide
gccgtgagtgttacccgcgttcgattccgccctgc

SEQ ID NO: 165891 - DNA, 35 bp, Artificial Sequence
  Synthetic oligonucleotide
ggaacgcgtcccggccctctcactcgctcgcaatc

SEQ ID NO: 165892 - DNA, 35 bp, Artificial Sequence
  Synthetic oligonucleotide
gcccatcgggggggcggggttggggccctgacatc

SEQ ID NO: 165893 - DNA, 35 bp, Artificial Sequence
  Synthetic oligonucleotide
gtcgcgccctgtaaacctgcactcttctgccactc

SEQ ID NO: 165894 - DNA, 34 bp, Artificial Sequence
  Synthetic oligonucleotide
agtacacccttcaggccccccccctcgcctactc

SEQ ID NO: 165895 - DNA, 35 bp, Artificial Sequence
  Synthetic oligonucleotide
tgaccgggcgatcttcagccgtcccctagcccctc

SEQ ID NO: 165896 - DNA, 35 bp, Artificial Sequence
  Synthetic oligonucleotide
tccacgcacggacgcgatccactgctgatatcctc

SEQ ID NO: 165897 - DNA, 35 bp, Artificial Sequence
  Synthetic oligonucleotide
tgccgatcccgcttagattgccgccgtttatcctc

SEQ ID NO: 165898 - DNA, 35 bp, Artificial Sequence
  Synthetic oligonucleotide
tacctatccgagccgcgctgtccgagccgttcctc

SEQ ID NO: 165899 - DNA, 35 bp, Artificial Sequence
  Synthetic oligonucleotide
caacgccaccggcgaaatgctatccctccctgctc

SEQ ID NO: 165900 - DNA, 35 bp, Artificial Sequence
  Synthetic oligonucleotide
gacgcatccctcctgccgctttacgctccacattc

SEQ ID NO: 165901 - DNA, 35 bp, Artificial Sequence
  Synthetic oligonucleotide
agtggaaagggaggtgaaaggtgggcgtatatcag

SEQ ID NO: 165902 - DNA, 35 bp, Artificial Sequence
  Synthetic oligonucleotide
ggtagagagaggaaaggagcggagaagagaaaacg

SEQ ID NO: 165903 - DNA, 35 bp, Artificial Sequence
  Synthetic oligonucleotide
gctgtaatcgcccttcctccagccagccccacacg

SEQ ID NO: 165904 - DNA, 35 bp, Artificial Sequence
  Synthetic oligonucleotide
tacgcccggtatccttcttttgcgtcttcgacccg

SEQ ID NO: 165905 - DNA, 35 bp, Artificial Sequence
  Synthetic oligonucleotide
tcgcacccattaagatagttatgttcgtccccccg

SEQ ID NO: 165906 - DNA, 34 bp, Artificial Sequence
  Synthetic oligonucleotide
aacgccctttattgagcccattgaccccagcccg

SEQ ID NO: 165907 - DNA, 35 bp, Artificial Sequence
  Synthetic oligonucleotide
gtctgtgctgctagcgaccccccgcccaaccgccg

SEQ ID NO: 165908 - DNA, 35 bp, Artificial Sequence
  Synthetic oligonucleotide
gcacttctcgcgcccgccgccttttcctccccagg

SEQ ID NO: 165909 - DNA, 35 bp, Artificial Sequence
  Synthetic oligonucleotide
ttccccacgcgtgttcggtctctgctctacctagg

SEQ ID NO: 165910 - DNA, 34 bp, Artificial Sequence
  Synthetic oligonucleotide
gccgtcacctaacttgccgtttcttcccactatg

SEQ ID NO: 165911 - DNA, 35 bp, Artificial Sequence
  Synthetic oligonucleotide
gatgccccacattgtactctcgatctaccaccctg

SEQ ID NO: 165912 - DNA, 35 bp, Artificial Sequence
  Synthetic oligonucleotide
tttgcccttccccagcgtccctcggcccctcagtg

SEQ ID NO: 165913 - DNA, 35 bp, Artificial Sequence
  Synthetic oligonucleotide
atactacatccgttcccctgtcccgcccagccgtg

SEQ ID NO: 165914 - DNA, 35 bp, Artificial Sequence
  Synthetic oligonucleotide
tcctccccttgtcaacgccggccccccgaatattg

SEQ ID NO: 165915 - DNA, 35 bp, Artificial Sequence
  Synthetic oligonucleotide
tccccttcccgaccgtgcccgcctggatcagcttg

SEQ ID NO: 165916 - DNA, 35 bp, Artificial Sequence
  Synthetic oligonucleotide
tgttcatgcgtgccacctcgccccttccgtacaat

SEQ ID NO: 165917 - DNA, 35 bp, Artificial Sequence
  Synthetic oligonucleotide
atcgaactgtgcgcctccgctcgctttaactccat

SEQ ID NO: 165918 - DNA, 34 bp, Artificial Sequence
  Synthetic oligonucleotide
acattagccctcctctgtatctactttcacatat

SEQ ID NO: 165919 - DNA, 35 bp, Artificial Sequence
  Synthetic oligonucleotide
acaccatccccactcacactgacactgttccgtat

SEQ ID NO: 165920 - DNA, 34 bp, Artificial Sequence
  Synthetic oligonucleotide
acttgccctggcctacactttgatttgctgtact

SEQ ID NO: 165921 - DNA, 35 bp, Artificial Sequence
  Synthetic oligonucleotide
tagcaccactggcccttccgccacatcggccacct

SEQ ID NO: 165922 - DNA, 35 bp, Artificial Sequence
  Synthetic oligonucleotide
tgcgatcctcaccgccctcggcgcccgttacccct

SEQ ID NO: 165923 - DNA, 35 bp, Artificial Sequence
  Synthetic oligonucleotide
tgacaacgagtccatttacctgcctgggtccccct

SEQ ID NO: 165924 - DNA, 36 bp, Artificial Sequence
  Synthetic oligonucleotide
gtcactccaccccgtaggtcagcactgccggtccct

SEQ ID NO: 165925 - DNA, 35 bp, Artificial Sequence
  Synthetic oligonucleotide
tcagtccccggttgcggtacaacactgcccgctct

SEQ ID NO: 165926 - DNA, 35 bp, Artificial Sequence
  Synthetic oligonucleotide
tgcgcgccgccactgtccctgttattcctgtccgt

SEQ ID NO: 165927 - DNA, 35 bp, Artificial Sequence
  Synthetic oligonucleotide
acatttgcccatcgcctccctacagtacgtaatgt

SEQ ID NO: 165928 - DNA, 35 bp, Artificial Sequence
  Synthetic oligonucleotide
tgcctccccgtcactttgctaccgttcatttgatt

SEQ ID NO: 165929 - DNA, 35 bp, Artificial Sequence
  Synthetic oligonucleotide
atgcaccaccaccttcgccatcggttgtccacctt

SEQ ID NO: 165930 - DNA, 35 bp, Artificial Sequence
  Synthetic oligonucleotide
gccatgctcctaagttatctgtttcgccccccctt

SEQ ID NO: 165931 - DNA, 35 bp, Artificial Sequence
  Synthetic oligonucleotide
tgtccgcccccctggttatcgtagtagcccgcctt

SEQ ID NO: 165932 - DNA, 35 bp, Artificial Sequence
  Synthetic oligonucleotide
aaccggcgagaagggtggaatgggggtagtacgtt

SEQ ID NO: 165933 - DNA, 36 bp, Artificial Sequence
  Synthetic oligonucleotide
gtccaaggccgattgggcgggaagggtgggctcaaa

SEQ ID NO: 165934 - DNA, 35 bp, Artificial Sequence
  Synthetic oligonucleotide
tcccgcccacgtattcgccggtccgtccttctcaa

SEQ ID NO: 165935 - DNA, 36 bp, Artificial Sequence
  Synthetic oligonucleotide
tgagtcgctccatctttctatgcctgtggttccgaa

SEQ ID NO: 165936 - DNA, 36 bp, Artificial Sequence
  Synthetic oligonucleotide
gtgagggggggagtgggggaaggctcggcatgtgaa

SEQ ID NO: 165937 - DNA, 36 bp, Artificial Sequence
  Synthetic oligonucleotide
gccaactgacagcccttgtgagtcccccccccgtaa

SEQ ID NO: 165938 - DNA, 35 bp, Artificial Sequence
  Synthetic oligonucleotide
gccatggcgcatcatttttctgtccctcttgaaca

SEQ ID NO: 165939 - DNA, 36 bp, Artificial Sequence
  Synthetic oligonucleotide
tggggcactcttctttcccggtaatgtctggcacca

SEQ ID NO: 165940 - DNA, 36 bp, Artificial Sequence
  Synthetic oligonucleotide
actgttgccaccgcatcgtgcctagcctacgaccca

SEQ ID NO: 165941 - DNA, 36 bp, Artificial Sequence
  Synthetic oligonucleotide
actacatcagcctacccatgttttcctgtgccgcca

SEQ ID NO: 165942 - DNA, 35 bp, Artificial Sequence
  Synthetic oligonucleotide
tattgcgttcgccatgcctcccaatgcctgttcca

SEQ ID NO: 165943 - DNA, 36 bp, Artificial Sequence
  Synthetic oligonucleotide
gatgcatgccgcatgtcccaccacttagcacccgca

SEQ ID NO: 165944 - DNA, 36 bp, Artificial Sequence
  Synthetic oligonucleotide
tccctgcctcccctagtatgctaccgttcgcctgca

SEQ ID NO: 165945 - DNA, 36 bp, Artificial Sequence
  Synthetic oligonucleotide
atagacagccaccaatcgcatacacgtcacgcctca

SEQ ID NO: 165946 - DNA, 37 bp, Artificial Sequence
  Synthetic oligonucleotide
gccacattggctttgaatttgccgcctctccgataga

SEQ ID NO: 165947 - DNA, 36 bp, Artificial Sequence
  Synthetic oligonucleotide
accgcgccgcctgcagctactctaccatgccaacga

SEQ ID NO: 165948 - DNA, 35 bp, Artificial Sequence
  Synthetic oligonucleotide
tcaccatcttcttttgttccctctcgtcctcacga

SEQ ID NO: 165949 - DNA, 37 bp, Artificial Sequence
  Synthetic oligonucleotide
tcgtgagccaccagctgccgtccccacacacttacga

SEQ ID NO: 165950 - DNA, 37 bp, Artificial Sequence
  Synthetic oligonucleotide
gccccccagctggacccccgcgaccgaacactcccga

SEQ ID NO: 165951 - DNA, 37 bp, Artificial Sequence
  Synthetic oligonucleotide
acaagggggaggacgggcgggcgggtataggtacgga

SEQ ID NO: 165952 - DNA, 36 bp, Artificial Sequence
  Synthetic oligonucleotide
ttggggttgtttagggaggggtaggttggaggggga

SEQ ID NO: 165953 - DNA, 37 bp, Artificial Sequence
  Synthetic oligonucleotide
tgagaacaggggagccatggtgtgtgggagatgggga

SEQ ID NO: 165954 - DNA, 37 bp, Artificial Sequence
  Synthetic oligonucleotide
attggggatagctagggaggggagtgcctactgggga

SEQ ID NO: 165955 - DNA, 37 bp, Artificial Sequence
  Synthetic oligonucleotide
gacgtgtggcaaaggctagagggccgagaggtgggga

SEQ ID NO: 165956 - DNA, 36 bp, Artificial Sequence
  Synthetic oligonucleotide
tgcggatccgcgggcggggcgtggggactttgggga

SEQ ID NO: 165957 - DNA, 37 bp, Artificial Sequence
  Synthetic oligonucleotide
aacgccgggaggagggcgggggtgacgggggagtgga

SEQ ID NO: 165958 - DNA, 36 bp, Artificial Sequence
  Synthetic oligonucleotide
gctaggggaggggggggagggcggagaacacgatga

SEQ ID NO: 165959 - DNA, 38 bp, Artificial Sequence
  Synthetic oligonucleotide
gcaagggagaaggtggaacggtggtcggccacggatga

SEQ ID NO: 165960 - DNA, 38 bp, Artificial Sequence
  Synthetic oligonucleotide
tggacgttcagtgcgctaccttcttcctgcccctatga

SEQ ID NO: 165961 - DNA, 38 bp, Artificial Sequence
  Synthetic oligonucleotide
tgttgcccgcccaccaactgatcgccactctgctatga

SEQ ID NO: 165962 - DNA, 38 bp, Artificial Sequence
  Synthetic oligonucleotide
gatgaagcaggaggcgggggaaagcagggttggtctga

SEQ ID NO: 165963 - DNA, 37 bp, Artificial Sequence
  Synthetic oligonucleotide
tgcgtccccgaccagccatcgtgcccttccattctga

SEQ ID NO: 165964 - DNA, 38 bp, Artificial Sequence
  Synthetic oligonucleotide
ggacgaggaaaggaagggattagatgagggtgcagtga

SEQ ID NO: 165965 - DNA, 38 bp, Artificial Sequence
  Synthetic oligonucleotide
gctgagcgaaaaggggtcagggaaggggggacgagtga

SEQ ID NO: 165966 - DNA, 38 bp, Artificial Sequence
  Synthetic oligonucleotide
tcaccgcacattgcccttcgaacatttcccacctgtga

SEQ ID NO: 165967 - DNA, 38 bp, Artificial Sequence
  Synthetic oligonucleotide
ttcggacgctcgctcgtcttctatcgttccaccattga

SEQ ID NO: 165968 - DNA, 35 bp, Artificial Sequence
  Synthetic oligonucleotide
gtgcgtggctttgtcctgtacctcccaccccgcta

SEQ ID NO: 165969 - DNA, 36 bp, Artificial Sequence
  Synthetic oligonucleotide
gttccgctgcgatagtcttcaatgacccccccgcta

SEQ ID NO: 165970 - DNA, 36 bp, Artificial Sequence
  Synthetic oligonucleotide
tgcaatcgctgcacctccgtcgccacgctcttctta

SEQ ID NO: 165971 - DNA, 35 bp, Artificial Sequence
  Synthetic oligonucleotide
tccaagcggactggcttcgttccatccgttccaac

SEQ ID NO: 165972 - DNA, 35 bp, Artificial Sequence
  Synthetic oligonucleotide
agatccatcacttgcgcctataacgccttaactac

SEQ ID NO: 165973 - DNA, 35 bp, Artificial Sequence
  Synthetic oligonucleotide
atctgcgccctgtccctctggtcttcgcccattac

SEQ ID NO: 165974 - DNA, 34 bp, Artificial Sequence
  Synthetic oligonucleotide
tgacgctcaatccgtcaaagactccgccccaacc

SEQ ID NO: 165975 - DNA, 35 bp, Artificial Sequence
  Synthetic oligonucleotide
tcctgcatctacctaccgtttggtcacctgctacc

SEQ ID NO: 165976 - DNA, 35 bp, Artificial Sequence
  Synthetic oligonucleotide
tcacccaccgatgagctaacgcttgaaccggcccc

SEQ ID NO: 165977 - DNA, 35 bp, Artificial Sequence
  Synthetic oligonucleotide
ggataccccctgaagcttatttattacaccctccc

SEQ ID NO: 165978 - DNA, 35 bp, Artificial Sequence
  Synthetic oligonucleotide
tctcggtcggccccttacagtaccaccacttcgcc

SEQ ID NO: 165979 - DNA, 35 bp, Artificial Sequence
  Synthetic oligonucleotide
tcctcctcatgtgcgcttttcatcgccgggtatcc

SEQ ID NO: 165980 - DNA, 35 bp, Artificial Sequence
  Synthetic oligonucleotide
tttgcgatgcgcggtcggtttattcctccttatcc

SEQ ID NO: 165981 - DNA, 35 bp, Artificial Sequence
  Synthetic oligonucleotide
gagctcccgctgctattgatagccccttcttatcc

SEQ ID NO: 165982 - DNA, 35 bp, Artificial Sequence
  Synthetic oligonucleotide
gcacgggacatcgccaccaacgtaccgacccctcc

SEQ ID NO: 165983 - DNA, 36 bp, Artificial Sequence
  Synthetic oligonucleotide
atggaccacactgcagatcagtctccgtctgcctcc

SEQ ID NO: 165984 - DNA, 35 bp, Artificial Sequence
  Synthetic oligonucleotide
gcccaatgcttgcccccaccgcgagatatttctcc

SEQ ID NO: 165985 - DNA, 35 bp, Artificial Sequence
  Synthetic oligonucleotide
gtcccgcctgtgcacccatgaccccgccattgtcc

SEQ ID NO: 165986 - DNA, 35 bp, Artificial Sequence
  Synthetic oligonucleotide
tggtctcgcaacgccgacgctggtctccctattcc

SEQ ID NO: 165987 - DNA, 35 bp, Artificial Sequence
  Synthetic oligonucleotide
ttgcgcccgggtccaattctatgttcactccttcc

SEQ ID NO: 165988 - DNA, 35 bp, Artificial Sequence
  Synthetic oligonucleotide
ttgaacccgcagggcgctaccggaacctctcttcc

SEQ ID NO: 165989 - DNA, 35 bp, Artificial Sequence
  Synthetic oligonucleotide
actaaccctctgtttttgcctactaatctggttcc

SEQ ID NO: 165990 - DNA, 35 bp, Artificial Sequence
  Synthetic oligonucleotide
aatcaaccgcacagtcgctgccgccaacacccagc

SEQ ID NO: 165991 - DNA, 35 bp, Artificial Sequence
  Synthetic oligonucleotide
tattcaagcaggcgaggtgggacgggaaggggtgc

SEQ ID NO: 165992 - DNA, 35 bp, Artificial Sequence
  Synthetic oligonucleotide
gtgcatatgccaccccaccctggtacaaccgttgc

SEQ ID NO: 165993 - DNA, 35 bp, Artificial Sequence
  Synthetic oligonucleotide
tatcaccatcccgaggttacatccgctggacactc

SEQ ID NO: 165994 - DNA, 35 bp, Artificial Sequence
  Synthetic oligonucleotide
agcgcgtggtcatccgcgttccttcgtctccactc

SEQ ID NO: 165995 - DNA, 35 bp, Artificial Sequence
  Synthetic oligonucleotide
accgaatgtcagacttaccacacgtcctttctctc

SEQ ID NO: 165996 - DNA, 35 bp, Artificial Sequence
  Synthetic oligonucleotide
gcgctctctgcctcatcgtcttcgcacttgccgtc

SEQ ID NO: 165997 - DNA, 35 bp, Artificial Sequence
  Synthetic oligonucleotide
ttgaaccactgtacctgcatggacacagcccattc

SEQ ID NO: 165998 - DNA, 35 bp, Artificial Sequence
  Synthetic oligonucleotide
gacgcgcaacccccatctagttatgttgtctgttc

SEQ ID NO: 165999 - DNA, 35 bp, Artificial Sequence
  Synthetic oligonucleotide
gaagggaggggcgggagggataggttatacgacag

SEQ ID NO: 166000 - DNA, 35 bp, Artificial Sequence
  Synthetic oligonucleotide
tatccttgccctgttgcgccgcctgttctgtttag

SEQ ID NO: 166001 - DNA, 35 bp, Artificial Sequence
  Synthetic oligonucleotide
acactccacacgcctcgagggcgcaacctgtatcg

SEQ ID NO: 166002 - DNA, 35 bp, Artificial Sequence
  Synthetic oligonucleotide
gacctcatccatagtttaactctctctcaccgagg

SEQ ID NO: 166003 - DNA, 35 bp, Artificial Sequence
  Synthetic oligonucleotide
tcaccaccttctccagtaccgcccgacggagccgg

SEQ ID NO: 166004 - DNA, 35 bp, Artificial Sequence
  Synthetic oligonucleotide
acagggggggcagtcagggtaggggccggagaatg

SEQ ID NO: 166005 - DNA, 35 bp, Artificial Sequence
  Synthetic oligonucleotide
tcgctgagcatgcctcccccgctttatccatcatg

SEQ ID NO: 166006 - DNA, 35 bp, Artificial Sequence
  Synthetic oligonucleotide
gttgcccgcctcgctaccatctcccccgagaccat

SEQ ID NO: 166007 - DNA, 35 bp, Artificial Sequence
  Synthetic oligonucleotide
agctggcactgccctcccccggataccgctctcat

SEQ ID NO: 166008 - DNA, 35 bp, Artificial Sequence
  Synthetic oligonucleotide
atccgctccttcgcttatcctgtccattccgagat

SEQ ID NO: 166009 - DNA, 35 bp, Artificial Sequence
  Synthetic oligonucleotide
gtccctccaccgtatttccgccattcgtttaggat

SEQ ID NO: 166010 - DNA, 35 bp, Artificial Sequence
  Synthetic oligonucleotide
gagccccagcccaccccgtgcgttttctccatgat

SEQ ID NO: 166011 - DNA, 35 bp, Artificial Sequence
  Synthetic oligonucleotide
ccgacaccctcaccatgctcgttactgtcctatat

SEQ ID NO: 166012 - DNA, 35 bp, Artificial Sequence
  Synthetic oligonucleotide
gtcaccctccccattctgtgcacttcacccactat

SEQ ID NO: 166013 - DNA, 35 bp, Artificial Sequence
  Synthetic oligonucleotide
tacgcaccccctctcctccatcattcaccgcacct

SEQ ID NO: 166014 - DNA, 35 bp, Artificial Sequence
  Synthetic oligonucleotide
tcataagcgccgatattttattgatgcccccccct

SEQ ID NO: 166015 - DNA, 36 bp, Artificial Sequence
  Synthetic oligonucleotide
acactgctcacgcctcaatcggttccggttccatct

SEQ ID NO: 166016 - DNA, 35 bp, Artificial Sequence
  Synthetic oligonucleotide
gcttctcgcccgcctcccctgacttaccgtcatct

SEQ ID NO: 166017 - DNA, 35 bp, Artificial Sequence
  Synthetic oligonucleotide
acgcggacattatgcgtacctaactcgccgtttct

SEQ ID NO: 166018 - DNA, 35 bp, Artificial Sequence
  Synthetic oligonucleotide
ttggcctgtagctctccatccgcctggttcctcgt

SEQ ID NO: 166019 - DNA, 35 bp, Artificial Sequence
  Synthetic oligonucleotide
ttggggaacggggggggcaaagccgaagaggtcgt

SEQ ID NO: 166020 - DNA, 35 bp, Artificial Sequence
  Synthetic oligonucleotide
ttcgccccccagtatctgcgcttctggttcttgtt

SEQ ID NO: 166021 - DNA, 36 bp, Artificial Sequence
  Synthetic oligonucleotide
gcgagttgggcagggggtgggaaggggatgccaaaa

SEQ ID NO: 166022 - DNA, 36 bp, Artificial Sequence
  Synthetic oligonucleotide
gtagtgcacacagaagggaacggggctatggcacaa

SEQ ID NO: 166023 - DNA, 36 bp, Artificial Sequence
  Synthetic oligonucleotide
gccctctccaatcgctaagactccgttcttcattaa

SEQ ID NO: 166024 - DNA, 35 bp, Artificial Sequence
  Synthetic oligonucleotide
gctgaacgagcgtcgtctcccccgccgacctaaca

SEQ ID NO: 166025 - DNA, 36 bp, Artificial Sequence
  Synthetic oligonucleotide
tgtccactgcactcggtcctacctactcaccgcaca

SEQ ID NO: 166026 - DNA, 36 bp, Artificial Sequence
  Synthetic oligonucleotide
ggacgcccgtcgcggccctggaaacctattcgcaca

SEQ ID NO: 166027 - DNA, 35 bp, Artificial Sequence
  Synthetic oligonucleotide
gttgctcagactgccgcctcgttacacccacgcca

SEQ ID NO: 166028 - DNA, 35 bp, Artificial Sequence
  Synthetic oligonucleotide
tgccattcacgttgtcctcttggtccctcgttgca

SEQ ID NO: 166029 - DNA, 35 bp, Artificial Sequence
  Synthetic oligonucleotide
gccgcgggcctccgactctgctccattttctatca

SEQ ID NO: 166030 - DNA, 37 bp, Artificial Sequence
  Synthetic oligonucleotide
ttaggggccgggggtggacagaagaaggggcgcgaga

SEQ ID NO: 166031 - DNA, 37 bp, Artificial Sequence
  Synthetic oligonucleotide
aggtgaggagggtgtgggggggcagtaagggcataga

SEQ ID NO: 166032 - DNA, 36 bp, Artificial Sequence
  Synthetic oligonucleotide
actgcctccctctacttcgattatcgtgacatacga

SEQ ID NO: 166033 - DNA, 37 bp, Artificial Sequence
  Synthetic oligonucleotide
tgtcaaccccacggagtgccgggcccttcacccccga

SEQ ID NO: 166034 - DNA, 36 bp, Artificial Sequence
  Synthetic oligonucleotide
gaaggaagggggaagatggcggggctaggatcgcga

SEQ ID NO: 166035 - DNA, 37 bp, Artificial Sequence
  Synthetic oligonucleotide
aaaagcagggtaagggagggagggtgttcatctcgga

SEQ ID NO: 166036 - DNA, 37 bp, Artificial Sequence
  Synthetic oligonucleotide
atgcttacaggggggggaggggagcaagaggaaggga

SEQ ID NO: 166037 - DNA, 37 bp, Artificial Sequence
  Synthetic oligonucleotide
tatgtagggacgaagaaccggaggtgggagggaggga

SEQ ID NO: 166038 - DNA, 37 bp, Artificial Sequence
  Synthetic oligonucleotide
tgctcccccattcgcgctcttcccaactactttggga

SEQ ID NO: 166039 - DNA, 36 bp, Artificial Sequence
  Synthetic oligonucleotide
atcggcgaaagggggaggaaaaaaagggtgggtgga

SEQ ID NO: 166040 - DNA, 38 bp, Artificial Sequence
  Synthetic oligonucleotide
ggaaactgggggcgaggtggggcgggaggggacgatga

SEQ ID NO: 166041 - DNA, 37 bp, Artificial Sequence
  Synthetic oligonucleotide
gtcacggcaatggccagctccgttcgtcctcccctga

SEQ ID NO: 166042 - DNA, 37 bp, Artificial Sequence
  Synthetic oligonucleotide
atgctccgccctgcctcttaacacgcttctggcctga

SEQ ID NO: 166043 - DNA, 37 bp, Artificial Sequence
  Synthetic oligonucleotide
tccggtcccaccacttgtcatctgtccgttatcctga

SEQ ID NO: 166044 - DNA, 37 bp, Artificial Sequence
  Synthetic oligonucleotide
gccccacgcccccctcccgtttcttgagatgtagtga

SEQ ID NO: 166045 - DNA, 37 bp, Artificial Sequence
  Synthetic oligonucleotide
accccggtcacctcccgatctatacgctcacccgtga

SEQ ID NO: 166046 - DNA, 38 bp, Artificial Sequence
  Synthetic oligonucleotide
gacgaaggggaagatagaagcttagggggtgagggtga

SEQ ID NO: 166047 - DNA, 38 bp, Artificial Sequence
  Synthetic oligonucleotide
gggaaagaggggggttcggggtggagtagggacattga

SEQ ID NO: 166048 - DNA, 36 bp, Artificial Sequence
  Synthetic oligonucleotide
ttgccacgtgctaatgcgtcgccctactcgccttga

SEQ ID NO: 166049 - DNA, 36 bp, Artificial Sequence
  Synthetic oligonucleotide
tgtccggcacccgcgacccctgcacgccctccttga

SEQ ID NO: 166050 - DNA, 37 bp, Artificial Sequence
  Synthetic oligonucleotide
gactgcgtggagtgaggggtgtgggaagggcggttga

SEQ ID NO: 166051 - DNA, 36 bp, Artificial Sequence
  Synthetic oligonucleotide
ttcatccccgccgactttacttttagggctccacta

SEQ ID NO: 166052 - DNA, 36 bp, Artificial Sequence
  Synthetic oligonucleotide
tgatcctccgcatctatacctcaccacccgtgccta

SEQ ID NO: 166053 - DNA, 36 bp, Artificial Sequence
  Synthetic oligonucleotide
gttggccccggatgacactagcccctcccgtttgta

SEQ ID NO: 166054 - DNA, 36 bp, Artificial Sequence
  Synthetic oligonucleotide
tgaccgtcacatgccccttctccgcggcctccctta

SEQ ID NO: 166055 - DNA, 36 bp, Artificial Sequence
  Synthetic oligonucleotide
gcactcctcgcacggcttttcgctccactcacttta

SEQ ID NO: 166056 - DNA, 33 bp, Artificial Sequence
  Synthetic oligonucleotide
gcgatggtaaggaagtacgaagggagggctaac

SEQ ID NO: 166057 - DNA, 35 bp, Artificial Sequence
  Synthetic oligonucleotide
actatgccgggcagggaggcgagggatgcagacac

SEQ ID NO: 166058 - DNA, 35 bp, Artificial Sequence
  Synthetic oligonucleotide
tccccctccccatgtattatcacgcgaaccgccac

SEQ ID NO: 166059 - DNA, 35 bp, Artificial Sequence
  Synthetic oligonucleotide
ttgcgagcgggttctgtctttcttgggcctttcac

SEQ ID NO: 166060 - DNA, 35 bp, Artificial Sequence
  Synthetic oligonucleotide
ttgacacgctcgtcatcgctacgcaatcgccctac

SEQ ID NO: 166061 - DNA, 35 bp, Artificial Sequence
  Synthetic oligonucleotide
aaacgcgcccacaccttgtctcattggaaccaacc

SEQ ID NO: 166062 - DNA, 35 bp, Artificial Sequence
  Synthetic oligonucleotide
ttgtgctcgccccccttgacgtagcactgataacc

SEQ ID NO: 166063 - DNA, 35 bp, Artificial Sequence
  Synthetic oligonucleotide
gcctacagacctgaatcttcccgtgcccgaccacc

SEQ ID NO: 166064 - DNA, 35 bp, Artificial Sequence
  Synthetic oligonucleotide
tgtacgcattcgccgcctccctccacgacgtaccc

SEQ ID NO: 166065 - DNA, 35 bp, Artificial Sequence
  Synthetic oligonucleotide
tgcacactagcagtcggccttggcaagctccgccc

SEQ ID NO: 166066 - DNA, 35 bp, Artificial Sequence
  Synthetic oligonucleotide
gcacccatctcggttgggtcgaatattcccctccc

SEQ ID NO: 166067 - DNA, 35 bp, Artificial Sequence
  Synthetic oligonucleotide
gcattgttatgtgcctgtgcccccctcgtgccgcc

SEQ ID NO: 166068 - DNA, 35 bp, Artificial Sequence
  Synthetic oligonucleotide
gttagccagcacgatctatacctagctaccctgcc

SEQ ID NO: 166069 - DNA, 35 bp, Artificial Sequence
  Synthetic oligonucleotide
gcactggtactcggtgtccccttgcgtgcccatcc

SEQ ID NO: 166070 - DNA, 35 bp, Artificial Sequence
  Synthetic oligonucleotide
tatgccctgcgctgtctagatccggcgcactatcc

SEQ ID NO: 166071 - DNA, 35 bp, Artificial Sequence
  Synthetic oligonucleotide
tggaggccaatgacttttctccgcatccctgttcc

SEQ ID NO: 166072 - DNA, 35 bp, Artificial Sequence
  Synthetic oligonucleotide
ttgcacctctttcagcgcaagcctaattttgttcc

SEQ ID NO: 166073 - DNA, 35 bp, Artificial Sequence
  Synthetic oligonucleotide
tctcacgggtgcatgcggcctaggggagggtgggc

SEQ ID NO: 166074 - DNA, 35 bp, Artificial Sequence
  Synthetic oligonucleotide
cccacaccatccctatcgttcatcgccaggctggc

SEQ ID NO: 166075 - DNA, 35 bp, Artificial Sequence
  Synthetic oligonucleotide
taacctgtctcaccctgcgccttgcgcccccatgc

SEQ ID NO: 166076 - DNA, 35 bp, Artificial Sequence
  Synthetic oligonucleotide
acacacgttcactctgcactatcattccgcactgc

SEQ ID NO: 166077 - DNA, 35 bp, Artificial Sequence
  Synthetic oligonucleotide
tgtggtgccccgaagcatttccccgcggtccctgc

SEQ ID NO: 166078 - DNA, 35 bp, Artificial Sequence
  Synthetic oligonucleotide
gtatgcgtctattgctgccccccgtttctgcttgc

SEQ ID NO: 166079 - DNA, 35 bp, Artificial Sequence
  Synthetic oligonucleotide
tccacggacaatcctcctctgggccttatgtaatc

SEQ ID NO: 166080 - DNA, 35 bp, Artificial Sequence
  Synthetic oligonucleotide
taccccattctgtgcagtgcccacgtgcctccctc

SEQ ID NO: 166081 - DNA, 35 bp, Artificial Sequence
  Synthetic oligonucleotide
gacgaccatcggtgattcagtacccgcgctccctc

SEQ ID NO: 166082 - DNA, 35 bp, Artificial Sequence
  Synthetic oligonucleotide
taccgcgatccccctctcatcacacggcacctctc

SEQ ID NO: 166083 - DNA, 35 bp, Artificial Sequence
  Synthetic oligonucleotide
accccaaccctttcatcctgcttacctttcaggtc

SEQ ID NO: 166084 - DNA, 35 bp, Artificial Sequence
  Synthetic oligonucleotide
gggcctgtcatatcctgcccgcctttcctttggtc

SEQ ID NO: 166085 - DNA, 35 bp, Artificial Sequence
  Synthetic oligonucleotide
tttaccggccccgcttgttcttcccccctacgttc

SEQ ID NO: 166086 - DNA, 35 bp, Artificial Sequence
  Synthetic oligonucleotide
tgcaaacattccctgcgtcttcattgttcctgttc

SEQ ID NO: 166087 - DNA, 35 bp, Artificial Sequence
  Synthetic oligonucleotide
gtgagtagcggggagggcggagggggcaggggaag

SEQ ID NO: 166088 - DNA, 35 bp, Artificial Sequence
  Synthetic oligonucleotide
ggtgtgtaggcatgggagagggagggtgggaagag

SEQ ID NO: 166089 - DNA, 35 bp, Artificial Sequence
  Synthetic oligonucleotide
ggaatgcctcccttccgctataatggtcctgtacg

SEQ ID NO: 166090 - DNA, 35 bp, Artificial Sequence
  Synthetic oligonucleotide
ttgtaacattctgcctccgctgcgtatctcctccg

SEQ ID NO: 166091 - DNA, 35 bp, Artificial Sequence
  Synthetic oligonucleotide
gttgtgcgctacccgcccgctcgcctctgcccgcg

SEQ ID NO: 166092 - DNA, 36 bp, Artificial Sequence
  Synthetic oligonucleotide
gagctcacgggcgggaaggaggataaattgcgcagg

SEQ ID NO: 166093 - DNA, 35 bp, Artificial Sequence
  Synthetic oligonucleotide
aagctgccatccctattcgcgcatacatcacctgg

SEQ ID NO: 166094 - DNA, 35 bp, Artificial Sequence
  Synthetic oligonucleotide
tacgttccacctcttgctacaactccgtgtatctg

SEQ ID NO: 166095 - DNA, 35 bp, Artificial Sequence
  Synthetic oligonucleotide
atccagccatccccagccgtctgccttgtgccaat

SEQ ID NO: 166096 - DNA, 35 bp, Artificial Sequence
  Synthetic oligonucleotide
acccaagctctctgtgctgtctcctgctactccat

SEQ ID NO: 166097 - DNA, 35 bp, Artificial Sequence
  Synthetic oligonucleotide
acgctccccccactcacacgagtcatactctcact

SEQ ID NO: 166098 - DNA, 35 bp, Artificial Sequence
  Synthetic oligonucleotide
ttcccccaccgtgcgcccaacagcctcacccgact

SEQ ID NO: 166099 - DNA, 35 bp, Artificial Sequence
  Synthetic oligonucleotide
actcactcccgacacattgaccgagaatgtaccct

SEQ ID NO: 166100 - DNA, 35 bp, Artificial Sequence
  Synthetic oligonucleotide
accccggtgaacattgaggccttcacctcccccct

SEQ ID NO: 166101 - DNA, 35 bp, Artificial Sequence
  Synthetic oligonucleotide
gacgtcatcgatccccagatctcgtcatcgcccct

SEQ ID NO: 166102 - DNA, 35 bp, Artificial Sequence
  Synthetic oligonucleotide
tctacacagcgcttattacctaacggcacctccct

SEQ ID NO: 166103 - DNA, 35 bp, Artificial Sequence
  Synthetic oligonucleotide
gcactctctgtatttaatgtcatgtccccttccct

SEQ ID NO: 166104 - DNA, 35 bp, Artificial Sequence
  Synthetic oligonucleotide
ttctgccgctgccctgcggttactccgcttctcct

SEQ ID NO: 166105 - DNA, 35 bp, Artificial Sequence
  Synthetic oligonucleotide
gatcacctgagcctctcacactctccatagactct

SEQ ID NO: 166106 - DNA, 35 bp, Artificial Sequence
  Synthetic oligonucleotide
gaatgtcgagccacatgtctatctgcattacctct

SEQ ID NO: 166107 - DNA, 35 bp, Artificial Sequence
  Synthetic oligonucleotide
ttgccgccctgttcgtaatctgctgcctcctccgt

SEQ ID NO: 166108 - DNA, 35 bp, Artificial Sequence
  Synthetic oligonucleotide
tgcgtactcaacggatccctgcctccccatgtctt

SEQ ID NO: 166109 - DNA, 35 bp, Artificial Sequence
  Synthetic oligonucleotide
gttacagagcaagggaggcttttgagggggggaaa

SEQ ID NO: 166110 - DNA, 35 bp, Artificial Sequence
  Synthetic oligonucleotide
gtccaccccacccagctgttatagccgcgaaccaa

SEQ ID NO: 166111 - DNA, 36 bp, Artificial Sequence
  Synthetic oligonucleotide
gttcaggggggaggtggggtgggtcaagcggtttaa

SEQ ID NO: 166112 - DNA, 36 bp, Artificial Sequence
  Synthetic oligonucleotide
gagcaccacctggtctttcttcccccgcagttcaca

SEQ ID NO: 166113 - DNA, 36 bp, Artificial Sequence
  Synthetic oligonucleotide
tcctcgaggcccacctgctccggtccagtttttaca

SEQ ID NO: 166114 - DNA, 36 bp, Artificial Sequence
  Synthetic oligonucleotide
tcagacctggtcccttgaagtctgtcccgtacccca

SEQ ID NO: 166115 - DNA, 34 bp, Artificial Sequence
  Synthetic oligonucleotide
gtgatcgccacccctgttttcgctcaataatcca

SEQ ID NO: 166116 - DNA, 35 bp, Artificial Sequence
  Synthetic oligonucleotide
gactcaacctccgctgattaggaaatattcctcca

SEQ ID NO: 166117 - DNA, 35 bp, Artificial Sequence
  Synthetic oligonucleotide
tcaccggtttcagcctcccgctggtccttctatca

SEQ ID NO: 166118 - DNA, 36 bp, Artificial Sequence
  Synthetic oligonucleotide
acactggccaccactcggctgctcctttctgcttca

SEQ ID NO: 166119 - DNA, 36 bp, Artificial Sequence
  Synthetic oligonucleotide
atcccaccatactgtattaacccatgtcccggttca

SEQ ID NO: 166120 - DNA, 35 bp, Artificial Sequence
  Synthetic oligonucleotide
gaaccttcctcacacctgctctaaccagtttacga

SEQ ID NO: 166121 - DNA, 37 bp, Artificial Sequence
  Synthetic oligonucleotide
atcaccgccccctcttggccattccagtctctgtcga

SEQ ID NO: 166122 - DNA, 36 bp, Artificial Sequence
  Synthetic oligonucleotide
gtggggcgaataatgggattgggcatggggaaggga

SEQ ID NO: 166123 - DNA, 37 bp, Artificial Sequence
  Synthetic oligonucleotide
tcactcatcccctgccacgatagtcaagagacaggga

SEQ ID NO: 166124 - DNA, 37 bp, Artificial Sequence
  Synthetic oligonucleotide
gagtgggggacgggaattaacggtagtgagaagggga

SEQ ID NO: 166125 - DNA, 37 bp, Artificial Sequence
  Synthetic oligonucleotide
acaggaccagcggaacgggcaggggggcaactgggga

SEQ ID NO: 166126 - DNA, 37 bp, Artificial Sequence
  Synthetic oligonucleotide
acttcatccccctgctcaagggtcagcccgtgctgga

SEQ ID NO: 166127 - DNA, 38 bp, Artificial Sequence
  Synthetic oligonucleotide
tgcgatcacgatcgccccgcactcctcgccttccatga

SEQ ID NO: 166128 - DNA, 38 bp, Artificial Sequence
  Synthetic oligonucleotide
tgtggcacgccacgtctcgactgctcccttcccactga

SEQ ID NO: 166129 - DNA, 38 bp, Artificial Sequence
  Synthetic oligonucleotide
tgccaggctcaacgtaggttctgccatccacttcctga

SEQ ID NO: 166130 - DNA, 38 bp, Artificial Sequence
  Synthetic oligonucleotide
gagacagttgaacggaataagggtgaaggtggaggtga

SEQ ID NO: 166131 - DNA, 38 bp, Artificial Sequence
  Synthetic oligonucleotide
gagggtggggagcgagaggggcatcggatagcgggtga

SEQ ID NO: 166132 - DNA, 36 bp, Artificial Sequence
  Synthetic oligonucleotide
aacctcagcctccacgcgtgcttatcttccttgtga

SEQ ID NO: 166133 - DNA, 37 bp, Artificial Sequence
  Synthetic oligonucleotide
tatgtgtcgactcacaatccttgcccttcgcccttga

SEQ ID NO: 166134 - DNA, 36 bp, Artificial Sequence
  Synthetic oligonucleotide
tcccgccactccacctgctttttgaatgacgctata

SEQ ID NO: 166135 - DNA, 36 bp, Artificial Sequence
  Synthetic oligonucleotide
catcctcccgtctggccaccgtttcatgcctttcta

SEQ ID NO: 166136 - DNA, 35 bp, Artificial Sequence
  Synthetic oligonucleotide
gtgacccacctgcacgtcaccgctgacccgcgtta

SEQ ID NO: 166137 - DNA, 36 bp, Artificial Sequence
  Synthetic oligonucleotide
acatgaccccgactgttctatggacccctctcgtta

SEQ ID NO: 166138 - DNA, 37 bp, Artificial Sequence
  Synthetic oligonucleotide
gatccgcccgaggatcgtaccttggtttacaccttta

SEQ ID NO: 166139 - DNA, 36 bp, Artificial Sequence
  Synthetic oligonucleotide
acatcgccgtgatgctctattcacctgcacccttta

SEQ ID NO: 166140 - DNA, 35 bp, Artificial Sequence
  Synthetic oligonucleotide
tctgtcccagtgatctcctatcgcccgccaccgac

SEQ ID NO: 166141 - DNA, 35 bp, Artificial Sequence
  Synthetic oligonucleotide
gtgctccctgcttgttcgtacgaccctgccgtgac

SEQ ID NO: 166142 - DNA, 35 bp, Artificial Sequence
  Synthetic oligonucleotide
tttgcccgtccgtctggccgactgttacccacacc

SEQ ID NO: 166143 - DNA, 35 bp, Artificial Sequence
  Synthetic oligonucleotide
aggcccatgctacacccctgcccgcgccatgcccc

SEQ ID NO: 166144 - DNA, 35 bp, Artificial Sequence
  Synthetic oligonucleotide
tagtccatggtaacctctgtatggcccctccgccc

SEQ ID NO: 166145 - DNA, 35 bp, Artificial Sequence
  Synthetic oligonucleotide
ttggactaccactttaacgctgttttattgctccc

SEQ ID NO: 166146 - DNA, 35 bp, Artificial Sequence
  Synthetic oligonucleotide
aagctagctgtacagcaaccccctttaatgccgcc

SEQ ID NO: 166147 - DNA, 35 bp, Artificial Sequence
  Synthetic oligonucleotide
gtgatgcatcactcggaagtacccacccggtctcc

SEQ ID NO: 166148 - DNA, 35 bp, Artificial Sequence
  Synthetic oligonucleotide
gaccaccattgttctgtctcctctcaatttgacgc

SEQ ID NO: 166149 - DNA, 35 bp, Artificial Sequence
  Synthetic oligonucleotide
ggacaccccgaggactgcgcacctccctgccccgc

SEQ ID NO: 166150 - DNA, 35 bp, Artificial Sequence
  Synthetic oligonucleotide
tctatcagacaacacgtcaccttgccccctgccgc

SEQ ID NO: 166151 - DNA, 35 bp, Artificial Sequence
  Synthetic oligonucleotide
tccatccctcatcgagcctacgcttgctacccggc

SEQ ID NO: 166152 - DNA, 35 bp, Artificial Sequence
  Synthetic oligonucleotide
tccaacccatcccagtgctatccaatttctttggc

SEQ ID NO: 166153 - DNA, 35 bp, Artificial Sequence
  Synthetic oligonucleotide
gcaatgccccaatgcttaactttcctcccatatgc

SEQ ID NO: 166154 - DNA, 35 bp, Artificial Sequence
  Synthetic oligonucleotide
tcgcaccccttccggaccactagaccaagtcctgc

SEQ ID NO: 166155 - DNA, 35 bp, Artificial Sequence
  Synthetic oligonucleotide
tcatgaccacgtcgccgctacggttactacacatc

SEQ ID NO: 166156 - DNA, 35 bp, Artificial Sequence
  Synthetic oligonucleotide
acctatcgcctcactcctataacctggaattgatc

SEQ ID NO: 166157 - DNA, 35 bp, Artificial Sequence
  Synthetic oligonucleotide
accggacacatgtcgacggcgttccgtccctcctc

SEQ ID NO: 166158 - DNA, 35 bp, Artificial Sequence
  Synthetic oligonucleotide
gcacgaaagtgcagccgtagtacatccgcttcctc

SEQ ID NO: 166159 - DNA, 35 bp, Artificial Sequence
  Synthetic oligonucleotide
tttgcccccctctgtagctcccgggatccactctc

SEQ ID NO: 166160 - DNA, 35 bp, Artificial Sequence
  Synthetic oligonucleotide
aaccgctaccacgtacatgttggccctcccccttc

SEQ ID NO: 166161 - DNA, 35 bp, Artificial Sequence
  Synthetic oligonucleotide
ccactcctgcatccattcttcgaccgttcatcccg

SEQ ID NO: 166162 - DNA, 35 bp, Artificial Sequence
  Synthetic oligonucleotide
gtagccgactgcactgtctcatcgtcctcttcccg

SEQ ID NO: 166163 - DNA, 35 bp, Artificial Sequence
  Synthetic oligonucleotide
gacattgcactgagaatggagggtgggtcggggcg

SEQ ID NO: 166164 - DNA, 35 bp, Artificial Sequence
  Synthetic oligonucleotide
tccgtgccagcctcacccccctccggccttgctcg

SEQ ID NO: 166165 - DNA, 35 bp, Artificial Sequence
  Synthetic oligonucleotide
acatgctccggccgctacgctttctctgtttttcg

SEQ ID NO: 166166 - DNA, 35 bp, Artificial Sequence
  Synthetic oligonucleotide
atgcgtaccggtcccatctaatctcctcgttcagg

SEQ ID NO: 166167 - DNA, 33 bp, Artificial Sequence
  Synthetic oligonucleotide
gctctgacctccgcctccgtaattcttccatgg

SEQ ID NO: 166168 - DNA, 35 bp, Artificial Sequence
  Synthetic oligonucleotide
cacgtgcaccaccctcgccgccgtaccactcttgg

SEQ ID NO: 166169 - DNA, 35 bp, Artificial Sequence
  Synthetic oligonucleotide
agaccccggctctgcatactttacttacacgcctg

SEQ ID NO: 166170 - DNA, 35 bp, Artificial Sequence
  Synthetic oligonucleotide
gtatctacccgtcactgtccatcttctcccttcat

SEQ ID NO: 166171 - DNA, 35 bp, Artificial Sequence
  Synthetic oligonucleotide
gtgcgcaccacaccgcgaccaccgtttcgtactat

SEQ ID NO: 166172 - DNA, 35 bp, Artificial Sequence
  Synthetic oligonucleotide
tccgcctgcaatgtttattatatccgctccccact

SEQ ID NO: 166173 - DNA, 36 bp, Artificial Sequence
  Synthetic oligonucleotide
tcgcgaggcctctctcgggtttcagccttgtccact

SEQ ID NO: 166174 - DNA, 35 bp, Artificial Sequence
  Synthetic oligonucleotide
ggtatccccgccgcgtaagaatctgctctccacct

SEQ ID NO: 166175 - DNA, 35 bp, Artificial Sequence
  Synthetic oligonucleotide
tgttcgcacgtgcctgaccgaagcgccctttacct

SEQ ID NO: 166176 - DNA, 35 bp, Artificial Sequence
  Synthetic oligonucleotide
tccgcacccggatttccctgcgcacccctagccct

SEQ ID NO: 166177 - DNA, 35 bp, Artificial Sequence
  Synthetic oligonucleotide
ggaacatccggctctgtttcacgctactcttggct

SEQ ID NO: 166178 - DNA, 35 bp, Artificial Sequence
  Synthetic oligonucleotide
aatgccagcccgatcacattgtccttctgctctct

SEQ ID NO: 166179 - DNA, 35 bp, Artificial Sequence
  Synthetic oligonucleotide
atggagctctcttgcgtcacccgtaccatccgtct

SEQ ID NO: 166180 - DNA, 34 bp, Artificial Sequence
  Synthetic oligonucleotide
tccgccctatcgggatcgtacattttgcctgtct

SEQ ID NO: 166181 - DNA, 35 bp, Artificial Sequence
  Synthetic oligonucleotide
gactgcgaaatggcgggggaggggagaagcttggt

SEQ ID NO: 166182 - DNA, 35 bp, Artificial Sequence
  Synthetic oligonucleotide
gcctacctcacatatttagttctgaccctaacctt

SEQ ID NO: 166183 - DNA, 35 bp, Artificial Sequence
  Synthetic oligonucleotide
tatcgacatcgcctcgcgagcccctacctttcctt

SEQ ID NO: 166184 - DNA, 35 bp, Artificial Sequence
  Synthetic oligonucleotide
tgccctccgcatccctatggtgtgcctctcctctt

SEQ ID NO: 166185 - DNA, 35 bp, Artificial Sequence
  Synthetic oligonucleotide
ttcgcctcctctcttccggttcaagtttaggtctt

SEQ ID NO: 166186 - DNA, 36 bp, Artificial Sequence
  Synthetic oligonucleotide
tagggatgaaagagcgggacataggagaagaagaaa

SEQ ID NO: 166187 - DNA, 35 bp, Artificial Sequence
  Synthetic oligonucleotide
tcgtaccaccttacggctccgtcactcctgcacaa

SEQ ID NO: 166188 - DNA, 36 bp, Artificial Sequence
  Synthetic oligonucleotide
tcgctcacccagtgctttaacccggtatctccccaa

SEQ ID NO: 166189 - DNA, 36 bp, Artificial Sequence
  Synthetic oligonucleotide
gcccgtgcccatttcgttctgctctctgtttatcaa

SEQ ID NO: 166190 - DNA, 36 bp, Artificial Sequence
  Synthetic oligonucleotide
gccaacgcaaagttacagccgtgccccccttctgaa

SEQ ID NO: 166191 - DNA, 36 bp, Artificial Sequence
  Synthetic oligonucleotide
gtcctccgacccctacagtacctgtggccatcacca

SEQ ID NO: 166192 - DNA, 36 bp, Artificial Sequence
  Synthetic oligonucleotide
gttgcgggacactcgccgatctttagccccgaccca

SEQ ID NO: 166193 - DNA, 36 bp, Artificial Sequence
  Synthetic oligonucleotide
tgacatccggcctcgctgccccgtacatcagcccca

SEQ ID NO: 166194 - DNA, 35 bp, Artificial Sequence
  Synthetic oligonucleotide
gtctgtccccgccctcgaccccgcagacacatcca

SEQ ID NO: 166195 - DNA, 36 bp, Artificial Sequence
  Synthetic oligonucleotide
tcctcgctcccagatgtctcacacatcatctccgca

SEQ ID NO: 166196 - DNA, 36 bp, Artificial Sequence
  Synthetic oligonucleotide
acgctcgccctccactgttacattcccaccgcctca

SEQ ID NO: 166197 - DNA, 35 bp, Artificial Sequence
  Synthetic oligonucleotide
taatgcgtacgcgatatttaggctccctctcttca

SEQ ID NO: 166198 - DNA, 37 bp, Artificial Sequence
  Synthetic oligonucleotide
atgtggaaagcgcgcggggtggagcggagcgcgaaga

SEQ ID NO: 166199 - DNA, 38 bp, Artificial Sequence
  Synthetic oligonucleotide
tccaccggcccctcggtgcgtcaacattcccaacccga

SEQ ID NO: 166200 - DNA, 37 bp, Artificial Sequence
  Synthetic oligonucleotide
tttggcacctgtcccttcacaatattggcctctccga

SEQ ID NO: 166201 - DNA, 36 bp, Artificial Sequence
  Synthetic oligonucleotide
tgcaccgccacacctttgaacacctgttttctgcga

SEQ ID NO: 166202 - DNA, 37 bp, Artificial Sequence
  Synthetic oligonucleotide
gaggggtgataggaggggactgggagtggggtgtcga

SEQ ID NO: 166203 - DNA, 37 bp, Artificial Sequence
  Synthetic oligonucleotide
atcgcacctcacgcccccctccccgtcatgcaccgga

SEQ ID NO: 166204 - DNA, 35 bp, Artificial Sequence
  Synthetic oligonucleotide
aacgtgtggggggggcggagaagcagctaatcgga

SEQ ID NO: 166205 - DNA, 37 bp, Artificial Sequence
  Synthetic oligonucleotide
tctatcgccacgcctcttgccccttcaatccctcgga

SEQ ID NO: 166206 - DNA, 37 bp, Artificial Sequence
  Synthetic oligonucleotide
aagaccgggatgggctgggatacgagcgcacatggga

SEQ ID NO: 166207 - DNA, 37 bp, Artificial Sequence
  Synthetic oligonucleotide
gccgtacgggagggagtgtggggggagggattatgga

SEQ ID NO: 166208 - DNA, 37 bp, Artificial Sequence
  Synthetic oligonucleotide
aaggtgcgaagaggatgggggtggaggggatgctgga

SEQ ID NO: 166209 - DNA, 37 bp, Artificial Sequence
  Synthetic oligonucleotide
aacgcgggtgcagaaaggagcgtagggggcaatatga

SEQ ID NO: 166210 - DNA, 37 bp, Artificial Sequence
  Synthetic oligonucleotide
tgtagccccgcccacccccctacgtatgtgcctatga

SEQ ID NO: 166211 - DNA, 37 bp, Artificial Sequence
  Synthetic oligonucleotide
tttcggagccgccacccctccacaccccgttcattga

SEQ ID NO: 166212 - DNA, 38 bp, Artificial Sequence
  Synthetic oligonucleotide
gccctgccctttgccactcgctgtcctttccctattga

SEQ ID NO: 166213 - DNA, 38 bp, Artificial Sequence
  Synthetic oligonucleotide
taggactgcctcgccactgccctgtgactcacatttga

SEQ ID NO: 166214 - DNA, 38 bp, Artificial Sequence
  Synthetic oligonucleotide
gctgggcgggtgggaggtgggcgcatgaactagtttga

SEQ ID NO: 166215 - DNA, 36 bp, Artificial Sequence
  Synthetic oligonucleotide
aacgagagtgcaggggggaacggcgagtgtgtagta

SEQ ID NO: 166216 - DNA, 36 bp, Artificial Sequence
  Synthetic oligonucleotide
ggcgggggagggggataggattgcagggggatggta

SEQ ID NO: 166217 - DNA, 35 bp, Artificial Sequence
  Synthetic oligonucleotide
tcgcgccttgccattgcgcatccttctgtcctgta

SEQ ID NO: 166218 - DNA, 36 bp, Artificial Sequence
  Synthetic oligonucleotide
acttcccccccagtcccatgaaacgtgtcgtactta

SEQ ID NO: 166219 - DNA, 35 bp, Artificial Sequence
  Synthetic oligonucleotide
ccacccccccacgttactggacgatccctcgcaac

SEQ ID NO: 166220 - DNA, 35 bp, Artificial Sequence
  Synthetic oligonucleotide
acacaactatactcggcctcgttgctgtcccacac

SEQ ID NO: 166221 - DNA, 35 bp, Artificial Sequence
  Synthetic oligonucleotide
tcacccacagctgtctttctatctcacgctgccac

SEQ ID NO: 166222 - DNA, 35 bp, Artificial Sequence
  Synthetic oligonucleotide
agacgttgcatcgcacacttagccttccgctccac

SEQ ID NO: 166223 - DNA, 36 bp, Artificial Sequence
  Synthetic oligonucleotide
tggacaccccccgtcggcccactctgttttttatac

SEQ ID NO: 166224 - DNA, 34 bp, Artificial Sequence
  Synthetic oligonucleotide
agcccggtcctaagtgtgggcccgcacccccccc

SEQ ID NO: 166225 - DNA, 35 bp, Artificial Sequence
  Synthetic oligonucleotide
tttatgtacagcggcaccagttcgtccgcgccccc

SEQ ID NO: 166226 - DNA, 35 bp, Artificial Sequence
  Synthetic oligonucleotide
gactccgcacagtgaacaccacgccccgcctcccc

SEQ ID NO: 166227 - DNA, 35 bp, Artificial Sequence
  Synthetic oligonucleotide
taccgaccgacggtcactttaggtttacaacgccc

SEQ ID NO: 166228 - DNA, 35 bp, Artificial Sequence
  Synthetic oligonucleotide
tgctcccatgcctagactcgcttagatactcgccc

SEQ ID NO: 166229 - DNA, 35 bp, Artificial Sequence
  Synthetic oligonucleotide
ggccgaggaaatgtcgcccgcacctccccctgccc

SEQ ID NO: 166230 - DNA, 35 bp, Artificial Sequence
  Synthetic oligonucleotide
gcctcaatgttacgctgccagttcgaacccatccc

SEQ ID NO: 166231 - DNA, 35 bp, Artificial Sequence
  Synthetic oligonucleotide
gtggagcgagaccgtcattattcaccgtggttccc

SEQ ID NO: 166232 - DNA, 35 bp, Artificial Sequence
  Synthetic oligonucleotide
catctgaaaccaccgcccggcctgagtgctttgcc

SEQ ID NO: 166233 - DNA, 35 bp, Artificial Sequence
  Synthetic oligonucleotide
aaaggcatcgctacgcccgttcccgtcccccgtcc

SEQ ID NO: 166234 - DNA, 35 bp, Artificial Sequence
  Synthetic oligonucleotide
gtctcgcctcggttatctcaccagtctttccttcc

SEQ ID NO: 166235 - DNA, 35 bp, Artificial Sequence
  Synthetic oligonucleotide
tgcgatcctcgcccacctgattaagcccctgttcc

SEQ ID NO: 166236 - DNA, 35 bp, Artificial Sequence
  Synthetic oligonucleotide
gcacgccctccccgccaactttgccgcaggtacgc

SEQ ID NO: 166237 - DNA, 35 bp, Artificial Sequence
  Synthetic oligonucleotide
gcctgcaacggtcctaggatacccccctttaccgc

SEQ ID NO: 166238 - DNA, 35 bp, Artificial Sequence
  Synthetic oligonucleotide
tacgtgctcggactcgatccccacgcattttccgc

SEQ ID NO: 166239 - DNA, 35 bp, Artificial Sequence
  Synthetic oligonucleotide
gaagacttcccacacatcgcgccaccagctaatgc

SEQ ID NO: 166240 - DNA, 35 bp, Artificial Sequence
  Synthetic oligonucleotide
tgcctactgttctgctacactcagtctcctactgc

SEQ ID NO: 166241 - DNA, 35 bp, Artificial Sequence
  Synthetic oligonucleotide
tatgttcccgccgccactttgttgcccaattctgc

SEQ ID NO: 166242 - DNA, 35 bp, Artificial Sequence
  Synthetic oligonucleotide
aaccctcggagccactgttgcctactagtccttgc

SEQ ID NO: 166243 - DNA, 35 bp, Artificial Sequence
  Synthetic oligonucleotide
tgctctacaccccactgcctgctggaacttcgatc

SEQ ID NO: 166244 - DNA, 35 bp, Artificial Sequence
  Synthetic oligonucleotide
agatggctcaggtccctctagtcatttcgtgcctc

SEQ ID NO: 166245 - DNA, 35 bp, Artificial Sequence
  Synthetic oligonucleotide
gccgcccatttctgctgcatcaactgcttctcgtc

SEQ ID NO: 166246 - DNA, 35 bp, Artificial Sequence
  Synthetic oligonucleotide
gtgcgctcacgttcgtgacttccgttgttccattc

SEQ ID NO: 166247 - DNA, 35 bp, Artificial Sequence
  Synthetic oligonucleotide
tgcatgccacgcatttacttagtttgtcccatttc

SEQ ID NO: 166248 - DNA, 35 bp, Artificial Sequence
  Synthetic oligonucleotide
tactgcgcgcctcatgtcagatcatcgttcgtttc

SEQ ID NO: 166249 - DNA, 35 bp, Artificial Sequence
  Synthetic oligonucleotide
aagcctgtgtagggggtgaggaacggggaagtaag

SEQ ID NO: 166250 - DNA, 35 bp, Artificial Sequence
  Synthetic oligonucleotide
tcagaccgtcttccactctttatagtcttccctcg

SEQ ID NO: 166251 - DNA, 35 bp, Artificial Sequence
  Synthetic oligonucleotide
tgttccggccgttcactccgctaatccatgtctcg

SEQ ID NO: 166252 - DNA, 35 bp, Artificial Sequence
  Synthetic oligonucleotide
acgctgccttcctgttcttgtttcgtacctcgagg

SEQ ID NO: 166253 - DNA, 35 bp, Artificial Sequence
  Synthetic oligonucleotide
tgttaagggatgaaggaggggatagaagggggagg

SEQ ID NO: 166254 - DNA, 35 bp, Artificial Sequence
  Synthetic oligonucleotide
gacgttagcagtcattcgtcttcttctctatcctg

SEQ ID NO: 166255 - DNA, 35 bp, Artificial Sequence
  Synthetic oligonucleotide
gctgcatccgatccgctattcacccgcctcccttg

SEQ ID NO: 166256 - DNA, 35 bp, Artificial Sequence
  Synthetic oligonucleotide
gactcaccgcccttccatgtttcaggtacccgcat

SEQ ID NO: 166257 - DNA, 35 bp, Artificial Sequence
  Synthetic oligonucleotide
gccgttatccgttcggcccttgttactttgcttat

SEQ ID NO: 166258 - DNA, 35 bp, Artificial Sequence
  Synthetic oligonucleotide
tttgcccttcccccattgctctctaggaacgtact

SEQ ID NO: 166259 - DNA, 35 bp, Artificial Sequence
  Synthetic oligonucleotide
gcaccgccccgttggactaacgctcctcacttcct

SEQ ID NO: 166260 - DNA, 35 bp, Artificial Sequence
  Synthetic oligonucleotide
tacgcctctgccataactctcgacactccgcctct

SEQ ID NO: 166261 - DNA, 35 bp, Artificial Sequence
  Synthetic oligonucleotide
taacccagccgtatcttcgcgccctcccaaagtct

SEQ ID NO: 166262 - DNA, 35 bp, Artificial Sequence
  Synthetic oligonucleotide
tcctccacctcgtccctctaaaagcagtccggcgt

SEQ ID NO: 166263 - DNA, 38 bp, Artificial Sequence
  Synthetic oligonucleotide
tgagggcggagggaggggggtggatttggacggtatgt

SEQ ID NO: 166264 - DNA, 35 bp, Artificial Sequence
  Synthetic oligonucleotide
gacctaaccgccacctcgcccaaactggttcctgt

SEQ ID NO: 166265 - DNA, 35 bp, Artificial Sequence
  Synthetic oligonucleotide
acacatgcccgcgccgtctgcttccctcgcgctgt

SEQ ID NO: 166266 - DNA, 35 bp, Artificial Sequence
  Synthetic oligonucleotide
gttactggtcctatcgtacatagcactgcctcctt

SEQ ID NO: 166267 - DNA, 35 bp, Artificial Sequence
  Synthetic oligonucleotide
tgtcgccctcaccgtctcccccatgccaggtcctt

SEQ ID NO: 166268 - DNA, 35 bp, Artificial Sequence
  Synthetic oligonucleotide
aatcctccgcccctgaatgttttaatatcattctt

SEQ ID NO: 166269 - DNA, 35 bp, Artificial Sequence
  Synthetic oligonucleotide
attgctcctagcaattccgcattccaccccctgtt

SEQ ID NO: 166270 - DNA, 35 bp, Artificial Sequence
  Synthetic oligonucleotide
tacgccacctacctcggcacaaggtcccccttgtt

SEQ ID NO: 166271 - DNA, 35 bp, Artificial Sequence
  Synthetic oligonucleotide
gatgtactgcaggggaagtagggcaagatggaaaa

SEQ ID NO: 166272 - DNA, 35 bp, Artificial Sequence
  Synthetic oligonucleotide
actccagtgccacctcatcgctcggaccttgccaa

SEQ ID NO: 166273 - DNA, 36 bp, Artificial Sequence
  Synthetic oligonucleotide
gccccgagtttcgtgcgatacgatcccccccccgaa

SEQ ID NO: 166274 - DNA, 36 bp, Artificial Sequence
  Synthetic oligonucleotide
gaagcgaggcggtcacgtgcggggggtggcggcgaa

SEQ ID NO: 166275 - DNA, 36 bp, Artificial Sequence
  Synthetic oligonucleotide
gttcacgtggaaggaggggcgggctcgggataggaa

SEQ ID NO: 166276 - DNA, 35 bp, Artificial Sequence
  Synthetic oligonucleotide
ggccactctcgcatccgtttcgcccgttcattaca

SEQ ID NO: 166277 - DNA, 36 bp, Artificial Sequence
  Synthetic oligonucleotide
acccacacccgcggtgatctgtcttctcctgggcca

SEQ ID NO: 166278 - DNA, 36 bp, Artificial Sequence
  Synthetic oligonucleotide
agtaggtgaaacgggaggtatggaaaagggtgggca

SEQ ID NO: 166279 - DNA, 37 bp, Artificial Sequence
  Synthetic oligonucleotide
gcgcgggtgggggcaaggggcgaagagaaggttcaga

SEQ ID NO: 166280 - DNA, 37 bp, Artificial Sequence
  Synthetic oligonucleotide
gcactggggaaagagggattaggaagagggaccgaga

SEQ ID NO: 166281 - DNA, 36 bp, Artificial Sequence
  Synthetic oligonucleotide
tgagcccatctatgcatcattggcctttcaccacga

SEQ ID NO: 166282 - DNA, 37 bp, Artificial Sequence
  Synthetic oligonucleotide
tcaccgtccgaacatcagttctatcctcgacctccga

SEQ ID NO: 166283 - DNA, 37 bp, Artificial Sequence
  Synthetic oligonucleotide
aagcccaccatcctattccctcgtccgcttgctccga

SEQ ID NO: 166284 - DNA, 37 bp, Artificial Sequence
  Synthetic oligonucleotide
atcaacggggcagtaagaatatggggggagggatcga

SEQ ID NO: 166285 - DNA, 37 bp, Artificial Sequence
  Synthetic oligonucleotide
tctcgcacatggttcacgaccgcccggcccacctcga

SEQ ID NO: 166286 - DNA, 37 bp, Artificial Sequence
  Synthetic oligonucleotide
ttacgcccctttgtcccgtcatccctcgagaattcga

SEQ ID NO: 166287 - DNA, 37 bp, Artificial Sequence
  Synthetic oligonucleotide
gtgaccccgtgtcccagattgctccccgtaccttcga

SEQ ID NO: 166288 - DNA, 37 bp, Artificial Sequence
  Synthetic oligonucleotide
tgttccttccccaccgactatctgaacctgtcttcga

SEQ ID NO: 166289 - DNA, 37 bp, Artificial Sequence
  Synthetic oligonucleotide
atactgaggggcaaaggggtggacgggggggttagga

SEQ ID NO: 166290 - DNA, 37 bp, Artificial Sequence
  Synthetic oligonucleotide
gtgtcctaccagttctgtttcgtccttatcctccgga

SEQ ID NO: 166291 - DNA, 36 bp, Artificial Sequence
  Synthetic oligonucleotide
aaatggggggggtatgagggtgggggtgagagcgga

SEQ ID NO: 166292 - DNA, 36 bp, Artificial Sequence
  Synthetic oligonucleotide
atccccctcccatgttgcctttccttcaggctcgga

SEQ ID NO: 166293 - DNA, 37 bp, Artificial Sequence
  Synthetic oligonucleotide
tatgcagtccgaacatccgtactatcactctttcgga

SEQ ID NO: 166294 - DNA, 37 bp, Artificial Sequence
  Synthetic oligonucleotide
aagttgcgactacgggggcacggggggcgaggcggga

SEQ ID NO: 166295 - DNA, 37 bp, Artificial Sequence
  Synthetic oligonucleotide
tcgatgtggggggcactcggggtcggagggaggggga

SEQ ID NO: 166296 - DNA, 37 bp, Artificial Sequence
  Synthetic oligonucleotide
acgatagggtatgacgggaggggggtagtatggggga

SEQ ID NO: 166297 - DNA, 37 bp, Artificial Sequence
  Synthetic oligonucleotide
tctgggggtaacaagcggggggagggttttatgggga

SEQ ID NO: 166298 - DNA, 37 bp, Artificial Sequence
  Synthetic oligonucleotide
tgagtgaagtcggaggatgatacggtggcgggtggga

SEQ ID NO: 166299 - DNA, 36 bp, Artificial Sequence
  Synthetic oligonucleotide
ggtgggcaggggagccgggtaggatgggaaggtgga

SEQ ID NO: 166300 - DNA, 38 bp, Artificial Sequence
  Synthetic oligonucleotide
tgattgggggggagttgattgggaagggcataaaatga

SEQ ID NO: 166301 - DNA, 38 bp, Artificial Sequence
  Synthetic oligonucleotide
gcccacatgccctcctgactcagccctatgagacatga

SEQ ID NO: 166302 - DNA, 37 bp, Artificial Sequence
  Synthetic oligonucleotide
tgtgggggggagggcggcaaggtgggcatctttatga

SEQ ID NO: 166303 - DNA, 37 bp, Artificial Sequence
  Synthetic oligonucleotide
gccccccccaccccgacttgtagttcagtccacctga

SEQ ID NO: 166304 - DNA, 38 bp, Artificial Sequence
  Synthetic oligonucleotide
tcaggggaaccagggaggggaaataggtaggaacgtga

SEQ ID NO: 166305 - DNA, 38 bp, Artificial Sequence
  Synthetic oligonucleotide
gacgtgggaagggggggaggtcgcaagttacgacgtga

SEQ ID NO: 166306 - DNA, 38 bp, Artificial Sequence
  Synthetic oligonucleotide
tcctaccacacgtgctttcccgaagttcacctctgtga

SEQ ID NO: 166307 - DNA, 38 bp, Artificial Sequence
  Synthetic oligonucleotide
tttgtcacgccttctctccatagtatgccaccccttga

SEQ ID NO: 166308 - DNA, 38 bp, Artificial Sequence
  Synthetic oligonucleotide
tccacaacgactcctcgtctactatcgctcctgcttga

SEQ ID NO: 166309 - DNA, 35 bp, Artificial Sequence
  Synthetic oligonucleotide
tagacagtgcgcctggcccgtcccctatgctttga

SEQ ID NO: 166310 - DNA, 37 bp, Artificial Sequence
  Synthetic oligonucleotide
gcacggccatatccgcataattcgccccgctctttga

SEQ ID NO: 166311 - DNA, 36 bp, Artificial Sequence
  Synthetic oligonucleotide
tatgccctgctgcaggtccgtttcctttctcgcata

SEQ ID NO: 166312 - DNA, 35 bp, Artificial Sequence
  Synthetic oligonucleotide
atgggaggacgggagggtggttctgacctggtata

SEQ ID NO: 166313 - DNA, 36 bp, Artificial Sequence
  Synthetic oligonucleotide
tcatgcaacgcccttgcgcctctcgtttcgtaccta

SEQ ID NO: 166314 - DNA, 36 bp, Artificial Sequence
  Synthetic oligonucleotide
ggtcgcatgtcccgcgcgtttccttttggtccccta

SEQ ID NO: 166315 - DNA, 36 bp, Artificial Sequence
  Synthetic oligonucleotide
gtcaccctgccactgctatcttccgggtctgttcta

SEQ ID NO: 166316 - DNA, 36 bp, Artificial Sequence
  Synthetic oligonucleotide
tctgactccaggccgcgctaacgcctctccaccgta

SEQ ID NO: 166317 - DNA, 36 bp, Artificial Sequence
  Synthetic oligonucleotide
gtcatggcgaggagtaggggtgggtatgggaaggta

SEQ ID NO: 166318 - DNA, 36 bp, Artificial Sequence
  Synthetic oligonucleotide
tgatcctccgctcacagacgactttgtctatcctta

SEQ ID NO: 166319 - DNA, 35 bp, Artificial Sequence
  Synthetic oligonucleotide
acccctatcaccgcccagtgcccttgccaccttta

SEQ ID NO: 166320 - DNA, 36 bp, Artificial Sequence
  Synthetic oligonucleotide
accacctacaagcttggtttcccgcatacactttta

SEQ ID NO: 166321 - DNA, 35 bp, Artificial Sequence
  Synthetic oligonucleotide
agccaaaccggtccgctccgtccccaccagtttta

SEQ ID NO: 166322 - DNA, 35 bp, Artificial Sequence
  Synthetic oligonucleotide
tcccgcctcacccgcttatgcacgctcctacgaac

SEQ ID NO: 166323 - DNA, 35 bp, Artificial Sequence
  Synthetic oligonucleotide
gtccatcgcagtagcccggtccttgcttaattcac

SEQ ID NO: 166324 - DNA, 35 bp, Artificial Sequence
  Synthetic oligonucleotide
gttccgatcgctcgttgcccctccacatacttcac

SEQ ID NO: 166325 - DNA, 35 bp, Artificial Sequence
  Synthetic oligonucleotide
taccaatccgcccaccacatgaacataaagttcac

SEQ ID NO: 166326 - DNA, 34 bp, Artificial Sequence
  Synthetic oligonucleotide
gcacgaacgccctccccgacgtatgaacgtatac

SEQ ID NO: 166327 - DNA, 35 bp, Artificial Sequence
  Synthetic oligonucleotide
acacgttagatcgtcccactctctttgacccttac

SEQ ID NO: 166328 - DNA, 35 bp, Artificial Sequence
  Synthetic oligonucleotide
tatcgtctcgccccgttcggaccatctcttgttac

SEQ ID NO: 166329 - DNA, 35 bp, Artificial Sequence
  Synthetic oligonucleotide
aagccgtcgacctgaccgcctccacacttcggacc

SEQ ID NO: 166330 - DNA, 35 bp, Artificial Sequence
  Synthetic oligonucleotide
aaacgcgtatagcacggtctgtcatcttcaccccc

SEQ ID NO: 166331 - DNA, 35 bp, Artificial Sequence
  Synthetic oligonucleotide
tgtgattcctgccggccctatagtacgccctgccc

SEQ ID NO: 166332 - DNA, 35 bp, Artificial Sequence
  Synthetic oligonucleotide
tgtgcggtcgccctctctcttagttctcctttccc

SEQ ID NO: 166333 - DNA, 35 bp, Artificial Sequence
  Synthetic oligonucleotide
tccctcctcaggcttatcaaacagctcttaccgcc

SEQ ID NO: 166334 - DNA, 35 bp, Artificial Sequence
  Synthetic oligonucleotide
gcctcaccgcccgccgtatgaatataatctcggcc

SEQ ID NO: 166335 - DNA, 35 bp, Artificial Sequence
  Synthetic oligonucleotide
ggagcccctgctcttcgtttttcactgcgcctgcc

SEQ ID NO: 166336 - DNA, 35 bp, Artificial Sequence
  Synthetic oligonucleotide
acgtggaatcgcctcgatctttaccaatttgtgcc

SEQ ID NO: 166337 - DNA, 35 bp, Artificial Sequence
  Synthetic oligonucleotide
aacgccacacacttagcgcatcattccatctatcc

SEQ ID NO: 166338 - DNA, 35 bp, Artificial Sequence
  Synthetic oligonucleotide
gccttgccgccggctccacgaataccctacactcc

SEQ ID NO: 166339 - DNA, 35 bp, Artificial Sequence
  Synthetic oligonucleotide
gcaagcgtagtcgttccttccgctgacaccggtcc

SEQ ID NO: 166340 - DNA, 35 bp, Artificial Sequence
  Synthetic oligonucleotide
gatgccacgtcaagctcacgtccgttttcacccgc

SEQ ID NO: 166341 - DNA, 35 bp, Artificial Sequence
  Synthetic oligonucleotide
accacccttcacgccatgggcacaacgatcctcgc

SEQ ID NO: 166342 - DNA, 35 bp, Artificial Sequence
  Synthetic oligonucleotide
atctgctgtcttcaccgccatccgtcattgctcgc

SEQ ID NO: 166343 - DNA, 35 bp, Artificial Sequence
  Synthetic oligonucleotide
tgcccttccccagtttcctgatcccctttgatggc

SEQ ID NO: 166344 - DNA, 35 bp, Artificial Sequence
  Synthetic oligonucleotide
aacctcatacctcttcgccgtgttacgacccgatc

SEQ ID NO: 166345 - DNA, 35 bp, Artificial Sequence
  Synthetic oligonucleotide
gcccatccagttcgaccgcactacatcacttgatc

SEQ ID NO: 166346 - DNA, 35 bp, Artificial Sequence
  Synthetic oligonucleotide
acactgactgcaccctggcctgcttctacaaactc

SEQ ID NO: 166347 - DNA, 35 bp, Artificial Sequence
  Synthetic oligonucleotide
tgtcccttgccgccttcccaggtcgatgcccactc

SEQ ID NO: 166348 - DNA, 35 bp, Artificial Sequence
  Synthetic oligonucleotide
tgaacacgcctatgttcctccatttccgtaggctc

SEQ ID NO: 166349 - DNA, 35 bp, Artificial Sequence
  Synthetic oligonucleotide
ggcacaacgtgcatcatgcccccccccttctgctc

SEQ ID NO: 166350 - DNA, 35 bp, Artificial Sequence
  Synthetic oligonucleotide
gaggcgcctcctagtgtgatgcatccttccctctc

SEQ ID NO: 166351 - DNA, 35 bp, Artificial Sequence
  Synthetic oligonucleotide
gcctacccttcttgtcctttagtgtgcgtgttctc

SEQ ID NO: 166352 - DNA, 35 bp, Artificial Sequence
  Synthetic oligonucleotide
aagctccacatgtccatccctcggtctgttccttc

SEQ ID NO: 166353 - DNA, 35 bp, Artificial Sequence
  Synthetic oligonucleotide
ttgaccatctatcgttctactgcgtcacccctttc

SEQ ID NO: 166354 - DNA, 35 bp, Artificial Sequence
  Synthetic oligonucleotide
gcccccgccgcgttgtcttcccctgtcatcttttc

SEQ ID NO: 166355 - DNA, 35 bp, Artificial Sequence
  Synthetic oligonucleotide
atcgccgacagaactgggcccctttcgtctttttc

SEQ ID NO: 166356 - DNA, 35 bp, Artificial Sequence
  Synthetic oligonucleotide
atgtggaggttgtggaggggaatatggacgaagag

SEQ ID NO: 166357 - DNA, 34 bp, Artificial Sequence
  Synthetic oligonucleotide
tgttacctctgacactcccaggccccacacgccg

SEQ ID NO: 166358 - DNA, 34 bp, Artificial Sequence
  Synthetic oligonucleotide
ttgctatgtcgcagtccttccagttcacccgccg

SEQ ID NO: 166359 - DNA, 35 bp, Artificial Sequence
  Synthetic oligonucleotide
gatgctcccggtcctgacttgaatagtcccctgcg

SEQ ID NO: 166360 - DNA, 35 bp, Artificial Sequence
  Synthetic oligonucleotide
agaactgggacagagcaggagaagaagggtcacgg

SEQ ID NO: 166361 - DNA, 35 bp, Artificial Sequence
  Synthetic oligonucleotide
actcactccactgcatcatccgcgttagccgcggg

SEQ ID NO: 166362 - DNA, 35 bp, Artificial Sequence
  Synthetic oligonucleotide
atgcctccatgcccgccggcccttccactcggggg

SEQ ID NO: 166363 - DNA, 35 bp, Artificial Sequence
  Synthetic oligonucleotide
tgggtgggggagttaggaacagggaagggcttggg

SEQ ID NO: 166364 - DNA, 35 bp, Artificial Sequence
  Synthetic oligonucleotide
gtatggtggaggaacggtagaaaggtgcagtctgg

SEQ ID NO: 166365 - DNA, 35 bp, Artificial Sequence
  Synthetic oligonucleotide
acacgccacctaacatgttcgccgttccgctcttg

SEQ ID NO: 166366 - DNA, 35 bp, Artificial Sequence
  Synthetic oligonucleotide
atcacagcaataggcaggggtagggaaaggagttg

SEQ ID NO: 166367 - DNA, 35 bp, Artificial Sequence
  Synthetic oligonucleotide
gagcgggatggggagggagccaagaacgtgggcat

SEQ ID NO: 166368 - DNA, 35 bp, Artificial Sequence
  Synthetic oligonucleotide
gtcctcgatccctgacaatccgtccctccgtgcct

SEQ ID NO: 166369 - DNA, 35 bp, Artificial Sequence
  Synthetic oligonucleotide
gccacgggaccgactgtctcagagcctcccctcct

SEQ ID NO: 166370 - DNA, 35 bp, Artificial Sequence
  Synthetic oligonucleotide
tcgccctcgcctgagacacttgccttccgtttcct

SEQ ID NO: 166371 - DNA, 35 bp, Artificial Sequence
  Synthetic oligonucleotide
gccgtccggtgttcacgttcctctgttccctggct

SEQ ID NO: 166372 - DNA, 35 bp, Artificial Sequence
  Synthetic oligonucleotide
tacaaatccacccgccaactctgtatttaatgtct

SEQ ID NO: 166373 - DNA, 34 bp, Artificial Sequence
  Synthetic oligonucleotide
ggagggtgtcggggggggtaagggggtttatggt

SEQ ID NO: 166374 - DNA, 35 bp, Artificial Sequence
  Synthetic oligonucleotide
tccgccatcattaccatggtttgagttcacccatt

SEQ ID NO: 166375 - DNA, 35 bp, Artificial Sequence
  Synthetic oligonucleotide
tgcccctccgccaccacgttactggtagagctatt

SEQ ID NO: 166376 - DNA, 35 bp, Artificial Sequence
  Synthetic oligonucleotide
tctgtcctctctcgcgcaagcatgcattgcacctt

SEQ ID NO: 166377 - DNA, 35 bp, Artificial Sequence
  Synthetic oligonucleotide
tgtgtcataaagcttcgtcccatccgctccctgtt

SEQ ID NO: 166378 - DNA, 35 bp, Artificial Sequence
  Synthetic oligonucleotide
aaagatcgagacgggtgggctaaagggtgggcttt

SEQ ID NO: 166379 - DNA, 35 bp, Artificial Sequence
  Synthetic oligonucleotide
cacgacgccttcatgctctgctcgccgccctcttt

SEQ ID NO: 166380 - DNA, 35 bp, Artificial Sequence
  Synthetic oligonucleotide
tgcccagaccgtacccccctattcagcgacgtttt

SEQ ID NO: 166381 - DNA, 36 bp, Artificial Sequence
  Synthetic oligonucleotide
gctaggacggggggttggggcgcaagaggggtcaaa

SEQ ID NO: 166382 - DNA, 36 bp, Artificial Sequence
  Synthetic oligonucleotide
gcacacatcctctctttcagggacctgctctccgaa

SEQ ID NO: 166383 - DNA, 36 bp, Artificial Sequence
  Synthetic oligonucleotide
acgccgttacaggccagtatctcaccgcttcccaca

SEQ ID NO: 166384 - DNA, 36 bp, Artificial Sequence
  Synthetic oligonucleotide
tcccgcctcctcctgcgatgcgatctacctgccaca

SEQ ID NO: 166385 - DNA, 36 bp, Artificial Sequence
  Synthetic oligonucleotide
tgaccagccgccccgtttccgccaccgttgttccca

SEQ ID NO: 166386 - DNA, 36 bp, Artificial Sequence
  Synthetic oligonucleotide
gtctccccgcatactcccccgtgttcgattccgcca

SEQ ID NO: 166387 - DNA, 36 bp, Artificial Sequence
  Synthetic oligonucleotide
ttgaccgcctcaacccaagccacccccaccggtcca

SEQ ID NO: 166388 - DNA, 35 bp, Artificial Sequence
  Synthetic oligonucleotide
gaatcaccccatcacatgaccatagattttgtcca

SEQ ID NO: 166389 - DNA, 36 bp, Artificial Sequence
  Synthetic oligonucleotide
gatccagttgggtagttgttcactcgcttttttcca

SEQ ID NO: 166390 - DNA, 35 bp, Artificial Sequence
  Synthetic oligonucleotide
cacaccgccacttttgccaccctttatatgccgca

SEQ ID NO: 166391 - DNA, 35 bp, Artificial Sequence
  Synthetic oligonucleotide
tcacgcctccttacctcgggccctaacacagtgca

SEQ ID NO: 166392 - DNA, 33 bp, Artificial Sequence
  Synthetic oligonucleotide
agtgccgcatggttactatcgcccgctatctca

SEQ ID NO: 166393 - DNA, 35 bp, Artificial Sequence
  Synthetic oligonucleotide
tcagctaaacgtcaatttcccgcccacccttctca

SEQ ID NO: 166394 - DNA, 36 bp, Artificial Sequence
  Synthetic oligonucleotide
gcaaagcgcaacggtccatcaagccctcggttctca

SEQ ID NO: 166395 - DNA, 37 bp, Artificial Sequence
  Synthetic oligonucleotide
tactcacccccacgatgcgcccctataggtcagcaga

SEQ ID NO: 166396 - DNA, 37 bp, Artificial Sequence
  Synthetic oligonucleotide
gctatggggggtgcagaacgaagggaagaaggtcaga

SEQ ID NO: 166397 - DNA, 37 bp, Artificial Sequence
  Synthetic oligonucleotide
ggtcgagagaacgagggtaagaggtgggaaggtcaga

SEQ ID NO: 166398 - DNA, 37 bp, Artificial Sequence
  Synthetic oligonucleotide
tcccaggtcggacaagggagggaggcgggccaagaga

SEQ ID NO: 166399 - DNA, 37 bp, Artificial Sequence
  Synthetic oligonucleotide
tccaccactgccgtgtttggccctaccgctcccgaga

SEQ ID NO: 166400 - DNA, 37 bp, Artificial Sequence
  Synthetic oligonucleotide
acctcgagtcgtctgcaaggaaagcccccccacccga

SEQ ID NO: 166401 - DNA, 35 bp, Artificial Sequence
  Synthetic oligonucleotide
tgcacagatctgccttgtttctctgtcacccccga

SEQ ID NO: 166402 - DNA, 37 bp, Artificial Sequence
  Synthetic oligonucleotide
gcgaagcctcccatctccggttcgctggttctctcga

SEQ ID NO: 166403 - DNA, 37 bp, Artificial Sequence
  Synthetic oligonucleotide
gtgtgaagtacaggaggggaatgaacgaatgagagga

SEQ ID NO: 166404 - DNA, 36 bp, Artificial Sequence
  Synthetic oligonucleotide
tcccccccggtcacatctccgtctcacgagaacgga

SEQ ID NO: 166405 - DNA, 36 bp, Artificial Sequence
  Synthetic oligonucleotide
atcgggacggggaaaatggttggctatagggcggga

SEQ ID NO: 166406 - DNA, 36 bp, Artificial Sequence
  Synthetic oligonucleotide
tcacgcgctacccctagtctcgtcttccgccttgga

SEQ ID NO: 166407 - DNA, 36 bp, Artificial Sequence
  Synthetic oligonucleotide
acctggagcgggacatggggattatcgggggttgga

SEQ ID NO: 166408 - DNA, 38 bp, Artificial Sequence
  Synthetic oligonucleotide
atgacggaactccgggagggtgtgggagggcaaaatga

SEQ ID NO: 166409 - DNA, 38 bp, Artificial Sequence
  Synthetic oligonucleotide
ggagctctcctccgtgtgcacgtaccatcctctcatga

SEQ ID NO: 166410 - DNA, 38 bp, Artificial Sequence
  Synthetic oligonucleotide
tgagggcggagggaggggggtggatttggactgtatga

SEQ ID NO: 166411 - DNA, 38 bp, Artificial Sequence
  Synthetic oligonucleotide
atcccccgacctcgagtgttaacctctgttttgcctga

SEQ ID NO: 166412 - DNA, 38 bp, Artificial Sequence
  Synthetic oligonucleotide
tgtcgtgcggtaggggagagggaacggggcggagctga

SEQ ID NO: 166413 - DNA, 36 bp, Artificial Sequence
  Synthetic oligonucleotide
ggaggggggggagtaggatcgggatagaggaagtga

SEQ ID NO: 166414 - DNA, 37 bp, Artificial Sequence
  Synthetic oligonucleotide
aatgcggggagaaatgggcaaggtctgggaggggtga

SEQ ID NO: 166415 - DNA, 36 bp, Artificial Sequence
  Synthetic oligonucleotide
tccgtgccggactcacattggtatttccgcccttga

SEQ ID NO: 166416 - DNA, 37 bp, Artificial Sequence
  Synthetic oligonucleotide
tgccccgatccaccctgtttctatgatcttttcttga

SEQ ID NO: 166417 - DNA, 38 bp, Artificial Sequence
  Synthetic oligonucleotide
agcggaactccgcccgtgtcctgcccacttcttgttga

SEQ ID NO: 166418 - DNA, 37 bp, Artificial Sequence
  Synthetic oligonucleotide
ataacagccgcatatatcgttcccccgcctagtttga

SEQ ID NO: 166419 - DNA, 36 bp, Artificial Sequence
  Synthetic oligonucleotide
gatccctcaccgctacattggtttttgttcttacta

SEQ ID NO: 166420 - DNA, 36 bp, Artificial Sequence
  Synthetic oligonucleotide
gtcgcccccgcaatcccaccctcccttgagtgccta

SEQ ID NO: 166421 - DNA, 36 bp, Artificial Sequence
  Synthetic oligonucleotide
tctggcgctgttgttatcgcatcgtgccctcctcta

SEQ ID NO: 166422 - DNA, 35 bp, Artificial Sequence
  Synthetic oligonucleotide
gccctccgcctcatgttatgcctcctctgtccgta

SEQ ID NO: 166423 - DNA, 36 bp, Artificial Sequence
  Synthetic oligonucleotide
gaccacgtgtatggctatacacgccgacctccatta

SEQ ID NO: 166424 - DNA, 36 bp, Artificial Sequence
  Synthetic oligonucleotide
gcacacctgatctctgtcgctgcttcccccgcctta

SEQ ID NO: 166425 - DNA, 35 bp, Artificial Sequence
  Synthetic oligonucleotide
gcccttcccatccgttgtaaattcctgctatcaac

SEQ ID NO: 166426 - DNA, 35 bp, Artificial Sequence
  Synthetic oligonucleotide
atgcgtaccccgttaccgcgtccccaccgttacac

SEQ ID NO: 166427 - DNA, 35 bp, Artificial Sequence
  Synthetic oligonucleotide
atccacacgcgccagcgttccctcgcaacctgcac

SEQ ID NO: 166428 - DNA, 35 bp, Artificial Sequence
  Synthetic oligonucleotide
gcatccacaccgacgtagtcacccgttccctgcac

SEQ ID NO: 166429 - DNA, 35 bp, Artificial Sequence
  Synthetic oligonucleotide
attacgctcccgtcctcccgtcccgttgatttcac

SEQ ID NO: 166430 - DNA, 35 bp, Artificial Sequence
  Synthetic oligonucleotide
gttccccccccctctttcagatggtctcaactgac

SEQ ID NO: 166431 - DNA, 35 bp, Artificial Sequence
  Synthetic oligonucleotide
gactccgccttcctaccggcctcttggttctatac

SEQ ID NO: 166432 - DNA, 35 bp, Artificial Sequence
  Synthetic oligonucleotide
acttgtgcgccgcttccgtactaccgtgcttttac

SEQ ID NO: 166433 - DNA, 35 bp, Artificial Sequence
  Synthetic oligonucleotide
gtccccctcgagctatgcacgctttgtaacacacc

SEQ ID NO: 166434 - DNA, 35 bp, Artificial Sequence
  Synthetic oligonucleotide
tcaacggacctccacgatctattttctcgggcacc

SEQ ID NO: 166435 - DNA, 35 bp, Artificial Sequence
  Synthetic oligonucleotide
agtacctgcatccgtttgacatccaaaacgccccc

SEQ ID NO: 166436 - DNA, 35 bp, Artificial Sequence
  Synthetic oligonucleotide
tcacacgtgtctgtccatgtcgtccgtcgttgccc

SEQ ID NO: 166437 - DNA, 35 bp, Artificial Sequence
  Synthetic oligonucleotide
aagggccaagccgtagctgattttacgccactccc

SEQ ID NO: 166438 - DNA, 35 bp, Artificial Sequence
  Synthetic oligonucleotide
tgccgctgcccttaatgcgcctttcagtcttagcc

SEQ ID NO: 166439 - DNA, 35 bp, Artificial Sequence
  Synthetic oligonucleotide
agaccggatcagtctatctacgtatgctcgcctcc

SEQ ID NO: 166440 - DNA, 35 bp, Artificial Sequence
  Synthetic oligonucleotide
tatgtattcgtgcgcctccctaccgcagtatgtcc

SEQ ID NO: 166441 - DNA, 35 bp, Artificial Sequence
  Synthetic oligonucleotide
gacgaatctgccccctgctgtcttcacccctgtcc

SEQ ID NO: 166442 - DNA, 35 bp, Artificial Sequence
  Synthetic oligonucleotide
agccacgtaccctgttctcctgtctgctcgattcc

SEQ ID NO: 166443 - DNA, 35 bp, Artificial Sequence
  Synthetic oligonucleotide
taacccgatcgcctgtttacgcttcttttgtttcc

SEQ ID NO: 166444 - DNA, 35 bp, Artificial Sequence
  Synthetic oligonucleotide
gcttgttcccccacacatactcgtaaccgtaccgc

SEQ ID NO: 166445 - DNA, 35 bp, Artificial Sequence
  Synthetic oligonucleotide
gcacttccccctgacctatcgatccacaccatggc

SEQ ID NO: 166446 - DNA, 35 bp, Artificial Sequence
  Synthetic oligonucleotide
tccgtaaccagcccttcaatgccccgccatagtgc

SEQ ID NO: 166447 - DNA, 35 bp, Artificial Sequence
  Synthetic oligonucleotide
ttcgctactgttcatctcagccattccacctgctc

SEQ ID NO: 166448 - DNA, 35 bp, Artificial Sequence
  Synthetic oligonucleotide
ttcccaccctgcccgaaatgtttttggttcccgtc

SEQ ID NO: 166449 - DNA, 35 bp, Artificial Sequence
  Synthetic oligonucleotide
ttatcgcgtgttgctttgccctctcctccggtgtc

SEQ ID NO: 166450 - DNA, 35 bp, Artificial Sequence
  Synthetic oligonucleotide
gcccacacacacttccccttctttggagtaccttc

SEQ ID NO: 166451 - DNA, 35 bp, Artificial Sequence
  Synthetic oligonucleotide
ttgacccctgccccacaagcgctggttcattgttc

SEQ ID NO: 166452 - DNA, 35 bp, Artificial Sequence
  Synthetic oligonucleotide
tcactgctggtacccgattcagtcctcgcgctttc

SEQ ID NO: 166453 - DNA, 35 bp, Artificial Sequence
  Synthetic oligonucleotide
tgtgcacaccgcttttgcttcgaactatctatccg

SEQ ID NO: 166454 - DNA, 35 bp, Artificial Sequence
  Synthetic oligonucleotide
taacctgcctgacgcctgagcaccactcccctccg

SEQ ID NO: 166455 - DNA, 34 bp, Artificial Sequence
  Synthetic oligonucleotide
tcatactcgccgctacatgtcctttcgttacctg

SEQ ID NO: 166456 - DNA, 35 bp, Artificial Sequence
  Synthetic oligonucleotide
acgaagtcccagctaacccgcccctccctgcgctg

SEQ ID NO: 166457 - DNA, 35 bp, Artificial Sequence
  Synthetic oligonucleotide
agtgggcaacggtcgcttctcctcctttactgctg

SEQ ID NO: 166458 - DNA, 35 bp, Artificial Sequence
  Synthetic oligonucleotide
gtcccgtgcccgcgatcccccttaactactgtctg

SEQ ID NO: 166459 - DNA, 35 bp, Artificial Sequence
  Synthetic oligonucleotide
gccgccaggttttaccatacgcctctattcctttg

SEQ ID NO: 166460 - DNA, 35 bp, Artificial Sequence
  Synthetic oligonucleotide
tcctggtcagtaggccgctcttcgtcatacaccat

SEQ ID NO: 166461 - DNA, 35 bp, Artificial Sequence
  Synthetic oligonucleotide
accgcaggcccgcccatgacattgaccactttact

SEQ ID NO: 166462 - DNA, 35 bp, Artificial Sequence
  Synthetic oligonucleotide
aaggaagggtgggagcggggcaaacagcgagacct

SEQ ID NO: 166463 - DNA, 35 bp, Artificial Sequence
  Synthetic oligonucleotide
acagccacgtggatctttttcctacatcgccccct

SEQ ID NO: 166464 - DNA, 35 bp, Artificial Sequence
  Synthetic oligonucleotide
agcccccactgcgcactgatggcctatcgtcccct

SEQ ID NO: 166465 - DNA, 35 bp, Artificial Sequence
  Synthetic oligonucleotide
ggtagacatcctcagcacgcaaccgcttgtcccct

SEQ ID NO: 166466 - DNA, 35 bp, Artificial Sequence
  Synthetic oligonucleotide
ggtcgcatcactcaactgtgagtccttccgtccct

SEQ ID NO: 166467 - DNA, 35 bp, Artificial Sequence
  Synthetic oligonucleotide
actttccgccgcacttccagccgactgtcttagct

SEQ ID NO: 166468 - DNA, 35 bp, Artificial Sequence
  Synthetic oligonucleotide
gagcctatccccgtccgcctcggcccgtaccatct

SEQ ID NO: 166469 - DNA, 35 bp, Artificial Sequence
  Synthetic oligonucleotide
tgagaggtgacgggcagttaagcggggggtggtct

SEQ ID NO: 166470 - DNA, 35 bp, Artificial Sequence
  Synthetic oligonucleotide
ttggtggccgtactcctgttatccatcttttaggt

SEQ ID NO: 166471 - DNA, 35 bp, Artificial Sequence
  Synthetic oligonucleotide
tggggtgtggttggggtgaaggcgaggcggggggt

SEQ ID NO: 166472 - DNA, 35 bp, Artificial Sequence
  Synthetic oligonucleotide
ttgacagatctactgcgcattccccccttactctt

SEQ ID NO: 166473 - DNA, 36 bp, Artificial Sequence
  Synthetic oligonucleotide
gtacgaaaaggggcgaagacaaggggaggctggaaa

SEQ ID NO: 166474 - DNA, 36 bp, Artificial Sequence
  Synthetic oligonucleotide
gatagccaccctccgcctaccgccgattgttaccaa

SEQ ID NO: 166475 - DNA, 36 bp, Artificial Sequence
  Synthetic oligonucleotide
gtcaaggaagggtgggaatgggtggtagtgtacgaa

SEQ ID NO: 166476 - DNA, 36 bp, Artificial Sequence
  Synthetic oligonucleotide
taacgctaggcagacgtagccccgcccttccttgaa

SEQ ID NO: 166477 - DNA, 35 bp, Artificial Sequence
  Synthetic oligonucleotide
gacctcccacccgtgctgtaacaacgccgccaaca

SEQ ID NO: 166478 - DNA, 36 bp, Artificial Sequence
  Synthetic oligonucleotide
gcccccccgaaccatgctttcactctgcggtcacca

SEQ ID NO: 166479 - DNA, 36 bp, Artificial Sequence
  Synthetic oligonucleotide
ttcgcaggacatcctgctttaagtcttatcccgcca

SEQ ID NO: 166480 - DNA, 36 bp, Artificial Sequence
  Synthetic oligonucleotide
acatgagccctcgccgttcggatcacctgctttcca

SEQ ID NO: 166481 - DNA, 36 bp, Artificial Sequence
  Synthetic oligonucleotide
ggggaggactgaggggggggtcgccaacagggagca

SEQ ID NO: 166482 - DNA, 34 bp, Artificial Sequence
  Synthetic oligonucleotide
acgcgacgccccagcccatcacatccggtgcgca

SEQ ID NO: 166483 - DNA, 36 bp, Artificial Sequence
  Synthetic oligonucleotide
tcccacgcctttgactcatccgaccataatttatca

SEQ ID NO: 166484 - DNA, 35 bp, Artificial Sequence
  Synthetic oligonucleotide
gccccgcatgcaacactgcgatacttacccgctca

SEQ ID NO: 166485 - DNA, 37 bp, Artificial Sequence
  Synthetic oligonucleotide
tgggtgaggaagaacggggatgggggtggcattaaga

SEQ ID NO: 166486 - DNA, 36 bp, Artificial Sequence
  Synthetic oligonucleotide
gtcatgggagggtgagggtgtagggatacgagcaga

SEQ ID NO: 166487 - DNA, 36 bp, Artificial Sequence
  Synthetic oligonucleotide
gtacacccttaatgctgcccgaccattccacttaga

SEQ ID NO: 166488 - DNA, 37 bp, Artificial Sequence
  Synthetic oligonucleotide
atgctctgcacctgttctcccaatatgttacacccga

SEQ ID NO: 166489 - DNA, 37 bp, Artificial Sequence
  Synthetic oligonucleotide
atctcccagttgctatcccgtccatctttcatgccga

SEQ ID NO: 166490 - DNA, 37 bp, Artificial Sequence
  Synthetic oligonucleotide
ttgcctgtcacgcccatactgcgctgctcccctccga

SEQ ID NO: 166491 - DNA, 36 bp, Artificial Sequence
  Synthetic oligonucleotide
agagggaggatggataggttgttggagggtgggcga

SEQ ID NO: 166492 - DNA, 36 bp, Artificial Sequence
  Synthetic oligonucleotide
acgcatgctcctcctctctgtccgctcccctatcga

SEQ ID NO: 166493 - DNA, 35 bp, Artificial Sequence
  Synthetic oligonucleotide
aagaatccttacgccgcctgcctcgcctccctcga

SEQ ID NO: 166494 - DNA, 37 bp, Artificial Sequence
  Synthetic oligonucleotide
tcccctcgcttcaccgtgctttgtttgttccagtcga

SEQ ID NO: 166495 - DNA, 37 bp, Artificial Sequence
  Synthetic oligonucleotide
gcacagggggggtacgtagagaggtgcacggggagga

SEQ ID NO: 166496 - DNA, 37 bp, Artificial Sequence
  Synthetic oligonucleotide
gagtccaccgcaccgacccacctttccagccatcgga

SEQ ID NO: 166497 - DNA, 37 bp, Artificial Sequence
  Synthetic oligonucleotide
tatcaccacatgtcttcacctctcttccggactcgga

SEQ ID NO: 166498 - DNA, 37 bp, Artificial Sequence
  Synthetic oligonucleotide
tcccgggcggggtgtcctaggggcgcgtattagggga

SEQ ID NO: 166499 - DNA, 37 bp, Artificial Sequence
  Synthetic oligonucleotide
tcttcacccccccgcatttggtttgcccgctcttgga

SEQ ID NO: 166500 - DNA, 38 bp, Artificial Sequence
  Synthetic oligonucleotide
gcatcctcgcttgtaccccccccgccgtccccgcctga

SEQ ID NO: 166501 - DNA, 38 bp, Artificial Sequence
  Synthetic oligonucleotide
tccccgccccatgtctatctttcgccgcctgttcctga

SEQ ID NO: 166502 - DNA, 38 bp, Artificial Sequence
  Synthetic oligonucleotide
gtagtaggagtaacagcgtgtgggggagggacgggtga

SEQ ID NO: 166503 - DNA, 38 bp, Artificial Sequence
  Synthetic oligonucleotide
gtacaggggggagggggtggacagtaagtggagtgtga

SEQ ID NO: 166504 - DNA, 37 bp, Artificial Sequence
  Synthetic oligonucleotide
aagtcatagtcctgaccctgtttttcgcccccattga

SEQ ID NO: 166505 - DNA, 38 bp, Artificial Sequence
  Synthetic oligonucleotide
tctatgcggcgcctcgcttcctcccctccccgtgttga

SEQ ID NO: 166506 - DNA, 36 bp, Artificial Sequence
  Synthetic oligonucleotide
gagagtaagggaggggtttagggggagggagttata

SEQ ID NO: 166507 - DNA, 36 bp, Artificial Sequence
  Synthetic oligonucleotide
gtctacgattgatcctggtcaccgctcctgtttcta

SEQ ID NO: 166508 - DNA, 36 bp, Artificial Sequence
  Synthetic oligonucleotide
gacaccaccccgctgtgctcttgtctctcattggta

SEQ ID NO: 166509 - DNA, 36 bp, Artificial Sequence
  Synthetic oligonucleotide
gtggaacgccgtgacatcgatttacccttgcctgta

SEQ ID NO: 166510 - DNA, 36 bp, Artificial Sequence
  Synthetic oligonucleotide
tgctgcacatttgcatacgctccatccaatcttgta

SEQ ID NO: 166511 - DNA, 35 bp, Artificial Sequence
  Synthetic oligonucleotide
tcgcacttcctggacgtgaccgttccccccgctta

SEQ ID NO: 166512 - DNA, 36 bp, Artificial Sequence
  Synthetic oligonucleotide
gaccgatccccaccccgcctgcgccgttaatcgtta

SEQ ID NO: 166513 - DNA, 35 bp, Artificial Sequence
  Synthetic oligonucleotide
tagccagtcctgtccctcgtacttcgcccggcaac

SEQ ID NO: 166514 - DNA, 35 bp, Artificial Sequence
  Synthetic oligonucleotide
tccacccttatccttgtcctttcgacggatttaac

SEQ ID NO: 166515 - DNA, 35 bp, Artificial Sequence
  Synthetic oligonucleotide
agaccacccgccggttttgctgttccatctaccac

SEQ ID NO: 166516 - DNA, 35 bp, Artificial Sequence
  Synthetic oligonucleotide
acgccccgcttgtaacctatatgctccccccccac

SEQ ID NO: 166517 - DNA, 35 bp, Artificial Sequence
  Synthetic oligonucleotide
acccacactctaatacgttttaacccagtatccac

SEQ ID NO: 166518 - DNA, 35 bp, Artificial Sequence
  Synthetic oligonucleotide
taggggccgggacaagggagggggggggcacggac

SEQ ID NO: 166519 - DNA, 35 bp, Artificial Sequence
  Synthetic oligonucleotide
tacccgtgccgtggtcttgggccactcatatctac

SEQ ID NO: 166520 - DNA, 35 bp, Artificial Sequence
  Synthetic oligonucleotide
gcatgtacgaatcgccccctgtcactctacgcacc

SEQ ID NO: 166521 - DNA, 35 bp, Artificial Sequence
  Synthetic oligonucleotide
tgcactcccattagttacctttgtacagccttacc

SEQ ID NO: 166522 - DNA, 35 bp, Artificial Sequence
  Synthetic oligonucleotide
tgcctcgcagcccgccgactctgcaggacaccccc

SEQ ID NO: 166523 - DNA, 35 bp, Artificial Sequence
  Synthetic oligonucleotide
tcacgaacgtgtcagctctcatttctcaacccccc

SEQ ID NO: 166524 - DNA, 35 bp, Artificial Sequence
  Synthetic oligonucleotide
ccaagtcacaaccgccaagtcccaggccgctcccc

SEQ ID NO: 166525 - DNA, 35 bp, Artificial Sequence
  Synthetic oligonucleotide
gaatgcaagcgtgcggctttccctctgaccatccc

SEQ ID NO: 166526 - DNA, 35 bp, Artificial Sequence
  Synthetic oligonucleotide
tcccggcgccgcccgctttatctgaacctctagcc

SEQ ID NO: 166527 - DNA, 35 bp, Artificial Sequence
  Synthetic oligonucleotide
tgaccatcccaccgccctggccctacggatccgcc

SEQ ID NO: 166528 - DNA, 35 bp, Artificial Sequence
  Synthetic oligonucleotide
tcccgcccgcctctgccatcgttcaggcttccgcc

SEQ ID NO: 166529 - DNA, 35 bp, Artificial Sequence
  Synthetic oligonucleotide
gattgtccgtgacgtctgtcttttgatccccatcc

SEQ ID NO: 166530 - DNA, 33 bp, Artificial Sequence
  Synthetic oligonucleotide
gcgactttcgccctcgctccgatcaacttatcc

SEQ ID NO: 166531 - DNA, 35 bp, Artificial Sequence
  Synthetic oligonucleotide
gatgcatgtcccttctgcctcgcttgctcccctcc

SEQ ID NO: 166532 - DNA, 35 bp, Artificial Sequence
  Synthetic oligonucleotide
ttggcgcctcttatatatgccgttgcgtaccttcc

SEQ ID NO: 166533 - DNA, 35 bp, Artificial Sequence
  Synthetic oligonucleotide
tccgcccggtttcgaatccttccggccctggttcc

SEQ ID NO: 166534 - DNA, 35 bp, Artificial Sequence
  Synthetic oligonucleotide
gtcgagcgttttgctcgtcccctctactactacgc

SEQ ID NO: 166535 - DNA, 35 bp, Artificial Sequence
  Synthetic oligonucleotide
gtccacgtccctgccatactcaaagccccctccgc

SEQ ID NO: 166536 - DNA, 35 bp, Artificial Sequence
  Synthetic oligonucleotide
gccgactgcccgaattgcaagcgtcttggccgatc

SEQ ID NO: 166537 - DNA, 35 bp, Artificial Sequence
  Synthetic oligonucleotide
acaccaccctttcgtcctattgcctaaggcctatc

SEQ ID NO: 166538 - DNA, 35 bp, Artificial Sequence
  Synthetic oligonucleotide
gtcgacgccgctatcccattaggacctgcccactc

SEQ ID NO: 166539 - DNA, 35 bp, Artificial Sequence
  Synthetic oligonucleotide
acgcacgtcctggcatgtacccgctgctgcatctc

SEQ ID NO: 166540 - DNA, 35 bp, Artificial Sequence
  Synthetic oligonucleotide
atcgcatcttagtgcgcagaccctctcgttgtctc

SEQ ID NO: 166541 - DNA, 35 bp, Artificial Sequence
  Synthetic oligonucleotide
ttccccgtcgccctagttaatgcttctggtttgtc

SEQ ID NO: 166542 - DNA, 35 bp, Artificial Sequence
  Synthetic oligonucleotide
tgacgccgccgcacgcatatcgtactttttgcttc

SEQ ID NO: 166543 - DNA, 35 bp, Artificial Sequence
  Synthetic oligonucleotide
tccccacgtcgctgatccgcggcctgtggttcttc

SEQ ID NO: 166544 - DNA, 35 bp, Artificial Sequence
  Synthetic oligonucleotide
gagggtggaggggtgtttgataggaacagggagag

SEQ ID NO: 166545 - DNA, 35 bp, Artificial Sequence
  Synthetic oligonucleotide
taccctccaccggccacctctactagtgcaccccg

SEQ ID NO: 166546 - DNA, 35 bp, Artificial Sequence
  Synthetic oligonucleotide
gaaacacttcaccctccgatggctattctgtgccg

SEQ ID NO: 166547 - DNA, 35 bp, Artificial Sequence
  Synthetic oligonucleotide
gatgcggcatctccgtccgccctcccaccttgaat

SEQ ID NO: 166548 - DNA, 32 bp, Artificial Sequence
  Synthetic oligonucleotide
accccgttcccttactgtttaagccgccccat

SEQ ID NO: 166549 - DNA, 35 bp, Artificial Sequence
  Synthetic oligonucleotide
tacgcaccatcctaggagcatcagacgtacctcat

SEQ ID NO: 166550 - DNA, 35 bp, Artificial Sequence
  Synthetic oligonucleotide
ttcaccctccatcttggccccgacctgacggtcat

SEQ ID NO: 166551 - DNA, 35 bp, Artificial Sequence
  Synthetic oligonucleotide
gtactcgccccccttttcgttcacccgaccagtat

SEQ ID NO: 166552 - DNA, 35 bp, Artificial Sequence
  Synthetic oligonucleotide
tgctacataatgcgcttgcacactgaccccccact

SEQ ID NO: 166553 - DNA, 35 bp, Artificial Sequence
  Synthetic oligonucleotide
acctcgcttagaactaagccttgtgaccttaccct

SEQ ID NO: 166554 - DNA, 35 bp, Artificial Sequence
  Synthetic oligonucleotide
tgtccctccctcgcccggctccgatttcgcccgct

SEQ ID NO: 166555 - DNA, 35 bp, Artificial Sequence
  Synthetic oligonucleotide
gtgccgacggcctctgcttgtttacgttccttgct

SEQ ID NO: 166556 - DNA, 35 bp, Artificial Sequence
  Synthetic oligonucleotide
acacccctagcttataatggttttgcccgcattct

SEQ ID NO: 166557 - DNA, 35 bp, Artificial Sequence
  Synthetic oligonucleotide
gcctctctcgctcctccattgcccttagacatagt

SEQ ID NO: 166558 - DNA, 35 bp, Artificial Sequence
  Synthetic oligonucleotide
tgtacccccgcccagtcacaaccatttgccacggt

SEQ ID NO: 166559 - DNA, 35 bp, Artificial Sequence
  Synthetic oligonucleotide
aactacccacgtcatgcgttctcctccctatctgt

SEQ ID NO: 166560 - DNA, 35 bp, Artificial Sequence
  Synthetic oligonucleotide
agagtgcatccgccgtgtccttttccccctgttgt

SEQ ID NO: 166561 - DNA, 35 bp, Artificial Sequence
  Synthetic oligonucleotide
attcaccctcggtcgcactcgctggccctcccatt

SEQ ID NO: 166562 - DNA, 35 bp, Artificial Sequence
  Synthetic oligonucleotide
gccccccacacctggcctaaaagtgcaccgccatt

SEQ ID NO: 166563 - DNA, 35 bp, Artificial Sequence
  Synthetic oligonucleotide
gtaatcccttcagagcgctgttttaccctgtcctt

SEQ ID NO: 166564 - DNA, 35 bp, Artificial Sequence
  Synthetic oligonucleotide
gctccaccctctgtactcgatcgcctcgtactgtt

SEQ ID NO: 166565 - DNA, 35 bp, Artificial Sequence
  Synthetic oligonucleotide
acttcacccgccgctactatgcctttccacttttt

SEQ ID NO: 166566 - DNA, 36 bp, Artificial Sequence
  Synthetic oligonucleotide
gtcgcccctgctgatttgacccttcccggcacggaa

SEQ ID NO: 166567 - DNA, 36 bp, Artificial Sequence
  Synthetic oligonucleotide
ccatcccccgctagatattcgcccacttgccctgaa

SEQ ID NO: 166568 - DNA, 34 bp, Artificial Sequence
  Synthetic oligonucleotide
acccccccctccgctccagtagttcgcccttgaa

SEQ ID NO: 166569 - DNA, 36 bp, Artificial Sequence
  Synthetic oligonucleotide
gttaagggaaaggagctgggggatgagacggtaaca

SEQ ID NO: 166570 - DNA, 35 bp, Artificial Sequence
  Synthetic oligonucleotide
cctccgccacaatccctctgcactcttatggcaca

SEQ ID NO: 166571 - DNA, 36 bp, Artificial Sequence
  Synthetic oligonucleotide
tccattgccctgcccgagtttttccgactaagtaca

SEQ ID NO: 166572 - DNA, 36 bp, Artificial Sequence
  Synthetic oligonucleotide
tgcacgcatatgcatgcccgtcctcggctcccacca

SEQ ID NO: 166573 - DNA, 36 bp, Artificial Sequence
  Synthetic oligonucleotide
gtccaccctgatcttgccacgcttcagtccatacca

SEQ ID NO: 166574 - DNA, 33 bp, Artificial Sequence
  Synthetic oligonucleotide
gccaacgcgtcacttggcgccccactcttacca

SEQ ID NO: 166575 - DNA, 35 bp, Artificial Sequence
  Synthetic oligonucleotide
ttggagcaaggagtccccgattagccctcccccca

SEQ ID NO: 166576 - DNA, 36 bp, Artificial Sequence
  Synthetic oligonucleotide
gggacgccctgatgcctccagccccccccaatgcca

SEQ ID NO: 166577 - DNA, 36 bp, Artificial Sequence
  Synthetic oligonucleotide
gccatcgaaccaatctgcttgcacgcactacccgca

SEQ ID NO: 166578 - DNA, 36 bp, Artificial Sequence
  Synthetic oligonucleotide
acaccactacctttgatgttttggattccccctgca

SEQ ID NO: 166579 - DNA, 36 bp, Artificial Sequence
  Synthetic oligonucleotide
atcccaccgatcttactttgacacgaccttgctgca

SEQ ID NO: 166580 - DNA, 36 bp, Artificial Sequence
  Synthetic oligonucleotide
agacaagcctcagcctccaggcgtcccctctcctca

SEQ ID NO: 166581 - DNA, 33 bp, Artificial Sequence
  Synthetic oligonucleotide
gctactcctggctgcgatcccgcctggccttca

SEQ ID NO: 166582 - DNA, 36 bp, Artificial Sequence
  Synthetic oligonucleotide
atcgttgcctcccaatagccggtattgccatcttca

SEQ ID NO: 166583 - DNA, 36 bp, Artificial Sequence
  Synthetic oligonucleotide
tactgccagcctgccaacatccctctcctgcccaga

SEQ ID NO: 166584 - DNA, 37 bp, Artificial Sequence
  Synthetic oligonucleotide
acaggaatgaagggagtgagttaagggggaggcgaga

SEQ ID NO: 166585 - DNA, 37 bp, Artificial Sequence
  Synthetic oligonucleotide
tgggaaccgaaagcaggagaatggaggggagaaacga

SEQ ID NO: 166586 - DNA, 36 bp, Artificial Sequence
  Synthetic oligonucleotide
agctccatcgtactcgatgctttcacctgcccccga

SEQ ID NO: 166587 - DNA, 37 bp, Artificial Sequence
  Synthetic oligonucleotide
tgcctccccaggtttcctcaaatcgtcccgccgccga

SEQ ID NO: 166588 - DNA, 37 bp, Artificial Sequence
  Synthetic oligonucleotide
ccacagctctggtacgttaacacctcactctccgcga

SEQ ID NO: 166589 - DNA, 37 bp, Artificial Sequence
  Synthetic oligonucleotide
taaagagggaggtggtggaacgaagtgaagatggcga

SEQ ID NO: 166590 - DNA, 37 bp, Artificial Sequence
  Synthetic oligonucleotide
tgccactcattagttccatccatcgattccatatcga

SEQ ID NO: 166591 - DNA, 37 bp, Artificial Sequence
  Synthetic oligonucleotide
gatgaacgaaagggctagcagaaccgggagaggggga

SEQ ID NO: 166592 - DNA, 37 bp, Artificial Sequence
  Synthetic oligonucleotide
ggggaggggggtacggaggagctgacatcacgatgga

SEQ ID NO: 166593 - DNA, 38 bp, Artificial Sequence
  Synthetic oligonucleotide
tagcttctccgcctgcctgtacgctacgccttccatga

SEQ ID NO: 166594 - DNA, 37 bp, Artificial Sequence
  Synthetic oligonucleotide
tgaccgaccctgcccccagactcccctcagtcgatga

SEQ ID NO: 166595 - DNA, 36 bp, Artificial Sequence
  Synthetic oligonucleotide
gcatggagggagaggggggcggggtgtcttcactga

SEQ ID NO: 166596 - DNA, 37 bp, Artificial Sequence
  Synthetic oligonucleotide
gttgccgggtcagctatcctttgtttcctccgtctga

SEQ ID NO: 166597 - DNA, 37 bp, Artificial Sequence
  Synthetic oligonucleotide
tccattccacatgattgtccacttctgctcttcgtga

SEQ ID NO: 166598 - DNA, 37 bp, Artificial Sequence
  Synthetic oligonucleotide
gcggagcaaccaactgattgatcgcctccccctgtga

SEQ ID NO: 166599 - DNA, 36 bp, Artificial Sequence
  Synthetic oligonucleotide
atgctgagccatcccttgttccctgcatgccattga

SEQ ID NO: 166600 - DNA, 37 bp, Artificial Sequence
  Synthetic oligonucleotide
accccagcaacatgccccccgatttacccgtcgttga

SEQ ID NO: 166601 - DNA, 37 bp, Artificial Sequence
  Synthetic oligonucleotide
taacccgcctacccttgtgcttgtaataccctgttga

SEQ ID NO: 166602 - DNA, 37 bp, Artificial Sequence
  Synthetic oligonucleotide
gttgtgccgacccttttgttgctcctgaccttgttga

SEQ ID NO: 166603 - DNA, 36 bp, Artificial Sequence
  Synthetic oligonucleotide
aacgccaactcccctctttctgcctgttacatttga

SEQ ID NO: 166604 - DNA, 36 bp, Artificial Sequence
  Synthetic oligonucleotide
acgcctccccagccccccttggacgcctttttgata

SEQ ID NO: 166605 - DNA, 35 bp, Artificial Sequence
  Synthetic oligonucleotide
aaccaccgccctgttcagaagctaacactatccta

SEQ ID NO: 166606 - DNA, 35 bp, Artificial Sequence
  Synthetic oligonucleotide
acgtgggagggcatagaagggggtgtgacggagta

SEQ ID NO: 166607 - DNA, 35 bp, Artificial Sequence
  Synthetic oligonucleotide
atagcccggtgccggagggggggagtagaagggta

SEQ ID NO: 166608 - DNA, 35 bp, Artificial Sequence
  Synthetic oligonucleotide
gctcccaccacactgtattcatccttaacgctgta

SEQ ID NO: 166609 - DNA, 35 bp, Artificial Sequence
  Synthetic oligonucleotide
tccgcgctacacgaactctgaccacacctcgctta

SEQ ID NO: 166610 - DNA, 36 bp, Artificial Sequence
  Synthetic oligonucleotide
gatgctaagcctgcaatcgctcctgcctcttcgtta

SEQ ID NO: 166611 - DNA, 35 bp, Artificial Sequence
  Synthetic oligonucleotide
gtcgcagacatgtccagcccccccttgttttgtta

SEQ ID NO: 166612 - DNA, 36 bp, Artificial Sequence
  Synthetic oligonucleotide
tggagatctccgccgtggatttcgccctctccttta

SEQ ID NO: 166613 - DNA, 36 bp, Artificial Sequence
  Synthetic oligonucleotide
tacgatgcttaccaacgtgcactccctgtctcttta

SEQ ID NO: 166614 - DNA, 36 bp, Artificial Sequence
  Synthetic oligonucleotide
aactccggcctccctgtattcgcctgggctttttta

SEQ ID NO: 166615 - DNA, 35 bp, Artificial Sequence
  Synthetic oligonucleotide
gttgcacgtaactgtctagtcactcctttcaacac

SEQ ID NO: 166616 - DNA, 35 bp, Artificial Sequence
  Synthetic oligonucleotide
gttccatcgaggtaatccagtccgaccgcccccac

SEQ ID NO: 166617 - DNA, 35 bp, Artificial Sequence
  Synthetic oligonucleotide
gatacctccgcctgggtgcgattcaagtgccccac

SEQ ID NO: 166618 - DNA, 35 bp, Artificial Sequence
  Synthetic oligonucleotide
gactccgtgcatttttgccgtatttacttccaacc

SEQ ID NO: 166619 - DNA, 35 bp, Artificial Sequence
  Synthetic oligonucleotide
gttccacctgcccatcagacattcagttgtctacc

SEQ ID NO: 166620 - DNA, 36 bp, Artificial Sequence
  Synthetic oligonucleotide
tcccctgcccccgtccattgacatgcgctgcccccc

SEQ ID NO: 166621 - DNA, 35 bp, Artificial Sequence
  Synthetic oligonucleotide
tccaccacaacggcacccctagccgtccccttccc

SEQ ID NO: 166622 - DNA, 35 bp, Artificial Sequence
  Synthetic oligonucleotide
gtcgcctgcctggagcctttcgtcctgatcctgcc

SEQ ID NO: 166623 - DNA, 35 bp, Artificial Sequence
  Synthetic oligonucleotide
tgcgcgttcgaatggcttttgcgtcttctctatcc

SEQ ID NO: 166624 - DNA, 35 bp, Artificial Sequence
  Synthetic oligonucleotide
aaccctcctcgtacactgtgtcagccttcatgtcc

SEQ ID NO: 166625 - DNA, 35 bp, Artificial Sequence
  Synthetic oligonucleotide
actccggattgcagcattcgataactaccccttcc

SEQ ID NO: 166626 - DNA, 35 bp, Artificial Sequence
  Synthetic oligonucleotide
ttcaggcgcacctccgcgggtttgactttcgttcc

SEQ ID NO: 166627 - DNA, 35 bp, Artificial Sequence
  Synthetic oligonucleotide
gctacccgcgcgacctagctacaacacctgtccgc

SEQ ID NO: 166628 - DNA, 35 bp, Artificial Sequence
  Synthetic oligonucleotide
gccccgtaatacttctctgtccccgtgccaatggc

SEQ ID NO: 166629 - DNA, 35 bp, Artificial Sequence
  Synthetic oligonucleotide
atggtagacggtgcccgccccaacccctgccgtgc

SEQ ID NO: 166630 - DNA, 35 bp, Artificial Sequence
  Synthetic oligonucleotide
gtccagccgggatttattccttcgttcccaccatc

SEQ ID NO: 166631 - DNA, 35 bp, Artificial Sequence
  Synthetic oligonucleotide
agatagcgtccgaggcctctcttccctgcgtcatc

SEQ ID NO: 166632 - DNA, 35 bp, Artificial Sequence
  Synthetic oligonucleotide
acctcccttcatagtgacatccagcgccgaccctc

SEQ ID NO: 166633 - DNA, 35 bp, Artificial Sequence
  Synthetic oligonucleotide
ttaggctatccccggtgacgtctcttcgccctgtc

SEQ ID NO: 166634 - DNA, 35 bp, Artificial Sequence
  Synthetic oligonucleotide
ggtgcccccgaattacccccccgacttatgctgtc

SEQ ID NO: 166635 - DNA, 35 bp, Artificial Sequence
  Synthetic oligonucleotide
ttcacgcccaccacttgtgcctcgagatcttgttc

SEQ ID NO: 166636 - DNA, 34 bp, Artificial Sequence
  Synthetic oligonucleotide
tgaccctccgatcgccctcatggtgctccgtttc

SEQ ID NO: 166637 - DNA, 35 bp, Artificial Sequence
  Synthetic oligonucleotide
tgatgcctgcgcaatcgctcgctctgtaacctacg

SEQ ID NO: 166638 - DNA, 35 bp, Artificial Sequence
  Synthetic oligonucleotide
taaaccgctccctgatccccttgtaataccgtacg

SEQ ID NO: 166639 - DNA, 35 bp, Artificial Sequence
  Synthetic oligonucleotide
tctcccccctgcatccagtaactcgctatataccg

SEQ ID NO: 166640 - DNA, 35 bp, Artificial Sequence
  Synthetic oligonucleotide
aatgtaaccctctccgccactgctcgcgcaccccg

SEQ ID NO: 166641 - DNA, 34 bp, Artificial Sequence
  Synthetic oligonucleotide
atcactcagcacatcccacacggcctcctcgtcg

SEQ ID NO: 166642 - DNA, 35 bp, Artificial Sequence
  Synthetic oligonucleotide
tccgctcacaccctcatccccttcgctgtactggg

SEQ ID NO: 166643 - DNA, 35 bp, Artificial Sequence
  Synthetic oligonucleotide
acctccgaaccttgatgacttgtccccgccctctg

SEQ ID NO: 166644 - DNA, 35 bp, Artificial Sequence
  Synthetic oligonucleotide
tgcccaaaccgcaggcatcgcttccttcctccaat

SEQ ID NO: 166645 - DNA, 35 bp, Artificial Sequence
  Synthetic oligonucleotide
gcgcattcctgtttctctcccgttcgctgtacgat

SEQ ID NO: 166646 - DNA, 35 bp, Artificial Sequence
  Synthetic oligonucleotide
gctaccaaggcgtcttccggtgcccttcctctact

SEQ ID NO: 166647 - DNA, 36 bp, Artificial Sequence
  Synthetic oligonucleotide
tgtggctgttgcagggtccacatcgcattccttcct

SEQ ID NO: 166648 - DNA, 35 bp, Artificial Sequence
  Synthetic oligonucleotide
tcaaatgcgtgggcgcgctgcctgattctcttcct

SEQ ID NO: 166649 - DNA, 35 bp, Artificial Sequence
  Synthetic oligonucleotide
ggacgatgcccccccctcccgctgctgtgctctct

SEQ ID NO: 166650 - DNA, 35 bp, Artificial Sequence
  Synthetic oligonucleotide
tagaaatgggcgggaggaggatggggcggttgtct

SEQ ID NO: 166651 - DNA, 35 bp, Artificial Sequence
  Synthetic oligonucleotide
tttgagtcgcggtcaacgttctttttcccccttct

SEQ ID NO: 166652 - DNA, 35 bp, Artificial Sequence
  Synthetic oligonucleotide
gctgaccaccgctaccctgtcccttttaaagccgt

SEQ ID NO: 166653 - DNA, 35 bp, Artificial Sequence
  Synthetic oligonucleotide
gcgtggggtggggaggtaaaggagttgggggtcgt

SEQ ID NO: 166654 - DNA, 35 bp, Artificial Sequence
  Synthetic oligonucleotide
tatgttccatcccttaacgacctgcgctgcccttt

SEQ ID NO: 166655 - DNA, 35 bp, Artificial Sequence
  Synthetic oligonucleotide
tcaggagctcaccgttctatactttgctagccttt

SEQ ID NO: 166656 - DNA, 35 bp, Artificial Sequence
  Synthetic oligonucleotide
gaaggggggagagtggtcagggggccggtggtttt

SEQ ID NO: 166657 - DNA, 35 bp, Artificial Sequence
  Synthetic oligonucleotide
aggatgcaggaagaaaaattgaggagggggaagaa

SEQ ID NO: 166658 - DNA, 36 bp, Artificial Sequence
  Synthetic oligonucleotide
taacacgcgcggtcaaaggagggagggaaggatgaa

SEQ ID NO: 166659 - DNA, 36 bp, Artificial Sequence
  Synthetic oligonucleotide
taggactcattggggggggggcggaagagacgataa

SEQ ID NO: 166660 - DNA, 36 bp, Artificial Sequence
  Synthetic oligonucleotide
ggggtacgtaccgaggaagaggggggcggagtataa

SEQ ID NO: 166661 - DNA, 36 bp, Artificial Sequence
  Synthetic oligonucleotide
tcgcaacatctggtctgcataccctcgttcctttaa

SEQ ID NO: 166662 - DNA, 35 bp, Artificial Sequence
  Synthetic oligonucleotide
gcccctctcctcatgtgctcatggtacatgccaca

SEQ ID NO: 166663 - DNA, 36 bp, Artificial Sequence
  Synthetic oligonucleotide
gagcacccccttctcgaactgaaatcgatctgtaca

SEQ ID NO: 166664 - DNA, 33 bp, Artificial Sequence
  Synthetic oligonucleotide
gcgagcgagcacttgcctttaacgccctcgcca

SEQ ID NO: 166665 - DNA, 36 bp, Artificial Sequence
  Synthetic oligonucleotide
accccatgccgttcaccttcgctccaccgtttggca

SEQ ID NO: 166666 - DNA, 36 bp, Artificial Sequence
  Synthetic oligonucleotide
gagtccaccacaacaccctgctatagctgactatca

SEQ ID NO: 166667 - DNA, 36 bp, Artificial Sequence
  Synthetic oligonucleotide
gccatgacacgctccccccataaggcccatcactca

SEQ ID NO: 166668 - DNA, 37 bp, Artificial Sequence
  Synthetic oligonucleotide
atgaacgaaggaggaatatgggtcagggggggctaga

SEQ ID NO: 166669 - DNA, 36 bp, Artificial Sequence
  Synthetic oligonucleotide
gcgaacgccgcagctcgtaccacccgaagaacacga

SEQ ID NO: 166670 - DNA, 37 bp, Artificial Sequence
  Synthetic oligonucleotide
tcatccctactgctgcctcgttatcgtcacctgacga

SEQ ID NO: 166671 - DNA, 36 bp, Artificial Sequence
  Synthetic oligonucleotide
tctgtcgttgaagcctcgttgtctcgccccccccga

SEQ ID NO: 166672 - DNA, 37 bp, Artificial Sequence
  Synthetic oligonucleotide
gagggtggggtggggttcggaagggatcatctcgcga

SEQ ID NO: 166673 - DNA, 37 bp, Artificial Sequence
  Synthetic oligonucleotide
gtttgccatctgaccccgccaccctgctcgccggcga

SEQ ID NO: 166674 - DNA, 37 bp, Artificial Sequence
  Synthetic oligonucleotide
gaggggggggtgaggctgtgggattactaggggtcga

SEQ ID NO: 166675 - DNA, 37 bp, Artificial Sequence
  Synthetic oligonucleotide
gaggaaacgcggatgggcgtaaggggggggtggtcga

SEQ ID NO: 166676 - DNA, 36 bp, Artificial Sequence
  Synthetic oligonucleotide
ggagaggaatggactgggggaaagcgataaacagga

SEQ ID NO: 166677 - DNA, 36 bp, Artificial Sequence
  Synthetic oligonucleotide
gtgggggggtggtgggaagctcgtttggcgcgagga

SEQ ID NO: 166678 - DNA, 37 bp, Artificial Sequence
  Synthetic oligonucleotide
gtctagagcagggggagggacgcttgaacgaggagga

SEQ ID NO: 166679 - DNA, 36 bp, Artificial Sequence
  Synthetic oligonucleotide
gcaaggctaaaatagggtggaacgggcggatgagga

SEQ ID NO: 166680 - DNA, 37 bp, Artificial Sequence
  Synthetic oligonucleotide
aagggaagggagtggcacatacgatgggggggaggga

SEQ ID NO: 166681 - DNA, 38 bp, Artificial Sequence
  Synthetic oligonucleotide
tgcacatctgtacctctcagcgccgccctcccaactga

SEQ ID NO: 166682 - DNA, 37 bp, Artificial Sequence
  Synthetic oligonucleotide
tgctcgtcggaaaaatgttagcccgcccgccctctga

SEQ ID NO: 166683 - DNA, 38 bp, Artificial Sequence
  Synthetic oligonucleotide
agagggggatgaaggtaggggagtggtacggggagtga

SEQ ID NO: 166684 - DNA, 38 bp, Artificial Sequence
  Synthetic oligonucleotide
gcccacttccatcgcactgctttcctctctctgagtga

SEQ ID NO: 166685 - DNA, 38 bp, Artificial Sequence
  Synthetic oligonucleotide
gcgaaatagtcagggagggatggggcgggttggcgtga

SEQ ID NO: 166686 - DNA, 38 bp, Artificial Sequence
  Synthetic oligonucleotide
gtgggcggtaggagggtgggtaatacatggggtcgtga

SEQ ID NO: 166687 - DNA, 37 bp, Artificial Sequence
  Synthetic oligonucleotide
gttatctgccatccgacttgcgcgtccttttccttga

SEQ ID NO: 166688 - DNA, 37 bp, Artificial Sequence
  Synthetic oligonucleotide
gaaagagtagtggggtgaaggtgaggagggctgttga

SEQ ID NO: 166689 - DNA, 38 bp, Artificial Sequence
  Synthetic oligonucleotide
gcggatcgggccgggaggggtgggatgcagcactttga

SEQ ID NO: 166690 - DNA, 36 bp, Artificial Sequence
  Synthetic oligonucleotide
gcgggagacatgcgatcagggaggcggaggggaata

SEQ ID NO: 166691 - DNA, 31 bp, Artificial Sequence
  Synthetic oligonucleotide
gcccgcccactcctgccctgtaccattacta

SEQ ID NO: 166692 - DNA, 35 bp, Artificial Sequence
  Synthetic oligonucleotide
gtgcgcttacccgtgccttttatagttccgtgcta

SEQ ID NO: 166693 - DNA, 36 bp, Artificial Sequence
  Synthetic oligonucleotide
gcatcacatccgttaggcactcgcccttctcctcta

SEQ ID NO: 166694 - DNA, 36 bp, Artificial Sequence
  Synthetic oligonucleotide
gtccacgcgctacacctcccgcccctccgtacagta

SEQ ID NO: 166695 - DNA, 35 bp, Artificial Sequence
  Synthetic oligonucleotide
acacacccactccgcagggctatcaccccatcgta

SEQ ID NO: 166696 - DNA, 36 bp, Artificial Sequence
  Synthetic oligonucleotide
gggaactgttcatacgtcatgcacgcgccctctgta

SEQ ID NO: 166697 - DNA, 35 bp, Artificial Sequence
  Synthetic oligonucleotide
gccgactggcccctctgttgaacgccccggttgta

SEQ ID NO: 166698 - DNA, 35 bp, Artificial Sequence
  Synthetic oligonucleotide
agcccctcctctttggtccatcgaacagcccgtta

SEQ ID NO: 166699 - DNA, 35 bp, Artificial Sequence
  Synthetic oligonucleotide
gcagggcgaacgggtgggcagtatggggagggtta

SEQ ID NO: 166700 - DNA, 36 bp, Artificial Sequence
  Synthetic oligonucleotide
tcacactgcctctgttgcgtgagcaactgtccttta

SEQ ID NO: 166701 - DNA, 35 bp, Artificial Sequence
  Synthetic oligonucleotide
tgcccgcaagtataccaagctgctgacgctccacc

SEQ ID NO: 166702 - DNA, 35 bp, Artificial Sequence
  Synthetic oligonucleotide
accacactcattgccctttggttcattttggtacc

SEQ ID NO: 166703 - DNA, 35 bp, Artificial Sequence
  Synthetic oligonucleotide
tatgtcccggttacatgaatcgtttggtccccccc

SEQ ID NO: 166704 - DNA, 35 bp, Artificial Sequence
  Synthetic oligonucleotide
gcgtaccgcctcctcggtacagctcacgctccccc

SEQ ID NO: 166705 - DNA, 35 bp, Artificial Sequence
  Synthetic oligonucleotide
gcccccgttccagctttgctaccgtcttagctccc

SEQ ID NO: 166706 - DNA, 35 bp, Artificial Sequence
  Synthetic oligonucleotide
gtgcctccggtccctcggtctagcctacagcctcc

SEQ ID NO: 166707 - DNA, 35 bp, Artificial Sequence
  Synthetic oligonucleotide
tccagcatttgaaccacgtgacgatccaccgctcc

SEQ ID NO: 166708 - DNA, 35 bp, Artificial Sequence
  Synthetic oligonucleotide
gcacatcaaacgccgacgggcgctccccgttactc

SEQ ID NO: 166709 - DNA, 35 bp, Artificial Sequence
  Synthetic oligonucleotide
tcccgtgccctccctctgatgctacccctccgttc

SEQ ID NO: 166710 - DNA, 35 bp, Artificial Sequence
  Synthetic oligonucleotide
tactgcacgttcgtcgctatcttacgtccgttttc

SEQ ID NO: 166711 - DNA, 36 bp, Artificial Sequence
  Synthetic oligonucleotide
aggacgccccctctgggaaaactgaagcctcccccg

SEQ ID NO: 166712 - DNA, 34 bp, Artificial Sequence
  Synthetic oligonucleotide
tgtgagctaggtgctccccccgtaatacatcccg

SEQ ID NO: 166713 - DNA, 35 bp, Artificial Sequence
  Synthetic oligonucleotide
ggactcgacccgcactcgttctgcaacttcctccg

SEQ ID NO: 166714 - DNA, 35 bp, Artificial Sequence
  Synthetic oligonucleotide
agacatcgcgagattccgtagccgttactcttccg

SEQ ID NO: 166715 - DNA, 35 bp, Artificial Sequence
  Synthetic oligonucleotide
tccatctgacccctcattttgttcccgcatgagcg

SEQ ID NO: 166716 - DNA, 35 bp, Artificial Sequence
  Synthetic oligonucleotide
gacccgggcctagctgtcccttccgccatgattcg

SEQ ID NO: 166717 - DNA, 34 bp, Artificial Sequence
  Synthetic oligonucleotide
gttgagagcggatatgggcgggcagagggtgggg

SEQ ID NO: 166718 - DNA, 35 bp, Artificial Sequence
  Synthetic oligonucleotide
gagaggggaacgggagctcgggaaggtgcggctgg

SEQ ID NO: 166719 - DNA, 35 bp, Artificial Sequence
  Synthetic oligonucleotide
gacgcaatggaacgggggaggtaaaatagttgatg

SEQ ID NO: 166720 - DNA, 35 bp, Artificial Sequence
  Synthetic oligonucleotide
ttactatcccggactgttcaccttccagccacctg

SEQ ID NO: 166721 - DNA, 35 bp, Artificial Sequence
  Synthetic oligonucleotide
tgcacatgaaccgctatacgtccacaccaaccttg

SEQ ID NO: 166722 - DNA, 35 bp, Artificial Sequence
  Synthetic oligonucleotide
gaattgcccgcttccccgactgtacgctttatcct

SEQ ID NO: 166723 - DNA, 35 bp, Artificial Sequence
  Synthetic oligonucleotide
tcccgcaccctctcactactcgattcagcattagt

SEQ ID NO: 166724 - DNA, 35 bp, Artificial Sequence
  Synthetic oligonucleotide
ttcctgctaccgtcacgtcaatcccccaccctcgt

SEQ ID NO: 166725 - DNA, 35 bp, Artificial Sequence
  Synthetic oligonucleotide
gccttcgcgttccttcctttgtcgaccgtcctcgt

SEQ ID NO: 166726 - DNA, 35 bp, Artificial Sequence
  Synthetic oligonucleotide
tgccaacgtccccttccaagtcgaagtccccctgt

SEQ ID NO: 166727 - DNA, 35 bp, Artificial Sequence
  Synthetic oligonucleotide
taagctcaagaggcacgtcaaccccgccccccctt

SEQ ID NO: 166728 - DNA, 35 bp, Artificial Sequence
  Synthetic oligonucleotide
acacaccgccactccttgtacttccagcccctctt

SEQ ID NO: 166729 - DNA, 35 bp, Artificial Sequence
  Synthetic oligonucleotide
gccaccctgcacgcgctatcgttctcttacatttt

SEQ ID NO: 166730 - DNA, 36 bp, Artificial Sequence
  Synthetic oligonucleotide
tctccccccgctttggcaagttccgccttgctagaa

SEQ ID NO: 166731 - DNA, 36 bp, Artificial Sequence
  Synthetic oligonucleotide
gcaaaggtacatgaacaagggggggggagtgcggaa

SEQ ID NO: 166732 - DNA, 35 bp, Artificial Sequence
  Synthetic oligonucleotide
gaggggggtatagggtagaacgagctatgtagtaa

SEQ ID NO: 166733 - DNA, 36 bp, Artificial Sequence
  Synthetic oligonucleotide
tgaccatatgcctagtgtgcgcgccccccttcaaca

SEQ ID NO: 166734 - DNA, 36 bp, Artificial Sequence
  Synthetic oligonucleotide
ttaccccgccgccggactactgtttctacgttcaca

SEQ ID NO: 166735 - DNA, 36 bp, Artificial Sequence
  Synthetic oligonucleotide
acgcccaccctccaatcgtatgtattttcataccca

SEQ ID NO: 166736 - DNA, 36 bp, Artificial Sequence
  Synthetic oligonucleotide
ggtcccgctgctgttagtccctggtttgtcccccca

SEQ ID NO: 166737 - DNA, 35 bp, Artificial Sequence
  Synthetic oligonucleotide
tccgccacactctaccgcctctctccaatggccca

SEQ ID NO: 166738 - DNA, 36 bp, Artificial Sequence
  Synthetic oligonucleotide
aaaccaccgcacctagacttgagcaccattctccca

SEQ ID NO: 166739 - DNA, 36 bp, Artificial Sequence
  Synthetic oligonucleotide
ttagccaatcacagtacctgttcacgtgtcttccca

SEQ ID NO: 166740 - DNA, 36 bp, Artificial Sequence
  Synthetic oligonucleotide
gttcgcctccgcgtcgatcggccctctcacttgcca

SEQ ID NO: 166741 - DNA, 35 bp, Artificial Sequence
  Synthetic oligonucleotide
ttacgcactccccccgtaactggtaacactctcca

SEQ ID NO: 166742 - DNA, 36 bp, Artificial Sequence
  Synthetic oligonucleotide
gaagagccggtagggaatgggtggggtagcgaagca

SEQ ID NO: 166743 - DNA, 35 bp, Artificial Sequence
  Synthetic oligonucleotide
tggaaccatctcaaccatgtcttgaccctgctgca

SEQ ID NO: 166744 - DNA, 36 bp, Artificial Sequence
  Synthetic oligonucleotide
gtgtgcctgtctattctcttcgatacctcctttgca

SEQ ID NO: 166745 - DNA, 35 bp, Artificial Sequence
  Synthetic oligonucleotide
gcacctccgaagcgttagctccgtcgttctcatca

SEQ ID NO: 166746 - DNA, 36 bp, Artificial Sequence
  Synthetic oligonucleotide
tccctagcgggggggacagggagggacgatttatca

SEQ ID NO: 166747 - DNA, 32 bp, Artificial Sequence
  Synthetic oligonucleotide
gtctcccccgcctatagctcgttttacagtca

SEQ ID NO: 166748 - DNA, 35 bp, Artificial Sequence
  Synthetic oligonucleotide
ttggccgcctcaccatcttcacatacacctgttca

SEQ ID NO: 166749 - DNA, 36 bp, Artificial Sequence
  Synthetic oligonucleotide
tgtaccggggggcagtgggacggtgggagggggaga

SEQ ID NO: 166750 - DNA, 37 bp, Artificial Sequence
  Synthetic oligonucleotide
accaacaccctccccgtctccttcggacagtcgtaga

SEQ ID NO: 166751 - DNA, 37 bp, Artificial Sequence
  Synthetic oligonucleotide
ttacgaaccgcccatccctgtttttgaccttggtaga

SEQ ID NO: 166752 - DNA, 35 bp, Artificial Sequence
  Synthetic oligonucleotide
gagccattcgccatttcctgattagttcctaccga

SEQ ID NO: 166753 - DNA, 37 bp, Artificial Sequence
  Synthetic oligonucleotide
actgtagccgtccgcctcgctactatcgtactcccga

SEQ ID NO: 166754 - DNA, 36 bp, Artificial Sequence
  Synthetic oligonucleotide
gtacactgctattcgccacccgctattttccgccga

SEQ ID NO: 166755 - DNA, 37 bp, Artificial Sequence
  Synthetic oligonucleotide
gtttgcccaacatgccttattcgaatttgttctccga

SEQ ID NO: 166756 - DNA, 35 bp, Artificial Sequence
  Synthetic oligonucleotide
gcactatccgcctgttccagtaccacatgactcga

SEQ ID NO: 166757 - DNA, 37 bp, Artificial Sequence
  Synthetic oligonucleotide
gaaacggaggaggtggggccgagggaggttcgttcga

SEQ ID NO: 166758 - DNA, 37 bp, Artificial Sequence
  Synthetic oligonucleotide
tccgacctcatcacacttcgtacttaagtctgttcga

SEQ ID NO: 166759 - DNA, 37 bp, Artificial Sequence
  Synthetic oligonucleotide
gagagacgaaggagaggacggttgaggcaaaacagga

SEQ ID NO: 166760 - DNA, 37 bp, Artificial Sequence
  Synthetic oligonucleotide
gatatgagacagggagaagaaggtagtgcaacgagga

SEQ ID NO: 166761 - DNA, 37 bp, Artificial Sequence
  Synthetic oligonucleotide
tcaccgcatgtacggttctatttgctcctccttcgga

SEQ ID NO: 166762 - DNA, 37 bp, Artificial Sequence
  Synthetic oligonucleotide
gcaaactagctgggtgggaagagataaaggggcggga

SEQ ID NO: 166763 - DNA, 35 bp, Artificial Sequence
  Synthetic oligonucleotide
ttactcaccccacctccgaggccacccatgctgga

SEQ ID NO: 166764 - DNA, 38 bp, Artificial Sequence
  Synthetic oligonucleotide
gacccctcaacgcgctatacgacttccgatcctcatga

SEQ ID NO: 166765 - DNA, 35 bp, Artificial Sequence
  Synthetic oligonucleotide
gacgggggaggtatacgacacggtgggagggatga

SEQ ID NO: 166766 - DNA, 38 bp, Artificial Sequence
  Synthetic oligonucleotide
gccctcacatcgccccatggttccgtgacctcttatga

SEQ ID NO: 166767 - DNA, 38 bp, Artificial Sequence
  Synthetic oligonucleotide
ttggggggggagggaggaaggatcccagctaagactga

SEQ ID NO: 166768 - DNA, 38 bp, Artificial Sequence
  Synthetic oligonucleotide
gaaaggcaggtcactattgcgttccatcacctccctga

SEQ ID NO: 166769 - DNA, 38 bp, Artificial Sequence
  Synthetic oligonucleotide
gcgaaccggcacttcgtcaacacgtacacccttcctga

SEQ ID NO: 166770 - DNA, 38 bp, Artificial Sequence
  Synthetic oligonucleotide
acagaggggcgggtaggggcagaatggcaggcaagtga

SEQ ID NO: 166771 - DNA, 38 bp, Artificial Sequence
  Synthetic oligonucleotide
gacccagcctgcctccccccacgccccacagcgggtga

SEQ ID NO: 166772 - DNA, 38 bp, Artificial Sequence
  Synthetic oligonucleotide
acaagaggaggggcggttgggcgggtgggacttggtga

SEQ ID NO: 166773 - DNA, 37 bp, Artificial Sequence
  Synthetic oligonucleotide
atcgcaagcacatgctcgttccatcctgtcaaattga

SEQ ID NO: 166774 - DNA, 37 bp, Artificial Sequence
  Synthetic oligonucleotide
atgccccccctccccctacgaccggacaatcaattga

SEQ ID NO: 166775 - DNA, 36 bp, Artificial Sequence
  Synthetic oligonucleotide
tgagcgacaaccgttgttctctgtttcctcctttga

SEQ ID NO: 166776 - DNA, 38 bp, Artificial Sequence
  Synthetic oligonucleotide
tcccacgaccgcccttcatgaccgccacacatctttga

SEQ ID NO: 166777 - DNA, 35 bp, Artificial Sequence
  Synthetic oligonucleotide
gacttggggccgagaggggagggggattgggacta

SEQ ID NO: 166778 - DNA, 36 bp, Artificial Sequence
  Synthetic oligonucleotide
atccacccccccgtcactaattggtatacatcgcta

SEQ ID NO: 166779 - DNA, 35 bp, Artificial Sequence
  Synthetic oligonucleotide
gtcatcccgcatactgaaaaggttcgttcgctcta

SEQ ID NO: 166780 - DNA, 35 bp, Artificial Sequence
  Synthetic oligonucleotide
agccatgacgcaattgccgctcttcgccttccgta

SEQ ID NO: 166781 - DNA, 36 bp, Artificial Sequence
  Synthetic oligonucleotide
ttacacgcacctccctctctgcctccaactggggta

SEQ ID NO: 166782 - DNA, 35 bp, Artificial Sequence
  Synthetic oligonucleotide
atcacgacttgcgccacaccatcgcgcactcctta

SEQ ID NO: 166783 - DNA, 36 bp, Artificial Sequence
  Synthetic oligonucleotide
gctgcacgcgctgtccgtcgcttcctctccaggtta

SEQ ID NO: 166784 - DNA, 34 bp, Artificial Sequence
  Synthetic oligonucleotide
tgacctcccccgtcatctttccgttatccgtccc

SEQ ID NO: 166785 - DNA, 35 bp, Artificial Sequence
  Synthetic oligonucleotide
gcattgcacccccgccgacacatggttactttccc

SEQ ID NO: 166786 - DNA, 35 bp, Artificial Sequence
  Synthetic oligonucleotide
tacgcccgccctgcgtccctgactggatctacgcc

SEQ ID NO: 166787 - DNA, 35 bp, Artificial Sequence
  Synthetic oligonucleotide
tacttccaccgagaccacatgtagtccaccgtgcc

SEQ ID NO: 166788 - DNA, 35 bp, Artificial Sequence
  Synthetic oligonucleotide
tcaccctcccatgctcgcatattctgccccttgcc

SEQ ID NO: 166789 - DNA, 35 bp, Artificial Sequence
  Synthetic oligonucleotide
acgctcaccgaactgttgcgtgtcgccttcactcc

SEQ ID NO: 166790 - DNA, 35 bp, Artificial Sequence
  Synthetic oligonucleotide
gagactggggaacatgggaaggggaggggagcagc

SEQ ID NO: 166791 - DNA, 35 bp, Artificial Sequence
  Synthetic oligonucleotide
tctccgaggcaactgccgtttcacacgcttcccgc

SEQ ID NO: 166792 - DNA, 35 bp, Artificial Sequence
  Synthetic oligonucleotide
ttgacgacccctgaggtaatagcctaccctctcgc

SEQ ID NO: 166793 - DNA, 35 bp, Artificial Sequence
  Synthetic oligonucleotide
tccagtagcgcacaatgacgttctcacactccggc

SEQ ID NO: 166794 - DNA, 35 bp, Artificial Sequence
  Synthetic oligonucleotide
gggcctacactggaccaacacgcctcactccatgc

SEQ ID NO: 166795 - DNA, 35 bp, Artificial Sequence
  Synthetic oligonucleotide
gcgtgcgaggttggctgcccctctcttcgccctgc

SEQ ID NO: 166796 - DNA, 35 bp, Artificial Sequence
  Synthetic oligonucleotide
gagcacatcacgcctcccctgtcttttggtgctgc

SEQ ID NO: 166797 - DNA, 35 bp, Artificial Sequence
  Synthetic oligonucleotide
gctccctctcacctcgtcttttccggccatcttgc

SEQ ID NO: 166798 - DNA, 35 bp, Artificial Sequence
  Synthetic oligonucleotide
gcccggtcgctagactatgccattacagtcacctc

SEQ ID NO: 166799 - DNA, 35 bp, Artificial Sequence
  Synthetic oligonucleotide
gagctgaacgcatcacttgcccattgtcatctctc

SEQ ID NO: 166800 - DNA, 35 bp, Artificial Sequence
  Synthetic oligonucleotide
tcctactcgccgcgccgccactctaccttctcgtc

SEQ ID NO: 166801 - DNA, 35 bp, Artificial Sequence
  Synthetic oligonucleotide
acaccacacctatcaatagtgaaatccttaatgtc

SEQ ID NO: 166802 - DNA, 35 bp, Artificial Sequence
  Synthetic oligonucleotide
atctcgccggtcacacctgctttcgctattctgtc

SEQ ID NO: 166803 - DNA, 35 bp, Artificial Sequence
  Synthetic oligonucleotide
atgcttgcccgctggatactccattcccttttgtc

SEQ ID NO: 166804 - DNA, 35 bp, Artificial Sequence
  Synthetic oligonucleotide
atgcctagatgtctcggtttttgctcccctcattc

SEQ ID NO: 166805 - DNA, 35 bp, Artificial Sequence
  Synthetic oligonucleotide
accctgctccacacccgtactaattgcccggattc

SEQ ID NO: 166806 - DNA, 35 bp, Artificial Sequence
  Synthetic oligonucleotide
ggtgcgctccactgtccctccgttaacccggcttc

SEQ ID NO: 166807 - DNA, 35 bp, Artificial Sequence
  Synthetic oligonucleotide
acacctccgcgcgtcatagggccccactttctttc

SEQ ID NO: 166808 - DNA, 35 bp, Artificial Sequence
  Synthetic oligonucleotide
tgccacctcggctccactctaacagctatgcacag

SEQ ID NO: 166809 - DNA, 35 bp, Artificial Sequence
  Synthetic oligonucleotide
gggaatccccgcctgccatttcacctgtaataccg

SEQ ID NO: 166810 - DNA, 35 bp, Artificial Sequence
  Synthetic oligonucleotide
atctgccacagtgctatccttcgtaccccgttccg

SEQ ID NO: 166811 - DNA, 35 bp, Artificial Sequence
  Synthetic oligonucleotide
tggtcgaatacggggagggagtaacggtgggcggg

SEQ ID NO: 166812 - DNA, 35 bp, Artificial Sequence
  Synthetic oligonucleotide
atcgggccgtaggaaggcaggaaagtaggtagggg

SEQ ID NO: 166813 - DNA, 35 bp, Artificial Sequence
  Synthetic oligonucleotide
taagggggggtaggacacggattagagtggtggtg

SEQ ID NO: 166814 - DNA, 35 bp, Artificial Sequence
  Synthetic oligonucleotide
tgcgacagcccctgctccttcgaaatctacttttg

SEQ ID NO: 166815 - DNA, 35 bp, Artificial Sequence
  Synthetic oligonucleotide
acacaccacccgccaaagcctcgcattacgcaaat

SEQ ID NO: 166816 - DNA, 35 bp, Artificial Sequence
  Synthetic oligonucleotide
ttgcttacactgtatctggtggcctcgctttctat

SEQ ID NO: 166817 - DNA, 35 bp, Artificial Sequence
  Synthetic oligonucleotide
gtacctctgtccatgtacgccacttccttcgaact

SEQ ID NO: 166818 - DNA, 35 bp, Artificial Sequence
  Synthetic oligonucleotide
atccctcacatactatcgagtacacttgtcacact

SEQ ID NO: 166819 - DNA, 35 bp, Artificial Sequence
  Synthetic oligonucleotide
cacgacctcctccgcttcggtgtcgccctaaccct

SEQ ID NO: 166820 - DNA, 35 bp, Artificial Sequence
  Synthetic oligonucleotide
tgataccgcatatttgacactttcctgaccaccct

SEQ ID NO: 166821 - DNA, 35 bp, Artificial Sequence
  Synthetic oligonucleotide
tcacccatcgggaacgtacgagtcgcatataccct

SEQ ID NO: 166822 - DNA, 35 bp, Artificial Sequence
  Synthetic oligonucleotide
ggagggtcagcttaaacgtgtgcgccgctccccct

SEQ ID NO: 166823 - DNA, 35 bp, Artificial Sequence
  Synthetic oligonucleotide
agaacgtcacagttgccgccccatctttgaccgct

SEQ ID NO: 166824 - DNA, 35 bp, Artificial Sequence
  Synthetic oligonucleotide
tctcccacgccatggcactctttgtctttaccgct

SEQ ID NO: 166825 - DNA, 35 bp, Artificial Sequence
  Synthetic oligonucleotide
taacgcaccttctcaccattgtaattggcttcgct

SEQ ID NO: 166826 - DNA, 35 bp, Artificial Sequence
  Synthetic oligonucleotide
gagccacgtcccaccaccctacgttcacgctatgt

SEQ ID NO: 166827 - DNA, 35 bp, Artificial Sequence
  Synthetic oligonucleotide
ttcagccgcgcaatcacagtaaccgccatcctctt

SEQ ID NO: 166828 - DNA, 35 bp, Artificial Sequence
  Synthetic oligonucleotide
gcactcgtctagccgccaaacccctgccgcttctt

SEQ ID NO: 166829 - DNA, 35 bp, Artificial Sequence
  Synthetic oligonucleotide
gaatgtccccacatgccctccgttcctctgttctt

SEQ ID NO: 166830 - DNA, 34 bp, Artificial Sequence
  Synthetic oligonucleotide
tacacgccctccctttactcaacatatcgatgtt

SEQ ID NO: 166831 - DNA, 35 bp, Artificial Sequence
  Synthetic oligonucleotide
ggaatacgggtctggggggggatggagggtaccaa

SEQ ID NO: 166832 - DNA, 36 bp, Artificial Sequence
  Synthetic oligonucleotide
tctcccccgtacctgcttgaaaccgtagttctccaa

SEQ ID NO: 166833 - DNA, 36 bp, Artificial Sequence
  Synthetic oligonucleotide
gaatgggacaggggagggtaccaaaaggggctgtaa

SEQ ID NO: 166834 - DNA, 36 bp, Artificial Sequence
  Synthetic oligonucleotide
atggtgctcctggtccggcaccccaccttaccaaca

SEQ ID NO: 166835 - DNA, 36 bp, Artificial Sequence
  Synthetic oligonucleotide
actgaacccacccctgtacttgaagacgtagtcaca

SEQ ID NO: 166836 - DNA, 36 bp, Artificial Sequence
  Synthetic oligonucleotide
tcgcacctccttccgttaccttgtctgtattataca

SEQ ID NO: 166837 - DNA, 36 bp, Artificial Sequence
  Synthetic oligonucleotide
taccgggggggatcggtgggtggggtatgggttaca

SEQ ID NO: 166838 - DNA, 35 bp, Artificial Sequence
  Synthetic oligonucleotide
gtcacttcggccctctcacgctcgttcgcacacca

SEQ ID NO: 166839 - DNA, 36 bp, Artificial Sequence
  Synthetic oligonucleotide
tcccccaaccactatgctgccacgccacacgtacca

SEQ ID NO: 166840 - DNA, 36 bp, Artificial Sequence
  Synthetic oligonucleotide
tcacgtcacagaccgagtcattccgctctcctccca

SEQ ID NO: 166841 - DNA, 36 bp, Artificial Sequence
  Synthetic oligonucleotide
cacatgcctccgcctgaattgcttttctcaccgcca

SEQ ID NO: 166842 - DNA, 35 bp, Artificial Sequence
  Synthetic oligonucleotide
tactgcactacccagctccagctcctctgtacgca

SEQ ID NO: 166843 - DNA, 36 bp, Artificial Sequence
  Synthetic oligonucleotide
ttactgtctccgccactcagtcctgtggtccaggca

SEQ ID NO: 166844 - DNA, 36 bp, Artificial Sequence
  Synthetic oligonucleotide
ttgcacacccgtaagtgcgctgcgtggcccccctca

SEQ ID NO: 166845 - DNA, 36 bp, Artificial Sequence
  Synthetic oligonucleotide
gccctcgcacacccgtagttctataaactgccctca

SEQ ID NO: 166846 - DNA, 37 bp, Artificial Sequence
  Synthetic oligonucleotide
tgggtggtcgcgggtggggtagtagccattaccacga

SEQ ID NO: 166847 - DNA, 37 bp, Artificial Sequence
  Synthetic oligonucleotide
aatcccctccccgtccgctctgttcaaccgcctacga

SEQ ID NO: 166848 - DNA, 35 bp, Artificial Sequence
  Synthetic oligonucleotide
tccgctccactccgcctgcactcctaggatcccga

SEQ ID NO: 166849 - DNA, 37 bp, Artificial Sequence
  Synthetic oligonucleotide
gtaggcccccgtcgaacgccatccacccgattcccga

SEQ ID NO: 166850 - DNA, 37 bp, Artificial Sequence
  Synthetic oligonucleotide
gtgcgtatttgcctttgctcagccccctctttgccga

SEQ ID NO: 166851 - DNA, 36 bp, Artificial Sequence
  Synthetic oligonucleotide
actcgggggggcaggggagcacagggtggacggcga

SEQ ID NO: 166852 - DNA, 37 bp, Artificial Sequence
  Synthetic oligonucleotide
ggtggctgttagtgaggtgggggtggtggaagggcga

SEQ ID NO: 166853 - DNA, 37 bp, Artificial Sequence
  Synthetic oligonucleotide
gccgacggagaataaacaggtaggaaggggcgggcga

SEQ ID NO: 166854 - DNA, 37 bp, Artificial Sequence
  Synthetic oligonucleotide
gcccacctctactaagccttgaatcgctcccaccgga

SEQ ID NO: 166855 - DNA, 37 bp, Artificial Sequence
  Synthetic oligonucleotide
gcgccagggtacgaatagggagggggagctaacggga

SEQ ID NO: 166856 - DNA, 37 bp, Artificial Sequence
  Synthetic oligonucleotide
gggaaggggttcggggggaggtaaggaacctgcggga

SEQ ID NO: 166857 - DNA, 37 bp, Artificial Sequence
  Synthetic oligonucleotide
acaaagagccgggggagggcgtgaggcgatgagggga

SEQ ID NO: 166858 - DNA, 37 bp, Artificial Sequence
  Synthetic oligonucleotide
gggggctagttaggggcgggtatgttgtaatcgggga

SEQ ID NO: 166859 - DNA, 37 bp, Artificial Sequence
  Synthetic oligonucleotide
gccaccgagccggagtgcacctctcttttctgctgga

SEQ ID NO: 166860 - DNA, 37 bp, Artificial Sequence
  Synthetic oligonucleotide
acattgacccacctgtgcaggcactctacttcttgga

SEQ ID NO: 166861 - DNA, 38 bp, Artificial Sequence
  Synthetic oligonucleotide
acgtgggaggtgagtggggggggtcgctatgaacatga

SEQ ID NO: 166862 - DNA, 36 bp, Artificial Sequence
  Synthetic oligonucleotide
acccccacgcctccacttatcagcacctctccctga

SEQ ID NO: 166863 - DNA, 38 bp, Artificial Sequence
  Synthetic oligonucleotide
tgagggctaaggatggggaaaagcggacggaggtctga

SEQ ID NO: 166864 - DNA, 37 bp, Artificial Sequence
  Synthetic oligonucleotide
gcactcacctcccctggttgcaagccctgtcccgtga

SEQ ID NO: 166865 - DNA, 37 bp, Artificial Sequence
  Synthetic oligonucleotide
gccacccgttatcctatgaatcattacttcgccgtga

SEQ ID NO: 166866 - DNA, 38 bp, Artificial Sequence
  Synthetic oligonucleotide
actcaccctctctacccgtttttttgagacaggcgtga

SEQ ID NO: 166867 - DNA, 38 bp, Artificial Sequence
  Synthetic oligonucleotide
acgcccgtctggcccgccccctcttgcctctttcgtga

SEQ ID NO: 166868 - DNA, 38 bp, Artificial Sequence
  Synthetic oligonucleotide
gggggtggcgggacatgggagtagatcggcatcggtga

SEQ ID NO: 166869 - DNA, 38 bp, Artificial Sequence
  Synthetic oligonucleotide
gcctgtctccgccttaattccacctgctcactatgtga

SEQ ID NO: 166870 - DNA, 38 bp, Artificial Sequence
  Synthetic oligonucleotide
tctggtcagactcacgcccctaggacctcctccattga

SEQ ID NO: 166871 - DNA, 38 bp, Artificial Sequence
  Synthetic oligonucleotide
ttggccacctcggcctggatcatctccccacctcttga

SEQ ID NO: 166872 - DNA, 36 bp, Artificial Sequence
  Synthetic oligonucleotide
acctcaccccaatcttgtaccctgaacattttttga

SEQ ID NO: 166873 - DNA, 36 bp, Artificial Sequence
  Synthetic oligonucleotide
gatgccgcggcattgtctcctgcgccgcccttaata

SEQ ID NO: 166874 - DNA, 35 bp, Artificial Sequence
  Synthetic oligonucleotide
gacgacctcccttgtgcgcccttattgtccgacta

SEQ ID NO: 166875 - DNA, 35 bp, Artificial Sequence
  Synthetic oligonucleotide
tccttgccacacacccattggcccttatggcccta

SEQ ID NO: 166876 - DNA, 37 bp, Artificial Sequence
  Synthetic oligonucleotide
tacgggtgggtgtggagggtatttggctggtttgcta

SEQ ID NO: 166877 - DNA, 35 bp, Artificial Sequence
  Synthetic oligonucleotide
attgcctcactctgtccgtccctactcggtaatta

SEQ ID NO: 166878 - DNA, 35 bp, Artificial Sequence
  Synthetic oligonucleotide
tgttccagcccctctcggtccgtaaacatcactta

SEQ ID NO: 166879 - DNA, 35 bp, Artificial Sequence
  Synthetic oligonucleotide
tgaccgtatcaccatgcacttccccccgaagctta

SEQ ID NO: 166880 - DNA, 35 bp, Artificial Sequence
  Synthetic oligonucleotide
agccgtcgcgctgctggtccctttctcggctctta

SEQ ID NO: 166881 - DNA, 35 bp, Artificial Sequence
  Synthetic oligonucleotide
acgcgacgacttcgcctgctccgccccctgtctta

SEQ ID NO: 166882 - DNA, 35 bp, Artificial Sequence
  Synthetic oligonucleotide
atgggcactagtgccacccgttcctccgctttaac

SEQ ID NO: 166883 - DNA, 35 bp, Artificial Sequence
  Synthetic oligonucleotide
gaccagatctggctgctccctatgccattctctac

SEQ ID NO: 166884 - DNA, 35 bp, Artificial Sequence
  Synthetic oligonucleotide
agctcccgccgaatgcctgaatctttgccacaacc

SEQ ID NO: 166885 - DNA, 35 bp, Artificial Sequence
  Synthetic oligonucleotide
gttagcccggccgttcgatcgctaccctttctacc

SEQ ID NO: 166886 - DNA, 35 bp, Artificial Sequence
  Synthetic oligonucleotide
tccttccgcaggcctctcgcatctggttacttacc

SEQ ID NO: 166887 - DNA, 35 bp, Artificial Sequence
  Synthetic oligonucleotide
acaccccatcgttcaggctcgaagcctcccgaccc

SEQ ID NO: 166888 - DNA, 35 bp, Artificial Sequence
  Synthetic oligonucleotide
gcatgcggctcgaactttcctcgtggtcgcccccc

SEQ ID NO: 166889 - DNA, 35 bp, Artificial Sequence
  Synthetic oligonucleotide
gtgctagcactgatttgtgatgttcgcgcctcccc

SEQ ID NO: 166890 - DNA, 35 bp, Artificial Sequence
  Synthetic oligonucleotide
gtgcccggctgacttagcgttccccgtagctcccc

SEQ ID NO: 166891 - DNA, 35 bp, Artificial Sequence
  Synthetic oligonucleotide
tcgtgactctttaggttagttccatcctggtcccc

SEQ ID NO: 166892 - DNA, 35 bp, Artificial Sequence
  Synthetic oligonucleotide
acctacccgcccccacgtcgtacactctttcagcc

SEQ ID NO: 166893 - DNA, 35 bp, Artificial Sequence
  Synthetic oligonucleotide
attgaccccgcaggtcattcagttgccgccccgcc

SEQ ID NO: 166894 - DNA, 35 bp, Artificial Sequence
  Synthetic oligonucleotide
gcccgtactcttctcattgtccccatgcctatgcc

SEQ ID NO: 166895 - DNA, 36 bp, Artificial Sequence
  Synthetic oligonucleotide
gtgacaccgccccctttctctgtaatacgtactgcc

SEQ ID NO: 166896 - DNA, 35 bp, Artificial Sequence
  Synthetic oligonucleotide
gagacgcacaaatcggtcatctaatcacatctgcc

SEQ ID NO: 166897 - DNA, 35 bp, Artificial Sequence
  Synthetic oligonucleotide
acctcgaccgactctccccggagccccggaactcc

SEQ ID NO: 166898 - DNA, 35 bp, Artificial Sequence
  Synthetic oligonucleotide
tacctcgacccctggcgcttccaccctcgccttcc

SEQ ID NO: 166899 - DNA, 35 bp, Artificial Sequence
  Synthetic oligonucleotide
ttaaccgccccttatggtgaaaccctcctagttcc

SEQ ID NO: 166900 - DNA, 35 bp, Artificial Sequence
  Synthetic oligonucleotide
gcatccccctcgcgccctaagtagtgccccgttcc

SEQ ID NO: 166901 - DNA, 35 bp, Artificial Sequence
  Synthetic oligonucleotide
tcagaagaggaaggggggtaggtaaacagcgaagc

SEQ ID NO: 166902 - DNA, 35 bp, Artificial Sequence
  Synthetic oligonucleotide
gccacatcgttcttataatgtctcttcatcgcagc

SEQ ID NO: 166903 - DNA, 35 bp, Artificial Sequence
  Synthetic oligonucleotide
gggtgccctccctacccgatgtatctcttgtccgc

SEQ ID NO: 166904 - DNA, 35 bp, Artificial Sequence
  Synthetic oligonucleotide
aacgcgtgtacgggatcgggagggtggggcacggc

SEQ ID NO: 166905 - DNA, 35 bp, Artificial Sequence
  Synthetic oligonucleotide
gctcgctccctctcctgtgtgccatcctcccgtgc

SEQ ID NO: 166906 - DNA, 35 bp, Artificial Sequence
  Synthetic oligonucleotide
gatgcggcccccgtgctcccttcttttacgattgc

SEQ ID NO: 166907 - DNA, 35 bp, Artificial Sequence
  Synthetic oligonucleotide
tgaaggggggtgtgggctagcggggcaagactatc

SEQ ID NO: 166908 - DNA, 35 bp, Artificial Sequence
  Synthetic oligonucleotide
acgcccactcccctgattactcagtgcatgctatc

SEQ ID NO: 166909 - DNA, 35 bp, Artificial Sequence
  Synthetic oligonucleotide
tctccactccagctgtacgttgaccgcctaccctc

SEQ ID NO: 166910 - DNA, 35 bp, Artificial Sequence
  Synthetic oligonucleotide
gtctaccgcgtctaacgtactggcccgctaccctc

SEQ ID NO: 166911 - DNA, 35 bp, Artificial Sequence
  Synthetic oligonucleotide
gtccgcccaaagtgttaacgtcgtctggccgcctc

SEQ ID NO: 166912 - DNA, 35 bp, Artificial Sequence
  Synthetic oligonucleotide
taagccagcagttgtacgccgtgctcaccgtcctc

SEQ ID NO: 166913 - DNA, 35 bp, Artificial Sequence
  Synthetic oligonucleotide
gtcgtggtactacacgtcactccgttttccctgtc

SEQ ID NO: 166914 - DNA, 35 bp, Artificial Sequence
  Synthetic oligonucleotide
acactccggctcgctctctccatctcgtcgcattc

SEQ ID NO: 166915 - DNA, 35 bp, Artificial Sequence
  Synthetic oligonucleotide
gacgacccatgttgcatattcctcttgcagccttc

SEQ ID NO: 166916 - DNA, 35 bp, Artificial Sequence
  Synthetic oligonucleotide
tatttctcaccgcctgtttatcgcttcacgccacg

SEQ ID NO: 166917 - DNA, 35 bp, Artificial Sequence
  Synthetic oligonucleotide
tttccggagcccgcctacatccgcccatgctaccg

SEQ ID NO: 166918 - DNA, 35 bp, Artificial Sequence
  Synthetic oligonucleotide
gatccctcccgctcttggtaacacggttccgcccg

SEQ ID NO: 166919 - DNA, 35 bp, Artificial Sequence
  Synthetic oligonucleotide
tccggagggggagtgggatttatgggaacacagcg

SEQ ID NO: 166920 - DNA, 35 bp, Artificial Sequence
  Synthetic oligonucleotide
gacaaggagggagttagcgggaggggattatgtcg

SEQ ID NO: 166921 - DNA, 35 bp, Artificial Sequence
  Synthetic oligonucleotide
attgggcactcgcgcagttcgctccccgccgttcg

SEQ ID NO: 166922 - DNA, 34 bp, Artificial Sequence
  Synthetic oligonucleotide
ggatgccaggaggggacgggggttcgggtcaagg

SEQ ID NO: 166923 - DNA, 35 bp, Artificial Sequence
  Synthetic oligonucleotide
gaggggtgtgagcgggggggcgagacaggtggagg

SEQ ID NO: 166924 - DNA, 35 bp, Artificial Sequence
  Synthetic oligonucleotide
acacctccacgcgccatcgtgcccccagattccgg

SEQ ID NO: 166925 - DNA, 35 bp, Artificial Sequence
  Synthetic oligonucleotide
gagttgggagctcaaaagggagggtgggagagggg

SEQ ID NO: 166926 - DNA, 35 bp, Artificial Sequence
  Synthetic oligonucleotide
gaagaaggtgggagtgaagtttatggtgagtgggg

SEQ ID NO: 166927 - DNA, 35 bp, Artificial Sequence
  Synthetic oligonucleotide
gtcctgcctcggttctttttttcagtctggttctg

SEQ ID NO: 166928 - DNA, 35 bp, Artificial Sequence
  Synthetic oligonucleotide
gctgccacgctcccctctcatcccgtgcagccgat

SEQ ID NO: 166929 - DNA, 35 bp, Artificial Sequence
  Synthetic oligonucleotide
gtctggctcgatatgcccctagtctagatacctct

SEQ ID NO: 166930 - DNA, 34 bp, Artificial Sequence
  Synthetic oligonucleotide
gtacactgtgagggcgctgcctacttcctcctct

SEQ ID NO: 166931 - DNA, 35 bp, Artificial Sequence
  Synthetic oligonucleotide
taccgtgaccttaccgatcgatcggtccgccttct

SEQ ID NO: 166932 - DNA, 35 bp, Artificial Sequence
  Synthetic oligonucleotide
tctactgctccatctacctggtgcctcgcctttct

SEQ ID NO: 166933 - DNA, 35 bp, Artificial Sequence
  Synthetic oligonucleotide
tgccacacggatccactcccgccctagttatcggt

SEQ ID NO: 166934 - DNA, 35 bp, Artificial Sequence
  Synthetic oligonucleotide
ggtgcaccttcatgctctactctccggctaccatt

SEQ ID NO: 166935 - DNA, 35 bp, Artificial Sequence
  Synthetic oligonucleotide
tagtccgaccaccaggtactgttacaattgctctt

SEQ ID NO: 166936 - DNA, 36 bp, Artificial Sequence
  Synthetic oligonucleotide
accaccctcgtaccgctgtatttccatccgtcaaaa

SEQ ID NO: 166937 - DNA, 36 bp, Artificial Sequence
  Synthetic oligonucleotide
gaggggttggaatgaacgggaagggaatgagaggaa

SEQ ID NO: 166938 - DNA, 35 bp, Artificial Sequence
  Synthetic oligonucleotide
gttcgttcatagggtcgggggggcaggagagggaa

SEQ ID NO: 166939 - DNA, 36 bp, Artificial Sequence
  Synthetic oligonucleotide
ggtaacggggagaacgggtacgacacggggagggaa

SEQ ID NO: 166940 - DNA, 36 bp, Artificial Sequence
  Synthetic oligonucleotide
atcgccccccgtccccatcgtcaagtcttagctaca

SEQ ID NO: 166941 - DNA, 36 bp, Artificial Sequence
  Synthetic oligonucleotide
gccctcacgccaccctgccccgaaataccgacccca

SEQ ID NO: 166942 - DNA, 35 bp, Artificial Sequence
  Synthetic oligonucleotide
gtccgccgccactatcccggctcgtatctaggcca

SEQ ID NO: 166943 - DNA, 36 bp, Artificial Sequence
  Synthetic oligonucleotide
actttgcagggcgcgacgtctcctttggcccatcca

SEQ ID NO: 166944 - DNA, 36 bp, Artificial Sequence
  Synthetic oligonucleotide
acttgcgccttcctgtctactgcccatggatttcca

SEQ ID NO: 166945 - DNA, 37 bp, Artificial Sequence
  Synthetic oligonucleotide
gccgggagggtggtcgagggggatcatgcattaagca

SEQ ID NO: 166946 - DNA, 36 bp, Artificial Sequence
  Synthetic oligonucleotide
tcccacaccatgcctcctgtgccccatcaccgatca

SEQ ID NO: 166947 - DNA, 37 bp, Artificial Sequence
  Synthetic oligonucleotide
agtagggggggagatagtaggggcagggaatacaaga

SEQ ID NO: 166948 - DNA, 37 bp, Artificial Sequence
  Synthetic oligonucleotide
gaggagagaggttggggggtacggcagtcaaaggaga

SEQ ID NO: 166949 - DNA, 37 bp, Artificial Sequence
  Synthetic oligonucleotide
gtgggtggggtcatggggtaagggagaaggggaacga

SEQ ID NO: 166950 - DNA, 36 bp, Artificial Sequence
  Synthetic oligonucleotide
gtgcacccgcaacgacggtctgtcttcgcctctcga

SEQ ID NO: 166951 - DNA, 37 bp, Artificial Sequence
  Synthetic oligonucleotide
agggcaccaccccgcccgtaacatcactgccattcga

SEQ ID NO: 166952 - DNA, 37 bp, Artificial Sequence
  Synthetic oligonucleotide
tcccacctcgtgctgatcgatagcacctcctcacgga

SEQ ID NO: 166953 - DNA, 37 bp, Artificial Sequence
  Synthetic oligonucleotide
agagtgtacggaggtggggccgaggggagtaaaggga

SEQ ID NO: 166954 - DNA, 36 bp, Artificial Sequence
  Synthetic oligonucleotide
taccgccccaccgcttctttggtactgtctcaggga

SEQ ID NO: 166955 - DNA, 36 bp, Artificial Sequence
  Synthetic oligonucleotide
ccagagtccgcctgcccttgccccaccgcctatgga

SEQ ID NO: 166956 - DNA, 35 bp, Artificial Sequence
  Synthetic oligonucleotide
gtacaccacatgcctgcccgcattgcccacttgga

SEQ ID NO: 166957 - DNA, 38 bp, Artificial Sequence
  Synthetic oligonucleotide
aatggggcggaggaagggtggcggtatgggtggtatga

SEQ ID NO: 166958 - DNA, 38 bp, Artificial Sequence
  Synthetic oligonucleotide
tcatgcgcgatcgtccactactgcaccctctaccctga

SEQ ID NO: 166959 - DNA, 37 bp, Artificial Sequence
  Synthetic oligonucleotide
tcattctgccactctgtccgtcctcccccgccgctga

SEQ ID NO: 166960 - DNA, 37 bp, Artificial Sequence
  Synthetic oligonucleotide
gtgtgcccccgccctatggtccctgttcgtactctga

SEQ ID NO: 166961 - DNA, 37 bp, Artificial Sequence
  Synthetic oligonucleotide
gagggggtgaggggatgggaactagtgtgcgaagtga

SEQ ID NO: 166962 - DNA, 36 bp, Artificial Sequence
  Synthetic oligonucleotide
tcgtagccctggccgccctgttaactcctgtcaata

SEQ ID NO: 166963 - DNA, 35 bp, Artificial Sequence
  Synthetic oligonucleotide
gttcagggaggctaagtgagggtgggaacgggcta

SEQ ID NO: 166964 - DNA, 36 bp, Artificial Sequence
  Synthetic oligonucleotide
tccatctgccctccatcttttgcacgaccgttgcta

SEQ ID NO: 166965 - DNA, 36 bp, Artificial Sequence
  Synthetic oligonucleotide
agcctactcgcacacccgtcctttagtcctgttcta

SEQ ID NO: 166966 - DNA, 36 bp, Artificial Sequence
  Synthetic oligonucleotide
tctcgcctgcagttggccttgcaccacctattatta

SEQ ID NO: 166967 - DNA, 35 bp, Artificial Sequence
  Synthetic oligonucleotide
attcaccgcagacgcctgcctctattatcccgtta

SEQ ID NO: 166968 - DNA, 36 bp, Artificial Sequence
  Synthetic oligonucleotide
actacgcacaacttgcataaccacccgtgtccttta

SEQ ID NO: 166969 - DNA, 35 bp, Artificial Sequence
  Synthetic oligonucleotide
gctgctcaaagttacgcgcccgtctctcctagcac

SEQ ID NO: 166970 - DNA, 35 bp, Artificial Sequence
  Synthetic oligonucleotide
gtgcaccgccagggagtagtatcaccatctttcac

SEQ ID NO: 166971 - DNA, 35 bp, Artificial Sequence
  Synthetic oligonucleotide
tagccctctcatgtcaatcacatctcgcgcaaacc

SEQ ID NO: 166972 - DNA, 35 bp, Artificial Sequence
  Synthetic oligonucleotide
atcccgacccgagtgtcgccagactagattccacc

SEQ ID NO: 166973 - DNA, 34 bp, Artificial Sequence
  Synthetic oligonucleotide
tttgccaccacggcgtactgcgttgttactatcc

SEQ ID NO: 166974 - DNA, 35 bp, Artificial Sequence
  Synthetic oligonucleotide
tcctcccaacctgtgctgggccttggcgaccctcc

SEQ ID NO: 166975 - DNA, 35 bp, Artificial Sequence
  Synthetic oligonucleotide
accgagcacccacattcctccaagatttccagtcc

SEQ ID NO: 166976 - DNA, 35 bp, Artificial Sequence
  Synthetic oligonucleotide
tccatacgcagtgtgaacctgccattaacccttcc

SEQ ID NO: 166977 - DNA, 35 bp, Artificial Sequence
  Synthetic oligonucleotide
tgcgccttcctcagtttgactttttgtttgctcgc

SEQ ID NO: 166978 - DNA, 29 bp, Artificial Sequence
  Synthetic oligonucleotide
tttcccgcccggtaattcctgtctttcgc

SEQ ID NO: 166979 - DNA, 35 bp, Artificial Sequence
  Synthetic oligonucleotide
ccgaaccacatcactttccatcctgccccgacggc

SEQ ID NO: 166980 - DNA, 34 bp, Artificial Sequence
  Synthetic oligonucleotide
aatcaccccgcccgcaccatccccggtatggggc

SEQ ID NO: 166981 - DNA, 36 bp, Artificial Sequence
  Synthetic oligonucleotide
tgtacgcggcattttctcattggtcgctcctactgc

SEQ ID NO: 166982 - DNA, 35 bp, Artificial Sequence
  Synthetic oligonucleotide
acccttcaaggctgacttgcttactccatccctgc

SEQ ID NO: 166983 - DNA, 35 bp, Artificial Sequence
  Synthetic oligonucleotide
tcctttccccatatcctgttcacgtgcaaacttgc

SEQ ID NO: 166984 - DNA, 35 bp, Artificial Sequence
  Synthetic oligonucleotide
gacgactcggctcctggctctactacacttacatc

SEQ ID NO: 166985 - DNA, 35 bp, Artificial Sequence
  Synthetic oligonucleotide
atgacatccgaccggactacttatctcctcctatc

SEQ ID NO: 166986 - DNA, 35 bp, Artificial Sequence
  Synthetic oligonucleotide
gtatcacctgttcatccattcgcgtctaggccctc

SEQ ID NO: 166987 - DNA, 35 bp, Artificial Sequence
  Synthetic oligonucleotide
ggtcgagtcggtgtacgttccccctctgatccctc

SEQ ID NO: 166988 - DNA, 35 bp, Artificial Sequence
  Synthetic oligonucleotide
gtcaccagtctatctccgccctcaggcaatgcttc

SEQ ID NO: 166989 - DNA, 35 bp, Artificial Sequence
  Synthetic oligonucleotide
gcctcatcccatccaggcaaattgtatattgcttc

SEQ ID NO: 166990 - DNA, 34 bp, Artificial Sequence
  Synthetic oligonucleotide
tccgcacctgctgccccctcgccgaacttagttc

SEQ ID NO: 166991 - DNA, 35 bp, Artificial Sequence
  Synthetic oligonucleotide
gtctatgggtgaggacgggaggggaggctcataag

SEQ ID NO: 166992 - DNA, 35 bp, Artificial Sequence
  Synthetic oligonucleotide
ggtgggcggagacaagacgggtgggaagaagcgcg

SEQ ID NO: 166993 - DNA, 35 bp, Artificial Sequence
  Synthetic oligonucleotide
tgtccagacctccaccttctcgcgatagttattcg

SEQ ID NO: 166994 - DNA, 35 bp, Artificial Sequence
  Synthetic oligonucleotide
gtcacccccctggtggccttgacgtacttacttcg

SEQ ID NO: 166995 - DNA, 35 bp, Artificial Sequence
  Synthetic oligonucleotide
gtcacgcccctgttctccgcctgcaatcttgttcg

SEQ ID NO: 166996 - DNA, 35 bp, Artificial Sequence
  Synthetic oligonucleotide
atgaccttgacatcgccgcccgctccacccacagg

SEQ ID NO: 166997 - DNA, 35 bp, Artificial Sequence
  Synthetic oligonucleotide
gtctccgcccccgaccgaactaccgtccaacacgg

SEQ ID NO: 166998 - DNA, 35 bp, Artificial Sequence
  Synthetic oligonucleotide
actgagcgactctgcttgacctctctccttcacgg

SEQ ID NO: 166999 - DNA, 35 bp, Artificial Sequence
  Synthetic oligonucleotide
gggatggagcgcaacagggaacttcggggggaggg

SEQ ID NO: 167000 - DNA, 35 bp, Artificial Sequence
  Synthetic oligonucleotide
gcggaggggtgttatattggttaagggtgggaggg

SEQ ID NO: 167001 - DNA, 35 bp, Artificial Sequence
  Synthetic oligonucleotide
aactaacgggggcgggggagtggtggttagatggg

SEQ ID NO: 167002 - DNA, 35 bp, Artificial Sequence
  Synthetic oligonucleotide
tatgctgcccctggccacctctcgcttactacatg

SEQ ID NO: 167003 - DNA, 35 bp, Artificial Sequence
  Synthetic oligonucleotide
attcgccattgtgcatcctgttatctccactcgtg

SEQ ID NO: 167004 - DNA, 35 bp, Artificial Sequence
  Synthetic oligonucleotide
tccacaccgccatagtactctgctgttgctctttg

SEQ ID NO: 167005 - DNA, 35 bp, Artificial Sequence
  Synthetic oligonucleotide
gtgttccaactatccgccccctgcgcccgcattat

SEQ ID NO: 167006 - DNA, 35 bp, Artificial Sequence
  Synthetic oligonucleotide
gccaatccgccatcattccatatcgggatctttat

SEQ ID NO: 167007 - DNA, 35 bp, Artificial Sequence
  Synthetic oligonucleotide
gactgcctttgatccctgttattggcttcttcact

SEQ ID NO: 167008 - DNA, 35 bp, Artificial Sequence
  Synthetic oligonucleotide
tagcgccccatgtcttttcttctatcaggcgccct

SEQ ID NO: 167009 - DNA, 35 bp, Artificial Sequence
  Synthetic oligonucleotide
cccattgccctgtactaaaggtcgttcctcccgct

SEQ ID NO: 167010 - DNA, 35 bp, Artificial Sequence
  Synthetic oligonucleotide
tgttccacaccatatccacctgctgaccccatgct

SEQ ID NO: 167011 - DNA, 35 bp, Artificial Sequence
  Synthetic oligonucleotide
tcagacacaggtcctgtctatccctttttcgttct

SEQ ID NO: 167012 - DNA, 35 bp, Artificial Sequence
  Synthetic oligonucleotide
tccttcctaccgctgcccgccccaacctgtgtagt

SEQ ID NO: 167013 - DNA, 36 bp, Artificial Sequence
  Synthetic oligonucleotide
gccactcctttggtactactcctccgcgtgactcgt

SEQ ID NO: 167014 - DNA, 35 bp, Artificial Sequence
  Synthetic oligonucleotide
tcacctgcaatttatggccctgcttacacttaggt

SEQ ID NO: 167015 - DNA, 35 bp, Artificial Sequence
  Synthetic oligonucleotide
ttcagcaatgctcgccactatcacctccgcacggt

SEQ ID NO: 167016 - DNA, 35 bp, Artificial Sequence
  Synthetic oligonucleotide
agctccctctcatgttgctctccccccacatcggt

SEQ ID NO: 167017 - DNA, 35 bp, Artificial Sequence
  Synthetic oligonucleotide
gcaacgctccctcatccttctaggcgacttttctt

SEQ ID NO: 167018 - DNA, 35 bp, Artificial Sequence
  Synthetic oligonucleotide
accaccgtcggtccagtcttttcgttcgccgcgtt

SEQ ID NO: 167019 - DNA, 35 bp, Artificial Sequence
  Synthetic oligonucleotide
tcaactcccatccgcgattctatgaacgatctgtt

SEQ ID NO: 167020 - DNA, 35 bp, Artificial Sequence
  Synthetic oligonucleotide
accctaccgccgttcgatcctcatgaatatccttt

SEQ ID NO: 167021 - DNA, 35 bp, Artificial Sequence
  Synthetic oligonucleotide
gtagcggagaaaaaagaggggatggggcgggagaa

SEQ ID NO: 167022 - DNA, 28 bp, Artificial Sequence
  Synthetic oligonucleotide
actccgcacctccaacccgtgtgccgaa

SEQ ID NO: 167023 - DNA, 36 bp, Artificial Sequence
  Synthetic oligonucleotide
gcaaggaggagtgtgcaggcttgatgggggcgggaa

SEQ ID NO: 167024 - DNA, 36 bp, Artificial Sequence
  Synthetic oligonucleotide
agtggggagaagagaggcgcggggtgcggttgtgaa

SEQ ID NO: 167025 - DNA, 36 bp, Artificial Sequence
  Synthetic oligonucleotide
gaccggggtgggagagaagggacgtagcgcgggtaa

SEQ ID NO: 167026 - DNA, 35 bp, Artificial Sequence
  Synthetic oligonucleotide
gtccggttaatctgttgagcgccccccaccccaca

SEQ ID NO: 167027 - DNA, 36 bp, Artificial Sequence
  Synthetic oligonucleotide
gcctgactgtcccagtgtcacacctcactctccaca

SEQ ID NO: 167028 - DNA, 35 bp, Artificial Sequence
  Synthetic oligonucleotide
tcacctcgaaatctgtctagtctaatgctcctcca

SEQ ID NO: 167029 - DNA, 35 bp, Artificial Sequence
  Synthetic oligonucleotide
tcccgccccttctctcgattttgctacgtggctca

SEQ ID NO: 167030 - DNA, 36 bp, Artificial Sequence
  Synthetic oligonucleotide
aataggctgagccccccctgtaatcgcgccatctca

SEQ ID NO: 167031 - DNA, 36 bp, Artificial Sequence
  Synthetic oligonucleotide
gcatcctgcgatgccggattcctgtcttcctattca

SEQ ID NO: 167032 - DNA, 35 bp, Artificial Sequence
  Synthetic oligonucleotide
taaccggatcatccccccagcctgtgcacccttca

SEQ ID NO: 167033 - DNA, 36 bp, Artificial Sequence
  Synthetic oligonucleotide
atgaccaaggcaacaagcggagggaaacgggggaga

SEQ ID NO: 167034 - DNA, 35 bp, Artificial Sequence
  Synthetic oligonucleotide
gaagaggtggagctatatacagggggggcttgaga

SEQ ID NO: 167035 - DNA, 37 bp, Artificial Sequence
  Synthetic oligonucleotide
atgggagggtggggggacttgagcggaaacgtgacga

SEQ ID NO: 167036 - DNA, 37 bp, Artificial Sequence
  Synthetic oligonucleotide
tgcacacgttacattctgctgcaccacattccaccga

SEQ ID NO: 167037 - DNA, 37 bp, Artificial Sequence
  Synthetic oligonucleotide
tctccacgacttgtcatattgcacctacgccccccga

SEQ ID NO: 167038 - DNA, 37 bp, Artificial Sequence
  Synthetic oligonucleotide
ttcccacgagctgtccaagctcccgcccatcctccga

SEQ ID NO: 167039 - DNA, 35 bp, Artificial Sequence
  Synthetic oligonucleotide
tctccgcctcatccatatccctattcgatcatcga

SEQ ID NO: 167040 - DNA, 37 bp, Artificial Sequence
  Synthetic oligonucleotide
gtgcaccctttacctgctcccgactcgttttcatcga

SEQ ID NO: 167041 - DNA, 35 bp, Artificial Sequence
  Synthetic oligonucleotide
gattacccacccgttttgaggtccacccccctcga

SEQ ID NO: 167042 - DNA, 36 bp, Artificial Sequence
  Synthetic oligonucleotide
tgtcccccgccacgttgatctctttagccatttcga

SEQ ID NO: 167043 - DNA, 37 bp, Artificial Sequence
  Synthetic oligonucleotide
gaagggaggagggcgcgtatcagggaagttcaaagga

SEQ ID NO: 167044 - DNA, 37 bp, Artificial Sequence
  Synthetic oligonucleotide
agagagtaaaggggtggggggttaaggcgggtacgga

SEQ ID NO: 167045 - DNA, 37 bp, Artificial Sequence
  Synthetic oligonucleotide
ttctgcactcggacctgcgatctgcccctccaccgga

SEQ ID NO: 167046 - DNA, 36 bp, Artificial Sequence
  Synthetic oligonucleotide
gaccaagcgatcaggcgctccccaccgccatccgga

SEQ ID NO: 167047 - DNA, 37 bp, Artificial Sequence
  Synthetic oligonucleotide
tctggtgaagtaacggggtggggtgggatgcgaggga

SEQ ID NO: 167048 - DNA, 37 bp, Artificial Sequence
  Synthetic oligonucleotide
acacgcggggacgtgagaggggtgggcgatggaggga

SEQ ID NO: 167049 - DNA, 37 bp, Artificial Sequence
  Synthetic oligonucleotide
tatgggacatcgatatgggaggggcaataaagcggga

SEQ ID NO: 167050 - DNA, 37 bp, Artificial Sequence
  Synthetic oligonucleotide
acaaatgcgcggggcctgggaggggatcggaggggga

SEQ ID NO: 167051 - DNA, 37 bp, Artificial Sequence
  Synthetic oligonucleotide
atacgggagggcaacatggtaaagacccgggtgggga

SEQ ID NO: 167052 - DNA, 37 bp, Artificial Sequence
  Synthetic oligonucleotide
atggtggagggcgatggggcggcactgcgtggtggga

SEQ ID NO: 167053 - DNA, 37 bp, Artificial Sequence
  Synthetic oligonucleotide
gcccccctgcccgcatgtctttccatcaacaagtgga

SEQ ID NO: 167054 - DNA, 38 bp, Artificial Sequence
  Synthetic oligonucleotide
taccaccccgcggcgtctttagtcccccatctgcatga

SEQ ID NO: 167055 - DNA, 36 bp, Artificial Sequence
  Synthetic oligonucleotide
gtcgccgcctccggcatccccacgtcatttttatga

SEQ ID NO: 167056 - DNA, 37 bp, Artificial Sequence
  Synthetic oligonucleotide
gaccatgctctcgacgcgtcgcctcctttcaccctga

SEQ ID NO: 167057 - DNA, 38 bp, Artificial Sequence
  Synthetic oligonucleotide
gggacctccgccgtgtgccgctaccaactacctcctga

SEQ ID NO: 167058 - DNA, 38 bp, Artificial Sequence
  Synthetic oligonucleotide
gtaggcggaggaggggagggaactgtaccttcaagtga

SEQ ID NO: 167059 - DNA, 38 bp, Artificial Sequence
  Synthetic oligonucleotide
tgaagggagggggtatgcagtcgaaagggacggagtga

SEQ ID NO: 167060 - DNA, 38 bp, Artificial Sequence
  Synthetic oligonucleotide
acgccccctcctgcccgtacggtgacaacaattagtga

SEQ ID NO: 167061 - DNA, 37 bp, Artificial Sequence
  Synthetic oligonucleotide
ggtcacctactggtcctataatactctacccccgtga

SEQ ID NO: 167062 - DNA, 37 bp, Artificial Sequence
  Synthetic oligonucleotide
gccacacctcttgctgtcctaggaatatgccccgtga

SEQ ID NO: 167063 - DNA, 38 bp, Artificial Sequence
  Synthetic oligonucleotide
tcaaccggggaaggacgggtggctaggaaggagggtga

SEQ ID NO: 167064 - DNA, 38 bp, Artificial Sequence
  Synthetic oligonucleotide
atgaccacctcccatgtgaaaacattacccgatcttga

SEQ ID NO: 167065 - DNA, 35 bp, Artificial Sequence
  Synthetic oligonucleotide
accaccaacacgtgcgctcttactcgctctcgata

SEQ ID NO: 167066 - DNA, 35 bp, Artificial Sequence
  Synthetic oligonucleotide
gaaccgggcccccccccgtgttgttaaccttccta

SEQ ID NO: 167067 - DNA, 36 bp, Artificial Sequence
  Synthetic oligonucleotide
ttccactgtccgttgctaaattcggaaccctctcta

SEQ ID NO: 167068 - DNA, 35 bp, Artificial Sequence
  Synthetic oligonucleotide
gccacccggttccgcattatcgccggcctcctgta

SEQ ID NO: 167069 - DNA, 36 bp, Artificial Sequence
  Synthetic oligonucleotide
gcaccccgccctaacgatgtggaccccctgcttgta

SEQ ID NO: 167070 - DNA, 35 bp, Artificial Sequence
  Synthetic oligonucleotide
ggacagtagccagtcccgaaccgccactgttacac

SEQ ID NO: 167071 - DNA, 35 bp, Artificial Sequence
  Synthetic oligonucleotide
ggtccccagcctttgcgtcacactctcgtactcac

SEQ ID NO: 167072 - DNA, 35 bp, Artificial Sequence
  Synthetic oligonucleotide
gttccacatcctccgaagtagcttatacccttgac

SEQ ID NO: 167073 - DNA, 35 bp, Artificial Sequence
  Synthetic oligonucleotide
tcacctacccaaatggtttatttgccaagcactac

SEQ ID NO: 167074 - DNA, 35 bp, Artificial Sequence
  Synthetic oligonucleotide
gtcactcccctgtccttctacatagtatgctctac

SEQ ID NO: 167075 - DNA, 35 bp, Artificial Sequence
  Synthetic oligonucleotide
gacacatccctcgtatttcaccgccattgcaaacc

SEQ ID NO: 167076 - DNA, 35 bp, Artificial Sequence
  Synthetic oligonucleotide
aactgaagtagccgctgcccgccctcgctaagacc

SEQ ID NO: 167077 - DNA, 34 bp, Artificial Sequence
  Synthetic oligonucleotide
tcacagccaccgcgtgaatttgtccaccgccccc

SEQ ID NO: 167078 - DNA, 35 bp, Artificial Sequence
  Synthetic oligonucleotide
gcacacgtccactccgcgcgccagaccgacccgcc

SEQ ID NO: 167079 - DNA, 35 bp, Artificial Sequence
  Synthetic oligonucleotide
tcgtgcccctgtccggtcgtatccacctcaactcc

SEQ ID NO: 167080 - DNA, 35 bp, Artificial Sequence
  Synthetic oligonucleotide
actcccattgcccgtaccttcttgattatacgtcc

SEQ ID NO: 167081 - DNA, 35 bp, Artificial Sequence
  Synthetic oligonucleotide
tgatgtcgtgtcatagcctgctccaacgtccttcc

SEQ ID NO: 167082 - DNA, 35 bp, Artificial Sequence
  Synthetic oligonucleotide
ccctgacctgtaccgtacccgcatcgtggctttcc

SEQ ID NO: 167083 - DNA, 35 bp, Artificial Sequence
  Synthetic oligonucleotide
gtcccaggccctccctctaacacctacgctgatgc

SEQ ID NO: 167084 - DNA, 35 bp, Artificial Sequence
  Synthetic oligonucleotide
gtcgtcctccgcacttgttaccgctcctttgctgc

SEQ ID NO: 167085 - DNA, 35 bp, Artificial Sequence
  Synthetic oligonucleotide
tataccgccgaggtcacgttttttacgtctcgatc

SEQ ID NO: 167086 - DNA, 35 bp, Artificial Sequence
  Synthetic oligonucleotide
acccctcgcgtgttccctgtatatctgtcgctatc

SEQ ID NO: 167087 - DNA, 35 bp, Artificial Sequence
  Synthetic oligonucleotide
tgacagagctcccgcccgttacgaaattttgcctc

SEQ ID NO: 167088 - DNA, 34 bp, Artificial Sequence
  Synthetic oligonucleotide
gacctgtgttgcctgttctactatagccccgctc

SEQ ID NO: 167089 - DNA, 35 bp, Artificial Sequence
  Synthetic oligonucleotide
ttcgcaacccgcccctctactctaagtgctcgctc

SEQ ID NO: 167090 - DNA, 35 bp, Artificial Sequence
  Synthetic oligonucleotide
tctccccacagttgttctgtcacccccaatggctc

SEQ ID NO: 167091 - DNA, 35 bp, Artificial Sequence
  Synthetic oligonucleotide
tcgcaacatcctagactctcctattggtccttctc

SEQ ID NO: 167092 - DNA, 35 bp, Artificial Sequence
  Synthetic oligonucleotide
tcgcccattgcccctccagagttgaccgccatgtc

SEQ ID NO: 167093 - DNA, 35 bp, Artificial Sequence
  Synthetic oligonucleotide
gttcccgttacgcgtgttctatgtacctcctcttc

SEQ ID NO: 167094 - DNA, 35 bp, Artificial Sequence
  Synthetic oligonucleotide
gacgaccctcccacggcctatggttcccccttaag

SEQ ID NO: 167095 - DNA, 36 bp, Artificial Sequence
  Synthetic oligonucleotide
tcagtgcggaggagaataattcaagaagggggggag

SEQ ID NO: 167096 - DNA, 35 bp, Artificial Sequence
  Synthetic oligonucleotide
atcctgtcaaccctatggctgcacctcatgcaccg

SEQ ID NO: 167097 - DNA, 35 bp, Artificial Sequence
  Synthetic oligonucleotide
tgttcactacatgccataccatcctattcatagcg

SEQ ID NO: 167098 - DNA, 32 bp, Artificial Sequence
  Synthetic oligonucleotide
gtctagctccgtctaatcccgcccttgccgcg

SEQ ID NO: 167099 - DNA, 35 bp, Artificial Sequence
  Synthetic oligonucleotide
aaacaccgcctccatccagatcacctccgggcgcg

SEQ ID NO: 167100 - DNA, 35 bp, Artificial Sequence
  Synthetic oligonucleotide
ggacacacctttctctgcccactgctccattatcg

SEQ ID NO: 167101 - DNA, 35 bp, Artificial Sequence
  Synthetic oligonucleotide
tcccgtgcctgaccgccaaacctcctcactgctcg

SEQ ID NO: 167102 - DNA, 35 bp, Artificial Sequence
  Synthetic oligonucleotide
tccgattcctctggtacccatcaactacgctttcg

SEQ ID NO: 167103 - DNA, 35 bp, Artificial Sequence
  Synthetic oligonucleotide
aaaggggagagagtcggatagatggaagggtgatg

SEQ ID NO: 167104 - DNA, 35 bp, Artificial Sequence
  Synthetic oligonucleotide
acttgcccctgtcgcgtcttcagctgccctccctg

SEQ ID NO: 167105 - DNA, 35 bp, Artificial Sequence
  Synthetic oligonucleotide
gagctacgcagtgggtcttcactactctctccttg

SEQ ID NO: 167106 - DNA, 35 bp, Artificial Sequence
  Synthetic oligonucleotide
acacaccacctaacaggttcgccgttccgctcttg

SEQ ID NO: 167107 - DNA, 35 bp, Artificial Sequence
  Synthetic oligonucleotide
atacaccacctaacatgttcgccgttccgctcttg

SEQ ID NO: 167108 - DNA, 35 bp, Artificial Sequence
  Synthetic oligonucleotide
actccccacagtatacgcgctctgctcttccacat

SEQ ID NO: 167109 - DNA, 35 bp, Artificial Sequence
  Synthetic oligonucleotide
ttcgggggggccatgggtagggtttgagtagacat

SEQ ID NO: 167110 - DNA, 35 bp, Artificial Sequence
  Synthetic oligonucleotide
atccgatcccctgtagcggttctaccttgtaccat

SEQ ID NO: 167111 - DNA, 35 bp, Artificial Sequence
  Synthetic oligonucleotide
actgctggccttgccttcctatagcctgcctccat

SEQ ID NO: 167112 - DNA, 35 bp, Artificial Sequence
  Synthetic oligonucleotide
tgcacccccgatactgcctataattctcggttcat

SEQ ID NO: 167113 - DNA, 35 bp, Artificial Sequence
  Synthetic oligonucleotide
atcgcccctctcgccctcacttgggacttttcgat

SEQ ID NO: 167114 - DNA, 35 bp, Artificial Sequence
  Synthetic oligonucleotide
agctcgaccagagcccgctccaccttcgcccggat

SEQ ID NO: 167115 - DNA, 35 bp, Artificial Sequence
  Synthetic oligonucleotide
taccatcgaattgtcctcccgagtctcacatgcct

SEQ ID NO: 167116 - DNA, 35 bp, Artificial Sequence
  Synthetic oligonucleotide
ttcacggtggcccccacacacgacgttctactcct

SEQ ID NO: 167117 - DNA, 35 bp, Artificial Sequence
  Synthetic oligonucleotide
gttacccgccgcaaacacatctgttgctatttcct

SEQ ID NO: 167118 - DNA, 35 bp, Artificial Sequence
  Synthetic oligonucleotide
tcagctccccgctgtcgctccatccgccccgatct

SEQ ID NO: 167119 - DNA, 35 bp, Artificial Sequence
  Synthetic oligonucleotide
tgacgatgcccccccctcccgctgcggtgctctct

SEQ ID NO: 167120 - DNA, 35 bp, Artificial Sequence
  Synthetic oligonucleotide
gaacaccacacccgccgtacaagtagataccaagt

SEQ ID NO: 167121 - DNA, 34 bp, Artificial Sequence
  Synthetic oligonucleotide
gacccccgttcccttctcgccctgtcattccagt

SEQ ID NO: 167122 - DNA, 35 bp, Artificial Sequence
  Synthetic oligonucleotide
acctagcccctgcccttgatccaacgtgtatacgt

SEQ ID NO: 167123 - DNA, 35 bp, Artificial Sequence
  Synthetic oligonucleotide
actccccgctagcctcccgaccctcttggatatgt

SEQ ID NO: 167124 - DNA, 35 bp, Artificial Sequence
  Synthetic oligonucleotide
tcctcgttactgcccgctcctattctggaaatttt

SEQ ID NO: 167125 - DNA, 35 bp, Artificial Sequence
  Synthetic oligonucleotide
atccaccgtagccgtgtaccatcgtgtcaccaaaa

SEQ ID NO: 167126 - DNA, 36 bp, Artificial Sequence
  Synthetic oligonucleotide
tccgtcgcccccttatgggttccatgcccaccgaaa

SEQ ID NO: 167127 - DNA, 36 bp, Artificial Sequence
  Synthetic oligonucleotide
tgccaccgtgcgatagcattgatcccgccctcgaaa

SEQ ID NO: 167128 - DNA, 36 bp, Artificial Sequence
  Synthetic oligonucleotide
gtttgcccacgtctcatatatcgccgtctctcgcaa

SEQ ID NO: 167129 - DNA, 36 bp, Artificial Sequence
  Synthetic oligonucleotide
gtgcctgcccttgccgctttttgaccgatgaaccca

SEQ ID NO: 167130 - DNA, 35 bp, Artificial Sequence
  Synthetic oligonucleotide
tacgcacgtcctgcctagtcccgggctctcaccca

SEQ ID NO: 167131 - DNA, 36 bp, Artificial Sequence
  Synthetic oligonucleotide
attctgcccccagggactcataggttgccaccccca

SEQ ID NO: 167132 - DNA, 32 bp, Artificial Sequence
  Synthetic oligonucleotide
gacgccggttcgctctgttacgctgcccccca

SEQ ID NO: 167133 - DNA, 36 bp, Artificial Sequence
  Synthetic oligonucleotide
atcaccactctggtactccctacagagccgccccca

SEQ ID NO: 167134 - DNA, 36 bp, Artificial Sequence
  Synthetic oligonucleotide
gtacgacgtatcctggatcgtcccacctgttcccca

SEQ ID NO: 167135 - DNA, 35 bp, Artificial Sequence
  Synthetic oligonucleotide
ttacatccgcccgccttacagtggtgcttcgcgca

SEQ ID NO: 167136 - DNA, 36 bp, Artificial Sequence
  Synthetic oligonucleotide
acgatgaggagtgaagggtaggggggggatgctgca

SEQ ID NO: 167137 - DNA, 36 bp, Artificial Sequence
  Synthetic oligonucleotide
gcgatcctcacctcccagaccatgtgactgtctgca

SEQ ID NO: 167138 - DNA, 35 bp, Artificial Sequence
  Synthetic oligonucleotide
ttcaaatatcaccgtccgccgttccacctgttgca

SEQ ID NO: 167139 - DNA, 35 bp, Artificial Sequence
  Synthetic oligonucleotide
agccaactgtcgaagatgccgccccctcgctctca

SEQ ID NO: 167140 - DNA, 36 bp, Artificial Sequence
  Synthetic oligonucleotide
tgcctaccactgcgttgtcaactagttccctgttca

SEQ ID NO: 167141 - DNA, 37 bp, Artificial Sequence
  Synthetic oligonucleotide
ttcctccaccctcacctatgttacttatagaccaaga

SEQ ID NO: 167142 - DNA, 37 bp, Artificial Sequence
  Synthetic oligonucleotide
tcaaacccgccgaactagccccacgctccgcccgaga

SEQ ID NO: 167143 - DNA, 36 bp, Artificial Sequence
  Synthetic oligonucleotide
gggagggggtcaagaaggggaagggggaggtctaga

SEQ ID NO: 167144 - DNA, 35 bp, Artificial Sequence
  Synthetic oligonucleotide
gaagggaggaggatgaagggccgaaattagaacga

SEQ ID NO: 167145 - DNA, 35 bp, Artificial Sequence
  Synthetic oligonucleotide
tcaccccctctgttcgctggccccctatctaacga

SEQ ID NO: 167146 - DNA, 37 bp, Artificial Sequence
  Synthetic oligonucleotide
taccgcctgcacattttacttggtcccccgttgacga

SEQ ID NO: 167147 - DNA, 35 bp, Artificial Sequence
  Synthetic oligonucleotide
aacacccgaccgatctggttcatccttccctccga

SEQ ID NO: 167148 - DNA, 37 bp, Artificial Sequence
  Synthetic oligonucleotide
ggggacataacatgggtgtaaggggggggcgaaggga

SEQ ID NO: 167149 - DNA, 35 bp, Artificial Sequence
  Synthetic oligonucleotide
aggtgaatggggaggtggaaaagcaggatagggga

SEQ ID NO: 167150 - DNA, 37 bp, Artificial Sequence
  Synthetic oligonucleotide
tccaagtggggagtcgcagggagtggagggcggggga

SEQ ID NO: 167151 - DNA, 38 bp, Artificial Sequence
  Synthetic oligonucleotide
agatggggggtgaatgggagcattggagggggacatga

SEQ ID NO: 167152 - DNA, 37 bp, Artificial Sequence
  Synthetic oligonucleotide
actccacctcgttgtttccaaagtcctttgtccctga

SEQ ID NO: 167153 - DNA, 38 bp, Artificial Sequence
  Synthetic oligonucleotide
gacaccagccgttaatcttacacactccatgctcctga

SEQ ID NO: 167154 - DNA, 37 bp, Artificial Sequence
  Synthetic oligonucleotide
acgttgagcctgatatactcgcctcccctacccgtga

SEQ ID NO: 167155 - DNA, 38 bp, Artificial Sequence
  Synthetic oligonucleotide
tccctccactctgactatcacgacgtcgcgctccgtga

SEQ ID NO: 167156 - DNA, 37 bp, Artificial Sequence
  Synthetic oligonucleotide
taagtgagtcgacagaagaagaggggggtggaggtga

SEQ ID NO: 167157 - DNA, 38 bp, Artificial Sequence
  Synthetic oligonucleotide
atacgggagggtagggtggggactggacccgaaattga

SEQ ID NO: 167158 - DNA, 37 bp, Artificial Sequence
  Synthetic oligonucleotide
gacacctcctcttatgctgcactgccatgacacttga

SEQ ID NO: 167159 - DNA, 38 bp, Artificial Sequence
  Synthetic oligonucleotide
gtcgatgctctatctgcgcctaacgactccttacttga

SEQ ID NO: 167160 - DNA, 38 bp, Artificial Sequence
  Synthetic oligonucleotide
tcagatcaggtctgcagacctacccgttacctccttga

SEQ ID NO: 167161 - DNA, 36 bp, Artificial Sequence
  Synthetic oligonucleotide
accacgacccgccaaatcgccgcttactggttccta

SEQ ID NO: 167162 - DNA, 34 bp, Artificial Sequence
  Synthetic oligonucleotide
tgccgactatcctgctcacgtgcacataccgcta

SEQ ID NO: 167163 - DNA, 36 bp, Artificial Sequence
  Synthetic oligonucleotide
atccgcccgtggttccgcccttcgctacgcggtgta

SEQ ID NO: 167164 - DNA, 35 bp, Artificial Sequence
  Synthetic oligonucleotide
gagatcctcgccccggtttcccgcatagtgcctta

SEQ ID NO: 167165 - DNA, 35 bp, Artificial Sequence
  Synthetic oligonucleotide
tcacgcaatagttaccagcacccggtcctctcaac

SEQ ID NO: 167166 - DNA, 35 bp, Artificial Sequence
  Synthetic oligonucleotide
tgtaccccacttcccgacgccagtttagggctcac

SEQ ID NO: 167167 - DNA, 35 bp, Artificial Sequence
  Synthetic oligonucleotide
agaccgaccgctcgcatatttctatcgccattgac

SEQ ID NO: 167168 - DNA, 35 bp, Artificial Sequence
  Synthetic oligonucleotide
gtgacaggctcgcattcttaccagcccttgattac

SEQ ID NO: 167169 - DNA, 35 bp, Artificial Sequence
  Synthetic oligonucleotide
tcactgcctccagggcttatcggttattgctcccc

SEQ ID NO: 167170 - DNA, 35 bp, Artificial Sequence
  Synthetic oligonucleotide
gtcatcgctgctctgtacatcacaccgcctccgcc

SEQ ID NO: 167171 - DNA, 35 bp, Artificial Sequence
  Synthetic oligonucleotide
ttatcccgtgtgtagcgccctccctgccatatgcc

SEQ ID NO: 167172 - DNA, 36 bp, Artificial Sequence
  Synthetic oligonucleotide
atgcccccgatccatcctcggtaccatccggactcc

SEQ ID NO: 167173 - DNA, 35 bp, Artificial Sequence
  Synthetic oligonucleotide
tcccccgcatcatgcacctgcgcccttccttgtcc

SEQ ID NO: 167174 - DNA, 35 bp, Artificial Sequence
  Synthetic oligonucleotide
ttcgccgatccgcccaattgatgtagctcgattcc

SEQ ID NO: 167175 - DNA, 35 bp, Artificial Sequence
  Synthetic oligonucleotide
tacctctgccacgcgctgccgccactccatcttcc

SEQ ID NO: 167176 - DNA, 35 bp, Artificial Sequence
  Synthetic oligonucleotide
tacgacaccacccttctcctttaagcctctgttcc

SEQ ID NO: 167177 - DNA, 35 bp, Artificial Sequence
  Synthetic oligonucleotide
atgccccgctttattttggatcgctacgctcttgc

SEQ ID NO: 167178 - DNA, 35 bp, Artificial Sequence
  Synthetic oligonucleotide
tcaggtggctcacttcattgcgtccgtgcaccatc

SEQ ID NO: 167179 - DNA, 35 bp, Artificial Sequence
  Synthetic oligonucleotide
tccaggtgtacttgcccatctgttaccctgccatc

SEQ ID NO: 167180 - DNA, 35 bp, Artificial Sequence
  Synthetic oligonucleotide
atgatatcaacctccatgccgccacaggacagctc

SEQ ID NO: 167181 - DNA, 35 bp, Artificial Sequence
  Synthetic oligonucleotide
tccaccggtaccgtgtctttgcccgcaatccgctc

SEQ ID NO: 167182 - DNA, 35 bp, Artificial Sequence
  Synthetic oligonucleotide
attgtggcgcccacacatgttctacttttcttttc

SEQ ID NO: 167183 - DNA, 35 bp, Artificial Sequence
  Synthetic oligonucleotide
ttagtgtaacaggggagggggcggaaggaaacgag

SEQ ID NO: 167184 - DNA, 35 bp, Artificial Sequence
  Synthetic oligonucleotide
tcttgccctccacgctcaactccagctcgctaccg

SEQ ID NO: 167185 - DNA, 34 bp, Artificial Sequence
  Synthetic oligonucleotide
atctaccctccatctggtgcgcaaatgagccccg

SEQ ID NO: 167186 - DNA, 35 bp, Artificial Sequence
  Synthetic oligonucleotide
tactcccacccccaatgtcgacatcttgtgccccg

SEQ ID NO: 167187 - DNA, 35 bp, Artificial Sequence
  Synthetic oligonucleotide
tgaacctacgtcgcagatacattcttgtcctcccg

SEQ ID NO: 167188 - DNA, 35 bp, Artificial Sequence
  Synthetic oligonucleotide
ttcccgccgattacctgcgacccactcccacgccg

SEQ ID NO: 167189 - DNA, 35 bp, Artificial Sequence
  Synthetic oligonucleotide
tggaccgctcttgttgtcacgcataccctccgccg

SEQ ID NO: 167190 - DNA, 34 bp, Artificial Sequence
  Synthetic oligonucleotide
tcaccgccccactatgccgagcttatgtactgcg

SEQ ID NO: 167191 - DNA, 35 bp, Artificial Sequence
  Synthetic oligonucleotide
ttccgctacctcggctgttaattgccactcattcg

SEQ ID NO: 167192 - DNA, 35 bp, Artificial Sequence
  Synthetic oligonucleotide
ttcatgcctcccttcaatcggttccaggcccttcg

SEQ ID NO: 167193 - DNA, 35 bp, Artificial Sequence
  Synthetic oligonucleotide
atagcccaccaccacctcgccatcgatcctcattg

SEQ ID NO: 167194 - DNA, 35 bp, Artificial Sequence
  Synthetic oligonucleotide
acacaccaccgaacatgttcgccgttccgctcttg

SEQ ID NO: 167195 - DNA, 35 bp, Artificial Sequence
  Synthetic oligonucleotide
ggggggaccccacatctccgccgacccgctttaat

SEQ ID NO: 167196 - DNA, 35 bp, Artificial Sequence
  Synthetic oligonucleotide
gggacaacaggacggacgagaagggggaggagtat

SEQ ID NO: 167197 - DNA, 35 bp, Artificial Sequence
  Synthetic oligonucleotide
tcgccccccagccgtgcgtagcaatccactgttat

SEQ ID NO: 167198 - DNA, 35 bp, Artificial Sequence
  Synthetic oligonucleotide
tcacctcgcttcctctactagcaaacagcatacct

SEQ ID NO: 167199 - DNA, 35 bp, Artificial Sequence
  Synthetic oligonucleotide
agggacaccggtggcgtacctgttcctgtcctgct

SEQ ID NO: 167200 - DNA, 35 bp, Artificial Sequence
  Synthetic oligonucleotide
taccccatcgttgttatggacgtcctgccccctct

SEQ ID NO: 167201 - DNA, 35 bp, Artificial Sequence
  Synthetic oligonucleotide
tcccattcgcctggtgctcgttgctttttccttct

SEQ ID NO: 167202 - DNA, 35 bp, Artificial Sequence
  Synthetic oligonucleotide
acgcatgcacctatcgtattcaccgtttcacccgt

SEQ ID NO: 167203 - DNA, 35 bp, Artificial Sequence
  Synthetic oligonucleotide
gaatgcagtgcagggaagggacaggttgttcgcgt

SEQ ID NO: 167204 - DNA, 35 bp, Artificial Sequence
  Synthetic oligonucleotide
taccgtgtccaactgccgtattctatccttatcgt

SEQ ID NO: 167205 - DNA, 35 bp, Artificial Sequence
  Synthetic oligonucleotide
ttgatgcactcccttttgtgcggtttgttcttatt

SEQ ID NO: 167206 - DNA, 35 bp, Artificial Sequence
  Synthetic oligonucleotide
acctcatccccgcatggcttgtgggcattatcctt

SEQ ID NO: 167207 - DNA, 35 bp, Artificial Sequence
  Synthetic oligonucleotide
actgcgttcacattatcccggtccctctcctcgtt

SEQ ID NO: 167208 - DNA, 35 bp, Artificial Sequence
  Synthetic oligonucleotide
aaaggatggtagtggaaggaagggagggcgaggtt

SEQ ID NO: 167209 - DNA, 35 bp, Artificial Sequence
  Synthetic oligonucleotide
tctagtgcacattgtactaggtccctcaactcttt

SEQ ID NO: 167210 - DNA, 35 bp, Artificial Sequence
  Synthetic oligonucleotide
atactgaggtggagagggggacgtaggtgaagaaa

SEQ ID NO: 167211 - DNA, 35 bp, Artificial Sequence
  Synthetic oligonucleotide
tctggccccctctccgtttggcttcttgttcacaa

SEQ ID NO: 167212 - DNA, 35 bp, Artificial Sequence
  Synthetic oligonucleotide
gacacgtgcgtaatgccgtgagcttccctttccaa

SEQ ID NO: 167213 - DNA, 36 bp, Artificial Sequence
  Synthetic oligonucleotide
gactgtgctagggggaaagggagggagtttgggcaa

SEQ ID NO: 167214 - DNA, 36 bp, Artificial Sequence
  Synthetic oligonucleotide
gagtggagcgaggggggcgttagggacggacaagaa

SEQ ID NO: 167215 - DNA, 35 bp, Artificial Sequence
  Synthetic oligonucleotide
gagggggggcgggaggaagcattacgggccgataa

SEQ ID NO: 167216 - DNA, 36 bp, Artificial Sequence
  Synthetic oligonucleotide
gcgaacaacggggggacatggggtaatggtgggtaa

SEQ ID NO: 167217 - DNA, 36 bp, Artificial Sequence
  Synthetic oligonucleotide
aacaccacctttctatccttatttatgccagttaca

SEQ ID NO: 167218 - DNA, 36 bp, Artificial Sequence
  Synthetic oligonucleotide
tccgccgcctttcatcttgcgtcctagttggcccca

SEQ ID NO: 167219 - DNA, 36 bp, Artificial Sequence
  Synthetic oligonucleotide
tgtttcgccagtccctttctgtcttccatgtctcca

SEQ ID NO: 167220 - DNA, 36 bp, Artificial Sequence
  Synthetic oligonucleotide
gagcctggtccgtgttcacttgtccctgcccccgca

SEQ ID NO: 167221 - DNA, 35 bp, Artificial Sequence
  Synthetic oligonucleotide
gccaatgcctggcttgttcgcccatcactctcgca

SEQ ID NO: 167222 - DNA, 36 bp, Artificial Sequence
  Synthetic oligonucleotide
acccgcccctgtggctttcgcccgccttattgatca

SEQ ID NO: 167223 - DNA, 36 bp, Artificial Sequence
  Synthetic oligonucleotide
acgtgcacctcatgccttcatctccgcgctttttca

SEQ ID NO: 167224 - DNA, 37 bp, Artificial Sequence
  Synthetic oligonucleotide
gtagcacagagggaggagaaggggcaaagagctaaga

SEQ ID NO: 167225 - DNA, 37 bp, Artificial Sequence
  Synthetic oligonucleotide
tcaccccctcacatactggcccagtcctacaaataga

SEQ ID NO: 167226 - DNA, 37 bp, Artificial Sequence
  Synthetic oligonucleotide
ttggtggaaggtggaggccatggggggaggctctaga

SEQ ID NO: 167227 - DNA, 36 bp, Artificial Sequence
  Synthetic oligonucleotide
acacctccgtgttcaatgtacggcccccccccacga

SEQ ID NO: 167228 - DNA, 37 bp, Artificial Sequence
  Synthetic oligonucleotide
gcaaccctcctctaaaccgtgcccgtcgcatgcccga

SEQ ID NO: 167229 - DNA, 37 bp, Artificial Sequence
  Synthetic oligonucleotide
tttggctggcctagccaggttcgtttctttccgccga

SEQ ID NO: 167230 - DNA, 36 bp, Artificial Sequence
  Synthetic oligonucleotide
gacctgggcccagctgtattctgcctctaccatcga

SEQ ID NO: 167231 - DNA, 37 bp, Artificial Sequence
  Synthetic oligonucleotide
gagggggacccgggggagggaggttgaacgcgatcga

SEQ ID NO: 167232 - DNA, 37 bp, Artificial Sequence
  Synthetic oligonucleotide
tgcccacaagcggaaggtaccccacccccctcttcga

SEQ ID NO: 167233 - DNA, 36 bp, Artificial Sequence
  Synthetic oligonucleotide
acaggagacatgacggtggaggcggggcaagcagga

SEQ ID NO: 167234 - DNA, 37 bp, Artificial Sequence
  Synthetic oligonucleotide
acgttggggcacaagggggtacagggattggggagga

SEQ ID NO: 167235 - DNA, 37 bp, Artificial Sequence
  Synthetic oligonucleotide
catgacgggtggaggtctggggtgagtggatttagga

SEQ ID NO: 167236 - DNA, 37 bp, Artificial Sequence
  Synthetic oligonucleotide
ggtacgcgccgccgcccctctagttgcttctctcgga

SEQ ID NO: 167237 - DNA, 36 bp, Artificial Sequence
  Synthetic oligonucleotide
gatgaaagcggcggggtgcaacagggaaggacggga

SEQ ID NO: 167238 - DNA, 37 bp, Artificial Sequence
  Synthetic oligonucleotide
actacaggagagcgggagggcggggtgagtctcggga

SEQ ID NO: 167239 - DNA, 36 bp, Artificial Sequence
  Synthetic oligonucleotide
gggtgaacggcgggggactatacagggggccgggga

SEQ ID NO: 167240 - DNA, 37 bp, Artificial Sequence
  Synthetic oligonucleotide
gtgtcaagtgaagggaacaagcaggggtggtggggga

SEQ ID NO: 167241 - DNA, 37 bp, Artificial Sequence
  Synthetic oligonucleotide
ggagatgtgggagtggaagcggaggggcttggtggga

SEQ ID NO: 167242 - DNA, 35 bp, Artificial Sequence
  Synthetic oligonucleotide
aaccgcatcccatcttgttgtctgcatttcctgga

SEQ ID NO: 167243 - DNA, 38 bp, Artificial Sequence
  Synthetic oligonucleotide
tccacctccgctcttcattaatacaagtcttgtcatga

SEQ ID NO: 167244 - DNA, 37 bp, Artificial Sequence
  Synthetic oligonucleotide
tcatgggggtgggtgggaacggggaaattgtagatga

SEQ ID NO: 167245 - DNA, 37 bp, Artificial Sequence
  Synthetic oligonucleotide
gggagtggggcggggagagacgggttggggtgtatga

SEQ ID NO: 167246 - DNA, 38 bp, Artificial Sequence
  Synthetic oligonucleotide
tccaacgcaaaacgtgttctattccgctccttcactga

SEQ ID NO: 167247 - DNA, 37 bp, Artificial Sequence
  Synthetic oligonucleotide
tgttgtcgccattgtcatgcccccgtccatctcctga

SEQ ID NO: 167248 - DNA, 38 bp, Artificial Sequence
  Synthetic oligonucleotide
ttgcactaggaggggaggagggaagcgaggggagctga

SEQ ID NO: 167249 - DNA, 38 bp, Artificial Sequence
  Synthetic oligonucleotide
acaacagcaaatctgtctcactcccatctttccgctga

SEQ ID NO: 167250 - DNA, 38 bp, Artificial Sequence
  Synthetic oligonucleotide
atacgccgagccgctgttttccttgcacccttcgctga

SEQ ID NO: 167251 - DNA, 37 bp, Artificial Sequence
  Synthetic oligonucleotide
tgtaccagaggcggggtaatcaggggaagggaggtga

SEQ ID NO: 167252 - DNA, 37 bp, Artificial Sequence
  Synthetic oligonucleotide
gacccgcaacatccgtagcacgccccatgttccttga

SEQ ID NO: 167253 - DNA, 38 bp, Artificial Sequence
  Synthetic oligonucleotide
aataccgccaccctgttcttcttgtgcacaccgcttga

SEQ ID NO: 167254 - DNA, 36 bp, Artificial Sequence
  Synthetic oligonucleotide
gtcgcaccccctccaatcccccaggctatactttga

SEQ ID NO: 167255 - DNA, 37 bp, Artificial Sequence
  Synthetic oligonucleotide
tcacaacgcagtttcgccaccctgccataacttttga

SEQ ID NO: 167256 - DNA, 35 bp, Artificial Sequence
  Synthetic oligonucleotide
atgtgcttgccatccgatcctcatctctccacata

SEQ ID NO: 167257 - DNA, 36 bp, Artificial Sequence
  Synthetic oligonucleotide
tgacctaccggccgcaagttaaccctgccttccata

SEQ ID NO: 167258 - DNA, 36 bp, Artificial Sequence
  Synthetic oligonucleotide
cacaccgccacgcatacatccgccttacccacgcta

SEQ ID NO: 167259 - DNA, 36 bp, Artificial Sequence
  Synthetic oligonucleotide
tcctcccatcagctagttctatcttcggtacgtcta

SEQ ID NO: 167260 - DNA, 35 bp, Artificial Sequence
  Synthetic oligonucleotide
gcacgtgcgatggcccctcctctacatcctacgta

SEQ ID NO: 167261 - DNA, 36 bp, Artificial Sequence
  Synthetic oligonucleotide
gcaccggcgcccctgtacctcgcccgttcctccgta

SEQ ID NO: 167262 - DNA, 36 bp, Artificial Sequence
  Synthetic oligonucleotide
gcacacgcgccctcgctcgactcgttcatcctcgta

SEQ ID NO: 167263 - DNA, 36 bp, Artificial Sequence
  Synthetic oligonucleotide
tcctttgcgcgatcgtgcgtcctacctttgcgctta

SEQ ID NO: 167264 - DNA, 36 bp, Artificial Sequence
  Synthetic oligonucleotide
actcccccggatcccgcgtatactcacctatgctta

SEQ ID NO: 167265 - DNA, 36 bp, Artificial Sequence
  Synthetic oligonucleotide
agtgtccgcgcaacctcccaacacctcactgcttta

SEQ ID NO: 167266 - DNA, 35 bp, Artificial Sequence
  Synthetic oligonucleotide
tacacaccatgcatttccgttactagggatcccac

SEQ ID NO: 167267 - DNA, 35 bp, Artificial Sequence
  Synthetic oligonucleotide
gagaagcgatggctgtccacctttgtccgctttac

SEQ ID NO: 167268 - DNA, 34 bp, Artificial Sequence
  Synthetic oligonucleotide
acgaacagtaccacctgtcgtttgtgaacccacc

SEQ ID NO: 167269 - DNA, 35 bp, Artificial Sequence
  Synthetic oligonucleotide
gggttatcgctccatctcgcagtgacccgatcccc

SEQ ID NO: 167270 - DNA, 35 bp, Artificial Sequence
  Synthetic oligonucleotide
acgtacaccaccgcccccgacgctgtggactcccc

SEQ ID NO: 167271 - DNA, 35 bp, Artificial Sequence
  Synthetic oligonucleotide
gtcgaccgtcgaacgctaacagacgtctcctcccc

SEQ ID NO: 167272 - DNA, 35 bp, Artificial Sequence
  Synthetic oligonucleotide
tcacaacctctgaaatgacgcgattctggctcccc

SEQ ID NO: 167273 - DNA, 35 bp, Artificial Sequence
  Synthetic oligonucleotide
gacaggtatagtcgctcatacgcccccttttgccc

SEQ ID NO: 167274 - DNA, 35 bp, Artificial Sequence
  Synthetic oligonucleotide
ttaagccccgctttcgttacccgcttcttggcgcc

SEQ ID NO: 167275 - DNA, 35 bp, Artificial Sequence
  Synthetic oligonucleotide
ggatgcgcgttgttcttcggtccgtgatttcctcc

SEQ ID NO: 167276 - DNA, 35 bp, Artificial Sequence
  Synthetic oligonucleotide
tcatttcgcccctagccagcgtatattcccagtcc

SEQ ID NO: 167277 - DNA, 35 bp, Artificial Sequence
  Synthetic oligonucleotide
taccatgccttccccctgtgttttgccttctgtcc

SEQ ID NO: 167278 - DNA, 35 bp, Artificial Sequence
  Synthetic oligonucleotide
gataccaccgcacgcttggctacttccttttgtcc

SEQ ID NO: 167279 - DNA, 35 bp, Artificial Sequence
  Synthetic oligonucleotide
tagatcggcccgctctccgtgacttttgcgcttcc

SEQ ID NO: 167280 - DNA, 35 bp, Artificial Sequence
  Synthetic oligonucleotide
actacctcacgccatccacaccacgtctgatcagc

SEQ ID NO: 167281 - DNA, 35 bp, Artificial Sequence
  Synthetic oligonucleotide
ggagcctgcttaacgtaacctctcgccgtcctggc

SEQ ID NO: 167282 - DNA, 35 bp, Artificial Sequence
  Synthetic oligonucleotide
aacccaccgataatcctttttctgcgctcccttgc

SEQ ID NO: 167283 - DNA, 35 bp, Artificial Sequence
  Synthetic oligonucleotide
gccctccccgcccgtcgttcacccgttactcttgc

SEQ ID NO: 167284 - DNA, 35 bp, Artificial Sequence
  Synthetic oligonucleotide
gtccacaacattgcatccatcacaccttccgttgc

SEQ ID NO: 167285 - DNA, 35 bp, Artificial Sequence
  Synthetic oligonucleotide
actcatgatcccgcgccgcagactttactgccatc

SEQ ID NO: 167286 - DNA, 35 bp, Artificial Sequence
  Synthetic oligonucleotide
tagctgccacgcaccgttccatccggataacactc

SEQ ID NO: 167287 - DNA, 35 bp, Artificial Sequence
  Synthetic oligonucleotide
tactctctgacctgcctccttgtgttgcccccctc

SEQ ID NO: 167288 - DNA, 35 bp, Artificial Sequence
  Synthetic oligonucleotide
gcagcccacgccccgatgactcctccccccggctc

SEQ ID NO: 167289 - DNA, 35 bp, Artificial Sequence
  Synthetic oligonucleotide
tcactccgttcagtatgctctcctcaatgtttctc

SEQ ID NO: 167290 - DNA, 35 bp, Artificial Sequence
  Synthetic oligonucleotide
ataggctcacctctggtccgctgatcttgtccttc

SEQ ID NO: 167291 - DNA, 34 bp, Artificial Sequence
  Synthetic oligonucleotide
aagctagcacacatccgtatcttctatcactttc

SEQ ID NO: 167292 - DNA, 35 bp, Artificial Sequence
  Synthetic oligonucleotide
aaccctattgcagcaccccgaccctatgcgctttc

SEQ ID NO: 167293 - DNA, 36 bp, Artificial Sequence
  Synthetic oligonucleotide
gcgaaacggcatgtattacgtcgcgcccttgctttc

SEQ ID NO: 167294 - DNA, 35 bp, Artificial Sequence
  Synthetic oligonucleotide
gaccctcccccggtgcctccgacatccatgttttc

SEQ ID NO: 167295 - DNA, 35 bp, Artificial Sequence
  Synthetic oligonucleotide
gtgaggggagtgacggggcgaggtcgcgagtacag

SEQ ID NO: 167296 - DNA, 34 bp, Artificial Sequence
  Synthetic oligonucleotide
gtactgtcactgtccctgcctccccttttcaacg

SEQ ID NO: 167297 - DNA, 35 bp, Artificial Sequence
  Synthetic oligonucleotide
gctgagcgggtgggtggagggtctcggggtgaccg

SEQ ID NO: 167298 - DNA, 34 bp, Artificial Sequence
  Synthetic oligonucleotide
gtacgtcaccaacgggtctgcccatgtttctccg

SEQ ID NO: 167299 - DNA, 35 bp, Artificial Sequence
  Synthetic oligonucleotide
ttgcccgcgctcgtccgtttctgtcctacatcgcg

SEQ ID NO: 167300 - DNA, 35 bp, Artificial Sequence
  Synthetic oligonucleotide
gtcacgcctcccatctatctcacgcagccgtatcg

SEQ ID NO: 167301 - DNA, 35 bp, Artificial Sequence
  Synthetic oligonucleotide
aaaagggcacggtccatgtgcttactcccccctcg

SEQ ID NO: 167302 - DNA, 35 bp, Artificial Sequence
  Synthetic oligonucleotide
gtcgagaaggttggtggcggggggcgcaatggagg

SEQ ID NO: 167303 - DNA, 35 bp, Artificial Sequence
  Synthetic oligonucleotide
gcacactcgttgtccctgggccccttcgatcctgg

SEQ ID NO: 167304 - DNA, 35 bp, Artificial Sequence
  Synthetic oligonucleotide
acacgcgtatctctttagccccctttcgctccatg

SEQ ID NO: 167305 - DNA, 31 bp, Artificial Sequence
  Synthetic oligonucleotide
taaccagccattcggcccacccttgttcttg

SEQ ID NO: 167306 - DNA, 35 bp, Artificial Sequence
  Synthetic oligonucleotide
gcccacgccttgtcccgccgtttctttgttaaaat

SEQ ID NO: 167307 - DNA, 35 bp, Artificial Sequence
  Synthetic oligonucleotide
accgagcccgggtagatgggggggttcgggctaat

SEQ ID NO: 167308 - DNA, 35 bp, Artificial Sequence
  Synthetic oligonucleotide
gcccaacccctccgctaccgtatggtgcatgccat

SEQ ID NO: 167309 - DNA, 35 bp, Artificial Sequence
  Synthetic oligonucleotide
ttcgatccatcatactatacctgcacttggagact

SEQ ID NO: 167310 - DNA, 35 bp, Artificial Sequence
  Synthetic oligonucleotide
gctcgccctcctgttgcctccgagcagattggact

SEQ ID NO: 167311 - DNA, 35 bp, Artificial Sequence
  Synthetic oligonucleotide
ttgtggcccaccctggttctcgtgactccctcgct

SEQ ID NO: 167312 - DNA, 35 bp, Artificial Sequence
  Synthetic oligonucleotide
gaccaccatttgccctgctcgacttcttcgaggct

SEQ ID NO: 167313 - DNA, 35 bp, Artificial Sequence
  Synthetic oligonucleotide
tcaccctttacccgttttgaacgcgccttctggct

SEQ ID NO: 167314 - DNA, 35 bp, Artificial Sequence
  Synthetic oligonucleotide
gacgcggcatggcttccgcctctgacatcacctct

SEQ ID NO: 167315 - DNA, 35 bp, Artificial Sequence
  Synthetic oligonucleotide
tccgcaccaaactattcgatatcctgtgctcctct

SEQ ID NO: 167316 - DNA, 35 bp, Artificial Sequence
  Synthetic oligonucleotide
tccaggctcgcctcgttccaacacctcacctcagt

SEQ ID NO: 167317 - DNA, 35 bp, Artificial Sequence
  Synthetic oligonucleotide
attaccgcgcactagctcttctcaccactcctcgt

SEQ ID NO: 167318 - DNA, 35 bp, Artificial Sequence
  Synthetic oligonucleotide
gtggaggggtaacgggtccgggggaaagcgggggt

SEQ ID NO: 167319 - DNA, 35 bp, Artificial Sequence
  Synthetic oligonucleotide
acaccgggggggaaagggtgggaacgagaaccatt

SEQ ID NO: 167320 - DNA, 35 bp, Artificial Sequence
  Synthetic oligonucleotide
cctgtcctgcccatgagtcctctctgttccacctt

SEQ ID NO: 167321 - DNA, 35 bp, Artificial Sequence
  Synthetic oligonucleotide
tgtgtccccggcccgaattaaaccagccctacctt

SEQ ID NO: 167322 - DNA, 35 bp, Artificial Sequence
  Synthetic oligonucleotide
acctccgcggtccaacctgttcgccctgtgccctt

SEQ ID NO: 167323 - DNA, 35 bp, Artificial Sequence
  Synthetic oligonucleotide
gcctcgcacacgtactatctccccctcttttagtt

SEQ ID NO: 167324 - DNA, 35 bp, Artificial Sequence
  Synthetic oligonucleotide
gactggggagaaggcgggctaaggtgagggttaaa

SEQ ID NO: 167325 - DNA, 36 bp, Artificial Sequence
  Synthetic oligonucleotide
agtccggccgtcctcgtttatgctcccccatgcaca

SEQ ID NO: 167326 - DNA, 36 bp, Artificial Sequence
  Synthetic oligonucleotide
gctgacgctgtcgtggcctccccgttgctttctaca

SEQ ID NO: 167327 - DNA, 35 bp, Artificial Sequence
  Synthetic oligonucleotide
tcgacatccgtgaggccgttcacactccttttcca

SEQ ID NO: 167328 - DNA, 36 bp, Artificial Sequence
  Synthetic oligonucleotide
gcccacccagccactcattccttgcccaactccgca

SEQ ID NO: 167329 - DNA, 36 bp, Artificial Sequence
  Synthetic oligonucleotide
gccagtggtggtcggtcggggttttgcggtggatca

SEQ ID NO: 167330 - DNA, 36 bp, Artificial Sequence
  Synthetic oligonucleotide
gaggcctccctcccattgcattttgtacagcactca

SEQ ID NO: 167331 - DNA, 36 bp, Artificial Sequence
  Synthetic oligonucleotide
tccccgtccaacgtattgcgtcttctttatttctca

SEQ ID NO: 167332 - DNA, 36 bp, Artificial Sequence
  Synthetic oligonucleotide
gcacatcgtcatgcccgcgtaatcactcgcccgtca

SEQ ID NO: 167333 - DNA, 34 bp, Artificial Sequence
  Synthetic oligonucleotide
gcatcgcatctgggtcccgccttatcgttcttca

SEQ ID NO: 167334 - DNA, 36 bp, Artificial Sequence
  Synthetic oligonucleotide
gccccccttatgggtatcccgtttctcgtttgttca

SEQ ID NO: 167335 - DNA, 37 bp, Artificial Sequence
  Synthetic oligonucleotide
taatctcagacaggtaggacggaagggacgggggaga

SEQ ID NO: 167336 - DNA, 37 bp, Artificial Sequence
  Synthetic oligonucleotide
gcccgccacgcccaacctatggtttcatcgaacccga

SEQ ID NO: 167337 - DNA, 37 bp, Artificial Sequence
  Synthetic oligonucleotide
attcacgcccgcactgccctcctcggctagatgccga

SEQ ID NO: 167338 - DNA, 37 bp, Artificial Sequence
  Synthetic oligonucleotide
tgatccacctacctcggctgcgcccctccccatccga

SEQ ID NO: 167339 - DNA, 37 bp, Artificial Sequence
  Synthetic oligonucleotide
aacaacctcaatttgctctctccatccgcccaggcga

SEQ ID NO: 167340 - DNA, 37 bp, Artificial Sequence
  Synthetic oligonucleotide
tgtgctcacccccatctcgtgctaaccgaacactcga

SEQ ID NO: 167341 - DNA, 37 bp, Artificial Sequence
  Synthetic oligonucleotide
ggtcacacgtccggtttcccatcacacgcctactcga

SEQ ID NO: 167342 - DNA, 36 bp, Artificial Sequence
  Synthetic oligonucleotide
gtgcgatctaccgcccctccgcccagttcacctcga

SEQ ID NO: 167343 - DNA, 37 bp, Artificial Sequence
  Synthetic oligonucleotide
agctacgactagggggggccagggacacgggaaagga

SEQ ID NO: 167344 - DNA, 37 bp, Artificial Sequence
  Synthetic oligonucleotide
atcggggtggggaggctacgggtcgaaggaggaggga

SEQ ID NO: 167345 - DNA, 37 bp, Artificial Sequence
  Synthetic oligonucleotide
tgagagggcaggtgggggggtgaagcggagaactgga

SEQ ID NO: 167346 - DNA, 37 bp, Artificial Sequence
  Synthetic oligonucleotide
tggggcggaggcggggtggagaggagggtcggctgga

SEQ ID NO: 167347 - DNA, 37 bp, Artificial Sequence
  Synthetic oligonucleotide
gagcggggaattgggtggcggaggtcgttcgagtgga

SEQ ID NO: 167348 - DNA, 36 bp, Artificial Sequence
  Synthetic oligonucleotide
agtgtgagggtgctaggaggggcgttggggattgga

SEQ ID NO: 167349 - DNA, 38 bp, Artificial Sequence
  Synthetic oligonucleotide
tcgcatgcctcacacatattttgctacacttgccctga

SEQ ID NO: 167350 - DNA, 38 bp, Artificial Sequence
  Synthetic oligonucleotide
tcaccccgcacagcctccacccgctgtccctcctctga

SEQ ID NO: 167351 - DNA, 38 bp, Artificial Sequence
  Synthetic oligonucleotide
gccgccgtcacactttgaacacttctctcaccgtctga

SEQ ID NO: 167352 - DNA, 33 bp, Artificial Sequence
  Synthetic oligonucleotide
tgtaccaacctaaccccagccgaccgcccgtga

SEQ ID NO: 167353 - DNA, 37 bp, Artificial Sequence
  Synthetic oligonucleotide
acggtcgcaggggggacgaggggcgtggtggcggtga

SEQ ID NO: 167354 - DNA, 37 bp, Artificial Sequence
  Synthetic oligonucleotide
tggggagtgaggtggagtggagtgggttggagggtga

SEQ ID NO: 167355 - DNA, 35 bp, Artificial Sequence
  Synthetic oligonucleotide
taagggtaggtgattgggggtggagggaatggtga

SEQ ID NO: 167356 - DNA, 38 bp, Artificial Sequence
  Synthetic oligonucleotide
gtaacgtcgggtggtggtcggggtcgggttggtggtga

SEQ ID NO: 167357 - DNA, 38 bp, Artificial Sequence
  Synthetic oligonucleotide
gtacgcagatggactcgattcgtccctctttgccttga

SEQ ID NO: 167358 - DNA, 38 bp, Artificial Sequence
  Synthetic oligonucleotide
atcccgccgccatacttcctcgactgctgtctttttga

SEQ ID NO: 167359 - DNA, 35 bp, Artificial Sequence
  Synthetic oligonucleotide
agacgccgaccctgaatacatgccactcgtaccta

SEQ ID NO: 167360 - DNA, 35 bp, Artificial Sequence
  Synthetic oligonucleotide
agacactacccccatttacgccgacgctcgcccta

SEQ ID NO: 167361 - DNA, 36 bp, Artificial Sequence
  Synthetic oligonucleotide
gtcctccgatcccgtgcttcgtgctccacgcctcta

SEQ ID NO: 167362 - DNA, 36 bp, Artificial Sequence
  Synthetic oligonucleotide
ggtcaccactcatctgcccaattcccgtaccttcta

SEQ ID NO: 167363 - DNA, 36 bp, Artificial Sequence
  Synthetic oligonucleotide
atcgcctcccccgttggcttgcctggaccaccagta

SEQ ID NO: 167364 - DNA, 35 bp, Artificial Sequence
  Synthetic oligonucleotide
ttgctcacctcgttctcagccgtaccaccgctgta

SEQ ID NO: 167365 - DNA, 36 bp, Artificial Sequence
  Synthetic oligonucleotide
atcctaccgcctcattgcccgacagagctctattta

SEQ ID NO: 167366 - DNA, 36 bp, Artificial Sequence
  Synthetic oligonucleotide
aacaacgggaagaaaggaagggggaggcgtagttta

SEQ ID NO: 167367 - DNA, 35 bp, Artificial Sequence
  Synthetic oligonucleotide
atacccacctgcgccgtcctctcgggtcttgctac

SEQ ID NO: 167368 - DNA, 35 bp, Artificial Sequence
  Synthetic oligonucleotide
gttactcctcactgcggggccatccgatttccacc

SEQ ID NO: 167369 - DNA, 35 bp, Artificial Sequence
  Synthetic oligonucleotide
ttgcctagcgcgctcttgattccgtctgtttcacc

SEQ ID NO: 167370 - DNA, 35 bp, Artificial Sequence
  Synthetic oligonucleotide
gtttattccgtgccctgcctactcgcaccgaaccc

SEQ ID NO: 167371 - DNA, 35 bp, Artificial Sequence
  Synthetic oligonucleotide
tccaacaatgcccaggcccgtgccgcaacctcccc

SEQ ID NO: 167372 - DNA, 35 bp, Artificial Sequence
  Synthetic oligonucleotide
tctactgtcctagcccctacgccgccatccagccc

SEQ ID NO: 167373 - DNA, 35 bp, Artificial Sequence
  Synthetic oligonucleotide
ttcgagcaaccgcccccgtctgactgtgcgttccc

SEQ ID NO: 167374 - DNA, 35 bp, Artificial Sequence
  Synthetic oligonucleotide
gcccagaggccccaccgccaaacgatctgctagcc

SEQ ID NO: 167375 - DNA, 35 bp, Artificial Sequence
  Synthetic oligonucleotide
tactatacccggcaccctctcttctgtgcaacgcc

SEQ ID NO: 167376 - DNA, 35 bp, Artificial Sequence
  Synthetic oligonucleotide
gtagccgcaccttattaccctcattcccgcgggcc

SEQ ID NO: 167377 - DNA, 35 bp, Artificial Sequence
  Synthetic oligonucleotide
ttgtcgcatggcatcccctgctcgaaccttcccgc

SEQ ID NO: 167378 - DNA, 33 bp, Artificial Sequence
  Synthetic oligonucleotide
acaaccctccgccactcatcgctcgttcatcgc

SEQ ID NO: 167379 - DNA, 35 bp, Artificial Sequence
  Synthetic oligonucleotide
gcatgtaggaggggggcagggcgggtggaacatgc

SEQ ID NO: 167380 - DNA, 35 bp, Artificial Sequence
  Synthetic oligonucleotide
atacgcgagtacttcctaggccttcccgctcctgc

SEQ ID NO: 167381 - DNA, 35 bp, Artificial Sequence
  Synthetic oligonucleotide
aaactcccgccgggtcgtaccacactttcttctgc

SEQ ID NO: 167382 - DNA, 35 bp, Artificial Sequence
  Synthetic oligonucleotide
tagtggcacagttgccccgttgttcccttctaatc

SEQ ID NO: 167383 - DNA, 35 bp, Artificial Sequence
  Synthetic oligonucleotide
gtccgcaccccgttgtctagtttctatcgcccatc

SEQ ID NO: 167384 - DNA, 35 bp, Artificial Sequence
  Synthetic oligonucleotide
gccctgtaggcccactttgagcacgggctcacctc

SEQ ID NO: 167385 - DNA, 35 bp, Artificial Sequence
  Synthetic oligonucleotide
attcccccagaggttatgtccgggtcatccgcctc

SEQ ID NO: 167386 - DNA, 35 bp, Artificial Sequence
  Synthetic oligonucleotide
ttgtgcagatcagacagtctccataccgtcgcctc

SEQ ID NO: 167387 - DNA, 35 bp, Artificial Sequence
  Synthetic oligonucleotide
tccaagcgcgcgccaacactgcaccatttcgtctc

SEQ ID NO: 167388 - DNA, 34 bp, Artificial Sequence
  Synthetic oligonucleotide
gtctcgctccacctgcctctctgactattatgtc

SEQ ID NO: 167389 - DNA, 35 bp, Artificial Sequence
  Synthetic oligonucleotide
gcacgacgcccctactgctggcccggtgcttattc

SEQ ID NO: 167390 - DNA, 35 bp, Artificial Sequence
  Synthetic oligonucleotide
tttgctatccccactgggcctcccgttgtaccttc

SEQ ID NO: 167391 - DNA, 35 bp, Artificial Sequence
  Synthetic oligonucleotide
tgcatcacatccctggcccttactttgcttttcag

SEQ ID NO: 167392 - DNA, 35 bp, Artificial Sequence
  Synthetic oligonucleotide
gacgagccttctatccgggattcctgtctcctacg

SEQ ID NO: 167393 - DNA, 35 bp, Artificial Sequence
  Synthetic oligonucleotide
aagcgccgccccctgggacctacgtgaaacccccg

SEQ ID NO: 167394 - DNA, 35 bp, Artificial Sequence
  Synthetic oligonucleotide
acactgaggcggctggaaatatcggggggagggcg

SEQ ID NO: 167395 - DNA, 35 bp, Artificial Sequence
  Synthetic oligonucleotide
acagctcgctccctgaccccgcctagtgttcatcg

SEQ ID NO: 167396 - DNA, 35 bp, Artificial Sequence
  Synthetic oligonucleotide
accgcaattcccccttgtcttcccttagctctggg

SEQ ID NO: 167397 - DNA, 35 bp, Artificial Sequence
  Synthetic oligonucleotide
tcccccggcctcccccgcactgaagaatatgcgtg

SEQ ID NO: 167398 - DNA, 35 bp, Artificial Sequence
  Synthetic oligonucleotide
gactacgtgcgaaatataccaccaatcacttcttg

SEQ ID NO: 167399 - DNA, 35 bp, Artificial Sequence
  Synthetic oligonucleotide
aaacgcactgcccgggcgacccgcttcccatcaat

SEQ ID NO: 167400 - DNA, 35 bp, Artificial Sequence
  Synthetic oligonucleotide
acctacgaccaaccctgcctcacgtgccctgacat

SEQ ID NO: 167401 - DNA, 35 bp, Artificial Sequence
  Synthetic oligonucleotide
ttatcccgcagcaagccttctccgccgtcgctgat

SEQ ID NO: 167402 - DNA, 35 bp, Artificial Sequence
  Synthetic oligonucleotide
tcaactccgcgcatcacaccttcgaggccgttcct

SEQ ID NO: 167403 - DNA, 35 bp, Artificial Sequence
  Synthetic oligonucleotide
ggacggctggtaccacctcgtcgcgcccctctgct

SEQ ID NO: 167404 - DNA, 35 bp, Artificial Sequence
  Synthetic oligonucleotide
actcgcgtcccacctgctctatgctcggccgtgct

SEQ ID NO: 167405 - DNA, 35 bp, Artificial Sequence
  Synthetic oligonucleotide
agcctcgacctcagccgtcagcccttctctttgct

SEQ ID NO: 167406 - DNA, 35 bp, Artificial Sequence
  Synthetic oligonucleotide
gtgcgctacagtaagagggggggaggaaggatagt

SEQ ID NO: 167407 - DNA, 35 bp, Artificial Sequence
  Synthetic oligonucleotide
gtggggcggggcggctcaagtgggggtgggatcgt

SEQ ID NO: 167408 - DNA, 35 bp, Artificial Sequence
  Synthetic oligonucleotide
actgcgtggttgtccatccgccttcctgccacggt

SEQ ID NO: 167409 - DNA, 35 bp, Artificial Sequence
  Synthetic oligonucleotide
tgtgagcgagcatacttcatcgccctgttcttggt

SEQ ID NO: 167410 - DNA, 35 bp, Artificial Sequence
  Synthetic oligonucleotide
tccgccgccactcctactttattgttcactctgtt

SEQ ID NO: 167411 - DNA, 36 bp, Artificial Sequence
  Synthetic oligonucleotide
gcaccactccgtcactctcttcgccttttggatcaa

SEQ ID NO: 167412 - DNA, 36 bp, Artificial Sequence
  Synthetic oligonucleotide
gcccacgcacactcgccgatatggccagcccctcaa

SEQ ID NO: 167413 - DNA, 36 bp, Artificial Sequence
  Synthetic oligonucleotide
gattctcatcccgctcgcctgtactgtctactagaa

SEQ ID NO: 167414 - DNA, 35 bp, Artificial Sequence
  Synthetic oligonucleotide
tcacgggggaggggaacgggtaaaatggcggtgaa

SEQ ID NO: 167415 - DNA, 36 bp, Artificial Sequence
  Synthetic oligonucleotide
acatgggagggatgtacatacgggggggaattccca

SEQ ID NO: 167416 - DNA, 36 bp, Artificial Sequence
  Synthetic oligonucleotide
agacccccccacatgactagacaaccgtgtttccca

SEQ ID NO: 167417 - DNA, 36 bp, Artificial Sequence
  Synthetic oligonucleotide
gggtcgccaccgcctgtaaatcgtccgctctctcca

SEQ ID NO: 167418 - DNA, 33 bp, Artificial Sequence
  Synthetic oligonucleotide
gatgccgtactccgcactatgtcttcctgtcca

SEQ ID NO: 167419 - DNA, 36 bp, Artificial Sequence
  Synthetic oligonucleotide
gaaggagggggacgggagtaagaagaaaagtacgca

SEQ ID NO: 167420 - DNA, 35 bp, Artificial Sequence
  Synthetic oligonucleotide
gaccacgtactctcggtcttaattatagccactca

SEQ ID NO: 167421 - DNA, 35 bp, Artificial Sequence
  Synthetic oligonucleotide
ggccccgcactgctgtctacggtttctcgctctca

SEQ ID NO: 167422 - DNA, 37 bp, Artificial Sequence
  Synthetic oligonucleotide
ggtggagagcagggggcgtagtggagcgggggagaga

SEQ ID NO: 167423 - DNA, 37 bp, Artificial Sequence
  Synthetic oligonucleotide
gcgttggggggggaaaggccggaagaaggacggtaga

SEQ ID NO: 167424 - DNA, 37 bp, Artificial Sequence
  Synthetic oligonucleotide
gctcgccccgcctgtcaagctgcatttccttggccga

SEQ ID NO: 167425 - DNA, 37 bp, Artificial Sequence
  Synthetic oligonucleotide
tccgcctccgtacataatcgccgttgatcccctccga

SEQ ID NO: 167426 - DNA, 36 bp, Artificial Sequence
  Synthetic oligonucleotide
atcagccccctctcattatgtttttgtctcgtccga

SEQ ID NO: 167427 - DNA, 37 bp, Artificial Sequence
  Synthetic oligonucleotide
tgcggcctccaccccttattcagcgcgtcactctcga

SEQ ID NO: 167428 - DNA, 36 bp, Artificial Sequence
  Synthetic oligonucleotide
agtgggggaacggggctgggagagagataaggcgga

SEQ ID NO: 167429 - DNA, 37 bp, Artificial Sequence
  Synthetic oligonucleotide
accgcccacactcttctcaagcccgtccactatcgga

SEQ ID NO: 167430 - DNA, 37 bp, Artificial Sequence
  Synthetic oligonucleotide
tcactcgccactattcgccgccacactcctaccggga

SEQ ID NO: 167431 - DNA, 36 bp, Artificial Sequence
  Synthetic oligonucleotide
gagagcggccagcaggggggtttctgggggcgggga

SEQ ID NO: 167432 - DNA, 38 bp, Artificial Sequence
  Synthetic oligonucleotide
gggtagaggggcacgggggacgggaactggacaaatga

SEQ ID NO: 167433 - DNA, 38 bp, Artificial Sequence
  Synthetic oligonucleotide
gcacgcccctccaggccatattactgtcccgccactga

SEQ ID NO: 167434 - DNA, 38 bp, Artificial Sequence
  Synthetic oligonucleotide
tacctcgtcccgccatgtagcgcccggtccctcactga

SEQ ID NO: 167435 - DNA, 29 bp, Artificial Sequence
  Synthetic oligonucleotide
gctactccagctgaccccggcccccctga

SEQ ID NO: 167436 - DNA, 38 bp, Artificial Sequence
  Synthetic oligonucleotide
tcaagcgacgacactatctttgatgccactccctctga

SEQ ID NO: 167437 - DNA, 38 bp, Artificial Sequence
  Synthetic oligonucleotide
ttaggacgcgaaggggcaaacaaggggaatggacgtga

SEQ ID NO: 167438 - DNA, 38 bp, Artificial Sequence
  Synthetic oligonucleotide
gcgcccaaccctgccgatgcccagcccacctcccgtga

SEQ ID NO: 167439 - DNA, 37 bp, Artificial Sequence
  Synthetic oligonucleotide
agtacgggtaaaggggtgaatgggaataggaaggtga

SEQ ID NO: 167440 - DNA, 37 bp, Artificial Sequence
  Synthetic oligonucleotide
attatccagggtgggagggcactgatacatggggtga

SEQ ID NO: 167441 - DNA, 37 bp, Artificial Sequence
  Synthetic oligonucleotide
gaatgcgtagttctccgccccgaccatctgcccttga

SEQ ID NO: 167442 - DNA, 37 bp, Artificial Sequence
  Synthetic oligonucleotide
gaacgtgagagagggggcaggggggggtacatcttga

SEQ ID NO: 167443 - DNA, 38 bp, Artificial Sequence
  Synthetic oligonucleotide
tcacgccatacgccgctgcataggcttccctttcttga

SEQ ID NO: 167444 - DNA, 35 bp, Artificial Sequence
  Synthetic oligonucleotide
taacccctcccccggcgctctcatctgccttttga

SEQ ID NO: 167445 - DNA, 36 bp, Artificial Sequence
  Synthetic oligonucleotide
gcaagctccatccgctataaaactcccaccgcgcta

SEQ ID NO: 167446 - DNA, 36 bp, Artificial Sequence
  Synthetic oligonucleotide
gaacgcgctatatgttccaccccctctgcttcggta

SEQ ID NO: 167447 - DNA, 35 bp, Artificial Sequence
  Synthetic oligonucleotide
gaccacgggggggggggggagggaaggacaagtta

SEQ ID NO: 167448 - DNA, 35 bp, Artificial Sequence
  Synthetic oligonucleotide
tccaaaccgctgactctgctacttgaaaaattaac

SEQ ID NO: 167449 - DNA, 35 bp, Artificial Sequence
  Synthetic oligonucleotide
tgccaccgctaacttgttctcgtgctctctaccac

SEQ ID NO: 167450 - DNA, 34 bp, Artificial Sequence
  Synthetic oligonucleotide
tagccaacgccgtcttgtttctgcccaccgccac

SEQ ID NO: 167451 - DNA, 35 bp, Artificial Sequence
  Synthetic oligonucleotide
tctcgagggggaggaggggcggttggacggatcac

SEQ ID NO: 167452 - DNA, 35 bp, Artificial Sequence
  Synthetic oligonucleotide
tctcgaacgcctgcccccggaagtggctccgcacc

SEQ ID NO: 167453 - DNA, 35 bp, Artificial Sequence
  Synthetic oligonucleotide
gccaacctgtcgagagtgcgtttcctttcggcccc

SEQ ID NO: 167454 - DNA, 35 bp, Artificial Sequence
  Synthetic oligonucleotide
agccccgtgtgccaccttcctcgtcagtgaacgcc

SEQ ID NO: 167455 - DNA, 35 bp, Artificial Sequence
  Synthetic oligonucleotide
gaaccttctccatgtacaacttatgacgtcccgcc

SEQ ID NO: 167456 - DNA, 35 bp, Artificial Sequence
  Synthetic oligonucleotide
agctggcccggtactcccttctgttccctcgatcc

SEQ ID NO: 167457 - DNA, 35 bp, Artificial Sequence
  Synthetic oligonucleotide
gaccgaactccgtcggagtcatccagttcctatcc

SEQ ID NO: 167458 - DNA, 35 bp, Artificial Sequence
  Synthetic oligonucleotide
tcacggcacttatacgttgattccggccttcttcc

SEQ ID NO: 167459 - DNA, 35 bp, Artificial Sequence
  Synthetic oligonucleotide
accacaccctctagaggcataacattgagtcccgc

SEQ ID NO: 167460 - DNA, 35 bp, Artificial Sequence
  Synthetic oligonucleotide
ttcgccttgacgtattcgcgcatcatcctcttcgc

SEQ ID NO: 167461 - DNA, 35 bp, Artificial Sequence
  Synthetic oligonucleotide
gccgtccggcgcaatccccctactccgtgtctggc

SEQ ID NO: 167462 - DNA, 35 bp, Artificial Sequence
  Synthetic oligonucleotide
tgacgtttcatactgtactatgcgttctccccatc

SEQ ID NO: 167463 - DNA, 35 bp, Artificial Sequence
  Synthetic oligonucleotide
gatcagccatcgctacaacgttctccggggccatc

SEQ ID NO: 167464 - DNA, 35 bp, Artificial Sequence
  Synthetic oligonucleotide
gcccacctttacgcttgtccccattctgatccatc

SEQ ID NO: 167465 - DNA, 35 bp, Artificial Sequence
  Synthetic oligonucleotide
aaaacgcagcccctcctgtgcactacgctccactc

SEQ ID NO: 167466 - DNA, 35 bp, Artificial Sequence
  Synthetic oligonucleotide
tggtgcgcacgccccgggccattctcgctccactc

SEQ ID NO: 167467 - DNA, 35 bp, Artificial Sequence
  Synthetic oligonucleotide
actcgtcaatgtgcctatcttcctgcataaccctc

SEQ ID NO: 167468 - DNA, 35 bp, Artificial Sequence
  Synthetic oligonucleotide
tcacggtccagcactccatcctctggcgcccgctc

SEQ ID NO: 167469 - DNA, 35 bp, Artificial Sequence
  Synthetic oligonucleotide
tcttcgaccgtcgttactaacacccccgctggctc

SEQ ID NO: 167470 - DNA, 36 bp, Artificial Sequence
  Synthetic oligonucleotide
atcgcccatccaattcccccttatgtcgccgtgctc

SEQ ID NO: 167471 - DNA, 35 bp, Artificial Sequence
  Synthetic oligonucleotide
gccgttgtgtcccagtgcaccagcctgtccctgtc

SEQ ID NO: 167472 - DNA, 35 bp, Artificial Sequence
  Synthetic oligonucleotide
tctcagttacaccctgctcttagcgtactgctttc

SEQ ID NO: 167473 - DNA, 35 bp, Artificial Sequence
  Synthetic oligonucleotide
gtggtcgcgcattgtttccttgtctcttcattccg

SEQ ID NO: 167474 - DNA, 35 bp, Artificial Sequence
  Synthetic oligonucleotide
tgttcccccgcccacccgcctataagtggcgacgg

SEQ ID NO: 167475 - DNA, 35 bp, Artificial Sequence
  Synthetic oligonucleotide
ggaaagaaggtggaggtgcgggactcgaggcgggg

SEQ ID NO: 167476 - DNA, 35 bp, Artificial Sequence
  Synthetic oligonucleotide
tgtcccccacactccatgtctctcgcccataatgg

SEQ ID NO: 167477 - DNA, 35 bp, Artificial Sequence
  Synthetic oligonucleotide
aacccacccaccttgccccgaacagcttgggcatg

SEQ ID NO: 167478 - DNA, 35 bp, Artificial Sequence
  Synthetic oligonucleotide
gcgaggacctgtggtggagtgggagggagtagatg

SEQ ID NO: 167479 - DNA, 35 bp, Artificial Sequence
  Synthetic oligonucleotide
tgatacgtgtcgactgtatctgtccccgtcctctg

SEQ ID NO: 167480 - DNA, 35 bp, Artificial Sequence
  Synthetic oligonucleotide
actgcattaccctccgccctgctgaacattttctg

SEQ ID NO: 167481 - DNA, 35 bp, Artificial Sequence
  Synthetic oligonucleotide
actcccgcctgaccccgggcccgacagccaccgtg

SEQ ID NO: 167482 - DNA, 35 bp, Artificial Sequence
  Synthetic oligonucleotide
accggaccgggacgggtacagggtgggtaacgttg

SEQ ID NO: 167483 - DNA, 35 bp, Artificial Sequence
  Synthetic oligonucleotide
atggggcaagcaacgggacgggaatgggaggtttg

SEQ ID NO: 167484 - DNA, 35 bp, Artificial Sequence
  Synthetic oligonucleotide
accatcccgttgttccgtccgtactgaccatacat

SEQ ID NO: 167485 - DNA, 35 bp, Artificial Sequence
  Synthetic oligonucleotide
ttcgactcccatccgccgttgccctaacgacccct

SEQ ID NO: 167486 - DNA, 35 bp, Artificial Sequence
  Synthetic oligonucleotide
ttctgctaggcccgagccgtccacctgttcctcct

SEQ ID NO: 167487 - DNA, 35 bp, Artificial Sequence
  Synthetic oligonucleotide
ttgccgtagccgcagtcgctgacccttccctggct

SEQ ID NO: 167488 - DNA, 35 bp, Artificial Sequence
  Synthetic oligonucleotide
gacccccagtctggtaagcccccctcacactctct

SEQ ID NO: 167489 - DNA, 32 bp, Artificial Sequence
  Synthetic oligonucleotide
gcctaggtccttccttgtaaattcgctcttct

SEQ ID NO: 167490 - DNA, 35 bp, Artificial Sequence
  Synthetic oligonucleotide
aagggggggaagggccgtgtaaaatgcgggaaatt

SEQ ID NO: 167491 - DNA, 35 bp, Artificial Sequence
  Synthetic oligonucleotide
taacatcgctcctgtccagcctccgtacattactt

SEQ ID NO: 167492 - DNA, 35 bp, Artificial Sequence
  Synthetic oligonucleotide
tagggtgtgagagaggggaagtgggaggggtagtt

SEQ ID NO: 167493 - DNA, 35 bp, Artificial Sequence
  Synthetic oligonucleotide
aaaaccggtcgactcggtctcgttccattcctgtt

SEQ ID NO: 167494 - DNA, 35 bp, Artificial Sequence
  Synthetic oligonucleotide
acacatggtgagtgggacgggctgaacggggattt

SEQ ID NO: 167495 - DNA, 35 bp, Artificial Sequence
  Synthetic oligonucleotide
gttgggtagccccccgagtgcttgtccggcccttt

SEQ ID NO: 167496 - DNA, 35 bp, Artificial Sequence
  Synthetic oligonucleotide
acgccagtcggttcatgtcttcgctgccatctttt

SEQ ID NO: 167497 - DNA, 36 bp, Artificial Sequence
  Synthetic oligonucleotide
tctcaaccatctgagctcttcgccctgtccggccaa

SEQ ID NO: 167498 - DNA, 36 bp, Artificial Sequence
  Synthetic oligonucleotide
tggggccaagggggtggaggtaggtgaatggtgcaa

SEQ ID NO: 167499 - DNA, 36 bp, Artificial Sequence
  Synthetic oligonucleotide
accccgcgcgccctgtttcttctccgcttctgtaca

SEQ ID NO: 167500 - DNA, 36 bp, Artificial Sequence
  Synthetic oligonucleotide
agacgactgctacgacgcgtactacctcccgcccca

SEQ ID NO: 167501 - DNA, 35 bp, Artificial Sequence
  Synthetic oligonucleotide
tcccatccgctctctcgtcaagctctggtcctcca

SEQ ID NO: 167502 - DNA, 36 bp, Artificial Sequence
  Synthetic oligonucleotide
acgatgcgctcctcttacgtccaatagcctgccgca

SEQ ID NO: 167503 - DNA, 36 bp, Artificial Sequence
  Synthetic oligonucleotide
ttcgtttgccttcctgtttctcacccctgctccgca

SEQ ID NO: 167504 - DNA, 35 bp, Artificial Sequence
  Synthetic oligonucleotide
ggagccaccacaccttgtcatttaagtatctcgca

SEQ ID NO: 167505 - DNA, 36 bp, Artificial Sequence
  Synthetic oligonucleotide
tgccgcccctatttacgattggacactttctcttca

SEQ ID NO: 167506 - DNA, 36 bp, Artificial Sequence
  Synthetic oligonucleotide
tctccaccctcccatcgaatcttggtcctcgtttca

SEQ ID NO: 167507 - DNA, 37 bp, Artificial Sequence
  Synthetic oligonucleotide
ggacaggaggcaaggacgggactaaaaatagggcaga

SEQ ID NO: 167508 - DNA, 36 bp, Artificial Sequence
  Synthetic oligonucleotide
ttgagcatctgacgtaaactctccttgcctgcccga

SEQ ID NO: 167509 - DNA, 37 bp, Artificial Sequence
  Synthetic oligonucleotide
gagtgcatctgtcacctctctcaacatctgccgccga

SEQ ID NO: 167510 - DNA, 36 bp, Artificial Sequence
  Synthetic oligonucleotide
agtccgtcaccgcctcccataggtcccttctgccga

SEQ ID NO: 167511 - DNA, 37 bp, Artificial Sequence
  Synthetic oligonucleotide
taagccgtgctgttgactttaatgttcctctctccga

SEQ ID NO: 167512 - DNA, 37 bp, Artificial Sequence
  Synthetic oligonucleotide
tatgtacgtgtgggagggactgggagggtctgaagga

SEQ ID NO: 167513 - DNA, 34 bp, Artificial Sequence
  Synthetic oligonucleotide
tagtggggaaggggtggaggttcttgaggtcgga

SEQ ID NO: 167514 - DNA, 37 bp, Artificial Sequence
  Synthetic oligonucleotide
aagggacgggggggtaggccagggtagttaggtcgga

SEQ ID NO: 167515 - DNA, 37 bp, Artificial Sequence
  Synthetic oligonucleotide
gcggtaccatcgcttgctcatactcgcccacttcgga

SEQ ID NO: 167516 - DNA, 36 bp, Artificial Sequence
  Synthetic oligonucleotide
taccctcaccactgtacacacgattcctccaaggga

SEQ ID NO: 167517 - DNA, 37 bp, Artificial Sequence
  Synthetic oligonucleotide
gtcccacctactattacttgccgacccccgccgggga

SEQ ID NO: 167518 - DNA, 37 bp, Artificial Sequence
  Synthetic oligonucleotide
gagttgagggccgtagggcgtggaccggggaggggga

SEQ ID NO: 167519 - DNA, 37 bp, Artificial Sequence
  Synthetic oligonucleotide
gggagggagacaggcggggaattgaggacatggggga

SEQ ID NO: 167520 - DNA, 38 bp, Artificial Sequence
  Synthetic oligonucleotide
agtggagggggttgggccggaggcggtcggaggaatga

SEQ ID NO: 167521 - DNA, 38 bp, Artificial Sequence
  Synthetic oligonucleotide
tcgacgccccatctctgttcagccagccgcccccatga

SEQ ID NO: 167522 - DNA, 38 bp, Artificial Sequence
  Synthetic oligonucleotide
tgtttcgcccaccctgccttcggacctcatgtaactga

SEQ ID NO: 167523 - DNA, 37 bp, Artificial Sequence
  Synthetic oligonucleotide
ccgaaacgccgcagcgctcgcccgccctacccactga

SEQ ID NO: 167524 - DNA, 38 bp, Artificial Sequence
  Synthetic oligonucleotide
tacccgctcacacctgcataaggcctcttaacccctga

SEQ ID NO: 167525 - DNA, 38 bp, Artificial Sequence
  Synthetic oligonucleotide
gcctagccgcacgatcgctgccacccccgctacgctga

SEQ ID NO: 167526 - DNA, 37 bp, Artificial Sequence
  Synthetic oligonucleotide
ttgcgccggcgcatctctacctgctactactacgtga

SEQ ID NO: 167527 - DNA, 38 bp, Artificial Sequence
  Synthetic oligonucleotide
ggaggactggggaaggaggctcctgggaagaggggtga

SEQ ID NO: 167528 - DNA, 38 bp, Artificial Sequence
  Synthetic oligonucleotide
gggggtgcagatactgaggagaggggtcggggatgtga

SEQ ID NO: 167529 - DNA, 37 bp, Artificial Sequence
  Synthetic oligonucleotide
ggaacctactggtgcgggggggacggagagggattga

SEQ ID NO: 167530 - DNA, 38 bp, Artificial Sequence
  Synthetic oligonucleotide
acccaccggagtttcttgctatccatctgtctccttga

SEQ ID NO: 167531 - DNA, 38 bp, Artificial Sequence
  Synthetic oligonucleotide
taccgccctccgccgttattgttgatccctgcagttga

SEQ ID NO: 167532 - DNA, 38 bp, Artificial Sequence
  Synthetic oligonucleotide
tcacactgcttgtgttcacttactctcttccctgttga

SEQ ID NO: 167533 - DNA, 36 bp, Artificial Sequence
  Synthetic oligonucleotide
gtaggaaagggctagtacgcgggtgggtggggaata

SEQ ID NO: 167534 - DNA, 36 bp, Artificial Sequence
  Synthetic oligonucleotide
agcccctgcgctgcccctggacccgactctactata

SEQ ID NO: 167535 - DNA, 35 bp, Artificial Sequence
  Synthetic oligonucleotide
ggtcgacgtccccgctccatttgatcactgtacta

SEQ ID NO: 167536 - DNA, 36 bp, Artificial Sequence
  Synthetic oligonucleotide
gttaacgcccctatcctgtaatttccagcatggcta

SEQ ID NO: 167537 - DNA, 36 bp, Artificial Sequence
  Synthetic oligonucleotide
tcctcccccgggttccaacactgacatgtcttgcta

SEQ ID NO: 167538 - DNA, 36 bp, Artificial Sequence
  Synthetic oligonucleotide
acactcccctccccctcgatggaacggtaacccgta

SEQ ID NO: 167539 - DNA, 36 bp, Artificial Sequence
  Synthetic oligonucleotide
ttgtaaccagcgctgttctccatcctggctccttta

SEQ ID NO: 167540 - DNA, 35 bp, Artificial Sequence
  Synthetic oligonucleotide
tcacccttacacgtacaaggccccctatctgttta

SEQ ID NO: 167541 - DNA, 35 bp, Artificial Sequence
  Synthetic oligonucleotide
atcctacgcctccgcgcaccggcccccggtttaac

SEQ ID NO: 167542 - DNA, 35 bp, Artificial Sequence
  Synthetic oligonucleotide
gcgaggtgcaggccagcgcgtcaccccctttacac

SEQ ID NO: 167543 - DNA, 35 bp, Artificial Sequence
  Synthetic oligonucleotide
gttcgccccgtgctccctgtaatgtcactttccac

SEQ ID NO: 167544 - DNA, 36 bp, Artificial Sequence
  Synthetic oligonucleotide
tgtcaggtcgcagcctatttcttccacctctacgac

SEQ ID NO: 167545 - DNA, 35 bp, Artificial Sequence
  Synthetic oligonucleotide
gccgtgccttactgcttacccgcgggcctaactac

SEQ ID NO: 167546 - DNA, 35 bp, Artificial Sequence
  Synthetic oligonucleotide
gagatcgccacaggtgatcccggtaacccttctac

SEQ ID NO: 167547 - DNA, 35 bp, Artificial Sequence
  Synthetic oligonucleotide
gactgaccctaaggccttgtaccctctcgtgaccc

SEQ ID NO: 167548 - DNA, 35 bp, Artificial Sequence
  Synthetic oligonucleotide
ggacccgctcacccttgatatttcgtgctcacccc

SEQ ID NO: 167549 - DNA, 35 bp, Artificial Sequence
  Synthetic oligonucleotide
gacggaccctagtgccgcgtaagctcccttgcccc

SEQ ID NO: 167550 - DNA, 35 bp, Artificial Sequence
  Synthetic oligonucleotide
attggcgatctccgccgtccgtaacccatccgccc

SEQ ID NO: 167551 - DNA, 34 bp, Artificial Sequence
  Synthetic oligonucleotide
tgtcgctgcatactttcgccccttacgtgctgcc

SEQ ID NO: 167552 - DNA, 35 bp, Artificial Sequence
  Synthetic oligonucleotide
agcccggcaccgggctctatcgctgaccctcatcc

SEQ ID NO: 167553 - DNA, 35 bp, Artificial Sequence
  Synthetic oligonucleotide
gttgcctatccgtcagtacgaatcccccttgctcc

SEQ ID NO: 167554 - DNA, 35 bp, Artificial Sequence
  Synthetic oligonucleotide
actgggagactcgcatgtcctccttcccgttctcc

SEQ ID NO: 167555 - DNA, 35 bp, Artificial Sequence
  Synthetic oligonucleotide
atccgctaccccttaacacgtatcctcgctcgtcc

SEQ ID NO: 167556 - DNA, 35 bp, Artificial Sequence
  Synthetic oligonucleotide
tgacaccctcaaggtcccgtttcgctctagtttcc

SEQ ID NO: 167557 - DNA, 35 bp, Artificial Sequence
  Synthetic oligonucleotide
tgttcccgactgccaactatcttcgtcacacaagc

SEQ ID NO: 167558 - DNA, 35 bp, Artificial Sequence
  Synthetic oligonucleotide
atggaggtcgcgggcctctatctgttcctttccgc

SEQ ID NO: 167559 - DNA, 35 bp, Artificial Sequence
  Synthetic oligonucleotide
gtcaccgcaggtcaactggatcacgttccccgcgc

SEQ ID NO: 167560 - DNA, 35 bp, Artificial Sequence
  Synthetic oligonucleotide
acgttcgatctcccgccctcacttagcccgctcgc

SEQ ID NO: 167561 - DNA, 35 bp, Artificial Sequence
  Synthetic oligonucleotide
gcacgctaatgtgtgcgcatgttccctctttctgc

SEQ ID NO: 167562 - DNA, 35 bp, Artificial Sequence
  Synthetic oligonucleotide
ttacatgccctccagcggtcttcaagtcaactatc

SEQ ID NO: 167563 - DNA, 35 bp, Artificial Sequence
  Synthetic oligonucleotide
gcttcgactcgacctccccttgtgttcctcctatc

SEQ ID NO: 167564 - DNA, 35 bp, Artificial Sequence
  Synthetic oligonucleotide
atccgctctttgccgtttcttctcgacgcctactc

SEQ ID NO: 167565 - DNA, 35 bp, Artificial Sequence
  Synthetic oligonucleotide
accttcgtgacagccgcactcatctcttcgtcctc

SEQ ID NO: 167566 - DNA, 35 bp, Artificial Sequence
  Synthetic oligonucleotide
gcaggtgcctgtgcctatctctagtctttctgctc

SEQ ID NO: 167567 - DNA, 35 bp, Artificial Sequence
  Synthetic oligonucleotide
ttgcgggacacatgtccgctaatccacttttgctc

SEQ ID NO: 167568 - DNA, 35 bp, Artificial Sequence
  Synthetic oligonucleotide
gccatgacatcaagcgtcagcttcttggtcctctc

SEQ ID NO: 167569 - DNA, 35 bp, Artificial Sequence
  Synthetic oligonucleotide
tctggccgtaccatcgcgacaccattgacttagtc

SEQ ID NO: 167570 - DNA, 35 bp, Artificial Sequence
  Synthetic oligonucleotide
tgattgacctccttgctttacactggcaccaattc

SEQ ID NO: 167571 - DNA, 35 bp, Artificial Sequence
  Synthetic oligonucleotide
gcccacgctgaattccgccacagctctgcccattc

SEQ ID NO: 167572 - DNA, 35 bp, Artificial Sequence
  Synthetic oligonucleotide
gtgtgcaccccgaaactctgcttcttctgtacttc

SEQ ID NO: 167573 - DNA, 35 bp, Artificial Sequence
  Synthetic oligonucleotide
gcatcgcgcctgtctactccctgttactcgtcttc

SEQ ID NO: 167574 - DNA, 35 bp, Artificial Sequence
  Synthetic oligonucleotide
ttcgcggtcaccgttccctaccaacaccagagttc

SEQ ID NO: 167575 - DNA, 35 bp, Artificial Sequence
  Synthetic oligonucleotide
gtcggaacccaccaaaccatgttaccgcactgttc

SEQ ID NO: 167576 - DNA, 35 bp, Artificial Sequence
  Synthetic oligonucleotide
ataaccggcgggcaggagggagcgagggaacacag

SEQ ID NO: 167577 - DNA, 35 bp, Artificial Sequence
  Synthetic oligonucleotide
atgggggagtcggtggtggtttggggcgaaggtag

SEQ ID NO: 167578 - DNA, 35 bp, Artificial Sequence
  Synthetic oligonucleotide
gaagagcagtcagggcggctggggtggggatcacg

SEQ ID NO: 167579 - DNA, 35 bp, Artificial Sequence
  Synthetic oligonucleotide
tgacgtctacgagcttaagcgtctcaccccccccg

SEQ ID NO: 167580 - DNA, 35 bp, Artificial Sequence
  Synthetic oligonucleotide
tgccctccctcagtcccctactggcgtttgtcccg

SEQ ID NO: 167581 - DNA, 35 bp, Artificial Sequence
  Synthetic oligonucleotide
actctgtgggggggcgggtacggggaatctggccg

SEQ ID NO: 167582 - DNA, 35 bp, Artificial Sequence
  Synthetic oligonucleotide
actcggaccgttgctctgctcccgcacataccctg

SEQ ID NO: 167583 - DNA, 35 bp, Artificial Sequence
  Synthetic oligonucleotide
gagagggaacgaacgaatgagcgggggtgtgagtg

SEQ ID NO: 167584 - DNA, 35 bp, Artificial Sequence
  Synthetic oligonucleotide
actatacccgcctcaatgataatcagcccccgaat

SEQ ID NO: 167585 - DNA, 35 bp, Artificial Sequence
  Synthetic oligonucleotide
tatccgcagtaccgtagcctctcactatgccccat

SEQ ID NO: 167586 - DNA, 35 bp, Artificial Sequence
  Synthetic oligonucleotide
tgtaggccttggcgcggtaactgctcacttctcct

SEQ ID NO: 167587 - DNA, 35 bp, Artificial Sequence
  Synthetic oligonucleotide
gaccccctcttccaacactgcccgctccagaagct

SEQ ID NO: 167588 - DNA, 35 bp, Artificial Sequence
  Synthetic oligonucleotide
ttcggtgctctgttccgctctcactgtctctagct

SEQ ID NO: 167589 - DNA, 35 bp, Artificial Sequence
  Synthetic oligonucleotide
agtgcatatcattgcccgcccgaggtccacccgct

SEQ ID NO: 167590 - DNA, 35 bp, Artificial Sequence
  Synthetic oligonucleotide
gatataccacccaggccttgtaaaagctctgttct

SEQ ID NO: 167591 - DNA, 35 bp, Artificial Sequence
  Synthetic oligonucleotide
gtaacgggggggagtcgcaaaagggaggcgccagt

SEQ ID NO: 167592 - DNA, 35 bp, Artificial Sequence
  Synthetic oligonucleotide
tgcccccgcatggcccccttacgatgatcctggtt

SEQ ID NO: 167593 - DNA, 35 bp, Artificial Sequence
  Synthetic oligonucleotide
agtcccgacgcagcctggttccttctcttgtacaa

SEQ ID NO: 167594 - DNA, 36 bp, Artificial Sequence
  Synthetic oligonucleotide
acccatctctggtctttatgcgctccctgtactcaa

SEQ ID NO: 167595 - DNA, 36 bp, Artificial Sequence
  Synthetic oligonucleotide
tacctgccgggggggggtaaaatgctgtggagggaa

SEQ ID NO: 167596 - DNA, 35 bp, Artificial Sequence
  Synthetic oligonucleotide
gagatcgaggaaggaagatagaaatggtgttggaa

SEQ ID NO: 167597 - DNA, 35 bp, Artificial Sequence
  Synthetic oligonucleotide
tgcacggtctgtcttttttgtcaccatggcctgaa

SEQ ID NO: 167598 - DNA, 34 bp, Artificial Sequence
  Synthetic oligonucleotide
ccccacccttcccatgtcatgcttttcttttgaa

SEQ ID NO: 167599 - DNA, 35 bp, Artificial Sequence
  Synthetic oligonucleotide
ttgtaccaacgcctaaagctgccctccaccaccca

SEQ ID NO: 167600 - DNA, 35 bp, Artificial Sequence
  Synthetic oligonucleotide
gcgacgaccaccagccggtctgactctaccaccca

SEQ ID NO: 167601 - DNA, 35 bp, Artificial Sequence
  Synthetic oligonucleotide
tgccaccattcatcccgcacaactccgacggccca

SEQ ID NO: 167602 - DNA, 31 bp, Artificial Sequence
  Synthetic oligonucleotide
atgatccacctgggagagggctaccttccca

SEQ ID NO: 167603 - DNA, 36 bp, Artificial Sequence
  Synthetic oligonucleotide
aatgtgacgccggcacatgtcctccgacccccgcca

SEQ ID NO: 167604 - DNA, 36 bp, Artificial Sequence
  Synthetic oligonucleotide
acaccacactccgccgataatctgttaacctatcca

SEQ ID NO: 167605 - DNA, 35 bp, Artificial Sequence
  Synthetic oligonucleotide
tatgcccgatcctactttcacccagtgcctctcca

SEQ ID NO: 167606 - DNA, 36 bp, Artificial Sequence
  Synthetic oligonucleotide
gcagaccccacgcccgcccaccttccaagctacgca

SEQ ID NO: 167607 - DNA, 36 bp, Artificial Sequence
  Synthetic oligonucleotide
tgacgctcacctcgtcgccattgctatctattttca

SEQ ID NO: 167608 - DNA, 36 bp, Artificial Sequence
  Synthetic oligonucleotide
gtgaggactgcgggggcgtttgggggcggggaaaga

SEQ ID NO: 167609 - DNA, 37 bp, Artificial Sequence
  Synthetic oligonucleotide
ttcgggtaacaaggtggaggggtagggccggggaaga

SEQ ID NO: 167610 - DNA, 37 bp, Artificial Sequence
  Synthetic oligonucleotide
gcaacgagaacaggggcagggtagaagaggggccaga

SEQ ID NO: 167611 - DNA, 37 bp, Artificial Sequence
  Synthetic oligonucleotide
tgtgccccctcaccccattatgccgcccgcttcgaga

SEQ ID NO: 167612 - DNA, 37 bp, Artificial Sequence
  Synthetic oligonucleotide
ttcgggcacatcccaccttctttcgccgtccgcacga

SEQ ID NO: 167613 - DNA, 37 bp, Artificial Sequence
  Synthetic oligonucleotide
gccgctgccaattccttacgggcctgctttcttacga

SEQ ID NO: 167614 - DNA, 37 bp, Artificial Sequence
  Synthetic oligonucleotide
taccagacgccccgctgagccctctccagatccccga

SEQ ID NO: 167615 - DNA, 36 bp, Artificial Sequence
  Synthetic oligonucleotide
gagaggggggtcggagagagacggagagaaacgcga

SEQ ID NO: 167616 - DNA, 37 bp, Artificial Sequence
  Synthetic oligonucleotide
attccgctgcctgtttcttgcccatccacatatgcga

SEQ ID NO: 167617 - DNA, 36 bp, Artificial Sequence
  Synthetic oligonucleotide
acacccttccgacttcgttcccacgacgagactcga

SEQ ID NO: 167618 - DNA, 34 bp, Artificial Sequence
  Synthetic oligonucleotide
accccattcttcctatgcgctggaaccttctcga

SEQ ID NO: 167619 - DNA, 37 bp, Artificial Sequence
  Synthetic oligonucleotide
tccatgcccggcctgcggtaatccctgcttttctcga

SEQ ID NO: 167620 - DNA, 37 bp, Artificial Sequence
  Synthetic oligonucleotide
acgccacgggcggcgggggtgggggtatggatttcga

SEQ ID NO: 167621 - DNA, 37 bp, Artificial Sequence
  Synthetic oligonucleotide
tccaccacttcccccgctctgagacgtagcgtttcga

SEQ ID NO: 167622 - DNA, 37 bp, Artificial Sequence
  Synthetic oligonucleotide
aacgaatggtccagacagagggcgtggggcgggggga

SEQ ID NO: 167623 - DNA, 37 bp, Artificial Sequence
  Synthetic oligonucleotide
gtggaaagtacaggggcaagcgaatgggagggatgga

SEQ ID NO: 167624 - DNA, 37 bp, Artificial Sequence
  Synthetic oligonucleotide
gccacctcaagactccttctccataatgcctgctgga

SEQ ID NO: 167625 - DNA, 38 bp, Artificial Sequence
  Synthetic oligonucleotide
tcatcccactccccagtgaataacgctagtttaaatga

SEQ ID NO: 167626 - DNA, 37 bp, Artificial Sequence
  Synthetic oligonucleotide
taccaaacgcagatttatcgccttcttccacacctga

SEQ ID NO: 167627 - DNA, 38 bp, Artificial Sequence
  Synthetic oligonucleotide
tagcccgccctcgctgggtgcaatccctcttatcctga

SEQ ID NO: 167628 - DNA, 36 bp, Artificial Sequence
  Synthetic oligonucleotide
acgagcctcccgctctgcttaccctttcactcgtga

SEQ ID NO: 167629 - DNA, 38 bp, Artificial Sequence
  Synthetic oligonucleotide
tgagtgtgggcaggatgagggggggttgaagttcgtga

SEQ ID NO: 167630 - DNA, 36 bp, Artificial Sequence
  Synthetic oligonucleotide
ttgttcgcctccgatcgcattcactcacaaccttga

SEQ ID NO: 167631 - DNA, 37 bp, Artificial Sequence
  Synthetic oligonucleotide
gcccatcctcacctgccccccaggcagtgccccttga

SEQ ID NO: 167632 - DNA, 37 bp, Artificial Sequence
  Synthetic oligonucleotide
tgttacctctgccctgtcaaacttcactttcccttga

SEQ ID NO: 167633 - DNA, 38 bp, Artificial Sequence
  Synthetic oligonucleotide
tagccctgatgtcgtcctcgcacgccgcccctgcttga

SEQ ID NO: 167634 - DNA, 38 bp, Artificial Sequence
  Synthetic oligonucleotide
gggggtaagggcccgggggaggataaggatgaagttga

SEQ ID NO: 167635 - DNA, 36 bp, Artificial Sequence
  Synthetic oligonucleotide
tgcctccgacgcttcccgcctgacccgtgttttata

SEQ ID NO: 167636 - DNA, 35 bp, Artificial Sequence
  Synthetic oligonucleotide
gccccccccccggccattgttaatgtacacaacta

SEQ ID NO: 167637 - DNA, 36 bp, Artificial Sequence
  Synthetic oligonucleotide
acactcctcgccgcaatacagtatgcttccccccta

SEQ ID NO: 167638 - DNA, 35 bp, Artificial Sequence
  Synthetic oligonucleotide
gtccgccatggcccttgggtctactcccccgccta

SEQ ID NO: 167639 - DNA, 36 bp, Artificial Sequence
  Synthetic oligonucleotide
ttacgccctaccgcttgtgctcctcggccatgccta

SEQ ID NO: 167640 - DNA, 36 bp, Artificial Sequence
  Synthetic oligonucleotide
acttgccgtccctcgagccttcaaactgttgtccta

SEQ ID NO: 167641 - DNA, 35 bp, Artificial Sequence
  Synthetic oligonucleotide
taagcgtgccattcagttttgtcgtcgtccctcta

SEQ ID NO: 167642 - DNA, 36 bp, Artificial Sequence
  Synthetic oligonucleotide
accccctcgccggctcgcaatatcccctctgcatta

SEQ ID NO: 167643 - DNA, 36 bp, Artificial Sequence
  Synthetic oligonucleotide
tccgtctcggcctccattagcttatcctccgtttta

SEQ ID NO: 167644 - DNA, 35 bp, Artificial Sequence
  Synthetic oligonucleotide
agtgactagctctcggtcaccgcctcttttgccac

SEQ ID NO: 167645 - DNA, 35 bp, Artificial Sequence
  Synthetic oligonucleotide
tgcatgcaccgtgccaacgcgcgctccttgtccac

SEQ ID NO: 167646 - DNA, 35 bp, Artificial Sequence
  Synthetic oligonucleotide
ggaggctctgacgccccgacgttctttcctgcacc

SEQ ID NO: 167647 - DNA, 35 bp, Artificial Sequence
  Synthetic oligonucleotide
gctgccacccgccggtaacagtacaaacttgtacc

SEQ ID NO: 167648 - DNA, 35 bp, Artificial Sequence
  Synthetic oligonucleotide
tgtgtatccgttctcagcccgccagcccgtcaccc

SEQ ID NO: 167649 - DNA, 35 bp, Artificial Sequence
  Synthetic oligonucleotide
acacccggcctccgatccgcaaattatctccgccc

SEQ ID NO: 167650 - DNA, 35 bp, Artificial Sequence
  Synthetic oligonucleotide
tgcacgcactcgttctggcttccggactaattccc

SEQ ID NO: 167651 - DNA, 35 bp, Artificial Sequence
  Synthetic oligonucleotide
aatccgcggtgcttctgttagttccctccccagcc

SEQ ID NO: 167652 - DNA, 35 bp, Artificial Sequence
  Synthetic oligonucleotide
accctgtgctcgccctgatgtcactcctatccgcc

SEQ ID NO: 167653 - DNA, 35 bp, Artificial Sequence
  Synthetic oligonucleotide
aaaaccgcctgttcgcccgcaaggccacactcgcc

SEQ ID NO: 167654 - DNA, 35 bp, Artificial Sequence
  Synthetic oligonucleotide
agacctcagtcacgcgaacgcatcagtccctcgcc

SEQ ID NO: 167655 - DNA, 35 bp, Artificial Sequence
  Synthetic oligonucleotide
aagccgatcgccttccccagttcacgacctatgcc

SEQ ID NO: 167656 - DNA, 35 bp, Artificial Sequence
  Synthetic oligonucleotide
taccctacgatctagcctcgtttcattcgcactcc

SEQ ID NO: 167657 - DNA, 35 bp, Artificial Sequence
  Synthetic oligonucleotide
gccgtggcccctattcctcgttatgccccttgtcc

SEQ ID NO: 167658 - DNA, 35 bp, Artificial Sequence
  Synthetic oligonucleotide
tgagcggctgatgtactattaccatccacccttcc

SEQ ID NO: 167659 - DNA, 34 bp, Artificial Sequence
  Synthetic oligonucleotide
ttcgccgccccattgattgttccatccgtcttcc

SEQ ID NO: 167660 - DNA, 35 bp, Artificial Sequence
  Synthetic oligonucleotide
gcgccgcctggcgttcgtatactcacgtcctttcc

SEQ ID NO: 167661 - DNA, 35 bp, Artificial Sequence
  Synthetic oligonucleotide
agtgtgcattccgcaatgcgcaccgatccttttcc

SEQ ID NO: 167662 - DNA, 35 bp, Artificial Sequence
  Synthetic oligonucleotide
accattccacgacgaacgttctagccgtagcccgc

SEQ ID NO: 167663 - DNA, 35 bp, Artificial Sequence
  Synthetic oligonucleotide
gttaccagcagttcattcatatccgtacctgccgc

SEQ ID NO: 167664 - DNA, 35 bp, Artificial Sequence
  Synthetic oligonucleotide
ttgtatcgggcgggtgggtaagggggctagtccgc

SEQ ID NO: 167665 - DNA, 35 bp, Artificial Sequence
  Synthetic oligonucleotide
accaccgacatgttcggtatcccgatttcattcgc

SEQ ID NO: 167666 - DNA, 35 bp, Artificial Sequence
  Synthetic oligonucleotide
gtgcaatggcaatgggtaggggaaattggggcggc

SEQ ID NO: 167667 - DNA, 35 bp, Artificial Sequence
  Synthetic oligonucleotide
gcctccgcccacgtaatcaacccacatacccctgc

SEQ ID NO: 167668 - DNA, 35 bp, Artificial Sequence
  Synthetic oligonucleotide
agcccacccaccttgcctctaggagtccttcctgc

SEQ ID NO: 167669 - DNA, 35 bp, Artificial Sequence
  Synthetic oligonucleotide
atccgcacgggcgcccccccccatcggacaacatc

SEQ ID NO: 167670 - DNA, 35 bp, Artificial Sequence
  Synthetic oligonucleotide
gacgggcgggtcattcgtccacgtcgcccctactc

SEQ ID NO: 167671 - DNA, 35 bp, Artificial Sequence
  Synthetic oligonucleotide
acttaacgccgccccttttatattggttgctactc

SEQ ID NO: 167672 - DNA, 35 bp, Artificial Sequence
  Synthetic oligonucleotide
actccgcttgctactgcctatctatgtgcaccctc

SEQ ID NO: 167673 - DNA, 35 bp, Artificial Sequence
  Synthetic oligonucleotide
agcgatgccccgctgttcggtgctgcttacccctc

SEQ ID NO: 167674 - DNA, 35 bp, Artificial Sequence
  Synthetic oligonucleotide
tcacccaacgcatctatacgtttgacctatccctc

SEQ ID NO: 167675 - DNA, 35 bp, Artificial Sequence
  Synthetic oligonucleotide
aagcaccagcccccgtgaacgccctccgctatgtc

SEQ ID NO: 167676 - DNA, 35 bp, Artificial Sequence
  Synthetic oligonucleotide
gacgccctctttgcccatggcgatgctaccttgtc

SEQ ID NO: 167677 - DNA, 35 bp, Artificial Sequence
  Synthetic oligonucleotide
tgagcccttgtgttcagtctgtcgctgcttccttc

SEQ ID NO: 167678 - DNA, 35 bp, Artificial Sequence
  Synthetic oligonucleotide
gcccttgccgagtcctgctgcgagttcacccgttc

SEQ ID NO: 167679 - DNA, 35 bp, Artificial Sequence
  Synthetic oligonucleotide
acatcgcggggtggctggtcggtggggtgagggag

SEQ ID NO: 167680 - DNA, 35 bp, Artificial Sequence
  Synthetic oligonucleotide
gtgccacgccttatcccttatcatgggccgacccg

SEQ ID NO: 167681 - DNA, 35 bp, Artificial Sequence
  Synthetic oligonucleotide
tcccaccacctttgggctatcctgaccgtcttccg

SEQ ID NO: 167682 - DNA, 35 bp, Artificial Sequence
  Synthetic oligonucleotide
gcacatcttcattattcgcctccgaaccactttcg

SEQ ID NO: 167683 - DNA, 35 bp, Artificial Sequence
  Synthetic oligonucleotide
acgtatgagcgtaacaggggagggtggtggggagg

SEQ ID NO: 167684 - DNA, 35 bp, Artificial Sequence
  Synthetic oligonucleotide
gatctggagaattgagggggcacagtaatgggagg

SEQ ID NO: 167685 - DNA, 35 bp, Artificial Sequence
  Synthetic oligonucleotide
atctcgcccacccgactgatcccctgaattccggg

SEQ ID NO: 167686 - DNA, 35 bp, Artificial Sequence
  Synthetic oligonucleotide
gtaagggtggggaagtggggtatgcactcctgggg

SEQ ID NO: 167687 - DNA, 35 bp, Artificial Sequence
  Synthetic oligonucleotide
tcgtagaggcaagttcctctcattcgcccaccatg

SEQ ID NO: 167688 - DNA, 35 bp, Artificial Sequence
  Synthetic oligonucleotide
gtttcgcctcccgcctccatgtttaaacctgcatg

SEQ ID NO: 167689 - DNA, 35 bp, Artificial Sequence
  Synthetic oligonucleotide
gaccgaaccacgtgtatactcatcccttctcactg

SEQ ID NO: 167690 - DNA, 35 bp, Artificial Sequence
  Synthetic oligonucleotide
tctggctaagcgctcgattttcataccatcctctg

SEQ ID NO: 167691 - DNA, 35 bp, Artificial Sequence
  Synthetic oligonucleotide
tcctccactatgccggagcacccatcactttcttg

SEQ ID NO: 167692 - DNA, 35 bp, Artificial Sequence
  Synthetic oligonucleotide
gtaaggacgaggaaaggcgggtggacgtagcgttg

SEQ ID NO: 167693 - DNA, 35 bp, Artificial Sequence
  Synthetic oligonucleotide
tgctgaagaggcgggggggagaagatgagagcgat

SEQ ID NO: 167694 - DNA, 35 bp, Artificial Sequence
  Synthetic oligonucleotide
ttcatcgctactgcccaaccgcctgcgcctctact

SEQ ID NO: 167695 - DNA, 35 bp, Artificial Sequence
  Synthetic oligonucleotide
tcgcacgatgctcttgtagacctgccataccacct

SEQ ID NO: 167696 - DNA, 35 bp, Artificial Sequence
  Synthetic oligonucleotide
gttcgtaatatgcccgggccactccctgctcccct

SEQ ID NO: 167697 - DNA, 35 bp, Artificial Sequence
  Synthetic oligonucleotide
tcagcccctgccttgactcgatatccttgttgcct

SEQ ID NO: 167698 - DNA, 35 bp, Artificial Sequence
  Synthetic oligonucleotide
tacgtccgtatctggtccactcttaaagtcctcct

SEQ ID NO: 167699 - DNA, 35 bp, Artificial Sequence
  Synthetic oligonucleotide
tgacctgatacacgctgcacccccccatacctgct

SEQ ID NO: 167700 - DNA, 35 bp, Artificial Sequence
  Synthetic oligonucleotide
gtcgccccgtagtccccctcgttttctcctgctct

SEQ ID NO: 167701 - DNA, 35 bp, Artificial Sequence
  Synthetic oligonucleotide
tactcgccgttgttccccactatcctgcacgcagt

SEQ ID NO: 167702 - DNA, 35 bp, Artificial Sequence
  Synthetic oligonucleotide
tggtggtgtccacgcccctctgctatttgtaccgt

SEQ ID NO: 167703 - DNA, 35 bp, Artificial Sequence
  Synthetic oligonucleotide
gcaccatggctacccctgccaccctccccttgggt

SEQ ID NO: 167704 - DNA, 35 bp, Artificial Sequence
  Synthetic oligonucleotide
agatcaccgcctcgccgtactccctcactgcctgt

SEQ ID NO: 167705 - DNA, 35 bp, Artificial Sequence
  Synthetic oligonucleotide
ggtcgaagtcgacgaatcgccgctccctatcctgt

SEQ ID NO: 167706 - DNA, 35 bp, Artificial Sequence
  Synthetic oligonucleotide
ttggcgccattctgcattacaccgattacaccctt

SEQ ID NO: 167707 - DNA, 35 bp, Artificial Sequence
  Synthetic oligonucleotide
tgcgagctgatctaatcaagccccaatgttccctt

SEQ ID NO: 167708 - DNA, 35 bp, Artificial Sequence
  Synthetic oligonucleotide
gcaacgaccgttcctgcatccgcctgttactcctt

SEQ ID NO: 167709 - DNA, 35 bp, Artificial Sequence
  Synthetic oligonucleotide
tgcaccttcatgttaaaccccccaagtcgttcctt

SEQ ID NO: 167710 - DNA, 35 bp, Artificial Sequence
  Synthetic oligonucleotide
tgcgagcctctccatcctagtatcgatttccgctt

SEQ ID NO: 167711 - DNA, 35 bp, Artificial Sequence
  Synthetic oligonucleotide
agccgactagccccctgcaaaagccctgatccgtt

SEQ ID NO: 167712 - DNA, 36 bp, Artificial Sequence
  Synthetic oligonucleotide
tcctcacataccgctggtacccgccccccgtaccaa

SEQ ID NO: 167713 - DNA, 35 bp, Artificial Sequence
  Synthetic oligonucleotide
aactcaccctccgatttattcctggtgttccccaa

SEQ ID NO: 167714 - DNA, 35 bp, Artificial Sequence
  Synthetic oligonucleotide
gaataggggagggatgtaactgggccggggtcgaa

SEQ ID NO: 167715 - DNA, 36 bp, Artificial Sequence
  Synthetic oligonucleotide
gcccacgctctagcaccaattcgcctccttacggaa

SEQ ID NO: 167716 - DNA, 36 bp, Artificial Sequence
  Synthetic oligonucleotide
gcatcacctcttccatgtcacccaactgtgtcaaca

SEQ ID NO: 167717 - DNA, 36 bp, Artificial Sequence
  Synthetic oligonucleotide
ttgccggggcgggatgtttccgagggcgggtgaaca

SEQ ID NO: 167718 - DNA, 35 bp, Artificial Sequence
  Synthetic oligonucleotide
gtactccccagcaagcattgcccccgattcccaca

SEQ ID NO: 167719 - DNA, 36 bp, Artificial Sequence
  Synthetic oligonucleotide
tctgtccccgcccctcccagtgccagcaagtttaca

SEQ ID NO: 167720 - DNA, 35 bp, Artificial Sequence
  Synthetic oligonucleotide
attgcccacgttcggttccaccattgctgatacca

SEQ ID NO: 167721 - DNA, 36 bp, Artificial Sequence
  Synthetic oligonucleotide
gatccatgcgtgagagtccactaacccgccctacca

SEQ ID NO: 167722 - DNA, 36 bp, Artificial Sequence
  Synthetic oligonucleotide
tcacatccctcaccgtgccttgtcgccatggaccca

SEQ ID NO: 167723 - DNA, 36 bp, Artificial Sequence
  Synthetic oligonucleotide
acccaacctcatcttcaaagccgtcccttgcggcca

SEQ ID NO: 167724 - DNA, 36 bp, Artificial Sequence
  Synthetic oligonucleotide
tcaaccctgctccttccccggcctgcatcactgcca

SEQ ID NO: 167725 - DNA, 35 bp, Artificial Sequence
  Synthetic oligonucleotide
accattcaacatgtttaatgctataccctgttcca

SEQ ID NO: 167726 - DNA, 36 bp, Artificial Sequence
  Synthetic oligonucleotide
atcccgctttagcctcccaccacgcccttgtatgca

SEQ ID NO: 167727 - DNA, 34 bp, Artificial Sequence
  Synthetic oligonucleotide
gtgcgcacacgccccgcttgtcacctcctttgca

SEQ ID NO: 167728 - DNA, 36 bp, Artificial Sequence
  Synthetic oligonucleotide
gggcctgaccccattattccacggcctgttatatca

SEQ ID NO: 167729 - DNA, 35 bp, Artificial Sequence
  Synthetic oligonucleotide
tgttcgccactttgcccgcctgttacccacgttca

SEQ ID NO: 167730 - DNA, 37 bp, Artificial Sequence
  Synthetic oligonucleotide
ttgatccatccgctgaaagtgctcgctcctacgaaga

SEQ ID NO: 167731 - DNA, 37 bp, Artificial Sequence
  Synthetic oligonucleotide
atccaacccgtacagcccgttaccccgccgcatacga

SEQ ID NO: 167732 - DNA, 37 bp, Artificial Sequence
  Synthetic oligonucleotide
gccacccctcgatttgacccatctgacgatgctacga

SEQ ID NO: 167733 - DNA, 37 bp, Artificial Sequence
  Synthetic oligonucleotide
aagagggtggaaggctgaagtaggagtggggcaccga

SEQ ID NO: 167734 - DNA, 37 bp, Artificial Sequence
  Synthetic oligonucleotide
ttgatcacccccaccatccgatagcatcgcctaccga

SEQ ID NO: 167735 - DNA, 37 bp, Artificial Sequence
  Synthetic oligonucleotide
gtcacaccgcagaccctgaccggtcactgctccccga

SEQ ID NO: 167736 - DNA, 37 bp, Artificial Sequence
  Synthetic oligonucleotide
tagcgcacgggtggaccggagggaggctgggaaagga

SEQ ID NO: 167737 - DNA, 37 bp, Artificial Sequence
  Synthetic oligonucleotide
acccgcctttgccaccgtatctgctcggactcccgga

SEQ ID NO: 167738 - DNA, 37 bp, Artificial Sequence
  Synthetic oligonucleotide
gctgtgggagtgagggggtaggcattcagggagggga

SEQ ID NO: 167739 - DNA, 38 bp, Artificial Sequence
  Synthetic oligonucleotide
tccgagacgaggttgggatggaggcgggaaaaaaatga

SEQ ID NO: 167740 - DNA, 38 bp, Artificial Sequence
  Synthetic oligonucleotide
acgacacggacaccgcagcatccccgccccgcccatga

SEQ ID NO: 167741 - DNA, 38 bp, Artificial Sequence
  Synthetic oligonucleotide
gccatttccgctcccgttttctatccaatcattgatga

SEQ ID NO: 167742 - DNA, 38 bp, Artificial Sequence
  Synthetic oligonucleotide
gacgcatagtatggggtgggaagggttaagggttatga

SEQ ID NO: 167743 - DNA, 38 bp, Artificial Sequence
  Synthetic oligonucleotide
gtgggcccgcagagtcccatggtcatcctcctccctga

SEQ ID NO: 167744 - DNA, 35 bp, Artificial Sequence
  Synthetic oligonucleotide
attggccgccctctgggacccacccttgctcctga

SEQ ID NO: 167745 - DNA, 37 bp, Artificial Sequence
  Synthetic oligonucleotide
gtagggcgaaagggtggacgggggggcggactagtga

SEQ ID NO: 167746 - DNA, 38 bp, Artificial Sequence
  Synthetic oligonucleotide
accacctcgctcacctacccgcgacacgatccacgtga

SEQ ID NO: 167747 - DNA, 38 bp, Artificial Sequence
  Synthetic oligonucleotide
gaagtgccaatgaagggggaggaacgaaatggcggtga

SEQ ID NO: 167748 - DNA, 38 bp, Artificial Sequence
  Synthetic oligonucleotide
aggtggggcggtgcaagtaggtggggtagtgggggtga

SEQ ID NO: 167749 - DNA, 38 bp, Artificial Sequence
  Synthetic oligonucleotide
accgactgggctccatctgaatattgtttttcccttga

SEQ ID NO: 167750 - DNA, 37 bp, Artificial Sequence
  Synthetic oligonucleotide
gggagggcaaagggttggttcttaggggcggggttga

SEQ ID NO: 167751 - DNA, 38 bp, Artificial Sequence
  Synthetic oligonucleotide
aacccaaccacccgccactgttatgtcacatttgttga

SEQ ID NO: 167752 - DNA, 36 bp, Artificial Sequence
  Synthetic oligonucleotide
atcccccccaccctcagccgtaacgggtgccctata

SEQ ID NO: 167753 - DNA, 35 bp, Artificial Sequence
  Synthetic oligonucleotide
gaggactgggagggcgaatgggggcttggagtata

SEQ ID NO: 167754 - DNA, 35 bp, Artificial Sequence
  Synthetic oligonucleotide
tcgcactcccctcggtgccttcgaattctggccta

SEQ ID NO: 167755 - DNA, 35 bp, Artificial Sequence
  Synthetic oligonucleotide
gggcgggtggggacgggaatatctgtagttccgta

SEQ ID NO: 167756 - DNA, 36 bp, Artificial Sequence
  Synthetic oligonucleotide
atgtccttccgctcgtacgctaataacatgccatta

SEQ ID NO: 167757 - DNA, 36 bp, Artificial Sequence
  Synthetic oligonucleotide
actccgccgcaactggccttcccttgttttaactta

SEQ ID NO: 167758 - DNA, 35 bp, Artificial Sequence
  Synthetic oligonucleotide
tcatccgggtcattgtactgtccacccttgctaac

SEQ ID NO: 167759 - DNA, 35 bp, Artificial Sequence
  Synthetic oligonucleotide
tgtcttagcgtgctccccccttgtcagcctaccac

SEQ ID NO: 167760 - DNA, 35 bp, Artificial Sequence
  Synthetic oligonucleotide
agggagtgtcagcggtcccatctgcacgctcccac

SEQ ID NO: 167761 - DNA, 35 bp, Artificial Sequence
  Synthetic oligonucleotide
gagaagggccgggttcggggtagggctaggaagac

SEQ ID NO: 167762 - DNA, 35 bp, Artificial Sequence
  Synthetic oligonucleotide
tgctcgcacggccccaggctgcaccattcttctac

SEQ ID NO: 167763 - DNA, 35 bp, Artificial Sequence
  Synthetic oligonucleotide
gccctcccctccgtttggtgccctggaaagggacc

SEQ ID NO: 167764 - DNA, 35 bp, Artificial Sequence
  Synthetic oligonucleotide
ggaccgtgtccaactcttttctgcgccgctcaccc

SEQ ID NO: 167765 - DNA, 35 bp, Artificial Sequence
  Synthetic oligonucleotide
ttcccgccggattacggcatttcgcctttgccccc

SEQ ID NO: 167766 - DNA, 35 bp, Artificial Sequence
  Synthetic oligonucleotide
caagacacctcaattctccccgctgtgccgtgccc

SEQ ID NO: 167767 - DNA, 35 bp, Artificial Sequence
  Synthetic oligonucleotide
gagagcgttaccctggttgaaatgcggcccctccc

SEQ ID NO: 167768 - DNA, 35 bp, Artificial Sequence
  Synthetic oligonucleotide
ggaaccttccgcccaatcaagtctcgtggcctccc

SEQ ID NO: 167769 - DNA, 35 bp, Artificial Sequence
  Synthetic oligonucleotide
tatagcgccccttgtccctatttgaacctgctccc

SEQ ID NO: 167770 - DNA, 35 bp, Artificial Sequence
  Synthetic oligonucleotide
tccgccacccctgcgtttctctcttggcctgtccc

SEQ ID NO: 167771 - DNA, 35 bp, Artificial Sequence
  Synthetic oligonucleotide
ttcgcgccctcctccatgtcaaaccgacccgcgcc

SEQ ID NO: 167772 - DNA, 35 bp, Artificial Sequence
  Synthetic oligonucleotide
acccatctgccttttatcgccggagtactaactcc

SEQ ID NO: 167773 - DNA, 35 bp, Artificial Sequence
  Synthetic oligonucleotide
gctaacggaccgcctgcagtagtagccttccctcc

SEQ ID NO: 167774 - DNA, 35 bp, Artificial Sequence
  Synthetic oligonucleotide
acatccatcctgccagtcccgcctttgcccagagc

SEQ ID NO: 167775 - DNA, 35 bp, Artificial Sequence
  Synthetic oligonucleotide
tcccaatccatagccggagcgcaactttctcccgc

SEQ ID NO: 167776 - DNA, 35 bp, Artificial Sequence
  Synthetic oligonucleotide
gctcgccgccaactgatttatgacacctcttccgc

SEQ ID NO: 167777 - DNA, 35 bp, Artificial Sequence
  Synthetic oligonucleotide
ggacgacggcaccctctttacatctgcctccttgc

SEQ ID NO: 167778 - DNA, 35 bp, Artificial Sequence
  Synthetic oligonucleotide
tgatcccaccgccgagtacgaatctaccgctcctc

SEQ ID NO: 167779 - DNA, 35 bp, Artificial Sequence
  Synthetic oligonucleotide
attcgtgcttagtatgcgcttggctccctgtcctc

SEQ ID NO: 167780 - DNA, 35 bp, Artificial Sequence
  Synthetic oligonucleotide
tgcttgaccgctataccccctgtgaccctcagctc

SEQ ID NO: 167781 - DNA, 35 bp, Artificial Sequence
  Synthetic oligonucleotide
accaaccccttgtattgcataaaagtccactcgtc

SEQ ID NO: 167782 - DNA, 35 bp, Artificial Sequence
  Synthetic oligonucleotide
tattgtccgtccgccccctgcgtttctaacgggtc

SEQ ID NO: 167783 - DNA, 35 bp, Artificial Sequence
  Synthetic oligonucleotide
tgcacgtctcgcctcccacgcctgtaggacttgtc

SEQ ID NO: 167784 - DNA, 35 bp, Artificial Sequence
  Synthetic oligonucleotide
gcacacgcgtttagcaactcatcgcccttcccttc

SEQ ID NO: 167785 - DNA, 35 bp, Artificial Sequence
  Synthetic oligonucleotide
acgctccacatgtccatccctcggtcttttccttc

SEQ ID NO: 167786 - DNA, 35 bp, Artificial Sequence
  Synthetic oligonucleotide
agcccgagctcgccgtctcgcctaatactcgcttc

SEQ ID NO: 167787 - DNA, 35 bp, Artificial Sequence
  Synthetic oligonucleotide
gtgctttctgccccgttcgaccctgctgttcgttc

SEQ ID NO: 167788 - DNA, 35 bp, Artificial Sequence
  Synthetic oligonucleotide
gttcgggagcggagggaggcaaacgggggatgcag

SEQ ID NO: 167789 - DNA, 35 bp, Artificial Sequence
  Synthetic oligonucleotide
gaatacaaccccgctgactcaagccctccgcctag

SEQ ID NO: 167790 - DNA, 35 bp, Artificial Sequence
  Synthetic oligonucleotide
gacacgtctaccctttcatctacgccggtcttacg

SEQ ID NO: 167791 - DNA, 35 bp, Artificial Sequence
  Synthetic oligonucleotide
accacaagcgcatgtcttgtaccttacctcacccg

SEQ ID NO: 167792 - DNA, 35 bp, Artificial Sequence
  Synthetic oligonucleotide
ggactgctgatgtcacctgctgttcgtcttctccg

SEQ ID NO: 167793 - DNA, 35 bp, Artificial Sequence
  Synthetic oligonucleotide
aacatcgggggtggaacaaaaggtgggggttagcg

SEQ ID NO: 167794 - DNA, 35 bp, Artificial Sequence
  Synthetic oligonucleotide
tccttgcccacaccagcgacttccctctcgcccgg

SEQ ID NO: 167795 - DNA, 35 bp, Artificial Sequence
  Synthetic oligonucleotide
gcaggcggtattgggtggaaatgggataggaaggg

SEQ ID NO: 167796 - DNA, 35 bp, Artificial Sequence
  Synthetic oligonucleotide
ggggataggcggtctagattagacggagggggggg

SEQ ID NO: 167797 - DNA, 35 bp, Artificial Sequence
  Synthetic oligonucleotide
gagggggagtggtggcgtttatgagggcaggtggg

SEQ ID NO: 167798 - DNA, 27 bp, Artificial Sequence
  Synthetic oligonucleotide
gtactcctgcaaaacctcacccattgg

SEQ ID NO: 167799 - DNA, 35 bp, Artificial Sequence
  Synthetic oligonucleotide
tccacgcctcccgacttgtcacgatgaccaccctg

SEQ ID NO: 167800 - DNA, 35 bp, Artificial Sequence
  Synthetic oligonucleotide
ttgggccacatccgcatagccacctattactcctg

SEQ ID NO: 167801 - DNA, 35 bp, Artificial Sequence
  Synthetic oligonucleotide
cataccccgccccatgcgcacttcctaatctcgtg

SEQ ID NO: 167802 - DNA, 35 bp, Artificial Sequence
  Synthetic oligonucleotide
gactacaacgcgatatgtctaccatccccccctat

SEQ ID NO: 167803 - DNA, 35 bp, Artificial Sequence
  Synthetic oligonucleotide
gtgccgcagagcacttgtatcatcccccgtttact

SEQ ID NO: 167804 - DNA, 35 bp, Artificial Sequence
  Synthetic oligonucleotide
gtgtaacctcgcaggtacctgacgcacattcacct

SEQ ID NO: 167805 - DNA, 35 bp, Artificial Sequence
  Synthetic oligonucleotide
gtttacctccgccgtttgttgaacccgctgcccct

SEQ ID NO: 167806 - DNA, 35 bp, Artificial Sequence
  Synthetic oligonucleotide
acagtgcgccacaactgctcgccgactctccgcct

SEQ ID NO: 167807 - DNA, 35 bp, Artificial Sequence
  Synthetic oligonucleotide
ttgccacccctgtgtccggccatgaatacctgcct

SEQ ID NO: 167808 - DNA, 35 bp, Artificial Sequence
  Synthetic oligonucleotide
ttcgtcggatggtcctgttacatcctgtttctcgt

SEQ ID NO: 167809 - DNA, 35 bp, Artificial Sequence
  Synthetic oligonucleotide
tccctgtggctcccgctgttcccgtccttgtctgt

SEQ ID NO: 167810 - DNA, 35 bp, Artificial Sequence
  Synthetic oligonucleotide
taagtgtcacccccgcgcaccatcacccagccatt

SEQ ID NO: 167811 - DNA, 35 bp, Artificial Sequence
  Synthetic oligonucleotide
gagcaccgcccctggtattcatcacctcactcctt

SEQ ID NO: 167812 - DNA, 35 bp, Artificial Sequence
  Synthetic oligonucleotide
gttacgcgcccttaccgtggctctcccattttgtt

SEQ ID NO: 167813 - DNA, 35 bp, Artificial Sequence
  Synthetic oligonucleotide
tccgcctactcattatcgacacgcacccggccttt

SEQ ID NO: 167814 - DNA, 35 bp, Artificial Sequence
  Synthetic oligonucleotide
gccccgagcgccaatcagccgattatcccctgttt

SEQ ID NO: 167815 - DNA, 37 bp, Artificial Sequence
  Synthetic oligonucleotide
gcataactggaggagaatagggggaaggtatgggaaa

SEQ ID NO: 167816 - DNA, 36 bp, Artificial Sequence
  Synthetic oligonucleotide
aaacaaccgaacaaggggagggcatggggcaattaa

SEQ ID NO: 167817 - DNA, 36 bp, Artificial Sequence
  Synthetic oligonucleotide
ttgagaaccgccgcctcgttcatcccccctagttaa

SEQ ID NO: 167818 - DNA, 35 bp, Artificial Sequence
  Synthetic oligonucleotide
gttgacacaccccgtcattgctcccccggtctaca

SEQ ID NO: 167819 - DNA, 35 bp, Artificial Sequence
  Synthetic oligonucleotide
gccaccaggccccaatcattactcagagcccgcca

SEQ ID NO: 167820 - DNA, 34 bp, Artificial Sequence
  Synthetic oligonucleotide
gtcccttgccgaccgtggctcactttcccgtcca

SEQ ID NO: 167821 - DNA, 36 bp, Artificial Sequence
  Synthetic oligonucleotide
gcaagcccctcctgcctatggtttctgaatattcca

SEQ ID NO: 167822 - DNA, 36 bp, Artificial Sequence
  Synthetic oligonucleotide
ccctcatccccgccccgactgagtagccgtatctca

SEQ ID NO: 167823 - DNA, 37 bp, Artificial Sequence
  Synthetic oligonucleotide
gtacagagagggtgagtgaggggagagtaaggaaaga

SEQ ID NO: 167824 - DNA, 37 bp, Artificial Sequence
  Synthetic oligonucleotide
atcgggggaccgagaggaagacgagggggtggggaga

SEQ ID NO: 167825 - DNA, 37 bp, Artificial Sequence
  Synthetic oligonucleotide
gcgaggctcgaagaataggggaggagggggctggaga

SEQ ID NO: 167826 - DNA, 37 bp, Artificial Sequence
  Synthetic oligonucleotide
gggagatgagggagggcagaaggaggaaaaggataga

SEQ ID NO: 167827 - DNA, 37 bp, Artificial Sequence
  Synthetic oligonucleotide
tttgtcgcggctgtccctcgtccccctgctactccga

SEQ ID NO: 167828 - DNA, 37 bp, Artificial Sequence
  Synthetic oligonucleotide
gaaatgcggaaaggaattgacgggagataggccgcga

SEQ ID NO: 167829 - DNA, 37 bp, Artificial Sequence
  Synthetic oligonucleotide
gtgcccccttgtacgcgccagtcccttcccattgcga

SEQ ID NO: 167830 - DNA, 35 bp, Artificial Sequence
  Synthetic oligonucleotide
gccacgcttagctggccgtgcctctatctcccgga

SEQ ID NO: 167831 - DNA, 35 bp, Artificial Sequence
  Synthetic oligonucleotide
ttgtactcctcgtctgtctttcctccctggccgga

SEQ ID NO: 167832 - DNA, 37 bp, Artificial Sequence
  Synthetic oligonucleotide
aatctggcactggtggggggggaaaaggtagggcgga

SEQ ID NO: 167833 - DNA, 36 bp, Artificial Sequence
  Synthetic oligonucleotide
ggtcaccagccgctgcacaaagcttccaccctcgga

SEQ ID NO: 167834 - DNA, 36 bp, Artificial Sequence
  Synthetic oligonucleotide
gtggggtacatgcacgtcgtggggtatgggtgggga

SEQ ID NO: 167835 - DNA, 36 bp, Artificial Sequence
  Synthetic oligonucleotide
gacgggggggaggtaggctacgagcaaacttgggga

SEQ ID NO: 167836 - DNA, 36 bp, Artificial Sequence
  Synthetic oligonucleotide
agaacgaggtagaaggggtaaggtaggggcgtggga

SEQ ID NO: 167837 - DNA, 37 bp, Artificial Sequence
  Synthetic oligonucleotide
gtctacgacggggggagggggagtcacgagtttggga

SEQ ID NO: 167838 - DNA, 36 bp, Artificial Sequence
  Synthetic oligonucleotide
gccaactctccgctcgccatcgccctcctcgctgga

SEQ ID NO: 167839 - DNA, 37 bp, Artificial Sequence
  Synthetic oligonucleotide
gagacaccgcacccccgccttcacgtctcaacgatga

SEQ ID NO: 167840 - DNA, 36 bp, Artificial Sequence
  Synthetic oligonucleotide
tgacgcggaggggaaggcgggcggacggggcgatga

SEQ ID NO: 167841 - DNA, 37 bp, Artificial Sequence
  Synthetic oligonucleotide
gagtggtgcgggagggagggtaccttatcagggatga

SEQ ID NO: 167842 - DNA, 37 bp, Artificial Sequence
  Synthetic oligonucleotide
gacgccccacctcctgtcgcagaccttcttacactga

SEQ ID NO: 167843 - DNA, 37 bp, Artificial Sequence
  Synthetic oligonucleotide
cccacccacctggagatatgaacctctgcccacctga

SEQ ID NO: 167844 - DNA, 38 bp, Artificial Sequence
  Synthetic oligonucleotide
acgagccaccttgctactatgccaccaccaggacctga

SEQ ID NO: 167845 - DNA, 37 bp, Artificial Sequence
  Synthetic oligonucleotide
tcccacgacctggtggtttccctcgaccctaccctga

SEQ ID NO: 167846 - DNA, 36 bp, Artificial Sequence
  Synthetic oligonucleotide
tacctgtcggtgctgcaccctgtttgctatccctga

SEQ ID NO: 167847 - DNA, 37 bp, Artificial Sequence
  Synthetic oligonucleotide
tgcgtacatccggccttagtagtaccatctgtcctga

SEQ ID NO: 167848 - DNA, 37 bp, Artificial Sequence
  Synthetic oligonucleotide
gagtcagggggcgggggggggcgtatgggacctctga

SEQ ID NO: 167849 - DNA, 36 bp, Artificial Sequence
  Synthetic oligonucleotide
aacccgtgtacaatgccccgcctattcgccctctga

SEQ ID NO: 167850 - DNA, 38 bp, Artificial Sequence
  Synthetic oligonucleotide
tcagccctccgcctgaccttccagacctactattctga

SEQ ID NO: 167851 - DNA, 37 bp, Artificial Sequence
  Synthetic oligonucleotide
agagaggggggaacgaactggctggaggggaaagtga

SEQ ID NO: 167852 - DNA, 38 bp, Artificial Sequence
  Synthetic oligonucleotide
atgcccatcatgcgtactgcccccctatgcctccgtga

SEQ ID NO: 167853 - DNA, 38 bp, Artificial Sequence
  Synthetic oligonucleotide
tgaacacaacgaagggggggcaagaataggcaaggtga

SEQ ID NO: 167854 - DNA, 38 bp, Artificial Sequence
  Synthetic oligonucleotide
ggtacaacgcgggcataggatggggaagggggaggtga

SEQ ID NO: 167855 - DNA, 38 bp, Artificial Sequence
  Synthetic oligonucleotide
gactccaccactatccgccgcatcttggacacacttga

SEQ ID NO: 167856 - DNA, 38 bp, Artificial Sequence
  Synthetic oligonucleotide
ttctaagcgccccctccgccgttcgtatccacccttga

SEQ ID NO: 167857 - DNA, 37 bp, Artificial Sequence
  Synthetic oligonucleotide
tcgagcccgccccgcttgacttaatttgttctcttga

SEQ ID NO: 167858 - DNA, 38 bp, Artificial Sequence
  Synthetic oligonucleotide
aagagcggcccccgtgattgcctctgccttccatttga

SEQ ID NO: 167859 - DNA, 38 bp, Artificial Sequence
  Synthetic oligonucleotide
gtccaccgctatcctccgccgcccgccatgcactttga

SEQ ID NO: 167860 - DNA, 36 bp, Artificial Sequence
  Synthetic oligonucleotide
attcgtgcgcctcgcattctacctccccgttcacta

SEQ ID NO: 167861 - DNA, 36 bp, Artificial Sequence
  Synthetic oligonucleotide
tcttcacgcctgtatcgatcgcatatgctccaccta

SEQ ID NO: 167862 - DNA, 35 bp, Artificial Sequence
  Synthetic oligonucleotide
attgcccaccctccacgtcccctggtttcacccta

SEQ ID NO: 167863 - DNA, 36 bp, Artificial Sequence
  Synthetic oligonucleotide
gtaccatacggggcaccgtaaacccccccacccgta

SEQ ID NO: 167864 - DNA, 35 bp, Artificial Sequence
  Synthetic oligonucleotide
agccacatgggagagggtagggcggagtgcgggta

SEQ ID NO: 167865 - DNA, 35 bp, Artificial Sequence
  Synthetic oligonucleotide
atcattccgacccctgaggcttcatggccacctta

SEQ ID NO: 167866 - DNA, 36 bp, Artificial Sequence
  Synthetic oligonucleotide
ggtgtccctgtatttcgttatgtccgccgttcctta

SEQ ID NO: 167867 - DNA, 35 bp, Artificial Sequence
  Synthetic oligonucleotide
tgcccactggttcttgccttcttagcctgctgtta

SEQ ID NO: 167868 - DNA, 34 bp, Artificial Sequence
  Synthetic oligonucleotide
atagcacgcccttactgttttcacgcgcttgtta

SEQ ID NO: 167869 - DNA, 36 bp, Artificial Sequence
  Synthetic oligonucleotide
ctactgccttcgccttgccgttttcacatgttttta

SEQ ID NO: 167870 - DNA, 35 bp, Artificial Sequence
  Synthetic oligonucleotide
accgcctccactaggtcttccgtttcttgtcgcac

SEQ ID NO: 167871 - DNA, 35 bp, Artificial Sequence
  Synthetic oligonucleotide
acgcgcatctacttgtaactgtgcccctctctcac

SEQ ID NO: 167872 - DNA, 35 bp, Artificial Sequence
  Synthetic oligonucleotide
tgtgtgctacccgtcgcgaaccttccccattggac

SEQ ID NO: 167873 - DNA, 35 bp, Artificial Sequence
  Synthetic oligonucleotide
gcccacccctccaaccccagggattaaaagctacc

SEQ ID NO: 167874 - DNA, 35 bp, Artificial Sequence
  Synthetic oligonucleotide
gcgcgccctcgatcgcacttggcttctggctaccc

SEQ ID NO: 167875 - DNA, 35 bp, Artificial Sequence
  Synthetic oligonucleotide
ttctcgcctgtctctgcccgacccatagatgcccc

SEQ ID NO: 167876 - DNA, 35 bp, Artificial Sequence
  Synthetic oligonucleotide
gtccgcccggaaggtctttcgctctacgatgcccc

SEQ ID NO: 167877 - DNA, 35 bp, Artificial Sequence
  Synthetic oligonucleotide
gaaccgtccctcagtagaccgccgctccgtcgccc

SEQ ID NO: 167878 - DNA, 35 bp, Artificial Sequence
  Synthetic oligonucleotide
tacatctgccctgaaccatacgtccggccgtgccc

SEQ ID NO: 167879 - DNA, 35 bp, Artificial Sequence
  Synthetic oligonucleotide
tcccatgtcctcaccctgcctgctgccggtacgcc

SEQ ID NO: 167880 - DNA, 35 bp, Artificial Sequence
  Synthetic oligonucleotide
gttgctaaccagcttttcccccggttttcggtgcc

SEQ ID NO: 167881 - DNA, 35 bp, Artificial Sequence
  Synthetic oligonucleotide
ttcacgctgtccttctgtctgatatttgcacttcc

SEQ ID NO: 167882 - DNA, 35 bp, Artificial Sequence
  Synthetic oligonucleotide
gtagccctctctcactatctgaactgctgggttcc

SEQ ID NO: 167883 - DNA, 35 bp, Artificial Sequence
  Synthetic oligonucleotide
tctctcccctggcccggtgccgtttcatgtaacgc

SEQ ID NO: 167884 - DNA, 35 bp, Artificial Sequence
  Synthetic oligonucleotide
tgtgtcgaacttctcgctccattggtcttctacgc

SEQ ID NO: 167885 - DNA, 35 bp, Artificial Sequence
  Synthetic oligonucleotide
tcaatgtgtagtaacacccctcccctgcccaccgc

SEQ ID NO: 167886 - DNA, 35 bp, Artificial Sequence
  Synthetic oligonucleotide
gccgtcccagtaagtacacccgtcccccgcaccgc

SEQ ID NO: 167887 - DNA, 35 bp, Artificial Sequence
  Synthetic oligonucleotide
gtctgagcccccgccaatataactgaatccttcgc

SEQ ID NO: 167888 - DNA, 35 bp, Artificial Sequence
  Synthetic oligonucleotide
gcgccctctgctgctcctccgtcctacgaataggc

SEQ ID NO: 167889 - DNA, 35 bp, Artificial Sequence
  Synthetic oligonucleotide
atctcgcaccccccgcgcctgatagtccctttggc

SEQ ID NO: 167890 - DNA, 35 bp, Artificial Sequence
  Synthetic oligonucleotide
atcgaccgatccctgggtgctttttctgtccctgc

SEQ ID NO: 167891 - DNA, 35 bp, Artificial Sequence
  Synthetic oligonucleotide
tacagccctaggcacgccagttctgtccttcctgc

SEQ ID NO: 167892 - DNA, 35 bp, Artificial Sequence
  Synthetic oligonucleotide
cctctgccatccttgttcacccgtcaccccgctgc

SEQ ID NO: 167893 - DNA, 35 bp, Artificial Sequence
  Synthetic oligonucleotide
tacccgccccatctaggcatacgatattcgcttgc

SEQ ID NO: 167894 - DNA, 35 bp, Artificial Sequence
  Synthetic oligonucleotide
ccaccggtagtaccacctgttcgcctcccccggtc

SEQ ID NO: 167895 - DNA, 35 bp, Artificial Sequence
  Synthetic oligonucleotide
aaccacctaaccgacaatgtgcaccacctgttgtc

SEQ ID NO: 167896 - DNA, 35 bp, Artificial Sequence
  Synthetic oligonucleotide
tacattccccccctcataagaccaggttttgcttc

SEQ ID NO: 167897 - DNA, 35 bp, Artificial Sequence
  Synthetic oligonucleotide
accgggcaggccggccgccatatgcctccccgttc

SEQ ID NO: 167898 - DNA, 35 bp, Artificial Sequence
  Synthetic oligonucleotide
tcacagcctccatctgcttttcgttgcccactttc

SEQ ID NO: 167899 - DNA, 35 bp, Artificial Sequence
  Synthetic oligonucleotide
gaggatggtcaggggaggcggatggagaagatcag

SEQ ID NO: 167900 - DNA, 35 bp, Artificial Sequence
  Synthetic oligonucleotide
acatcccgcccgtgccatcaatttgcccccgtacg

SEQ ID NO: 167901 - DNA, 35 bp, Artificial Sequence
  Synthetic oligonucleotide
tctcgccccatgccacggtccgctccctactcccg

SEQ ID NO: 167902 - DNA, 35 bp, Artificial Sequence
  Synthetic oligonucleotide
ggtcgtccaccgatggtagccctctcttcccgccg

SEQ ID NO: 167903 - DNA, 35 bp, Artificial Sequence
  Synthetic oligonucleotide
tcccaccccaccatatgttgccatttcgtattccg

SEQ ID NO: 167904 - DNA, 36 bp, Artificial Sequence
  Synthetic oligonucleotide
gacgggatggggggaagcggggaagtaacccaaggg

SEQ ID NO: 167905 - DNA, 34 bp, Artificial Sequence
  Synthetic oligonucleotide
acgtaggcgggggggatcgtgaagaagggagggg

SEQ ID NO: 167906 - DNA, 34 bp, Artificial Sequence
  Synthetic oligonucleotide
aactgagccggaccgcgtaaatttccttccctgg

SEQ ID NO: 167907 - DNA, 35 bp, Artificial Sequence
  Synthetic oligonucleotide
tgcaagaggaggggagaaggaacggtaaggagtgg

SEQ ID NO: 167908 - DNA, 35 bp, Artificial Sequence
  Synthetic oligonucleotide
acctgcccccccacgcgaaacaaaccctcctgttg

SEQ ID NO: 167909 - DNA, 35 bp, Artificial Sequence
  Synthetic oligonucleotide
atgcacgtagtcccctttgtggcttctcttttttg

SEQ ID NO: 167910 - DNA, 34 bp, Artificial Sequence
  Synthetic oligonucleotide
ggttcaccgccgcttttgtttccctcgtaacgat

SEQ ID NO: 167911 - DNA, 35 bp, Artificial Sequence
  Synthetic oligonucleotide
tgcctcaccgtgcctcactgatcacttctacccct

SEQ ID NO: 167912 - DNA, 35 bp, Artificial Sequence
  Synthetic oligonucleotide
gccgaagcacgtcatccccatccgtttggtcgcct

SEQ ID NO: 167913 - DNA, 35 bp, Artificial Sequence
  Synthetic oligonucleotide
tagccgccgcgccccccgagtgtgcatcgtctcct

SEQ ID NO: 167914 - DNA, 35 bp, Artificial Sequence
  Synthetic oligonucleotide
tcatcgacaagcattctctgttggcttatcttcct

SEQ ID NO: 167915 - DNA, 35 bp, Artificial Sequence
  Synthetic oligonucleotide
gcgtgccactctgcccgtatatgccttctcacgct

SEQ ID NO: 167916 - DNA, 35 bp, Artificial Sequence
  Synthetic oligonucleotide
tgtcgccatagtagccaccgtgcctgctccactct

SEQ ID NO: 167917 - DNA, 35 bp, Artificial Sequence
  Synthetic oligonucleotide
agaacgtcccctgccccatgtcaccgttacttagt

SEQ ID NO: 167918 - DNA, 35 bp, Artificial Sequence
  Synthetic oligonucleotide
gggggacaagggaggccggaagggaggtaaagggt

SEQ ID NO: 167919 - DNA, 35 bp, Artificial Sequence
  Synthetic oligonucleotide
tctgcgtcacacgtttagttcgcctcacacctatt

SEQ ID NO: 167920 - DNA, 35 bp, Artificial Sequence
  Synthetic oligonucleotide
acttactgccatcgcggggccctcccctgctcctt

SEQ ID NO: 167921 - DNA, 35 bp, Artificial Sequence
  Synthetic oligonucleotide
gttcaactgccctgcctgccgtatcttacacgctt

SEQ ID NO: 167922 - DNA, 35 bp, Artificial Sequence
  Synthetic oligonucleotide
gcacgcttcgctcacggtcctcttaagcccctctt

SEQ ID NO: 167923 - DNA, 35 bp, Artificial Sequence
  Synthetic oligonucleotide
ttatgcctcccatctctatgtctctgaactctttt

SEQ ID NO: 167924 - DNA, 35 bp, Artificial Sequence
  Synthetic oligonucleotide
acccgtcctccggccttatatactcacaatgtttt

SEQ ID NO: 167925 - DNA, 35 bp, Artificial Sequence
  Synthetic oligonucleotide
gtggacaccgaacagcgcctatctccccatgtttt

SEQ ID NO: 167926 - DNA, 36 bp, Artificial Sequence
  Synthetic oligonucleotide
attgaccgcccccctgatcgcctttgccgaccaaaa

SEQ ID NO: 167927 - DNA, 36 bp, Artificial Sequence
  Synthetic oligonucleotide
ttcagtcgagggtaggggtgagagggtaggagggaa

SEQ ID NO: 167928 - DNA, 36 bp, Artificial Sequence
  Synthetic oligonucleotide
gttgggagggccggattcgggggtgtgggacgggaa

SEQ ID NO: 167929 - DNA, 35 bp, Artificial Sequence
  Synthetic oligonucleotide
ggtgacatgagggagttgggggatgtaggtgggaa

SEQ ID NO: 167930 - DNA, 35 bp, Artificial Sequence
  Synthetic oligonucleotide
gtctcctgcccccccgctgattatactacgatgaa

SEQ ID NO: 167931 - DNA, 36 bp, Artificial Sequence
  Synthetic oligonucleotide
aatccagggagggatgtgtgggggagctgtgggtaa

SEQ ID NO: 167932 - DNA, 36 bp, Artificial Sequence
  Synthetic oligonucleotide
gccccgaccgcacactcacatgttctcgcgcccaca

SEQ ID NO: 167933 - DNA, 36 bp, Artificial Sequence
  Synthetic oligonucleotide
gtcccgcgccccatctgtcatcctcactgagtcaca

SEQ ID NO: 167934 - DNA, 35 bp, Artificial Sequence
  Synthetic oligonucleotide
gacacccacgttttgtccctgttccctactgtaca

SEQ ID NO: 167935 - DNA, 36 bp, Artificial Sequence
  Synthetic oligonucleotide
gtgaatcgcctcgctttgtctcgtcgcctatcgcca

SEQ ID NO: 167936 - DNA, 36 bp, Artificial Sequence
  Synthetic oligonucleotide
tcacgcctcaccaatgctgtgttacactagccctca

SEQ ID NO: 167937 - DNA, 35 bp, Artificial Sequence
  Synthetic oligonucleotide
gcaaacgtaggcgtcctagtcatctcctgctctca

SEQ ID NO: 167938 - DNA, 35 bp, Artificial Sequence
  Synthetic oligonucleotide
tcatggggcgggcgtgggggggtgggagagcgtca

SEQ ID NO: 167939 - DNA, 37 bp, Artificial Sequence
  Synthetic oligonucleotide
gagaacgagagggggggagccgggtatattaagacga

SEQ ID NO: 167940 - DNA, 37 bp, Artificial Sequence
  Synthetic oligonucleotide
aggggaacagggggggtaagtggaccggagtatacga

SEQ ID NO: 167941 - DNA, 37 bp, Artificial Sequence
  Synthetic oligonucleotide
tggtgaggggcggaggaggaaatatggcatgctacga

SEQ ID NO: 167942 - DNA, 35 bp, Artificial Sequence
  Synthetic oligonucleotide
tattcgcaccactcgcctgtccgtccgacgaccga

SEQ ID NO: 167943 - DNA, 36 bp, Artificial Sequence
  Synthetic oligonucleotide
gcttctagcgccacaatactgcccagcccgccccga

SEQ ID NO: 167944 - DNA, 37 bp, Artificial Sequence
  Synthetic oligonucleotide
aatcctccacccctgctgcctcgaacctgtttgccga

SEQ ID NO: 167945 - DNA, 37 bp, Artificial Sequence
  Synthetic oligonucleotide
aactgctcagactaggcaccatgctcccaccccgcga

SEQ ID NO: 167946 - DNA, 36 bp, Artificial Sequence
  Synthetic oligonucleotide
tctccgcccattaccgttctctggagtactcttcga

SEQ ID NO: 167947 - DNA, 37 bp, Artificial Sequence
  Synthetic oligonucleotide
tgcacctctaccacctgcgtacttcggctattttcga

SEQ ID NO: 167948 - DNA, 36 bp, Artificial Sequence
  Synthetic oligonucleotide
actcaatgcgaagtggggaacggaaatggcggagga

SEQ ID NO: 167949 - DNA, 37 bp, Artificial Sequence
  Synthetic oligonucleotide
aagggtatggggggtctagggaggtggggtggaggga

SEQ ID NO: 167950 - DNA, 37 bp, Artificial Sequence
  Synthetic oligonucleotide
gatggatggggtagaaggcggggataggaggccggga

SEQ ID NO: 167951 - DNA, 37 bp, Artificial Sequence
  Synthetic oligonucleotide
atagatcacagaggggcttatgtgggcggggagggga

SEQ ID NO: 167952 - DNA, 37 bp, Artificial Sequence
  Synthetic oligonucleotide
gggacaagttccggtgggcagggaaggcggctgggga

SEQ ID NO: 167953 - DNA, 35 bp, Artificial Sequence
  Synthetic oligonucleotide
gcacccacctcccagggttaaccgtacttgctgga

SEQ ID NO: 167954 - DNA, 38 bp, Artificial Sequence
  Synthetic oligonucleotide
accgccctccccagttcgttaacctcctgtacccatga

SEQ ID NO: 167955 - DNA, 38 bp, Artificial Sequence
  Synthetic oligonucleotide
gccgagctacactcgttccacacacccactgcccatga

SEQ ID NO: 167956 - DNA, 38 bp, Artificial Sequence
  Synthetic oligonucleotide
tccggacatcccccgctcatcctccaccatgccactga

SEQ ID NO: 167957 - DNA, 38 bp, Artificial Sequence
  Synthetic oligonucleotide
tcctgccccacgtcccgtgcaatacaccaccctcctga

SEQ ID NO: 167958 - DNA, 38 bp, Artificial Sequence
  Synthetic oligonucleotide
atgctgcacacatactatcgacacctgatccaccgtga

SEQ ID NO: 167959 - DNA, 38 bp, Artificial Sequence
  Synthetic oligonucleotide
ggacggggcgggcgacggagggtggggtagaaatgtga

SEQ ID NO: 167960 - DNA, 38 bp, Artificial Sequence
  Synthetic oligonucleotide
tcaacgcagagagggagggaggggtagtgctagattga

SEQ ID NO: 167961 - DNA, 38 bp, Artificial Sequence
  Synthetic oligonucleotide
gttgactcaccctcgtttcatgcttacggtcctattga

SEQ ID NO: 167962 - DNA, 38 bp, Artificial Sequence
  Synthetic oligonucleotide
gttcacctcgtgccgtctatctctcccgtctcgcttga

SEQ ID NO: 167963 - DNA, 38 bp, Artificial Sequence
  Synthetic oligonucleotide
gccgccgcccgccatactcacgatcagatctttcttga

SEQ ID NO: 167964 - DNA, 38 bp, Artificial Sequence
  Synthetic oligonucleotide
accgcacatccatcgtccttatttcccggctctgttga

SEQ ID NO: 167965 - DNA, 36 bp, Artificial Sequence
  Synthetic oligonucleotide
ggagttagtgcgggaggagagaggggagagtcaata

SEQ ID NO: 167966 - DNA, 35 bp, Artificial Sequence
  Synthetic oligonucleotide
gacgggagacgagaggaggcgaaagagtgatgata

SEQ ID NO: 167967 - DNA, 35 bp, Artificial Sequence
  Synthetic oligonucleotide
tccgccactcccatttctgagtactcaacgaacta

SEQ ID NO: 167968 - DNA, 36 bp, Artificial Sequence
  Synthetic oligonucleotide
ggagtggtgggggcggaattggaacgtaggtaacta

SEQ ID NO: 167969 - DNA, 35 bp, Artificial Sequence
  Synthetic oligonucleotide
gcgaagaagccgggaagggggggaatgaaaatgta

SEQ ID NO: 167970 - DNA, 36 bp, Artificial Sequence
  Synthetic oligonucleotide
tacgctctcccttccgtgggtacagcccctgtttta

SEQ ID NO: 167971 - DNA, 35 bp, Artificial Sequence
  Synthetic oligonucleotide
gtccactcacaccaacacctgttattagttcacac

SEQ ID NO: 167972 - DNA, 35 bp, Artificial Sequence
  Synthetic oligonucleotide
gggtccaccgacctgctcatctttttttccgccac

SEQ ID NO: 167973 - DNA, 35 bp, Artificial Sequence
  Synthetic oligonucleotide
tgtcacgttcagacctcgccgcctctacccgtcac

SEQ ID NO: 167974 - DNA, 35 bp, Artificial Sequence
  Synthetic oligonucleotide
gccacccccagccaaactagttttcacatgccgac

SEQ ID NO: 167975 - DNA, 35 bp, Artificial Sequence
  Synthetic oligonucleotide
acctccccgccccgcactcgagatagagttgtgac

SEQ ID NO: 167976 - DNA, 35 bp, Artificial Sequence
  Synthetic oligonucleotide
gagtcgcggttagcgctttcacctcagcccgcacc

SEQ ID NO: 167977 - DNA, 35 bp, Artificial Sequence
  Synthetic oligonucleotide
atgggcggcaagttattatccggccgttccctacc

SEQ ID NO: 167978 - DNA, 35 bp, Artificial Sequence
  Synthetic oligonucleotide
gattcccctccgcaacgtggtagtacgcttttacc

SEQ ID NO: 167979 - DNA, 35 bp, Artificial Sequence
  Synthetic oligonucleotide
acccgcctcccattgcgacccgccattagccaccc

SEQ ID NO: 167980 - DNA, 35 bp, Artificial Sequence
  Synthetic oligonucleotide
taacaccggcgcgcaacccgtacccatgtccaccc

SEQ ID NO: 167981 - DNA, 35 bp, Artificial Sequence
  Synthetic oligonucleotide
tccatccacccgtccgttccacttcatagcacccc

SEQ ID NO: 167982 - DNA, 35 bp, Artificial Sequence
  Synthetic oligonucleotide
tcgtgtaccgttcgtctgcaattagttctaccccc

SEQ ID NO: 167983 - DNA, 35 bp, Artificial Sequence
  Synthetic oligonucleotide
tccacccttatcgtgagttcggcccttccagcccc

SEQ ID NO: 167984 - DNA, 35 bp, Artificial Sequence
  Synthetic oligonucleotide
acgaacaactacccgatatacaacgactgctcccc

SEQ ID NO: 167985 - DNA, 35 bp, Artificial Sequence
  Synthetic oligonucleotide
gacactatccgtgctatcctaggaacgatcttccc

SEQ ID NO: 167986 - DNA, 35 bp, Artificial Sequence
  Synthetic oligonucleotide
gccgccccaccacgcgtcgcattatgcctgacgcc

SEQ ID NO: 167987 - DNA, 35 bp, Artificial Sequence
  Synthetic oligonucleotide
ttatccccggcatagaaccccgccccacccgtgcc

SEQ ID NO: 167988 - DNA, 35 bp, Artificial Sequence
  Synthetic oligonucleotide
ttcacccctcaccacctaaggacccccgtgcatcc

SEQ ID NO: 167989 - DNA, 35 bp, Artificial Sequence
  Synthetic oligonucleotide
gagcccgttggggcctaaacacacgcacaacctcc

SEQ ID NO: 167990 - DNA, 34 bp, Artificial Sequence
  Synthetic oligonucleotide
aaggccgatgtcgcagtccgtcgttactttctcc

SEQ ID NO: 167991 - DNA, 35 bp, Artificial Sequence
  Synthetic oligonucleotide
acctgcctcacctaatattctatcgcccgtggtcc

SEQ ID NO: 167992 - DNA, 35 bp, Artificial Sequence
  Synthetic oligonucleotide
aatgccctgtccgctgcctcaacttcacaggttgc

SEQ ID NO: 167993 - DNA, 35 bp, Artificial Sequence
  Synthetic oligonucleotide
gattgtgtacgcgttcaatcccgtccttcgcactc

SEQ ID NO: 167994 - DNA, 35 bp, Artificial Sequence
  Synthetic oligonucleotide
gacctccaggttctgtttctcggggctaccccctc

SEQ ID NO: 167995 - DNA, 35 bp, Artificial Sequence
  Synthetic oligonucleotide
agcgccacaccgcacatggtctctggtctgccctc

SEQ ID NO: 167996 - DNA, 35 bp, Artificial Sequence
  Synthetic oligonucleotide
gcacccgctggatcttcacccatttcttccatctc

SEQ ID NO: 167997 - DNA, 35 bp, Artificial Sequence
  Synthetic oligonucleotide
tgcaccccgcgtgcccaagccccaacagcccggtc

SEQ ID NO: 167998 - DNA, 35 bp, Artificial Sequence
  Synthetic oligonucleotide
gtacatctatcgcctggtttcgttcccctgacttc

SEQ ID NO: 167999 - DNA, 35 bp, Artificial Sequence
  Synthetic oligonucleotide
acagtgggggtgggcaagggacgggtggctagttc

SEQ ID NO: 168000 - DNA, 35 bp, Artificial Sequence
  Synthetic oligonucleotide
aatgggtcgcgctgtccttcccttacccctatttc

SEQ ID NO: 168001 - DNA, 35 bp, Artificial Sequence
  Synthetic oligonucleotide
acgaacgggagaagtatggagaagggggtggaacg

SEQ ID NO: 168002 - DNA, 35 bp, Artificial Sequence
  Synthetic oligonucleotide
tatgttacctccttgcctctgccgcgacgctgccg

SEQ ID NO: 168003 - DNA, 35 bp, Artificial Sequence
  Synthetic oligonucleotide
aaccacgagtcagcgtaagtcctccccttcgcgcg

SEQ ID NO: 168004 - DNA, 35 bp, Artificial Sequence
  Synthetic oligonucleotide
accatcaccacttctacagttctcagtactgcgcg

SEQ ID NO: 168005 - DNA, 36 bp, Artificial Sequence
  Synthetic oligonucleotide
agtgccatcactccgagattctgttatccaccttcg

SEQ ID NO: 168006 - DNA, 35 bp, Artificial Sequence
  Synthetic oligonucleotide
agtacgcacctcccttatttcagtcttagctttcg

SEQ ID NO: 168007 - DNA, 35 bp, Artificial Sequence
  Synthetic oligonucleotide
gctaggaaagtggaagtgggggcatggtaggtagg

SEQ ID NO: 168008 - DNA, 35 bp, Artificial Sequence
  Synthetic oligonucleotide
tataggtggaaaaggtaggtggtacgggtaaacgg

SEQ ID NO: 168009 - DNA, 35 bp, Artificial Sequence
  Synthetic oligonucleotide
gctatgcaaggtggggggaggtggaacatgagtgg

SEQ ID NO: 168010 - DNA, 35 bp, Artificial Sequence
  Synthetic oligonucleotide
gagcccggtgcgggagggtgtgggtgtccatcatg

SEQ ID NO: 168011 - DNA, 35 bp, Artificial Sequence
  Synthetic oligonucleotide
tttgcccagcctccattcgtaacatctgcctactg

SEQ ID NO: 168012 - DNA, 35 bp, Artificial Sequence
  Synthetic oligonucleotide
actcagtgtcaaatcctcgcttggtttcccctctg

SEQ ID NO: 168013 - DNA, 35 bp, Artificial Sequence
  Synthetic oligonucleotide
ctcgatggcggcctctcgtcctgcttttacttctg

SEQ ID NO: 168014 - DNA, 35 bp, Artificial Sequence
  Synthetic oligonucleotide
atcaccactccaggccactcacatggctatcccat

SEQ ID NO: 168015 - DNA, 35 bp, Artificial Sequence
  Synthetic oligonucleotide
ggtgacccgccgcgccccattttcgatctcgccat

SEQ ID NO: 168016 - DNA, 35 bp, Artificial Sequence
  Synthetic oligonucleotide
gcacgctcaccgtaccgcccggcccccacctaact

SEQ ID NO: 168017 - DNA, 35 bp, Artificial Sequence
  Synthetic oligonucleotide
tcacttaccacaccgcccttcccgaggttgaacct

SEQ ID NO: 168018 - DNA, 35 bp, Artificial Sequence
  Synthetic oligonucleotide
tccaccctcccgttgtttatccctaataaacacct

SEQ ID NO: 168019 - DNA, 35 bp, Artificial Sequence
  Synthetic oligonucleotide
attgggcgcagtacgccgaccgtgtttgtccccct

SEQ ID NO: 168020 - DNA, 35 bp, Artificial Sequence
  Synthetic oligonucleotide
ggtgcccccgtaagttcgtatccggtaactctcct

SEQ ID NO: 168021 - DNA, 35 bp, Artificial Sequence
  Synthetic oligonucleotide
ggtgaggcgggggggaagagcagcacaaacaagct

SEQ ID NO: 168022 - DNA, 35 bp, Artificial Sequence
  Synthetic oligonucleotide
tgattactgcaccgtttacgcccccgccgaccgct

SEQ ID NO: 168023 - DNA, 35 bp, Artificial Sequence
  Synthetic oligonucleotide
gccccgccgccccccttaccatctttgcatggtct

SEQ ID NO: 168024 - DNA, 35 bp, Artificial Sequence
  Synthetic oligonucleotide
ttgcccactcgcacagatccgccctgttgtttcgt

SEQ ID NO: 168025 - DNA, 35 bp, Artificial Sequence
  Synthetic oligonucleotide
gcggggtgaagggaagagccggtgcggaaggtggt

SEQ ID NO: 168026 - DNA, 35 bp, Artificial Sequence
  Synthetic oligonucleotide
aactcctccatccctgccagatgatgcacatcatt

SEQ ID NO: 168027 - DNA, 35 bp, Artificial Sequence
  Synthetic oligonucleotide
gtgtgttcgggtcccatcgcattttttgtgccctt

SEQ ID NO: 168028 - DNA, 35 bp, Artificial Sequence
  Synthetic oligonucleotide
tcccatacgtcgttcttacttcgcccttctccctt

SEQ ID NO: 168029 - DNA, 35 bp, Artificial Sequence
  Synthetic oligonucleotide
accaaactgctcgggatctccgcctcctccacgtt

SEQ ID NO: 168030 - DNA, 35 bp, Artificial Sequence
  Synthetic oligonucleotide
atgcgtgatcccttgcgcccccaacctgtactgtt

SEQ ID NO: 168031 - DNA, 35 bp, Artificial Sequence
  Synthetic oligonucleotide
gtcacaccatcgcccctcacgccctccagctgttt

SEQ ID NO: 168032 - DNA, 35 bp, Artificial Sequence
  Synthetic oligonucleotide
tcgcatccgccacccgttgcttcttctcatcggaa

SEQ ID NO: 168033 - DNA, 36 bp, Artificial Sequence
  Synthetic oligonucleotide
ttagaggggcgagaaaggcggggggtagacactgaa

SEQ ID NO: 168034 - DNA, 36 bp, Artificial Sequence
  Synthetic oligonucleotide
gccaccccctgcccccatgcagtagtaccacgttaa

SEQ ID NO: 168035 - DNA, 35 bp, Artificial Sequence
  Synthetic oligonucleotide
tcacctcagccctgcgacatcgttcatcccacaca

SEQ ID NO: 168036 - DNA, 36 bp, Artificial Sequence
  Synthetic oligonucleotide
ttcccgcctgcctcactttgcgcctatgccatccca

SEQ ID NO: 168037 - DNA, 36 bp, Artificial Sequence
  Synthetic oligonucleotide
ttgtcatcaccgtactaaccgacttgcccgctccca

SEQ ID NO: 168038 - DNA, 35 bp, Artificial Sequence
  Synthetic oligonucleotide
acaacactacatcgccgtccgtcccccccgtccca

SEQ ID NO: 168039 - DNA, 36 bp, Artificial Sequence
  Synthetic oligonucleotide
gacacctcccagactgctaagaccaacacccccgca

SEQ ID NO: 168040 - DNA, 35 bp, Artificial Sequence
  Synthetic oligonucleotide
tgctactgtaccgtcgctgtaccttcctctgctca

SEQ ID NO: 168041 - DNA, 36 bp, Artificial Sequence
  Synthetic oligonucleotide
tgcctgcattccatcttgtccgtgttcgctctctca

SEQ ID NO: 168042 - DNA, 36 bp, Artificial Sequence
  Synthetic oligonucleotide
tctaacacccccatgtggccccttgtccttctctca

SEQ ID NO: 168043 - DNA, 36 bp, Artificial Sequence
  Synthetic oligonucleotide
tactgcccttctcccgttctccagccacacgcaaga

SEQ ID NO: 168044 - DNA, 37 bp, Artificial Sequence
  Synthetic oligonucleotide
taagcgggtggacggagggtagggattattctgcaga

SEQ ID NO: 168045 - DNA, 37 bp, Artificial Sequence
  Synthetic oligonucleotide
tgagacataaagggtgcgcggggggggaacgggtaga

SEQ ID NO: 168046 - DNA, 37 bp, Artificial Sequence
  Synthetic oligonucleotide
gattaaggtggtaggaaagggagtaagtgagtgacga

SEQ ID NO: 168047 - DNA, 36 bp, Artificial Sequence
  Synthetic oligonucleotide
aaccgacgcgccaccgcgatcctgtcctcttgacga

SEQ ID NO: 168048 - DNA, 37 bp, Artificial Sequence
  Synthetic oligonucleotide
tcagggtggaaggccgggtgggtaacaagggatacga

SEQ ID NO: 168049 - DNA, 37 bp, Artificial Sequence
  Synthetic oligonucleotide
tccaccgcccactcctcaggcccagatggtaccccga

SEQ ID NO: 168050 - DNA, 34 bp, Artificial Sequence
  Synthetic oligonucleotide
gcccgcccccgcccatcgttcccagggaagccga

SEQ ID NO: 168051 - DNA, 37 bp, Artificial Sequence
  Synthetic oligonucleotide
gactgccccgccgtgccatctcagcctgatgctgcga

SEQ ID NO: 168052 - DNA, 37 bp, Artificial Sequence
  Synthetic oligonucleotide
agtaccaccgctgcgttgcctcctccgttctgttcga

SEQ ID NO: 168053 - DNA, 36 bp, Artificial Sequence
  Synthetic oligonucleotide
ttggggtaagagttaaaagggcgggggtggagagga

SEQ ID NO: 168054 - DNA, 37 bp, Artificial Sequence
  Synthetic oligonucleotide
ttcccccccttgtatgtcactcgaacttccctacgga

SEQ ID NO: 168055 - DNA, 37 bp, Artificial Sequence
  Synthetic oligonucleotide
gtcaccgctttatctctatctccgaccctccgtcgga

SEQ ID NO: 168056 - DNA, 35 bp, Artificial Sequence
  Synthetic oligonucleotide
cgtctctgcccccatcacacttctcaccgtaggga

SEQ ID NO: 168057 - DNA, 37 bp, Artificial Sequence
  Synthetic oligonucleotide
acagtcaaggaaacaggagcagtgggacgggtaggga

SEQ ID NO: 168058 - DNA, 36 bp, Artificial Sequence
  Synthetic oligonucleotide
atcatagtggcgggatacctgggggggggacgggga

SEQ ID NO: 168059 - DNA, 37 bp, Artificial Sequence
  Synthetic oligonucleotide
gacgccgcattctctacccactgcctcttctctggga

SEQ ID NO: 168060 - DNA, 37 bp, Artificial Sequence
  Synthetic oligonucleotide
tacgccggttttgatgtacaccaccctccccccatga

SEQ ID NO: 168061 - DNA, 38 bp, Artificial Sequence
  Synthetic oligonucleotide
tcccgcaccctctgaacacagcctaaaccccgccctga

SEQ ID NO: 168062 - DNA, 36 bp, Artificial Sequence
  Synthetic oligonucleotide
tgtggtgtcaacttctatagccgcccgccactctga

SEQ ID NO: 168063 - DNA, 38 bp, Artificial Sequence
  Synthetic oligonucleotide
gacgagaggggaggcgaagaggacaaggacgtgtgtga

SEQ ID NO: 168064 - DNA, 36 bp, Artificial Sequence
  Synthetic oligonucleotide
tacgcacctcctcttttgattttccagcacacttga

SEQ ID NO: 168065 - DNA, 36 bp, Artificial Sequence
  Synthetic oligonucleotide
gttcgcccactgaccattgccatcagtctcatttga

SEQ ID NO: 168066 - DNA, 38 bp, Artificial Sequence
  Synthetic oligonucleotide
gttggccacctgcccctgtttgttagctttcactttga

SEQ ID NO: 168067 - DNA, 36 bp, Artificial Sequence
  Synthetic oligonucleotide
aatgcaggagtgggcgtgaggcggagggatcggata

SEQ ID NO: 168068 - DNA, 35 bp, Artificial Sequence
  Synthetic oligonucleotide
taatcgtgtccgcctctctgtctgctcaccgccta

SEQ ID NO: 168069 - DNA, 36 bp, Artificial Sequence
  Synthetic oligonucleotide
acagtcccctcccacgtacattgacgtgccttgcta

SEQ ID NO: 168070 - DNA, 35 bp, Artificial Sequence
  Synthetic oligonucleotide
acgccgcagcctgccgtccgttccccctaacagta

SEQ ID NO: 168071 - DNA, 36 bp, Artificial Sequence
  Synthetic oligonucleotide
ttcgcccttctcacacgttagcttccccttgtcgta

SEQ ID NO: 168072 - DNA, 35 bp, Artificial Sequence
  Synthetic oligonucleotide
gccgcgccgcccccccttctgccaatcctatggta

SEQ ID NO: 168073 - DNA, 36 bp, Artificial Sequence
  Synthetic oligonucleotide
gaggggggggccacggcggacatgggaacgggctta

SEQ ID NO: 168074 - DNA, 35 bp, Artificial Sequence
  Synthetic oligonucleotide
gaaggtgggctcaaaatctgggggcggggttcaac

SEQ ID NO: 168075 - DNA, 35 bp, Artificial Sequence
  Synthetic oligonucleotide
accacaccctggtaccttgcccagtccttagccac

SEQ ID NO: 168076 - DNA, 35 bp, Artificial Sequence
  Synthetic oligonucleotide
acccgaccaccatgccccccactctatgcgttcac

SEQ ID NO: 168077 - DNA, 35 bp, Artificial Sequence
  Synthetic oligonucleotide
acacgctcgctcctgttgccattggtctgtttcac

SEQ ID NO: 168078 - DNA, 35 bp, Artificial Sequence
  Synthetic oligonucleotide
gatgcgccgatcctgccctcatcgtcccttttcac

SEQ ID NO: 168079 - DNA, 35 bp, Artificial Sequence
  Synthetic oligonucleotide
tcacgtatcccgctcgtatgccccaatccattgac

SEQ ID NO: 168080 - DNA, 35 bp, Artificial Sequence
  Synthetic oligonucleotide
ttagctgcccacctattactcctgcctgttagtac

SEQ ID NO: 168081 - DNA, 35 bp, Artificial Sequence
  Synthetic oligonucleotide
gacccgtttccctaagcctcgtttctagtgtcccc

SEQ ID NO: 168082 - DNA, 35 bp, Artificial Sequence
  Synthetic oligonucleotide
attcccccgataagtgtgatgcccctgaccacgcc

SEQ ID NO: 168083 - DNA, 35 bp, Artificial Sequence
  Synthetic oligonucleotide
gccgcgcgaagagtttcttcctcctccgatacgcc

SEQ ID NO: 168084 - DNA, 35 bp, Artificial Sequence
  Synthetic oligonucleotide
tgaccgatctcccacctctcaagcgtaggtacgcc

SEQ ID NO: 168085 - DNA, 35 bp, Artificial Sequence
  Synthetic oligonucleotide
gctctcccccccgtgcttataatgtaattggcgcc

SEQ ID NO: 168086 - DNA, 35 bp, Artificial Sequence
  Synthetic oligonucleotide
gaccgggggggcctcttgggacgggtgtcatatcc

SEQ ID NO: 168087 - DNA, 35 bp, Artificial Sequence
  Synthetic oligonucleotide
accccccccagtgtggattcacctacgctgcctcc

SEQ ID NO: 168088 - DNA, 35 bp, Artificial Sequence
  Synthetic oligonucleotide
gacctacgcgccaatggctggccgtgcaatcctcc

SEQ ID NO: 168089 - DNA, 34 bp, Artificial Sequence
  Synthetic oligonucleotide
gtaccgcaatcggatctaatttgttccttcctcc

SEQ ID NO: 168090 - DNA, 35 bp, Artificial Sequence
  Synthetic oligonucleotide
attcgttcccgccattcactctggattcaggctcc

SEQ ID NO: 168091 - DNA, 35 bp, Artificial Sequence
  Synthetic oligonucleotide
ttcaccgtcgcatttccgtacctctacccgtgtcc

SEQ ID NO: 168092 - DNA, 35 bp, Artificial Sequence
  Synthetic oligonucleotide
atgacgctgtcccctttccaggcttggctccttcc

SEQ ID NO: 168093 - DNA, 35 bp, Artificial Sequence
  Synthetic oligonucleotide
atccccccgcacctgccccacgtctaccgacctgc

SEQ ID NO: 168094 - DNA, 36 bp, Artificial Sequence
  Synthetic oligonucleotide
acccaccgccaaatgtttgtgtctcgcccccacatc

SEQ ID NO: 168095 - DNA, 35 bp, Artificial Sequence
  Synthetic oligonucleotide
atcatccatctgtgtccctgcccctttctgctatc

SEQ ID NO: 168096 - DNA, 35 bp, Artificial Sequence
  Synthetic oligonucleotide
gatcgccgtacaatctcttccctgacgatgacctc

SEQ ID NO: 168097 - DNA, 35 bp, Artificial Sequence
  Synthetic oligonucleotide
accttcgccaccgcagtattatagaccctcccctc

SEQ ID NO: 168098 - DNA, 35 bp, Artificial Sequence
  Synthetic oligonucleotide
gcgcacaatggcctgtgcgctgactcctgattctc

SEQ ID NO: 168099 - DNA, 35 bp, Artificial Sequence
  Synthetic oligonucleotide
tcccatctccctgatcactagaaccaaactccgtc

SEQ ID NO: 168100 - DNA, 35 bp, Artificial Sequence
  Synthetic oligonucleotide
ttctgtgcgacgttgttgtcgcgcgccccctcttc

SEQ ID NO: 168101 - DNA, 35 bp, Artificial Sequence
  Synthetic oligonucleotide
attcagcggcgagctcttctccctccatcttgtag

SEQ ID NO: 168102 - DNA, 35 bp, Artificial Sequence
  Synthetic oligonucleotide
aattgcggtcccggcccatctcgacccccgccccg

SEQ ID NO: 168103 - DNA, 35 bp, Artificial Sequence
  Synthetic oligonucleotide
atggaggggtgctcggggtggaagcgagggaggcg

SEQ ID NO: 168104 - DNA, 35 bp, Artificial Sequence
  Synthetic oligonucleotide
gccacaccctctccagtgtattctcatttgttgcg

SEQ ID NO: 168105 - DNA, 35 bp, Artificial Sequence
  Synthetic oligonucleotide
caacccccatccctgttgatccttgaaccacctcg

SEQ ID NO: 168106 - DNA, 35 bp, Artificial Sequence
  Synthetic oligonucleotide
tgcggtcgttgggacggttgtaggagggggtaggg

SEQ ID NO: 168107 - DNA, 35 bp, Artificial Sequence
  Synthetic oligonucleotide
tgcagatgaagcggggggagttgaggtgaaccggg

SEQ ID NO: 168108 - DNA, 35 bp, Artificial Sequence
  Synthetic oligonucleotide
gagcaatccgtccatctcgcttcccctttacatgg

SEQ ID NO: 168109 - DNA, 35 bp, Artificial Sequence
  Synthetic oligonucleotide
atcctcgcaacctgtcccttcccatcaagtcctgg

SEQ ID NO: 168110 - DNA, 35 bp, Artificial Sequence
  Synthetic oligonucleotide
gtctcatgtctccaccgtccttcatcctgctgtgg

SEQ ID NO: 168111 - DNA, 35 bp, Artificial Sequence
  Synthetic oligonucleotide
tgcgctctagcatcgtagccaccgactcctccctg

SEQ ID NO: 168112 - DNA, 35 bp, Artificial Sequence
  Synthetic oligonucleotide
tacctgccacccttcccgctattgcactagccgtg

SEQ ID NO: 168113 - DNA, 35 bp, Artificial Sequence
  Synthetic oligonucleotide
gctactctgtgccccccctgatttagcctgccttg

SEQ ID NO: 168114 - DNA, 35 bp, Artificial Sequence
  Synthetic oligonucleotide
tccaccaggtgcatcctccgtccatacattccttg

SEQ ID NO: 168115 - DNA, 35 bp, Artificial Sequence
  Synthetic oligonucleotide
gcccaaggctccccgttacgtcccgctagccacat

SEQ ID NO: 168116 - DNA, 35 bp, Artificial Sequence
  Synthetic oligonucleotide
tgtcccttgccacggttgttaatgtatccctctat

SEQ ID NO: 168117 - DNA, 35 bp, Artificial Sequence
  Synthetic oligonucleotide
gtgcaccggagtcgcccgcctgagaacctctctat

SEQ ID NO: 168118 - DNA, 35 bp, Artificial Sequence
  Synthetic oligonucleotide
tttggccggatcgcaccacatttttgccacctact

SEQ ID NO: 168119 - DNA, 35 bp, Artificial Sequence
  Synthetic oligonucleotide
taccatgcccgttccttgaagcgctcttaccacct

SEQ ID NO: 168120 - DNA, 35 bp, Artificial Sequence
  Synthetic oligonucleotide
tgcgcctcgcggagcgactcttacctcggtcccct

SEQ ID NO: 168121 - DNA, 35 bp, Artificial Sequence
  Synthetic oligonucleotide
gcccgtcgttcacctgcagtcgttcgttacatcct

SEQ ID NO: 168122 - DNA, 35 bp, Artificial Sequence
  Synthetic oligonucleotide
actaccgccgcctcagcccctcttggcgaaacgct

SEQ ID NO: 168123 - DNA, 33 bp, Artificial Sequence
  Synthetic oligonucleotide
tcctgtccggtcccgtcaatgctcttcgcctct

SEQ ID NO: 168124 - DNA, 34 bp, Artificial Sequence
  Synthetic oligonucleotide
acagtgtccccgggtcgtccctaacttacgctct

SEQ ID NO: 168125 - DNA, 35 bp, Artificial Sequence
  Synthetic oligonucleotide
ggtcaaggcgatcaaccactcctccgtcgtcccgt

SEQ ID NO: 168126 - DNA, 35 bp, Artificial Sequence
  Synthetic oligonucleotide
gcccgctaccgcacactggatcccgtctacttcgt

SEQ ID NO: 168127 - DNA, 35 bp, Artificial Sequence
  Synthetic oligonucleotide
tccgtccctccgtgttgcgcctctattacccgtgt

SEQ ID NO: 168128 - DNA, 35 bp, Artificial Sequence
  Synthetic oligonucleotide
tcattcaccaccaatatgcgttacttactagcatt

SEQ ID NO: 168129 - DNA, 35 bp, Artificial Sequence
  Synthetic oligonucleotide
actcgccctctcacctctgccgtcgttggtccctt

SEQ ID NO: 168130 - DNA, 35 bp, Artificial Sequence
  Synthetic oligonucleotide
gtggcatcccgcccccttggagccccctgtccctt

SEQ ID NO: 168131 - DNA, 35 bp, Artificial Sequence
  Synthetic oligonucleotide
gccccgcccggtttgcttatcctggtcagcctgtt

SEQ ID NO: 168132 - DNA, 35 bp, Artificial Sequence
  Synthetic oligonucleotide
tgtgaggacgcacgccccttcgccctccttttgtt

SEQ ID NO: 168133 - DNA, 36 bp, Artificial Sequence
  Synthetic oligonucleotide
gaacacggggaaggagagcgaccagtgggggggaaa

SEQ ID NO: 168134 - DNA, 36 bp, Artificial Sequence
  Synthetic oligonucleotide
tacgccattctccatcatttttcatcgactgttaaa

SEQ ID NO: 168135 - DNA, 35 bp, Artificial Sequence
  Synthetic oligonucleotide
ggacacctctcgtaaccgttactcgcctctctaca

SEQ ID NO: 168136 - DNA, 36 bp, Artificial Sequence
  Synthetic oligonucleotide
aatgcccgcacccgcaccaagatcggtcgattccca

SEQ ID NO: 168137 - DNA, 36 bp, Artificial Sequence
  Synthetic oligonucleotide
tcccatgttctcgacgcatttaactcgccatatcca

SEQ ID NO: 168138 - DNA, 36 bp, Artificial Sequence
  Synthetic oligonucleotide
actgctccccatcatggctgcggtacctttcttcca

SEQ ID NO: 168139 - DNA, 36 bp, Artificial Sequence
  Synthetic oligonucleotide
attccgggtggggttgggagggattggacatcggca

SEQ ID NO: 168140 - DNA, 36 bp, Artificial Sequence
  Synthetic oligonucleotide
gcaccgtccaataatatgggtaggggagggcgggca

SEQ ID NO: 168141 - DNA, 36 bp, Artificial Sequence
  Synthetic oligonucleotide
accgccgtagctttcaactcgccaccgttgcctgca

SEQ ID NO: 168142 - DNA, 36 bp, Artificial Sequence
  Synthetic oligonucleotide
ttatgccccgcaccgtgtcgtcccttagctattgca

SEQ ID NO: 168143 - DNA, 36 bp, Artificial Sequence
  Synthetic oligonucleotide
gaactgcacccccccctcccaggcacccagggttca

SEQ ID NO: 168144 - DNA, 37 bp, Artificial Sequence
  Synthetic oligonucleotide
tgagctagacggtgagcagggggagtgggggagaaga

SEQ ID NO: 168145 - DNA, 37 bp, Artificial Sequence
  Synthetic oligonucleotide
gggaagatgacggggggatgggtgcgggttggtcaga

SEQ ID NO: 168146 - DNA, 37 bp, Artificial Sequence
  Synthetic oligonucleotide
gaaccaagttaggcaaggggaggagaaggcgccgaga

SEQ ID NO: 168147 - DNA, 37 bp, Artificial Sequence
  Synthetic oligonucleotide
tgtacgggaagggaaaggggggtacagggggctgaga

SEQ ID NO: 168148 - DNA, 37 bp, Artificial Sequence
  Synthetic oligonucleotide
gttcaccatccattcgtcacgtagcatcgttcaccga

SEQ ID NO: 168149 - DNA, 36 bp, Artificial Sequence
  Synthetic oligonucleotide
gaaccgtacatatcccgcacacaacccgaccgccga

SEQ ID NO: 168150 - DNA, 37 bp, Artificial Sequence
  Synthetic oligonucleotide
atcacctcatcctgacgacgacatcactcccctccga

SEQ ID NO: 168151 - DNA, 35 bp, Artificial Sequence
  Synthetic oligonucleotide
accatcgggaggaggggaagaaagggggggaagga

SEQ ID NO: 168152 - DNA, 37 bp, Artificial Sequence
  Synthetic oligonucleotide
gaaagatggcagggggaatgaagcaatggggtgagga

SEQ ID NO: 168153 - DNA, 35 bp, Artificial Sequence
  Synthetic oligonucleotide
ccactcccagccggtttccctctcctcttgtagga

SEQ ID NO: 168154 - DNA, 37 bp, Artificial Sequence
  Synthetic oligonucleotide
gtgggatgaagagggagtggggggtggtaaagaggga

SEQ ID NO: 168155 - DNA, 37 bp, Artificial Sequence
  Synthetic oligonucleotide
agcaatggagggggggaaaggacctgattcatgggga

SEQ ID NO: 168156 - DNA, 37 bp, Artificial Sequence
  Synthetic oligonucleotide
tagggcgtttatcatgggggcggggattagcttggga

SEQ ID NO: 168157 - DNA, 37 bp, Artificial Sequence
  Synthetic oligonucleotide
atgatcggcgtacaccatgcttaccttacctcctgga

SEQ ID NO: 168158 - DNA, 37 bp, Artificial Sequence
  Synthetic oligonucleotide
tcacgtcttccgaagttgccccccccgcccgacctga

SEQ ID NO: 168159 - DNA, 37 bp, Artificial Sequence
  Synthetic oligonucleotide
ggggccactgccgttcctgcccatgttcctatcctga

SEQ ID NO: 168160 - DNA, 38 bp, Artificial Sequence
  Synthetic oligonucleotide
gggaacggggccgaggacggggaaagtgggctaagtga

SEQ ID NO: 168161 - DNA, 36 bp, Artificial Sequence
  Synthetic oligonucleotide
gtatgggaaggggaggtggggcctaaggaatcgtga

SEQ ID NO: 168162 - DNA, 37 bp, Artificial Sequence
  Synthetic oligonucleotide
gactgggtgggtggtggggggctaataaagatcgtga

SEQ ID NO: 168163 - DNA, 38 bp, Artificial Sequence
  Synthetic oligonucleotide
agacagtcgcaaagagcccccccccctgccctcggtga

SEQ ID NO: 168164 - DNA, 38 bp, Artificial Sequence
  Synthetic oligonucleotide
aggggtagacaggggggaacaaggagatcggagggtga

SEQ ID NO: 168165 - DNA, 36 bp, Artificial Sequence
  Synthetic oligonucleotide
ttccaccccccgcccggttgcaccaactacctgtga

SEQ ID NO: 168166 - DNA, 38 bp, Artificial Sequence
  Synthetic oligonucleotide
tacagtcatccgaccccgtgttcgcccctccgcattga

SEQ ID NO: 168167 - DNA, 38 bp, Artificial Sequence
  Synthetic oligonucleotide
gatcgcgccacctcgtatgcccacttcaccccacttga

SEQ ID NO: 168168 - DNA, 37 bp, Artificial Sequence
  Synthetic oligonucleotide
aaccgccgcgcatctatattttcgtccgcctccttga

SEQ ID NO: 168169 - DNA, 38 bp, Artificial Sequence
  Synthetic oligonucleotide
tagtgggggagggtcaggtaagcagggggggcagttga

SEQ ID NO: 168170 - DNA, 36 bp, Artificial Sequence
  Synthetic oligonucleotide
accaccccgcttgattccgtaaccccaatatgttga

SEQ ID NO: 168171 - DNA, 38 bp, Artificial Sequence
  Synthetic oligonucleotide
acgaaagggtggaggcgggtaaagcagtgcggtgttga

SEQ ID NO: 168172 - DNA, 38 bp, Artificial Sequence
  Synthetic oligonucleotide
ttcgcatcccacacacaacgttttcgacctgcctttga

SEQ ID NO: 168173 - DNA, 36 bp, Artificial Sequence
  Synthetic oligonucleotide
atccgccggtgctggtggccctccgctctcgaccta

SEQ ID NO: 168174 - DNA, 36 bp, Artificial Sequence
  Synthetic oligonucleotide
aactcggcacatgactctttggctccactacatcta

SEQ ID NO: 168175 - DNA, 36 bp, Artificial Sequence
  Synthetic oligonucleotide
gatggcacggccctgcgctcttacttacaccatcta

SEQ ID NO: 168176 - DNA, 35 bp, Artificial Sequence
  Synthetic oligonucleotide
gcctgccacactttcgttcctatccgtttcccgta

SEQ ID NO: 168177 - DNA, 36 bp, Artificial Sequence
  Synthetic oligonucleotide
tactccccaccacctgtcgcctagttccggtccgta

SEQ ID NO: 168178 - DNA, 36 bp, Artificial Sequence
  Synthetic oligonucleotide
gtagccctccgccactggtgtcactttctactcgta

SEQ ID NO: 168179 - DNA, 35 bp, Artificial Sequence
  Synthetic oligonucleotide
gcacctccctccgtctctgtttaccggccttcaac

SEQ ID NO: 168180 - DNA, 35 bp, Artificial Sequence
  Synthetic oligonucleotide
gtgcgatcaagcccatgtcccccgtttggccatac

SEQ ID NO: 168181 - DNA, 34 bp, Artificial Sequence
  Synthetic oligonucleotide
agccgctttccgcctacgccctccatgccgatac

SEQ ID NO: 168182 - DNA, 35 bp, Artificial Sequence
  Synthetic oligonucleotide
cccaccgtacagctcggcgctcatctccccatacc

SEQ ID NO: 168183 - DNA, 35 bp, Artificial Sequence
  Synthetic oligonucleotide
attttcgtcacctgcgctcggtccatgcacctacc

SEQ ID NO: 168184 - DNA, 35 bp, Artificial Sequence
  Synthetic oligonucleotide
agtgatggccatcttgcgtgtaactcctgtcgccc

SEQ ID NO: 168185 - DNA, 35 bp, Artificial Sequence
  Synthetic oligonucleotide
tactccatggcctgcatgacctcgtaacctttccc

SEQ ID NO: 168186 - DNA, 31 bp, Artificial Sequence
  Synthetic oligonucleotide
gactaaccggctcgccatacttccccgcgcc

SEQ ID NO: 168187 - DNA, 35 bp, Artificial Sequence
  Synthetic oligonucleotide
taacgcgcacctgtccagctttaggcacactcgcc

SEQ ID NO: 168188 - DNA, 35 bp, Artificial Sequence
  Synthetic oligonucleotide
gatacatcatacagcttgcacgctcctgcttcgcc

SEQ ID NO: 168189 - DNA, 35 bp, Artificial Sequence
  Synthetic oligonucleotide
gtcgccccctctgcgagcacctccactttgttgcc

SEQ ID NO: 168190 - DNA, 35 bp, Artificial Sequence
  Synthetic oligonucleotide
ttgtgcacgtgatgtactcacccctgtacgcctcc

SEQ ID NO: 168191 - DNA, 35 bp, Artificial Sequence
  Synthetic oligonucleotide
aaggccatccccggcctcacgacttaatgtcctcc

SEQ ID NO: 168192 - DNA, 35 bp, Artificial Sequence
  Synthetic oligonucleotide
gccctcccatgccttcccatcgatttacgatctcc

SEQ ID NO: 168193 - DNA, 35 bp, Artificial Sequence
  Synthetic oligonucleotide
ttgcacgaccgtaccactcgcgcccccagtatcgc

SEQ ID NO: 168194 - DNA, 35 bp, Artificial Sequence
  Synthetic oligonucleotide
tcacacccttccctttctggcgataccagccgggc

SEQ ID NO: 168195 - DNA, 35 bp, Artificial Sequence
  Synthetic oligonucleotide
gacgcccgaacctccccgtaaaccccgaacgtggc

SEQ ID NO: 168196 - DNA, 35 bp, Artificial Sequence
  Synthetic oligonucleotide
tttcgaccccctacgtacgctacatctgatcctgc

SEQ ID NO: 168197 - DNA, 35 bp, Artificial Sequence
  Synthetic oligonucleotide
atcagccctcccctgttcacgttctcgggatctgc

SEQ ID NO: 168198 - DNA, 36 bp, Artificial Sequence
  Synthetic oligonucleotide
actcaacctcctcatcatccttggcaccggttctgc

SEQ ID NO: 168199 - DNA, 35 bp, Artificial Sequence
  Synthetic oligonucleotide
atgtgccacccactccctcctaagtgtatgatatc

SEQ ID NO: 168200 - DNA, 35 bp, Artificial Sequence
  Synthetic oligonucleotide
atcgggactcgggcgggtgggggacgcgtattatc

SEQ ID NO: 168201 - DNA, 35 bp, Artificial Sequence
  Synthetic oligonucleotide
acctcccaccacccgaggcctaacaatgacgactc

SEQ ID NO: 168202 - DNA, 35 bp, Artificial Sequence
  Synthetic oligonucleotide
aagcaacgcttaagtcctgctcgatcacgctactc

SEQ ID NO: 168203 - DNA, 35 bp, Artificial Sequence
  Synthetic oligonucleotide
tgagactcatcgtgtcattcgccgttttgaacctc

SEQ ID NO: 168204 - DNA, 35 bp, Artificial Sequence
  Synthetic oligonucleotide
atcactcctgtgcgttgctccaggcctaattgctc

SEQ ID NO: 168205 - DNA, 35 bp, Artificial Sequence
  Synthetic oligonucleotide
tcgcgaggccggtctatcttgtggttgtctcgttc

SEQ ID NO: 168206 - DNA, 35 bp, Artificial Sequence
  Synthetic oligonucleotide
gagatgggaagggtgaggatgtcaagtaaatgcag

SEQ ID NO: 168207 - DNA, 35 bp, Artificial Sequence
  Synthetic oligonucleotide
ttcccatccatccggtgccttagcctcccaactag

SEQ ID NO: 168208 - DNA, 35 bp, Artificial Sequence
  Synthetic oligonucleotide
gaggaggactccgggatagggggggaagtgactag

SEQ ID NO: 168209 - DNA, 35 bp, Artificial Sequence
  Synthetic oligonucleotide
ggagccccgatccccgctgctcgccgtgctacccg

SEQ ID NO: 168210 - DNA, 35 bp, Artificial Sequence
  Synthetic oligonucleotide
gcatcccttgcatcccgtccgttacccgaccgccg

SEQ ID NO: 168211 - DNA, 35 bp, Artificial Sequence
  Synthetic oligonucleotide
tcctatagcctccgcactcacagacccacctatcg

SEQ ID NO: 168212 - DNA, 35 bp, Artificial Sequence
  Synthetic oligonucleotide
gcctgtgcctctcgaattttggttttcccgtatcg

SEQ ID NO: 168213 - DNA, 35 bp, Artificial Sequence
  Synthetic oligonucleotide
gcaccacctgcctacatcatttccgtaccttgtcg

SEQ ID NO: 168214 - DNA, 35 bp, Artificial Sequence
  Synthetic oligonucleotide
ttacttcctccgtctggcactcctgcactttgtcg

SEQ ID NO: 168215 - DNA, 35 bp, Artificial Sequence
  Synthetic oligonucleotide
gtcgctccgccactcttcatgactcttctccttcg

SEQ ID NO: 168216 - DNA, 35 bp, Artificial Sequence
  Synthetic oligonucleotide
ggtggaggaattgcagggggaagtcgtaggagcgg

SEQ ID NO: 168217 - DNA, 35 bp, Artificial Sequence
  Synthetic oligonucleotide
ggatggagaagacgaggcaataggcgataggaggg

SEQ ID NO: 168218 - DNA, 35 bp, Artificial Sequence
  Synthetic oligonucleotide
tgccactctacttttctccactcgtttacatcggg

SEQ ID NO: 168219 - DNA, 35 bp, Artificial Sequence
  Synthetic oligonucleotide
gtgatagggaggggttgttgttttcagggcggggg

SEQ ID NO: 168220 - DNA, 35 bp, Artificial Sequence
  Synthetic oligonucleotide
gaatccaaccactgctgcctttagacttatcatgg

SEQ ID NO: 168221 - DNA, 35 bp, Artificial Sequence
  Synthetic oligonucleotide
gcgcatgtatcctccactgtcatttttccgacctg

SEQ ID NO: 168222 - DNA, 35 bp, Artificial Sequence
  Synthetic oligonucleotide
ggtggctggcatccattatttcgtcactctttctg

SEQ ID NO: 168223 - DNA, 35 bp, Artificial Sequence
  Synthetic oligonucleotide
agcacgaatcctccagtaccgccccacccgacttg

SEQ ID NO: 168224 - DNA, 35 bp, Artificial Sequence
  Synthetic oligonucleotide
agctacatgcaagcgttgtatcatcctcccctttg

SEQ ID NO: 168225 - DNA, 35 bp, Artificial Sequence
  Synthetic oligonucleotide
aaagggtaggcgaagaggagggtacacggccgcat

SEQ ID NO: 168226 - DNA, 35 bp, Artificial Sequence
  Synthetic oligonucleotide
ggaggggctgagggttgcatgagtggaagggtcat

SEQ ID NO: 168227 - DNA, 35 bp, Artificial Sequence
  Synthetic oligonucleotide
gtccgcaacgagtaattcgcagcctttccgcctat

SEQ ID NO: 168228 - DNA, 35 bp, Artificial Sequence
  Synthetic oligonucleotide
gcgaacctcgtgtcgtccgccccttcctgttcact

SEQ ID NO: 168229 - DNA, 35 bp, Artificial Sequence
  Synthetic oligonucleotide
ttcactccggcctccctcgcaccagtgccaatact

SEQ ID NO: 168230 - DNA, 35 bp, Artificial Sequence
  Synthetic oligonucleotide
tgtgaccccgccttgtacgccctgcggctccacct

SEQ ID NO: 168231 - DNA, 35 bp, Artificial Sequence
  Synthetic oligonucleotide
aatcccaccccattccgcacgttcctattagacct

SEQ ID NO: 168232 - DNA, 35 bp, Artificial Sequence
  Synthetic oligonucleotide
gcaaccaccatcgagccgcgctacgggaacgccct

SEQ ID NO: 168233 - DNA, 35 bp, Artificial Sequence
  Synthetic oligonucleotide
acactgtccccggttccagctctgaatccacgcct

SEQ ID NO: 168234 - DNA, 35 bp, Artificial Sequence
  Synthetic oligonucleotide
agacgcgagggggactcacaggggaggggagggct

SEQ ID NO: 168235 - DNA, 35 bp, Artificial Sequence
  Synthetic oligonucleotide
gtcaacgcccaatcaacacgcgtagtaacacctct

SEQ ID NO: 168236 - DNA, 35 bp, Artificial Sequence
  Synthetic oligonucleotide
acctgtacctccctctgctgccacgacctaggcgt

SEQ ID NO: 168237 - DNA, 35 bp, Artificial Sequence
  Synthetic oligonucleotide
gacggagggaaggttcggggcatagtgggcattgt

SEQ ID NO: 168238 - DNA, 35 bp, Artificial Sequence
  Synthetic oligonucleotide
ggtccgccttctgctggatcctgttcccttgcatt

SEQ ID NO: 168239 - DNA, 35 bp, Artificial Sequence
  Synthetic oligonucleotide
taacctccgcatttggagagtccacaatcgccctt

SEQ ID NO: 168240 - DNA, 35 bp, Artificial Sequence
  Synthetic oligonucleotide
taccccgcgagccgcacatgtactcgccactcctt

SEQ ID NO: 168241 - DNA, 35 bp, Artificial Sequence
  Synthetic oligonucleotide
atttaccactccgcacgtcttttcaggcccttctt

SEQ ID NO: 168242 - DNA, 35 bp, Artificial Sequence
  Synthetic oligonucleotide
gagaacagacgacatattctatcgcgcctctcgtt

SEQ ID NO: 168243 - DNA, 35 bp, Artificial Sequence
  Synthetic oligonucleotide
gcgatcggtcggcattactctgcctgctttcgttt

SEQ ID NO: 168244 - DNA, 35 bp, Artificial Sequence
  Synthetic oligonucleotide
tgccaagcaccccatgcgctccgttgtcatcccaa

SEQ ID NO: 168245 - DNA, 36 bp, Artificial Sequence
  Synthetic oligonucleotide
acgttcagaccgctctttccctactcgttccgcaca

SEQ ID NO: 168246 - DNA, 35 bp, Artificial Sequence
  Synthetic oligonucleotide
tcttgctccctctttgcttctccgctccgttgaca

SEQ ID NO: 168247 - DNA, 35 bp, Artificial Sequence
  Synthetic oligonucleotide
ttccgtactcgcctcttacggttcaactgactaca

SEQ ID NO: 168248 - DNA, 36 bp, Artificial Sequence
  Synthetic oligonucleotide
ggaccgttcaggatgttttccgcccatccttaccca

SEQ ID NO: 168249 - DNA, 36 bp, Artificial Sequence
  Synthetic oligonucleotide
gccaccatcacctgacccctatgttgtataccccca

SEQ ID NO: 168250 - DNA, 36 bp, Artificial Sequence
  Synthetic oligonucleotide
acactgtgcacgcgtcacttacctagattgccccca

SEQ ID NO: 168251 - DNA, 33 bp, Artificial Sequence
  Synthetic oligonucleotide
tgtccctccgccctactatgaaccccgtcccca

SEQ ID NO: 168252 - DNA, 34 bp, Artificial Sequence
  Synthetic oligonucleotide
tgtagtctgcatcctcgtctatcgtcacatccca

SEQ ID NO: 168253 - DNA, 35 bp, Artificial Sequence
  Synthetic oligonucleotide
ggcatcccacttgttctgcctgcgtgcctttccca

SEQ ID NO: 168254 - DNA, 35 bp, Artificial Sequence
  Synthetic oligonucleotide
tccctcccccgctccttcttcatgacagcttgcca

SEQ ID NO: 168255 - DNA, 36 bp, Artificial Sequence
  Synthetic oligonucleotide
gcaaacccacgatcgtaatcacctcacctcccagca

SEQ ID NO: 168256 - DNA, 36 bp, Artificial Sequence
  Synthetic oligonucleotide
gacccgtaagcccccccatagcgttccaccttatca

SEQ ID NO: 168257 - DNA, 36 bp, Artificial Sequence
  Synthetic oligonucleotide
tccgggggggatgggagcgggaaacaggttttatca

SEQ ID NO: 168258 - DNA, 36 bp, Artificial Sequence
  Synthetic oligonucleotide
tagcgtacgctccccttgttcaaactactgcactca

SEQ ID NO: 168259 - DNA, 35 bp, Artificial Sequence
  Synthetic oligonucleotide
ttgccacgacgcgcacgccacggctctccacctca

SEQ ID NO: 168260 - DNA, 37 bp, Artificial Sequence
  Synthetic oligonucleotide
gcagggggagaaggacatgggattatgtgggggcaga

SEQ ID NO: 168261 - DNA, 35 bp, Artificial Sequence
  Synthetic oligonucleotide
acttgccactccccgaccccgacatcgcgaagcga

SEQ ID NO: 168262 - DNA, 37 bp, Artificial Sequence
  Synthetic oligonucleotide
gaccacgtccagaaggcgtacacccctgcaccatcga

SEQ ID NO: 168263 - DNA, 37 bp, Artificial Sequence
  Synthetic oligonucleotide
tccccatcgtgccagttgctattattgatctcctcga

SEQ ID NO: 168264 - DNA, 36 bp, Artificial Sequence
  Synthetic oligonucleotide
ttcgtcgcacctggccccgttcctcctcaagttcga

SEQ ID NO: 168265 - DNA, 36 bp, Artificial Sequence
  Synthetic oligonucleotide
agtgggggggcgggtgaccgggcacgggtggtagga

SEQ ID NO: 168266 - DNA, 37 bp, Artificial Sequence
  Synthetic oligonucleotide
gatgtagtgccaaatagcgggcggggtgtgggaggga

SEQ ID NO: 168267 - DNA, 37 bp, Artificial Sequence
  Synthetic oligonucleotide
ggggtagggcaagtgtggggagaggaaacatagggga

SEQ ID NO: 168268 - DNA, 36 bp, Artificial Sequence
  Synthetic oligonucleotide
aaccgatgagaggggtaaatgatgtggtggggggga

SEQ ID NO: 168269 - DNA, 37 bp, Artificial Sequence
  Synthetic oligonucleotide
tgcctcccctatgctgactagtccagtacctccatga

SEQ ID NO: 168270 - DNA, 38 bp, Artificial Sequence
  Synthetic oligonucleotide
gactgcctctttgcctacacgaacaccctggtcactga

SEQ ID NO: 168271 - DNA, 37 bp, Artificial Sequence
  Synthetic oligonucleotide
tgctatgcctcttgccgaccgtacacccaccccctga

SEQ ID NO: 168272 - DNA, 37 bp, Artificial Sequence
  Synthetic oligonucleotide
gacattggaagggaggggagcaggaggcaagaagtga

SEQ ID NO: 168273 - DNA, 37 bp, Artificial Sequence
  Synthetic oligonucleotide
atattccgcgtcctggccttaacatcctcccgcgtga

SEQ ID NO: 168274 - DNA, 38 bp, Artificial Sequence
  Synthetic oligonucleotide
atggggctgggggatggggtggacggcatcgtgcgtga

SEQ ID NO: 168275 - DNA, 38 bp, Artificial Sequence
  Synthetic oligonucleotide
gcaccttccccgacgcctcgacttcaacagtctcttga

SEQ ID NO: 168276 - DNA, 36 bp, Artificial Sequence
  Synthetic oligonucleotide
tacaagtccctgtaggtcccgacgcgctccccctta

SEQ ID NO: 168277 - DNA, 36 bp, Artificial Sequence
  Synthetic oligonucleotide
tcttactgccaccgttgtatccgtcgtcgcacttta

SEQ ID NO: 168278 - DNA, 35 bp, Artificial Sequence
  Synthetic oligonucleotide
acaccaccctcatcctggctttcagggtcccgcac

SEQ ID NO: 168279 - DNA, 34 bp, Artificial Sequence
  Synthetic oligonucleotide
gttgcacgagcccttcgccgactcgcattatcac

SEQ ID NO: 168280 - DNA, 35 bp, Artificial Sequence
  Synthetic oligonucleotide
aacaccacatgttactgcttacccctgatcactac

SEQ ID NO: 168281 - DNA, 35 bp, Artificial Sequence
  Synthetic oligonucleotide
ttcgctagacgccctctaccctgcatgacggaacc

SEQ ID NO: 168282 - DNA, 35 bp, Artificial Sequence
  Synthetic oligonucleotide
gacccacaccgagccgcacatcgcctgtccacacc

SEQ ID NO: 168283 - DNA, 35 bp, Artificial Sequence
  Synthetic oligonucleotide
aaagcccactgcctactgtccgcgtacgccgtacc

SEQ ID NO: 168284 - DNA, 35 bp, Artificial Sequence
  Synthetic oligonucleotide
gccatgatcactgcgtaacactgtacctgcccccc

SEQ ID NO: 168285 - DNA, 35 bp, Artificial Sequence
  Synthetic oligonucleotide
gatcagccggttagtatgcctcccttcctcagccc

SEQ ID NO: 168286 - DNA, 35 bp, Artificial Sequence
  Synthetic oligonucleotide
ttgggctcggttctgactccactgtcgtttcgccc

SEQ ID NO: 168287 - DNA, 35 bp, Artificial Sequence
  Synthetic oligonucleotide
tccccgtaattgcagtatatcttcgtgtccttccc

SEQ ID NO: 168288 - DNA, 35 bp, Artificial Sequence
  Synthetic oligonucleotide
tgcgcactctggcgaacctaagagcctccgccgcc

SEQ ID NO: 168289 - DNA, 35 bp, Artificial Sequence
  Synthetic oligonucleotide
tgcccctcgttcgtaccctgtcctcgctatccgcc

SEQ ID NO: 168290 - DNA, 35 bp, Artificial Sequence
  Synthetic oligonucleotide
ttggcctgtgcccgccatgacggtttctctccgcc

SEQ ID NO: 168291 - DNA, 35 bp, Artificial Sequence
  Synthetic oligonucleotide
gcctatcctgagcgtaaagctccatctctttatcc

SEQ ID NO: 168292 - DNA, 35 bp, Artificial Sequence
  Synthetic oligonucleotide
caacccgatgataggccgtatcgggtactacctcc

SEQ ID NO: 168293 - DNA, 35 bp, Artificial Sequence
  Synthetic oligonucleotide
tcacgctactacgtgataacatgttttacgcctcc

SEQ ID NO: 168294 - DNA, 35 bp, Artificial Sequence
  Synthetic oligonucleotide
caccctccggccggtgcttacccgctctctgctcc

SEQ ID NO: 168295 - DNA, 35 bp, Artificial Sequence
  Synthetic oligonucleotide
actccacgtgtcacgctcctcttattcttccacgc

SEQ ID NO: 168296 - DNA, 35 bp, Artificial Sequence
  Synthetic oligonucleotide
tcaccccccacgctggctatccacgactcgtccgc

SEQ ID NO: 168297 - DNA, 35 bp, Artificial Sequence
  Synthetic oligonucleotide
ttgaccactgttgattccgacgtcattgccctcgc

SEQ ID NO: 168298 - DNA, 35 bp, Artificial Sequence
  Synthetic oligonucleotide
tccaaacactgacctctatccgaaacgccctgggc

SEQ ID NO: 168299 - DNA, 35 bp, Artificial Sequence
  Synthetic oligonucleotide
tccacattggaccctgtttcgtacatcttgcctgc

SEQ ID NO: 168300 - DNA, 35 bp, Artificial Sequence
  Synthetic oligonucleotide
cactcacccccgatgctccgagcctccgttcctgc

SEQ ID NO: 168301 - DNA, 35 bp, Artificial Sequence
  Synthetic oligonucleotide
ggactcccccttcgccctggcccgttttcccgtgc

SEQ ID NO: 168302 - DNA, 35 bp, Artificial Sequence
  Synthetic oligonucleotide
agtgcgctcctgccctgcacgtttctgtacccctc

SEQ ID NO: 168303 - DNA, 35 bp, Artificial Sequence
  Synthetic oligonucleotide
acacgtaccgttgcgctattgttcattcacacttc

SEQ ID NO: 168304 - DNA, 35 bp, Artificial Sequence
  Synthetic oligonucleotide
gtgtccatcggccataggtcgtctccctttagttc

SEQ ID NO: 168305 - DNA, 35 bp, Artificial Sequence
  Synthetic oligonucleotide
tttgccctccggaccctcccactttgttagtaccg

SEQ ID NO: 168306 - DNA, 35 bp, Artificial Sequence
  Synthetic oligonucleotide
ccaccccccccagacccgcttacatccttgtcccg

SEQ ID NO: 168307 - DNA, 35 bp, Artificial Sequence
  Synthetic oligonucleotide
tgaatgcgcacctcttaccatggtctgcccccgcg

SEQ ID NO: 168308 - DNA, 35 bp, Artificial Sequence
  Synthetic oligonucleotide
agtgctcacttggtactccgctagccacctcctcg

SEQ ID NO: 168309 - DNA, 35 bp, Artificial Sequence
  Synthetic oligonucleotide
agggggaaaggggaactgcaggaaaggccgggggg

SEQ ID NO: 168310 - DNA, 35 bp, Artificial Sequence
  Synthetic oligonucleotide
accaaccgccgactctatagcctactgatctcctg

SEQ ID NO: 168311 - DNA, 32 bp, Artificial Sequence
  Synthetic oligonucleotide
tacttgctgtcttcatgcctgcccatcctctg

SEQ ID NO: 168312 - DNA, 35 bp, Artificial Sequence
  Synthetic oligonucleotide
ggacagacaagtggggtatcggggggtcgggggtg

SEQ ID NO: 168313 - DNA, 31 bp, Artificial Sequence
  Synthetic oligonucleotide
agccaccccctctcactcggaacgatatttg

SEQ ID NO: 168314 - DNA, 35 bp, Artificial Sequence
  Synthetic oligonucleotide
aacggggagaaggcaggggggtggccgtagttcat

SEQ ID NO: 168315 - DNA, 35 bp, Artificial Sequence
  Synthetic oligonucleotide
gtcaatcgcttaccccaccgctgcacactgttcat

SEQ ID NO: 168316 - DNA, 35 bp, Artificial Sequence
  Synthetic oligonucleotide
atctgcccatccgccctgttgctgccatcttgtat

SEQ ID NO: 168317 - DNA, 35 bp, Artificial Sequence
  Synthetic oligonucleotide
gtccgacattggttgtccgctacccttttacccct

SEQ ID NO: 168318 - DNA, 35 bp, Artificial Sequence
  Synthetic oligonucleotide
gatcttcgaccctcgtgccctaacgaacttcccct

SEQ ID NO: 168319 - DNA, 35 bp, Artificial Sequence
  Synthetic oligonucleotide
tctcgatcgaccctagctgtttgttattcttcagt

SEQ ID NO: 168320 - DNA, 35 bp, Artificial Sequence
  Synthetic oligonucleotide
aatgtgctcctgtccgttcgctttctatctgtagt

SEQ ID NO: 168321 - DNA, 35 bp, Artificial Sequence
  Synthetic oligonucleotide
ggaacacccctccgtccaagttccgccgccctggt

SEQ ID NO: 168322 - DNA, 35 bp, Artificial Sequence
  Synthetic oligonucleotide
gcgataccacccgtacccgcatacagacccgtggt

SEQ ID NO: 168323 - DNA, 35 bp, Artificial Sequence
  Synthetic oligonucleotide
gcaagcatgaacgggaagagggaggaggtcttggt

SEQ ID NO: 168324 - DNA, 35 bp, Artificial Sequence
  Synthetic oligonucleotide
gagacacgtccttattcgcgcaactttccccatgt

SEQ ID NO: 168325 - DNA, 35 bp, Artificial Sequence
  Synthetic oligonucleotide
ttccgacgtcctcgcattttttccacgccactatt

SEQ ID NO: 168326 - DNA, 35 bp, Artificial Sequence
  Synthetic oligonucleotide
gtggcgatctttcgggtgctcttcgctctgccctt

SEQ ID NO: 168327 - DNA, 35 bp, Artificial Sequence
  Synthetic oligonucleotide
atcaccatcgagcttgcatccgttctcatctgttt

SEQ ID NO: 168328 - DNA, 36 bp, Artificial Sequence
  Synthetic oligonucleotide
gcgaatgcgccacggcatcccgcccacccgatccaa

SEQ ID NO: 168329 - DNA, 36 bp, Artificial Sequence
  Synthetic oligonucleotide
gaccaagggggggttccgaaaacagggagggatgaa

SEQ ID NO: 168330 - DNA, 35 bp, Artificial Sequence
  Synthetic oligonucleotide
gggtgaggggtagggattagaggcggcgggaataa

SEQ ID NO: 168331 - DNA, 36 bp, Artificial Sequence
  Synthetic oligonucleotide
tcaacattcgctcctggtatttattacaccccataa

SEQ ID NO: 168332 - DNA, 36 bp, Artificial Sequence
  Synthetic oligonucleotide
ttcccacgcgctccccttggccgtaataaacccaca

SEQ ID NO: 168333 - DNA, 35 bp, Artificial Sequence
  Synthetic oligonucleotide
gacccacccgcgcgcgaagcccactgacccgcaca

SEQ ID NO: 168334 - DNA, 36 bp, Artificial Sequence
  Synthetic oligonucleotide
acgtcactcgctgtctcaaagtaccaccacacgcca

SEQ ID NO: 168335 - DNA, 36 bp, Artificial Sequence
  Synthetic oligonucleotide
gtgccctctatccagctctggacgccatgttctcca

SEQ ID NO: 168336 - DNA, 36 bp, Artificial Sequence
  Synthetic oligonucleotide
tcccgctcgcctgtttcaccagggcttatttttcca

SEQ ID NO: 168337 - DNA, 35 bp, Artificial Sequence
  Synthetic oligonucleotide
gaccgccctcgccccagtaccgcgcgacaacctca

SEQ ID NO: 168338 - DNA, 35 bp, Artificial Sequence
  Synthetic oligonucleotide
tcaatcgaatgatgtttgcctccgccacctgctca

SEQ ID NO: 168339 - DNA, 35 bp, Artificial Sequence
  Synthetic oligonucleotide
tgatcaacgccaatagctcacctccctcattgtca

SEQ ID NO: 168340 - DNA, 35 bp, Artificial Sequence
  Synthetic oligonucleotide
gataccccccgctatcctttagagccggtgtttca

SEQ ID NO: 168341 - DNA, 37 bp, Artificial Sequence
  Synthetic oligonucleotide
gaggtgtcggggtggaggagtggcactgggaagaaga

SEQ ID NO: 168342 - DNA, 37 bp, Artificial Sequence
  Synthetic oligonucleotide
acgtcgcccctccactgtattcttggtgccaacacga

SEQ ID NO: 168343 - DNA, 37 bp, Artificial Sequence
  Synthetic oligonucleotide
ttggtatgggcacagtagggggagggggaaaggacga

SEQ ID NO: 168344 - DNA, 37 bp, Artificial Sequence
  Synthetic oligonucleotide
gacttggtgcgacgggcgggatgggatgggcttacga

SEQ ID NO: 168345 - DNA, 36 bp, Artificial Sequence
  Synthetic oligonucleotide
gagctccatcccgttcctacccattggttacaccga

SEQ ID NO: 168346 - DNA, 37 bp, Artificial Sequence
  Synthetic oligonucleotide
gccaaacctcgtccctcgatctgttatcttcacccga

SEQ ID NO: 168347 - DNA, 37 bp, Artificial Sequence
  Synthetic oligonucleotide
tgtccccgcctcgacccgctgttcattcatcctccga

SEQ ID NO: 168348 - DNA, 36 bp, Artificial Sequence
  Synthetic oligonucleotide
gacaggggggggggtacaatggcgtaaggggtgcga

SEQ ID NO: 168349 - DNA, 36 bp, Artificial Sequence
  Synthetic oligonucleotide
tcagaacgccacctatgccaacccaagcctgctcga

SEQ ID NO: 168350 - DNA, 35 bp, Artificial Sequence
  Synthetic oligonucleotide
gtgcctaagcatctggatcccgaccctcctctcga

SEQ ID NO: 168351 - DNA, 37 bp, Artificial Sequence
  Synthetic oligonucleotide
tccgcgacgttcgataacactcctctccacccgtcga

SEQ ID NO: 168352 - DNA, 36 bp, Artificial Sequence
  Synthetic oligonucleotide
taacccctcacacgccctgcccctgccagtctagga

SEQ ID NO: 168353 - DNA, 36 bp, Artificial Sequence
  Synthetic oligonucleotide
attgagcctcacgtcgctgcacccaacccccccgga

SEQ ID NO: 168354 - DNA, 37 bp, Artificial Sequence
  Synthetic oligonucleotide
gaggggggaggtaacatgagcgtaaacggggagcgga

SEQ ID NO: 168355 - DNA, 35 bp, Artificial Sequence
  Synthetic oligonucleotide
aagggaaggcgttggggtgggtggtggaggcggga

SEQ ID NO: 168356 - DNA, 36 bp, Artificial Sequence
  Synthetic oligonucleotide
aagatggtgaggcggcaaggggccagggagagggga

SEQ ID NO: 168357 - DNA, 37 bp, Artificial Sequence
  Synthetic oligonucleotide
ttgatggtgaggtgagcaaaatatggacgggagggga

SEQ ID NO: 168358 - DNA, 37 bp, Artificial Sequence
  Synthetic oligonucleotide
gttcagggcggggttgtttggggtgtcgctctgggga

SEQ ID NO: 168359 - DNA, 37 bp, Artificial Sequence
  Synthetic oligonucleotide
actcaaggaggggggtctgagaaggagggctgtggga

SEQ ID NO: 168360 - DNA, 37 bp, Artificial Sequence
  Synthetic oligonucleotide
tccccctccatcgtcctgccggcatccaggaacctga

SEQ ID NO: 168361 - DNA, 35 bp, Artificial Sequence
  Synthetic oligonucleotide
aacgtggggggagcaaggtgggaagggttacctga

SEQ ID NO: 168362 - DNA, 38 bp, Artificial Sequence
  Synthetic oligonucleotide
tggacgcacctgaagttagcctcgccctcctgccctga

SEQ ID NO: 168363 - DNA, 38 bp, Artificial Sequence
  Synthetic oligonucleotide
gtacactcgccctgccttcttcacacgtattacgctga

SEQ ID NO: 168364 - DNA, 37 bp, Artificial Sequence
  Synthetic oligonucleotide
ggggaacacggggggggtggggtcacttactggctga

SEQ ID NO: 168365 - DNA, 38 bp, Artificial Sequence
  Synthetic oligonucleotide
tccatccccgttcaatcgctcacgagcaccactagtga

SEQ ID NO: 168366 - DNA, 38 bp, Artificial Sequence
  Synthetic oligonucleotide
gagaacgggatagaacggtaaggcgggtagggtagtga

SEQ ID NO: 168367 - DNA, 35 bp, Artificial Sequence
  Synthetic oligonucleotide
gattaagcggaggggaacgaagagaggaaaggtga

SEQ ID NO: 168368 - DNA, 38 bp, Artificial Sequence
  Synthetic oligonucleotide
gttatgcccctgtttgtcgtacttttcctgcccggtga

SEQ ID NO: 168369 - DNA, 38 bp, Artificial Sequence
  Synthetic oligonucleotide
ggatcgccccgccctgctcgtatcccgtttactggtga

SEQ ID NO: 168370 - DNA, 38 bp, Artificial Sequence
  Synthetic oligonucleotide
tccctcgcccccgattaatgcccttgtatcacgtgtga

SEQ ID NO: 168371 - DNA, 36 bp, Artificial Sequence
  Synthetic oligonucleotide
gccgccacgcgcacccgtccatccgcccccccttga

SEQ ID NO: 168372 - DNA, 36 bp, Artificial Sequence
  Synthetic oligonucleotide
tgtcgaacctgctgcttgttgcccccctccgcttga

SEQ ID NO: 168373 - DNA, 38 bp, Artificial Sequence
  Synthetic oligonucleotide
tagtgagagtggagggtcggggggcggaaagcagttga

SEQ ID NO: 168374 - DNA, 37 bp, Artificial Sequence
  Synthetic oligonucleotide
gaaaagggaggggaagtggggtgatgacgaggtttga

SEQ ID NO: 168375 - DNA, 35 bp, Artificial Sequence
  Synthetic oligonucleotide
acaccacgctatcatcccctcctctgttgttcata

SEQ ID NO: 168376 - DNA, 35 bp, Artificial Sequence
  Synthetic oligonucleotide
tctgtgcgttcgccattgcatacctcctgtaccta

SEQ ID NO: 168377 - DNA, 36 bp, Artificial Sequence
  Synthetic oligonucleotide
gtacgccgaaacccagctgccttccttgccccccta

SEQ ID NO: 168378 - DNA, 35 bp, Artificial Sequence
  Synthetic oligonucleotide
tcactctcttgttgcctcccagagccaatttccta

SEQ ID NO: 168379 - DNA, 36 bp, Artificial Sequence
  Synthetic oligonucleotide
atccaggcctcttccgccgacctgttactcgcctta

SEQ ID NO: 168380 - DNA, 36 bp, Artificial Sequence
  Synthetic oligonucleotide
gtccagccagccgctctgttctcttgtccggattta

SEQ ID NO: 168381 - DNA, 33 bp, Artificial Sequence
  Synthetic oligonucleotide
tactccctactgaaactgtaagtcgacctcaac

SEQ ID NO: 168382 - DNA, 35 bp, Artificial Sequence
  Synthetic oligonucleotide
acgtgagctccgttcgcgaattattgcgcctccac

SEQ ID NO: 168383 - DNA, 35 bp, Artificial Sequence
  Synthetic oligonucleotide
gccgcttacgccgcgctttaatgggcctgctccac

SEQ ID NO: 168384 - DNA, 35 bp, Artificial Sequence
  Synthetic oligonucleotide
acgccctccgcccaagttggcttctgtaaactcac

SEQ ID NO: 168385 - DNA, 35 bp, Artificial Sequence
  Synthetic oligonucleotide
acgccgacctatgagctcctccgccgtcgcttcac

SEQ ID NO: 168386 - DNA, 35 bp, Artificial Sequence
  Synthetic oligonucleotide
cacacacctcctgtctctgtcctctagcgtgtacc

SEQ ID NO: 168387 - DNA, 35 bp, Artificial Sequence
  Synthetic oligonucleotide
tgctcggccaacttacaatggtcacggtccacccc

SEQ ID NO: 168388 - DNA, 35 bp, Artificial Sequence
  Synthetic oligonucleotide
gaaggccaatcagagtcccgcctttgtcgcccccc

SEQ ID NO: 168389 - DNA, 35 bp, Artificial Sequence
  Synthetic oligonucleotide
gcccgcggattgccggcctaattttccccctgccc

SEQ ID NO: 168390 - DNA, 35 bp, Artificial Sequence
  Synthetic oligonucleotide
atcccgaactcctatggtcgcgcttcacccctccc

SEQ ID NO: 168391 - DNA, 35 bp, Artificial Sequence
  Synthetic oligonucleotide
tccgaggactccttgtgcatggctacgttcttccc

SEQ ID NO: 168392 - DNA, 35 bp, Artificial Sequence
  Synthetic oligonucleotide
tccagttgcccgtgttccttgtttaaatccccgcc

SEQ ID NO: 168393 - DNA, 35 bp, Artificial Sequence
  Synthetic oligonucleotide
tgcacccctcccaagtgccttgatctgttcaatcc

SEQ ID NO: 168394 - DNA, 35 bp, Artificial Sequence
  Synthetic oligonucleotide
gcaaaccactccggttcactgcccctgcccgatcc

SEQ ID NO: 168395 - DNA, 35 bp, Artificial Sequence
  Synthetic oligonucleotide
accgcatcggacacgcttctgcatccatcgcctcc

SEQ ID NO: 168396 - DNA, 35 bp, Artificial Sequence
  Synthetic oligonucleotide
gccccagctccctccgctaccttcgaactcgctcc

SEQ ID NO: 168397 - DNA, 35 bp, Artificial Sequence
  Synthetic oligonucleotide
gcggactctcgcttggtcccgacgatcctggttcc

SEQ ID NO: 168398 - DNA, 35 bp, Artificial Sequence
  Synthetic oligonucleotide
accgatccactctcagctacgcacccttccgccgc

SEQ ID NO: 168399 - DNA, 35 bp, Artificial Sequence
  Synthetic oligonucleotide
tccccatgctcttacccgcctactagatccgtcgc

SEQ ID NO: 168400 - DNA, 35 bp, Artificial Sequence
  Synthetic oligonucleotide
taagttggcggtgcagatcctaccaccccccgtgc

SEQ ID NO: 168401 - DNA, 35 bp, Artificial Sequence
  Synthetic oligonucleotide
agcgccccctctgcttttgttccttctgctccatc

SEQ ID NO: 168402 - DNA, 35 bp, Artificial Sequence
  Synthetic oligonucleotide
ggacgttcggtcgccactttcgtcttttgggcctc

SEQ ID NO: 168403 - DNA, 35 bp, Artificial Sequence
  Synthetic oligonucleotide
gcacgccatctaaccgccagagggcattcctcctc

SEQ ID NO: 168404 - DNA, 35 bp, Artificial Sequence
  Synthetic oligonucleotide
acacgccatccaagccccccgcctcatcccggctc

SEQ ID NO: 168405 - DNA, 35 bp, Artificial Sequence
  Synthetic oligonucleotide
tccacaactccttctgagccattgaacactctctc

SEQ ID NO: 168406 - DNA, 35 bp, Artificial Sequence
  Synthetic oligonucleotide
aaaacatccgccaatcctagccaccctcttaggtc

SEQ ID NO: 168407 - DNA, 35 bp, Artificial Sequence
  Synthetic oligonucleotide
acacccttccatctgctcacatctatctggggttc

SEQ ID NO: 168408 - DNA, 35 bp, Artificial Sequence
  Synthetic oligonucleotide
aacgagggaagggagggcgggtcaagaggggacgg

SEQ ID NO: 168409 - DNA, 35 bp, Artificial Sequence
  Synthetic oligonucleotide
gaacaaaggtggtagtgtgagtagatggaacgggg

SEQ ID NO: 168410 - DNA, 35 bp, Artificial Sequence
  Synthetic oligonucleotide
acatggtttggtaagggggcgggtagggagcgggg

SEQ ID NO: 168411 - DNA, 35 bp, Artificial Sequence
  Synthetic oligonucleotide
taatcgccccgccccgtccaatcttccctccatgg

SEQ ID NO: 168412 - DNA, 35 bp, Artificial Sequence
  Synthetic oligonucleotide
ttcagaggaggggaagtgtggtaggggtagaagtg

SEQ ID NO: 168413 - DNA, 35 bp, Artificial Sequence
  Synthetic oligonucleotide
tcgctgatcagtccgttggcaccctcctctgtttg

SEQ ID NO: 168414 - DNA, 35 bp, Artificial Sequence
  Synthetic oligonucleotide
gccgctcgccctgtccccgttcccgacgtgtccat

SEQ ID NO: 168415 - DNA, 35 bp, Artificial Sequence
  Synthetic oligonucleotide
gcaaagcgtaccgtatacgactcactgccccccct

SEQ ID NO: 168416 - DNA, 35 bp, Artificial Sequence
  Synthetic oligonucleotide
tcccctcatccacggtacctctgcgaaaattcgct

SEQ ID NO: 168417 - DNA, 35 bp, Artificial Sequence
  Synthetic oligonucleotide
tgagagcctcacctcgttaactaatatgccttgct

SEQ ID NO: 168418 - DNA, 35 bp, Artificial Sequence
  Synthetic oligonucleotide
tccaggcacagctgcccgtcatgtagtttccctct

SEQ ID NO: 168419 - DNA, 35 bp, Artificial Sequence
  Synthetic oligonucleotide
taaccccccgctccttaccccttgagacagctcgt

SEQ ID NO: 168420 - DNA, 35 bp, Artificial Sequence
  Synthetic oligonucleotide
gcatgattaccccgccgcctgtattagtctcctgt

SEQ ID NO: 168421 - DNA, 35 bp, Artificial Sequence
  Synthetic oligonucleotide
acccccatctcgcctgcaacttctccgctgatctt

SEQ ID NO: 168422 - DNA, 35 bp, Artificial Sequence
  Synthetic oligonucleotide
ttcgccctatctctccaggtgttgctgttcctctt

SEQ ID NO: 168423 - DNA, 35 bp, Artificial Sequence
  Synthetic oligonucleotide
gattgctactcctggcacgtgcacctccccccgtt

SEQ ID NO: 168424 - DNA, 35 bp, Artificial Sequence
  Synthetic oligonucleotide
tgctagccacaatttttccgtctcccaggcccgtt

SEQ ID NO: 168425 - DNA, 35 bp, Artificial Sequence
  Synthetic oligonucleotide
tttcgccccgaactctccatgtgttgccccgtaaa

SEQ ID NO: 168426 - DNA, 35 bp, Artificial Sequence
  Synthetic oligonucleotide
gtcccacctgcctcggtctgttgcctagcatccaa

SEQ ID NO: 168427 - DNA, 35 bp, Artificial Sequence
  Synthetic oligonucleotide
gtgggggggatgggcgacgtagggctagactataa

SEQ ID NO: 168428 - DNA, 35 bp, Artificial Sequence
  Synthetic oligonucleotide
tcgtccccccccgattctcactgcatctgtgaaca

SEQ ID NO: 168429 - DNA, 36 bp, Artificial Sequence
  Synthetic oligonucleotide
gccaccaccggcctatcacatacaccaagttacaca

SEQ ID NO: 168430 - DNA, 36 bp, Artificial Sequence
  Synthetic oligonucleotide
accatgacctctgcaccggactaactgcaccccaca

SEQ ID NO: 168431 - DNA, 36 bp, Artificial Sequence
  Synthetic oligonucleotide
actcctacgccgacgataacaccgcgattttcacca

SEQ ID NO: 168432 - DNA, 36 bp, Artificial Sequence
  Synthetic oligonucleotide
gacaccacagcgttgtagattctttcggtctcccca

SEQ ID NO: 168433 - DNA, 36 bp, Artificial Sequence
  Synthetic oligonucleotide
tgagatgtccaatcgataacgctcctaccttcccca

SEQ ID NO: 168434 - DNA, 36 bp, Artificial Sequence
  Synthetic oligonucleotide
tagttgctcccaccttgcttcccgtcctccgtgcca

SEQ ID NO: 168435 - DNA, 36 bp, Artificial Sequence
  Synthetic oligonucleotide
tacaaagagaggtggaagttggagaggcgggcagca

SEQ ID NO: 168436 - DNA, 35 bp, Artificial Sequence
  Synthetic oligonucleotide
ttgtgccctccgcttacttctcctcgctgtgagca

SEQ ID NO: 168437 - DNA, 36 bp, Artificial Sequence
  Synthetic oligonucleotide
tctacgcatttatgccccacccgtgccttacccgca

SEQ ID NO: 168438 - DNA, 35 bp, Artificial Sequence
  Synthetic oligonucleotide
tccctgccccgataccattaccgttatgctccgca

SEQ ID NO: 168439 - DNA, 36 bp, Artificial Sequence
  Synthetic oligonucleotide
gagtggggtgggatgggggtaggatcgattatggca

SEQ ID NO: 168440 - DNA, 36 bp, Artificial Sequence
  Synthetic oligonucleotide
acgttctgccaccagtttgcgtttgccgcccctgca

SEQ ID NO: 168441 - DNA, 35 bp, Artificial Sequence
  Synthetic oligonucleotide
tcacgatcgacttcgttttttctccctggtttgca

SEQ ID NO: 168442 - DNA, 36 bp, Artificial Sequence
  Synthetic oligonucleotide
gtccaacgccgtgcgcttgcgatcttatacacctca

SEQ ID NO: 168443 - DNA, 35 bp, Artificial Sequence
  Synthetic oligonucleotide
tccgtatcctcaggcggccaattacccccgcttca

SEQ ID NO: 168444 - DNA, 37 bp, Artificial Sequence
  Synthetic oligonucleotide
gagggggtggagaggggcaaagggctgatagagcaga

SEQ ID NO: 168445 - DNA, 37 bp, Artificial Sequence
  Synthetic oligonucleotide
gctgccccgtacccccctaagcccgctccctcgcaga

SEQ ID NO: 168446 - DNA, 36 bp, Artificial Sequence
  Synthetic oligonucleotide
agcgagaagtagacgggggggggtcggtcatgcaga

SEQ ID NO: 168447 - DNA, 36 bp, Artificial Sequence
  Synthetic oligonucleotide
gaggggggggcgatggggttataacatatggggaga

SEQ ID NO: 168448 - DNA, 37 bp, Artificial Sequence
  Synthetic oligonucleotide
gtagggagttagggataatacaaggggcgggggagga

SEQ ID NO: 168449 - DNA, 37 bp, Artificial Sequence
  Synthetic oligonucleotide
atgactacctccctgttccgcctaccgccgagtagga

SEQ ID NO: 168450 - DNA, 36 bp, Artificial Sequence
  Synthetic oligonucleotide
gagatccgagcaggaggtaggggacggcgtgcggga

SEQ ID NO: 168451 - DNA, 36 bp, Artificial Sequence
  Synthetic oligonucleotide
ggagggaagggaagtgaatcggagggggaccgggga

SEQ ID NO: 168452 - DNA, 37 bp, Artificial Sequence
  Synthetic oligonucleotide
tgcgcaagcgggagggtgacggtagggggtgggggga

SEQ ID NO: 168453 - DNA, 37 bp, Artificial Sequence
  Synthetic oligonucleotide
tatgggtgcctaagacctgtgcggagagggggtggga

SEQ ID NO: 168454 - DNA, 37 bp, Artificial Sequence
  Synthetic oligonucleotide
atcgaaggggacggagagaagtgacaccggatatgga

SEQ ID NO: 168455 - DNA, 36 bp, Artificial Sequence
  Synthetic oligonucleotide
acaccacctcgaagtttaacgcccctgaaaccatga

SEQ ID NO: 168456 - DNA, 38 bp, Artificial Sequence
  Synthetic oligonucleotide
gaacacggacaggggtagaaaagcaattggcaacgtga

SEQ ID NO: 168457 - DNA, 38 bp, Artificial Sequence
  Synthetic oligonucleotide
ggtgactcgaaacggggtaaggtgaggcggaggggtga

SEQ ID NO: 168458 - DNA, 38 bp, Artificial Sequence
  Synthetic oligonucleotide
aaggtgggcgggagggtttatgtaggggtttactgtga

SEQ ID NO: 168459 - DNA, 38 bp, Artificial Sequence
  Synthetic oligonucleotide
agcccaacgcaatcccttatacaccgcgcaccccttga

SEQ ID NO: 168460 - DNA, 35 bp, Artificial Sequence
  Synthetic oligonucleotide
ttgcacaccacccggcctacccacccctcatggta

SEQ ID NO: 168461 - DNA, 36 bp, Artificial Sequence
  Synthetic oligonucleotide
agtcacccggtctcccgacgtcataacttgccctta

SEQ ID NO: 168462 - DNA, 36 bp, Artificial Sequence
  Synthetic oligonucleotide
aaactggagcatacggacggggaggggggaatgtta

SEQ ID NO: 168463 - DNA, 35 bp, Artificial Sequence
  Synthetic oligonucleotide
ttccccttcgctcattattggttattcgtgcccac

SEQ ID NO: 168464 - DNA, 35 bp, Artificial Sequence
  Synthetic oligonucleotide
gcaaaccggtccctccgccagaccacggctcttac

SEQ ID NO: 168465 - DNA, 35 bp, Artificial Sequence
  Synthetic oligonucleotide
aaaccgcccccttccgcccgtgcgtaggttgaacc

SEQ ID NO: 168466 - DNA, 35 bp, Artificial Sequence
  Synthetic oligonucleotide
atgtggtgcccatgtctacgcctactaccaatacc

SEQ ID NO: 168467 - DNA, 35 bp, Artificial Sequence
  Synthetic oligonucleotide
tccgcacccgccgcttgtataccctcccccatacc

SEQ ID NO: 168468 - DNA, 35 bp, Artificial Sequence
  Synthetic oligonucleotide
aacacccccgaccgttttagcatatagcgctcccc

SEQ ID NO: 168469 - DNA, 34 bp, Artificial Sequence
  Synthetic oligonucleotide
gcattgtgagctgtttcaccctcgttctttcccc

SEQ ID NO: 168470 - DNA, 34 bp, Artificial Sequence
  Synthetic oligonucleotide
tagcacatccatcactccgtaagcaagttggccc

SEQ ID NO: 168471 - DNA, 35 bp, Artificial Sequence
  Synthetic oligonucleotide
gtcgtttgtcagccgtactactcctgtttctgccc

SEQ ID NO: 168472 - DNA, 35 bp, Artificial Sequence
  Synthetic oligonucleotide
gtcctcgaagagctagatccgtccccacacgtccc

SEQ ID NO: 168473 - DNA, 35 bp, Artificial Sequence
  Synthetic oligonucleotide
atccgcctagtagccgcccgctttcaggagttccc

SEQ ID NO: 168474 - DNA, 35 bp, Artificial Sequence
  Synthetic oligonucleotide
gaccgcctccatccgtactcgttaacgctttagcc

SEQ ID NO: 168475 - DNA, 35 bp, Artificial Sequence
  Synthetic oligonucleotide
gcaaactacccagcccacagcctgctgccccaagc

SEQ ID NO: 168476 - DNA, 35 bp, Artificial Sequence
  Synthetic oligonucleotide
accctgcattgcattcgattcaccttcccctcggc

SEQ ID NO: 168477 - DNA, 35 bp, Artificial Sequence
  Synthetic oligonucleotide
gccgcccagctaccgagggctccatcgctccatgc

SEQ ID NO: 168478 - DNA, 35 bp, Artificial Sequence
  Synthetic oligonucleotide
gtcggtgccaccgtatccattctgtctttttatgc

SEQ ID NO: 168479 - DNA, 35 bp, Artificial Sequence
  Synthetic oligonucleotide
gccacccgagttctacccatccgccatgtcgctgc

SEQ ID NO: 168480 - DNA, 35 bp, Artificial Sequence
  Synthetic oligonucleotide
gttgacgctagcacgtggatctgtccctcctctgc

SEQ ID NO: 168481 - DNA, 35 bp, Artificial Sequence
  Synthetic oligonucleotide
gccatatcccgatcgcacgcgcacttgcccattgc

SEQ ID NO: 168482 - DNA, 35 bp, Artificial Sequence
  Synthetic oligonucleotide
attggacctgcgttgttctgtcgcgctccccaatc

SEQ ID NO: 168483 - DNA, 35 bp, Artificial Sequence
  Synthetic oligonucleotide
gtcgaccattaatctcctctgataagcctgccatc

SEQ ID NO: 168484 - DNA, 35 bp, Artificial Sequence
  Synthetic oligonucleotide
tcctctgccacagttgtcttcggccacatactatc

SEQ ID NO: 168485 - DNA, 35 bp, Artificial Sequence
  Synthetic oligonucleotide
tccccgctacggtcacccgacgtcccctgtacctc

SEQ ID NO: 168486 - DNA, 35 bp, Artificial Sequence
  Synthetic oligonucleotide
tgcacccccacgtacccaactatgcgaaagccctc

SEQ ID NO: 168487 - DNA, 35 bp, Artificial Sequence
  Synthetic oligonucleotide
gcatcacttggcgatcggtttcctccttgctcctc

SEQ ID NO: 168488 - DNA, 35 bp, Artificial Sequence
  Synthetic oligonucleotide
acccacgagctcctggagtcgtctacctctcagtc

SEQ ID NO: 168489 - DNA, 35 bp, Artificial Sequence
  Synthetic oligonucleotide
tgaacgtcacagtctgttttcgtccttctatcgtc

SEQ ID NO: 168490 - DNA, 35 bp, Artificial Sequence
  Synthetic oligonucleotide
tcccaccgcttccatactgtggcggtccacatttc

SEQ ID NO: 168491 - DNA, 35 bp, Artificial Sequence
  Synthetic oligonucleotide
tgcggaggggagggaccaaggggccgcgggcaaag

SEQ ID NO: 168492 - DNA, 35 bp, Artificial Sequence
  Synthetic oligonucleotide
tacactttcaattacgctgcccacccccctcggag

SEQ ID NO: 168493 - DNA, 35 bp, Artificial Sequence
  Synthetic oligonucleotide
gtggtcccgcacaactccttgcttacacatttacg

SEQ ID NO: 168494 - DNA, 35 bp, Artificial Sequence
  Synthetic oligonucleotide
gagttcgcccccacattgtacgccgctaccctccg

SEQ ID NO: 168495 - DNA, 35 bp, Artificial Sequence
  Synthetic oligonucleotide
gttgtctgccctcctgctcacttcagttaatgtcg

SEQ ID NO: 168496 - DNA, 35 bp, Artificial Sequence
  Synthetic oligonucleotide
gactgtgctggtacttctccatccccctatattcg

SEQ ID NO: 168497 - DNA, 33 bp, Artificial Sequence
  Synthetic oligonucleotide
gagcggaacacttatggtggagagggggagggg

SEQ ID NO: 168498 - DNA, 35 bp, Artificial Sequence
  Synthetic oligonucleotide
gaccgccaacactcgcaccttcaccccctacctgg

SEQ ID NO: 168499 - DNA, 35 bp, Artificial Sequence
  Synthetic oligonucleotide
atagcctgggctgtccgtgtccccctccctctatg

SEQ ID NO: 168500 - DNA, 35 bp, Artificial Sequence
  Synthetic oligonucleotide
acttgccctacacgctggacatttcaccctttatg

SEQ ID NO: 168501 - DNA, 35 bp, Artificial Sequence
  Synthetic oligonucleotide
tctctaccttgcccgccactacctcgcccccgttg

SEQ ID NO: 168502 - DNA, 35 bp, Artificial Sequence
  Synthetic oligonucleotide
gcactcctcccgccacctcggtttatgatccgttg

SEQ ID NO: 168503 - DNA, 35 bp, Artificial Sequence
  Synthetic oligonucleotide
tgtccaatcgacacactgcccccccactgcttaat

SEQ ID NO: 168504 - DNA, 35 bp, Artificial Sequence
  Synthetic oligonucleotide
ccacgccgccatctgctccccacgcctcatccact

SEQ ID NO: 168505 - DNA, 35 bp, Artificial Sequence
  Synthetic oligonucleotide
ttgcacagggcgctacaccacactgccctctcact

SEQ ID NO: 168506 - DNA, 35 bp, Artificial Sequence
  Synthetic oligonucleotide
agagtcacccgccgcttattatgacatctgtacct

SEQ ID NO: 168507 - DNA, 35 bp, Artificial Sequence
  Synthetic oligonucleotide
gcccccttccatttgtcctacactctggtagccct

SEQ ID NO: 168508 - DNA, 35 bp, Artificial Sequence
  Synthetic oligonucleotide
tacctgacccacacgtattgccgtgaccgctccct

SEQ ID NO: 168509 - DNA, 35 bp, Artificial Sequence
  Synthetic oligonucleotide
tttgtgcgagcatcgcttcccttgccttgttccct

SEQ ID NO: 168510 - DNA, 35 bp, Artificial Sequence
  Synthetic oligonucleotide
acacgacctccggtaccccctcagcactccgcgct

SEQ ID NO: 168511 - DNA, 35 bp, Artificial Sequence
  Synthetic oligonucleotide
gcacgcaataattgtgcgccctatgtctccctgct

SEQ ID NO: 168512 - DNA, 35 bp, Artificial Sequence
  Synthetic oligonucleotide
gtgcatgtagcccccttgttcccctgagcgttgct

SEQ ID NO: 168513 - DNA, 35 bp, Artificial Sequence
  Synthetic oligonucleotide
gcactccactagcagtcgcccattgccacgcctct

SEQ ID NO: 168514 - DNA, 35 bp, Artificial Sequence
  Synthetic oligonucleotide
acttagccgccccacacaccacgcattttatgtct

SEQ ID NO: 168515 - DNA, 35 bp, Artificial Sequence
  Synthetic oligonucleotide
tcttcgccgacgcccttgaaccgactctgccttct

SEQ ID NO: 168516 - DNA, 35 bp, Artificial Sequence
  Synthetic oligonucleotide
tcgaccagccacactgtaccgttcctgttcgtagt

SEQ ID NO: 168517 - DNA, 35 bp, Artificial Sequence
  Synthetic oligonucleotide
tcattgtgcggggttagggggggaggcataggggt

SEQ ID NO: 168518 - DNA, 35 bp, Artificial Sequence
  Synthetic oligonucleotide
acttaccctcggagggggtctatcacttgatcctt

SEQ ID NO: 168519 - DNA, 34 bp, Artificial Sequence
  Synthetic oligonucleotide
tcctcactcacaacgtgtctatcaccctcatgtt

SEQ ID NO: 168520 - DNA, 36 bp, Artificial Sequence
  Synthetic oligonucleotide
actccgcccactccacttgccgatgccttcatgaaa

SEQ ID NO: 168521 - DNA, 36 bp, Artificial Sequence
  Synthetic oligonucleotide
atggggcgggacgggtacgacgggattcttgaccaa

SEQ ID NO: 168522 - DNA, 36 bp, Artificial Sequence
  Synthetic oligonucleotide
tatgggcaagggagcgggggactaacagtacgggaa

SEQ ID NO: 168523 - DNA, 35 bp, Artificial Sequence
  Synthetic oligonucleotide
ggggcgggtggtggggaagcggatggagaggctaa

SEQ ID NO: 168524 - DNA, 36 bp, Artificial Sequence
  Synthetic oligonucleotide
tagatcctcacacatgttcctcgccgccatacaaca

SEQ ID NO: 168525 - DNA, 35 bp, Artificial Sequence
  Synthetic oligonucleotide
agtgaccgccgcctttcaacctgatcccccgcaca

SEQ ID NO: 168526 - DNA, 36 bp, Artificial Sequence
  Synthetic oligonucleotide
tttacgcgtaccgcatcccgcactgttcacctcaca

SEQ ID NO: 168527 - DNA, 36 bp, Artificial Sequence
  Synthetic oligonucleotide
tgacaggggaggcgggcggggcaaagaaaaaataca

SEQ ID NO: 168528 - DNA, 35 bp, Artificial Sequence
  Synthetic oligonucleotide
ttacgccaccttgccaatatccccatggagttcca

SEQ ID NO: 168529 - DNA, 36 bp, Artificial Sequence
  Synthetic oligonucleotide
gccctcccactccggcccgttccataattgcacgca

SEQ ID NO: 168530 - DNA, 36 bp, Artificial Sequence
  Synthetic oligonucleotide
tcccccctccattctctatacaacagttgcccggca

SEQ ID NO: 168531 - DNA, 35 bp, Artificial Sequence
  Synthetic oligonucleotide
gatgcctcccagtcagtatatctgcccgctatgca

SEQ ID NO: 168532 - DNA, 35 bp, Artificial Sequence
  Synthetic oligonucleotide
ttcgtgcgaccgtcgcagtaacatggcccctctca

SEQ ID NO: 168533 - DNA, 37 bp, Artificial Sequence
  Synthetic oligonucleotide
gtcacccctgttgcccgtcatctgccaccgcttccga

SEQ ID NO: 168534 - DNA, 37 bp, Artificial Sequence
  Synthetic oligonucleotide
tcatccacctccagggccatcccgcgccatgccgcga

SEQ ID NO: 168535 - DNA, 37 bp, Artificial Sequence
  Synthetic oligonucleotide
gcacctcatgagcgcgcattagatatccccctctcga

SEQ ID NO: 168536 - DNA, 37 bp, Artificial Sequence
  Synthetic oligonucleotide
atcacactgtcgcatccgtcgtcccccttgctctcga

SEQ ID NO: 168537 - DNA, 37 bp, Artificial Sequence
  Synthetic oligonucleotide
atcatccgcccacttaccgcacacagccccccccgga

SEQ ID NO: 168538 - DNA, 37 bp, Artificial Sequence
  Synthetic oligonucleotide
gaccggaggatgggtcatggggcggtggggcttcgga

SEQ ID NO: 168539 - DNA, 35 bp, Artificial Sequence
  Synthetic oligonucleotide
tgtgatgaacccccctcgctccacgcagtccggga

SEQ ID NO: 168540 - DNA, 34 bp, Artificial Sequence
  Synthetic oligonucleotide
aagatgagggacgcggtcaggagcagggggggga

SEQ ID NO: 168541 - DNA, 36 bp, Artificial Sequence
  Synthetic oligonucleotide
gcaaaggaacaaagggtgcagtggaggagtggggga

SEQ ID NO: 168542 - DNA, 37 bp, Artificial Sequence
  Synthetic oligonucleotide
acccacattcgcttgtgcccgatcttcccatcatgga

SEQ ID NO: 168543 - DNA, 37 bp, Artificial Sequence
  Synthetic oligonucleotide
taacggggagaggaaggggcggtgagaccaatatgga

SEQ ID NO: 168544 - DNA, 38 bp, Artificial Sequence
  Synthetic oligonucleotide
agtcctccgcccccctgctgtaacacgctacacaatga

SEQ ID NO: 168545 - DNA, 35 bp, Artificial Sequence
  Synthetic oligonucleotide
gccctcttgtcctgccccagcgccgccactcgtga

SEQ ID NO: 168546 - DNA, 37 bp, Artificial Sequence
  Synthetic oligonucleotide
gtcacaacgcctgcttttccctcttctctgttcgtga

SEQ ID NO: 168547 - DNA, 38 bp, Artificial Sequence
  Synthetic oligonucleotide
agtggggggcggcggacgggtaacacggcggagggtga

SEQ ID NO: 168548 - DNA, 38 bp, Artificial Sequence
  Synthetic oligonucleotide
atgcggtaccgagttgggtgggggggagtatagggtga

SEQ ID NO: 168549 - DNA, 38 bp, Artificial Sequence
  Synthetic oligonucleotide
atccaccggccacttgtatgctcacccccaccccttga

SEQ ID NO: 168550 - DNA, 35 bp, Artificial Sequence
  Synthetic oligonucleotide
gaaacatatggtgaggatatagggggggaaggata

SEQ ID NO: 168551 - DNA, 36 bp, Artificial Sequence
  Synthetic oligonucleotide
ggatggctccctctgttcccgtgacccgccgcccta

SEQ ID NO: 168552 - DNA, 36 bp, Artificial Sequence
  Synthetic oligonucleotide
tccagaacagccggcccaactgcttgtactactcta

SEQ ID NO: 168553 - DNA, 36 bp, Artificial Sequence
  Synthetic oligonucleotide
gttccgccctcacaatatttcctgtactcatgtcta

SEQ ID NO: 168554 - DNA, 36 bp, Artificial Sequence
  Synthetic oligonucleotide
aatgtccacgcctctagttactccgccaccctagta

SEQ ID NO: 168555 - DNA, 36 bp, Artificial Sequence
  Synthetic oligonucleotide
gaacccaccccagaccgtggatcctccgaaacggta

SEQ ID NO: 168556 - DNA, 34 bp, Artificial Sequence
  Synthetic oligonucleotide
gaacccccccgcttccgtctaggtagccttctta

SEQ ID NO: 168557 - DNA, 35 bp, Artificial Sequence
  Synthetic oligonucleotide
acccgcactccctctgcacgctgatcacccgtaac

SEQ ID NO: 168558 - DNA, 35 bp, Artificial Sequence
  Synthetic oligonucleotide
tgctccacattcaccttgccgtatgcggtcaccac

SEQ ID NO: 168559 - DNA, 35 bp, Artificial Sequence
  Synthetic oligonucleotide
tccagtcgaactgatccactcgcctctggctccac

SEQ ID NO: 168560 - DNA, 35 bp, Artificial Sequence
  Synthetic oligonucleotide
tgccatcaatccacctgttgcgctcgtaccatcac

SEQ ID NO: 168561 - DNA, 35 bp, Artificial Sequence
  Synthetic oligonucleotide
tccgatcactgcatattctcacctccgggctcgac

SEQ ID NO: 168562 - DNA, 35 bp, Artificial Sequence
  Synthetic oligonucleotide
tgcatggctgtgcgggcccattcacctccatttac

SEQ ID NO: 168563 - DNA, 35 bp, Artificial Sequence
  Synthetic oligonucleotide
tcaacccaaatggtatcctcgtcacttattgcacc

SEQ ID NO: 168564 - DNA, 35 bp, Artificial Sequence
  Synthetic oligonucleotide
gacaagacgatggctccactacacgccttccgccc

SEQ ID NO: 168565 - DNA, 35 bp, Artificial Sequence
  Synthetic oligonucleotide
tgacgctttgaattctcctcttagtacctgctccc

SEQ ID NO: 168566 - DNA, 35 bp, Artificial Sequence
  Synthetic oligonucleotide
atggaccaccgtctaagacgccattcgttgctccc

SEQ ID NO: 168567 - DNA, 35 bp, Artificial Sequence
  Synthetic oligonucleotide
gcaggcctgtagctcgccattgaacgccgattccc

SEQ ID NO: 168568 - DNA, 35 bp, Artificial Sequence
  Synthetic oligonucleotide
taaccgtgcccctctctcttaggtcgtatcatgcc

SEQ ID NO: 168569 - DNA, 35 bp, Artificial Sequence
  Synthetic oligonucleotide
gacgccccgactctacggttggttgctactcatcc

SEQ ID NO: 168570 - DNA, 35 bp, Artificial Sequence
  Synthetic oligonucleotide
gatactcgttcgttctcgtgaccccgacgcactcc

SEQ ID NO: 168571 - DNA, 35 bp, Artificial Sequence
  Synthetic oligonucleotide
gtccaaccccgtgcaatcgtgagtgccgctcctcc

SEQ ID NO: 168572 - DNA, 35 bp, Artificial Sequence
  Synthetic oligonucleotide
agatgctaacgtcgcatgcagcctgttccctgtcc

SEQ ID NO: 168573 - DNA, 35 bp, Artificial Sequence
  Synthetic oligonucleotide
tccgcacggtttccgacttagctcttcttggttcc

SEQ ID NO: 168574 - DNA, 35 bp, Artificial Sequence
  Synthetic oligonucleotide
accccccaccgttcgtttttacctgcttccaacgc

SEQ ID NO: 168575 - DNA, 35 bp, Artificial Sequence
  Synthetic oligonucleotide
cccacatctgacctgttattcacaccctcatacgc

SEQ ID NO: 168576 - DNA, 35 bp, Artificial Sequence
  Synthetic oligonucleotide
gttgcgcccggtaagtccccgattgatctccccgc

SEQ ID NO: 168577 - DNA, 35 bp, Artificial Sequence
  Synthetic oligonucleotide
gacactaacatccgcgcgtaactcctccctatggc

SEQ ID NO: 168578 - DNA, 35 bp, Artificial Sequence
  Synthetic oligonucleotide
acaccccacccgccgcctgttttagcccttgtggc

SEQ ID NO: 168579 - DNA, 34 bp, Artificial Sequence
  Synthetic oligonucleotide
atcttccaccgcccactcgctaacactatgcatc

SEQ ID NO: 168580 - DNA, 35 bp, Artificial Sequence
  Synthetic oligonucleotide
ttgtcctccgcccgatctttgtctagtctaagatc

SEQ ID NO: 168581 - DNA, 35 bp, Artificial Sequence
  Synthetic oligonucleotide
gatccaacatcgccctctacgaactgcattaggtc

SEQ ID NO: 168582 - DNA, 35 bp, Artificial Sequence
  Synthetic oligonucleotide
atacactgcgtgccagagtgcttcttcctcgtgtc

SEQ ID NO: 168583 - DNA, 35 bp, Artificial Sequence
  Synthetic oligonucleotide
accatccctcgcggcggtcggtcctacctctattc

SEQ ID NO: 168584 - DNA, 35 bp, Artificial Sequence
  Synthetic oligonucleotide
tgtgtgaccactcagcacactgtacattcgccttc

SEQ ID NO: 168585 - DNA, 33 bp, Artificial Sequence
  Synthetic oligonucleotide
ccagagctcagatttcgcctccccgcctgcttc

SEQ ID NO: 168586 - DNA, 35 bp, Artificial Sequence
  Synthetic oligonucleotide
agtgtgcttgctgacaacgccctgctgtagctttc

SEQ ID NO: 168587 - DNA, 35 bp, Artificial Sequence
  Synthetic oligonucleotide
atccccgatggtacttcgccattgtttcctctttc

SEQ ID NO: 168588 - DNA, 35 bp, Artificial Sequence
  Synthetic oligonucleotide
gggaaccgtcccactaaccttcgacgccctccccg

SEQ ID NO: 168589 - DNA, 35 bp, Artificial Sequence
  Synthetic oligonucleotide
tacttcacccccgacgttcgtttccgaggactccg

SEQ ID NO: 168590 - DNA, 35 bp, Artificial Sequence
  Synthetic oligonucleotide
tcgacacccccaccccggccagggagcaacctccg

SEQ ID NO: 168591 - DNA, 35 bp, Artificial Sequence
  Synthetic oligonucleotide
ttgtaaccgttgtcgttctattaatgccctctccg

SEQ ID NO: 168592 - DNA, 34 bp, Artificial Sequence
  Synthetic oligonucleotide
gccactcacactggcctgtaaaccttatatctcg

SEQ ID NO: 168593 - DNA, 35 bp, Artificial Sequence
  Synthetic oligonucleotide
gccgaaagaaggggtgattggagttggggtggagg

SEQ ID NO: 168594 - DNA, 35 bp, Artificial Sequence
  Synthetic oligonucleotide
gatgcacacctctctccgtccgttgagcccgaggg

SEQ ID NO: 168595 - DNA, 35 bp, Artificial Sequence
  Synthetic oligonucleotide
gggtacgttctgttttgcctacaccccccactctg

SEQ ID NO: 168596 - DNA, 34 bp, Artificial Sequence
  Synthetic oligonucleotide
atgacgctactcaccgctcacttcgcctgctttg

SEQ ID NO: 168597 - DNA, 35 bp, Artificial Sequence
  Synthetic oligonucleotide
gcctatctccgtgctactgctcttccaaacatgat

SEQ ID NO: 168598 - DNA, 35 bp, Artificial Sequence
  Synthetic oligonucleotide
tacgccgcccctgatgaccagccgctccccccact

SEQ ID NO: 168599 - DNA, 35 bp, Artificial Sequence
  Synthetic oligonucleotide
cccccgcgtagattcgatgaactcccggcccccct

SEQ ID NO: 168600 - DNA, 35 bp, Artificial Sequence
  Synthetic oligonucleotide
tgagggcgaatctcacctacatgccgtccgtccct

SEQ ID NO: 168601 - DNA, 35 bp, Artificial Sequence
  Synthetic oligonucleotide
tgctcgcacatgctctccatttattgcacatcgct

SEQ ID NO: 168602 - DNA, 35 bp, Artificial Sequence
  Synthetic oligonucleotide
ttaaccgctgtgctatgcctgccccacttaactct

SEQ ID NO: 168603 - DNA, 35 bp, Artificial Sequence
  Synthetic oligonucleotide
agctccgcacatactgtccagcgcacttatactct

SEQ ID NO: 168604 - DNA, 35 bp, Artificial Sequence
  Synthetic oligonucleotide
tgccttcgaatcgaccctgtacctttagcgcctct

SEQ ID NO: 168605 - DNA, 35 bp, Artificial Sequence
  Synthetic oligonucleotide
attccccaccgcctccgaggaactcttatgggtct

SEQ ID NO: 168606 - DNA, 35 bp, Artificial Sequence
  Synthetic oligonucleotide
gccgctgtagtcactgcattatgccccccgttggt

SEQ ID NO: 168607 - DNA, 35 bp, Artificial Sequence
  Synthetic oligonucleotide
tctcgaacggccagtgtcgtgtctcacctaacctt

SEQ ID NO: 168608 - DNA, 35 bp, Artificial Sequence
  Synthetic oligonucleotide
accatcggtggcatcctctcagccgacctatcctt

SEQ ID NO: 168609 - DNA, 35 bp, Artificial Sequence
  Synthetic oligonucleotide
gaccacctacctcgtgactgtctgtccgtttattt

SEQ ID NO: 168610 - DNA, 35 bp, Artificial Sequence
  Synthetic oligonucleotide
ttcgactcgccttctaacctaggttgcctgctttt

SEQ ID NO: 168611 - DNA, 35 bp, Artificial Sequence
  Synthetic oligonucleotide
gttgtccgtgctccatgttacttatccgttttttt

SEQ ID NO: 168612 - DNA, 34 bp, Artificial Sequence
  Synthetic oligonucleotide
tcatgccactctcctgcctcttttaatcgggaaa

SEQ ID NO: 168613 - DNA, 36 bp, Artificial Sequence
  Synthetic oligonucleotide
acactgccgactttccagtactgtaccgcccttcaa

SEQ ID NO: 168614 - DNA, 35 bp, Artificial Sequence
  Synthetic oligonucleotide
tgtgggggagaaaaggaaaaaagggcccacgggaa

SEQ ID NO: 168615 - DNA, 36 bp, Artificial Sequence
  Synthetic oligonucleotide
gccgcccgcttacctccgcgtgcctcatgatctaca

SEQ ID NO: 168616 - DNA, 35 bp, Artificial Sequence
  Synthetic oligonucleotide
tctactcgtaactctgggctcccccccgcacccca

SEQ ID NO: 168617 - DNA, 35 bp, Artificial Sequence
  Synthetic oligonucleotide
tcgtaacccggtactcgtgcatctttggctcccca

SEQ ID NO: 168618 - DNA, 36 bp, Artificial Sequence
  Synthetic oligonucleotide
ttactacctccgacctgcctccatgccaccatatca

SEQ ID NO: 168619 - DNA, 35 bp, Artificial Sequence
  Synthetic oligonucleotide
tgcacttcagccgcatcatctattataccatctca

SEQ ID NO: 168620 - DNA, 36 bp, Artificial Sequence
  Synthetic oligonucleotide
ttgggctcagggagggggggaggtattggcggttca

SEQ ID NO: 168621 - DNA, 37 bp, Artificial Sequence
  Synthetic oligonucleotide
gttcccgccaccaccacctgctttttttgataagaga

SEQ ID NO: 168622 - DNA, 37 bp, Artificial Sequence
  Synthetic oligonucleotide
ggggtgggccccgtaggggtaagagcggggtaaacga

SEQ ID NO: 168623 - DNA, 37 bp, Artificial Sequence
  Synthetic oligonucleotide
gcctcgcccccccggaggtaccttgactcacacacga

SEQ ID NO: 168624 - DNA, 37 bp, Artificial Sequence
  Synthetic oligonucleotide
tcacctccgagaactatcgcactcccagtcattacga

SEQ ID NO: 168625 - DNA, 37 bp, Artificial Sequence
  Synthetic oligonucleotide
cccgccccctcctgccgacacacgactacatttacga

SEQ ID NO: 168626 - DNA, 37 bp, Artificial Sequence
  Synthetic oligonucleotide
aggtgcccccaccattgaacaacacccgccctaccga

SEQ ID NO: 168627 - DNA, 37 bp, Artificial Sequence
  Synthetic oligonucleotide
tgcctacgcccttccccaaggtacgtcctctcgccga

SEQ ID NO: 168628 - DNA, 37 bp, Artificial Sequence
  Synthetic oligonucleotide
aacacgtacgtgcgcactattgcgaccttttctccga

SEQ ID NO: 168629 - DNA, 36 bp, Artificial Sequence
  Synthetic oligonucleotide
tctcccgccccaggaattatctagcccactaacgga

SEQ ID NO: 168630 - DNA, 35 bp, Artificial Sequence
  Synthetic oligonucleotide
accccctgcccttatgattggccgtcctcctcgga

SEQ ID NO: 168631 - DNA, 37 bp, Artificial Sequence
  Synthetic oligonucleotide
gtggtgtgtcatcaagcgggggatcgggcggagggga

SEQ ID NO: 168632 - DNA, 37 bp, Artificial Sequence
  Synthetic oligonucleotide
agatagagggggaaaggggacggcacggactggggga

SEQ ID NO: 168633 - DNA, 37 bp, Artificial Sequence
  Synthetic oligonucleotide
tcagggtggggtagcactaaattgggggtcgtgggga

SEQ ID NO: 168634 - DNA, 36 bp, Artificial Sequence
  Synthetic oligonucleotide
accccacctccgatttactatagcactatggctgga

SEQ ID NO: 168635 - DNA, 36 bp, Artificial Sequence
  Synthetic oligonucleotide
accatccaccctccgccatgctcacgtccgcttgga

SEQ ID NO: 168636 - DNA, 36 bp, Artificial Sequence
  Synthetic oligonucleotide
agtatgggagggtgggtggtcgagaatggggttgga

SEQ ID NO: 168637 - DNA, 37 bp, Artificial Sequence
  Synthetic oligonucleotide
atcgcccccactggaagtcccgatcctgccccaatga

SEQ ID NO: 168638 - DNA, 37 bp, Artificial Sequence
  Synthetic oligonucleotide
ggaggggagggggtggcaaagataaccgagagaatga

SEQ ID NO: 168639 - DNA, 38 bp, Artificial Sequence
  Synthetic oligonucleotide
tcacccatccccagcaactgtatactcactacccatga

SEQ ID NO: 168640 - DNA, 35 bp, Artificial Sequence
  Synthetic oligonucleotide
atcgaaccatcccctccgtcgctccggcctcatga

SEQ ID NO: 168641 - DNA, 37 bp, Artificial Sequence
  Synthetic oligonucleotide
gctaggaggatagtacgggctgggtgataggggatga

SEQ ID NO: 168642 - DNA, 38 bp, Artificial Sequence
  Synthetic oligonucleotide
gccatcccgctgatccctcgagcctccgacctatatga

SEQ ID NO: 168643 - DNA, 38 bp, Artificial Sequence
  Synthetic oligonucleotide
gccaggcatatgtgcttccctgcgccccgtacccctga

SEQ ID NO: 168644 - DNA, 36 bp, Artificial Sequence
  Synthetic oligonucleotide
atcgcgcatccctcactattaaggttctcctcctga

SEQ ID NO: 168645 - DNA, 37 bp, Artificial Sequence
  Synthetic oligonucleotide
gcccccccgcccaacaatagaaagcctcgccacgtga

SEQ ID NO: 168646 - DNA, 35 bp, Artificial Sequence
  Synthetic oligonucleotide
gctgaagggatcgggtgggcactgggtgggcgtga

SEQ ID NO: 168647 - DNA, 37 bp, Artificial Sequence
  Synthetic oligonucleotide
attccaactgcctcttctcacccacgtcccttcgtga

SEQ ID NO: 168648 - DNA, 38 bp, Artificial Sequence
  Synthetic oligonucleotide
tctccaccgcccgacccttagtccactctcggtattga

SEQ ID NO: 168649 - DNA, 36 bp, Artificial Sequence
  Synthetic oligonucleotide
tgatacatcaggctctccaactcccgcactacttga

SEQ ID NO: 168650 - DNA, 36 bp, Artificial Sequence
  Synthetic oligonucleotide
acactccccgttcctctgcatgacaatatggcttga

SEQ ID NO: 168651 - DNA, 36 bp, Artificial Sequence
  Synthetic oligonucleotide
gtgaacctcctctatcataaagacgctccctcttga

SEQ ID NO: 168652 - DNA, 38 bp, Artificial Sequence
  Synthetic oligonucleotide
gcaacccacgcgccacccatcacagcccgctttcttga

SEQ ID NO: 168653 - DNA, 37 bp, Artificial Sequence
  Synthetic oligonucleotide
ggatgggtggaagggcaagagttggggctggagttga

SEQ ID NO: 168654 - DNA, 38 bp, Artificial Sequence
  Synthetic oligonucleotide
tccgtccctcgctccccccctgcttgacacacatttga

SEQ ID NO: 168655 - DNA, 36 bp, Artificial Sequence
  Synthetic oligonucleotide
gcaaccacatccgctccacgttactacagcatttga

SEQ ID NO: 168656 - DNA, 36 bp, Artificial Sequence
  Synthetic oligonucleotide
ttggggaggagagggggtatatgtgactagggcata

SEQ ID NO: 168657 - DNA, 36 bp, Artificial Sequence
  Synthetic oligonucleotide
tgaatgggagggtggggctggggttggctgtgcata

SEQ ID NO: 168658 - DNA, 36 bp, Artificial Sequence
  Synthetic oligonucleotide
gtgcccgcgttcttctcgtcccgccccctgtcacta

SEQ ID NO: 168659 - DNA, 36 bp, Artificial Sequence
  Synthetic oligonucleotide
tcactccagacctccattcgaccgtgtccacgccta

SEQ ID NO: 168660 - DNA, 36 bp, Artificial Sequence
  Synthetic oligonucleotide
tacctcgctgtatccccactgttttgccctgttgta

SEQ ID NO: 168661 - DNA, 36 bp, Artificial Sequence
  Synthetic oligonucleotide
tattggtcgacgccgttgccctccgttactacctta

SEQ ID NO: 168662 - DNA, 36 bp, Artificial Sequence
  Synthetic oligonucleotide
tacccgtatcagtcgctgctaacctgccggccctta

SEQ ID NO: 168663 - DNA, 36 bp, Artificial Sequence
  Synthetic oligonucleotide
aacgtgcaacggtttcccccttccgtcgttccctta

SEQ ID NO: 168664 - DNA, 37 bp, Artificial Sequence
  Synthetic oligonucleotide
gtccgtcgttcacctgttggtctatcagccctcctta

SEQ ID NO: 168665 - DNA, 35 bp, Artificial Sequence
  Synthetic oligonucleotide
gcacaacctcgtaggttccttgcccccttagttta

SEQ ID NO: 168666 - DNA, 36 bp, Artificial Sequence
  Synthetic oligonucleotide
tatgacctcggattgatccgctccacccactgttta

SEQ ID NO: 168667 - DNA, 35 bp, Artificial Sequence
  Synthetic oligonucleotide
acgagctcgcctatgatagcgtctcccctttccac

SEQ ID NO: 168668 - DNA, 35 bp, Artificial Sequence
  Synthetic oligonucleotide
agtcaacgcacatttgagcccacctcgccttgcac

SEQ ID NO: 168669 - DNA, 35 bp, Artificial Sequence
  Synthetic oligonucleotide
tctcacccctgcctgttattacccaccctgcttac

SEQ ID NO: 168670 - DNA, 35 bp, Artificial Sequence
  Synthetic oligonucleotide
tacaccaccgcattggacgactcgccattctcacc

SEQ ID NO: 168671 - DNA, 35 bp, Artificial Sequence
  Synthetic oligonucleotide
acagaccagcgctatgctagacccgtactgccccc

SEQ ID NO: 168672 - DNA, 35 bp, Artificial Sequence
  Synthetic oligonucleotide
tagactcgcgcgcccgagattcctatcctcgcccc

SEQ ID NO: 168673 - DNA, 35 bp, Artificial Sequence
  Synthetic oligonucleotide
gggaagaggtcattgtctccgtctccactgtcccc

SEQ ID NO: 168674 - DNA, 35 bp, Artificial Sequence
  Synthetic oligonucleotide
tgccctgcagtgcggttctcgtgataccccccgcc

SEQ ID NO: 168675 - DNA, 35 bp, Artificial Sequence
  Synthetic oligonucleotide
ccttaccgccctctctgctctgtcctcgccaggcc

SEQ ID NO: 168676 - DNA, 35 bp, Artificial Sequence
  Synthetic oligonucleotide
ttcgccaacacttacatttgcccttttacatgtcc

SEQ ID NO: 168677 - DNA, 35 bp, Artificial Sequence
  Synthetic oligonucleotide
ttcgccttccccaactgtccttgttacgaactagc

SEQ ID NO: 168678 - DNA, 35 bp, Artificial Sequence
  Synthetic oligonucleotide
agtgccctttcgaagtctttgcccgccctgtacgc

SEQ ID NO: 168679 - DNA, 35 bp, Artificial Sequence
  Synthetic oligonucleotide
accgactcctacctcgtagcgtatctgaatcccgc

SEQ ID NO: 168680 - DNA, 35 bp, Artificial Sequence
  Synthetic oligonucleotide
acgctgtgctcccgtccgttacatgtcgccgtcgc

SEQ ID NO: 168681 - DNA, 35 bp, Artificial Sequence
  Synthetic oligonucleotide
tacgcgcctctcattcctttccatcgccccctggc

SEQ ID NO: 168682 - DNA, 35 bp, Artificial Sequence
  Synthetic oligonucleotide
gctctccacccccggcgccaatacagggcacgtgc

SEQ ID NO: 168683 - DNA, 34 bp, Artificial Sequence
  Synthetic oligonucleotide
gagtcattccgcacgccgtggccctgatctaatc

SEQ ID NO: 168684 - DNA, 35 bp, Artificial Sequence
  Synthetic oligonucleotide
tctgctcccccctagccttgtcgcctacacgcatc

SEQ ID NO: 168685 - DNA, 35 bp, Artificial Sequence
  Synthetic oligonucleotide
tagcaaactccgccggttcccataaggctgccctc

SEQ ID NO: 168686 - DNA, 35 bp, Artificial Sequence
  Synthetic oligonucleotide
atccgtcactgccgctgttgacgaaaatatgcctc

SEQ ID NO: 168687 - DNA, 35 bp, Artificial Sequence
  Synthetic oligonucleotide
tgtggcactccgtgcgtgcctcctctgaactcctc

SEQ ID NO: 168688 - DNA, 35 bp, Artificial Sequence
  Synthetic oligonucleotide
tctgctatgtccacctgtcttcccgtcaagcgctc

SEQ ID NO: 168689 - DNA, 34 bp, Artificial Sequence
  Synthetic oligonucleotide
gattcgcgcatctatgccagttctttcctatgtc

SEQ ID NO: 168690 - DNA, 35 bp, Artificial Sequence
  Synthetic oligonucleotide
ttgctcatccggcaccagaactcacccttagcttc

SEQ ID NO: 168691 - DNA, 35 bp, Artificial Sequence
  Synthetic oligonucleotide
atgcaagggtgagggtgggatgggcatgagacaag

SEQ ID NO: 168692 - DNA, 35 bp, Artificial Sequence
  Synthetic oligonucleotide
atggtcacaggatgtggagggggtggttggggaag

SEQ ID NO: 168693 - DNA, 35 bp, Artificial Sequence
  Synthetic oligonucleotide
gctgtaccatcactgaatcggcccctgactacccg

SEQ ID NO: 168694 - DNA, 35 bp, Artificial Sequence
  Synthetic oligonucleotide
tgaaacgccatccagcttctcctatgacatccccg

SEQ ID NO: 168695 - DNA, 35 bp, Artificial Sequence
  Synthetic oligonucleotide
gatgcctccccgtcgatatttccggcttctgcccg

SEQ ID NO: 168696 - DNA, 35 bp, Artificial Sequence
  Synthetic oligonucleotide
tcacccagtgtggctttttggcgtcctcgctcccg

SEQ ID NO: 168697 - DNA, 35 bp, Artificial Sequence
  Synthetic oligonucleotide
gcgctgtaagccgttactccccccgcgcttgttcg

SEQ ID NO: 168698 - DNA, 35 bp, Artificial Sequence
  Synthetic oligonucleotide
tctagcccctccgccaccctttgcgtgcctatagg

SEQ ID NO: 168699 - DNA, 35 bp, Artificial Sequence
  Synthetic oligonucleotide
tgtgcccttctctcctgcgtttgcttcctgttagg

SEQ ID NO: 168700 - DNA, 35 bp, Artificial Sequence
  Synthetic oligonucleotide
cctgacaccacacttgttcccgctctatcttatgg

SEQ ID NO: 168701 - DNA, 35 bp, Artificial Sequence
  Synthetic oligonucleotide
atcacaaccccttcctcgccgcctgcccgcccatg

SEQ ID NO: 168702 - DNA, 35 bp, Artificial Sequence
  Synthetic oligonucleotide
tccaaacctgtcatttgagctcgccaccctacctg

SEQ ID NO: 168703 - DNA, 35 bp, Artificial Sequence
  Synthetic oligonucleotide
tgagcactcccctttgattacacggtccggtcctg

SEQ ID NO: 168704 - DNA, 35 bp, Artificial Sequence
  Synthetic oligonucleotide
gccccatcaggttctatcgtgccatttcgcacttg

SEQ ID NO: 168705 - DNA, 35 bp, Artificial Sequence
  Synthetic oligonucleotide
atcactcactcccaccgccaaggcctaatgccttg

SEQ ID NO: 168706 - DNA, 35 bp, Artificial Sequence
  Synthetic oligonucleotide
ccacatcctcacattccgactactgcccatcccat

SEQ ID NO: 168707 - DNA, 35 bp, Artificial Sequence
  Synthetic oligonucleotide
atctgtctccgctatgtctttgtcgctcgccaact

SEQ ID NO: 168708 - DNA, 35 bp, Artificial Sequence
  Synthetic oligonucleotide
aaccgccctcccctgttgctctatgtaacgggact

SEQ ID NO: 168709 - DNA, 35 bp, Artificial Sequence
  Synthetic oligonucleotide
aggtccaggacgtcatcggtcttcggttcccccct

SEQ ID NO: 168710 - DNA, 35 bp, Artificial Sequence
  Synthetic oligonucleotide
cacgagccacgcgatgttcccgccgccacctccct

SEQ ID NO: 168711 - DNA, 35 bp, Artificial Sequence
  Synthetic oligonucleotide
gcaggacaatatcgcgtcgctagctaccacctcct

SEQ ID NO: 168712 - DNA, 35 bp, Artificial Sequence
  Synthetic oligonucleotide
ttacacatgtcaaggagcccgctgcccttcttcct

SEQ ID NO: 168713 - DNA, 35 bp, Artificial Sequence
  Synthetic oligonucleotide
gccctcatgcgctgtctgatgctcccccttccgct

SEQ ID NO: 168714 - DNA, 35 bp, Artificial Sequence
  Synthetic oligonucleotide
tagtagacgccgcttgcctatattgcttcccttct

SEQ ID NO: 168715 - DNA, 35 bp, Artificial Sequence
  Synthetic oligonucleotide
acagtatacgcccgcctgccaaacatcctcactgt

SEQ ID NO: 168716 - DNA, 35 bp, Artificial Sequence
  Synthetic oligonucleotide
tacacctcacctattcccggtcctgcccgccctgt

SEQ ID NO: 168717 - DNA, 35 bp, Artificial Sequence
  Synthetic oligonucleotide
acaccgccctgctctatcttcagtctgcgtattgt

SEQ ID NO: 168718 - DNA, 35 bp, Artificial Sequence
  Synthetic oligonucleotide
tccgtcaccttcagtcccaccgtggccccgcattt

SEQ ID NO: 168719 - DNA, 36 bp, Artificial Sequence
  Synthetic oligonucleotide
gccacgcctccgaagccatgatcgcactctcatcaa

SEQ ID NO: 168720 - DNA, 35 bp, Artificial Sequence
  Synthetic oligonucleotide
ggggtagggcagggagggataggcagacgttggaa

SEQ ID NO: 168721 - DNA, 36 bp, Artificial Sequence
  Synthetic oligonucleotide
ggtggaggggcgaattggggtagatggcaggacaca

SEQ ID NO: 168722 - DNA, 36 bp, Artificial Sequence
  Synthetic oligonucleotide
ttgccatcgctcccgagttcgcccacctttccgaca

SEQ ID NO: 168723 - DNA, 36 bp, Artificial Sequence
  Synthetic oligonucleotide
ggtggaatgcaggggaacaaggcgggagataggaca

SEQ ID NO: 168724 - DNA, 35 bp, Artificial Sequence
  Synthetic oligonucleotide
gaacagaccaccgcaaccgttatacccgccctaca

SEQ ID NO: 168725 - DNA, 35 bp, Artificial Sequence
  Synthetic oligonucleotide
gtgaagtgaagggggggccgaggaagaactgtaca

SEQ ID NO: 168726 - DNA, 35 bp, Artificial Sequence
  Synthetic oligonucleotide
tgtcgcccgcgacagctcccccccgcgttccacca

SEQ ID NO: 168727 - DNA, 36 bp, Artificial Sequence
  Synthetic oligonucleotide
atcgcaccacctctccaatgatctgtggacctccca

SEQ ID NO: 168728 - DNA, 35 bp, Artificial Sequence
  Synthetic oligonucleotide
gatctgcacgagcacgcccccactccatctcgcca

SEQ ID NO: 168729 - DNA, 35 bp, Artificial Sequence
  Synthetic oligonucleotide
atccacgtgcgccctacctttcagctgcgcctcca

SEQ ID NO: 168730 - DNA, 36 bp, Artificial Sequence
  Synthetic oligonucleotide
gccctccgtttcgtagcctccctggtccatggatca

SEQ ID NO: 168731 - DNA, 36 bp, Artificial Sequence
  Synthetic oligonucleotide
gcgcacctcccgattcgaacgcgtcactatccttca

SEQ ID NO: 168732 - DNA, 36 bp, Artificial Sequence
  Synthetic oligonucleotide
gcccccgccgagcctttcatctacgtggtgtcttca

SEQ ID NO: 168733 - DNA, 35 bp, Artificial Sequence
  Synthetic oligonucleotide
aggaacactcgcctcccgctatgtctaccctttca

SEQ ID NO: 168734 - DNA, 37 bp, Artificial Sequence
  Synthetic oligonucleotide
aatgagggacaggaggtgagaaagggcgcaaatcaga

SEQ ID NO: 168735 - DNA, 37 bp, Artificial Sequence
  Synthetic oligonucleotide
agtagggtgaggtggtaggcgtgggtgggtcatcaga

SEQ ID NO: 168736 - DNA, 31 bp, Artificial Sequence
  Synthetic oligonucleotide
acggtgagggggggggtgaagggagcagaga

SEQ ID NO: 168737 - DNA, 37 bp, Artificial Sequence
  Synthetic oligonucleotide
tacgagaggggggtgggggcctggggcaggtgaacga

SEQ ID NO: 168738 - DNA, 37 bp, Artificial Sequence
  Synthetic oligonucleotide
agcatcccccgcccaccccatacgcagtgccttacga

SEQ ID NO: 168739 - DNA, 37 bp, Artificial Sequence
  Synthetic oligonucleotide
aacacgcctggcccatcgcttacattaccgttaccga

SEQ ID NO: 168740 - DNA, 35 bp, Artificial Sequence
  Synthetic oligonucleotide
ttcaaagccgccgatcgtcccctctcaccctccga

SEQ ID NO: 168741 - DNA, 37 bp, Artificial Sequence
  Synthetic oligonucleotide
tcacgaacgaagatggggggtggggagtgatcggcga

SEQ ID NO: 168742 - DNA, 37 bp, Artificial Sequence
  Synthetic oligonucleotide
tccgtccacagttcgtcccccctgtcccgatcctcga

SEQ ID NO: 168743 - DNA, 37 bp, Artificial Sequence
  Synthetic oligonucleotide
ggccctggcccccgttgaccatcccgtgacccttcga

SEQ ID NO: 168744 - DNA, 37 bp, Artificial Sequence
  Synthetic oligonucleotide
tgatgtacgggtaagggaagaaaataggggacaagga

SEQ ID NO: 168745 - DNA, 35 bp, Artificial Sequence
  Synthetic oligonucleotide
gggcctccccattgacattactcaacccccccgga

SEQ ID NO: 168746 - DNA, 37 bp, Artificial Sequence
  Synthetic oligonucleotide
gtggggtgggttggggagaatgaagggtaaaccggga

SEQ ID NO: 168747 - DNA, 37 bp, Artificial Sequence
  Synthetic oligonucleotide
tgcactccctctgcggtgcccattgcactcctttgga

SEQ ID NO: 168748 - DNA, 37 bp, Artificial Sequence
  Synthetic oligonucleotide
gaagaaccgcctaggtgcaccctgatcccttccatga

SEQ ID NO: 168749 - DNA, 38 bp, Artificial Sequence
  Synthetic oligonucleotide
tgccacgcccttgcctttagtacactctccggatatga

SEQ ID NO: 168750 - DNA, 35 bp, Artificial Sequence
  Synthetic oligonucleotide
agttcgcccctgacctcaccttcagttcaaactga

SEQ ID NO: 168751 - DNA, 36 bp, Artificial Sequence
  Synthetic oligonucleotide
tcccacgccccaaggtagtcattccgacctcactga

SEQ ID NO: 168752 - DNA, 38 bp, Artificial Sequence
  Synthetic oligonucleotide
accccgcggccacccatgtccctcctgtatatacctga

SEQ ID NO: 168753 - DNA, 38 bp, Artificial Sequence
  Synthetic oligonucleotide
aacccgtgcctatatgttacccgccacctactacctga

SEQ ID NO: 168754 - DNA, 38 bp, Artificial Sequence
  Synthetic oligonucleotide
ttgggcgggaggggttgagcggccttacggggccctga

SEQ ID NO: 168755 - DNA, 38 bp, Artificial Sequence
  Synthetic oligonucleotide
ggttgcacccagcctgtcctctagcgccacccctctga

SEQ ID NO: 168756 - DNA, 38 bp, Artificial Sequence
  Synthetic oligonucleotide
aacccgccatatgctgccgccctcgtactactctctga

SEQ ID NO: 168757 - DNA, 37 bp, Artificial Sequence
  Synthetic oligonucleotide
tagccgttcgatctgctccgtactctctgctctctga

SEQ ID NO: 168758 - DNA, 38 bp, Artificial Sequence
  Synthetic oligonucleotide
gatgaggacgggggaatacgggacgggagggagagtga

SEQ ID NO: 168759 - DNA, 38 bp, Artificial Sequence
  Synthetic oligonucleotide
gtcctgtccccccgctatcaccactgtacttttagtga

SEQ ID NO: 168760 - DNA, 38 bp, Artificial Sequence
  Synthetic oligonucleotide
tgtgtggggcctaaaggtgaaggggaagggggagttga

SEQ ID NO: 168761 - DNA, 37 bp, Artificial Sequence
  Synthetic oligonucleotide
aaatgtcagagggccgggagggggggtgaaacgttga

SEQ ID NO: 168762 - DNA, 35 bp, Artificial Sequence
  Synthetic oligonucleotide
gcccatcgcgagtcactggaccgccgccctctcta

SEQ ID NO: 168763 - DNA, 36 bp, Artificial Sequence
  Synthetic oligonucleotide
tctgccgcagccttgggttcacgcgcctcttgtcta

SEQ ID NO: 168764 - DNA, 36 bp, Artificial Sequence
  Synthetic oligonucleotide
actgcctcccgcccaatccctgactcggacccatta

SEQ ID NO: 168765 - DNA, 35 bp, Artificial Sequence
  Synthetic oligonucleotide
aacgccacgcccgcgtacgtcgcctatggccctta

SEQ ID NO: 168766 - DNA, 36 bp, Artificial Sequence
  Synthetic oligonucleotide
ttgatgcggcacgccactcccttccggtccgcctta

SEQ ID NO: 168767 - DNA, 35 bp, Artificial Sequence
  Synthetic oligonucleotide
gtcgtcctttgccggcctgcttagttccatcctta

SEQ ID NO: 168768 - DNA, 36 bp, Artificial Sequence
  Synthetic oligonucleotide
atccgcccttcgccatagtgcgctattatctattta

SEQ ID NO: 168769 - DNA, 36 bp, Artificial Sequence
  Synthetic oligonucleotide
taccaccgtactgccgcgcccgcctggattccttta

SEQ ID NO: 168770 - DNA, 36 bp, Artificial Sequence
  Synthetic oligonucleotide
gctccaccggctctatgctttgtttttcacctttta

SEQ ID NO: 168771 - DNA, 35 bp, Artificial Sequence
  Synthetic oligonucleotide
aacaccgctttcgttcccgacacgtgatgcaccac

SEQ ID NO: 168772 - DNA, 35 bp, Artificial Sequence
  Synthetic oligonucleotide
gatccacttgcgggtggatccggtactttttccac

SEQ ID NO: 168773 - DNA, 35 bp, Artificial Sequence
  Synthetic oligonucleotide
aacgcaccggcctcatcgtattccgccaacctcac

SEQ ID NO: 168774 - DNA, 35 bp, Artificial Sequence
  Synthetic oligonucleotide
ttccgcagtcgaacccttcacactcctcgcctgac

SEQ ID NO: 168775 - DNA, 35 bp, Artificial Sequence
  Synthetic oligonucleotide
aaccctcgctacggtccaatgcctgatcctcgtac

SEQ ID NO: 168776 - DNA, 35 bp, Artificial Sequence
  Synthetic oligonucleotide
acgcactgtatcacacctggcgctttccccacacc

SEQ ID NO: 168777 - DNA, 35 bp, Artificial Sequence
  Synthetic oligonucleotide
tgcttcatccccgctatcctagttctatgtgcacc

SEQ ID NO: 168778 - DNA, 35 bp, Artificial Sequence
  Synthetic oligonucleotide
gggtcctccgagcgccgcccttattcttacgtacc

SEQ ID NO: 168779 - DNA, 35 bp, Artificial Sequence
  Synthetic oligonucleotide
gtgacgcatgatcctgtttggcctcagcacacccc

SEQ ID NO: 168780 - DNA, 35 bp, Artificial Sequence
  Synthetic oligonucleotide
tgttcgcgcaccatctcccgagtccagtcgccccc

SEQ ID NO: 168781 - DNA, 35 bp, Artificial Sequence
  Synthetic oligonucleotide
gacgcaacttatgtcccttaattctctgggccccc

SEQ ID NO: 168782 - DNA, 35 bp, Artificial Sequence
  Synthetic oligonucleotide
aaccatgaccgactcccggctgccacggctccccc

SEQ ID NO: 168783 - DNA, 35 bp, Artificial Sequence
  Synthetic oligonucleotide
aacccccgcagcttcgccctcgtaaccctagcccc

SEQ ID NO: 168784 - DNA, 35 bp, Artificial Sequence
  Synthetic oligonucleotide
tgtaccgcgcacatttcggtcaattagccctgccc

SEQ ID NO: 168785 - DNA, 34 bp, Artificial Sequence
  Synthetic oligonucleotide
ttcaccaccccgcgcataacagcaaaccacggcc

SEQ ID NO: 168786 - DNA, 35 bp, Artificial Sequence
  Synthetic oligonucleotide
gaactcccgccgcaaaccgctggtctgccaatgcc

SEQ ID NO: 168787 - DNA, 35 bp, Artificial Sequence
  Synthetic oligonucleotide
tccggtggcaccaggcacccgcacctcgctcctcc

SEQ ID NO: 168788 - DNA, 35 bp, Artificial Sequence
  Synthetic oligonucleotide
gcacatcatcctactggcgttaaccgtcgacttcc

SEQ ID NO: 168789 - DNA, 35 bp, Artificial Sequence
  Synthetic oligonucleotide
atgcgatacaccgacactgttcaccccccagttcc

SEQ ID NO: 168790 - DNA, 35 bp, Artificial Sequence
  Synthetic oligonucleotide
tcgctccgaggaagtgatgcaacacccgcctttcc

SEQ ID NO: 168791 - DNA, 35 bp, Artificial Sequence
  Synthetic oligonucleotide
gacggtccgacttctttccaacacacgttcgccgc

SEQ ID NO: 168792 - DNA, 35 bp, Artificial Sequence
  Synthetic oligonucleotide
tgcacgataacatccagcccgccccattaatgcgc

SEQ ID NO: 168793 - DNA, 35 bp, Artificial Sequence
  Synthetic oligonucleotide
acactccccgccgactcctagcgttatttttgcgc

SEQ ID NO: 168794 - DNA, 35 bp, Artificial Sequence
  Synthetic oligonucleotide
gctcgcacccatagtaccacctaccccaaccgggc

SEQ ID NO: 168795 - DNA, 35 bp, Artificial Sequence
  Synthetic oligonucleotide
tgcttccacgccacctatcactacagacatcgtgc

SEQ ID NO: 168796 - DNA, 35 bp, Artificial Sequence
  Synthetic oligonucleotide
ttagcccgatctccgccgtactacattgattttgc

SEQ ID NO: 168797 - DNA, 35 bp, Artificial Sequence
  Synthetic oligonucleotide
ggccagcctctcggacctcccacagccattacatc

SEQ ID NO: 168798 - DNA, 35 bp, Artificial Sequence
  Synthetic oligonucleotide
ataccgccactcgttcccttccatatgcgcgcatc

SEQ ID NO: 168799 - DNA, 35 bp, Artificial Sequence
  Synthetic oligonucleotide
ttgagtgcgctcctgactttccactaccatctatc

SEQ ID NO: 168800 - DNA, 35 bp, Artificial Sequence
  Synthetic oligonucleotide
gtggatctcgacgccacgtgcccttacgcaacctc

SEQ ID NO: 168801 - DNA, 35 bp, Artificial Sequence
  Synthetic oligonucleotide
gaggacaacatcacagctgcttctctctcttcctc

SEQ ID NO: 168802 - DNA, 35 bp, Artificial Sequence
  Synthetic oligonucleotide
tcccgctgagcagttatgaccatgcgcttcatctc

SEQ ID NO: 168803 - DNA, 35 bp, Artificial Sequence
  Synthetic oligonucleotide
aagtccgactcacctgctcttcgtactctggtctc

SEQ ID NO: 168804 - DNA, 35 bp, Artificial Sequence
  Synthetic oligonucleotide
tgcccgctcctaccccactcggttcgccctgcgtc

SEQ ID NO: 168805 - DNA, 35 bp, Artificial Sequence
  Synthetic oligonucleotide
gcccaagcctgaacacgaccggcgtaccaccattc

SEQ ID NO: 168806 - DNA, 35 bp, Artificial Sequence
  Synthetic oligonucleotide
gcctcgtcttccaccgtcccttaacgagctcgttc

SEQ ID NO: 168807 - DNA, 35 bp, Artificial Sequence
  Synthetic oligonucleotide
tacgaccatcacggcccttcatctcccacgtgttc

SEQ ID NO: 168808 - DNA, 35 bp, Artificial Sequence
  Synthetic oligonucleotide
gagcatcggcgcatctttgactaccacctttcacg

SEQ ID NO: 168809 - DNA, 35 bp, Artificial Sequence
  Synthetic oligonucleotide
tacgcgagcttcgtcacctgacctgcccccctacg

SEQ ID NO: 168810 - DNA, 35 bp, Artificial Sequence
  Synthetic oligonucleotide
atgcggctctcgttccgtccgctccaccagctacg

SEQ ID NO: 168811 - DNA, 35 bp, Artificial Sequence
  Synthetic oligonucleotide
ttgtcatccataccccgccagcacccatgttcgcg

SEQ ID NO: 168812 - DNA, 35 bp, Artificial Sequence
  Synthetic oligonucleotide
ttcggttcacccgcctcacttggacctacccatcg

SEQ ID NO: 168813 - DNA, 35 bp, Artificial Sequence
  Synthetic oligonucleotide
gccccccctcaccagccactcgcctgtttgatagg

SEQ ID NO: 168814 - DNA, 35 bp, Artificial Sequence
  Synthetic oligonucleotide
gagaggcgccgcaccaccttgtctccattatctgg

SEQ ID NO: 168815 - DNA, 35 bp, Artificial Sequence
  Synthetic oligonucleotide
tctcactcacctgccacctgttcactcacatgatg

SEQ ID NO: 168816 - DNA, 35 bp, Artificial Sequence
  Synthetic oligonucleotide
atcctgtgcagtcatcgtcccgcttcactctcctg

SEQ ID NO: 168817 - DNA, 35 bp, Artificial Sequence
  Synthetic oligonucleotide
gatggtaagggggcctagcgggaggtaagggcgtg

SEQ ID NO: 168818 - DNA, 35 bp, Artificial Sequence
  Synthetic oligonucleotide
acctccaggcgagagggagggagggtaccagtgtg

SEQ ID NO: 168819 - DNA, 36 bp, Artificial Sequence
  Synthetic oligonucleotide
atcgcaccgcccgtcctcatttcgcacccgcccaat

SEQ ID NO: 168820 - DNA, 35 bp, Artificial Sequence
  Synthetic oligonucleotide
tgtgtgtcgccatggtttcttttcacgtacttcat

SEQ ID NO: 168821 - DNA, 35 bp, Artificial Sequence
  Synthetic oligonucleotide
tacactggggggacgggactgggggagacagctat

SEQ ID NO: 168822 - DNA, 35 bp, Artificial Sequence
  Synthetic oligonucleotide
gcccaggcccgtttcactctcgccctgcctgttat

SEQ ID NO: 168823 - DNA, 35 bp, Artificial Sequence
  Synthetic oligonucleotide
ttcccgtagagtgcattgtaccatcccccgtttat

SEQ ID NO: 168824 - DNA, 35 bp, Artificial Sequence
  Synthetic oligonucleotide
ggatcaccttcgaattgtcctctcgccattaaact

SEQ ID NO: 168825 - DNA, 35 bp, Artificial Sequence
  Synthetic oligonucleotide
gctccatcggcacttcatttctatcgcctttcact

SEQ ID NO: 168826 - DNA, 35 bp, Artificial Sequence
  Synthetic oligonucleotide
ttacgtccgtaccgtccatagcacttgtcacacct

SEQ ID NO: 168827 - DNA, 35 bp, Artificial Sequence
  Synthetic oligonucleotide
gccaggtcgatagcctttcttgcatgccattacct

SEQ ID NO: 168828 - DNA, 35 bp, Artificial Sequence
  Synthetic oligonucleotide
tgtcacagcactacctctagttacatccgggccct

SEQ ID NO: 168829 - DNA, 35 bp, Artificial Sequence
  Synthetic oligonucleotide
agcccacctgcaccatctctaaaggcccttgccct

SEQ ID NO: 168830 - DNA, 35 bp, Artificial Sequence
  Synthetic oligonucleotide
ttcaggtgtaccgtttgctaagcaccccactccct

SEQ ID NO: 168831 - DNA, 35 bp, Artificial Sequence
  Synthetic oligonucleotide
gcccaccggtcacgcactaccttcccaggtctcct

SEQ ID NO: 168832 - DNA, 34 bp, Artificial Sequence
  Synthetic oligonucleotide
tgcattccaaccccatgctggccctccactcgct

SEQ ID NO: 168833 - DNA, 35 bp, Artificial Sequence
  Synthetic oligonucleotide
gttccgtaccccagcttacctctccatgactctct

SEQ ID NO: 168834 - DNA, 35 bp, Artificial Sequence
  Synthetic oligonucleotide
gcgccgttgcgcttccagacccttgtgccggttct

SEQ ID NO: 168835 - DNA, 35 bp, Artificial Sequence
  Synthetic oligonucleotide
ttcccatcaccgggcgtcacctcccgctttcacgt

SEQ ID NO: 168836 - DNA, 35 bp, Artificial Sequence
  Synthetic oligonucleotide
aatgccgccacttcgcttcccgctcttgagcccgt

SEQ ID NO: 168837 - DNA, 32 bp, Artificial Sequence
  Synthetic oligonucleotide
acaaggtggtgtgccatcccttccatcgcctt

SEQ ID NO: 168838 - DNA, 35 bp, Artificial Sequence
  Synthetic oligonucleotide
tgtagcccacacgtttctgctgcctcctgttaaaa

SEQ ID NO: 168839 - DNA, 36 bp, Artificial Sequence
  Synthetic oligonucleotide
gctccacccttcattgtagttccgttcgcgcacaaa

SEQ ID NO: 168840 - DNA, 36 bp, Artificial Sequence
  Synthetic oligonucleotide
gtctccacatgtccgtccactttacccttccgtaaa

SEQ ID NO: 168841 - DNA, 35 bp, Artificial Sequence
  Synthetic oligonucleotide
aatcgcccccagccgcccccagtattaaacaccaa

SEQ ID NO: 168842 - DNA, 36 bp, Artificial Sequence
  Synthetic oligonucleotide
gaatggggcgggtggtaacacgggggacacctcgaa

SEQ ID NO: 168843 - DNA, 36 bp, Artificial Sequence
  Synthetic oligonucleotide
atcacggcggagagggcggagggaggtcattgtgaa

SEQ ID NO: 168844 - DNA, 36 bp, Artificial Sequence
  Synthetic oligonucleotide
ggaaggacgagtggaagcggagggacggtgggataa

SEQ ID NO: 168845 - DNA, 36 bp, Artificial Sequence
  Synthetic oligonucleotide
gtcccgcacctctgcacgcccaccgcttttatgtaa

SEQ ID NO: 168846 - DNA, 35 bp, Artificial Sequence
  Synthetic oligonucleotide
gtgccattcatcgtctcggtcacacttcctccaca

SEQ ID NO: 168847 - DNA, 36 bp, Artificial Sequence
  Synthetic oligonucleotide
gttccaccgatatgcctaccaagcccactttgcaca

SEQ ID NO: 168848 - DNA, 36 bp, Artificial Sequence
  Synthetic oligonucleotide
gatacgcaccatcgcccggcccaagcagtgatacca

SEQ ID NO: 168849 - DNA, 36 bp, Artificial Sequence
  Synthetic oligonucleotide
gcccatcccccgtcgttgtggtcccattgcaatcca

SEQ ID NO: 168850 - DNA, 35 bp, Artificial Sequence
  Synthetic oligonucleotide
atcgccacccgggcatgaccgtctctccttccgca

SEQ ID NO: 168851 - DNA, 36 bp, Artificial Sequence
  Synthetic oligonucleotide
tgttgcgctccactctataccgccgttcgtctcgca

SEQ ID NO: 168852 - DNA, 36 bp, Artificial Sequence
  Synthetic oligonucleotide
gtacccgccacattaccgtacggtttttcttaatca

SEQ ID NO: 168853 - DNA, 36 bp, Artificial Sequence
  Synthetic oligonucleotide
aacgcaactcatgcgcatgtgacaccctctcactca

SEQ ID NO: 168854 - DNA, 37 bp, Artificial Sequence
  Synthetic oligonucleotide
accatgcgtcacctgcgccccccgtccccagtcaaga

SEQ ID NO: 168855 - DNA, 37 bp, Artificial Sequence
  Synthetic oligonucleotide
taagggagagacgcggcggggggatgcggggggtaga

SEQ ID NO: 168856 - DNA, 37 bp, Artificial Sequence
  Synthetic oligonucleotide
gtaagcacgacgaggatgggggggagtggaacaacga

SEQ ID NO: 168857 - DNA, 37 bp, Artificial Sequence
  Synthetic oligonucleotide
ggtgaataaagggggggtagaaatgggtgggagacga

SEQ ID NO: 168858 - DNA, 37 bp, Artificial Sequence
  Synthetic oligonucleotide
gcgcgcaccattgtcctctcgttgctctgtcgcccga

SEQ ID NO: 168859 - DNA, 37 bp, Artificial Sequence
  Synthetic oligonucleotide
gaagtgccgatggaaatagaattgagggggggagcga

SEQ ID NO: 168860 - DNA, 37 bp, Artificial Sequence
  Synthetic oligonucleotide
tagcgtagccatctttcgcccttatctgctcactcga

SEQ ID NO: 168861 - DNA, 37 bp, Artificial Sequence
  Synthetic oligonucleotide
tggtagacgaactgggaagggtggagggcgggctcga

SEQ ID NO: 168862 - DNA, 37 bp, Artificial Sequence
  Synthetic oligonucleotide
agacatacccgctgcccatccgtacaattcttgtcga

SEQ ID NO: 168863 - DNA, 36 bp, Artificial Sequence
  Synthetic oligonucleotide
acaccatgcagctgtcatgcccccctcatgcttcga

SEQ ID NO: 168864 - DNA, 37 bp, Artificial Sequence
  Synthetic oligonucleotide
tgataacgcacataggagggctggggaaggggccgga

SEQ ID NO: 168865 - DNA, 36 bp, Artificial Sequence
  Synthetic oligonucleotide
accagggacgggaatggagggacaagagtgacggga

SEQ ID NO: 168866 - DNA, 37 bp, Artificial Sequence
  Synthetic oligonucleotide
ggagaagggaaagaaggccatcgtagactggggggga

SEQ ID NO: 168867 - DNA, 37 bp, Artificial Sequence
  Synthetic oligonucleotide
gcatacacctccgagtcgtactcgttgacttcctgga

SEQ ID NO: 168868 - DNA, 38 bp, Artificial Sequence
  Synthetic oligonucleotide
gacgaaagaggtagaacgggaactaggacggagcatga

SEQ ID NO: 168869 - DNA, 38 bp, Artificial Sequence
  Synthetic oligonucleotide
actcaggcgcggaggggtgggggagcggatgaagatga

SEQ ID NO: 168870 - DNA, 38 bp, Artificial Sequence
  Synthetic oligonucleotide
gagggggccgatgaggggaggtagaaggtcgtggatga

SEQ ID NO: 168871 - DNA, 37 bp, Artificial Sequence
  Synthetic oligonucleotide
tacgccccactgtgtttttcgtcgcctttccttatga

SEQ ID NO: 168872 - DNA, 38 bp, Artificial Sequence
  Synthetic oligonucleotide
gtcaccttctcgtgctttctaccgtggtctcaccctga

SEQ ID NO: 168873 - DNA, 38 bp, Artificial Sequence
  Synthetic oligonucleotide
aactgccaaccgtcacattcgtgatttacctcccctga

SEQ ID NO: 168874 - DNA, 38 bp, Artificial Sequence
  Synthetic oligonucleotide
tgctacctccgacggtctctacgagtcggcctccctga

SEQ ID NO: 168875 - DNA, 38 bp, Artificial Sequence
  Synthetic oligonucleotide
tcccgcccccctaggttaacgaatcttcaccttcctga

SEQ ID NO: 168876 - DNA, 37 bp, Artificial Sequence
  Synthetic oligonucleotide
atcgagtgaagagggtagtggggaacgggttgagtga

SEQ ID NO: 168877 - DNA, 38 bp, Artificial Sequence
  Synthetic oligonucleotide
ggatggcgaatgcggggaaagggggatcagggtggtga

SEQ ID NO: 168878 - DNA, 38 bp, Artificial Sequence
  Synthetic oligonucleotide
tcacctccgcgtactcttggcccgtgcccatccattga

SEQ ID NO: 168879 - DNA, 38 bp, Artificial Sequence
  Synthetic oligonucleotide
actgtgacagggaggggaggtatcggggaaggcattga

SEQ ID NO: 168880 - DNA, 37 bp, Artificial Sequence
  Synthetic oligonucleotide
tacgcgccgacccaggctctgcatcaccacctattga

SEQ ID NO: 168881 - DNA, 38 bp, Artificial Sequence
  Synthetic oligonucleotide
acaggaggcggatggtacgtggtgtgggcggatcttga

SEQ ID NO: 168882 - DNA, 35 bp, Artificial Sequence
  Synthetic oligonucleotide
aagggtgccccaccgcttcccgacgcctctttcta

SEQ ID NO: 168883 - DNA, 36 bp, Artificial Sequence
  Synthetic oligonucleotide
gttgactggtcctgccctgagtaaccaccccccgta

SEQ ID NO: 168884 - DNA, 36 bp, Artificial Sequence
  Synthetic oligonucleotide
tccacgcattcaggcagggtacaccacccccccgta

SEQ ID NO: 168885 - DNA, 36 bp, Artificial Sequence
  Synthetic oligonucleotide
ttggtcccttccctccacaagctgtaaagcactgta

SEQ ID NO: 168886 - DNA, 35 bp, Artificial Sequence
  Synthetic oligonucleotide
tatcaccgccacacgttccttccgggctatttgta

SEQ ID NO: 168887 - DNA, 36 bp, Artificial Sequence
  Synthetic oligonucleotide
gggacaacagtcgcgactgccttcgtttctccctta

SEQ ID NO: 168888 - DNA, 36 bp, Artificial Sequence
  Synthetic oligonucleotide
tagtcctcctcaccgctaatagctccctgtcgctta

SEQ ID NO: 168889 - DNA, 35 bp, Artificial Sequence
  Synthetic oligonucleotide
tcgctctcaccagccgaatgccgccgatcacacac

SEQ ID NO: 168890 - DNA, 35 bp, Artificial Sequence
  Synthetic oligonucleotide
tagccccgcctcgagtgacgccgctcttgtcccac

SEQ ID NO: 168891 - DNA, 35 bp, Artificial Sequence
  Synthetic oligonucleotide
cgcctcaaggtggtcggcccctagcacttttccac

SEQ ID NO: 168892 - DNA, 35 bp, Artificial Sequence
  Synthetic oligonucleotide
gtccacgccctactccatgccccgaaaatatgcac

SEQ ID NO: 168893 - DNA, 35 bp, Artificial Sequence
  Synthetic oligonucleotide
atccgaccacgctatcgctgttagtaccctttcac

SEQ ID NO: 168894 - DNA, 35 bp, Artificial Sequence
  Synthetic oligonucleotide
gtactgccttccattgataccttccgcatttcgac

SEQ ID NO: 168895 - DNA, 34 bp, Artificial Sequence
  Synthetic oligonucleotide
tggtccacccgcatgctactcccctctatgttac

SEQ ID NO: 168896 - DNA, 35 bp, Artificial Sequence
  Synthetic oligonucleotide
gctacttccccaggtacgtgcctgtcctcttttac

SEQ ID NO: 168897 - DNA, 35 bp, Artificial Sequence
  Synthetic oligonucleotide
tcgaaagttcgcgtccattcatcgccgccctcacc

SEQ ID NO: 168898 - DNA, 35 bp, Artificial Sequence
  Synthetic oligonucleotide
tcgcattgctctcccgttgttctttcttttcgacc

SEQ ID NO: 168899 - DNA, 35 bp, Artificial Sequence
  Synthetic oligonucleotide
ttcgaccacatcaatttatatgattcctgcatacc

SEQ ID NO: 168900 - DNA, 35 bp, Artificial Sequence
  Synthetic oligonucleotide
tcgcattgcccactcaaagttacggcctgctaccc

SEQ ID NO: 168901 - DNA, 34 bp, Artificial Sequence
  Synthetic oligonucleotide
acattccttgccttatgccgcggtcgccgacccc

SEQ ID NO: 168902 - DNA, 35 bp, Artificial Sequence
  Synthetic oligonucleotide
tgcgagccttgttcttccatccacggtgctagccc

SEQ ID NO: 168903 - DNA, 35 bp, Artificial Sequence
  Synthetic oligonucleotide
aaccatcaccctcggattaccctgggcccgcgccc

SEQ ID NO: 168904 - DNA, 35 bp, Artificial Sequence
  Synthetic oligonucleotide
agggcgccatcccagctgccccgggccatactccc

SEQ ID NO: 168905 - DNA, 35 bp, Artificial Sequence
  Synthetic oligonucleotide
actcccatgccctgtttggttcgtgagaacgtccc

SEQ ID NO: 168906 - DNA, 35 bp, Artificial Sequence
  Synthetic oligonucleotide
acgcactccctgtcttccgtttgagctctgaagcc

SEQ ID NO: 168907 - DNA, 35 bp, Artificial Sequence
  Synthetic oligonucleotide
agaccctgccccgtgcatcgttttatttttcagcc

SEQ ID NO: 168908 - DNA, 35 bp, Artificial Sequence
  Synthetic oligonucleotide
gcccttcgcgaagggtgcctgctttaccccatgcc

SEQ ID NO: 168909 - DNA, 35 bp, Artificial Sequence
  Synthetic oligonucleotide
ggtgactccacacgatcgcctcaagcttccttgcc

SEQ ID NO: 168910 - DNA, 35 bp, Artificial Sequence
  Synthetic oligonucleotide
tcatctgccccatctgtttagcctaaccttactcc

SEQ ID NO: 168911 - DNA, 35 bp, Artificial Sequence
  Synthetic oligonucleotide
gatgctgcctgccctcagacttatcaacggcctcc

SEQ ID NO: 168912 - DNA, 35 bp, Artificial Sequence
  Synthetic oligonucleotide
tgattgcaccgaacctgctcagttttgcttcctcc

SEQ ID NO: 168913 - DNA, 35 bp, Artificial Sequence
  Synthetic oligonucleotide
actgctgggcccgctgactactccgactatcgtcc

SEQ ID NO: 168914 - DNA, 35 bp, Artificial Sequence
  Synthetic oligonucleotide
gcacacccagttcacctgttttgacactccttagc

SEQ ID NO: 168915 - DNA, 35 bp, Artificial Sequence
  Synthetic oligonucleotide
attgacacctctcgaacgtctaacgcggaccccgc

SEQ ID NO: 168916 - DNA, 35 bp, Artificial Sequence
  Synthetic oligonucleotide
tctcagacgcatcctctccttgtccgcgcatccgc

SEQ ID NO: 168917 - DNA, 35 bp, Artificial Sequence
  Synthetic oligonucleotide
gccggctcccacagactcccttgcgttttacctgc

SEQ ID NO: 168918 - DNA, 35 bp, Artificial Sequence
  Synthetic oligonucleotide
attcgcgtacactggacgcaacttgatacaccatc

SEQ ID NO: 168919 - DNA, 35 bp, Artificial Sequence
  Synthetic oligonucleotide
acattcgtacgaagcaccatccattctgtgccatc

SEQ ID NO: 168920 - DNA, 35 bp, Artificial Sequence
  Synthetic oligonucleotide
cacaccacgggctgtctgtaattccggcgcctctc

SEQ ID NO: 168921 - DNA, 35 bp, Artificial Sequence
  Synthetic oligonucleotide
gaccgcagatttacaattcgtgctgtttttctctc

SEQ ID NO: 168922 - DNA, 35 bp, Artificial Sequence
  Synthetic oligonucleotide
agtcaccacgccttcgtactatctgggctcgattc

SEQ ID NO: 168923 - DNA, 35 bp, Artificial Sequence
  Synthetic oligonucleotide
gttacgtacgccctgccatatggactctgaccttc

SEQ ID NO: 168924 - DNA, 35 bp, Artificial Sequence
  Synthetic oligonucleotide
atctgagggcacggagggagggcgagcaatgagag

SEQ ID NO: 168925 - DNA, 36 bp, Artificial Sequence
  Synthetic oligonucleotide
gtgaactgcgcaaagggagggtgggtatatgggccg

SEQ ID NO: 168926 - DNA, 35 bp, Artificial Sequence
  Synthetic oligonucleotide
gttcccccccgtatgaccatgcatctctacatccg

SEQ ID NO: 168927 - DNA, 35 bp, Artificial Sequence
  Synthetic oligonucleotide
tctgcgccaccgcactcttattctactagactccg

SEQ ID NO: 168928 - DNA, 35 bp, Artificial Sequence
  Synthetic oligonucleotide
ccgttcccggcgcaacgagtcccaaccctactccg

SEQ ID NO: 168929 - DNA, 35 bp, Artificial Sequence
  Synthetic oligonucleotide
gctccactccccgagattgttcgcatccatttccg

SEQ ID NO: 168930 - DNA, 35 bp, Artificial Sequence
  Synthetic oligonucleotide
gatgaagacaaaagtaagagttcggagggggggcg

SEQ ID NO: 168931 - DNA, 35 bp, Artificial Sequence
  Synthetic oligonucleotide
tatgccctcgctttgacgcctcacttctacatgcg

SEQ ID NO: 168932 - DNA, 35 bp, Artificial Sequence
  Synthetic oligonucleotide
tagtcgggaggtcggtgggaagggtcgatatgtcg

SEQ ID NO: 168933 - DNA, 35 bp, Artificial Sequence
  Synthetic oligonucleotide
tgtgtttgccctcgccggtttaccgatttccttcg

SEQ ID NO: 168934 - DNA, 35 bp, Artificial Sequence
  Synthetic oligonucleotide
gtagcatacgacctcccttttccgttccctgttcg

SEQ ID NO: 168935 - DNA, 35 bp, Artificial Sequence
  Synthetic oligonucleotide
gcttggaggaaggagtgatgtgggggcatgggcgg

SEQ ID NO: 168936 - DNA, 35 bp, Artificial Sequence
  Synthetic oligonucleotide
gaggggcaagaagaatagactggagggagcatggg

SEQ ID NO: 168937 - DNA, 35 bp, Artificial Sequence
  Synthetic oligonucleotide
ggtcgccgtcgatcctcccgccgcctctcagcttg

SEQ ID NO: 168938 - DNA, 35 bp, Artificial Sequence
  Synthetic oligonucleotide
gaccgtcctgacttgccactccgcgacctcaacat

SEQ ID NO: 168939 - DNA, 35 bp, Artificial Sequence
  Synthetic oligonucleotide
tccgtgccccgccctttcgcacaccacgtgtacat

SEQ ID NO: 168940 - DNA, 35 bp, Artificial Sequence
  Synthetic oligonucleotide
tactacgccctcggaagtccgacctcggccaccat

SEQ ID NO: 168941 - DNA, 35 bp, Artificial Sequence
  Synthetic oligonucleotide
gactctcgccccctgttcacactaacctgctatat

SEQ ID NO: 168942 - DNA, 35 bp, Artificial Sequence
  Synthetic oligonucleotide
ggatgccccctcctgctaccctgtttggtatacct

SEQ ID NO: 168943 - DNA, 35 bp, Artificial Sequence
  Synthetic oligonucleotide
aagcgggcttcatcggtccgctaaccctgttccct

SEQ ID NO: 168944 - DNA, 35 bp, Artificial Sequence
  Synthetic oligonucleotide
tcccacccactgtcggacggccttctctgccgcct

SEQ ID NO: 168945 - DNA, 35 bp, Artificial Sequence
  Synthetic oligonucleotide
gtatcgtcgccctgttgtccgttcctggattgcct

SEQ ID NO: 168946 - DNA, 35 bp, Artificial Sequence
  Synthetic oligonucleotide
gctgtcctctggccccttatacggatgcaccatct

SEQ ID NO: 168947 - DNA, 35 bp, Artificial Sequence
  Synthetic oligonucleotide
gcgagattcaggctgtcgtgctactccctccctct

SEQ ID NO: 168948 - DNA, 35 bp, Artificial Sequence
  Synthetic oligonucleotide
tgcatccccccgttccatcgcatctagtacattct

SEQ ID NO: 168949 - DNA, 35 bp, Artificial Sequence
  Synthetic oligonucleotide
gtgggggaaaggaagtaggcaggatgggacgcagt

SEQ ID NO: 168950 - DNA, 35 bp, Artificial Sequence
  Synthetic oligonucleotide
actaactcgctggtcgtcgcccaccctccgctggt

SEQ ID NO: 168951 - DNA, 35 bp, Artificial Sequence
  Synthetic oligonucleotide
gtcaccccgatacgtcagagcacatccgtccctgt

SEQ ID NO: 168952 - DNA, 35 bp, Artificial Sequence
  Synthetic oligonucleotide
agtccacgccccatcactcccgttatatacggtgt

SEQ ID NO: 168953 - DNA, 34 bp, Artificial Sequence
  Synthetic oligonucleotide
atcatcactcgcccctgtcaaagacctttggtgt

SEQ ID NO: 168954 - DNA, 34 bp, Artificial Sequence
  Synthetic oligonucleotide
gcacgctgtacccttcatgtctgggtctctcctt

SEQ ID NO: 168955 - DNA, 35 bp, Artificial Sequence
  Synthetic oligonucleotide
acttgccactttccgcgatgcagtaccacactctt

SEQ ID NO: 168956 - DNA, 35 bp, Artificial Sequence
  Synthetic oligonucleotide
acacccccgcctcacctcacggcgtgaatacaaaa

SEQ ID NO: 168957 - DNA, 35 bp, Artificial Sequence
  Synthetic oligonucleotide
gagtgggcgagaggggggaattgtgtggtgtaaaa

SEQ ID NO: 168958 - DNA, 36 bp, Artificial Sequence
  Synthetic oligonucleotide
cccacacctcctcgcccctcggaagctgccttgaaa

SEQ ID NO: 168959 - DNA, 36 bp, Artificial Sequence
  Synthetic oligonucleotide
tcgtgattccttccgtgcgtggccactcttatccaa

SEQ ID NO: 168960 - DNA, 36 bp, Artificial Sequence
  Synthetic oligonucleotide
gacactcccactatactgccgccttcctacaggaca

SEQ ID NO: 168961 - DNA, 32 bp, Artificial Sequence
  Synthetic oligonucleotide
ttccaacgcccattgctaaccttcccccacca

SEQ ID NO: 168962 - DNA, 36 bp, Artificial Sequence
  Synthetic oligonucleotide
gcatctgtctcatgtctgtctacgtctacctcccca

SEQ ID NO: 168963 - DNA, 36 bp, Artificial Sequence
  Synthetic oligonucleotide
gtccctcacatcacatctttcgacattgctcgccca

SEQ ID NO: 168964 - DNA, 35 bp, Artificial Sequence
  Synthetic oligonucleotide
gaggacatctcctgccctgtccataaaacgttcca

SEQ ID NO: 168965 - DNA, 36 bp, Artificial Sequence
  Synthetic oligonucleotide
gcctgctcgccctctatttgacctatgatcccagca

SEQ ID NO: 168966 - DNA, 36 bp, Artificial Sequence
  Synthetic oligonucleotide
ggatcgtcgtgtcctgcccccctgcccgatccagca

SEQ ID NO: 168967 - DNA, 36 bp, Artificial Sequence
  Synthetic oligonucleotide
acctcgcaccatcgtctcaactcgcccgtcaaatca

SEQ ID NO: 168968 - DNA, 36 bp, Artificial Sequence
  Synthetic oligonucleotide
gtttccccgatccatcatgtttttagtgttgcctca

SEQ ID NO: 168969 - DNA, 35 bp, Artificial Sequence
  Synthetic oligonucleotide
tgcccgggttccggccgttcgccttcctctgctca

SEQ ID NO: 168970 - DNA, 35 bp, Artificial Sequence
  Synthetic oligonucleotide
gccagacatcaacccattgcgcctcaactgtctca

SEQ ID NO: 168971 - DNA, 36 bp, Artificial Sequence
  Synthetic oligonucleotide
gcaaccctactcatggtttttgccttttgctcttca

SEQ ID NO: 168972 - DNA, 35 bp, Artificial Sequence
  Synthetic oligonucleotide
gttgcgtacagtctccccctctctgtcgaagttca

SEQ ID NO: 168973 - DNA, 34 bp, Artificial Sequence
  Synthetic oligonucleotide
gtttgggtggggttgggggtgaggggaatgtaga

SEQ ID NO: 168974 - DNA, 37 bp, Artificial Sequence
  Synthetic oligonucleotide
tcacgcgtcaccatctccgctctcactgtcttgacga

SEQ ID NO: 168975 - DNA, 37 bp, Artificial Sequence
  Synthetic oligonucleotide
agtcctcacgccattccgttacaaccgatacctccga

SEQ ID NO: 168976 - DNA, 37 bp, Artificial Sequence
  Synthetic oligonucleotide
ggtcgctacacccgtatggttaccctgattcttccga

SEQ ID NO: 168977 - DNA, 34 bp, Artificial Sequence
  Synthetic oligonucleotide
gaccccactgccactaatgacgatgctatcgcga

SEQ ID NO: 168978 - DNA, 37 bp, Artificial Sequence
  Synthetic oligonucleotide
ggactatgccgaagggtggtgtgcgagggagggcgga

SEQ ID NO: 168979 - DNA, 37 bp, Artificial Sequence
  Synthetic oligonucleotide
accacatgggtgggtttgaatgcgggaaagggcggga

SEQ ID NO: 168980 - DNA, 35 bp, Artificial Sequence
  Synthetic oligonucleotide
ataccacctcgctctactgccatgcccaatgggga

SEQ ID NO: 168981 - DNA, 36 bp, Artificial Sequence
  Synthetic oligonucleotide
tcagagctcgtagtagctctccacacacaccctgga

SEQ ID NO: 168982 - DNA, 37 bp, Artificial Sequence
  Synthetic oligonucleotide
acagacgtagtattgccctgtttcgttccctccatga

SEQ ID NO: 168983 - DNA, 37 bp, Artificial Sequence
  Synthetic oligonucleotide
aggataacgcaggagagagggggtggtgcgggtatga

SEQ ID NO: 168984 - DNA, 38 bp, Artificial Sequence
  Synthetic oligonucleotide
tattcgtgcgtccatcgtccctcgccccatttcactga

SEQ ID NO: 168985 - DNA, 38 bp, Artificial Sequence
  Synthetic oligonucleotide
gagccacttccgcctgttcttactgctccttcacctga

SEQ ID NO: 168986 - DNA, 37 bp, Artificial Sequence
  Synthetic oligonucleotide
tatgtgaacgccgtgcccgcgccctcccggaccctga

SEQ ID NO: 168987 - DNA, 37 bp, Artificial Sequence
  Synthetic oligonucleotide
tgtgcttacgttcaccctgtgccatcatcgcccctga

SEQ ID NO: 168988 - DNA, 38 bp, Artificial Sequence
  Synthetic oligonucleotide
gacgcctcatcgtctcctgctcaacgaaccactcctga

SEQ ID NO: 168989 - DNA, 35 bp, Artificial Sequence
  Synthetic oligonucleotide
accccctttaactgtgcctcccccagccatgctga

SEQ ID NO: 168990 - DNA, 38 bp, Artificial Sequence
  Synthetic oligonucleotide
tagaccacgccgcagcctccttccctgtgcattgctga

SEQ ID NO: 168991 - DNA, 38 bp, Artificial Sequence
  Synthetic oligonucleotide
ggatgagagtgcaggagagagtggtggggcgggtctga

SEQ ID NO: 168992 - DNA, 38 bp, Artificial Sequence
  Synthetic oligonucleotide
gccccccggtcattggtctctccctccgtccgacttga

SEQ ID NO: 168993 - DNA, 37 bp, Artificial Sequence
  Synthetic oligonucleotide
ttcccaccccattgtgagttcaccttccgccccttga

SEQ ID NO: 168994 - DNA, 37 bp, Artificial Sequence
  Synthetic oligonucleotide
tccgcccctgccactccaaagggtctccgtcccttga

SEQ ID NO: 168995 - DNA, 38 bp, Artificial Sequence
  Synthetic oligonucleotide
actccccgccacccccgccgtgctgcataaactcttga

SEQ ID NO: 168996 - DNA, 37 bp, Artificial Sequence
  Synthetic oligonucleotide
ggactgccttccaggtcttcgaacgcgccccctttga

SEQ ID NO: 168997 - DNA, 35 bp, Artificial Sequence
  Synthetic oligonucleotide
gacgtgtgggggggaggaactggacgtcaagaata

SEQ ID NO: 168998 - DNA, 36 bp, Artificial Sequence
  Synthetic oligonucleotide
acacccgcccttgctttctaatgtatcgttttgata

SEQ ID NO: 168999 - DNA, 36 bp, Artificial Sequence
  Synthetic oligonucleotide
ggacggaagcttctcgcccctctgcccccgtcacta

SEQ ID NO: 169000 - DNA, 36 bp, Artificial Sequence
  Synthetic oligonucleotide
accatcgccacatatggcaagcgtgcttcttcccta

SEQ ID NO: 169001 - DNA, 36 bp, Artificial Sequence
  Synthetic oligonucleotide
tgggcgggcggggcagggacatttcagccaccgcta

SEQ ID NO: 169002 - DNA, 36 bp, Artificial Sequence
  Synthetic oligonucleotide
gactctcgcccaccgcgtcatctagccgtcccgcta

SEQ ID NO: 169003 - DNA, 36 bp, Artificial Sequence
  Synthetic oligonucleotide
acgcatgccgattgctacatccctcgctcctcgcta

SEQ ID NO: 169004 - DNA, 36 bp, Artificial Sequence
  Synthetic oligonucleotide
tagtcccccatcaaccgctggctctgaccccatgta

SEQ ID NO: 169005 - DNA, 36 bp, Artificial Sequence
  Synthetic oligonucleotide
tactgcccgccttctctggttaagtcgcttcctgta

SEQ ID NO: 169006 - DNA, 34 bp, Artificial Sequence
  Synthetic oligonucleotide
ataccccgtggtcttggtctgttctcttcctgta

SEQ ID NO: 169007 - DNA, 35 bp, Artificial Sequence
  Synthetic oligonucleotide
attgacctcctgctgaccgttttgactactttgta

SEQ ID NO: 169008 - DNA, 35 bp, Artificial Sequence
  Synthetic oligonucleotide
gcgaggaaaggaaagatggggtcgaaggggagtta

SEQ ID NO: 169009 - DNA, 34 bp, Artificial Sequence
  Synthetic oligonucleotide
accgcatccttcgtggccatgcgtttcaccccac

SEQ ID NO: 169010 - DNA, 35 bp, Artificial Sequence
  Synthetic oligonucleotide
aatgctcgctcttcgttcatactctgccggcccac

SEQ ID NO: 169011 - DNA, 35 bp, Artificial Sequence
  Synthetic oligonucleotide
tcttcgccctgtcattattgttcccatttggccac

SEQ ID NO: 169012 - DNA, 35 bp, Artificial Sequence
  Synthetic oligonucleotide
tgccacagcccctcaccctcagcgatgcctctgac

SEQ ID NO: 169013 - DNA, 35 bp, Artificial Sequence
  Synthetic oligonucleotide
actacccaccgctaccgtcccctttcattaggtac

SEQ ID NO: 169014 - DNA, 35 bp, Artificial Sequence
  Synthetic oligonucleotide
gccccgtgtgctgccccttctcaataagcgtcacc

SEQ ID NO: 169015 - DNA, 35 bp, Artificial Sequence
  Synthetic oligonucleotide
tcacccacgcccctcgacgctgccccgggcaaccc

SEQ ID NO: 169016 - DNA, 35 bp, Artificial Sequence
  Synthetic oligonucleotide
gacactgtaagtttactcgcccctgacgtactccc

SEQ ID NO: 169017 - DNA, 35 bp, Artificial Sequence
  Synthetic oligonucleotide
gcgctcgcctgcctatcgtagcatccaccgctccc

SEQ ID NO: 169018 - DNA, 35 bp, Artificial Sequence
  Synthetic oligonucleotide
acacgacaaatccgcacgccccgtcccattttccc

SEQ ID NO: 169019 - DNA, 35 bp, Artificial Sequence
  Synthetic oligonucleotide
ggggatccaccctctcattgcatgaggcctttgcc

SEQ ID NO: 169020 - DNA, 35 bp, Artificial Sequence
  Synthetic oligonucleotide
gcatcctgcgctacactgagccctcgtattattcc

SEQ ID NO: 169021 - DNA, 35 bp, Artificial Sequence
  Synthetic oligonucleotide
tcctatcacccttcccatgccgctccataactagc

SEQ ID NO: 169022 - DNA, 35 bp, Artificial Sequence
  Synthetic oligonucleotide
gtggccacggtcgtgttctgtcctctgtccatcgc

SEQ ID NO: 169023 - DNA, 35 bp, Artificial Sequence
  Synthetic oligonucleotide
gtcgccacccttgaatccgcttcacacttaccggc

SEQ ID NO: 169024 - DNA, 35 bp, Artificial Sequence
  Synthetic oligonucleotide
acgaccctcctcctgactccctcaccttttgatgc

SEQ ID NO: 169025 - DNA, 35 bp, Artificial Sequence
  Synthetic oligonucleotide
tcccacgcctgtattattatgtctatctacgcatc

SEQ ID NO: 169026 - DNA, 35 bp, Artificial Sequence
  Synthetic oligonucleotide
acgaacccgacccaccgatccattgacgttgactc

SEQ ID NO: 169027 - DNA, 35 bp, Artificial Sequence
  Synthetic oligonucleotide
tcgctattgctgccactgtaccggtcgcttacctc

SEQ ID NO: 169028 - DNA, 35 bp, Artificial Sequence
  Synthetic oligonucleotide
tcctgccttgctctccatcggaccatctgcgcctc

SEQ ID NO: 169029 - DNA, 35 bp, Artificial Sequence
  Synthetic oligonucleotide
tcgctcacccgcccgctgagctggcaaccttcctc

SEQ ID NO: 169030 - DNA, 35 bp, Artificial Sequence
  Synthetic oligonucleotide
aacgtcattcctcgatcccgcgtgtctacactctc

SEQ ID NO: 169031 - DNA, 35 bp, Artificial Sequence
  Synthetic oligonucleotide
gacgcgcggcctctggtcccggaccccgccctgtc

SEQ ID NO: 169032 - DNA, 35 bp, Artificial Sequence
  Synthetic oligonucleotide
acctcgagcgagctaccgttcctcctgcattcttc

SEQ ID NO: 169033 - DNA, 35 bp, Artificial Sequence
  Synthetic oligonucleotide
gttccagcggttgacccacctttgcgctgctgttc

SEQ ID NO: 169034 - DNA, 35 bp, Artificial Sequence
  Synthetic oligonucleotide
agtggatcagcctcctttccccctgtctgcctttc

SEQ ID NO: 169035 - DNA, 35 bp, Artificial Sequence
  Synthetic oligonucleotide
tccacctgccctctatgctccttgaacgaccacag

SEQ ID NO: 169036 - DNA, 35 bp, Artificial Sequence
  Synthetic oligonucleotide
aactggagcagggaagggaaagggtctgaagtacg

SEQ ID NO: 169037 - DNA, 35 bp, Artificial Sequence
  Synthetic oligonucleotide
gggggaggggggaggtggtttagtgtctaattacg

SEQ ID NO: 169038 - DNA, 35 bp, Artificial Sequence
  Synthetic oligonucleotide
gggtggcgggggggttttgcggatggaacatcgcg

SEQ ID NO: 169039 - DNA, 35 bp, Artificial Sequence
  Synthetic oligonucleotide
acagtcggggaggagaaggggcatcgtgctgggcg

SEQ ID NO: 169040 - DNA, 35 bp, Artificial Sequence
  Synthetic oligonucleotide
agccacttccgctttttgttccaccgtatgattcg

SEQ ID NO: 169041 - DNA, 35 bp, Artificial Sequence
  Synthetic oligonucleotide
gcgaggcgggaagggtggggatagggtttataggg

SEQ ID NO: 169042 - DNA, 35 bp, Artificial Sequence
  Synthetic oligonucleotide
gagaatgatcgagggtggtggactgtggagtaggg

SEQ ID NO: 169043 - DNA, 35 bp, Artificial Sequence
  Synthetic oligonucleotide
aacaatcgatgcgggggggcgggagattctacggg

SEQ ID NO: 169044 - DNA, 36 bp, Artificial Sequence
  Synthetic oligonucleotide
ttcggaacgcacggacttcacctgcacttatacctg

SEQ ID NO: 169045 - DNA, 35 bp, Artificial Sequence
  Synthetic oligonucleotide
gtcaccttctcattctacagtccctggctctcgtg

SEQ ID NO: 169046 - DNA, 35 bp, Artificial Sequence
  Synthetic oligonucleotide
tccaggggccagttatcagggcgggagggagtaat

SEQ ID NO: 169047 - DNA, 35 bp, Artificial Sequence
  Synthetic oligonucleotide
acgatagcccccatattgcgagtgccgcccaccat

SEQ ID NO: 169048 - DNA, 35 bp, Artificial Sequence
  Synthetic oligonucleotide
tcaacactcgcctcgaaccaccctctacaacggat

SEQ ID NO: 169049 - DNA, 35 bp, Artificial Sequence
  Synthetic oligonucleotide
accctccgccattgccactcaggattgctcgctat

SEQ ID NO: 169050 - DNA, 35 bp, Artificial Sequence
  Synthetic oligonucleotide
tccccccgaaggttgtccgttctccgatccgacct

SEQ ID NO: 169051 - DNA, 35 bp, Artificial Sequence
  Synthetic oligonucleotide
gcaatgtcatcagttccgttcatcgctccatgcct

SEQ ID NO: 169052 - DNA, 35 bp, Artificial Sequence
  Synthetic oligonucleotide
aaacccccaccgttgccctttgtttgcgacccgct

SEQ ID NO: 169053 - DNA, 35 bp, Artificial Sequence
  Synthetic oligonucleotide
ccgtcgcaatccctgtctctttgagttcctttgct

SEQ ID NO: 169054 - DNA, 35 bp, Artificial Sequence
  Synthetic oligonucleotide
atttgggcgggtggggaggagggcactcgaaaagt

SEQ ID NO: 169055 - DNA, 35 bp, Artificial Sequence
  Synthetic oligonucleotide
tcaatgcctccccaggttggaatgtcaccctccgt

SEQ ID NO: 169056 - DNA, 35 bp, Artificial Sequence
  Synthetic oligonucleotide
gcaccatctcggctcttcttgaaactttgcgctgt

SEQ ID NO: 169057 - DNA, 35 bp, Artificial Sequence
  Synthetic oligonucleotide
tgtctcccgaccctgtctcaagtgcccccagtatt

SEQ ID NO: 169058 - DNA, 35 bp, Artificial Sequence
  Synthetic oligonucleotide
tcgacccgacaggtaagtcactctgctgtcccctt

SEQ ID NO: 169059 - DNA, 35 bp, Artificial Sequence
  Synthetic oligonucleotide
gtggctcgcggtccagtatactcccctcctccctt

SEQ ID NO: 169060 - DNA, 35 bp, Artificial Sequence
  Synthetic oligonucleotide
atggttccggttcaggtgcacccgtcctgtccctt

SEQ ID NO: 169061 - DNA, 35 bp, Artificial Sequence
  Synthetic oligonucleotide
atcgtgatagtccgtcgagccgtgccccccgcctt

SEQ ID NO: 169062 - DNA, 35 bp, Artificial Sequence
  Synthetic oligonucleotide
gcgcttctaccgtccgccgtcactttcctcccgtt

SEQ ID NO: 169063 - DNA, 35 bp, Artificial Sequence
  Synthetic oligonucleotide
gcaccccctccgcggtcagtaacacttccccggtt

SEQ ID NO: 169064 - DNA, 35 bp, Artificial Sequence
  Synthetic oligonucleotide
gacgcccccccgttatggtatctgtcccccttgtt

SEQ ID NO: 169065 - DNA, 35 bp, Artificial Sequence
  Synthetic oligonucleotide
tcctcccgccgccatagggatgcaaccatctccaa

SEQ ID NO: 169066 - DNA, 35 bp, Artificial Sequence
  Synthetic oligonucleotide
tgcaacccggctcacgcacttccctatcggtccaa

SEQ ID NO: 169067 - DNA, 36 bp, Artificial Sequence
  Synthetic oligonucleotide
aagcaagggccgcggggaagggaggggggttccgaa

SEQ ID NO: 169068 - DNA, 36 bp, Artificial Sequence
  Synthetic oligonucleotide
agttggggggggtaggggtcaatcaaagggtaaaca

SEQ ID NO: 169069 - DNA, 36 bp, Artificial Sequence
  Synthetic oligonucleotide
gcctgattccgccacctggtacgttgggccattaca

SEQ ID NO: 169070 - DNA, 36 bp, Artificial Sequence
  Synthetic oligonucleotide
gagacccactcacatatgatattcaccgggccacca

SEQ ID NO: 169071 - DNA, 36 bp, Artificial Sequence
  Synthetic oligonucleotide
tgtgtacccgctgcgtatcgcctgtccgcctgacca

SEQ ID NO: 169072 - DNA, 36 bp, Artificial Sequence
  Synthetic oligonucleotide
gcttaagctcagtatcgtccctccgcgcttacccca

SEQ ID NO: 169073 - DNA, 35 bp, Artificial Sequence
  Synthetic oligonucleotide
ggactccactccgctcgttcatggggccatcccca

SEQ ID NO: 169074 - DNA, 35 bp, Artificial Sequence
  Synthetic oligonucleotide
gttcagcccctggtaacaacctccttcgttcgcca

SEQ ID NO: 169075 - DNA, 35 bp, Artificial Sequence
  Synthetic oligonucleotide
ttacccctccgcctgccacatacaagtcagatcca

SEQ ID NO: 169076 - DNA, 33 bp, Artificial Sequence
  Synthetic oligonucleotide
cgcattgcgcggacttgtctgcatccccctcca

SEQ ID NO: 169077 - DNA, 36 bp, Artificial Sequence
  Synthetic oligonucleotide
gagcgagaagcgaagggcggcggagtaggagaagca

SEQ ID NO: 169078 - DNA, 35 bp, Artificial Sequence
  Synthetic oligonucleotide
gatgccatcaccgccaggactcattcatcctctca

SEQ ID NO: 169079 - DNA, 36 bp, Artificial Sequence
  Synthetic oligonucleotide
atcccccccccctgctccaccagtgacatgctgtca

SEQ ID NO: 169080 - DNA, 35 bp, Artificial Sequence
  Synthetic oligonucleotide
tgcctacctcctagcgtttcgtccatccaacttca

SEQ ID NO: 169081 - DNA, 35 bp, Artificial Sequence
  Synthetic oligonucleotide
tcgcacttccatcccgtctatccttctcctgttca

SEQ ID NO: 169082 - DNA, 36 bp, Artificial Sequence
  Synthetic oligonucleotide
ggtctccccccccaccgtaccgctccatgtatttca

SEQ ID NO: 169083 - DNA, 36 bp, Artificial Sequence
  Synthetic oligonucleotide
tctcccctcacacattgttttggccaatccacgaga

SEQ ID NO: 169084 - DNA, 37 bp, Artificial Sequence
  Synthetic oligonucleotide
gaccggggagacgggtaacggggaaagtaacgcgaga

SEQ ID NO: 169085 - DNA, 37 bp, Artificial Sequence
  Synthetic oligonucleotide
gacacccctttctgacgtctaccatccacccgcgaga

SEQ ID NO: 169086 - DNA, 37 bp, Artificial Sequence
  Synthetic oligonucleotide
tcacgtcgctgttcaaagtccccccggccccacacga

SEQ ID NO: 169087 - DNA, 37 bp, Artificial Sequence
  Synthetic oligonucleotide
gagtgaagagggtgaaggtagggataactaaggacga

SEQ ID NO: 169088 - DNA, 37 bp, Artificial Sequence
  Synthetic oligonucleotide
tgagccgaccctgccgtttagtccctccgccctacga

SEQ ID NO: 169089 - DNA, 37 bp, Artificial Sequence
  Synthetic oligonucleotide
tgtcctcctcgccatgcaagccacattacaccgccga

SEQ ID NO: 169090 - DNA, 36 bp, Artificial Sequence
  Synthetic oligonucleotide
tcacctccccccttgtgcccagcaattcgtcgccga

SEQ ID NO: 169091 - DNA, 37 bp, Artificial Sequence
  Synthetic oligonucleotide
tcatcctcacggctgtttacatacccgcctgttccga

SEQ ID NO: 169092 - DNA, 37 bp, Artificial Sequence
  Synthetic oligonucleotide
gacgagggtgggtgggtgcggtttacattgcgcagga

SEQ ID NO: 169093 - DNA, 37 bp, Artificial Sequence
  Synthetic oligonucleotide
agtgatggaggggcgacttggggacaacggggacgga

SEQ ID NO: 169094 - DNA, 37 bp, Artificial Sequence
  Synthetic oligonucleotide
tgacactggggtgggttctagtccaattgggagggga

SEQ ID NO: 169095 - DNA, 37 bp, Artificial Sequence
  Synthetic oligonucleotide
aggtggggggagggaaggagggagtatctctcgggga

SEQ ID NO: 169096 - DNA, 37 bp, Artificial Sequence
  Synthetic oligonucleotide
gggggcaatacgtggggaatatgatcccgggtgggga

SEQ ID NO: 169097 - DNA, 36 bp, Artificial Sequence
  Synthetic oligonucleotide
gtttggggagggatggaagtgcgggggttcatggga

SEQ ID NO: 169098 - DNA, 36 bp, Artificial Sequence
  Synthetic oligonucleotide
agccggggtcgacaggagtggtggtagggggatgga

SEQ ID NO: 169099 - DNA, 38 bp, Artificial Sequence
  Synthetic oligonucleotide
ggtgtgcacagcggagggaaagggatggaccgggatga

SEQ ID NO: 169100 - DNA, 38 bp, Artificial Sequence
  Synthetic oligonucleotide
gatggggaggcgggggaggttggggaaaatcacactga

SEQ ID NO: 169101 - DNA, 36 bp, Artificial Sequence
  Synthetic oligonucleotide
agacacttcgccgtcccttcgccccacatccactga

SEQ ID NO: 169102 - DNA, 38 bp, Artificial Sequence
  Synthetic oligonucleotide
tcgccggtacagttgaacctcctccccgtgcctgctga

SEQ ID NO: 169103 - DNA, 38 bp, Artificial Sequence
  Synthetic oligonucleotide
tcaatgcgcaggggggaaggaggggcacctgcgtctga

SEQ ID NO: 169104 - DNA, 37 bp, Artificial Sequence
  Synthetic oligonucleotide
tgcaccacagcatgcttacctccgtccgttcgtctga

SEQ ID NO: 169105 - DNA, 38 bp, Artificial Sequence
  Synthetic oligonucleotide
gacgaggggaggggtgcatggagagaggctggcagtga

SEQ ID NO: 169106 - DNA, 38 bp, Artificial Sequence
  Synthetic oligonucleotide
ggtggggtggagaagggatcgctgggagaatagggtga

SEQ ID NO: 169107 - DNA, 37 bp, Artificial Sequence
  Synthetic oligonucleotide
gcgagggaggtggggaaaagggtttttaaacgggtga

SEQ ID NO: 169108 - DNA, 37 bp, Artificial Sequence
  Synthetic oligonucleotide
acaccacctccctgattggctgccatacaatacttga

SEQ ID NO: 169109 - DNA, 36 bp, Artificial Sequence
  Synthetic oligonucleotide
ggccaaccccacccctgtacctgcagcaccgcttga

SEQ ID NO: 169110 - DNA, 38 bp, Artificial Sequence
  Synthetic oligonucleotide
ggtgcgctagacgccacgctccctctgttccccgttga

SEQ ID NO: 169111 - DNA, 35 bp, Artificial Sequence
  Synthetic oligonucleotide
gcatccccggttcgggtatccttcttgccacacta

SEQ ID NO: 169112 - DNA, 36 bp, Artificial Sequence
  Synthetic oligonucleotide
tcgctcgccaatactcgccggttgcccccgctccta

SEQ ID NO: 169113 - DNA, 36 bp, Artificial Sequence
  Synthetic oligonucleotide
atgttccgccccacaagtcgtttttcgtcatatcta

SEQ ID NO: 169114 - DNA, 35 bp, Artificial Sequence
  Synthetic oligonucleotide
atagggataggggtacgggagaagggagctaagta

SEQ ID NO: 169115 - DNA, 36 bp, Artificial Sequence
  Synthetic oligonucleotide
ggggagatagggtgatgacgggtgaaggagcgcgta

SEQ ID NO: 169116 - DNA, 36 bp, Artificial Sequence
  Synthetic oligonucleotide
gtactgctccctcccgcatatgctcctcggtgccac

SEQ ID NO: 169117 - DNA, 35 bp, Artificial Sequence
  Synthetic oligonucleotide
atgaccccgtgccgggatacgttccaattcccgac

SEQ ID NO: 169118 - DNA, 35 bp, Artificial Sequence
  Synthetic oligonucleotide
tcacctgtccccatatgtttttcatgtttggttac

SEQ ID NO: 169119 - DNA, 35 bp, Artificial Sequence
  Synthetic oligonucleotide
tgaccctgtcttcacttgcactgaaccgtcccccc

SEQ ID NO: 169120 - DNA, 35 bp, Artificial Sequence
  Synthetic oligonucleotide
ttagcatgactacgtgttcccccctcggcctatcc

SEQ ID NO: 169121 - DNA, 35 bp, Artificial Sequence
  Synthetic oligonucleotide
aatgacattgctgcagctgaacgcactccccgtcc

SEQ ID NO: 169122 - DNA, 35 bp, Artificial Sequence
  Synthetic oligonucleotide
tttacattccgcacgctgttccatgctcacggtcc

SEQ ID NO: 169123 - DNA, 35 bp, Artificial Sequence
  Synthetic oligonucleotide
gaccggccgttctgcctacccttcccagatcttcc

SEQ ID NO: 169124 - DNA, 35 bp, Artificial Sequence
  Synthetic oligonucleotide
attaccgcagaagcagtgcgaaccctccgtcttcc

SEQ ID NO: 169125 - DNA, 35 bp, Artificial Sequence
  Synthetic oligonucleotide
gcctcctgcacaattacgcccggtacttttgttcc

SEQ ID NO: 169126 - DNA, 35 bp, Artificial Sequence
  Synthetic oligonucleotide
aactgtgcgtccttctccgctggtcaccatcccgc

SEQ ID NO: 169127 - DNA, 35 bp, Artificial Sequence
  Synthetic oligonucleotide
acaatccgtttcgcgcacattatgcacacctccgc

SEQ ID NO: 169128 - DNA, 35 bp, Artificial Sequence
  Synthetic oligonucleotide
acaacaacactaccgatcctacgccgcatctccgc

SEQ ID NO: 169129 - DNA, 35 bp, Artificial Sequence
  Synthetic oligonucleotide
ttgtgttccacccagttgctttgtccttacttcgc

SEQ ID NO: 169130 - DNA, 35 bp, Artificial Sequence
  Synthetic oligonucleotide
gatcgagctccgtgcgtctggtcccgtcgcccctc

SEQ ID NO: 169131 - DNA, 35 bp, Artificial Sequence
  Synthetic oligonucleotide
atccccaatcggaatgtacccagccgatcctcctc

SEQ ID NO: 169132 - DNA, 35 bp, Artificial Sequence
  Synthetic oligonucleotide
aacctgcacgctttgcctttttcctcactgtgctc

SEQ ID NO: 169133 - DNA, 35 bp, Artificial Sequence
  Synthetic oligonucleotide
tagccgtccgctccttcgccgttgtcttagtattc

SEQ ID NO: 169134 - DNA, 35 bp, Artificial Sequence
  Synthetic oligonucleotide
accaccatcccgtgattacccgcaaccaggccttc

SEQ ID NO: 169135 - DNA, 35 bp, Artificial Sequence
  Synthetic oligonucleotide
agcccctcgagctgctttcggtcccaactttcttc

SEQ ID NO: 169136 - DNA, 35 bp, Artificial Sequence
  Synthetic oligonucleotide
ttgcccccagtgcgcggtcgccatccctatcgttc

SEQ ID NO: 169137 - DNA, 35 bp, Artificial Sequence
  Synthetic oligonucleotide
ttcgcgctccttacctattccatcgccagggtttc

SEQ ID NO: 169138 - DNA, 35 bp, Artificial Sequence
  Synthetic oligonucleotide
tccccacccctgatgctttccgccaacgccttacg

SEQ ID NO: 169139 - DNA, 35 bp, Artificial Sequence
  Synthetic oligonucleotide
ttccgtgcagttatcattgccgcctgatccccccg

SEQ ID NO: 169140 - DNA, 35 bp, Artificial Sequence
  Synthetic oligonucleotide
atcgcggagggactatggggagggagctgttttcg

SEQ ID NO: 169141 - DNA, 35 bp, Artificial Sequence
  Synthetic oligonucleotide
gatatgaacagcatgtgggtggaatggggtggagg

SEQ ID NO: 169142 - DNA, 35 bp, Artificial Sequence
  Synthetic oligonucleotide
ttcgcatggttggtgtgggggggcgtggaggcggg

SEQ ID NO: 169143 - DNA, 35 bp, Artificial Sequence
  Synthetic oligonucleotide
tatcggtgtgtgctgggagggcatggggtgggtgg

SEQ ID NO: 169144 - DNA, 35 bp, Artificial Sequence
  Synthetic oligonucleotide
agtgtgcatccatctcccctgttcttctaactgtg

SEQ ID NO: 169145 - DNA, 35 bp, Artificial Sequence
  Synthetic oligonucleotide
gtcacctcgccgtatcgcctcctgaattccgtttg

SEQ ID NO: 169146 - DNA, 35 bp, Artificial Sequence
  Synthetic oligonucleotide
tccacccccaataagcacaccatcgacgaatgcat

SEQ ID NO: 169147 - DNA, 35 bp, Artificial Sequence
  Synthetic oligonucleotide
ttcagccccattgttttgtgtatatcccgccctat

SEQ ID NO: 169148 - DNA, 35 bp, Artificial Sequence
  Synthetic oligonucleotide
acagccgtcgctcctctatgctcctcctcggaact

SEQ ID NO: 169149 - DNA, 35 bp, Artificial Sequence
  Synthetic oligonucleotide
gaagcgatcgcctttagcctttcgagcctgcacct

SEQ ID NO: 169150 - DNA, 35 bp, Artificial Sequence
  Synthetic oligonucleotide
tcacattcccccacgttgtgcctccgagcctccct

SEQ ID NO: 169151 - DNA, 35 bp, Artificial Sequence
  Synthetic oligonucleotide
acgcgaccatcctgcttttctgagtcctcccgcct

SEQ ID NO: 169152 - DNA, 35 bp, Artificial Sequence
  Synthetic oligonucleotide
ttcgaagggcgttcagaccttttcttctctccgct

SEQ ID NO: 169153 - DNA, 35 bp, Artificial Sequence
  Synthetic oligonucleotide
actacccgccattgaccattctctgcctcgcacgt

SEQ ID NO: 169154 - DNA, 35 bp, Artificial Sequence
  Synthetic oligonucleotide
tgccacccactccacacgacacggggacacctcgt

SEQ ID NO: 169155 - DNA, 35 bp, Artificial Sequence
  Synthetic oligonucleotide
gcacactcaatgcagataccttccctactaccggt

SEQ ID NO: 169156 - DNA, 36 bp, Artificial Sequence
  Synthetic oligonucleotide
tagaccaccgaagcatccttagtttcccgcctctgt

SEQ ID NO: 169157 - DNA, 35 bp, Artificial Sequence
  Synthetic oligonucleotide
gtcaacgcctcacctctagtctcccgtaccggtgt

SEQ ID NO: 169158 - DNA, 35 bp, Artificial Sequence
  Synthetic oligonucleotide
ttgacgctccatcctcatggttccacccgaccatt

SEQ ID NO: 169159 - DNA, 35 bp, Artificial Sequence
  Synthetic oligonucleotide
atccacccactcgttctgtcagaattggaactatt

SEQ ID NO: 169160 - DNA, 35 bp, Artificial Sequence
  Synthetic oligonucleotide
gtccactccatcgccataatttaggtgccattatt

SEQ ID NO: 169161 - DNA, 35 bp, Artificial Sequence
  Synthetic oligonucleotide
acgccccctggcttccattgaagtcttctgccctt

SEQ ID NO: 169162 - DNA, 35 bp, Artificial Sequence
  Synthetic oligonucleotide
tcttggtcacgtagtcgtccctgccccttttcctt

SEQ ID NO: 169163 - DNA, 36 bp, Artificial Sequence
  Synthetic oligonucleotide
gccctggtcctgttgccgtcttacaccccttccaaa

SEQ ID NO: 169164 - DNA, 36 bp, Artificial Sequence
  Synthetic oligonucleotide
gacgataaccgggagaaggaattgggatgggagaaa

SEQ ID NO: 169165 - DNA, 35 bp, Artificial Sequence
  Synthetic oligonucleotide
actcacccacgccgcttttatttgacctaacgcaa

SEQ ID NO: 169166 - DNA, 35 bp, Artificial Sequence
  Synthetic oligonucleotide
tttgcgccctgttcgcccgttcctctattgctcaa

SEQ ID NO: 169167 - DNA, 36 bp, Artificial Sequence
  Synthetic oligonucleotide
tccgcccggcccagttttccgccttgctcttttcaa

SEQ ID NO: 169168 - DNA, 35 bp, Artificial Sequence
  Synthetic oligonucleotide
agggcaactgccaccgttccctcttgtgccactaa

SEQ ID NO: 169169 - DNA, 36 bp, Artificial Sequence
  Synthetic oligonucleotide
gaatggggcgggtgggaacacgggggacacctctaa

SEQ ID NO: 169170 - DNA, 36 bp, Artificial Sequence
  Synthetic oligonucleotide
gtgatccctgcctccccgcctaagaagcccttgtaa

SEQ ID NO: 169171 - DNA, 36 bp, Artificial Sequence
  Synthetic oligonucleotide
gggatcggtaggggggaagggggggatccgagttaa

SEQ ID NO: 169172 - DNA, 36 bp, Artificial Sequence
  Synthetic oligonucleotide
atccgaccccccccgctttgtatataatgttaacca

SEQ ID NO: 169173 - DNA, 36 bp, Artificial Sequence
  Synthetic oligonucleotide
acccacacgcgcacgtttttacttacccacacacca

SEQ ID NO: 169174 - DNA, 35 bp, Artificial Sequence
  Synthetic oligonucleotide
taagcacgccgactccctatatgttctcgccccca

SEQ ID NO: 169175 - DNA, 35 bp, Artificial Sequence
  Synthetic oligonucleotide
tctagcgccccgtattttggtccagctgtccccca

SEQ ID NO: 169176 - DNA, 35 bp, Artificial Sequence
  Synthetic oligonucleotide
ttgtccattcccgcgctggatcgtcccctggccca

SEQ ID NO: 169177 - DNA, 35 bp, Artificial Sequence
  Synthetic oligonucleotide
accatgatcgcggccatcctgctgaactattccca

SEQ ID NO: 169178 - DNA, 35 bp, Artificial Sequence
  Synthetic oligonucleotide
gccgatccacagccgcttaccagcctcccaatcca

SEQ ID NO: 169179 - DNA, 35 bp, Artificial Sequence
  Synthetic oligonucleotide
tgcccccctgtttgtgtgcttcgtacgttcatcca

SEQ ID NO: 169180 - DNA, 35 bp, Artificial Sequence
  Synthetic oligonucleotide
ttagatcctgccgttcccatctttgctgacttcca

SEQ ID NO: 169181 - DNA, 36 bp, Artificial Sequence
  Synthetic oligonucleotide
tttgaccgcctgaccgccacctctccgacgaacgca

SEQ ID NO: 169182 - DNA, 36 bp, Artificial Sequence
  Synthetic oligonucleotide
ttccgccatcctgacgttctttcctgtcatctctca

SEQ ID NO: 169183 - DNA, 34 bp, Artificial Sequence
  Synthetic oligonucleotide
tcctcgcgcgggccaccccatgcttatcccttca

SEQ ID NO: 169184 - DNA, 35 bp, Artificial Sequence
  Synthetic oligonucleotide
gattgcaccctagttccgtttaccctgcctgttca

SEQ ID NO: 169185 - DNA, 37 bp, Artificial Sequence
  Synthetic oligonucleotide
aaatagggcgggaggttcataacgggggaagggcaga

SEQ ID NO: 169186 - DNA, 34 bp, Artificial Sequence
  Synthetic oligonucleotide
tcagtagggaaacggggggggggccgttggtaga

SEQ ID NO: 169187 - DNA, 37 bp, Artificial Sequence
  Synthetic oligonucleotide
aacttggcggaggccgggtggcggaggggggctacga

SEQ ID NO: 169188 - DNA, 36 bp, Artificial Sequence
  Synthetic oligonucleotide
atgacctcttcacatgcttacctcccccctcaccga

SEQ ID NO: 169189 - DNA, 37 bp, Artificial Sequence
  Synthetic oligonucleotide
tgaccaacgccccctttactcttttgctgcccgccga

SEQ ID NO: 169190 - DNA, 38 bp, Artificial Sequence
  Synthetic oligonucleotide
ggtaagtgggagggggggggcaggaacgaatcaggcga

SEQ ID NO: 169191 - DNA, 36 bp, Artificial Sequence
  Synthetic oligonucleotide
tactaccggcatccgattctgtcttctctctctcga

SEQ ID NO: 169192 - DNA, 37 bp, Artificial Sequence
  Synthetic oligonucleotide
gcgcaacctcccttccgtactcttgactttacttcga

SEQ ID NO: 169193 - DNA, 37 bp, Artificial Sequence
  Synthetic oligonucleotide
gttccatgccccctctagccttaattacagtctagga

SEQ ID NO: 169194 - DNA, 36 bp, Artificial Sequence
  Synthetic oligonucleotide
acgaagcagggagggaccgacgggagggtttccgga

SEQ ID NO: 169195 - DNA, 37 bp, Artificial Sequence
  Synthetic oligonucleotide
tcgtgctctcgcccccttatctacgccactcttggga

SEQ ID NO: 169196 - DNA, 37 bp, Artificial Sequence
  Synthetic oligonucleotide
gacacactcgccttcgcatggcgtaacctcccttgga

SEQ ID NO: 169197 - DNA, 37 bp, Artificial Sequence
  Synthetic oligonucleotide
gtgcgacgacgcctatacaaccgcctcccatcttgga

SEQ ID NO: 169198 - DNA, 38 bp, Artificial Sequence
  Synthetic oligonucleotide
gcacccatcccatgcccgcgatagctccttgaccctga

SEQ ID NO: 169199 - DNA, 37 bp, Artificial Sequence
  Synthetic oligonucleotide
gcctccttcctgacgcggtatccctcacagcccctga

SEQ ID NO: 169200 - DNA, 37 bp, Artificial Sequence
  Synthetic oligonucleotide
atcacccgcacagtttcgtaccggcccactctcctga

SEQ ID NO: 169201 - DNA, 37 bp, Artificial Sequence
  Synthetic oligonucleotide
gcacgccgttcatcgttctttacccttcctgtagtga

SEQ ID NO: 169202 - DNA, 38 bp, Artificial Sequence
  Synthetic oligonucleotide
tcacgcccacccccttaattgtcattccgctcacgtga

SEQ ID NO: 169203 - DNA, 38 bp, Artificial Sequence
  Synthetic oligonucleotide
gacgagggaaggggtctacaggcgagggggacgcgtga

SEQ ID NO: 169204 - DNA, 35 bp, Artificial Sequence
  Synthetic oligonucleotide
gcgcccgctcctccctctttcgcacagacctgtga

SEQ ID NO: 169205 - DNA, 38 bp, Artificial Sequence
  Synthetic oligonucleotide
atgcgtgcccccacctctgttagttttcctgtttgtga

SEQ ID NO: 169206 - DNA, 36 bp, Artificial Sequence
  Synthetic oligonucleotide
gtcaccactctccgtttgttactggttctacattga

SEQ ID NO: 169207 - DNA, 35 bp, Artificial Sequence
  Synthetic oligonucleotide
gaaccccactccactcagccgccatctgccattga

SEQ ID NO: 169208 - DNA, 37 bp, Artificial Sequence
  Synthetic oligonucleotide
ttaaagacgcccgcctgttgcctgtatccccgcttga

SEQ ID NO: 169209 - DNA, 38 bp, Artificial Sequence
  Synthetic oligonucleotide
tgcacccttaatgttcgttcggccccttttatgcttga

SEQ ID NO: 169210 - DNA, 37 bp, Artificial Sequence
  Synthetic oligonucleotide
tctggaaggtgcctcgcgttgatcccccccttgttga

SEQ ID NO: 169211 - DNA, 38 bp, Artificial Sequence
  Synthetic oligonucleotide
accctccgtggccgccctgcctggtttctatcctttga

SEQ ID NO: 169212 - DNA, 38 bp, Artificial Sequence
  Synthetic oligonucleotide
ttgtcaccttgaacacgtattgccgccttcctttttga

SEQ ID NO: 169213 - DNA, 35 bp, Artificial Sequence
  Synthetic oligonucleotide
ggtgcccttgtccgcgcgttttttccactcctata

SEQ ID NO: 169214 - DNA, 35 bp, Artificial Sequence
  Synthetic oligonucleotide
acacccgccacataaccaacacacatatcccacta

SEQ ID NO: 169215 - DNA, 36 bp, Artificial Sequence
  Synthetic oligonucleotide
acttgtcccggtctgtatcgccctcatgtctccgta

SEQ ID NO: 169216 - DNA, 35 bp, Artificial Sequence
  Synthetic oligonucleotide
tactgcctcccgctgttaccatgtgcaccttcgta

SEQ ID NO: 169217 - DNA, 36 bp, Artificial Sequence
  Synthetic oligonucleotide
gaatgccgtgcctttccattcctgtcaccgttcgta

SEQ ID NO: 169218 - DNA, 35 bp, Artificial Sequence
  Synthetic oligonucleotide
ggtatccccaccccggccaattgatcctgttcgta

SEQ ID NO: 169219 - DNA, 35 bp, Artificial Sequence
  Synthetic oligonucleotide
ttcgcaacggtgtcccatatctcgtctcgccctta

SEQ ID NO: 169220 - DNA, 36 bp, Artificial Sequence
  Synthetic oligonucleotide
acattcaccgggtacacctgaggtcactttccctta

SEQ ID NO: 169221 - DNA, 36 bp, Artificial Sequence
  Synthetic oligonucleotide
gtaccgcctctatcgagtcatttccacgcctcctta

SEQ ID NO: 169222 - DNA, 36 bp, Artificial Sequence
  Synthetic oligonucleotide
tgccaaccccccgcgccgtctgcacgattctcttta

SEQ ID NO: 169223 - DNA, 35 bp, Artificial Sequence
  Synthetic oligonucleotide
tcgcgccctcccacttgtttaacctgattcaaaac

SEQ ID NO: 169224 - DNA, 35 bp, Artificial Sequence
  Synthetic oligonucleotide
aacctcctcgcaatcgctgatctctccggtgccac

SEQ ID NO: 169225 - DNA, 35 bp, Artificial Sequence
  Synthetic oligonucleotide
gagccactccatcaggtattcctcgcgtacgaacc

SEQ ID NO: 169226 - DNA, 35 bp, Artificial Sequence
  Synthetic oligonucleotide
ttcctctcgccgaaagaccgcgcgcttcctccacc

SEQ ID NO: 169227 - DNA, 35 bp, Artificial Sequence
  Synthetic oligonucleotide
gtgggagctggagtgttcgctgccgttgcccgccc

SEQ ID NO: 169228 - DNA, 35 bp, Artificial Sequence
  Synthetic oligonucleotide
accgctagtgcgtccttaccctcccttcgttagcc

SEQ ID NO: 169229 - DNA, 35 bp, Artificial Sequence
  Synthetic oligonucleotide
aagcacttccctgcactctctcgtccctgcacgcc

SEQ ID NO: 169230 - DNA, 35 bp, Artificial Sequence
  Synthetic oligonucleotide
ggatcgggccacctggagttactttccgcctcgcc

SEQ ID NO: 169231 - DNA, 35 bp, Artificial Sequence
  Synthetic oligonucleotide
tcctgctttcaactgtttccatagctcatcctgcc

SEQ ID NO: 169232 - DNA, 35 bp, Artificial Sequence
  Synthetic oligonucleotide
gtgccgtgcttccgccttcgtgctcgctttgatcc

SEQ ID NO: 169233 - DNA, 35 bp, Artificial Sequence
  Synthetic oligonucleotide
gcccacccaatctgcgtgctcgcccatgcccttcc

SEQ ID NO: 169234 - DNA, 35 bp, Artificial Sequence
  Synthetic oligonucleotide
gacactcaaaacctgcctcccgccgatgccacagc

SEQ ID NO: 169235 - DNA, 35 bp, Artificial Sequence
  Synthetic oligonucleotide
agtacatctgccccgtcctgtaagacctctccagc

SEQ ID NO: 169236 - DNA, 35 bp, Artificial Sequence
  Synthetic oligonucleotide
ttgcccagaaccgcaacacttacccgccatgctgc

SEQ ID NO: 169237 - DNA, 35 bp, Artificial Sequence
  Synthetic oligonucleotide
gaccgcgcctaaacagtacggcccttcccactatc

SEQ ID NO: 169238 - DNA, 35 bp, Artificial Sequence
  Synthetic oligonucleotide
aatcacggctcagcactgcatcctatacgtccctc

SEQ ID NO: 169239 - DNA, 34 bp, Artificial Sequence
  Synthetic oligonucleotide
agtttggtccgcagtcgtcttggccccgtccctc

SEQ ID NO: 169240 - DNA, 35 bp, Artificial Sequence
  Synthetic oligonucleotide
ttcccatccgtgctatcccttagcatgccccgctc

SEQ ID NO: 169241 - DNA, 35 bp, Artificial Sequence
  Synthetic oligonucleotide
tgcaaactccagtttgcttgccactttgacatctc

SEQ ID NO: 169242 - DNA, 35 bp, Artificial Sequence
  Synthetic oligonucleotide
tcagttaacctctgtgtgctgttactcttcccttc

SEQ ID NO: 169243 - DNA, 35 bp, Artificial Sequence
  Synthetic oligonucleotide
agaccactcagtcaaccccccactcgatcccgttc

SEQ ID NO: 169244 - DNA, 35 bp, Artificial Sequence
  Synthetic oligonucleotide
tacatccagcgttggccattcctcatgctcggttc

SEQ ID NO: 169245 - DNA, 35 bp, Artificial Sequence
  Synthetic oligonucleotide
tggtccactcgcggatgtcctcccccacatggttc

SEQ ID NO: 169246 - DNA, 35 bp, Artificial Sequence
  Synthetic oligonucleotide
agtgcccgtgcccgcccgtcccatcactactaaag

SEQ ID NO: 169247 - DNA, 35 bp, Artificial Sequence
  Synthetic oligonucleotide
taccgtaccaccgcccttctctatggacactgaag

SEQ ID NO: 169248 - DNA, 35 bp, Artificial Sequence
  Synthetic oligonucleotide
gaagaaggggaccacaggggacggtgatggcggag

SEQ ID NO: 169249 - DNA, 35 bp, Artificial Sequence
  Synthetic oligonucleotide
ggatcgtcttcgtcccgggccgcctaaaccccacg

SEQ ID NO: 169250 - DNA, 35 bp, Artificial Sequence
  Synthetic oligonucleotide
tctcccccacattactgccagccagccaacgcacg

SEQ ID NO: 169251 - DNA, 35 bp, Artificial Sequence
  Synthetic oligonucleotide
gcgggctaccgccttgactcatactccgttcaccg

SEQ ID NO: 169252 - DNA, 35 bp, Artificial Sequence
  Synthetic oligonucleotide
gtacccgcccgcctatgcacaatgtcttttagccg

SEQ ID NO: 169253 - DNA, 35 bp, Artificial Sequence
  Synthetic oligonucleotide
tcgctccgccttctccatcggtcccgcagttatcg

SEQ ID NO: 169254 - DNA, 35 bp, Artificial Sequence
  Synthetic oligonucleotide
gcttcatcacccagttgctggcttttccccgttcg

SEQ ID NO: 169255 - DNA, 35 bp, Artificial Sequence
  Synthetic oligonucleotide
gaaaggacagggggggaaagagtacgggtgggagg

SEQ ID NO: 169256 - DNA, 35 bp, Artificial Sequence
  Synthetic oligonucleotide
gagggagggtacaagatacggaacatggcgggggg

SEQ ID NO: 169257 - DNA, 35 bp, Artificial Sequence
  Synthetic oligonucleotide
acccatgtacgcttgctttaacctcccactaatgg

SEQ ID NO: 169258 - DNA, 35 bp, Artificial Sequence
  Synthetic oligonucleotide
ctccaagcggaaggagggggaggtacgtaaattgg

SEQ ID NO: 169259 - DNA, 35 bp, Artificial Sequence
  Synthetic oligonucleotide
tcttacgtccccccgcttgtcttctctgatacctg

SEQ ID NO: 169260 - DNA, 35 bp, Artificial Sequence
  Synthetic oligonucleotide
acagtcgaatgccgggcatccccctccaccccctg

SEQ ID NO: 169261 - DNA, 35 bp, Artificial Sequence
  Synthetic oligonucleotide
gttgcccgctgttctccctcgctccgtggatcgtg

SEQ ID NO: 169262 - DNA, 35 bp, Artificial Sequence
  Synthetic oligonucleotide
ttcctgggccactgctatgtgccatcttctccttg

SEQ ID NO: 169263 - DNA, 35 bp, Artificial Sequence
  Synthetic oligonucleotide
gcactgctgttcccccccctcgtcgttcatgcact

SEQ ID NO: 169264 - DNA, 35 bp, Artificial Sequence
  Synthetic oligonucleotide
atcgcgacccctctattgcgcctgaccctgcacct

SEQ ID NO: 169265 - DNA, 35 bp, Artificial Sequence
  Synthetic oligonucleotide
tccatcgtccctgagcgctctctgcttcatcacct

SEQ ID NO: 169266 - DNA, 35 bp, Artificial Sequence
  Synthetic oligonucleotide
gcaacctccgggtgccttgccatttgcccttccct

SEQ ID NO: 169267 - DNA, 35 bp, Artificial Sequence
  Synthetic oligonucleotide
ggtgcccatcgctcgtgtctgcgtcgctcattcct

SEQ ID NO: 169268 - DNA, 35 bp, Artificial Sequence
  Synthetic oligonucleotide
tccgaccaccctatcgtatattcgccctgattcct

SEQ ID NO: 169269 - DNA, 35 bp, Artificial Sequence
  Synthetic oligonucleotide
gacggaactacgtagttcgctcctgttctccctct

SEQ ID NO: 169270 - DNA, 35 bp, Artificial Sequence
  Synthetic oligonucleotide
acgccaagatgctgctccctgttcgcccctgtagt

SEQ ID NO: 169271 - DNA, 35 bp, Artificial Sequence
  Synthetic oligonucleotide
ccactgtccacatggtcctgcctcttcccgctcgt

SEQ ID NO: 169272 - DNA, 35 bp, Artificial Sequence
  Synthetic oligonucleotide
ggttggcgggggggtggagggcggagcacattcgt

SEQ ID NO: 169273 - DNA, 35 bp, Artificial Sequence
  Synthetic oligonucleotide
gttgaggggggggcggtgaatcgcataggggtggt

SEQ ID NO: 169274 - DNA, 35 bp, Artificial Sequence
  Synthetic oligonucleotide
ggacggggaagggggaagctcccggggaggaatgt

SEQ ID NO: 169275 - DNA, 35 bp, Artificial Sequence
  Synthetic oligonucleotide
gccactccccttatagttctaaaggccactgcatt

SEQ ID NO: 169276 - DNA, 35 bp, Artificial Sequence
  Synthetic oligonucleotide
ccagtcgttcgcccgttcatgccgccttgtcactt

SEQ ID NO: 169277 - DNA, 35 bp, Artificial Sequence
  Synthetic oligonucleotide
tctaggtccacgcccttctatcttatgccaccctt

SEQ ID NO: 169278 - DNA, 35 bp, Artificial Sequence
  Synthetic oligonucleotide
accctgcgcggtccttgacttaagtcccctccctt

SEQ ID NO: 169279 - DNA, 35 bp, Artificial Sequence
  Synthetic oligonucleotide
gctggaccgctccgacttttccaccgctttgcctt

SEQ ID NO: 169280 - DNA, 35 bp, Artificial Sequence
  Synthetic oligonucleotide
ttgaccaccggactcacccgtcaccgcctaccttt

SEQ ID NO: 169281 - DNA, 36 bp, Artificial Sequence
  Synthetic oligonucleotide
acagccgccccaccaggtctctttgctccggacaaa

SEQ ID NO: 169282 - DNA, 36 bp, Artificial Sequence
  Synthetic oligonucleotide
tgccacacgtgccctccgccccactcgtttccacaa

SEQ ID NO: 169283 - DNA, 36 bp, Artificial Sequence
  Synthetic oligonucleotide
gaatgcgccccgcttataccttcccccaccgggcaa

SEQ ID NO: 169284 - DNA, 35 bp, Artificial Sequence
  Synthetic oligonucleotide
acgggacagagggggggaaggttagtcggatggaa

SEQ ID NO: 169285 - DNA, 36 bp, Artificial Sequence
  Synthetic oligonucleotide
tccaggcccattccgttgcctactcacttcgctgaa

SEQ ID NO: 169286 - DNA, 36 bp, Artificial Sequence
  Synthetic oligonucleotide
tacggagaatgggtagggggggttgggaggatttaa

SEQ ID NO: 169287 - DNA, 35 bp, Artificial Sequence
  Synthetic oligonucleotide
acgtgccaccccagacccatcggcgactctttaca

SEQ ID NO: 169288 - DNA, 36 bp, Artificial Sequence
  Synthetic oligonucleotide
tctgcgcacttttgtttacgatccttcccggcacca

SEQ ID NO: 169289 - DNA, 36 bp, Artificial Sequence
  Synthetic oligonucleotide
tacccccgaccagccttcgcgcgcaaaccaccccca

SEQ ID NO: 169290 - DNA, 35 bp, Artificial Sequence
  Synthetic oligonucleotide
tttgccatcgagccgactatactttgaaccatcca

SEQ ID NO: 169291 - DNA, 36 bp, Artificial Sequence
  Synthetic oligonucleotide
ggaccacccgtcactcccctgcccctaagcgaagca

SEQ ID NO: 169292 - DNA, 35 bp, Artificial Sequence
  Synthetic oligonucleotide
acccacctagccggccccgcggacctcgcctcgca

SEQ ID NO: 169293 - DNA, 35 bp, Artificial Sequence
  Synthetic oligonucleotide
gccattgcacgtgcgttcccaaggtcccaattgca

SEQ ID NO: 169294 - DNA, 34 bp, Artificial Sequence
  Synthetic oligonucleotide
tttacctcccgactccacgcgccgcgccttctca

SEQ ID NO: 169295 - DNA, 35 bp, Artificial Sequence
  Synthetic oligonucleotide
ttgtacgtcacttatccctttcgtgtctgttctca

SEQ ID NO: 169296 - DNA, 37 bp, Artificial Sequence
  Synthetic oligonucleotide
actgaagagggggggagagacggtatcgggagggaga

SEQ ID NO: 169297 - DNA, 37 bp, Artificial Sequence
  Synthetic oligonucleotide
gtgtagggtgccggtgtgcgggagggatatgactaga

SEQ ID NO: 169298 - DNA, 37 bp, Artificial Sequence
  Synthetic oligonucleotide
gtcaccgcccgcatttttggttcctcgcactccacga

SEQ ID NO: 169299 - DNA, 37 bp, Artificial Sequence
  Synthetic oligonucleotide
gccttgacccaccgccaccacattcttattgagacga

SEQ ID NO: 169300 - DNA, 37 bp, Artificial Sequence
  Synthetic oligonucleotide
tgattccccactcgcctcgtttttggcagtcctacga

SEQ ID NO: 169301 - DNA, 37 bp, Artificial Sequence
  Synthetic oligonucleotide
accccctcgcctctagcttgtctcgtaatacatccga

SEQ ID NO: 169302 - DNA, 35 bp, Artificial Sequence
  Synthetic oligonucleotide
atgactgtcccccccgcatagaactcgctctccga

SEQ ID NO: 169303 - DNA, 37 bp, Artificial Sequence
  Synthetic oligonucleotide
gtggcgggcaaagggaggcatgagtggagggccgcga

SEQ ID NO: 169304 - DNA, 37 bp, Artificial Sequence
  Synthetic oligonucleotide
tttgcgagatgtgtacctactcccatctccctctcga

SEQ ID NO: 169305 - DNA, 37 bp, Artificial Sequence
  Synthetic oligonucleotide
gcagagcgccctgctttatttttgctgtttctctcga

SEQ ID NO: 169306 - DNA, 37 bp, Artificial Sequence
  Synthetic oligonucleotide
ggtgctactcctggtttcgatcatccctctcattcga

SEQ ID NO: 169307 - DNA, 37 bp, Artificial Sequence
  Synthetic oligonucleotide
atgcgttgcgggggggcgggttgtcacagtgggagga

SEQ ID NO: 169308 - DNA, 37 bp, Artificial Sequence
  Synthetic oligonucleotide
gcgataccctgccctgctccacatccgccccccggga

SEQ ID NO: 169309 - DNA, 35 bp, Artificial Sequence
  Synthetic oligonucleotide
gaccagacggagtagatgtggggcgatggggggga

SEQ ID NO: 169310 - DNA, 37 bp, Artificial Sequence
  Synthetic oligonucleotide
accacaccctcgtcccgtccgctaccgtctcgctgga

SEQ ID NO: 169311 - DNA, 38 bp, Artificial Sequence
  Synthetic oligonucleotide
ttaagccgggtgggagggttcgtgcctgggactttgga

SEQ ID NO: 169312 - DNA, 38 bp, Artificial Sequence
  Synthetic oligonucleotide
tgacttgcagaatgtgtttgtcgccctcccctcactga

SEQ ID NO: 169313 - DNA, 37 bp, Artificial Sequence
  Synthetic oligonucleotide
ggtgaccctgctcgttccagcccgctttatcccctga

SEQ ID NO: 169314 - DNA, 38 bp, Artificial Sequence
  Synthetic oligonucleotide
atgggagggagggtaagctaggaggggaggggttctga

SEQ ID NO: 169315 - DNA, 38 bp, Artificial Sequence
  Synthetic oligonucleotide
ggaagagacctggaagtggtgcgggggaggtgcagtga

SEQ ID NO: 169316 - DNA, 38 bp, Artificial Sequence
  Synthetic oligonucleotide
ggagaggtcgggaagaggggaaatactggcacgcgtga

SEQ ID NO: 169317 - DNA, 38 bp, Artificial Sequence
  Synthetic oligonucleotide
tatggggcagttagggcggggagtgggatctggggtga

SEQ ID NO: 169318 - DNA, 37 bp, Artificial Sequence
  Synthetic oligonucleotide
ggggggggctcaaccatggggacctttcacttggtga

SEQ ID NO: 169319 - DNA, 37 bp, Artificial Sequence
  Synthetic oligonucleotide
ggggaagggagggagcgagcgacgagaccgtctgtga

SEQ ID NO: 169320 - DNA, 35 bp, Artificial Sequence
  Synthetic oligonucleotide
atcggactccatcacacctgctacaggaccattga

SEQ ID NO: 169321 - DNA, 38 bp, Artificial Sequence
  Synthetic oligonucleotide
acaggaagggtgggagcgggcaaaagaggggttattga

SEQ ID NO: 169322 - DNA, 37 bp, Artificial Sequence
  Synthetic oligonucleotide
ttatcgcaccgcattgccgattctgccattaccttga

SEQ ID NO: 169323 - DNA, 38 bp, Artificial Sequence
  Synthetic oligonucleotide
agacactccctccgttactctcttactgccatccttga

SEQ ID NO: 169324 - DNA, 37 bp, Artificial Sequence
  Synthetic oligonucleotide
atcacatcgctatgacgcccacctcgcgcctccttga

SEQ ID NO: 169325 - DNA, 38 bp, Artificial Sequence
  Synthetic oligonucleotide
attccaccctgcacctgctatacatgtagccctcttga

SEQ ID NO: 169326 - DNA, 38 bp, Artificial Sequence
  Synthetic oligonucleotide
acgtgccgcccaactgcatcacccactcccgctcttga

SEQ ID NO: 169327 - DNA, 37 bp, Artificial Sequence
  Synthetic oligonucleotide
aactgttgcacatggccgttttgcttcactctcttga

SEQ ID NO: 169328 - DNA, 35 bp, Artificial Sequence
  Synthetic oligonucleotide
tgctcgcgagaacgcgaccgtcccccccccgcata

SEQ ID NO: 169329 - DNA, 36 bp, Artificial Sequence
  Synthetic oligonucleotide
gctgcctccccgcctgagcatgagcctcgctgccta

SEQ ID NO: 169330 - DNA, 36 bp, Artificial Sequence
  Synthetic oligonucleotide
tttggccgtcgttcctgcttcaacgccccgactcta

SEQ ID NO: 169331 - DNA, 35 bp, Artificial Sequence
  Synthetic oligonucleotide
ttccctgccccacggtacacaccactcgatacgta

SEQ ID NO: 169332 - DNA, 36 bp, Artificial Sequence
  Synthetic oligonucleotide
acttggtccatctgtcccgctacacagtgcccctta

SEQ ID NO: 169333 - DNA, 36 bp, Artificial Sequence
  Synthetic oligonucleotide
gcccgtcacgcccgctgactatatgattccgcctta

SEQ ID NO: 169334 - DNA, 33 bp, Artificial Sequence
  Synthetic oligonucleotide
tagtccggcctccacatattacttttcccttta

SEQ ID NO: 169335 - DNA, 35 bp, Artificial Sequence
  Synthetic oligonucleotide
gcagatgaccgcctgccgctcgctaccgctcttta

SEQ ID NO: 169336 - DNA, 35 bp, Artificial Sequence
  Synthetic oligonucleotide
ttctcgccgcgggtaccgtccagccatcctaccac

SEQ ID NO: 169337 - DNA, 35 bp, Artificial Sequence
  Synthetic oligonucleotide
gtcgacgacggcattggccgctgctcgccccccac

SEQ ID NO: 169338 - DNA, 35 bp, Artificial Sequence
  Synthetic oligonucleotide
gatcgcgccgagagggcaatcctccgcctccccac

SEQ ID NO: 169339 - DNA, 35 bp, Artificial Sequence
  Synthetic oligonucleotide
tccacaactgtgagttcgcctataaccctgcgcac

SEQ ID NO: 169340 - DNA, 35 bp, Artificial Sequence
  Synthetic oligonucleotide
tcacccatcctgcacccggccccggtgtctcgcac

SEQ ID NO: 169341 - DNA, 35 bp, Artificial Sequence
  Synthetic oligonucleotide
acactcccttcgttggtattccatcacggtcgcac

SEQ ID NO: 169342 - DNA, 35 bp, Artificial Sequence
  Synthetic oligonucleotide
aaaacacgccagccatttgctttcttgtccgctac

SEQ ID NO: 169343 - DNA, 35 bp, Artificial Sequence
  Synthetic oligonucleotide
gctcctggggcgggccgttggggtggggtttttac

SEQ ID NO: 169344 - DNA, 35 bp, Artificial Sequence
  Synthetic oligonucleotide
gcccaccaccgaacgatatctatcgacatgtaacc

SEQ ID NO: 169345 - DNA, 35 bp, Artificial Sequence
  Synthetic oligonucleotide
gcaccccaactggactctgaacaccgattaatacc

SEQ ID NO: 169346 - DNA, 35 bp, Artificial Sequence
  Synthetic oligonucleotide
gcaactacgcggcgtggcacattcgtcgttctacc

SEQ ID NO: 169347 - DNA, 35 bp, Artificial Sequence
  Synthetic oligonucleotide
gaaccgcctctctagtaaatttgttgccgttcccc

SEQ ID NO: 169348 - DNA, 35 bp, Artificial Sequence
  Synthetic oligonucleotide
gtcgctcactggtttgcgaacctcaccctcctgcc

SEQ ID NO: 169349 - DNA, 35 bp, Artificial Sequence
  Synthetic oligonucleotide
gctctgctcgcaatcctacgccatccgcctccagc

SEQ ID NO: 169350 - DNA, 35 bp, Artificial Sequence
  Synthetic oligonucleotide
tctgacctaccaggtcttcttttgtgaccacccgc

SEQ ID NO: 169351 - DNA, 36 bp, Artificial Sequence
  Synthetic oligonucleotide
tgattccccgcatgttcggtacttttcttgtcccgc

SEQ ID NO: 169352 - DNA, 35 bp, Artificial Sequence
  Synthetic oligonucleotide
ttcaccacccgttcgctcagacatggcctcagcgc

SEQ ID NO: 169353 - DNA, 35 bp, Artificial Sequence
  Synthetic oligonucleotide
tttggaagcccgggcgggagggccaatcctagggc

SEQ ID NO: 169354 - DNA, 35 bp, Artificial Sequence
  Synthetic oligonucleotide
gttagtagaggggggagcgaaggagagcgcggggc

SEQ ID NO: 169355 - DNA, 35 bp, Artificial Sequence
  Synthetic oligonucleotide
tgcatgggcacacatcgtccctaagcctttctatc

SEQ ID NO: 169356 - DNA, 35 bp, Artificial Sequence
  Synthetic oligonucleotide
gtgtgcatttgcctggggttatgtcctgctccctc

SEQ ID NO: 169357 - DNA, 35 bp, Artificial Sequence
  Synthetic oligonucleotide
aacgaggccctaccccagccccaaatattgtcctc

SEQ ID NO: 169358 - DNA, 35 bp, Artificial Sequence
  Synthetic oligonucleotide
aagacagatgccgccccctttatgcactgttcctc

SEQ ID NO: 169359 - DNA, 35 bp, Artificial Sequence
  Synthetic oligonucleotide
acagcgctgggcactccctacactcgtcttagctc

SEQ ID NO: 169360 - DNA, 35 bp, Artificial Sequence
  Synthetic oligonucleotide
gtgtacggttcattgtactcgtggttctccctctc

SEQ ID NO: 169361 - DNA, 35 bp, Artificial Sequence
  Synthetic oligonucleotide
aatgcctcaacacatcggcgtattccatctccgtc

SEQ ID NO: 169362 - DNA, 35 bp, Artificial Sequence
  Synthetic oligonucleotide
gcactaactcccatttcgatgtaactacgccggtc

SEQ ID NO: 169363 - DNA, 35 bp, Artificial Sequence
  Synthetic oligonucleotide
tccgcatcatgctcgcttaccccccgcccgctgtc

SEQ ID NO: 169364 - DNA, 35 bp, Artificial Sequence
  Synthetic oligonucleotide
acgggtgacaaagacgagggcgggggggttcaaag

SEQ ID NO: 169365 - DNA, 35 bp, Artificial Sequence
  Synthetic oligonucleotide
ttgcctcaaccgcccatttatcctgccgaattacg

SEQ ID NO: 169366 - DNA, 35 bp, Artificial Sequence
  Synthetic oligonucleotide
ttgcgcacgctagctctatccgacctcttcttccg

SEQ ID NO: 169367 - DNA, 35 bp, Artificial Sequence
  Synthetic oligonucleotide
tgagcccgcaggaacttgtcacgcccaccttttcg

SEQ ID NO: 169368 - DNA, 35 bp, Artificial Sequence
  Synthetic oligonucleotide
ttggagagtgggtgggagggttcttgcaccactgg

SEQ ID NO: 169369 - DNA, 35 bp, Artificial Sequence
  Synthetic oligonucleotide
tgtactcggttgctccacccttccgccctttctgg

SEQ ID NO: 169370 - DNA, 35 bp, Artificial Sequence
  Synthetic oligonucleotide
tttggtggggcgcggcggctcgtgggaggggcatg

SEQ ID NO: 169371 - DNA, 35 bp, Artificial Sequence
  Synthetic oligonucleotide
tcgatcccagccacaagccctcaccccgccctatg

SEQ ID NO: 169372 - DNA, 35 bp, Artificial Sequence
  Synthetic oligonucleotide
cccccatcgcagatctcactcgttctatccacctg

SEQ ID NO: 169373 - DNA, 35 bp, Artificial Sequence
  Synthetic oligonucleotide
ttagtggctgctgcctcccttccggaacccatctg

SEQ ID NO: 169374 - DNA, 35 bp, Artificial Sequence
  Synthetic oligonucleotide
tatcagtcccggtggttcttttgtctcccatcttg

SEQ ID NO: 169375 - DNA, 35 bp, Artificial Sequence
  Synthetic oligonucleotide
agaccagtcatacgcctccgtcgctcacgcctcat

SEQ ID NO: 169376 - DNA, 35 bp, Artificial Sequence
  Synthetic oligonucleotide
atgggaggggggggactggtgtgtggcgatcagat

SEQ ID NO: 169377 - DNA, 35 bp, Artificial Sequence
  Synthetic oligonucleotide
gggggacaatcgggagaggggggtacagagggtat

SEQ ID NO: 169378 - DNA, 35 bp, Artificial Sequence
  Synthetic oligonucleotide
tctgacacgcctcactatcggtcgacaactacact

SEQ ID NO: 169379 - DNA, 36 bp, Artificial Sequence
  Synthetic oligonucleotide
tgctggactgcccgacccacgctaatgaccgccact

SEQ ID NO: 169380 - DNA, 35 bp, Artificial Sequence
  Synthetic oligonucleotide
gaatgcccccgcgctacgccttttagcctatccct

SEQ ID NO: 169381 - DNA, 35 bp, Artificial Sequence
  Synthetic oligonucleotide
acattgctgcgttcacggttcatttgcctcatcct

SEQ ID NO: 169382 - DNA, 35 bp, Artificial Sequence
  Synthetic oligonucleotide
ttcccgcccaggctcccgctcgcaaacccctggct

SEQ ID NO: 169383 - DNA, 35 bp, Artificial Sequence
  Synthetic oligonucleotide
gacaccacaaccggttcgcgttcttgacactctct

SEQ ID NO: 169384 - DNA, 34 bp, Artificial Sequence
  Synthetic oligonucleotide
actccttgcattatgttgcttgctcctgttctct

SEQ ID NO: 169385 - DNA, 35 bp, Artificial Sequence
  Synthetic oligonucleotide
tacccgccgaccatgtactcccgccgcgagagtct

SEQ ID NO: 169386 - DNA, 35 bp, Artificial Sequence
  Synthetic oligonucleotide
gaggagtattcgccgtaactgtcaatcccgtttct

SEQ ID NO: 169387 - DNA, 35 bp, Artificial Sequence
  Synthetic oligonucleotide
actgtgccaagtcgcctatgcgcgtccctttttct

SEQ ID NO: 169388 - DNA, 35 bp, Artificial Sequence
  Synthetic oligonucleotide
tgagctgccctcctttgccctcgtaccttagcagt

SEQ ID NO: 169389 - DNA, 35 bp, Artificial Sequence
  Synthetic oligonucleotide
gtatccagatcaaccgtgctgcccccccctttagt

SEQ ID NO: 169390 - DNA, 35 bp, Artificial Sequence
  Synthetic oligonucleotide
gcccaccgacaggaggttctcgttccacctcccgt

SEQ ID NO: 169391 - DNA, 35 bp, Artificial Sequence
  Synthetic oligonucleotide
atgctcctgcctggcacccgcacctcgtctctcgt

SEQ ID NO: 169392 - DNA, 35 bp, Artificial Sequence
  Synthetic oligonucleotide
taacgctgcgttcgcgatcgcccctcattcctggt

SEQ ID NO: 169393 - DNA, 35 bp, Artificial Sequence
  Synthetic oligonucleotide
gcgcgaactgcctcactaacccgtgtctctttggt

SEQ ID NO: 169394 - DNA, 35 bp, Artificial Sequence
  Synthetic oligonucleotide
gtctctcatccggcgcctgtagttatcttgccctt

SEQ ID NO: 169395 - DNA, 35 bp, Artificial Sequence
  Synthetic oligonucleotide
ttctcacgcattctcgtgctccatactcgtgcctt

SEQ ID NO: 169396 - DNA, 35 bp, Artificial Sequence
  Synthetic oligonucleotide
tgtgtcaaccccgctggatcctccctgtaccgctt

SEQ ID NO: 169397 - DNA, 35 bp, Artificial Sequence
  Synthetic oligonucleotide
aaccctcctccgccgcccacgtaagtgaccccgtt

SEQ ID NO: 169398 - DNA, 35 bp, Artificial Sequence
  Synthetic oligonucleotide
ggtcaactgacgccccccagttgtcttttaccttt

SEQ ID NO: 169399 - DNA, 35 bp, Artificial Sequence
  Synthetic oligonucleotide
gcgcacatcgcagcttaacatccgctcgttatttt

SEQ ID NO: 169400 - DNA, 36 bp, Artificial Sequence
  Synthetic oligonucleotide
acccgccgcttgctatccgcccatcgacatgttaaa

SEQ ID NO: 169401 - DNA, 36 bp, Artificial Sequence
  Synthetic oligonucleotide
gcccccgactgtgcccccacatggctccaccccgaa

SEQ ID NO: 169402 - DNA, 36 bp, Artificial Sequence
  Synthetic oligonucleotide
tgcaatcccccttgttaacgccccccgctctcggaa

SEQ ID NO: 169403 - DNA, 36 bp, Artificial Sequence
  Synthetic oligonucleotide
ttcgatgggcaatgagtagtcgtgggtgggagggaa

SEQ ID NO: 169404 - DNA, 36 bp, Artificial Sequence
  Synthetic oligonucleotide
attaggacggatagtgaggggggcgggaattgggaa

SEQ ID NO: 169405 - DNA, 36 bp, Artificial Sequence
  Synthetic oligonucleotide
gttagagttcgggtggtgggaaggggaacgcggtaa

SEQ ID NO: 169406 - DNA, 35 bp, Artificial Sequence
  Synthetic oligonucleotide
atggtggagggggagtgagggacgggctagagaca

SEQ ID NO: 169407 - DNA, 35 bp, Artificial Sequence
  Synthetic oligonucleotide
gagagaatagggaggagaagtggaggtcgatgaca

SEQ ID NO: 169408 - DNA, 36 bp, Artificial Sequence
  Synthetic oligonucleotide
tctacccctgcggtatcaacacaccttcttgcacca

SEQ ID NO: 169409 - DNA, 36 bp, Artificial Sequence
  Synthetic oligonucleotide
tccattaccgacccatagttcctctactcccagcca

SEQ ID NO: 169410 - DNA, 36 bp, Artificial Sequence
  Synthetic oligonucleotide
ttgtgcgctgtcaccctgacactgtctgccccgcca

SEQ ID NO: 169411 - DNA, 35 bp, Artificial Sequence
  Synthetic oligonucleotide
gtcacatcttggccggccctccttagctcctgcca

SEQ ID NO: 169412 - DNA, 36 bp, Artificial Sequence
  Synthetic oligonucleotide
tagtatcccccccgctgtgattttgacaccccggca

SEQ ID NO: 169413 - DNA, 36 bp, Artificial Sequence
  Synthetic oligonucleotide
tccgaccgactctaggccccgcatttgaacaattca

SEQ ID NO: 169414 - DNA, 36 bp, Artificial Sequence
  Synthetic oligonucleotide
agctcaaccgtcaggccaccccccttcgcccgttca

SEQ ID NO: 169415 - DNA, 36 bp, Artificial Sequence
  Synthetic oligonucleotide
gttccaccccgccgtgtcccgtctgcaaatctttca

SEQ ID NO: 169416 - DNA, 37 bp, Artificial Sequence
  Synthetic oligonucleotide
gcaccgttcatccgcctgttcccgcccatcctcgaga

SEQ ID NO: 169417 - DNA, 35 bp, Artificial Sequence
  Synthetic oligonucleotide
gcctcccgagccctttattcgtactgatctgacga

SEQ ID NO: 169418 - DNA, 34 bp, Artificial Sequence
  Synthetic oligonucleotide
tcgcgcactctcgttctccctattcgcatcccga

SEQ ID NO: 169419 - DNA, 37 bp, Artificial Sequence
  Synthetic oligonucleotide
atcgtgcctccacctggtaactcgccctctatcccga

SEQ ID NO: 169420 - DNA, 37 bp, Artificial Sequence
  Synthetic oligonucleotide
tgtgcccttcacagatgtgcgccttctaccacccgga

SEQ ID NO: 169421 - DNA, 35 bp, Artificial Sequence
  Synthetic oligonucleotide
tgaggggagggtatgtagggtccatattgagggga

SEQ ID NO: 169422 - DNA, 37 bp, Artificial Sequence
  Synthetic oligonucleotide
gaaagcggtagaagggaaagggctagcgcggggggga

SEQ ID NO: 169423 - DNA, 35 bp, Artificial Sequence
  Synthetic oligonucleotide
tagagagagggagtgcggaggtagcggttttggga

SEQ ID NO: 169424 - DNA, 35 bp, Artificial Sequence
  Synthetic oligonucleotide
gccctggagggtcggagagggaggggcactttgga

SEQ ID NO: 169425 - DNA, 37 bp, Artificial Sequence
  Synthetic oligonucleotide
agtggggaacggtggggaaggaaaaacgtggtgatga

SEQ ID NO: 169426 - DNA, 38 bp, Artificial Sequence
  Synthetic oligonucleotide
atccccgcccccttcacctatgttccaaagacttatga

SEQ ID NO: 169427 - DNA, 35 bp, Artificial Sequence
  Synthetic oligonucleotide
tcctaacctcgcccttgtttttttgccgatactga

SEQ ID NO: 169428 - DNA, 37 bp, Artificial Sequence
  Synthetic oligonucleotide
gtctcccccctaattgcgtcgtcgacctcctccctga

SEQ ID NO: 169429 - DNA, 37 bp, Artificial Sequence
  Synthetic oligonucleotide
aatccgctgcccctgcctgatcgcacacacacgctga

SEQ ID NO: 169430 - DNA, 37 bp, Artificial Sequence
  Synthetic oligonucleotide
tgacgtgcgcccgacccctgcctcctctgtacagtga

SEQ ID NO: 169431 - DNA, 37 bp, Artificial Sequence
  Synthetic oligonucleotide
gacaggtggagcggggtaggtagtacaaggcgggtga

SEQ ID NO: 169432 - DNA, 38 bp, Artificial Sequence
  Synthetic oligonucleotide
tacccatccgcctccgcctagtttagcacagaacttga

SEQ ID NO: 169433 - DNA, 37 bp, Artificial Sequence
  Synthetic oligonucleotide
tcactcgactcttccgctcacagttgccggttcttga

SEQ ID NO: 169434 - DNA, 38 bp, Artificial Sequence
  Synthetic oligonucleotide
tactcccgggtcgttcccctcgcctaatgtgatgttga

SEQ ID NO: 169435 - DNA, 37 bp, Artificial Sequence
  Synthetic oligonucleotide
tactgacacggcgggtgagggtggggagggactttga

SEQ ID NO: 169436 - DNA, 36 bp, Artificial Sequence
  Synthetic oligonucleotide
gtcctaccagccgttctcaagccagcccccttacta

SEQ ID NO: 169437 - DNA, 35 bp, Artificial Sequence
  Synthetic oligonucleotide
gaccaggcctcagccacatatatgccctataccta

SEQ ID NO: 169438 - DNA, 36 bp, Artificial Sequence
  Synthetic oligonucleotide
tctaccccaagcctcaaacgctgtctttgtctccta

SEQ ID NO: 169439 - DNA, 35 bp, Artificial Sequence
  Synthetic oligonucleotide
gataggatagggtggggctcgtccggaggggggta

SEQ ID NO: 169440 - DNA, 35 bp, Artificial Sequence
  Synthetic oligonucleotide
gcgcatccacctgtataggcttattccgcccctac

SEQ ID NO: 169441 - DNA, 35 bp, Artificial Sequence
  Synthetic oligonucleotide
ggtcccgttcctgaccgtcagccccggccaccacc

SEQ ID NO: 169442 - DNA, 35 bp, Artificial Sequence
  Synthetic oligonucleotide
gaccctgcccgaccgcatagcctccaactgagacc

SEQ ID NO: 169443 - DNA, 35 bp, Artificial Sequence
  Synthetic oligonucleotide
tcacaccatcatagttgtatggttccccgcccccc

SEQ ID NO: 169444 - DNA, 35 bp, Artificial Sequence
  Synthetic oligonucleotide
acactcccccctcgttcgtaataggttcccgcccc

SEQ ID NO: 169445 - DNA, 35 bp, Artificial Sequence
  Synthetic oligonucleotide
tgagggaaacctctcgatcgtgacaccttcctccc

SEQ ID NO: 169446 - DNA, 35 bp, Artificial Sequence
  Synthetic oligonucleotide
gtgcagcctcacccgtccccttcgttaccggtccc

SEQ ID NO: 169447 - DNA, 35 bp, Artificial Sequence
  Synthetic oligonucleotide
atggccaaggaaggccgcccctatacatacccgcc

SEQ ID NO: 169448 - DNA, 34 bp, Artificial Sequence
  Synthetic oligonucleotide
ggcccacccagtctgcgtcggtcccacgcccgcc

SEQ ID NO: 169449 - DNA, 35 bp, Artificial Sequence
  Synthetic oligonucleotide
ttttagcccaccctgttccggcacaggtctctgcc

SEQ ID NO: 169450 - DNA, 35 bp, Artificial Sequence
  Synthetic oligonucleotide
tgccagcgtagccgccgtcttcctccgctattgcc

SEQ ID NO: 169451 - DNA, 36 bp, Artificial Sequence
  Synthetic oligonucleotide
ttcacctctggtgtccgattcatccagtagctctcc

SEQ ID NO: 169452 - DNA, 35 bp, Artificial Sequence
  Synthetic oligonucleotide
aagacagttaccatgcgtagcaccgcctccaccgc

SEQ ID NO: 169453 - DNA, 35 bp, Artificial Sequence
  Synthetic oligonucleotide
ggtgtacgctataccgccgcaacttccattaccgc

SEQ ID NO: 169454 - DNA, 35 bp, Artificial Sequence
  Synthetic oligonucleotide
accggggggggttctatggggtacgtgtatggggc

SEQ ID NO: 169455 - DNA, 35 bp, Artificial Sequence
  Synthetic oligonucleotide
actacgctcgtcgttttggctcaattggctccatc

SEQ ID NO: 169456 - DNA, 35 bp, Artificial Sequence
  Synthetic oligonucleotide
atcagggccctcacctgctatttgggtctctcatc

SEQ ID NO: 169457 - DNA, 34 bp, Artificial Sequence
  Synthetic oligonucleotide
tcctcgacccgcctaaatgttgcaaacacatatc

SEQ ID NO: 169458 - DNA, 35 bp, Artificial Sequence
  Synthetic oligonucleotide
gacgccaacttgagcatcggtcaccatttgccctc

SEQ ID NO: 169459 - DNA, 35 bp, Artificial Sequence
  Synthetic oligonucleotide
tgcaagcgcacgtatctgtactgtccctttttctc

SEQ ID NO: 169460 - DNA, 35 bp, Artificial Sequence
  Synthetic oligonucleotide
ttgaccccaccgccgaacgtccgccacgcgttgtc

SEQ ID NO: 169461 - DNA, 35 bp, Artificial Sequence
  Synthetic oligonucleotide
ttatcctccgccggtaactttgggctgattccttc

SEQ ID NO: 169462 - DNA, 35 bp, Artificial Sequence
  Synthetic oligonucleotide
tgctcatcttacgcgtgttctccggtgcccgcttc

SEQ ID NO: 169463 - DNA, 35 bp, Artificial Sequence
  Synthetic oligonucleotide
acaggcgcttacctgcccgcgttccgtaaatgttc

SEQ ID NO: 169464 - DNA, 35 bp, Artificial Sequence
  Synthetic oligonucleotide
gggtacgcctggtttgatctccgccacctgttttc

SEQ ID NO: 169465 - DNA, 35 bp, Artificial Sequence
  Synthetic oligonucleotide
gagcgagacgctgtaacggggagggatgaaggaag

SEQ ID NO: 169466 - DNA, 35 bp, Artificial Sequence
  Synthetic oligonucleotide
agcaaggggactgcaggaggggggccaggatggag

SEQ ID NO: 169467 - DNA, 35 bp, Artificial Sequence
  Synthetic oligonucleotide
gcccgccccgcttgcattgtccgacgcgtaccccg

SEQ ID NO: 169468 - DNA, 35 bp, Artificial Sequence
  Synthetic oligonucleotide
tcatacttcgcccgcccccccttgtcgacgctccg

SEQ ID NO: 169469 - DNA, 35 bp, Artificial Sequence
  Synthetic oligonucleotide
gtctgatgcccccgctcgtcctccctcgcatggcg

SEQ ID NO: 169470 - DNA, 35 bp, Artificial Sequence
  Synthetic oligonucleotide
agcctagcgccgcgcaggactcctcttctctctcg

SEQ ID NO: 169471 - DNA, 35 bp, Artificial Sequence
  Synthetic oligonucleotide
aattgcctcccccggtcacctacaatatgttctcg

SEQ ID NO: 169472 - DNA, 35 bp, Artificial Sequence
  Synthetic oligonucleotide
tcaataggacccatccggcgcgccctccatcttcg

SEQ ID NO: 169473 - DNA, 35 bp, Artificial Sequence
  Synthetic oligonucleotide
aagggaggggggcacattaaacggggcgatgacgg

SEQ ID NO: 169474 - DNA, 35 bp, Artificial Sequence
  Synthetic oligonucleotide
gtcagtaagagggaatgggcgggatgactgggggg

SEQ ID NO: 169475 - DNA, 35 bp, Artificial Sequence
  Synthetic oligonucleotide
atgaattcgggtaggggggggacgggggaactggg

SEQ ID NO: 169476 - DNA, 35 bp, Artificial Sequence
  Synthetic oligonucleotide
acagtgctgggaccgggggggtagtgggatccatg

SEQ ID NO: 169477 - DNA, 35 bp, Artificial Sequence
  Synthetic oligonucleotide
tgggggtgaaggcaggtggttcgggcgctgggatg

SEQ ID NO: 169478 - DNA, 35 bp, Artificial Sequence
  Synthetic oligonucleotide
gtggataggggagggaacatgggtgtgagtaactg

SEQ ID NO: 169479 - DNA, 35 bp, Artificial Sequence
  Synthetic oligonucleotide
ttgtacgcctctgtggcacaccacccctattcctg

SEQ ID NO: 169480 - DNA, 35 bp, Artificial Sequence
  Synthetic oligonucleotide
tcccatgcggttccccgagtcccaacctgttcctg

SEQ ID NO: 169481 - DNA, 35 bp, Artificial Sequence
  Synthetic oligonucleotide
gagtcgcaaccctcaaatcgcgtatgtttcctctg

SEQ ID NO: 169482 - DNA, 35 bp, Artificial Sequence
  Synthetic oligonucleotide
gtcgctgccaccgtcgttccgctccatccttcgtg

SEQ ID NO: 169483 - DNA, 35 bp, Artificial Sequence
  Synthetic oligonucleotide
gatgtggagaggggtggaatagtctcgctaaggtg

SEQ ID NO: 169484 - DNA, 35 bp, Artificial Sequence
  Synthetic oligonucleotide
tgcggccccccaccgttgttgcccttctcgcggtg

SEQ ID NO: 169485 - DNA, 35 bp, Artificial Sequence
  Synthetic oligonucleotide
ccacgccacgcaccgacgttcgccctacccaacat

SEQ ID NO: 169486 - DNA, 35 bp, Artificial Sequence
  Synthetic oligonucleotide
attgcccagtggattatccgtcctttgtccaccat

SEQ ID NO: 169487 - DNA, 35 bp, Artificial Sequence
  Synthetic oligonucleotide
ggatgtcactgccttactactgcctgtcccgccat

SEQ ID NO: 169488 - DNA, 35 bp, Artificial Sequence
  Synthetic oligonucleotide
atggggaccctaaatgtagtgggcgggtgggtgat

SEQ ID NO: 169489 - DNA, 35 bp, Artificial Sequence
  Synthetic oligonucleotide
gtcgaccatcctttaaatgttccttccacgagtat

SEQ ID NO: 169490 - DNA, 35 bp, Artificial Sequence
  Synthetic oligonucleotide
gtctactcacatctttgtgatccaccgcccttcct

SEQ ID NO: 169491 - DNA, 35 bp, Artificial Sequence
  Synthetic oligonucleotide
aatcgcgaccggtcaattcgcctcccctgctcgct

SEQ ID NO: 169492 - DNA, 35 bp, Artificial Sequence
  Synthetic oligonucleotide
gtatgtactgccaccgtcgttgcccttctcctgct

SEQ ID NO: 169493 - DNA, 35 bp, Artificial Sequence
  Synthetic oligonucleotide
gcacagtgtagctctgggcacttcccttgtactct

SEQ ID NO: 169494 - DNA, 34 bp, Artificial Sequence
  Synthetic oligonucleotide
aaacagggcgtacggtagggacggggagggctct

SEQ ID NO: 169495 - DNA, 35 bp, Artificial Sequence
  Synthetic oligonucleotide
ttccatgcactatcccgagttccagtagcccttct

SEQ ID NO: 169496 - DNA, 35 bp, Artificial Sequence
  Synthetic oligonucleotide
aagatgtaggtgggtgggctagaggagcatggggt

SEQ ID NO: 169497 - DNA, 35 bp, Artificial Sequence
  Synthetic oligonucleotide
aagacttccagcccctgcctcgttactccatcatt

SEQ ID NO: 169498 - DNA, 35 bp, Artificial Sequence
  Synthetic oligonucleotide
tcgagtgcatcactcctaccgttctgtccccgatt

SEQ ID NO: 169499 - DNA, 35 bp, Artificial Sequence
  Synthetic oligonucleotide
agtgcactcccgtttggctgacatgccgtcccctt

SEQ ID NO: 169500 - DNA, 35 bp, Artificial Sequence
  Synthetic oligonucleotide
gtgacacctttcttcgtgtgttcgccacactgctt

SEQ ID NO: 169501 - DNA, 35 bp, Artificial Sequence
  Synthetic oligonucleotide
gcccgactcgctctgcctaaatcaggcccttagtt

SEQ ID NO: 169502 - DNA, 35 bp, Artificial Sequence
  Synthetic oligonucleotide
gccattccttgtagttgccttacccgttcccggtt

SEQ ID NO: 169503 - DNA, 35 bp, Artificial Sequence
  Synthetic oligonucleotide
gccgagtctatccggattttgtctacccctccttt

SEQ ID NO: 169504 - DNA, 35 bp, Artificial Sequence
  Synthetic oligonucleotide
gagggggagggaggatcagggccctggagacgttt

SEQ ID NO: 169505 - DNA, 35 bp, Artificial Sequence
  Synthetic oligonucleotide
gtactgccgaccctttctcttctggccatgttttt

SEQ ID NO: 169506 - DNA, 36 bp, Artificial Sequence
  Synthetic oligonucleotide
ggatacacccccgctttgtgcacacctggcctacaa

SEQ ID NO: 169507 - DNA, 35 bp, Artificial Sequence
  Synthetic oligonucleotide
acagtgaggtccgttgtcgtcatccaccccctcaa

SEQ ID NO: 169508 - DNA, 35 bp, Artificial Sequence
  Synthetic oligonucleotide
gacccgagtcacacgtttatactctctcttccgaa

SEQ ID NO: 169509 - DNA, 36 bp, Artificial Sequence
  Synthetic oligonucleotide
gcgccccctctcctcgatgatcaccagcccctcaca

SEQ ID NO: 169510 - DNA, 36 bp, Artificial Sequence
  Synthetic oligonucleotide
tgtactccattgcatatcccgcggtgctctttcaca

SEQ ID NO: 169511 - DNA, 35 bp, Artificial Sequence
  Synthetic oligonucleotide
atatgtccggcccgcccgacggtctcacttataca

SEQ ID NO: 169512 - DNA, 35 bp, Artificial Sequence
  Synthetic oligonucleotide
aacgtctcaccccagttctgcctcgtgtggttaca

SEQ ID NO: 169513 - DNA, 35 bp, Artificial Sequence
  Synthetic oligonucleotide
atccgcctccactatgcggtttccacactctccca

SEQ ID NO: 169514 - DNA, 36 bp, Artificial Sequence
  Synthetic oligonucleotide
gcacaccatgctgaactgttcctcctcgccgtccca

SEQ ID NO: 169515 - DNA, 36 bp, Artificial Sequence
  Synthetic oligonucleotide
gagtgatggcgaggggcgaacgagggaggagggcca

SEQ ID NO: 169516 - DNA, 36 bp, Artificial Sequence
  Synthetic oligonucleotide
ttgtcccttccgccatatgttaccattcctttagca

SEQ ID NO: 169517 - DNA, 36 bp, Artificial Sequence
  Synthetic oligonucleotide
gctactccacctcgccgccactgggctccacgcgca

SEQ ID NO: 169518 - DNA, 36 bp, Artificial Sequence
  Synthetic oligonucleotide
actgtcgctgcctatcgctgtaccatcgcatttgca

SEQ ID NO: 169519 - DNA, 36 bp, Artificial Sequence
  Synthetic oligonucleotide
gtctccacccgcctggttttctttgccggtttatca

SEQ ID NO: 169520 - DNA, 36 bp, Artificial Sequence
  Synthetic oligonucleotide
cgatgctgcgtttcatactttgtttagcacctctca

SEQ ID NO: 169521 - DNA, 36 bp, Artificial Sequence
  Synthetic oligonucleotide
tgcatactccggtcttgtcatcaaaaacacttctca

SEQ ID NO: 169522 - DNA, 37 bp, Artificial Sequence
  Synthetic oligonucleotide
gaagagagggtagagggaaggtacagtaatgagaaga

SEQ ID NO: 169523 - DNA, 37 bp, Artificial Sequence
  Synthetic oligonucleotide
atccgggagggaaaggaggggctataggttggccaga

SEQ ID NO: 169524 - DNA, 36 bp, Artificial Sequence
  Synthetic oligonucleotide
gtggtacgtataacgggggggaaagaaagggtgaga

SEQ ID NO: 169525 - DNA, 37 bp, Artificial Sequence
  Synthetic oligonucleotide
ggaggaggaggggagggataagtaaactcgtgataga

SEQ ID NO: 169526 - DNA, 36 bp, Artificial Sequence
  Synthetic oligonucleotide
tcctccgccccttcttgtacaccattgtgctttaga

SEQ ID NO: 169527 - DNA, 35 bp, Artificial Sequence
  Synthetic oligonucleotide
tgtcattcccccgccccagagtcaagcccgttcga

SEQ ID NO: 169528 - DNA, 35 bp, Artificial Sequence
  Synthetic oligonucleotide
gaagggaaggtaattggggggtgctcgagggagga

SEQ ID NO: 169529 - DNA, 37 bp, Artificial Sequence
  Synthetic oligonucleotide
gtaaggtaggaggaaggggtgagcgagcagaaaggga

SEQ ID NO: 169530 - DNA, 37 bp, Artificial Sequence
  Synthetic oligonucleotide
ccgaagggtaaacggggaataagggtggggaaaggga

SEQ ID NO: 169531 - DNA, 37 bp, Artificial Sequence
  Synthetic oligonucleotide
aaggagggtatcgacgggggaacgcaggatagaggga

SEQ ID NO: 169532 - DNA, 37 bp, Artificial Sequence
  Synthetic oligonucleotide
gtgggcggaagggacgggagggtagcccaactcggga

SEQ ID NO: 169533 - DNA, 37 bp, Artificial Sequence
  Synthetic oligonucleotide
tccccgttgcatgatccacacctccccctttatggga

SEQ ID NO: 169534 - DNA, 37 bp, Artificial Sequence
  Synthetic oligonucleotide
gtgaggggggagatgggcaggtgggaacggcgtggga

SEQ ID NO: 169535 - DNA, 37 bp, Artificial Sequence
  Synthetic oligonucleotide
gggagtaacgatagaaggacgtggagcgggggtggga

SEQ ID NO: 169536 - DNA, 38 bp, Artificial Sequence
  Synthetic oligonucleotide
accggcggtgtgaggggtgccatggcggagggacctga

SEQ ID NO: 169537 - DNA, 37 bp, Artificial Sequence
  Synthetic oligonucleotide
gtgtgcagccgcacattcgcctttcatcgctacctga

SEQ ID NO: 169538 - DNA, 37 bp, Artificial Sequence
  Synthetic oligonucleotide
accttccaccgccacttgaccccggacacagtcctga

SEQ ID NO: 169539 - DNA, 38 bp, Artificial Sequence
  Synthetic oligonucleotide
ttgccccggcttccatcgtattacccgttctgttctga

SEQ ID NO: 169540 - DNA, 35 bp, Artificial Sequence
  Synthetic oligonucleotide
gaccacttcccgctgacgtatccttccccctgtga

SEQ ID NO: 169541 - DNA, 38 bp, Artificial Sequence
  Synthetic oligonucleotide
tgatgggcggtgggtggaggctcggggagggtaattga

SEQ ID NO: 169542 - DNA, 37 bp, Artificial Sequence
  Synthetic oligonucleotide
ggagccctgcgtgcacccactccgccactttacttga

SEQ ID NO: 169543 - DNA, 37 bp, Artificial Sequence
  Synthetic oligonucleotide
gtcccgccgccttgacgtattatccctcatttcttga

SEQ ID NO: 169544 - DNA, 35 bp, Artificial Sequence
  Synthetic oligonucleotide
actccccctcgcgcccggttaactagcacgcaata

SEQ ID NO: 169545 - DNA, 35 bp, Artificial Sequence
  Synthetic oligonucleotide
gtgaagcgcagaagccctgcctcacccactgcata

SEQ ID NO: 169546 - DNA, 35 bp, Artificial Sequence
  Synthetic oligonucleotide
ccccacagcccgatctgcttcgtacgttctcccta

SEQ ID NO: 169547 - DNA, 35 bp, Artificial Sequence
  Synthetic oligonucleotide
gcctatccgcctcaccgcgttatgctctacccgta

SEQ ID NO: 169548 - DNA, 36 bp, Artificial Sequence
  Synthetic oligonucleotide
aaccctgtgcgtccgtcttccatgctgcctggctta

SEQ ID NO: 169549 - DNA, 35 bp, Artificial Sequence
  Synthetic oligonucleotide
tacgagacgcccctctccttgtggtgccattaaac

SEQ ID NO: 169550 - DNA, 35 bp, Artificial Sequence
  Synthetic oligonucleotide
tgaggcctcgcaagtgctaacttttccaccaacac

SEQ ID NO: 169551 - DNA, 35 bp, Artificial Sequence
  Synthetic oligonucleotide
ttcactcgaccctctatcgacaggctttgttccac

SEQ ID NO: 169552 - DNA, 35 bp, Artificial Sequence
  Synthetic oligonucleotide
gcgagcctccggtactcatcacatctccgcccgac

SEQ ID NO: 169553 - DNA, 34 bp, Artificial Sequence
  Synthetic oligonucleotide
gcagaccgccaccgcgtttggccccactctctac

SEQ ID NO: 169554 - DNA, 35 bp, Artificial Sequence
  Synthetic oligonucleotide
gtcgctgcccctcataatcccggtctattcccacc

SEQ ID NO: 169555 - DNA, 35 bp, Artificial Sequence
  Synthetic oligonucleotide
atactgcacatccacatctatgcctgcgctccacc

SEQ ID NO: 169556 - DNA, 35 bp, Artificial Sequence
  Synthetic oligonucleotide
acacctcaacgtgaactatcactaccctgccgacc

SEQ ID NO: 169557 - DNA, 35 bp, Artificial Sequence
  Synthetic oligonucleotide
tacacccatcttgcttccactccaggcgatatacc

SEQ ID NO: 169558 - DNA, 35 bp, Artificial Sequence
  Synthetic oligonucleotide
tcggttgccacagactcctgcccgcacaccacccc

SEQ ID NO: 169559 - DNA, 35 bp, Artificial Sequence
  Synthetic oligonucleotide
attcgcacgaatggactgcgcctctcgaacccccc

SEQ ID NO: 169560 - DNA, 35 bp, Artificial Sequence
  Synthetic oligonucleotide
tcaagtctcggccacgcggttccatcgatcccccc

SEQ ID NO: 169561 - DNA, 35 bp, Artificial Sequence
  Synthetic oligonucleotide
tagcccggtttcgcccctgatccacccgtgatccc

SEQ ID NO: 169562 - DNA, 34 bp, Artificial Sequence
  Synthetic oligonucleotide
acctccacccccgctctgtattcgttcgaatgcc

SEQ ID NO: 169563 - DNA, 35 bp, Artificial Sequence
  Synthetic oligonucleotide
gttcccccagaccctgctcgctccctgcccttgcc

SEQ ID NO: 169564 - DNA, 35 bp, Artificial Sequence
  Synthetic oligonucleotide
tatgccgcctcactttagcgccgctcatccttgcc

SEQ ID NO: 169565 - DNA, 35 bp, Artificial Sequence
  Synthetic oligonucleotide
tgccgaacccccgacttgccaccgagcattcctcc

SEQ ID NO: 169566 - DNA, 35 bp, Artificial Sequence
  Synthetic oligonucleotide
taacttaacgtgcaccgccccggtaccgaccttcc

SEQ ID NO: 169567 - DNA, 34 bp, Artificial Sequence
  Synthetic oligonucleotide
ttcgccgccacattgcttgttccatccgtcttcc

SEQ ID NO: 169568 - DNA, 35 bp, Artificial Sequence
  Synthetic oligonucleotide
ggggtggggccttggggggaggacaaagagacagc

SEQ ID NO: 169569 - DNA, 35 bp, Artificial Sequence
  Synthetic oligonucleotide
ttctcaccgcgattttagtctttcacgtccgccgc

SEQ ID NO: 169570 - DNA, 35 bp, Artificial Sequence
  Synthetic oligonucleotide
accccttgtatgaccttttgagccccgaccattgc

SEQ ID NO: 169571 - DNA, 35 bp, Artificial Sequence
  Synthetic oligonucleotide
aagcccccgggtcccgccacattgctctcccttgc

SEQ ID NO: 169572 - DNA, 35 bp, Artificial Sequence
  Synthetic oligonucleotide
gtgactcggcctttgaaatttgctgcccttatatc

SEQ ID NO: 169573 - DNA, 35 bp, Artificial Sequence
  Synthetic oligonucleotide
agcatgggtctgccttttactactgtcgccctatc

SEQ ID NO: 169574 - DNA, 35 bp, Artificial Sequence
  Synthetic oligonucleotide
gtgggccctccattcaaagtactcgttcatacctc

SEQ ID NO: 169575 - DNA, 35 bp, Artificial Sequence
  Synthetic oligonucleotide
tcctccaagttgcgttcttcgtcctgccatcgctc

SEQ ID NO: 169576 - DNA, 35 bp, Artificial Sequence
  Synthetic oligonucleotide
ttgaatatgccgtccttgcgctccatagccctctc

SEQ ID NO: 169577 - DNA, 35 bp, Artificial Sequence
  Synthetic oligonucleotide
tgcgcaccctctgcacccggttcacgaccatcgtc

SEQ ID NO: 169578 - DNA, 35 bp, Artificial Sequence
  Synthetic oligonucleotide
tcatccgcccttaattgtgggtcttttttcttgtc

SEQ ID NO: 169579 - DNA, 35 bp, Artificial Sequence
  Synthetic oligonucleotide
accattggcccgacttacggcttacgctccccttc

SEQ ID NO: 169580 - DNA, 35 bp, Artificial Sequence
  Synthetic oligonucleotide
gtgccgcacgcacgcttattcccgcctatctgttc

SEQ ID NO: 169581 - DNA, 35 bp, Artificial Sequence
  Synthetic oligonucleotide
gccgagcttcatccagtttgtccgcgtcctttttc

SEQ ID NO: 169582 - DNA, 35 bp, Artificial Sequence
  Synthetic oligonucleotide
tacacacacgtgctgttcgtttttgttccacccag

SEQ ID NO: 169583 - DNA, 35 bp, Artificial Sequence
  Synthetic oligonucleotide
gaggggtaatggggagaaggaaatgtaaggccgag

SEQ ID NO: 169584 - DNA, 35 bp, Artificial Sequence
  Synthetic oligonucleotide
tctgcgccgcctccccttaatcactgccccgtacg

SEQ ID NO: 169585 - DNA, 32 bp, Artificial Sequence
  Synthetic oligonucleotide
atgccgtgccctcttataacgcaacaatcccg

SEQ ID NO: 169586 - DNA, 35 bp, Artificial Sequence
  Synthetic oligonucleotide
aactcgccctgtgccctatcttgttgttattgccg

SEQ ID NO: 169587 - DNA, 35 bp, Artificial Sequence
  Synthetic oligonucleotide
gccttgcattcggactaacaatcgcctcccactcg

SEQ ID NO: 169588 - DNA, 34 bp, Artificial Sequence
  Synthetic oligonucleotide
gatatcaccccacctcagatccggcgaagcacgg

SEQ ID NO: 169589 - DNA, 35 bp, Artificial Sequence
  Synthetic oligonucleotide
tgaggggtattaactggggggccgatagcttgggg

SEQ ID NO: 169590 - DNA, 35 bp, Artificial Sequence
  Synthetic oligonucleotide
gacaccatccgaactatacccaaatgcacccatgg

SEQ ID NO: 169591 - DNA, 35 bp, Artificial Sequence
  Synthetic oligonucleotide
aatgtggtgggagatttagtggagggagggagtgg

SEQ ID NO: 169592 - DNA, 35 bp, Artificial Sequence
  Synthetic oligonucleotide
agaaccacgccgccctggttaccttcccctgactg

SEQ ID NO: 169593 - DNA, 35 bp, Artificial Sequence
  Synthetic oligonucleotide
tgagctacgagctcgtttgcttgaattcccccctg

SEQ ID NO: 169594 - DNA, 35 bp, Artificial Sequence
  Synthetic oligonucleotide
aacgaaatgggcgaggtgtggtgggtgatcgtctg

SEQ ID NO: 169595 - DNA, 35 bp, Artificial Sequence
  Synthetic oligonucleotide
gcggggttgggggccatggggtggtgcaggtggtg

SEQ ID NO: 169596 - DNA, 36 bp, Artificial Sequence
  Synthetic oligonucleotide
aactgaggagggggcctgaggggagtggagaccttg

SEQ ID NO: 169597 - DNA, 35 bp, Artificial Sequence
  Synthetic oligonucleotide
aaccctgcccactccacgttgactttcgtgctttg

SEQ ID NO: 169598 - DNA, 35 bp, Artificial Sequence
  Synthetic oligonucleotide
gttcgcaccaccatgcacgcccttggacacgccat

SEQ ID NO: 169599 - DNA, 35 bp, Artificial Sequence
  Synthetic oligonucleotide
tgctgccccctcacgtacagcgcgatacactctat

SEQ ID NO: 169600 - DNA, 35 bp, Artificial Sequence
  Synthetic oligonucleotide
gcgtaacgcccacacatcttgcacggagtctctat

SEQ ID NO: 169601 - DNA, 35 bp, Artificial Sequence
  Synthetic oligonucleotide
tgcatgcccagacccctatcccgactcgcaccact

SEQ ID NO: 169602 - DNA, 35 bp, Artificial Sequence
  Synthetic oligonucleotide
tagtgggcctcccgatgttagtttctactcgccct

SEQ ID NO: 169603 - DNA, 35 bp, Artificial Sequence
  Synthetic oligonucleotide
ttccgccaccgccacctccccatgaagccacgcct

SEQ ID NO: 169604 - DNA, 35 bp, Artificial Sequence
  Synthetic oligonucleotide
gttgaaccccgtctcgttactttgcgatgcatcct

SEQ ID NO: 169605 - DNA, 36 bp, Artificial Sequence
  Synthetic oligonucleotide
acccgcgccccctgcatacgtaacccctcctgtgct

SEQ ID NO: 169606 - DNA, 36 bp, Artificial Sequence
  Synthetic oligonucleotide
tccccgggcctccttatccacacccagttctgtgct

SEQ ID NO: 169607 - DNA, 35 bp, Artificial Sequence
  Synthetic oligonucleotide
tagtgctcacatcggcatcgccccgcgccccttct

SEQ ID NO: 169608 - DNA, 35 bp, Artificial Sequence
  Synthetic oligonucleotide
tcaaccgccccccgtgaaccccgtcagaggttggt

SEQ ID NO: 169609 - DNA, 35 bp, Artificial Sequence
  Synthetic oligonucleotide
gccctccacgaacgacactgcttcccccgctatgt

SEQ ID NO: 169610 - DNA, 35 bp, Artificial Sequence
  Synthetic oligonucleotide
gcctcaccatccggttcataacctcaaagcacctt

SEQ ID NO: 169611 - DNA, 35 bp, Artificial Sequence
  Synthetic oligonucleotide
tgcaatggtccgaacgccacctattactgtacctt

SEQ ID NO: 169612 - DNA, 34 bp, Artificial Sequence
  Synthetic oligonucleotide
gtgaaacgtgtgtcgcttgctagtcctcgccctt

SEQ ID NO: 169613 - DNA, 35 bp, Artificial Sequence
  Synthetic oligonucleotide
tttgcttgtgcagtcgcctttcagttcttgccctt

SEQ ID NO: 169614 - DNA, 35 bp, Artificial Sequence
  Synthetic oligonucleotide
acgttagtcgctcgccttgaccgtaccatcgcttt

SEQ ID NO: 169615 - DNA, 35 bp, Artificial Sequence
  Synthetic oligonucleotide
acgccgattcccccggcacgacttctgccccgttt

SEQ ID NO: 169616 - DNA, 35 bp, Artificial Sequence
  Synthetic oligonucleotide
attcccgccgattgcctgatttcctctctgctttt

SEQ ID NO: 169617 - DNA, 36 bp, Artificial Sequence
  Synthetic oligonucleotide
taggtggagaaaggaatggaagggggtaggtagaaa

SEQ ID NO: 169618 - DNA, 36 bp, Artificial Sequence
  Synthetic oligonucleotide
tgacaccggggggcgactagggaaaggggtaaacaa

SEQ ID NO: 169619 - DNA, 36 bp, Artificial Sequence
  Synthetic oligonucleotide
atccactccatcctacaatagtacttgtcgtgacaa

SEQ ID NO: 169620 - DNA, 36 bp, Artificial Sequence
  Synthetic oligonucleotide
gacaccccccctcatgctgccgacggttactcccaa

SEQ ID NO: 169621 - DNA, 36 bp, Artificial Sequence
  Synthetic oligonucleotide
tttgtcccgtgttcctcccaccgtctcgcctggcaa

SEQ ID NO: 169622 - DNA, 36 bp, Artificial Sequence
  Synthetic oligonucleotide
gtgaggggaggaatttcgggggaggagtcgagtcaa

SEQ ID NO: 169623 - DNA, 36 bp, Artificial Sequence
  Synthetic oligonucleotide
taccgggcggggaagggagggaagggtgtgtaggaa

SEQ ID NO: 169624 - DNA, 37 bp, Artificial Sequence
  Synthetic oligonucleotide
gaagggggatgggggggatggaggagtaacgtgataa

SEQ ID NO: 169625 - DNA, 36 bp, Artificial Sequence
  Synthetic oligonucleotide
gtacaccccccctagcggtaacagacgcgcttaaca

SEQ ID NO: 169626 - DNA, 36 bp, Artificial Sequence
  Synthetic oligonucleotide
gaccgtctcgtctgccagcccgtcgcttctctcaca

SEQ ID NO: 169627 - DNA, 36 bp, Artificial Sequence
  Synthetic oligonucleotide
tagttcgcccccctcgtacattcgccttagcttaca

SEQ ID NO: 169628 - DNA, 36 bp, Artificial Sequence
  Synthetic oligonucleotide
tgcacctcgccgtctcaccgtaaaatcgccccacca

SEQ ID NO: 169629 - DNA, 35 bp, Artificial Sequence
  Synthetic oligonucleotide
ttacgccaacaccatcccctcacatgcttatacca

SEQ ID NO: 169630 - DNA, 36 bp, Artificial Sequence
  Synthetic oligonucleotide
aaaccagccgctgtcctctcacattgttacgcccca

SEQ ID NO: 169631 - DNA, 35 bp, Artificial Sequence
  Synthetic oligonucleotide
aaccacgactagcccctcccgtggcctccgcccca

SEQ ID NO: 169632 - DNA, 36 bp, Artificial Sequence
  Synthetic oligonucleotide
gcccccctcggatattgcacggcgcctcgatcccca

SEQ ID NO: 169633 - DNA, 36 bp, Artificial Sequence
  Synthetic oligonucleotide
gcgaagtcgcagccatccctgcctcggacctcccca

SEQ ID NO: 169634 - DNA, 36 bp, Artificial Sequence
  Synthetic oligonucleotide
gctcatgccgacgttccgattcgtcccttctgccca

SEQ ID NO: 169635 - DNA, 35 bp, Artificial Sequence
  Synthetic oligonucleotide
agacgcctacgcataaccgtgtacctcccctccca

SEQ ID NO: 169636 - DNA, 36 bp, Artificial Sequence
  Synthetic oligonucleotide
ctgctcccttcctccgctcaatcagtacaacggcca

SEQ ID NO: 169637 - DNA, 36 bp, Artificial Sequence
  Synthetic oligonucleotide
tgctcccttccgacactcacacttcgcccgatgcca

SEQ ID NO: 169638 - DNA, 35 bp, Artificial Sequence
  Synthetic oligonucleotide
tccgccgtttccgttggccccatacactaccggca

SEQ ID NO: 169639 - DNA, 36 bp, Artificial Sequence
  Synthetic oligonucleotide
tcccagcctgcgatgctttccgctgccatctaatca

SEQ ID NO: 169640 - DNA, 35 bp, Artificial Sequence
  Synthetic oligonucleotide
gctcgcccctccgctatagctggacctagtggtca

SEQ ID NO: 169641 - DNA, 36 bp, Artificial Sequence
  Synthetic oligonucleotide
tcacccgatcagacatcctaggtccagcctccttca

SEQ ID NO: 169642 - DNA, 36 bp, Artificial Sequence
  Synthetic oligonucleotide
gcacgggaccgcttcggggggggagagggactttca

SEQ ID NO: 169643 - DNA, 37 bp, Artificial Sequence
  Synthetic oligonucleotide
gagagggaaactagtgtggggcggcaggggggggaga

SEQ ID NO: 169644 - DNA, 37 bp, Artificial Sequence
  Synthetic oligonucleotide
aacgatagcaagcggaggggctatgggggggttgaga

SEQ ID NO: 169645 - DNA, 37 bp, Artificial Sequence
  Synthetic oligonucleotide
acgtctaacccctgccgttgcccctcccgtccataga

SEQ ID NO: 169646 - DNA, 35 bp, Artificial Sequence
  Synthetic oligonucleotide
aaatggatggggggcgggtaacaggggcccgtaga

SEQ ID NO: 169647 - DNA, 37 bp, Artificial Sequence
  Synthetic oligonucleotide
tgccactggacggggagggcagggtgggtaaaaccga

SEQ ID NO: 169648 - DNA, 37 bp, Artificial Sequence
  Synthetic oligonucleotide
attgcctcgcattggttcacgccctcagtcaccccga

SEQ ID NO: 169649 - DNA, 36 bp, Artificial Sequence
  Synthetic oligonucleotide
gcctctcacgcaccattaagcctgccctcacgccga

SEQ ID NO: 169650 - DNA, 37 bp, Artificial Sequence
  Synthetic oligonucleotide
actcatctgcccgcacgtctcatatctgcacctccga

SEQ ID NO: 169651 - DNA, 37 bp, Artificial Sequence
  Synthetic oligonucleotide
tgcactcagtcgcttcctgttcattgttccctgtcga

SEQ ID NO: 169652 - DNA, 37 bp, Artificial Sequence
  Synthetic oligonucleotide
tccgacacccccaccccaagtagcctagccggttcga

SEQ ID NO: 169653 - DNA, 37 bp, Artificial Sequence
  Synthetic oligonucleotide
gaattgagggggaagggggtatgaggcggtctgagga

SEQ ID NO: 169654 - DNA, 37 bp, Artificial Sequence
  Synthetic oligonucleotide
gccgcaacacaactgctttgaaacccacccacgcgga

SEQ ID NO: 169655 - DNA, 36 bp, Artificial Sequence
  Synthetic oligonucleotide
acgaccaccccccttccgaccgacgtagtccgcgga

SEQ ID NO: 169656 - DNA, 37 bp, Artificial Sequence
  Synthetic oligonucleotide
acgacggggggaggctctttggggcacggtgggcgga

SEQ ID NO: 169657 - DNA, 36 bp, Artificial Sequence
  Synthetic oligonucleotide
tccatccttccacgcacctgtagtcgctctcgggga

SEQ ID NO: 169658 - DNA, 37 bp, Artificial Sequence
  Synthetic oligonucleotide
tgtttgctctccgccaccgattcgccactccattgga

SEQ ID NO: 169659 - DNA, 38 bp, Artificial Sequence
  Synthetic oligonucleotide
tcagccactgccgcgctcccccctagactgcccgatga

SEQ ID NO: 169660 - DNA, 37 bp, Artificial Sequence
  Synthetic oligonucleotide
gctcgtgttgcgtaattaccctgcctccgtacactga

SEQ ID NO: 169661 - DNA, 38 bp, Artificial Sequence
  Synthetic oligonucleotide
tccaccgcccgactgcgccctgttttactactcactga

SEQ ID NO: 169662 - DNA, 38 bp, Artificial Sequence
  Synthetic oligonucleotide
taatgcacccctcaatccgtagtaccattcccgcctga

SEQ ID NO: 169663 - DNA, 38 bp, Artificial Sequence
  Synthetic oligonucleotide
tgaccgtacgactgcgcccccttaccttctcttcctga

SEQ ID NO: 169664 - DNA, 38 bp, Artificial Sequence
  Synthetic oligonucleotide
gaaacccccgcccttcgctaagtatagtcacttggtga

SEQ ID NO: 169665 - DNA, 38 bp, Artificial Sequence
  Synthetic oligonucleotide
attggcccctcgaagtcgtaacacctctccccctgtga

SEQ ID NO: 169666 - DNA, 36 bp, Artificial Sequence
  Synthetic oligonucleotide
tccccatgctacactctggctttggttccatcaata

SEQ ID NO: 169667 - DNA, 36 bp, Artificial Sequence
  Synthetic oligonucleotide
ggtcaggaaagggtagagcaggagcggcgggtaata

SEQ ID NO: 169668 - DNA, 36 bp, Artificial Sequence
  Synthetic oligonucleotide
accagggggaacaacgggaagggaggggcacacata

SEQ ID NO: 169669 - DNA, 36 bp, Artificial Sequence
  Synthetic oligonucleotide
tgtcctcgcctcccatggaccttctcatacaaccta

SEQ ID NO: 169670 - DNA, 36 bp, Artificial Sequence
  Synthetic oligonucleotide
ttccgccgcctcacaggttgacttgcccgtgtccta

SEQ ID NO: 169671 - DNA, 36 bp, Artificial Sequence
  Synthetic oligonucleotide
gtgactaccgcctgctatctccatccttttttgcta

SEQ ID NO: 169672 - DNA, 35 bp, Artificial Sequence
  Synthetic oligonucleotide
tagtacacgcagagtctatcgacccgccgcctcta

SEQ ID NO: 169673 - DNA, 36 bp, Artificial Sequence
  Synthetic oligonucleotide
tgcacctgttggatccgttacccaccctcccgtcta

SEQ ID NO: 169674 - DNA, 35 bp, Artificial Sequence
  Synthetic oligonucleotide
gtagaccggccactacttctcctgctcctcctgta

SEQ ID NO: 169675 - DNA, 35 bp, Artificial Sequence
  Synthetic oligonucleotide
tattcgcacctcgccactgttcatcggcctctgta

SEQ ID NO: 169676 - DNA, 36 bp, Artificial Sequence
  Synthetic oligonucleotide
gcatcgatcacggcgggtgatgggaggggggcatta

SEQ ID NO: 169677 - DNA, 36 bp, Artificial Sequence
  Synthetic oligonucleotide
gcgaaccgtgatccgcgttcattctacccgccctta

SEQ ID NO: 169678 - DNA, 35 bp, Artificial Sequence
  Synthetic oligonucleotide
aaacccgcctccgtatatacttcacgccttgctta

SEQ ID NO: 169679 - DNA, 36 bp, Artificial Sequence
  Synthetic oligonucleotide
ggtcgcaccggcacctgatttactatcgcctcgtta

SEQ ID NO: 169680 - DNA, 36 bp, Artificial Sequence
  Synthetic oligonucleotide
ggagtgagcgtgagtaggggggggcgggatttgtta

SEQ ID NO: 169681 - DNA, 35 bp, Artificial Sequence
  Synthetic oligonucleotide
acttcacctccagaggccatttatccacttcaaac

SEQ ID NO: 169682 - DNA, 35 bp, Artificial Sequence
  Synthetic oligonucleotide
aacatgacaacctccgctctgctactcatgacgac

SEQ ID NO: 169683 - DNA, 35 bp, Artificial Sequence
  Synthetic oligonucleotide
tacaccacgtgttccatttgccggtcatttcatac

SEQ ID NO: 169684 - DNA, 35 bp, Artificial Sequence
  Synthetic oligonucleotide
gaccggtgtaggcagtgcacgtcccccttccctac

SEQ ID NO: 169685 - DNA, 35 bp, Artificial Sequence
  Synthetic oligonucleotide
tcaccatcttccgcgttgtcttatcgcccggttac

SEQ ID NO: 169686 - DNA, 35 bp, Artificial Sequence
  Synthetic oligonucleotide
tatcacactccatgagacagccagcccctccgacc

SEQ ID NO: 169687 - DNA, 35 bp, Artificial Sequence
  Synthetic oligonucleotide
gccctggacccgtgcccggttttgccttactgacc

SEQ ID NO: 169688 - DNA, 35 bp, Artificial Sequence
  Synthetic oligonucleotide
atgccccctctcctagatcccattagtgaagcccc

SEQ ID NO: 169689 - DNA, 35 bp, Artificial Sequence
  Synthetic oligonucleotide
atcacggtcctcccacgctccccctgcccgagccc

SEQ ID NO: 169690 - DNA, 36 bp, Artificial Sequence
  Synthetic oligonucleotide
tgctgcccccctgctgttgcgaccttccattgtccc

SEQ ID NO: 169691 - DNA, 35 bp, Artificial Sequence
  Synthetic oligonucleotide
tcacctcacacccgtggttcataggaggtattccc

SEQ ID NO: 169692 - DNA, 30 bp, Artificial Sequence
  Synthetic oligonucleotide
tcctcccgccccaccggtcgctcttgagcc

SEQ ID NO: 169693 - DNA, 35 bp, Artificial Sequence
  Synthetic oligonucleotide
tactaccgcaacctcacctgcaccgaaggagcgcc

SEQ ID NO: 169694 - DNA, 35 bp, Artificial Sequence
  Synthetic oligonucleotide
gttgtgcctacgttcgtggtcttctgtttctcgcc

SEQ ID NO: 169695 - DNA, 35 bp, Artificial Sequence
  Synthetic oligonucleotide
tgcatcgaccctgcccctgccgctcccagatggcc

SEQ ID NO: 169696 - DNA, 35 bp, Artificial Sequence
  Synthetic oligonucleotide
tcaccatccatttagtgctaattaacgaacgctcc

SEQ ID NO: 169697 - DNA, 35 bp, Artificial Sequence
  Synthetic oligonucleotide
ggtccggacctcacttgctttcgtgctcgctacgc

SEQ ID NO: 169698 - DNA, 35 bp, Artificial Sequence
  Synthetic oligonucleotide
tagacgcgattcagtcctttctcccctagctccgc

SEQ ID NO: 169699 - DNA, 35 bp, Artificial Sequence
  Synthetic oligonucleotide
gccaccgcccttcctgaataatggcatcgactcgc

SEQ ID NO: 169700 - DNA, 35 bp, Artificial Sequence
  Synthetic oligonucleotide
tacgccccttcgcattgtgcaacactccttcgggc

SEQ ID NO: 169701 - DNA, 35 bp, Artificial Sequence
  Synthetic oligonucleotide
tgaccctccaccgttcccttggttctccagcctgc

SEQ ID NO: 169702 - DNA, 35 bp, Artificial Sequence
  Synthetic oligonucleotide
agatgacacctccctgcctataattaggaaattgc

SEQ ID NO: 169703 - DNA, 35 bp, Artificial Sequence
  Synthetic oligonucleotide
gaagacgcacatatttttctgatcctcgcaacatc

SEQ ID NO: 169704 - DNA, 35 bp, Artificial Sequence
  Synthetic oligonucleotide
atgacctgccttatccgcccgtttttgatcacatc

SEQ ID NO: 169705 - DNA, 35 bp, Artificial Sequence
  Synthetic oligonucleotide
ggagacagcacagagtttaacccgttcaccccttc

SEQ ID NO: 169706 - DNA, 35 bp, Artificial Sequence
  Synthetic oligonucleotide
gaatacggtccagtgagacctatgcacctcccttc

SEQ ID NO: 169707 - DNA, 35 bp, Artificial Sequence
  Synthetic oligonucleotide
tgacgctcttcgccacgctgcacccattgctgttc

SEQ ID NO: 169708 - DNA, 34 bp, Artificial Sequence
  Synthetic oligonucleotide
tcacaccgcaacacctttgattccctttcactag

SEQ ID NO: 169709 - DNA, 35 bp, Artificial Sequence
  Synthetic oligonucleotide
tctgcacgcactgcgctgtcccccgaccctccacg

SEQ ID NO: 169710 - DNA, 35 bp, Artificial Sequence
  Synthetic oligonucleotide
gatgggggcagtagggtagtgggtcgggtaatccg

SEQ ID NO: 169711 - DNA, 35 bp, Artificial Sequence
  Synthetic oligonucleotide
gctccttaccgactgtttttcgtatctcctccgcg

SEQ ID NO: 169712 - DNA, 35 bp, Artificial Sequence
  Synthetic oligonucleotide
ggtgaggagtgggagaacacaacggggagctaagg

SEQ ID NO: 169713 - DNA, 35 bp, Artificial Sequence
  Synthetic oligonucleotide
ttgtggaaagtgaaggtcggagggggaagagtagg

SEQ ID NO: 169714 - DNA, 35 bp, Artificial Sequence
  Synthetic oligonucleotide
gaaccccgcacagcatccgctatcaagcgcccctg

SEQ ID NO: 169715 - DNA, 35 bp, Artificial Sequence
  Synthetic oligonucleotide
attgtgtcccatgcttccctcgctccttaggtctg

SEQ ID NO: 169716 - DNA, 35 bp, Artificial Sequence
  Synthetic oligonucleotide
accgcccctgttcgtccttgctcaaccactcagtg

SEQ ID NO: 169717 - DNA, 35 bp, Artificial Sequence
  Synthetic oligonucleotide
aatggaatcacagcacaaccactcgttccctgttg

SEQ ID NO: 169718 - DNA, 35 bp, Artificial Sequence
  Synthetic oligonucleotide
tgggcctctgcctgggcattctggccacctcctat

SEQ ID NO: 169719 - DNA, 35 bp, Artificial Sequence
  Synthetic oligonucleotide
tcccccccggtgatttgggctttcccgccgtacct

SEQ ID NO: 169720 - DNA, 35 bp, Artificial Sequence
  Synthetic oligonucleotide
tttcgccacccctcctgctcgcagcacactaggct

SEQ ID NO: 169721 - DNA, 35 bp, Artificial Sequence
  Synthetic oligonucleotide
gcctccggcgtgaggggatttgttccatccctgct

SEQ ID NO: 169722 - DNA, 35 bp, Artificial Sequence
  Synthetic oligonucleotide
gtggagggagggtcacggggcgattgggaagtgct

SEQ ID NO: 169723 - DNA, 35 bp, Artificial Sequence
  Synthetic oligonucleotide
tctaccccaccagatgcgtcggttcctgcgcctct

SEQ ID NO: 169724 - DNA, 35 bp, Artificial Sequence
  Synthetic oligonucleotide
tcgcatggggggcgggaagaacaggcgggcgcggt

SEQ ID NO: 169725 - DNA, 35 bp, Artificial Sequence
  Synthetic oligonucleotide
gttcccgccttccttcctatcgtcctgcccgtggt

SEQ ID NO: 169726 - DNA, 35 bp, Artificial Sequence
  Synthetic oligonucleotide
gctggatccggatgggatcggcctttctcctctgt

SEQ ID NO: 169727 - DNA, 35 bp, Artificial Sequence
  Synthetic oligonucleotide
accccccgcaaccaaactgaccttgggttcccctt

SEQ ID NO: 169728 - DNA, 35 bp, Artificial Sequence
  Synthetic oligonucleotide
acctcacagggcacaaagtctataccctgctcctt

SEQ ID NO: 169729 - DNA, 35 bp, Artificial Sequence
  Synthetic oligonucleotide
tgcatgttgggcgggtcgcgtatgtatggtggctt

SEQ ID NO: 169730 - DNA, 35 bp, Artificial Sequence
  Synthetic oligonucleotide
tccaggcacgcatcccccctcctcttgtgccggtt

SEQ ID NO: 169731 - DNA, 35 bp, Artificial Sequence
  Synthetic oligonucleotide
gagacgggtcaagggtggggcttagggcaaggttt

SEQ ID NO: 169732 - DNA, 35 bp, Artificial Sequence
  Synthetic oligonucleotide
atccatccgtaccattccgcgcgtgtcacctccaa

SEQ ID NO: 169733 - DNA, 36 bp, Artificial Sequence
  Synthetic oligonucleotide
tcgatcggccatctgcgtcctcatctgcacctggaa

SEQ ID NO: 169734 - DNA, 36 bp, Artificial Sequence
  Synthetic oligonucleotide
tgccatacgccatcattcgctgtaactcttctctaa

SEQ ID NO: 169735 - DNA, 36 bp, Artificial Sequence
  Synthetic oligonucleotide
tgccgtccccggttccgtgacctcccccccttttaa

SEQ ID NO: 169736 - DNA, 35 bp, Artificial Sequence
  Synthetic oligonucleotide
tgcaccgatcgcccgcgtgccatggctctcacaca

SEQ ID NO: 169737 - DNA, 36 bp, Artificial Sequence
  Synthetic oligonucleotide
tgcatcctccccgattgatcctttaatgacctcaca

SEQ ID NO: 169738 - DNA, 35 bp, Artificial Sequence
  Synthetic oligonucleotide
agtggccgctgacctaccgcccattgactcttaca

SEQ ID NO: 169739 - DNA, 37 bp, Artificial Sequence
  Synthetic oligonucleotide
agcaccaacctccctgttcatacgtgaccagccacca

SEQ ID NO: 169740 - DNA, 36 bp, Artificial Sequence
  Synthetic oligonucleotide
ccaccctccaccgcccagagttctcacgctcaccca

SEQ ID NO: 169741 - DNA, 36 bp, Artificial Sequence
  Synthetic oligonucleotide
gcctgtccgcatataaagtccggtccgttctcccca

SEQ ID NO: 169742 - DNA, 36 bp, Artificial Sequence
  Synthetic oligonucleotide
tagtcccctaccaccgctgtctatatcctgcgagca

SEQ ID NO: 169743 - DNA, 36 bp, Artificial Sequence
  Synthetic oligonucleotide
gtcccaccccgcgcgatcaatgtctcaggctatgca

SEQ ID NO: 169744 - DNA, 36 bp, Artificial Sequence
  Synthetic oligonucleotide
gcgatactcccgcccccgtgttctggccaatcatca

SEQ ID NO: 169745 - DNA, 34 bp, Artificial Sequence
  Synthetic oligonucleotide
taacgcccgagcgtgaaacacccttccaccctca

SEQ ID NO: 169746 - DNA, 35 bp, Artificial Sequence
  Synthetic oligonucleotide
gcttgccgtccgttccgttcgtccaccgtctttca

SEQ ID NO: 169747 - DNA, 36 bp, Artificial Sequence
  Synthetic oligonucleotide
ttgccacatcatgccgggcatcatcgagttctttca

SEQ ID NO: 169748 - DNA, 37 bp, Artificial Sequence
  Synthetic oligonucleotide
ttacacgacagtagacgcgagaggagggggggagaga

SEQ ID NO: 169749 - DNA, 36 bp, Artificial Sequence
  Synthetic oligonucleotide
tgacacagggaggagtgggggggagcgggtgggaga

SEQ ID NO: 169750 - DNA, 37 bp, Artificial Sequence
  Synthetic oligonucleotide
tacaaggtgaggtaggacgggagggcggatagaacga

SEQ ID NO: 169751 - DNA, 37 bp, Artificial Sequence
  Synthetic oligonucleotide
aatgcggaggcatggtgggagggcgggcgcagtacga

SEQ ID NO: 169752 - DNA, 36 bp, Artificial Sequence
  Synthetic oligonucleotide
gcttcccgccctctctactgcactgatctgccccga

SEQ ID NO: 169753 - DNA, 37 bp, Artificial Sequence
  Synthetic oligonucleotide
gatgggggggagggttggggatctgtcagttgcgcga

SEQ ID NO: 169754 - DNA, 37 bp, Artificial Sequence
  Synthetic oligonucleotide
gcccaccgccgccctttcaagccgactccactggcga

SEQ ID NO: 169755 - DNA, 37 bp, Artificial Sequence
  Synthetic oligonucleotide
gtgaccaccggtgccccgactcctccatgtttttcga

SEQ ID NO: 169756 - DNA, 37 bp, Artificial Sequence
  Synthetic oligonucleotide
acgaagggtgagaactggtgaaaatgcgggagaagga

SEQ ID NO: 169757 - DNA, 37 bp, Artificial Sequence
  Synthetic oligonucleotide
gatccgtggggagggtgggtgttgagtctgaacggga

SEQ ID NO: 169758 - DNA, 37 bp, Artificial Sequence
  Synthetic oligonucleotide
gtacggggaggtgagtgggcggtagaggttcggggga

SEQ ID NO: 169759 - DNA, 37 bp, Artificial Sequence
  Synthetic oligonucleotide
agatccatcggggggaggaggaaatgtcgggtgggga

SEQ ID NO: 169760 - DNA, 37 bp, Artificial Sequence
  Synthetic oligonucleotide
ccgaacctcctgctattatccccgctccaccatggga

SEQ ID NO: 169761 - DNA, 37 bp, Artificial Sequence
  Synthetic oligonucleotide
accgctcgcccgccgcgctagccatgacctacctgga

SEQ ID NO: 169762 - DNA, 38 bp, Artificial Sequence
  Synthetic oligonucleotide
gtagggcggaaagggtagcggtatgccggggggaatga

SEQ ID NO: 169763 - DNA, 38 bp, Artificial Sequence
  Synthetic oligonucleotide
aggttggaggtggggcggtggtggtgacccggaactga

SEQ ID NO: 169764 - DNA, 37 bp, Artificial Sequence
  Synthetic oligonucleotide
ttgtgggggtggatgaacaagcggcgggagggactga

SEQ ID NO: 169765 - DNA, 38 bp, Artificial Sequence
  Synthetic oligonucleotide
tatgccctatcttgtgcccgtacgtgccgttcccctga

SEQ ID NO: 169766 - DNA, 37 bp, Artificial Sequence
  Synthetic oligonucleotide
tctgaccgcatcacttggctctcttttcgttccctga

SEQ ID NO: 169767 - DNA, 36 bp, Artificial Sequence
  Synthetic oligonucleotide
taccaatgcccccacacagtgtctcacacctcctga

SEQ ID NO: 169768 - DNA, 37 bp, Artificial Sequence
  Synthetic oligonucleotide
aacggggggtggggaggtcagggcaggatccgagtga

SEQ ID NO: 169769 - DNA, 38 bp, Artificial Sequence
  Synthetic oligonucleotide
gtcgatcactgtgccctcgctttgtcccctccctgtga

SEQ ID NO: 169770 - DNA, 38 bp, Artificial Sequence
  Synthetic oligonucleotide
tcctcaccctgccgcacgctctatctagcagcccttga

SEQ ID NO: 169771 - DNA, 38 bp, Artificial Sequence
  Synthetic oligonucleotide
gactgatgtggatgtcccgttcctgcccaccatgttga

SEQ ID NO: 169772 - DNA, 37 bp, Artificial Sequence
  Synthetic oligonucleotide
ggaggtggtggggtgtacttatggcggtacctgttga

SEQ ID NO: 169773 - DNA, 38 bp, Artificial Sequence
  Synthetic oligonucleotide
acacgccggcctttcatcgtttacccgaacttctttga

SEQ ID NO: 169774 - DNA, 35 bp, Artificial Sequence
  Synthetic oligonucleotide
tgaccgttacaccccccgcgtttgtagacttttga

SEQ ID NO: 169775 - DNA, 36 bp, Artificial Sequence
  Synthetic oligonucleotide
gtcgtcatgcccgcacgttgcgcccccccgttttga

SEQ ID NO: 169776 - DNA, 36 bp, Artificial Sequence
  Synthetic oligonucleotide
acttgcggccctgcccacccgctcgtatgccacata

SEQ ID NO: 169777 - DNA, 35 bp, Artificial Sequence
  Synthetic oligonucleotide
gaactgtcctctcctgccacatcgcgccgatcata

SEQ ID NO: 169778 - DNA, 36 bp, Artificial Sequence
  Synthetic oligonucleotide
gcaacggccggaggggtaacggggtagggagggata

SEQ ID NO: 169779 - DNA, 37 bp, Artificial Sequence
  Synthetic oligonucleotide
gcgtggtagccgctctgttccgtccccgcttcccgta

SEQ ID NO: 169780 - DNA, 36 bp, Artificial Sequence
  Synthetic oligonucleotide
gacactccccctttcgccacccccgcccagtgggta

SEQ ID NO: 169781 - DNA, 36 bp, Artificial Sequence
  Synthetic oligonucleotide
actattcccctcgcccccattgatggtactgtggta

SEQ ID NO: 169782 - DNA, 35 bp, Artificial Sequence
  Synthetic oligonucleotide
atgacgccttattgatctggcttccctcccttgta

SEQ ID NO: 169783 - DNA, 36 bp, Artificial Sequence
  Synthetic oligonucleotide
gagacgggatcaccgccgccgcctgttttcacctta

SEQ ID NO: 169784 - DNA, 35 bp, Artificial Sequence
  Synthetic oligonucleotide
gcaaaatgatgtgccgctcgtccttatccccgtta

SEQ ID NO: 169785 - DNA, 36 bp, Artificial Sequence
  Synthetic oligonucleotide
gaacacctgggtgggtttagcaggaagggcgggtta

SEQ ID NO: 169786 - DNA, 35 bp, Artificial Sequence
  Synthetic oligonucleotide
actccgccccaccgaatcagtagccacatcaaaac

SEQ ID NO: 169787 - DNA, 35 bp, Artificial Sequence
  Synthetic oligonucleotide
aaattcccgcccccgacgctcctgaccgtgttaac

SEQ ID NO: 169788 - DNA, 35 bp, Artificial Sequence
  Synthetic oligonucleotide
atctgactgccacatacttccattacgttcgccac

SEQ ID NO: 169789 - DNA, 35 bp, Artificial Sequence
  Synthetic oligonucleotide
gactcccgcactgcctaacccttgccttaacagac

SEQ ID NO: 169790 - DNA, 35 bp, Artificial Sequence
  Synthetic oligonucleotide
ttgcgtctcggtctgcctggtcgcttattgtcccc

SEQ ID NO: 169791 - DNA, 35 bp, Artificial Sequence
  Synthetic oligonucleotide
gtggggtgggggtgcacacacgggggttatcgccc

SEQ ID NO: 169792 - DNA, 35 bp, Artificial Sequence
  Synthetic oligonucleotide
agatctgccgtctaatcgtcccatgctgttcgccc

SEQ ID NO: 169793 - DNA, 35 bp, Artificial Sequence
  Synthetic oligonucleotide
gcgttgtcccacgtcctctttttcagctcttgccc

SEQ ID NO: 169794 - DNA, 35 bp, Artificial Sequence
  Synthetic oligonucleotide
atgagctcactccgccgctattggtgcctgctccc

SEQ ID NO: 169795 - DNA, 35 bp, Artificial Sequence
  Synthetic oligonucleotide
tcacccgcccccttgtagtcttcataagctctccc

SEQ ID NO: 169796 - DNA, 35 bp, Artificial Sequence
  Synthetic oligonucleotide
gccccggtatctcgctccccaccaatcgccccgcc

SEQ ID NO: 169797 - DNA, 35 bp, Artificial Sequence
  Synthetic oligonucleotide
gtgcccttcgcctccttcctccgtccatcgccgcc

SEQ ID NO: 169798 - DNA, 35 bp, Artificial Sequence
  Synthetic oligonucleotide
acaccacctcaccatctgtgcctcttaccctggcc

SEQ ID NO: 169799 - DNA, 35 bp, Artificial Sequence
  Synthetic oligonucleotide
tacgcaaccccagttcgttgggtgatccaccctcc

SEQ ID NO: 169800 - DNA, 27 bp, Artificial Sequence
  Synthetic oligonucleotide
aggttatctgccccgccactggcctcc

SEQ ID NO: 169801 - DNA, 35 bp, Artificial Sequence
  Synthetic oligonucleotide
gtccccgaacggtcatccgcttcgacccatcctcc

SEQ ID NO: 169802 - DNA, 35 bp, Artificial Sequence
  Synthetic oligonucleotide
taaggccctccccgcccggaagcctccgaatctcc

SEQ ID NO: 169803 - DNA, 35 bp, Artificial Sequence
  Synthetic oligonucleotide
tccatggcactcgtttgattccttcccacgtctcc

SEQ ID NO: 169804 - DNA, 35 bp, Artificial Sequence
  Synthetic oligonucleotide
tcgcgaaccgctgtgcttaccaacttactgtctcc

SEQ ID NO: 169805 - DNA, 35 bp, Artificial Sequence
  Synthetic oligonucleotide
tgtacttctgcattgtccctgcttgttcaccttcc

SEQ ID NO: 169806 - DNA, 34 bp, Artificial Sequence
  Synthetic oligonucleotide
taacactcccccccccgtatgcactgtctgttcc

SEQ ID NO: 169807 - DNA, 35 bp, Artificial Sequence
  Synthetic oligonucleotide
agcccacaaccgaatccggtcattagacccaccgc

SEQ ID NO: 169808 - DNA, 35 bp, Artificial Sequence
  Synthetic oligonucleotide
gagcagccccgaccgttcatacacgcacacttcgc

SEQ ID NO: 169809 - DNA, 35 bp, Artificial Sequence
  Synthetic oligonucleotide
tgtttacggcccatgccttctgttgcccgcttcgc

SEQ ID NO: 169810 - DNA, 35 bp, Artificial Sequence
  Synthetic oligonucleotide
agtcccgcccccagccctagcattttttagtaatc

SEQ ID NO: 169811 - DNA, 35 bp, Artificial Sequence
  Synthetic oligonucleotide
cacccccgcccaggtcgcccttgccccagaatatc

SEQ ID NO: 169812 - DNA, 35 bp, Artificial Sequence
  Synthetic oligonucleotide
gcctgctccctcccatgcatggacgctacttcctc

SEQ ID NO: 169813 - DNA, 35 bp, Artificial Sequence
  Synthetic oligonucleotide
ttcttatcaactctgccccgacgcctgctggtctc

SEQ ID NO: 169814 - DNA, 36 bp, Artificial Sequence
  Synthetic oligonucleotide
gaccccccccccgcaccccagagtggatcacttctc

SEQ ID NO: 169815 - DNA, 35 bp, Artificial Sequence
  Synthetic oligonucleotide
acctcgagtccccatcgcgctgttcccatctcgtc

SEQ ID NO: 169816 - DNA, 35 bp, Artificial Sequence
  Synthetic oligonucleotide
gtgatcgcccccccgctactgtcgaatcctatgtc

SEQ ID NO: 169817 - DNA, 35 bp, Artificial Sequence
  Synthetic oligonucleotide
catactgacgcttgcatcctcacttgatcgccttc

SEQ ID NO: 169818 - DNA, 35 bp, Artificial Sequence
  Synthetic oligonucleotide
ccaccatcagtatgttcatttgtccgtcgccgttc

SEQ ID NO: 169819 - DNA, 35 bp, Artificial Sequence
  Synthetic oligonucleotide
gaattcggtggttatggtgggggggaggcggagag

SEQ ID NO: 169820 - DNA, 35 bp, Artificial Sequence
  Synthetic oligonucleotide
gttgggaggggccgggaggtaggaggggtcatgcg

SEQ ID NO: 169821 - DNA, 34 bp, Artificial Sequence
  Synthetic oligonucleotide
agcgtgtcagtacccccgtccttcgtcactatcg

SEQ ID NO: 169822 - DNA, 35 bp, Artificial Sequence
  Synthetic oligonucleotide
gtgcacacgccgtcaagtgcatcatttcctcttcg

SEQ ID NO: 169823 - DNA, 35 bp, Artificial Sequence
  Synthetic oligonucleotide
taccacgctcccatctcttcacccacagtcgtggg

SEQ ID NO: 169824 - DNA, 35 bp, Artificial Sequence
  Synthetic oligonucleotide
aactgcgcaccgcttaccgccgcctccgtgttctg

SEQ ID NO: 169825 - DNA, 35 bp, Artificial Sequence
  Synthetic oligonucleotide
tatgaaccgccggttagacgcaccctccccaattg

SEQ ID NO: 169826 - DNA, 35 bp, Artificial Sequence
  Synthetic oligonucleotide
gtaccacccggcactgttgcgtcaactcctttcat

SEQ ID NO: 169827 - DNA, 35 bp, Artificial Sequence
  Synthetic oligonucleotide
tcctgtctgttgcccccctccgctgtcctccagat

SEQ ID NO: 169828 - DNA, 35 bp, Artificial Sequence
  Synthetic oligonucleotide
ggagggtacagggtacggagggcgggcaaagggat

SEQ ID NO: 169829 - DNA, 35 bp, Artificial Sequence
  Synthetic oligonucleotide
taactggtcgcccggaatcgcatctccaactctat

SEQ ID NO: 169830 - DNA, 35 bp, Artificial Sequence
  Synthetic oligonucleotide
ttgcgaggccccgtatgcgctatacctctccttat

SEQ ID NO: 169831 - DNA, 35 bp, Artificial Sequence
  Synthetic oligonucleotide
atgtccaactgtccaatttactgtctcctacacct

SEQ ID NO: 169832 - DNA, 25 bp, Artificial Sequence
  Synthetic oligonucleotide
tagtcctcgcaaaccgctaccacct

SEQ ID NO: 169833 - DNA, 35 bp, Artificial Sequence
  Synthetic oligonucleotide
tccagattcagttcctagcttgatccgctccccct

SEQ ID NO: 169834 - DNA, 35 bp, Artificial Sequence
  Synthetic oligonucleotide
tcctcaatcgcctggtcgttttccattgcatatct

SEQ ID NO: 169835 - DNA, 35 bp, Artificial Sequence
  Synthetic oligonucleotide
gacaccacgcttggttgccccgtaaaggatcctct

SEQ ID NO: 169836 - DNA, 35 bp, Artificial Sequence
  Synthetic oligonucleotide
ttgtgccgtcattttaattcgccgtgctcacttct

SEQ ID NO: 169837 - DNA, 35 bp, Artificial Sequence
  Synthetic oligonucleotide
tacaggtcggacattatcgcgcgtcccactcttct

SEQ ID NO: 169838 - DNA, 35 bp, Artificial Sequence
  Synthetic oligonucleotide
tagacaccacatctgggaacctgggcattttttct

SEQ ID NO: 169839 - DNA, 35 bp, Artificial Sequence
  Synthetic oligonucleotide
gactgtcgttccatcgtaacccattcccttcccgt

SEQ ID NO: 169840 - DNA, 35 bp, Artificial Sequence
  Synthetic oligonucleotide
tgctccgccgctggcaccatcttcctgtcccctgt

SEQ ID NO: 169841 - DNA, 35 bp, Artificial Sequence
  Synthetic oligonucleotide
gtgtgtgtcgggttcaccgtttgtgctcgcctctt

SEQ ID NO: 169842 - DNA, 35 bp, Artificial Sequence
  Synthetic oligonucleotide
gtgaaccctacgcctttgtctcatattttgctctt

SEQ ID NO: 169843 - DNA, 35 bp, Artificial Sequence
  Synthetic oligonucleotide
tccagggggcgtattgtatgccgcgcctctctctt

SEQ ID NO: 169844 - DNA, 36 bp, Artificial Sequence
  Synthetic oligonucleotide
tcttgccccgctgaccgccccagctcgtttacccaa

SEQ ID NO: 169845 - DNA, 36 bp, Artificial Sequence
  Synthetic oligonucleotide
accgggaagggtagttagtacatggagggggcggaa

SEQ ID NO: 169846 - DNA, 36 bp, Artificial Sequence
  Synthetic oligonucleotide
aacctgcggggggggggtaaaatgctggggagggaa

SEQ ID NO: 169847 - DNA, 36 bp, Artificial Sequence
  Synthetic oligonucleotide
accgtgcatcgctactcgccgcatatagccctctaa

SEQ ID NO: 169848 - DNA, 35 bp, Artificial Sequence
  Synthetic oligonucleotide
gacccgcatatgtcttccatctccctcgcggaaca

SEQ ID NO: 169849 - DNA, 36 bp, Artificial Sequence
  Synthetic oligonucleotide
gccattggccccacttgcttctgctattacgctaca

SEQ ID NO: 169850 - DNA, 35 bp, Artificial Sequence
  Synthetic oligonucleotide
acataccccgcttaacgccgccccgcaactgtaca

SEQ ID NO: 169851 - DNA, 36 bp, Artificial Sequence
  Synthetic oligonucleotide
tgcggggtctatgcccacgtgccctgttctccacca

SEQ ID NO: 169852 - DNA, 36 bp, Artificial Sequence
  Synthetic oligonucleotide
tcatgtcacggtaccacgaacgtggccctcgcccca

SEQ ID NO: 169853 - DNA, 36 bp, Artificial Sequence
  Synthetic oligonucleotide
gcccgccagttatctttctcaatgtctcgttctcca

SEQ ID NO: 169854 - DNA, 36 bp, Artificial Sequence
  Synthetic oligonucleotide
gttcactcgccccactttatcagctaagtggttcca

SEQ ID NO: 169855 - DNA, 35 bp, Artificial Sequence
  Synthetic oligonucleotide
gaccaccacgtcggctcgattcccctgctaaagca

SEQ ID NO: 169856 - DNA, 36 bp, Artificial Sequence
  Synthetic oligonucleotide
accctggcccatgctgccatatcccgtcctgacgca

SEQ ID NO: 169857 - DNA, 36 bp, Artificial Sequence
  Synthetic oligonucleotide
atcccctccgcgcatcctatcatgtacatggtcgca

SEQ ID NO: 169858 - DNA, 36 bp, Artificial Sequence
  Synthetic oligonucleotide
aacgagacatagacggacacgggagtgagaagggca

SEQ ID NO: 169859 - DNA, 35 bp, Artificial Sequence
  Synthetic oligonucleotide
gataccttgtcctgtctgccgcacaacacccctca

SEQ ID NO: 169860 - DNA, 36 bp, Artificial Sequence
  Synthetic oligonucleotide
tcgaacccctcttctgctttacgagcgatctgctca

SEQ ID NO: 169861 - DNA, 36 bp, Artificial Sequence
  Synthetic oligonucleotide
accccgtcctctgcatcttgtcacttagtcaattca

SEQ ID NO: 169862 - DNA, 37 bp, Artificial Sequence
  Synthetic oligonucleotide
gactgcctgatgccttgccgctccatatcctcctaga

SEQ ID NO: 169863 - DNA, 37 bp, Artificial Sequence
  Synthetic oligonucleotide
gagcacagtaaagaaaaggaggagggaaagtgtacga

SEQ ID NO: 169864 - DNA, 37 bp, Artificial Sequence
  Synthetic oligonucleotide
tagcccttccgccactccatggttacagatcttacga

SEQ ID NO: 169865 - DNA, 37 bp, Artificial Sequence
  Synthetic oligonucleotide
tggacgaggggggagtaggaaggagcggcaagaccga

SEQ ID NO: 169866 - DNA, 37 bp, Artificial Sequence
  Synthetic oligonucleotide
tgagggaaaggagaggatttgaaatagggggaacgga

SEQ ID NO: 169867 - DNA, 36 bp, Artificial Sequence
  Synthetic oligonucleotide
attcaccgccacaatcaataatatgcctctcccgga

SEQ ID NO: 169868 - DNA, 37 bp, Artificial Sequence
  Synthetic oligonucleotide
gcatggtaaggacgtggcatgaaaaggggggggcgga

SEQ ID NO: 169869 - DNA, 37 bp, Artificial Sequence
  Synthetic oligonucleotide
aagtcgacggtccgtggtaggtaggcggggggaggga

SEQ ID NO: 169870 - DNA, 37 bp, Artificial Sequence
  Synthetic oligonucleotide
gagagcatgagggaccaaaactagagagggataggga

SEQ ID NO: 169871 - DNA, 37 bp, Artificial Sequence
  Synthetic oligonucleotide
gttatcacggggagtttggggaagggctgggtaggga

SEQ ID NO: 169872 - DNA, 35 bp, Artificial Sequence
  Synthetic oligonucleotide
tccgccttctctccgctttcgctcatagcctggga

SEQ ID NO: 169873 - DNA, 38 bp, Artificial Sequence
  Synthetic oligonucleotide
gaagggtggcctagagggggggtgagtaggggtaatga

SEQ ID NO: 169874 - DNA, 38 bp, Artificial Sequence
  Synthetic oligonucleotide
gtcgcccctcccctgttgaaccgcacagaatctactga

SEQ ID NO: 169875 - DNA, 37 bp, Artificial Sequence
  Synthetic oligonucleotide
gccactcctcgttttgtagggccctttattttcctga

SEQ ID NO: 169876 - DNA, 38 bp, Artificial Sequence
  Synthetic oligonucleotide
gtggggggaaatggggaggagacggagtacagagctga

SEQ ID NO: 169877 - DNA, 37 bp, Artificial Sequence
  Synthetic oligonucleotide
gacaacaccgttgttgagctacgttcctctccgctga

SEQ ID NO: 169878 - DNA, 38 bp, Artificial Sequence
  Synthetic oligonucleotide
tcgctacgccacacactccaagatcccccgctggctga

SEQ ID NO: 169879 - DNA, 37 bp, Artificial Sequence
  Synthetic oligonucleotide
gtgggggtccgtgcgagtagggagggcgggggtctga

SEQ ID NO: 169880 - DNA, 37 bp, Artificial Sequence
  Synthetic oligonucleotide
agttgactcacttgcctccgccaccaccttacagtga

SEQ ID NO: 169881 - DNA, 36 bp, Artificial Sequence
  Synthetic oligonucleotide
gcagaaaacggaggggcgggagaagaaacgcggtga

SEQ ID NO: 169882 - DNA, 37 bp, Artificial Sequence
  Synthetic oligonucleotide
tcagagcgcatcagatcgcgccttcgccatcccttga

SEQ ID NO: 169883 - DNA, 38 bp, Artificial Sequence
  Synthetic oligonucleotide
atgggggtgaggagaagaaggtgaggagggggtcttga

SEQ ID NO: 169884 - DNA, 38 bp, Artificial Sequence
  Synthetic oligonucleotide
agagcggggacggaagggatcaaagggcagacggttga

SEQ ID NO: 169885 - DNA, 36 bp, Artificial Sequence
  Synthetic oligonucleotide
tcaacgatccctgaccgccccgcccagcctcccata

SEQ ID NO: 169886 - DNA, 35 bp, Artificial Sequence
  Synthetic oligonucleotide
taaccacctgtgccgccaccatggccttctgcata

SEQ ID NO: 169887 - DNA, 35 bp, Artificial Sequence
  Synthetic oligonucleotide
tcaggtactggtgcgtgcgcgattcatctacacta

SEQ ID NO: 169888 - DNA, 36 bp, Artificial Sequence
  Synthetic oligonucleotide
tcgcaactgcgcaatcttcatgcctacccgccacta

SEQ ID NO: 169889 - DNA, 36 bp, Artificial Sequence
  Synthetic oligonucleotide
tgcaccgccgtacttccctttcccagccatcggcta

SEQ ID NO: 169890 - DNA, 36 bp, Artificial Sequence
  Synthetic oligonucleotide
acccccgtaccctgcttcttccactagtgatggcta

SEQ ID NO: 169891 - DNA, 36 bp, Artificial Sequence
  Synthetic oligonucleotide
gtccctctatgcgttttctgtcctaccgctcctcta

SEQ ID NO: 169892 - DNA, 37 bp, Artificial Sequence
  Synthetic oligonucleotide
tcacctcagtgcgcttgacccacctcgcccccactta

SEQ ID NO: 169893 - DNA, 36 bp, Artificial Sequence
  Synthetic oligonucleotide
attagccacgacttgcccgttccaccgttcttctta

SEQ ID NO: 169894 - DNA, 35 bp, Artificial Sequence
  Synthetic oligonucleotide
acaccctgtacgttccgtaaatctcgcctgcttta

SEQ ID NO: 169895 - DNA, 33 bp, Artificial Sequence
  Synthetic oligonucleotide
gctgacctccgcacacaccttccgctcctgaac

SEQ ID NO: 169896 - DNA, 35 bp, Artificial Sequence
  Synthetic oligonucleotide
tcacgcacgcgctaaatttatgcgccacaattcac

SEQ ID NO: 169897 - DNA, 34 bp, Artificial Sequence
  Synthetic oligonucleotide
tgttgcgggacgtgggtctgtgctctctcttcac

SEQ ID NO: 169898 - DNA, 35 bp, Artificial Sequence
  Synthetic oligonucleotide
attctgtccaccaccatgcgtaggcgtttactacc

SEQ ID NO: 169899 - DNA, 35 bp, Artificial Sequence
  Synthetic oligonucleotide
gcgtccacgtaatctgtccacttcccgggccaccc

SEQ ID NO: 169900 - DNA, 35 bp, Artificial Sequence
  Synthetic oligonucleotide
gtgccgttcctccccttgctaataattgccccccc

SEQ ID NO: 169901 - DNA, 35 bp, Artificial Sequence
  Synthetic oligonucleotide
agtgaccgtcaggcagcctccgctccttccccccc

SEQ ID NO: 169902 - DNA, 35 bp, Artificial Sequence
  Synthetic oligonucleotide
ttcagacccgccgctcgacgaccgctatccagccc

SEQ ID NO: 169903 - DNA, 35 bp, Artificial Sequence
  Synthetic oligonucleotide
aagatgtgtgccacgttgaatgtcccgatccgccc

SEQ ID NO: 169904 - DNA, 35 bp, Artificial Sequence
  Synthetic oligonucleotide
gacagggacaggcgatgggagggtatgagggtccc

SEQ ID NO: 169905 - DNA, 35 bp, Artificial Sequence
  Synthetic oligonucleotide
ttgtctgacgcccacgatcaacgagccttcccgcc

SEQ ID NO: 169906 - DNA, 35 bp, Artificial Sequence
  Synthetic oligonucleotide
gttacctacgtgcgcccctgcttctcttcatggcc

SEQ ID NO: 169907 - DNA, 35 bp, Artificial Sequence
  Synthetic oligonucleotide
tagttaccgtgcccccttctactttgatgccatcc

SEQ ID NO: 169908 - DNA, 35 bp, Artificial Sequence
  Synthetic oligonucleotide
aacgcggcctcatactcgcttctggcgtccactcc

SEQ ID NO: 169909 - DNA, 35 bp, Artificial Sequence
  Synthetic oligonucleotide
gtcactgcctttggcggtggttaatatcatcctcc

SEQ ID NO: 169910 - DNA, 35 bp, Artificial Sequence
  Synthetic oligonucleotide
tacgcctcgccttagtattacaccttcggtattcc

SEQ ID NO: 169911 - DNA, 35 bp, Artificial Sequence
  Synthetic oligonucleotide
gttagccgacgcttgtcgtacgagtcgcctcttcc

SEQ ID NO: 169912 - DNA, 35 bp, Artificial Sequence
  Synthetic oligonucleotide
atgtgcgcaacgcagctcacgcttattacggttcc

SEQ ID NO: 169913 - DNA, 35 bp, Artificial Sequence
  Synthetic oligonucleotide
gactgtccctctacgtgtcttttggaaaccaccgc

SEQ ID NO: 169914 - DNA, 34 bp, Artificial Sequence
  Synthetic oligonucleotide
tccaacatgttcccacgctcagatgattcgccgc

SEQ ID NO: 169915 - DNA, 35 bp, Artificial Sequence
  Synthetic oligonucleotide
gcatgcggcttctttgcttaccctctgtcgtgcgc

SEQ ID NO: 169916 - DNA, 35 bp, Artificial Sequence
  Synthetic oligonucleotide
aaccaccgcccttattcagtgacccccttgtgcgc

SEQ ID NO: 169917 - DNA, 34 bp, Artificial Sequence
  Synthetic oligonucleotide
tcccgactcgtgttgtctttctcttctgccctgc

SEQ ID NO: 169918 - DNA, 35 bp, Artificial Sequence
  Synthetic oligonucleotide
tgacgccctccatcgcgtagcaccgtgctccctgc

SEQ ID NO: 169919 - DNA, 35 bp, Artificial Sequence
  Synthetic oligonucleotide
tcaccatctagtccctcgtcccccgtatcccgtgc

SEQ ID NO: 169920 - DNA, 35 bp, Artificial Sequence
  Synthetic oligonucleotide
atcggtccccccaatatggttctcttcatgctatc

SEQ ID NO: 169921 - DNA, 35 bp, Artificial Sequence
  Synthetic oligonucleotide
aggcccccccccgttctgcttatactcggtctatc

SEQ ID NO: 169922 - DNA, 35 bp, Artificial Sequence
  Synthetic oligonucleotide
tcccgacggtcctctctcaacgggttttccgactc

SEQ ID NO: 169923 - DNA, 35 bp, Artificial Sequence
  Synthetic oligonucleotide
acgcgaggatggcactgctcctgtcttattgtctc

SEQ ID NO: 169924 - DNA, 35 bp, Artificial Sequence
  Synthetic oligonucleotide
tgccacccgcctccataggaacttccttacaaacg

SEQ ID NO: 169925 - DNA, 35 bp, Artificial Sequence
  Synthetic oligonucleotide
gtggccgtaccgtgcgtggccctactcgtcccccg

SEQ ID NO: 169926 - DNA, 35 bp, Artificial Sequence
  Synthetic oligonucleotide
attagtcacgttctctgcccgccgctgtttccccg

SEQ ID NO: 169927 - DNA, 35 bp, Artificial Sequence
  Synthetic oligonucleotide
gcatcgcggcgctcttggttctactgttccatccg

SEQ ID NO: 169928 - DNA, 35 bp, Artificial Sequence
  Synthetic oligonucleotide
tgtgagcctcaccatgctttgttttaatcattccg

SEQ ID NO: 169929 - DNA, 35 bp, Artificial Sequence
  Synthetic oligonucleotide
aaagaaacggtggggtggagtataggcgtaacagg

SEQ ID NO: 169930 - DNA, 35 bp, Artificial Sequence
  Synthetic oligonucleotide
tgccatcccccacccgcgcacccattaagtccagg

SEQ ID NO: 169931 - DNA, 35 bp, Artificial Sequence
  Synthetic oligonucleotide
gtctggcacggggagggaatacggtcgggataggg

SEQ ID NO: 169932 - DNA, 35 bp, Artificial Sequence
  Synthetic oligonucleotide
aacaccgggcagacaatcaatttgggtggggcggg

SEQ ID NO: 169933 - DNA, 35 bp, Artificial Sequence
  Synthetic oligonucleotide
ataggtggccagagggtggtgcagggggctcatgg

SEQ ID NO: 169934 - DNA, 35 bp, Artificial Sequence
  Synthetic oligonucleotide
ttggagagttggtgggagggttctggcaccactgg

SEQ ID NO: 169935 - DNA, 35 bp, Artificial Sequence
  Synthetic oligonucleotide
atgagggagcaaggcctgggaaggacggggtgtgg

SEQ ID NO: 169936 - DNA, 35 bp, Artificial Sequence
  Synthetic oligonucleotide
tgcaccgctccacatccgtcggaccacctttcttg

SEQ ID NO: 169937 - DNA, 35 bp, Artificial Sequence
  Synthetic oligonucleotide
gcctactgcgaacattctgccttcccgcaactttg

SEQ ID NO: 169938 - DNA, 35 bp, Artificial Sequence
  Synthetic oligonucleotide
gcgggggctgggagggcgggtggtcaaagtggaat

SEQ ID NO: 169939 - DNA, 35 bp, Artificial Sequence
  Synthetic oligonucleotide
taagcgccgctcgaccattgtacgatccttccact

SEQ ID NO: 169940 - DNA, 35 bp, Artificial Sequence
  Synthetic oligonucleotide
gcctgcaccatatgcgtcaccgcatctcaatacct

SEQ ID NO: 169941 - DNA, 35 bp, Artificial Sequence
  Synthetic oligonucleotide
acatcacccaactgttccgctccgtctcgttccct

SEQ ID NO: 169942 - DNA, 35 bp, Artificial Sequence
  Synthetic oligonucleotide
ggtcgcaccaccatattgttcgctgtctctcgcct

SEQ ID NO: 169943 - DNA, 29 bp, Artificial Sequence
  Synthetic oligonucleotide
gaactatgggccactaataccctccctct

SEQ ID NO: 169944 - DNA, 35 bp, Artificial Sequence
  Synthetic oligonucleotide
gacagaccgtgcgaggtctctcttaccgtttctct

SEQ ID NO: 169945 - DNA, 35 bp, Artificial Sequence
  Synthetic oligonucleotide
tcacgtccagcgagtcatacaatccccacacgtct

SEQ ID NO: 169946 - DNA, 35 bp, Artificial Sequence
  Synthetic oligonucleotide
taatgcccgcctgccacacccttccccctggcagt

SEQ ID NO: 169947 - DNA, 34 bp, Artificial Sequence
  Synthetic oligonucleotide
tgtctcccgtcctgcttacctacttgctatacgt

SEQ ID NO: 169948 - DNA, 35 bp, Artificial Sequence
  Synthetic oligonucleotide
tctccccccccgttcacgatgtccggtttcgtatt

SEQ ID NO: 169949 - DNA, 35 bp, Artificial Sequence
  Synthetic oligonucleotide
gatcatcaccggttcgatttagaacgttacttctt

SEQ ID NO: 169950 - DNA, 35 bp, Artificial Sequence
  Synthetic oligonucleotide
ttggagcctccattcgttcagtggcttggcccttt

SEQ ID NO: 169951 - DNA, 35 bp, Artificial Sequence
  Synthetic oligonucleotide
actaccactctcgatgatccagtctttgctctttt

SEQ ID NO: 169952 - DNA, 35 bp, Artificial Sequence
  Synthetic oligonucleotide
gccggtctggctttcatacgcctttcgtactttaa

SEQ ID NO: 169953 - DNA, 35 bp, Artificial Sequence
  Synthetic oligonucleotide
tcaccgaccaatgtctcgttcctgtcattcctaca

SEQ ID NO: 169954 - DNA, 36 bp, Artificial Sequence
  Synthetic oligonucleotide
tgccagccacaggccatgccccctccaccggaacca

SEQ ID NO: 169955 - DNA, 34 bp, Artificial Sequence
  Synthetic oligonucleotide
ttccggtagcaactgtccctgcaattagccccca

SEQ ID NO: 169956 - DNA, 36 bp, Artificial Sequence
  Synthetic oligonucleotide
ttcgtcgtgaccctattgtttgtacacccgccccca

SEQ ID NO: 169957 - DNA, 36 bp, Artificial Sequence
  Synthetic oligonucleotide
gcgaatgcccgttcgccctccccccacgccgcccca

SEQ ID NO: 169958 - DNA, 36 bp, Artificial Sequence
  Synthetic oligonucleotide
taccgaccctggtttgcctctcgcccttgtatccca

SEQ ID NO: 169959 - DNA, 35 bp, Artificial Sequence
  Synthetic oligonucleotide
tggatccctctcgttcgatagcaccttcgttccca

SEQ ID NO: 169960 - DNA, 36 bp, Artificial Sequence
  Synthetic oligonucleotide
tcgaccgccgcaccatccacctgtgtccgtctgcca

SEQ ID NO: 169961 - DNA, 36 bp, Artificial Sequence
  Synthetic oligonucleotide
gtcaagggcacgctgctcctcactccccagttgcca

SEQ ID NO: 169962 - DNA, 35 bp, Artificial Sequence
  Synthetic oligonucleotide
ttgttccgccccacattcccgtcatgctgaatcca

SEQ ID NO: 169963 - DNA, 34 bp, Artificial Sequence
  Synthetic oligonucleotide
tccacgcactccggctccagcatttcacgacgca

SEQ ID NO: 169964 - DNA, 36 bp, Artificial Sequence
  Synthetic oligonucleotide
tgttcatggggaggtggtgttcaggggggggtgtca

SEQ ID NO: 169965 - DNA, 36 bp, Artificial Sequence
  Synthetic oligonucleotide
tcgactcatcagtctcttgtatcccctcgccgttca

SEQ ID NO: 169966 - DNA, 36 bp, Artificial Sequence
  Synthetic oligonucleotide
gtcccaactcctgggttatatcaccgcctaatttca

SEQ ID NO: 169967 - DNA, 36 bp, Artificial Sequence
  Synthetic oligonucleotide
aaccactctgtgactccttatgcaccgcccgtttca

SEQ ID NO: 169968 - DNA, 37 bp, Artificial Sequence
  Synthetic oligonucleotide
gtccacacataccttctcgcacgctgcttaccaccga

SEQ ID NO: 169969 - DNA, 36 bp, Artificial Sequence
  Synthetic oligonucleotide
ggaacggcggggagccgagcagggagagagggccga

SEQ ID NO: 169970 - DNA, 37 bp, Artificial Sequence
  Synthetic oligonucleotide
ggagacccagtgggaggaggggcaacgcgaaaggcga

SEQ ID NO: 169971 - DNA, 36 bp, Artificial Sequence
  Synthetic oligonucleotide
gtcctgccccgacccgctgctttgtgaactcgtcga

SEQ ID NO: 169972 - DNA, 37 bp, Artificial Sequence
  Synthetic oligonucleotide
ttgtgtctcgaggcggggtgggggaagggcggaagga

SEQ ID NO: 169973 - DNA, 37 bp, Artificial Sequence
  Synthetic oligonucleotide
gactaaggtggggttggaagggaggtagatgaacgga

SEQ ID NO: 169974 - DNA, 36 bp, Artificial Sequence
  Synthetic oligonucleotide
acaatcgcaccttgcccggaacatctctctcacgga

SEQ ID NO: 169975 - DNA, 35 bp, Artificial Sequence
  Synthetic oligonucleotide
aatgcatgggtgggagcgggggggtccaatctgga

SEQ ID NO: 169976 - DNA, 38 bp, Artificial Sequence
  Synthetic oligonucleotide
ttgcctcccgttccatccgttgtcgacacgatctctga

SEQ ID NO: 169977 - DNA, 38 bp, Artificial Sequence
  Synthetic oligonucleotide
ttgccacgcatgagctacttataccgccacttctctga

SEQ ID NO: 169978 - DNA, 36 bp, Artificial Sequence
  Synthetic oligonucleotide
tcaacgcctcgttccttccgccccccactggagtga

SEQ ID NO: 169979 - DNA, 35 bp, Artificial Sequence
  Synthetic oligonucleotide
acacagtggagagaaggacggtgtggtgatagtga

SEQ ID NO: 169980 - DNA, 38 bp, Artificial Sequence
  Synthetic oligonucleotide
gccccgacacccatttgccctacgtcacttcgccgtga

SEQ ID NO: 169981 - DNA, 38 bp, Artificial Sequence
  Synthetic oligonucleotide
gagagggtagggtggcacggggagagttcgattggtga

SEQ ID NO: 169982 - DNA, 36 bp, Artificial Sequence
  Synthetic oligonucleotide
gagcaggtcagggccttcctctcctgcccccattga

SEQ ID NO: 169983 - DNA, 37 bp, Artificial Sequence
  Synthetic oligonucleotide
accccaccccaccgtcctgacaggcatagcttattga

SEQ ID NO: 169984 - DNA, 37 bp, Artificial Sequence
  Synthetic oligonucleotide
gctacgaccactgcatgccattcctcgcgctccttga

SEQ ID NO: 169985 - DNA, 38 bp, Artificial Sequence
  Synthetic oligonucleotide
gtgagagtcacgggcggggggtgagggggtagatttga

SEQ ID NO: 169986 - DNA, 37 bp, Artificial Sequence
  Synthetic oligonucleotide
actcgtacgcctcctgaccccgtgcctcattgtttga

SEQ ID NO: 169987 - DNA, 36 bp, Artificial Sequence
  Synthetic oligonucleotide
tgtgaggtggagagagggcatgggctgaagacgata

SEQ ID NO: 169988 - DNA, 36 bp, Artificial Sequence
  Synthetic oligonucleotide
tcactcacccgacttctatgcttccatagcccccta

SEQ ID NO: 169989 - DNA, 35 bp, Artificial Sequence
  Synthetic oligonucleotide
tgcgtagatctcattgcaccacccgctcttgccta

SEQ ID NO: 169990 - DNA, 35 bp, Artificial Sequence
  Synthetic oligonucleotide
tgttggagggcgggaagggtactcatcggggtcta

SEQ ID NO: 169991 - DNA, 36 bp, Artificial Sequence
  Synthetic oligonucleotide
actccctccgtggtctatttagtatttccctgtcta

SEQ ID NO: 169992 - DNA, 35 bp, Artificial Sequence
  Synthetic oligonucleotide
gcagtggacaatccgttttgccttccgcccttcta

SEQ ID NO: 169993 - DNA, 35 bp, Artificial Sequence
  Synthetic oligonucleotide
gtctcccctggtgctttgccacttgttatcttcta

SEQ ID NO: 169994 - DNA, 34 bp, Artificial Sequence
  Synthetic oligonucleotide
ggaccccacctggcacaacgccacacacttagta

SEQ ID NO: 169995 - DNA, 35 bp, Artificial Sequence
  Synthetic oligonucleotide
cccgaccccttctgctgccaaactacaggcacgta

SEQ ID NO: 169996 - DNA, 35 bp, Artificial Sequence
  Synthetic oligonucleotide
aacgcccccttgtgtttgccacatcctccattgta

SEQ ID NO: 169997 - DNA, 36 bp, Artificial Sequence
  Synthetic oligonucleotide
aacccacgagtgtcgtttcgttcttcgcccacttta

SEQ ID NO: 169998 - DNA, 36 bp, Artificial Sequence
  Synthetic oligonucleotide
gtgccgaccttctcccatgtcttgttcggcccttta

SEQ ID NO: 169999 - DNA, 35 bp, Artificial Sequence
  Synthetic oligonucleotide
gatgaagcctcctggaccctgcctccccttgaaac

SEQ ID NO: 170000 - DNA, 35 bp, Artificial Sequence
  Synthetic oligonucleotide
atctgccccaccgccccggcttaccagggataaac

SEQ ID NO: 170001 - DNA, 35 bp, Artificial Sequence
  Synthetic oligonucleotide
gatcacatccaatgggcgcatgcacatcctcccac

SEQ ID NO: 170002 - DNA, 34 bp, Artificial Sequence
  Synthetic oligonucleotide
ttcccccaccgctccagccattcacatacacgac

SEQ ID NO: 170003 - DNA, 35 bp, Artificial Sequence
  Synthetic oligonucleotide
atcaccaaccccccaactgcaatccagagccaccc

SEQ ID NO: 170004 - DNA, 35 bp, Artificial Sequence
  Synthetic oligonucleotide
ttgcaactacactgtttaggccgccccttcacccc

SEQ ID NO: 170005 - DNA, 35 bp, Artificial Sequence
  Synthetic oligonucleotide
gcctccggcctcctgtttcaatatatcggaccccc

SEQ ID NO: 170006 - DNA, 35 bp, Artificial Sequence
  Synthetic oligonucleotide
gtcaaccgagcgggttgttctcgaattgctccccc

SEQ ID NO: 170007 - DNA, 34 bp, Artificial Sequence
  Synthetic oligonucleotide
atgaaccggacctcgagtttgttacaccccgccc

SEQ ID NO: 170008 - DNA, 35 bp, Artificial Sequence
  Synthetic oligonucleotide
gcgctactggctatgccggcctccccgttaccgcc

SEQ ID NO: 170009 - DNA, 35 bp, Artificial Sequence
  Synthetic oligonucleotide
tgtcgtggtccactttgcatctcgcccggcccgcc

SEQ ID NO: 170010 - DNA, 35 bp, Artificial Sequence
  Synthetic oligonucleotide
ggaccagtcgcctcgaatcattacacatttgcgcc

SEQ ID NO: 170011 - DNA, 35 bp, Artificial Sequence
  Synthetic oligonucleotide
acttctcgcccgatatcgctgggtcacaacctgcc

SEQ ID NO: 170012 - DNA, 35 bp, Artificial Sequence
  Synthetic oligonucleotide
atatccacacatcttgtattcttgccgtgacctcc

SEQ ID NO: 170013 - DNA, 35 bp, Artificial Sequence
  Synthetic oligonucleotide
gaacgcccagtggcctggtccgctatttcgcctcc

SEQ ID NO: 170014 - DNA, 35 bp, Artificial Sequence
  Synthetic oligonucleotide
gtcatggatgggtacaccttatctcgctttcctcc

SEQ ID NO: 170015 - DNA, 35 bp, Artificial Sequence
  Synthetic oligonucleotide
ttgccctgcccctctgtcccgcctcatctaagagc

SEQ ID NO: 170016 - DNA, 35 bp, Artificial Sequence
  Synthetic oligonucleotide
tccccacccaggtgctgccacctacttatacgtgc

SEQ ID NO: 170017 - DNA, 35 bp, Artificial Sequence
  Synthetic oligonucleotide
atccctccgacatccgacccgcaggcccgatttgc

SEQ ID NO: 170018 - DNA, 35 bp, Artificial Sequence
  Synthetic oligonucleotide
tcccaatacctcgctgtgctccctcgctgaacatc

SEQ ID NO: 170019 - DNA, 35 bp, Artificial Sequence
  Synthetic oligonucleotide
ggaggccctccgctctctatccttgcttagtcctc

SEQ ID NO: 170020 - DNA, 35 bp, Artificial Sequence
  Synthetic oligonucleotide
ttccaccctctagttataccttcaccagcctgctc

SEQ ID NO: 170021 - DNA, 35 bp, Artificial Sequence
  Synthetic oligonucleotide
ttggttcgcacctgggcagtcccaccatttctctc

SEQ ID NO: 170022 - DNA, 35 bp, Artificial Sequence
  Synthetic oligonucleotide
tgtacctccaccctcgcaatccgttacatagtctc

SEQ ID NO: 170023 - DNA, 35 bp, Artificial Sequence
  Synthetic oligonucleotide
gagcggccaccctcgcgttcttgggccttctattc

SEQ ID NO: 170024 - DNA, 35 bp, Artificial Sequence
  Synthetic oligonucleotide
tccgtcgctattcgctatgtcacgctccacgcttc

SEQ ID NO: 170025 - DNA, 35 bp, Artificial Sequence
  Synthetic oligonucleotide
tgacctccatgcctgaaatattcgccgattgcttc

SEQ ID NO: 170026 - DNA, 36 bp, Artificial Sequence
  Synthetic oligonucleotide
gaaacattcgccgatcggtctcaacaatccctcttc

SEQ ID NO: 170027 - DNA, 35 bp, Artificial Sequence
  Synthetic oligonucleotide
gtaaagggcgggggggagtggaagctgttgtcttc

SEQ ID NO: 170028 - DNA, 34 bp, Artificial Sequence
  Synthetic oligonucleotide
tagaggagggggggggatagggtcggttggatag

SEQ ID NO: 170029 - DNA, 35 bp, Artificial Sequence
  Synthetic oligonucleotide
acctactcagtaacgttacagtcccgtccatcccg

SEQ ID NO: 170030 - DNA, 35 bp, Artificial Sequence
  Synthetic oligonucleotide
tctcactccctgggtcctttccgcgcgcccaagcg

SEQ ID NO: 170031 - DNA, 35 bp, Artificial Sequence
  Synthetic oligonucleotide
gctacctctgccggctacatggcaccttgctctcg

SEQ ID NO: 170032 - DNA, 35 bp, Artificial Sequence
  Synthetic oligonucleotide
tgcacgccctctgcacctgtttaccatcttattgg

SEQ ID NO: 170033 - DNA, 35 bp, Artificial Sequence
  Synthetic oligonucleotide
tacccatggccgggggggaggagcgggcgggagtg

SEQ ID NO: 170034 - DNA, 35 bp, Artificial Sequence
  Synthetic oligonucleotide
gaccatcccgttgctccgatcacccccttgaggtg

SEQ ID NO: 170035 - DNA, 35 bp, Artificial Sequence
  Synthetic oligonucleotide
tcaacgttcgccgtccaatgaccatcctcttgttg

SEQ ID NO: 170036 - DNA, 35 bp, Artificial Sequence
  Synthetic oligonucleotide
tagttcagcccttttcgcattatcctgagccccat

SEQ ID NO: 170037 - DNA, 35 bp, Artificial Sequence
  Synthetic oligonucleotide
gccgtatccccgcccgaacgtttccaggcatccat

SEQ ID NO: 170038 - DNA, 34 bp, Artificial Sequence
  Synthetic oligonucleotide
gccgtctctctctggtcttacgagtctcccccct

SEQ ID NO: 170039 - DNA, 35 bp, Artificial Sequence
  Synthetic oligonucleotide
taccgacgtcggtctagttctactcaaatgcccct

SEQ ID NO: 170040 - DNA, 35 bp, Artificial Sequence
  Synthetic oligonucleotide
tgatgcctatggaagcttacctgccgacctccgct

SEQ ID NO: 170041 - DNA, 35 bp, Artificial Sequence
  Synthetic oligonucleotide
ccacgccctcattccgccctcacagtcctcttgct

SEQ ID NO: 170042 - DNA, 35 bp, Artificial Sequence
  Synthetic oligonucleotide
ttccgacggaactgagattaccgaacaccccctct

SEQ ID NO: 170043 - DNA, 32 bp, Artificial Sequence
  Synthetic oligonucleotide
aacatccgcctccttgtctcactgtttccagt

SEQ ID NO: 170044 - DNA, 35 bp, Artificial Sequence
  Synthetic oligonucleotide
tcaccatggctacccctgccacccgccccttgggt

SEQ ID NO: 170045 - DNA, 35 bp, Artificial Sequence
  Synthetic oligonucleotide
gctcatcagcggtaacaccacctgccctgtcctgt

SEQ ID NO: 170046 - DNA, 35 bp, Artificial Sequence
  Synthetic oligonucleotide
gggaccaccgttcgttattttgcggcccactcatt

SEQ ID NO: 170047 - DNA, 35 bp, Artificial Sequence
  Synthetic oligonucleotide
agagtacccgcccgcccatcaccttagcttgactt

SEQ ID NO: 170048 - DNA, 36 bp, Artificial Sequence
  Synthetic oligonucleotide
gtgaatcctcgcgactgttacaacgaacccgccctt

SEQ ID NO: 170049 - DNA, 36 bp, Artificial Sequence
  Synthetic oligonucleotide
tgcccaaccctcggagtacctagatacctcggcctt

SEQ ID NO: 170050 - DNA, 35 bp, Artificial Sequence
  Synthetic oligonucleotide
tacaacacatgtgcagcccaccgacccgccctgtt

SEQ ID NO: 170051 - DNA, 35 bp, Artificial Sequence
  Synthetic oligonucleotide
atcacgaccgacctttgccctacttgtggtccttt

SEQ ID NO: 170052 - DNA, 35 bp, Artificial Sequence
  Synthetic oligonucleotide
cactgcccgccccagcattcgtcgtcctagtcttt

SEQ ID NO: 170053 - DNA, 35 bp, Artificial Sequence
  Synthetic oligonucleotide
attactcgccatcacatctgtacgccaatccgttt

SEQ ID NO: 170054 - DNA, 36 bp, Artificial Sequence
  Synthetic oligonucleotide
gttaggtatcgggtaggtgggaggggaaggttcaaa

SEQ ID NO: 170055 - DNA, 36 bp, Artificial Sequence
  Synthetic oligonucleotide
gctcaccacctcatgtttggatccgcccttcgtaaa

SEQ ID NO: 170056 - DNA, 35 bp, Artificial Sequence
  Synthetic oligonucleotide
tgaacgcccgccggtctttctacgttcgttactaa

SEQ ID NO: 170057 - DNA, 36 bp, Artificial Sequence
  Synthetic oligonucleotide
tacccgctctggcccacccatttacgcgacgttaca

SEQ ID NO: 170058 - DNA, 36 bp, Artificial Sequence
  Synthetic oligonucleotide
actgtgtgctcccccggtcctcgctgacaggtacca

SEQ ID NO: 170059 - DNA, 35 bp, Artificial Sequence
  Synthetic oligonucleotide
tcgaccggctcctatattgcgccctgctccgccca

SEQ ID NO: 170060 - DNA, 36 bp, Artificial Sequence
  Synthetic oligonucleotide
accttggttcgccggcggtctcgatccccgctccca

SEQ ID NO: 170061 - DNA, 36 bp, Artificial Sequence
  Synthetic oligonucleotide
gattacgtggtgccacatccggtttgtcacttccca

SEQ ID NO: 170062 - DNA, 36 bp, Artificial Sequence
  Synthetic oligonucleotide
ttgggtccgtcgttcatggtccgtcactcgttccca

SEQ ID NO: 170063 - DNA, 36 bp, Artificial Sequence
  Synthetic oligonucleotide
acccccgcccccacctagtacgtgatcctttgatca

SEQ ID NO: 170064 - DNA, 35 bp, Artificial Sequence
  Synthetic oligonucleotide
tgttagtgccacctcacgtacctttgtcgacctca

SEQ ID NO: 170065 - DNA, 36 bp, Artificial Sequence
  Synthetic oligonucleotide
tccgtccctcctgcacacactttgacactttcgtca

SEQ ID NO: 170066 - DNA, 35 bp, Artificial Sequence
  Synthetic oligonucleotide
atccccccccctgctccaccagtgacatgctgtca

SEQ ID NO: 170067 - DNA, 37 bp, Artificial Sequence
  Synthetic oligonucleotide
gcgttcaacgccccgcctctatagttcgccatccaga

SEQ ID NO: 170068 - DNA, 37 bp, Artificial Sequence
  Synthetic oligonucleotide
gcggagtggagggtagcattgggggggtggcatgaga

SEQ ID NO: 170069 - DNA, 37 bp, Artificial Sequence
  Synthetic oligonucleotide
aaggacagacaaaggggtgaggggaaggtgaactaga

SEQ ID NO: 170070 - DNA, 37 bp, Artificial Sequence
  Synthetic oligonucleotide
tttcaccccgctcccaggtccacagtcggggacccga

SEQ ID NO: 170071 - DNA, 37 bp, Artificial Sequence
  Synthetic oligonucleotide
ggtgcaccgagcacaccttctcacgccagtaccccga

SEQ ID NO: 170072 - DNA, 36 bp, Artificial Sequence
  Synthetic oligonucleotide
gggggctcggttctccctgccgtatcatcatcccga

SEQ ID NO: 170073 - DNA, 36 bp, Artificial Sequence
  Synthetic oligonucleotide
gatccatgagccgatctatagtcaccccctcgccga

SEQ ID NO: 170074 - DNA, 37 bp, Artificial Sequence
  Synthetic oligonucleotide
acccaatcctcctgccggataaacccagtctcgccga

SEQ ID NO: 170075 - DNA, 37 bp, Artificial Sequence
  Synthetic oligonucleotide
aacccaacgtgatcgctatccaacctgccccctgcga

SEQ ID NO: 170076 - DNA, 36 bp, Artificial Sequence
  Synthetic oligonucleotide
tgtgagcccctcaccgtgcccaacattttccatcga

SEQ ID NO: 170077 - DNA, 37 bp, Artificial Sequence
  Synthetic oligonucleotide
atcacgccctctagcggtgtagttcaccatctatcga

SEQ ID NO: 170078 - DNA, 36 bp, Artificial Sequence
  Synthetic oligonucleotide
acacacgcctgcatcgtttaccatcttctacctcga

SEQ ID NO: 170079 - DNA, 36 bp, Artificial Sequence
  Synthetic oligonucleotide
gaccccccacatgccgtgctcgctcattttgctcga

SEQ ID NO: 170080 - DNA, 37 bp, Artificial Sequence
  Synthetic oligonucleotide
ggactggggcaggtggagcgggtagggagatgttcga

SEQ ID NO: 170081 - DNA, 37 bp, Artificial Sequence
  Synthetic oligonucleotide
gtgcgccttccggtgcgttcttacctcctctgttcga

SEQ ID NO: 170082 - DNA, 35 bp, Artificial Sequence
  Synthetic oligonucleotide
ttatgccacgttggcataccacatctcccccagga

SEQ ID NO: 170083 - DNA, 34 bp, Artificial Sequence
  Synthetic oligonucleotide
tgacacgggagtggctgggaagggtgccaacgga

SEQ ID NO: 170084 - DNA, 37 bp, Artificial Sequence
  Synthetic oligonucleotide
actgtgccctcggttccgaatcgtgacccctcccgga

SEQ ID NO: 170085 - DNA, 37 bp, Artificial Sequence
  Synthetic oligonucleotide
gcctggggaactggaaagggcgggagagggtcgcgga

SEQ ID NO: 170086 - DNA, 37 bp, Artificial Sequence
  Synthetic oligonucleotide
aatcgggctaggtgggtgggtcaaaggggcggaggga

SEQ ID NO: 170087 - DNA, 36 bp, Artificial Sequence
  Synthetic oligonucleotide
gtggaggataatggaggaaatgcaggaggttaggga

SEQ ID NO: 170088 - DNA, 35 bp, Artificial Sequence
  Synthetic oligonucleotide
gtctacctcgattctacgccccgctcacatctgga

SEQ ID NO: 170089 - DNA, 37 bp, Artificial Sequence
  Synthetic oligonucleotide
aacacgcgttacccctctgcccgtttagccatcatga

SEQ ID NO: 170090 - DNA, 37 bp, Artificial Sequence
  Synthetic oligonucleotide
atccttcgccgccacattaagccttcgccttccctga

SEQ ID NO: 170091 - DNA, 37 bp, Artificial Sequence
  Synthetic oligonucleotide
atggtcaacgcactgtcaacttggtccctcctcctga

SEQ ID NO: 170092 - DNA, 38 bp, Artificial Sequence
  Synthetic oligonucleotide
agccccctgcctctgactcgttattaatgttccgctga

SEQ ID NO: 170093 - DNA, 37 bp, Artificial Sequence
  Synthetic oligonucleotide
gttcccgctccccgatccctaatcctccgcgcgctga

SEQ ID NO: 170094 - DNA, 38 bp, Artificial Sequence
  Synthetic oligonucleotide
aagggaaggggggagcagataggagcggggcacagtga

SEQ ID NO: 170095 - DNA, 38 bp, Artificial Sequence
  Synthetic oligonucleotide
ggatgaggggggatggaaggagcgccatcgccgagtga

SEQ ID NO: 170096 - DNA, 37 bp, Artificial Sequence
  Synthetic oligonucleotide
atgttgcgcgctcctcttgctacaccctccaccgtga

SEQ ID NO: 170097 - DNA, 38 bp, Artificial Sequence
  Synthetic oligonucleotide
tacagctcctctctgtccttcctcgttcctctgcgtga

SEQ ID NO: 170098 - DNA, 38 bp, Artificial Sequence
  Synthetic oligonucleotide
acatctgccccgcccttcgtcaccgtgcctctttgtga

SEQ ID NO: 170099 - DNA, 38 bp, Artificial Sequence
  Synthetic oligonucleotide
gagcacctcgcttttcccacccagcccatgtcaattga

SEQ ID NO: 170100 - DNA, 38 bp, Artificial Sequence
  Synthetic oligonucleotide
gtgcggtatcattgcgtttccatctgcaccacacttga

SEQ ID NO: 170101 - DNA, 38 bp, Artificial Sequence
  Synthetic oligonucleotide
gcccccccacacttgtctcagattcccgcgtgccttga

SEQ ID NO: 170102 - DNA, 37 bp, Artificial Sequence
  Synthetic oligonucleotide
gacaagggtgagaacgggtagggaagggtgagcttga

SEQ ID NO: 170103 - DNA, 38 bp, Artificial Sequence
  Synthetic oligonucleotide
gacgggggggcgggcagtgacagggacctagggcttga

SEQ ID NO: 170104 - DNA, 35 bp, Artificial Sequence
  Synthetic oligonucleotide
tccacactcgccattcgccgcacatgccctcttga

SEQ ID NO: 170105 - DNA, 37 bp, Artificial Sequence
  Synthetic oligonucleotide
acccttgcgcccttattttgtctttctgctctgttga

SEQ ID NO: 170106 - DNA, 38 bp, Artificial Sequence
  Synthetic oligonucleotide
accgcccggtcaagcgatgccacgtccctcttttttga

SEQ ID NO: 170107 - DNA, 36 bp, Artificial Sequence
  Synthetic oligonucleotide
gcgctcactcctccggtctcgttttttggcaacata

SEQ ID NO: 170108 - DNA, 35 bp, Artificial Sequence
  Synthetic oligonucleotide
gatccacccacacttatgtagtcacatttctgata

SEQ ID NO: 170109 - DNA, 35 bp, Artificial Sequence
  Synthetic oligonucleotide
atacaccccgcccagcccgaataacgcacggtata

SEQ ID NO: 170110 - DNA, 36 bp, Artificial Sequence
  Synthetic oligonucleotide
gacccttgctcacttggtacgttcgcctttcgccta

SEQ ID NO: 170111 - DNA, 35 bp, Artificial Sequence
  Synthetic oligonucleotide
gaacgcccgccctcatgcatagcaggctccttcta

SEQ ID NO: 170112 - DNA, 36 bp, Artificial Sequence
  Synthetic oligonucleotide
gggatgcagtcacttctttcccgccgtcccgtagta

SEQ ID NO: 170113 - DNA, 36 bp, Artificial Sequence
  Synthetic oligonucleotide
actcaacgccccgcatatcccagcccggccttctta

SEQ ID NO: 170114 - DNA, 36 bp, Artificial Sequence
  Synthetic oligonucleotide
tcgctacccttatgcctgttttccccagttccgtta

SEQ ID NO: 170115 - DNA, 35 bp, Artificial Sequence
  Synthetic oligonucleotide
tgccacacatgattcggcataccctggccctttta

SEQ ID NO: 170116 - DNA, 35 bp, Artificial Sequence
  Synthetic oligonucleotide
acaatgagggggaggggggtctggataggtggaac

SEQ ID NO: 170117 - DNA, 35 bp, Artificial Sequence
  Synthetic oligonucleotide
tcctgccctcattcgcacactaactcagcccacac

SEQ ID NO: 170118 - DNA, 35 bp, Artificial Sequence
  Synthetic oligonucleotide
gtatgctacaccatgcctgccgggttttctaccac

SEQ ID NO: 170119 - DNA, 35 bp, Artificial Sequence
  Synthetic oligonucleotide
taccccccctatgataataagtcccgcccaaggac

SEQ ID NO: 170120 - DNA, 35 bp, Artificial Sequence
  Synthetic oligonucleotide
tccgtcactcgccgccattttgatacccgaacacc

SEQ ID NO: 170121 - DNA, 35 bp, Artificial Sequence
  Synthetic oligonucleotide
gatggaggttgtcacgtgcccccccgtacctcacc

SEQ ID NO: 170122 - DNA, 35 bp, Artificial Sequence
  Synthetic oligonucleotide
tgcggtacggaaggttactcgctgccatcgtcccc

SEQ ID NO: 170123 - DNA, 35 bp, Artificial Sequence
  Synthetic oligonucleotide
actcctcgcccacccgtgatcgctcctcgaatccc

SEQ ID NO: 170124 - DNA, 35 bp, Artificial Sequence
  Synthetic oligonucleotide
aacctcaccccaccgtaatttgaccaggccatccc

SEQ ID NO: 170125 - DNA, 35 bp, Artificial Sequence
  Synthetic oligonucleotide
ggggcggtggaggggccggcggaggcctgtctccc

SEQ ID NO: 170126 - DNA, 35 bp, Artificial Sequence
  Synthetic oligonucleotide
agttgaccagctggtgtcctgtatctccctccgcc

SEQ ID NO: 170127 - DNA, 35 bp, Artificial Sequence
  Synthetic oligonucleotide
gcattagcataatgcgtgctatgctcccccaatcc

SEQ ID NO: 170128 - DNA, 35 bp, Artificial Sequence
  Synthetic oligonucleotide
gcctggccccattcacgtctattcgcatagcctcc

SEQ ID NO: 170129 - DNA, 35 bp, Artificial Sequence
  Synthetic oligonucleotide
gcatcaccgccgcaacggttctcccgaagtcctcc

SEQ ID NO: 170130 - DNA, 35 bp, Artificial Sequence
  Synthetic oligonucleotide
aagccggcaatctcccccatccagtttatagctcc

SEQ ID NO: 170131 - DNA, 35 bp, Artificial Sequence
  Synthetic oligonucleotide
gaacagcccgtctccgttcgaccgtagtgtgctcc

SEQ ID NO: 170132 - DNA, 35 bp, Artificial Sequence
  Synthetic oligonucleotide
tgatcccttccaacagacctacgttatcgctgtcc

SEQ ID NO: 170133 - DNA, 35 bp, Artificial Sequence
  Synthetic oligonucleotide
acacctcgccccctctgtaatgtaccactggttcc

SEQ ID NO: 170134 - DNA, 35 bp, Artificial Sequence
  Synthetic oligonucleotide
tctggcacgccgccactcctccactgcatagacgc

SEQ ID NO: 170135 - DNA, 35 bp, Artificial Sequence
  Synthetic oligonucleotide
gttgttacagcagctttatttcaccattcctgcgc

SEQ ID NO: 170136 - DNA, 35 bp, Artificial Sequence
  Synthetic oligonucleotide
tcagttccccatcggccttgtactctcgcgttcgc

SEQ ID NO: 170137 - DNA, 35 bp, Artificial Sequence
  Synthetic oligonucleotide
gtgggcaattggtgggtaatgggggaggtgccggc

SEQ ID NO: 170138 - DNA, 35 bp, Artificial Sequence
  Synthetic oligonucleotide
gccccccgcccactcatcttgcctcatacctgggc

SEQ ID NO: 170139 - DNA, 35 bp, Artificial Sequence
  Synthetic oligonucleotide
tgagtcacatcctgcataagcgtttccccacctgc

SEQ ID NO: 170140 - DNA, 35 bp, Artificial Sequence
  Synthetic oligonucleotide
tgatcgtgtctcagactcctcccacccgtgcttgc

SEQ ID NO: 170141 - DNA, 35 bp, Artificial Sequence
  Synthetic oligonucleotide
gaccacatcagtgaattccttgtcctttcgctatc

SEQ ID NO: 170142 - DNA, 35 bp, Artificial Sequence
  Synthetic oligonucleotide
atcgagcgctgcgaggggcttccgtttgttctatc

SEQ ID NO: 170143 - DNA, 35 bp, Artificial Sequence
  Synthetic oligonucleotide
atgtatcctccgccagtcctgccgccgcctgtatc

SEQ ID NO: 170144 - DNA, 35 bp, Artificial Sequence
  Synthetic oligonucleotide
tcatcacactctacaggcgcaacacagcaccactc

SEQ ID NO: 170145 - DNA, 35 bp, Artificial Sequence
  Synthetic oligonucleotide
gcgcacccgctcactatctgtacgtcagtccactc

SEQ ID NO: 170146 - DNA, 35 bp, Artificial Sequence
  Synthetic oligonucleotide
tccacctccgaatacctagtagtatggtaatcctc

SEQ ID NO: 170147 - DNA, 35 bp, Artificial Sequence
  Synthetic oligonucleotide
atcatctatggcacccgcccgacttcctttggctc

SEQ ID NO: 170148 - DNA, 35 bp, Artificial Sequence
  Synthetic oligonucleotide
ttcataccacagcagttggtccctgccgatctctc

SEQ ID NO: 170149 - DNA, 35 bp, Artificial Sequence
  Synthetic oligonucleotide
acagcatgttgccatccttgttcttgttccccgtc

SEQ ID NO: 170150 - DNA, 31 bp, Artificial Sequence
  Synthetic oligonucleotide
gtgggacgatgcgtcactgctgctcccgttc

SEQ ID NO: 170151 - DNA, 35 bp, Artificial Sequence
  Synthetic oligonucleotide
agttcagccatcgcgccggtgcctttcctagtttc

SEQ ID NO: 170152 - DNA, 35 bp, Artificial Sequence
  Synthetic oligonucleotide
tgaccgggcgagtagaggaaagtggaggggtacag

SEQ ID NO: 170153 - DNA, 35 bp, Artificial Sequence
  Synthetic oligonucleotide
tacttcaaccgattgcctttcgaccaccgaaaccg

SEQ ID NO: 170154 - DNA, 35 bp, Artificial Sequence
  Synthetic oligonucleotide
tcctcgtcacctgtactaaccgtttgcctatcccg

SEQ ID NO: 170155 - DNA, 35 bp, Artificial Sequence
  Synthetic oligonucleotide
tacccactcatcgcacttgtaaatgtcaccctccg

SEQ ID NO: 170156 - DNA, 35 bp, Artificial Sequence
  Synthetic oligonucleotide
taatcagcacactacccgcctaatccgaccccgcg

SEQ ID NO: 170157 - DNA, 35 bp, Artificial Sequence
  Synthetic oligonucleotide
aagagggtgggggccgggggggttgtccaagcgcg

SEQ ID NO: 170158 - DNA, 35 bp, Artificial Sequence
  Synthetic oligonucleotide
tctccgtcccgcctgctcgtaccccttaatcggcg

SEQ ID NO: 170159 - DNA, 35 bp, Artificial Sequence
  Synthetic oligonucleotide
gtccgtaggcgctccctgacttactttgatcctcg

SEQ ID NO: 170160 - DNA, 35 bp, Artificial Sequence
  Synthetic oligonucleotide
gagggtgtgggacggcttgtgtaagggggggtatg

SEQ ID NO: 170161 - DNA, 35 bp, Artificial Sequence
  Synthetic oligonucleotide
tcgcccggtgcaccatcgccttccagatcaccctg

SEQ ID NO: 170162 - DNA, 35 bp, Artificial Sequence
  Synthetic oligonucleotide
gcccgccgtcccaccttgccgccgttaccccagtg

SEQ ID NO: 170163 - DNA, 35 bp, Artificial Sequence
  Synthetic oligonucleotide
gattcgtccaccccatgaccccctcccagtccttg

SEQ ID NO: 170164 - DNA, 35 bp, Artificial Sequence
  Synthetic oligonucleotide
atacagagcctttcatcgccccgtctcgttcccat

SEQ ID NO: 170165 - DNA, 35 bp, Artificial Sequence
  Synthetic oligonucleotide
ttgtgataccgcttctgctatacgctactctccat

SEQ ID NO: 170166 - DNA, 35 bp, Artificial Sequence
  Synthetic oligonucleotide
cccccgcccggttcttcgcccagtcatcaaatgat

SEQ ID NO: 170167 - DNA, 35 bp, Artificial Sequence
  Synthetic oligonucleotide
tccgaccgcatcacctgcctccattcgccgactat

SEQ ID NO: 170168 - DNA, 35 bp, Artificial Sequence
  Synthetic oligonucleotide
gttcacgccgcccaatcgttgcgttctgcacctat

SEQ ID NO: 170169 - DNA, 35 bp, Artificial Sequence
  Synthetic oligonucleotide
tctagcgtaggggagggacggcgcgggcggggtat

SEQ ID NO: 170170 - DNA, 35 bp, Artificial Sequence
  Synthetic oligonucleotide
tgttctcccctcgaactgtgttccgcccgccccct

SEQ ID NO: 170171 - DNA, 35 bp, Artificial Sequence
  Synthetic oligonucleotide
gccatcggcggacattgagcccccacacccccgct

SEQ ID NO: 170172 - DNA, 35 bp, Artificial Sequence
  Synthetic oligonucleotide
gcccaacattgcgtgcaggtcttcctcacccctct

SEQ ID NO: 170173 - DNA, 35 bp, Artificial Sequence
  Synthetic oligonucleotide
gtgccagtctaggtcatctcctgctcctatcctct

SEQ ID NO: 170174 - DNA, 35 bp, Artificial Sequence
  Synthetic oligonucleotide
gatgcaggctgctatgcacctagtacctgtcctct

SEQ ID NO: 170175 - DNA, 35 bp, Artificial Sequence
  Synthetic oligonucleotide
gtcgcatagaaggtgtttagtcctcctccgcttct

SEQ ID NO: 170176 - DNA, 36 bp, Artificial Sequence
  Synthetic oligonucleotide
gcacatgacggggcggacgagggggatgggccaggt

SEQ ID NO: 170177 - DNA, 35 bp, Artificial Sequence
  Synthetic oligonucleotide
actggacgctaccaccacgcccttcttactacggt

SEQ ID NO: 170178 - DNA, 35 bp, Artificial Sequence
  Synthetic oligonucleotide
gacactccccccccacgagatccccgtgtttttgt

SEQ ID NO: 170179 - DNA, 35 bp, Artificial Sequence
  Synthetic oligonucleotide
gcccagcccctctccagacctcacacgactgtctt

SEQ ID NO: 170180 - DNA, 35 bp, Artificial Sequence
  Synthetic oligonucleotide
gagccactcatcatgtcgtcctgtacctgtttgtt

SEQ ID NO: 170181 - DNA, 34 bp, Artificial Sequence
  Synthetic oligonucleotide
ggacgtccctacccgccaattgttccttcgtttt

SEQ ID NO: 170182 - DNA, 36 bp, Artificial Sequence
  Synthetic oligonucleotide
gcagggcccgctccaatgctgccattcctttcacaa

SEQ ID NO: 170183 - DNA, 35 bp, Artificial Sequence
  Synthetic oligonucleotide
gcccactcgcataactcataatcctgtctccccaa

SEQ ID NO: 170184 - DNA, 36 bp, Artificial Sequence
  Synthetic oligonucleotide
gtgtgggacgatgagatggagtgggattaacggcaa

SEQ ID NO: 170185 - DNA, 36 bp, Artificial Sequence
  Synthetic oligonucleotide
tcgacccctccaactcgttccgtgggcttaccaaca

SEQ ID NO: 170186 - DNA, 36 bp, Artificial Sequence
  Synthetic oligonucleotide
tgccctctgtctgtcccctcgtacggcgcttgaaca

SEQ ID NO: 170187 - DNA, 36 bp, Artificial Sequence
  Synthetic oligonucleotide
tcgtccaactctggactgtcctttcctgccgccaca

SEQ ID NO: 170188 - DNA, 36 bp, Artificial Sequence
  Synthetic oligonucleotide
tctcacgcccagctccctcggttacattactctaca

SEQ ID NO: 170189 - DNA, 36 bp, Artificial Sequence
  Synthetic oligonucleotide
gcatgtccggtgtccacgttcgtttcccttgcacca

SEQ ID NO: 170190 - DNA, 36 bp, Artificial Sequence
  Synthetic oligonucleotide
tgtgcaccgacaccgcgccccaggactattatgcca

SEQ ID NO: 170191 - DNA, 36 bp, Artificial Sequence
  Synthetic oligonucleotide
gtgacgcgcagtttttccggcgtacaatcccctcca

SEQ ID NO: 170192 - DNA, 36 bp, Artificial Sequence
  Synthetic oligonucleotide
tagttatcctctcgacctgacgcccgcggctctcca

SEQ ID NO: 170193 - DNA, 36 bp, Artificial Sequence
  Synthetic oligonucleotide
tgtctggggccgtccctcgtccgccgtttacccgca

SEQ ID NO: 170194 - DNA, 35 bp, Artificial Sequence
  Synthetic oligonucleotide
tgcgctacccctgtaccctgccgattccccaggca

SEQ ID NO: 170195 - DNA, 36 bp, Artificial Sequence
  Synthetic oligonucleotide
gtgcccgctattgttttccactcctgctatcgctca

SEQ ID NO: 170196 - DNA, 37 bp, Artificial Sequence
  Synthetic oligonucleotide
tttgtacgagcggagggggaggggtgcaaggcaaaga

SEQ ID NO: 170197 - DNA, 37 bp, Artificial Sequence
  Synthetic oligonucleotide
aacacgagggggaaggagcggagacggttatgataga

SEQ ID NO: 170198 - DNA, 37 bp, Artificial Sequence
  Synthetic oligonucleotide
gaccccacctggttctgtactgaccgctctaccacga

SEQ ID NO: 170199 - DNA, 35 bp, Artificial Sequence
  Synthetic oligonucleotide
tccatccctcggaggcccctacttcagactcacga

SEQ ID NO: 170200 - DNA, 37 bp, Artificial Sequence
  Synthetic oligonucleotide
gcgattcgcccgcccccttcatctctgtgcgctacga

SEQ ID NO: 170201 - DNA, 37 bp, Artificial Sequence
  Synthetic oligonucleotide
agaccgccccccaatggctatcacccccaagttacga

SEQ ID NO: 170202 - DNA, 37 bp, Artificial Sequence
  Synthetic oligonucleotide
tgtactccctctctctgtttattacgcttgcacccga

SEQ ID NO: 170203 - DNA, 35 bp, Artificial Sequence
  Synthetic oligonucleotide
actcacttgctacagccgtaaccgtccacccccga

SEQ ID NO: 170204 - DNA, 37 bp, Artificial Sequence
  Synthetic oligonucleotide
attaggccagtctcagtctgctgccgttcccccccga

SEQ ID NO: 170205 - DNA, 37 bp, Artificial Sequence
  Synthetic oligonucleotide
attccacactgtgagatcccgcccctcgcctatccga

SEQ ID NO: 170206 - DNA, 35 bp, Artificial Sequence
  Synthetic oligonucleotide
aactcaaggtcggcaagctttttctccgcctccga

SEQ ID NO: 170207 - DNA, 35 bp, Artificial Sequence
  Synthetic oligonucleotide
gcccgcacccctcagcacatggcatttctttccga

SEQ ID NO: 170208 - DNA, 36 bp, Artificial Sequence
  Synthetic oligonucleotide
ttaacgccccgtgaccatctaagctcccatcctcga

SEQ ID NO: 170209 - DNA, 36 bp, Artificial Sequence
  Synthetic oligonucleotide
gggttgacacggaagaggagggcggaagcaaaagga

SEQ ID NO: 170210 - DNA, 36 bp, Artificial Sequence
  Synthetic oligonucleotide
gaagtgggggagatttgggggctgactaatacagga

SEQ ID NO: 170211 - DNA, 37 bp, Artificial Sequence
  Synthetic oligonucleotide
atcgggtgagggtgggagggtcagttccgcgcgcgga

SEQ ID NO: 170212 - DNA, 37 bp, Artificial Sequence
  Synthetic oligonucleotide
gagacaggcggaagggtcaagggagggggcgcaggga

SEQ ID NO: 170213 - DNA, 37 bp, Artificial Sequence
  Synthetic oligonucleotide
gagacggacggggggaagtagacgagcagcgggggga

SEQ ID NO: 170214 - DNA, 37 bp, Artificial Sequence
  Synthetic oligonucleotide
ctcggggaggggcaaagtggggggtgcatcctgggga

SEQ ID NO: 170215 - DNA, 36 bp, Artificial Sequence
  Synthetic oligonucleotide
tgattcgccgccgcccaatatgcctcctcccttgga

SEQ ID NO: 170216 - DNA, 38 bp, Artificial Sequence
  Synthetic oligonucleotide
tttgcccccctgagtgaaaccccgcctcaataccatga

SEQ ID NO: 170217 - DNA, 38 bp, Artificial Sequence
  Synthetic oligonucleotide
tccacgtcggctcggttgctcccacgtttctccactga

SEQ ID NO: 170218 - DNA, 38 bp, Artificial Sequence
  Synthetic oligonucleotide
gtcacgccgaagtggccgcgctgccccctgcctcctga

SEQ ID NO: 170219 - DNA, 37 bp, Artificial Sequence
  Synthetic oligonucleotide
aacagcctgaattcgttcgaagccccaccctcgctga

SEQ ID NO: 170220 - DNA, 38 bp, Artificial Sequence
  Synthetic oligonucleotide
gcccaccccccccgttgatactgactccgcgacagtga

SEQ ID NO: 170221 - DNA, 37 bp, Artificial Sequence
  Synthetic oligonucleotide
acaccgccctatcctgctttatgaattcctgacgtga

SEQ ID NO: 170222 - DNA, 38 bp, Artificial Sequence
  Synthetic oligonucleotide
aactcacccatcccgttttagtactccaccaccggtga

SEQ ID NO: 170223 - DNA, 38 bp, Artificial Sequence
  Synthetic oligonucleotide
acctggtcggaggcgggggtggcacggggtctgggtga

SEQ ID NO: 170224 - DNA, 38 bp, Artificial Sequence
  Synthetic oligonucleotide
gcctactacagcctgttccttcctagctacgtacttga

SEQ ID NO: 170225 - DNA, 38 bp, Artificial Sequence
  Synthetic oligonucleotide
gttgcgcgtacattcgttcagtttcacccaccccttga

SEQ ID NO: 170226 - DNA, 37 bp, Artificial Sequence
  Synthetic oligonucleotide
agtagggtgcgggggagtaaggggatgaaaggcttga

SEQ ID NO: 170227 - DNA, 36 bp, Artificial Sequence
  Synthetic oligonucleotide
actagcgggcgggggggcatatttgggactcgttga

SEQ ID NO: 170228 - DNA, 38 bp, Artificial Sequence
  Synthetic oligonucleotide
gtccggagaggcacggggaggtaggaggctatggttga

SEQ ID NO: 170229 - DNA, 38 bp, Artificial Sequence
  Synthetic oligonucleotide
tttaccatacgctgtgctcctcaccatccttctgttga

SEQ ID NO: 170230 - DNA, 37 bp, Artificial Sequence
  Synthetic oligonucleotide
gcgagcgccttcctttttttggccagccccactttga

SEQ ID NO: 170231 - DNA, 35 bp, Artificial Sequence
  Synthetic oligonucleotide
tccactcacccatccccggactgtatgcttagata

SEQ ID NO: 170232 - DNA, 35 bp, Artificial Sequence
  Synthetic oligonucleotide
tgaagccgtcgctccatccctcgtcccttcttata

SEQ ID NO: 170233 - DNA, 36 bp, Artificial Sequence
  Synthetic oligonucleotide
tacctgccacatggcgctccaccaaccaattttcta

SEQ ID NO: 170234 - DNA, 36 bp, Artificial Sequence
  Synthetic oligonucleotide
tataccccgaccgcttgtcctaacgcgctgccttta

SEQ ID NO: 170235 - DNA, 36 bp, Artificial Sequence
  Synthetic oligonucleotide
accgcccccccacctgcatcctgtttcaacggttta

SEQ ID NO: 170236 - DNA, 35 bp, Artificial Sequence
  Synthetic oligonucleotide
gccccagctcccccaagtgtccagcttcccttaac

SEQ ID NO: 170237 - DNA, 35 bp, Artificial Sequence
  Synthetic oligonucleotide
gagtcacgcccgccctgaatagccgacgtcatcac

SEQ ID NO: 170238 - DNA, 35 bp, Artificial Sequence
  Synthetic oligonucleotide
acgtgcccacgggacgttgctctccctccgcatac

SEQ ID NO: 170239 - DNA, 35 bp, Artificial Sequence
  Synthetic oligonucleotide
agacagtacggccattgccccctcaccctcgctac

SEQ ID NO: 170240 - DNA, 35 bp, Artificial Sequence
  Synthetic oligonucleotide
gtgacacatccggagtaccccaccgccaggacacc

SEQ ID NO: 170241 - DNA, 35 bp, Artificial Sequence
  Synthetic oligonucleotide
acgcacacctctctgttaacaatcattgctacccc

SEQ ID NO: 170242 - DNA, 35 bp, Artificial Sequence
  Synthetic oligonucleotide
tgataccgttcaaaatgctttcggatcgctccccc

SEQ ID NO: 170243 - DNA, 35 bp, Artificial Sequence
  Synthetic oligonucleotide
actactctcgcgcaacgacctttgcgtcctgcccc

SEQ ID NO: 170244 - DNA, 35 bp, Artificial Sequence
  Synthetic oligonucleotide
cctacctccgatctcgtactcgcttttcgttgccc

SEQ ID NO: 170245 - DNA, 35 bp, Artificial Sequence
  Synthetic oligonucleotide
gacccgtgtgcatccgttttaagccccccgttccc

SEQ ID NO: 170246 - DNA, 34 bp, Artificial Sequence
  Synthetic oligonucleotide
gtacagcacatacctcctcgttctgatccaagcc

SEQ ID NO: 170247 - DNA, 35 bp, Artificial Sequence
  Synthetic oligonucleotide
atgtccgcagctggttctcgatctcccctgccgcc

SEQ ID NO: 170248 - DNA, 35 bp, Artificial Sequence
  Synthetic oligonucleotide
acttcccgctcacctggatctcaaaactgcatgcc

SEQ ID NO: 170249 - DNA, 35 bp, Artificial Sequence
  Synthetic oligonucleotide
gggatccgccgccccactcgaggtctaactagtcc

SEQ ID NO: 170250 - DNA, 35 bp, Artificial Sequence
  Synthetic oligonucleotide
gtcaaccccctttcctgtcgttcttgttacggtcc

SEQ ID NO: 170251 - DNA, 35 bp, Artificial Sequence
  Synthetic oligonucleotide
acgttggacgtcaaatgttcgtctcgcacccttcc

SEQ ID NO: 170252 - DNA, 35 bp, Artificial Sequence
  Synthetic oligonucleotide
agatctgccacacccgcttcccgtcctccgtttcc

SEQ ID NO: 170253 - DNA, 35 bp, Artificial Sequence
  Synthetic oligonucleotide
ggtgaccgttagactttttccctgtccgtgcccgc

SEQ ID NO: 170254 - DNA, 35 bp, Artificial Sequence
  Synthetic oligonucleotide
aaaggccgactcccccccccagcatcagctcgcgc

SEQ ID NO: 170255 - DNA, 35 bp, Artificial Sequence
  Synthetic oligonucleotide
gcacctactacgcccctgatttcgcctggcccggc

SEQ ID NO: 170256 - DNA, 35 bp, Artificial Sequence
  Synthetic oligonucleotide
gcttgccggagcgttaatccctatcccctcatggc

SEQ ID NO: 170257 - DNA, 35 bp, Artificial Sequence
  Synthetic oligonucleotide
gcccgccccggggtacttctgacttcctatattgc

SEQ ID NO: 170258 - DNA, 35 bp, Artificial Sequence
  Synthetic oligonucleotide
acccacgcgtaatggtctaacaccctccttacatc

SEQ ID NO: 170259 - DNA, 35 bp, Artificial Sequence
  Synthetic oligonucleotide
ggtcgaggtccgccccccagctgttcggtcttatc

SEQ ID NO: 170260 - DNA, 36 bp, Artificial Sequence
  Synthetic oligonucleotide
tccgtaccctgccgccagccggcgcaattgctactc

SEQ ID NO: 170261 - DNA, 35 bp, Artificial Sequence
  Synthetic oligonucleotide
tcatcatcgcgtcgattttgcaccctgttgtcctc

SEQ ID NO: 170262 - DNA, 35 bp, Artificial Sequence
  Synthetic oligonucleotide
ttgcagttcgtccagtgctctagctcgcacctctc

SEQ ID NO: 170263 - DNA, 35 bp, Artificial Sequence
  Synthetic oligonucleotide
agtgcgagcacccctcctataatccgtacgccgtc

SEQ ID NO: 170264 - DNA, 35 bp, Artificial Sequence
  Synthetic oligonucleotide
gacgcccccgacacatctctctctatagtgcggtc

SEQ ID NO: 170265 - DNA, 35 bp, Artificial Sequence
  Synthetic oligonucleotide
tcagatctagcccatattgcctcgtccgactattc

SEQ ID NO: 170266 - DNA, 35 bp, Artificial Sequence
  Synthetic oligonucleotide
gcaggaagggtgagggggggaggtcataggagaag

SEQ ID NO: 170267 - DNA, 35 bp, Artificial Sequence
  Synthetic oligonucleotide
atcgagtgaaggggggggaggtgaagggccataag

SEQ ID NO: 170268 - DNA, 35 bp, Artificial Sequence
  Synthetic oligonucleotide
acatggacagtagctcgcctccccgttatccaacg

SEQ ID NO: 170269 - DNA, 35 bp, Artificial Sequence
  Synthetic oligonucleotide
agggcgggggggacaaggagtaggttgggcgcacg

SEQ ID NO: 170270 - DNA, 35 bp, Artificial Sequence
  Synthetic oligonucleotide
actcattccctgcgtcatcttacttcttccccccg

SEQ ID NO: 170271 - DNA, 35 bp, Artificial Sequence
  Synthetic oligonucleotide
gatagccccacgcctcgaaagaatgccttcccccg

SEQ ID NO: 170272 - DNA, 35 bp, Artificial Sequence
  Synthetic oligonucleotide
gcccgcctcccctcgcttgaaagcaccctgttccg

SEQ ID NO: 170273 - DNA, 35 bp, Artificial Sequence
  Synthetic oligonucleotide
accctgcacccctctagcctgaaatgacctttgcg

SEQ ID NO: 170274 - DNA, 35 bp, Artificial Sequence
  Synthetic oligonucleotide
ttcggggcctcaccgtatccttcaaactcccttcg

SEQ ID NO: 170275 - DNA, 35 bp, Artificial Sequence
  Synthetic oligonucleotide
tccacctccatggcacccttacgcaattctgttcg

SEQ ID NO: 170276 - DNA, 35 bp, Artificial Sequence
  Synthetic oligonucleotide
aaaggtggaggctggtggaagggagggggaggggg

SEQ ID NO: 170277 - DNA, 35 bp, Artificial Sequence
  Synthetic oligonucleotide
aacaacccagtggtgtgtggtgggaagaagtgggg

SEQ ID NO: 170278 - DNA, 35 bp, Artificial Sequence
  Synthetic oligonucleotide
ttcgacggctccatcccccaggtaacccccgctgg

SEQ ID NO: 170279 - DNA, 35 bp, Artificial Sequence
  Synthetic oligonucleotide
acacaccacctatcatgttcgccgttccgctcttg

SEQ ID NO: 170280 - DNA, 35 bp, Artificial Sequence
  Synthetic oligonucleotide
gtgtggggcgcgggggggtgggggcgtgcgctttg

SEQ ID NO: 170281 - DNA, 35 bp, Artificial Sequence
  Synthetic oligonucleotide
aatgccccccacacctgtgactttagacccctact

SEQ ID NO: 170282 - DNA, 35 bp, Artificial Sequence
  Synthetic oligonucleotide
accatcccgtgcgagggtgcaatggcctctaccct

SEQ ID NO: 170283 - DNA, 35 bp, Artificial Sequence
  Synthetic oligonucleotide
gacaccgctgccatctgcatgatcaaatcgcccct

SEQ ID NO: 170284 - DNA, 35 bp, Artificial Sequence
  Synthetic oligonucleotide
tctgccacgccacttgaactgtagtaacccgccct

SEQ ID NO: 170285 - DNA, 35 bp, Artificial Sequence
  Synthetic oligonucleotide
accgtggtctcgttgctatccactctcctggccct

SEQ ID NO: 170286 - DNA, 35 bp, Artificial Sequence
  Synthetic oligonucleotide
gcaactgacctcgtatctgttcgtatcttgtccct

SEQ ID NO: 170287 - DNA, 35 bp, Artificial Sequence
  Synthetic oligonucleotide
gctcgtcccgccatgttccgtcgactttcgcgcct

SEQ ID NO: 170288 - DNA, 35 bp, Artificial Sequence
  Synthetic oligonucleotide
gcatgccgtctccactccgcgtccctccgaatcct

SEQ ID NO: 170289 - DNA, 34 bp, Artificial Sequence
  Synthetic oligonucleotide
tgttagctctacctgtcgtcaccacgtcttcgct

SEQ ID NO: 170290 - DNA, 35 bp, Artificial Sequence
  Synthetic oligonucleotide
gcttcaacgccagtcccagcgctttatccacatct

SEQ ID NO: 170291 - DNA, 35 bp, Artificial Sequence
  Synthetic oligonucleotide
acgcaaccgccgttccccgcgccgggtacatctct

SEQ ID NO: 170292 - DNA, 35 bp, Artificial Sequence
  Synthetic oligonucleotide
gatggccacccccgtcttcctgtcatagttatagt

SEQ ID NO: 170293 - DNA, 35 bp, Artificial Sequence
  Synthetic oligonucleotide
actccccccgcgcgttagcatacgttgttttccgt

SEQ ID NO: 170294 - DNA, 35 bp, Artificial Sequence
  Synthetic oligonucleotide
aagcccgtggatgggcggggcaagttaggggaggt

SEQ ID NO: 170295 - DNA, 35 bp, Artificial Sequence
  Synthetic oligonucleotide
aggggcaaggggcaagagggcggaaacaagggggt

SEQ ID NO: 170296 - DNA, 35 bp, Artificial Sequence
  Synthetic oligonucleotide
ttcccgccggtctcacacttcctaactcacatggt

SEQ ID NO: 170297 - DNA, 35 bp, Artificial Sequence
  Synthetic oligonucleotide
actctccaaccgctgaatgtaaggttccctcctgt

SEQ ID NO: 170298 - DNA, 35 bp, Artificial Sequence
  Synthetic oligonucleotide
gaggctccgatacctgcccctcgccactccgctgt

SEQ ID NO: 170299 - DNA, 35 bp, Artificial Sequence
  Synthetic oligonucleotide
gtaccttccccatcttaacctccgcctgcctttgt

SEQ ID NO: 170300 - DNA, 35 bp, Artificial Sequence
  Synthetic oligonucleotide
gcctgtccttgttttggcgccttttacctgcactt

SEQ ID NO: 170301 - DNA, 34 bp, Artificial Sequence
  Synthetic oligonucleotide
gccctgcaccccggacgtcgtactccgctgcctt

SEQ ID NO: 170302 - DNA, 35 bp, Artificial Sequence
  Synthetic oligonucleotide
tcacccagtcatctcgccctttaagctccgacttt

SEQ ID NO: 170303 - DNA, 35 bp, Artificial Sequence
  Synthetic oligonucleotide
taccagtcccttccttctgtatggctacacccttt

SEQ ID NO: 170304 - DNA, 35 bp, Artificial Sequence
  Synthetic oligonucleotide
gagccagctcacgttcgtacctccaactgcccttt

SEQ ID NO: 170305 - DNA, 36 bp, Artificial Sequence
  Synthetic oligonucleotide
tgttgcatacccagtttgtcttacccgcccctccaa

SEQ ID NO: 170306 - DNA, 36 bp, Artificial Sequence
  Synthetic oligonucleotide
tcatccctctcgacttggaccggaccattccacgaa

SEQ ID NO: 170307 - DNA, 36 bp, Artificial Sequence
  Synthetic oligonucleotide
aagagaaacggagtgctgggggacgaggggaaataa

SEQ ID NO: 170308 - DNA, 36 bp, Artificial Sequence
  Synthetic oligonucleotide
tcctcccctcgccgtttgcaaggttcatacatttaa

SEQ ID NO: 170309 - DNA, 35 bp, Artificial Sequence
  Synthetic oligonucleotide
taccaacccctttgccggtgtacgatcaccctaca

SEQ ID NO: 170310 - DNA, 36 bp, Artificial Sequence
  Synthetic oligonucleotide
gtgtgcccccccgtgttccactcgccgacctctaca

SEQ ID NO: 170311 - DNA, 36 bp, Artificial Sequence
  Synthetic oligonucleotide
gtgacgcgcacacctctgttccagcaatcattacca

SEQ ID NO: 170312 - DNA, 36 bp, Artificial Sequence
  Synthetic oligonucleotide
ttctcgctcctgcctccaatgataacaccctaccca

SEQ ID NO: 170313 - DNA, 36 bp, Artificial Sequence
  Synthetic oligonucleotide
cccaccgccatcgccctgaggcatcttcctcgccca

SEQ ID NO: 170314 - DNA, 36 bp, Artificial Sequence
  Synthetic oligonucleotide
gatccgcctatcctgaattcgtagctaactgtccca

SEQ ID NO: 170315 - DNA, 36 bp, Artificial Sequence
  Synthetic oligonucleotide
taccaccgcacccgatcgcattgtagatcaatgcca

SEQ ID NO: 170316 - DNA, 35 bp, Artificial Sequence
  Synthetic oligonucleotide
tgtccccgagtattgcgtcacaaagcccttttcca

SEQ ID NO: 170317 - DNA, 36 bp, Artificial Sequence
  Synthetic oligonucleotide
ttggcatccatccatctgttgtcctgctcttcagca

SEQ ID NO: 170318 - DNA, 36 bp, Artificial Sequence
  Synthetic oligonucleotide
gacgtgagtgcaagagagtagagggaacggggagca

SEQ ID NO: 170319 - DNA, 36 bp, Artificial Sequence
  Synthetic oligonucleotide
ctccccccgtccatcctgttacggtccagccccgca

SEQ ID NO: 170320 - DNA, 36 bp, Artificial Sequence
  Synthetic oligonucleotide
agaggttagggcgggaagcgggggcgagggggggca

SEQ ID NO: 170321 - DNA, 35 bp, Artificial Sequence
  Synthetic oligonucleotide
tagccctccgacatagctcgttcctgtgtcctgca

SEQ ID NO: 170322 - DNA, 36 bp, Artificial Sequence
  Synthetic oligonucleotide
tgagtaccaccagcttgcactccctcgttgccctca

SEQ ID NO: 170323 - DNA, 36 bp, Artificial Sequence
  Synthetic oligonucleotide
gctcaacccgcatccttcgtaatcaggcctgtctca

SEQ ID NO: 170324 - DNA, 36 bp, Artificial Sequence
  Synthetic oligonucleotide
acgtactaccaccgcttgactatgtgcagtccgtca

SEQ ID NO: 170325 - DNA, 36 bp, Artificial Sequence
  Synthetic oligonucleotide
tttgcgccccgcctcgcattcctgttagttgtttca

SEQ ID NO: 170326 - DNA, 37 bp, Artificial Sequence
  Synthetic oligonucleotide
gagacgggggtgaagaggaattggggatgaggtaaga

SEQ ID NO: 170327 - DNA, 37 bp, Artificial Sequence
  Synthetic oligonucleotide
taaagggggcgggcctgggatgggcgaatgaggcaga

SEQ ID NO: 170328 - DNA, 37 bp, Artificial Sequence
  Synthetic oligonucleotide
tagctcggggagggaaccgggaggaaaggtggggaga

SEQ ID NO: 170329 - DNA, 35 bp, Artificial Sequence
  Synthetic oligonucleotide
taggggagggatggagcagggaaccgtgagctaga

SEQ ID NO: 170330 - DNA, 37 bp, Artificial Sequence
  Synthetic oligonucleotide
gcgaaaggttgggtgcggatggggcaggtggggtaga

SEQ ID NO: 170331 - DNA, 35 bp, Artificial Sequence
  Synthetic oligonucleotide
gccaccctagccggatacccccgatctacatacga

SEQ ID NO: 170332 - DNA, 36 bp, Artificial Sequence
  Synthetic oligonucleotide
tcacgcatatcagaccgtcaccgccgcttttaccga

SEQ ID NO: 170333 - DNA, 36 bp, Artificial Sequence
  Synthetic oligonucleotide
gtctcccatcccccaaccggcccaggccttgcccga

SEQ ID NO: 170334 - DNA, 37 bp, Artificial Sequence
  Synthetic oligonucleotide
aggtgcgcattgccgtttttcatgcccccttcatcga

SEQ ID NO: 170335 - DNA, 37 bp, Artificial Sequence
  Synthetic oligonucleotide
gaaagccgcctcgtgctttaacgccccatcccctcga

SEQ ID NO: 170336 - DNA, 37 bp, Artificial Sequence
  Synthetic oligonucleotide
acatccgctcctacgttatcccgtatcgctctctcga

SEQ ID NO: 170337 - DNA, 36 bp, Artificial Sequence
  Synthetic oligonucleotide
agggtggatgggggtgcgggagtttacggtggagga

SEQ ID NO: 170338 - DNA, 37 bp, Artificial Sequence
  Synthetic oligonucleotide
tagggtgatgtgggggagaccgcatggggtctgagga

SEQ ID NO: 170339 - DNA, 37 bp, Artificial Sequence
  Synthetic oligonucleotide
tctacccgcaacttgcatcttacgctcactcttagga

SEQ ID NO: 170340 - DNA, 36 bp, Artificial Sequence
  Synthetic oligonucleotide
gctcccccgacatgccgcccttatagcgcccccgga

SEQ ID NO: 170341 - DNA, 36 bp, Artificial Sequence
  Synthetic oligonucleotide
ttgcatgtcacgtcggggaagtagggggggcaggga

SEQ ID NO: 170342 - DNA, 37 bp, Artificial Sequence
  Synthetic oligonucleotide
gtacttaacgtaccgggtgggaagaacgggagaggga

SEQ ID NO: 170343 - DNA, 36 bp, Artificial Sequence
  Synthetic oligonucleotide
gacgacgggcgaaggtgtgtgggaactcgggcggga

SEQ ID NO: 170344 - DNA, 37 bp, Artificial Sequence
  Synthetic oligonucleotide
acaccagcatcccgcttttccctgccccataggtgga

SEQ ID NO: 170345 - DNA, 38 bp, Artificial Sequence
  Synthetic oligonucleotide
gaaccaccgcctactcgctgccttttagtatcccatga

SEQ ID NO: 170346 - DNA, 38 bp, Artificial Sequence
  Synthetic oligonucleotide
gtgcctctccgcccccccatacatgtgtcaccctatga

SEQ ID NO: 170347 - DNA, 36 bp, Artificial Sequence
  Synthetic oligonucleotide
accccaccccccgtatcgtaccctgtatttgtatga

SEQ ID NO: 170348 - DNA, 38 bp, Artificial Sequence
  Synthetic oligonucleotide
tgttgccatcagacctggccctcgcttctcgaccctga

SEQ ID NO: 170349 - DNA, 38 bp, Artificial Sequence
  Synthetic oligonucleotide
taagagctcagcgggagaagggttggggggggatctga

SEQ ID NO: 170350 - DNA, 38 bp, Artificial Sequence
  Synthetic oligonucleotide
ggacaccgccactaaggcttgcaccacttcctccgtga

SEQ ID NO: 170351 - DNA, 38 bp, Artificial Sequence
  Synthetic oligonucleotide
gtggatgccgccacagacctcccttcttagcttcgtga

SEQ ID NO: 170352 - DNA, 38 bp, Artificial Sequence
  Synthetic oligonucleotide
acttcccccactagtcttcgcacctgtccccccggtga

SEQ ID NO: 170353 - DNA, 38 bp, Artificial Sequence
  Synthetic oligonucleotide
attgcacaaaggaagctgtaggagggggagtggggtga

SEQ ID NO: 170354 - DNA, 37 bp, Artificial Sequence
  Synthetic oligonucleotide
tcgccctccgacctgtctcgtgccgcctgatcattga

SEQ ID NO: 170355 - DNA, 38 bp, Artificial Sequence
  Synthetic oligonucleotide
gtgctcgcatctcggtcgtgccctctccattgccttga

SEQ ID NO: 170356 - DNA, 38 bp, Artificial Sequence
  Synthetic oligonucleotide
tgtgggggtggtgtgaggagggggacagagagcgttga

SEQ ID NO: 170357 - DNA, 38 bp, Artificial Sequence
  Synthetic oligonucleotide
tccgtcgcctcgcccgcttctttgcttgatcactttga

SEQ ID NO: 170358 - DNA, 37 bp, Artificial Sequence
  Synthetic oligonucleotide
gtgcggggtggaaaaagggaagggggtggtgttttga

SEQ ID NO: 170359 - DNA, 35 bp, Artificial Sequence
  Synthetic oligonucleotide
atgggtgggaggggcttctcaagggccttgcaata

SEQ ID NO: 170360 - DNA, 36 bp, Artificial Sequence
  Synthetic oligonucleotide
acccactcatccctgttccagcccactcgaacgata

SEQ ID NO: 170361 - DNA, 36 bp, Artificial Sequence
  Synthetic oligonucleotide
gcgcacacctgctcgtcctaggctctccagctccta

SEQ ID NO: 170362 - DNA, 36 bp, Artificial Sequence
  Synthetic oligonucleotide
gctgccatgtccgttccgcccccaatcgtgactcta

SEQ ID NO: 170363 - DNA, 36 bp, Artificial Sequence
  Synthetic oligonucleotide
gctgctgccttctccatgccttctctgcgtatcgta

SEQ ID NO: 170364 - DNA, 35 bp, Artificial Sequence
  Synthetic oligonucleotide
acttcccaccttcactatggttcaccatctcggta

SEQ ID NO: 170365 - DNA, 36 bp, Artificial Sequence
  Synthetic oligonucleotide
gacatcgcactatctctggtattcgtctcccttgta

SEQ ID NO: 170366 - DNA, 35 bp, Artificial Sequence
  Synthetic oligonucleotide
gaggagcagaagtgcacacgttacacccgccctta

SEQ ID NO: 170367 - DNA, 36 bp, Artificial Sequence
  Synthetic oligonucleotide
gtgtgccccccgccggtttttcgcttgccttgttta

SEQ ID NO: 170368 - DNA, 35 bp, Artificial Sequence
  Synthetic oligonucleotide
ccgacaagccgggagggaaaggggtgggcgttgac

SEQ ID NO: 170369 - DNA, 35 bp, Artificial Sequence
  Synthetic oligonucleotide
gacctagcggcaacttcccgacccgtctttacacc

SEQ ID NO: 170370 - DNA, 35 bp, Artificial Sequence
  Synthetic oligonucleotide
accgaatcgatgtcaccctgcacgtcaaccgcccc

SEQ ID NO: 170371 - DNA, 35 bp, Artificial Sequence
  Synthetic oligonucleotide
gtctagctgcccgcctccattgaccaggagtcccc

SEQ ID NO: 170372 - DNA, 35 bp, Artificial Sequence
  Synthetic oligonucleotide
acgttacccgcccgcttgtttttgaacccgttccc

SEQ ID NO: 170373 - DNA, 35 bp, Artificial Sequence
  Synthetic oligonucleotide
ttgctccatcaccgcattccattgccgcaaatgcc

SEQ ID NO: 170374 - DNA, 35 bp, Artificial Sequence
  Synthetic oligonucleotide
tcacgcgccaaccacccgattccacgagtcttgcc

SEQ ID NO: 170375 - DNA, 35 bp, Artificial Sequence
  Synthetic oligonucleotide
tccgggatatctactgttccctgtcaccgccctcc

SEQ ID NO: 170376 - DNA, 35 bp, Artificial Sequence
  Synthetic oligonucleotide
gcgaatcctgccgtacgtaccttgcacttatctcc

SEQ ID NO: 170377 - DNA, 35 bp, Artificial Sequence
  Synthetic oligonucleotide
tgacgttgcggtatgcgctaactgtcgacccttcc

SEQ ID NO: 170378 - DNA, 35 bp, Artificial Sequence
  Synthetic oligonucleotide
tcggacgggcctccgatatcttcacctctcctcgc

SEQ ID NO: 170379 - DNA, 35 bp, Artificial Sequence
  Synthetic oligonucleotide
ttgcccaccatcgtgcacaccgtttatcttatggc

SEQ ID NO: 170380 - DNA, 35 bp, Artificial Sequence
  Synthetic oligonucleotide
acccccgcccggtcccattctcttgacgatcactc

SEQ ID NO: 170381 - DNA, 35 bp, Artificial Sequence
  Synthetic oligonucleotide
gtgccggaactatagtaatgcggattttacccctc

SEQ ID NO: 170382 - DNA, 35 bp, Artificial Sequence
  Synthetic oligonucleotide
agattgcagactgtccattcgcaccccttggcctc

SEQ ID NO: 170383 - DNA, 35 bp, Artificial Sequence
  Synthetic oligonucleotide
gcctcggcccggcctccacctttgcaaacctcctc

SEQ ID NO: 170384 - DNA, 35 bp, Artificial Sequence
  Synthetic oligonucleotide
gttactccaatgctggcgatccctgttcacttgtc

SEQ ID NO: 170385 - DNA, 35 bp, Artificial Sequence
  Synthetic oligonucleotide
gcaacgcgcgcctcctcatgccttgaatgtgcttc

SEQ ID NO: 170386 - DNA, 35 bp, Artificial Sequence
  Synthetic oligonucleotide
gcgtgccgccggtatctagtcttcactgcttcttc

SEQ ID NO: 170387 - DNA, 35 bp, Artificial Sequence
  Synthetic oligonucleotide
agtcgcctcccccgctttaacagccagattacaag

SEQ ID NO: 170388 - DNA, 35 bp, Artificial Sequence
  Synthetic oligonucleotide
aagggaaatggaggtagggtgggaggtacgctaag

SEQ ID NO: 170389 - DNA, 35 bp, Artificial Sequence
  Synthetic oligonucleotide
gaaatggagcgaatagcaagcaggagggcaggacg

SEQ ID NO: 170390 - DNA, 35 bp, Artificial Sequence
  Synthetic oligonucleotide
tcagaccctccccgatgaccgccgctccgtatacg

SEQ ID NO: 170391 - DNA, 35 bp, Artificial Sequence
  Synthetic oligonucleotide
tccatctagatcccgcattaaaaactcgctccccg

SEQ ID NO: 170392 - DNA, 35 bp, Artificial Sequence
  Synthetic oligonucleotide
acattaacgccccacacgcaccgctcacagttccg

SEQ ID NO: 170393 - DNA, 35 bp, Artificial Sequence
  Synthetic oligonucleotide
tcaacggtcccttttttctgttttcctgctcttcg

SEQ ID NO: 170394 - DNA, 35 bp, Artificial Sequence
  Synthetic oligonucleotide
gtgtccaacgcccctttacatatcttttcatttcg

SEQ ID NO: 170395 - DNA, 35 bp, Artificial Sequence
  Synthetic oligonucleotide
atgggcgcgggcggtggggagggctaaggttcagg

SEQ ID NO: 170396 - DNA, 35 bp, Artificial Sequence
  Synthetic oligonucleotide
tgatgtctcagcgcttgtcatctttctcccctagg

SEQ ID NO: 170397 - DNA, 35 bp, Artificial Sequence
  Synthetic oligonucleotide
tcagcgcatcaaccagattccgcctcatgatcctg

SEQ ID NO: 170398 - DNA, 36 bp, Artificial Sequence
  Synthetic oligonucleotide
aggtgcgcagcccactccctcagttttccatctctg

SEQ ID NO: 170399 - DNA, 35 bp, Artificial Sequence
  Synthetic oligonucleotide
tgcctcatccccggctaactacctctcaccgtttg

SEQ ID NO: 170400 - DNA, 35 bp, Artificial Sequence
  Synthetic oligonucleotide
gaagccgccctgccactagtaggacccccttacat

SEQ ID NO: 170401 - DNA, 35 bp, Artificial Sequence
  Synthetic oligonucleotide
aatctgcatccctggtcacgcgagttcctcaccat

SEQ ID NO: 170402 - DNA, 35 bp, Artificial Sequence
  Synthetic oligonucleotide
tcagacgcacctccttttccatcaaggccccgtat

SEQ ID NO: 170403 - DNA, 35 bp, Artificial Sequence
  Synthetic oligonucleotide
gcagatctgactccccttccacgattactttcgct

SEQ ID NO: 170404 - DNA, 35 bp, Artificial Sequence
  Synthetic oligonucleotide
tttccaccaccatcggcgttttcagccttcactct

SEQ ID NO: 170405 - DNA, 35 bp, Artificial Sequence
  Synthetic oligonucleotide
cccatggccatgcccgaactactctgaatacctct

SEQ ID NO: 170406 - DNA, 35 bp, Artificial Sequence
  Synthetic oligonucleotide
gccccctcttgcaacatgtcccgctctgtgccatt

SEQ ID NO: 170407 - DNA, 35 bp, Artificial Sequence
  Synthetic oligonucleotide
gcgtaccatctagcgccttgtcacctcatatcctt

SEQ ID NO: 170408 - DNA, 35 bp, Artificial Sequence
  Synthetic oligonucleotide
tccctcgacgctctccccgtacactgaatttagtt

SEQ ID NO: 170409 - DNA, 35 bp, Artificial Sequence
  Synthetic oligonucleotide
accgtccccccctccgtcatccgaacctatgtttt

SEQ ID NO: 170410 - DNA, 35 bp, Artificial Sequence
  Synthetic oligonucleotide
gacgctcggggtcgaccagcaccatctccattttt

SEQ ID NO: 170411 - DNA, 36 bp, Artificial Sequence
  Synthetic oligonucleotide
ttgcggggaatcgggggtgcggggaagagggaaaaa

SEQ ID NO: 170412 - DNA, 36 bp, Artificial Sequence
  Synthetic oligonucleotide
agatgagggtgttagggggagggctgcaggagaaaa

SEQ ID NO: 170413 - DNA, 35 bp, Artificial Sequence
  Synthetic oligonucleotide
aacgacgcacctacctgtccgcatggctccccgaa

SEQ ID NO: 170414 - DNA, 36 bp, Artificial Sequence
  Synthetic oligonucleotide
tcgaaacagtaggatagcaaaggggggagggtcgaa

SEQ ID NO: 170415 - DNA, 36 bp, Artificial Sequence
  Synthetic oligonucleotide
gtggtggggggaaataaagggataacaggtggtgaa

SEQ ID NO: 170416 - DNA, 36 bp, Artificial Sequence
  Synthetic oligonucleotide
tcactccaccgttccatagtctatatcgccccaaca

SEQ ID NO: 170417 - DNA, 36 bp, Artificial Sequence
  Synthetic oligonucleotide
tagaacgcagagctgcccgtccttcactgttccaca

SEQ ID NO: 170418 - DNA, 36 bp, Artificial Sequence
  Synthetic oligonucleotide
actgcatgccggccctgttccttcggtcctttcaca

SEQ ID NO: 170419 - DNA, 35 bp, Artificial Sequence
  Synthetic oligonucleotide
gtgacccaccgccgagctatcttatgacgtgacca

SEQ ID NO: 170420 - DNA, 36 bp, Artificial Sequence
  Synthetic oligonucleotide
gcatgccccgcatgccgcttaagccttttcatacca

SEQ ID NO: 170421 - DNA, 35 bp, Artificial Sequence
  Synthetic oligonucleotide
actgtgtcacccccctgtagccgtaatggatccca

SEQ ID NO: 170422 - DNA, 36 bp, Artificial Sequence
  Synthetic oligonucleotide
gatgaccccacaccagacctgagccgctttgagcca

SEQ ID NO: 170423 - DNA, 36 bp, Artificial Sequence
  Synthetic oligonucleotide
gtcgccgtcgctttcggctaatcgccccaccatcca

SEQ ID NO: 170424 - DNA, 35 bp, Artificial Sequence
  Synthetic oligonucleotide
acttacccacccccggacagtgccaatcaggtcca

SEQ ID NO: 170425 - DNA, 35 bp, Artificial Sequence
  Synthetic oligonucleotide
gagatgggtagggaaaggaggagcgggtaaaggca

SEQ ID NO: 170426 - DNA, 35 bp, Artificial Sequence
  Synthetic oligonucleotide
aacacgccaagtgcctcttcactacagctccctca

SEQ ID NO: 170427 - DNA, 35 bp, Artificial Sequence
  Synthetic oligonucleotide
tcaactccgccgaatttcttccgctctgtgattca

SEQ ID NO: 170428 - DNA, 36 bp, Artificial Sequence
  Synthetic oligonucleotide
tacacaccaccacgtttttcgcaccgcaccgcttca

SEQ ID NO: 170429 - DNA, 36 bp, Artificial Sequence
  Synthetic oligonucleotide
acaccctctcctcgtgcctattgccttctcgtcaga

SEQ ID NO: 170430 - DNA, 37 bp, Artificial Sequence
  Synthetic oligonucleotide
ggaagggaggggggttagggtagagctatgtgcgaga

SEQ ID NO: 170431 - DNA, 37 bp, Artificial Sequence
  Synthetic oligonucleotide
gtagggtgagggcaaaaccgtagggtaaggggggaga

SEQ ID NO: 170432 - DNA, 37 bp, Artificial Sequence
  Synthetic oligonucleotide
atcccgtacaggggagcatcacgccatcttccaccga

SEQ ID NO: 170433 - DNA, 36 bp, Artificial Sequence
  Synthetic oligonucleotide
gccaccgccaacttcactgggtctcccttcagccga

SEQ ID NO: 170434 - DNA, 36 bp, Artificial Sequence
  Synthetic oligonucleotide
tccgccgaacgacagaagccccccgtactccgccga

SEQ ID NO: 170435 - DNA, 35 bp, Artificial Sequence
  Synthetic oligonucleotide
gagcaacatctgagcgaagcgccactctccgccga

SEQ ID NO: 170436 - DNA, 37 bp, Artificial Sequence
  Synthetic oligonucleotide
tgcgagacgaggacgggtaggaggggggcgtgtccga

SEQ ID NO: 170437 - DNA, 36 bp, Artificial Sequence
  Synthetic oligonucleotide
gaccacgccacagagccgcgccatagcctcttccga

SEQ ID NO: 170438 - DNA, 37 bp, Artificial Sequence
  Synthetic oligonucleotide
atccagccccgccgtttctgagcttttaccaccgcga

SEQ ID NO: 170439 - DNA, 37 bp, Artificial Sequence
  Synthetic oligonucleotide
gtcgttccctccagccactattagcgccaccccgcga

SEQ ID NO: 170440 - DNA, 37 bp, Artificial Sequence
  Synthetic oligonucleotide
gacaagggggagggcgagagaggcggaggattcgcga

SEQ ID NO: 170441 - DNA, 37 bp, Artificial Sequence
  Synthetic oligonucleotide
gcaccgtgcacgctggttcttcatccccatatatcga

SEQ ID NO: 170442 - DNA, 37 bp, Artificial Sequence
  Synthetic oligonucleotide
acattccaccctcctgccttgatcaggtacacctcga

SEQ ID NO: 170443 - DNA, 36 bp, Artificial Sequence
  Synthetic oligonucleotide
gtcagagacgggggaagaggagaaggtacctgagga

SEQ ID NO: 170444 - DNA, 37 bp, Artificial Sequence
  Synthetic oligonucleotide
gccctacccgcttctgttttatcctcacctctaggga

SEQ ID NO: 170445 - DNA, 35 bp, Artificial Sequence
  Synthetic oligonucleotide
aagtacccgccccgacccgactccctccaccggga

SEQ ID NO: 170446 - DNA, 36 bp, Artificial Sequence
  Synthetic oligonucleotide
tcgaaacaggaggcgggagggatacctatgagggga

SEQ ID NO: 170447 - DNA, 35 bp, Artificial Sequence
  Synthetic oligonucleotide
acatcccggcgggtggtgcgggaaaagaaggggga

SEQ ID NO: 170448 - DNA, 37 bp, Artificial Sequence
  Synthetic oligonucleotide
aacgaacatcacatcaccacctctcgccccgctggga

SEQ ID NO: 170449 - DNA, 37 bp, Artificial Sequence
  Synthetic oligonucleotide
ttcgcgcgtgacatcttcctgcaccactcccccatga

SEQ ID NO: 170450 - DNA, 38 bp, Artificial Sequence
  Synthetic oligonucleotide
ttctaccacacatggccaagtacatccactccgcatga

SEQ ID NO: 170451 - DNA, 36 bp, Artificial Sequence
  Synthetic oligonucleotide
atggcccctccgcccagtatcttgtcctctgcatga

SEQ ID NO: 170452 - DNA, 37 bp, Artificial Sequence
  Synthetic oligonucleotide
gtatcctccgccgtgcccagtgcacacgttactatga

SEQ ID NO: 170453 - DNA, 38 bp, Artificial Sequence
  Synthetic oligonucleotide
acccaccccgatctggacgaacgcctgccacctactga

SEQ ID NO: 170454 - DNA, 38 bp, Artificial Sequence
  Synthetic oligonucleotide
ttgctcggcactcgtttcttgctgcactatcctactga

SEQ ID NO: 170455 - DNA, 38 bp, Artificial Sequence
  Synthetic oligonucleotide
aacgcgtgcctctctggcgtcctatccaaccatcctga

SEQ ID NO: 170456 - DNA, 37 bp, Artificial Sequence
  Synthetic oligonucleotide
actggtggccctcttgtactcttatacgccctcctga

SEQ ID NO: 170457 - DNA, 38 bp, Artificial Sequence
  Synthetic oligonucleotide
gttcgcacctcttgtcccccgccacctccccccagtga

SEQ ID NO: 170458 - DNA, 38 bp, Artificial Sequence
  Synthetic oligonucleotide
atccaggtcaatcgctccgacaacctttccccccgtga

SEQ ID NO: 170459 - DNA, 38 bp, Artificial Sequence
  Synthetic oligonucleotide
tcacgcctcacctgcatcatgtactgccggccccttga

SEQ ID NO: 170460 - DNA, 37 bp, Artificial Sequence
  Synthetic oligonucleotide
tcgcaggtccttcgcgcccgatccattcctgggttga

SEQ ID NO: 170461 - DNA, 34 bp, Artificial Sequence
  Synthetic oligonucleotide
tgtccgacctctgccttgtcgttcaattccacta

SEQ ID NO: 170462 - DNA, 36 bp, Artificial Sequence
  Synthetic oligonucleotide
gatctcgatcacggcgcctcactcgggtccttgcta

SEQ ID NO: 170463 - DNA, 35 bp, Artificial Sequence
  Synthetic oligonucleotide
ggagttggtgggagggggtgtgagggcaggaggta

SEQ ID NO: 170464 - DNA, 36 bp, Artificial Sequence
  Synthetic oligonucleotide
atccggtaaccagccggatctacttctcgcctatta

SEQ ID NO: 170465 - DNA, 36 bp, Artificial Sequence
  Synthetic oligonucleotide
tccctgccccacgttctgccctacgcgcatctatta

SEQ ID NO: 170466 - DNA, 36 bp, Artificial Sequence
  Synthetic oligonucleotide
gcctggcccaaccctccgcttgctatatatcgctta

SEQ ID NO: 170467 - DNA, 35 bp, Artificial Sequence
  Synthetic oligonucleotide
tcctggcacctcccccatcagctagtccgccaaac

SEQ ID NO: 170468 - DNA, 35 bp, Artificial Sequence
  Synthetic oligonucleotide
aaggtcacgccatttcacccctacacgccactcac

SEQ ID NO: 170469 - DNA, 35 bp, Artificial Sequence
  Synthetic oligonucleotide
gccctgcgtacattattcgtttcttccggtgtcac

SEQ ID NO: 170470 - DNA, 35 bp, Artificial Sequence
  Synthetic oligonucleotide
gtctccatcagccaacccctgttcgcgtactaacc

SEQ ID NO: 170471 - DNA, 35 bp, Artificial Sequence
  Synthetic oligonucleotide
tgctaccccttcttatccctggcgctttccgcacc

SEQ ID NO: 170472 - DNA, 35 bp, Artificial Sequence
  Synthetic oligonucleotide
tgctcccttaacctctcgtgtcgtctcgccttacc

SEQ ID NO: 170473 - DNA, 35 bp, Artificial Sequence
  Synthetic oligonucleotide
tgcccccctgtatactgcccaggccttcccacccc

SEQ ID NO: 170474 - DNA, 35 bp, Artificial Sequence
  Synthetic oligonucleotide
agaatccatcgggcctgatccgtttacgccacccc

SEQ ID NO: 170475 - DNA, 35 bp, Artificial Sequence
  Synthetic oligonucleotide
tcacaccatgtgtgtggttcctccgtcttgccccc

SEQ ID NO: 170476 - DNA, 35 bp, Artificial Sequence
  Synthetic oligonucleotide
cagtactgcccatctgggtcgcatatcctgtcccc

SEQ ID NO: 170477 - DNA, 35 bp, Artificial Sequence
  Synthetic oligonucleotide
aaacgggagcctcactggttctgccccatccgccc

SEQ ID NO: 170478 - DNA, 35 bp, Artificial Sequence
  Synthetic oligonucleotide
aagccgcatgccagtcaccttccaaatgtccgccc

SEQ ID NO: 170479 - DNA, 35 bp, Artificial Sequence
  Synthetic oligonucleotide
actccatccctcagaccgaccctgttgtcctgccc

SEQ ID NO: 170480 - DNA, 35 bp, Artificial Sequence
  Synthetic oligonucleotide
tctagcccacattgtaccctcccacggtccctccc

SEQ ID NO: 170481 - DNA, 35 bp, Artificial Sequence
  Synthetic oligonucleotide
atcgttccgcgctatccgcatcacctattggtccc

SEQ ID NO: 170482 - DNA, 35 bp, Artificial Sequence
  Synthetic oligonucleotide
aaactcgcctcctattcgcccacggttctgtagcc

SEQ ID NO: 170483 - DNA, 35 bp, Artificial Sequence
  Synthetic oligonucleotide
tagacaccgcatttcccgccgccttctcctgggcc

SEQ ID NO: 170484 - DNA, 35 bp, Artificial Sequence
  Synthetic oligonucleotide
atgcgcccgctcgccatctaatcgctccctgtgcc

SEQ ID NO: 170485 - DNA, 35 bp, Artificial Sequence
  Synthetic oligonucleotide
gccacttacccgcccgatccggccactcctgtgcc

SEQ ID NO: 170486 - DNA, 35 bp, Artificial Sequence
  Synthetic oligonucleotide
tgctctactcaacccgtgctctgttttgccttgcc

SEQ ID NO: 170487 - DNA, 35 bp, Artificial Sequence
  Synthetic oligonucleotide
gcctatgcgcacaccaccgacgtacacgcagttcc

SEQ ID NO: 170488 - DNA, 35 bp, Artificial Sequence
  Synthetic oligonucleotide
accctctgtgccacaacggtttgaattctctccgc

SEQ ID NO: 170489 - DNA, 35 bp, Artificial Sequence
  Synthetic oligonucleotide
ttgcccccttgcgatcgaagcccgttcatgtccgc

SEQ ID NO: 170490 - DNA, 35 bp, Artificial Sequence
  Synthetic oligonucleotide
accgggggggaatggtggaactgggcacagccggc

SEQ ID NO: 170491 - DNA, 35 bp, Artificial Sequence
  Synthetic oligonucleotide
gtgaggccccctcataaagtttttccatcacctgc

SEQ ID NO: 170492 - DNA, 35 bp, Artificial Sequence
  Synthetic oligonucleotide
gccacgcccgccatattacccagtcctgcgcctgc

SEQ ID NO: 170493 - DNA, 35 bp, Artificial Sequence
  Synthetic oligonucleotide
ttacccctgactacgcccctctgtgccgatcttgc

SEQ ID NO: 170494 - DNA, 35 bp, Artificial Sequence
  Synthetic oligonucleotide
agccgaccgccaaaatctgtcacaatggcccaatc

SEQ ID NO: 170495 - DNA, 35 bp, Artificial Sequence
  Synthetic oligonucleotide
aagccccgccacacagtcctcctgcgacacggatc

SEQ ID NO: 170496 - DNA, 35 bp, Artificial Sequence
  Synthetic oligonucleotide
gatgccccgggccaatttcggtttttcggttactc

SEQ ID NO: 170497 - DNA, 35 bp, Artificial Sequence
  Synthetic oligonucleotide
actaccactgtacttccccaggagttgtgcccctc

SEQ ID NO: 170498 - DNA, 35 bp, Artificial Sequence
  Synthetic oligonucleotide
gatctccctggaagatggttcaaacgcctcccctc

SEQ ID NO: 170499 - DNA, 35 bp, Artificial Sequence
  Synthetic oligonucleotide
acttggccaccccgcttatctgttgctatcaattc

SEQ ID NO: 170500 - DNA, 35 bp, Artificial Sequence
  Synthetic oligonucleotide
ttcatgaccctttcccgatgcgcactacacccttc

SEQ ID NO: 170501 - DNA, 35 bp, Artificial Sequence
  Synthetic oligonucleotide
aagttctgcccgccgcccctgatcaaccagccttc

SEQ ID NO: 170502 - DNA, 35 bp, Artificial Sequence
  Synthetic oligonucleotide
acccactacgccacatcctgactatgtttacaccg

SEQ ID NO: 170503 - DNA, 35 bp, Artificial Sequence
  Synthetic oligonucleotide
tcatccgctcctctcttgtcactaccggctcaccg

SEQ ID NO: 170504 - DNA, 35 bp, Artificial Sequence
  Synthetic oligonucleotide
ccctccctgctaccatacatgctaatgccaccccg

SEQ ID NO: 170505 - DNA, 35 bp, Artificial Sequence
  Synthetic oligonucleotide
tcgttggtcactacacctgcccttcggttcccccg

SEQ ID NO: 170506 - DNA, 35 bp, Artificial Sequence
  Synthetic oligonucleotide
gtgcccttgcgtgctagctttaatacgtccctccg

SEQ ID NO: 170507 - DNA, 35 bp, Artificial Sequence
  Synthetic oligonucleotide
acaccctcacctgtaacctcgtcttgcattactcg

SEQ ID NO: 170508 - DNA, 35 bp, Artificial Sequence
  Synthetic oligonucleotide
ggacccttatcccgacccaccacgtcatggccctg

SEQ ID NO: 170509 - DNA, 35 bp, Artificial Sequence
  Synthetic oligonucleotide
gcgcggacacaacacctgccccgccttgccttctg

SEQ ID NO: 170510 - DNA, 35 bp, Artificial Sequence
  Synthetic oligonucleotide
gagtgcccagttatacccctccttccgtcctcgtg

SEQ ID NO: 170511 - DNA, 35 bp, Artificial Sequence
  Synthetic oligonucleotide
tccgacccccaccatatgaactgtttccgcccttg

SEQ ID NO: 170512 - DNA, 35 bp, Artificial Sequence
  Synthetic oligonucleotide
gcgctggggaaaggggagggtgggggataatcaat

SEQ ID NO: 170513 - DNA, 35 bp, Artificial Sequence
  Synthetic oligonucleotide
ttacactcgttgctccctggttgtccttgcgaact

SEQ ID NO: 170514 - DNA, 35 bp, Artificial Sequence
  Synthetic oligonucleotide
actttgcctctcgtagttataccatcaccattact

SEQ ID NO: 170515 - DNA, 35 bp, Artificial Sequence
  Synthetic oligonucleotide
gcgcactttgctgccgtcgctccgaccctccacct

SEQ ID NO: 170516 - DNA, 35 bp, Artificial Sequence
  Synthetic oligonucleotide
ttgcccctgtaccggacgggtactctatactgcct

SEQ ID NO: 170517 - DNA, 35 bp, Artificial Sequence
  Synthetic oligonucleotide
gcaattcctctgcctgctcccccacgtgcacttct

SEQ ID NO: 170518 - DNA, 35 bp, Artificial Sequence
  Synthetic oligonucleotide
gctgaatcctcgaccctccgcctacgatccgttct

SEQ ID NO: 170519 - DNA, 35 bp, Artificial Sequence
  Synthetic oligonucleotide
acgaggggaagtaacaaggtatggtgaaacggcgt

SEQ ID NO: 170520 - DNA, 35 bp, Artificial Sequence
  Synthetic oligonucleotide
attggccccccgttctgtacccctccttgccaggt

SEQ ID NO: 170521 - DNA, 35 bp, Artificial Sequence
  Synthetic oligonucleotide
ttaacgcccccggacgtcctccgatcatttcactt

SEQ ID NO: 170522 - DNA, 35 bp, Artificial Sequence
  Synthetic oligonucleotide
ttccacgtaagccactccctccagcgcgacacctt

SEQ ID NO: 170523 - DNA, 35 bp, Artificial Sequence
  Synthetic oligonucleotide
tgagggccagcatacaccccgttcatcatctcgtt

SEQ ID NO: 170524 - DNA, 35 bp, Artificial Sequence
  Synthetic oligonucleotide
tcgacctctcccgtaattgttattatctgcccttt

SEQ ID NO: 170525 - DNA, 35 bp, Artificial Sequence
  Synthetic oligonucleotide
tgccctgcgcatttattatctgtccttatgctttt

SEQ ID NO: 170526 - DNA, 36 bp, Artificial Sequence
  Synthetic oligonucleotide
aaatgcggggggggtgggggctgcagggtagcgaaa

SEQ ID NO: 170527 - DNA, 36 bp, Artificial Sequence
  Synthetic oligonucleotide
atagtacgtgtggccggggggggtggatgggcgaaa

SEQ ID NO: 170528 - DNA, 36 bp, Artificial Sequence
  Synthetic oligonucleotide
tcccccaccggatcttctctggccatgacaccataa

SEQ ID NO: 170529 - DNA, 36 bp, Artificial Sequence
  Synthetic oligonucleotide
gactgccctgcccctgtgtcctgcctctcgtgataa

SEQ ID NO: 170530 - DNA, 36 bp, Artificial Sequence
  Synthetic oligonucleotide
gatatgccatcacatcccttatgtgcaccatcctaa

SEQ ID NO: 170531 - DNA, 36 bp, Artificial Sequence
  Synthetic oligonucleotide
gacgtgccagccctagtcgttctctagccaccaaca

SEQ ID NO: 170532 - DNA, 36 bp, Artificial Sequence
  Synthetic oligonucleotide
aactgcccccgcctacataggtttgacttttcgaca

SEQ ID NO: 170533 - DNA, 36 bp, Artificial Sequence
  Synthetic oligonucleotide
tcgcaccctcattgaaaacccgccccgactcctaca

SEQ ID NO: 170534 - DNA, 36 bp, Artificial Sequence
  Synthetic oligonucleotide
ttcgcatccagtatctgtcaccgcccgccctgtaca

SEQ ID NO: 170535 - DNA, 35 bp, Artificial Sequence
  Synthetic oligonucleotide
gtgccccccgcccacgccatcactgcccgtttaca

SEQ ID NO: 170536 - DNA, 36 bp, Artificial Sequence
  Synthetic oligonucleotide
ttcgcctcattctgtagcacatgcccgtccacacca

SEQ ID NO: 170537 - DNA, 36 bp, Artificial Sequence
  Synthetic oligonucleotide
acattagctgggaagggtgggataagcatgggagca

SEQ ID NO: 170538 - DNA, 36 bp, Artificial Sequence
  Synthetic oligonucleotide
gcacatacgtcacgtctgcttctactacaccgggca

SEQ ID NO: 170539 - DNA, 35 bp, Artificial Sequence
  Synthetic oligonucleotide
acaccggccattgtactaacaccctctacccatca

SEQ ID NO: 170540 - DNA, 35 bp, Artificial Sequence
  Synthetic oligonucleotide
gcgatgcctccccttactatcaactcgtgcgatca

SEQ ID NO: 170541 - DNA, 35 bp, Artificial Sequence
  Synthetic oligonucleotide
gtctggttcgctgcacatatccggtctcccactca

SEQ ID NO: 170542 - DNA, 36 bp, Artificial Sequence
  Synthetic oligonucleotide
gtcactgtcctcggtttccgctcatgtactgtctca

SEQ ID NO: 170543 - DNA, 35 bp, Artificial Sequence
  Synthetic oligonucleotide
tccctggaccgactgttcaatacccacttgtctca

SEQ ID NO: 170544 - DNA, 36 bp, Artificial Sequence
  Synthetic oligonucleotide
actccatctgttgtcgcttgttccttgtcactgtca

SEQ ID NO: 170545 - DNA, 36 bp, Artificial Sequence
  Synthetic oligonucleotide
aacacggacaggagggggcagtaggtgggccgaaga

SEQ ID NO: 170546 - DNA, 37 bp, Artificial Sequence
  Synthetic oligonucleotide
ttatcaccgttcagtcgttactctgctccaccaccga

SEQ ID NO: 170547 - DNA, 37 bp, Artificial Sequence
  Synthetic oligonucleotide
tcaacccgtctgttcgttcccttcgtatgtcccccga

SEQ ID NO: 170548 - DNA, 37 bp, Artificial Sequence
  Synthetic oligonucleotide
accacaacctcatctgcactcacgtgaaagccttcga

SEQ ID NO: 170549 - DNA, 37 bp, Artificial Sequence
  Synthetic oligonucleotide
ttgggaacgggagtggagggattgggcaggtcttcga

SEQ ID NO: 170550 - DNA, 37 bp, Artificial Sequence
  Synthetic oligonucleotide
aaacgaagcgaagtaagggggcggacttgagggagga

SEQ ID NO: 170551 - DNA, 37 bp, Artificial Sequence
  Synthetic oligonucleotide
ggaggggccacggggggacaaagggaagggtggagga

SEQ ID NO: 170552 - DNA, 37 bp, Artificial Sequence
  Synthetic oligonucleotide
tcaacgcgatgtgccaacagggaaggggggtggagga

SEQ ID NO: 170553 - DNA, 37 bp, Artificial Sequence
  Synthetic oligonucleotide
gcatcctccccatccagcccgccgttcgatctacgga

SEQ ID NO: 170554 - DNA, 36 bp, Artificial Sequence
  Synthetic oligonucleotide
aagacatgggagggaacacaagtaagggagtacgga

SEQ ID NO: 170555 - DNA, 37 bp, Artificial Sequence
  Synthetic oligonucleotide
aacgaagaacggatcgaggggcaagcaaagagaggga

SEQ ID NO: 170556 - DNA, 37 bp, Artificial Sequence
  Synthetic oligonucleotide
ggagaaggaggcacgagggttggggagtgctgaggga

SEQ ID NO: 170557 - DNA, 37 bp, Artificial Sequence
  Synthetic oligonucleotide
gtcctgggctcaatgcgtgtagaaggggcggggggga

SEQ ID NO: 170558 - DNA, 36 bp, Artificial Sequence
  Synthetic oligonucleotide
gctcgcctcccctccctaccatgactgcacgttgga

SEQ ID NO: 170559 - DNA, 38 bp, Artificial Sequence
  Synthetic oligonucleotide
gttaggcgagacgagtagggaggggaatggtggaatga

SEQ ID NO: 170560 - DNA, 38 bp, Artificial Sequence
  Synthetic oligonucleotide
gagggcggcaagagggggggaaaaaatgcgtgctatga

SEQ ID NO: 170561 - DNA, 37 bp, Artificial Sequence
  Synthetic oligonucleotide
gccgcccgtctgccgccaactccacatcttccactga

SEQ ID NO: 170562 - DNA, 35 bp, Artificial Sequence
  Synthetic oligonucleotide
ggaatcccactgttgcctactccccccgcacctga

SEQ ID NO: 170563 - DNA, 38 bp, Artificial Sequence
  Synthetic oligonucleotide
tacacggcctttctctacccagcgcgtttcatacctga

SEQ ID NO: 170564 - DNA, 37 bp, Artificial Sequence
  Synthetic oligonucleotide
taactgtgaccacagtgccatatgctcctactcctga

SEQ ID NO: 170565 - DNA, 38 bp, Artificial Sequence
  Synthetic oligonucleotide
tctgaggccgttactgatcccgtctttcctcctcctga

SEQ ID NO: 170566 - DNA, 38 bp, Artificial Sequence
  Synthetic oligonucleotide
aaccacctcggtttgcttctcatcgggccctctcctga

SEQ ID NO: 170567 - DNA, 38 bp, Artificial Sequence
  Synthetic oligonucleotide
acgtccttactcctgctgtactgacccacccttgctga

SEQ ID NO: 170568 - DNA, 35 bp, Artificial Sequence
  Synthetic oligonucleotide
gccccccccatgacgcccccgtataccaatggtga

SEQ ID NO: 170569 - DNA, 38 bp, Artificial Sequence
  Synthetic oligonucleotide
aaatggggagggggggtaagagaagtgataagacttga

SEQ ID NO: 170570 - DNA, 35 bp, Artificial Sequence
  Synthetic oligonucleotide
gagtcatcgtatcccggcgccctacccccccttga

SEQ ID NO: 170571 - DNA, 38 bp, Artificial Sequence
  Synthetic oligonucleotide
acatcgcgctgccctcctgatatcccgcaccgccttga

SEQ ID NO: 170572 - DNA, 38 bp, Artificial Sequence
  Synthetic oligonucleotide
gagcaccacccttgggtaaatgtaccttctcgccttga

SEQ ID NO: 170573 - DNA, 36 bp, Artificial Sequence
  Synthetic oligonucleotide
gacctgacgctcccggttccgacgcccctattcata

SEQ ID NO: 170574 - DNA, 27 bp, Artificial Sequence
  Synthetic oligonucleotide
tccactcacccagaaacctttctgcta

SEQ ID NO: 170575 - DNA, 36 bp, Artificial Sequence
  Synthetic oligonucleotide
ataccactcacctggtcttgctaccctgcattgcta

SEQ ID NO: 170576 - DNA, 36 bp, Artificial Sequence
  Synthetic oligonucleotide
tcgcctcccccaatgttgccgtgcgattccatatta

SEQ ID NO: 170577 - DNA, 35 bp, Artificial Sequence
  Synthetic oligonucleotide
ttgcctcacacccccctcttcctgcccgactgtac

SEQ ID NO: 170578 - DNA, 35 bp, Artificial Sequence
  Synthetic oligonucleotide
gatctcgttcgttcccctgtcattgcccatctacc

SEQ ID NO: 170579 - DNA, 35 bp, Artificial Sequence
  Synthetic oligonucleotide
gtagggcggggaaaccgcgacctgggtgggttacc

SEQ ID NO: 170580 - DNA, 35 bp, Artificial Sequence
  Synthetic oligonucleotide
tgcacaacttacattgtctacttaattgtccaccc

SEQ ID NO: 170581 - DNA, 35 bp, Artificial Sequence
  Synthetic oligonucleotide
acctaaccgttgccaacacctgcgtgaccgccccc

SEQ ID NO: 170582 - DNA, 35 bp, Artificial Sequence
  Synthetic oligonucleotide
aggtccggtcacagccaccataagtctcccatccc

SEQ ID NO: 170583 - DNA, 35 bp, Artificial Sequence
  Synthetic oligonucleotide
atcattgaccctccaccccacggactgttttagcc

SEQ ID NO: 170584 - DNA, 35 bp, Artificial Sequence
  Synthetic oligonucleotide
gtcccccttcctcactgtcagtctcgtgaaacgcc

SEQ ID NO: 170585 - DNA, 35 bp, Artificial Sequence
  Synthetic oligonucleotide
tcccttcgccgctctaggttactctagcatttgcc

SEQ ID NO: 170586 - DNA, 35 bp, Artificial Sequence
  Synthetic oligonucleotide
tctcgccagagtttatggccttccacccgaactcc

SEQ ID NO: 170587 - DNA, 35 bp, Artificial Sequence
  Synthetic oligonucleotide
gctcgaacctcctccgcaccgcatttcaatgctcc

SEQ ID NO: 170588 - DNA, 35 bp, Artificial Sequence
  Synthetic oligonucleotide
gacgctgctcactgtcgcccactcctcggatttcc

SEQ ID NO: 170589 - DNA, 35 bp, Artificial Sequence
  Synthetic oligonucleotide
agtccgacttctctgtactgcatctttctgctcgc

SEQ ID NO: 170590 - DNA, 35 bp, Artificial Sequence
  Synthetic oligonucleotide
gatcacatctatagccgcacacttcgactacctgc

SEQ ID NO: 170591 - DNA, 35 bp, Artificial Sequence
  Synthetic oligonucleotide
gtctactgccggcaatttagccgcttcgaccgatc

SEQ ID NO: 170592 - DNA, 35 bp, Artificial Sequence
  Synthetic oligonucleotide
tccatcgacaagttctctcgatgcacctgtccctc

SEQ ID NO: 170593 - DNA, 35 bp, Artificial Sequence
  Synthetic oligonucleotide
agccgaccccgattccatgatctttgacacgcctc

SEQ ID NO: 170594 - DNA, 35 bp, Artificial Sequence
  Synthetic oligonucleotide
tattcagcctcactgaccctccaccgggacatctc

SEQ ID NO: 170595 - DNA, 35 bp, Artificial Sequence
  Synthetic oligonucleotide
tgcgccttcattatcggacgtatcgttttcctctc

SEQ ID NO: 170596 - DNA, 35 bp, Artificial Sequence
  Synthetic oligonucleotide
gtgcctgccctttcgttatcggtgcccccgctctc

SEQ ID NO: 170597 - DNA, 35 bp, Artificial Sequence
  Synthetic oligonucleotide
cacgccacctccacccttctgtcttcatgccagtc

SEQ ID NO: 170598 - DNA, 35 bp, Artificial Sequence
  Synthetic oligonucleotide
gtgtggcctgtcatccagctctatctgtctttgtc

SEQ ID NO: 170599 - DNA, 35 bp, Artificial Sequence
  Synthetic oligonucleotide
gccacacacgaagcattatcaagtacctgcacttc

SEQ ID NO: 170600 - DNA, 35 bp, Artificial Sequence
  Synthetic oligonucleotide
aattcaacgccgcctagcacctcctagcccccgag

SEQ ID NO: 170601 - DNA, 35 bp, Artificial Sequence
  Synthetic oligonucleotide
gcacgtatatgggttctatgggcgggatgggcgag

SEQ ID NO: 170602 - DNA, 35 bp, Artificial Sequence
  Synthetic oligonucleotide
tcacctggcccccggatggcttatacttacccccg

SEQ ID NO: 170603 - DNA, 35 bp, Artificial Sequence
  Synthetic oligonucleotide
gcctaaccgccggctgaggcacatggctcctcccg

SEQ ID NO: 170604 - DNA, 35 bp, Artificial Sequence
  Synthetic oligonucleotide
gagagatttgggagggtggagggactcagggagcg

SEQ ID NO: 170605 - DNA, 35 bp, Artificial Sequence
  Synthetic oligonucleotide
agagtggggcaacgaggggggacggcttcaagcgg

SEQ ID NO: 170606 - DNA, 35 bp, Artificial Sequence
  Synthetic oligonucleotide
acacaccacctaacatgttcgccgttccactcttg

SEQ ID NO: 170607 - DNA, 35 bp, Artificial Sequence
  Synthetic oligonucleotide
acacaccacctaacatgttctcctttccgctcttg

SEQ ID NO: 170608 - DNA, 35 bp, Artificial Sequence
  Synthetic oligonucleotide
gtccagtgcctgcctggcccttgtcttacccgaat

SEQ ID NO: 170609 - DNA, 35 bp, Artificial Sequence
  Synthetic oligonucleotide
gaacccccgacactcctatatcgtttcacgcacat

SEQ ID NO: 170610 - DNA, 35 bp, Artificial Sequence
  Synthetic oligonucleotide
tacctcctgcccactagttagaacgttccatcgat

SEQ ID NO: 170611 - DNA, 35 bp, Artificial Sequence
  Synthetic oligonucleotide
gacagttcgcgcgcatactctttacccttcgtcct

SEQ ID NO: 170612 - DNA, 35 bp, Artificial Sequence
  Synthetic oligonucleotide
aaccaccgtggggggtgatttccgttaccattcct

SEQ ID NO: 170613 - DNA, 35 bp, Artificial Sequence
  Synthetic oligonucleotide
gtgtccccgtccgtctcatttttttaggcaatgct

SEQ ID NO: 170614 - DNA, 35 bp, Artificial Sequence
  Synthetic oligonucleotide
gcctacgccggtctcctacggttgtgatcccctct

SEQ ID NO: 170615 - DNA, 35 bp, Artificial Sequence
  Synthetic oligonucleotide
tacgcccccatggtccgcaccgttgtcaacgctct

SEQ ID NO: 170616 - DNA, 35 bp, Artificial Sequence
  Synthetic oligonucleotide
gtcccaccgcactaatgtttccgtcgcccttttct

SEQ ID NO: 170617 - DNA, 35 bp, Artificial Sequence
  Synthetic oligonucleotide
ggatgagcgaaccggtggaggaaggggcgtcgagt

SEQ ID NO: 170618 - DNA, 35 bp, Artificial Sequence
  Synthetic oligonucleotide
gaagggaactcaaggagggaagatggaaactgggt

SEQ ID NO: 170619 - DNA, 35 bp, Artificial Sequence
  Synthetic oligonucleotide
tggggaatggaagtaggggaggacggtggggtggt

SEQ ID NO: 170620 - DNA, 35 bp, Artificial Sequence
  Synthetic oligonucleotide
gcccgctcctgtacgcgtgtggctttccattcctt

SEQ ID NO: 170621 - DNA, 35 bp, Artificial Sequence
  Synthetic oligonucleotide
gagctgtccgcacatccgtttgagttttccacttt

SEQ ID NO: 170622 - DNA, 35 bp, Artificial Sequence
  Synthetic oligonucleotide
ggaggactgtcgttgctccccgatcctggtacttt

SEQ ID NO: 170623 - DNA, 35 bp, Artificial Sequence
  Synthetic oligonucleotide
gatcaacctccctgccgtttacgtcacacatcttt

SEQ ID NO: 170624 - DNA, 35 bp, Artificial Sequence
  Synthetic oligonucleotide
tcctgtcctcatggtcatcttgaacctttcttttt

SEQ ID NO: 170625 - DNA, 36 bp, Artificial Sequence
  Synthetic oligonucleotide
gtttcgcacctatgcctatccacatccgtttcccaa

SEQ ID NO: 170626 - DNA, 36 bp, Artificial Sequence
  Synthetic oligonucleotide
tgccaccactccgctcggtatagagcactcgctcaa

SEQ ID NO: 170627 - DNA, 35 bp, Artificial Sequence
  Synthetic oligonucleotide
ggatgaggggtcggggagggactaagaaaggggaa

SEQ ID NO: 170628 - DNA, 36 bp, Artificial Sequence
  Synthetic oligonucleotide
gagtgtgcggggagggccgggagggtaccctgtgaa

SEQ ID NO: 170629 - DNA, 36 bp, Artificial Sequence
  Synthetic oligonucleotide
gacacacgctccgaatccacactgcgctcctgctaa

SEQ ID NO: 170630 - DNA, 35 bp, Artificial Sequence
  Synthetic oligonucleotide
tgcccgctcggttacttgttcacacccgcccttaa

SEQ ID NO: 170631 - DNA, 36 bp, Artificial Sequence
  Synthetic oligonucleotide
gtggggggaagaaagggagaccagcagtgccgaaca

SEQ ID NO: 170632 - DNA, 36 bp, Artificial Sequence
  Synthetic oligonucleotide
acgacacggggtgtggggggtggggtccatggaaca

SEQ ID NO: 170633 - DNA, 36 bp, Artificial Sequence
  Synthetic oligonucleotide
ttgacatggccgtagatgtcaccatcctgctcccca

SEQ ID NO: 170634 - DNA, 35 bp, Artificial Sequence
  Synthetic oligonucleotide
ttgaccacccacacaataccgatgcatgcaagcca

SEQ ID NO: 170635 - DNA, 35 bp, Artificial Sequence
  Synthetic oligonucleotide
cccgtccctcccctaggcgcccgaactgtccgcca

SEQ ID NO: 170636 - DNA, 36 bp, Artificial Sequence
  Synthetic oligonucleotide
gcacagcccgccttcgtgccccatagccccactcca

SEQ ID NO: 170637 - DNA, 36 bp, Artificial Sequence
  Synthetic oligonucleotide
gccctcgctgtccgggccccagtcgattcccttcca

SEQ ID NO: 170638 - DNA, 36 bp, Artificial Sequence
  Synthetic oligonucleotide
tagctgccagtacggattgtcgccgtccctcttcca

SEQ ID NO: 170639 - DNA, 36 bp, Artificial Sequence
  Synthetic oligonucleotide
tcactacccagagttcactttacctgttgtcttcca

SEQ ID NO: 170640 - DNA, 36 bp, Artificial Sequence
  Synthetic oligonucleotide
tcgctacacgcctcgttcctcccgttcaatgtcgca

SEQ ID NO: 170641 - DNA, 36 bp, Artificial Sequence
  Synthetic oligonucleotide
aaccgccccgcccctgtgacaagacgaaaccttgca

SEQ ID NO: 170642 - DNA, 35 bp, Artificial Sequence
  Synthetic oligonucleotide
ttagcctccgaactgaaaaacccgccgcccaatca

SEQ ID NO: 170643 - DNA, 36 bp, Artificial Sequence
  Synthetic oligonucleotide
tttgtcaccgcaagttgtcgatctttgcggccttca

SEQ ID NO: 170644 - DNA, 37 bp, Artificial Sequence
  Synthetic oligonucleotide
tgcctccgacacatcctataagcgtccctgctgacga

SEQ ID NO: 170645 - DNA, 37 bp, Artificial Sequence
  Synthetic oligonucleotide
acgacgcccccccgctgactacgatctcgtcctacga

SEQ ID NO: 170646 - DNA, 37 bp, Artificial Sequence
  Synthetic oligonucleotide
ttcgcctcccctgcctgtactgtgttatacgctccga

SEQ ID NO: 170647 - DNA, 35 bp, Artificial Sequence
  Synthetic oligonucleotide
tgagagacgaggctaatgagggggcgagggtgcga

SEQ ID NO: 170648 - DNA, 37 bp, Artificial Sequence
  Synthetic oligonucleotide
tcaccctccacgcttgcctacggacgataataatcga

SEQ ID NO: 170649 - DNA, 35 bp, Artificial Sequence
  Synthetic oligonucleotide
ccgacccccatgccaataagccgtacctctctcga

SEQ ID NO: 170650 - DNA, 37 bp, Artificial Sequence
  Synthetic oligonucleotide
tgtgcatgtcgcttctctttcagcctccctcctcgga

SEQ ID NO: 170651 - DNA, 36 bp, Artificial Sequence
  Synthetic oligonucleotide
ttggaaatgggtgccgggtgggaaggttgtcaggga

SEQ ID NO: 170652 - DNA, 36 bp, Artificial Sequence
  Synthetic oligonucleotide
tgccaccgccgtgcctgttttgctatcttttcggga

SEQ ID NO: 170653 - DNA, 37 bp, Artificial Sequence
  Synthetic oligonucleotide
gttcagggggagcaaggagctagaaggaggaactgga

SEQ ID NO: 170654 - DNA, 37 bp, Artificial Sequence
  Synthetic oligonucleotide
agagcccgatcattctatcgccgcactcccacctgga

SEQ ID NO: 170655 - DNA, 38 bp, Artificial Sequence
  Synthetic oligonucleotide
gactgtgggaagggtagggtgagatggaggggccatga

SEQ ID NO: 170656 - DNA, 38 bp, Artificial Sequence
  Synthetic oligonucleotide
tccgcctcccctggtttctgttacggctccttgactga

SEQ ID NO: 170657 - DNA, 38 bp, Artificial Sequence
  Synthetic oligonucleotide
tccaccgtcggccatctaactccccgggtcgtacctga

SEQ ID NO: 170658 - DNA, 36 bp, Artificial Sequence
  Synthetic oligonucleotide
atggccttcctcgctgggctcgagttctccccctga

SEQ ID NO: 170659 - DNA, 38 bp, Artificial Sequence
  Synthetic oligonucleotide
tgccaccaacccgcatgactcacccaatactgccctga

SEQ ID NO: 170660 - DNA, 37 bp, Artificial Sequence
  Synthetic oligonucleotide
acatctcgccccagggtacaaggcccccatatcctga

SEQ ID NO: 170661 - DNA, 37 bp, Artificial Sequence
  Synthetic oligonucleotide
gagagggtggggaaatcgggatagagttagtctctga

SEQ ID NO: 170662 - DNA, 38 bp, Artificial Sequence
  Synthetic oligonucleotide
tccgtgacaacgcacacccgacgtcccccttcccgtga

SEQ ID NO: 170663 - DNA, 37 bp, Artificial Sequence
  Synthetic oligonucleotide
ggggagggagacgaagggagggcaccgtacagcgtga

SEQ ID NO: 170664 - DNA, 38 bp, Artificial Sequence
  Synthetic oligonucleotide
gagaactcggacagtggggggaggagtgggggaggtga

SEQ ID NO: 170665 - DNA, 37 bp, Artificial Sequence
  Synthetic oligonucleotide
acaccctctccaacattgtccaggcactcttgggtga

SEQ ID NO: 170666 - DNA, 38 bp, Artificial Sequence
  Synthetic oligonucleotide
aacatgaacggtggagggagggggatgagggggattga

SEQ ID NO: 170667 - DNA, 38 bp, Artificial Sequence
  Synthetic oligonucleotide
atgggcatgggtgggtggggttgtgcagataatattga

SEQ ID NO: 170668 - DNA, 38 bp, Artificial Sequence
  Synthetic oligonucleotide
gtacgatctgggcggtgggggggtagggtggtacttga

SEQ ID NO: 170669 - DNA, 37 bp, Artificial Sequence
  Synthetic oligonucleotide
agactcgtcctgctacacaaccgctccactctcttga

SEQ ID NO: 170670 - DNA, 36 bp, Artificial Sequence
  Synthetic oligonucleotide
acgcttccgccaccgtgccacttagtcgttcaacta

SEQ ID NO: 170671 - DNA, 36 bp, Artificial Sequence
  Synthetic oligonucleotide
gagtgacaccatcgcgcattgattctcccttaccta

SEQ ID NO: 170672 - DNA, 36 bp, Artificial Sequence
  Synthetic oligonucleotide
tcacctctctgtcaatatcgcgggccgtgctcccta

SEQ ID NO: 170673 - DNA, 36 bp, Artificial Sequence
  Synthetic oligonucleotide
cctacctgcccaatccatgctaagctcacttctcta

SEQ ID NO: 170674 - DNA, 35 bp, Artificial Sequence
  Synthetic oligonucleotide
gacgatcacccctactgtgcgctccttccaaggta

SEQ ID NO: 170675 - DNA, 35 bp, Artificial Sequence
  Synthetic oligonucleotide
tccccaccaattctcctgtcgtcccagttcaacac

SEQ ID NO: 170676 - DNA, 35 bp, Artificial Sequence
  Synthetic oligonucleotide
ggtcaccaccactaatcgcgcttttgaacatacac

SEQ ID NO: 170677 - DNA, 35 bp, Artificial Sequence
  Synthetic oligonucleotide
gctcgcacttcagccattctaccgtcctttttcac

SEQ ID NO: 170678 - DNA, 34 bp, Artificial Sequence
  Synthetic oligonucleotide
tcgctatcctgcactaccacctttggtttacgac

SEQ ID NO: 170679 - DNA, 35 bp, Artificial Sequence
  Synthetic oligonucleotide
gcccactctctcacccgccaagcttaggtatcgac

SEQ ID NO: 170680 - DNA, 34 bp, Artificial Sequence
  Synthetic oligonucleotide
ttacctgtcaccatcattacgcgattgctcctac

SEQ ID NO: 170681 - DNA, 35 bp, Artificial Sequence
  Synthetic oligonucleotide
tccaggacatcgtccttttaccacgcccgccttac

SEQ ID NO: 170682 - DNA, 35 bp, Artificial Sequence
  Synthetic oligonucleotide
tgtggcccccccaatgggcgcatcacccctcttac

SEQ ID NO: 170683 - DNA, 35 bp, Artificial Sequence
  Synthetic oligonucleotide
tgtggcctacgacgcaccttaccactggcttttac

SEQ ID NO: 170684 - DNA, 35 bp, Artificial Sequence
  Synthetic oligonucleotide
ggggtcgccgcgtccctgctcgcctttaaaccacc

SEQ ID NO: 170685 - DNA, 35 bp, Artificial Sequence
  Synthetic oligonucleotide
atcttgtcctgccccccggcgtagtaatcccaccc

SEQ ID NO: 170686 - DNA, 35 bp, Artificial Sequence
  Synthetic oligonucleotide
gttgcctcttcatgattttgccttctcgtcacccc

SEQ ID NO: 170687 - DNA, 35 bp, Artificial Sequence
  Synthetic oligonucleotide
ttagccgcacgctttcagtccaattttccctcccc

SEQ ID NO: 170688 - DNA, 35 bp, Artificial Sequence
  Synthetic oligonucleotide
atcccgcatctattgttatcaatacaacgctcccc

SEQ ID NO: 170689 - DNA, 35 bp, Artificial Sequence
  Synthetic oligonucleotide
gaacccatgttatctctgttgagcgtcgcccgccc

SEQ ID NO: 170690 - DNA, 35 bp, Artificial Sequence
  Synthetic oligonucleotide
ttctgacacatcccaggtaggttccccgttcgccc

SEQ ID NO: 170691 - DNA, 35 bp, Artificial Sequence
  Synthetic oligonucleotide
tgaacctccgcgtgtcaccccgtccatcatgtccc

SEQ ID NO: 170692 - DNA, 35 bp, Artificial Sequence
  Synthetic oligonucleotide
acattacccgcttgattgttactcgttctccagcc

SEQ ID NO: 170693 - DNA, 35 bp, Artificial Sequence
  Synthetic oligonucleotide
gttcatccccgtttgctcacaggtcagtttcggcc

SEQ ID NO: 170694 - DNA, 35 bp, Artificial Sequence
  Synthetic oligonucleotide
tccccccggcataccttctctaatgacgattacgc

SEQ ID NO: 170695 - DNA, 34 bp, Artificial Sequence
  Synthetic oligonucleotide
atatgtgcgccgaccacacgatcctgccacccgc

SEQ ID NO: 170696 - DNA, 35 bp, Artificial Sequence
  Synthetic oligonucleotide
attcgcttatctacgcctcgccgtcttcccacggc

SEQ ID NO: 170697 - DNA, 35 bp, Artificial Sequence
  Synthetic oligonucleotide
tatccactgccggaacgttaagatctacctcctgc

SEQ ID NO: 170698 - DNA, 35 bp, Artificial Sequence
  Synthetic oligonucleotide
tcctactgccgtccactgggcccggcctcccttgc

SEQ ID NO: 170699 - DNA, 35 bp, Artificial Sequence
  Synthetic oligonucleotide
ttcctgtctcagcgccctatcccccgcacgtgatc

SEQ ID NO: 170700 - DNA, 36 bp, Artificial Sequence
  Synthetic oligonucleotide
gatcacagtcctctagcatccacccaccagcccgtc

SEQ ID NO: 170701 - DNA, 35 bp, Artificial Sequence
  Synthetic oligonucleotide
actctgtgcctttccatcatggtatctatctggtc

SEQ ID NO: 170702 - DNA, 29 bp, Artificial Sequence
  Synthetic oligonucleotide
tctgtcgcccattatcgtttgtttggttc

SEQ ID NO: 170703 - DNA, 35 bp, Artificial Sequence
  Synthetic oligonucleotide
acgtcaaaccacacctactgcgcccgccttgtttc

SEQ ID NO: 170704 - DNA, 35 bp, Artificial Sequence
  Synthetic oligonucleotide
acgcgagaaagagcatgaggtagggggaggatcag

SEQ ID NO: 170705 - DNA, 35 bp, Artificial Sequence
  Synthetic oligonucleotide
ttccctgccctcccccctagccctacttgaccgag

SEQ ID NO: 170706 - DNA, 35 bp, Artificial Sequence
  Synthetic oligonucleotide
gtcccacaccccacgtaccccatttggtccatgag

SEQ ID NO: 170707 - DNA, 35 bp, Artificial Sequence
  Synthetic oligonucleotide
gacagggggggtgtggtggggttcgtatggaaacg

SEQ ID NO: 170708 - DNA, 35 bp, Artificial Sequence
  Synthetic oligonucleotide
ggggttaatgggaaggaggaagggggacacggccg

SEQ ID NO: 170709 - DNA, 35 bp, Artificial Sequence
  Synthetic oligonucleotide
gtatcctcacatggctgttcacccggtctaatccg

SEQ ID NO: 170710 - DNA, 35 bp, Artificial Sequence
  Synthetic oligonucleotide
taatccccccacgtgtcaactgaacaatgtctccg

SEQ ID NO: 170711 - DNA, 35 bp, Artificial Sequence
  Synthetic oligonucleotide
gggtggcggggtggttttgcggatggcacatcgcg

SEQ ID NO: 170712 - DNA, 35 bp, Artificial Sequence
  Synthetic oligonucleotide
gcacggaaggaaaaggtgggatacacgggaaacgg

SEQ ID NO: 170713 - DNA, 36 bp, Artificial Sequence
  Synthetic oligonucleotide
gtgtcacgtgttaggggttgggggggcggcacgggg

SEQ ID NO: 170714 - DNA, 35 bp, Artificial Sequence
  Synthetic oligonucleotide
agccatgggggggagggttaagtcacatgatgggg

SEQ ID NO: 170715 - DNA, 35 bp, Artificial Sequence
  Synthetic oligonucleotide
ttgttgccgtaattccgcgccccccctaaccctgg

SEQ ID NO: 170716 - DNA, 35 bp, Artificial Sequence
  Synthetic oligonucleotide
tccaactgcgcatttcatccttcctcgtatcttgg

SEQ ID NO: 170717 - DNA, 35 bp, Artificial Sequence
  Synthetic oligonucleotide
accgccacccaatcaggcgcctaccgatgtccttg

SEQ ID NO: 170718 - DNA, 35 bp, Artificial Sequence
  Synthetic oligonucleotide
tcctgctaacatgcagtgttttcctaatccaccat

SEQ ID NO: 170719 - DNA, 35 bp, Artificial Sequence
  Synthetic oligonucleotide
gccttagaccgcgcctccctccttatatgtgccat

SEQ ID NO: 170720 - DNA, 35 bp, Artificial Sequence
  Synthetic oligonucleotide
tgcctacctccgcacccccgtgacagcccttgcat

SEQ ID NO: 170721 - DNA, 35 bp, Artificial Sequence
  Synthetic oligonucleotide
aaccccgggtctgttctagccgtatccgccccact

SEQ ID NO: 170722 - DNA, 35 bp, Artificial Sequence
  Synthetic oligonucleotide
actcgctgcaccacgcctaagtacttcctgccact

SEQ ID NO: 170723 - DNA, 35 bp, Artificial Sequence
  Synthetic oligonucleotide
gtgacggggggggacgagggaagtacagaacacct

SEQ ID NO: 170724 - DNA, 35 bp, Artificial Sequence
  Synthetic oligonucleotide
tccatctgactccgcctatctgtatcgtagcccct

SEQ ID NO: 170725 - DNA, 35 bp, Artificial Sequence
  Synthetic oligonucleotide
gacgacacaccagccctcttcaccggttattccct

SEQ ID NO: 170726 - DNA, 35 bp, Artificial Sequence
  Synthetic oligonucleotide
gcacgtatggccggttctcacagccctctccgcct

SEQ ID NO: 170727 - DNA, 35 bp, Artificial Sequence
  Synthetic oligonucleotide
tcgccccacctcagcgtcgccctcgcgcacttcct

SEQ ID NO: 170728 - DNA, 35 bp, Artificial Sequence
  Synthetic oligonucleotide
tacccgtcacatctctcgccacccttgcccacgct

SEQ ID NO: 170729 - DNA, 35 bp, Artificial Sequence
  Synthetic oligonucleotide
gcgaggcgtaaccggcctcacttcctttctgtgct

SEQ ID NO: 170730 - DNA, 35 bp, Artificial Sequence
  Synthetic oligonucleotide
atgccctggtcgttccatgctagccctcttcatct

SEQ ID NO: 170731 - DNA, 34 bp, Artificial Sequence
  Synthetic oligonucleotide
tgccctcacttatcacatttgtgcccgctcctct

SEQ ID NO: 170732 - DNA, 35 bp, Artificial Sequence
  Synthetic oligonucleotide
gccgcccaacgtttcaccacccgaattcacgctct

SEQ ID NO: 170733 - DNA, 35 bp, Artificial Sequence
  Synthetic oligonucleotide
ttcgtgctaagctcagtcccctttttagtctctct

SEQ ID NO: 170734 - DNA, 35 bp, Artificial Sequence
  Synthetic oligonucleotide
gccgaccttgaattggctgccctcgatccttctct

SEQ ID NO: 170735 - DNA, 35 bp, Artificial Sequence
  Synthetic oligonucleotide
gttggcgagcagatgcccttctgtttgctctttct

SEQ ID NO: 170736 - DNA, 35 bp, Artificial Sequence
  Synthetic oligonucleotide
agaggaggggggaatcgcaaggaggacatgtcagt

SEQ ID NO: 170737 - DNA, 35 bp, Artificial Sequence
  Synthetic oligonucleotide
gaagaacgagcgggagagggattggacggccaggt

SEQ ID NO: 170738 - DNA, 35 bp, Artificial Sequence
  Synthetic oligonucleotide
tggtgcgacattcgcgcctcccccgccaccacggt

SEQ ID NO: 170739 - DNA, 35 bp, Artificial Sequence
  Synthetic oligonucleotide
aatggcacccccgcgcccccgctcccttacgatgt

SEQ ID NO: 170740 - DNA, 35 bp, Artificial Sequence
  Synthetic oligonucleotide
tcagccaccatttagtcaactcgcacactctttgt

SEQ ID NO: 170741 - DNA, 34 bp, Artificial Sequence
  Synthetic oligonucleotide
gtttgtaccatcctcccgcccacaggaccgtatt

SEQ ID NO: 170742 - DNA, 35 bp, Artificial Sequence
  Synthetic oligonucleotide
tacagacctgtttacggagcaccatctgcaccctt

SEQ ID NO: 170743 - DNA, 35 bp, Artificial Sequence
  Synthetic oligonucleotide
tctcattcgccccagtggtcttggtctcgttgctt

SEQ ID NO: 170744 - DNA, 35 bp, Artificial Sequence
  Synthetic oligonucleotide
gagccgtactatcacctgacctgtcctgcctcgtt

SEQ ID NO: 170745 - DNA, 35 bp, Artificial Sequence
  Synthetic oligonucleotide
accgactagcctcactgcccaccatactgtacttt

SEQ ID NO: 170746 - DNA, 35 bp, Artificial Sequence
  Synthetic oligonucleotide
gtgttgtgcccccttctttgcttccgcctgttgaa

SEQ ID NO: 170747 - DNA, 36 bp, Artificial Sequence
  Synthetic oligonucleotide
tatccaccatctgccgcttgcacgacttcgtgaaca

SEQ ID NO: 170748 - DNA, 35 bp, Artificial Sequence
  Synthetic oligonucleotide
gcggagccatgccctagtatatcacaccgctccca

SEQ ID NO: 170749 - DNA, 35 bp, Artificial Sequence
  Synthetic oligonucleotide
ggatctgctacacgctcgtcaacgctcatctccca

SEQ ID NO: 170750 - DNA, 36 bp, Artificial Sequence
  Synthetic oligonucleotide
gtgacaggcacaccgggtggatggcgggaagggcca

SEQ ID NO: 170751 - DNA, 36 bp, Artificial Sequence
  Synthetic oligonucleotide
gccctgcatcggtcttattttcactgcccattgcca

SEQ ID NO: 170752 - DNA, 36 bp, Artificial Sequence
  Synthetic oligonucleotide
gaattcctgccccattgcctctctgcctccttgcca

SEQ ID NO: 170753 - DNA, 36 bp, Artificial Sequence
  Synthetic oligonucleotide
aacgattgctcgcctgccattgatatttcccatcca

SEQ ID NO: 170754 - DNA, 36 bp, Artificial Sequence
  Synthetic oligonucleotide
ttggccggtgccagatctcgcccttacaccgctcca

SEQ ID NO: 170755 - DNA, 36 bp, Artificial Sequence
  Synthetic oligonucleotide
actcacgtcacctcctattctatcgtccgttaagca

SEQ ID NO: 170756 - DNA, 35 bp, Artificial Sequence
  Synthetic oligonucleotide
acactacgtaccgccccatccccctagtttgatca

SEQ ID NO: 170757 - DNA, 36 bp, Artificial Sequence
  Synthetic oligonucleotide
gccccttgcctgtcgaccgtcgggttttcgccctca

SEQ ID NO: 170758 - DNA, 37 bp, Artificial Sequence
  Synthetic oligonucleotide
tcccctctcacacggttaacaagacccccgacgacga

SEQ ID NO: 170759 - DNA, 37 bp, Artificial Sequence
  Synthetic oligonucleotide
aattccccgcccctgagtctacgttcatgtcccccga

SEQ ID NO: 170760 - DNA, 36 bp, Artificial Sequence
  Synthetic oligonucleotide
gactcgcccggtcaactttggttcttcctcgcccga

SEQ ID NO: 170761 - DNA, 36 bp, Artificial Sequence
  Synthetic oligonucleotide
ggtctcccctgcctgcattaccgataatctttccga

SEQ ID NO: 170762 - DNA, 35 bp, Artificial Sequence
  Synthetic oligonucleotide
actccgccctcttttccaccgtcagtcgagcgcga

SEQ ID NO: 170763 - DNA, 37 bp, Artificial Sequence
  Synthetic oligonucleotide
gcaggagaggcgaaggtgtagggcggtgggaaggcga

SEQ ID NO: 170764 - DNA, 37 bp, Artificial Sequence
  Synthetic oligonucleotide
tgaagtcgcagatgcacactcccccgtatcttgtcga

SEQ ID NO: 170765 - DNA, 37 bp, Artificial Sequence
  Synthetic oligonucleotide
gatagtgagggatcctgaggagggacacgagggagga

SEQ ID NO: 170766 - DNA, 37 bp, Artificial Sequence
  Synthetic oligonucleotide
aaagaagagcagaaagaggggggagagcgggggagga

SEQ ID NO: 170767 - DNA, 36 bp, Artificial Sequence
  Synthetic oligonucleotide
agcagagcccagaaaaggaggtaggggcatgaggga

SEQ ID NO: 170768 - DNA, 37 bp, Artificial Sequence
  Synthetic oligonucleotide
ttgagccactggagtggttaggtggggtgggagggga

SEQ ID NO: 170769 - DNA, 37 bp, Artificial Sequence
  Synthetic oligonucleotide
gactagcgggcaaggggtcgtgagggggtggctggga

SEQ ID NO: 170770 - DNA, 37 bp, Artificial Sequence
  Synthetic oligonucleotide
cacaccctcggcatacgcgccccccttccctgctgga

SEQ ID NO: 170771 - DNA, 37 bp, Artificial Sequence
  Synthetic oligonucleotide
gagacagacaagggcaggaacgaagtgaacgggtgga

SEQ ID NO: 170772 - DNA, 36 bp, Artificial Sequence
  Synthetic oligonucleotide
gtccacgctcatgtcgttccccgacccgcttactga

SEQ ID NO: 170773 - DNA, 38 bp, Artificial Sequence
  Synthetic oligonucleotide
atccctgccgccgttttgccgccatccctgaccagtga

SEQ ID NO: 170774 - DNA, 38 bp, Artificial Sequence
  Synthetic oligonucleotide
ttgcgctggtagcttgcccgttccattcccttacgtga

SEQ ID NO: 170775 - DNA, 37 bp, Artificial Sequence
  Synthetic oligonucleotide
tccgccaccgcgaaccatgcctcatttcatcccgtga

SEQ ID NO: 170776 - DNA, 38 bp, Artificial Sequence
  Synthetic oligonucleotide
accccagctcgttctctgaccccagccccgatccgtga

SEQ ID NO: 170777 - DNA, 38 bp, Artificial Sequence
  Synthetic oligonucleotide
ggggcaccgccacccgcccgcccatgtctatctcgtga

SEQ ID NO: 170778 - DNA, 38 bp, Artificial Sequence
  Synthetic oligonucleotide
gaagtagcgacggtaggggcttgcaagggggaaggtga

SEQ ID NO: 170779 - DNA, 38 bp, Artificial Sequence
  Synthetic oligonucleotide
accgacctccactgatccgcccagagtacactcggtga

SEQ ID NO: 170780 - DNA, 38 bp, Artificial Sequence
  Synthetic oligonucleotide
tagcgaggtggcgagcgaggagggaaggggatatgtga

SEQ ID NO: 170781 - DNA, 37 bp, Artificial Sequence
  Synthetic oligonucleotide
tcccacatccatgggatacataccgcttaccctgtga

SEQ ID NO: 170782 - DNA, 38 bp, Artificial Sequence
  Synthetic oligonucleotide
gttgggcgagtggggattacggggtgcgggggaattga

SEQ ID NO: 170783 - DNA, 36 bp, Artificial Sequence
  Synthetic oligonucleotide
tcctgccccatccgcacagtcttttcgctggcttga

SEQ ID NO: 170784 - DNA, 38 bp, Artificial Sequence
  Synthetic oligonucleotide
tcagccacagcagtactgtacccacgcggccctcttga

SEQ ID NO: 170785 - DNA, 36 bp, Artificial Sequence
  Synthetic oligonucleotide
tctacacctgctgagctcccgtcggccactgttata

SEQ ID NO: 170786 - DNA, 36 bp, Artificial Sequence
  Synthetic oligonucleotide
tgcacccactcgctatggactttctcgtacgcacta

SEQ ID NO: 170787 - DNA, 35 bp, Artificial Sequence
  Synthetic oligonucleotide
gtacactgccctccactggtattccggggttacta

SEQ ID NO: 170788 - DNA, 36 bp, Artificial Sequence
  Synthetic oligonucleotide
tcatcctgctgccgcccttcctggatattatgtcta

SEQ ID NO: 170789 - DNA, 36 bp, Artificial Sequence
  Synthetic oligonucleotide
acaccgacaccacgcgcgctggccctttgccttcta

SEQ ID NO: 170790 - DNA, 36 bp, Artificial Sequence
  Synthetic oligonucleotide
gctcactcctcattgcgccccttagaacttcttcta

SEQ ID NO: 170791 - DNA, 36 bp, Artificial Sequence
  Synthetic oligonucleotide
gctgcccgtccatattccgtcccgcacacttttcta

SEQ ID NO: 170792 - DNA, 35 bp, Artificial Sequence
  Synthetic oligonucleotide
gacccggtcagcactctacctcgctcccttccaac

SEQ ID NO: 170793 - DNA, 29 bp, Artificial Sequence
  Synthetic oligonucleotide
tctacacaattgccgttctctcgcttaac

SEQ ID NO: 170794 - DNA, 35 bp, Artificial Sequence
  Synthetic oligonucleotide
gttgcaagcgccgaccgccgaccccctatgtacac

SEQ ID NO: 170795 - DNA, 35 bp, Artificial Sequence
  Synthetic oligonucleotide
ttcagcgtagctgccggctaccttttctctcttac

SEQ ID NO: 170796 - DNA, 35 bp, Artificial Sequence
  Synthetic oligonucleotide
ccagaccaagctgtctccatccgccagccgctacc

SEQ ID NO: 170797 - DNA, 35 bp, Artificial Sequence
  Synthetic oligonucleotide
acccaatgccctgggctatatgtactccgccaccc

SEQ ID NO: 170798 - DNA, 35 bp, Artificial Sequence
  Synthetic oligonucleotide
tgacactccccttcgtaatcccaccaggcaacccc

SEQ ID NO: 170799 - DNA, 35 bp, Artificial Sequence
  Synthetic oligonucleotide
ggacgcttcccttgcttcgttatccgctccgtccc

SEQ ID NO: 170800 - DNA, 35 bp, Artificial Sequence
  Synthetic oligonucleotide
gtccattccatcacacgacccgtgagtcccacgcc

SEQ ID NO: 170801 - DNA, 35 bp, Artificial Sequence
  Synthetic oligonucleotide
ggtcatccccacctagtttggccctatctgtcgcc

SEQ ID NO: 170802 - DNA, 35 bp, Artificial Sequence
  Synthetic oligonucleotide
gtcgtgcctcattttctgcacgtctgttacactcc

SEQ ID NO: 170803 - DNA, 35 bp, Artificial Sequence
  Synthetic oligonucleotide
aacacctccgggcctcactcatttgccatgtctcc

SEQ ID NO: 170804 - DNA, 35 bp, Artificial Sequence
  Synthetic oligonucleotide
tgtgtgcctctcctgattatccctgcggcccttcc

SEQ ID NO: 170805 - DNA, 36 bp, Artificial Sequence
  Synthetic oligonucleotide
gatcgactgtatatcgcctagtttgctccccgttcc

SEQ ID NO: 170806 - DNA, 35 bp, Artificial Sequence
  Synthetic oligonucleotide
gtccaggtctgccacagctacgccacgccatttcc

SEQ ID NO: 170807 - DNA, 35 bp, Artificial Sequence
  Synthetic oligonucleotide
tagaggaagaaggtggggtgttgtcggggaagagc

SEQ ID NO: 170808 - DNA, 35 bp, Artificial Sequence
  Synthetic oligonucleotide
gccgtcacatcacgtccccctgatcagcccgtagc

SEQ ID NO: 170809 - DNA, 35 bp, Artificial Sequence
  Synthetic oligonucleotide
gtcactccaccatgttccccacgccagtccttagc

SEQ ID NO: 170810 - DNA, 35 bp, Artificial Sequence
  Synthetic oligonucleotide
tccccgcccgctcttgacaccgatttagttggcgc

SEQ ID NO: 170811 - DNA, 35 bp, Artificial Sequence
  Synthetic oligonucleotide
cacaccgccgccccttctgcctgcgttacgatcgc

SEQ ID NO: 170812 - DNA, 35 bp, Artificial Sequence
  Synthetic oligonucleotide
gcgacactgccatttcactcgctctttttcctcgc

SEQ ID NO: 170813 - DNA, 35 bp, Artificial Sequence
  Synthetic oligonucleotide
gcattcgcctccctcttaatctgctcggtttaggc

SEQ ID NO: 170814 - DNA, 35 bp, Artificial Sequence
  Synthetic oligonucleotide
accgtgcgcggttgccctgtccagtctttccctgc

SEQ ID NO: 170815 - DNA, 35 bp, Artificial Sequence
  Synthetic oligonucleotide
atgcacctttcggtagcctttgtacttgctcctgc

SEQ ID NO: 170816 - DNA, 35 bp, Artificial Sequence
  Synthetic oligonucleotide
gacttccctcaatatgcctcctggtccctatgtgc

SEQ ID NO: 170817 - DNA, 35 bp, Artificial Sequence
  Synthetic oligonucleotide
acgcaacagcgagaccctgctgtcccttccgttgc

SEQ ID NO: 170818 - DNA, 35 bp, Artificial Sequence
  Synthetic oligonucleotide
tcagtccgttcacccccgattcatgcatgaccctc

SEQ ID NO: 170819 - DNA, 35 bp, Artificial Sequence
  Synthetic oligonucleotide
tgacctcccggctcctctcctcttaactggtcctc

SEQ ID NO: 170820 - DNA, 35 bp, Artificial Sequence
  Synthetic oligonucleotide
gccagccccttcctgtatgtcaagcggcgcctctc

SEQ ID NO: 170821 - DNA, 35 bp, Artificial Sequence
  Synthetic oligonucleotide
tgagtcgtcgacgtgctctgccgccctttcctgtc

SEQ ID NO: 170822 - DNA, 35 bp, Artificial Sequence
  Synthetic oligonucleotide
gcggacggcttcaaccttgctcgttactgttcttc

SEQ ID NO: 170823 - DNA, 34 bp, Artificial Sequence
  Synthetic oligonucleotide
gtcaccccgcacactcagtgttcccgccctccag

SEQ ID NO: 170824 - DNA, 36 bp, Artificial Sequence
  Synthetic oligonucleotide
gccgcccgccgcatcgtcgcacactcaccgccggag

SEQ ID NO: 170825 - DNA, 35 bp, Artificial Sequence
  Synthetic oligonucleotide
ggaaaggaaggaagcgttggggcgggtagggctag

SEQ ID NO: 170826 - DNA, 35 bp, Artificial Sequence
  Synthetic oligonucleotide
agctgtcccccgtcctttgtcctcacattctaccg

SEQ ID NO: 170827 - DNA, 35 bp, Artificial Sequence
  Synthetic oligonucleotide
tccaccttccctccgatctgccactgctgctcgcg

SEQ ID NO: 170828 - DNA, 35 bp, Artificial Sequence
  Synthetic oligonucleotide
gtgctgcctatcccatccccgtcgtctcgacatcg

SEQ ID NO: 170829 - DNA, 35 bp, Artificial Sequence
  Synthetic oligonucleotide
tgtgtccagtccgttcgccgccctccttgccatcg

SEQ ID NO: 170830 - DNA, 35 bp, Artificial Sequence
  Synthetic oligonucleotide
gatgtgccccccccaatccgacctacttcccgtcg

SEQ ID NO: 170831 - DNA, 35 bp, Artificial Sequence
  Synthetic oligonucleotide
aaggaaacgaagagggaaggaaaacggaatccagg

SEQ ID NO: 170832 - DNA, 34 bp, Artificial Sequence
  Synthetic oligonucleotide
tgggtacggggggaggattttggaacgcaattgg

SEQ ID NO: 170833 - DNA, 36 bp, Artificial Sequence
  Synthetic oligonucleotide
atgtcgtagcgtactcgcgtttgtcaactcctcctg

SEQ ID NO: 170834 - DNA, 35 bp, Artificial Sequence
  Synthetic oligonucleotide
atctgcccctacatccacttgtgacccgtctcctg

SEQ ID NO: 170835 - DNA, 35 bp, Artificial Sequence
  Synthetic oligonucleotide
tgccaccatctactgcgccaaccctaacggtcttg

SEQ ID NO: 170836 - DNA, 35 bp, Artificial Sequence
  Synthetic oligonucleotide
tccaccagtctccgtgcctttcgctattcattcat

SEQ ID NO: 170837 - DNA, 35 bp, Artificial Sequence
  Synthetic oligonucleotide
gccatagcctgcgtgttcttactagcccccgcact

SEQ ID NO: 170838 - DNA, 35 bp, Artificial Sequence
  Synthetic oligonucleotide
tataacgtccgttcgccatctcagtcccctgcact

SEQ ID NO: 170839 - DNA, 35 bp, Artificial Sequence
  Synthetic oligonucleotide
tgcaacgccgagtcaatttcctgcgcctcccgcct

SEQ ID NO: 170840 - DNA, 35 bp, Artificial Sequence
  Synthetic oligonucleotide
gagtagctcgcccgtccttctcgcctggaaagtct

SEQ ID NO: 170841 - DNA, 35 bp, Artificial Sequence
  Synthetic oligonucleotide
tacggtccgactgggtcttcctccctccattccgt

SEQ ID NO: 170842 - DNA, 35 bp, Artificial Sequence
  Synthetic oligonucleotide
gacatactgtggcgcaggtcacccgtccttcctgt

SEQ ID NO: 170843 - DNA, 35 bp, Artificial Sequence
  Synthetic oligonucleotide
gtgccgacccgttgtaccgcccgccttttttgtgt

SEQ ID NO: 170844 - DNA, 35 bp, Artificial Sequence
  Synthetic oligonucleotide
gttccccggccgtgttctcttttagttccaccatt

SEQ ID NO: 170845 - DNA, 35 bp, Artificial Sequence
  Synthetic oligonucleotide
ttccgctcatccgccttggctttggactccctatt

SEQ ID NO: 170846 - DNA, 35 bp, Artificial Sequence
  Synthetic oligonucleotide
acactcctgtcgttctgaccgacctgcctgccttt

SEQ ID NO: 170847 - DNA, 35 bp, Artificial Sequence
  Synthetic oligonucleotide
atcacgactgtctgcgctgccactacatctccttt

SEQ ID NO: 170848 - DNA, 36 bp, Artificial Sequence
  Synthetic oligonucleotide
gagaatgaggcgggggaaggctagtgaacgcggcaa

SEQ ID NO: 170849 - DNA, 36 bp, Artificial Sequence
  Synthetic oligonucleotide
actcgccatctttgcctccaccagtcgtaatacgaa

SEQ ID NO: 170850 - DNA, 36 bp, Artificial Sequence
  Synthetic oligonucleotide
tttccctgcccccgttttccagaagcccttgcctaa

SEQ ID NO: 170851 - DNA, 35 bp, Artificial Sequence
  Synthetic oligonucleotide
tagaccaggggcacggggtgggtgggtcataaaca

SEQ ID NO: 170852 - DNA, 36 bp, Artificial Sequence
  Synthetic oligonucleotide
tcaaccttctcatacatgtctgtccctcgccgaaca

SEQ ID NO: 170853 - DNA, 35 bp, Artificial Sequence
  Synthetic oligonucleotide
aacatcaacctcgtactggcctgttcttccataca

SEQ ID NO: 170854 - DNA, 36 bp, Artificial Sequence
  Synthetic oligonucleotide
tactagcgctgcgcccgggcccttctcaccccccca

SEQ ID NO: 170855 - DNA, 36 bp, Artificial Sequence
  Synthetic oligonucleotide
tcagtagtccctgccctcatgacagacgccgcccca

SEQ ID NO: 170856 - DNA, 35 bp, Artificial Sequence
  Synthetic oligonucleotide
tatcccccccatacgaaccgcacctggcctgccca

SEQ ID NO: 170857 - DNA, 35 bp, Artificial Sequence
  Synthetic oligonucleotide
agcctgctccaccgagtccccccccatggtgccca

SEQ ID NO: 170858 - DNA, 36 bp, Artificial Sequence
  Synthetic oligonucleotide
gaccccgggggccggtaatgtcgcatcctcactcca

SEQ ID NO: 170859 - DNA, 36 bp, Artificial Sequence
  Synthetic oligonucleotide
gagtcacgacctgtatccgcccctattacccccgca

SEQ ID NO: 170860 - DNA, 36 bp, Artificial Sequence
  Synthetic oligonucleotide
aacatcggcactatttacacctgcgaccacccctca

SEQ ID NO: 170861 - DNA, 36 bp, Artificial Sequence
  Synthetic oligonucleotide
gcccaccccagcccggatctaccctgatttttgtca

SEQ ID NO: 170862 - DNA, 35 bp, Artificial Sequence
  Synthetic oligonucleotide
atccgcctattccgcctccacgcagtctttattca

SEQ ID NO: 170863 - DNA, 36 bp, Artificial Sequence
  Synthetic oligonucleotide
ttccaccactcacttgttgtctcccctgttccttca

SEQ ID NO: 170864 - DNA, 36 bp, Artificial Sequence
  Synthetic oligonucleotide
acatcctgcgccacctgaggattctatcccttttca

SEQ ID NO: 170865 - DNA, 37 bp, Artificial Sequence
  Synthetic oligonucleotide
acccactctcgcccacattgtgaacttgtactaacga

SEQ ID NO: 170866 - DNA, 37 bp, Artificial Sequence
  Synthetic oligonucleotide
ttacacccgacttgcccaaccgccttcacttgcccga

SEQ ID NO: 170867 - DNA, 37 bp, Artificial Sequence
  Synthetic oligonucleotide
gcccgaccctgactatgatataccccttcctagccga

SEQ ID NO: 170868 - DNA, 37 bp, Artificial Sequence
  Synthetic oligonucleotide
acacgcggaagtcttccgctccgcccctctgatccga

SEQ ID NO: 170869 - DNA, 37 bp, Artificial Sequence
  Synthetic oligonucleotide
gagaagggtgaccgggaggggggggatggaagagcga

SEQ ID NO: 170870 - DNA, 37 bp, Artificial Sequence
  Synthetic oligonucleotide
tgtgcccttcccatatgtcccactgtttccgtatcga

SEQ ID NO: 170871 - DNA, 37 bp, Artificial Sequence
  Synthetic oligonucleotide
tataccgggcgggtgggttaaagggacagagtgagga

SEQ ID NO: 170872 - DNA, 37 bp, Artificial Sequence
  Synthetic oligonucleotide
atagggatgccgggagagagggggagggacgctcgga

SEQ ID NO: 170873 - DNA, 37 bp, Artificial Sequence
  Synthetic oligonucleotide
tccagtaggtactgggtgaatcatgggcgggaaggga

SEQ ID NO: 170874 - DNA, 36 bp, Artificial Sequence
  Synthetic oligonucleotide
gtcacgtgaaaggaatcatggaagtgggatcgggga

SEQ ID NO: 170875 - DNA, 37 bp, Artificial Sequence
  Synthetic oligonucleotide
atggaggggacattggctgggaacgacggggttggga

SEQ ID NO: 170876 - DNA, 37 bp, Artificial Sequence
  Synthetic oligonucleotide
gtggtcgtgagtagacttaagggaggggggcgatgga

SEQ ID NO: 170877 - DNA, 37 bp, Artificial Sequence
  Synthetic oligonucleotide
gccaccattccgcttttatccgccattttcctctgga

SEQ ID NO: 170878 - DNA, 37 bp, Artificial Sequence
  Synthetic oligonucleotide
tcctcccgccaccacttcacagtgacagaacattgga

SEQ ID NO: 170879 - DNA, 37 bp, Artificial Sequence
  Synthetic oligonucleotide
gtgcaccccctcgcagttttcttcagcacacacatga

SEQ ID NO: 170880 - DNA, 38 bp, Artificial Sequence
  Synthetic oligonucleotide
tgagggcggagggagtggggtggatttggacggtatga

SEQ ID NO: 170881 - DNA, 38 bp, Artificial Sequence
  Synthetic oligonucleotide
gcccaatcccctgcttgcctataaggttctgatcctga

SEQ ID NO: 170882 - DNA, 37 bp, Artificial Sequence
  Synthetic oligonucleotide
acagtccccattccgtgtcttcggatctcccccgtga

SEQ ID NO: 170883 - DNA, 38 bp, Artificial Sequence
  Synthetic oligonucleotide
tactcgtcgtacgtccatccactcgtcccatcccgtga

SEQ ID NO: 170884 - DNA, 38 bp, Artificial Sequence
  Synthetic oligonucleotide
gtacctcccccgccgccactcgatttgtcaatcggtga

SEQ ID NO: 170885 - DNA, 38 bp, Artificial Sequence
  Synthetic oligonucleotide
tcccaccaccctattgttctagcctcctcacaaattga

SEQ ID NO: 170886 - DNA, 38 bp, Artificial Sequence
  Synthetic oligonucleotide
tgcgagctgcaatccagccgcttatgtactccacttga

SEQ ID NO: 170887 - DNA, 38 bp, Artificial Sequence
  Synthetic oligonucleotide
actagccgcaggcgtcgctactgccatccttcgcttga

SEQ ID NO: 170888 - DNA, 38 bp, Artificial Sequence
  Synthetic oligonucleotide
aaaagacggaggggaaggatgggcggggggcaagttga

SEQ ID NO: 170889 - DNA, 38 bp, Artificial Sequence
  Synthetic oligonucleotide
gagccaggggaggggacaggggccagtgggggtgttga

SEQ ID NO: 170890 - DNA, 38 bp, Artificial Sequence
  Synthetic oligonucleotide
tcccgcccccacttgatcgctataaaacacattgttga

SEQ ID NO: 170891 - DNA, 37 bp, Artificial Sequence
  Synthetic oligonucleotide
tcccgggatcgcccttctgctctgccactgcctttga

SEQ ID NO: 170892 - DNA, 38 bp, Artificial Sequence
  Synthetic oligonucleotide
gagcaggtccgccccactccccctgcggcaccttttga

SEQ ID NO: 170893 - DNA, 36 bp, Artificial Sequence
  Synthetic oligonucleotide
gtgaacgagaaagggggggtagtgacgagaataata

SEQ ID NO: 170894 - DNA, 36 bp, Artificial Sequence
  Synthetic oligonucleotide
gattgcacctccatgcaccagtttatcttacccata

SEQ ID NO: 170895 - DNA, 36 bp, Artificial Sequence
  Synthetic oligonucleotide
cattccacccgcctgttgcacgtacatttcgccata

SEQ ID NO: 170896 - DNA, 35 bp, Artificial Sequence
  Synthetic oligonucleotide
acaccgtcctgcctgtccggccacacagcttacta

SEQ ID NO: 170897 - DNA, 35 bp, Artificial Sequence
  Synthetic oligonucleotide
tcctgctccccgatctatgctttcctttgcacgta

SEQ ID NO: 170898 - DNA, 30 bp, Artificial Sequence
  Synthetic oligonucleotide
attcgccttgccctttcttgacatctggta

SEQ ID NO: 170899 - DNA, 33 bp, Artificial Sequence
  Synthetic oligonucleotide
tcctgccctacaacatcgttctcgaacacctta

SEQ ID NO: 170900 - DNA, 36 bp, Artificial Sequence
  Synthetic oligonucleotide
gcacggagaaggtgctcatttccctctcgttcctta

SEQ ID NO: 170901 - DNA, 35 bp, Artificial Sequence
  Synthetic oligonucleotide
gcaaaagggggggtgttaccgggccgggctagtta

SEQ ID NO: 170902 - DNA, 36 bp, Artificial Sequence
  Synthetic oligonucleotide
tgcgtgacacatatgacgccccctgtgcctgcttta

SEQ ID NO: 170903 - DNA, 35 bp, Artificial Sequence
  Synthetic oligonucleotide
aggggaggaagccgaggggaaggatacagcaaaac

SEQ ID NO: 170904 - DNA, 35 bp, Artificial Sequence
  Synthetic oligonucleotide
atgtccccgccgtattcctaaagggccttaacaac

SEQ ID NO: 170905 - DNA, 35 bp, Artificial Sequence
  Synthetic oligonucleotide
tctcgcaccccggtccaatgctctcggtagtccac

SEQ ID NO: 170906 - DNA, 35 bp, Artificial Sequence
  Synthetic oligonucleotide
actactctgccgcctttgaattacgtcactccgac

SEQ ID NO: 170907 - DNA, 35 bp, Artificial Sequence
  Synthetic oligonucleotide
gaagcgcgccaacttgccctttgctaggcccctac

SEQ ID NO: 170908 - DNA, 35 bp, Artificial Sequence
  Synthetic oligonucleotide
tgggacatgccatcccgcgtacctcaagtcccacc

SEQ ID NO: 170909 - DNA, 35 bp, Artificial Sequence
  Synthetic oligonucleotide
aagcttgggcgggtgggcgtgagggagttgtaccc

SEQ ID NO: 170910 - DNA, 35 bp, Artificial Sequence
  Synthetic oligonucleotide
tccatctctctgcggacttgaagccaacccgcccc

SEQ ID NO: 170911 - DNA, 35 bp, Artificial Sequence
  Synthetic oligonucleotide
acacctgtctcggcgaatatgctacttatgctccc

SEQ ID NO: 170912 - DNA, 35 bp, Artificial Sequence
  Synthetic oligonucleotide
tcaccccctcatctctgtatgccggacacgttccc

SEQ ID NO: 170913 - DNA, 35 bp, Artificial Sequence
  Synthetic oligonucleotide
acgacgtgcctgccctaaaactatccctggttgcc

SEQ ID NO: 170914 - DNA, 35 bp, Artificial Sequence
  Synthetic oligonucleotide
tgctctgtagggtgttcatccattctctgttatcc

SEQ ID NO: 170915 - DNA, 35 bp, Artificial Sequence
  Synthetic oligonucleotide
tatgcccggccacattactgcgctgcttaagctcc

SEQ ID NO: 170916 - DNA, 35 bp, Artificial Sequence
  Synthetic oligonucleotide
ttgtaacgaagtgcggcattgcatccccctgctcc

SEQ ID NO: 170917 - DNA, 35 bp, Artificial Sequence
  Synthetic oligonucleotide
ttaccatcactctatatgcgggttatgcaccttcc

SEQ ID NO: 170918 - DNA, 32 bp, Artificial Sequence
  Synthetic oligonucleotide
ttgtcctggcctacctgccgctgaaaatttcc

SEQ ID NO: 170919 - DNA, 35 bp, Artificial Sequence
  Synthetic oligonucleotide
acccatcgcatcctccaccatattgcattattagc

SEQ ID NO: 170920 - DNA, 35 bp, Artificial Sequence
  Synthetic oligonucleotide
tctggcctgctcgactcctggatcttttcccctgc

SEQ ID NO: 170921 - DNA, 35 bp, Artificial Sequence
  Synthetic oligonucleotide
tgcggaacacgcgcatattccaactgaccacactc

SEQ ID NO: 170922 - DNA, 35 bp, Artificial Sequence
  Synthetic oligonucleotide
acgctgggacagcgacatataaattcaccccgctc

SEQ ID NO: 170923 - DNA, 35 bp, Artificial Sequence
  Synthetic oligonucleotide
acttgcgcctcccactgttttttgatttgcttctc

SEQ ID NO: 170924 - DNA, 35 bp, Artificial Sequence
  Synthetic oligonucleotide
tccacagccgcggatctctttgccccaattgcgtc

SEQ ID NO: 170925 - DNA, 35 bp, Artificial Sequence
  Synthetic oligonucleotide
tctgcctgccccaagcccgccctgtctccccggtc

SEQ ID NO: 170926 - DNA, 35 bp, Artificial Sequence
  Synthetic oligonucleotide
gagtttaccccccctcctgatgtatgcatccggtc

SEQ ID NO: 170927 - DNA, 35 bp, Artificial Sequence
  Synthetic oligonucleotide
gatggacacatcggctcagcacttctgtctctgtc

SEQ ID NO: 170928 - DNA, 35 bp, Artificial Sequence
  Synthetic oligonucleotide
gccccaccctaaaagtttcatctagtgacgttgtc

SEQ ID NO: 170929 - DNA, 35 bp, Artificial Sequence
  Synthetic oligonucleotide
tgcgctgtcacctcgttcggttctcactctggttc

SEQ ID NO: 170930 - DNA, 34 bp, Artificial Sequence
  Synthetic oligonucleotide
atgtgtacacgcttaaccgccgttgccccccccg

SEQ ID NO: 170931 - DNA, 35 bp, Artificial Sequence
  Synthetic oligonucleotide
agtctgtccgtacagttatcttcctcctctcttcg

SEQ ID NO: 170932 - DNA, 35 bp, Artificial Sequence
  Synthetic oligonucleotide
acgaccacaaacccatcgcactgccagcccgttcg

SEQ ID NO: 170933 - DNA, 35 bp, Artificial Sequence
  Synthetic oligonucleotide
gccctcccccgtcgtgttaacttcaccacatcatg

SEQ ID NO: 170934 - DNA, 33 bp, Artificial Sequence
  Synthetic oligonucleotide
ggggggagggagggtttagagaagtgagtcatg

SEQ ID NO: 170935 - DNA, 35 bp, Artificial Sequence
  Synthetic oligonucleotide
gtgtcaccgtccctgttgcgatcggtttttctctg

SEQ ID NO: 170936 - DNA, 35 bp, Artificial Sequence
  Synthetic oligonucleotide
ttgtccctctaatcctcactcgtacagcctacgtg

SEQ ID NO: 170937 - DNA, 35 bp, Artificial Sequence
  Synthetic oligonucleotide
acgcgccatggcctccgaattttgtctcccctaat

SEQ ID NO: 170938 - DNA, 35 bp, Artificial Sequence
  Synthetic oligonucleotide
gactactacacatgccctgtcccacagtccgttat

SEQ ID NO: 170939 - DNA, 33 bp, Artificial Sequence
  Synthetic oligonucleotide
tgccgccgcgctcctgctcccacgtcccttact

SEQ ID NO: 170940 - DNA, 35 bp, Artificial Sequence
  Synthetic oligonucleotide
gtacgccatttaccctctgctagtgcgattcccct

SEQ ID NO: 170941 - DNA, 35 bp, Artificial Sequence
  Synthetic oligonucleotide
tgtcacccttggggtggcctcgcatatctcgccct

SEQ ID NO: 170942 - DNA, 35 bp, Artificial Sequence
  Synthetic oligonucleotide
aatgggaatcagggcgggcggggctgaaaggccct

SEQ ID NO: 170943 - DNA, 35 bp, Artificial Sequence
  Synthetic oligonucleotide
gacccaggcatatatctgctccgcctgccctgcct

SEQ ID NO: 170944 - DNA, 35 bp, Artificial Sequence
  Synthetic oligonucleotide
gcccccctcggacccgggtaatcatgctcgatcct

SEQ ID NO: 170945 - DNA, 35 bp, Artificial Sequence
  Synthetic oligonucleotide
gcaaacaccaatgactagctgccgttgaccctcct

SEQ ID NO: 170946 - DNA, 35 bp, Artificial Sequence
  Synthetic oligonucleotide
gacaccagttaccatgtgttctaccatcttttgct

SEQ ID NO: 170947 - DNA, 35 bp, Artificial Sequence
  Synthetic oligonucleotide
gagcccacgtgagcttttgctttatttcccccggt

SEQ ID NO: 170948 - DNA, 35 bp, Artificial Sequence
  Synthetic oligonucleotide
aacgcgccacgcactcctgttcttgcaccctctgt

SEQ ID NO: 170949 - DNA, 35 bp, Artificial Sequence
  Synthetic oligonucleotide
gcccacctcgctctgtaccaccggtttatgccatt

SEQ ID NO: 170950 - DNA, 35 bp, Artificial Sequence
  Synthetic oligonucleotide
tcatcccgccgtggccaatctggggttcgtttctt

SEQ ID NO: 170951 - DNA, 35 bp, Artificial Sequence
  Synthetic oligonucleotide
tttaccgcggtcccacgcctctcagtccaccgcaa

SEQ ID NO: 170952 - DNA, 35 bp, Artificial Sequence
  Synthetic oligonucleotide
atgccacgggttggggaatgcaggggggaggtcaa

SEQ ID NO: 170953 - DNA, 36 bp, Artificial Sequence
  Synthetic oligonucleotide
accagggcgagaggggcgggggacctgacggaataa

SEQ ID NO: 170954 - DNA, 35 bp, Artificial Sequence
  Synthetic oligonucleotide
tcgcccatacgcccccaatcgacgtcctgtactaa

SEQ ID NO: 170955 - DNA, 36 bp, Artificial Sequence
  Synthetic oligonucleotide
gacactctcccgtatgcccctgcttgaccatccaca

SEQ ID NO: 170956 - DNA, 36 bp, Artificial Sequence
  Synthetic oligonucleotide
acacaaagccgtctgtcctcattgctaccgtccaca

SEQ ID NO: 170957 - DNA, 36 bp, Artificial Sequence
  Synthetic oligonucleotide
ttgatcacctcggccttgatagcgcggctccaccca

SEQ ID NO: 170958 - DNA, 36 bp, Artificial Sequence
  Synthetic oligonucleotide
tgccatttccccgggttttacaagattgccccccca

SEQ ID NO: 170959 - DNA, 36 bp, Artificial Sequence
  Synthetic oligonucleotide
gaacaccgattagctctgtcttaatgctcgccccca

SEQ ID NO: 170960 - DNA, 36 bp, Artificial Sequence
  Synthetic oligonucleotide
tacccggcgccctctaggtcgatattgctttcccca

SEQ ID NO: 170961 - DNA, 28 bp, Artificial Sequence
  Synthetic oligonucleotide
acctccattgctgccttccatttagcca

SEQ ID NO: 170962 - DNA, 35 bp, Artificial Sequence
  Synthetic oligonucleotide
aaccaatgtcagggcgaatccggcccccctctcca

SEQ ID NO: 170963 - DNA, 36 bp, Artificial Sequence
  Synthetic oligonucleotide
ttcgttcgccctggttcgtaggtcccttggtctcca

SEQ ID NO: 170964 - DNA, 35 bp, Artificial Sequence
  Synthetic oligonucleotide
gtcgttcggcactctcgtactgcaacttccttcca

SEQ ID NO: 170965 - DNA, 35 bp, Artificial Sequence
  Synthetic oligonucleotide
atgtgcccttccctgtcgccccagttctgaccgca

SEQ ID NO: 170966 - DNA, 35 bp, Artificial Sequence
  Synthetic oligonucleotide
atcgacaacttccatctggtcacttcccctaggca

SEQ ID NO: 170967 - DNA, 36 bp, Artificial Sequence
  Synthetic oligonucleotide
acacacaaagcaggggaggaatgatgtcatggggca

SEQ ID NO: 170968 - DNA, 36 bp, Artificial Sequence
  Synthetic oligonucleotide
ggaggcctgcctggaccttctccgtttctccgctca

SEQ ID NO: 170969 - DNA, 36 bp, Artificial Sequence
  Synthetic oligonucleotide
tccatccacccctgcgctgaactgtttcgatgctca

SEQ ID NO: 170970 - DNA, 34 bp, Artificial Sequence
  Synthetic oligonucleotide
gtaccgacgttatcggtcctcgcccttttcttca

SEQ ID NO: 170971 - DNA, 36 bp, Artificial Sequence
  Synthetic oligonucleotide
agcgtacccccccagcgctgtacgtactcactttca

SEQ ID NO: 170972 - DNA, 36 bp, Artificial Sequence
  Synthetic oligonucleotide
gccctcccactcgtacggtctaggaatctagtttca

SEQ ID NO: 170973 - DNA, 37 bp, Artificial Sequence
  Synthetic oligonucleotide
gtccgcccatgacccccctccgcccgacgttcaccga

SEQ ID NO: 170974 - DNA, 37 bp, Artificial Sequence
  Synthetic oligonucleotide
atccaccccttcgaagttgttaacgcttatctaccga

SEQ ID NO: 170975 - DNA, 37 bp, Artificial Sequence
  Synthetic oligonucleotide
aacaactcatacgcaaagccgtccgccgcccacccga

SEQ ID NO: 170976 - DNA, 35 bp, Artificial Sequence
  Synthetic oligonucleotide
ttgtcactttcacttcatcgagtacgccctcccga

SEQ ID NO: 170977 - DNA, 37 bp, Artificial Sequence
  Synthetic oligonucleotide
ttgttgccacagatgacaatatcctgccctccgccga

SEQ ID NO: 170978 - DNA, 36 bp, Artificial Sequence
  Synthetic oligonucleotide
catatgccccgtcgctcgcttccccgccttctccga

SEQ ID NO: 170979 - DNA, 37 bp, Artificial Sequence
  Synthetic oligonucleotide
tgactaggtactgcgggaggaaggtggggtggagcga

SEQ ID NO: 170980 - DNA, 36 bp, Artificial Sequence
  Synthetic oligonucleotide
tcacccttcgcatctcttataaccgcttctgcgcga

SEQ ID NO: 170981 - DNA, 37 bp, Artificial Sequence
  Synthetic oligonucleotide
tatgcgtgagtgaggggggaggaatagcagggatcga

SEQ ID NO: 170982 - DNA, 37 bp, Artificial Sequence
  Synthetic oligonucleotide
tccacccgcgcatgaatcgtggcgtccactcactcga

SEQ ID NO: 170983 - DNA, 37 bp, Artificial Sequence
  Synthetic oligonucleotide
ttcgcgtaccactgccttcgtccaagaccattctcga

SEQ ID NO: 170984 - DNA, 37 bp, Artificial Sequence
  Synthetic oligonucleotide
gagtgaggttgggaggcataaagggggagacacagga

SEQ ID NO: 170985 - DNA, 36 bp, Artificial Sequence
  Synthetic oligonucleotide
cctaggggagactgggtgatgcgggggcaccgagga

SEQ ID NO: 170986 - DNA, 37 bp, Artificial Sequence
  Synthetic oligonucleotide
tgactcctgccggtttctgccctccccccgagtagga

SEQ ID NO: 170987 - DNA, 37 bp, Artificial Sequence
  Synthetic oligonucleotide
tgatccgccacttcttcgttccctcttcctgaccgga

SEQ ID NO: 170988 - DNA, 37 bp, Artificial Sequence
  Synthetic oligonucleotide
gaagagaggcggggggggtggactcggactaggcgga

SEQ ID NO: 170989 - DNA, 37 bp, Artificial Sequence
  Synthetic oligonucleotide
ttgtgacgcctaatatctgcttcctccccgttaggga

SEQ ID NO: 170990 - DNA, 37 bp, Artificial Sequence
  Synthetic oligonucleotide
gactgatcaccctgcctatgcacgctctccaacggga

SEQ ID NO: 170991 - DNA, 37 bp, Artificial Sequence
  Synthetic oligonucleotide
gtgaagtccatagagggagggggatgacacgacggga

SEQ ID NO: 170992 - DNA, 37 bp, Artificial Sequence
  Synthetic oligonucleotide
agtcagggcggggtcgtgtggggtaaaatcatgggga

SEQ ID NO: 170993 - DNA, 37 bp, Artificial Sequence
  Synthetic oligonucleotide
actgggaggggaagaaatgctcaaggggacctgggga

SEQ ID NO: 170994 - DNA, 38 bp, Artificial Sequence
  Synthetic oligonucleotide
acctgtgcccccaccccgcttcaagagatggccaatga

SEQ ID NO: 170995 - DNA, 38 bp, Artificial Sequence
  Synthetic oligonucleotide
tagaccacgcctgggaagggtaggggtggggcatatga

SEQ ID NO: 170996 - DNA, 37 bp, Artificial Sequence
  Synthetic oligonucleotide
agcgcacaggtcctcatttccacccgctgccaactga

SEQ ID NO: 170997 - DNA, 38 bp, Artificial Sequence
  Synthetic oligonucleotide
tcaacaccccacacgtaacagccgcccctcttcactga

SEQ ID NO: 170998 - DNA, 37 bp, Artificial Sequence
  Synthetic oligonucleotide
tcactccatctgaccttcctgacaggcacgatactga

SEQ ID NO: 170999 - DNA, 38 bp, Artificial Sequence
  Synthetic oligonucleotide
atcgacgccccgttgttgccatcatctcattagcctga

SEQ ID NO: 171000 - DNA, 37 bp, Artificial Sequence
  Synthetic oligonucleotide
acgcctacttcgtgctctatcctcggctttatcctga

SEQ ID NO: 171001 - DNA, 37 bp, Artificial Sequence
  Synthetic oligonucleotide
atcactccgccacacattctctgcccacaagagctga

SEQ ID NO: 171002 - DNA, 37 bp, Artificial Sequence
  Synthetic oligonucleotide
agccccatccacgctatgacatcatcatccccgctga

SEQ ID NO: 171003 - DNA, 38 bp, Artificial Sequence
  Synthetic oligonucleotide
acatcagccgcccaatatcgttgtctctccgttgctga

SEQ ID NO: 171004 - DNA, 37 bp, Artificial Sequence
  Synthetic oligonucleotide
accgaccgactgacctgcccctctctatcttgtctga

SEQ ID NO: 171005 - DNA, 38 bp, Artificial Sequence
  Synthetic oligonucleotide
gcggattgaggagaagggtgaagggtgaagggaagtga

SEQ ID NO: 171006 - DNA, 38 bp, Artificial Sequence
  Synthetic oligonucleotide
tctgacgacgtaccacctgattcccacacccaccgtga

SEQ ID NO: 171007 - DNA, 38 bp, Artificial Sequence
  Synthetic oligonucleotide
tgtatcggcccatgccctatcgtcctgtctccccgtga

SEQ ID NO: 171008 - DNA, 37 bp, Artificial Sequence
  Synthetic oligonucleotide
ggagacggatgattggggctgatggaagcgggggtga

SEQ ID NO: 171009 - DNA, 38 bp, Artificial Sequence
  Synthetic oligonucleotide
gacgagggaggagagcgtagaggagcttagcgatgtga

SEQ ID NO: 171010 - DNA, 38 bp, Artificial Sequence
  Synthetic oligonucleotide
tccgcgcctctcctcatctttgcttgtacgacctgtga

SEQ ID NO: 171011 - DNA, 38 bp, Artificial Sequence
  Synthetic oligonucleotide
gccctgcccacgctcttagagacatcgtccccccttga

SEQ ID NO: 171012 - DNA, 37 bp, Artificial Sequence
  Synthetic oligonucleotide
gcccacatcatgatcgctagataaatcctccccttga

SEQ ID NO: 171013 - DNA, 37 bp, Artificial Sequence
  Synthetic oligonucleotide
tcatactccgccattccagtagggatccgtcccttga

SEQ ID NO: 171014 - DNA, 38 bp, Artificial Sequence
  Synthetic oligonucleotide
gctgaccgtcgcccgcctcacctgcttgtaagccttga

SEQ ID NO: 171015 - DNA, 38 bp, Artificial Sequence
  Synthetic oligonucleotide
tcgccccatccgccctccatcgaaagaagacgccttga

SEQ ID NO: 171016 - DNA, 38 bp, Artificial Sequence
  Synthetic oligonucleotide
tgccatctgtacttcttatatgcccgctctcccgttga

SEQ ID NO: 171017 - DNA, 35 bp, Artificial Sequence
  Synthetic oligonucleotide
tttgcacgagcaccgctgtcttcctgcccatttga

SEQ ID NO: 171018 - DNA, 38 bp, Artificial Sequence
  Synthetic oligonucleotide
tcgttaagaggggaaggggggcggacagcaggctttga

SEQ ID NO: 171019 - DNA, 38 bp, Artificial Sequence
  Synthetic oligonucleotide
accgccgtcatctcgacccacgactgtgccctctttga

SEQ ID NO: 171020 - DNA, 36 bp, Artificial Sequence
  Synthetic oligonucleotide
gctcccgtgtcccgccagctcactcgatccgcccta

SEQ ID NO: 171021 - DNA, 35 bp, Artificial Sequence
  Synthetic oligonucleotide
tcccgtcgacccatcttcgctcactacaggcccta

SEQ ID NO: 171022 - DNA, 35 bp, Artificial Sequence
  Synthetic oligonucleotide
aatgtggtgggggagtcggggagggggttcaagta

SEQ ID NO: 171023 - DNA, 35 bp, Artificial Sequence
  Synthetic oligonucleotide
ttgcccgctcgccccttggtcccagcccggattta

SEQ ID NO: 171024 - DNA, 36 bp, Artificial Sequence
  Synthetic oligonucleotide
agaacatgtccgcaccgattcttccgccctgtttta

SEQ ID NO: 171025 - DNA, 35 bp, Artificial Sequence
  Synthetic oligonucleotide
gacatccaggctcattgcgattccctcctatacac

SEQ ID NO: 171026 - DNA, 35 bp, Artificial Sequence
  Synthetic oligonucleotide
gtacgcgcacccactcctggtcctatcatacttac

SEQ ID NO: 171027 - DNA, 35 bp, Artificial Sequence
  Synthetic oligonucleotide
tcctcgcccttaaccgctatcacgactagtccacc

SEQ ID NO: 171028 - DNA, 35 bp, Artificial Sequence
  Synthetic oligonucleotide
tctaaccggcgacttccgtgtcagtctctctcccc

SEQ ID NO: 171029 - DNA, 35 bp, Artificial Sequence
  Synthetic oligonucleotide
atcgtgccgctgtatcatcgttcccctccgtgccc

SEQ ID NO: 171030 - DNA, 35 bp, Artificial Sequence
  Synthetic oligonucleotide
gatcattgccccagttttattatccctgccttccc

SEQ ID NO: 171031 - DNA, 35 bp, Artificial Sequence
  Synthetic oligonucleotide
aacagctcagtcggaactatgcactctctaccgcc

SEQ ID NO: 171032 - DNA, 35 bp, Artificial Sequence
  Synthetic oligonucleotide
tgtctctcgcccacttgtgctaccctgctcccgcc

SEQ ID NO: 171033 - DNA, 35 bp, Artificial Sequence
  Synthetic oligonucleotide
tctcactcacctatcattccatcagacgcgccgcc

SEQ ID NO: 171034 - DNA, 35 bp, Artificial Sequence
  Synthetic oligonucleotide
tgctatcctcgcccacctgattaagcccctgtgcc

SEQ ID NO: 171035 - DNA, 35 bp, Artificial Sequence
  Synthetic oligonucleotide
ttggactgctgccacctcgatctgttagttttgcc

SEQ ID NO: 171036 - DNA, 35 bp, Artificial Sequence
  Synthetic oligonucleotide
tccaacgccaatgctaaacccattcatccctatcc

SEQ ID NO: 171037 - DNA, 35 bp, Artificial Sequence
  Synthetic oligonucleotide
tcatccacccgatctattggcaccttagcacctcc

SEQ ID NO: 171038 - DNA, 35 bp, Artificial Sequence
  Synthetic oligonucleotide
gaccacgtatccgtgggcttatattcgttccctcc

SEQ ID NO: 171039 - DNA, 35 bp, Artificial Sequence
  Synthetic oligonucleotide
tacgcctccgacatcgtgagttacgattagcctcc

SEQ ID NO: 171040 - DNA, 35 bp, Artificial Sequence
  Synthetic oligonucleotide
tcccctccagataggcatatccgtggtccatctcc

SEQ ID NO: 171041 - DNA, 35 bp, Artificial Sequence
  Synthetic oligonucleotide
ttggccagcaacctatgcttacttccctgttcggc

SEQ ID NO: 171042 - DNA, 33 bp, Artificial Sequence
  Synthetic oligonucleotide
acactgccactgggagaaaatgggggggggggc

SEQ ID NO: 171043 - DNA, 35 bp, Artificial Sequence
  Synthetic oligonucleotide
acgtgccgcagatggccagtccctccaatccaatc

SEQ ID NO: 171044 - DNA, 35 bp, Artificial Sequence
  Synthetic oligonucleotide
tcgcacaacgcgtacttatatccctcgctcctatc

SEQ ID NO: 171045 - DNA, 35 bp, Artificial Sequence
  Synthetic oligonucleotide
gccccaccttcgatcattgcacgcgtgttgccctc

SEQ ID NO: 171046 - DNA, 35 bp, Artificial Sequence
  Synthetic oligonucleotide
gtccacccttcgccggagtaagtgagcaacttctc

SEQ ID NO: 171047 - DNA, 35 bp, Artificial Sequence
  Synthetic oligonucleotide
ttcacgcacacatgtcggtgcatcccgtcgttctc

SEQ ID NO: 171048 - DNA, 35 bp, Artificial Sequence
  Synthetic oligonucleotide
ggccgatccacccgccgcctccgcctgaactcgtc

SEQ ID NO: 171049 - DNA, 35 bp, Artificial Sequence
  Synthetic oligonucleotide
gtgacacccgtgccgtcatctaacacgctgccttc

SEQ ID NO: 171050 - DNA, 35 bp, Artificial Sequence
  Synthetic oligonucleotide
ttacgtcgctggcaccctcactcctcacacggttc

SEQ ID NO: 171051 - DNA, 35 bp, Artificial Sequence
  Synthetic oligonucleotide
tagcacctcgaagtaagcatcacccaccctcttag

SEQ ID NO: 171052 - DNA, 35 bp, Artificial Sequence
  Synthetic oligonucleotide
gttccatgccgctgcaagaccccccgtaccaaacg

SEQ ID NO: 171053 - DNA, 35 bp, Artificial Sequence
  Synthetic oligonucleotide
agtccggtaccatcttgaaaaccgcccctcccccg

SEQ ID NO: 171054 - DNA, 35 bp, Artificial Sequence
  Synthetic oligonucleotide
ttcgaggtacagaggtcagtttcatcccaccgccg

SEQ ID NO: 171055 - DNA, 35 bp, Artificial Sequence
  Synthetic oligonucleotide
atccccaccgccaacttacgggcattttagctccg

SEQ ID NO: 171056 - DNA, 35 bp, Artificial Sequence
  Synthetic oligonucleotide
gatgctggtagccaatcgcccccctgtccattccg

SEQ ID NO: 171057 - DNA, 35 bp, Artificial Sequence
  Synthetic oligonucleotide
gtccgggggagctagtgagcggaagggggtaggcg

SEQ ID NO: 171058 - DNA, 35 bp, Artificial Sequence
  Synthetic oligonucleotide
agtctccccacatcctcatctgcacctacccattg

SEQ ID NO: 171059 - DNA, 35 bp, Artificial Sequence
  Synthetic oligonucleotide
accccccgccaacttctccagttttctcgtacttg

SEQ ID NO: 171060 - DNA, 35 bp, Artificial Sequence
  Synthetic oligonucleotide
ccgcccaccactgcttgtcctcgccatcacaccat

SEQ ID NO: 171061 - DNA, 35 bp, Artificial Sequence
  Synthetic oligonucleotide
aaggtccacctcgctgttgccgctctggtccccat

SEQ ID NO: 171062 - DNA, 35 bp, Artificial Sequence
  Synthetic oligonucleotide
gctactgacgccccgccaccccttacacgattcat

SEQ ID NO: 171063 - DNA, 35 bp, Artificial Sequence
  Synthetic oligonucleotide
atccgccccaccccctagtattaggtcgcctgact

SEQ ID NO: 171064 - DNA, 35 bp, Artificial Sequence
  Synthetic oligonucleotide
tgacggactcctgccattgttctcaccccccgcct

SEQ ID NO: 171065 - DNA, 35 bp, Artificial Sequence
  Synthetic oligonucleotide
gcaactacccacgccattgtttcatccgttccgct

SEQ ID NO: 171066 - DNA, 35 bp, Artificial Sequence
  Synthetic oligonucleotide
agtagcctcctccacctgttccgtaattttgcgct

SEQ ID NO: 171067 - DNA, 35 bp, Artificial Sequence
  Synthetic oligonucleotide
ttaccatgcgtcagacctattgcttacaccgctct

SEQ ID NO: 171068 - DNA, 35 bp, Artificial Sequence
  Synthetic oligonucleotide
gcgcacgcttacccctgcttcactatcatgtctct

SEQ ID NO: 171069 - DNA, 35 bp, Artificial Sequence
  Synthetic oligonucleotide
agttcccgtacccctgcccttgtgccccccggtct

SEQ ID NO: 171070 - DNA, 35 bp, Artificial Sequence
  Synthetic oligonucleotide
tcagacgaaggaagagctggggagagcggggtagt

SEQ ID NO: 171071 - DNA, 35 bp, Artificial Sequence
  Synthetic oligonucleotide
agggggcaaggaggggtggagggaatatactcggt

SEQ ID NO: 171072 - DNA, 35 bp, Artificial Sequence
  Synthetic oligonucleotide
acagacgcatctggtcggttatattcccctccatt

SEQ ID NO: 171073 - DNA, 35 bp, Artificial Sequence
  Synthetic oligonucleotide
caccctaccgcctgactcctgccccccgcagcctt

SEQ ID NO: 171074 - DNA, 35 bp, Artificial Sequence
  Synthetic oligonucleotide
ggacacgtggatatgtctccttgtatcgcctcctt

SEQ ID NO: 171075 - DNA, 35 bp, Artificial Sequence
  Synthetic oligonucleotide
gaatctgcgcagtcctgcctggtacctcccctgtt

SEQ ID NO: 171076 - DNA, 35 bp, Artificial Sequence
  Synthetic oligonucleotide
tgtgcgccacgtccctgcccccttgattgtcacaa

SEQ ID NO: 171077 - DNA, 35 bp, Artificial Sequence
  Synthetic oligonucleotide
ttgtcccccgcgttttccctgtccatgcaaccgaa

SEQ ID NO: 171078 - DNA, 36 bp, Artificial Sequence
  Synthetic oligonucleotide
gagcgatctattggaggggagggctaagggagggaa

SEQ ID NO: 171079 - DNA, 35 bp, Artificial Sequence
  Synthetic oligonucleotide
agctcatcccctccctgtgtcgatcccgcctctaa

SEQ ID NO: 171080 - DNA, 36 bp, Artificial Sequence
  Synthetic oligonucleotide
gtgccacgatccctcactgttagtccaccccgcaca

SEQ ID NO: 171081 - DNA, 36 bp, Artificial Sequence
  Synthetic oligonucleotide
tcgtggcaacgatgggggggctcagggagggtcaca

SEQ ID NO: 171082 - DNA, 36 bp, Artificial Sequence
  Synthetic oligonucleotide
gaacactctgccccctttcgcataattgctgtgaca

SEQ ID NO: 171083 - DNA, 35 bp, Artificial Sequence
  Synthetic oligonucleotide
gtccaatcactgtactctgtgtccgcctatcacca

SEQ ID NO: 171084 - DNA, 36 bp, Artificial Sequence
  Synthetic oligonucleotide
gtgtgaccgccccgaccgccctgattgaatccccca

SEQ ID NO: 171085 - DNA, 36 bp, Artificial Sequence
  Synthetic oligonucleotide
caaacacgtgcacccattgcaaatccgtaccgccca

SEQ ID NO: 171086 - DNA, 35 bp, Artificial Sequence
  Synthetic oligonucleotide
tccccccctccctgaatggtgagccttatttgcca

SEQ ID NO: 171087 - DNA, 36 bp, Artificial Sequence
  Synthetic oligonucleotide
ttgacaggcctccatcgccctcgccctctccacgca

SEQ ID NO: 171088 - DNA, 35 bp, Artificial Sequence
  Synthetic oligonucleotide
gcaccatccaccagccttacatgttccccgttgca

SEQ ID NO: 171089 - DNA, 35 bp, Artificial Sequence
  Synthetic oligonucleotide
gcgatgtgtcttagcgcctcgttcccgtctcttca

SEQ ID NO: 171090 - DNA, 36 bp, Artificial Sequence
  Synthetic oligonucleotide
tgcgaccagctgcgaacgccccccccgcccgcgaga

SEQ ID NO: 171091 - DNA, 37 bp, Artificial Sequence
  Synthetic oligonucleotide
gtgcaatcagggagcggtggtacaggggtaggggaga

SEQ ID NO: 171092 - DNA, 37 bp, Artificial Sequence
  Synthetic oligonucleotide
ggagcggaggagaatgggggggctcggcggagtacga

SEQ ID NO: 171093 - DNA, 34 bp, Artificial Sequence
  Synthetic oligonucleotide
ggacccacaccttccatgtctctcgcccccccga

SEQ ID NO: 171094 - DNA, 34 bp, Artificial Sequence
  Synthetic oligonucleotide
ggacccacaccttccatgtcgctctcccccccga

SEQ ID NO: 171095 - DNA, 37 bp, Artificial Sequence
  Synthetic oligonucleotide
atccgcccagccgttccgtaggcctttcacgctccga

SEQ ID NO: 171096 - DNA, 36 bp, Artificial Sequence
  Synthetic oligonucleotide
gtactgcaaccccgctttatagactccaacccgcga

SEQ ID NO: 171097 - DNA, 37 bp, Artificial Sequence
  Synthetic oligonucleotide
aacacgcagagggtcctgggcgggtgggacggatcga

SEQ ID NO: 171098 - DNA, 36 bp, Artificial Sequence
  Synthetic oligonucleotide
taccgatgcgcccccgaccggttctaacctcctcga

SEQ ID NO: 171099 - DNA, 37 bp, Artificial Sequence
  Synthetic oligonucleotide
tgctgaggcaccccgacctggctccactccatctcga

SEQ ID NO: 171100 - DNA, 36 bp, Artificial Sequence
  Synthetic oligonucleotide
acgccctccaccagtacctatactcacgtctctcga

SEQ ID NO: 171101 - DNA, 37 bp, Artificial Sequence
  Synthetic oligonucleotide
tgacaacaggggggataaggggcggcaaacacgtcga

SEQ ID NO: 171102 - DNA, 37 bp, Artificial Sequence
  Synthetic oligonucleotide
gagttaggagggaggaagggtgggtcgtaccacagga

SEQ ID NO: 171103 - DNA, 36 bp, Artificial Sequence
  Synthetic oligonucleotide
gttaagtgtgtgcggtgacggaggcgggggggagga

SEQ ID NO: 171104 - DNA, 36 bp, Artificial Sequence
  Synthetic oligonucleotide
atccgcgcccgcccattagtaattcatcccatcgga

SEQ ID NO: 171105 - DNA, 37 bp, Artificial Sequence
  Synthetic oligonucleotide
cccaacccctgccccgtttattgccactcagtaggga

SEQ ID NO: 171106 - DNA, 37 bp, Artificial Sequence
  Synthetic oligonucleotide
tctcctacgccgccggtcgccctccccatttcaatga

SEQ ID NO: 171107 - DNA, 38 bp, Artificial Sequence
  Synthetic oligonucleotide
tcccagtgccactcagtgcttattcctcccccccatga

SEQ ID NO: 171108 - DNA, 38 bp, Artificial Sequence
  Synthetic oligonucleotide
ggttgggaccgggaaaatagggggtagggcatatatga

SEQ ID NO: 171109 - DNA, 38 bp, Artificial Sequence
  Synthetic oligonucleotide
aacgccctatgtgcggccctgctccccccccgacctga

SEQ ID NO: 171110 - DNA, 38 bp, Artificial Sequence
  Synthetic oligonucleotide
aaagcgccgaccgcctatacgttccctcaagcccctga

SEQ ID NO: 171111 - DNA, 38 bp, Artificial Sequence
  Synthetic oligonucleotide
ggaggcccccgattgctaagttcccacccccctgctga

SEQ ID NO: 171112 - DNA, 36 bp, Artificial Sequence
  Synthetic oligonucleotide
ttaccgccctcgtccatcggcactttctccatctga

SEQ ID NO: 171113 - DNA, 37 bp, Artificial Sequence
  Synthetic oligonucleotide
tcgttccctctcctcgtgcatacatgcctgtacgtga

SEQ ID NO: 171114 - DNA, 37 bp, Artificial Sequence
  Synthetic oligonucleotide
gaggttgcgtgtcgggactagggaggggggggcgtga

SEQ ID NO: 171115 - DNA, 38 bp, Artificial Sequence
  Synthetic oligonucleotide
gactggcctgctccacatgtcctcttaatgccccttga

SEQ ID NO: 171116 - DNA, 37 bp, Artificial Sequence
  Synthetic oligonucleotide
ttcgccgtgccacctctgtcacatcaataggccttga

SEQ ID NO: 171117 - DNA, 38 bp, Artificial Sequence
  Synthetic oligonucleotide
gacccctccgagagctcctatcgcgccccttgccttga

SEQ ID NO: 171118 - DNA, 38 bp, Artificial Sequence
  Synthetic oligonucleotide
tgatcctacattgttttgcacctctcacctctcgttga

SEQ ID NO: 171119 - DNA, 35 bp, Artificial Sequence
  Synthetic oligonucleotide
gatgttgggggcggggcggggagcaggtcggttga

SEQ ID NO: 171120 - DNA, 38 bp, Artificial Sequence
  Synthetic oligonucleotide
acatcccccgggctgctcgtcctctctccgctggttga

SEQ ID NO: 171121 - DNA, 36 bp, Artificial Sequence
  Synthetic oligonucleotide
tccgccggacgccacccgcttcccatggtcaccata

SEQ ID NO: 171122 - DNA, 36 bp, Artificial Sequence
  Synthetic oligonucleotide
accctgtcccgctttatcatatacgcctgttcccta

SEQ ID NO: 171123 - DNA, 36 bp, Artificial Sequence
  Synthetic oligonucleotide
gtgagagtaacgaaaggataagggcgagggcagcta

SEQ ID NO: 171124 - DNA, 36 bp, Artificial Sequence
  Synthetic oligonucleotide
gaaccctccgccgtccgaccttcacgcattcctcta

SEQ ID NO: 171125 - DNA, 35 bp, Artificial Sequence
  Synthetic oligonucleotide
acttgccatcccaagatccttcttcagccaccgta

SEQ ID NO: 171126 - DNA, 36 bp, Artificial Sequence
  Synthetic oligonucleotide
tgcacgccacatatcatcctggctgtccccccatta

SEQ ID NO: 171127 - DNA, 36 bp, Artificial Sequence
  Synthetic oligonucleotide
tccccccgccacattttcgtatcgcacctaccgtta

SEQ ID NO: 171128 - DNA, 35 bp, Artificial Sequence
  Synthetic oligonucleotide
aacgagagagaggcacggaggtaggcaagaggtta

SEQ ID NO: 171129 - DNA, 35 bp, Artificial Sequence
  Synthetic oligonucleotide
accttgcctgccaaccgccgggtttacgcttccac

SEQ ID NO: 171130 - DNA, 35 bp, Artificial Sequence
  Synthetic oligonucleotide
atcgcgactgacgtctcccaccctgctattctcac

SEQ ID NO: 171131 - DNA, 35 bp, Artificial Sequence
  Synthetic oligonucleotide
aattacgccccccatcgcttacagaccgggaggac

SEQ ID NO: 171132 - DNA, 35 bp, Artificial Sequence
  Synthetic oligonucleotide
ttgtgccactctcctctgggtcaagtaccgcaccc

SEQ ID NO: 171133 - DNA, 35 bp, Artificial Sequence
  Synthetic oligonucleotide
gtaaaccacactcggtaaaagtcactgccgtcccc

SEQ ID NO: 171134 - DNA, 35 bp, Artificial Sequence
  Synthetic oligonucleotide
gttgctctgcttccgttcgcaccttacccaagccc

SEQ ID NO: 171135 - DNA, 34 bp, Artificial Sequence
  Synthetic oligonucleotide
aattccgagcacctcatccctccttgtctcagcc

SEQ ID NO: 171136 - DNA, 35 bp, Artificial Sequence
  Synthetic oligonucleotide
aaagactgcactccggttcccagtgaccccactcc

SEQ ID NO: 171137 - DNA, 35 bp, Artificial Sequence
  Synthetic oligonucleotide
ttgccaccctcgctgcatggagtctccgtggctcc

SEQ ID NO: 171138 - DNA, 35 bp, Artificial Sequence
  Synthetic oligonucleotide
gatgtggaccacgccctcctccccacggagacagc

SEQ ID NO: 171139 - DNA, 35 bp, Artificial Sequence
  Synthetic oligonucleotide
tctgaacccgccgtaagcctccacgcctatctagc

SEQ ID NO: 171140 - DNA, 35 bp, Artificial Sequence
  Synthetic oligonucleotide
acagcccgctcgcacattgttccaccgcccgccgc

SEQ ID NO: 171141 - DNA, 35 bp, Artificial Sequence
  Synthetic oligonucleotide
accgcaggcccttccgttacgccgtcttctgccgc

SEQ ID NO: 171142 - DNA, 35 bp, Artificial Sequence
  Synthetic oligonucleotide
tcccactgtgccctcagtttgccgctgccattcgc

SEQ ID NO: 171143 - DNA, 35 bp, Artificial Sequence
  Synthetic oligonucleotide
ttcccaccgcttcctcccgactccatgcgcggtgc

SEQ ID NO: 171144 - DNA, 35 bp, Artificial Sequence
  Synthetic oligonucleotide
tcacaccatggggaccgctcctcgttcttccttgc

SEQ ID NO: 171145 - DNA, 35 bp, Artificial Sequence
  Synthetic oligonucleotide
tgcctcaacggaacacttgcgcctcccttgctatc

SEQ ID NO: 171146 - DNA, 35 bp, Artificial Sequence
  Synthetic oligonucleotide
taactacgtctgagtcccccgccccactcgacttc

SEQ ID NO: 171147 - DNA, 35 bp, Artificial Sequence
  Synthetic oligonucleotide
tactcccattccctccgcccgttatgctactgttc

SEQ ID NO: 171148 - DNA, 35 bp, Artificial Sequence
  Synthetic oligonucleotide
tacgacgctgtgtgttactctcttcggctctgttc

SEQ ID NO: 171149 - DNA, 35 bp, Artificial Sequence
  Synthetic oligonucleotide
ttggactcacgccgcacgccttcaccatttcatag

SEQ ID NO: 171150 - DNA, 35 bp, Artificial Sequence
  Synthetic oligonucleotide
tatgatcccctgcccttcaccccgccgacttgcgg

SEQ ID NO: 171151 - DNA, 35 bp, Artificial Sequence
  Synthetic oligonucleotide
tcaacgaccccgacctgcctactcacacgcttcgg

SEQ ID NO: 171152 - DNA, 35 bp, Artificial Sequence
  Synthetic oligonucleotide
gaagatgggaggggtacgaagggcctaacggaggg

SEQ ID NO: 171153 - DNA, 35 bp, Artificial Sequence
  Synthetic oligonucleotide
tgctgggaggggagggggacttagatggttcgggg

SEQ ID NO: 171154 - DNA, 35 bp, Artificial Sequence
  Synthetic oligonucleotide
gtttgacaacgaccaaggtgggagggtgtggtggg

SEQ ID NO: 171155 - DNA, 34 bp, Artificial Sequence
  Synthetic oligonucleotide
tgccctcctccgtttcctctcctgtactccctgg

SEQ ID NO: 171156 - DNA, 35 bp, Artificial Sequence
  Synthetic oligonucleotide
aacgcactgccgccggtattttgtcgctatcactg

SEQ ID NO: 171157 - DNA, 35 bp, Artificial Sequence
  Synthetic oligonucleotide
ttgagccatatttgcccgctgaacaccttcctctg

SEQ ID NO: 171158 - DNA, 35 bp, Artificial Sequence
  Synthetic oligonucleotide
tgccgcaccccgggtcttctcatctatcgctcgat

SEQ ID NO: 171159 - DNA, 35 bp, Artificial Sequence
  Synthetic oligonucleotide
tccaccattcccctcttgttattagaatctggtat

SEQ ID NO: 171160 - DNA, 35 bp, Artificial Sequence
  Synthetic oligonucleotide
atcccatcaatgtgctctccatggtactacaccct

SEQ ID NO: 171161 - DNA, 35 bp, Artificial Sequence
  Synthetic oligonucleotide
tccgccgatctagctggaagctcttccctatgcct

SEQ ID NO: 171162 - DNA, 35 bp, Artificial Sequence
  Synthetic oligonucleotide
tcatgcttggccgtattggcctgggcccccttcct

SEQ ID NO: 171163 - DNA, 35 bp, Artificial Sequence
  Synthetic oligonucleotide
agggctgcccctcgtttattatcgcccaccatgct

SEQ ID NO: 171164 - DNA, 35 bp, Artificial Sequence
  Synthetic oligonucleotide
tgggccaagctaagaaagggtgggaggggggtgct

SEQ ID NO: 171165 - DNA, 35 bp, Artificial Sequence
  Synthetic oligonucleotide
tcccggcctcaattggggctccatacacctactct

SEQ ID NO: 171166 - DNA, 35 bp, Artificial Sequence
  Synthetic oligonucleotide
tccgctcagtcgcactatctacctctgccatgtct

SEQ ID NO: 171167 - DNA, 35 bp, Artificial Sequence
  Synthetic oligonucleotide
tgcctgtccactctttataggcgtacttttcttct

SEQ ID NO: 171168 - DNA, 35 bp, Artificial Sequence
  Synthetic oligonucleotide
tccacactccactccgtgtcaccggaccgttttct

SEQ ID NO: 171169 - DNA, 35 bp, Artificial Sequence
  Synthetic oligonucleotide
attgggaaagaggaaatggagcgaggggaggcagt

SEQ ID NO: 171170 - DNA, 35 bp, Artificial Sequence
  Synthetic oligonucleotide
gcacgggggagaatttgggatagggaaggtaacgt

SEQ ID NO: 171171 - DNA, 35 bp, Artificial Sequence
  Synthetic oligonucleotide
gcccctcacccgccgccatatctcacgctgacggt

SEQ ID NO: 171172 - DNA, 35 bp, Artificial Sequence
  Synthetic oligonucleotide
agcgcaatccactctgcctgccaccttttccttgt

SEQ ID NO: 171173 - DNA, 35 bp, Artificial Sequence
  Synthetic oligonucleotide
tccgttcccccccgaattgctacgaccacgtcgtt

SEQ ID NO: 171174 - DNA, 35 bp, Artificial Sequence
  Synthetic oligonucleotide
gtttgcccctcgacggttcatgaggtccatctttt

SEQ ID NO: 171175 - DNA, 36 bp, Artificial Sequence
  Synthetic oligonucleotide
gcctgtggcaccaaccatgccttaactaccgcccaa

SEQ ID NO: 171176 - DNA, 36 bp, Artificial Sequence
  Synthetic oligonucleotide
taccaccgatcaacccgcccgagaccgcctcctcaa

SEQ ID NO: 171177 - DNA, 35 bp, Artificial Sequence
  Synthetic oligonucleotide
gccgcccccacggagtagaataagcctcctctcaa

SEQ ID NO: 171178 - DNA, 36 bp, Artificial Sequence
  Synthetic oligonucleotide
acagtgggatgaggggtgcatcggggcaaaaaggaa

SEQ ID NO: 171179 - DNA, 35 bp, Artificial Sequence
  Synthetic oligonucleotide
gcgttcatcgggtgaggggggaaggggagaagtaa

SEQ ID NO: 171180 - DNA, 35 bp, Artificial Sequence
  Synthetic oligonucleotide
tcttgcgcacagttgcctccgctcttttcccgtaa

SEQ ID NO: 171181 - DNA, 36 bp, Artificial Sequence
  Synthetic oligonucleotide
gttcacgccccccaaacacctcgtatcgccggttaa

SEQ ID NO: 171182 - DNA, 35 bp, Artificial Sequence
  Synthetic oligonucleotide
accgggcgctcagaacggagagggggggcgggaca

SEQ ID NO: 171183 - DNA, 35 bp, Artificial Sequence
  Synthetic oligonucleotide
acaccgctgcatacctttctcttgttttttgccca

SEQ ID NO: 171184 - DNA, 36 bp, Artificial Sequence
  Synthetic oligonucleotide
tactcgcctcagacccactcatcgatctctccgcca

SEQ ID NO: 171185 - DNA, 35 bp, Artificial Sequence
  Synthetic oligonucleotide
ttccccacccttcttggtctgtactatagtacgca

SEQ ID NO: 171186 - DNA, 37 bp, Artificial Sequence
  Synthetic oligonucleotide
gagcggagtcctatgacctatccttgtcccgtccgca

SEQ ID NO: 171187 - DNA, 35 bp, Artificial Sequence
  Synthetic oligonucleotide
gcatcatcatggcacgttatacgctaccttctgca

SEQ ID NO: 171188 - DNA, 35 bp, Artificial Sequence
  Synthetic oligonucleotide
acgttcgccccacggtccgccttctacactcctca

SEQ ID NO: 171189 - DNA, 35 bp, Artificial Sequence
  Synthetic oligonucleotide
accgtatcttcactctgccttcagccgacctctca

SEQ ID NO: 171190 - DNA, 36 bp, Artificial Sequence
  Synthetic oligonucleotide
atcgccaagcaatcatcggcgtcactgtccctttca

SEQ ID NO: 171191 - DNA, 36 bp, Artificial Sequence
  Synthetic oligonucleotide
aacgccccccgcgccgtaaataaccgcgctctttca

SEQ ID NO: 171192 - DNA, 37 bp, Artificial Sequence
  Synthetic oligonucleotide
tatccgcccttctttctgtttgccccgagtctcgaga

SEQ ID NO: 171193 - DNA, 37 bp, Artificial Sequence
  Synthetic oligonucleotide
acttggcgaccgggttgcgaattgggtgggagggaga

SEQ ID NO: 171194 - DNA, 37 bp, Artificial Sequence
  Synthetic oligonucleotide
accgccctttcccatcgccgtggacctaccttgccga

SEQ ID NO: 171195 - DNA, 37 bp, Artificial Sequence
  Synthetic oligonucleotide
gggtggtggcgggggtattggaggcggcaccaatcga

SEQ ID NO: 171196 - DNA, 37 bp, Artificial Sequence
  Synthetic oligonucleotide
gactgtcgcactcggtactcgccactccacgcctcga

SEQ ID NO: 171197 - DNA, 37 bp, Artificial Sequence
  Synthetic oligonucleotide
attcgcgaggacacaggggtcagggaagggggacgga

SEQ ID NO: 171198 - DNA, 37 bp, Artificial Sequence
  Synthetic oligonucleotide
ggtacacgaacggtctggggaagggggcgggaaggga

SEQ ID NO: 171199 - DNA, 36 bp, Artificial Sequence
  Synthetic oligonucleotide
acagccatccatcgcatatcccttcccgaacaggga

SEQ ID NO: 171200 - DNA, 37 bp, Artificial Sequence
  Synthetic oligonucleotide
gccccccgtccttgccatcaatcacgctcaccaggga

SEQ ID NO: 171201 - DNA, 37 bp, Artificial Sequence
  Synthetic oligonucleotide
gggggccaaggtggttggggaagtagctggaagggga

SEQ ID NO: 171202 - DNA, 37 bp, Artificial Sequence
  Synthetic oligonucleotide
ggatagtgccgagggatgggaagaaggggtatgggga

SEQ ID NO: 171203 - DNA, 38 bp, Artificial Sequence
  Synthetic oligonucleotide
acacaccatccattcagcctggcactcccccaccatga

SEQ ID NO: 171204 - DNA, 38 bp, Artificial Sequence
  Synthetic oligonucleotide
tgatgtacgaacggggaggaacaggggaccaggcatga

SEQ ID NO: 171205 - DNA, 36 bp, Artificial Sequence
  Synthetic oligonucleotide
atcctcaccgcccaggtgtcaccacaccctctatga

SEQ ID NO: 171206 - DNA, 38 bp, Artificial Sequence
  Synthetic oligonucleotide
gtccccccgcgattgtcgtccgtactggctctcactga

SEQ ID NO: 171207 - DNA, 37 bp, Artificial Sequence
  Synthetic oligonucleotide
accatccgcatctgtaacacccggttctgtcacctga

SEQ ID NO: 171208 - DNA, 37 bp, Artificial Sequence
  Synthetic oligonucleotide
atcgctgcctcactcacatgtactttcgccaccctga

SEQ ID NO: 171209 - DNA, 38 bp, Artificial Sequence
  Synthetic oligonucleotide
gtcgccctcatccactgccacgcgctccgcttccctga

SEQ ID NO: 171210 - DNA, 37 bp, Artificial Sequence
  Synthetic oligonucleotide
tcgcacgccccctgctcctccgctatggaacctctga

SEQ ID NO: 171211 - DNA, 38 bp, Artificial Sequence
  Synthetic oligonucleotide
gcacccccgtgatatatccttctgcccctcgttagtga

SEQ ID NO: 171212 - DNA, 37 bp, Artificial Sequence
  Synthetic oligonucleotide
tagcatccgttccagcctcatcccttctgccccgtga

SEQ ID NO: 171213 - DNA, 36 bp, Artificial Sequence
  Synthetic oligonucleotide
gacgcccccaatgtccttaggaccaccgccccttga

SEQ ID NO: 171214 - DNA, 38 bp, Artificial Sequence
  Synthetic oligonucleotide
atccccctcttcatcgtgtcgctccagtcgacttttga

SEQ ID NO: 171215 - DNA, 36 bp, Artificial Sequence
  Synthetic oligonucleotide
gccgaagcctcgttttgttcgctccacttgccccta

SEQ ID NO: 171216 - DNA, 36 bp, Artificial Sequence
  Synthetic oligonucleotide
gccgcccctgcctacggtcatcggttacttctccta

SEQ ID NO: 171217 - DNA, 35 bp, Artificial Sequence
  Synthetic oligonucleotide
actctgcactcccaccggttattgcccctctcgta

SEQ ID NO: 171218 - DNA, 35 bp, Artificial Sequence
  Synthetic oligonucleotide
gcccgccctcgccagcaccacctgggcactaatta

SEQ ID NO: 171219 - DNA, 35 bp, Artificial Sequence
  Synthetic oligonucleotide
gatccatcccgctctaccactcaccggtgtagtta

SEQ ID NO: 171220 - DNA, 35 bp, Artificial Sequence
  Synthetic oligonucleotide
tctgtcctgcaatcacactcgcagcgcttgcccac

SEQ ID NO: 171221 - DNA, 35 bp, Artificial Sequence
  Synthetic oligonucleotide
gaggaccaaggggagggaggtgcaggagtgttcac

SEQ ID NO: 171222 - DNA, 35 bp, Artificial Sequence
  Synthetic oligonucleotide
gcccatcgtagcattccagccgccccactctcgac

SEQ ID NO: 171223 - DNA, 35 bp, Artificial Sequence
  Synthetic oligonucleotide
ttccccccctcgtcatcttggcttatcttctggac

SEQ ID NO: 171224 - DNA, 35 bp, Artificial Sequence
  Synthetic oligonucleotide
acgcgctgacgaactatgattctgccagcccttac

SEQ ID NO: 171225 - DNA, 35 bp, Artificial Sequence
  Synthetic oligonucleotide
gtgcacggcattattccggtccctgcttttgaacc

SEQ ID NO: 171226 - DNA, 35 bp, Artificial Sequence
  Synthetic oligonucleotide
aacgccccgaccctctatttgactcgacgaacacc

SEQ ID NO: 171227 - DNA, 35 bp, Artificial Sequence
  Synthetic oligonucleotide
tcactccccccccctgctgtttggttggttccacc

SEQ ID NO: 171228 - DNA, 35 bp, Artificial Sequence
  Synthetic oligonucleotide
gcttggtcccatgagccataccattcgcctgtacc

SEQ ID NO: 171229 - DNA, 35 bp, Artificial Sequence
  Synthetic oligonucleotide
ttggtcaggacggatgactcgttgcccactccccc

SEQ ID NO: 171230 - DNA, 35 bp, Artificial Sequence
  Synthetic oligonucleotide
gatcacgctcgttcgctaataactgcgatcctccc

SEQ ID NO: 171231 - DNA, 35 bp, Artificial Sequence
  Synthetic oligonucleotide
tagctacggcgccgtgccgcacagcccattttccc

SEQ ID NO: 171232 - DNA, 35 bp, Artificial Sequence
  Synthetic oligonucleotide
ttccgtacctccggctgtctgggcactgcctcgcc

SEQ ID NO: 171233 - DNA, 35 bp, Artificial Sequence
  Synthetic oligonucleotide
tcaccgcctttgccttggtaatctcccgttttgcc

SEQ ID NO: 171234 - DNA, 35 bp, Artificial Sequence
  Synthetic oligonucleotide
gaccccactctaattgcacatgcaggttacagtcc

SEQ ID NO: 171235 - DNA, 35 bp, Artificial Sequence
  Synthetic oligonucleotide
gtagcgccctcagatttccttatatcaccgcgtcc

SEQ ID NO: 171236 - DNA, 35 bp, Artificial Sequence
  Synthetic oligonucleotide
tgtggtgtgagaccatatgtgatcctctgccttcc

SEQ ID NO: 171237 - DNA, 35 bp, Artificial Sequence
  Synthetic oligonucleotide
accaccgtagcaccgtgaggttcgccatcattcgc

SEQ ID NO: 171238 - DNA, 35 bp, Artificial Sequence
  Synthetic oligonucleotide
tccttcccgcgcccactatccctgactctgccggc

SEQ ID NO: 171239 - DNA, 35 bp, Artificial Sequence
  Synthetic oligonucleotide
agagtacctccgccgccaaccaagcccgattctgc

SEQ ID NO: 171240 - DNA, 35 bp, Artificial Sequence
  Synthetic oligonucleotide
tcctacatccgctgctgagccaaattacagcactc

SEQ ID NO: 171241 - DNA, 35 bp, Artificial Sequence
  Synthetic oligonucleotide
tagatgggtagatccccgtcttcacgcctttcctc

SEQ ID NO: 171242 - DNA, 35 bp, Artificial Sequence
  Synthetic oligonucleotide
tcacgcactgtcctccagtttcttgtcccgggctc

SEQ ID NO: 171243 - DNA, 35 bp, Artificial Sequence
  Synthetic oligonucleotide
gcccagggcgacgaccagaagatccgcaccctctc

SEQ ID NO: 171244 - DNA, 35 bp, Artificial Sequence
  Synthetic oligonucleotide
gtccgtcgccacatactcccttacgcacggctacg

SEQ ID NO: 171245 - DNA, 35 bp, Artificial Sequence
  Synthetic oligonucleotide
tgctcgtacccctctatccccagaccatatgcccg

SEQ ID NO: 171246 - DNA, 34 bp, Artificial Sequence
  Synthetic oligonucleotide
tccccctcccctgcgccttctaatagatcccgcg

SEQ ID NO: 171247 - DNA, 33 bp, Artificial Sequence
  Synthetic oligonucleotide
gaaaccccccgtcccccgaaccagcagtccagg

SEQ ID NO: 171248 - DNA, 35 bp, Artificial Sequence
  Synthetic oligonucleotide
attcggggggtgagagggatgggaaggatttttgg

SEQ ID NO: 171249 - DNA, 35 bp, Artificial Sequence
  Synthetic oligonucleotide
gtgctctgcctatgctttcccaccgcgattcactg

SEQ ID NO: 171250 - DNA, 35 bp, Artificial Sequence
  Synthetic oligonucleotide
atcccgaggtgtcccgtctccagtcccttcccgtg

SEQ ID NO: 171251 - DNA, 35 bp, Artificial Sequence
  Synthetic oligonucleotide
gcgaactaacccgcgcccccgactcttcgttacat

SEQ ID NO: 171252 - DNA, 35 bp, Artificial Sequence
  Synthetic oligonucleotide
acaccacgtcgctccgataattcccgttttctcat

SEQ ID NO: 171253 - DNA, 35 bp, Artificial Sequence
  Synthetic oligonucleotide
tactaggccccggtcctgttccacctggctctact

SEQ ID NO: 171254 - DNA, 35 bp, Artificial Sequence
  Synthetic oligonucleotide
tcgcggtcacaggatcgcaccccccgtcttgccct

SEQ ID NO: 171255 - DNA, 35 bp, Artificial Sequence
  Synthetic oligonucleotide
gtgccccccatcacccggacgggtcatcctatcct

SEQ ID NO: 171256 - DNA, 35 bp, Artificial Sequence
  Synthetic oligonucleotide
tgtcttcctcggcgcgaccaccgactgtctctcct

SEQ ID NO: 171257 - DNA, 35 bp, Artificial Sequence
  Synthetic oligonucleotide
atgtgccccagttcgcggcaacaccattccccgct

SEQ ID NO: 171258 - DNA, 35 bp, Artificial Sequence
  Synthetic oligonucleotide
gagaggaatgacggtagtgatggagcgggggatct

SEQ ID NO: 171259 - DNA, 35 bp, Artificial Sequence
  Synthetic oligonucleotide
aattccatccgcggcggatcattataccaccttct

SEQ ID NO: 171260 - DNA, 35 bp, Artificial Sequence
  Synthetic oligonucleotide
tgtgtaagccctgcccggcttcttcgaactcttct

SEQ ID NO: 171261 - DNA, 35 bp, Artificial Sequence
  Synthetic oligonucleotide
tcgatcagaccccacccctcccaccttagggttct

SEQ ID NO: 171262 - DNA, 36 bp, Artificial Sequence
  Synthetic oligonucleotide
tccgtcctgccgcatcccccatgccttccgatccgt

SEQ ID NO: 171263 - DNA, 35 bp, Artificial Sequence
  Synthetic oligonucleotide
tccagccgctcgctcccacccttacttcacctggt

SEQ ID NO: 171264 - DNA, 35 bp, Artificial Sequence
  Synthetic oligonucleotide
aagcacgtgcgctctggtctactactaccccaatt

SEQ ID NO: 171265 - DNA, 35 bp, Artificial Sequence
  Synthetic oligonucleotide
attcgcccctgccctatgtatttgcccaaggaatt

SEQ ID NO: 171266 - DNA, 35 bp, Artificial Sequence
  Synthetic oligonucleotide
taactctgcccccgcacatgacacagtcactcatt

SEQ ID NO: 171267 - DNA, 35 bp, Artificial Sequence
  Synthetic oligonucleotide
gcacctagtaccggtgcattgtacttagtcccctt

SEQ ID NO: 171268 - DNA, 35 bp, Artificial Sequence
  Synthetic oligonucleotide
gtctcagcgacctcgcttcaggactgttcgccctt

SEQ ID NO: 171269 - DNA, 35 bp, Artificial Sequence
  Synthetic oligonucleotide
gcacccttatggtctgctatctccgtctccccgtt

SEQ ID NO: 171270 - DNA, 35 bp, Artificial Sequence
  Synthetic oligonucleotide
accatctcgtcgcctatattgtccccttcctcgtt

SEQ ID NO: 171271 - DNA, 35 bp, Artificial Sequence
  Synthetic oligonucleotide
acacaccctcccgattaataggcgacgccactgtt

SEQ ID NO: 171272 - DNA, 35 bp, Artificial Sequence
  Synthetic oligonucleotide
aatcccagcggaccgcgtcactccgccctcgtgtt

SEQ ID NO: 171273 - DNA, 34 bp, Artificial Sequence
  Synthetic oligonucleotide
gatgcgctttacaaattgttaacgcccacctttt

SEQ ID NO: 171274 - DNA, 35 bp, Artificial Sequence
  Synthetic oligonucleotide
ggtccggacagtgtgtccaatgctgccctcctttt

SEQ ID NO: 171275 - DNA, 35 bp, Artificial Sequence
  Synthetic oligonucleotide
acgtgggcctgtgcgttaccatcagccatcttttt

SEQ ID NO: 171276 - DNA, 36 bp, Artificial Sequence
  Synthetic oligonucleotide
tcaccaccgccgcctcgacccctatcctgttgtaaa

SEQ ID NO: 171277 - DNA, 35 bp, Artificial Sequence
  Synthetic oligonucleotide
gtagcggatgctagggcatagggggggccgggcaa

SEQ ID NO: 171278 - DNA, 36 bp, Artificial Sequence
  Synthetic oligonucleotide
gtctcacagagtgcttccacgcttgccatccatcaa

SEQ ID NO: 171279 - DNA, 36 bp, Artificial Sequence
  Synthetic oligonucleotide
gatgtcacgaagacagggactgaaggagggggggaa

SEQ ID NO: 171280 - DNA, 35 bp, Artificial Sequence
  Synthetic oligonucleotide
acgttcatccttccgctgcctgctggctatcttaa

SEQ ID NO: 171281 - DNA, 35 bp, Artificial Sequence
  Synthetic oligonucleotide
gttgccccgcccgtcctgttcggaacccctaaaca

SEQ ID NO: 171282 - DNA, 35 bp, Artificial Sequence
  Synthetic oligonucleotide
tccccgcatcacccctagaccgaggtcaccctaca

SEQ ID NO: 171283 - DNA, 35 bp, Artificial Sequence
  Synthetic oligonucleotide
gtaagcgcccgtcccttgcgcccctacccgaacca

SEQ ID NO: 171284 - DNA, 34 bp, Artificial Sequence
  Synthetic oligonucleotide
gcaagcaccatccgtgcaggcaccacctcaccca

SEQ ID NO: 171285 - DNA, 35 bp, Artificial Sequence
  Synthetic oligonucleotide
tccgaccagctcacacctgatggaccactctccca

SEQ ID NO: 171286 - DNA, 35 bp, Artificial Sequence
  Synthetic oligonucleotide
taccgtaagaatgctgccctcccgtcacacttcca

SEQ ID NO: 171287 - DNA, 36 bp, Artificial Sequence
  Synthetic oligonucleotide
ttcaacatcctcagtaatgccgtcgcacgccccgca

SEQ ID NO: 171288 - DNA, 35 bp, Artificial Sequence
  Synthetic oligonucleotide
gagcatccaccagatccacctgtctctttcatgca

SEQ ID NO: 171289 - DNA, 35 bp, Artificial Sequence
  Synthetic oligonucleotide
ttaccccgacaatgcgcatgtcctgttctcttgca

SEQ ID NO: 171290 - DNA, 35 bp, Artificial Sequence
  Synthetic oligonucleotide
gccaactcctagaagccttcgccgctgtaccctca

SEQ ID NO: 171291 - DNA, 35 bp, Artificial Sequence
  Synthetic oligonucleotide
ggtgccctgatcctcaaagtacacatcgcccctca

SEQ ID NO: 171292 - DNA, 35 bp, Artificial Sequence
  Synthetic oligonucleotide
tccgccggcctgctcgtcatgtcatggtcctctca

SEQ ID NO: 171293 - DNA, 37 bp, Artificial Sequence
  Synthetic oligonucleotide
ttgggggggtgccggtgaatggagatgatcggtcaga

SEQ ID NO: 171294 - DNA, 37 bp, Artificial Sequence
  Synthetic oligonucleotide
gagagggggaggtgcgagacgtggacagagtacgaga

SEQ ID NO: 171295 - DNA, 36 bp, Artificial Sequence
  Synthetic oligonucleotide
agaacacctcccgcccccgtcttcctatccagtaga

SEQ ID NO: 171296 - DNA, 37 bp, Artificial Sequence
  Synthetic oligonucleotide
tccactgcctgttcctcgccttcttataagctcacga

SEQ ID NO: 171297 - DNA, 36 bp, Artificial Sequence
  Synthetic oligonucleotide
ggagcatacatgaagcccacgcccccctccgcccga

SEQ ID NO: 171298 - DNA, 35 bp, Artificial Sequence
  Synthetic oligonucleotide
tgtttgcccccatgttaaccgcacttggttcccga

SEQ ID NO: 171299 - DNA, 37 bp, Artificial Sequence
  Synthetic oligonucleotide
taggagggagggtgtggaaattgggacgggtcatcga

SEQ ID NO: 171300 - DNA, 37 bp, Artificial Sequence
  Synthetic oligonucleotide
ttagcgaaagagggtggtggagtgggctggggaagga

SEQ ID NO: 171301 - DNA, 36 bp, Artificial Sequence
  Synthetic oligonucleotide
aacacgtgggtggagaatatggactggagcggagga

SEQ ID NO: 171302 - DNA, 37 bp, Artificial Sequence
  Synthetic oligonucleotide
tacatcacgccctctctgtactgcattacactacgga

SEQ ID NO: 171303 - DNA, 37 bp, Artificial Sequence
  Synthetic oligonucleotide
tacccgccgccacatgcctcctacccctccgagcgga

SEQ ID NO: 171304 - DNA, 37 bp, Artificial Sequence
  Synthetic oligonucleotide
tgggggtgaaggcatgagagacaagggaaagagggga

SEQ ID NO: 171305 - DNA, 37 bp, Artificial Sequence
  Synthetic oligonucleotide
ttcagggcgggtggggagcatgtctgaggaagtggga

SEQ ID NO: 171306 - DNA, 37 bp, Artificial Sequence
  Synthetic oligonucleotide
tgccatttccgtgctcatcctcgcttctcttttggga

SEQ ID NO: 171307 - DNA, 35 bp, Artificial Sequence
  Synthetic oligonucleotide
acgctccacctcatctcgtactttcggttttggga

SEQ ID NO: 171308 - DNA, 37 bp, Artificial Sequence
  Synthetic oligonucleotide
tagggggcaaggtggtaggggggcagttggtactgga

SEQ ID NO: 171309 - DNA, 38 bp, Artificial Sequence
  Synthetic oligonucleotide
tgagacaggtggcgggtgaacgcaggaggtgacgatga

SEQ ID NO: 171310 - DNA, 38 bp, Artificial Sequence
  Synthetic oligonucleotide
gccccctgcccacgtgcaaacctccccacacactatga

SEQ ID NO: 171311 - DNA, 36 bp, Artificial Sequence
  Synthetic oligonucleotide
gtgtcctgaccccgctggcctcactaccgtccctga

SEQ ID NO: 171312 - DNA, 37 bp, Artificial Sequence
  Synthetic oligonucleotide
ttgtatagccgccgctgctcgtttgccccaatcctga

SEQ ID NO: 171313 - DNA, 37 bp, Artificial Sequence
  Synthetic oligonucleotide
ggtacggactgggagggagggggagggcccatgctga

SEQ ID NO: 171314 - DNA, 37 bp, Artificial Sequence
  Synthetic oligonucleotide
tgtgcggctcattttatttgcgccctaccttccgtga

SEQ ID NO: 171315 - DNA, 38 bp, Artificial Sequence
  Synthetic oligonucleotide
gtcgtggtaggtcgtggcaagggggaggggtggcgtga

SEQ ID NO: 171316 - DNA, 38 bp, Artificial Sequence
  Synthetic oligonucleotide
gactcgcccctccacattgttactgccagtaccggtga

SEQ ID NO: 171317 - DNA, 38 bp, Artificial Sequence
  Synthetic oligonucleotide
acaatatacgggcaagagtagggaagggggcggggtga

SEQ ID NO: 171318 - DNA, 37 bp, Artificial Sequence
  Synthetic oligonucleotide
tcttgctacgccacccccgcacacgctccgccattga

SEQ ID NO: 171319 - DNA, 37 bp, Artificial Sequence
  Synthetic oligonucleotide
tcgcttaccacaccattgaattgcccgtgacccttga

SEQ ID NO: 171320 - DNA, 37 bp, Artificial Sequence
  Synthetic oligonucleotide
tgcccattcggctcccctagcatgccccagtccttga

SEQ ID NO: 171321 - DNA, 38 bp, Artificial Sequence
  Synthetic oligonucleotide
tacgcccccaccctactagcagagactggactatttga

SEQ ID NO: 171322 - DNA, 38 bp, Artificial Sequence
  Synthetic oligonucleotide
gaagggaggcgcgggcaaggggcgtggcggggctttga

SEQ ID NO: 171323 - DNA, 38 bp, Artificial Sequence
  Synthetic oligonucleotide
tctgtgcaaggggtgggtgtggagggtatttgctttga

SEQ ID NO: 171324 - DNA, 37 bp, Artificial Sequence
  Synthetic oligonucleotide
gcctgtcagtccgtcccttccttcccgccaggtttga

SEQ ID NO: 171325 - DNA, 35 bp, Artificial Sequence
  Synthetic oligonucleotide
atagctccacccgattctatgcctttgtctcacta

SEQ ID NO: 171326 - DNA, 36 bp, Artificial Sequence
  Synthetic oligonucleotide
tcacctcccctctatgctgaccatggccacggacta

SEQ ID NO: 171327 - DNA, 36 bp, Artificial Sequence
  Synthetic oligonucleotide
agcattaggcaatgtcttccttctccagctccccta

SEQ ID NO: 171328 - DNA, 36 bp, Artificial Sequence
  Synthetic oligonucleotide
tagtccggcctcgcttattgccccttgtccattcta

SEQ ID NO: 171329 - DNA, 36 bp, Artificial Sequence
  Synthetic oligonucleotide
gaaccgggcattggaaggggggggagggtagaagta

SEQ ID NO: 171330 - DNA, 36 bp, Artificial Sequence
  Synthetic oligonucleotide
ggggggggggcatggcgaaagggcacatgggcggta

SEQ ID NO: 171331 - DNA, 35 bp, Artificial Sequence
  Synthetic oligonucleotide
gactgagggaggaggggcggaagtatcgaaggtta

SEQ ID NO: 171332 - DNA, 35 bp, Artificial Sequence
  Synthetic oligonucleotide
atgcccacgccatattaccatttcaccgttgcaac

SEQ ID NO: 171333 - DNA, 35 bp, Artificial Sequence
  Synthetic oligonucleotide
tacgcaccgccctactgaacgatccacctgcacac

SEQ ID NO: 171334 - DNA, 35 bp, Artificial Sequence
  Synthetic oligonucleotide
ggttcaccatccgctcgagactccttcaacagcac

SEQ ID NO: 171335 - DNA, 35 bp, Artificial Sequence
  Synthetic oligonucleotide
atgactagcagcccgcgggattattgcctctcacc

SEQ ID NO: 171336 - DNA, 35 bp, Artificial Sequence
  Synthetic oligonucleotide
tcaggaccggtggcgggactggacggacggggacc

SEQ ID NO: 171337 - DNA, 35 bp, Artificial Sequence
  Synthetic oligonucleotide
gttcggatcagcggcatctttcgttcccccgtacc

SEQ ID NO: 171338 - DNA, 35 bp, Artificial Sequence
  Synthetic oligonucleotide
gtgtgcatgtggcctggccgcctttcgtttcaccc

SEQ ID NO: 171339 - DNA, 35 bp, Artificial Sequence
  Synthetic oligonucleotide
gtcagtgacaaccgtccgtcatcgctctccagccc

SEQ ID NO: 171340 - DNA, 35 bp, Artificial Sequence
  Synthetic oligonucleotide
tcacttgggcccctgcagcaatgttgctacctccc

SEQ ID NO: 171341 - DNA, 35 bp, Artificial Sequence
  Synthetic oligonucleotide
agccccctccctgtgagcgccttatccggcctccc

SEQ ID NO: 171342 - DNA, 35 bp, Artificial Sequence
  Synthetic oligonucleotide
atcgacccgcacgcgcccacaccgttgtgcgtccc

SEQ ID NO: 171343 - DNA, 35 bp, Artificial Sequence
  Synthetic oligonucleotide
gcccacgtccctgctcacctaacgtagcccacgcc

SEQ ID NO: 171344 - DNA, 29 bp, Artificial Sequence
  Synthetic oligonucleotide
actgactaggcctcaccatttctccctcc

SEQ ID NO: 171345 - DNA, 35 bp, Artificial Sequence
  Synthetic oligonucleotide
tgtgcctcccacccggtgtaccttcgtgcctgtcc

SEQ ID NO: 171346 - DNA, 35 bp, Artificial Sequence
  Synthetic oligonucleotide
gcctcaagcatcagccccgcttgactcgcccttcc

SEQ ID NO: 171347 - DNA, 35 bp, Artificial Sequence
  Synthetic oligonucleotide
atgcggtcgccaaatacgtccaacaccctatccgc

SEQ ID NO: 171348 - DNA, 35 bp, Artificial Sequence
  Synthetic oligonucleotide
tgccaagttatgttcgtttatcgtcccgctcctgc

SEQ ID NO: 171349 - DNA, 35 bp, Artificial Sequence
  Synthetic oligonucleotide
atcgctgttgctgagccgttttaaacccttcctgc

SEQ ID NO: 171350 - DNA, 35 bp, Artificial Sequence
  Synthetic oligonucleotide
gtacccgtacgctacctctatggatgtccccttgc

SEQ ID NO: 171351 - DNA, 35 bp, Artificial Sequence
  Synthetic oligonucleotide
ttgaagcggtatgttcccctgtgccctccatcatc

SEQ ID NO: 171352 - DNA, 35 bp, Artificial Sequence
  Synthetic oligonucleotide
ggatcgacgttacagacctgcctagatccaccctc

SEQ ID NO: 171353 - DNA, 35 bp, Artificial Sequence
  Synthetic oligonucleotide
atgtgcaccccccttcatgctgcgtgtttccgctc

SEQ ID NO: 171354 - DNA, 35 bp, Artificial Sequence
  Synthetic oligonucleotide
gcgaggggggggggcttagggagggctgtttgctc

SEQ ID NO: 171355 - DNA, 35 bp, Artificial Sequence
  Synthetic oligonucleotide
tgcctgtgctggcgtatccgactcctcttcaattc

SEQ ID NO: 171356 - DNA, 35 bp, Artificial Sequence
  Synthetic oligonucleotide
gtgcggccacccatgactgatcatgcctactcttc

SEQ ID NO: 171357 - DNA, 35 bp, Artificial Sequence
  Synthetic oligonucleotide
gccttccaccatcaacgatagccttcatcgagttc

SEQ ID NO: 171358 - DNA, 35 bp, Artificial Sequence
  Synthetic oligonucleotide
ttgacctctcccgtatcgtacctgcctgttgtttc

SEQ ID NO: 171359 - DNA, 35 bp, Artificial Sequence
  Synthetic oligonucleotide
attatccgctcccctcctcacgaattagagaccag

SEQ ID NO: 171360 - DNA, 35 bp, Artificial Sequence
  Synthetic oligonucleotide
tgtctccaccgcgtatttcacgactactatcaccg

SEQ ID NO: 171361 - DNA, 35 bp, Artificial Sequence
  Synthetic oligonucleotide
ggatcctccggcttgcactctctcgttctctaccg

SEQ ID NO: 171362 - DNA, 35 bp, Artificial Sequence
  Synthetic oligonucleotide
gatgaatcagttccgtcctttatagctcccgcccg

SEQ ID NO: 171363 - DNA, 35 bp, Artificial Sequence
  Synthetic oligonucleotide
aatgagaggagtgagcacagtacgagaggggacgg

SEQ ID NO: 171364 - DNA, 35 bp, Artificial Sequence
  Synthetic oligonucleotide
tggtcccatccctcttgtcgcttccgccgattcgg

SEQ ID NO: 171365 - DNA, 35 bp, Artificial Sequence
  Synthetic oligonucleotide
gcacctcatactatccacccctgggcttgaccatg

SEQ ID NO: 171366 - DNA, 35 bp, Artificial Sequence
  Synthetic oligonucleotide
atgcactcgcctgagcgaacgtctctaccccactg

SEQ ID NO: 171367 - DNA, 35 bp, Artificial Sequence
  Synthetic oligonucleotide
tcagcacatccaaccccggtctccgccccatactg

SEQ ID NO: 171368 - DNA, 35 bp, Artificial Sequence
  Synthetic oligonucleotide
ttcccccgctctgggcgttctattgtttactcctg

SEQ ID NO: 171369 - DNA, 35 bp, Artificial Sequence
  Synthetic oligonucleotide
gtagggacgaaaaagggtggaacacgtgaggtctg

SEQ ID NO: 171370 - DNA, 35 bp, Artificial Sequence
  Synthetic oligonucleotide
gcctcctcactcctgttactttaacgaccgttgtg

SEQ ID NO: 171371 - DNA, 35 bp, Artificial Sequence
  Synthetic oligonucleotide
gcagtcgccttgtccgccccccatccttagcccat

SEQ ID NO: 171372 - DNA, 35 bp, Artificial Sequence
  Synthetic oligonucleotide
attgtacgctgccccccatctgcacctttgggcat

SEQ ID NO: 171373 - DNA, 35 bp, Artificial Sequence
  Synthetic oligonucleotide
gctcaccgcccccagcattgctttgtctactcgat

SEQ ID NO: 171374 - DNA, 35 bp, Artificial Sequence
  Synthetic oligonucleotide
ggagtgggggaggggggaagatatcagtttgtgat

SEQ ID NO: 171375 - DNA, 35 bp, Artificial Sequence
  Synthetic oligonucleotide
attgccttctgcgccactatcgacgccggtgccct

SEQ ID NO: 171376 - DNA, 35 bp, Artificial Sequence
  Synthetic oligonucleotide
accgccgccctgcgcgctgtgtttttattatccct

SEQ ID NO: 171377 - DNA, 35 bp, Artificial Sequence
  Synthetic oligonucleotide
ggatcaacgcacatcggcccgcaccacaacgcgct

SEQ ID NO: 171378 - DNA, 35 bp, Artificial Sequence
  Synthetic oligonucleotide
agtggggcgggagagacggagcaattgggtgggct

SEQ ID NO: 171379 - DNA, 35 bp, Artificial Sequence
  Synthetic oligonucleotide
gcgaatagactgcctcgcgtttcctagtaccatct

SEQ ID NO: 171380 - DNA, 35 bp, Artificial Sequence
  Synthetic oligonucleotide
accctccgcccgcccctcactgatgaggtgactct

SEQ ID NO: 171381 - DNA, 35 bp, Artificial Sequence
  Synthetic oligonucleotide
atgccgaaccggcggtctttcaacacagtacctct

SEQ ID NO: 171382 - DNA, 35 bp, Artificial Sequence
  Synthetic oligonucleotide
tcgtagaccttctgctctgtaatctttcccgtggt

SEQ ID NO: 171383 - DNA, 35 bp, Artificial Sequence
  Synthetic oligonucleotide
actccgtacgcctcttgacctgggtgggatccctt

SEQ ID NO: 171384 - DNA, 35 bp, Artificial Sequence
  Synthetic oligonucleotide
ttgcccatttccgaccccgcgtgacagtacttctt

SEQ ID NO: 171385 - DNA, 36 bp, Artificial Sequence
  Synthetic oligonucleotide
gagtgagagacgggggggcaagcacaattgtggcaa

SEQ ID NO: 171386 - DNA, 36 bp, Artificial Sequence
  Synthetic oligonucleotide
gagaagggggaggggcgaagggggggaaacaatcaa

SEQ ID NO: 171387 - DNA, 35 bp, Artificial Sequence
  Synthetic oligonucleotide
tctatccaccccattgcgctcacgcctctgcgtaa

SEQ ID NO: 171388 - DNA, 35 bp, Artificial Sequence
  Synthetic oligonucleotide
tagcaccccgccgaacgtcttcgcttttcactaca

SEQ ID NO: 171389 - DNA, 35 bp, Artificial Sequence
  Synthetic oligonucleotide
ttgacccgcctcctgtctgcgaactcctccttaca

SEQ ID NO: 171390 - DNA, 35 bp, Artificial Sequence
  Synthetic oligonucleotide
gcctggcgaggtcgacgctgccccctgtttaccca

SEQ ID NO: 171391 - DNA, 36 bp, Artificial Sequence
  Synthetic oligonucleotide
atcccgatcctgcctttccactcaagtgtcacgcca

SEQ ID NO: 171392 - DNA, 35 bp, Artificial Sequence
  Synthetic oligonucleotide
tctgggcatcccattcatcccctttcgttctgcca

SEQ ID NO: 171393 - DNA, 36 bp, Artificial Sequence
  Synthetic oligonucleotide
tgctcacacctgctttcgatctacaaagtccctcca

SEQ ID NO: 171394 - DNA, 36 bp, Artificial Sequence
  Synthetic oligonucleotide
taaccatgcacgtgtcaccgttttttcgccgctcca

SEQ ID NO: 171395 - DNA, 36 bp, Artificial Sequence
  Synthetic oligonucleotide
cccatgccccttaccctggtccgtccccgacccgca

SEQ ID NO: 171396 - DNA, 36 bp, Artificial Sequence
  Synthetic oligonucleotide
tgtgctatcctcctgctacctttaccgcccaaggca

SEQ ID NO: 171397 - DNA, 36 bp, Artificial Sequence
  Synthetic oligonucleotide
tcaggagggggaaaattgaaagacgaaacggtggca

SEQ ID NO: 171398 - DNA, 36 bp, Artificial Sequence
  Synthetic oligonucleotide
tgcctccccgctgaaatatgcctgtccaggcctgca

SEQ ID NO: 171399 - DNA, 35 bp, Artificial Sequence
  Synthetic oligonucleotide
agtccagcgcaagcttccactttaacgccgcctca

SEQ ID NO: 171400 - DNA, 36 bp, Artificial Sequence
  Synthetic oligonucleotide
ttaccaccttgtcctcagcttatgcattgtgcctca

SEQ ID NO: 171401 - DNA, 36 bp, Artificial Sequence
  Synthetic oligonucleotide
taacgacaacggtcggcaaatacgcacctctcctca

SEQ ID NO: 171402 - DNA, 36 bp, Artificial Sequence
  Synthetic oligonucleotide
taactgcgcacgcccctgttctgcacccttgtctca

SEQ ID NO: 171403 - DNA, 35 bp, Artificial Sequence
  Synthetic oligonucleotide
tgattgtgcagcaccctttttgcccgccgttctca

SEQ ID NO: 171404 - DNA, 36 bp, Artificial Sequence
  Synthetic oligonucleotide
tagtaccaccgcccgcacctacccacccccgcgtca

SEQ ID NO: 171405 - DNA, 36 bp, Artificial Sequence
  Synthetic oligonucleotide
acgatccagaccagctgctgcccgtgccatccaaga

SEQ ID NO: 171406 - DNA, 37 bp, Artificial Sequence
  Synthetic oligonucleotide
gacacccctgactattcttccctggcctctctcaaga

SEQ ID NO: 171407 - DNA, 37 bp, Artificial Sequence
  Synthetic oligonucleotide
tgcaggaggttcggggtgggggttggtgggcggaaga

SEQ ID NO: 171408 - DNA, 37 bp, Artificial Sequence
  Synthetic oligonucleotide
gatgggagcaggggggagagcgccaactggaaacaga

SEQ ID NO: 171409 - DNA, 37 bp, Artificial Sequence
  Synthetic oligonucleotide
tccgccgttacatctattttgcatgccccttacgaga

SEQ ID NO: 171410 - DNA, 37 bp, Artificial Sequence
  Synthetic oligonucleotide
gagccccgcccgttgagcccttatttcaccaacacga

SEQ ID NO: 171411 - DNA, 36 bp, Artificial Sequence
  Synthetic oligonucleotide
acacacgccgtacccccggcctctattgttccccga

SEQ ID NO: 171412 - DNA, 37 bp, Artificial Sequence
  Synthetic oligonucleotide
ttgcccgtcattgctctactcccgtgaatcctcccga

SEQ ID NO: 171413 - DNA, 37 bp, Artificial Sequence
  Synthetic oligonucleotide
tccacactctccgtttcgttaacctttgctttagcga

SEQ ID NO: 171414 - DNA, 35 bp, Artificial Sequence
  Synthetic oligonucleotide
agtgtcgcctcgcccctcgttaagccacctctcga

SEQ ID NO: 171415 - DNA, 37 bp, Artificial Sequence
  Synthetic oligonucleotide
tatgtcaccgcccctactcttattctgacgacttcga

SEQ ID NO: 171416 - DNA, 36 bp, Artificial Sequence
  Synthetic oligonucleotide
gacgtacgcctacataatcgatgttccatctttcga

SEQ ID NO: 171417 - DNA, 37 bp, Artificial Sequence
  Synthetic oligonucleotide
ggagggtagagggaattggggaaagggcggatcagga

SEQ ID NO: 171418 - DNA, 37 bp, Artificial Sequence
  Synthetic oligonucleotide
gcccgggtggtgaggggaatgatagtgggttggagga

SEQ ID NO: 171419 - DNA, 37 bp, Artificial Sequence
  Synthetic oligonucleotide
gcacgttggatatgcccctccgtttaccccccccgga

SEQ ID NO: 171420 - DNA, 36 bp, Artificial Sequence
  Synthetic oligonucleotide
agtgggaggggactcagttgttgcgggaagggggga

SEQ ID NO: 171421 - DNA, 37 bp, Artificial Sequence
  Synthetic oligonucleotide
atcgaactcgggtgggggggtatttgagccagtggga

SEQ ID NO: 171422 - DNA, 37 bp, Artificial Sequence
  Synthetic oligonucleotide
gactgtccccgttaactgtgctacccgccctcatgga

SEQ ID NO: 171423 - DNA, 35 bp, Artificial Sequence
  Synthetic oligonucleotide
agataaacacgggttggacggggaggagggctgga

SEQ ID NO: 171424 - DNA, 37 bp, Artificial Sequence
  Synthetic oligonucleotide
tagtcactacggtgcatatcaccacctccctcttgga

SEQ ID NO: 171425 - DNA, 38 bp, Artificial Sequence
  Synthetic oligonucleotide
agctgtacgggaggggagggggcaaggctagaaaatga

SEQ ID NO: 171426 - DNA, 38 bp, Artificial Sequence
  Synthetic oligonucleotide
tcatgcgacaatctctttccgcctgccatctgccatga

SEQ ID NO: 171427 - DNA, 38 bp, Artificial Sequence
  Synthetic oligonucleotide
aaggggacggggctgcgggcaaataagggggaggatga

SEQ ID NO: 171428 - DNA, 37 bp, Artificial Sequence
  Synthetic oligonucleotide
tcctgcacctcatcctcggtccgttcagccattatga

SEQ ID NO: 171429 - DNA, 38 bp, Artificial Sequence
  Synthetic oligonucleotide
gtcaccccgatccccattatgactactgtacccactga

SEQ ID NO: 171430 - DNA, 37 bp, Artificial Sequence
  Synthetic oligonucleotide
ggtcaccgtccttgctcaccgccacgtattccactga

SEQ ID NO: 171431 - DNA, 38 bp, Artificial Sequence
  Synthetic oligonucleotide
actgcgccccgcattgtccatttctgtttccgacctga

SEQ ID NO: 171432 - DNA, 38 bp, Artificial Sequence
  Synthetic oligonucleotide
ggtcgcccctattgctgttgcgtaatccccttccctga

SEQ ID NO: 171433 - DNA, 38 bp, Artificial Sequence
  Synthetic oligonucleotide
gagcacgaggggggaggaccaaggatagacgctgctga

SEQ ID NO: 171434 - DNA, 38 bp, Artificial Sequence
  Synthetic oligonucleotide
aggatatgggggaacgggagaagagtggggcggagtga

SEQ ID NO: 171435 - DNA, 37 bp, Artificial Sequence
  Synthetic oligonucleotide
gaccgccgcaaccaccctgccacacatacacgcgtga

SEQ ID NO: 171436 - DNA, 36 bp, Artificial Sequence
  Synthetic oligonucleotide
accccccccgctggtcacggaatgacgagtgcgtga

SEQ ID NO: 171437 - DNA, 37 bp, Artificial Sequence
  Synthetic oligonucleotide
gccttcacggcacatgtcatcccccccgccgtcgtga

SEQ ID NO: 171438 - DNA, 37 bp, Artificial Sequence
  Synthetic oligonucleotide
gagagtgacggtgggcatgggggggcgggtgcggtga

SEQ ID NO: 171439 - DNA, 38 bp, Artificial Sequence
  Synthetic oligonucleotide
gggggatgggtgggagggaaagagctcgtcaacattga

SEQ ID NO: 171440 - DNA, 36 bp, Artificial Sequence
  Synthetic oligonucleotide
gaatcggggtgggagtggtgggagggtgacccttga

SEQ ID NO: 171441 - DNA, 38 bp, Artificial Sequence
  Synthetic oligonucleotide
gtcgcaccttcacccttatagttctttctcgtccttga

SEQ ID NO: 171442 - DNA, 37 bp, Artificial Sequence
  Synthetic oligonucleotide
ttcgtgtgcagctgataaccgccgaccctccgcttga

SEQ ID NO: 171443 - DNA, 38 bp, Artificial Sequence
  Synthetic oligonucleotide
agcccccccgtggtatgtactgccctttttactcttga

SEQ ID NO: 171444 - DNA, 29 bp, Artificial Sequence
  Synthetic oligonucleotide
ttgcgaccaagcccatcctgacctgcata

SEQ ID NO: 171445 - DNA, 36 bp, Artificial Sequence
  Synthetic oligonucleotide
gtcaccgcccatcccttcgatgtgtacgcaccacta

SEQ ID NO: 171446 - DNA, 35 bp, Artificial Sequence
  Synthetic oligonucleotide
tgcaacacctgccccgtggaaactccctttgacta

SEQ ID NO: 171447 - DNA, 36 bp, Artificial Sequence
  Synthetic oligonucleotide
gtgacgtgagtctgtttactggcttccccctaccta

SEQ ID NO: 171448 - DNA, 36 bp, Artificial Sequence
  Synthetic oligonucleotide
attcctgctcggcgcggtgtcctctgctccaccgta

SEQ ID NO: 171449 - DNA, 35 bp, Artificial Sequence
  Synthetic oligonucleotide
atcgcccttccatgatatacctctcctacgcggta

SEQ ID NO: 171450 - DNA, 35 bp, Artificial Sequence
  Synthetic oligonucleotide
gagtcacatcctgtccccgcaatcatgtctcatta

SEQ ID NO: 171451 - DNA, 35 bp, Artificial Sequence
  Synthetic oligonucleotide
gtcccacccatgccttttaacagctaattcgctta

SEQ ID NO: 171452 - DNA, 35 bp, Artificial Sequence
  Synthetic oligonucleotide
gcccctcgccttgttgtacgtcccgcccattctta

SEQ ID NO: 171453 - DNA, 35 bp, Artificial Sequence
  Synthetic oligonucleotide
tcctcgtgccctactgcctggttttttgccctgac

SEQ ID NO: 171454 - DNA, 35 bp, Artificial Sequence
  Synthetic oligonucleotide
gtcgcccggaatctagtaacaagcatcccgccccc

SEQ ID NO: 171455 - DNA, 35 bp, Artificial Sequence
  Synthetic oligonucleotide
gccaccccgcaggtccccgctccgttacattgccc

SEQ ID NO: 171456 - DNA, 35 bp, Artificial Sequence
  Synthetic oligonucleotide
tcacatgtccttctgggcttccaccctcaggtccc

SEQ ID NO: 171457 - DNA, 35 bp, Artificial Sequence
  Synthetic oligonucleotide
tttccaccgatcggccaatggaccgccctgttccc

SEQ ID NO: 171458 - DNA, 35 bp, Artificial Sequence
  Synthetic oligonucleotide
tgtcccggccggcctgccccgctccccgagtagcc

SEQ ID NO: 171459 - DNA, 35 bp, Artificial Sequence
  Synthetic oligonucleotide
gatccacgtgtagatggtttgcaatctccttcgcc

SEQ ID NO: 171460 - DNA, 35 bp, Artificial Sequence
  Synthetic oligonucleotide
gttcaaacgcaggcctcgcagtactcctccttgcc

SEQ ID NO: 171461 - DNA, 35 bp, Artificial Sequence
  Synthetic oligonucleotide
gccgatccaccacgtatgtctgttctttttttgcc

SEQ ID NO: 171462 - DNA, 35 bp, Artificial Sequence
  Synthetic oligonucleotide
ttcaccccacgctccactgtcccgtagcctactcc

SEQ ID NO: 171463 - DNA, 35 bp, Artificial Sequence
  Synthetic oligonucleotide
gtggtagccgtagtatcatcttcatcgccgcctcc

SEQ ID NO: 171464 - DNA, 35 bp, Artificial Sequence
  Synthetic oligonucleotide
ttgacaccaccttcgcgtatggttgccctcgctcc

SEQ ID NO: 171465 - DNA, 35 bp, Artificial Sequence
  Synthetic oligonucleotide
ccctgcccgccgctgtttacaggcgtgtaccttcc

SEQ ID NO: 171466 - DNA, 35 bp, Artificial Sequence
  Synthetic oligonucleotide
ggtgagggcccctgttcgcttcttccttcgtttcc

SEQ ID NO: 171467 - DNA, 35 bp, Artificial Sequence
  Synthetic oligonucleotide
aatacccgcctcgccgcacattatacaaccggatc

SEQ ID NO: 171468 - DNA, 35 bp, Artificial Sequence
  Synthetic oligonucleotide
gccgaagcggttccgccatgtttgattcccctatc

SEQ ID NO: 171469 - DNA, 35 bp, Artificial Sequence
  Synthetic oligonucleotide
tgcgcacctactctgctcgaaacaagcccgtcctc

SEQ ID NO: 171470 - DNA, 35 bp, Artificial Sequence
  Synthetic oligonucleotide
gcaccaaccgttgccctgaacgggtatcctatctc

SEQ ID NO: 171471 - DNA, 35 bp, Artificial Sequence
  Synthetic oligonucleotide
aacacgagcgtcctgctattctgtacccggctctc

SEQ ID NO: 171472 - DNA, 35 bp, Artificial Sequence
  Synthetic oligonucleotide
ttcctcgcacccccctcccacctcccatagaggtc

SEQ ID NO: 171473 - DNA, 35 bp, Artificial Sequence
  Synthetic oligonucleotide
gtaggtagggaagaagaagggggttaacctggacg

SEQ ID NO: 171474 - DNA, 35 bp, Artificial Sequence
  Synthetic oligonucleotide
aaagcccctccaccccacgtcgccgacactagccg

SEQ ID NO: 171475 - DNA, 35 bp, Artificial Sequence
  Synthetic oligonucleotide
aaacgcccttcccgctgggccaacgatgccctccg

SEQ ID NO: 171476 - DNA, 35 bp, Artificial Sequence
  Synthetic oligonucleotide
tggggtgaggggggtgggagtggaagtagggatcg

SEQ ID NO: 171477 - DNA, 35 bp, Artificial Sequence
  Synthetic oligonucleotide
accgtgcagatatcgttctcggtcccctcttatcg

SEQ ID NO: 171478 - DNA, 35 bp, Artificial Sequence
  Synthetic oligonucleotide
tacgctcgtcgctccgggccggctctcttacttcg

SEQ ID NO: 171479 - DNA, 35 bp, Artificial Sequence
  Synthetic oligonucleotide
ggggggctgagtacgggggggactagtaggaaggg

SEQ ID NO: 171480 - DNA, 35 bp, Artificial Sequence
  Synthetic oligonucleotide
gcacaccttcagttcgaattatttgcccccccctg

SEQ ID NO: 171481 - DNA, 35 bp, Artificial Sequence
  Synthetic oligonucleotide
gatgggcatcctttgcgattatcacctttcctttg

SEQ ID NO: 171482 - DNA, 35 bp, Artificial Sequence
  Synthetic oligonucleotide
ttccgtacaagcctccccgccccgtaatatgcaat

SEQ ID NO: 171483 - DNA, 35 bp, Artificial Sequence
  Synthetic oligonucleotide
gagggaacaggtgtacttacgtaggcggggggaat

SEQ ID NO: 171484 - DNA, 35 bp, Artificial Sequence
  Synthetic oligonucleotide
gtctatccaccacatacgtgcaatctgtccaccat

SEQ ID NO: 171485 - DNA, 35 bp, Artificial Sequence
  Synthetic oligonucleotide
gcaagggggggggaggggcatacattgggtactat

SEQ ID NO: 171486 - DNA, 35 bp, Artificial Sequence
  Synthetic oligonucleotide
ttccgtagccgcctcgcttgcctgctttttcgtat

SEQ ID NO: 171487 - DNA, 36 bp, Artificial Sequence
  Synthetic oligonucleotide
agcaacattcacacgtccgccctacttccggtttat

SEQ ID NO: 171488 - DNA, 35 bp, Artificial Sequence
  Synthetic oligonucleotide
gcaaaccgcgccgtttcccatctctcaatgttact

SEQ ID NO: 171489 - DNA, 35 bp, Artificial Sequence
  Synthetic oligonucleotide
gcttacaccgcactccccgaagtatattccaccct

SEQ ID NO: 171490 - DNA, 35 bp, Artificial Sequence
  Synthetic oligonucleotide
ttccgacctcacatatattcgatacctgcccccct

SEQ ID NO: 171491 - DNA, 35 bp, Artificial Sequence
  Synthetic oligonucleotide
tgtcaaaggcgccgcttcccatatgctgatcccct

SEQ ID NO: 171492 - DNA, 35 bp, Artificial Sequence
  Synthetic oligonucleotide
tgctccctcctggtgccttctgagaaccctacgct

SEQ ID NO: 171493 - DNA, 35 bp, Artificial Sequence
  Synthetic oligonucleotide
tttgccacactcgggatcccgtcgccaccctcgct

SEQ ID NO: 171494 - DNA, 35 bp, Artificial Sequence
  Synthetic oligonucleotide
tccctccacccgcaagaagcgaaggtaacatctct

SEQ ID NO: 171495 - DNA, 35 bp, Artificial Sequence
  Synthetic oligonucleotide
tgctatcgcgcccgacccctaccacgccatcttct

SEQ ID NO: 171496 - DNA, 35 bp, Artificial Sequence
  Synthetic oligonucleotide
tagtacagcatccggccgtaccttgttgctcctgt

SEQ ID NO: 171497 - DNA, 35 bp, Artificial Sequence
  Synthetic oligonucleotide
gtcgacaccctctactgaataccgttgcttagctt

SEQ ID NO: 171498 - DNA, 35 bp, Artificial Sequence
  Synthetic oligonucleotide
tcactcgccccactagtctcatattcaggtccttt

SEQ ID NO: 171499 - DNA, 35 bp, Artificial Sequence
  Synthetic oligonucleotide
ggcggtactcaccatcatgtcccttctgctatttt

SEQ ID NO: 171500 - DNA, 36 bp, Artificial Sequence
  Synthetic oligonucleotide
gaccatgccagcttgttagttctcgatccgccccaa

SEQ ID NO: 171501 - DNA, 36 bp, Artificial Sequence
  Synthetic oligonucleotide
tgccccctcccgttttcgcagtttctgcacttcaca

SEQ ID NO: 171502 - DNA, 36 bp, Artificial Sequence
  Synthetic oligonucleotide
tgaagcaccaaccccagccactgcccccgcttgaca

SEQ ID NO: 171503 - DNA, 35 bp, Artificial Sequence
  Synthetic oligonucleotide
acactcatcctcggctataaaccaccgcacataca

SEQ ID NO: 171504 - DNA, 36 bp, Artificial Sequence
  Synthetic oligonucleotide
taccgcgtgctgcccgacccgctaagttttgctaca

SEQ ID NO: 171505 - DNA, 35 bp, Artificial Sequence
  Synthetic oligonucleotide
tcatattgccacccggttactgccccgttgttaca

SEQ ID NO: 171506 - DNA, 36 bp, Artificial Sequence
  Synthetic oligonucleotide
accatccgccccgcttgccgtatatccaccccgcca

SEQ ID NO: 171507 - DNA, 36 bp, Artificial Sequence
  Synthetic oligonucleotide
gagcactcccttgcgtacccgaaaacgcgcttgcca

SEQ ID NO: 171508 - DNA, 36 bp, Artificial Sequence
  Synthetic oligonucleotide
gcctaaccgccctgtgtaaattcattccctgctcca

SEQ ID NO: 171509 - DNA, 36 bp, Artificial Sequence
  Synthetic oligonucleotide
tccaggggtggtcggtcggggttttgcggtggatca

SEQ ID NO: 171510 - DNA, 37 bp, Artificial Sequence
  Synthetic oligonucleotide
acaaaccgttacatccgcgactccgagcccatcccga

SEQ ID NO: 171511 - DNA, 37 bp, Artificial Sequence
  Synthetic oligonucleotide
ttaccaacgcccccttgactcttttgctgcccgccga

SEQ ID NO: 171512 - DNA, 37 bp, Artificial Sequence
  Synthetic oligonucleotide
acgctaccccattgctcatccgtttccttcaatccga

SEQ ID NO: 171513 - DNA, 37 bp, Artificial Sequence
  Synthetic oligonucleotide
tgttcaggggcgaagggatggggggggccgtatccga

SEQ ID NO: 171514 - DNA, 36 bp, Artificial Sequence
  Synthetic oligonucleotide
accgcacctcgatcacgttcctacttctcactgcga

SEQ ID NO: 171515 - DNA, 37 bp, Artificial Sequence
  Synthetic oligonucleotide
accatccgtaccctctgttatattgtgtcctgctcga

SEQ ID NO: 171516 - DNA, 37 bp, Artificial Sequence
  Synthetic oligonucleotide
tttaccctccacgttcacatcgttacaccctcttcga

SEQ ID NO: 171517 - DNA, 36 bp, Artificial Sequence
  Synthetic oligonucleotide
atctccccgcaacaaatgtgctcgcccaccaccgga

SEQ ID NO: 171518 - DNA, 37 bp, Artificial Sequence
  Synthetic oligonucleotide
gtgggcctccatgctaatacccgttttctccttcgga

SEQ ID NO: 171519 - DNA, 37 bp, Artificial Sequence
  Synthetic oligonucleotide
ggtccaggggtacaatcgttccggagagggggcggga

SEQ ID NO: 171520 - DNA, 37 bp, Artificial Sequence
  Synthetic oligonucleotide
gaacggagggaagggaagggttaccagagtccgggga

SEQ ID NO: 171521 - DNA, 37 bp, Artificial Sequence
  Synthetic oligonucleotide
aatgtcacgggggggagcgggacacagatcatgggga

SEQ ID NO: 171522 - DNA, 37 bp, Artificial Sequence
  Synthetic oligonucleotide
ggggcctcgttcaaatctagggtgggggaactgggga

SEQ ID NO: 171523 - DNA, 36 bp, Artificial Sequence
  Synthetic oligonucleotide
gtgggtggggtttagcaccaggggcgacgctgggga

SEQ ID NO: 171524 - DNA, 36 bp, Artificial Sequence
  Synthetic oligonucleotide
tcatcctccgctcctacgtccaatcacacactggga

SEQ ID NO: 171525 - DNA, 37 bp, Artificial Sequence
  Synthetic oligonucleotide
gcactgtgaagtgtcggcatttcactctacccctgga

SEQ ID NO: 171526 - DNA, 36 bp, Artificial Sequence
  Synthetic oligonucleotide
gacgacgagtaaataggggggagaaagggtgctgga

SEQ ID NO: 171527 - DNA, 37 bp, Artificial Sequence
  Synthetic oligonucleotide
tgtccaagggaggggcgcagggggggtccatcttgga

SEQ ID NO: 171528 - DNA, 35 bp, Artificial Sequence
  Synthetic oligonucleotide
gtgcgcccctcggtagtttccgctctatgccatga

SEQ ID NO: 171529 - DNA, 38 bp, Artificial Sequence
  Synthetic oligonucleotide
atactcgctgctgcacctggttctcgcgccctccatga

SEQ ID NO: 171530 - DNA, 38 bp, Artificial Sequence
  Synthetic oligonucleotide
acccattgctctgtcccgtgcccgaatgccactcctga

SEQ ID NO: 171531 - DNA, 38 bp, Artificial Sequence
  Synthetic oligonucleotide
aacgggagggtggggtcctgtgcaattcggggtcctga

SEQ ID NO: 171532 - DNA, 38 bp, Artificial Sequence
  Synthetic oligonucleotide
tgcgggtggggagggggagagggacagacgctgcgtga

SEQ ID NO: 171533 - DNA, 38 bp, Artificial Sequence
  Synthetic oligonucleotide
agggcggggtacggggggcaaactggaatagggggtga

SEQ ID NO: 171534 - DNA, 38 bp, Artificial Sequence
  Synthetic oligonucleotide
ggtgggggggcggggtcgatcaggaacgggtaaattga

SEQ ID NO: 171535 - DNA, 36 bp, Artificial Sequence
  Synthetic oligonucleotide
gcacctctccgcatgcgagctccgttccgaccttga

SEQ ID NO: 171536 - DNA, 37 bp, Artificial Sequence
  Synthetic oligonucleotide
ggatggagggcaaggcatggaggcaagggtaggttga

SEQ ID NO: 171537 - DNA, 38 bp, Artificial Sequence
  Synthetic oligonucleotide
gccgtgccttcccccggacctgtcctgtttactgttga

SEQ ID NO: 171538 - DNA, 38 bp, Artificial Sequence
  Synthetic oligonucleotide
tccccgtcgtagttacccggtgtctgttccctctttga

SEQ ID NO: 171539 - DNA, 35 bp, Artificial Sequence
  Synthetic oligonucleotide
ttgaaatgccccacatcgtaataccctgattttga

SEQ ID NO: 171540 - DNA, 36 bp, Artificial Sequence
  Synthetic oligonucleotide
gcctgctcttacgctccgcccgtttcgccgtgccta

SEQ ID NO: 171541 - DNA, 34 bp, Artificial Sequence
  Synthetic oligonucleotide
tttgcgtgtacccgccgccatattgattccgcta

SEQ ID NO: 171542 - DNA, 35 bp, Artificial Sequence
  Synthetic oligonucleotide
gtaactccgccgttcttccgtacccgcttgctcta

SEQ ID NO: 171543 - DNA, 35 bp, Artificial Sequence
  Synthetic oligonucleotide
gaagggaacggggcggtggagaacagtgtggcgta

SEQ ID NO: 171544 - DNA, 35 bp, Artificial Sequence
  Synthetic oligonucleotide
tcactgctcgcacaccctgcctgttgaccctcgta

SEQ ID NO: 171545 - DNA, 36 bp, Artificial Sequence
  Synthetic oligonucleotide
gatgctgtgaggggcggggagggctgcgggtatgta

SEQ ID NO: 171546 - DNA, 35 bp, Artificial Sequence
  Synthetic oligonucleotide
tcagcatccttgccagctgccttgtccttcgctta

SEQ ID NO: 171547 - DNA, 36 bp, Artificial Sequence
  Synthetic oligonucleotide
tgagtcccgcgacgccggctcctcgctcccaattta

SEQ ID NO: 171548 - DNA, 35 bp, Artificial Sequence
  Synthetic oligonucleotide
actccaccgatgatttctgaatagtatcctgccac

SEQ ID NO: 171549 - DNA, 35 bp, Artificial Sequence
  Synthetic oligonucleotide
tgcacctcctgccgtggcgttggcgacctacctac

SEQ ID NO: 171550 - DNA, 35 bp, Artificial Sequence
  Synthetic oligonucleotide
ttcgcccgtacctatatcttatgtcgtcaccgtac

SEQ ID NO: 171551 - DNA, 35 bp, Artificial Sequence
  Synthetic oligonucleotide
tcttctacccctcgcgctggtctcgccgctgttac

SEQ ID NO: 171552 - DNA, 36 bp, Artificial Sequence
  Synthetic oligonucleotide
taactcatcggcgctactgcctctctccgacggacc

SEQ ID NO: 171553 - DNA, 35 bp, Artificial Sequence
  Synthetic oligonucleotide
gcgaccctcgagcattgaacccgatccccgccccc

SEQ ID NO: 171554 - DNA, 35 bp, Artificial Sequence
  Synthetic oligonucleotide
tccggagtgcagtccaatccgctatttacatcccc

SEQ ID NO: 171555 - DNA, 35 bp, Artificial Sequence
  Synthetic oligonucleotide
gtgacccacttcctgcctatataacccgaacgccc

SEQ ID NO: 171556 - DNA, 34 bp, Artificial Sequence
  Synthetic oligonucleotide
cctatctcaggtgttcacgacctgacctccgccc

SEQ ID NO: 171557 - DNA, 35 bp, Artificial Sequence
  Synthetic oligonucleotide
aaactcggccctgtacgcttcgacacctcgccgcc

SEQ ID NO: 171558 - DNA, 35 bp, Artificial Sequence
  Synthetic oligonucleotide
atccgcaaaggagcgttcccccggccgtacatgcc

SEQ ID NO: 171559 - DNA, 35 bp, Artificial Sequence
  Synthetic oligonucleotide
acgcggactgccactgattctctctcgcccttgcc

SEQ ID NO: 171560 - DNA, 35 bp, Artificial Sequence
  Synthetic oligonucleotide
gtcgcccccgctgcgatcacctccactttgttgcc

SEQ ID NO: 171561 - DNA, 35 bp, Artificial Sequence
  Synthetic oligonucleotide
attgtccgaccctcttataacatctggcgatatcc

SEQ ID NO: 171562 - DNA, 35 bp, Artificial Sequence
  Synthetic oligonucleotide
tctccactcctagggtgttaccagcctttgtctcc

SEQ ID NO: 171563 - DNA, 36 bp, Artificial Sequence
  Synthetic oligonucleotide
ccacatgttctccatctcagccacgggctcccttcc

SEQ ID NO: 171564 - DNA, 35 bp, Artificial Sequence
  Synthetic oligonucleotide
tcttcgttgcgcaccgtcttacctggctctcttcc

SEQ ID NO: 171565 - DNA, 35 bp, Artificial Sequence
  Synthetic oligonucleotide
acataaccccctcagacctgccttgttccagttcc

SEQ ID NO: 171566 - DNA, 34 bp, Artificial Sequence
  Synthetic oligonucleotide
gggagcacgagtccctgtacattgtttccgttcc

SEQ ID NO: 171567 - DNA, 35 bp, Artificial Sequence
  Synthetic oligonucleotide
tccagcccgcgccccgtccgccccatcgatcaatc

SEQ ID NO: 171568 - DNA, 35 bp, Artificial Sequence
  Synthetic oligonucleotide
gactatgcccaggttttccgcctgccttctccatc

SEQ ID NO: 171569 - DNA, 35 bp, Artificial Sequence
  Synthetic oligonucleotide
tagatacggcatagcatcttccccccccgctcatc

SEQ ID NO: 171570 - DNA, 35 bp, Artificial Sequence
  Synthetic oligonucleotide
tactggacctcggccgtcgttacttagcttctatc

SEQ ID NO: 171571 - DNA, 35 bp, Artificial Sequence
  Synthetic oligonucleotide
acttcatcccggtcaatctggttatacaaccactc

SEQ ID NO: 171572 - DNA, 35 bp, Artificial Sequence
  Synthetic oligonucleotide
tgttgcgcacgccccgggccattctcgctccactc

SEQ ID NO: 171573 - DNA, 35 bp, Artificial Sequence
  Synthetic oligonucleotide
gtgctggatctatattttgcttctgcctggccctc

SEQ ID NO: 171574 - DNA, 35 bp, Artificial Sequence
  Synthetic oligonucleotide
gatgcatgtcgctacccctcacgttatgtcaagtc

SEQ ID NO: 171575 - DNA, 35 bp, Artificial Sequence
  Synthetic oligonucleotide
acgccgtccgcctaggccctatttactgacccgtc

SEQ ID NO: 171576 - DNA, 35 bp, Artificial Sequence
  Synthetic oligonucleotide
gacggcctttgcccaggcactttgatccacccttc

SEQ ID NO: 171577 - DNA, 35 bp, Artificial Sequence
  Synthetic oligonucleotide
tgggcgcatgtgtatcatttccgtactcgcccttc

SEQ ID NO: 171578 - DNA, 35 bp, Artificial Sequence
  Synthetic oligonucleotide
gatacctcgtgtgttcgtgcctttgctctacgttc

SEQ ID NO: 171579 - DNA, 35 bp, Artificial Sequence
  Synthetic oligonucleotide
tcatgccatccatattttcgctgccttggattttc

SEQ ID NO: 171580 - DNA, 35 bp, Artificial Sequence
  Synthetic oligonucleotide
tactccccccgacagatttatgtcgccatgttttc

SEQ ID NO: 171581 - DNA, 35 bp, Artificial Sequence
  Synthetic oligonucleotide
ggagcaaggaggggggaaatttggggagacaggag

SEQ ID NO: 171582 - DNA, 35 bp, Artificial Sequence
  Synthetic oligonucleotide
attacaagtacagaggggacgatggggagggggag

SEQ ID NO: 171583 - DNA, 35 bp, Artificial Sequence
  Synthetic oligonucleotide
tcttgcccccccgtgtcctacccagcaggatgtag

SEQ ID NO: 171584 - DNA, 35 bp, Artificial Sequence
  Synthetic oligonucleotide
actgcaccgcctgcttatcacttattcgatcttcg

SEQ ID NO: 171585 - DNA, 35 bp, Artificial Sequence
  Synthetic oligonucleotide
gtgtcacggggtgggatagggtaaagtaggagtgg

SEQ ID NO: 171586 - DNA, 35 bp, Artificial Sequence
  Synthetic oligonucleotide
gttgcaatgcggtcaagtcagtgatcctacccctg

SEQ ID NO: 171587 - DNA, 35 bp, Artificial Sequence
  Synthetic oligonucleotide
gggtgggtgggggaggtggttttgaatagggaaat

SEQ ID NO: 171588 - DNA, 35 bp, Artificial Sequence
  Synthetic oligonucleotide
tcccgacgcttcaacgctgtatcacttcgccccat

SEQ ID NO: 171589 - DNA, 35 bp, Artificial Sequence
  Synthetic oligonucleotide
tgcacaggaagaaggggagtggctggatagatgat

SEQ ID NO: 171590 - DNA, 35 bp, Artificial Sequence
  Synthetic oligonucleotide
gctcacctgccctcccctttcgcgttcctggtact

SEQ ID NO: 171591 - DNA, 35 bp, Artificial Sequence
  Synthetic oligonucleotide
tctaggcaccggtctgactcggcgctttcacccct

SEQ ID NO: 171592 - DNA, 35 bp, Artificial Sequence
  Synthetic oligonucleotide
ggagacgtgtgccccgactggctgctccatcccct

SEQ ID NO: 171593 - DNA, 35 bp, Artificial Sequence
  Synthetic oligonucleotide
tgaacactcgctcccccttcagccgccctgtccct

SEQ ID NO: 171594 - DNA, 35 bp, Artificial Sequence
  Synthetic oligonucleotide
ttgagcgcatcactaggatcctgaccatcgctgct

SEQ ID NO: 171595 - DNA, 35 bp, Artificial Sequence
  Synthetic oligonucleotide
gagtacattgcccgccgtatcgcccctaacgctct

SEQ ID NO: 171596 - DNA, 35 bp, Artificial Sequence
  Synthetic oligonucleotide
ataccaccgcgaattgacctgggggccctccttct

SEQ ID NO: 171597 - DNA, 35 bp, Artificial Sequence
  Synthetic oligonucleotide
gattccgccaggccaacgcactccgtacttgttct

SEQ ID NO: 171598 - DNA, 35 bp, Artificial Sequence
  Synthetic oligonucleotide
agccccagtgctctccccttccgcccttgaactgt

SEQ ID NO: 171599 - DNA, 35 bp, Artificial Sequence
  Synthetic oligonucleotide
atacacgccacttccgcgtaactgtcgaaccctgt

SEQ ID NO: 171600 - DNA, 35 bp, Artificial Sequence
  Synthetic oligonucleotide
gaatacgcccatgcacgttaactttcttcgccctt

SEQ ID NO: 171601 - DNA, 35 bp, Artificial Sequence
  Synthetic oligonucleotide
gccactgctcagcgttttcgggcctctcgtctctt

SEQ ID NO: 171602 - DNA, 35 bp, Artificial Sequence
  Synthetic oligonucleotide
tgccccccctgccgctaacaatactgacagttctt

SEQ ID NO: 171603 - DNA, 34 bp, Artificial Sequence
  Synthetic oligonucleotide
ttccgtgcttccttccactccgccccttttcgtt

SEQ ID NO: 171604 - DNA, 35 bp, Artificial Sequence
  Synthetic oligonucleotide
tcatcgtcccccatctgctggttccacacctgttt

SEQ ID NO: 171605 - DNA, 36 bp, Artificial Sequence
  Synthetic oligonucleotide
gggaatcgggaggaggaggagggtgggttccgaaaa

SEQ ID NO: 171606 - DNA, 36 bp, Artificial Sequence
  Synthetic oligonucleotide
ggatgatagggggtcggattaggaggggcgggcaaa

SEQ ID NO: 171607 - DNA, 35 bp, Artificial Sequence
  Synthetic oligonucleotide
ttgacgcagtatcgcccctgcctggacccccacaa

SEQ ID NO: 171608 - DNA, 36 bp, Artificial Sequence
  Synthetic oligonucleotide
atgcggcatgatgtatatcaccgtcctcctccgcaa

SEQ ID NO: 171609 - DNA, 36 bp, Artificial Sequence
  Synthetic oligonucleotide
ttcgccaccactcgcctaggccgtatattccctcaa

SEQ ID NO: 171610 - DNA, 36 bp, Artificial Sequence
  Synthetic oligonucleotide
gtggtgtggagatcgtgacaagcggggggggatgaa

SEQ ID NO: 171611 - DNA, 36 bp, Artificial Sequence
  Synthetic oligonucleotide
gatgggggtgggggctgagggcaagccggtgactaa

SEQ ID NO: 171612 - DNA, 36 bp, Artificial Sequence
  Synthetic oligonucleotide
gttgtgactgggagggtgcttgggggccgggagtaa

SEQ ID NO: 171613 - DNA, 36 bp, Artificial Sequence
  Synthetic oligonucleotide
agtgagagggggaagagcacataggagatcgtgtaa

SEQ ID NO: 171614 - DNA, 36 bp, Artificial Sequence
  Synthetic oligonucleotide
accagagtcgccacgtgccgtactcttctccataca

SEQ ID NO: 171615 - DNA, 36 bp, Artificial Sequence
  Synthetic oligonucleotide
acagccgcccgggcctgatgctcccgtccatctaca

SEQ ID NO: 171616 - DNA, 36 bp, Artificial Sequence
  Synthetic oligonucleotide
ggtacgcatcgccttgtctagtcccgttcactacca

SEQ ID NO: 171617 - DNA, 36 bp, Artificial Sequence
  Synthetic oligonucleotide
gtatccagttcacacggtatttacgctcccatccca

SEQ ID NO: 171618 - DNA, 35 bp, Artificial Sequence
  Synthetic oligonucleotide
acccaccaccttgatgcccacaccgagattttcca

SEQ ID NO: 171619 - DNA, 36 bp, Artificial Sequence
  Synthetic oligonucleotide
tacgccggtcacacggcctcaggtacccccaccgca

SEQ ID NO: 171620 - DNA, 36 bp, Artificial Sequence
  Synthetic oligonucleotide
ttccacccgctttctgtatgtcggcctcaatcatca

SEQ ID NO: 171621 - DNA, 35 bp, Artificial Sequence
  Synthetic oligonucleotide
gtctcgctacgtggtaatactcatccttcccctca

SEQ ID NO: 171622 - DNA, 36 bp, Artificial Sequence
  Synthetic oligonucleotide
ttgacttgcctacagcgccgcaccctccccgtctca

SEQ ID NO: 171623 - DNA, 34 bp, Artificial Sequence
  Synthetic oligonucleotide
aaagacgctacccgctccatcgtacccttggtca

SEQ ID NO: 171624 - DNA, 35 bp, Artificial Sequence
  Synthetic oligonucleotide
ttacgccccggttggtcccccccgacacgaattca

SEQ ID NO: 171625 - DNA, 36 bp, Artificial Sequence
  Synthetic oligonucleotide
tccagtcaaatggctcaccgcaaccgtactccttca

SEQ ID NO: 171626 - DNA, 36 bp, Artificial Sequence
  Synthetic oligonucleotide
gaacaggggtggggtaaggtatttaaggtggggaga

SEQ ID NO: 171627 - DNA, 37 bp, Artificial Sequence
  Synthetic oligonucleotide
gttcgccctcccacgttgtactgctgtagcacctaga

SEQ ID NO: 171628 - DNA, 36 bp, Artificial Sequence
  Synthetic oligonucleotide
gtggaagcctcaccaagatcccccccactgtaccga

SEQ ID NO: 171629 - DNA, 37 bp, Artificial Sequence
  Synthetic oligonucleotide
tcctcctcaaactgatcccgctgtgcctagtccccga

SEQ ID NO: 171630 - DNA, 37 bp, Artificial Sequence
  Synthetic oligonucleotide
gcgaaccgtactcctgttttagccctgcctttcccga

SEQ ID NO: 171631 - DNA, 37 bp, Artificial Sequence
  Synthetic oligonucleotide
atccgcctgccctaatatgctgctttcaattcgccga

SEQ ID NO: 171632 - DNA, 37 bp, Artificial Sequence
  Synthetic oligonucleotide
gaagcagtcacttgtccaatgcacatctccccctcga

SEQ ID NO: 171633 - DNA, 37 bp, Artificial Sequence
  Synthetic oligonucleotide
atccgcgagcagttccatgtactatcgtcctgctcga

SEQ ID NO: 171634 - DNA, 37 bp, Artificial Sequence
  Synthetic oligonucleotide
agacccgcccaagcatactcgcccaccgtactctcga

SEQ ID NO: 171635 - DNA, 38 bp, Artificial Sequence
  Synthetic oligonucleotide
gaggtgcgaggggaagggaaaaccaggggtcaaacgga

SEQ ID NO: 171636 - DNA, 37 bp, Artificial Sequence
  Synthetic oligonucleotide
acgtaggacatgggcagggggaccagggcggacggga

SEQ ID NO: 171637 - DNA, 37 bp, Artificial Sequence
  Synthetic oligonucleotide
taaaggtggagcaaagggcaaagtggatctaggggga

SEQ ID NO: 171638 - DNA, 37 bp, Artificial Sequence
  Synthetic oligonucleotide
acgcacttacgacctgcctccattctccactagtgga

SEQ ID NO: 171639 - DNA, 36 bp, Artificial Sequence
  Synthetic oligonucleotide
tcccacccccgcccccgctatcgggtctaatactga

SEQ ID NO: 171640 - DNA, 37 bp, Artificial Sequence
  Synthetic oligonucleotide
gctccgtctgctctcagccccgccgccccgttactga

SEQ ID NO: 171641 - DNA, 38 bp, Artificial Sequence
  Synthetic oligonucleotide
agcccgcgcatccgcggtttaactacccttgcccctga

SEQ ID NO: 171642 - DNA, 38 bp, Artificial Sequence
  Synthetic oligonucleotide
gtgaggggagaacgaacggacgaccgggaatgaagtga

SEQ ID NO: 171643 - DNA, 38 bp, Artificial Sequence
  Synthetic oligonucleotide
aatggggaacgggtagtagggaagaagggtttgggtga

SEQ ID NO: 171644 - DNA, 38 bp, Artificial Sequence
  Synthetic oligonucleotide
gtacgaggagaggtaaggcataggagggggacttgtga

SEQ ID NO: 171645 - DNA, 38 bp, Artificial Sequence
  Synthetic oligonucleotide
tcagtaccgccggccgccgcatttgacttgcccattga

SEQ ID NO: 171646 - DNA, 38 bp, Artificial Sequence
  Synthetic oligonucleotide
gacgtctgtcctttgtctttcaccgcgcttcaccttga

SEQ ID NO: 171647 - DNA, 36 bp, Artificial Sequence
  Synthetic oligonucleotide
gaccaccgcctcccgatcttcgatacgttttcttga

SEQ ID NO: 171648 - DNA, 38 bp, Artificial Sequence
  Synthetic oligonucleotide
ggaaggtaagtcgggaggagggaggagggaaacgttga

SEQ ID NO: 171649 - DNA, 38 bp, Artificial Sequence
  Synthetic oligonucleotide
gagacctccgctcctgcttgcccaacattgccatttga

SEQ ID NO: 171650 - DNA, 36 bp, Artificial Sequence
  Synthetic oligonucleotide
acgatccggaggaggggagggctaggagacgtttga

SEQ ID NO: 171651 - DNA, 36 bp, Artificial Sequence
  Synthetic oligonucleotide
gttgcgggtgggggggccgaagtacagcgggacata

SEQ ID NO: 171652 - DNA, 35 bp, Artificial Sequence
  Synthetic oligonucleotide
attgatgtacgtcgccgccccgttgttacccgcta

SEQ ID NO: 171653 - DNA, 36 bp, Artificial Sequence
  Synthetic oligonucleotide
atagccgtcacccctggtcaaatcttccatgttcta

SEQ ID NO: 171654 - DNA, 36 bp, Artificial Sequence
  Synthetic oligonucleotide
gtcactcgtccaaaattggcgtctcccttccccgta

SEQ ID NO: 171655 - DNA, 34 bp, Artificial Sequence
  Synthetic oligonucleotide
tctccgcccgccccctcggttactgacactgaac

SEQ ID NO: 171656 - DNA, 35 bp, Artificial Sequence
  Synthetic oligonucleotide
ttccccgcccgcactgtaattgccatcattcgcac

SEQ ID NO: 171657 - DNA, 35 bp, Artificial Sequence
  Synthetic oligonucleotide
gatgacttccacaatgtgtatcgtccctttgtcac

SEQ ID NO: 171658 - DNA, 35 bp, Artificial Sequence
  Synthetic oligonucleotide
tacccgatcctctttagtacatagtcactgttcac

SEQ ID NO: 171659 - DNA, 35 bp, Artificial Sequence
  Synthetic oligonucleotide
tagggcgggtgggtgtagtgtgtcggttgggctac

SEQ ID NO: 171660 - DNA, 35 bp, Artificial Sequence
  Synthetic oligonucleotide
acctatgtcgccacatctggcattttccgtattac

SEQ ID NO: 171661 - DNA, 35 bp, Artificial Sequence
  Synthetic oligonucleotide
gtcggggcattcttaccgctctacatgttcgtacc

SEQ ID NO: 171662 - DNA, 35 bp, Artificial Sequence
  Synthetic oligonucleotide
tgccacgtacccggcccagcccgtcgtaaacaccc

SEQ ID NO: 171663 - DNA, 35 bp, Artificial Sequence
  Synthetic oligonucleotide
ttggatcgtggtcagacgtactcccccccctcccc

SEQ ID NO: 171664 - DNA, 35 bp, Artificial Sequence
  Synthetic oligonucleotide
atctgtcaggcactgttcataccacccatgctccc

SEQ ID NO: 171665 - DNA, 35 bp, Artificial Sequence
  Synthetic oligonucleotide
ttgtcaccgcctcggtggtcacccgaatttgtccc

SEQ ID NO: 171666 - DNA, 35 bp, Artificial Sequence
  Synthetic oligonucleotide
gtgttcaacccgtagcgcttctccgcacttttgcc

SEQ ID NO: 171667 - DNA, 35 bp, Artificial Sequence
  Synthetic oligonucleotide
gctgagcaccatatctgctccgatatcacacatcc

SEQ ID NO: 171668 - DNA, 35 bp, Artificial Sequence
  Synthetic oligonucleotide
ggacttccctccctgtcttaacctgggaaccatcc

SEQ ID NO: 171669 - DNA, 35 bp, Artificial Sequence
  Synthetic oligonucleotide
tgtaggccctagggtccttagctctcctgttctcc

SEQ ID NO: 171670 - DNA, 35 bp, Artificial Sequence
  Synthetic oligonucleotide
gtcccgccattcggttccaggattctaccccttcc

SEQ ID NO: 171671 - DNA, 35 bp, Artificial Sequence
  Synthetic oligonucleotide
acgcaaaggactctccccggcgaccatgcccttcc

SEQ ID NO: 171672 - DNA, 35 bp, Artificial Sequence
  Synthetic oligonucleotide
tgctacccagtgcgtgtgcgtttcctgttccttcc

SEQ ID NO: 171673 - DNA, 35 bp, Artificial Sequence
  Synthetic oligonucleotide
agccgacactggcacttggtttacgcactccccgc

SEQ ID NO: 171674 - DNA, 35 bp, Artificial Sequence
  Synthetic oligonucleotide
attcagctccgttgactttcccccactaacttcgc

SEQ ID NO: 171675 - DNA, 35 bp, Artificial Sequence
  Synthetic oligonucleotide
gctatgcctcccagggtccagcatccacgtttcgc

SEQ ID NO: 171676 - DNA, 35 bp, Artificial Sequence
  Synthetic oligonucleotide
gcgttccccccgtgccctttgaatatgtacttggc

SEQ ID NO: 171677 - DNA, 35 bp, Artificial Sequence
  Synthetic oligonucleotide
ttctccctcgcgctgttacgactctcctgttatgc

SEQ ID NO: 171678 - DNA, 35 bp, Artificial Sequence
  Synthetic oligonucleotide
gtttggcgaagcgccctgctttcctcctattctgc

SEQ ID NO: 171679 - DNA, 35 bp, Artificial Sequence
  Synthetic oligonucleotide
tgacataatccaaatgggggggcacgggtgggtgc

SEQ ID NO: 171680 - DNA, 35 bp, Artificial Sequence
  Synthetic oligonucleotide
tcatgtgcgccatccctaggacctgttcaccttgc

SEQ ID NO: 171681 - DNA, 35 bp, Artificial Sequence
  Synthetic oligonucleotide
tatcgccctgctgcattatcgacgctaatttcatc

SEQ ID NO: 171682 - DNA, 35 bp, Artificial Sequence
  Synthetic oligonucleotide
tgccatcatcgtgacgatgaccctaccttcttatc

SEQ ID NO: 171683 - DNA, 35 bp, Artificial Sequence
  Synthetic oligonucleotide
gagccatcgtgcagtgcctgcgtccgacacacctc

SEQ ID NO: 171684 - DNA, 35 bp, Artificial Sequence
  Synthetic oligonucleotide
ttcaccgcgctcctggattcagcatgtcatccctc

SEQ ID NO: 171685 - DNA, 35 bp, Artificial Sequence
  Synthetic oligonucleotide
gaagcgctgtctctggcgttatctcccccccgctc

SEQ ID NO: 171686 - DNA, 35 bp, Artificial Sequence
  Synthetic oligonucleotide
tgaacccatctgcttagttatcctttgaattgctc

SEQ ID NO: 171687 - DNA, 35 bp, Artificial Sequence
  Synthetic oligonucleotide
tgtgtaacgccgcggtgatttttttctgtcttgtc

SEQ ID NO: 171688 - DNA, 35 bp, Artificial Sequence
  Synthetic oligonucleotide
attccacgaagtggcctctaagccctggttaattc

SEQ ID NO: 171689 - DNA, 35 bp, Artificial Sequence
  Synthetic oligonucleotide
atcccatgccctatccactagcgtatccacggttc

SEQ ID NO: 171690 - DNA, 35 bp, Artificial Sequence
  Synthetic oligonucleotide
gtgatcgcctcccacttctttgtcttagcgtgttc

SEQ ID NO: 171691 - DNA, 35 bp, Artificial Sequence
  Synthetic oligonucleotide
ttgaagaagagggagtaaatcggagggtagaggag

SEQ ID NO: 171692 - DNA, 35 bp, Artificial Sequence
  Synthetic oligonucleotide
tgtcccatcacatcaggcatgccactccacgaccg

SEQ ID NO: 171693 - DNA, 35 bp, Artificial Sequence
  Synthetic oligonucleotide
agatccgcctcgaagtgattccttttttccccgcg

SEQ ID NO: 171694 - DNA, 35 bp, Artificial Sequence
  Synthetic oligonucleotide
gtcccccccgctttccgtttcctgtatcacccagg

SEQ ID NO: 171695 - DNA, 35 bp, Artificial Sequence
  Synthetic oligonucleotide
ttaggaaggaggggggtagggaatcagtgacaggg

SEQ ID NO: 171696 - DNA, 35 bp, Artificial Sequence
  Synthetic oligonucleotide
aaaaacggggtgggaggagggccgtgatgtgaatg

SEQ ID NO: 171697 - DNA, 35 bp, Artificial Sequence
  Synthetic oligonucleotide
tccagaagcccgcctcattctcgcctcttgccatg

SEQ ID NO: 171698 - DNA, 35 bp, Artificial Sequence
  Synthetic oligonucleotide
gtgtcttaccggcccctccgcttcgtgctcacctg

SEQ ID NO: 171699 - DNA, 35 bp, Artificial Sequence
  Synthetic oligonucleotide
acccgcgcctcctgtcactccccctgttgcgcctg

SEQ ID NO: 171700 - DNA, 35 bp, Artificial Sequence
  Synthetic oligonucleotide
gttcagccctttatcattgtacctccgcttagctg

SEQ ID NO: 171701 - DNA, 35 bp, Artificial Sequence
  Synthetic oligonucleotide
ataccgccgccctcgatcgtgtgctccccctgctg

SEQ ID NO: 171702 - DNA, 35 bp, Artificial Sequence
  Synthetic oligonucleotide
agtcccccaacacctctgtcctgtcaacccgacat

SEQ ID NO: 171703 - DNA, 35 bp, Artificial Sequence
  Synthetic oligonucleotide
gtgccccccgtcactacgtcgtccctgagccccat

SEQ ID NO: 171704 - DNA, 35 bp, Artificial Sequence
  Synthetic oligonucleotide
gacgtccctccctgtctcttgtctttctaggcgat

SEQ ID NO: 171705 - DNA, 35 bp, Artificial Sequence
  Synthetic oligonucleotide
actgaaagagggggaagagagacacaggggcggat

SEQ ID NO: 171706 - DNA, 35 bp, Artificial Sequence
  Synthetic oligonucleotide
atagcccacccctgcggtcgtttaacgatcttact

SEQ ID NO: 171707 - DNA, 35 bp, Artificial Sequence
  Synthetic oligonucleotide
tccccccgcctgcctctaaccgactctcccagcct

SEQ ID NO: 171708 - DNA, 35 bp, Artificial Sequence
  Synthetic oligonucleotide
gatgccaacaccacaggtgaatccgaaaacctcct

SEQ ID NO: 171709 - DNA, 36 bp, Artificial Sequence
  Synthetic oligonucleotide
tcatatgtccatctttgtcacgcgccgcttaccgct

SEQ ID NO: 171710 - DNA, 35 bp, Artificial Sequence
  Synthetic oligonucleotide
gtccatgcccctacccagctgatcccgcacatgct

SEQ ID NO: 171711 - DNA, 35 bp, Artificial Sequence
  Synthetic oligonucleotide
gcccggccaagacttctgtccacccccactttggt

SEQ ID NO: 171712 - DNA, 35 bp, Artificial Sequence
  Synthetic oligonucleotide
acgtgccaccgcacccttggtctctttccccctgt

SEQ ID NO: 171713 - DNA, 35 bp, Artificial Sequence
  Synthetic oligonucleotide
atgacctgctttccggacactctctatgctcctgt

SEQ ID NO: 171714 - DNA, 35 bp, Artificial Sequence
  Synthetic oligonucleotide
gcccactccccgccgcccctacaatttaggtcatt

SEQ ID NO: 171715 - DNA, 35 bp, Artificial Sequence
  Synthetic oligonucleotide
gttatctgaccgtcctgttcgctgccctatctatt

SEQ ID NO: 171716 - DNA, 34 bp, Artificial Sequence
  Synthetic oligonucleotide
aactccagcgcacctccgctaacatccgctcctt

SEQ ID NO: 171717 - DNA, 35 bp, Artificial Sequence
  Synthetic oligonucleotide
gagcgcccccccccttttgatttgccagttcggtt

SEQ ID NO: 171718 - DNA, 35 bp, Artificial Sequence
  Synthetic oligonucleotide
acctgcgcgccatctctcagcgattccactgcttt

SEQ ID NO: 171719 - DNA, 35 bp, Artificial Sequence
  Synthetic oligonucleotide
aatggggggatgggttgggatggaaagtgctcaaa

SEQ ID NO: 171720 - DNA, 35 bp, Artificial Sequence
  Synthetic oligonucleotide
tatgcggcacatttcacctgctgcctctcacacaa

SEQ ID NO: 171721 - DNA, 35 bp, Artificial Sequence
  Synthetic oligonucleotide
gagagtggggcgggggaaggcatggcgcaaaccaa

SEQ ID NO: 171722 - DNA, 35 bp, Artificial Sequence
  Synthetic oligonucleotide
tatgccccaccattgcgtccccctcacccacgcaa

SEQ ID NO: 171723 - DNA, 36 bp, Artificial Sequence
  Synthetic oligonucleotide
gagactgggagggcggggaataaaagttgcggtgaa

SEQ ID NO: 171724 - DNA, 36 bp, Artificial Sequence
  Synthetic oligonucleotide
gcatcatctatgcttacctgcccccccgttcttgaa

SEQ ID NO: 171725 - DNA, 35 bp, Artificial Sequence
  Synthetic oligonucleotide
gccggccccctcttctgtactcgtgcctgagctaa

SEQ ID NO: 171726 - DNA, 36 bp, Artificial Sequence
  Synthetic oligonucleotide
acatgtccaccccgagcctgcctttttcaccagaca

SEQ ID NO: 171727 - DNA, 35 bp, Artificial Sequence
  Synthetic oligonucleotide
tgcgatccaccttacccgtacccgtctatatgaca

SEQ ID NO: 171728 - DNA, 36 bp, Artificial Sequence
  Synthetic oligonucleotide
atccgggtcggttctcgttatccccttggccaccca

SEQ ID NO: 171729 - DNA, 35 bp, Artificial Sequence
  Synthetic oligonucleotide
gttcaccccttgtctccgtctttctcaccgtccca

SEQ ID NO: 171730 - DNA, 34 bp, Artificial Sequence
  Synthetic oligonucleotide
tttagccggcctacttaatctgttcccggtccca

SEQ ID NO: 171731 - DNA, 36 bp, Artificial Sequence
  Synthetic oligonucleotide
tccgcgctgcgttttcatcattcgttcctggctcca

SEQ ID NO: 171732 - DNA, 35 bp, Artificial Sequence
  Synthetic oligonucleotide
tacaactcccgtaattaagcacgtgcccctctcca

SEQ ID NO: 171733 - DNA, 36 bp, Artificial Sequence
  Synthetic oligonucleotide
acgcaaatgcgccctactttcagccccccgcctgca

SEQ ID NO: 171734 - DNA, 35 bp, Artificial Sequence
  Synthetic oligonucleotide
ggttacagcctcattcacgtccattcccgtctgca

SEQ ID NO: 171735 - DNA, 36 bp, Artificial Sequence
  Synthetic oligonucleotide
accaggtctgctggttcactcgcttatctgccctca

SEQ ID NO: 171736 - DNA, 35 bp, Artificial Sequence
  Synthetic oligonucleotide
gccctttgcccccccgtatgactcacacgacgtca

SEQ ID NO: 171737 - DNA, 36 bp, Artificial Sequence
  Synthetic oligonucleotide
tagcccccctccgtttcagtattgtacgcgctgtca

SEQ ID NO: 171738 - DNA, 32 bp, Artificial Sequence
  Synthetic oligonucleotide
ctcatgcctgtatcctaccacccatcctttca

SEQ ID NO: 171739 - DNA, 37 bp, Artificial Sequence
  Synthetic oligonucleotide
gagtggttggaggaggagtgggtgggtgggtgtaaga

SEQ ID NO: 171740 - DNA, 37 bp, Artificial Sequence
  Synthetic oligonucleotide
tgctccgttccgccccccctgttgtacacagttaaga

SEQ ID NO: 171741 - DNA, 37 bp, Artificial Sequence
  Synthetic oligonucleotide
tgggctgggtgtggtggggccggagaggaggcgcaga

SEQ ID NO: 171742 - DNA, 37 bp, Artificial Sequence
  Synthetic oligonucleotide
tttcacctccgtttgctactgacgtctcgtactccga

SEQ ID NO: 171743 - DNA, 37 bp, Artificial Sequence
  Synthetic oligonucleotide
acaccaactcacggacttgtaacgcgaactcctccga

SEQ ID NO: 171744 - DNA, 37 bp, Artificial Sequence
  Synthetic oligonucleotide
tcaccgtcttactttcctgcgccacctgccggtccga

SEQ ID NO: 171745 - DNA, 35 bp, Artificial Sequence
  Synthetic oligonucleotide
tgtgtccctccgatccccctctttcatggttgcga

SEQ ID NO: 171746 - DNA, 37 bp, Artificial Sequence
  Synthetic oligonucleotide
acaaatgggatggggggtgaagggaagacgtactcga

SEQ ID NO: 171747 - DNA, 35 bp, Artificial Sequence
  Synthetic oligonucleotide
gacactcggtaggtccctgcttttccctgcctcga

SEQ ID NO: 171748 - DNA, 37 bp, Artificial Sequence
  Synthetic oligonucleotide
aaaggggaagggcaagaaagcagagatagtggacgga

SEQ ID NO: 171749 - DNA, 37 bp, Artificial Sequence
  Synthetic oligonucleotide
gaagaagaggatgaaggagggtagagggagacccgga

SEQ ID NO: 171750 - DNA, 37 bp, Artificial Sequence
  Synthetic oligonucleotide
gtcgatgcgggggtgaagttgggggacaagggaggga

SEQ ID NO: 171751 - DNA, 37 bp, Artificial Sequence
  Synthetic oligonucleotide
gatggctcggtagtgatggagagagaggagggaggga

SEQ ID NO: 171752 - DNA, 37 bp, Artificial Sequence
  Synthetic oligonucleotide
gctggggtttccggggtattaggggtaagtctgggga

SEQ ID NO: 171753 - DNA, 37 bp, Artificial Sequence
  Synthetic oligonucleotide
atcgcgacgttcctacgccccacacgctcttacatga

SEQ ID NO: 171754 - DNA, 37 bp, Artificial Sequence
  Synthetic oligonucleotide
cactccctccgactcgccgttgatacgcccttcatga

SEQ ID NO: 171755 - DNA, 38 bp, Artificial Sequence
  Synthetic oligonucleotide
gtttgccaatgaaccctgtcccaccacctccctgatga

SEQ ID NO: 171756 - DNA, 37 bp, Artificial Sequence
  Synthetic oligonucleotide
tcaagcaagtctgtccgtctctccgccgcccgtatga

SEQ ID NO: 171757 - DNA, 36 bp, Artificial Sequence
  Synthetic oligonucleotide
gatccctgtccccgtgatctttaccgttccttatga

SEQ ID NO: 171758 - DNA, 37 bp, Artificial Sequence
  Synthetic oligonucleotide
tagatcaccggcattctgcaacccctcactgacctga

SEQ ID NO: 171759 - DNA, 37 bp, Artificial Sequence
  Synthetic oligonucleotide
tgagcccccccttctgggcactgccatcctatcctga

SEQ ID NO: 171760 - DNA, 38 bp, Artificial Sequence
  Synthetic oligonucleotide
gcccctccccatccttgtccgcacgtacttgagcgtga

SEQ ID NO: 171761 - DNA, 38 bp, Artificial Sequence
  Synthetic oligonucleotide
tgtgtgtcggtcgcctttccccacgtctcctttcgtga

SEQ ID NO: 171762 - DNA, 37 bp, Artificial Sequence
  Synthetic oligonucleotide
accctgcaacacacccgttattttactgcccttgtga

SEQ ID NO: 171763 - DNA, 37 bp, Artificial Sequence
  Synthetic oligonucleotide
acgacacgccgagcttcccgtgtgtctactcaattga

SEQ ID NO: 171764 - DNA, 35 bp, Artificial Sequence
  Synthetic oligonucleotide
gctttgcctcgcccccaccggataccgcaccttga

SEQ ID NO: 171765 - DNA, 37 bp, Artificial Sequence
  Synthetic oligonucleotide
gcgcccgcaccgttgcttcctcgctttagatccttga

SEQ ID NO: 171766 - DNA, 37 bp, Artificial Sequence
  Synthetic oligonucleotide
tactgccccttctctagctgccctacgaagtccttga

SEQ ID NO: 171767 - DNA, 38 bp, Artificial Sequence
  Synthetic oligonucleotide
accgcaaacgtcctagcccctccgccagctctgtttga

SEQ ID NO: 171768 - DNA, 38 bp, Artificial Sequence
  Synthetic oligonucleotide
ttaccatcccgctttgttacaagccgtgcctcttttga

SEQ ID NO: 171769 - DNA, 36 bp, Artificial Sequence
  Synthetic oligonucleotide
tgcactccatgccaccgtgttttttcggcctcaata

SEQ ID NO: 171770 - DNA, 35 bp, Artificial Sequence
  Synthetic oligonucleotide
gacgttgtgacgctctcccgttgccccaatacata

SEQ ID NO: 171771 - DNA, 35 bp, Artificial Sequence
  Synthetic oligonucleotide
tgcactccacaacgttatccctcaccgcttctcta

SEQ ID NO: 171772 - DNA, 36 bp, Artificial Sequence
  Synthetic oligonucleotide
tatcccacgcaaattgcccagccaccctctccagta

SEQ ID NO: 171773 - DNA, 36 bp, Artificial Sequence
  Synthetic oligonucleotide
ggatgtggggaagggggtattatgaggggaattgta

SEQ ID NO: 171774 - DNA, 35 bp, Artificial Sequence
  Synthetic oligonucleotide
atgcgccggtctgcaattacttatgcccctaccac

SEQ ID NO: 171775 - DNA, 35 bp, Artificial Sequence
  Synthetic oligonucleotide
ttccgacgtcgtcatcctcacgctcatccacccac

SEQ ID NO: 171776 - DNA, 35 bp, Artificial Sequence
  Synthetic oligonucleotide
agacgtacaggctgtacgttctcatcctcttccac

SEQ ID NO: 171777 - DNA, 35 bp, Artificial Sequence
  Synthetic oligonucleotide
acctacaactcccgccggttcacggttcctgaacc

SEQ ID NO: 171778 - DNA, 35 bp, Artificial Sequence
  Synthetic oligonucleotide
gcgagtgctgcggaacattgcctctcttttctacc

SEQ ID NO: 171779 - DNA, 35 bp, Artificial Sequence
  Synthetic oligonucleotide
tccaactgctgttgtagtcttatctttggcgtacc

SEQ ID NO: 171780 - DNA, 35 bp, Artificial Sequence
  Synthetic oligonucleotide
tttgaccaggcgccaagttcctattccgcgtaccc

SEQ ID NO: 171781 - DNA, 35 bp, Artificial Sequence
  Synthetic oligonucleotide
gttggtcgtaagtaggaagtcattcgcctcccccc

SEQ ID NO: 171782 - DNA, 35 bp, Artificial Sequence
  Synthetic oligonucleotide
tgccgaccgcagcttgttttatgtacgcccgcccc

SEQ ID NO: 171783 - DNA, 35 bp, Artificial Sequence
  Synthetic oligonucleotide
tcctctgtcccagcgccaccccatttcttcggccc

SEQ ID NO: 171784 - DNA, 34 bp, Artificial Sequence
  Synthetic oligonucleotide
tgtccgtccgcctttccatgactcttacttgccc

SEQ ID NO: 171785 - DNA, 35 bp, Artificial Sequence
  Synthetic oligonucleotide
ttacgctcccccatcgcgtctatggcttttcagcc

SEQ ID NO: 171786 - DNA, 35 bp, Artificial Sequence
  Synthetic oligonucleotide
acgcattacacacagttctgaaaccccgccacgcc

SEQ ID NO: 171787 - DNA, 35 bp, Artificial Sequence
  Synthetic oligonucleotide
gatgtatcgttaggtccgcgccctactgcctgtcc

SEQ ID NO: 171788 - DNA, 35 bp, Artificial Sequence
  Synthetic oligonucleotide
tatgactgcgcggagtactcctgcacccgtcttcc

SEQ ID NO: 171789 - DNA, 35 bp, Artificial Sequence
  Synthetic oligonucleotide
actctgtgcaggccatgtctactccgccgtgttcc

SEQ ID NO: 171790 - DNA, 35 bp, Artificial Sequence
  Synthetic oligonucleotide
tccaacttggctgcctcatcgcctctgctcgtagc

SEQ ID NO: 171791 - DNA, 35 bp, Artificial Sequence
  Synthetic oligonucleotide
taccctgccctgtggtaaagcccctccctgtccgc

SEQ ID NO: 171792 - DNA, 35 bp, Artificial Sequence
  Synthetic oligonucleotide
tattgccacttcctgcgttgtttaataccacctgc

SEQ ID NO: 171793 - DNA, 35 bp, Artificial Sequence
  Synthetic oligonucleotide
tatggcttccgacctctgacactgtcaactcctgc

SEQ ID NO: 171794 - DNA, 35 bp, Artificial Sequence
  Synthetic oligonucleotide
tgtgccgaaagcttgactttgacttcctcctctgc

SEQ ID NO: 171795 - DNA, 35 bp, Artificial Sequence
  Synthetic oligonucleotide
tatctacgccaggtctctgacaccaccagtccatc

SEQ ID NO: 171796 - DNA, 35 bp, Artificial Sequence
  Synthetic oligonucleotide
gatgaagcgaacatctctctgccgaccgtcctatc

SEQ ID NO: 171797 - DNA, 35 bp, Artificial Sequence
  Synthetic oligonucleotide
tcacgtctaagctccaccgcgcatttcacgctatc

SEQ ID NO: 171798 - DNA, 35 bp, Artificial Sequence
  Synthetic oligonucleotide
gtcgtgctcgtaacccagtgtgccgcccccgcctc

SEQ ID NO: 171799 - DNA, 35 bp, Artificial Sequence
  Synthetic oligonucleotide
gaaggggggttcgggtggggtgaggggacagagtc

SEQ ID NO: 171800 - DNA, 35 bp, Artificial Sequence
  Synthetic oligonucleotide
gagtgttggccccaccccgtcgtttccctatcgtc

SEQ ID NO: 171801 - DNA, 35 bp, Artificial Sequence
  Synthetic oligonucleotide
gtgcccctgtcccacggatctttcgctggcctgtc

SEQ ID NO: 171802 - DNA, 35 bp, Artificial Sequence
  Synthetic oligonucleotide
ttccacgcgtaggtgagagggagggtggggttgtc

SEQ ID NO: 171803 - DNA, 35 bp, Artificial Sequence
  Synthetic oligonucleotide
gtggttcagtccgatcccgcttacgcccagccttc

SEQ ID NO: 171804 - DNA, 35 bp, Artificial Sequence
  Synthetic oligonucleotide
agagtcctgcccactgtcgtccatccgccacgttc

SEQ ID NO: 171805 - DNA, 35 bp, Artificial Sequence
  Synthetic oligonucleotide
ccctgaccttcaactgccaaccatcccgctttcag

SEQ ID NO: 171806 - DNA, 35 bp, Artificial Sequence
  Synthetic oligonucleotide
tggggaggcgatagagaatgagggtgggacgggag

SEQ ID NO: 171807 - DNA, 35 bp, Artificial Sequence
  Synthetic oligonucleotide
gtagctcggctccatggttctctttcacatcaccg

SEQ ID NO: 171808 - DNA, 35 bp, Artificial Sequence
  Synthetic oligonucleotide
acgcgtccggttcacgcttagccccattcgccccg

SEQ ID NO: 171809 - DNA, 35 bp, Artificial Sequence
  Synthetic oligonucleotide
cattcgttcccagtgtcactatattcgaatccccg

SEQ ID NO: 171810 - DNA, 35 bp, Artificial Sequence
  Synthetic oligonucleotide
actgcagggtcctgtgccccgccccgaattgcccg

SEQ ID NO: 171811 - DNA, 35 bp, Artificial Sequence
  Synthetic oligonucleotide
tcatcctttcccctgtcccgcacatgccgatcccg

SEQ ID NO: 171812 - DNA, 35 bp, Artificial Sequence
  Synthetic oligonucleotide
atcgtcacatccttttaggtccatctacatctccg

SEQ ID NO: 171813 - DNA, 35 bp, Artificial Sequence
  Synthetic oligonucleotide
gcgcgcggcatgccctcgttgccctatcctgtccg

SEQ ID NO: 171814 - DNA, 35 bp, Artificial Sequence
  Synthetic oligonucleotide
gtctgccactggtgcgcaagtgccctcctatatcg

SEQ ID NO: 171815 - DNA, 35 bp, Artificial Sequence
  Synthetic oligonucleotide
gccacccgacgcctcgagttcgtaatctctcctcg

SEQ ID NO: 171816 - DNA, 35 bp, Artificial Sequence
  Synthetic oligonucleotide
aagaggaggcggggaggacgtagggcacattgagg

SEQ ID NO: 171817 - DNA, 35 bp, Artificial Sequence
  Synthetic oligonucleotide
aggagagaagagaggggcggcaaacaggggcgggg

SEQ ID NO: 171818 - DNA, 35 bp, Artificial Sequence
  Synthetic oligonucleotide
tcagcatctacctgctcactttctcactcccatgg

SEQ ID NO: 171819 - DNA, 35 bp, Artificial Sequence
  Synthetic oligonucleotide
gatcgacctacgtgttttgttccatttgccttatg

SEQ ID NO: 171820 - DNA, 35 bp, Artificial Sequence
  Synthetic oligonucleotide
gagcggtatgtcgctcgttccccactttttcactg

SEQ ID NO: 171821 - DNA, 35 bp, Artificial Sequence
  Synthetic oligonucleotide
gtcccttcgccttcgccttatccccacattgagtg

SEQ ID NO: 171822 - DNA, 35 bp, Artificial Sequence
  Synthetic oligonucleotide
gtgcgaagtctagtcttgcatttttcccgcccttg

SEQ ID NO: 171823 - DNA, 35 bp, Artificial Sequence
  Synthetic oligonucleotide
ttgtgcaacggcggggaaacaagggagggaatttg

SEQ ID NO: 171824 - DNA, 34 bp, Artificial Sequence
  Synthetic oligonucleotide
tgttgcgatgtttgcttcgttcctgttttcccat

SEQ ID NO: 171825 - DNA, 35 bp, Artificial Sequence
  Synthetic oligonucleotide
ccataacgacgtcgttcccagccaacacctgccat

SEQ ID NO: 171826 - DNA, 35 bp, Artificial Sequence
  Synthetic oligonucleotide
tagctttgccaccactcgtcctcctggttgactat

SEQ ID NO: 171827 - DNA, 35 bp, Artificial Sequence
  Synthetic oligonucleotide
tctgcacccgccgccatcccgttcaactcgattat

SEQ ID NO: 171828 - DNA, 35 bp, Artificial Sequence
  Synthetic oligonucleotide
acacgtccatttgcggtcccagttccaccccccct

SEQ ID NO: 171829 - DNA, 35 bp, Artificial Sequence
  Synthetic oligonucleotide
gtcgccccccggcgcagaccgaaactctcttgcct

SEQ ID NO: 171830 - DNA, 35 bp, Artificial Sequence
  Synthetic oligonucleotide
tcacccccggtccgggcctgcgttcgcccgccgct

SEQ ID NO: 171831 - DNA, 35 bp, Artificial Sequence
  Synthetic oligonucleotide
gcgcactgtccagcttacattcgaccgttgcttct

SEQ ID NO: 171832 - DNA, 35 bp, Artificial Sequence
  Synthetic oligonucleotide
gcacgtccagctgcttattagctcccttttgttct

SEQ ID NO: 171833 - DNA, 35 bp, Artificial Sequence
  Synthetic oligonucleotide
actgccaccctgctgcattctacgcaattgcgtgt

SEQ ID NO: 171834 - DNA, 35 bp, Artificial Sequence
  Synthetic oligonucleotide
gcccccgcgccccattagtaccgctcccgtggatt

SEQ ID NO: 171835 - DNA, 35 bp, Artificial Sequence
  Synthetic oligonucleotide
gtgctttccggtcgcctcctgtcccgtatcctatt

SEQ ID NO: 171836 - DNA, 34 bp, Artificial Sequence
  Synthetic oligonucleotide
acctcgtccaaaccccgtctaccaagcttccctt

SEQ ID NO: 171837 - DNA, 35 bp, Artificial Sequence
  Synthetic oligonucleotide
agccacgccgccgatccatgtgtcctcgcttgctt

SEQ ID NO: 171838 - DNA, 35 bp, Artificial Sequence
  Synthetic oligonucleotide
gtctgccagccgctccactaccatttctactcgtt

SEQ ID NO: 171839 - DNA, 35 bp, Artificial Sequence
  Synthetic oligonucleotide
gtagcggagccgctgctttttcatccctgtctgtt

SEQ ID NO: 171840 - DNA, 36 bp, Artificial Sequence
  Synthetic oligonucleotide
tgcccgccccccccgattgctcaagtccaatgaaaa

SEQ ID NO: 171841 - DNA, 35 bp, Artificial Sequence
  Synthetic oligonucleotide
gtcaccccgtccgatccgtacgcccacctcatcaa

SEQ ID NO: 171842 - DNA, 36 bp, Artificial Sequence
  Synthetic oligonucleotide
ttgccaacctccttcgcatgctcacgggccacctaa

SEQ ID NO: 171843 - DNA, 36 bp, Artificial Sequence
  Synthetic oligonucleotide
gtgctcgccgcccctgcctccccggtccattggtaa

SEQ ID NO: 171844 - DNA, 36 bp, Artificial Sequence
  Synthetic oligonucleotide
gcccacaggctgagcgcaccttgcacaccttcttaa

SEQ ID NO: 171845 - DNA, 36 bp, Artificial Sequence
  Synthetic oligonucleotide
gcacccagcccaccacccgtttcggcaatacgtaca

SEQ ID NO: 171846 - DNA, 35 bp, Artificial Sequence
  Synthetic oligonucleotide
acacgtcggacacttctgtcttttatggcccacca

SEQ ID NO: 171847 - DNA, 36 bp, Artificial Sequence
  Synthetic oligonucleotide
tacgtgaaccgcccccgactctgaagcaggccccca

SEQ ID NO: 171848 - DNA, 36 bp, Artificial Sequence
  Synthetic oligonucleotide
agttcgaccgactccacctgctggcgctctccccca

SEQ ID NO: 171849 - DNA, 36 bp, Artificial Sequence
  Synthetic oligonucleotide
cccaatctcgcccgcccgttaatccactgtgcccca

SEQ ID NO: 171850 - DNA, 35 bp, Artificial Sequence
  Synthetic oligonucleotide
gcgcggcattctcgtctcgttcaggctctcctcca

SEQ ID NO: 171851 - DNA, 36 bp, Artificial Sequence
  Synthetic oligonucleotide
atcccaccctctgacctgtcgctccagttacttcca

SEQ ID NO: 171852 - DNA, 35 bp, Artificial Sequence
  Synthetic oligonucleotide
tcatcacccttgcccccgtaattattcaggacgca

SEQ ID NO: 171853 - DNA, 36 bp, Artificial Sequence
  Synthetic oligonucleotide
gaccaccaccttccgatggttattgaaccgagggca

SEQ ID NO: 171854 - DNA, 35 bp, Artificial Sequence
  Synthetic oligonucleotide
acttctcgctctcgaccttgccctcggacggttca

SEQ ID NO: 171855 - DNA, 36 bp, Artificial Sequence
  Synthetic oligonucleotide
ggtatgggtaaatctggaaaagggtggggcggaaga

SEQ ID NO: 171856 - DNA, 35 bp, Artificial Sequence
  Synthetic oligonucleotide
acattgcggacgaggttatgggtaggggggggaga

SEQ ID NO: 171857 - DNA, 37 bp, Artificial Sequence
  Synthetic oligonucleotide
cattcaccccgctccatcactgctcgacgtctctaga

SEQ ID NO: 171858 - DNA, 36 bp, Artificial Sequence
  Synthetic oligonucleotide
ggtcaccgcagctgcacgccacctattcttttccga

SEQ ID NO: 171859 - DNA, 36 bp, Artificial Sequence
  Synthetic oligonucleotide
aaccctgcccgccacagagcgtatcttcccccgcga

SEQ ID NO: 171860 - DNA, 37 bp, Artificial Sequence
  Synthetic oligonucleotide
tcgcccatgccatcgtgacctggcccctcattatcga

SEQ ID NO: 171861 - DNA, 37 bp, Artificial Sequence
  Synthetic oligonucleotide
gcttactcactgctgctgatatattcacccctctcga

SEQ ID NO: 171862 - DNA, 37 bp, Artificial Sequence
  Synthetic oligonucleotide
acgcattgatcctgcccttcgccccagtccttcagga

SEQ ID NO: 171863 - DNA, 37 bp, Artificial Sequence
  Synthetic oligonucleotide
accccccgcggcccaccagctagctatacatcccgga

SEQ ID NO: 171864 - DNA, 37 bp, Artificial Sequence
  Synthetic oligonucleotide
acatcagggggccggtcgggttggaggggggtaggga

SEQ ID NO: 171865 - DNA, 37 bp, Artificial Sequence
  Synthetic oligonucleotide
tactgggggggggtaggggtatgagaggccttgggga

SEQ ID NO: 171866 - DNA, 35 bp, Artificial Sequence
  Synthetic oligonucleotide
gagaagggtcaagggaaaggctaaatggaatggga

SEQ ID NO: 171867 - DNA, 37 bp, Artificial Sequence
  Synthetic oligonucleotide
gcccacacctccccccgacacatggcttcagcatgga

SEQ ID NO: 171868 - DNA, 37 bp, Artificial Sequence
  Synthetic oligonucleotide
tggacatagccatcgcctttccacctgcccttatgga

SEQ ID NO: 171869 - DNA, 37 bp, Artificial Sequence
  Synthetic oligonucleotide
taaggtggaggcggggttgtacggacagcatggtgga

SEQ ID NO: 171870 - DNA, 38 bp, Artificial Sequence
  Synthetic oligonucleotide
gaagcaaaggggcagggggggcacagctagagccatga

SEQ ID NO: 171871 - DNA, 38 bp, Artificial Sequence
  Synthetic oligonucleotide
tcctcccgtcgaacttttttagcccctcaccctactga

SEQ ID NO: 171872 - DNA, 38 bp, Artificial Sequence
  Synthetic oligonucleotide
aaccctgccccacattggaccttccctagttcccctga

SEQ ID NO: 171873 - DNA, 38 bp, Artificial Sequence
  Synthetic oligonucleotide
tcttgctaacctcgtggcctcggtctctccttccctga

SEQ ID NO: 171874 - DNA, 38 bp, Artificial Sequence
  Synthetic oligonucleotide
gaccgtgcggaatgcgtacctccccctgtcttgcctga

SEQ ID NO: 171875 - DNA, 38 bp, Artificial Sequence
  Synthetic oligonucleotide
ggaaagcgcgggcggatggggagcgggtggggcagtga

SEQ ID NO: 171876 - DNA, 37 bp, Artificial Sequence
  Synthetic oligonucleotide
ggtggaggagggtaaggtgatgcatcgggggaggtga

SEQ ID NO: 171877 - DNA, 38 bp, Artificial Sequence
  Synthetic oligonucleotide
acgtgcctacgcacctctgcatgccgtgccatccttga

SEQ ID NO: 171878 - DNA, 38 bp, Artificial Sequence
  Synthetic oligonucleotide
aacgacgtcctccgtgacctcctctatccgttccttga

SEQ ID NO: 171879 - DNA, 38 bp, Artificial Sequence
  Synthetic oligonucleotide
cacccgcgcccgagcccccagcgtgccagtacagttga

SEQ ID NO: 171880 - DNA, 35 bp, Artificial Sequence
  Synthetic oligonucleotide
gtacacacgtgagctccgtcccttcacgatccata

SEQ ID NO: 171881 - DNA, 36 bp, Artificial Sequence
  Synthetic oligonucleotide
gaacccccagacttttgccacgaccgccatgtccta

SEQ ID NO: 171882 - DNA, 35 bp, Artificial Sequence
  Synthetic oligonucleotide
tatcacatgtccactatctgtcatcccacccggta

SEQ ID NO: 171883 - DNA, 35 bp, Artificial Sequence
  Synthetic oligonucleotide
tagagaaggagggaggtggggaacgtccagtggta

SEQ ID NO: 171884 - DNA, 35 bp, Artificial Sequence
  Synthetic oligonucleotide
gggaggggaaaaacggtgggagcaagggggcatta

SEQ ID NO: 171885 - DNA, 36 bp, Artificial Sequence
  Synthetic oligonucleotide
actgcatacactccatgccgttactttagcctgtta

SEQ ID NO: 171886 - DNA, 35 bp, Artificial Sequence
  Synthetic oligonucleotide
tcaaccgccgcatgcgcagccttctccccgtcaac

SEQ ID NO: 171887 - DNA, 35 bp, Artificial Sequence
  Synthetic oligonucleotide
agcaccacgccccacgccgcactatgagactttac

SEQ ID NO: 171888 - DNA, 35 bp, Artificial Sequence
  Synthetic oligonucleotide
tgtgcctcggttcagtctgctttttcttttccacc

SEQ ID NO: 171889 - DNA, 35 bp, Artificial Sequence
  Synthetic oligonucleotide
tcatgtcgcgccggctctctctgcgtgcacttacc

SEQ ID NO: 171890 - DNA, 35 bp, Artificial Sequence
  Synthetic oligonucleotide
gctctcgtacgtgtcgtcccccttcatcacgcccc

SEQ ID NO: 171891 - DNA, 35 bp, Artificial Sequence
  Synthetic oligonucleotide
aagcgcccatctttctgtgaccgtcttcatgcccc

SEQ ID NO: 171892 - DNA, 35 bp, Artificial Sequence
  Synthetic oligonucleotide
ttcgagtccgtccctctgagttccgccgccccgcc

SEQ ID NO: 171893 - DNA, 35 bp, Artificial Sequence
  Synthetic oligonucleotide
tgcggtccgtcattgcgcatgcacattttctcgcc

SEQ ID NO: 171894 - DNA, 34 bp, Artificial Sequence
  Synthetic oligonucleotide
tcactacgctccctctgaggctccaccgcctgcc

SEQ ID NO: 171895 - DNA, 35 bp, Artificial Sequence
  Synthetic oligonucleotide
ttaagcgacaaagccgcataccaccgctatcctcc

SEQ ID NO: 171896 - DNA, 35 bp, Artificial Sequence
  Synthetic oligonucleotide
catcttcagcctccatttcagcacttcgcatgtcc

SEQ ID NO: 171897 - DNA, 35 bp, Artificial Sequence
  Synthetic oligonucleotide
tgtggcgcaatactctctgcttcttgacgttgtcc

SEQ ID NO: 171898 - DNA, 35 bp, Artificial Sequence
  Synthetic oligonucleotide
aacttcgcttacacatgtccatagttcgatcttcc

SEQ ID NO: 171899 - DNA, 35 bp, Artificial Sequence
  Synthetic oligonucleotide
acaccttccctgtcccgacttccaaccggatcagc

SEQ ID NO: 171900 - DNA, 35 bp, Artificial Sequence
  Synthetic oligonucleotide
atcagctcgccgaccttacattcgctccataccgc

SEQ ID NO: 171901 - DNA, 35 bp, Artificial Sequence
  Synthetic oligonucleotide
tagagcaaagccccccgcacgttcatctcagccgc

SEQ ID NO: 171902 - DNA, 35 bp, Artificial Sequence
  Synthetic oligonucleotide
gtccccccaaatgtgccgatccacccttaccgtgc

SEQ ID NO: 171903 - DNA, 35 bp, Artificial Sequence
  Synthetic oligonucleotide
gtacctgccgggcgtgtcacttcgttttacacctc

SEQ ID NO: 171904 - DNA, 35 bp, Artificial Sequence
  Synthetic oligonucleotide
agtgccagtacattgctcgccgtatgctgcccctc

SEQ ID NO: 171905 - DNA, 35 bp, Artificial Sequence
  Synthetic oligonucleotide
atcgccatggcgtaacctcctgttttcctctcctc

SEQ ID NO: 171906 - DNA, 35 bp, Artificial Sequence
  Synthetic oligonucleotide
tgcctgtccccgccggtggccttttcgtgttcctc

SEQ ID NO: 171907 - DNA, 35 bp, Artificial Sequence
  Synthetic oligonucleotide
gatgcccaccccactctgtgctaggaggtttgctc

SEQ ID NO: 171908 - DNA, 35 bp, Artificial Sequence
  Synthetic oligonucleotide
ttgtgccccccgcctttcttcagtgcattcttcag

SEQ ID NO: 171909 - DNA, 35 bp, Artificial Sequence
  Synthetic oligonucleotide
acacgcctcacaccttacactgcattttcctcccg

SEQ ID NO: 171910 - DNA, 35 bp, Artificial Sequence
  Synthetic oligonucleotide
ggacaggacggggcggtggtgacgcagtgagagcg

SEQ ID NO: 171911 - DNA, 35 bp, Artificial Sequence
  Synthetic oligonucleotide
gtcacaagccccgcccgctcgcctcctggtatgcg

SEQ ID NO: 171912 - DNA, 35 bp, Artificial Sequence
  Synthetic oligonucleotide
ttcgcggctcattgatcccaccgttttccgctgcg

SEQ ID NO: 171913 - DNA, 36 bp, Artificial Sequence
  Synthetic oligonucleotide
gttgaagcatccggttatccaccacctctttctgcg

SEQ ID NO: 171914 - DNA, 35 bp, Artificial Sequence
  Synthetic oligonucleotide
tccactgggtgggctatcgggtagggtgtcactcg

SEQ ID NO: 171915 - DNA, 35 bp, Artificial Sequence
  Synthetic oligonucleotide
gtctcagcaggcgtggcgtgtgggggggagggtcg

SEQ ID NO: 171916 - DNA, 33 bp, Artificial Sequence
  Synthetic oligonucleotide
tccccccctccgctcgttttgtacgcacattcg

SEQ ID NO: 171917 - DNA, 35 bp, Artificial Sequence
  Synthetic oligonucleotide
gaaagaaggcaatttgaaggaccatgggggaaggg

SEQ ID NO: 171918 - DNA, 35 bp, Artificial Sequence
  Synthetic oligonucleotide
gtaaatgttcgggtgtgcaagtgaggggaaagggg

SEQ ID NO: 171919 - DNA, 35 bp, Artificial Sequence
  Synthetic oligonucleotide
tagcggagtgggaggaatggctgggagtgagcatg

SEQ ID NO: 171920 - DNA, 35 bp, Artificial Sequence
  Synthetic oligonucleotide
aaccagtgaatgagaagggtggggggaggtggatg

SEQ ID NO: 171921 - DNA, 35 bp, Artificial Sequence
  Synthetic oligonucleotide
acctcccgcccctcatagtcgtaacgtaaccactg

SEQ ID NO: 171922 - DNA, 35 bp, Artificial Sequence
  Synthetic oligonucleotide
tgagagggcgaacggggaaggaactacatcatctg

SEQ ID NO: 171923 - DNA, 35 bp, Artificial Sequence
  Synthetic oligonucleotide
actcgccactcgctaaccggtatctacattttctg

SEQ ID NO: 171924 - DNA, 35 bp, Artificial Sequence
  Synthetic oligonucleotide
tcgtacccctccaaggtcataggcctctttactat

SEQ ID NO: 171925 - DNA, 35 bp, Artificial Sequence
  Synthetic oligonucleotide
tcaccgcgggccagttgtttaccgttccaactcct

SEQ ID NO: 171926 - DNA, 35 bp, Artificial Sequence
  Synthetic oligonucleotide
tcgacatccccgtccgcgttcccgcacatggctct

SEQ ID NO: 171927 - DNA, 35 bp, Artificial Sequence
  Synthetic oligonucleotide
agccaactcaccccctgtcctcctgttccgaaagt

SEQ ID NO: 171928 - DNA, 35 bp, Artificial Sequence
  Synthetic oligonucleotide
atgtgtcagcctctttacattgcgccatccaacgt

SEQ ID NO: 171929 - DNA, 35 bp, Artificial Sequence
  Synthetic oligonucleotide
actcaccggtcgctgagccgttcgtcttttcctgt

SEQ ID NO: 171930 - DNA, 34 bp, Artificial Sequence
  Synthetic oligonucleotide
gtcgccccctccctgcattgttagatttcacctt

SEQ ID NO: 171931 - DNA, 35 bp, Artificial Sequence
  Synthetic oligonucleotide
ggtcacatccaacccccgccacatcgttcgatctt

SEQ ID NO: 171932 - DNA, 35 bp, Artificial Sequence
  Synthetic oligonucleotide
tattcatacccgtgccctcccttgccctggctgtt

SEQ ID NO: 171933 - DNA, 35 bp, Artificial Sequence
  Synthetic oligonucleotide
gacaaacgtgtcgatcctgcgcaattccctgtttt

SEQ ID NO: 171934 - DNA, 36 bp, Artificial Sequence
  Synthetic oligonucleotide
gccactcctctcgactctggtcactccgtgagacaa

SEQ ID NO: 171935 - DNA, 36 bp, Artificial Sequence
  Synthetic oligonucleotide
tcgacgggaccgcgctgtccgttttcacctctacaa

SEQ ID NO: 171936 - DNA, 36 bp, Artificial Sequence
  Synthetic oligonucleotide
agcagagtggctgggattggggaagggagggcggaa

SEQ ID NO: 171937 - DNA, 36 bp, Artificial Sequence
  Synthetic oligonucleotide
tatgacagggacacaaggcgtagggaaagggggtaa

SEQ ID NO: 171938 - DNA, 35 bp, Artificial Sequence
  Synthetic oligonucleotide
atcacccttcagctctctcgctcttgtgtcacaca

SEQ ID NO: 171939 - DNA, 36 bp, Artificial Sequence
  Synthetic oligonucleotide
gagcgtaaagcaaagggggggtagggggctgtgaca

SEQ ID NO: 171940 - DNA, 35 bp, Artificial Sequence
  Synthetic oligonucleotide
tagtaccgtctagctgctcatctctctctacacca

SEQ ID NO: 171941 - DNA, 36 bp, Artificial Sequence
  Synthetic oligonucleotide
tgtgtccatcctgctgtttttaggcccttcccacca

SEQ ID NO: 171942 - DNA, 36 bp, Artificial Sequence
  Synthetic oligonucleotide
agttcccgagccctcgcgcattgcccgcctgtacca

SEQ ID NO: 171943 - DNA, 36 bp, Artificial Sequence
  Synthetic oligonucleotide
atacgcgccaacgcctggctgacctgccccatccca

SEQ ID NO: 171944 - DNA, 35 bp, Artificial Sequence
  Synthetic oligonucleotide
tgtgcgcatcttttccccgaggtcccccctgcgca

SEQ ID NO: 171945 - DNA, 36 bp, Artificial Sequence
  Synthetic oligonucleotide
tagaagaggggaagaagcggggagacgccagcggca

SEQ ID NO: 171946 - DNA, 36 bp, Artificial Sequence
  Synthetic oligonucleotide
gtggtagccagctcttggtcctccgctcccccctca

SEQ ID NO: 171947 - DNA, 37 bp, Artificial Sequence
  Synthetic oligonucleotide
gcgatccacccatgacttgccttttctgtcctacaga

SEQ ID NO: 171948 - DNA, 37 bp, Artificial Sequence
  Synthetic oligonucleotide
tccacaaccatccacgccaactcgggcatcctgccga

SEQ ID NO: 171949 - DNA, 37 bp, Artificial Sequence
  Synthetic oligonucleotide
tcgtcacctctgccccacccacccgcgcttttcgcga

SEQ ID NO: 171950 - DNA, 37 bp, Artificial Sequence
  Synthetic oligonucleotide
ggaagtactgtggggggatatagggaaggggaggcga

SEQ ID NO: 171951 - DNA, 36 bp, Artificial Sequence
  Synthetic oligonucleotide
gagggagggcgtggaggagggaaaatgcattatcga

SEQ ID NO: 171952 - DNA, 35 bp, Artificial Sequence
  Synthetic oligonucleotide
acaccactcagggctcgcgccgtaccccacctcga

SEQ ID NO: 171953 - DNA, 37 bp, Artificial Sequence
  Synthetic oligonucleotide
tctccaccggctaacccttcgcattgcgccacctcga

SEQ ID NO: 171954 - DNA, 37 bp, Artificial Sequence
  Synthetic oligonucleotide
gcaccgcagccgtacttgactgccttccacccttcga

SEQ ID NO: 171955 - DNA, 37 bp, Artificial Sequence
  Synthetic oligonucleotide
agggacggtaaaaaatgggtgatggggcagggaggga

SEQ ID NO: 171956 - DNA, 37 bp, Artificial Sequence
  Synthetic oligonucleotide
gacgagcggggtggatagcgggcgggttaagacggga

SEQ ID NO: 171957 - DNA, 37 bp, Artificial Sequence
  Synthetic oligonucleotide
gagggcgggcagtattggaaattagatgggtggggga

SEQ ID NO: 171958 - DNA, 36 bp, Artificial Sequence
  Synthetic oligonucleotide
gagggttacgggaggtggggtagttgatgatgggga

SEQ ID NO: 171959 - DNA, 37 bp, Artificial Sequence
  Synthetic oligonucleotide
gcggggttgggggcgaaggtgaaggggaacctgggga

SEQ ID NO: 171960 - DNA, 37 bp, Artificial Sequence
  Synthetic oligonucleotide
tgtttcccatccactgtagcatcgcagtccgaatgga

SEQ ID NO: 171961 - DNA, 37 bp, Artificial Sequence
  Synthetic oligonucleotide
tccgacccgccccacgtagcttattctgtcacctgga

SEQ ID NO: 171962 - DNA, 36 bp, Artificial Sequence
  Synthetic oligonucleotide
aggggggcgggagggctcaggggtaaacacattgga

SEQ ID NO: 171963 - DNA, 36 bp, Artificial Sequence
  Synthetic oligonucleotide
acacctcccccttgagcaaatgcacggtactttgga

SEQ ID NO: 171964 - DNA, 37 bp, Artificial Sequence
  Synthetic oligonucleotide
tctgcccacctactgctgcctatgactgtactttgga

SEQ ID NO: 171965 - DNA, 38 bp, Artificial Sequence
  Synthetic oligonucleotide
acgcctcccacagctctgcttttcttcgacctttatga

SEQ ID NO: 171966 - DNA, 38 bp, Artificial Sequence
  Synthetic oligonucleotide
ttacgccctctgtatccgcgtgataacatcccccctga

SEQ ID NO: 171967 - DNA, 37 bp, Artificial Sequence
  Synthetic oligonucleotide
tgctgccactactcacgcgatctatcaccagccctga

SEQ ID NO: 171968 - DNA, 38 bp, Artificial Sequence
  Synthetic oligonucleotide
gaccccctccacatatcccgttctgcccgtttcgctga

SEQ ID NO: 171969 - DNA, 37 bp, Artificial Sequence
  Synthetic oligonucleotide
agagggtggaaaggtagaggggggatcgcaatgctga

SEQ ID NO: 171970 - DNA, 37 bp, Artificial Sequence
  Synthetic oligonucleotide
ttaccgtcccatcctacagcggcacttgcgttgctga

SEQ ID NO: 171971 - DNA, 38 bp, Artificial Sequence
  Synthetic oligonucleotide
ttcgtcatggccccgcgatcctttccatccacttctga

SEQ ID NO: 171972 - DNA, 37 bp, Artificial Sequence
  Synthetic oligonucleotide
tccccgacgccgccccagcttaactctctcacagtga

SEQ ID NO: 171973 - DNA, 38 bp, Artificial Sequence
  Synthetic oligonucleotide
gatggacttagtcagtgggaaaagggagggacgggtga

SEQ ID NO: 171974 - DNA, 38 bp, Artificial Sequence
  Synthetic oligonucleotide
aagagacgagtgtgggggagaggtagacggaggtgtga

SEQ ID NO: 171975 - DNA, 37 bp, Artificial Sequence
  Synthetic oligonucleotide
acccgtgctcacgccccactgtacttctcgatcttga

SEQ ID NO: 171976 - DNA, 38 bp, Artificial Sequence
  Synthetic oligonucleotide
ggaaagaaggggtgggcggaataaggtgaggaagttga

SEQ ID NO: 171977 - DNA, 38 bp, Artificial Sequence
  Synthetic oligonucleotide
tccgatgggcgcggtgggtgcgaagagaggggggttga

SEQ ID NO: 171978 - DNA, 37 bp, Artificial Sequence
  Synthetic oligonucleotide
atagggggggcgggtcacatatggagtagggatttga

SEQ ID NO: 171979 - DNA, 36 bp, Artificial Sequence
  Synthetic oligonucleotide
agccatccgcccttctatcgcgtacgctccacccta

SEQ ID NO: 171980 - DNA, 36 bp, Artificial Sequence
  Synthetic oligonucleotide
agtatcaccatcgcttaatgctaacgccctgttcta

SEQ ID NO: 171981 - DNA, 35 bp, Artificial Sequence
  Synthetic oligonucleotide
aaacgccacatcccatccccgagtgacccatggta

SEQ ID NO: 171982 - DNA, 36 bp, Artificial Sequence
  Synthetic oligonucleotide
gctcatcttccgctatttcgtgcctatttccctgta

SEQ ID NO: 171983 - DNA, 36 bp, Artificial Sequence
  Synthetic oligonucleotide
accatctatctgcctccgccttgttcgtgactctta

SEQ ID NO: 171984 - DNA, 36 bp, Artificial Sequence
  Synthetic oligonucleotide
ttacaccccactcgccgtctgctttagcactagtta

SEQ ID NO: 171985 - DNA, 36 bp, Artificial Sequence
  Synthetic oligonucleotide
tactcgcactgtcctatccatctacagccccggtta

SEQ ID NO: 171986 - DNA, 36 bp, Artificial Sequence
  Synthetic oligonucleotide
tgcaccctcccgcggttcgaaacgattgcctgttta

SEQ ID NO: 171987 - DNA, 35 bp, Artificial Sequence
  Synthetic oligonucleotide
gccccaccctcgccaaactcgagttcggagtttta

SEQ ID NO: 171988 - DNA, 35 bp, Artificial Sequence
  Synthetic oligonucleotide
agccacatcacttgcccacgctgcatttctctaac

SEQ ID NO: 171989 - DNA, 35 bp, Artificial Sequence
  Synthetic oligonucleotide
taacgggccccgactcttcgccaatagccacacac

SEQ ID NO: 171990 - DNA, 35 bp, Artificial Sequence
  Synthetic oligonucleotide
gcccctatgcaccctgtttccgtactgcccgacac

SEQ ID NO: 171991 - DNA, 35 bp, Artificial Sequence
  Synthetic oligonucleotide
tcgcatgccacgtccatcctgctcacgtttgtcac

SEQ ID NO: 171992 - DNA, 33 bp, Artificial Sequence
  Synthetic oligonucleotide
gcttccccccgcctccacagccgtccttgtgac

SEQ ID NO: 171993 - DNA, 35 bp, Artificial Sequence
  Synthetic oligonucleotide
gaaccacctcatctccgactatgctctcaaagtac

SEQ ID NO: 171994 - DNA, 35 bp, Artificial Sequence
  Synthetic oligonucleotide
tcagtccagtacccgcgtgctttcgttgcccttac

SEQ ID NO: 171995 - DNA, 35 bp, Artificial Sequence
  Synthetic oligonucleotide
gaccgagccttcctcagttgccgtcatgttacccc

SEQ ID NO: 171996 - DNA, 35 bp, Artificial Sequence
  Synthetic oligonucleotide
agccgaccacaacgcaaatctggacaccatgcccc

SEQ ID NO: 171997 - DNA, 35 bp, Artificial Sequence
  Synthetic oligonucleotide
acttgttgccaaagcataccgtgacctacgctccc

SEQ ID NO: 171998 - DNA, 35 bp, Artificial Sequence
  Synthetic oligonucleotide
tcgccacgtgtatgtgcatcccgctgtatcttccc

SEQ ID NO: 171999 - DNA, 35 bp, Artificial Sequence
  Synthetic oligonucleotide
tctatcggtagccaccgccacacattgtccctgcc

SEQ ID NO: 172000 - DNA, 35 bp, Artificial Sequence
  Synthetic oligonucleotide
gactccttgccctgttgcgacataataacgcatcc

SEQ ID NO: 172001 - DNA, 35 bp, Artificial Sequence
  Synthetic oligonucleotide
tgattaccctccttcttgcgatataagacccgtcc

SEQ ID NO: 172002 - DNA, 35 bp, Artificial Sequence
  Synthetic oligonucleotide
acgctgttccctgttcacgtttaaattacccttcc

SEQ ID NO: 172003 - DNA, 35 bp, Artificial Sequence
  Synthetic oligonucleotide
gcttccgcgccagcgtgcttactcgccgatcttcc

SEQ ID NO: 172004 - DNA, 35 bp, Artificial Sequence
  Synthetic oligonucleotide
accctacgtgtttgtttgtcgatccccttttttcc

SEQ ID NO: 172005 - DNA, 35 bp, Artificial Sequence
  Synthetic oligonucleotide
tgaagcgccatgtcgccccccctgtcaatgtaagc

SEQ ID NO: 172006 - DNA, 35 bp, Artificial Sequence
  Synthetic oligonucleotide
ttcgatatcggctgctgaccgtgccgtccttccgc

SEQ ID NO: 172007 - DNA, 35 bp, Artificial Sequence
  Synthetic oligonucleotide
gaacggggttccaatgagcggtgggggaggtaggc

SEQ ID NO: 172008 - DNA, 35 bp, Artificial Sequence
  Synthetic oligonucleotide
gagcacctaactttctgtactgtggctcgccctgc

SEQ ID NO: 172009 - DNA, 35 bp, Artificial Sequence
  Synthetic oligonucleotide
gctgccccgtatcctgctgcggagctcattcttgc

SEQ ID NO: 172010 - DNA, 35 bp, Artificial Sequence
  Synthetic oligonucleotide
gtggtcccactgattcctactattgttccgcgatc

SEQ ID NO: 172011 - DNA, 35 bp, Artificial Sequence
  Synthetic oligonucleotide
ttgcgactacgacgtcccaactctgtcctcctatc

SEQ ID NO: 172012 - DNA, 35 bp, Artificial Sequence
  Synthetic oligonucleotide
ttgagcgccgcatatttgcggaaacattgcccctc

SEQ ID NO: 172013 - DNA, 35 bp, Artificial Sequence
  Synthetic oligonucleotide
ttaggctagcgctgcctcttgcttaaccgtctctc

SEQ ID NO: 172014 - DNA, 29 bp, Artificial Sequence
  Synthetic oligonucleotide
tcattcccccgtgcacatcctgacgtctc

SEQ ID NO: 172015 - DNA, 35 bp, Artificial Sequence
  Synthetic oligonucleotide
gcacccgctatctgtccttaaggcacaaccctgtc

SEQ ID NO: 172016 - DNA, 35 bp, Artificial Sequence
  Synthetic oligonucleotide
gcaacaagccccaatccccgtccggctgactgttc

SEQ ID NO: 172017 - DNA, 35 bp, Artificial Sequence
  Synthetic oligonucleotide
acggaggaccgggccgggggagttaaggggtaaag

SEQ ID NO: 172018 - DNA, 35 bp, Artificial Sequence
  Synthetic oligonucleotide
gacgtcgatgcgccgccgctcacaccatccataag

SEQ ID NO: 172019 - DNA, 35 bp, Artificial Sequence
  Synthetic oligonucleotide
agaggggtagccgggtagggtgggacggtctagag

SEQ ID NO: 172020 - DNA, 35 bp, Artificial Sequence
  Synthetic oligonucleotide
gacccccatgtaattacccacgccttcttcacgag

SEQ ID NO: 172021 - DNA, 35 bp, Artificial Sequence
  Synthetic oligonucleotide
tatccaccggtcagcacggtgttgttttcctcacg

SEQ ID NO: 172022 - DNA, 35 bp, Artificial Sequence
  Synthetic oligonucleotide
acggtcccgttccttacgcgttcactccctatccg

SEQ ID NO: 172023 - DNA, 35 bp, Artificial Sequence
  Synthetic oligonucleotide
tccccacaacacattctgctctatgcagccctccg

SEQ ID NO: 172024 - DNA, 35 bp, Artificial Sequence
  Synthetic oligonucleotide
gataggccccgtcaatagaaccctccccgtacgcg

SEQ ID NO: 172025 - DNA, 35 bp, Artificial Sequence
  Synthetic oligonucleotide
accacaactgagtccaaatcatgcatcttccctcg

SEQ ID NO: 172026 - DNA, 35 bp, Artificial Sequence
  Synthetic oligonucleotide
tgctacgctcatgcttggtcccctgtttcctgtcg

SEQ ID NO: 172027 - DNA, 35 bp, Artificial Sequence
  Synthetic oligonucleotide
tcgtgccctgcgatatcacgtccctctctccaagg

SEQ ID NO: 172028 - DNA, 35 bp, Artificial Sequence
  Synthetic oligonucleotide
agagacggtgttaatgggaggtgaagtgggtaggg

SEQ ID NO: 172029 - DNA, 35 bp, Artificial Sequence
  Synthetic oligonucleotide
ttggagagtgggtgggatggttctggcaccactgg

SEQ ID NO: 172030 - DNA, 35 bp, Artificial Sequence
  Synthetic oligonucleotide
tccccggacgtaatggcccttacacctcacacctg

SEQ ID NO: 172031 - DNA, 34 bp, Artificial Sequence
  Synthetic oligonucleotide
tcacgtcgcccccgaagctcctaccctgttcgat

SEQ ID NO: 172032 - DNA, 35 bp, Artificial Sequence
  Synthetic oligonucleotide
tgatcatcgcttcggcctgtcttgtacttccacct

SEQ ID NO: 172033 - DNA, 35 bp, Artificial Sequence
  Synthetic oligonucleotide
atagttgctgcagccgggtcgccgttactgcacct

SEQ ID NO: 172034 - DNA, 35 bp, Artificial Sequence
  Synthetic oligonucleotide
atctcaccttggctcatgaaatgttaccgctccct

SEQ ID NO: 172035 - DNA, 35 bp, Artificial Sequence
  Synthetic oligonucleotide
gccggtccccctcctacaagtcgcgtagcatgcct

SEQ ID NO: 172036 - DNA, 35 bp, Artificial Sequence
  Synthetic oligonucleotide
tatggcatggcctacactgtttcaaccacctttct

SEQ ID NO: 172037 - DNA, 35 bp, Artificial Sequence
  Synthetic oligonucleotide
ttgcactgtgggagtagggctgggggagggcgagt

SEQ ID NO: 172038 - DNA, 35 bp, Artificial Sequence
  Synthetic oligonucleotide
gatgcacccatacgctagccctaccccccgcacgt

SEQ ID NO: 172039 - DNA, 35 bp, Artificial Sequence
  Synthetic oligonucleotide
acccgacctcccacttaactcgccccattacgcgt

SEQ ID NO: 172040 - DNA, 35 bp, Artificial Sequence
  Synthetic oligonucleotide
gaagggtgggagggatatatagagggtttatcggt

SEQ ID NO: 172041 - DNA, 35 bp, Artificial Sequence
  Synthetic oligonucleotide
actctcccacccccgcccgcatgccggtctttggt

SEQ ID NO: 172042 - DNA, 36 bp, Artificial Sequence
  Synthetic oligonucleotide
atcgcatcacgccgtgccttggaatctcttctcctt

SEQ ID NO: 172043 - DNA, 35 bp, Artificial Sequence
  Synthetic oligonucleotide
aactccacgcttaccgctctgtacagggtttcctt

SEQ ID NO: 172044 - DNA, 35 bp, Artificial Sequence
  Synthetic oligonucleotide
accagtggctctggtccgcatttctcccctgtctt

SEQ ID NO: 172045 - DNA, 28 bp, Artificial Sequence
  Synthetic oligonucleotide
tcgtcccccgcactcctacatccggttt

SEQ ID NO: 172046 - DNA, 36 bp, Artificial Sequence
  Synthetic oligonucleotide
tagactgtagtcgtagcgtactcgttcccatcccaa

SEQ ID NO: 172047 - DNA, 36 bp, Artificial Sequence
  Synthetic oligonucleotide
atcaccctgagtgaccatgatctccttgtcctgcaa

SEQ ID NO: 172048 - DNA, 36 bp, Artificial Sequence
  Synthetic oligonucleotide
tagccatgccgcacgtcgacccgctgtctatttcaa

SEQ ID NO: 172049 - DNA, 37 bp, Artificial Sequence
  Synthetic oligonucleotide
gggaactcgaggaggaggggggggccgagtccaggaa

SEQ ID NO: 172050 - DNA, 36 bp, Artificial Sequence
  Synthetic oligonucleotide
gcgcaacgtgggggggggaacagtaagaggtaggaa

SEQ ID NO: 172051 - DNA, 36 bp, Artificial Sequence
  Synthetic oligonucleotide
gactgcttgccacgttgcccatctctatcgcctgaa

SEQ ID NO: 172052 - DNA, 36 bp, Artificial Sequence
  Synthetic oligonucleotide
tggggggaggacggggttgaaggtggattaacataa

SEQ ID NO: 172053 - DNA, 35 bp, Artificial Sequence
  Synthetic oligonucleotide
atggtggagggggagggaggaacgggctagagaca

SEQ ID NO: 172054 - DNA, 36 bp, Artificial Sequence
  Synthetic oligonucleotide
tgcgtgtccttggtaattgttgccttccgaccccca

SEQ ID NO: 172055 - DNA, 35 bp, Artificial Sequence
  Synthetic oligonucleotide
aaagccacatccatcgtccccccatttcgcgccca

SEQ ID NO: 172056 - DNA, 36 bp, Artificial Sequence
  Synthetic oligonucleotide
ttgccgtccccctcacgtctctgattcacctcgcca

SEQ ID NO: 172057 - DNA, 35 bp, Artificial Sequence
  Synthetic oligonucleotide
gacactcctgcctaattaggactaattctactcca

SEQ ID NO: 172058 - DNA, 35 bp, Artificial Sequence
  Synthetic oligonucleotide
agttccacacgcacccgggtatatccttcgctcca

SEQ ID NO: 172059 - DNA, 36 bp, Artificial Sequence
  Synthetic oligonucleotide
gcggattggaaggtggcatggggggtgggagaagca

SEQ ID NO: 172060 - DNA, 35 bp, Artificial Sequence
  Synthetic oligonucleotide
gagagaggaggtatagcaatcgggtaaggagggca

SEQ ID NO: 172061 - DNA, 36 bp, Artificial Sequence
  Synthetic oligonucleotide
gatcaccttcattgagtgagtccgcctacaccttca

SEQ ID NO: 172062 - DNA, 37 bp, Artificial Sequence
  Synthetic oligonucleotide
gtggacaagggaggaacggatataggagttggccaga

SEQ ID NO: 172063 - DNA, 37 bp, Artificial Sequence
  Synthetic oligonucleotide
gcgcgacgcccccctgccgtgcctattatcttgacga

SEQ ID NO: 172064 - DNA, 36 bp, Artificial Sequence
  Synthetic oligonucleotide
tccgtcacgccaataattgctctcgcctcgcaccga

SEQ ID NO: 172065 - DNA, 37 bp, Artificial Sequence
  Synthetic oligonucleotide
gcgcgccccgatcaatgtcccgtaaccgcccccccga

SEQ ID NO: 172066 - DNA, 37 bp, Artificial Sequence
  Synthetic oligonucleotide
gcgcatacacccgacctatatcatggcccgcctccga

SEQ ID NO: 172067 - DNA, 37 bp, Artificial Sequence
  Synthetic oligonucleotide
tgtgctatttcctctgatctgccctgttcttctccga

SEQ ID NO: 172068 - DNA, 35 bp, Artificial Sequence
  Synthetic oligonucleotide
atcaccgccctcccttccgctaacatttggtccga

SEQ ID NO: 172069 - DNA, 35 bp, Artificial Sequence
  Synthetic oligonucleotide
ttcccaaccccccctcgctacaggtcaatgtgcga

SEQ ID NO: 172070 - DNA, 36 bp, Artificial Sequence
  Synthetic oligonucleotide
gactcgtcatcgctctattcacgcattccctttcga

SEQ ID NO: 172071 - DNA, 37 bp, Artificial Sequence
  Synthetic oligonucleotide
tacggatgtgtacggggtgtgagggataacgggagga

SEQ ID NO: 172072 - DNA, 36 bp, Artificial Sequence
  Synthetic oligonucleotide
aagtccgaggggcggaggtagaatagagggaaggga

SEQ ID NO: 172073 - DNA, 37 bp, Artificial Sequence
  Synthetic oligonucleotide
attcggtgtagaacgtggtgaagggttgggggaggga

SEQ ID NO: 172074 - DNA, 37 bp, Artificial Sequence
  Synthetic oligonucleotide
gttagagaaactgatgggagggggagggctggaggga

SEQ ID NO: 172075 - DNA, 37 bp, Artificial Sequence
  Synthetic oligonucleotide
ggggaggtgaggaggatgctgatggaaaggagcggga

SEQ ID NO: 172076 - DNA, 36 bp, Artificial Sequence
  Synthetic oligonucleotide
aagagaacggaggaggtggtgtgagaatgatcggga

SEQ ID NO: 172077 - DNA, 37 bp, Artificial Sequence
  Synthetic oligonucleotide
tgctaccgtgcctccagttttcctcactccccctgga

SEQ ID NO: 172078 - DNA, 37 bp, Artificial Sequence
  Synthetic oligonucleotide
tgaagggaggttgcggagggaactggggtgcggtgga

SEQ ID NO: 172079 - DNA, 36 bp, Artificial Sequence
  Synthetic oligonucleotide
accgtatgcctgcctggtttcccctcacgctgtgga

SEQ ID NO: 172080 - DNA, 38 bp, Artificial Sequence
  Synthetic oligonucleotide
gggagtggaggggtggggtacgtatgccgaggacatga

SEQ ID NO: 172081 - DNA, 37 bp, Artificial Sequence
  Synthetic oligonucleotide
gtccaccccctcataatgcatacgtccttctttatga

SEQ ID NO: 172082 - DNA, 37 bp, Artificial Sequence
  Synthetic oligonucleotide
tatccctccgcccactctgcattagaagcctccctga

SEQ ID NO: 172083 - DNA, 37 bp, Artificial Sequence
  Synthetic oligonucleotide
tcccatccgccctcgacccggaatgtcagtctgctga

SEQ ID NO: 172084 - DNA, 37 bp, Artificial Sequence
  Synthetic oligonucleotide
gcaaggggggtaatataggggcgagggagacatctga

SEQ ID NO: 172085 - DNA, 38 bp, Artificial Sequence
  Synthetic oligonucleotide
tgacctcgcagaagttggtgggttgggggggggagtga

SEQ ID NO: 172086 - DNA, 38 bp, Artificial Sequence
  Synthetic oligonucleotide
tctggtacaggaggggggtggagctagaagagtggtga

SEQ ID NO: 172087 - DNA, 38 bp, Artificial Sequence
  Synthetic oligonucleotide
gctggagagtgaacatggggaggggatgacgcgtgtga

SEQ ID NO: 172088 - DNA, 38 bp, Artificial Sequence
  Synthetic oligonucleotide
gtgcgtacgggctgggagggtggggctgaccggtgtga

SEQ ID NO: 172089 - DNA, 36 bp, Artificial Sequence
  Synthetic oligonucleotide
gatagggtaaggggtaggagggagtggtgggattga

SEQ ID NO: 172090 - DNA, 37 bp, Artificial Sequence
  Synthetic oligonucleotide
tctttcccacccgtcagtcccgtttctgcccccttga

SEQ ID NO: 172091 - DNA, 36 bp, Artificial Sequence
  Synthetic oligonucleotide
tccgccctcattcgttaggcttcccctgcctgcata

SEQ ID NO: 172092 - DNA, 35 bp, Artificial Sequence
  Synthetic oligonucleotide
gaagggagggaacggaggggggggttaagtaacta

SEQ ID NO: 172093 - DNA, 36 bp, Artificial Sequence
  Synthetic oligonucleotide
gaggaagggggggtcaacaggaagggcatcgacgta

SEQ ID NO: 172094 - DNA, 35 bp, Artificial Sequence
  Synthetic oligonucleotide
gtatccctcagcgcgtccagcccttcctacgcgta

SEQ ID NO: 172095 - DNA, 36 bp, Artificial Sequence
  Synthetic oligonucleotide
tccacacatcttgtttgattctgccaccccactgta

SEQ ID NO: 172096 - DNA, 36 bp, Artificial Sequence
  Synthetic oligonucleotide
tccacacatctggtttgattcttccaccccactgta

SEQ ID NO: 172097 - DNA, 36 bp, Artificial Sequence
  Synthetic oligonucleotide
gagatgcctacgaccctccccccatgtaccacgtta

SEQ ID NO: 172098 - DNA, 35 bp, Artificial Sequence
  Synthetic oligonucleotide
tttcatccccgctctgtccacggacgacactccac

SEQ ID NO: 172099 - DNA, 35 bp, Artificial Sequence
  Synthetic oligonucleotide
acctgcccacccgcttgtatgttagtgtgcgctac

SEQ ID NO: 172100 - DNA, 35 bp, Artificial Sequence
  Synthetic oligonucleotide
agtccgcagccgccacgcccgtacacccaacttac

SEQ ID NO: 172101 - DNA, 35 bp, Artificial Sequence
  Synthetic oligonucleotide
gagtccgtcacctcgagtttcgcccttcgatttac

SEQ ID NO: 172102 - DNA, 35 bp, Artificial Sequence
  Synthetic oligonucleotide
agccaacgcctcctcacgtaaacctcccgcccacc

SEQ ID NO: 172103 - DNA, 35 bp, Artificial Sequence
  Synthetic oligonucleotide
atagccaccgcgataacctcatgccgctgcccccc

SEQ ID NO: 172104 - DNA, 35 bp, Artificial Sequence
  Synthetic oligonucleotide
aattcggagcccttttacccatgcgagcccgcccc

SEQ ID NO: 172105 - DNA, 35 bp, Artificial Sequence
  Synthetic oligonucleotide
tcgaaccggtacgttcctccctgccttggttgccc

SEQ ID NO: 172106 - DNA, 35 bp, Artificial Sequence
  Synthetic oligonucleotide
atgaccctcgtacatgaattatcctgtcttatccc

SEQ ID NO: 172107 - DNA, 35 bp, Artificial Sequence
  Synthetic oligonucleotide
tacccccccggtccgtacacagcccaccacttgcc

SEQ ID NO: 172108 - DNA, 35 bp, Artificial Sequence
  Synthetic oligonucleotide
gatctagggcgtccaccagcccttccgttacatcc

SEQ ID NO: 172109 - DNA, 35 bp, Artificial Sequence
  Synthetic oligonucleotide
gataaccagcccagtgccattcttagtctacctcc

SEQ ID NO: 172110 - DNA, 34 bp, Artificial Sequence
  Synthetic oligonucleotide
ttcgccgccccattgcttgttacatccgtcttcc

SEQ ID NO: 172111 - DNA, 35 bp, Artificial Sequence
  Synthetic oligonucleotide
aacgccccccctgctactacctattttggacaagc

SEQ ID NO: 172112 - DNA, 35 bp, Artificial Sequence
  Synthetic oligonucleotide
tcctatgccccgccgtaatctttccaaccccccgc

SEQ ID NO: 172113 - DNA, 35 bp, Artificial Sequence
  Synthetic oligonucleotide
gtgggagaggggaggacatcggtgacaggtggggc

SEQ ID NO: 172114 - DNA, 35 bp, Artificial Sequence
  Synthetic oligonucleotide
ttagacccagtcctttccatctgctacatgactgc

SEQ ID NO: 172115 - DNA, 35 bp, Artificial Sequence
  Synthetic oligonucleotide
gctgcatccattgacctttccgccggtcgttctgc

SEQ ID NO: 172116 - DNA, 35 bp, Artificial Sequence
  Synthetic oligonucleotide
gacccgtgtagtttactccgaacctgtccctcatc

SEQ ID NO: 172117 - DNA, 35 bp, Artificial Sequence
  Synthetic oligonucleotide
tcgatccaccttgaggcatacgggccctacttatc

SEQ ID NO: 172118 - DNA, 35 bp, Artificial Sequence
  Synthetic oligonucleotide
agccggacccaggctctcccgacaccggtaatctc

SEQ ID NO: 172119 - DNA, 35 bp, Artificial Sequence
  Synthetic oligonucleotide
gtgctccccagatgtccatcactgtcgcgcctctc

SEQ ID NO: 172120 - DNA, 35 bp, Artificial Sequence
  Synthetic oligonucleotide
tgtttcgccgctcccattccccctacgccctagtc

SEQ ID NO: 172121 - DNA, 35 bp, Artificial Sequence
  Synthetic oligonucleotide
atgccgaccccgtagcaccgtccacaaattccgtc

SEQ ID NO: 172122 - DNA, 35 bp, Artificial Sequence
  Synthetic oligonucleotide
acatcctactgtctgacaccgcccgccttctggtc

SEQ ID NO: 172123 - DNA, 35 bp, Artificial Sequence
  Synthetic oligonucleotide
tcccacctacatgcctcacaacgtacacccctgtc

SEQ ID NO: 172124 - DNA, 35 bp, Artificial Sequence
  Synthetic oligonucleotide
tacacgagtgtccggcctttcgttctctcctattc

SEQ ID NO: 172125 - DNA, 35 bp, Artificial Sequence
  Synthetic oligonucleotide
tgtgagctgcctccgccgctttaccatttacgttc

SEQ ID NO: 172126 - DNA, 35 bp, Artificial Sequence
  Synthetic oligonucleotide
gcttgcacaccgttcgggccattcattagcctttc

SEQ ID NO: 172127 - DNA, 35 bp, Artificial Sequence
  Synthetic oligonucleotide
gcatcaatatgcacgtcgggtctggtgtctctttc

SEQ ID NO: 172128 - DNA, 35 bp, Artificial Sequence
  Synthetic oligonucleotide
ttggcatggtcccacgcctggtgtccgcccgtttc

SEQ ID NO: 172129 - DNA, 35 bp, Artificial Sequence
  Synthetic oligonucleotide
actgcgcgggtgggttaattgtgggagggggaaag

SEQ ID NO: 172130 - DNA, 35 bp, Artificial Sequence
  Synthetic oligonucleotide
ggggagaactgatcggaagggggagagggaataag

SEQ ID NO: 172131 - DNA, 35 bp, Artificial Sequence
  Synthetic oligonucleotide
tgcagcccgaccgatccgccttgttacatccaccg

SEQ ID NO: 172132 - DNA, 35 bp, Artificial Sequence
  Synthetic oligonucleotide
tgcctcgatccacatctggaaagttcgcacctccg

SEQ ID NO: 172133 - DNA, 35 bp, Artificial Sequence
  Synthetic oligonucleotide
gcaacgccccccctgtcatccctcctccttgcgcg

SEQ ID NO: 172134 - DNA, 35 bp, Artificial Sequence
  Synthetic oligonucleotide
atactcctgttccccccgtccgcgcgacccggtcg

SEQ ID NO: 172135 - DNA, 35 bp, Artificial Sequence
  Synthetic oligonucleotide
tcagcacctcatgggcatggtccgcctctcattcg

SEQ ID NO: 172136 - DNA, 35 bp, Artificial Sequence
  Synthetic oligonucleotide
ccaatcccacctgtcgcccacccccgctccatagg

SEQ ID NO: 172137 - DNA, 35 bp, Artificial Sequence
  Synthetic oligonucleotide
agtatacctccgctgcgatctgtgaattccccctg

SEQ ID NO: 172138 - DNA, 35 bp, Artificial Sequence
  Synthetic oligonucleotide
gaggacggaggggagttgacgaacgggtgttgctg

SEQ ID NO: 172139 - DNA, 35 bp, Artificial Sequence
  Synthetic oligonucleotide
ctccgtcattacgcgccccggcctgtttgtaccat

SEQ ID NO: 172140 - DNA, 35 bp, Artificial Sequence
  Synthetic oligonucleotide
tatcccaccgcccgctcaccacgccctccgcagat

SEQ ID NO: 172141 - DNA, 35 bp, Artificial Sequence
  Synthetic oligonucleotide
atcgcgccatcggggggaggaaggcatagagggat

SEQ ID NO: 172142 - DNA, 35 bp, Artificial Sequence
  Synthetic oligonucleotide
gtcccatcccccttgcgagtgtcgcgctgaacact

SEQ ID NO: 172143 - DNA, 34 bp, Artificial Sequence
  Synthetic oligonucleotide
tcccatgcccctctgccgaggccctaaaagcact

SEQ ID NO: 172144 - DNA, 35 bp, Artificial Sequence
  Synthetic oligonucleotide
gatcttacgccccggttacggtactttgctcccct

SEQ ID NO: 172145 - DNA, 35 bp, Artificial Sequence
  Synthetic oligonucleotide
gttccagctcaacactaccgcacttacgccgccct

SEQ ID NO: 172146 - DNA, 35 bp, Artificial Sequence
  Synthetic oligonucleotide
ttaccgctcagtgacatgatccaccttgccgccct

SEQ ID NO: 172147 - DNA, 35 bp, Artificial Sequence
  Synthetic oligonucleotide
gttaccgtccacctgattactgccccagtttagct

SEQ ID NO: 172148 - DNA, 35 bp, Artificial Sequence
  Synthetic oligonucleotide
acctccgtacatgcacatgccctccaagtaactct

SEQ ID NO: 172149 - DNA, 35 bp, Artificial Sequence
  Synthetic oligonucleotide
ttccgcatcaaggaacgttgcaccctgcgccctct

SEQ ID NO: 172150 - DNA, 35 bp, Artificial Sequence
  Synthetic oligonucleotide
tcaccccaaccgccctgggcatatccttcccccgt

SEQ ID NO: 172151 - DNA, 35 bp, Artificial Sequence
  Synthetic oligonucleotide
gtcgaccgctcaggtctctcctctctctcccaggt

SEQ ID NO: 172152 - DNA, 35 bp, Artificial Sequence
  Synthetic oligonucleotide
cccatttgcctaagccctactacgttcctccttgt

SEQ ID NO: 172153 - DNA, 35 bp, Artificial Sequence
  Synthetic oligonucleotide
gcactgcatccacacctgctgtttatttatgcctt

SEQ ID NO: 172154 - DNA, 35 bp, Artificial Sequence
  Synthetic oligonucleotide
tcccccccagacttctgcgtgcctttcgctccgtt

SEQ ID NO: 172155 - DNA, 35 bp, Artificial Sequence
  Synthetic oligonucleotide
ggtccctcccccgtttacttactgcgtgagcattt

SEQ ID NO: 172156 - DNA, 35 bp, Artificial Sequence
  Synthetic oligonucleotide
accccccgctccccgtagtatttaaactgtcattt

SEQ ID NO: 172157 - DNA, 36 bp, Artificial Sequence
  Synthetic oligonucleotide
acgccctatcccctgtgctcaatctacactgtgaaa

SEQ ID NO: 172158 - DNA, 36 bp, Artificial Sequence
  Synthetic oligonucleotide
tccggatcccactgctggacaagcccttctccacaa

SEQ ID NO: 172159 - DNA, 36 bp, Artificial Sequence
  Synthetic oligonucleotide
gtaaaggggggttggggacaaggtgagttgggggaa

SEQ ID NO: 172160 - DNA, 36 bp, Artificial Sequence
  Synthetic oligonucleotide
aacccccccgtatcaacgtgtcagcacttctcgtaa

SEQ ID NO: 172161 - DNA, 35 bp, Artificial Sequence
  Synthetic oligonucleotide
attccaccgacccaaaggtccacagtaccctcaca

SEQ ID NO: 172162 - DNA, 35 bp, Artificial Sequence
  Synthetic oligonucleotide
tgctaggcgcagtcaacgcagccccgcccccacca

SEQ ID NO: 172163 - DNA, 36 bp, Artificial Sequence
  Synthetic oligonucleotide
accccgacctccttgtacacactgggccaagtccca

SEQ ID NO: 172164 - DNA, 36 bp, Artificial Sequence
  Synthetic oligonucleotide
atcctcacgccttttgtcttgtacactacattccca

SEQ ID NO: 172165 - DNA, 36 bp, Artificial Sequence
  Synthetic oligonucleotide
gccaggctcccgtccccatcgttacctggccatcca

SEQ ID NO: 172166 - DNA, 36 bp, Artificial Sequence
  Synthetic oligonucleotide
tcactcgaatctggggcaagggcgggtgggtctcca

SEQ ID NO: 172167 - DNA, 36 bp, Artificial Sequence
  Synthetic oligonucleotide
gccatctaccacctgatttagctaacatgttccgca

SEQ ID NO: 172168 - DNA, 36 bp, Artificial Sequence
  Synthetic oligonucleotide
acctcccaagttgcgctcgagctagcccctcctgca

SEQ ID NO: 172169 - DNA, 36 bp, Artificial Sequence
  Synthetic oligonucleotide
atgggaacgttgggggggtagggagcgggcggtgca

SEQ ID NO: 172170 - DNA, 34 bp, Artificial Sequence
  Synthetic oligonucleotide
aagcaccagcccaacttctgccgacccaccatca

SEQ ID NO: 172171 - DNA, 35 bp, Artificial Sequence
  Synthetic oligonucleotide
tccactctgtcactattcggttactgctgttctca

SEQ ID NO: 172172 - DNA, 36 bp, Artificial Sequence
  Synthetic oligonucleotide
gccgccttaccgacaatatactctatgccaccttca

SEQ ID NO: 172173 - DNA, 35 bp, Artificial Sequence
  Synthetic oligonucleotide
gcgtgggcagggtgggtggggtccgaaaatgttca

SEQ ID NO: 172174 - DNA, 37 bp, Artificial Sequence
  Synthetic oligonucleotide
ggggggagtggcaaggagaggacggcggtagtcgaga

SEQ ID NO: 172175 - DNA, 37 bp, Artificial Sequence
  Synthetic oligonucleotide
gcctacggtccatactgctctaactgaacccacccga

SEQ ID NO: 172176 - DNA, 37 bp, Artificial Sequence
  Synthetic oligonucleotide
atccgccccgtcgtacgcctgttcacgatttacccga

SEQ ID NO: 172177 - DNA, 37 bp, Artificial Sequence
  Synthetic oligonucleotide
tcctgcacgcctgtgacaacctccgtctcgatcccga

SEQ ID NO: 172178 - DNA, 37 bp, Artificial Sequence
  Synthetic oligonucleotide
tactctcacgtcagctcaccactcgcccgcctcccga

SEQ ID NO: 172179 - DNA, 37 bp, Artificial Sequence
  Synthetic oligonucleotide
ataaccgcccgcccgctccggatcatacttcctccga

SEQ ID NO: 172180 - DNA, 37 bp, Artificial Sequence
  Synthetic oligonucleotide
aagctccccacagctccgttaccgatcaactctccga

SEQ ID NO: 172181 - DNA, 35 bp, Artificial Sequence
  Synthetic oligonucleotide
accaccgccgccttcggtcgcatccacacaccgga

SEQ ID NO: 172182 - DNA, 37 bp, Artificial Sequence
  Synthetic oligonucleotide
tgtacaccctcacccactcactcgcaccacgtgcgga

SEQ ID NO: 172183 - DNA, 37 bp, Artificial Sequence
  Synthetic oligonucleotide
ggggcaaagaacctggggcgcgataaagggaggggga

SEQ ID NO: 172184 - DNA, 37 bp, Artificial Sequence
  Synthetic oligonucleotide
atgggagggagggggcgaaactggctgagatttggga

SEQ ID NO: 172185 - DNA, 38 bp, Artificial Sequence
  Synthetic oligonucleotide
ggtcacccgcctgccccgtgacaaagtcccccccatga

SEQ ID NO: 172186 - DNA, 37 bp, Artificial Sequence
  Synthetic oligonucleotide
gatcacccccgcccgcactataaagggctagccctga

SEQ ID NO: 172187 - DNA, 38 bp, Artificial Sequence
  Synthetic oligonucleotide
atgtcctgccctcatcagctcccgccgtcacattctga

SEQ ID NO: 172188 - DNA, 38 bp, Artificial Sequence
  Synthetic oligonucleotide
gggaggggcgggctggggggagtcgcggaggattctga

SEQ ID NO: 172189 - DNA, 38 bp, Artificial Sequence
  Synthetic oligonucleotide
gagacaggcggtgaaattgcgtgggaaagtgggggtga

SEQ ID NO: 172190 - DNA, 37 bp, Artificial Sequence
  Synthetic oligonucleotide
gagacgggacggggaagacgtttggggcgggctgtga

SEQ ID NO: 172191 - DNA, 37 bp, Artificial Sequence
  Synthetic oligonucleotide
acaccactgcttgaccttccgctgcccctggacttga

SEQ ID NO: 172192 - DNA, 36 bp, Artificial Sequence
  Synthetic oligonucleotide
acttgcgcgcaccactccccttcttgaccgccttga

SEQ ID NO: 172193 - DNA, 36 bp, Artificial Sequence
  Synthetic oligonucleotide
tttagccccccactggtccgcctcgtgccatcttga

SEQ ID NO: 172194 - DNA, 38 bp, Artificial Sequence
  Synthetic oligonucleotide
accaccctcgttcgctatgcagacccttgctcatttga

SEQ ID NO: 172195 - DNA, 36 bp, Artificial Sequence
  Synthetic oligonucleotide
gccacgtccttgccgccccatagtgtcgtcactcta

SEQ ID NO: 172196 - DNA, 36 bp, Artificial Sequence
  Synthetic oligonucleotide
acaggggaaaggctcgggggcacggggcgagtagta

SEQ ID NO: 172197 - DNA, 36 bp, Artificial Sequence
  Synthetic oligonucleotide
acatccacgtctttgcgcgcggccttttcctgctta

SEQ ID NO: 172198 - DNA, 36 bp, Artificial Sequence
  Synthetic oligonucleotide
ttcaacgcccgtggcatgcccccgtacccaacgtta

SEQ ID NO: 172199 - DNA, 36 bp, Artificial Sequence
  Synthetic oligonucleotide
tccacacatctggtttgattctgccaccccacttta

SEQ ID NO: 172200 - DNA, 35 bp, Artificial Sequence
  Synthetic oligonucleotide
gccggatctcgttcctgtagccacctccactgcac

SEQ ID NO: 172201 - DNA, 35 bp, Artificial Sequence
  Synthetic oligonucleotide
gtgcctcccgagattcccccgtctccatgtacgac

SEQ ID NO: 172202 - DNA, 35 bp, Artificial Sequence
  Synthetic oligonucleotide
gcacacacatcttttggctatcccgtttacagtac

SEQ ID NO: 172203 - DNA, 35 bp, Artificial Sequence
  Synthetic oligonucleotide
gttagcatccctctttaagcccctggttccggtac

SEQ ID NO: 172204 - DNA, 35 bp, Artificial Sequence
  Synthetic oligonucleotide
tccgggcccctatgcgaatgcctacttatcctacc

SEQ ID NO: 172205 - DNA, 35 bp, Artificial Sequence
  Synthetic oligonucleotide
agcaccgtcgacgccgtatccgatctgcgcccccc

SEQ ID NO: 172206 - DNA, 35 bp, Artificial Sequence
  Synthetic oligonucleotide
atcgcgagctgccatggttgagtcgcgatgccccc

SEQ ID NO: 172207 - DNA, 35 bp, Artificial Sequence
  Synthetic oligonucleotide
gttgctccccttcccgaccggggcctgcacctccc

SEQ ID NO: 172208 - DNA, 35 bp, Artificial Sequence
  Synthetic oligonucleotide
tagagccagttccgtgcgcccctgtagttgctccc

SEQ ID NO: 172209 - DNA, 35 bp, Artificial Sequence
  Synthetic oligonucleotide
agcgtagtacaccaccgtcacaccttccacgcgcc

SEQ ID NO: 172210 - DNA, 35 bp, Artificial Sequence
  Synthetic oligonucleotide
agtcatcaccacacacgagtcgccccgctccgtcc

SEQ ID NO: 172211 - DNA, 35 bp, Artificial Sequence
  Synthetic oligonucleotide
gcataccattcagttgtgctcctccctcacggtcc

SEQ ID NO: 172212 - DNA, 35 bp, Artificial Sequence
  Synthetic oligonucleotide
tctcgcccccccgtttatcgttgtcgacgttgtcc

SEQ ID NO: 172213 - DNA, 35 bp, Artificial Sequence
  Synthetic oligonucleotide
gtgccatccctgcctcgtccgctgcacgccgttcc

SEQ ID NO: 172214 - DNA, 35 bp, Artificial Sequence
  Synthetic oligonucleotide
tattgcaccccccagaggatgcatgtccattttcc

SEQ ID NO: 172215 - DNA, 35 bp, Artificial Sequence
  Synthetic oligonucleotide
tcctgcccctgggcggttccccaattttgttttcc

SEQ ID NO: 172216 - DNA, 35 bp, Artificial Sequence
  Synthetic oligonucleotide
tcccctccgacacccgccagtgcccactcgtaagc

SEQ ID NO: 172217 - DNA, 35 bp, Artificial Sequence
  Synthetic oligonucleotide
ggagctctccccatgccgattttcaccggacccgc

SEQ ID NO: 172218 - DNA, 35 bp, Artificial Sequence
  Synthetic oligonucleotide
tacgaccagcgcattcatttccgcctcctgcccgc

SEQ ID NO: 172219 - DNA, 35 bp, Artificial Sequence
  Synthetic oligonucleotide
actgaccccacatatgagccgaccttgcctcgcgc

SEQ ID NO: 172220 - DNA, 35 bp, Artificial Sequence
  Synthetic oligonucleotide
ggacctagcccttcatgcgtccatctagtccttgc

SEQ ID NO: 172221 - DNA, 35 bp, Artificial Sequence
  Synthetic oligonucleotide
atccgcaccatctctattatactgccaacgaaatc

SEQ ID NO: 172222 - DNA, 35 bp, Artificial Sequence
  Synthetic oligonucleotide
ggtcgcgctgtcttggagcccccaccgccctactc

SEQ ID NO: 172223 - DNA, 35 bp, Artificial Sequence
  Synthetic oligonucleotide
tgatcgtgcagcactcttcacgctttctcccgctc

SEQ ID NO: 172224 - DNA, 35 bp, Artificial Sequence
  Synthetic oligonucleotide
tcacgaacgcctgggttactgtaccacctagtctc

SEQ ID NO: 172225 - DNA, 35 bp, Artificial Sequence
  Synthetic oligonucleotide
tctaccttgtcctctgcacccctgaccgtagagtc

SEQ ID NO: 172226 - DNA, 35 bp, Artificial Sequence
  Synthetic oligonucleotide
tttcgcgggacctgcaattcgtataccttctcttc

SEQ ID NO: 172227 - DNA, 35 bp, Artificial Sequence
  Synthetic oligonucleotide
atgtttccccatgcttatcgtacgtgacccccccg

SEQ ID NO: 172228 - DNA, 35 bp, Artificial Sequence
  Synthetic oligonucleotide
ggagccgacccacagacagtacccccctccctccg

SEQ ID NO: 172229 - DNA, 35 bp, Artificial Sequence
  Synthetic oligonucleotide
gaacactgcactgaagggcatggggtgaagaagcg

SEQ ID NO: 172230 - DNA, 35 bp, Artificial Sequence
  Synthetic oligonucleotide
gacttgccacacaagccctgccccactcctacgcg

SEQ ID NO: 172231 - DNA, 35 bp, Artificial Sequence
  Synthetic oligonucleotide
gagggatacggaaggagtaaaggtgttggatgagg

SEQ ID NO: 172232 - DNA, 35 bp, Artificial Sequence
  Synthetic oligonucleotide
gccactccgccgacttttctgcctctcgtgattgg

SEQ ID NO: 172233 - DNA, 35 bp, Artificial Sequence
  Synthetic oligonucleotide
tccttgcccagcgtgaccctcttctgtttctttgg

SEQ ID NO: 172234 - DNA, 35 bp, Artificial Sequence
  Synthetic oligonucleotide
ttgcccacgcactgatctttgccctccctgccctg

SEQ ID NO: 172235 - DNA, 33 bp, Artificial Sequence
  Synthetic oligonucleotide
gttggctcccctctttcagtatctcttatgctg

SEQ ID NO: 172236 - DNA, 35 bp, Artificial Sequence
  Synthetic oligonucleotide
gaaaccactgtaattctataacccctgcctctctg

SEQ ID NO: 172237 - DNA, 35 bp, Artificial Sequence
  Synthetic oligonucleotide
ttgacgccgttgcccacatgatcctattgtttcat

SEQ ID NO: 172238 - DNA, 35 bp, Artificial Sequence
  Synthetic oligonucleotide
ggacctacatcctcccaaagccatgcgctagccct

SEQ ID NO: 172239 - DNA, 35 bp, Artificial Sequence
  Synthetic oligonucleotide
accacctatcagtccgtttacaatcgttcgtccct

SEQ ID NO: 172240 - DNA, 35 bp, Artificial Sequence
  Synthetic oligonucleotide
actcgacctccgcctggttctcccccatatgtcct

SEQ ID NO: 172241 - DNA, 36 bp, Artificial Sequence
  Synthetic oligonucleotide
gatacaccgctccatgttgaacccatcacccgcgct

SEQ ID NO: 172242 - DNA, 35 bp, Artificial Sequence
  Synthetic oligonucleotide
acgcgtgtcaactatcgacgtgccctttatcctct

SEQ ID NO: 172243 - DNA, 35 bp, Artificial Sequence
  Synthetic oligonucleotide
tatcctcctcggcctgaatgcgctcctctcgttct

SEQ ID NO: 172244 - DNA, 35 bp, Artificial Sequence
  Synthetic oligonucleotide
gcactcctccgcacacgccctgcctgtttaccagt

SEQ ID NO: 172245 - DNA, 35 bp, Artificial Sequence
  Synthetic oligonucleotide
gtcgtcacgcatctagcctttcttcatcccttcgt

SEQ ID NO: 172246 - DNA, 35 bp, Artificial Sequence
  Synthetic oligonucleotide
caagcacgccgcccctatatgctccacgcttctgt

SEQ ID NO: 172247 - DNA, 35 bp, Artificial Sequence
  Synthetic oligonucleotide
acgttcccatcaccctcgtttacatcttgagtctt

SEQ ID NO: 172248 - DNA, 35 bp, Artificial Sequence
  Synthetic oligonucleotide
ttcccgccgctcgggtcatattcaccatctttctt

SEQ ID NO: 172249 - DNA, 35 bp, Artificial Sequence
  Synthetic oligonucleotide
gcatcgattccggcgctgctatttaccttctcgtt

SEQ ID NO: 172250 - DNA, 35 bp, Artificial Sequence
  Synthetic oligonucleotide
atccgtccaactgctccgcctttcctcactctgtt

SEQ ID NO: 172251 - DNA, 35 bp, Artificial Sequence
  Synthetic oligonucleotide
ggtgccggaggcgtcccctgccctccccgccgttt

SEQ ID NO: 172252 - DNA, 35 bp, Artificial Sequence
  Synthetic oligonucleotide
tgtcgcacacgccctgctctacccctctaattttt

SEQ ID NO: 172253 - DNA, 36 bp, Artificial Sequence
  Synthetic oligonucleotide
aaccacccgccacatccccggacgctacgggctaaa

SEQ ID NO: 172254 - DNA, 36 bp, Artificial Sequence
  Synthetic oligonucleotide
gaccagagcaagaagggatgatgggaggacgggcaa

SEQ ID NO: 172255 - DNA, 36 bp, Artificial Sequence
  Synthetic oligonucleotide
acatccctgctgcagccccaccatcttgcttctcaa

SEQ ID NO: 172256 - DNA, 36 bp, Artificial Sequence
  Synthetic oligonucleotide
gcgccctttcggccatcgtccatgcacccttttcaa

SEQ ID NO: 172257 - DNA, 36 bp, Artificial Sequence
  Synthetic oligonucleotide
tcgcaccctgctgaacccgccgccaccctaagcgaa

SEQ ID NO: 172258 - DNA, 36 bp, Artificial Sequence
  Synthetic oligonucleotide
acaacgaggaggcaggtggggcggatgggcggtgaa

SEQ ID NO: 172259 - DNA, 36 bp, Artificial Sequence
  Synthetic oligonucleotide
actaccccttgccattgctatacgtgctttcgctaa

SEQ ID NO: 172260 - DNA, 36 bp, Artificial Sequence
  Synthetic oligonucleotide
gacccctccgaccccgtccctcgcttttaggtttaa

SEQ ID NO: 172261 - DNA, 36 bp, Artificial Sequence
  Synthetic oligonucleotide
gcctccccgcacgccacccacggtgctttagcaaca

SEQ ID NO: 172262 - DNA, 36 bp, Artificial Sequence
  Synthetic oligonucleotide
tgcccactgccagtttcgttctggaccccctgtaca

SEQ ID NO: 172263 - DNA, 36 bp, Artificial Sequence
  Synthetic oligonucleotide
acactaccgcactttaggtccttagaccgtccacca

SEQ ID NO: 172264 - DNA, 36 bp, Artificial Sequence
  Synthetic oligonucleotide
tccccccccactggaacagcatgctccaacagacca

SEQ ID NO: 172265 - DNA, 36 bp, Artificial Sequence
  Synthetic oligonucleotide
accgtcacctcctttgccgaatccgctctaccgcca

SEQ ID NO: 172266 - DNA, 35 bp, Artificial Sequence
  Synthetic oligonucleotide
gatgcgcatgcacacacaataccgaccttccgcca

SEQ ID NO: 172267 - DNA, 35 bp, Artificial Sequence
  Synthetic oligonucleotide
tcgggacgccgtttatcatggccctcgttcctcca

SEQ ID NO: 172268 - DNA, 36 bp, Artificial Sequence
  Synthetic oligonucleotide
aacatcttgcgccccagccgttttatccgtgctcca

SEQ ID NO: 172269 - DNA, 35 bp, Artificial Sequence
  Synthetic oligonucleotide
gtagttcgcgttcgaactgcgatacacccacctca

SEQ ID NO: 172270 - DNA, 36 bp, Artificial Sequence
  Synthetic oligonucleotide
tcctcgccctagccctctgtaccatctcccgaaaga

SEQ ID NO: 172271 - DNA, 37 bp, Artificial Sequence
  Synthetic oligonucleotide
tcatcctcccccctcttgatgtctcgctatgcctaga

SEQ ID NO: 172272 - DNA, 36 bp, Artificial Sequence
  Synthetic oligonucleotide
gtacggaacgggaggggctggggggcggccgttaga

SEQ ID NO: 172273 - DNA, 37 bp, Artificial Sequence
  Synthetic oligonucleotide
tacgctcgccgcccgcctctagcttatctacacacga

SEQ ID NO: 172274 - DNA, 36 bp, Artificial Sequence
  Synthetic oligonucleotide
gacctgctccggccatttacgtgccttccctcccga

SEQ ID NO: 172275 - DNA, 37 bp, Artificial Sequence
  Synthetic oligonucleotide
gtctgcctctcatactaatgtagcttccgtttcccga

SEQ ID NO: 172276 - DNA, 37 bp, Artificial Sequence
  Synthetic oligonucleotide
tgcccacccgctccttctcgttcaaacacctcgccga

SEQ ID NO: 172277 - DNA, 37 bp, Artificial Sequence
  Synthetic oligonucleotide
ttgcacacgcaaagaggtcacgtgctactccctccga

SEQ ID NO: 172278 - DNA, 37 bp, Artificial Sequence
  Synthetic oligonucleotide
gagtcagaggggcggtggaggaggggtagtaaatcga

SEQ ID NO: 172279 - DNA, 37 bp, Artificial Sequence
  Synthetic oligonucleotide
agttccaccacactcagtagcctgctcctaccctcga

SEQ ID NO: 172280 - DNA, 37 bp, Artificial Sequence
  Synthetic oligonucleotide
atgaccctgatcgtgccgttaacacacccgctttcga

SEQ ID NO: 172281 - DNA, 37 bp, Artificial Sequence
  Synthetic oligonucleotide
atagggcaggggtgggcggggcagtttcgattgagga

SEQ ID NO: 172282 - DNA, 36 bp, Artificial Sequence
  Synthetic oligonucleotide
tttgtccagcccatggtccctgcccacccatccgga

SEQ ID NO: 172283 - DNA, 37 bp, Artificial Sequence
  Synthetic oligonucleotide
gacgtagggcacgtacagtagcagggggaatggcgga

SEQ ID NO: 172284 - DNA, 37 bp, Artificial Sequence
  Synthetic oligonucleotide
tagggggaagggtgggttagcacgtcgatatcgggga

SEQ ID NO: 172285 - DNA, 37 bp, Artificial Sequence
  Synthetic oligonucleotide
atgagagggcggcaggaaatgaagaggggggtgggga

SEQ ID NO: 172286 - DNA, 36 bp, Artificial Sequence
  Synthetic oligonucleotide
gtcaccgtctttgccttccgccgtcttacctctgga

SEQ ID NO: 172287 - DNA, 37 bp, Artificial Sequence
  Synthetic oligonucleotide
gtgagccccatctatccagccgcccctgccttctgga

SEQ ID NO: 172288 - DNA, 38 bp, Artificial Sequence
  Synthetic oligonucleotide
tcatacgcggtggaggacgggaaaaacaagggggatga

SEQ ID NO: 172289 - DNA, 38 bp, Artificial Sequence
  Synthetic oligonucleotide
ggtacaccgccagtccttcctccaccgaccccaactga

SEQ ID NO: 172290 - DNA, 37 bp, Artificial Sequence
  Synthetic oligonucleotide
tcacactcgcccgctgactcaatacgctcctgactga

SEQ ID NO: 172291 - DNA, 38 bp, Artificial Sequence
  Synthetic oligonucleotide
ttcacctagcctcacacgcatttgtccatctatcctga

SEQ ID NO: 172292 - DNA, 37 bp, Artificial Sequence
  Synthetic oligonucleotide
ttgtgatcccctccggatgtgcctgccctcttcctga

SEQ ID NO: 172293 - DNA, 38 bp, Artificial Sequence
  Synthetic oligonucleotide
gcacagtcagactcagaaatccgctcctcccccgctga

SEQ ID NO: 172294 - DNA, 35 bp, Artificial Sequence
  Synthetic oligonucleotide
tgaccgatgcccgccgcctgctacttctgctctga

SEQ ID NO: 172295 - DNA, 37 bp, Artificial Sequence
  Synthetic oligonucleotide
acctcggcgcatgttcaccacgactctctctctctga

SEQ ID NO: 172296 - DNA, 37 bp, Artificial Sequence
  Synthetic oligonucleotide
tgcataccagcattgcgtcgcttcccttcccgcgtga

SEQ ID NO: 172297 - DNA, 38 bp, Artificial Sequence
  Synthetic oligonucleotide
tgtgaacctcccccactcctcggctaaagagacggtga

SEQ ID NO: 172298 - DNA, 38 bp, Artificial Sequence
  Synthetic oligonucleotide
acgccccccctacgcctcaagacctgttcctcgggtga

SEQ ID NO: 172299 - DNA, 38 bp, Artificial Sequence
  Synthetic oligonucleotide
ggggcgggtacagctggggttcaaggtacagggggtga

SEQ ID NO: 172300 - DNA, 37 bp, Artificial Sequence
  Synthetic oligonucleotide
tcactccgccattatattcgtactcaccgaagtgtga

SEQ ID NO: 172301 - DNA, 38 bp, Artificial Sequence
  Synthetic oligonucleotide
gtccttgcccggctttggcttccaatcgacccccttga

SEQ ID NO: 172302 - DNA, 38 bp, Artificial Sequence
  Synthetic oligonucleotide
gccacccacgtacggtattacgttcgttcaccttttga

SEQ ID NO: 172303 - DNA, 35 bp, Artificial Sequence
  Synthetic oligonucleotide
tctggccacgcccgttatcttacccgtgattccta

SEQ ID NO: 172304 - DNA, 36 bp, Artificial Sequence
  Synthetic oligonucleotide
ttacgccccccgcgcacccctgctgtctcgtacgta

SEQ ID NO: 172305 - DNA, 36 bp, Artificial Sequence
  Synthetic oligonucleotide
atcacatgccgtggcattgcgtccctcccgttgtta

SEQ ID NO: 172306 - DNA, 35 bp, Artificial Sequence
  Synthetic oligonucleotide
gcctccgttaccaccgctcacgtgcgactcgcaac

SEQ ID NO: 172307 - DNA, 35 bp, Artificial Sequence
  Synthetic oligonucleotide
agatctccgccaatgcccctagcataccactacac

SEQ ID NO: 172308 - DNA, 35 bp, Artificial Sequence
  Synthetic oligonucleotide
gagtgcagcctacctctctgtttgcctaccagcac

SEQ ID NO: 172309 - DNA, 35 bp, Artificial Sequence
  Synthetic oligonucleotide
ttaaccctcctgctttcttattcagtgcctgaacc

SEQ ID NO: 172310 - DNA, 35 bp, Artificial Sequence
  Synthetic oligonucleotide
ttgaccactctcccgaacattatcgacctgtgacc

SEQ ID NO: 172311 - DNA, 35 bp, Artificial Sequence
  Synthetic oligonucleotide
gatgccagagcctcatttgcccttttccactgccc

SEQ ID NO: 172312 - DNA, 35 bp, Artificial Sequence
  Synthetic oligonucleotide
gacccgcagggtgtggttccactcacttcgttccc

SEQ ID NO: 172313 - DNA, 35 bp, Artificial Sequence
  Synthetic oligonucleotide
tccttacgcctccttctccggacaatacgacctcc

SEQ ID NO: 172314 - DNA, 35 bp, Artificial Sequence
  Synthetic oligonucleotide
ttgtcctcacatcttgccgccgagctgccgattcc

SEQ ID NO: 172315 - DNA, 35 bp, Artificial Sequence
  Synthetic oligonucleotide
atggcgctcagtcttcggttggttctatctcttcc

SEQ ID NO: 172316 - DNA, 35 bp, Artificial Sequence
  Synthetic oligonucleotide
gcacggtgcctcccgcgaataagctgagccgttcc

SEQ ID NO: 172317 - DNA, 35 bp, Artificial Sequence
  Synthetic oligonucleotide
gacctacccccgatcactgtcggccgggccgttcc

SEQ ID NO: 172318 - DNA, 35 bp, Artificial Sequence
  Synthetic oligonucleotide
taccatctcggacccacccgcccctcgctatcagc

SEQ ID NO: 172319 - DNA, 35 bp, Artificial Sequence
  Synthetic oligonucleotide
aacatcccgttgccctcacaaacccattgctccgc

SEQ ID NO: 172320 - DNA, 35 bp, Artificial Sequence
  Synthetic oligonucleotide
ttcgatccttgctcatgctcgttgctctattccgc

SEQ ID NO: 172321 - DNA, 35 bp, Artificial Sequence
  Synthetic oligonucleotide
gggagcatctgggaagggggggaatcggaaggcgc

SEQ ID NO: 172322 - DNA, 35 bp, Artificial Sequence
  Synthetic oligonucleotide
tccttcccgcctggatcttcatatttgacgtatgc

SEQ ID NO: 172323 - DNA, 35 bp, Artificial Sequence
  Synthetic oligonucleotide
gaagcgatcgcccccgttcactcgcctgtcacatc

SEQ ID NO: 172324 - DNA, 35 bp, Artificial Sequence
  Synthetic oligonucleotide
gtctccgtgctgtttttgccccccgctgtacactc

SEQ ID NO: 172325 - DNA, 35 bp, Artificial Sequence
  Synthetic oligonucleotide
gtaacggccacccgtagtatttcttccattgtctc

SEQ ID NO: 172326 - DNA, 36 bp, Artificial Sequence
  Synthetic oligonucleotide
tgcctcgctccctccgtcctgctccgtacctaagtc

SEQ ID NO: 172327 - DNA, 35 bp, Artificial Sequence
  Synthetic oligonucleotide
ttctgtacacgacacactgttcatccccatggttc

SEQ ID NO: 172328 - DNA, 36 bp, Artificial Sequence
  Synthetic oligonucleotide
gtgggcggataacggggatgggggcttaggacgcag

SEQ ID NO: 172329 - DNA, 35 bp, Artificial Sequence
  Synthetic oligonucleotide
ttccctgccgccccttcgtttcgatacctcccccg

SEQ ID NO: 172330 - DNA, 34 bp, Artificial Sequence
  Synthetic oligonucleotide
accgtacgacttcagtgcactctctcatatcccg

SEQ ID NO: 172331 - DNA, 35 bp, Artificial Sequence
  Synthetic oligonucleotide
gtcacccgctgtactggtccttaactgatgatccg

SEQ ID NO: 172332 - DNA, 35 bp, Artificial Sequence
  Synthetic oligonucleotide
aaccccccctcccacatgctgtgtaccctgctccg

SEQ ID NO: 172333 - DNA, 35 bp, Artificial Sequence
  Synthetic oligonucleotide
gaggggtggtcgggtaattaggcgggtgaagagcg

SEQ ID NO: 172334 - DNA, 35 bp, Artificial Sequence
  Synthetic oligonucleotide
tggatccggctcgctccccttacctggtcacttgg

SEQ ID NO: 172335 - DNA, 35 bp, Artificial Sequence
  Synthetic oligonucleotide
tccgggagtacggggggggcgaggcggaacaaatg

SEQ ID NO: 172336 - DNA, 35 bp, Artificial Sequence
  Synthetic oligonucleotide
tccgtcgccgggctgcctgtgatgcctcctccgtg

SEQ ID NO: 172337 - DNA, 35 bp, Artificial Sequence
  Synthetic oligonucleotide
atgcgctcgtgaatgtaccgccccccacttatgtg

SEQ ID NO: 172338 - DNA, 35 bp, Artificial Sequence
  Synthetic oligonucleotide
tactgttatcgcccctgcctctctttggatcacat

SEQ ID NO: 172339 - DNA, 35 bp, Artificial Sequence
  Synthetic oligonucleotide
accatgcgccacaccataagtcagcccgtctccat

SEQ ID NO: 172340 - DNA, 35 bp, Artificial Sequence
  Synthetic oligonucleotide
attgggtacgccgcacaccatgtcactactctcat

SEQ ID NO: 172341 - DNA, 35 bp, Artificial Sequence
  Synthetic oligonucleotide
aaacccaccagcctcacgccccttcttcacctact

SEQ ID NO: 172342 - DNA, 35 bp, Artificial Sequence
  Synthetic oligonucleotide
agatgcgcgacgcctattcagtctccggtcctact

SEQ ID NO: 172343 - DNA, 35 bp, Artificial Sequence
  Synthetic oligonucleotide
gagcatgtcggggtctcgggtcactctcctcacct

SEQ ID NO: 172344 - DNA, 32 bp, Artificial Sequence
  Synthetic oligonucleotide
tcttactcgcctctgctcgctactaacgacct

SEQ ID NO: 172345 - DNA, 35 bp, Artificial Sequence
  Synthetic oligonucleotide
tacgatgctacccatgttttgaacgccgccgacct

SEQ ID NO: 172346 - DNA, 35 bp, Artificial Sequence
  Synthetic oligonucleotide
tccgacgccttttgcactacgcttattgactacct

SEQ ID NO: 172347 - DNA, 35 bp, Artificial Sequence
  Synthetic oligonucleotide
gatgggcgcatgcacttcctcccgtaccaacatct

SEQ ID NO: 172348 - DNA, 35 bp, Artificial Sequence
  Synthetic oligonucleotide
agcctcctcgccacagtcttggttccgaatgctct

SEQ ID NO: 172349 - DNA, 35 bp, Artificial Sequence
  Synthetic oligonucleotide
gaaaccccccgcccgcatctccgctgccatgccgt

SEQ ID NO: 172350 - DNA, 35 bp, Artificial Sequence
  Synthetic oligonucleotide
ttgccccctccttgccgctgtcctaaacctccggt

SEQ ID NO: 172351 - DNA, 35 bp, Artificial Sequence
  Synthetic oligonucleotide
actgaaagtcgcacggcttgcatccaccatcctgt

SEQ ID NO: 172352 - DNA, 35 bp, Artificial Sequence
  Synthetic oligonucleotide
actcccctccacgtcttcactcagcgccggcactt

SEQ ID NO: 172353 - DNA, 35 bp, Artificial Sequence
  Synthetic oligonucleotide
gatgctgggtcgcctgtctcgtttcggttctcctt

SEQ ID NO: 172354 - DNA, 35 bp, Artificial Sequence
  Synthetic oligonucleotide
ggacactgtgctgctaagcataacacccgttcctt

SEQ ID NO: 172355 - DNA, 35 bp, Artificial Sequence
  Synthetic oligonucleotide
ggtgggagggcgggctcgcgggtgaaggcggattt

SEQ ID NO: 172356 - DNA, 36 bp, Artificial Sequence
  Synthetic oligonucleotide
tacgcatcctgctctgctatatatatccactgccaa

SEQ ID NO: 172357 - DNA, 36 bp, Artificial Sequence
  Synthetic oligonucleotide
aggagcccacactgacccctactttgagcccgcaca

SEQ ID NO: 172358 - DNA, 35 bp, Artificial Sequence
  Synthetic oligonucleotide
accgccacttctccctggcccacttgaactcgaca

SEQ ID NO: 172359 - DNA, 36 bp, Artificial Sequence
  Synthetic oligonucleotide
gacaggaaggccagccatcctcgctatcctcctaca

SEQ ID NO: 172360 - DNA, 35 bp, Artificial Sequence
  Synthetic oligonucleotide
aagtgtcgcccccagccgttttcctcgcgtttaca

SEQ ID NO: 172361 - DNA, 35 bp, Artificial Sequence
  Synthetic oligonucleotide
acaccaccccacatgtcacttagccgccctcacca

SEQ ID NO: 172362 - DNA, 36 bp, Artificial Sequence
  Synthetic oligonucleotide
gtacatgcctctacgttcgtcttttcgttttcccca

SEQ ID NO: 172363 - DNA, 35 bp, Artificial Sequence
  Synthetic oligonucleotide
tagttcatcctcttgcttagcccctatccgtgcca

SEQ ID NO: 172364 - DNA, 34 bp, Artificial Sequence
  Synthetic oligonucleotide
actgatccgtccgctagttgttacccttatcgca

SEQ ID NO: 172365 - DNA, 36 bp, Artificial Sequence
  Synthetic oligonucleotide
ttagccgtgtacatggcttttatttgttccgcctca

SEQ ID NO: 172366 - DNA, 35 bp, Artificial Sequence
  Synthetic oligonucleotide
tgctggcgctggctcgtgcgttcttctccttctca

SEQ ID NO: 172367 - DNA, 34 bp, Artificial Sequence
  Synthetic oligonucleotide
acttcaagcatcccatgggccgcctgctctttca

SEQ ID NO: 172368 - DNA, 36 bp, Artificial Sequence
  Synthetic oligonucleotide
aaaagcggggcgtaggggaggagggtgaggggaaga

SEQ ID NO: 172369 - DNA, 37 bp, Artificial Sequence
  Synthetic oligonucleotide
gggatagatcgcaacggtgaaggagcggggggacaga

SEQ ID NO: 172370 - DNA, 36 bp, Artificial Sequence
  Synthetic oligonucleotide
tacaccgcaattcactctcagccgacttcttccaga

SEQ ID NO: 172371 - DNA, 37 bp, Artificial Sequence
  Synthetic oligonucleotide
agagaaccgaggaggaaggggataggcgtttgggaga

SEQ ID NO: 172372 - DNA, 35 bp, Artificial Sequence
  Synthetic oligonucleotide
gtaagccacccccctcgatccccgcccgccataga

SEQ ID NO: 172373 - DNA, 37 bp, Artificial Sequence
  Synthetic oligonucleotide
tccaagccctccgctggcccaaggcaccttaccccga

SEQ ID NO: 172374 - DNA, 36 bp, Artificial Sequence
  Synthetic oligonucleotide
tctggttagcctccttcccgatttagtgccgcccga

SEQ ID NO: 172375 - DNA, 37 bp, Artificial Sequence
  Synthetic oligonucleotide
tgttcccccttagctgtccagtaataccacctcccga

SEQ ID NO: 172376 - DNA, 37 bp, Artificial Sequence
  Synthetic oligonucleotide
atccgcccagctctcaggcattaactactccctccga

SEQ ID NO: 172377 - DNA, 37 bp, Artificial Sequence
  Synthetic oligonucleotide
gatccgcaccgtaggtacgtccgttccgccctctcga

SEQ ID NO: 172378 - DNA, 35 bp, Artificial Sequence
  Synthetic oligonucleotide
acacagtcggattcccccacccccacagccttcga

SEQ ID NO: 172379 - DNA, 37 bp, Artificial Sequence
  Synthetic oligonucleotide
gcagtggaatgcagggagagggagggagctgaaggga

SEQ ID NO: 172380 - DNA, 37 bp, Artificial Sequence
  Synthetic oligonucleotide
cacggggtagtgccgtcagggcggggttagccgggga

SEQ ID NO: 172381 - DNA, 36 bp, Artificial Sequence
  Synthetic oligonucleotide
gatgccgacctaaggggagaatggatggatgatgga

SEQ ID NO: 172382 - DNA, 38 bp, Artificial Sequence
  Synthetic oligonucleotide
ggtggagggagcaaggaccggaaagaaatgggggatga

SEQ ID NO: 172383 - DNA, 35 bp, Artificial Sequence
  Synthetic oligonucleotide
gttcccgccccatccaaatgcacgtctaattatga

SEQ ID NO: 172384 - DNA, 38 bp, Artificial Sequence
  Synthetic oligonucleotide
atcatccaccctcctcgtgtccttgcgagatcaactga

SEQ ID NO: 172385 - DNA, 38 bp, Artificial Sequence
  Synthetic oligonucleotide
gtgagccgcattgggctcctgtcaccttcgccacctga

SEQ ID NO: 172386 - DNA, 37 bp, Artificial Sequence
  Synthetic oligonucleotide
tccctccccccaactcgtgacattaagggaaccctga

SEQ ID NO: 172387 - DNA, 38 bp, Artificial Sequence
  Synthetic oligonucleotide
atcgcccgccctcattgcgccctatgttacatatctga

SEQ ID NO: 172388 - DNA, 37 bp, Artificial Sequence
  Synthetic oligonucleotide
agttagggagccaggagggaaggtgggcagcaagtga

SEQ ID NO: 172389 - DNA, 38 bp, Artificial Sequence
  Synthetic oligonucleotide
agagggggggaggagaggcggtagttaggccgcagtga

SEQ ID NO: 172390 - DNA, 37 bp, Artificial Sequence
  Synthetic oligonucleotide
gtgaaacaagggggtagaacgggaatgccaggcgtga

SEQ ID NO: 172391 - DNA, 38 bp, Artificial Sequence
  Synthetic oligonucleotide
ggggaagtgggggagggggagtgatgtggctgtggtga

SEQ ID NO: 172392 - DNA, 37 bp, Artificial Sequence
  Synthetic oligonucleotide
gggtggaggggtggaagaggatagcggaacaatgtga

SEQ ID NO: 172393 - DNA, 38 bp, Artificial Sequence
  Synthetic oligonucleotide
tccgaccccctctgctctcgcatgaatacggtctgtga

SEQ ID NO: 172394 - DNA, 38 bp, Artificial Sequence
  Synthetic oligonucleotide
gagtcaccccgcctgtactatgttgattctttccttga

SEQ ID NO: 172395 - DNA, 38 bp, Artificial Sequence
  Synthetic oligonucleotide
tcacgctgccctctgctttatgggctccctcctcttga

SEQ ID NO: 172396 - DNA, 37 bp, Artificial Sequence
  Synthetic oligonucleotide
gagtacgcaaggaggagaaataggcggtattagttga

SEQ ID NO: 172397 - DNA, 37 bp, Artificial Sequence
  Synthetic oligonucleotide
tccacctctccaatctatgtacgactccatgttttga

SEQ ID NO: 172398 - DNA, 35 bp, Artificial Sequence
  Synthetic oligonucleotide
tttagcacacctccacatgccctcaccgacttata

SEQ ID NO: 172399 - DNA, 36 bp, Artificial Sequence
  Synthetic oligonucleotide
atgactcatcacatctctatggtccagccccaccta

SEQ ID NO: 172400 - DNA, 36 bp, Artificial Sequence
  Synthetic oligonucleotide
tcacgccatcatgcatgcatggtctgtaacatccta

SEQ ID NO: 172401 - DNA, 36 bp, Artificial Sequence
  Synthetic oligonucleotide
tgttaccacccactgcacctgtatacgctcttcgta

SEQ ID NO: 172402 - DNA, 36 bp, Artificial Sequence
  Synthetic oligonucleotide
gaccgagcctggtccctcctcctctccacctaggta

SEQ ID NO: 172403 - DNA, 36 bp, Artificial Sequence
  Synthetic oligonucleotide
tacgcgcaccagcccgcttcgtttccaacttttgta

SEQ ID NO: 172404 - DNA, 36 bp, Artificial Sequence
  Synthetic oligonucleotide
taccgccacctgctgcctcctcgctccggagactta

SEQ ID NO: 172405 - DNA, 35 bp, Artificial Sequence
  Synthetic oligonucleotide
gtgccccccgcggcctcagcctgccgcccccgtta

SEQ ID NO: 172406 - DNA, 35 bp, Artificial Sequence
  Synthetic oligonucleotide
ttcgcatactcactgcttgcgcgatactacctaac

SEQ ID NO: 172407 - DNA, 35 bp, Artificial Sequence
  Synthetic oligonucleotide
tccccctccccatgtatgatcacgcgaacagccac

SEQ ID NO: 172408 - DNA, 35 bp, Artificial Sequence
  Synthetic oligonucleotide
tgcccacgctacatctcgcgctgcgccctccgcac

SEQ ID NO: 172409 - DNA, 34 bp, Artificial Sequence
  Synthetic oligonucleotide
ttcatagtccaggactatgcaccccgattctacc

SEQ ID NO: 172410 - DNA, 35 bp, Artificial Sequence
  Synthetic oligonucleotide
gctagccctccatctacgtccggccccttattacc

SEQ ID NO: 172411 - DNA, 35 bp, Artificial Sequence
  Synthetic oligonucleotide
gcacggcaatgtccttcgccggtacctatcacccc

SEQ ID NO: 172412 - DNA, 35 bp, Artificial Sequence
  Synthetic oligonucleotide
ggaccgccctctcaagaccgttgctagttattccc

SEQ ID NO: 172413 - DNA, 35 bp, Artificial Sequence
  Synthetic oligonucleotide
accagggccctccatttgagaactcgactaccgcc

SEQ ID NO: 172414 - DNA, 35 bp, Artificial Sequence
  Synthetic oligonucleotide
actgcccctaagttttcctgccaggttcactcgcc

SEQ ID NO: 172415 - DNA, 35 bp, Artificial Sequence
  Synthetic oligonucleotide
tgcgctccggctttgccaattttacatcgttcgcc

SEQ ID NO: 172416 - DNA, 35 bp, Artificial Sequence
  Synthetic oligonucleotide
tgagatgctgtatctgctcattggtctgtcctgcc

SEQ ID NO: 172417 - DNA, 35 bp, Artificial Sequence
  Synthetic oligonucleotide
agccctgcctcaaacttgaagtcccacctttgtcc

SEQ ID NO: 172418 - DNA, 35 bp, Artificial Sequence
  Synthetic oligonucleotide
tccatccgccttcccgttctcgtacgagtacttcc

SEQ ID NO: 172419 - DNA, 35 bp, Artificial Sequence
  Synthetic oligonucleotide
tagcatcgcgcttatttgtctccatgtccgcttcc

SEQ ID NO: 172420 - DNA, 35 bp, Artificial Sequence
  Synthetic oligonucleotide
ggattgcctccatcgttgacccagacccactcagc

SEQ ID NO: 172421 - DNA, 35 bp, Artificial Sequence
  Synthetic oligonucleotide
gctgggacccgcccacccctatacctttcggacgc

SEQ ID NO: 172422 - DNA, 35 bp, Artificial Sequence
  Synthetic oligonucleotide
accccaagcacctgctcctgctaacgaaccaccgc

SEQ ID NO: 172423 - DNA, 35 bp, Artificial Sequence
  Synthetic oligonucleotide
agcacccgcctaggagacttgtgtccttcctccgc

SEQ ID NO: 172424 - DNA, 35 bp, Artificial Sequence
  Synthetic oligonucleotide
gcgcaatgtccggttcttggtcctgctcgactcgc

SEQ ID NO: 172425 - DNA, 35 bp, Artificial Sequence
  Synthetic oligonucleotide
tgtacccaccctccatagctcctcgttctacgggc

SEQ ID NO: 172426 - DNA, 35 bp, Artificial Sequence
  Synthetic oligonucleotide
gcagccccccctcacattctataagtctccctggc

SEQ ID NO: 172427 - DNA, 35 bp, Artificial Sequence
  Synthetic oligonucleotide
tgcaccactgcaggtccctctccagcctcccatgc

SEQ ID NO: 172428 - DNA, 35 bp, Artificial Sequence
  Synthetic oligonucleotide
gcatcaccttatgccgaaattgggtcgccccctgc

SEQ ID NO: 172429 - DNA, 34 bp, Artificial Sequence
  Synthetic oligonucleotide
tagactcgctttatcccgggtaataccgccctgc

SEQ ID NO: 172430 - DNA, 35 bp, Artificial Sequence
  Synthetic oligonucleotide
gacgacttgactgtttaatcttcccttgtccctgc

SEQ ID NO: 172431 - DNA, 35 bp, Artificial Sequence
  Synthetic oligonucleotide
atcacggcccttctgagctcttcctgcctctctgc

SEQ ID NO: 172432 - DNA, 35 bp, Artificial Sequence
  Synthetic oligonucleotide
gcccccaccttgttactgacgtcgtcctatatatc

SEQ ID NO: 172433 - DNA, 35 bp, Artificial Sequence
  Synthetic oligonucleotide
tccgtctccgttcgcttgctcaatgcacctccctc

SEQ ID NO: 172434 - DNA, 35 bp, Artificial Sequence
  Synthetic oligonucleotide
atcatccctcgtcccgtcagcaatacagctgcctc

SEQ ID NO: 172435 - DNA, 35 bp, Artificial Sequence
  Synthetic oligonucleotide
gtctgctccctccggctcaacgtgggcttcctctc

SEQ ID NO: 172436 - DNA, 35 bp, Artificial Sequence
  Synthetic oligonucleotide
gtcactaccccattaatgcgaactaactgtctctc

SEQ ID NO: 172437 - DNA, 35 bp, Artificial Sequence
  Synthetic oligonucleotide
gcgtaccctcgcttctcgtttacttgttaagtctc

SEQ ID NO: 172438 - DNA, 35 bp, Artificial Sequence
  Synthetic oligonucleotide
gctgtatcccgcgcgtttataccgcccttattctc

SEQ ID NO: 172439 - DNA, 35 bp, Artificial Sequence
  Synthetic oligonucleotide
gtgaaccgacaactccccgttctatcaccccgttc

SEQ ID NO: 172440 - DNA, 35 bp, Artificial Sequence
  Synthetic oligonucleotide
tttaaccccacacatctcgaatgagcgcctcgttc

SEQ ID NO: 172441 - DNA, 35 bp, Artificial Sequence
  Synthetic oligonucleotide
gtgcaagtccgcctaaatttcgccgcccgttcaag

SEQ ID NO: 172442 - DNA, 35 bp, Artificial Sequence
  Synthetic oligonucleotide
gccgtgaagaagggcgggaagtgattgggtggaag

SEQ ID NO: 172443 - DNA, 35 bp, Artificial Sequence
  Synthetic oligonucleotide
ggtctgctctgccgttagtcgtcccgtcctcccag

SEQ ID NO: 172444 - DNA, 35 bp, Artificial Sequence
  Synthetic oligonucleotide
atgtgcctcaccatttgtgcggtttgtatcccccg

SEQ ID NO: 172445 - DNA, 35 bp, Artificial Sequence
  Synthetic oligonucleotide
tcactgttccacctcatcgttcaacgcgtgttgcg

SEQ ID NO: 172446 - DNA, 35 bp, Artificial Sequence
  Synthetic oligonucleotide
gaacccttctacgcacctgacaacgcactgcctcg

SEQ ID NO: 172447 - DNA, 35 bp, Artificial Sequence
  Synthetic oligonucleotide
actcccccccaggactggaccgattcacacgctcg

SEQ ID NO: 172448 - DNA, 35 bp, Artificial Sequence
  Synthetic oligonucleotide
gtcccaccgcactaatgtttccgtctcccttttcg

SEQ ID NO: 172449 - DNA, 35 bp, Artificial Sequence
  Synthetic oligonucleotide
gatccgttctcccaccagcgtcctctctggcctgg

SEQ ID NO: 172450 - DNA, 35 bp, Artificial Sequence
  Synthetic oligonucleotide
tccgccacggactgaacccctcttgcccgtccttg

SEQ ID NO: 172451 - DNA, 35 bp, Artificial Sequence
  Synthetic oligonucleotide
acccatccctcatatatctactctcatcacgcttg

SEQ ID NO: 172452 - DNA, 35 bp, Artificial Sequence
  Synthetic oligonucleotide
gttgcctccaccaatcgcccttcccgtctctcttg

SEQ ID NO: 172453 - DNA, 35 bp, Artificial Sequence
  Synthetic oligonucleotide
acctccgtataggatcgccacttgcctttcgccat

SEQ ID NO: 172454 - DNA, 35 bp, Artificial Sequence
  Synthetic oligonucleotide
gccgtctcagctccttccgtcgtcacgtaccgtat

SEQ ID NO: 172455 - DNA, 35 bp, Artificial Sequence
  Synthetic oligonucleotide
tagtacacctcttcgttttggcctgttctttaact

SEQ ID NO: 172456 - DNA, 35 bp, Artificial Sequence
  Synthetic oligonucleotide
ttccgtccgcacgcctcccacaagtactatggcct

SEQ ID NO: 172457 - DNA, 35 bp, Artificial Sequence
  Synthetic oligonucleotide
agtgacgccccttttctgtctgatcttccctggct

SEQ ID NO: 172458 - DNA, 35 bp, Artificial Sequence
  Synthetic oligonucleotide
gtgcctggcctcccgaccgctgaacagtgaactct

SEQ ID NO: 172459 - DNA, 35 bp, Artificial Sequence
  Synthetic oligonucleotide
atcgactctggtccaatggtctctgccacccttct

SEQ ID NO: 172460 - DNA, 35 bp, Artificial Sequence
  Synthetic oligonucleotide
tcctcatccaatcgatgcccctggtaaccccttct

SEQ ID NO: 172461 - DNA, 35 bp, Artificial Sequence
  Synthetic oligonucleotide
gcaccgctaggttcctgtgccccttgtcttatcgt

SEQ ID NO: 172462 - DNA, 35 bp, Artificial Sequence
  Synthetic oligonucleotide
gtcccatcgaatctggtcgcctttcccctccatgt

SEQ ID NO: 172463 - DNA, 35 bp, Artificial Sequence
  Synthetic oligonucleotide
tcacgtcagatctacatccgctccttctatcctgt

SEQ ID NO: 172464 - DNA, 35 bp, Artificial Sequence
  Synthetic oligonucleotide
gtgcaccattacgtcgcctcgcaatcctcgccatt

SEQ ID NO: 172465 - DNA, 35 bp, Artificial Sequence
  Synthetic oligonucleotide
acgacccgatagccctgccatttgctaagctcctt

SEQ ID NO: 172466 - DNA, 35 bp, Artificial Sequence
  Synthetic oligonucleotide
ttcagacgatgggtatctctgtgggtgggagggtt

SEQ ID NO: 172467 - DNA, 35 bp, Artificial Sequence
  Synthetic oligonucleotide
gtctgccccctcccgcagctcttaatgacccattt

SEQ ID NO: 172468 - DNA, 35 bp, Artificial Sequence
  Synthetic oligonucleotide
ggtcacatcaccagtcgtcacacgcgccccccttt

SEQ ID NO: 172469 - DNA, 35 bp, Artificial Sequence
  Synthetic oligonucleotide
gcacaggcctcattcgttatcccgctcctctcttt

SEQ ID NO: 172470 - DNA, 36 bp, Artificial Sequence
  Synthetic oligonucleotide
tccgagcgccgtcaacgcacttcccatcttggccaa

SEQ ID NO: 172471 - DNA, 36 bp, Artificial Sequence
  Synthetic oligonucleotide
gacacctatgtcgaactgaccacaatccccccgtaa

SEQ ID NO: 172472 - DNA, 35 bp, Artificial Sequence
  Synthetic oligonucleotide
aggagtaggcaagggggaggtcataggcatcgtaa

SEQ ID NO: 172473 - DNA, 36 bp, Artificial Sequence
  Synthetic oligonucleotide
tccagacggggtaagggagggtgttgggcgctttaa

SEQ ID NO: 172474 - DNA, 36 bp, Artificial Sequence
  Synthetic oligonucleotide
ccaccgatccccgggttcacttgcctgttcacaaca

SEQ ID NO: 172475 - DNA, 36 bp, Artificial Sequence
  Synthetic oligonucleotide
gccgcacgttccgcccaccatatggcactacccaca

SEQ ID NO: 172476 - DNA, 36 bp, Artificial Sequence
  Synthetic oligonucleotide
ttgtactcaccgtcacccttggcccctctgcataca

SEQ ID NO: 172477 - DNA, 36 bp, Artificial Sequence
  Synthetic oligonucleotide
tcgcccctgcatcgccctgtccttgatgcttctaca

SEQ ID NO: 172478 - DNA, 36 bp, Artificial Sequence
  Synthetic oligonucleotide
acgcccccctacgggtatacactttgcttcacacca

SEQ ID NO: 172479 - DNA, 35 bp, Artificial Sequence
  Synthetic oligonucleotide
atcccaatagtcagcccatactactcctccaccca

SEQ ID NO: 172480 - DNA, 36 bp, Artificial Sequence
  Synthetic oligonucleotide
gccgcatctcgattctgatccattctaccacgccca

SEQ ID NO: 172481 - DNA, 36 bp, Artificial Sequence
  Synthetic oligonucleotide
gagacatgctccagtctgcctcccttcgtccgccca

SEQ ID NO: 172482 - DNA, 35 bp, Artificial Sequence
  Synthetic oligonucleotide
tcaacactcccgcaatctcgtttgttcactctcca

SEQ ID NO: 172483 - DNA, 35 bp, Artificial Sequence
  Synthetic oligonucleotide
atcctcgccggtctagcaagcgcactctcggtcca

SEQ ID NO: 172484 - DNA, 36 bp, Artificial Sequence
  Synthetic oligonucleotide
tgttcacccgcctggttcgcccctcatgcccatgca

SEQ ID NO: 172485 - DNA, 36 bp, Artificial Sequence
  Synthetic oligonucleotide
aacgtgaggagtgggaaggccatagaggggagtgca

SEQ ID NO: 172486 - DNA, 36 bp, Artificial Sequence
  Synthetic oligonucleotide
actccctccccaaattgattgccctggtgttcatca

SEQ ID NO: 172487 - DNA, 35 bp, Artificial Sequence
  Synthetic oligonucleotide
tacgtcctatcccagcccttccatgtcgtgcctca

SEQ ID NO: 172488 - DNA, 35 bp, Artificial Sequence
  Synthetic oligonucleotide
gacacagacaggttcgccttagtcttcacatctca

SEQ ID NO: 172489 - DNA, 36 bp, Artificial Sequence
  Synthetic oligonucleotide
ttgacgcccccgtcgtagggcactcgaccctcttca

SEQ ID NO: 172490 - DNA, 36 bp, Artificial Sequence
  Synthetic oligonucleotide
gcaccgcccacttcaggccgtcgcccatggtcttca

SEQ ID NO: 172491 - DNA, 37 bp, Artificial Sequence
  Synthetic oligonucleotide
tgccgcctcaccgctgaccggcccctaatttacccga

SEQ ID NO: 172492 - DNA, 36 bp, Artificial Sequence
  Synthetic oligonucleotide
aacacgcccatcggtatgccacttctctccgcccga

SEQ ID NO: 172493 - DNA, 37 bp, Artificial Sequence
  Synthetic oligonucleotide
tgtacagggggaggcacggcggaaaggacgtaagcga

SEQ ID NO: 172494 - DNA, 37 bp, Artificial Sequence
  Synthetic oligonucleotide
atccacgtacgccccctcgcgtcagtcccccgctcga

SEQ ID NO: 172495 - DNA, 37 bp, Artificial Sequence
  Synthetic oligonucleotide
tccacccacaccatactagttttagcagttgtttcga

SEQ ID NO: 172496 - DNA, 36 bp, Artificial Sequence
  Synthetic oligonucleotide
gcaccacccggaatgtaccatcctcaccgtttagga

SEQ ID NO: 172497 - DNA, 37 bp, Artificial Sequence
  Synthetic oligonucleotide
taacaccccgcctgttcgttactttcaccaccacgga

SEQ ID NO: 172498 - DNA, 36 bp, Artificial Sequence
  Synthetic oligonucleotide
atgggcttgggggggtgggctggacaagagcaggga

SEQ ID NO: 172499 - DNA, 37 bp, Artificial Sequence
  Synthetic oligonucleotide
tgcaccccacacatgcactccccgcttggcctcggga

SEQ ID NO: 172500 - DNA, 37 bp, Artificial Sequence
  Synthetic oligonucleotide
gtcatgggggaggggggggatgagtgattcaagggga

SEQ ID NO: 172501 - DNA, 36 bp, Artificial Sequence
  Synthetic oligonucleotide
tctgggagggggacactgaggggtatgtcaggggga

SEQ ID NO: 172502 - DNA, 36 bp, Artificial Sequence
  Synthetic oligonucleotide
gtgaccgtgcggataaggggtagggcggtgcatgga

SEQ ID NO: 172503 - DNA, 37 bp, Artificial Sequence
  Synthetic oligonucleotide
aaagggcggagggggggggtgagagggggtagatgga

SEQ ID NO: 172504 - DNA, 36 bp, Artificial Sequence
  Synthetic oligonucleotide
tctggcacatctcccgctctgttcgcgctatctgga

SEQ ID NO: 172505 - DNA, 36 bp, Artificial Sequence
  Synthetic oligonucleotide
agaggtgaaggagggaggctgataacagggggatga

SEQ ID NO: 172506 - DNA, 38 bp, Artificial Sequence
  Synthetic oligonucleotide
tctgtgtgtaccgtcccctgccctcgagcccacactga

SEQ ID NO: 172507 - DNA, 37 bp, Artificial Sequence
  Synthetic oligonucleotide
ggagcagtacagttgctcctctcttcgccgtgcctga

SEQ ID NO: 172508 - DNA, 37 bp, Artificial Sequence
  Synthetic oligonucleotide
atccgctgtatacctgcccccgaactacctccgctga

SEQ ID NO: 172509 - DNA, 38 bp, Artificial Sequence
  Synthetic oligonucleotide
acgctccccgccccgttgtggatttttccccgttctga

SEQ ID NO: 172510 - DNA, 36 bp, Artificial Sequence
  Synthetic oligonucleotide
tgttgactctggcctattatgtttgctccaccgtga

SEQ ID NO: 172511 - DNA, 36 bp, Artificial Sequence
  Synthetic oligonucleotide
ggtgccactcggcggtgggaagggacgggagggtga

SEQ ID NO: 172512 - DNA, 38 bp, Artificial Sequence
  Synthetic oligonucleotide
tccgccattcgcccctttcacgtaccggagccttgtga

SEQ ID NO: 172513 - DNA, 36 bp, Artificial Sequence
  Synthetic oligonucleotide
tcttcaccctcgctcctgtgactcactcacgattga

SEQ ID NO: 172514 - DNA, 37 bp, Artificial Sequence
  Synthetic oligonucleotide
gtcaccaacaacgcccttgcccctgccgataccttga

SEQ ID NO: 172515 - DNA, 38 bp, Artificial Sequence
  Synthetic oligonucleotide
tgttgcaccagttctctctattgtgcttctcctgttga

SEQ ID NO: 172516 - DNA, 36 bp, Artificial Sequence
  Synthetic oligonucleotide
ttcatggacgcaccgccacgaacttcttcctgttga

SEQ ID NO: 172517 - DNA, 38 bp, Artificial Sequence
  Synthetic oligonucleotide
atgaccgctcacgagtctttcttcccctccctgtttga

SEQ ID NO: 172518 - DNA, 36 bp, Artificial Sequence
  Synthetic oligonucleotide
gcccgccaagcggctttagcgcgttcctccccccta

SEQ ID NO: 172519 - DNA, 36 bp, Artificial Sequence
  Synthetic oligonucleotide
acgcacccccctggtgaatactcctccgtaagccta

SEQ ID NO: 172520 - DNA, 35 bp, Artificial Sequence
  Synthetic oligonucleotide
acaccctactctgtgcttatcctaagtttgtccta

SEQ ID NO: 172521 - DNA, 35 bp, Artificial Sequence
  Synthetic oligonucleotide
ttaagccctggcttaaacgatactccaccttccta

SEQ ID NO: 172522 - DNA, 35 bp, Artificial Sequence
  Synthetic oligonucleotide
gagcaaagagggcggggtgaaaggtgagggttcta

SEQ ID NO: 172523 - DNA, 36 bp, Artificial Sequence
  Synthetic oligonucleotide
atctgggaccccgcgggtgggaggggcgggaccgta

SEQ ID NO: 172524 - DNA, 36 bp, Artificial Sequence
  Synthetic oligonucleotide
gggagagggaatgggtgtgggggtgtggacggcgta

SEQ ID NO: 172525 - DNA, 35 bp, Artificial Sequence
  Synthetic oligonucleotide
gacggagtgaggacgggggtaaacgctaatgggta

SEQ ID NO: 172526 - DNA, 35 bp, Artificial Sequence
  Synthetic oligonucleotide
gaagacgcacgggggttgaaggccagggggtggta

SEQ ID NO: 172527 - DNA, 35 bp, Artificial Sequence
  Synthetic oligonucleotide
gcccccctcgtgatcgttgccaccgtttgccctta

SEQ ID NO: 172528 - DNA, 35 bp, Artificial Sequence
  Synthetic oligonucleotide
ttcgcaccctccctacctgtaaatcgcgccggtta

SEQ ID NO: 172529 - DNA, 35 bp, Artificial Sequence
  Synthetic oligonucleotide
aaccctgccccgtgcattggcaccctttgaattta

SEQ ID NO: 172530 - DNA, 33 bp, Artificial Sequence
  Synthetic oligonucleotide
tcgtacattcgccccgaccataatgctacttta

SEQ ID NO: 172531 - DNA, 36 bp, Artificial Sequence
  Synthetic oligonucleotide
tcacttccgcccggcgaaatatctctggggccttta

SEQ ID NO: 172532 - DNA, 35 bp, Artificial Sequence
  Synthetic oligonucleotide
acccttcccatcattgtgctcatgcgtttacaaac

SEQ ID NO: 172533 - DNA, 35 bp, Artificial Sequence
  Synthetic oligonucleotide
acaaccccccctggccccgcctcctactcgttgac

SEQ ID NO: 172534 - DNA, 35 bp, Artificial Sequence
  Synthetic oligonucleotide
atgctccatcagcgcgtgtactactgcttacctac

SEQ ID NO: 172535 - DNA, 35 bp, Artificial Sequence
  Synthetic oligonucleotide
gtcacacctccccagcggtcattccccccgcttac

SEQ ID NO: 172536 - DNA, 35 bp, Artificial Sequence
  Synthetic oligonucleotide
gattgcacgcttagctccgtagtctacctctaacc

SEQ ID NO: 172537 - DNA, 35 bp, Artificial Sequence
  Synthetic oligonucleotide
ggtcggacgttccaggcctattgatcccctcgccc

SEQ ID NO: 172538 - DNA, 35 bp, Artificial Sequence
  Synthetic oligonucleotide
aaccggtgcacacgttctctcatgccggtcctccc

SEQ ID NO: 172539 - DNA, 35 bp, Artificial Sequence
  Synthetic oligonucleotide
accagacccacctatattgcgaactcgggatcgcc

SEQ ID NO: 172540 - DNA, 35 bp, Artificial Sequence
  Synthetic oligonucleotide
gtatcacagtttgtgctcccacgcttttcctcgcc

SEQ ID NO: 172541 - DNA, 35 bp, Artificial Sequence
  Synthetic oligonucleotide
ggtccggcgcattccacctcttcgctgtcatgtcc

SEQ ID NO: 172542 - DNA, 35 bp, Artificial Sequence
  Synthetic oligonucleotide
gcctgtcccgttccttcctgcttgttggtaattcc

SEQ ID NO: 172543 - DNA, 35 bp, Artificial Sequence
  Synthetic oligonucleotide
gtcccatccatagcgggtacgcgttcgttacttcc

SEQ ID NO: 172544 - DNA, 35 bp, Artificial Sequence
  Synthetic oligonucleotide
acacatgccccaagtagaacgtcacataaccccgc

SEQ ID NO: 172545 - DNA, 35 bp, Artificial Sequence
  Synthetic oligonucleotide
actaactgcagtgtcgtctactatcattccatcgc

SEQ ID NO: 172546 - DNA, 35 bp, Artificial Sequence
  Synthetic oligonucleotide
gttagcacgccaactctcgcccgttacttccgtgc

SEQ ID NO: 172547 - DNA, 35 bp, Artificial Sequence
  Synthetic oligonucleotide
gccccttgccattcagtttctttgactccagttgc

SEQ ID NO: 172548 - DNA, 35 bp, Artificial Sequence
  Synthetic oligonucleotide
acacgacgcccctggttccgttcttgttacccatc

SEQ ID NO: 172549 - DNA, 35 bp, Artificial Sequence
  Synthetic oligonucleotide
taatgcgccaagtctttctgcttttcctccccatc

SEQ ID NO: 172550 - DNA, 35 bp, Artificial Sequence
  Synthetic oligonucleotide
ttgcgtttcgtcacctccgcccttgccgcctcatc

SEQ ID NO: 172551 - DNA, 35 bp, Artificial Sequence
  Synthetic oligonucleotide
tagacgtacaaccgtggttttgcttagcctctctc

SEQ ID NO: 172552 - DNA, 35 bp, Artificial Sequence
  Synthetic oligonucleotide
gagtgtcaaaagtcgccacccctcgttgatccgtc

SEQ ID NO: 172553 - DNA, 35 bp, Artificial Sequence
  Synthetic oligonucleotide
tctccaacggctgctcgctccccataataccggtc

SEQ ID NO: 172554 - DNA, 35 bp, Artificial Sequence
  Synthetic oligonucleotide
atgctctcaacagatcgaacaccgcccctcatgtc

SEQ ID NO: 172555 - DNA, 35 bp, Artificial Sequence
  Synthetic oligonucleotide
gattgacgggggggattaggggaagggggctgtag

SEQ ID NO: 172556 - DNA, 35 bp, Artificial Sequence
  Synthetic oligonucleotide
acgatgcccttccaccatcttaagaacccagcacg

SEQ ID NO: 172557 - DNA, 35 bp, Artificial Sequence
  Synthetic oligonucleotide
tctccgtaggcccctatgttttagcttctttcccg

SEQ ID NO: 172558 - DNA, 35 bp, Artificial Sequence
  Synthetic oligonucleotide
tcaaccaacggcccctgtctttctcattgcttccg

SEQ ID NO: 172559 - DNA, 36 bp, Artificial Sequence
  Synthetic oligonucleotide
acccgcgtcccttcccaatggcctcgactacccgcg

SEQ ID NO: 172560 - DNA, 35 bp, Artificial Sequence
  Synthetic oligonucleotide
taacccccgacctcctgattatctagactgcatcg

SEQ ID NO: 172561 - DNA, 35 bp, Artificial Sequence
  Synthetic oligonucleotide
gccggagtctccatctcgcattcagttccacctcg

SEQ ID NO: 172562 - DNA, 35 bp, Artificial Sequence
  Synthetic oligonucleotide
gttgtcaccgctgaacgcccaatactcgtacttcg

SEQ ID NO: 172563 - DNA, 35 bp, Artificial Sequence
  Synthetic oligonucleotide
tatcggtgaaggtgaaggtggggagtcggagttcg

SEQ ID NO: 172564 - DNA, 35 bp, Artificial Sequence
  Synthetic oligonucleotide
aaaggaaaccagtgggaggcaggaacgggagaagg

SEQ ID NO: 172565 - DNA, 35 bp, Artificial Sequence
  Synthetic oligonucleotide
acttccctgccctctcagccccgccatactatagg

SEQ ID NO: 172566 - DNA, 35 bp, Artificial Sequence
  Synthetic oligonucleotide
gcttgccccgtagcctgcccgccactcaacttagg

SEQ ID NO: 172567 - DNA, 35 bp, Artificial Sequence
  Synthetic oligonucleotide
gcccggttccgctgtacccttactatctttttggg

SEQ ID NO: 172568 - DNA, 35 bp, Artificial Sequence
  Synthetic oligonucleotide
acctaaggaaagagggaaaaggtgaagaaaggtgg

SEQ ID NO: 172569 - DNA, 35 bp, Artificial Sequence
  Synthetic oligonucleotide
gaaggccccccggtaattgctccattctccacatg

SEQ ID NO: 172570 - DNA, 35 bp, Artificial Sequence
  Synthetic oligonucleotide
gacgcttccagcctttgccccctaacccattagtg

SEQ ID NO: 172571 - DNA, 35 bp, Artificial Sequence
  Synthetic oligonucleotide
tttgtccctcagccgtctcacctacctacccggtg

SEQ ID NO: 172572 - DNA, 35 bp, Artificial Sequence
  Synthetic oligonucleotide
tctcatccacccatacgtacgaaccctgacgccat

SEQ ID NO: 172573 - DNA, 35 bp, Artificial Sequence
  Synthetic oligonucleotide
gaggggaaagatagcagggagacggcggttgagat

SEQ ID NO: 172574 - DNA, 35 bp, Artificial Sequence
  Synthetic oligonucleotide
agcaaatccgggcgggggggctgggcaaatgcgat

SEQ ID NO: 172575 - DNA, 35 bp, Artificial Sequence
  Synthetic oligonucleotide
gtgtagcgcatcctctcgtcctgtccggtctcgat

SEQ ID NO: 172576 - DNA, 34 bp, Artificial Sequence
  Synthetic oligonucleotide
acacgggggggggagggttgcatggggtttaact

SEQ ID NO: 172577 - DNA, 35 bp, Artificial Sequence
  Synthetic oligonucleotide
gttgcctctcacggtacaatcgtccaccacaccct

SEQ ID NO: 172578 - DNA, 34 bp, Artificial Sequence
  Synthetic oligonucleotide
tcacaacaatctgagcgtcaaacagcaaccccct

SEQ ID NO: 172579 - DNA, 35 bp, Artificial Sequence
  Synthetic oligonucleotide
acatgcacggtaactgtctactttggcccccccct

SEQ ID NO: 172580 - DNA, 35 bp, Artificial Sequence
  Synthetic oligonucleotide
agcacctacacctttccgcagacccaacggcccct

SEQ ID NO: 172581 - DNA, 35 bp, Artificial Sequence
  Synthetic oligonucleotide
acccccactccggattgacgcacatcccaacctct

SEQ ID NO: 172582 - DNA, 35 bp, Artificial Sequence
  Synthetic oligonucleotide
ttcgacccacgcactctccgcccgacgacacaagt

SEQ ID NO: 172583 - DNA, 35 bp, Artificial Sequence
  Synthetic oligonucleotide
gtttcccagcatcacttagcccccctgcaccctgt

SEQ ID NO: 172584 - DNA, 35 bp, Artificial Sequence
  Synthetic oligonucleotide
ggcgaacacctgcccgccctgtatactgtaccctt

SEQ ID NO: 172585 - DNA, 35 bp, Artificial Sequence
  Synthetic oligonucleotide
actgccaccgtgttatcaattccaccgtgcctctt

SEQ ID NO: 172586 - DNA, 35 bp, Artificial Sequence
  Synthetic oligonucleotide
tacacgtgttcctgtgcgccttcgattacaccttt

SEQ ID NO: 172587 - DNA, 36 bp, Artificial Sequence
  Synthetic oligonucleotide
gtatccccgcactcgcttcctgtttgcatttcctaa

SEQ ID NO: 172588 - DNA, 36 bp, Artificial Sequence
  Synthetic oligonucleotide
tctcctcgacgggcttgttcctcctgtttcttcaca

SEQ ID NO: 172589 - DNA, 36 bp, Artificial Sequence
  Synthetic oligonucleotide
gagccaccgtcggccccccgtctacttgacctgaca

SEQ ID NO: 172590 - DNA, 36 bp, Artificial Sequence
  Synthetic oligonucleotide
gttcgtgtccttgtgaacgatcttgtacctccccca

SEQ ID NO: 172591 - DNA, 36 bp, Artificial Sequence
  Synthetic oligonucleotide
ccacccctcgccatgagcgatgctacgacctcccca

SEQ ID NO: 172592 - DNA, 36 bp, Artificial Sequence
  Synthetic oligonucleotide
tacgcatcacctatcgttatcctgccccccgttcca

SEQ ID NO: 172593 - DNA, 36 bp, Artificial Sequence
  Synthetic oligonucleotide
gcgcaaccccgattatcaaagtccggcccacactca

SEQ ID NO: 172594 - DNA, 36 bp, Artificial Sequence
  Synthetic oligonucleotide
tgcaacgaacacgaaggccgctccatccgaacctca

SEQ ID NO: 172595 - DNA, 35 bp, Artificial Sequence
  Synthetic oligonucleotide
gtgaacctcggcttgcctccgcctgctcactctca

SEQ ID NO: 172596 - DNA, 36 bp, Artificial Sequence
  Synthetic oligonucleotide
tgtttcacccgcccgcagcctccctggtcttcttca

SEQ ID NO: 172597 - DNA, 35 bp, Artificial Sequence
  Synthetic oligonucleotide
ttgcggagctagctctgtacctggttcgcctttca

SEQ ID NO: 172598 - DNA, 37 bp, Artificial Sequence
  Synthetic oligonucleotide
tgtccctccgacatttccccgccttttgccctgcaga

SEQ ID NO: 172599 - DNA, 37 bp, Artificial Sequence
  Synthetic oligonucleotide
gcgctgatagggaggggtgagcggtgggggccggaga

SEQ ID NO: 172600 - DNA, 36 bp, Artificial Sequence
  Synthetic oligonucleotide
aaaggtgaacggagatggtttagggggggggttaga

SEQ ID NO: 172601 - DNA, 36 bp, Artificial Sequence
  Synthetic oligonucleotide
tatcaggggtggacggggacggggtttgacggacga

SEQ ID NO: 172602 - DNA, 37 bp, Artificial Sequence
  Synthetic oligonucleotide
ttggacatgtacggcgggggggagggatgggggacga

SEQ ID NO: 172603 - DNA, 37 bp, Artificial Sequence
  Synthetic oligonucleotide
gttggccctacgtactctgccactaaccgacccccga

SEQ ID NO: 172604 - DNA, 36 bp, Artificial Sequence
  Synthetic oligonucleotide
tgactccccccagaagtacccgaatgcccttatcga

SEQ ID NO: 172605 - DNA, 37 bp, Artificial Sequence
  Synthetic oligonucleotide
ggtggccgggaggaaatactgcggggggggaactcga

SEQ ID NO: 172606 - DNA, 36 bp, Artificial Sequence
  Synthetic oligonucleotide
acccctgccctcttacatttgccgatcaggcctcga

SEQ ID NO: 172607 - DNA, 35 bp, Artificial Sequence
  Synthetic oligonucleotide
gctggccacccccgagccctcaccttcgatctcga

SEQ ID NO: 172608 - DNA, 36 bp, Artificial Sequence
  Synthetic oligonucleotide
tgttccccatcggtgctggacagcatcccctctcga

SEQ ID NO: 172609 - DNA, 37 bp, Artificial Sequence
  Synthetic oligonucleotide
acctgatccgcattgcttgttttacacttcttctcga

SEQ ID NO: 172610 - DNA, 37 bp, Artificial Sequence
  Synthetic oligonucleotide
ttaacacgcacccattggcctcactctaccctgtcga

SEQ ID NO: 172611 - DNA, 36 bp, Artificial Sequence
  Synthetic oligonucleotide
tcaacctccagtgcgtcccgccccccttttaaagga

SEQ ID NO: 172612 - DNA, 37 bp, Artificial Sequence
  Synthetic oligonucleotide
acgtatagctggaggtggtggggaagtcggaggcgga

SEQ ID NO: 172613 - DNA, 37 bp, Artificial Sequence
  Synthetic oligonucleotide
gttggggtggggggaggagccgttggtggggtcggga

SEQ ID NO: 172614 - DNA, 35 bp, Artificial Sequence
  Synthetic oligonucleotide
atggtacgagggcggaaaggggacatggtagggga

SEQ ID NO: 172615 - DNA, 37 bp, Artificial Sequence
  Synthetic oligonucleotide
tatggatgagccggagggacgaaggcggtggcgggga

SEQ ID NO: 172616 - DNA, 37 bp, Artificial Sequence
  Synthetic oligonucleotide
gccaggggtgagggtagatgggggatgaaggtgggga

SEQ ID NO: 172617 - DNA, 36 bp, Artificial Sequence
  Synthetic oligonucleotide
ttggggtgtaccagggggtgcaagcgcgggtgggga

SEQ ID NO: 172618 - DNA, 36 bp, Artificial Sequence
  Synthetic oligonucleotide
ttaaggagagggggaggaaggagtaacaggcaatga

SEQ ID NO: 172619 - DNA, 38 bp, Artificial Sequence
  Synthetic oligonucleotide
gcccaccccggttctgcattactatctcctctgaatga

SEQ ID NO: 172620 - DNA, 38 bp, Artificial Sequence
  Synthetic oligonucleotide
aaagagaggggaggacatgggagattaaggaggactga

SEQ ID NO: 172621 - DNA, 35 bp, Artificial Sequence
  Synthetic oligonucleotide
ttgcaccctccgcccgtcatgcccactagacctga

SEQ ID NO: 172622 - DNA, 37 bp, Artificial Sequence
  Synthetic oligonucleotide
tccctgacctgttccctctttgtgcccttagccctga

SEQ ID NO: 172623 - DNA, 37 bp, Artificial Sequence
  Synthetic oligonucleotide
gtgtcagtcgaaatggccttcgttgatctctccctga

SEQ ID NO: 172624 - DNA, 37 bp, Artificial Sequence
  Synthetic oligonucleotide
gtgacgcctcctgctttgccttaatgcaaccctctga

SEQ ID NO: 172625 - DNA, 38 bp, Artificial Sequence
  Synthetic oligonucleotide
tggaggctagggaaggaaagggtgggggaacggcgtga

SEQ ID NO: 172626 - DNA, 37 bp, Artificial Sequence
  Synthetic oligonucleotide
atacctccccgatgctgaccccctcacccgtatgtga

SEQ ID NO: 172627 - DNA, 37 bp, Artificial Sequence
  Synthetic oligonucleotide
tcgcacccgccaactgacccttcattgttccctgtga

SEQ ID NO: 172628 - DNA, 38 bp, Artificial Sequence
  Synthetic oligonucleotide
agtcaccgtggggtaggcggaagggggaatcggtgtga

SEQ ID NO: 172629 - DNA, 37 bp, Artificial Sequence
  Synthetic oligonucleotide
atctcaccacgatcgccgaaacatccaccagtattga

SEQ ID NO: 172630 - DNA, 37 bp, Artificial Sequence
  Synthetic oligonucleotide
tggacatcctcctagtatccaccacccatctcgttga

SEQ ID NO: 172631 - DNA, 36 bp, Artificial Sequence
  Synthetic oligonucleotide
attgtcagccttcccatgttttccacccttgttata

SEQ ID NO: 172632 - DNA, 35 bp, Artificial Sequence
  Synthetic oligonucleotide
gcacacccttcttgcgcctcctgtagtacgaacta

SEQ ID NO: 172633 - DNA, 36 bp, Artificial Sequence
  Synthetic oligonucleotide
tacctgttatcgcactgctgtggtgacccgccccta

SEQ ID NO: 172634 - DNA, 36 bp, Artificial Sequence
  Synthetic oligonucleotide
tgagggtgacaggggggctagaagggcgcgaggcta

SEQ ID NO: 172635 - DNA, 36 bp, Artificial Sequence
  Synthetic oligonucleotide
tcacacctgtccactgttacctctgaattgcatgta

SEQ ID NO: 172636 - DNA, 36 bp, Artificial Sequence
  Synthetic oligonucleotide
gtacacccgtcgtcttatgtctttatcgcgccctta

SEQ ID NO: 172637 - DNA, 35 bp, Artificial Sequence
  Synthetic oligonucleotide
tcatcgttacccgccatccccgtgtgtcacgttta

SEQ ID NO: 172638 - DNA, 35 bp, Artificial Sequence
  Synthetic oligonucleotide
tacagtaagtggagcggggaggggggatgtaaaac

SEQ ID NO: 172639 - DNA, 35 bp, Artificial Sequence
  Synthetic oligonucleotide
acaatccaggatcagccccccgtctagctcaccac

SEQ ID NO: 172640 - DNA, 35 bp, Artificial Sequence
  Synthetic oligonucleotide
gaacacctttcattatcgttctgtgggccatccac

SEQ ID NO: 172641 - DNA, 35 bp, Artificial Sequence
  Synthetic oligonucleotide
tccactctacgctcacccggtccgaaattccgcac

SEQ ID NO: 172642 - DNA, 35 bp, Artificial Sequence
  Synthetic oligonucleotide
atgtgcgcagaggcactccatctacgtttttgcac

SEQ ID NO: 172643 - DNA, 36 bp, Artificial Sequence
  Synthetic oligonucleotide
ttctgaccctctcgtgcaccttccgggccttcggac

SEQ ID NO: 172644 - DNA, 35 bp, Artificial Sequence
  Synthetic oligonucleotide
gttatcgcatgccccccgactgtctctcttaatac

SEQ ID NO: 172645 - DNA, 35 bp, Artificial Sequence
  Synthetic oligonucleotide
actccacctctgacccctaaccagccgtcgtatac

SEQ ID NO: 172646 - DNA, 35 bp, Artificial Sequence
  Synthetic oligonucleotide
gcccgcccactttaggtcactccttgggttcttac

SEQ ID NO: 172647 - DNA, 35 bp, Artificial Sequence
  Synthetic oligonucleotide
gactgggaacgtagcgtcatcttctgctgtccacc

SEQ ID NO: 172648 - DNA, 35 bp, Artificial Sequence
  Synthetic oligonucleotide
gtgaccctctgctctacgttcatactatatgcacc

SEQ ID NO: 172649 - DNA, 35 bp, Artificial Sequence
  Synthetic oligonucleotide
atcacaccgcgcacaggcttcccccgggcttcccc

SEQ ID NO: 172650 - DNA, 36 bp, Artificial Sequence
  Synthetic oligonucleotide
gaatccgttgtcccgctatgtccacccgtactgccc

SEQ ID NO: 172651 - DNA, 34 bp, Artificial Sequence
  Synthetic oligonucleotide
ttcccaatcagtcggctacgactagacccctgcc

SEQ ID NO: 172652 - DNA, 35 bp, Artificial Sequence
  Synthetic oligonucleotide
gaccctgcctctgattcatttgtcacctcgctgcc

SEQ ID NO: 172653 - DNA, 35 bp, Artificial Sequence
  Synthetic oligonucleotide
gagggcccgccagccaggtaataccggtcgcctcc

SEQ ID NO: 172654 - DNA, 35 bp, Artificial Sequence
  Synthetic oligonucleotide
gaatgcgaatgcacttggcactaacccccggctcc

SEQ ID NO: 172655 - DNA, 35 bp, Artificial Sequence
  Synthetic oligonucleotide
ggacgggcactcgcgttccatcaagttatgcttcc

SEQ ID NO: 172656 - DNA, 35 bp, Artificial Sequence
  Synthetic oligonucleotide
gtacgccccctatctctagatgccccatttttcgc

SEQ ID NO: 172657 - DNA, 35 bp, Artificial Sequence
  Synthetic oligonucleotide
ggagggtgggtggggctcagcataggcgtgtcggc

SEQ ID NO: 172658 - DNA, 35 bp, Artificial Sequence
  Synthetic oligonucleotide
gtcccgtacacatttttcatcgttgcgccacctgc

SEQ ID NO: 172659 - DNA, 35 bp, Artificial Sequence
  Synthetic oligonucleotide
gacgtcggaccccccgctgcgattatttcccctgc

SEQ ID NO: 172660 - DNA, 34 bp, Artificial Sequence
  Synthetic oligonucleotide
ttcgctgattactcccgcctctccacggtcctgc

SEQ ID NO: 172661 - DNA, 33 bp, Artificial Sequence
  Synthetic oligonucleotide
ttgctctgctcagtctgccacctcatctacatc

SEQ ID NO: 172662 - DNA, 35 bp, Artificial Sequence
  Synthetic oligonucleotide
tgcggtccagtcacagccgaccgtccacttttatc

SEQ ID NO: 172663 - DNA, 35 bp, Artificial Sequence
  Synthetic oligonucleotide
tcattgccctccacccaattgtgtggtctgcactc

SEQ ID NO: 172664 - DNA, 35 bp, Artificial Sequence
  Synthetic oligonucleotide
gttgccaaacctcggtgtggtcatacgcctacctc

SEQ ID NO: 172665 - DNA, 35 bp, Artificial Sequence
  Synthetic oligonucleotide
aaccatcaagacgcgttctgctccgtaaccttgtc

SEQ ID NO: 172666 - DNA, 35 bp, Artificial Sequence
  Synthetic oligonucleotide
tcgatgttctcacctgtttggccatgttctccttc

SEQ ID NO: 172667 - DNA, 35 bp, Artificial Sequence
  Synthetic oligonucleotide
tcgcacaaacaatgtcaccctgtccctccgaccag

SEQ ID NO: 172668 - DNA, 35 bp, Artificial Sequence
  Synthetic oligonucleotide
gttcgacactgccccccaccatcctaaaggactag

SEQ ID NO: 172669 - DNA, 35 bp, Artificial Sequence
  Synthetic oligonucleotide
ttagtcgtcctgcccccgtttttccatcaccgtag

SEQ ID NO: 172670 - DNA, 35 bp, Artificial Sequence
  Synthetic oligonucleotide
tcgtgcgtactctggggccttccgtttccttcacg

SEQ ID NO: 172671 - DNA, 35 bp, Artificial Sequence
  Synthetic oligonucleotide
ataatccgaagcccccaaactcctgtctgcacccg

SEQ ID NO: 172672 - DNA, 35 bp, Artificial Sequence
  Synthetic oligonucleotide
tcatctcccaaccgtactagaagtacgcctctccg

SEQ ID NO: 172673 - DNA, 35 bp, Artificial Sequence
  Synthetic oligonucleotide
attccccacatgctgtcttcacccggtgctttgcg

SEQ ID NO: 172674 - DNA, 35 bp, Artificial Sequence
  Synthetic oligonucleotide
gattttcgcagtaggttttcgctcaccgctcctcg

SEQ ID NO: 172675 - DNA, 35 bp, Artificial Sequence
  Synthetic oligonucleotide
gattgcccaccaccacgccccagttatttgttagg

SEQ ID NO: 172676 - DNA, 35 bp, Artificial Sequence
  Synthetic oligonucleotide
ttggagagtgggtgggagtgttctggcaccactgg

SEQ ID NO: 172677 - DNA, 35 bp, Artificial Sequence
  Synthetic oligonucleotide
gaagaccgcatctccccgtctccctcccacgtatg

SEQ ID NO: 172678 - DNA, 35 bp, Artificial Sequence
  Synthetic oligonucleotide
gtcgcctgacattacctgcccaccctcgttgactg

SEQ ID NO: 172679 - DNA, 35 bp, Artificial Sequence
  Synthetic oligonucleotide
tctgtcccaggtgctgaccccttcacattctactg

SEQ ID NO: 172680 - DNA, 35 bp, Artificial Sequence
  Synthetic oligonucleotide
acattgcatcagaccttaatcatccgctgtccctg

SEQ ID NO: 172681 - DNA, 35 bp, Artificial Sequence
  Synthetic oligonucleotide
gcccctgcgtacagctcgcccgcccccatttcttg

SEQ ID NO: 172682 - DNA, 35 bp, Artificial Sequence
  Synthetic oligonucleotide
gaccccatccgtactccgctctcataaagcctttg

SEQ ID NO: 172683 - DNA, 35 bp, Artificial Sequence
  Synthetic oligonucleotide
tgactcccgccttaccacctgtatcctactctcat

SEQ ID NO: 172684 - DNA, 35 bp, Artificial Sequence
  Synthetic oligonucleotide
gcaacccaatgtgccttgtatccccgtgtttgtat

SEQ ID NO: 172685 - DNA, 35 bp, Artificial Sequence
  Synthetic oligonucleotide
atgcgtacaattccctgtcccctgtcccgtcttat

SEQ ID NO: 172686 - DNA, 35 bp, Artificial Sequence
  Synthetic oligonucleotide
gtaaccccttcatctcatgttccatcatggacact

SEQ ID NO: 172687 - DNA, 35 bp, Artificial Sequence
  Synthetic oligonucleotide
tcgggcccgccggccgtccgttagctccccaccct

SEQ ID NO: 172688 - DNA, 33 bp, Artificial Sequence
  Synthetic oligonucleotide
gccactgacgtcctgctgtccttcaattgccct

SEQ ID NO: 172689 - DNA, 35 bp, Artificial Sequence
  Synthetic oligonucleotide
tggataagccactgaacccgctagccccctgtcct

SEQ ID NO: 172690 - DNA, 35 bp, Artificial Sequence
  Synthetic oligonucleotide
tgtcaaccacgcctgcattaccgttttcatcatct

SEQ ID NO: 172691 - DNA, 35 bp, Artificial Sequence
  Synthetic oligonucleotide
tgcactggccagtcacttccccgagcatttcctct

SEQ ID NO: 172692 - DNA, 35 bp, Artificial Sequence
  Synthetic oligonucleotide
agagctccggccgcccgtcctaaattacctctcgt

SEQ ID NO: 172693 - DNA, 35 bp, Artificial Sequence
  Synthetic oligonucleotide
gtccgactgccgcttcccatccgccgctctctcgt

SEQ ID NO: 172694 - DNA, 35 bp, Artificial Sequence
  Synthetic oligonucleotide
aacgggctgcaagtgggaggggttgggttgagatt

SEQ ID NO: 172695 - DNA, 35 bp, Artificial Sequence
  Synthetic oligonucleotide
atgtgcgcctcatacgcacgggctcattctacctt

SEQ ID NO: 172696 - DNA, 35 bp, Artificial Sequence
  Synthetic oligonucleotide
tgccaccaaccgcgggtgcgctcgaccactttttt

SEQ ID NO: 172697 - DNA, 36 bp, Artificial Sequence
  Synthetic oligonucleotide
aactccaccgtcccctgcccagggccacgcatacaa

SEQ ID NO: 172698 - DNA, 35 bp, Artificial Sequence
  Synthetic oligonucleotide
acttcgacaccccttcccacatgcccgtaaagcaa

SEQ ID NO: 172699 - DNA, 27 bp, Artificial Sequence
  Synthetic oligonucleotide
gtgtttctcccccccgtgccccccgaa

SEQ ID NO: 172700 - DNA, 35 bp, Artificial Sequence
  Synthetic oligonucleotide
gtgtccgcccctgaacctgctatctctcaccctaa

SEQ ID NO: 172701 - DNA, 36 bp, Artificial Sequence
  Synthetic oligonucleotide
gggtaacgtccctgagcccttctccccgctgtcaca

SEQ ID NO: 172702 - DNA, 36 bp, Artificial Sequence
  Synthetic oligonucleotide
gcccatcccatcgcattaggaccgtttgtcccgaca

SEQ ID NO: 172703 - DNA, 35 bp, Artificial Sequence
  Synthetic oligonucleotide
gcgcacctgccctgttattgttcgggttttctaca

SEQ ID NO: 172704 - DNA, 35 bp, Artificial Sequence
  Synthetic oligonucleotide
ttgaccctcctcctgtctgcgaacgcctccttaca

SEQ ID NO: 172705 - DNA, 36 bp, Artificial Sequence
  Synthetic oligonucleotide
taggccccgtaactgcctgcaactcgctttccccca

SEQ ID NO: 172706 - DNA, 36 bp, Artificial Sequence
  Synthetic oligonucleotide
gtcagacatcaacccctccgcttcaggtggccgcca

SEQ ID NO: 172707 - DNA, 36 bp, Artificial Sequence
  Synthetic oligonucleotide
tacttcccggtctagatcgctccccattttccgcca

SEQ ID NO: 172708 - DNA, 36 bp, Artificial Sequence
  Synthetic oligonucleotide
gaggggagaattgggagtaggacgaggggcaacgca

SEQ ID NO: 172709 - DNA, 36 bp, Artificial Sequence
  Synthetic oligonucleotide
agcaagacgcagtctccctctcacccgtcctactca

SEQ ID NO: 172710 - DNA, 37 bp, Artificial Sequence
  Synthetic oligonucleotide
tcacggagggatgggtgggaggccgtggttgatcaga

SEQ ID NO: 172711 - DNA, 37 bp, Artificial Sequence
  Synthetic oligonucleotide
atgtcaccttcgcctgcccgactacctctcacgtaga

SEQ ID NO: 172712 - DNA, 37 bp, Artificial Sequence
  Synthetic oligonucleotide
gagcacattgcacgtctcccgctcccttcctacacga

SEQ ID NO: 172713 - DNA, 36 bp, Artificial Sequence
  Synthetic oligonucleotide
gcgcccattcacgcctgactctgcacactgttacga

SEQ ID NO: 172714 - DNA, 37 bp, Artificial Sequence
  Synthetic oligonucleotide
tcttcggccgaccaccatcccgctataggccccccga

SEQ ID NO: 172715 - DNA, 36 bp, Artificial Sequence
  Synthetic oligonucleotide
gccgtgttccgtcattctgccgctattctcctccga

SEQ ID NO: 172716 - DNA, 37 bp, Artificial Sequence
  Synthetic oligonucleotide
tcatgtcctctgtccttgagtgcctccctctcctcga

SEQ ID NO: 172717 - DNA, 37 bp, Artificial Sequence
  Synthetic oligonucleotide
taggggaagatgggaaaggaagggggggtgctcagga

SEQ ID NO: 172718 - DNA, 37 bp, Artificial Sequence
  Synthetic oligonucleotide
agcccacccacgccactcccggccattttgcctcgga

SEQ ID NO: 172719 - DNA, 37 bp, Artificial Sequence
  Synthetic oligonucleotide
tatgggggggggtggttcaagatatcgatggagggga

SEQ ID NO: 172720 - DNA, 35 bp, Artificial Sequence
  Synthetic oligonucleotide
gtcccaggacatgggaaaaacgggtggagggggga

SEQ ID NO: 172721 - DNA, 37 bp, Artificial Sequence
  Synthetic oligonucleotide
gggtgtagggaatgaagggtggtgggggtcatgggga

SEQ ID NO: 172722 - DNA, 37 bp, Artificial Sequence
  Synthetic oligonucleotide
acctgcctgcccgtttttttatacccccgccatggga

SEQ ID NO: 172723 - DNA, 37 bp, Artificial Sequence
  Synthetic oligonucleotide
tagcacgccaaggggggaggggaggacacacgtggga

SEQ ID NO: 172724 - DNA, 37 bp, Artificial Sequence
  Synthetic oligonucleotide
gtgccctctcttatggtcattcgcctatcatcctgga

SEQ ID NO: 172725 - DNA, 37 bp, Artificial Sequence
  Synthetic oligonucleotide
tgaactcccctattatatctgcgccctgcctgctgga

SEQ ID NO: 172726 - DNA, 38 bp, Artificial Sequence
  Synthetic oligonucleotide
agttatgcggatggcggggagcaggaggaggacaatga

SEQ ID NO: 172727 - DNA, 38 bp, Artificial Sequence
  Synthetic oligonucleotide
tttagcgccatagccactcgtccgtcaacactccctga

SEQ ID NO: 172728 - DNA, 35 bp, Artificial Sequence
  Synthetic oligonucleotide
agccactccacccgcaattctggtccccctagtga

SEQ ID NO: 172729 - DNA, 36 bp, Artificial Sequence
  Synthetic oligonucleotide
gtgggtatcgactggaaaggcaggaggggggcgtga

SEQ ID NO: 172730 - DNA, 38 bp, Artificial Sequence
  Synthetic oligonucleotide
gagtcggtgtagagagcgcgggggtaggaaaggggtga

SEQ ID NO: 172731 - DNA, 38 bp, Artificial Sequence
  Synthetic oligonucleotide
acccccctcgctccaaagagttttcgtgcccctgttga

SEQ ID NO: 172732 - DNA, 37 bp, Artificial Sequence
  Synthetic oligonucleotide
acccatgtccccgattcggtgcccacaattcctttga

SEQ ID NO: 172733 - DNA, 38 bp, Artificial Sequence
  Synthetic oligonucleotide
gtccgccatccgttccccatcgcccagaatctgtttga

SEQ ID NO: 172734 - DNA, 36 bp, Artificial Sequence
  Synthetic oligonucleotide
gtatagctaccgtatcctcccccgcccgtctaaata

SEQ ID NO: 172735 - DNA, 35 bp, Artificial Sequence
  Synthetic oligonucleotide
tcagacgcccccgtgccttaattatcggtcccata

SEQ ID NO: 172736 - DNA, 36 bp, Artificial Sequence
  Synthetic oligonucleotide
tgtcatccgtcacgcccccctcgtcaaaggctcata

SEQ ID NO: 172737 - DNA, 35 bp, Artificial Sequence
  Synthetic oligonucleotide
tcacctccccacaaggccaggacccgcttctccta

SEQ ID NO: 172738 - DNA, 35 bp, Artificial Sequence
  Synthetic oligonucleotide
gtcgccccgttcttcttctcagcgtaccatgctta

SEQ ID NO: 172739 - DNA, 35 bp, Artificial Sequence
  Synthetic oligonucleotide
ggaccatgcctgctgcttttactctacccgtttta

SEQ ID NO: 172740 - DNA, 35 bp, Artificial Sequence
  Synthetic oligonucleotide
gttccccagtatctctgataagcccccgcatacac

SEQ ID NO: 172741 - DNA, 35 bp, Artificial Sequence
  Synthetic oligonucleotide
gagctccatcagttatattgcgccattgccctcac

SEQ ID NO: 172742 - DNA, 35 bp, Artificial Sequence
  Synthetic oligonucleotide
gccgtctccgttcccagtgcacctcttggccgtac

SEQ ID NO: 172743 - DNA, 35 bp, Artificial Sequence
  Synthetic oligonucleotide
tgccccgccatcctgtctcgttcgatcgcactacc

SEQ ID NO: 172744 - DNA, 35 bp, Artificial Sequence
  Synthetic oligonucleotide
gacgatcacgtgacccctgctgccgctcaccaccc

SEQ ID NO: 172745 - DNA, 35 bp, Artificial Sequence
  Synthetic oligonucleotide
agagtgcagatgacactatccttccttcgtgcccc

SEQ ID NO: 172746 - DNA, 35 bp, Artificial Sequence
  Synthetic oligonucleotide
acccacatcagacgcgctccactttgtcgttcccc

SEQ ID NO: 172747 - DNA, 35 bp, Artificial Sequence
  Synthetic oligonucleotide
gtccgtcggacgcgctactcataggacttccgccc

SEQ ID NO: 172748 - DNA, 35 bp, Artificial Sequence
  Synthetic oligonucleotide
tgcccccgcctcgaatggttccttcgatttcgccc

SEQ ID NO: 172749 - DNA, 35 bp, Artificial Sequence
  Synthetic oligonucleotide
agctcgcaccgtgcaccgctttcaactgaactccc

SEQ ID NO: 172750 - DNA, 35 bp, Artificial Sequence
  Synthetic oligonucleotide
tctggacacctccgctccctgctaaaatcccggcc

SEQ ID NO: 172751 - DNA, 35 bp, Artificial Sequence
  Synthetic oligonucleotide
tagaacggcccagccaccccgctcttgttgttgcc

SEQ ID NO: 172752 - DNA, 35 bp, Artificial Sequence
  Synthetic oligonucleotide
gcgagctgcactgttcaatacgtcgcctctactcc

SEQ ID NO: 172753 - DNA, 35 bp, Artificial Sequence
  Synthetic oligonucleotide
attgctcgccggttatggccttgtcccgaatctcc

SEQ ID NO: 172754 - DNA, 35 bp, Artificial Sequence
  Synthetic oligonucleotide
ttggaagccacctcaagttttggtcggtccattcc

SEQ ID NO: 172755 - DNA, 35 bp, Artificial Sequence
  Synthetic oligonucleotide
gcgaggcgccgccctcgttggttttttcgctttcc

SEQ ID NO: 172756 - DNA, 35 bp, Artificial Sequence
  Synthetic oligonucleotide
acatcactctcgatagcagtgcttcatcgccccgc

SEQ ID NO: 172757 - DNA, 35 bp, Artificial Sequence
  Synthetic oligonucleotide
tgcgatccgccagccttttttcgctagcttttggc

SEQ ID NO: 172758 - DNA, 35 bp, Artificial Sequence
  Synthetic oligonucleotide
tgcccccatatgatctgatcctattgtctcactgc

SEQ ID NO: 172759 - DNA, 35 bp, Artificial Sequence
  Synthetic oligonucleotide
ttagccacacacctcatgtcctcccgtgctcctgc

SEQ ID NO: 172760 - DNA, 35 bp, Artificial Sequence
  Synthetic oligonucleotide
atttgcacgcaaattttcctgtttgactcctctgc

SEQ ID NO: 172761 - DNA, 35 bp, Artificial Sequence
  Synthetic oligonucleotide
agggtgccatccattagtccattgtctcgttctgc

SEQ ID NO: 172762 - DNA, 35 bp, Artificial Sequence
  Synthetic oligonucleotide
gatgccggtgttcatcgcgtaccatccattcaatc

SEQ ID NO: 172763 - DNA, 35 bp, Artificial Sequence
  Synthetic oligonucleotide
attgcgacagtcggagcactcatacccagtccatc

SEQ ID NO: 172764 - DNA, 35 bp, Artificial Sequence
  Synthetic oligonucleotide
tcctgtcgtcgtcatagttcgttccctctcatatc

SEQ ID NO: 172765 - DNA, 35 bp, Artificial Sequence
  Synthetic oligonucleotide
gtgccaaactcggtcgcccctgaatctatcccctc

SEQ ID NO: 172766 - DNA, 30 bp, Artificial Sequence
  Synthetic oligonucleotide
atccgaagccagccttacacgtcatgcctc

SEQ ID NO: 172767 - DNA, 35 bp, Artificial Sequence
  Synthetic oligonucleotide
ttcaggttgcctgcagatctctccacgttgtcctc

SEQ ID NO: 172768 - DNA, 35 bp, Artificial Sequence
  Synthetic oligonucleotide
gaggttcaacgtccattccctcccgtcacttcctc

SEQ ID NO: 172769 - DNA, 35 bp, Artificial Sequence
  Synthetic oligonucleotide
gcacaacctcacacctgcccatctgtacgaacgtc

SEQ ID NO: 172770 - DNA, 35 bp, Artificial Sequence
  Synthetic oligonucleotide
taatcatgcgcccggaatgtccccctcacatcgtc

SEQ ID NO: 172771 - DNA, 35 bp, Artificial Sequence
  Synthetic oligonucleotide
tcacatggccgtgactccttatgcgccttaacttc

SEQ ID NO: 172772 - DNA, 35 bp, Artificial Sequence
  Synthetic oligonucleotide
cacgccgcccggaccctgatcggcaccttcccttc

SEQ ID NO: 172773 - DNA, 35 bp, Artificial Sequence
  Synthetic oligonucleotide
agccccccgcgacttccccacgtgaccgtactttc

SEQ ID NO: 172774 - DNA, 35 bp, Artificial Sequence
  Synthetic oligonucleotide
acaccactccgaacgcgctgcattaccccaccgag

SEQ ID NO: 172775 - DNA, 35 bp, Artificial Sequence
  Synthetic oligonucleotide
tgccgactgcccgcccagttttggacctccacacg

SEQ ID NO: 172776 - DNA, 35 bp, Artificial Sequence
  Synthetic oligonucleotide
atggcccctccaaatcccgaactcaccgtgctacg

SEQ ID NO: 172777 - DNA, 35 bp, Artificial Sequence
  Synthetic oligonucleotide
ccacttgtgacggacacactgttttcttttttccg

SEQ ID NO: 172778 - DNA, 35 bp, Artificial Sequence
  Synthetic oligonucleotide
gatagttcccgctcccttggtcttccgccgccgcg

SEQ ID NO: 172779 - DNA, 32 bp, Artificial Sequence
  Synthetic oligonucleotide
gatctctgccacacggtactgacccaccctcg

SEQ ID NO: 172780 - DNA, 35 bp, Artificial Sequence
  Synthetic oligonucleotide
gtcggggaagggaatcgggagggtcaaaagcttgg

SEQ ID NO: 172781 - DNA, 35 bp, Artificial Sequence
  Synthetic oligonucleotide
gaaggacagggtggagtgcggtagtttttgggctg

SEQ ID NO: 172782 - DNA, 35 bp, Artificial Sequence
  Synthetic oligonucleotide
gatcttcagcgcactccgcctcctatgtccttctg

SEQ ID NO: 172783 - DNA, 35 bp, Artificial Sequence
  Synthetic oligonucleotide
agtggcgccacgctctctccttcaccgtagtcttg

SEQ ID NO: 172784 - DNA, 35 bp, Artificial Sequence
  Synthetic oligonucleotide
gatgcgaaggaaaggaaggacaccgggggtaagat

SEQ ID NO: 172785 - DNA, 35 bp, Artificial Sequence
  Synthetic oligonucleotide
agctggtcggggtgggggaacggggatgttaagat

SEQ ID NO: 172786 - DNA, 35 bp, Artificial Sequence
  Synthetic oligonucleotide
acatcggcatccctccatcagctatactgcaacct

SEQ ID NO: 172787 - DNA, 35 bp, Artificial Sequence
  Synthetic oligonucleotide
ttcttgttgcagtctcacgcccgtctcgtcgccct

SEQ ID NO: 172788 - DNA, 35 bp, Artificial Sequence
  Synthetic oligonucleotide
tacggtccgcactcccgtattcactgccatggcct

SEQ ID NO: 172789 - DNA, 35 bp, Artificial Sequence
  Synthetic oligonucleotide
gacagaggaaaaaagcaggggagagggactaagct

SEQ ID NO: 172790 - DNA, 35 bp, Artificial Sequence
  Synthetic oligonucleotide
acccgccaccggtccgtacaaccatctttcacgct

SEQ ID NO: 172791 - DNA, 35 bp, Artificial Sequence
  Synthetic oligonucleotide
cctcccgccatgtttaaccggccccccgccctgct

SEQ ID NO: 172792 - DNA, 35 bp, Artificial Sequence
  Synthetic oligonucleotide
acgtgccccatctcgcccgaccatattgctttgct

SEQ ID NO: 172793 - DNA, 36 bp, Artificial Sequence
  Synthetic oligonucleotide
acgccccctctactcgccactggtacgagcctatct

SEQ ID NO: 172794 - DNA, 35 bp, Artificial Sequence
  Synthetic oligonucleotide
tacaggtcgttgtgtactattacgtcccttcctct

SEQ ID NO: 172795 - DNA, 35 bp, Artificial Sequence
  Synthetic oligonucleotide
ggatggggaggggtgttccggaaatgaaataaagt

SEQ ID NO: 172796 - DNA, 35 bp, Artificial Sequence
  Synthetic oligonucleotide
gctccccctgccgctgccaatgtatcaacaagcgt

SEQ ID NO: 172797 - DNA, 35 bp, Artificial Sequence
  Synthetic oligonucleotide
gtgagacaagatagggaggggtagatggcgctggt

SEQ ID NO: 172798 - DNA, 35 bp, Artificial Sequence
  Synthetic oligonucleotide
gtccgctgggggaggaacgggtagtgcgggtatgt

SEQ ID NO: 172799 - DNA, 35 bp, Artificial Sequence
  Synthetic oligonucleotide
tgcataacatcctcagtgtcagctatcttatttgt

SEQ ID NO: 172800 - DNA, 35 bp, Artificial Sequence
  Synthetic oligonucleotide
accccaccctttgtgtgcttcccacggtctccatt

SEQ ID NO: 172801 - DNA, 34 bp, Artificial Sequence
  Synthetic oligonucleotide
acgtccccctcgatttggctcggcccccctagtt

SEQ ID NO: 172802 - DNA, 35 bp, Artificial Sequence
  Synthetic oligonucleotide
gctatccttacgccgtgcctgtccattcattggtt

SEQ ID NO: 172803 - DNA, 35 bp, Artificial Sequence
  Synthetic oligonucleotide
acgacccccccttcgaacgcctctgtattttggtt

SEQ ID NO: 172804 - DNA, 35 bp, Artificial Sequence
  Synthetic oligonucleotide
ttccactccccgtgcccagaccgactctgggtgtt

SEQ ID NO: 172805 - DNA, 35 bp, Artificial Sequence
  Synthetic oligonucleotide
tccgcccaatcgaacgtcctgtccgctcgcctttt

SEQ ID NO: 172806 - DNA, 35 bp, Artificial Sequence
  Synthetic oligonucleotide
aacttgaagcagttggggataggtgcggggggaaa

SEQ ID NO: 172807 - DNA, 35 bp, Artificial Sequence
  Synthetic oligonucleotide
gttacccgtcctccagctccgtgtttttgtcccaa

SEQ ID NO: 172808 - DNA, 32 bp, Artificial Sequence
  Synthetic oligonucleotide
tcccccactccactatcgcggccctccgggaa

SEQ ID NO: 172809 - DNA, 36 bp, Artificial Sequence
  Synthetic oligonucleotide
tgtgctggatgtaagaagggggaggaggggcgggaa

SEQ ID NO: 172810 - DNA, 36 bp, Artificial Sequence
  Synthetic oligonucleotide
ggagaccgaaagtggggggtggggtgtcagggggaa

SEQ ID NO: 172811 - DNA, 36 bp, Artificial Sequence
  Synthetic oligonucleotide
acaaagtcgcacaccaccccccgtcacggagcaaca

SEQ ID NO: 172812 - DNA, 36 bp, Artificial Sequence
  Synthetic oligonucleotide
aacataacccccgcctttgttcctgcctcatgacca

SEQ ID NO: 172813 - DNA, 36 bp, Artificial Sequence
  Synthetic oligonucleotide
acaaaggggcaaagaataggggggcggagttgacca

SEQ ID NO: 172814 - DNA, 36 bp, Artificial Sequence
  Synthetic oligonucleotide
ttacgcccggcgtacccatctagccccctcttacca

SEQ ID NO: 172815 - DNA, 35 bp, Artificial Sequence
  Synthetic oligonucleotide
tcgagccattagcatgctatctccccacccaccca

SEQ ID NO: 172816 - DNA, 36 bp, Artificial Sequence
  Synthetic oligonucleotide
gtgcgcaacgggctttgcccaatccctcctccccca

SEQ ID NO: 172817 - DNA, 35 bp, Artificial Sequence
  Synthetic oligonucleotide
gccactctgcacgttaccgcctcgatcgcatgcca

SEQ ID NO: 172818 - DNA, 36 bp, Artificial Sequence
  Synthetic oligonucleotide
tgcgccgtaacacttccgaacctgtcccaccgcgca

SEQ ID NO: 172819 - DNA, 36 bp, Artificial Sequence
  Synthetic oligonucleotide
tacccagcacattagtatctgcctttccctatcgca

SEQ ID NO: 172820 - DNA, 36 bp, Artificial Sequence
  Synthetic oligonucleotide
gcccgtataggggccgaccatcttctcatcttcgca

SEQ ID NO: 172821 - DNA, 36 bp, Artificial Sequence
  Synthetic oligonucleotide
ttctgtctcacgctctgcctatcgccccgtgactca

SEQ ID NO: 172822 - DNA, 36 bp, Artificial Sequence
  Synthetic oligonucleotide
acaatcaccgccgtggtttcatatttcttgacctca

SEQ ID NO: 172823 - DNA, 35 bp, Artificial Sequence
  Synthetic oligonucleotide
gttagctcaaacttggagtcccccgttgcccctca

SEQ ID NO: 172824 - DNA, 36 bp, Artificial Sequence
  Synthetic oligonucleotide
cccaccgcaggggtattttctcttggtccgccctca

SEQ ID NO: 172825 - DNA, 36 bp, Artificial Sequence
  Synthetic oligonucleotide
ggagccaccgaatatctagctgcacccgtgtcctca

SEQ ID NO: 172826 - DNA, 36 bp, Artificial Sequence
  Synthetic oligonucleotide
tcccgccacgccctcaaatgtaaaatttctccttca

SEQ ID NO: 172827 - DNA, 36 bp, Artificial Sequence
  Synthetic oligonucleotide
atgtatcgggcgggagtagggggggtgtcatctaga

SEQ ID NO: 172828 - DNA, 36 bp, Artificial Sequence
  Synthetic oligonucleotide
acatgcgacactgcgctatgcctcactcctgcacga

SEQ ID NO: 172829 - DNA, 37 bp, Artificial Sequence
  Synthetic oligonucleotide
tccagccgttcgcctttcgtaattcgcctgtcgccga

SEQ ID NO: 172830 - DNA, 37 bp, Artificial Sequence
  Synthetic oligonucleotide
gttgacagacccgctgcctccctcctgccgaaatcga

SEQ ID NO: 172831 - DNA, 36 bp, Artificial Sequence
  Synthetic oligonucleotide
atgcccggatcgttcgttttcctgccccttactcga

SEQ ID NO: 172832 - DNA, 37 bp, Artificial Sequence
  Synthetic oligonucleotide
gagggggacgagggagagaaggggggtctcgccagga

SEQ ID NO: 172833 - DNA, 36 bp, Artificial Sequence
  Synthetic oligonucleotide
gtacggggatgaagggatgggaattgtggtggagga

SEQ ID NO: 172834 - DNA, 37 bp, Artificial Sequence
  Synthetic oligonucleotide
atgtcagggcgacaggggccgattgaggggggaggga

SEQ ID NO: 172835 - DNA, 37 bp, Artificial Sequence
  Synthetic oligonucleotide
agggaagggatgaagagcggcgggacgaggacgggga

SEQ ID NO: 172836 - DNA, 36 bp, Artificial Sequence
  Synthetic oligonucleotide
accctacccgactccgtgatgccgcactccttggga

SEQ ID NO: 172837 - DNA, 35 bp, Artificial Sequence
  Synthetic oligonucleotide
gataggcggctaggggctacagggggacggttgga

SEQ ID NO: 172838 - DNA, 37 bp, Artificial Sequence
  Synthetic oligonucleotide
tacatgtcgggggggaagggtcgagggattaccatga

SEQ ID NO: 172839 - DNA, 38 bp, Artificial Sequence
  Synthetic oligonucleotide
gggcggggaacggggtgggaggtcctggaggtccatga

SEQ ID NO: 172840 - DNA, 36 bp, Artificial Sequence
  Synthetic oligonucleotide
gcgcaccatctcgaccgattatatgcgccccactga

SEQ ID NO: 172841 - DNA, 38 bp, Artificial Sequence
  Synthetic oligonucleotide
acatcctccgcatccctggtccctgtatttcgcactga

SEQ ID NO: 172842 - DNA, 36 bp, Artificial Sequence
  Synthetic oligonucleotide
accccgccgccttttccgtaccttggcattatctga

SEQ ID NO: 172843 - DNA, 37 bp, Artificial Sequence
  Synthetic oligonucleotide
tcccgacccgcaatgtatgccacacactcttctctga

SEQ ID NO: 172844 - DNA, 38 bp, Artificial Sequence
  Synthetic oligonucleotide
gacgaagtaggacggtagtgatggaggggaggaagtga

SEQ ID NO: 172845 - DNA, 38 bp, Artificial Sequence
  Synthetic oligonucleotide
gatggctgcgataggggaaaggggcaacggggaagtga

SEQ ID NO: 172846 - DNA, 38 bp, Artificial Sequence
  Synthetic oligonucleotide
gaaaggacgggatgagaaggggagcggtgagtatttga

SEQ ID NO: 172847 - DNA, 38 bp, Artificial Sequence
  Synthetic oligonucleotide
gatacactcagaactcgcatactgcccttcacctttga

SEQ ID NO: 172848 - DNA, 37 bp, Artificial Sequence
  Synthetic oligonucleotide
tgacagggacaatttggcccgcccccctcgcctttga

SEQ ID NO: 172849 - DNA, 36 bp, Artificial Sequence
  Synthetic oligonucleotide
aagtgtcaccgcagctgatctcccgtttttctttga

SEQ ID NO: 172850 - DNA, 37 bp, Artificial Sequence
  Synthetic oligonucleotide
gcctcccccgtccagggcctgccttcttcaattttga

SEQ ID NO: 172851 - DNA, 37 bp, Artificial Sequence
  Synthetic oligonucleotide
ggaaatcgccgcccctcccattatcgtcagtttttga

SEQ ID NO: 172852 - DNA, 35 bp, Artificial Sequence
  Synthetic oligonucleotide
aatttgggcgggggtttaaatagggaggggtacta

SEQ ID NO: 172853 - DNA, 34 bp, Artificial Sequence
  Synthetic oligonucleotide
ttcgggcctcccatgctacgaaacccctgaccta

SEQ ID NO: 172854 - DNA, 35 bp, Artificial Sequence
  Synthetic oligonucleotide
tcttgtgcgtcacatctttcctgttgtttgcccta

SEQ ID NO: 172855 - DNA, 35 bp, Artificial Sequence
  Synthetic oligonucleotide
gattcccaccgcccacccatctataggaccatcta

SEQ ID NO: 172856 - DNA, 36 bp, Artificial Sequence
  Synthetic oligonucleotide
gtagcctggcgccctccccccgtgttctaactggta

SEQ ID NO: 172857 - DNA, 35 bp, Artificial Sequence
  Synthetic oligonucleotide
tacgccgtcgatttatttttgtcccgtctgcatta

SEQ ID NO: 172858 - DNA, 36 bp, Artificial Sequence
  Synthetic oligonucleotide
gcgacccactctcgacctgtcacggtgtcaccttta

SEQ ID NO: 172859 - DNA, 34 bp, Artificial Sequence
  Synthetic oligonucleotide
gacgagtacaggcctgcaaaaccaccccgcccac

SEQ ID NO: 172860 - DNA, 35 bp, Artificial Sequence
  Synthetic oligonucleotide
ttgcaccgtccgccccccctcataggtaatgccac

SEQ ID NO: 172861 - DNA, 35 bp, Artificial Sequence
  Synthetic oligonucleotide
ttaaccgcactcacactctgcacctggggacatac

SEQ ID NO: 172862 - DNA, 35 bp, Artificial Sequence
  Synthetic oligonucleotide
gtcccaactccagtagccttcgcctttgtcactac

SEQ ID NO: 172863 - DNA, 35 bp, Artificial Sequence
  Synthetic oligonucleotide
gttcggagtgcttaccccgctgtccacctcgcccc

SEQ ID NO: 172864 - DNA, 35 bp, Artificial Sequence
  Synthetic oligonucleotide
accacccggcctcatgctagggtgaaaatctcccc

SEQ ID NO: 172865 - DNA, 35 bp, Artificial Sequence
  Synthetic oligonucleotide
atcccctcccgtagataggtaccatgcatacgccc

SEQ ID NO: 172866 - DNA, 35 bp, Artificial Sequence
  Synthetic oligonucleotide
tccggtacgcatgtgtcacctccctgttcccgccc

SEQ ID NO: 172867 - DNA, 34 bp, Artificial Sequence
  Synthetic oligonucleotide
tgtagccctcccactgacctcagttagcagtccc

SEQ ID NO: 172868 - DNA, 35 bp, Artificial Sequence
  Synthetic oligonucleotide
tcccactggtcacatctgatcttctcttatacgcc

SEQ ID NO: 172869 - DNA, 35 bp, Artificial Sequence
  Synthetic oligonucleotide
agaacaccgccaagttttcgcatgtcgcacccgcc

SEQ ID NO: 172870 - DNA, 35 bp, Artificial Sequence
  Synthetic oligonucleotide
gccaactcgcttgctttgcgcgtatacccgccgcc

SEQ ID NO: 172871 - DNA, 35 bp, Artificial Sequence
  Synthetic oligonucleotide
tgtggaactagcgtcggtccgtctctcaccgcgcc

SEQ ID NO: 172872 - DNA, 35 bp, Artificial Sequence
  Synthetic oligonucleotide
gtacccctacccggccctttatcggatacctggcc

SEQ ID NO: 172873 - DNA, 35 bp, Artificial Sequence
  Synthetic oligonucleotide
atccacttgctgacctaaatacctgcccatatgcc

SEQ ID NO: 172874 - DNA, 35 bp, Artificial Sequence
  Synthetic oligonucleotide
taccgacgtcatgtcacacccacgacgctgattcc

SEQ ID NO: 172875 - DNA, 33 bp, Artificial Sequence
  Synthetic oligonucleotide
gcccagcgcagaccctcgcatctcgtcactagc

SEQ ID NO: 172876 - DNA, 35 bp, Artificial Sequence
  Synthetic oligonucleotide
accaccctcataaggtctggttctcaccttatcgc

SEQ ID NO: 172877 - DNA, 35 bp, Artificial Sequence
  Synthetic oligonucleotide
agttaaccccgcaccgaataccgcccctcgagctc

SEQ ID NO: 172878 - DNA, 35 bp, Artificial Sequence
  Synthetic oligonucleotide
agcgccccccggtttaattgctctgcctggtcgtc

SEQ ID NO: 172879 - DNA, 35 bp, Artificial Sequence
  Synthetic oligonucleotide
gatcacgctggaagcttagtacctcctcgccggtc

SEQ ID NO: 172880 - DNA, 35 bp, Artificial Sequence
  Synthetic oligonucleotide
ggaacaccgggaggtgtccctgcccttatcatgtc

SEQ ID NO: 172881 - DNA, 35 bp, Artificial Sequence
  Synthetic oligonucleotide
actccctccgatccactggtgtagttccaccattc

SEQ ID NO: 172882 - DNA, 35 bp, Artificial Sequence
  Synthetic oligonucleotide
tgccattccccattttcctattcaggaccaggttc

SEQ ID NO: 172883 - DNA, 35 bp, Artificial Sequence
  Synthetic oligonucleotide
ggtacatctcctggtattatcgcccgccccgcacg

SEQ ID NO: 172884 - DNA, 35 bp, Artificial Sequence
  Synthetic oligonucleotide
tccacctgccacctcaattcgatcctgaatcaccg

SEQ ID NO: 172885 - DNA, 35 bp, Artificial Sequence
  Synthetic oligonucleotide
tgttcacccaactgcccgttatccttgacagaccg

SEQ ID NO: 172886 - DNA, 35 bp, Artificial Sequence
  Synthetic oligonucleotide
gtttcatccggcagtctgctcgcctattctccgcg

SEQ ID NO: 172887 - DNA, 35 bp, Artificial Sequence
  Synthetic oligonucleotide
gcaaagggtcaggggagtatggggtatggaggggg

SEQ ID NO: 172888 - DNA, 35 bp, Artificial Sequence
  Synthetic oligonucleotide
agtccatctcccttgccactggtcaataccacatg

SEQ ID NO: 172889 - DNA, 35 bp, Artificial Sequence
  Synthetic oligonucleotide
atccgccgcccccctttcgttgctctcgactactg

SEQ ID NO: 172890 - DNA, 35 bp, Artificial Sequence
  Synthetic oligonucleotide
gttaccaggcccgctttcccgcgactccctacctg

SEQ ID NO: 172891 - DNA, 35 bp, Artificial Sequence
  Synthetic oligonucleotide
ttaggccctttccaactgtcttctctgtgactctg

SEQ ID NO: 172892 - DNA, 35 bp, Artificial Sequence
  Synthetic oligonucleotide
gcacaccacctaacatgttcgccgttccgctcttg

SEQ ID NO: 172893 - DNA, 35 bp, Artificial Sequence
  Synthetic oligonucleotide
tgccagcctgtattctgccgcttgattctccccat

SEQ ID NO: 172894 - DNA, 35 bp, Artificial Sequence
  Synthetic oligonucleotide
tgccgccgtagacgccgtcgtttagccttgtccat

SEQ ID NO: 172895 - DNA, 35 bp, Artificial Sequence
  Synthetic oligonucleotide
aaaggacagggtggcaggtgggtgcggggcttgat

SEQ ID NO: 172896 - DNA, 35 bp, Artificial Sequence
  Synthetic oligonucleotide
gaatgtagcccagccggagtccatgtcccgtccct

SEQ ID NO: 172897 - DNA, 35 bp, Artificial Sequence
  Synthetic oligonucleotide
gccccgcctcatccgtgaagaatgcttcgttgcct

SEQ ID NO: 172898 - DNA, 35 bp, Artificial Sequence
  Synthetic oligonucleotide
gtacacgccaccagccagggcattccccgcttcct

SEQ ID NO: 172899 - DNA, 30 bp, Artificial Sequence
  Synthetic oligonucleotide
tacccccccgcccactaccagaaccgttct

SEQ ID NO: 172900 - DNA, 35 bp, Artificial Sequence
  Synthetic oligonucleotide
tatgcactcccgctgcccgtgactctcctctttct

SEQ ID NO: 172901 - DNA, 35 bp, Artificial Sequence
  Synthetic oligonucleotide
agagcaaaggaggagggagggacagctatcgtcgt

SEQ ID NO: 172902 - DNA, 35 bp, Artificial Sequence
  Synthetic oligonucleotide
tgtgcgccacacatgtctcctctctccttcgtggt

SEQ ID NO: 172903 - DNA, 35 bp, Artificial Sequence
  Synthetic oligonucleotide
tcttcctcctcatcttgccctgccccttgtttggt

SEQ ID NO: 172904 - DNA, 35 bp, Artificial Sequence
  Synthetic oligonucleotide
ggatgggcgggagggcggtgattaccgatgacatt

SEQ ID NO: 172905 - DNA, 35 bp, Artificial Sequence
  Synthetic oligonucleotide
gtccaacctgcaccttcttgcctaacaatagcctt

SEQ ID NO: 172906 - DNA, 35 bp, Artificial Sequence
  Synthetic oligonucleotide
tccgtcgtcactgacccactatagctcacctcctt

SEQ ID NO: 172907 - DNA, 35 bp, Artificial Sequence
  Synthetic oligonucleotide
gacgccttgacgtcgcaccccgcccctactccgtt

SEQ ID NO: 172908 - DNA, 35 bp, Artificial Sequence
  Synthetic oligonucleotide
tgcgtgttggcgtgggcgggtgggtttgggctgtt

SEQ ID NO: 172909 - DNA, 35 bp, Artificial Sequence
  Synthetic oligonucleotide
agcttggtgcgcgcctgcttatgcctcccccattt

SEQ ID NO: 172910 - DNA, 35 bp, Artificial Sequence
  Synthetic oligonucleotide
gccgtatcggttgcctagccgccacttataccttt

SEQ ID NO: 172911 - DNA, 35 bp, Artificial Sequence
  Synthetic oligonucleotide
tatgctcgccgtgacttgctatcattcgcgttttt

SEQ ID NO: 172912 - DNA, 36 bp, Artificial Sequence
  Synthetic oligonucleotide
ttgaccgttcgccacatcacttactgtagcccccaa

SEQ ID NO: 172913 - DNA, 36 bp, Artificial Sequence
  Synthetic oligonucleotide
attccatccaccttctgagcatatgcacaatgccaa

SEQ ID NO: 172914 - DNA, 35 bp, Artificial Sequence
  Synthetic oligonucleotide
gagacgctccatcacgcagattacctccccgttaa

SEQ ID NO: 172915 - DNA, 35 bp, Artificial Sequence
  Synthetic oligonucleotide
tgtcgcccctgcttatggtcctcatactcccaaca

SEQ ID NO: 172916 - DNA, 36 bp, Artificial Sequence
  Synthetic oligonucleotide
gctcactccgcacccttgagtcccctcccgggcaca

SEQ ID NO: 172917 - DNA, 36 bp, Artificial Sequence
  Synthetic oligonucleotide
ggacagccacaatggtctctccgccgcgctatcaca

SEQ ID NO: 172918 - DNA, 35 bp, Artificial Sequence
  Synthetic oligonucleotide
aactccaccgacgacctctctattccgcgggacca

SEQ ID NO: 172919 - DNA, 35 bp, Artificial Sequence
  Synthetic oligonucleotide
ggggcgggttgggagggctggaaattatacgccca

SEQ ID NO: 172920 - DNA, 35 bp, Artificial Sequence
  Synthetic oligonucleotide
tgtccccccagtgcctatatccatcgttcctccca

SEQ ID NO: 172921 - DNA, 36 bp, Artificial Sequence
  Synthetic oligonucleotide
gtgaggccccagctacgttcgcaccattctactcca

SEQ ID NO: 172922 - DNA, 36 bp, Artificial Sequence
  Synthetic oligonucleotide
tcttcccgatcgcttgtcaccccgccgcccatagca

SEQ ID NO: 172923 - DNA, 36 bp, Artificial Sequence
  Synthetic oligonucleotide
ggttgcgctcctgtccacccctccagccggtctgca

SEQ ID NO: 172924 - DNA, 35 bp, Artificial Sequence
  Synthetic oligonucleotide
gttcctgccgcactccgatattctccgcccgatca

SEQ ID NO: 172925 - DNA, 35 bp, Artificial Sequence
  Synthetic oligonucleotide
accgtcaacgcccaccctgtacccagcgcctctca

SEQ ID NO: 172926 - DNA, 35 bp, Artificial Sequence
  Synthetic oligonucleotide
gtctcactccctgctcagtatcacttccactgtca

SEQ ID NO: 172927 - DNA, 37 bp, Artificial Sequence
  Synthetic oligonucleotide
tccgacgcttcctcttggccttacctccgcttccaga

SEQ ID NO: 172928 - DNA, 37 bp, Artificial Sequence
  Synthetic oligonucleotide
atgtgcgctgaagggtgggggtggtgcggcaacgaga

SEQ ID NO: 172929 - DNA, 37 bp, Artificial Sequence
  Synthetic oligonucleotide
gccctaccacatcgccttccatgcctccagacggaga

SEQ ID NO: 172930 - DNA, 37 bp, Artificial Sequence
  Synthetic oligonucleotide
gagcacacggcaaatacatctccgccccgcccctaga

SEQ ID NO: 172931 - DNA, 37 bp, Artificial Sequence
  Synthetic oligonucleotide
aatcacccaccagacttgcttagttaccttcttacga

SEQ ID NO: 172932 - DNA, 37 bp, Artificial Sequence
  Synthetic oligonucleotide
acgctctgccgccgcctgccgctccccgttcttacga

SEQ ID NO: 172933 - DNA, 37 bp, Artificial Sequence
  Synthetic oligonucleotide
tccctgccagatagccatcccgcccctgataacccga

SEQ ID NO: 172934 - DNA, 37 bp, Artificial Sequence
  Synthetic oligonucleotide
gactcgccacacatgccatcagtcttttctaccccga

SEQ ID NO: 172935 - DNA, 37 bp, Artificial Sequence
  Synthetic oligonucleotide
gtacgtcggttctgctctctttctcccgacctgccga

SEQ ID NO: 172936 - DNA, 37 bp, Artificial Sequence
  Synthetic oligonucleotide
gccctgccctctacgttccgcgttgccgatacctcga

SEQ ID NO: 172937 - DNA, 37 bp, Artificial Sequence
  Synthetic oligonucleotide
gaagtgggaggtggaaatagcatggcgcgtgggtcga

SEQ ID NO: 172938 - DNA, 36 bp, Artificial Sequence
  Synthetic oligonucleotide
gaggacacgtggtatcgggcaagggtagggaaagga

SEQ ID NO: 172939 - DNA, 35 bp, Artificial Sequence
  Synthetic oligonucleotide
gtgaggaggctggggcggggcatggattcggagga

SEQ ID NO: 172940 - DNA, 36 bp, Artificial Sequence
  Synthetic oligonucleotide
agagtgtgtgggtagggtggggcgatggtgggagga

SEQ ID NO: 172941 - DNA, 37 bp, Artificial Sequence
  Synthetic oligonucleotide
ggagaaagtgcaggaggggtaatcgggggagagcgga

SEQ ID NO: 172942 - DNA, 37 bp, Artificial Sequence
  Synthetic oligonucleotide
gtcgaagggaaggcttgtaagaagggggatggtcgga

SEQ ID NO: 172943 - DNA, 37 bp, Artificial Sequence
  Synthetic oligonucleotide
tacgtgctcagggggggtgggtagcacgttagaggga

SEQ ID NO: 172944 - DNA, 37 bp, Artificial Sequence
  Synthetic oligonucleotide
agacgcctcgctccctgtaccccgccgcccctcggga

SEQ ID NO: 172945 - DNA, 37 bp, Artificial Sequence
  Synthetic oligonucleotide
tatgtggtacgggaaatgggggaagaatagggtggga

SEQ ID NO: 172946 - DNA, 37 bp, Artificial Sequence
  Synthetic oligonucleotide
ttgtacccccctgccaacgctcccgtccattgtggga

SEQ ID NO: 172947 - DNA, 37 bp, Artificial Sequence
  Synthetic oligonucleotide
atccctgctgccccacatcgtatacccgcgctaatga

SEQ ID NO: 172948 - DNA, 38 bp, Artificial Sequence
  Synthetic oligonucleotide
atcgcgcccccgccccattgccctgacatcagtaatga

SEQ ID NO: 172949 - DNA, 38 bp, Artificial Sequence
  Synthetic oligonucleotide
gaagggaacagggaagtggaaggccgaagggcggatga

SEQ ID NO: 172950 - DNA, 38 bp, Artificial Sequence
  Synthetic oligonucleotide
atgtaccgccccaccgccgcttgtagtcacagaactga

SEQ ID NO: 172951 - DNA, 38 bp, Artificial Sequence
  Synthetic oligonucleotide
gacttgcccgccctatatgcacctagcttcactactga

SEQ ID NO: 172952 - DNA, 37 bp, Artificial Sequence
  Synthetic oligonucleotide
actgtacgcccacacgagcgaccctaccacgccctga

SEQ ID NO: 172953 - DNA, 38 bp, Artificial Sequence
  Synthetic oligonucleotide
ttcccctgcccccaccatgttaccccgcagtgccctga

SEQ ID NO: 172954 - DNA, 38 bp, Artificial Sequence
  Synthetic oligonucleotide
tcgacccgccctgtttacgtcgcacccctggtccctga

SEQ ID NO: 172955 - DNA, 38 bp, Artificial Sequence
  Synthetic oligonucleotide
tttccgcacactcccctccgtcctgccttacagcctga

SEQ ID NO: 172956 - DNA, 38 bp, Artificial Sequence
  Synthetic oligonucleotide
gcctggtaggaggtgggtgtggtggtggcatccagtga

SEQ ID NO: 172957 - DNA, 37 bp, Artificial Sequence
  Synthetic oligonucleotide
taggagtgggagagcggagtaagaggggggaccgtga

SEQ ID NO: 172958 - DNA, 38 bp, Artificial Sequence
  Synthetic oligonucleotide
tacgatccccggccattgttaaacccttcgacccgtga

SEQ ID NO: 172959 - DNA, 38 bp, Artificial Sequence
  Synthetic oligonucleotide
acctagggggagaagggacgcagagacacagaaggtga

SEQ ID NO: 172960 - DNA, 38 bp, Artificial Sequence
  Synthetic oligonucleotide
gccacctctaccctacgccttcacccaccgagtggtga

SEQ ID NO: 172961 - DNA, 38 bp, Artificial Sequence
  Synthetic oligonucleotide
gggaaggtaagcaggtgggtcaaaagggggcgatgtga

SEQ ID NO: 172962 - DNA, 38 bp, Artificial Sequence
  Synthetic oligonucleotide
gtgcgcagatgcgggtcgggggggctgggtctaattga

SEQ ID NO: 172963 - DNA, 38 bp, Artificial Sequence
  Synthetic oligonucleotide
gtcaccaccgagcttttgtcgccctcattattaattga

SEQ ID NO: 172964 - DNA, 38 bp, Artificial Sequence
  Synthetic oligonucleotide
tccccatgcctctgccccgactcacacagtctctttga

SEQ ID NO: 172965 - DNA, 38 bp, Artificial Sequence
  Synthetic oligonucleotide
gcacaccacaggtgcgatattcacccccgcatttttga

SEQ ID NO: 172966 - DNA, 36 bp, Artificial Sequence
  Synthetic oligonucleotide
gtagctgatcgtctgacggtccccccccccgtacta

SEQ ID NO: 172967 - DNA, 36 bp, Artificial Sequence
  Synthetic oligonucleotide
gcacgtgatccagtctgtccctcagcatcctcccta

SEQ ID NO: 172968 - DNA, 36 bp, Artificial Sequence
  Synthetic oligonucleotide
tcctgaccccctccttcatgaattaagagtacagta

SEQ ID NO: 172969 - DNA, 35 bp, Artificial Sequence
  Synthetic oligonucleotide
actgggggggagtaggggggtcgggctaggtggta

SEQ ID NO: 172970 - DNA, 35 bp, Artificial Sequence
  Synthetic oligonucleotide
tgtgccctgctcttgttacatccagctccctatta

SEQ ID NO: 172971 - DNA, 36 bp, Artificial Sequence
  Synthetic oligonucleotide
accgccccccatggtcttgtttaacgctcctactta

SEQ ID NO: 172972 - DNA, 35 bp, Artificial Sequence
  Synthetic oligonucleotide
acctccgccccccagcatgcctagctcccccgtta

SEQ ID NO: 172973 - DNA, 36 bp, Artificial Sequence
  Synthetic oligonucleotide
atacgacgcccaggagtcgtctccccttccagttta

SEQ ID NO: 172974 - DNA, 36 bp, Artificial Sequence
  Synthetic oligonucleotide
atgtattagcctctgcctgcctcacccacccgttta

SEQ ID NO: 172975 - DNA, 35 bp, Artificial Sequence
  Synthetic oligonucleotide
tccatacacatgtcggttatctcccgtgccttaac

SEQ ID NO: 172976 - DNA, 35 bp, Artificial Sequence
  Synthetic oligonucleotide
ttcgcaagttcgctcacaagattcacctgccacac

SEQ ID NO: 172977 - DNA, 35 bp, Artificial Sequence
  Synthetic oligonucleotide
tcacccaccagcccccagccattatggctctccac

SEQ ID NO: 172978 - DNA, 35 bp, Artificial Sequence
  Synthetic oligonucleotide
gacgagccctacaatgcgtcatcaccgcctctcac

SEQ ID NO: 172979 - DNA, 35 bp, Artificial Sequence
  Synthetic oligonucleotide
tgacgctgtaccctgccctgaccatcctcggcgac

SEQ ID NO: 172980 - DNA, 35 bp, Artificial Sequence
  Synthetic oligonucleotide
acatgaccgtaccggtccctagcccttctctcgac

SEQ ID NO: 172981 - DNA, 35 bp, Artificial Sequence
  Synthetic oligonucleotide
atcacgacccgcaccgcctatctaaaggccccccc

SEQ ID NO: 172982 - DNA, 35 bp, Artificial Sequence
  Synthetic oligonucleotide
gtcatcctcgatgcttctgcctactttagcgcccc

SEQ ID NO: 172983 - DNA, 35 bp, Artificial Sequence
  Synthetic oligonucleotide
tcccaggccattgtgccgtaatcatactgcgcccc

SEQ ID NO: 172984 - DNA, 35 bp, Artificial Sequence
  Synthetic oligonucleotide
gatcctcgcccatctgacaattgacccgcgggccc

SEQ ID NO: 172985 - DNA, 33 bp, Artificial Sequence
  Synthetic oligonucleotide
aatgttcacaaccccgcggtctcttacctgccc

SEQ ID NO: 172986 - DNA, 36 bp, Artificial Sequence
  Synthetic oligonucleotide
gccccgccttcctcctctctggtccggttgcgagcc

SEQ ID NO: 172987 - DNA, 35 bp, Artificial Sequence
  Synthetic oligonucleotide
gtcgcctcggtgcccaatgaccatcctccactgcc

SEQ ID NO: 172988 - DNA, 35 bp, Artificial Sequence
  Synthetic oligonucleotide
atgacagccacattcctaccttcacctacgctgcc

SEQ ID NO: 172989 - DNA, 35 bp, Artificial Sequence
  Synthetic oligonucleotide
caccccccccacattttaatgcctcgggaaactcc

SEQ ID NO: 172990 - DNA, 35 bp, Artificial Sequence
  Synthetic oligonucleotide
acgggcaccaccgtaagtggcctttctgttcctcc

SEQ ID NO: 172991 - DNA, 35 bp, Artificial Sequence
  Synthetic oligonucleotide
tacagctacctgactgcactcccgccgttctgtcc

SEQ ID NO: 172992 - DNA, 35 bp, Artificial Sequence
  Synthetic oligonucleotide
gatcatcgcaccgtattcgatcctgcttgttgtcc

SEQ ID NO: 172993 - DNA, 35 bp, Artificial Sequence
  Synthetic oligonucleotide
ttgccaaccgcccagagtcccctcatgtcctgcgc

SEQ ID NO: 172994 - DNA, 35 bp, Artificial Sequence
  Synthetic oligonucleotide
ggacttgcctccccttgtttgtggttctttgctgc

SEQ ID NO: 172995 - DNA, 35 bp, Artificial Sequence
  Synthetic oligonucleotide
gcctccccggctaaaaaccttcgatccgcctgtgc

SEQ ID NO: 172996 - DNA, 35 bp, Artificial Sequence
  Synthetic oligonucleotide
tctgtgaccactgtccctcgtatacgttgccttgc

SEQ ID NO: 172997 - DNA, 35 bp, Artificial Sequence
  Synthetic oligonucleotide
tgaataccatccgctggcccccttagcctttttgc

SEQ ID NO: 172998 - DNA, 35 bp, Artificial Sequence
  Synthetic oligonucleotide
ttccctcgcaccttcgctcaacgggacctgtaatc

SEQ ID NO: 172999 - DNA, 35 bp, Artificial Sequence
  Synthetic oligonucleotide
acgccatcagcactgctaaggcttaaacgcccctc

SEQ ID NO: 173000 - DNA, 35 bp, Artificial Sequence
  Synthetic oligonucleotide
ttgtcccgccccccacgcgtcgcataccaggcctc

SEQ ID NO: 173001 - DNA, 35 bp, Artificial Sequence
  Synthetic oligonucleotide
aaccgccactcctacccgccggtaaacacgagctc

SEQ ID NO: 173002 - DNA, 35 bp, Artificial Sequence
  Synthetic oligonucleotide
tgccaccaccttcaacgatctcgaaacgcagtctc

SEQ ID NO: 173003 - DNA, 35 bp, Artificial Sequence
  Synthetic oligonucleotide
gacagtcctgcgacgaccctccccccacgtacgtc

SEQ ID NO: 173004 - DNA, 35 bp, Artificial Sequence
  Synthetic oligonucleotide
tgaaaagcacgtgccccatctattatagccgcttc

SEQ ID NO: 173005 - DNA, 35 bp, Artificial Sequence
  Synthetic oligonucleotide
ttagcaagagatgcgcttacattgtccgcccgttc

SEQ ID NO: 173006 - DNA, 35 bp, Artificial Sequence
  Synthetic oligonucleotide
ggtgtctcaccatgcctcgaatcgtcctcccgttc

SEQ ID NO: 173007 - DNA, 35 bp, Artificial Sequence
  Synthetic oligonucleotide
gacgcctaccgcttatcgtcctgggacactatttc

SEQ ID NO: 173008 - DNA, 33 bp, Artificial Sequence
  Synthetic oligonucleotide
atcccccgcccatccccgtgtaagttcacacag

SEQ ID NO: 173009 - DNA, 35 bp, Artificial Sequence
  Synthetic oligonucleotide
tcatgcccgcccgtccccccagctaccaacgtacg

SEQ ID NO: 173010 - DNA, 35 bp, Artificial Sequence
  Synthetic oligonucleotide
acccaagcgatgcgatgaccgtctcttcacccgcg

SEQ ID NO: 173011 - DNA, 35 bp, Artificial Sequence
  Synthetic oligonucleotide
aacgttccacgcctgctccctgcacatgtttgtcg

SEQ ID NO: 173012 - DNA, 35 bp, Artificial Sequence
  Synthetic oligonucleotide
gcacaaccctgtcactctcgcctatgctcccttcg

SEQ ID NO: 173013 - DNA, 35 bp, Artificial Sequence
  Synthetic oligonucleotide
gtgacgtacatagtcggccgattcacccctcttcg

SEQ ID NO: 173014 - DNA, 35 bp, Artificial Sequence
  Synthetic oligonucleotide
gaccacctgacccccccctccatggtgctataagg

SEQ ID NO: 173015 - DNA, 35 bp, Artificial Sequence
  Synthetic oligonucleotide
gtggtgaacggtggtggatcacgaggaaggagggg

SEQ ID NO: 173016 - DNA, 35 bp, Artificial Sequence
  Synthetic oligonucleotide
agagggggatggggggctgggtcgaagaccatggg

SEQ ID NO: 173017 - DNA, 35 bp, Artificial Sequence
  Synthetic oligonucleotide
accaccgcctcctctggacccatgctttttagatg

SEQ ID NO: 173018 - DNA, 35 bp, Artificial Sequence
  Synthetic oligonucleotide
tgtagcgcgatcgctacagtcacccattctacctg

SEQ ID NO: 173019 - DNA, 35 bp, Artificial Sequence
  Synthetic oligonucleotide
tgatcgtctaccctcgcaccgtcactatctgtctg

SEQ ID NO: 173020 - DNA, 35 bp, Artificial Sequence
  Synthetic oligonucleotide
acagtggtcgtagtggggggagtggggggccggtg

SEQ ID NO: 173021 - DNA, 35 bp, Artificial Sequence
  Synthetic oligonucleotide
agacgccgcctgagtgacttcccttttgatccttg

SEQ ID NO: 173022 - DNA, 35 bp, Artificial Sequence
  Synthetic oligonucleotide
acgagtcaacgaccgccgcctttaccgtctaccat

SEQ ID NO: 173023 - DNA, 35 bp, Artificial Sequence
  Synthetic oligonucleotide
actggcacgctattgtcatcctgccgccgtgccat

SEQ ID NO: 173024 - DNA, 35 bp, Artificial Sequence
  Synthetic oligonucleotide
acccgtcgttttgccatcccagcgacgatctccat

SEQ ID NO: 173025 - DNA, 35 bp, Artificial Sequence
  Synthetic oligonucleotide
tcgccgacagtactcccgcttctgcacctcctcat

SEQ ID NO: 173026 - DNA, 35 bp, Artificial Sequence
  Synthetic oligonucleotide
agaactgctcaagccgatcgcacctgccctctcat

SEQ ID NO: 173027 - DNA, 35 bp, Artificial Sequence
  Synthetic oligonucleotide
acgtgggaccttccgcaggcctttcacctccaact

SEQ ID NO: 173028 - DNA, 35 bp, Artificial Sequence
  Synthetic oligonucleotide
gtggggagtcggtcccatgcgctgtccttcttact

SEQ ID NO: 173029 - DNA, 35 bp, Artificial Sequence
  Synthetic oligonucleotide
gccagacctctaggtcgtaccctgttttactacct

SEQ ID NO: 173030 - DNA, 35 bp, Artificial Sequence
  Synthetic oligonucleotide
tacgcaagctgctgcacgcacctgttatcaaccct

SEQ ID NO: 173031 - DNA, 35 bp, Artificial Sequence
  Synthetic oligonucleotide
taccgtgtcggacgcctattctcgctttcaaccct

SEQ ID NO: 173032 - DNA, 35 bp, Artificial Sequence
  Synthetic oligonucleotide
acgctacagatgggtgcgcccctccgattccccct

SEQ ID NO: 173033 - DNA, 35 bp, Artificial Sequence
  Synthetic oligonucleotide
gctgtcgtgtagccggccgtccccaatttgcccct

SEQ ID NO: 173034 - DNA, 35 bp, Artificial Sequence
  Synthetic oligonucleotide
aatcacctcgtagtccggtatccactttgctccct

SEQ ID NO: 173035 - DNA, 35 bp, Artificial Sequence
  Synthetic oligonucleotide
attcgccccgcgccctatcttgtttcaccttccct

SEQ ID NO: 173036 - DNA, 35 bp, Artificial Sequence
  Synthetic oligonucleotide
ttgacccgactgatgcctctacacctgccttatct

SEQ ID NO: 173037 - DNA, 35 bp, Artificial Sequence
  Synthetic oligonucleotide
acccacaccctgttcactgctccataacgtagtct

SEQ ID NO: 173038 - DNA, 34 bp, Artificial Sequence
  Synthetic oligonucleotide
gtagcaacccacgtgtgccatcgccccccctagt

SEQ ID NO: 173039 - DNA, 35 bp, Artificial Sequence
  Synthetic oligonucleotide
actcatagcggccgttgcattccgctcccctacgt

SEQ ID NO: 173040 - DNA, 35 bp, Artificial Sequence
  Synthetic oligonucleotide
gccccgccaacagcaccgttccgcccttcaaccgt

SEQ ID NO: 173041 - DNA, 34 bp, Artificial Sequence
  Synthetic oligonucleotide
acgcatccgcgttgtcgtcgcctagctctaactt

SEQ ID NO: 173042 - DNA, 35 bp, Artificial Sequence
  Synthetic oligonucleotide
acgttgacgcactgtgcctttgctccaccatcctt

SEQ ID NO: 173043 - DNA, 35 bp, Artificial Sequence
  Synthetic oligonucleotide
ggtacaccctgcacactccgagatcggtcccagtt

SEQ ID NO: 173044 - DNA, 35 bp, Artificial Sequence
  Synthetic oligonucleotide
aagctagcctcctgttccatctcttgactctagtt

SEQ ID NO: 173045 - DNA, 35 bp, Artificial Sequence
  Synthetic oligonucleotide
tgcggacaatgagagggtgtaggggatggggcgtt

SEQ ID NO: 173046 - DNA, 27 bp, Artificial Sequence
  Synthetic oligonucleotide
gactacaccgacccgttctgtactgtt

SEQ ID NO: 173047 - DNA, 35 bp, Artificial Sequence
  Synthetic oligonucleotide
tcagccatcatacaaggcccctcttctatcctgtt

SEQ ID NO: 173048 - DNA, 36 bp, Artificial Sequence
  Synthetic oligonucleotide
ttagccaacgccctcattcgttttcctctcgccaaa

SEQ ID NO: 173049 - DNA, 35 bp, Artificial Sequence
  Synthetic oligonucleotide
acgccgggaagcgagtatagcggggggagtaggaa

SEQ ID NO: 173050 - DNA, 36 bp, Artificial Sequence
  Synthetic oligonucleotide
tcatcaccgctgatcctggcatccacctttcatgaa

SEQ ID NO: 173051 - DNA, 34 bp, Artificial Sequence
  Synthetic oligonucleotide
cacgcgcacagcccgccgatcctcccctcgtgaa

SEQ ID NO: 173052 - DNA, 36 bp, Artificial Sequence
  Synthetic oligonucleotide
atctctccatcctgttcgccgtgtcccttgggaaca

SEQ ID NO: 173053 - DNA, 35 bp, Artificial Sequence
  Synthetic oligonucleotide
acgcccctctctgtattcgcctacctgggttcaca

SEQ ID NO: 173054 - DNA, 36 bp, Artificial Sequence
  Synthetic oligonucleotide
ttgcaacctcctcctgtctcatggcccgtgccacca

SEQ ID NO: 173055 - DNA, 36 bp, Artificial Sequence
  Synthetic oligonucleotide
ggatgcccagcccgccgacgttcctcgagccaccca

SEQ ID NO: 173056 - DNA, 36 bp, Artificial Sequence
  Synthetic oligonucleotide
gcccattgcatctactctcgtcacggtccaccccca

SEQ ID NO: 173057 - DNA, 36 bp, Artificial Sequence
  Synthetic oligonucleotide
gccacactcatgcttggcagggttcccgccgcccca

SEQ ID NO: 173058 - DNA, 36 bp, Artificial Sequence
  Synthetic oligonucleotide
gcccgcccaacacagtatgccgctttttctgtccca

SEQ ID NO: 173059 - DNA, 35 bp, Artificial Sequence
  Synthetic oligonucleotide
tccacaacgttcctccccgggcgctcttacagcca

SEQ ID NO: 173060 - DNA, 35 bp, Artificial Sequence
  Synthetic oligonucleotide
tccaccctccgattcacatgtccactcatcagcca

SEQ ID NO: 173061 - DNA, 36 bp, Artificial Sequence
  Synthetic oligonucleotide
tgtaactccgtgacgtacctgcttgaaacacctcca

SEQ ID NO: 173062 - DNA, 36 bp, Artificial Sequence
  Synthetic oligonucleotide
actaggcgcagttcgattaaacctcccgtccttcca

SEQ ID NO: 173063 - DNA, 36 bp, Artificial Sequence
  Synthetic oligonucleotide
accaacccacgcccgtgtgctcgctcccgtaaagca

SEQ ID NO: 173064 - DNA, 36 bp, Artificial Sequence
  Synthetic oligonucleotide
gtatggtcgaagcgaggaggggaagaaaggggcgca

SEQ ID NO: 173065 - DNA, 36 bp, Artificial Sequence
  Synthetic oligonucleotide
gatccccactctcgtgtgttctgccgtacaccctca

SEQ ID NO: 173066 - DNA, 37 bp, Artificial Sequence
  Synthetic oligonucleotide
ggacactgcgggggagggggttacgtagggggaaaga

SEQ ID NO: 173067 - DNA, 37 bp, Artificial Sequence
  Synthetic oligonucleotide
gatgatcgagttggggaggacggagggccaagacaga

SEQ ID NO: 173068 - DNA, 37 bp, Artificial Sequence
  Synthetic oligonucleotide
gggtgggcgtggagggcaggttgggggatccggcaga

SEQ ID NO: 173069 - DNA, 37 bp, Artificial Sequence
  Synthetic oligonucleotide
gtcagggtgagaacagagaaggggggtggggacgaga

SEQ ID NO: 173070 - DNA, 37 bp, Artificial Sequence
  Synthetic oligonucleotide
gccccctctggtccttcagttcaccttctttcggaga

SEQ ID NO: 173071 - DNA, 36 bp, Artificial Sequence
  Synthetic oligonucleotide
gacacctccagtccaattctgaccgcttgcccacga

SEQ ID NO: 173072 - DNA, 36 bp, Artificial Sequence
  Synthetic oligonucleotide
gggggggggagcatgagagcttagagttgaggacga

SEQ ID NO: 173073 - DNA, 37 bp, Artificial Sequence
  Synthetic oligonucleotide
gaacatggcagtgatgaggggaacgaacgggggacga

SEQ ID NO: 173074 - DNA, 35 bp, Artificial Sequence
  Synthetic oligonucleotide
tgtgtgcctcctgccttaccaagcaatgcctacga

SEQ ID NO: 173075 - DNA, 35 bp, Artificial Sequence
  Synthetic oligonucleotide
tagcctcgtgcaccagctcattctcaccctcccga

SEQ ID NO: 173076 - DNA, 37 bp, Artificial Sequence
  Synthetic oligonucleotide
acttacgcccattgatccggcccggttgttccttcga

SEQ ID NO: 173077 - DNA, 37 bp, Artificial Sequence
  Synthetic oligonucleotide
gctaacagacgagaagaagggatggcagggggaagga

SEQ ID NO: 173078 - DNA, 37 bp, Artificial Sequence
  Synthetic oligonucleotide
atgcggaacatacgagggggtgggagcacggatagga

SEQ ID NO: 173079 - DNA, 37 bp, Artificial Sequence
  Synthetic oligonucleotide
tcacggggagcgggttcgaatagggtggggtttagga

SEQ ID NO: 173080 - DNA, 37 bp, Artificial Sequence
  Synthetic oligonucleotide
accgagcccgttcctcatctcgtcctgtcttatcgga

SEQ ID NO: 173081 - DNA, 37 bp, Artificial Sequence
  Synthetic oligonucleotide
atatcacgaagcacggggggggaagggagtcaaggga

SEQ ID NO: 173082 - DNA, 37 bp, Artificial Sequence
  Synthetic oligonucleotide
tgagggtacagcaggggtacaggggggtggctcggga

SEQ ID NO: 173083 - DNA, 35 bp, Artificial Sequence
  Synthetic oligonucleotide
gagggggtgactagtatggggaggcgcgcagggga

SEQ ID NO: 173084 - DNA, 37 bp, Artificial Sequence
  Synthetic oligonucleotide
gtcgtgtggggaggattggacttgtgagcggagggga

SEQ ID NO: 173085 - DNA, 37 bp, Artificial Sequence
  Synthetic oligonucleotide
taacaggagggaagggcaggaagggtgtcgaggggga

SEQ ID NO: 173086 - DNA, 37 bp, Artificial Sequence
  Synthetic oligonucleotide
tgtgggaccgtgggggaagagttgcgggggagatgga

SEQ ID NO: 173087 - DNA, 36 bp, Artificial Sequence
  Synthetic oligonucleotide
ggagggccggggaagaggggaggggcgaatcgtgga

SEQ ID NO: 173088 - DNA, 38 bp, Artificial Sequence
  Synthetic oligonucleotide
atcgataacctctgcacgtgttcctcctacctccatga

SEQ ID NO: 173089 - DNA, 38 bp, Artificial Sequence
  Synthetic oligonucleotide
tgaccctcgctctgaccattgcaccacctcttgtatga

SEQ ID NO: 173090 - DNA, 37 bp, Artificial Sequence
  Synthetic oligonucleotide
acccacctcctggtcacactgcaggccgagtgcctga

SEQ ID NO: 173091 - DNA, 37 bp, Artificial Sequence
  Synthetic oligonucleotide
tcatctcctccgtttgccctcaaatagtcatctctga

SEQ ID NO: 173092 - DNA, 37 bp, Artificial Sequence
  Synthetic oligonucleotide
tcacgcaatctgtgctttcccgttttcccctgcgtga

SEQ ID NO: 173093 - DNA, 38 bp, Artificial Sequence
  Synthetic oligonucleotide
gtcccgtgaatgggtgggcagggacaacgaaggggtga

SEQ ID NO: 173094 - DNA, 37 bp, Artificial Sequence
  Synthetic oligonucleotide
ggggcgggcatgatccggggtattggataaggggtga

SEQ ID NO: 173095 - DNA, 38 bp, Artificial Sequence
  Synthetic oligonucleotide
taactgcccgcctgtaacgctacctcccccggacttga

SEQ ID NO: 173096 - DNA, 38 bp, Artificial Sequence
  Synthetic oligonucleotide
tgcatacctgattccgcgtctatccagcccttccttga

SEQ ID NO: 173097 - DNA, 38 bp, Artificial Sequence
  Synthetic oligonucleotide
tcccaactcactgattacaaacgccctatcctgcttga

SEQ ID NO: 173098 - DNA, 38 bp, Artificial Sequence
  Synthetic oligonucleotide
tacgtgccccatcgaccttgaattgcccttactcttga

SEQ ID NO: 173099 - DNA, 37 bp, Artificial Sequence
  Synthetic oligonucleotide
gagcccactgtccctcttgtttactggtccacgttga

SEQ ID NO: 173100 - DNA, 38 bp, Artificial Sequence
  Synthetic oligonucleotide
tactaacgtcgccccgtacgcctgccaatttcctttga

SEQ ID NO: 173101 - DNA, 35 bp, Artificial Sequence
  Synthetic oligonucleotide
tatgcagtctcttgccccacactcagccctccgta

SEQ ID NO: 173102 - DNA, 36 bp, Artificial Sequence
  Synthetic oligonucleotide
tctgatcagtctaggtggggctcgggagggggggta

SEQ ID NO: 173103 - DNA, 36 bp, Artificial Sequence
  Synthetic oligonucleotide
tgatggggctcaaagggagggggggatgaggaatta

SEQ ID NO: 173104 - DNA, 35 bp, Artificial Sequence
  Synthetic oligonucleotide
gagtgctaggggcggtacagcgggagggagcatta

SEQ ID NO: 173105 - DNA, 36 bp, Artificial Sequence
  Synthetic oligonucleotide
ttcgccccctagatgttcttacctgcttcgtcgtta

SEQ ID NO: 173106 - DNA, 36 bp, Artificial Sequence
  Synthetic oligonucleotide
gatccccgctttccctgtccgacgagacgtgattta

SEQ ID NO: 173107 - DNA, 35 bp, Artificial Sequence
  Synthetic oligonucleotide
tgattcgccccgtctaagcctccctttgattccac

SEQ ID NO: 173108 - DNA, 31 bp, Artificial Sequence
  Synthetic oligonucleotide
acctaccaccgaccaacgcgctgaccctacc

SEQ ID NO: 173109 - DNA, 35 bp, Artificial Sequence
  Synthetic oligonucleotide
gtgggccttccatccggtccgctcatagctttacc

SEQ ID NO: 173110 - DNA, 35 bp, Artificial Sequence
  Synthetic oligonucleotide
gccaacaccgaatgacacctgaggcgcttaacccc

SEQ ID NO: 173111 - DNA, 35 bp, Artificial Sequence
  Synthetic oligonucleotide
gtgggactacctccgttgggccgccgagccccccc

SEQ ID NO: 173112 - DNA, 35 bp, Artificial Sequence
  Synthetic oligonucleotide
tccacgatcacccgcgatccctggtcctgttagcc

SEQ ID NO: 173113 - DNA, 35 bp, Artificial Sequence
  Synthetic oligonucleotide
agccgctccccgtcccctgaattgttgctgccgcc

SEQ ID NO: 173114 - DNA, 35 bp, Artificial Sequence
  Synthetic oligonucleotide
gagctgctcatctgcccgtcccgaaatgttgcgcc

SEQ ID NO: 173115 - DNA, 35 bp, Artificial Sequence
  Synthetic oligonucleotide
gacgtctcccttccctgtgctcaagccaagtggcc

SEQ ID NO: 173116 - DNA, 35 bp, Artificial Sequence
  Synthetic oligonucleotide
ttctgcgtaagccctcgcgagcttcactccctgcc

SEQ ID NO: 173117 - DNA, 35 bp, Artificial Sequence
  Synthetic oligonucleotide
tttgcccctgctgctctaacacgaacttcacttcc

SEQ ID NO: 173118 - DNA, 35 bp, Artificial Sequence
  Synthetic oligonucleotide
taacactccccccccccgtatgcactgtctgttcc

SEQ ID NO: 173119 - DNA, 35 bp, Artificial Sequence
  Synthetic oligonucleotide
gtgcactacttcggtcccagactaggctcctttcc

SEQ ID NO: 173120 - DNA, 35 bp, Artificial Sequence
  Synthetic oligonucleotide
agtcactatccgcctcaggtccaccaaccgcccgc

SEQ ID NO: 173121 - DNA, 35 bp, Artificial Sequence
  Synthetic oligonucleotide
tgcctcacagcatggaaccgtcgaacgctctccgc

SEQ ID NO: 173122 - DNA, 35 bp, Artificial Sequence
  Synthetic oligonucleotide
ttacggttcctcccctgttttgcgtgcactatcgc

SEQ ID NO: 173123 - DNA, 35 bp, Artificial Sequence
  Synthetic oligonucleotide
ccgatctgatcacctgcgttcgtagctcctcctgc

SEQ ID NO: 173124 - DNA, 35 bp, Artificial Sequence
  Synthetic oligonucleotide
ttgtactaccttggccaaccacctgcatatcttgc

SEQ ID NO: 173125 - DNA, 35 bp, Artificial Sequence
  Synthetic oligonucleotide
gcaccccttaccatggttagcgagcctgttcttgc

SEQ ID NO: 173126 - DNA, 35 bp, Artificial Sequence
  Synthetic oligonucleotide
gtcaccacctacagtttgtagttctgtctcccatc

SEQ ID NO: 173127 - DNA, 30 bp, Artificial Sequence
  Synthetic oligonucleotide
acttcatacccccctgtatcatggcttatc

SEQ ID NO: 173128 - DNA, 35 bp, Artificial Sequence
  Synthetic oligonucleotide
tatccgccactgctcattttttggtacactttatc

SEQ ID NO: 173129 - DNA, 35 bp, Artificial Sequence
  Synthetic oligonucleotide
accattgttccctccggtgtgctaactcactactc

SEQ ID NO: 173130 - DNA, 35 bp, Artificial Sequence
  Synthetic oligonucleotide
tagtacctccgtcatcctctcgctgggtttacctc

SEQ ID NO: 173131 - DNA, 35 bp, Artificial Sequence
  Synthetic oligonucleotide
ggacacttctcacatcgatatagctatagcccctc

SEQ ID NO: 173132 - DNA, 35 bp, Artificial Sequence
  Synthetic oligonucleotide
tgctccgccaattatgatttttcgactatccgctc

SEQ ID NO: 173133 - DNA, 35 bp, Artificial Sequence
  Synthetic oligonucleotide
atcgtccggccggtcgagcccgttcctactgtctc

SEQ ID NO: 173134 - DNA, 35 bp, Artificial Sequence
  Synthetic oligonucleotide
tggttccagcacttcgtccgtacttgccccccgtc

SEQ ID NO: 173135 - DNA, 35 bp, Artificial Sequence
  Synthetic oligonucleotide
acacagatgcagcccccatccttatcaagccggtc

SEQ ID NO: 173136 - DNA, 35 bp, Artificial Sequence
  Synthetic oligonucleotide
gtggctcctgtcattccccgtcggtttcactggtc

SEQ ID NO: 173137 - DNA, 35 bp, Artificial Sequence
  Synthetic oligonucleotide
tgccctgatctcccgatccaccacagtacctggtc

SEQ ID NO: 173138 - DNA, 35 bp, Artificial Sequence
  Synthetic oligonucleotide
aattgatcagcctgcgtaaccctcgctcccttgtc

SEQ ID NO: 173139 - DNA, 35 bp, Artificial Sequence
  Synthetic oligonucleotide
gatccacctacgtattgcctcgcgtgaaccagttc

SEQ ID NO: 173140 - DNA, 35 bp, Artificial Sequence
  Synthetic oligonucleotide
gtggacgggtcacctacgtcgcgccttcttctttc

SEQ ID NO: 173141 - DNA, 35 bp, Artificial Sequence
  Synthetic oligonucleotide
tacttgctcgacacaccttgcccgccgcccctaag

SEQ ID NO: 173142 - DNA, 35 bp, Artificial Sequence
  Synthetic oligonucleotide
tcagtcacacatcattcctgcgttcgatcctccag

SEQ ID NO: 173143 - DNA, 35 bp, Artificial Sequence
  Synthetic oligonucleotide
ttcgccgtacgcccccttctctatttaccctcacg

SEQ ID NO: 173144 - DNA, 35 bp, Artificial Sequence
  Synthetic oligonucleotide
acgccgtgccgcaagttctgcttcaaccctctacg

SEQ ID NO: 173145 - DNA, 35 bp, Artificial Sequence
  Synthetic oligonucleotide
tgcatccgaccgtctggttacctcaccccactccg

SEQ ID NO: 173146 - DNA, 35 bp, Artificial Sequence
  Synthetic oligonucleotide
tcaacaggtcactcctctcggcttttccatactcg

SEQ ID NO: 173147 - DNA, 35 bp, Artificial Sequence
  Synthetic oligonucleotide
gacagggggcataatgagtgggtgggatgtagtcg

SEQ ID NO: 173148 - DNA, 35 bp, Artificial Sequence
  Synthetic oligonucleotide
ttacaaagcgcacagcctctctatatctcacttcg

SEQ ID NO: 173149 - DNA, 35 bp, Artificial Sequence
  Synthetic oligonucleotide
tagcggcccccgtgtttcactcacctgcatatagg

SEQ ID NO: 173150 - DNA, 35 bp, Artificial Sequence
  Synthetic oligonucleotide
gacgggggagggggggagaaggagatgaacaaggg

SEQ ID NO: 173151 - DNA, 35 bp, Artificial Sequence
  Synthetic oligonucleotide
atcaaatgcagcacgagggcgatgggtggtgcggg

SEQ ID NO: 173152 - DNA, 35 bp, Artificial Sequence
  Synthetic oligonucleotide
agtgtggaagggaggagaggagcggactcgtgtgg

SEQ ID NO: 173153 - DNA, 35 bp, Artificial Sequence
  Synthetic oligonucleotide
gactatggccagttcaaccactccaccctctttgg

SEQ ID NO: 173154 - DNA, 35 bp, Artificial Sequence
  Synthetic oligonucleotide
ttccgccccattcataccgctgtagcgccactact

SEQ ID NO: 173155 - DNA, 35 bp, Artificial Sequence
  Synthetic oligonucleotide
tagtgccatcctacggctttaatccacccgctact

SEQ ID NO: 173156 - DNA, 35 bp, Artificial Sequence
  Synthetic oligonucleotide
tccaaccacacactggattaaacgatctaacccct

SEQ ID NO: 173157 - DNA, 35 bp, Artificial Sequence
  Synthetic oligonucleotide
aatagctgccctcgttcacgtactgttactgccct

SEQ ID NO: 173158 - DNA, 35 bp, Artificial Sequence
  Synthetic oligonucleotide
tttgcctgcaaggtacgtcccgctcccacctcgct

SEQ ID NO: 173159 - DNA, 35 bp, Artificial Sequence
  Synthetic oligonucleotide
gtgtagtcccccatgtttcgcccgatattgctgct

SEQ ID NO: 173160 - DNA, 35 bp, Artificial Sequence
  Synthetic oligonucleotide
tcaccattgtgaacgcgatgtatccaaccacctct

SEQ ID NO: 173161 - DNA, 35 bp, Artificial Sequence
  Synthetic oligonucleotide
ttggcgtgccacgtcgttctctcgccgcctcccgt

SEQ ID NO: 173162 - DNA, 35 bp, Artificial Sequence
  Synthetic oligonucleotide
gccccctccgcctggccgaagcgattctccccggt

SEQ ID NO: 173163 - DNA, 35 bp, Artificial Sequence
  Synthetic oligonucleotide
ttccccccgctactagtgtataatccttcgctggt

SEQ ID NO: 173164 - DNA, 35 bp, Artificial Sequence
  Synthetic oligonucleotide
gatacgcgcgcatctttgcctgttttttctacatt

SEQ ID NO: 173165 - DNA, 35 bp, Artificial Sequence
  Synthetic oligonucleotide
acccacccggcggactaccactcttcctagcgctt

SEQ ID NO: 173166 - DNA, 35 bp, Artificial Sequence
  Synthetic oligonucleotide
gcgaatggacgaagggaaagttgagctgggaggtt

SEQ ID NO: 173167 - DNA, 35 bp, Artificial Sequence
  Synthetic oligonucleotide
acctacacctcccaccagggaataagttctcattt

SEQ ID NO: 173168 - DNA, 35 bp, Artificial Sequence
  Synthetic oligonucleotide
ttccattcgccttcacattgtagtccttcatcttt

SEQ ID NO: 173169 - DNA, 36 bp, Artificial Sequence
  Synthetic oligonucleotide
gttacctcaacaccctgctcacgcgccctcctgcaa

SEQ ID NO: 173170 - DNA, 36 bp, Artificial Sequence
  Synthetic oligonucleotide
gggcggggagggcgggtttaaaacactttgtatcaa

SEQ ID NO: 173171 - DNA, 36 bp, Artificial Sequence
  Synthetic oligonucleotide
ggggccaggactagaaatagggggcggtggtgcgaa

SEQ ID NO: 173172 - DNA, 36 bp, Artificial Sequence
  Synthetic oligonucleotide
gtgctcggtggagagcggacggggacttgggcggaa

SEQ ID NO: 173173 - DNA, 36 bp, Artificial Sequence
  Synthetic oligonucleotide
gtcccagcctccctagtcacacacactgctccataa

SEQ ID NO: 173174 - DNA, 36 bp, Artificial Sequence
  Synthetic oligonucleotide
atcacgccctcctgtttggccatccgaaaccgcaca

SEQ ID NO: 173175 - DNA, 35 bp, Artificial Sequence
  Synthetic oligonucleotide
gggactagggggacggaaggggtttcggcggtaca

SEQ ID NO: 173176 - DNA, 35 bp, Artificial Sequence
  Synthetic oligonucleotide
ttcactgtacccgcctcgttatatactgtcttaca

SEQ ID NO: 173177 - DNA, 35 bp, Artificial Sequence
  Synthetic oligonucleotide
agggctcaagttgggagggtgggtcttcatcacca

SEQ ID NO: 173178 - DNA, 35 bp, Artificial Sequence
  Synthetic oligonucleotide
aacactcgtgtccttgttttagtttctgccaccca

SEQ ID NO: 173179 - DNA, 36 bp, Artificial Sequence
  Synthetic oligonucleotide
ttacaagcacagtcgatcttgatcacgcccccccca

SEQ ID NO: 173180 - DNA, 36 bp, Artificial Sequence
  Synthetic oligonucleotide
tgatcaacctccacctagctatttctgctgctccca

SEQ ID NO: 173181 - DNA, 35 bp, Artificial Sequence
  Synthetic oligonucleotide
caggtccaccctcaccctctctgtttcatgcgcca

SEQ ID NO: 173182 - DNA, 36 bp, Artificial Sequence
  Synthetic oligonucleotide
gcgtatccgccacccagtctgttcttataacctcca

SEQ ID NO: 173183 - DNA, 36 bp, Artificial Sequence
  Synthetic oligonucleotide
gcctgtgtcggccgctccttagccccctatcgcgca

SEQ ID NO: 173184 - DNA, 36 bp, Artificial Sequence
  Synthetic oligonucleotide
actgcaccccgctcggtgtcgatacttccctgctca

SEQ ID NO: 173185 - DNA, 36 bp, Artificial Sequence
  Synthetic oligonucleotide
gtcgactcccgtcttttactatcagcacttctctca

SEQ ID NO: 173186 - DNA, 35 bp, Artificial Sequence
  Synthetic oligonucleotide
atgactcccctcaggcagtccacctccctacttca

SEQ ID NO: 173187 - DNA, 35 bp, Artificial Sequence
  Synthetic oligonucleotide
gtctggaccatctgtgccagcccttttattgttca

SEQ ID NO: 173188 - DNA, 35 bp, Artificial Sequence
  Synthetic oligonucleotide
ttgatgacctctgacgacgtacccctcttctttca

SEQ ID NO: 173189 - DNA, 37 bp, Artificial Sequence
  Synthetic oligonucleotide
ggaaaggcacagataggggtggggaggattgagcaga

SEQ ID NO: 173190 - DNA, 37 bp, Artificial Sequence
  Synthetic oligonucleotide
gaaggggggagcaagagggagcgacaactgggcgaga

SEQ ID NO: 173191 - DNA, 37 bp, Artificial Sequence
  Synthetic oligonucleotide
ttcgcctccacgcccctgctacagccccctgcataga

SEQ ID NO: 173192 - DNA, 35 bp, Artificial Sequence
  Synthetic oligonucleotide
gtccagagggaagggggatagagatagggcgtaga

SEQ ID NO: 173193 - DNA, 36 bp, Artificial Sequence
  Synthetic oligonucleotide
atgtgccttcccagccattgaccctttgcctaccga

SEQ ID NO: 173194 - DNA, 36 bp, Artificial Sequence
  Synthetic oligonucleotide
tacgcgtccaatggaaacacccactgcactccccga

SEQ ID NO: 173195 - DNA, 36 bp, Artificial Sequence
  Synthetic oligonucleotide
tgtctaggatcatcgctttttgctcacacctcccga

SEQ ID NO: 173196 - DNA, 35 bp, Artificial Sequence
  Synthetic oligonucleotide
gccctcaaccgcacatcatcatacgaatacgccga

SEQ ID NO: 173197 - DNA, 37 bp, Artificial Sequence
  Synthetic oligonucleotide
gagcccccccacagccattgcttcctagcctctgcga

SEQ ID NO: 173198 - DNA, 36 bp, Artificial Sequence
  Synthetic oligonucleotide
ggaccacgcccctctgatctgcctccacccacagga

SEQ ID NO: 173199 - DNA, 37 bp, Artificial Sequence
  Synthetic oligonucleotide
ttgacatcctcggcctccgtaaacctgcactaccgga

SEQ ID NO: 173200 - DNA, 35 bp, Artificial Sequence
  Synthetic oligonucleotide
gtcacccgttgttgtcgcctcccctaattcgcgga

SEQ ID NO: 173201 - DNA, 37 bp, Artificial Sequence
  Synthetic oligonucleotide
ataaccgcagcagggggcgggggtgtggggaggcgga

SEQ ID NO: 173202 - DNA, 37 bp, Artificial Sequence
  Synthetic oligonucleotide
tcccagcatcccagctttttctcgcctcctttcggga

SEQ ID NO: 173203 - DNA, 37 bp, Artificial Sequence
  Synthetic oligonucleotide
gcattacaggttaggcagggggaggcgggcgagggga

SEQ ID NO: 173204 - DNA, 37 bp, Artificial Sequence
  Synthetic oligonucleotide
agaatcacgcacacgggaagggagggatgtgggggga

SEQ ID NO: 173205 - DNA, 37 bp, Artificial Sequence
  Synthetic oligonucleotide
gggtggggaaggggggctggcggcggttcggtgggga

SEQ ID NO: 173206 - DNA, 36 bp, Artificial Sequence
  Synthetic oligonucleotide
gcagtgagagggggcaaaaaatggaatctgtgggga

SEQ ID NO: 173207 - DNA, 37 bp, Artificial Sequence
  Synthetic oligonucleotide
acccatcctctgatcctgattgctctctcgtattgga

SEQ ID NO: 173208 - DNA, 37 bp, Artificial Sequence
  Synthetic oligonucleotide
gaatgggcccaagtttgtcgagggagggcgggaatga

SEQ ID NO: 173209 - DNA, 37 bp, Artificial Sequence
  Synthetic oligonucleotide
gcctggggagggtgggactaagccggcacgggcatga

SEQ ID NO: 173210 - DNA, 38 bp, Artificial Sequence
  Synthetic oligonucleotide
tcgcgctgatcgtccagccccgtcctgcttaaccctga

SEQ ID NO: 173211 - DNA, 38 bp, Artificial Sequence
  Synthetic oligonucleotide
agtgggaggtggggtgccggggctgaggttaaccctga

SEQ ID NO: 173212 - DNA, 37 bp, Artificial Sequence
  Synthetic oligonucleotide
atcgcactggtaaggcgaccacctctgttccccctga

SEQ ID NO: 173213 - DNA, 37 bp, Artificial Sequence
  Synthetic oligonucleotide
acgacccgcccccgctctggatcgcccaatatcctga

SEQ ID NO: 173214 - DNA, 38 bp, Artificial Sequence
  Synthetic oligonucleotide
gtccgccacaattggtccgtcctccacgctagccgtga

SEQ ID NO: 173215 - DNA, 38 bp, Artificial Sequence
  Synthetic oligonucleotide
gaggggtaggtggggcaatggtcggttgggggaggtga

SEQ ID NO: 173216 - DNA, 37 bp, Artificial Sequence
  Synthetic oligonucleotide
ggtcgaggtaacacaagaggtgaggggggggcggtga

SEQ ID NO: 173217 - DNA, 38 bp, Artificial Sequence
  Synthetic oligonucleotide
gtggaaaggatagggggggttaattgtggacggggtga

SEQ ID NO: 173218 - DNA, 35 bp, Artificial Sequence
  Synthetic oligonucleotide
gccgtaggcctccctgatatcaccacccttattga

SEQ ID NO: 173219 - DNA, 38 bp, Artificial Sequence
  Synthetic oligonucleotide
tgccgcacgtactaacctgcccgccactcgtcccttga

SEQ ID NO: 173220 - DNA, 38 bp, Artificial Sequence
  Synthetic oligonucleotide
tgcccctctgcctctgcttgcatctgtgcactttttga

SEQ ID NO: 173221 - DNA, 36 bp, Artificial Sequence
  Synthetic oligonucleotide
gtcgagagacgcctcctgccttttcgacacttacta

SEQ ID NO: 173222 - DNA, 35 bp, Artificial Sequence
  Synthetic oligonucleotide
tgcgaactattgctcctgccagcctgtaaccccta

SEQ ID NO: 173223 - DNA, 36 bp, Artificial Sequence
  Synthetic oligonucleotide
tcctcatcccggatcccctcctacgctgaacgccta

SEQ ID NO: 173224 - DNA, 36 bp, Artificial Sequence
  Synthetic oligonucleotide
gtcgtgaaccgcctcaattaataccgtgccatccta

SEQ ID NO: 173225 - DNA, 35 bp, Artificial Sequence
  Synthetic oligonucleotide
gcatcgcaatgccctccgatcacctgcgcctccta

SEQ ID NO: 173226 - DNA, 36 bp, Artificial Sequence
  Synthetic oligonucleotide
accgccactccgaacgcgtattttcggtcccatcta

SEQ ID NO: 173227 - DNA, 36 bp, Artificial Sequence
  Synthetic oligonucleotide
tatccccactgctcctagccactgtttcctcgggta

SEQ ID NO: 173228 - DNA, 35 bp, Artificial Sequence
  Synthetic oligonucleotide
gatcaaggggggtggaagggcataaagcaattgta

SEQ ID NO: 173229 - DNA, 35 bp, Artificial Sequence
  Synthetic oligonucleotide
gcactcgcagaacgaaattgctccaccgtcactta

SEQ ID NO: 173230 - DNA, 36 bp, Artificial Sequence
  Synthetic oligonucleotide
tctgtctccctccgcagccggacactggtctggtta

SEQ ID NO: 173231 - DNA, 35 bp, Artificial Sequence
  Synthetic oligonucleotide
gctgtgcaactgggctaatgtccttcccctgcaac

SEQ ID NO: 173232 - DNA, 35 bp, Artificial Sequence
  Synthetic oligonucleotide
accccactacacttccgttctccgtgagagggaac

SEQ ID NO: 173233 - DNA, 35 bp, Artificial Sequence
  Synthetic oligonucleotide
tgatacaccccgatcgtatgtcaacgatccctaac

SEQ ID NO: 173234 - DNA, 35 bp, Artificial Sequence
  Synthetic oligonucleotide
atgccctccgtcaccccgcgcgaatacgacttaac

SEQ ID NO: 173235 - DNA, 35 bp, Artificial Sequence
  Synthetic oligonucleotide
acatgggttactgcttgagggcgggtgggttacac

SEQ ID NO: 173236 - DNA, 35 bp, Artificial Sequence
  Synthetic oligonucleotide
gacttcctggtgctcttgactcaggcgcctcccac

SEQ ID NO: 173237 - DNA, 36 bp, Artificial Sequence
  Synthetic oligonucleotide
actccttaccgctggtgtaatatctacctgcatcac

SEQ ID NO: 173238 - DNA, 35 bp, Artificial Sequence
  Synthetic oligonucleotide
atgaccctcggcatcacaacgagcccgattttacc

SEQ ID NO: 173239 - DNA, 35 bp, Artificial Sequence
  Synthetic oligonucleotide
ggtcctgtgccagctgcctagcccccgttgtaccc

SEQ ID NO: 173240 - DNA, 35 bp, Artificial Sequence
  Synthetic oligonucleotide
tatcgccaagcagccgtactgccgcaactcacccc

SEQ ID NO: 173241 - DNA, 36 bp, Artificial Sequence
  Synthetic oligonucleotide
gccatgccccctgaggcataccctggtgatcccccc

SEQ ID NO: 173242 - DNA, 35 bp, Artificial Sequence
  Synthetic oligonucleotide
atgtcatcagcccgctccccctgcgcccatgcgcc

SEQ ID NO: 173243 - DNA, 35 bp, Artificial Sequence
  Synthetic oligonucleotide
gttcaacgtagctgcccccgccccaaattaaatcc

SEQ ID NO: 173244 - DNA, 35 bp, Artificial Sequence
  Synthetic oligonucleotide
tccgatagcacgcttgcctgattccgatcgcctcc

SEQ ID NO: 173245 - DNA, 35 bp, Artificial Sequence
  Synthetic oligonucleotide
gtacgtgctcacgcctattacgtgttggttcctcc

SEQ ID NO: 173246 - DNA, 35 bp, Artificial Sequence
  Synthetic oligonucleotide
gtgccactcgggacactctgcttttgggcacttcc

SEQ ID NO: 173247 - DNA, 35 bp, Artificial Sequence
  Synthetic oligonucleotide
tacatgccctgtagcggttcacaggatcgccttcc

SEQ ID NO: 173248 - DNA, 35 bp, Artificial Sequence
  Synthetic oligonucleotide
tgattccctgtccactctgtacctgtcctttttcc

SEQ ID NO: 173249 - DNA, 33 bp, Artificial Sequence
  Synthetic oligonucleotide
tcagacgctctgcgcttgttcatacacccccgc

SEQ ID NO: 173250 - DNA, 36 bp, Artificial Sequence
  Synthetic oligonucleotide
gccatacttacggccgttcccctccgcttcaactgc

SEQ ID NO: 173251 - DNA, 35 bp, Artificial Sequence
  Synthetic oligonucleotide
ttagcagcccaacggtacctcctacgctatcttgc

SEQ ID NO: 173252 - DNA, 35 bp, Artificial Sequence
  Synthetic oligonucleotide
tccgcccgcgaccacagcaccttttagccagcctc

SEQ ID NO: 173253 - DNA, 35 bp, Artificial Sequence
  Synthetic oligonucleotide
acgaaccaccgctcgccatttgcccgtttcgcctc

SEQ ID NO: 173254 - DNA, 35 bp, Artificial Sequence
  Synthetic oligonucleotide
taaggctgggcagttcgcttgccctccgatgcctc

SEQ ID NO: 173255 - DNA, 35 bp, Artificial Sequence
  Synthetic oligonucleotide
attcccgcggttcttcccgcctatatgtctctctc

SEQ ID NO: 173256 - DNA, 35 bp, Artificial Sequence
  Synthetic oligonucleotide
gacctggtttcttcttgcgcactatgagccttctc

SEQ ID NO: 173257 - DNA, 35 bp, Artificial Sequence
  Synthetic oligonucleotide
gagtgcccctttcctgttgcctgcctgagtccttc

SEQ ID NO: 173258 - DNA, 35 bp, Artificial Sequence
  Synthetic oligonucleotide
tgcctgttgctgtaggtttttttgcccggtccttc

SEQ ID NO: 173259 - DNA, 35 bp, Artificial Sequence
  Synthetic oligonucleotide
tctctctggcggtggtgagggtggcggtggataag

SEQ ID NO: 173260 - DNA, 35 bp, Artificial Sequence
  Synthetic oligonucleotide
actacccaccgacaatggctccattccctcttgag

SEQ ID NO: 173261 - DNA, 35 bp, Artificial Sequence
  Synthetic oligonucleotide
tacgcgtgggattgggtggtgtgggccaacggtag

SEQ ID NO: 173262 - DNA, 35 bp, Artificial Sequence
  Synthetic oligonucleotide
tccagcctcatacttcactggagccccaaccaccg

SEQ ID NO: 173263 - DNA, 34 bp, Artificial Sequence
  Synthetic oligonucleotide
agtaacaggggggggtcgaaaaatggacgcggcg

SEQ ID NO: 173264 - DNA, 35 bp, Artificial Sequence
  Synthetic oligonucleotide
gcgaatcgcgcctcccaatctgattcttcctatcg

SEQ ID NO: 173265 - DNA, 35 bp, Artificial Sequence
  Synthetic oligonucleotide
gcctcggtcacatttcttttaacatcatttgctcg

SEQ ID NO: 173266 - DNA, 35 bp, Artificial Sequence
  Synthetic oligonucleotide
accactccgattcctcgcacgcccgacaactgtcg

SEQ ID NO: 173267 - DNA, 35 bp, Artificial Sequence
  Synthetic oligonucleotide
atggtgcaagtgaaggggtggcgtggggttagagg

SEQ ID NO: 173268 - DNA, 35 bp, Artificial Sequence
  Synthetic oligonucleotide
ttggagagtgggtgtgagggttctggcaccactgg

SEQ ID NO: 173269 - DNA, 35 bp, Artificial Sequence
  Synthetic oligonucleotide
gtgccttccctcgctgacctatgcccctgcaactg

SEQ ID NO: 173270 - DNA, 35 bp, Artificial Sequence
  Synthetic oligonucleotide
gcaccctagcgcccacccggaaggcccctttactg

SEQ ID NO: 173271 - DNA, 35 bp, Artificial Sequence
  Synthetic oligonucleotide
agctgtcgttccatcccaccacccttgcaaccgtg

SEQ ID NO: 173272 - DNA, 35 bp, Artificial Sequence
  Synthetic oligonucleotide
tcctgttcctgttcgtattttgcctgtttgccgtg

SEQ ID NO: 173273 - DNA, 35 bp, Artificial Sequence
  Synthetic oligonucleotide
agtgggaggggccagtagtgggattcgggtacgat

SEQ ID NO: 173274 - DNA, 35 bp, Artificial Sequence
  Synthetic oligonucleotide
gctgcgaacggggtgggtgcggttgggtgtacgat

SEQ ID NO: 173275 - DNA, 35 bp, Artificial Sequence
  Synthetic oligonucleotide
atgaggtgggaggaggagtggaatggggggtaact

SEQ ID NO: 173276 - DNA, 35 bp, Artificial Sequence
  Synthetic oligonucleotide
ttctccgcccgcacaactccactcagagtgttact

SEQ ID NO: 173277 - DNA, 35 bp, Artificial Sequence
  Synthetic oligonucleotide
tacatccccatttgccttatcacggaaagttacct

SEQ ID NO: 173278 - DNA, 35 bp, Artificial Sequence
  Synthetic oligonucleotide
gccggggcaagttagttactcgtcctggtccccct

SEQ ID NO: 173279 - DNA, 34 bp, Artificial Sequence
  Synthetic oligonucleotide
gccggcacttggacgccatctttgcccttcccct

SEQ ID NO: 173280 - DNA, 35 bp, Artificial Sequence
  Synthetic oligonucleotide
gcacgctgcgcaatatataccgtcttcgttggcct

SEQ ID NO: 173281 - DNA, 35 bp, Artificial Sequence
  Synthetic oligonucleotide
gtggggaccacctgcacgcattggtctttcttcct

SEQ ID NO: 173282 - DNA, 35 bp, Artificial Sequence
  Synthetic oligonucleotide
gtggcactccgcatgcacgtatcggtcccttcgct

SEQ ID NO: 173283 - DNA, 35 bp, Artificial Sequence
  Synthetic oligonucleotide
tatacgcctcccgtcccacctattgaatagcggct

SEQ ID NO: 173284 - DNA, 35 bp, Artificial Sequence
  Synthetic oligonucleotide
gaaggccttaccgcgtcctaccctgttccctctgt

SEQ ID NO: 173285 - DNA, 35 bp, Artificial Sequence
  Synthetic oligonucleotide
tgcaatcctcaccactgagtcatcgttgcctcctt

SEQ ID NO: 173286 - DNA, 35 bp, Artificial Sequence
  Synthetic oligonucleotide
gttgcccggccatttaacatcggttctgttctctt

SEQ ID NO: 173287 - DNA, 35 bp, Artificial Sequence
  Synthetic oligonucleotide
gtcgccccaatacgttgcgctggccccagtttttt

SEQ ID NO: 173288 - DNA, 36 bp, Artificial Sequence
  Synthetic oligonucleotide
ttgagaggtggcgtgttggcacaaagggggagggaa

SEQ ID NO: 173289 - DNA, 36 bp, Artificial Sequence
  Synthetic oligonucleotide
tgttccgcccgccacccgttcttatctcgcggataa

SEQ ID NO: 173290 - DNA, 35 bp, Artificial Sequence
  Synthetic oligonucleotide
accatcggcgatcgctgccttcacctcccatataa

SEQ ID NO: 173291 - DNA, 36 bp, Artificial Sequence
  Synthetic oligonucleotide
ttattgccccgtgcccgtctcgatagccctccctaa

SEQ ID NO: 173292 - DNA, 36 bp, Artificial Sequence
  Synthetic oligonucleotide
gacacccttgccattcatggtgtatgtcgctcccca

SEQ ID NO: 173293 - DNA, 34 bp, Artificial Sequence
  Synthetic oligonucleotide
tgccccgggtccttcacgcgttattctcagccca

SEQ ID NO: 173294 - DNA, 35 bp, Artificial Sequence
  Synthetic oligonucleotide
ggacaagcgcgcctccgttagctccaccatcgcca

SEQ ID NO: 173295 - DNA, 36 bp, Artificial Sequence
  Synthetic oligonucleotide
gccaccgccggtgaaacgataccaccctctcctcca

SEQ ID NO: 173296 - DNA, 36 bp, Artificial Sequence
  Synthetic oligonucleotide
gccacattcaagccaccctggaggccatccgctcca

SEQ ID NO: 173297 - DNA, 36 bp, Artificial Sequence
  Synthetic oligonucleotide
actgtgcgcgccgagcaaaccccacttctttcctca

SEQ ID NO: 173298 - DNA, 36 bp, Artificial Sequence
  Synthetic oligonucleotide
gatcgacgcccactgttctccgaatttcccctctca

SEQ ID NO: 173299 - DNA, 36 bp, Artificial Sequence
  Synthetic oligonucleotide
ttcgcccttccgctcattcgttatgctctcgtttca

SEQ ID NO: 173300 - DNA, 36 bp, Artificial Sequence
  Synthetic oligonucleotide
aacaaggtgcgggaagacgggaggggataagccaga

SEQ ID NO: 173301 - DNA, 37 bp, Artificial Sequence
  Synthetic oligonucleotide
aacgaggtggggaaagggatgggatggagacactaga

SEQ ID NO: 173302 - DNA, 37 bp, Artificial Sequence
  Synthetic oligonucleotide
aacacgaccacactctgcgtaagtctccttcccacga

SEQ ID NO: 173303 - DNA, 35 bp, Artificial Sequence
  Synthetic oligonucleotide
actacgccctcaccccgagacctgctaacctacga

SEQ ID NO: 173304 - DNA, 37 bp, Artificial Sequence
  Synthetic oligonucleotide
gtaacacagcagcctttgcaccacctcgtattcccga

SEQ ID NO: 173305 - DNA, 37 bp, Artificial Sequence
  Synthetic oligonucleotide
gttacaccttcacccgctcagtcctcactttgtgcga

SEQ ID NO: 173306 - DNA, 35 bp, Artificial Sequence
  Synthetic oligonucleotide
atcacacctcctgcccgctcccgagagctttgcga

SEQ ID NO: 173307 - DNA, 37 bp, Artificial Sequence
  Synthetic oligonucleotide
agtccggccccctagcctatctccacctgttgctcga

SEQ ID NO: 173308 - DNA, 37 bp, Artificial Sequence
  Synthetic oligonucleotide
agcacgagggtctagggagggagcaggtggggcagga

SEQ ID NO: 173309 - DNA, 37 bp, Artificial Sequence
  Synthetic oligonucleotide
gcgctgcctgccttccacatggccatccccccgcgga

SEQ ID NO: 173310 - DNA, 37 bp, Artificial Sequence
  Synthetic oligonucleotide
gatgccgccgccgggaagacacaagggagggcgcgga

SEQ ID NO: 173311 - DNA, 36 bp, Artificial Sequence
  Synthetic oligonucleotide
ttacgtggggcggaaggggggaggattcggttcgga

SEQ ID NO: 173312 - DNA, 37 bp, Artificial Sequence
  Synthetic oligonucleotide
gtggtgggagtgaaggggcacgcaggcaaatcgggga

SEQ ID NO: 173313 - DNA, 37 bp, Artificial Sequence
  Synthetic oligonucleotide
gagcaccccccccgcacgtaacgaaagtcctactgga

SEQ ID NO: 173314 - DNA, 37 bp, Artificial Sequence
  Synthetic oligonucleotide
acccggtccctgatgcctgtgtgcccccccctgtgga

SEQ ID NO: 173315 - DNA, 37 bp, Artificial Sequence
  Synthetic oligonucleotide
acactgagcctctataagccccctcgtacctccatga

SEQ ID NO: 173316 - DNA, 37 bp, Artificial Sequence
  Synthetic oligonucleotide
tgacacgtggggtgggggagcgaggaggccggactga

SEQ ID NO: 173317 - DNA, 38 bp, Artificial Sequence
  Synthetic oligonucleotide
gacactcgcgccactgtttcacgaatatacctccctga

SEQ ID NO: 173318 - DNA, 38 bp, Artificial Sequence
  Synthetic oligonucleotide
ggaccgactcaaatcctctcatactggcgcctccctga

SEQ ID NO: 173319 - DNA, 38 bp, Artificial Sequence
  Synthetic oligonucleotide
gacgcgttcctccgtttttgtcccccgtttgtgcctga

SEQ ID NO: 173320 - DNA, 37 bp, Artificial Sequence
  Synthetic oligonucleotide
ttgtgtcaccctcatcttttcatgctcgtccccgtga

SEQ ID NO: 173321 - DNA, 37 bp, Artificial Sequence
  Synthetic oligonucleotide
gcccccgaccaccacgcagcatacacgtttcccgtga

SEQ ID NO: 173322 - DNA, 36 bp, Artificial Sequence
  Synthetic oligonucleotide
acccacctctcttcatgcgtagtttaccgaaggtga

SEQ ID NO: 173323 - DNA, 37 bp, Artificial Sequence
  Synthetic oligonucleotide
aaatcagggacggggaggggacgcattgcaggggtga

SEQ ID NO: 173324 - DNA, 37 bp, Artificial Sequence
  Synthetic oligonucleotide
gtcgccgatcatgcctcaccgttacccaccttggtga

SEQ ID NO: 173325 - DNA, 38 bp, Artificial Sequence
  Synthetic oligonucleotide
agcggagaggggggacgggctgaccaagtagactgtga

SEQ ID NO: 173326 - DNA, 37 bp, Artificial Sequence
  Synthetic oligonucleotide
gcctaccgctgtggtttttcctggtcccgccacttga

SEQ ID NO: 173327 - DNA, 38 bp, Artificial Sequence
  Synthetic oligonucleotide
tcagaatagggctggaagggagggggggcgtgacttga

SEQ ID NO: 173328 - DNA, 38 bp, Artificial Sequence
  Synthetic oligonucleotide
gacatcgatcaagggggtggggggcgcatgtgggttga

SEQ ID NO: 173329 - DNA, 35 bp, Artificial Sequence
  Synthetic oligonucleotide
acttgtccccccgtgcgccactattccttctccta

SEQ ID NO: 173330 - DNA, 36 bp, Artificial Sequence
  Synthetic oligonucleotide
gaccagcccgtcgtactcttgccctgttctccgcta

SEQ ID NO: 173331 - DNA, 36 bp, Artificial Sequence
  Synthetic oligonucleotide
gcccaacatgccacctcactgttcaatgactcgcta

SEQ ID NO: 173332 - DNA, 35 bp, Artificial Sequence
  Synthetic oligonucleotide
aacgactcccgtgacctgcatacaatctccctcta

SEQ ID NO: 173333 - DNA, 35 bp, Artificial Sequence
  Synthetic oligonucleotide
taatgctcgccctgttcgcctctcttcccgctcta

SEQ ID NO: 173334 - DNA, 35 bp, Artificial Sequence
  Synthetic oligonucleotide
atgcactgcatcgtgattcgcccgtacgccgctta

SEQ ID NO: 173335 - DNA, 36 bp, Artificial Sequence
  Synthetic oligonucleotide
tccgccgatcacccatccctctatccaaccgtttta

SEQ ID NO: 173336 - DNA, 35 bp, Artificial Sequence
  Synthetic oligonucleotide
accttagcgggagggggggcgttgatataagcaac

SEQ ID NO: 173337 - DNA, 35 bp, Artificial Sequence
  Synthetic oligonucleotide
gcgcaccccgcgcatgcctcccaggtctttagaac

SEQ ID NO: 173338 - DNA, 35 bp, Artificial Sequence
  Synthetic oligonucleotide
tcccgagggactcatgtgctccatccgtcactaac

SEQ ID NO: 173339 - DNA, 35 bp, Artificial Sequence
  Synthetic oligonucleotide
gcgcgattccgagtgcccatcctcgctctttacac

SEQ ID NO: 173340 - DNA, 35 bp, Artificial Sequence
  Synthetic oligonucleotide
tgctccgccaatctgtccttgcagcaactccccac

SEQ ID NO: 173341 - DNA, 35 bp, Artificial Sequence
  Synthetic oligonucleotide
tgtcgccccccgcctcattggttgaccgcaggcac

SEQ ID NO: 173342 - DNA, 35 bp, Artificial Sequence
  Synthetic oligonucleotide
tgagcacacgctgtgaaccttccaccgtactttac

SEQ ID NO: 173343 - DNA, 35 bp, Artificial Sequence
  Synthetic oligonucleotide
ttccgtgcccaactccgaagtcccttacttacacc

SEQ ID NO: 173344 - DNA, 35 bp, Artificial Sequence
  Synthetic oligonucleotide
tgacccatatgatctatccttagcacggtgccacc

SEQ ID NO: 173345 - DNA, 35 bp, Artificial Sequence
  Synthetic oligonucleotide
gtagatgtcggtgccttctcattgtgccgtttacc

SEQ ID NO: 173346 - DNA, 35 bp, Artificial Sequence
  Synthetic oligonucleotide
acatccggatatgcgcccggcttttgtacaacccc

SEQ ID NO: 173347 - DNA, 35 bp, Artificial Sequence
  Synthetic oligonucleotide
aagtgccctgcgcctgctgcctcaacttacgcccc

SEQ ID NO: 173348 - DNA, 35 bp, Artificial Sequence
  Synthetic oligonucleotide
atcgcatcccgcccgaccgttctccggccatcccc

SEQ ID NO: 173349 - DNA, 35 bp, Artificial Sequence
  Synthetic oligonucleotide
acatgctgagtgcacactcgcgataatctcatccc

SEQ ID NO: 173350 - DNA, 35 bp, Artificial Sequence
  Synthetic oligonucleotide
tcagatcccgatccgatattatggccggctctccc

SEQ ID NO: 173351 - DNA, 35 bp, Artificial Sequence
  Synthetic oligonucleotide
gcaaacccgcgatgcccccttcctaaaccggtgcc

SEQ ID NO: 173352 - DNA, 35 bp, Artificial Sequence
  Synthetic oligonucleotide
tccgccccaactgttttactggtcaccatccatcc

SEQ ID NO: 173353 - DNA, 35 bp, Artificial Sequence
  Synthetic oligonucleotide
tacgaccgttcccccgcctattaattaggtactcc

SEQ ID NO: 173354 - DNA, 35 bp, Artificial Sequence
  Synthetic oligonucleotide
gtcccgttaagcactcccccaggactgtctcctcc

SEQ ID NO: 173355 - DNA, 35 bp, Artificial Sequence
  Synthetic oligonucleotide
acacactagcctccgctctggtccccagacagtcc

SEQ ID NO: 173356 - DNA, 35 bp, Artificial Sequence
  Synthetic oligonucleotide
gtacaccacccccaattcgtgcttaacgatagtcc

SEQ ID NO: 173357 - DNA, 35 bp, Artificial Sequence
  Synthetic oligonucleotide
cccacacatccccgacgctcccgcttaggccacgc

SEQ ID NO: 173358 - DNA, 35 bp, Artificial Sequence
  Synthetic oligonucleotide
acatcactcgcccctggtttcagcattgccgccgc

SEQ ID NO: 173359 - DNA, 35 bp, Artificial Sequence
  Synthetic oligonucleotide
gtagtacgcagattcctgccgccgtgtcgtttcgc

SEQ ID NO: 173360 - DNA, 35 bp, Artificial Sequence
  Synthetic oligonucleotide
tctaccccctccagctgtgtttcacaattgtcggc

SEQ ID NO: 173361 - DNA, 36 bp, Artificial Sequence
  Synthetic oligonucleotide
ttacctgcactgcgccctttcgtcattaccctatgc

SEQ ID NO: 173362 - DNA, 35 bp, Artificial Sequence
  Synthetic oligonucleotide
gtacacgaaggggggggagtaggactggcgcgtgc

SEQ ID NO: 173363 - DNA, 35 bp, Artificial Sequence
  Synthetic oligonucleotide
tccgtgacgcttatgtatttcgctccctcgcttgc

SEQ ID NO: 173364 - DNA, 35 bp, Artificial Sequence
  Synthetic oligonucleotide
cccagacccgttgccgtaccctctactgtactatc

SEQ ID NO: 173365 - DNA, 35 bp, Artificial Sequence
  Synthetic oligonucleotide
tagaccatgtgtacgctgaccgtaccgcttccctc

SEQ ID NO: 173366 - DNA, 35 bp, Artificial Sequence
  Synthetic oligonucleotide
tgagccaacaaccgcccgactgtgcctcctatctc

SEQ ID NO: 173367 - DNA, 35 bp, Artificial Sequence
  Synthetic oligonucleotide
atgtagcaactgccaccccatgtagggtccctctc

SEQ ID NO: 173368 - DNA, 35 bp, Artificial Sequence
  Synthetic oligonucleotide
tcaagcttgcctcctacgatatagcggtgcctctc

SEQ ID NO: 173369 - DNA, 35 bp, Artificial Sequence
  Synthetic oligonucleotide
tcacgtgcctccgattcatttactctctacgtctc

SEQ ID NO: 173370 - DNA, 35 bp, Artificial Sequence
  Synthetic oligonucleotide
atcaaacccctggtgaattatccatccctccggtc

SEQ ID NO: 173371 - DNA, 35 bp, Artificial Sequence
  Synthetic oligonucleotide
ttatcagctcagcatcggcgcgcccctaccttttc

SEQ ID NO: 173372 - DNA, 35 bp, Artificial Sequence
  Synthetic oligonucleotide
gaatcgacgcgcggttcgatctcatgcccgttttc

SEQ ID NO: 173373 - DNA, 35 bp, Artificial Sequence
  Synthetic oligonucleotide
tcccgccacagcggagtgccccacccgttcaaacg

SEQ ID NO: 173374 - DNA, 35 bp, Artificial Sequence
  Synthetic oligonucleotide
ttgttacgtccctctcttttctcgtccaccccacg

SEQ ID NO: 173375 - DNA, 35 bp, Artificial Sequence
  Synthetic oligonucleotide
tcgtacgagtcccgcgtacccccgcccgcgcaccg

SEQ ID NO: 173376 - DNA, 35 bp, Artificial Sequence
  Synthetic oligonucleotide
ggaagcagatcagtcaggtcccgccgtttctcccg

SEQ ID NO: 173377 - DNA, 35 bp, Artificial Sequence
  Synthetic oligonucleotide
tgtacggacacttcgcgcttcatttccttttcccg

SEQ ID NO: 173378 - DNA, 36 bp, Artificial Sequence
  Synthetic oligonucleotide
tccgccgccctaaaactacatcccaacgtcccggcg

SEQ ID NO: 173379 - DNA, 35 bp, Artificial Sequence
  Synthetic oligonucleotide
ggaatcccccctgtttcaccatccgccgggtacgg

SEQ ID NO: 173380 - DNA, 35 bp, Artificial Sequence
  Synthetic oligonucleotide
gcacgcctcctacattcgtttggcactgggccctg

SEQ ID NO: 173381 - DNA, 35 bp, Artificial Sequence
  Synthetic oligonucleotide
gttgccacctcaaaacgggcggagatgtcctcctg

SEQ ID NO: 173382 - DNA, 35 bp, Artificial Sequence
  Synthetic oligonucleotide
gcctcgcctcccgcccagtactgtggtacgtcctg

SEQ ID NO: 173383 - DNA, 35 bp, Artificial Sequence
  Synthetic oligonucleotide
gcctcctccacccttgagcacccatttataaagtg

SEQ ID NO: 173384 - DNA, 35 bp, Artificial Sequence
  Synthetic oligonucleotide
acatctcgctccaccaatcgcactcggtctgacat

SEQ ID NO: 173385 - DNA, 35 bp, Artificial Sequence
  Synthetic oligonucleotide
ttgtaccccgccacgctaatgcatatctctcccat

SEQ ID NO: 173386 - DNA, 35 bp, Artificial Sequence
  Synthetic oligonucleotide
gacgcagcaatcggggagaacgggcggaggagcat

SEQ ID NO: 173387 - DNA, 35 bp, Artificial Sequence
  Synthetic oligonucleotide
atcgccctcctgttcccgcgtaaatgtactctcat

SEQ ID NO: 173388 - DNA, 35 bp, Artificial Sequence
  Synthetic oligonucleotide
actttaccgccaccagttaacagccgaccgcttat

SEQ ID NO: 173389 - DNA, 34 bp, Artificial Sequence
  Synthetic oligonucleotide
tgcgagtgactccgtttgcatctttcctgtttat

SEQ ID NO: 173390 - DNA, 35 bp, Artificial Sequence
  Synthetic oligonucleotide
gtccgaaggtcccgttgtaccatctccatatcact

SEQ ID NO: 173391 - DNA, 35 bp, Artificial Sequence
  Synthetic oligonucleotide
gatcgccacccttcctgtccggattgcatccccct

SEQ ID NO: 173392 - DNA, 35 bp, Artificial Sequence
  Synthetic oligonucleotide
gaatcagccgctgccgctttaggttcgctttcgct

SEQ ID NO: 173393 - DNA, 35 bp, Artificial Sequence
  Synthetic oligonucleotide
tcaccacttgctgttctccggataccgtcccttct

SEQ ID NO: 173394 - DNA, 35 bp, Artificial Sequence
  Synthetic oligonucleotide
gtggccggacctcacgtctgttctcgctttcccgt

SEQ ID NO: 173395 - DNA, 35 bp, Artificial Sequence
  Synthetic oligonucleotide
acgtccgccgcctcgaaaatgcactgctacctcgt

SEQ ID NO: 173396 - DNA, 35 bp, Artificial Sequence
  Synthetic oligonucleotide
gaacaggtctcggatgtcctggtgctgccttcctt

SEQ ID NO: 173397 - DNA, 35 bp, Artificial Sequence
  Synthetic oligonucleotide
gccccccccttggtacctgaagcaggccttttgtt

SEQ ID NO: 173398 - DNA, 35 bp, Artificial Sequence
  Synthetic oligonucleotide
ttccgccctcaaccctcgttttgccgtttccgttt

SEQ ID NO: 173399 - DNA, 34 bp, Artificial Sequence
  Synthetic oligonucleotide
cacgctccttggaccttttacgtactcccggttt

SEQ ID NO: 173400 - DNA, 36 bp, Artificial Sequence
  Synthetic oligonucleotide
gtgaattgagcaaaaggaaggagaaggtggagagaa

SEQ ID NO: 173401 - DNA, 35 bp, Artificial Sequence
  Synthetic oligonucleotide
accatcaccgtcccttgcactttcgcccggtctaa

SEQ ID NO: 173402 - DNA, 35 bp, Artificial Sequence
  Synthetic oligonucleotide
actctcgttccagttcctcgcattagctgcccaca

SEQ ID NO: 173403 - DNA, 35 bp, Artificial Sequence
  Synthetic oligonucleotide
gccatcctgagcgccagtcatccatcgggccccca

SEQ ID NO: 173404 - DNA, 35 bp, Artificial Sequence
  Synthetic oligonucleotide
gagccgtcgatcatgctcgctcacctgtcctccca

SEQ ID NO: 173405 - DNA, 35 bp, Artificial Sequence
  Synthetic oligonucleotide
gcccacgttcccgatgttctcttctccgttgtcca

SEQ ID NO: 173406 - DNA, 35 bp, Artificial Sequence
  Synthetic oligonucleotide
atcgtcctccgcctgtacgcctgtcctgctttgca

SEQ ID NO: 173407 - DNA, 35 bp, Artificial Sequence
  Synthetic oligonucleotide
tataccccgcgctgatatcccttgccatccgatca

SEQ ID NO: 173408 - DNA, 36 bp, Artificial Sequence
  Synthetic oligonucleotide
agacgccccggcaccccctctcatggctacgactca

SEQ ID NO: 173409 - DNA, 35 bp, Artificial Sequence
  Synthetic oligonucleotide
accctgcccagctgccctctatcctgccgtcctca

SEQ ID NO: 173410 - DNA, 36 bp, Artificial Sequence
  Synthetic oligonucleotide
acaccatcacgtacgtagtatctcacctcatattca

SEQ ID NO: 173411 - DNA, 34 bp, Artificial Sequence
  Synthetic oligonucleotide
ttcgccgccccattgcttgttccatccgtcttca

SEQ ID NO: 173412 - DNA, 37 bp, Artificial Sequence
  Synthetic oligonucleotide
ggaggggtgggggaaaggggtgcaggatcatgtaaga

SEQ ID NO: 173413 - DNA, 37 bp, Artificial Sequence
  Synthetic oligonucleotide
gcacccagctgcctatccgccgaaccctctatacaga

SEQ ID NO: 173414 - DNA, 37 bp, Artificial Sequence
  Synthetic oligonucleotide
taaaggggaggggaggcgaaagggaacgggctcgaga

SEQ ID NO: 173415 - DNA, 37 bp, Artificial Sequence
  Synthetic oligonucleotide
gcgcccactgtccgctctttttctggccctctgtaga

SEQ ID NO: 173416 - DNA, 37 bp, Artificial Sequence
  Synthetic oligonucleotide
tatgggagggtgggagcgcacgggaggagtggttaga

SEQ ID NO: 173417 - DNA, 37 bp, Artificial Sequence
  Synthetic oligonucleotide
accgcccgtgcgatggtcttccctgcgatacttccga

SEQ ID NO: 173418 - DNA, 37 bp, Artificial Sequence
  Synthetic oligonucleotide
gtcctctatccggtgcgtattcatcctggcttctcga

SEQ ID NO: 173419 - DNA, 37 bp, Artificial Sequence
  Synthetic oligonucleotide
ttcgcacgcggccaatcagcacgcacctcaccttcga

SEQ ID NO: 173420 - DNA, 37 bp, Artificial Sequence
  Synthetic oligonucleotide
atcagccttcgcccggtcctggccacttcaccttcga

SEQ ID NO: 173421 - DNA, 37 bp, Artificial Sequence
  Synthetic oligonucleotide
gactatcataactccgccgccacagtcaagccttcga

SEQ ID NO: 173422 - DNA, 37 bp, Artificial Sequence
  Synthetic oligonucleotide
gagacaggcggaagggtcacgggagggggagcaggga

SEQ ID NO: 173423 - DNA, 36 bp, Artificial Sequence
  Synthetic oligonucleotide
ggggtgggcgcatgacataatatagtgaaagaggga

SEQ ID NO: 173424 - DNA, 37 bp, Artificial Sequence
  Synthetic oligonucleotide
agtacgggaaggatggcatcacggcatcggggaggga

SEQ ID NO: 173425 - DNA, 37 bp, Artificial Sequence
  Synthetic oligonucleotide
gctcagccccatgcccacccttcagtcacctccggga

SEQ ID NO: 173426 - DNA, 37 bp, Artificial Sequence
  Synthetic oligonucleotide
gtcgcaagtgggtgggaggggttcggtaagtcgggga

SEQ ID NO: 173427 - DNA, 37 bp, Artificial Sequence
  Synthetic oligonucleotide
ttggaggggaatataaagggcgataggagcaggggga

SEQ ID NO: 173428 - DNA, 37 bp, Artificial Sequence
  Synthetic oligonucleotide
atgaccccgccccaatagacgcccccccttctgggga

SEQ ID NO: 173429 - DNA, 37 bp, Artificial Sequence
  Synthetic oligonucleotide
actaagcaggagaggggatggaaagtaggatgtggga

SEQ ID NO: 173430 - DNA, 37 bp, Artificial Sequence
  Synthetic oligonucleotide
gtccacgtgggggtcgtggggggagtggatccgtgga

SEQ ID NO: 173431 - DNA, 37 bp, Artificial Sequence
  Synthetic oligonucleotide
acgcatgtacggggaatagggtggagcaaggtgtgga

SEQ ID NO: 173432 - DNA, 36 bp, Artificial Sequence
  Synthetic oligonucleotide
gcaccctcctgtctcgtcgtcgatctcctacttgga

SEQ ID NO: 173433 - DNA, 38 bp, Artificial Sequence
  Synthetic oligonucleotide
ttctgccccccggccactgatatgatcaccccacatga

SEQ ID NO: 173434 - DNA, 38 bp, Artificial Sequence
  Synthetic oligonucleotide
accgccgtgtctgcgccgcatgtcccccgttcccatga

SEQ ID NO: 173435 - DNA, 38 bp, Artificial Sequence
  Synthetic oligonucleotide
gtcaatcgcgggacgggaggggtaggggatctcgatga

SEQ ID NO: 173436 - DNA, 38 bp, Artificial Sequence
  Synthetic oligonucleotide
gaacggggggacatggggaagcaaaaggggagcactga

SEQ ID NO: 173437 - DNA, 38 bp, Artificial Sequence
  Synthetic oligonucleotide
tactcacgcccctccatgtcatgctcacatctccctga

SEQ ID NO: 173438 - DNA, 38 bp, Artificial Sequence
  Synthetic oligonucleotide
tcacgcccatacgctattttgtctaacaccttgcctga

SEQ ID NO: 173439 - DNA, 38 bp, Artificial Sequence
  Synthetic oligonucleotide
gccggcccctgttatgtaatcctcctgtatcctgctga

SEQ ID NO: 173440 - DNA, 37 bp, Artificial Sequence
  Synthetic oligonucleotide
gaagacagtgggggggagtataaggctgggatcgtga

SEQ ID NO: 173441 - DNA, 38 bp, Artificial Sequence
  Synthetic oligonucleotide
aacaacccgcccttctgtcctatacatgtccaaggtga

SEQ ID NO: 173442 - DNA, 37 bp, Artificial Sequence
  Synthetic oligonucleotide
atacacgtcactctcttcgcgctctcttgtccggtga

SEQ ID NO: 173443 - DNA, 38 bp, Artificial Sequence
  Synthetic oligonucleotide
gatggaagttcaacggggggaaagggaggtgggtgtga

SEQ ID NO: 173444 - DNA, 38 bp, Artificial Sequence
  Synthetic oligonucleotide
gcctgccccgcatcacaatttgctacatctacaattga

SEQ ID NO: 173445 - DNA, 37 bp, Artificial Sequence
  Synthetic oligonucleotide
gacttcaccgctccatcgctgggttaaccctctttga

SEQ ID NO: 173446 - DNA, 38 bp, Artificial Sequence
  Synthetic oligonucleotide
agacgcctgctctgtatctgccctctcgcctcttttga

SEQ ID NO: 173447 - DNA, 36 bp, Artificial Sequence
  Synthetic oligonucleotide
gacatggagtaggagggaaaaaaagcgggcacgata

SEQ ID NO: 173448 - DNA, 35 bp, Artificial Sequence
  Synthetic oligonucleotide
ttcgcatcagctcgttggttctatcgttccttata

SEQ ID NO: 173449 - DNA, 36 bp, Artificial Sequence
  Synthetic oligonucleotide
acatcctgcgccgggccctcctagctcctctgccta

SEQ ID NO: 173450 - DNA, 36 bp, Artificial Sequence
  Synthetic oligonucleotide
acgccgactcgcgcctgtagccccctcgttgttcta

SEQ ID NO: 173451 - DNA, 35 bp, Artificial Sequence
  Synthetic oligonucleotide
atgacccacctcgattcttgctgccactatacgta

SEQ ID NO: 173452 - DNA, 35 bp, Artificial Sequence
  Synthetic oligonucleotide
gcacctgtctctcgtctcgaccattagccctcgta

SEQ ID NO: 173453 - DNA, 36 bp, Artificial Sequence
  Synthetic oligonucleotide
gatccgcgccccctatatccctttgacgacgcggta

SEQ ID NO: 173454 - DNA, 35 bp, Artificial Sequence
  Synthetic oligonucleotide
tccaaggtgcatctacgccttcattgtcctgctta

SEQ ID NO: 173455 - DNA, 36 bp, Artificial Sequence
  Synthetic oligonucleotide
acccgcccattgctcaaatgattttggctcccttta

SEQ ID NO: 173456 - DNA, 36 bp, Artificial Sequence
  Synthetic oligonucleotide
atcctcccggccagccttaaatagctcccccgttta

SEQ ID NO: 173457 - DNA, 35 bp, Artificial Sequence
  Synthetic oligonucleotide
tcacatccccattgagtcccagtcatttgcaccac

SEQ ID NO: 173458 - DNA, 35 bp, Artificial Sequence
  Synthetic oligonucleotide
tcagccgcaaggctgcttttgactcgctctcccac

SEQ ID NO: 173459 - DNA, 35 bp, Artificial Sequence
  Synthetic oligonucleotide
ttggggggctggcgggtagcacgagttggggccac

SEQ ID NO: 173460 - DNA, 35 bp, Artificial Sequence
  Synthetic oligonucleotide
taaatcgccttcccccagcccgtcccctgtcgcac

SEQ ID NO: 173461 - DNA, 36 bp, Artificial Sequence
  Synthetic oligonucleotide
gatttgtcgtccgggctgtgtcgctcctcctcctac

SEQ ID NO: 173462 - DNA, 35 bp, Artificial Sequence
  Synthetic oligonucleotide
tgcacatgccagtgtaattcacgcccaccgtctac

SEQ ID NO: 173463 - DNA, 35 bp, Artificial Sequence
  Synthetic oligonucleotide
gaccggccctcctaacggtgctgctcttcttctac

SEQ ID NO: 173464 - DNA, 35 bp, Artificial Sequence
  Synthetic oligonucleotide
gtcctcagtcagaggttcatcccgctcccgtttac

SEQ ID NO: 173465 - DNA, 35 bp, Artificial Sequence
  Synthetic oligonucleotide
tctcgatacgcctcctcttaaaagactgctccacc

SEQ ID NO: 173466 - DNA, 35 bp, Artificial Sequence
  Synthetic oligonucleotide
acccttcacccgtcctgcctcgcggttcctgtacc

SEQ ID NO: 173467 - DNA, 35 bp, Artificial Sequence
  Synthetic oligonucleotide
gcccacttcgcctcagccgtcttagtcattttacc

SEQ ID NO: 173468 - DNA, 35 bp, Artificial Sequence
  Synthetic oligonucleotide
gccgtgcctccttctcgttctcggtcttgttaccc

SEQ ID NO: 173469 - DNA, 35 bp, Artificial Sequence
  Synthetic oligonucleotide
tacaatgttcagcccgaccttacgtgacgcccccc

SEQ ID NO: 173470 - DNA, 35 bp, Artificial Sequence
  Synthetic oligonucleotide
tatggagtcccttaatgttctgtgcctcgcccccc

SEQ ID NO: 173471 - DNA, 35 bp, Artificial Sequence
  Synthetic oligonucleotide
agacaaccagttctgcctctcggtgatccgccccc

SEQ ID NO: 173472 - DNA, 35 bp, Artificial Sequence
  Synthetic oligonucleotide
tgcaccatggcatttcgtcccaaggtacatccccc

SEQ ID NO: 173473 - DNA, 35 bp, Artificial Sequence
  Synthetic oligonucleotide
acgcctaggcggataatcgccagtcctcgttcccc

SEQ ID NO: 173474 - DNA, 35 bp, Artificial Sequence
  Synthetic oligonucleotide
acgcccgcaatatggtctactcctgtcatttcccc

SEQ ID NO: 173475 - DNA, 34 bp, Artificial Sequence
  Synthetic oligonucleotide
aatgcgcactgttacatgcctatttcgcctgccc

SEQ ID NO: 173476 - DNA, 35 bp, Artificial Sequence
  Synthetic oligonucleotide
tccgcaacccctgcgtttcgctcttggcctgtccc

SEQ ID NO: 173477 - DNA, 35 bp, Artificial Sequence
  Synthetic oligonucleotide
atctcaggcgcacgtaattgcaatccttcctggcc

SEQ ID NO: 173478 - DNA, 35 bp, Artificial Sequence
  Synthetic oligonucleotide
gatccccgccctccagtacatacttggcccatgcc

SEQ ID NO: 173479 - DNA, 35 bp, Artificial Sequence
  Synthetic oligonucleotide
atcctaacgggaacgccagccgcctccctccctcc

SEQ ID NO: 173480 - DNA, 35 bp, Artificial Sequence
  Synthetic oligonucleotide
attaacattgcccgctgtgcctcgtttgtacttcc

SEQ ID NO: 173481 - DNA, 35 bp, Artificial Sequence
  Synthetic oligonucleotide
tttcgcccgccctcggctgcttttacccggatcgc

SEQ ID NO: 173482 - DNA, 35 bp, Artificial Sequence
  Synthetic oligonucleotide
agttacagccactcccgcgcaccctatcgtatcgc

SEQ ID NO: 173483 - DNA, 35 bp, Artificial Sequence
  Synthetic oligonucleotide
gtcgatcactagggcatgtcccccgccatcctatc

SEQ ID NO: 173484 - DNA, 35 bp, Artificial Sequence
  Synthetic oligonucleotide
ccatcgccgccaatactccccagctcacggttatc

SEQ ID NO: 173485 - DNA, 35 bp, Artificial Sequence
  Synthetic oligonucleotide
tcccccgtgttaccagaaggcttcaatgccccctc

SEQ ID NO: 173486 - DNA, 35 bp, Artificial Sequence
  Synthetic oligonucleotide
tctgggtcctacctcccgagacctgctattccctc

SEQ ID NO: 173487 - DNA, 35 bp, Artificial Sequence
  Synthetic oligonucleotide
accgcataggtcgaggacgttcatcccgtttgctc

SEQ ID NO: 173488 - DNA, 35 bp, Artificial Sequence
  Synthetic oligonucleotide
aacgcggccgccagattcgtcctatcctctcagtc

SEQ ID NO: 173489 - DNA, 34 bp, Artificial Sequence
  Synthetic oligonucleotide
gcgtgaggtccgccccctaatattcgcgcatgtc

SEQ ID NO: 173490 - DNA, 35 bp, Artificial Sequence
  Synthetic oligonucleotide
ggagccaagtcctgacatctcatcgcgcctctgtc

SEQ ID NO: 173491 - DNA, 35 bp, Artificial Sequence
  Synthetic oligonucleotide
tggatcgctattgctgtcgaccaccttggcccttc

SEQ ID NO: 173492 - DNA, 35 bp, Artificial Sequence
  Synthetic oligonucleotide
atgtacgcacattttaactccattgctattagttc

SEQ ID NO: 173493 - DNA, 35 bp, Artificial Sequence
  Synthetic oligonucleotide
gcctcctgttcgctcctagattatcacgccggttc

SEQ ID NO: 173494 - DNA, 35 bp, Artificial Sequence
  Synthetic oligonucleotide
gtggcacgcacttggctcccttaactcggctgttc

SEQ ID NO: 173495 - DNA, 35 bp, Artificial Sequence
  Synthetic oligonucleotide
actcccccccgaacacgctgtataaactatctcag

SEQ ID NO: 173496 - DNA, 35 bp, Artificial Sequence
  Synthetic oligonucleotide
tcccccgcttcattccgtacatatcttgccgtgag

SEQ ID NO: 173497 - DNA, 35 bp, Artificial Sequence
  Synthetic oligonucleotide
gacaccactcaactactgccgcgcacctgttcacg

SEQ ID NO: 173498 - DNA, 35 bp, Artificial Sequence
  Synthetic oligonucleotide
aacccccggaccggcgcgaccgttcccgcccaccg

SEQ ID NO: 173499 - DNA, 35 bp, Artificial Sequence
  Synthetic oligonucleotide
actgacacgcttggtagtacttgtccctttctccg

SEQ ID NO: 173500 - DNA, 35 bp, Artificial Sequence
  Synthetic oligonucleotide
agtgtggccgaagggggaaggagatacaaggatcg

SEQ ID NO: 173501 - DNA, 35 bp, Artificial Sequence
  Synthetic oligonucleotide
gtgtaaacaccgcctatctgaaaccccctcgctcg

SEQ ID NO: 173502 - DNA, 35 bp, Artificial Sequence
  Synthetic oligonucleotide
gacccccgtccggtgcttggcttttcccagtctcg

SEQ ID NO: 173503 - DNA, 35 bp, Artificial Sequence
  Synthetic oligonucleotide
gttccgctcctccgtgtcgtgcctctccttcttcg

SEQ ID NO: 173504 - DNA, 35 bp, Artificial Sequence
  Synthetic oligonucleotide
aacaccaccccatgtcaaatctagcctgtcatagg

SEQ ID NO: 173505 - DNA, 35 bp, Artificial Sequence
  Synthetic oligonucleotide
accgaacccgggagggggggatatgggttcatagg

SEQ ID NO: 173506 - DNA, 35 bp, Artificial Sequence
  Synthetic oligonucleotide
acagaccagatgggaggggggacggtaggtgtagg

SEQ ID NO: 173507 - DNA, 35 bp, Artificial Sequence
  Synthetic oligonucleotide
gccccacgcacccgtttccccttcaccacctgggg

SEQ ID NO: 173508 - DNA, 35 bp, Artificial Sequence
  Synthetic oligonucleotide
tcccttaccgcctatgttgcgttcttcactgctgg

SEQ ID NO: 173509 - DNA, 35 bp, Artificial Sequence
  Synthetic oligonucleotide
accgcgacgcatctccgtcccctatgcccttgtgg

SEQ ID NO: 173510 - DNA, 35 bp, Artificial Sequence
  Synthetic oligonucleotide
ttagggctgttgggggcggaggggaacgggaactg

SEQ ID NO: 173511 - DNA, 35 bp, Artificial Sequence
  Synthetic oligonucleotide
acccgctccggctagcccggtctctgtactttctg

SEQ ID NO: 173512 - DNA, 35 bp, Artificial Sequence
  Synthetic oligonucleotide
actgacccccacgattgactgtttagcctcccgtg

SEQ ID NO: 173513 - DNA, 35 bp, Artificial Sequence
  Synthetic oligonucleotide
acctcggctgccctactctgccgtaccattccttg

SEQ ID NO: 173514 - DNA, 35 bp, Artificial Sequence
  Synthetic oligonucleotide
attctgtccccggtgccctgtctcgagtcatccat

SEQ ID NO: 173515 - DNA, 35 bp, Artificial Sequence
  Synthetic oligonucleotide
gccaaggtactgtaagccatctattcgttccacct

SEQ ID NO: 173516 - DNA, 35 bp, Artificial Sequence
  Synthetic oligonucleotide
tcctccaccccacgccgttctgtgttacgcaccct

SEQ ID NO: 173517 - DNA, 35 bp, Artificial Sequence
  Synthetic oligonucleotide
tagctccacttcgcacggcatcatcctgcattcct

SEQ ID NO: 173518 - DNA, 35 bp, Artificial Sequence
  Synthetic oligonucleotide
aacgccccacccccccgccgacagagccgcttcct

SEQ ID NO: 173519 - DNA, 35 bp, Artificial Sequence
  Synthetic oligonucleotide
tcaggatcaatgcctgtcacccgctgttaccatct

SEQ ID NO: 173520 - DNA, 35 bp, Artificial Sequence
  Synthetic oligonucleotide
ttaacccacccgctgtactcgacaaccatggctct

SEQ ID NO: 173521 - DNA, 35 bp, Artificial Sequence
  Synthetic oligonucleotide
acccccatccgtccgtgctgccgtagcctttctct

SEQ ID NO: 173522 - DNA, 35 bp, Artificial Sequence
  Synthetic oligonucleotide
gttcatccctcctcgcaccgacgttctcaggacgt

SEQ ID NO: 173523 - DNA, 35 bp, Artificial Sequence
  Synthetic oligonucleotide
tccacacactcggtctggtattgctgttctttcgt

SEQ ID NO: 173524 - DNA, 35 bp, Artificial Sequence
  Synthetic oligonucleotide
tgccgttccatctgcgtcttctgccttcgctctgt

SEQ ID NO: 173525 - DNA, 35 bp, Artificial Sequence
  Synthetic oligonucleotide
tccgtacgcctctctatcgtttcgtcaatcctatt

SEQ ID NO: 173526 - DNA, 35 bp, Artificial Sequence
  Synthetic oligonucleotide
tgccgtatgaagggtctttagggcgggagggactt

SEQ ID NO: 173527 - DNA, 35 bp, Artificial Sequence
  Synthetic oligonucleotide
cccaacgcacattatctatgcagccgcatcccctt

SEQ ID NO: 173528 - DNA, 35 bp, Artificial Sequence
  Synthetic oligonucleotide
gggatccgaccatggcaaccgcacacaacatcctt

SEQ ID NO: 173529 - DNA, 35 bp, Artificial Sequence
  Synthetic oligonucleotide
ttccgccccagcttgccccgccgtaaattatcctt

SEQ ID NO: 173530 - DNA, 35 bp, Artificial Sequence
  Synthetic oligonucleotide
gacgttatcagggctacccatccccccgttctctt

SEQ ID NO: 173531 - DNA, 35 bp, Artificial Sequence
  Synthetic oligonucleotide
atcgagaccgcgcccacccatctcccgtacttttt

SEQ ID NO: 173532 - DNA, 35 bp, Artificial Sequence
  Synthetic oligonucleotide
taaggagaaggaatggaacgggggaagttggcgaa

SEQ ID NO: 173533 - DNA, 36 bp, Artificial Sequence
  Synthetic oligonucleotide
aaccaccctccactgtatctgacgccccagtttgaa

SEQ ID NO: 173534 - DNA, 35 bp, Artificial Sequence
  Synthetic oligonucleotide
tgcaccagtccgcccttcatccagatccttggtaa

SEQ ID NO: 173535 - DNA, 33 bp, Artificial Sequence
  Synthetic oligonucleotide
catccactaccattacgaggttcccgccgcaca

SEQ ID NO: 173536 - DNA, 36 bp, Artificial Sequence
  Synthetic oligonucleotide
tgccaccccctgtctcatactcacctaggtattaca

SEQ ID NO: 173537 - DNA, 35 bp, Artificial Sequence
  Synthetic oligonucleotide
ttcacatcccaccccgcccgtcacagtgtgcacca

SEQ ID NO: 173538 - DNA, 36 bp, Artificial Sequence
  Synthetic oligonucleotide
cccaaccgcctttcgttctcctgttgctgtcgccca

SEQ ID NO: 173539 - DNA, 36 bp, Artificial Sequence
  Synthetic oligonucleotide
gagttccgccatctgtacttgctctccgtgatcgca

SEQ ID NO: 173540 - DNA, 36 bp, Artificial Sequence
  Synthetic oligonucleotide
ggcctccaccggtggttcattgttacgccctctgca

SEQ ID NO: 173541 - DNA, 36 bp, Artificial Sequence
  Synthetic oligonucleotide
tctacacccgcactaccgcgattgagctacgactca

SEQ ID NO: 173542 - DNA, 36 bp, Artificial Sequence
  Synthetic oligonucleotide
acgatggttcacagctgtgcgttccagcccccctca

SEQ ID NO: 173543 - DNA, 36 bp, Artificial Sequence
  Synthetic oligonucleotide
aatggcggcctgcaccttccgtcttcataacgctca

SEQ ID NO: 173544 - DNA, 36 bp, Artificial Sequence
  Synthetic oligonucleotide
ggttccagccagcagcctccgtccctctcgtgctca

SEQ ID NO: 173545 - DNA, 37 bp, Artificial Sequence
  Synthetic oligonucleotide
ggtccacactatgggcatgttcctcgctctaccacga

SEQ ID NO: 173546 - DNA, 35 bp, Artificial Sequence
  Synthetic oligonucleotide
gactgtccctcctcgtggtcgccatctccccacga

SEQ ID NO: 173547 - DNA, 35 bp, Artificial Sequence
  Synthetic oligonucleotide
ttgtacgtgcctattcaccgccacctgtcccacga

SEQ ID NO: 173548 - DNA, 37 bp, Artificial Sequence
  Synthetic oligonucleotide
gacgaacgtcgtcacgtaccacattgcgccccaccga

SEQ ID NO: 173549 - DNA, 37 bp, Artificial Sequence
  Synthetic oligonucleotide
tacaccacccgattagcgcattagtccgtatcaccga

SEQ ID NO: 173550 - DNA, 37 bp, Artificial Sequence
  Synthetic oligonucleotide
taggatagccccccacgcgtgtccttgccgcccccga

SEQ ID NO: 173551 - DNA, 37 bp, Artificial Sequence
  Synthetic oligonucleotide
acacacgcccactggcccacgtaatgcattcccccga

SEQ ID NO: 173552 - DNA, 37 bp, Artificial Sequence
  Synthetic oligonucleotide
aaccacattcacattgtcactacgcttacctgcccga

SEQ ID NO: 173553 - DNA, 37 bp, Artificial Sequence
  Synthetic oligonucleotide
tcgaacgattcctcgtgataaccttgtaccctcccga

SEQ ID NO: 173554 - DNA, 37 bp, Artificial Sequence
  Synthetic oligonucleotide
tcacgcccccctccgttttatcgctacgtcctgccga

SEQ ID NO: 173555 - DNA, 37 bp, Artificial Sequence
  Synthetic oligonucleotide
gatggaacaggtcggctaggaaggggaggcagggcga

SEQ ID NO: 173556 - DNA, 37 bp, Artificial Sequence
  Synthetic oligonucleotide
tagcacgccctagtcccgcccttagtctcgtcatcga

SEQ ID NO: 173557 - DNA, 37 bp, Artificial Sequence
  Synthetic oligonucleotide
tgcccttcccagcactgttccacgatttcgctatcga

SEQ ID NO: 173558 - DNA, 37 bp, Artificial Sequence
  Synthetic oligonucleotide
tacgacgggaggggctggggtgggtatattatttcga

SEQ ID NO: 173559 - DNA, 37 bp, Artificial Sequence
  Synthetic oligonucleotide
tggaagggcctaaagggagggagggccaggagcagga

SEQ ID NO: 173560 - DNA, 37 bp, Artificial Sequence
  Synthetic oligonucleotide
tacccgcttttcattcgttatttgctaccctcccgga

SEQ ID NO: 173561 - DNA, 37 bp, Artificial Sequence
  Synthetic oligonucleotide
gggaagaggcgaggaggaatgcgggggatttgaggga

SEQ ID NO: 173562 - DNA, 37 bp, Artificial Sequence
  Synthetic oligonucleotide
ggtggaggggagaacgtgcgaaggatcataggcggga

SEQ ID NO: 173563 - DNA, 37 bp, Artificial Sequence
  Synthetic oligonucleotide
ggggtggcacgaagcgcacgcggagggagggagggga

SEQ ID NO: 173564 - DNA, 37 bp, Artificial Sequence
  Synthetic oligonucleotide
gggtgaacgggggaatgcatactaaaatgggagggga

SEQ ID NO: 173565 - DNA, 37 bp, Artificial Sequence
  Synthetic oligonucleotide
tagtaagcgcaagtggattaggcggggtgggagggga

SEQ ID NO: 173566 - DNA, 36 bp, Artificial Sequence
  Synthetic oligonucleotide
tggggaagtacggcaagggggggagcaaacggggga

SEQ ID NO: 173567 - DNA, 36 bp, Artificial Sequence
  Synthetic oligonucleotide
ggaggaagtcgggtcaagcagggtcggtggggggga

SEQ ID NO: 173568 - DNA, 37 bp, Artificial Sequence
  Synthetic oligonucleotide
gcgaggtgggggggacgaagggttacaaagcactgga

SEQ ID NO: 173569 - DNA, 37 bp, Artificial Sequence
  Synthetic oligonucleotide
gatcgaggcgggggggaaacggtgttgcggcactgga

SEQ ID NO: 173570 - DNA, 37 bp, Artificial Sequence
  Synthetic oligonucleotide
tgcgtccgtcaccgcttttgctaactccttccctgga

SEQ ID NO: 173571 - DNA, 37 bp, Artificial Sequence
  Synthetic oligonucleotide
atccaccccgccccaacatggacctgtacatatatga

SEQ ID NO: 173572 - DNA, 38 bp, Artificial Sequence
  Synthetic oligonucleotide
acacccgcggcctcgttgacttttttcctgcaccctga

SEQ ID NO: 173573 - DNA, 37 bp, Artificial Sequence
  Synthetic oligonucleotide
acagccatgatgccctttctccgccgtcccgccctga

SEQ ID NO: 173574 - DNA, 36 bp, Artificial Sequence
  Synthetic oligonucleotide
tcagccgcttcctgagtatgcctccccgttccctga

SEQ ID NO: 173575 - DNA, 37 bp, Artificial Sequence
  Synthetic oligonucleotide
gccgcaggtcgatcgatccgttgttaccacctcctga

SEQ ID NO: 173576 - DNA, 38 bp, Artificial Sequence
  Synthetic oligonucleotide
gtgttcccgcagcatgttaacatcacccgcttttctga

SEQ ID NO: 173577 - DNA, 38 bp, Artificial Sequence
  Synthetic oligonucleotide
aagtgcagacgcctaaatgcatcccttcgcccccgtga

SEQ ID NO: 173578 - DNA, 38 bp, Artificial Sequence
  Synthetic oligonucleotide
gccccacatgggcccagctaccgcccgttcctccgtga

SEQ ID NO: 173579 - DNA, 38 bp, Artificial Sequence
  Synthetic oligonucleotide
tcccgcctcgtgccccatttgctttccttagtccgtga

SEQ ID NO: 173580 - DNA, 37 bp, Artificial Sequence
  Synthetic oligonucleotide
gcaaggtgataaaaggggaattagaggagggaggtga

SEQ ID NO: 173581 - DNA, 37 bp, Artificial Sequence
  Synthetic oligonucleotide
ttggcggtacagtacgggcatgggaaagggggggtga

SEQ ID NO: 173582 - DNA, 36 bp, Artificial Sequence
  Synthetic oligonucleotide
tgccagtacgggacggacgaagggatgggtgggtga

SEQ ID NO: 173583 - DNA, 36 bp, Artificial Sequence
  Synthetic oligonucleotide
gctgatgcctaccgctgcataggcccacttccttga

SEQ ID NO: 173584 - DNA, 37 bp, Artificial Sequence
  Synthetic oligonucleotide
gccattgccctttgccgtcgtggccacaccttcttga

SEQ ID NO: 173585 - DNA, 37 bp, Artificial Sequence
  Synthetic oligonucleotide
gcgatgacgctgactcgttctacttacccatctttga

SEQ ID NO: 173586 - DNA, 38 bp, Artificial Sequence
  Synthetic oligonucleotide
tcaaccctctgctagtgcgctccttccccccagtttga

SEQ ID NO: 173587 - DNA, 36 bp, Artificial Sequence
  Synthetic oligonucleotide
gtgggtgggcttactgggtgggagcacattgtttga

SEQ ID NO: 173588 - DNA, 38 bp, Artificial Sequence
  Synthetic oligonucleotide
agcgagctgggcgggtggggttctagttgggcttttga

SEQ ID NO: 173589 - DNA, 35 bp, Artificial Sequence
  Synthetic oligonucleotide
gatggggatgccaacgggacatgggagggtgacta

SEQ ID NO: 173590 - DNA, 36 bp, Artificial Sequence
  Synthetic oligonucleotide
gcttccacccgctgtccttatctttacgaccaccta

SEQ ID NO: 173591 - DNA, 36 bp, Artificial Sequence
  Synthetic oligonucleotide
gaggacactggtcggggggttagtggaagggttgta

SEQ ID NO: 173592 - DNA, 37 bp, Artificial Sequence
  Synthetic oligonucleotide
acgattcagcgcgctgtccacatccttcaccttctta

SEQ ID NO: 173593 - DNA, 35 bp, Artificial Sequence
  Synthetic oligonucleotide
gtcgacccgccacctccagtacgtcctcctgtaac

SEQ ID NO: 173594 - DNA, 35 bp, Artificial Sequence
  Synthetic oligonucleotide
accccacttcggaccgacggagcccgccacaccac

SEQ ID NO: 173595 - DNA, 35 bp, Artificial Sequence
  Synthetic oligonucleotide
tgccagagagctgcttgagtctacgcctcctccac

SEQ ID NO: 173596 - DNA, 35 bp, Artificial Sequence
  Synthetic oligonucleotide
acgatgttcctccgaccgtggctgcctctccgcac

SEQ ID NO: 173597 - DNA, 35 bp, Artificial Sequence
  Synthetic oligonucleotide
tttgcccccacggacactagcctgaacacctgcac

SEQ ID NO: 173598 - DNA, 35 bp, Artificial Sequence
  Synthetic oligonucleotide
tcgcaatccagtattcagtctctcctctgttgcac

SEQ ID NO: 173599 - DNA, 35 bp, Artificial Sequence
  Synthetic oligonucleotide
aacgccgcaggcctctcagcttgatcctgctctac

SEQ ID NO: 173600 - DNA, 35 bp, Artificial Sequence
  Synthetic oligonucleotide
tcctgggtccgaatcgtccgagtcttcctaccacc

SEQ ID NO: 173601 - DNA, 35 bp, Artificial Sequence
  Synthetic oligonucleotide
gctgtgccgtcccctgctcatctgtaggacccacc

SEQ ID NO: 173602 - DNA, 35 bp, Artificial Sequence
  Synthetic oligonucleotide
gtgagcgcctcaattcccgacgctcttgtcccacc

SEQ ID NO: 173603 - DNA, 35 bp, Artificial Sequence
  Synthetic oligonucleotide
tagctctaccgcccccaggctacgtacgttctacc

SEQ ID NO: 173604 - DNA, 35 bp, Artificial Sequence
  Synthetic oligonucleotide
tcttcacccgcatgcacacctccgcctcacgtacc

SEQ ID NO: 173605 - DNA, 35 bp, Artificial Sequence
  Synthetic oligonucleotide
gatcacgactttgcgctctgaactccccgcttacc

SEQ ID NO: 173606 - DNA, 35 bp, Artificial Sequence
  Synthetic oligonucleotide
ggttgcctgaaactgcacctacactggcttcaccc

SEQ ID NO: 173607 - DNA, 35 bp, Artificial Sequence
  Synthetic oligonucleotide
tgcagaacgcattgcccttttccgccattttaccc

SEQ ID NO: 173608 - DNA, 35 bp, Artificial Sequence
  Synthetic oligonucleotide
tgagtcagcacatttttgtcttcttttcagccccc

SEQ ID NO: 173609 - DNA, 35 bp, Artificial Sequence
  Synthetic oligonucleotide
gcgacccggcgcaaccctcatatgttcgtcctccc

SEQ ID NO: 173610 - DNA, 35 bp, Artificial Sequence
  Synthetic oligonucleotide
tcttggccccccaccgaattgactcgcaagttccc

SEQ ID NO: 173611 - DNA, 35 bp, Artificial Sequence
  Synthetic oligonucleotide
atcatcgctgccttgttatcttcggcgtccaagcc

SEQ ID NO: 173612 - DNA, 35 bp, Artificial Sequence
  Synthetic oligonucleotide
tccgctccgcccgagtattttcattctacgaagcc

SEQ ID NO: 173613 - DNA, 35 bp, Artificial Sequence
  Synthetic oligonucleotide
tatgccctctccacccggtatacgtggtgccagcc

SEQ ID NO: 173614 - DNA, 35 bp, Artificial Sequence
  Synthetic oligonucleotide
gtgctcattgtctcataccctgcctcgctacggcc

SEQ ID NO: 173615 - DNA, 35 bp, Artificial Sequence
  Synthetic oligonucleotide
tcatggaccgaaaggtagatgtagctgttccatcc

SEQ ID NO: 173616 - DNA, 35 bp, Artificial Sequence
  Synthetic oligonucleotide
gtgttcatccctcccacacgcccacctgacgctcc

SEQ ID NO: 173617 - DNA, 35 bp, Artificial Sequence
  Synthetic oligonucleotide
tctatcgtaccgccgcggttatcgaccttatctcc

SEQ ID NO: 173618 - DNA, 35 bp, Artificial Sequence
  Synthetic oligonucleotide
gatctctcgccccctggacatacgtgtcgtagtcc

SEQ ID NO: 173619 - DNA, 35 bp, Artificial Sequence
  Synthetic oligonucleotide
gcgtgactatgccctgatccttttgcggaacttcc

SEQ ID NO: 173620 - DNA, 35 bp, Artificial Sequence
  Synthetic oligonucleotide
tctgaccacaccgcttacgtaagtggcatccttcc

SEQ ID NO: 173621 - DNA, 35 bp, Artificial Sequence
  Synthetic oligonucleotide
ttgcctctctcctctcttgtactaccaggtctagc

SEQ ID NO: 173622 - DNA, 35 bp, Artificial Sequence
  Synthetic oligonucleotide
taccgcctactcggcacatatacgtaccttcacgc

SEQ ID NO: 173623 - DNA, 35 bp, Artificial Sequence
  Synthetic oligonucleotide
atgccccgcccacgctgcacgacgaagtccgacgc

SEQ ID NO: 173624 - DNA, 35 bp, Artificial Sequence
  Synthetic oligonucleotide
acctccccaccatctgtcccctttgagcagtacgc

SEQ ID NO: 173625 - DNA, 35 bp, Artificial Sequence
  Synthetic oligonucleotide
gatcctgctcgaccgtattacttttgtcgccccgc

SEQ ID NO: 173626 - DNA, 35 bp, Artificial Sequence
  Synthetic oligonucleotide
aacaccccgcatggccaaccccggaaccacatcgc

SEQ ID NO: 173627 - DNA, 35 bp, Artificial Sequence
  Synthetic oligonucleotide
acgcaatacgcaatccgctgttcttctctactggc

SEQ ID NO: 173628 - DNA, 35 bp, Artificial Sequence
  Synthetic oligonucleotide
tcgttgggagggtgggcgtacgggaagccccatgc

SEQ ID NO: 173629 - DNA, 35 bp, Artificial Sequence
  Synthetic oligonucleotide
ggctgggccttctgcgtctctcctctctgctcctc

SEQ ID NO: 173630 - DNA, 35 bp, Artificial Sequence
  Synthetic oligonucleotide
gaagcgcaatagcccttgcacaccgccagtatctc

SEQ ID NO: 173631 - DNA, 35 bp, Artificial Sequence
  Synthetic oligonucleotide
aaaccggaccgcccttcgcgctacattagtatctc

SEQ ID NO: 173632 - DNA, 35 bp, Artificial Sequence
  Synthetic oligonucleotide
gccgaaccgcctggccttcttgaaagcactctctc

SEQ ID NO: 173633 - DNA, 35 bp, Artificial Sequence
  Synthetic oligonucleotide
gccccattgcatgcatagccccccgaacaacggtc

SEQ ID NO: 173634 - DNA, 35 bp, Artificial Sequence
  Synthetic oligonucleotide
gttggatacctcgacttccctcgcgcctcctggtc

SEQ ID NO: 173635 - DNA, 33 bp, Artificial Sequence
  Synthetic oligonucleotide
atcttgtccttgctggccgacctactccttgtc

SEQ ID NO: 173636 - DNA, 35 bp, Artificial Sequence
  Synthetic oligonucleotide
tctctggtccgacgtcgtcatcccgtcgtgccttc

SEQ ID NO: 173637 - DNA, 35 bp, Artificial Sequence
  Synthetic oligonucleotide
attgcgccgtctaatcctgtttcgattccattttc

SEQ ID NO: 173638 - DNA, 35 bp, Artificial Sequence
  Synthetic oligonucleotide
tcaggaagagagggaggatacgggaggttatggag

SEQ ID NO: 173639 - DNA, 35 bp, Artificial Sequence
  Synthetic oligonucleotide
agtacacgcccagcctcctgccctttttgggaacg

SEQ ID NO: 173640 - DNA, 35 bp, Artificial Sequence
  Synthetic oligonucleotide
gagccgggcactcctccgctcccttgcttatcacg

SEQ ID NO: 173641 - DNA, 35 bp, Artificial Sequence
  Synthetic oligonucleotide
taccgctggcccgccccctcgcacaaagtgaaccg

SEQ ID NO: 173642 - DNA, 35 bp, Artificial Sequence
  Synthetic oligonucleotide
gtcgaagcgaatgtctcttcgtgttccacccaccg

SEQ ID NO: 173643 - DNA, 35 bp, Artificial Sequence
  Synthetic oligonucleotide
gcgccgagttcaggtccgttccttcgtctggcccg

SEQ ID NO: 173644 - DNA, 34 bp, Artificial Sequence
  Synthetic oligonucleotide
gctggttaccacatcctcgcctctactcctgccg

SEQ ID NO: 173645 - DNA, 35 bp, Artificial Sequence
  Synthetic oligonucleotide
tgtcgcggaagtcctccgtagtcgttttacctccg

SEQ ID NO: 173646 - DNA, 35 bp, Artificial Sequence
  Synthetic oligonucleotide
tcgagggaaggagtgggtcaacggtagagggggcg

SEQ ID NO: 173647 - DNA, 35 bp, Artificial Sequence
  Synthetic oligonucleotide
acacgccatacgtcttcacctcgtcatattattcg

SEQ ID NO: 173648 - DNA, 35 bp, Artificial Sequence
  Synthetic oligonucleotide
ttcagacgccttccagttgcctctaaatcccttcg

SEQ ID NO: 173649 - DNA, 35 bp, Artificial Sequence
  Synthetic oligonucleotide
aacgagggacgggagggcgggtaaagaggggacgg

SEQ ID NO: 173650 - DNA, 35 bp, Artificial Sequence
  Synthetic oligonucleotide
ggtgataggcgggaaggagggggattaaggtacgg

SEQ ID NO: 173651 - DNA, 35 bp, Artificial Sequence
  Synthetic oligonucleotide
aacctgcgttctcccgcctatcctccctcttccgg

SEQ ID NO: 173652 - DNA, 35 bp, Artificial Sequence
  Synthetic oligonucleotide
gcccagccatcgttcgccccccccactccatttgg

SEQ ID NO: 173653 - DNA, 35 bp, Artificial Sequence
  Synthetic oligonucleotide
gctcaccgccacaatcgttcttaccccgctccctg

SEQ ID NO: 173654 - DNA, 35 bp, Artificial Sequence
  Synthetic oligonucleotide
tcgaacttccatcagccgcacaccccctagcattg

SEQ ID NO: 173655 - DNA, 35 bp, Artificial Sequence
  Synthetic oligonucleotide
acacaccacctaacatgtgcgccgttccgctcttg

SEQ ID NO: 173656 - DNA, 35 bp, Artificial Sequence
  Synthetic oligonucleotide
gcatcacggtccgcaccccctccattcgctagttg

SEQ ID NO: 173657 - DNA, 35 bp, Artificial Sequence
  Synthetic oligonucleotide
gagggtgtaagagggggcattaaggggagtggaat

SEQ ID NO: 173658 - DNA, 35 bp, Artificial Sequence
  Synthetic oligonucleotide
taagcaaaggagcggggagggcggggtgtcgagat

SEQ ID NO: 173659 - DNA, 35 bp, Artificial Sequence
  Synthetic oligonucleotide
ggaccacccacgatacccacgacttgtctctaact

SEQ ID NO: 173660 - DNA, 35 bp, Artificial Sequence
  Synthetic oligonucleotide
ggtcactcacgttttcttcgccccacgccaccact

SEQ ID NO: 173661 - DNA, 35 bp, Artificial Sequence
  Synthetic oligonucleotide
gcccctacatgtgccctcaaggccctcaccaacct

SEQ ID NO: 173662 - DNA, 35 bp, Artificial Sequence
  Synthetic oligonucleotide
aagtggccgtccatcattttgctaccgtaccccct

SEQ ID NO: 173663 - DNA, 35 bp, Artificial Sequence
  Synthetic oligonucleotide
aaggtcggtacaggcttctccttcagccactccct

SEQ ID NO: 173664 - DNA, 35 bp, Artificial Sequence
  Synthetic oligonucleotide
tctagggccatctgacggcacccttactgctccct

SEQ ID NO: 173665 - DNA, 35 bp, Artificial Sequence
  Synthetic oligonucleotide
tcactagcgtacgtaatagcttcttcccccctgct

SEQ ID NO: 173666 - DNA, 35 bp, Artificial Sequence
  Synthetic oligonucleotide
ttgccacttggtgtttctgtttgtgcccaccctct

SEQ ID NO: 173667 - DNA, 35 bp, Artificial Sequence
  Synthetic oligonucleotide
gggagcacagttgttgcgtttcacctcggccctct

SEQ ID NO: 173668 - DNA, 35 bp, Artificial Sequence
  Synthetic oligonucleotide
tctcgcccacggtgccttaactcgtaattcgctct

SEQ ID NO: 173669 - DNA, 35 bp, Artificial Sequence
  Synthetic oligonucleotide
tcccctcgccccgttgcgtaccgaagccctagtct

SEQ ID NO: 173670 - DNA, 35 bp, Artificial Sequence
  Synthetic oligonucleotide
tgatccatgacgtcactaatcgctggtccctgtct

SEQ ID NO: 173671 - DNA, 35 bp, Artificial Sequence
  Synthetic oligonucleotide
gatgccacatttattgtctggtcccattggtttct

SEQ ID NO: 173672 - DNA, 35 bp, Artificial Sequence
  Synthetic oligonucleotide
aaggggggatggagtgggggacgtggttcagtagt

SEQ ID NO: 173673 - DNA, 35 bp, Artificial Sequence
  Synthetic oligonucleotide
ggggagtagagggggtaggattggaaatgggacgt

SEQ ID NO: 173674 - DNA, 35 bp, Artificial Sequence
  Synthetic oligonucleotide
gacccactcgctccacatctactctctgagcccgt

SEQ ID NO: 173675 - DNA, 35 bp, Artificial Sequence
  Synthetic oligonucleotide
ttcggaacccagctccaaacacgtcccactctcgt

SEQ ID NO: 173676 - DNA, 35 bp, Artificial Sequence
  Synthetic oligonucleotide
tccactacacgcctcacctcccaatgcttttaggt

SEQ ID NO: 173677 - DNA, 35 bp, Artificial Sequence
  Synthetic oligonucleotide
ttacggaatggggccgaaaaaggtgggataggggt

SEQ ID NO: 173678 - DNA, 35 bp, Artificial Sequence
  Synthetic oligonucleotide
gagtacgagggaaaggatagtgggataggcctggt

SEQ ID NO: 173679 - DNA, 35 bp, Artificial Sequence
  Synthetic oligonucleotide
tcagttctcgtacccttggcgtatctctcccctgt

SEQ ID NO: 173680 - DNA, 35 bp, Artificial Sequence
  Synthetic oligonucleotide
ttgtacagccgccttgtcatcattcctcctgctgt

SEQ ID NO: 173681 - DNA, 35 bp, Artificial Sequence
  Synthetic oligonucleotide
gctctcgtcacgccgcccgactacacacactcatt

SEQ ID NO: 173682 - DNA, 35 bp, Artificial Sequence
  Synthetic oligonucleotide
atgtgtgccaccgcatggggcctgggatccccctt

SEQ ID NO: 173683 - DNA, 35 bp, Artificial Sequence
  Synthetic oligonucleotide
atgccacgcaactcccatgctgtccacttgtcctt

SEQ ID NO: 173684 - DNA, 35 bp, Artificial Sequence
  Synthetic oligonucleotide
tgtaccgcaggtttactctgcccaccttcatcttt

SEQ ID NO: 173685 - DNA, 35 bp, Artificial Sequence
  Synthetic oligonucleotide
gtcctcccacatgtcttctcgctgacccatttttt

SEQ ID NO: 173686 - DNA, 36 bp, Artificial Sequence
  Synthetic oligonucleotide
accacacccgccccattgtacccatgtctcccaaaa

SEQ ID NO: 173687 - DNA, 35 bp, Artificial Sequence
  Synthetic oligonucleotide
ttgaggcggaagttaggtagaggcgggggggcgaa

SEQ ID NO: 173688 - DNA, 36 bp, Artificial Sequence
  Synthetic oligonucleotide
gaaaggggagggcgttgtttgggtgggccggtgtaa

SEQ ID NO: 173689 - DNA, 36 bp, Artificial Sequence
  Synthetic oligonucleotide
tcgatgcctgtagccttccctcacctcgtgtgcaca

SEQ ID NO: 173690 - DNA, 36 bp, Artificial Sequence
  Synthetic oligonucleotide
atgccaccccccagatcaaccgccgttcctggacca

SEQ ID NO: 173691 - DNA, 36 bp, Artificial Sequence
  Synthetic oligonucleotide
tcagccggagcgcgagggctgggggggacggggcca

SEQ ID NO: 173692 - DNA, 36 bp, Artificial Sequence
  Synthetic oligonucleotide
ggtccagcacaggtttccgcgcgcttctggcctcca

SEQ ID NO: 173693 - DNA, 37 bp, Artificial Sequence
  Synthetic oligonucleotide
tgtccgcctaatcatgacgctgcctaggccctctcca

SEQ ID NO: 173694 - DNA, 35 bp, Artificial Sequence
  Synthetic oligonucleotide
gtatatccgcaacctgtatcatcgctcctggtcca

SEQ ID NO: 173695 - DNA, 36 bp, Artificial Sequence
  Synthetic oligonucleotide
tcttgcgacctgtctcgttcttctgattccttcgca

SEQ ID NO: 173696 - DNA, 35 bp, Artificial Sequence
  Synthetic oligonucleotide
ttctccgccgctcgccttgatgaccccccccggca

SEQ ID NO: 173697 - DNA, 36 bp, Artificial Sequence
  Synthetic oligonucleotide
ttgtgctcctgtcccatcgacgcttttggttgctca

SEQ ID NO: 173698 - DNA, 36 bp, Artificial Sequence
  Synthetic oligonucleotide
gttacatccgcgaggtacccaagtaccgtcctctca

SEQ ID NO: 173699 - DNA, 35 bp, Artificial Sequence
  Synthetic oligonucleotide
acactgcccctaccttgcctttatcgacgcattca

SEQ ID NO: 173700 - DNA, 37 bp, Artificial Sequence
  Synthetic oligonucleotide
acacgccgagtgtaggtagggggagtgagtacaaaga

SEQ ID NO: 173701 - DNA, 37 bp, Artificial Sequence
  Synthetic oligonucleotide
ataatgagcggggggaagaaggggcgttgtggtcaga

SEQ ID NO: 173702 - DNA, 36 bp, Artificial Sequence
  Synthetic oligonucleotide
tggggggggggaggggcatagatacgagcgcagaga

SEQ ID NO: 173703 - DNA, 35 bp, Artificial Sequence
  Synthetic oligonucleotide
ttgggatactgcgggagggaggtgaggggtggaga

SEQ ID NO: 173704 - DNA, 35 bp, Artificial Sequence
  Synthetic oligonucleotide
accatgaggggggggtgatagggccacggttacga

SEQ ID NO: 173705 - DNA, 35 bp, Artificial Sequence
  Synthetic oligonucleotide
gccgcctccatgtggacccccgcccccggtaccga

SEQ ID NO: 173706 - DNA, 37 bp, Artificial Sequence
  Synthetic oligonucleotide
ggtacaaccgcccccagtgtgtccgtttctcccccga

SEQ ID NO: 173707 - DNA, 35 bp, Artificial Sequence
  Synthetic oligonucleotide
cccaacccgccgatcttgcttcgttcgatccccga

SEQ ID NO: 173708 - DNA, 37 bp, Artificial Sequence
  Synthetic oligonucleotide
gttccccatgctgcctatgatcctaccgcccactcga

SEQ ID NO: 173709 - DNA, 35 bp, Artificial Sequence
  Synthetic oligonucleotide
tctatcccgcctaggttccggtccatgtttctcga

SEQ ID NO: 173710 - DNA, 37 bp, Artificial Sequence
  Synthetic oligonucleotide
cactcctctatatgtaacacagctgcacctttttcga

SEQ ID NO: 173711 - DNA, 37 bp, Artificial Sequence
  Synthetic oligonucleotide
gaaggaaggcgggaggtagggaatgcggtgccgagga

SEQ ID NO: 173712 - DNA, 36 bp, Artificial Sequence
  Synthetic oligonucleotide
agtgcgtggggacgggggggtgaaggtaatatagga

SEQ ID NO: 173713 - DNA, 35 bp, Artificial Sequence
  Synthetic oligonucleotide
ttcgtcgccacttttattttgtacttccctccgga

SEQ ID NO: 173714 - DNA, 37 bp, Artificial Sequence
  Synthetic oligonucleotide
gccggtcccaacctaccttcacacctccgttctcgga

SEQ ID NO: 173715 - DNA, 37 bp, Artificial Sequence
  Synthetic oligonucleotide
aagatggtcgggggggatctgcagagcagggatggga

SEQ ID NO: 173716 - DNA, 37 bp, Artificial Sequence
  Synthetic oligonucleotide
tcgcggatagagggggaggggaaacggcaatgtggga

SEQ ID NO: 173717 - DNA, 35 bp, Artificial Sequence
  Synthetic oligonucleotide
tttgatcctccgtggccatcacgtccttacatgga

SEQ ID NO: 173718 - DNA, 37 bp, Artificial Sequence
  Synthetic oligonucleotide
atccccacccagatcgcgcactcctactgcccctgga

SEQ ID NO: 173719 - DNA, 37 bp, Artificial Sequence
  Synthetic oligonucleotide
tccaacaccgccgctttctagaccgcatcactctgga

SEQ ID NO: 173720 - DNA, 38 bp, Artificial Sequence
  Synthetic oligonucleotide
gtgagtggcggggtggaaagggtcgtgggcgaaaatga

SEQ ID NO: 173721 - DNA, 38 bp, Artificial Sequence
  Synthetic oligonucleotide
ttgcctccccaggtcggatgagccccccgccgcaatga

SEQ ID NO: 173722 - DNA, 37 bp, Artificial Sequence
  Synthetic oligonucleotide
actgccatccctcgttacatctggtacttcatcatga

SEQ ID NO: 173723 - DNA, 38 bp, Artificial Sequence
  Synthetic oligonucleotide
gcgccctcaccattgcacataggcccgcccctttatga

SEQ ID NO: 173724 - DNA, 38 bp, Artificial Sequence
  Synthetic oligonucleotide
gatgtgccgccggttgtcccatcgatcctccccactga

SEQ ID NO: 173725 - DNA, 38 bp, Artificial Sequence
  Synthetic oligonucleotide
gtcccaggctgcccaccccgtcattagttactccctga

SEQ ID NO: 173726 - DNA, 38 bp, Artificial Sequence
  Synthetic oligonucleotide
tcgtgccccttcctgaaccgtgctacatacatgcctga

SEQ ID NO: 173727 - DNA, 38 bp, Artificial Sequence
  Synthetic oligonucleotide
gtgacctgggcggaggggagcacggggaaaacaagtga

SEQ ID NO: 173728 - DNA, 38 bp, Artificial Sequence
  Synthetic oligonucleotide
gcagggtaaagggggaggacggaggtcgacaggagtga

SEQ ID NO: 173729 - DNA, 38 bp, Artificial Sequence
  Synthetic oligonucleotide
agtgcggggggcgggggattggagtcgcggtcgcgtga

SEQ ID NO: 173730 - DNA, 38 bp, Artificial Sequence
  Synthetic oligonucleotide
ggggcaccgatgggggagggtcctacgcgcaggggtga

SEQ ID NO: 173731 - DNA, 38 bp, Artificial Sequence
  Synthetic oligonucleotide
gtaactgtccccccggcataaccacgtcactttggtga

SEQ ID NO: 173732 - DNA, 38 bp, Artificial Sequence
  Synthetic oligonucleotide
atgtggaggggcggggtgggcggaaacctagtatgtga

SEQ ID NO: 173733 - DNA, 37 bp, Artificial Sequence
  Synthetic oligonucleotide
tttggagcaggagcaaagggaagtggggctggtgtga

SEQ ID NO: 173734 - DNA, 38 bp, Artificial Sequence
  Synthetic oligonucleotide
tcacccagtcaggtattccttcgctccaccaacattga

SEQ ID NO: 173735 - DNA, 36 bp, Artificial Sequence
  Synthetic oligonucleotide
aacgctccccgagaggtcgctaccgtttccccttga

SEQ ID NO: 173736 - DNA, 38 bp, Artificial Sequence
  Synthetic oligonucleotide
tacttcagcgccaattgaccttgcctccgccttcttga

SEQ ID NO: 173737 - DNA, 36 bp, Artificial Sequence
  Synthetic oligonucleotide
atgccctgccactgcacctgcccggttttttgaata

SEQ ID NO: 173738 - DNA, 36 bp, Artificial Sequence
  Synthetic oligonucleotide
gtagggaggaggacaaaacgagacagttggaagata

SEQ ID NO: 173739 - DNA, 36 bp, Artificial Sequence
  Synthetic oligonucleotide
agtgctccatcacgcctgatccttgcgttccaccta

SEQ ID NO: 173740 - DNA, 35 bp, Artificial Sequence
  Synthetic oligonucleotide
gatgcccaatttagttgttatgctctccaccccta

SEQ ID NO: 173741 - DNA, 36 bp, Artificial Sequence
  Synthetic oligonucleotide
tccctccgtactgccgattggtatcgtacttcccta

SEQ ID NO: 173742 - DNA, 35 bp, Artificial Sequence
  Synthetic oligonucleotide
ggtcgccacgcttagtccgttcgccctgtctccta

SEQ ID NO: 173743 - DNA, 36 bp, Artificial Sequence
  Synthetic oligonucleotide
attacccacctgagctggacctcgtactttcagcta

SEQ ID NO: 173744 - DNA, 36 bp, Artificial Sequence
  Synthetic oligonucleotide
acttggcccagccccttcctatgaccacttctcgta

SEQ ID NO: 173745 - DNA, 36 bp, Artificial Sequence
  Synthetic oligonucleotide
tacagagccgggcacaaaagggacgggcgaagggta

SEQ ID NO: 173746 - DNA, 36 bp, Artificial Sequence
  Synthetic oligonucleotide
gtacacacattccgctccctccgatagactgctgta

SEQ ID NO: 173747 - DNA, 36 bp, Artificial Sequence
  Synthetic oligonucleotide
aagtccctgccccaccattgtttcatgtaaattgta

SEQ ID NO: 173748 - DNA, 36 bp, Artificial Sequence
  Synthetic oligonucleotide
gtcgcacatgtcaacctgctgctcttcccactctta

SEQ ID NO: 173749 - DNA, 35 bp, Artificial Sequence
  Synthetic oligonucleotide
accccccacgggcacacatctcatattccggacac

SEQ ID NO: 173750 - DNA, 35 bp, Artificial Sequence
  Synthetic oligonucleotide
tttagcggggcacgtcttagttacatcctttccac

SEQ ID NO: 173751 - DNA, 35 bp, Artificial Sequence
  Synthetic oligonucleotide
actcaacccacgaccctgttgctcaaggctctcac

SEQ ID NO: 173752 - DNA, 35 bp, Artificial Sequence
  Synthetic oligonucleotide
gcacgcaagtagtcctgcccccgcgcgcaccatac

SEQ ID NO: 173753 - DNA, 35 bp, Artificial Sequence
  Synthetic oligonucleotide
gcacccgaaggcatcgtgtcgccgaaccctcctac

SEQ ID NO: 173754 - DNA, 35 bp, Artificial Sequence
  Synthetic oligonucleotide
gaccatgctgcacatccccttgctatccgatttac

SEQ ID NO: 173755 - DNA, 35 bp, Artificial Sequence
  Synthetic oligonucleotide
agcgtgcctgcatacataggtattttgcccgcccc

SEQ ID NO: 173756 - DNA, 35 bp, Artificial Sequence
  Synthetic oligonucleotide
gtggggtgggggggcacacacgggggttatcgccc

SEQ ID NO: 173757 - DNA, 35 bp, Artificial Sequence
  Synthetic oligonucleotide
tgcccccgcctcgaatgggtccttctatttcgccc

SEQ ID NO: 173758 - DNA, 35 bp, Artificial Sequence
  Synthetic oligonucleotide
ttgtaccccaccataggcgttcgttgcccctgccc

SEQ ID NO: 173759 - DNA, 35 bp, Artificial Sequence
  Synthetic oligonucleotide
aatgcccgtccagtctctggactctctccgatccc

SEQ ID NO: 173760 - DNA, 35 bp, Artificial Sequence
  Synthetic oligonucleotide
tccgccacccctgcttttcgctcttggcctgtccc

SEQ ID NO: 173761 - DNA, 35 bp, Artificial Sequence
  Synthetic oligonucleotide
tggacctggccacctgtacatgaattctcctagcc

SEQ ID NO: 173762 - DNA, 35 bp, Artificial Sequence
  Synthetic oligonucleotide
gctctgccacgtcgtcgtccccgactcttcacgcc

SEQ ID NO: 173763 - DNA, 35 bp, Artificial Sequence
  Synthetic oligonucleotide
tgtgtaagcgcccgccggcctcctctacctccgcc

SEQ ID NO: 173764 - DNA, 35 bp, Artificial Sequence
  Synthetic oligonucleotide
ttcgatcccgctgtccatttctgtccccgtccgcc

SEQ ID NO: 173765 - DNA, 35 bp, Artificial Sequence
  Synthetic oligonucleotide
tcccgcgaataactgagtttcgtcagctccctgcc

SEQ ID NO: 173766 - DNA, 35 bp, Artificial Sequence
  Synthetic oligonucleotide
gcgaggttcatcctctgttccttctaactcctgcc

SEQ ID NO: 173767 - DNA, 35 bp, Artificial Sequence
  Synthetic oligonucleotide
atcgacacgccttcccagtcgtctattttcactcc

SEQ ID NO: 173768 - DNA, 35 bp, Artificial Sequence
  Synthetic oligonucleotide
ttccccactcgcctcagcctactagtggttcctcc

SEQ ID NO: 173769 - DNA, 35 bp, Artificial Sequence
  Synthetic oligonucleotide
gagacgagcggtgctgtctacttccccggatctcc

SEQ ID NO: 173770 - DNA, 35 bp, Artificial Sequence
  Synthetic oligonucleotide
acttcatgcccggtccgtgccgccacactccgtgc

SEQ ID NO: 173771 - DNA, 35 bp, Artificial Sequence
  Synthetic oligonucleotide
tccacttcctcgtccgttgatgcgcgcgcccttgc

SEQ ID NO: 173772 - DNA, 35 bp, Artificial Sequence
  Synthetic oligonucleotide
tccgttttccgccgccttcgtattacgcttcttgc

SEQ ID NO: 173773 - DNA, 35 bp, Artificial Sequence
  Synthetic oligonucleotide
ttggaacctcccccttgcagagcgcatagctcatc

SEQ ID NO: 173774 - DNA, 35 bp, Artificial Sequence
  Synthetic oligonucleotide
acctatgtacagcgttttacaatgcctgctctatc

SEQ ID NO: 173775 - DNA, 31 bp, Artificial Sequence
  Synthetic oligonucleotide
gacccactgcctcgttcactgactacacctc

SEQ ID NO: 173776 - DNA, 35 bp, Artificial Sequence
  Synthetic oligonucleotide
agtcgtagtccctctctgtaacacgctcccttgtc

SEQ ID NO: 173777 - DNA, 35 bp, Artificial Sequence
  Synthetic oligonucleotide
ggatcataggcgctccatcgtcaatcggccctttc

SEQ ID NO: 173778 - DNA, 35 bp, Artificial Sequence
  Synthetic oligonucleotide
acaaaaggtggagaagggagtacggggaaggtaag

SEQ ID NO: 173779 - DNA, 35 bp, Artificial Sequence
  Synthetic oligonucleotide
aaggacgtaagtcggggtgaaggggaagtaactag

SEQ ID NO: 173780 - DNA, 35 bp, Artificial Sequence
  Synthetic oligonucleotide
gttcaacttcctgctaacatctgtccccctcaacg

SEQ ID NO: 173781 - DNA, 35 bp, Artificial Sequence
  Synthetic oligonucleotide
gatactctcacctcctcgttttatggctcactacg

SEQ ID NO: 173782 - DNA, 35 bp, Artificial Sequence
  Synthetic oligonucleotide
ttcacgacgtccatccctgcctaccgacggtaccg

SEQ ID NO: 173783 - DNA, 35 bp, Artificial Sequence
  Synthetic oligonucleotide
gccacacacagcccttatcgtttgatccccacccg

SEQ ID NO: 173784 - DNA, 35 bp, Artificial Sequence
  Synthetic oligonucleotide
tagttacccccaccactcagatacatgtttgtccg

SEQ ID NO: 173785 - DNA, 35 bp, Artificial Sequence
  Synthetic oligonucleotide
tgtgttccactctccatgcttataatgcctctgcg

SEQ ID NO: 173786 - DNA, 35 bp, Artificial Sequence
  Synthetic oligonucleotide
tcatccccccacgttcatgcaccaacgcgccctcg

SEQ ID NO: 173787 - DNA, 35 bp, Artificial Sequence
  Synthetic oligonucleotide
agccgcctccgccgcccccgccgccctgcctttcg

SEQ ID NO: 173788 - DNA, 35 bp, Artificial Sequence
  Synthetic oligonucleotide
acgcccctccgctatctttaacccagcgcacacgg

SEQ ID NO: 173789 - DNA, 35 bp, Artificial Sequence
  Synthetic oligonucleotide
ttctggtggtggggggtgggcaaataagggcaggg

SEQ ID NO: 173790 - DNA, 35 bp, Artificial Sequence
  Synthetic oligonucleotide
gtgaatcacaaggagggggggtacggggctatggg

SEQ ID NO: 173791 - DNA, 35 bp, Artificial Sequence
  Synthetic oligonucleotide
ctatgctatccaccaggcaggtctatcctccttgg

SEQ ID NO: 173792 - DNA, 35 bp, Artificial Sequence
  Synthetic oligonucleotide
acccccccctccgtacatatccaaagaccaacctg

SEQ ID NO: 173793 - DNA, 35 bp, Artificial Sequence
  Synthetic oligonucleotide
agctacgcactgacccttcgcatccctacgacctg

SEQ ID NO: 173794 - DNA, 35 bp, Artificial Sequence
  Synthetic oligonucleotide
aacgccatccggccacgccccccctacatcttttg

SEQ ID NO: 173795 - DNA, 35 bp, Artificial Sequence
  Synthetic oligonucleotide
ttgtcccgcgccgttcgtgcctggtttccgccaat

SEQ ID NO: 173796 - DNA, 35 bp, Artificial Sequence
  Synthetic oligonucleotide
agtgcaacccggtccttattacgctccctcgacat

SEQ ID NO: 173797 - DNA, 35 bp, Artificial Sequence
  Synthetic oligonucleotide
tcatcccggtctgaagactttcaattttgttccat

SEQ ID NO: 173798 - DNA, 35 bp, Artificial Sequence
  Synthetic oligonucleotide
gcaagggaggactgtggtggtggaaggtgcatcat

SEQ ID NO: 173799 - DNA, 35 bp, Artificial Sequence
  Synthetic oligonucleotide
gttcacccaccccatgctatcgaacgcagtggact

SEQ ID NO: 173800 - DNA, 35 bp, Artificial Sequence
  Synthetic oligonucleotide
ttccgcaccatgtccacccacacgctgtcttgact

SEQ ID NO: 173801 - DNA, 35 bp, Artificial Sequence
  Synthetic oligonucleotide
gcttaacccctgcatgtttctactggtaacaccct

SEQ ID NO: 173802 - DNA, 35 bp, Artificial Sequence
  Synthetic oligonucleotide
catccggtcagacatgccggccccctcgaccccct

SEQ ID NO: 173803 - DNA, 35 bp, Artificial Sequence
  Synthetic oligonucleotide
gctgcaagccgtgcagcaaaacctagttaccccct

SEQ ID NO: 173804 - DNA, 35 bp, Artificial Sequence
  Synthetic oligonucleotide
gacatagctgtccaccgcgtcatcaataccgtcct

SEQ ID NO: 173805 - DNA, 35 bp, Artificial Sequence
  Synthetic oligonucleotide
tacgttccgcacctctaccggttggttctgttcct

SEQ ID NO: 173806 - DNA, 35 bp, Artificial Sequence
  Synthetic oligonucleotide
gtcctctacgcacccacccactgtgttcatctgct

SEQ ID NO: 173807 - DNA, 35 bp, Artificial Sequence
  Synthetic oligonucleotide
ttacacgtgccccacccgccccactgcattgcagt

SEQ ID NO: 173808 - DNA, 35 bp, Artificial Sequence
  Synthetic oligonucleotide
tcactgccttggtttgtgttccgttccacctgggt

SEQ ID NO: 173809 - DNA, 35 bp, Artificial Sequence
  Synthetic oligonucleotide
tccctagctccacgtttgctctccctcgacgttgt

SEQ ID NO: 173810 - DNA, 35 bp, Artificial Sequence
  Synthetic oligonucleotide
agcccgtcaacccacatcgccgcccttctgtcatt

SEQ ID NO: 173811 - DNA, 35 bp, Artificial Sequence
  Synthetic oligonucleotide
gtcgcccttctgcctttgtctagtgcgtgcctctt

SEQ ID NO: 173812 - DNA, 36 bp, Artificial Sequence
  Synthetic oligonucleotide
agagggaagtgcagggagcagggagttgggtggaaa

SEQ ID NO: 173813 - DNA, 36 bp, Artificial Sequence
  Synthetic oligonucleotide
acctccccgcacgggagtgcaccctctccgctgaaa

SEQ ID NO: 173814 - DNA, 35 bp, Artificial Sequence
  Synthetic oligonucleotide
tcagcccccgcaccccttgagtagtaaatctacaa

SEQ ID NO: 173815 - DNA, 36 bp, Artificial Sequence
  Synthetic oligonucleotide
atccgtacagacgtgtcctcgtttctgtctctccaa

SEQ ID NO: 173816 - DNA, 38 bp, Artificial Sequence
  Synthetic oligonucleotide
tacatccactcgcctgcttggccgccccttctacggaa

SEQ ID NO: 173817 - DNA, 32 bp, Artificial Sequence
  Synthetic oligonucleotide
acgcgagactgcggaagggagggcgatagtaa

SEQ ID NO: 173818 - DNA, 36 bp, Artificial Sequence
  Synthetic oligonucleotide
ggtccccgccagcttctaacttcagctcgaccccca

SEQ ID NO: 173819 - DNA, 37 bp, Artificial Sequence
  Synthetic oligonucleotide
tagcgcatctatgccctccgtttcagcccccccccca

SEQ ID NO: 173820 - DNA, 36 bp, Artificial Sequence
  Synthetic oligonucleotide
agatcagacacacatatcggttcatgcctcgcccca

SEQ ID NO: 173821 - DNA, 36 bp, Artificial Sequence
  Synthetic oligonucleotide
gcaaccccgggccctctcaatgactgcacattgcca

SEQ ID NO: 173822 - DNA, 36 bp, Artificial Sequence
  Synthetic oligonucleotide
tatctgccctcaacatccatatctgaacacttgcca

SEQ ID NO: 173823 - DNA, 35 bp, Artificial Sequence
  Synthetic oligonucleotide
tgctatcccccggccatgacccatgcccttctcca

SEQ ID NO: 173824 - DNA, 36 bp, Artificial Sequence
  Synthetic oligonucleotide
acccaccccccatacgctcggtccggacaggttcca

SEQ ID NO: 173825 - DNA, 36 bp, Artificial Sequence
  Synthetic oligonucleotide
gcgtccccgtcctcgttctcctgtctttgacacgca

SEQ ID NO: 173826 - DNA, 35 bp, Artificial Sequence
  Synthetic oligonucleotide
tgatgtagccctgcttggtttaaccacccgccgca

SEQ ID NO: 173827 - DNA, 36 bp, Artificial Sequence
  Synthetic oligonucleotide
accgcctggctcattctaccgtctcagtcaatatca

SEQ ID NO: 173828 - DNA, 37 bp, Artificial Sequence
  Synthetic oligonucleotide
gagcgacgggtccgcgctaatccacctctctaccaga

SEQ ID NO: 173829 - DNA, 36 bp, Artificial Sequence
  Synthetic oligonucleotide
gtgatcgaagggtgggcggagggagaggttttgaga

SEQ ID NO: 173830 - DNA, 37 bp, Artificial Sequence
  Synthetic oligonucleotide
gacctcgccgccattgtacgtccacccccattgtaga

SEQ ID NO: 173831 - DNA, 37 bp, Artificial Sequence
  Synthetic oligonucleotide
accccaccgctgaccagccgccctgtcgcgccaccga

SEQ ID NO: 173832 - DNA, 37 bp, Artificial Sequence
  Synthetic oligonucleotide
ttcagctccggttcgcccctgctcctgcctgccccga

SEQ ID NO: 173833 - DNA, 37 bp, Artificial Sequence
  Synthetic oligonucleotide
atagcctgccattgcaataggttccatttcctcccga

SEQ ID NO: 173834 - DNA, 37 bp, Artificial Sequence
  Synthetic oligonucleotide
gaccggggtgggagatgggagaggattgagatgccga

SEQ ID NO: 173835 - DNA, 37 bp, Artificial Sequence
  Synthetic oligonucleotide
gacccaacccgcttcccgttcccagccttactggcga

SEQ ID NO: 173836 - DNA, 37 bp, Artificial Sequence
  Synthetic oligonucleotide
atggagggtgcgggagggttgggcagttcagaatcga

SEQ ID NO: 173837 - DNA, 36 bp, Artificial Sequence
  Synthetic oligonucleotide
tgaccccactccttctgtatcactgcataggctcga

SEQ ID NO: 173838 - DNA, 37 bp, Artificial Sequence
  Synthetic oligonucleotide
acccacgtttgcaagttctcaccgttcaccccccgga

SEQ ID NO: 173839 - DNA, 37 bp, Artificial Sequence
  Synthetic oligonucleotide
gagtttagaggaagagagggagggaggggccagggga

SEQ ID NO: 173840 - DNA, 37 bp, Artificial Sequence
  Synthetic oligonucleotide
aagggagggagggaatgaactgggtaggtatagggga

SEQ ID NO: 173841 - DNA, 37 bp, Artificial Sequence
  Synthetic oligonucleotide
gtacaccgggaggtgggagataaagggcactgtggga

SEQ ID NO: 173842 - DNA, 36 bp, Artificial Sequence
  Synthetic oligonucleotide
gaaccgcacaggggtagggaatggaggtgaaatgga

SEQ ID NO: 173843 - DNA, 38 bp, Artificial Sequence
  Synthetic oligonucleotide
agttggccagggcgggacgaatggggaaggcgggatga

SEQ ID NO: 173844 - DNA, 38 bp, Artificial Sequence
  Synthetic oligonucleotide
gtggggagggcgacgggtgggcgctaatatgcgtatga

SEQ ID NO: 173845 - DNA, 37 bp, Artificial Sequence
  Synthetic oligonucleotide
atccaccctcccatctgcatggagcccactaacctga

SEQ ID NO: 173846 - DNA, 38 bp, Artificial Sequence
  Synthetic oligonucleotide
ttgcaccatcggacagattcgtacgtccctccccctga

SEQ ID NO: 173847 - DNA, 38 bp, Artificial Sequence
  Synthetic oligonucleotide
gcccaccgcccctgttgtccgttagcatcagcccctga

SEQ ID NO: 173848 - DNA, 37 bp, Artificial Sequence
  Synthetic oligonucleotide
atgcaccctcgcaatgtggctgttcctcccggcctga

SEQ ID NO: 173849 - DNA, 38 bp, Artificial Sequence
  Synthetic oligonucleotide
actctccgccgcatccacgcccgctacgtatcccgtga

SEQ ID NO: 173850 - DNA, 38 bp, Artificial Sequence
  Synthetic oligonucleotide
gggattagcgtgcgtgggtcggggcgggcgggaggtga

SEQ ID NO: 173851 - DNA, 38 bp, Artificial Sequence
  Synthetic oligonucleotide
gagacagtctgggtgagaggaatggggacagtaggtga

SEQ ID NO: 173852 - DNA, 38 bp, Artificial Sequence
  Synthetic oligonucleotide
gtgtaggtgcggggggagggtctgggaggggatattga

SEQ ID NO: 173853 - DNA, 37 bp, Artificial Sequence
  Synthetic oligonucleotide
tctacaccccgtgaactggtttcttctcacaccttga

SEQ ID NO: 173854 - DNA, 37 bp, Artificial Sequence
  Synthetic oligonucleotide
acttcgccctctgataatgccttgcacttccccttga

SEQ ID NO: 173855 - DNA, 38 bp, Artificial Sequence
  Synthetic oligonucleotide
actccacattgagctccatcgcccagtacacttgttga

SEQ ID NO: 173856 - DNA, 38 bp, Artificial Sequence
  Synthetic oligonucleotide
acccaccctcccacgagcttcggagacggtcttgttga

SEQ ID NO: 173857 - DNA, 36 bp, Artificial Sequence
  Synthetic oligonucleotide
taaccccgcctctctgttacttggttgttctatata

SEQ ID NO: 173858 - DNA, 37 bp, Artificial Sequence
  Synthetic oligonucleotide
gatcagtgccctactcgctcactctagagacggtata

SEQ ID NO: 173859 - DNA, 36 bp, Artificial Sequence
  Synthetic oligonucleotide
tgcgactcccccgttgcttctgactccttgcgacta

SEQ ID NO: 173860 - DNA, 36 bp, Artificial Sequence
  Synthetic oligonucleotide
tctcgttcacatccccgttattgcccgttgtgccta

SEQ ID NO: 173861 - DNA, 36 bp, Artificial Sequence
  Synthetic oligonucleotide
acccaccactgctagaatacgtattccgtgccgcta

SEQ ID NO: 173862 - DNA, 36 bp, Artificial Sequence
  Synthetic oligonucleotide
gtagcgccacgggcgggaagggcgagggccgcgcta

SEQ ID NO: 173863 - DNA, 35 bp, Artificial Sequence
  Synthetic oligonucleotide
gccaacctcactgttgtccccctccctcagtgcta

SEQ ID NO: 173864 - DNA, 36 bp, Artificial Sequence
  Synthetic oligonucleotide
gccgccctgccatatcgtcctttacggtgaactgta

SEQ ID NO: 173865 - DNA, 36 bp, Artificial Sequence
  Synthetic oligonucleotide
gcccagagacgggagggaagggaaggggcagttgta

SEQ ID NO: 173866 - DNA, 36 bp, Artificial Sequence
  Synthetic oligonucleotide
gcccaacctcactctccatactagagcccgacctta

SEQ ID NO: 173867 - DNA, 35 bp, Artificial Sequence
  Synthetic oligonucleotide
gttgttacccgccgtgccactgatcgacaccttta

SEQ ID NO: 173868 - DNA, 36 bp, Artificial Sequence
  Synthetic oligonucleotide
atggacaacgctagtatgtcctactttgtcctttta

SEQ ID NO: 173869 - DNA, 35 bp, Artificial Sequence
  Synthetic oligonucleotide
acctctacatacacccgtgttcagtgcctccccac

SEQ ID NO: 173870 - DNA, 35 bp, Artificial Sequence
  Synthetic oligonucleotide
accactggtcagcaacgccttatctagcgcctcac

SEQ ID NO: 173871 - DNA, 35 bp, Artificial Sequence
  Synthetic oligonucleotide
gcgcaacgtgccgcacgccactgtcccgatcctac

SEQ ID NO: 173872 - DNA, 35 bp, Artificial Sequence
  Synthetic oligonucleotide
acgtaggacgcgattcgttctgggccccctcaccc

SEQ ID NO: 173873 - DNA, 35 bp, Artificial Sequence
  Synthetic oligonucleotide
gtggacctacaaatgtttattccccggtcgccccc

SEQ ID NO: 173874 - DNA, 35 bp, Artificial Sequence
  Synthetic oligonucleotide
ccctcctccacttgtcacaggcccctcgtagcccc

SEQ ID NO: 173875 - DNA, 35 bp, Artificial Sequence
  Synthetic oligonucleotide
agacccctgactatcgcttaccccaggtctgcccc

SEQ ID NO: 173876 - DNA, 35 bp, Artificial Sequence
  Synthetic oligonucleotide
accggtctccacctaccgcctatatacgcactccc

SEQ ID NO: 173877 - DNA, 35 bp, Artificial Sequence
  Synthetic oligonucleotide
tctggatctgttcgcgttatccctgccgtgctccc

SEQ ID NO: 173878 - DNA, 35 bp, Artificial Sequence
  Synthetic oligonucleotide
accctcacgcggtatttttgcacgcatgttctccc

SEQ ID NO: 173879 - DNA, 35 bp, Artificial Sequence
  Synthetic oligonucleotide
tttgcgatgcagccctccgatcaaagcctcttccc

SEQ ID NO: 173880 - DNA, 35 bp, Artificial Sequence
  Synthetic oligonucleotide
tgatcagacgcctggcttgcctactccgatttccc

SEQ ID NO: 173881 - DNA, 35 bp, Artificial Sequence
  Synthetic oligonucleotide
accaacgataaccagtcgcgcactccgccgtagcc

SEQ ID NO: 173882 - DNA, 35 bp, Artificial Sequence
  Synthetic oligonucleotide
gtgggcgcgtagcttagttgatctaccaccctgcc

SEQ ID NO: 173883 - DNA, 35 bp, Artificial Sequence
  Synthetic oligonucleotide
tacagggcgtccctaatggctccatctttccatcc

SEQ ID NO: 173884 - DNA, 27 bp, Artificial Sequence
  Synthetic oligonucleotide
tacctgcgcaactcgcggtgcccctcc

SEQ ID NO: 173885 - DNA, 35 bp, Artificial Sequence
  Synthetic oligonucleotide
gaaaccagccctacatcgatcttcccccggcctcc

SEQ ID NO: 173886 - DNA, 35 bp, Artificial Sequence
  Synthetic oligonucleotide
gagccacctctaatcatctatatatgcattgctcc

SEQ ID NO: 173887 - DNA, 35 bp, Artificial Sequence
  Synthetic oligonucleotide
acacgccgctcaatctgtctatcacgctcttctcc

SEQ ID NO: 173888 - DNA, 35 bp, Artificial Sequence
  Synthetic oligonucleotide
gccgcagtcaccacacggctcatattgtgttctcc

SEQ ID NO: 173889 - DNA, 35 bp, Artificial Sequence
  Synthetic oligonucleotide
aacaagtcagtctgtgcctcctgccctcccagtcc

SEQ ID NO: 173890 - DNA, 35 bp, Artificial Sequence
  Synthetic oligonucleotide
acctcccgctctttcgttctccttcagtggtgtcc

SEQ ID NO: 173891 - DNA, 35 bp, Artificial Sequence
  Synthetic oligonucleotide
gatggtcctcacagtaatccagcccgcccacacgc

SEQ ID NO: 173892 - DNA, 35 bp, Artificial Sequence
  Synthetic oligonucleotide
tcattgcgcacatattatcacgtttcaccacccgc

SEQ ID NO: 173893 - DNA, 35 bp, Artificial Sequence
  Synthetic oligonucleotide
tgttaccggacaaaagcatcttggactacctccgc

SEQ ID NO: 173894 - DNA, 35 bp, Artificial Sequence
  Synthetic oligonucleotide
tactatccatcccagtgcccgcctaagcccatggc

SEQ ID NO: 173895 - DNA, 35 bp, Artificial Sequence
  Synthetic oligonucleotide
aactgaaaccccagccccgtacatgaccccggtgc

SEQ ID NO: 173896 - DNA, 35 bp, Artificial Sequence
  Synthetic oligonucleotide
ttgaacgcgcacatcttccagctccggtcgtttgc

SEQ ID NO: 173897 - DNA, 35 bp, Artificial Sequence
  Synthetic oligonucleotide
tttagcatcctgctccgcccgacctggtactactc

SEQ ID NO: 173898 - DNA, 35 bp, Artificial Sequence
  Synthetic oligonucleotide
gccaggcgttggtaaattgggctccctcgtacctc

SEQ ID NO: 173899 - DNA, 35 bp, Artificial Sequence
  Synthetic oligonucleotide
gtggacctaccactgtctgtcttccattttgcctc

SEQ ID NO: 173900 - DNA, 35 bp, Artificial Sequence
  Synthetic oligonucleotide
ttgccatggtgcacctatgcttcattcctccgctc

SEQ ID NO: 173901 - DNA, 35 bp, Artificial Sequence
  Synthetic oligonucleotide
cctggcaggcacaatctgtttcttactactcgctc

SEQ ID NO: 173902 - DNA, 35 bp, Artificial Sequence
  Synthetic oligonucleotide
atccgtctgccatcccatttcatgctcgcactctc

SEQ ID NO: 173903 - DNA, 35 bp, Artificial Sequence
  Synthetic oligonucleotide
tttacctggcgctctccggctgtcaccattctgtc

SEQ ID NO: 173904 - DNA, 35 bp, Artificial Sequence
  Synthetic oligonucleotide
gaccaatccccttcgctccacgctgttgtaccttc

SEQ ID NO: 173905 - DNA, 35 bp, Artificial Sequence
  Synthetic oligonucleotide
tccagttcagttttccgctcccgcctgttgtcttc

SEQ ID NO: 173906 - DNA, 35 bp, Artificial Sequence
  Synthetic oligonucleotide
gcaccctccattgcattccaatgcacaccccttag

SEQ ID NO: 173907 - DNA, 35 bp, Artificial Sequence
  Synthetic oligonucleotide
gtcacactcgtcttatccgccctcacgacctttag

SEQ ID NO: 173908 - DNA, 35 bp, Artificial Sequence
  Synthetic oligonucleotide
gacccactcgccgctatgcaccctcctgatgtgcg

SEQ ID NO: 173909 - DNA, 35 bp, Artificial Sequence
  Synthetic oligonucleotide
acgtgcgccatcctgatcccgttggtcttttttcg

SEQ ID NO: 173910 - DNA, 35 bp, Artificial Sequence
  Synthetic oligonucleotide
agatccagcaagtggggggcggggaagttgacggg

SEQ ID NO: 173911 - DNA, 35 bp, Artificial Sequence
  Synthetic oligonucleotide
gaggaacgtggagagggagactggagggggtaatg

SEQ ID NO: 173912 - DNA, 35 bp, Artificial Sequence
  Synthetic oligonucleotide
tcacatgtccacgttttataatcttctcctaactg

SEQ ID NO: 173913 - DNA, 35 bp, Artificial Sequence
  Synthetic oligonucleotide
ttcctaccactagtgctcatgggacccttttcctg

SEQ ID NO: 173914 - DNA, 35 bp, Artificial Sequence
  Synthetic oligonucleotide
ccatcctccgacgccgtcccgccttgcattatctg

SEQ ID NO: 173915 - DNA, 35 bp, Artificial Sequence
  Synthetic oligonucleotide
ggtcccgtccctgctcatcgcatctcttatgtctg

SEQ ID NO: 173916 - DNA, 36 bp, Artificial Sequence
  Synthetic oligonucleotide
gagggggacattgcgggagggatgcagctgtaggtg

SEQ ID NO: 173917 - DNA, 35 bp, Artificial Sequence
  Synthetic oligonucleotide
gacgggttggggaggagagtgactatgagggtgtg

SEQ ID NO: 173918 - DNA, 35 bp, Artificial Sequence
  Synthetic oligonucleotide
acacaccacttaacatgttcgccgttccgctcttg

SEQ ID NO: 173919 - DNA, 35 bp, Artificial Sequence
  Synthetic oligonucleotide
actactgccggtgctcatgaaacgcgctctatcct

SEQ ID NO: 173920 - DNA, 35 bp, Artificial Sequence
  Synthetic oligonucleotide
accccaccctcctggctcgaggacctccatttcct

SEQ ID NO: 173921 - DNA, 35 bp, Artificial Sequence
  Synthetic oligonucleotide
atcccctgccaggttagcatcccaagcactttcct

SEQ ID NO: 173922 - DNA, 35 bp, Artificial Sequence
  Synthetic oligonucleotide
tccagcctcgtttcggccatcaacaacgcttctct

SEQ ID NO: 173923 - DNA, 35 bp, Artificial Sequence
  Synthetic oligonucleotide
gtgagaggggcggggaatcagctacgaggaaaggt

SEQ ID NO: 173924 - DNA, 35 bp, Artificial Sequence
  Synthetic oligonucleotide
gacctgttcacatggctccggtgttctccccctgt

SEQ ID NO: 173925 - DNA, 35 bp, Artificial Sequence
  Synthetic oligonucleotide
gaccgcccgccctctgctaaaggcaccctgccctt

SEQ ID NO: 173926 - DNA, 35 bp, Artificial Sequence
  Synthetic oligonucleotide
gtcgaccgttgttgagccttccgtgccctcatctt

SEQ ID NO: 173927 - DNA, 35 bp, Artificial Sequence
  Synthetic oligonucleotide
actgtggagcgtgtcgcaccatcctgaccctgttt

SEQ ID NO: 173928 - DNA, 36 bp, Artificial Sequence
  Synthetic oligonucleotide
ggtggggtatgcggggggaaaggggattggaccaaa

SEQ ID NO: 173929 - DNA, 36 bp, Artificial Sequence
  Synthetic oligonucleotide
tgtcccccggccaccatctgcatacgttcccgctaa

SEQ ID NO: 173930 - DNA, 36 bp, Artificial Sequence
  Synthetic oligonucleotide
ttcgactccccacccttgaatggtttacgaccttaa

SEQ ID NO: 173931 - DNA, 36 bp, Artificial Sequence
  Synthetic oligonucleotide
ttggcggccatcatggtcctgcctcgccttccttaa

SEQ ID NO: 173932 - DNA, 35 bp, Artificial Sequence
  Synthetic oligonucleotide
gccaggcccgcccgtctctacgcttgcccctaaca

SEQ ID NO: 173933 - DNA, 36 bp, Artificial Sequence
  Synthetic oligonucleotide
aatagccgccctcacccgcaatgtccttagccacca

SEQ ID NO: 173934 - DNA, 36 bp, Artificial Sequence
  Synthetic oligonucleotide
tcaccatctcccgacttacgatgccatctcgtacca

SEQ ID NO: 173935 - DNA, 35 bp, Artificial Sequence
  Synthetic oligonucleotide
tcagtcccgcctcctacgtccttttgtgctgccca

SEQ ID NO: 173936 - DNA, 35 bp, Artificial Sequence
  Synthetic oligonucleotide
acgccacttatacgcattgcatattcaccatccca

SEQ ID NO: 173937 - DNA, 36 bp, Artificial Sequence
  Synthetic oligonucleotide
tccgccgctctgcaagctcactttcgggccttccca

SEQ ID NO: 173938 - DNA, 35 bp, Artificial Sequence
  Synthetic oligonucleotide
actcctaccgcggcctaagctccactggttctgca

SEQ ID NO: 173939 - DNA, 36 bp, Artificial Sequence
  Synthetic oligonucleotide
acctacccatccgacaccacacggtgcccacttgca

SEQ ID NO: 173940 - DNA, 36 bp, Artificial Sequence
  Synthetic oligonucleotide
atgcacccacacattagattccacccgcaatttgca

SEQ ID NO: 173941 - DNA, 36 bp, Artificial Sequence
  Synthetic oligonucleotide
gacaccctcttatcgatctgtagccagcctttgtca

SEQ ID NO: 173942 - DNA, 37 bp, Artificial Sequence
  Synthetic oligonucleotide
attggggtccgatagggggggagtggaatgctgcaga

SEQ ID NO: 173943 - DNA, 37 bp, Artificial Sequence
  Synthetic oligonucleotide
ggtcgggagggaggggactggagcaagcgacaagaga

SEQ ID NO: 173944 - DNA, 37 bp, Artificial Sequence
  Synthetic oligonucleotide
gggtgggggagactggcgaatatgggaggggtcgaga

SEQ ID NO: 173945 - DNA, 37 bp, Artificial Sequence
  Synthetic oligonucleotide
gtgagaaatgacggaggagcggcatgggagagggaga

SEQ ID NO: 173946 - DNA, 37 bp, Artificial Sequence
  Synthetic oligonucleotide
aagactcgtgaggacgggacgggtggaaggatggaga

SEQ ID NO: 173947 - DNA, 37 bp, Artificial Sequence; identical to SEQ ID NO: 75327
  Synthetic oligonucleotide

SEQ ID NO: 173948 - DNA, 37 bp, Artificial Sequence
  Synthetic oligonucleotide
ggccactcgcattgctacctctcgcgttccaccccga

SEQ ID NO: 173949 - DNA, 37 bp, Artificial Sequence
  Synthetic oligonucleotide
agcccggaggtggcgtggatggatgggtggaatccga

SEQ ID NO: 173950 - DNA, 37 bp, Artificial Sequence
  Synthetic oligonucleotide
tttcacctcacaaggctatcgcaaccagtccgagcga

SEQ ID NO: 173951 - DNA, 37 bp, Artificial Sequence
  Synthetic oligonucleotide
tctatgctgttcatcccaccggccgcccctcccgcga

SEQ ID NO: 173952 - DNA, 37 bp, Artificial Sequence
  Synthetic oligonucleotide
gtcatgtaacgatctgttgttccgctgccctcctcga

SEQ ID NO: 173953 - DNA, 37 bp, Artificial Sequence
  Synthetic oligonucleotide
atgactgggagggggggagtgagtccagcggattcga

SEQ ID NO: 173954 - DNA, 37 bp, Artificial Sequence
  Synthetic oligonucleotide
acgcgcacccgtacattgctggcttccacctcttcga

SEQ ID NO: 173955 - DNA, 37 bp, Artificial Sequence
  Synthetic oligonucleotide
taggtgcagcatagtgcggggggtggggcaacgggga

SEQ ID NO: 173956 - DNA, 37 bp, Artificial Sequence
  Synthetic oligonucleotide
gttgctggggccgcaaggggatcggggaactggggga

SEQ ID NO: 173957 - DNA, 37 bp, Artificial Sequence
  Synthetic oligonucleotide
gacgggaggggcatacggagagaaaatgggaatggga

SEQ ID NO: 173958 - DNA, 37 bp, Artificial Sequence
  Synthetic oligonucleotide
tgcagtaccacccgtgatcatattgccccccactgga

SEQ ID NO: 173959 - DNA, 38 bp, Artificial Sequence
  Synthetic oligonucleotide
gtacccgccacccccgtcaccgtcggttcgccgaatga

SEQ ID NO: 173960 - DNA, 38 bp, Artificial Sequence
  Synthetic oligonucleotide
ttggaggcacagccgttcctgcccccattccttcatga

SEQ ID NO: 173961 - DNA, 38 bp, Artificial Sequence
  Synthetic oligonucleotide
gggtgggaggtgcgaaggagaaacgaggggacggatga

SEQ ID NO: 173962 - DNA, 38 bp, Artificial Sequence
  Synthetic oligonucleotide
acgaagcagtatagcggggggcggaggacggctgatga

SEQ ID NO: 173963 - DNA, 38 bp, Artificial Sequence
  Synthetic oligonucleotide
gctgcgggtggggggcgcagggagggcagtaaaactga

SEQ ID NO: 173964 - DNA, 37 bp, Artificial Sequence
  Synthetic oligonucleotide
atggcgtgtcggcgccacatgcactgccctaccctga

SEQ ID NO: 173965 - DNA, 26 bp, Artificial Sequence
  Synthetic oligonucleotide
gacctgggccctgtactacctcctga

SEQ ID NO: 173966 - DNA, 37 bp, Artificial Sequence
  Synthetic oligonucleotide
tgccaagtgcgcttccccctttggacgttcttcctga

SEQ ID NO: 173967 - DNA, 38 bp, Artificial Sequence
  Synthetic oligonucleotide
cccccgcacagccttgtgcctatgtcctctctcgctga

SEQ ID NO: 173968 - DNA, 36 bp, Artificial Sequence
  Synthetic oligonucleotide
ttccaccaacacggtctctaagtttcctgtcgctga

SEQ ID NO: 173969 - DNA, 38 bp, Artificial Sequence
  Synthetic oligonucleotide
gagtgccctcatactgactcccccactccacttcgtga

SEQ ID NO: 173970 - DNA, 38 bp, Artificial Sequence
  Synthetic oligonucleotide
gtaggagggggaggtgcccatggtgatgacgggggtga

SEQ ID NO: 173971 - DNA, 35 bp, Artificial Sequence
  Synthetic oligonucleotide
gtgcccgccatcttcccccccaatgtcttatgtga

SEQ ID NO: 173972 - DNA, 37 bp, Artificial Sequence
  Synthetic oligonucleotide
gatgcactttcacccgggctaccctgtcactctgtga

SEQ ID NO: 173973 - DNA, 38 bp, Artificial Sequence
  Synthetic oligonucleotide
tgcgcggggacaaggtggcgggctgggggagtctgtga

SEQ ID NO: 173974 - DNA, 38 bp, Artificial Sequence
  Synthetic oligonucleotide
atcgcgcccctgcttctttcgcatcactaccgttgtga

SEQ ID NO: 173975 - DNA, 37 bp, Artificial Sequence
  Synthetic oligonucleotide
tttgatgcaggtgtgtctcgtcccatacctcccttga

SEQ ID NO: 173976 - DNA, 36 bp, Artificial Sequence
  Synthetic oligonucleotide
aggaccgccggcctcttgcctctgtaacatcccata

SEQ ID NO: 173977 - DNA, 36 bp, Artificial Sequence
  Synthetic oligonucleotide
tacgcctccctctgcgaccaccgcacatttttacta

SEQ ID NO: 173978 - DNA, 36 bp, Artificial Sequence
  Synthetic oligonucleotide
gtaacgaggtgaagtggggggagcggtggggaccta

SEQ ID NO: 173979 - DNA, 36 bp, Artificial Sequence
  Synthetic oligonucleotide
accatcgccaatacgctgtccctagatccctcccta

SEQ ID NO: 173980 - DNA, 35 bp, Artificial Sequence
  Synthetic oligonucleotide
acagctcccgggccgccctagtaagttcctcccta

SEQ ID NO: 173981 - DNA, 35 bp, Artificial Sequence
  Synthetic oligonucleotide
gccaccagcccgacttgcagctctcgaatcctaac

SEQ ID NO: 173982 - DNA, 35 bp, Artificial Sequence
  Synthetic oligonucleotide
ttacctcatccgctggaacgtgactgcctgttaac

SEQ ID NO: 173983 - DNA, 35 bp, Artificial Sequence
  Synthetic oligonucleotide
tcagcaagcctccgactggaaaattgccgcaccac

SEQ ID NO: 173984 - DNA, 32 bp, Artificial Sequence
  Synthetic oligonucleotide
agcaacgcctcagcccaccgaatgccgcccac

SEQ ID NO: 173985 - DNA, 36 bp, Artificial Sequence
  Synthetic oligonucleotide
aactatccgccctgtgacctgtgctctgtcatccac

SEQ ID NO: 173986 - DNA, 35 bp, Artificial Sequence
  Synthetic oligonucleotide
tcgcgtttcccaggctcctgttattcgtttgtcac

SEQ ID NO: 173987 - DNA, 35 bp, Artificial Sequence
  Synthetic oligonucleotide
gatgacacctttcccagcctggggcctctattcac

SEQ ID NO: 173988 - DNA, 35 bp, Artificial Sequence
  Synthetic oligonucleotide
aatcgactgtccgttcgttcctcaacattcttcac

SEQ ID NO: 173989 - DNA, 35 bp, Artificial Sequence
  Synthetic oligonucleotide
aaggtccctccctacgcattgcctgttctatcgac

SEQ ID NO: 173990 - DNA, 35 bp, Artificial Sequence
  Synthetic oligonucleotide
acatccgcccctgatcacgtttccttcactcgtac

SEQ ID NO: 173991 - DNA, 35 bp, Artificial Sequence
  Synthetic oligonucleotide
tcatcttccgctccgcccgacgctcgtttatttac

SEQ ID NO: 173992 - DNA, 35 bp, Artificial Sequence
  Synthetic oligonucleotide
gtactgtcctccgctgatagacctccggtttttac

SEQ ID NO: 173993 - DNA, 35 bp, Artificial Sequence
  Synthetic oligonucleotide
acttccgacgcctccctctaacttccgtgagaacc

SEQ ID NO: 173994 - DNA, 35 bp, Artificial Sequence
  Synthetic oligonucleotide
ggatgcaacccctctgttctatctccaggcccacc

SEQ ID NO: 173995 - DNA, 35 bp, Artificial Sequence
  Synthetic oligonucleotide
atcaacgccctgcccacttgattggccccagcacc

SEQ ID NO: 173996 - DNA, 35 bp, Artificial Sequence
  Synthetic oligonucleotide
ttagcctcggccgcatttcgtacctatttcgcacc

SEQ ID NO: 173997 - DNA, 35 bp, Artificial Sequence
  Synthetic oligonucleotide
gacatcggacagatctcgtttaccgttccgcaccc

SEQ ID NO: 173998 - DNA, 35 bp, Artificial Sequence
  Synthetic oligonucleotide
aagacccggtcaccccgtctgtatttttacccccc

SEQ ID NO: 173999 - DNA, 35 bp, Artificial Sequence
  Synthetic oligonucleotide
ggaaggaggcatgcccggtccccgctacccgcccc

SEQ ID NO: 174000 - DNA, 35 bp, Artificial Sequence
  Synthetic oligonucleotide
gtaccctcgaggtgtctctaacttgtcaacctccc

SEQ ID NO: 174001 - DNA, 35 bp, Artificial Sequence
  Synthetic oligonucleotide
gtgggccgatcgtgggtacccgtgtctcttttccc

SEQ ID NO: 174002 - DNA, 35 bp, Artificial Sequence
  Synthetic oligonucleotide
tcggtttcatgcctcgcgcgccccacgccttatcc

SEQ ID NO: 174003 - DNA, 35 bp, Artificial Sequence
  Synthetic oligonucleotide
cacacgtcacctggcccgtcgttcattctaactcc

SEQ ID NO: 174004 - DNA, 35 bp, Artificial Sequence
  Synthetic oligonucleotide
gaggcccactgtctcttgcgtcatcaccaccctcc

SEQ ID NO: 174005 - DNA, 35 bp, Artificial Sequence
  Synthetic oligonucleotide
aattccgcacctgccccgcgcttgcaccttgctcc

SEQ ID NO: 174006 - DNA, 35 bp, Artificial Sequence
  Synthetic oligonucleotide
accccatcgccacaccgtctgccgattcctgttcc

SEQ ID NO: 174007 - DNA, 35 bp, Artificial Sequence
  Synthetic oligonucleotide
gaacattccatcgcatgattgcgccgcctgtttcc

SEQ ID NO: 174008 - DNA, 36 bp, Artificial Sequence
  Synthetic oligonucleotide
gccttatgcacaatgtcttcctgccgtactatccgc

SEQ ID NO: 174009 - DNA, 35 bp, Artificial Sequence
  Synthetic oligonucleotide
gggattacgcccctctcttattcgttctgctccgc

SEQ ID NO: 174010 - DNA, 35 bp, Artificial Sequence
  Synthetic oligonucleotide
aaccccctccgcacgagacccttcgaggattatgc

SEQ ID NO: 174011 - DNA, 35 bp, Artificial Sequence
  Synthetic oligonucleotide
gcgattacactcgaccgcctgcccataaaccctgc

SEQ ID NO: 174012 - DNA, 35 bp, Artificial Sequence
  Synthetic oligonucleotide
tgtgcctcatcagccctacccctgtgcgcgccatc

SEQ ID NO: 174013 - DNA, 35 bp, Artificial Sequence
  Synthetic oligonucleotide
acggaacgccgtctgttcccctagctctctcactc

SEQ ID NO: 174014 - DNA, 35 bp, Artificial Sequence
  Synthetic oligonucleotide
acgcgcctaccatgatcgccctgaactcgaacctc

SEQ ID NO: 174015 - DNA, 35 bp, Artificial Sequence
  Synthetic oligonucleotide
accactcctccgtgcgcctttcctagctccccctc

SEQ ID NO: 174016 - DNA, 35 bp, Artificial Sequence
  Synthetic oligonucleotide
gaggtgctgtcctcgtccgccttacttgttccctc

SEQ ID NO: 174017 - DNA, 35 bp, Artificial Sequence
  Synthetic oligonucleotide
aacccaccgtccgcgcgcttacacagaggaatctc

SEQ ID NO: 174018 - DNA, 35 bp, Artificial Sequence
  Synthetic oligonucleotide
aacacccgcacccttttttgcgcccgactctggtc

SEQ ID NO: 174019 - DNA, 35 bp, Artificial Sequence
  Synthetic oligonucleotide
ttagccccccccgtactgtagcgccgtgtcacttc

SEQ ID NO: 174020 - DNA, 36 bp, Artificial Sequence
  Synthetic oligonucleotide
gatccgccgggtcccattttcatgcccatcgcccag

SEQ ID NO: 174021 - DNA, 35 bp, Artificial Sequence
  Synthetic oligonucleotide
tcgttgctcgcttcgttttttcccaccccgccacg

SEQ ID NO: 174022 - DNA, 34 bp, Artificial Sequence
  Synthetic oligonucleotide
taacaaacctcttgctgctctctccgtggccacg

SEQ ID NO: 174023 - DNA, 35 bp, Artificial Sequence
  Synthetic oligonucleotide
tatgcccttcctccatactagtgatatcttgcacg

SEQ ID NO: 174024 - DNA, 35 bp, Artificial Sequence
  Synthetic oligonucleotide
gaatactccccacctggaccccacggattgcaccg

SEQ ID NO: 174025 - DNA, 35 bp, Artificial Sequence
  Synthetic oligonucleotide
gtttatgcccgtaatctcgccgtgaggaccccccg

SEQ ID NO: 174026 - DNA, 35 bp, Artificial Sequence
  Synthetic oligonucleotide
gtacgtcacaccccacctctagttgtgctatcccg

SEQ ID NO: 174027 - DNA, 35 bp, Artificial Sequence
  Synthetic oligonucleotide
tgtcccaccttgtctcgctaatgccatctgtcccg

SEQ ID NO: 174028 - DNA, 35 bp, Artificial Sequence
  Synthetic oligonucleotide
gccgatcgcccacctcgccccatacaccaggtgcg

SEQ ID NO: 174029 - DNA, 35 bp, Artificial Sequence
  Synthetic oligonucleotide
accacacgcgccgccttccatgtacaccgccctcg

SEQ ID NO: 174030 - DNA, 35 bp, Artificial Sequence
  Synthetic oligonucleotide
tgtgtcgatcacgatcggctttccctacctcctcg

SEQ ID NO: 174031 - DNA, 35 bp, Artificial Sequence
  Synthetic oligonucleotide
gagtagtggacgggcagataagagctgggaggcgg

SEQ ID NO: 174032 - DNA, 35 bp, Artificial Sequence
  Synthetic oligonucleotide
tcccctccaccatcaccacactgcccttagaaggg

SEQ ID NO: 174033 - DNA, 35 bp, Artificial Sequence
  Synthetic oligonucleotide
tcctgtcgccccatcacactgattatctaacactg

SEQ ID NO: 174034 - DNA, 35 bp, Artificial Sequence
  Synthetic oligonucleotide
tcaggacgggagggagagggcggacggatactctg

SEQ ID NO: 174035 - DNA, 35 bp, Artificial Sequence
  Synthetic oligonucleotide
acaacgggcaggagaggagggagtgaggcgaggtg

SEQ ID NO: 174036 - DNA, 35 bp, Artificial Sequence
  Synthetic oligonucleotide
aaccgacctgcccgtacaactctcccaatctgttg

SEQ ID NO: 174037 - DNA, 35 bp, Artificial Sequence
  Synthetic oligonucleotide
taccgtcaatgtagcacctacccctgttcccacat

SEQ ID NO: 174038 - DNA, 35 bp, Artificial Sequence
  Synthetic oligonucleotide
aactaccacctgctatggtccatcctagccaaact

SEQ ID NO: 174039 - DNA, 35 bp, Artificial Sequence
  Synthetic oligonucleotide
acccgcctcccattctaccaagacgtccgctaact

SEQ ID NO: 174040 - DNA, 35 bp, Artificial Sequence
  Synthetic oligonucleotide
gtcctcgctcctcgcgccctgcccgttccgacact

SEQ ID NO: 174041 - DNA, 35 bp, Artificial Sequence
  Synthetic oligonucleotide
gtcaccactggccactgtcatttattcgcctacct

SEQ ID NO: 174042 - DNA, 35 bp, Artificial Sequence
  Synthetic oligonucleotide
acactaccaccaatgtgcgccctatactgtgtcct

SEQ ID NO: 174043 - DNA, 35 bp, Artificial Sequence
  Synthetic oligonucleotide
tcgcgactcacgccctcgcctctacagacgcatct

SEQ ID NO: 174044 - DNA, 35 bp, Artificial Sequence
  Synthetic oligonucleotide
ttcccgctgcgtgatcgtctcggtctcgcccctct

SEQ ID NO: 174045 - DNA, 35 bp, Artificial Sequence
  Synthetic oligonucleotide
aacagggcatcatgcattacccatgtcgtacttct

SEQ ID NO: 174046 - DNA, 35 bp, Artificial Sequence
  Synthetic oligonucleotide
gttgccccgccgcggaccgcggtattccttgttct

SEQ ID NO: 174047 - DNA, 35 bp, Artificial Sequence
  Synthetic oligonucleotide
actcctcccgcgcaccctatacacttcgttgaagt

SEQ ID NO: 174048 - DNA, 35 bp, Artificial Sequence
  Synthetic oligonucleotide
gtcaacccagagtcgcctggccctcaacctccatt

SEQ ID NO: 174049 - DNA, 35 bp, Artificial Sequence
  Synthetic oligonucleotide
gaggagccgccctttggcgcataggccccctcctt

SEQ ID NO: 174050 - DNA, 35 bp, Artificial Sequence
  Synthetic oligonucleotide
ttgccttccgcccttggccccgtctttccacggtt

SEQ ID NO: 174051 - DNA, 35 bp, Artificial Sequence
  Synthetic oligonucleotide
acaccctcccgcatacgtacacctgtcttaatttt

SEQ ID NO: 174052 - DNA, 36 bp, Artificial Sequence
  Synthetic oligonucleotide
tactgctcgccacgacgcactatccatttgcccaaa

SEQ ID NO: 174053 - DNA, 36 bp, Artificial Sequence
  Synthetic oligonucleotide
gatgacgcaacaacagcaaggacggggaaagggaaa

SEQ ID NO: 174054 - DNA, 35 bp, Artificial Sequence
  Synthetic oligonucleotide
tttgcccgcagtccatcccctgacaccctttgcaa

SEQ ID NO: 174055 - DNA, 35 bp, Artificial Sequence
  Synthetic oligonucleotide
gtccgtctcctgcttacctgcctgtgccttacgaa

SEQ ID NO: 174056 - DNA, 36 bp, Artificial Sequence
  Synthetic oligonucleotide
gtggaggggggggtacagtgggatgggaccttggaa

SEQ ID NO: 174057 - DNA, 35 bp, Artificial Sequence
  Synthetic oligonucleotide
tcccacacctcctgctcaaggggaccgcaccataa

SEQ ID NO: 174058 - DNA, 36 bp, Artificial Sequence
  Synthetic oligonucleotide
atgcatcacagtttggcccacctcgcacccccttaa

SEQ ID NO: 174059 - DNA, 36 bp, Artificial Sequence
  Synthetic oligonucleotide
accgacgcgattatttaccccagcacctgctccaca

SEQ ID NO: 174060 - DNA, 36 bp, Artificial Sequence
  Synthetic oligonucleotide
gtcctctgcccctccgctacacataaggacttgaca

SEQ ID NO: 174061 - DNA, 36 bp, Artificial Sequence
  Synthetic oligonucleotide
agctaccactgagctatttacccacgcctcttgaca

SEQ ID NO: 174062 - DNA, 36 bp, Artificial Sequence
  Synthetic oligonucleotide
gtcccagcctcctcattgccccgtctcattcctaca

SEQ ID NO: 174063 - DNA, 36 bp, Artificial Sequence
  Synthetic oligonucleotide
gtccatcgagtgtcatgcgctcgtagctccacccca

SEQ ID NO: 174064 - DNA, 35 bp, Artificial Sequence
  Synthetic oligonucleotide
gaggatgcccgctcgatccttgctgtccccatcca

SEQ ID NO: 174065 - DNA, 36 bp, Artificial Sequence
  Synthetic oligonucleotide
gcatttatccgccacgcccaattcgctgtacctcca

SEQ ID NO: 174066 - DNA, 36 bp, Artificial Sequence
  Synthetic oligonucleotide
tcacctgcattcccctccctatgagccttcggcgca

SEQ ID NO: 174067 - DNA, 36 bp, Artificial Sequence
  Synthetic oligonucleotide
ggtactccccgccgcctgtcatgactgccgttcgca

SEQ ID NO: 174068 - DNA, 35 bp, Artificial Sequence
  Synthetic oligonucleotide
gttggtaggacgcaagacggaatggatggggggca

SEQ ID NO: 174069 - DNA, 35 bp, Artificial Sequence
  Synthetic oligonucleotide
gacggtgggggggggaagaatggatggtggtctca

SEQ ID NO: 174070 - DNA, 35 bp, Artificial Sequence
  Synthetic oligonucleotide
gccttgctccaccactgtacaacgtactaatgtca

SEQ ID NO: 174071 - DNA, 37 bp, Artificial Sequence
  Synthetic oligonucleotide
gcaacgctacctgccgccgtgtctcatccctccaaga

SEQ ID NO: 174072 - DNA, 36 bp, Artificial Sequence
  Synthetic oligonucleotide
taagcgaaggaaggggagaaacgggagtgagcaaga

SEQ ID NO: 174073 - DNA, 37 bp, Artificial Sequence
  Synthetic oligonucleotide
tggaaagacgggaaacgggtggcggagtacgtcaaga

SEQ ID NO: 174074 - DNA, 36 bp, Artificial Sequence
  Synthetic oligonucleotide
atgtcacctctctccgtcccacgtctatctacacga

SEQ ID NO: 174075 - DNA, 36 bp, Artificial Sequence
  Synthetic oligonucleotide
acgacccacccaccgaggaacgtcaccccccaccga

SEQ ID NO: 174076 - DNA, 36 bp, Artificial Sequence
  Synthetic oligonucleotide
tgccaatcaccatacgtgcttgtttcatccacccga

SEQ ID NO: 174077 - DNA, 37 bp, Artificial Sequence
  Synthetic oligonucleotide
atgcgtctctgtcaatctctaaagcctcaccccccga

SEQ ID NO: 174078 - DNA, 37 bp, Artificial Sequence
  Synthetic oligonucleotide
ttacttgcgcgccgtccccttggagccctcttcccga

SEQ ID NO: 174079 - DNA, 37 bp, Artificial Sequence
  Synthetic oligonucleotide
gtagccgctgcgtataccaactcccttcctcgcgcga

SEQ ID NO: 174080 - DNA, 36 bp, Artificial Sequence
  Synthetic oligonucleotide
gaaaataggtaggggagggcgaccgacaagggagga

SEQ ID NO: 174081 - DNA, 37 bp, Artificial Sequence
  Synthetic oligonucleotide
gcgacaagtaggggaggggggtcaagcctagacggga

SEQ ID NO: 174082 - DNA, 36 bp, Artificial Sequence
  Synthetic oligonucleotide
agcctcgtacatagggtatggtgcgggggggtggga

SEQ ID NO: 174083 - DNA, 37 bp, Artificial Sequence
  Synthetic oligonucleotide
agggcgggtgggtgtcagagtttcggcgtttgtggga

SEQ ID NO: 174084 - DNA, 37 bp, Artificial Sequence
  Synthetic oligonucleotide
cagatagcagtgcaagggggggtgggagctattggga

SEQ ID NO: 174085 - DNA, 37 bp, Artificial Sequence
  Synthetic oligonucleotide
tctcgccccctccgtcccacatcccacgccacatgga

SEQ ID NO: 174086 - DNA, 38 bp, Artificial Sequence
  Synthetic oligonucleotide
ttcgagagtaggtaggggaatagggcggggacgaatga

SEQ ID NO: 174087 - DNA, 37 bp, Artificial Sequence
  Synthetic oligonucleotide
tgacgatgcgctccttcacctgtgccgtttctcatga

SEQ ID NO: 174088 - DNA, 38 bp, Artificial Sequence
  Synthetic oligonucleotide
gccaggccatttcaaccatatgggctgccactctatga

SEQ ID NO: 174089 - DNA, 38 bp, Artificial Sequence
  Synthetic oligonucleotide
atgggcaccttccctgttctttgctggccttttactga

SEQ ID NO: 174090 - DNA, 35 bp, Artificial Sequence
  Synthetic oligonucleotide
tgatgcgcgccttgtccctattgtgttcctcctga

SEQ ID NO: 174091 - DNA, 37 bp, Artificial Sequence
  Synthetic oligonucleotide
aatttacgcgcgcagatccgccctcattccgtcctga

SEQ ID NO: 174092 - DNA, 38 bp, Artificial Sequence
  Synthetic oligonucleotide
ggagtcaaagagagaggtggagatgaggatggagctga

SEQ ID NO: 174093 - DNA, 38 bp, Artificial Sequence
  Synthetic oligonucleotide
agcggtggggaaaggaaaggagcgacgggggtcagtga

SEQ ID NO: 174094 - DNA, 36 bp, Artificial Sequence
  Synthetic oligonucleotide
atgtcttacgcaagggggagaagggcgagtgggtga

SEQ ID NO: 174095 - DNA, 38 bp, Artificial Sequence
  Synthetic oligonucleotide
gtggagggaccggaggagtgtggggaggggttgcttga

SEQ ID NO: 174096 - DNA, 38 bp, Artificial Sequence
  Synthetic oligonucleotide
taatggggcgtgaagggaagggggggacgccgggttga

SEQ ID NO: 174097 - DNA, 38 bp, Artificial Sequence
  Synthetic oligonucleotide
gcccacgctgacgttcgttccccccaatgcacctttga

SEQ ID NO: 174098 - DNA, 37 bp, Artificial Sequence
  Synthetic oligonucleotide
tgcacttccgccctttatcttcttggtgaccctttga

SEQ ID NO: 174099 - DNA, 36 bp, Artificial Sequence
  Synthetic oligonucleotide
ccatccaacgcgccctgcctcttccatctttgccta

SEQ ID NO: 174100 - DNA, 35 bp, Artificial Sequence
  Synthetic oligonucleotide
aacatttggcccctcccgcttgtacgattcgctta

SEQ ID NO: 174101 - DNA, 36 bp, Artificial Sequence
  Synthetic oligonucleotide
acaaggcaacccactcacggttgccgctcaccttta

SEQ ID NO: 174102 - DNA, 35 bp, Artificial Sequence
  Synthetic oligonucleotide
tgcttagcctgccccttcatcattggttctatcac

SEQ ID NO: 174103 - DNA, 35 bp, Artificial Sequence
  Synthetic oligonucleotide
tcagaagagggcggggcggtaatgtgggaggtcac

SEQ ID NO: 174104 - DNA, 35 bp, Artificial Sequence
  Synthetic oligonucleotide
tgcgacgtccttcctgtccgtcccaagccgccgac

SEQ ID NO: 174105 - DNA, 35 bp, Artificial Sequence
  Synthetic oligonucleotide
gtccgggggtcacttccgctcattactagccctac

SEQ ID NO: 174106 - DNA, 35 bp, Artificial Sequence
  Synthetic oligonucleotide
gcatagtcccgcctctcaatgattacatcagcccc

SEQ ID NO: 174107 - DNA, 35 bp, Artificial Sequence
  Synthetic oligonucleotide
tgcccgagaccgcaatggttcttctgtcactcccc

SEQ ID NO: 174108 - DNA, 35 bp, Artificial Sequence
  Synthetic oligonucleotide
tcctctgatctatccccgctggcccgattccgccc

SEQ ID NO: 174109 - DNA, 35 bp, Artificial Sequence
  Synthetic oligonucleotide
gcgcttcgtaggctgccgaatctcactccctgccc

SEQ ID NO: 174110 - DNA, 35 bp, Artificial Sequence
  Synthetic oligonucleotide
gttagcccgaccttggcagacactatcctactccc

SEQ ID NO: 174111 - DNA, 35 bp, Artificial Sequence
  Synthetic oligonucleotide
tcaccctcccatgctagcatagtctgccccttgcc

SEQ ID NO: 174112 - DNA, 35 bp, Artificial Sequence
  Synthetic oligonucleotide
ttatgcgcggtccacggttccctgattcgcactcc

SEQ ID NO: 174113 - DNA, 35 bp, Artificial Sequence
  Synthetic oligonucleotide
actgcccccgccgatttacctgtctggttcgctcc

SEQ ID NO: 174114 - DNA, 35 bp, Artificial Sequence
  Synthetic oligonucleotide
atcgaccctgcccctcttgacgtaacatccacagc

SEQ ID NO: 174115 - DNA, 35 bp, Artificial Sequence
  Synthetic oligonucleotide
gtcggtgccgcccatactccgtccttcgttacagc

SEQ ID NO: 174116 - DNA, 35 bp, Artificial Sequence
  Synthetic oligonucleotide
tccgctcctcacctgcttcgttttttgaacctagc

SEQ ID NO: 174117 - DNA, 35 bp, Artificial Sequence
  Synthetic oligonucleotide
tcccagtttgccccctgctatgtgcgatcttccgc

SEQ ID NO: 174118 - DNA, 35 bp, Artificial Sequence
  Synthetic oligonucleotide
acgctagctggctccattcgctgcacacgccctgc

SEQ ID NO: 174119 - DNA, 35 bp, Artificial Sequence
  Synthetic oligonucleotide
tcgccccaccgggcctttccccgtccatatcctgc

SEQ ID NO: 174120 - DNA, 35 bp, Artificial Sequence
  Synthetic oligonucleotide
gacactgcagagccggtttccgtgccacttcctgc

SEQ ID NO: 174121 - DNA, 35 bp, Artificial Sequence
  Synthetic oligonucleotide
tgtcacctccaccctgagcgttcccacctgattgc

SEQ ID NO: 174122 - DNA, 35 bp, Artificial Sequence
  Synthetic oligonucleotide
tgttaatccactagcttgtaacaccttgcccttgc

SEQ ID NO: 174123 - DNA, 35 bp, Artificial Sequence
  Synthetic oligonucleotide
tatgccattcaccgccccctggctcccatctcatc

SEQ ID NO: 174124 - DNA, 35 bp, Artificial Sequence
  Synthetic oligonucleotide
gtccaacaccggcattatcgagaaacccaccactc

SEQ ID NO: 174125 - DNA, 35 bp, Artificial Sequence
  Synthetic oligonucleotide
tcgagcaatcctgtcaagtatctatccctgccctc

SEQ ID NO: 174126 - DNA, 35 bp, Artificial Sequence
  Synthetic oligonucleotide
tcctgcccttccctcacactacgaacctgtatctc

SEQ ID NO: 174127 - DNA, 35 bp, Artificial Sequence
  Synthetic oligonucleotide
gcaactggctgacgtttagccgcttccatactctc

SEQ ID NO: 174128 - DNA, 35 bp, Artificial Sequence
  Synthetic oligonucleotide
gagtcgatctgtattggctctttcccacccttctc

SEQ ID NO: 174129 - DNA, 35 bp, Artificial Sequence
  Synthetic oligonucleotide
tcaccgtcgccaaggcctattgctaccactttctc

SEQ ID NO: 174130 - DNA, 34 bp, Artificial Sequence
  Synthetic oligonucleotide
gtgcaacgttcattatagtccttccctttacttc

SEQ ID NO: 174131 - DNA, 35 bp, Artificial Sequence
  Synthetic oligonucleotide
tcatcctgctgctcaaagcctgtaatcctgccttc

SEQ ID NO: 174132 - DNA, 35 bp, Artificial Sequence
  Synthetic oligonucleotide
gccgacccggcgtactcatgctattccacccgccg

SEQ ID NO: 174133 - DNA, 35 bp, Artificial Sequence
  Synthetic oligonucleotide
tactcgacccctgctaatactgtcaccttatgccg

SEQ ID NO: 174134 - DNA, 35 bp, Artificial Sequence
  Synthetic oligonucleotide
actgatccgcaaacgcccctctaccaccgtgagcg

SEQ ID NO: 174135 - DNA, 35 bp, Artificial Sequence
  Synthetic oligonucleotide
gcgaggcggggggaggaaacgcggtgtatgttgcg

SEQ ID NO: 174136 - DNA, 35 bp, Artificial Sequence
  Synthetic oligonucleotide
tttcacgctccgaccacaccccacccccagaaagg

SEQ ID NO: 174137 - DNA, 35 bp, Artificial Sequence
  Synthetic oligonucleotide
acacataccgccgccgcccctgggtcttacgactg

SEQ ID NO: 174138 - DNA, 35 bp, Artificial Sequence
  Synthetic oligonucleotide
gatgcttccagcgtcacggccgactattccacctg

SEQ ID NO: 174139 - DNA, 35 bp, Artificial Sequence
  Synthetic oligonucleotide
tatgcgccgcccccttgcgtacatttttccacctg

SEQ ID NO: 174140 - DNA, 35 bp, Artificial Sequence
  Synthetic oligonucleotide
tcatcccccactatgtatgtgctatcctgcacctg

SEQ ID NO: 174141 - DNA, 35 bp, Artificial Sequence
  Synthetic oligonucleotide
ttcgccttcccccgcctaatcctctccatgttgtg

SEQ ID NO: 174142 - DNA, 35 bp, Artificial Sequence
  Synthetic oligonucleotide
cgcatagctccagcgtccaaccccctctgcctttg

SEQ ID NO: 174143 - DNA, 30 bp, Artificial Sequence
  Synthetic oligonucleotide
tctagacctcctccgtgttgcctttagcat

SEQ ID NO: 174144 - DNA, 35 bp, Artificial Sequence
  Synthetic oligonucleotide
acaccccccgacgggcccgttaactattgtctcat

SEQ ID NO: 174145 - DNA, 35 bp, Artificial Sequence
  Synthetic oligonucleotide
aatctcccccgtacgctatgccaccgacacacgat

SEQ ID NO: 174146 - DNA, 35 bp, Artificial Sequence
  Synthetic oligonucleotide
gaacgaagggagggagtggaagggctggaaagtat

SEQ ID NO: 174147 - DNA, 35 bp, Artificial Sequence
  Synthetic oligonucleotide
gcgatacccccgcgccctcgtatttttcaccaact

SEQ ID NO: 174148 - DNA, 35 bp, Artificial Sequence
  Synthetic oligonucleotide
atctcgcccagctcctgcttcgagtctcccgtact

SEQ ID NO: 174149 - DNA, 35 bp, Artificial Sequence
  Synthetic oligonucleotide
tcagtggtcgcccattcatccacaagttccaacct

SEQ ID NO: 174150 - DNA, 35 bp, Artificial Sequence
  Synthetic oligonucleotide
tttcccacagtccgtaacgcgtgattctcccccct

SEQ ID NO: 174151 - DNA, 35 bp, Artificial Sequence
  Synthetic oligonucleotide
tcaattcccggcattgcttcgcgcctccatgccct

SEQ ID NO: 174152 - DNA, 35 bp, Artificial Sequence
  Synthetic oligonucleotide
tgagaccctcaaggtgtgtcgctacacctccgcct

SEQ ID NO: 174153 - DNA, 35 bp, Artificial Sequence
  Synthetic oligonucleotide
tctggggggctctgcgtgatcgtcctacacctcct

SEQ ID NO: 174154 - DNA, 35 bp, Artificial Sequence
  Synthetic oligonucleotide
taatcgtgcccaccctcgttcctttggtgtcatct

SEQ ID NO: 174155 - DNA, 35 bp, Artificial Sequence
  Synthetic oligonucleotide
tagaccctgttaccgctagctgcctcggctcctct

SEQ ID NO: 174156 - DNA, 36 bp, Artificial Sequence
  Synthetic oligonucleotide
gacccccctcaattctgtatccgctcacttgcgagt

SEQ ID NO: 174157 - DNA, 35 bp, Artificial Sequence
  Synthetic oligonucleotide
agcacacttcgacgcgatcgctactcctccccggt

SEQ ID NO: 174158 - DNA, 35 bp, Artificial Sequence
  Synthetic oligonucleotide
agtcacgtgagccttccatcccacctccctcatgt

SEQ ID NO: 174159 - DNA, 35 bp, Artificial Sequence
  Synthetic oligonucleotide
tatacaccacagtgcgctaacacctctgcccgtgt

SEQ ID NO: 174160 - DNA, 35 bp, Artificial Sequence
  Synthetic oligonucleotide
tctatgccgccccgttcaccatccgccattcttgt

SEQ ID NO: 174161 - DNA, 35 bp, Artificial Sequence
  Synthetic oligonucleotide
tccttcgcccgcctcccttaactggcttgcctatt

SEQ ID NO: 174162 - DNA, 35 bp, Artificial Sequence
  Synthetic oligonucleotide
gagaacggggggaaggggatcagtgggagggagtt

SEQ ID NO: 174163 - DNA, 36 bp, Artificial Sequence
  Synthetic oligonucleotide
gtgggggggaccagatgtgaggggcgcggagggaaa

SEQ ID NO: 174164 - DNA, 36 bp, Artificial Sequence
  Synthetic oligonucleotide
tcagggaaaggggggggtcacttagggatgggcgaa

SEQ ID NO: 174165 - DNA, 35 bp, Artificial Sequence
  Synthetic oligonucleotide
aaccatggcacaccttacgccctcacctgtgctaa

SEQ ID NO: 174166 - DNA, 35 bp, Artificial Sequence
  Synthetic oligonucleotide
ggaacagccctgacccatcgttcgttgctctctaa

SEQ ID NO: 174167 - DNA, 36 bp, Artificial Sequence
  Synthetic oligonucleotide
gcccacgtccacgccttgtctcccggtctctcgtaa

SEQ ID NO: 174168 - DNA, 36 bp, Artificial Sequence
  Synthetic oligonucleotide
tcgtgacactgtaccgtgctttcctttccgccttaa

SEQ ID NO: 174169 - DNA, 36 bp, Artificial Sequence
  Synthetic oligonucleotide
aattcaggccgtgttatctttgcgtcatcttcttaa

SEQ ID NO: 174170 - DNA, 36 bp, Artificial Sequence
  Synthetic oligonucleotide
tgagagggcggtgaggaaagggcacggtcgataaca

SEQ ID NO: 174171 - DNA, 36 bp, Artificial Sequence
  Synthetic oligonucleotide
agacgcccgggcccgatctggctgcactcctacaca

SEQ ID NO: 174172 - DNA, 36 bp, Artificial Sequence
  Synthetic oligonucleotide
gtagtccactcgcccttgatttaacatccgttcaca

SEQ ID NO: 174173 - DNA, 36 bp, Artificial Sequence
  Synthetic oligonucleotide
agcagtcccaggccgaccttgcccttcgctgcacca

SEQ ID NO: 174174 - DNA, 36 bp, Artificial Sequence
  Synthetic oligonucleotide
gacccgcagtgacttagtcgctgatcaactccccca

SEQ ID NO: 174175 - DNA, 36 bp, Artificial Sequence
  Synthetic oligonucleotide
agctagcatcccgccatttcaacacttgccctgcca

SEQ ID NO: 174176 - DNA, 35 bp, Artificial Sequence
  Synthetic oligonucleotide
gtgcgttcagcccgtcctccctgccccttttgcca

SEQ ID NO: 174177 - DNA, 36 bp, Artificial Sequence
  Synthetic oligonucleotide
tacctcaccgccctcttttcacggaagtgccgagca

SEQ ID NO: 174178 - DNA, 35 bp, Artificial Sequence
  Synthetic oligonucleotide
tacgttggcccctcacgtctgtccttattctcgca

SEQ ID NO: 174179 - DNA, 35 bp, Artificial Sequence
  Synthetic oligonucleotide
agaccgcccctgctcgccctattacaggttttgca

SEQ ID NO: 174180 - DNA, 36 bp, Artificial Sequence
  Synthetic oligonucleotide
gcatgccattcatgagaagctccctgtccaccatca

SEQ ID NO: 174181 - DNA, 36 bp, Artificial Sequence
  Synthetic oligonucleotide
atagcgctccaccatacatcgtcagtaactttatca

SEQ ID NO: 174182 - DNA, 36 bp, Artificial Sequence
  Synthetic oligonucleotide
aacgacgcctttgcttgctcccgttagcctctttca

SEQ ID NO: 174183 - DNA, 35 bp, Artificial Sequence
  Synthetic oligonucleotide
tctcacccatccccttgtatcacgattatgtttca

SEQ ID NO: 174184 - DNA, 35 bp, Artificial Sequence
  Synthetic oligonucleotide
gggaagagagggaccggttagagtaggagaggaga

SEQ ID NO: 174185 - DNA, 37 bp, Artificial Sequence
  Synthetic oligonucleotide
gaccctcactttccccccgtgccccgtctctgctaga

SEQ ID NO: 174186 - DNA, 37 bp, Artificial Sequence
  Synthetic oligonucleotide
gtgcttgcatcccgcccctgtcctcatcatgcgacga

SEQ ID NO: 174187 - DNA, 36 bp, Artificial Sequence
  Synthetic oligonucleotide
gctgagtaatcagcgcatagttcgccttcccaccga

SEQ ID NO: 174188 - DNA, 37 bp, Artificial Sequence
  Synthetic oligonucleotide
tgcgatctgcacacgttttcacgctccatcgtaccga

SEQ ID NO: 174189 - DNA, 36 bp, Artificial Sequence
  Synthetic oligonucleotide
gctcaccatcctatatcaaaccctgtcccttcgcga

SEQ ID NO: 174190 - DNA, 37 bp, Artificial Sequence
  Synthetic oligonucleotide
tgctcacctgctccacttgcgcgatttccgctctcga

SEQ ID NO: 174191 - DNA, 37 bp, Artificial Sequence
  Synthetic oligonucleotide
gcaaagcgtgggtgggagggatcgagagcaagtggga

SEQ ID NO: 174192 - DNA, 37 bp, Artificial Sequence
  Synthetic oligonucleotide
gtggggacgagcaaggcgggcgtaggggaaggttgga

SEQ ID NO: 174193 - DNA, 38 bp, Artificial Sequence
  Synthetic oligonucleotide
tcccgctcaccgccccgacctctctgttggcaacatga

SEQ ID NO: 174194 - DNA, 38 bp, Artificial Sequence
  Synthetic oligonucleotide
tcactacggcgccctttgtatcggcccccacaccatga

SEQ ID NO: 174195 - DNA, 38 bp, Artificial Sequence
  Synthetic oligonucleotide
tctccgtcgattcccttgctgcctctccactacgatga

SEQ ID NO: 174196 - DNA, 38 bp, Artificial Sequence
  Synthetic oligonucleotide
agaatgcacgcgggagggcgggagaggaccggtactga

SEQ ID NO: 174197 - DNA, 38 bp, Artificial Sequence
  Synthetic oligonucleotide
ttcaccgacgtcccacctgcgacttgcacaccccctga

SEQ ID NO: 174198 - DNA, 37 bp, Artificial Sequence
  Synthetic oligonucleotide
acccgtcatcctgtttcgtcgcagcctcatcccctga

SEQ ID NO: 174199 - DNA, 38 bp, Artificial Sequence
  Synthetic oligonucleotide
gtgagtatgggggagtgaaggacgggaggggaatctga

SEQ ID NO: 174200 - DNA, 38 bp, Artificial Sequence
  Synthetic oligonucleotide
accgttcccatctttgctgccagtgccactcactctga

SEQ ID NO: 174201 - DNA, 38 bp, Artificial Sequence
  Synthetic oligonucleotide
gagtgagaggaaggaaggcaaaaaataaagagaagtga

SEQ ID NO: 174202 - DNA, 38 bp, Artificial Sequence
  Synthetic oligonucleotide
agagacgaaaggcatgtgaggtaacggagtgggggtga

SEQ ID NO: 174203 - DNA, 37 bp, Artificial Sequence
  Synthetic oligonucleotide
gtttgcctcgcctctcgttttcgtcacataggtgtga

SEQ ID NO: 174204 - DNA, 38 bp, Artificial Sequence
  Synthetic oligonucleotide
gaagcgacgctgggtccgccatccccccttcgttgtga

SEQ ID NO: 174205 - DNA, 38 bp, Artificial Sequence
  Synthetic oligonucleotide
gcatgccttccgtcgccattcgttatcgttcaccttga

SEQ ID NO: 174206 - DNA, 37 bp, Artificial Sequence
  Synthetic oligonucleotide
gcatggccacattacctttgttttcgtacactcttga

SEQ ID NO: 174207 - DNA, 38 bp, Artificial Sequence
  Synthetic oligonucleotide
ggttccgctccatccgtctgtcctctacgttctcttga

SEQ ID NO: 174208 - DNA, 36 bp, Artificial Sequence
  Synthetic oligonucleotide
ttcgtgacaccctacatgcccccacagtaccgttga

SEQ ID NO: 174209 - DNA, 38 bp, Artificial Sequence
  Synthetic oligonucleotide
gttcgcccacaatactgctatgtcactttattttttga

SEQ ID NO: 174210 - DNA, 36 bp, Artificial Sequence
  Synthetic oligonucleotide
acgcatcgtccatcgtcttccgccacgcctgccata

SEQ ID NO: 174211 - DNA, 36 bp, Artificial Sequence
  Synthetic oligonucleotide
gaggaggggtaggataggaaggtggagatactgata

SEQ ID NO: 174212 - DNA, 36 bp, Artificial Sequence
  Synthetic oligonucleotide
tccatcccctgcgcatatgacgtcgcttcatctata

SEQ ID NO: 174213 - DNA, 35 bp, Artificial Sequence
  Synthetic oligonucleotide
gttggccacacgattctaccccccatcttgcacta

SEQ ID NO: 174214 - DNA, 35 bp, Artificial Sequence
  Synthetic oligonucleotide
gcccactttccgccgcctcgtggtgttttttccta

SEQ ID NO: 174215 - DNA, 35 bp, Artificial Sequence
  Synthetic oligonucleotide
ccacaccctacggcctaagacactgcacctctcta

SEQ ID NO: 174216 - DNA, 36 bp, Artificial Sequence
  Synthetic oligonucleotide
tcctcggtccggcgcgtaaactcgtctactcccgta

SEQ ID NO: 174217 - DNA, 36 bp, Artificial Sequence
  Synthetic oligonucleotide
actaccgtcccccgtgttcctctgcccctactctta

SEQ ID NO: 174218 - DNA, 36 bp, Artificial Sequence
  Synthetic oligonucleotide
agagacaaaagatgggggtaaagcgcggaagggtta

SEQ ID NO: 174219 - DNA, 36 bp, Artificial Sequence
  Synthetic oligonucleotide
aacgtgggaggcagaagggggttgggcggtagttta

SEQ ID NO: 174220 - DNA, 36 bp, Artificial Sequence
  Synthetic oligonucleotide
tccaccctgcgtacagcctcatatctctcctgttta

SEQ ID NO: 174221 - DNA, 35 bp, Artificial Sequence
  Synthetic oligonucleotide
agggtaggtccctactgcattacaatctgctccac

SEQ ID NO: 174222 - DNA, 35 bp, Artificial Sequence
  Synthetic oligonucleotide
gttgccgtcgcagcaccgtcctataagttctccac

SEQ ID NO: 174223 - DNA, 34 bp, Artificial Sequence
  Synthetic oligonucleotide
gagttcgcctcagttgacgtcattctaccatcac

SEQ ID NO: 174224 - DNA, 35 bp, Artificial Sequence
  Synthetic oligonucleotide
gaccccctccagagcgcgatatatgtccccgtcac

SEQ ID NO: 174225 - DNA, 35 bp, Artificial Sequence
  Synthetic oligonucleotide
gaccgacatcccatcactgccttatatactgcgac

SEQ ID NO: 174226 - DNA, 35 bp, Artificial Sequence
  Synthetic oligonucleotide
acacaccgtccgaacaccgcgattaccctcttgac

SEQ ID NO: 174227 - DNA, 35 bp, Artificial Sequence
  Synthetic oligonucleotide
acctgccagcccggcccgtcgtcccctgtcgctac

SEQ ID NO: 174228 - DNA, 35 bp, Artificial Sequence
  Synthetic oligonucleotide
atgagagccaccgcctgctgtaatactccccgtac

SEQ ID NO: 174229 - DNA, 35 bp, Artificial Sequence
  Synthetic oligonucleotide
tgcaaccctctccattgcccaggtttggcccgacc

SEQ ID NO: 174230 - DNA, 35 bp, Artificial Sequence
  Synthetic oligonucleotide
attatccggtgtcagcgttgcgccgccttcgtccc

SEQ ID NO: 174231 - DNA, 35 bp, Artificial Sequence
  Synthetic oligonucleotide
gtagcgtacgcccccccatccccaaaggctcagcc

SEQ ID NO: 174232 - DNA, 34 bp, Artificial Sequence
  Synthetic oligonucleotide
ttgccccatgggcatccggtcctctacatacgcc

SEQ ID NO: 174233 - DNA, 35 bp, Artificial Sequence
  Synthetic oligonucleotide
ggagtatggccgccactatcgattttgcttccgcc

SEQ ID NO: 174234 - DNA, 35 bp, Artificial Sequence
  Synthetic oligonucleotide
tcctgacaacccggttctgctccgctgctatcgcc

SEQ ID NO: 174235 - DNA, 35 bp, Artificial Sequence
  Synthetic oligonucleotide
tcgtggccaccctcaagcatcattcgttaccggcc

SEQ ID NO: 174236 - DNA, 35 bp, Artificial Sequence
  Synthetic oligonucleotide
gcggacgccagtcccctctgcaaacctctccggcc

SEQ ID NO: 174237 - DNA, 35 bp, Artificial Sequence
  Synthetic oligonucleotide
ggaggccttcctcgtttacgctcccgtcctcctcc

SEQ ID NO: 174238 - DNA, 35 bp, Artificial Sequence
  Synthetic oligonucleotide
ggaatgtccgcgactgtcacctcctaccgccgtcc

SEQ ID NO: 174239 - DNA, 35 bp, Artificial Sequence
  Synthetic oligonucleotide
aacctgtgtccgaaacccgtaattccagtccttcc

SEQ ID NO: 174240 - DNA, 35 bp, Artificial Sequence
  Synthetic oligonucleotide
gccagtgcgacggcaccttcttcattctagtttcc

SEQ ID NO: 174241 - DNA, 35 bp, Artificial Sequence
  Synthetic oligonucleotide
gccctcgaccatattatctgatctcaccattgcgc

SEQ ID NO: 174242 - DNA, 35 bp, Artificial Sequence
  Synthetic oligonucleotide
tcatcacccgcgctttattctcgcagtcccctcgc

SEQ ID NO: 174243 - DNA, 35 bp, Artificial Sequence
  Synthetic oligonucleotide
tgatctctactgctgttaccaatgccctttctcgc

SEQ ID NO: 174244 - DNA, 35 bp, Artificial Sequence
  Synthetic oligonucleotide
ttgcaccatttcgtcttctaggttcgtctcttcgc

SEQ ID NO: 174245 - DNA, 35 bp, Artificial Sequence
  Synthetic oligonucleotide
ttttgtgcccgtacttgttcacacctccgccctgc

SEQ ID NO: 174246 - DNA, 35 bp, Artificial Sequence
  Synthetic oligonucleotide
tgtctctaaacacgtccgccccgcctcagtcctgc

SEQ ID NO: 174247 - DNA, 35 bp, Artificial Sequence
  Synthetic oligonucleotide
tcccaatgtactgccccctctatcaggttgtctgc

SEQ ID NO: 174248 - DNA, 35 bp, Artificial Sequence
  Synthetic oligonucleotide
ccccgtgcttctgcctttgccgctgacctccttgc

SEQ ID NO: 174249 - DNA, 32 bp, Artificial Sequence
  Synthetic oligonucleotide
ttcccttacacctgcttatattgcgatcttgc

SEQ ID NO: 174250 - DNA, 35 bp, Artificial Sequence
  Synthetic oligonucleotide
tacagcgagaagcatcagcaccctccctgtctatc

SEQ ID NO: 174251 - DNA, 35 bp, Artificial Sequence
  Synthetic oligonucleotide
gtgccacgttttatctctcgccattcgtcgacctc

SEQ ID NO: 174252 - DNA, 35 bp, Artificial Sequence
  Synthetic oligonucleotide
tcactggtaaatcgtcatgtgcaccctaccccctc

SEQ ID NO: 174253 - DNA, 35 bp, Artificial Sequence
  Synthetic oligonucleotide
tgcactcaggctcggaatcagcttctcactccctc

SEQ ID NO: 174254 - DNA, 35 bp, Artificial Sequence
  Synthetic oligonucleotide
tacaccgtctcacaacatcgttcctgctggcgctc

SEQ ID NO: 174255 - DNA, 35 bp, Artificial Sequence
  Synthetic oligonucleotide
tcccccgtgcgatttgagaatccgtgctctttctc

SEQ ID NO: 174256 - DNA, 35 bp, Artificial Sequence
  Synthetic oligonucleotide
atggacgagctcatgttccgctgccatacactgtc

SEQ ID NO: 174257 - DNA, 35 bp, Artificial Sequence
  Synthetic oligonucleotide
gagtgcccaatgtattttcttcgcctcgccttgtc

SEQ ID NO: 174258 - DNA, 35 bp, Artificial Sequence
  Synthetic oligonucleotide
ttcagcccacgctcgaccctctccattatagattc

SEQ ID NO: 174259 - DNA, 35 bp, Artificial Sequence
  Synthetic oligonucleotide
ggagctcaggtccctccgacttcctcgcatacttc

SEQ ID NO: 174260 - DNA, 35 bp, Artificial Sequence
  Synthetic oligonucleotide
tgtcactgccggtgctccaagtttcgttttcccag

SEQ ID NO: 174261 - DNA, 35 bp, Artificial Sequence
  Synthetic oligonucleotide
tccgcccgcatgtttttggctcattctgatttccg

SEQ ID NO: 174262 - DNA, 35 bp, Artificial Sequence
  Synthetic oligonucleotide
tgattcggccctccgactccgctgaccctttatcg

SEQ ID NO: 174263 - DNA, 35 bp, Artificial Sequence
  Synthetic oligonucleotide
tgtgggtgggggggtggaaagccctggagggaagg

SEQ ID NO: 174264 - DNA, 35 bp, Artificial Sequence
  Synthetic oligonucleotide
gaacaaaggggggaataggggtaaccgcaggtagg

SEQ ID NO: 174265 - DNA, 36 bp, Artificial Sequence
  Synthetic oligonucleotide
gttggcgcacccccgcaccgtttctccctcgtccgg

SEQ ID NO: 174266 - DNA, 35 bp, Artificial Sequence
  Synthetic oligonucleotide
atgtgtctgctccatcttaacccacgtcgtactgg

SEQ ID NO: 174267 - DNA, 35 bp, Artificial Sequence
  Synthetic oligonucleotide
ttctgctgcagtatcgccacatgactcttcgcctg

SEQ ID NO: 174268 - DNA, 35 bp, Artificial Sequence
  Synthetic oligonucleotide
tcgtaccctctgcctccgcctcgaataaccaattg

SEQ ID NO: 174269 - DNA, 35 bp, Artificial Sequence
  Synthetic oligonucleotide
gagaggtagacggcgtaggggggtggagtacaaat

SEQ ID NO: 174270 - DNA, 35 bp, Artificial Sequence
  Synthetic oligonucleotide
tggaaactcgctgccttttgtcgatcacacaccat

SEQ ID NO: 174271 - DNA, 35 bp, Artificial Sequence
  Synthetic oligonucleotide
gttcaccttcactggtttcttattccgcttttcat

SEQ ID NO: 174272 - DNA, 35 bp, Artificial Sequence
  Synthetic oligonucleotide
acgataccttcgcggttgtcatgtagctcctccct

SEQ ID NO: 174273 - DNA, 35 bp, Artificial Sequence
  Synthetic oligonucleotide
attgtcacccccccttccgacgcacgtcacgtgct

SEQ ID NO: 174274 - DNA, 34 bp, Artificial Sequence
  Synthetic oligonucleotide
atccctccagtgatgtgacgcctctccaccttct

SEQ ID NO: 174275 - DNA, 25 bp, Artificial Sequence
  Synthetic oligonucleotide
aattttccaccctcgctacggttct

SEQ ID NO: 174276 - DNA, 35 bp, Artificial Sequence
  Synthetic oligonucleotide
gaccttgtcacgttcccccgcacctctaccaacgt

SEQ ID NO: 174277 - DNA, 35 bp, Artificial Sequence
  Synthetic oligonucleotide
ggggtggaggggcgtcggaagaagggagtgggcgt

SEQ ID NO: 174278 - DNA, 35 bp, Artificial Sequence
  Synthetic oligonucleotide
atgtacattggtcccgtccctcgcgcttgtctcgt

SEQ ID NO: 174279 - DNA, 35 bp, Artificial Sequence
  Synthetic oligonucleotide
tggaacagtcggaaggggagggggcatcatgcggt

SEQ ID NO: 174280 - DNA, 35 bp, Artificial Sequence
  Synthetic oligonucleotide
gtggtgctgtcctagggcatgggggggcaaggggt

SEQ ID NO: 174281 - DNA, 32 bp, Artificial Sequence
  Synthetic oligonucleotide
gaggagggaagggcggatgggacgggtctggt

SEQ ID NO: 174282 - DNA, 35 bp, Artificial Sequence
  Synthetic oligonucleotide
agataacgcagctgacatattcacaccacgccctt

SEQ ID NO: 174283 - DNA, 35 bp, Artificial Sequence
  Synthetic oligonucleotide
gaacgggtcaagcgtacatgcgccatggctccctt

SEQ ID NO: 174284 - DNA, 35 bp, Artificial Sequence
  Synthetic oligonucleotide
tatccatccgccatcaggttccctcttttggcctt

SEQ ID NO: 174285 - DNA, 35 bp, Artificial Sequence
  Synthetic oligonucleotide
tgctcccgcgttggggtctcgcccgttccttgctt

SEQ ID NO: 174286 - DNA, 26 bp, Artificial Sequence
  Synthetic oligonucleotide
ttgccatgcagcccccttcgattctt

SEQ ID NO: 174287 - DNA, 36 bp, Artificial Sequence
  Synthetic oligonucleotide
tcccggccgggggggggtaaaatgctggggagggaa

SEQ ID NO: 174288 - DNA, 35 bp, Artificial Sequence
  Synthetic oligonucleotide
tctccgcctctttgggaccttgccccttctctgaa

SEQ ID NO: 174289 - DNA, 36 bp, Artificial Sequence
  Synthetic oligonucleotide
tcaccaaccgcccgcactcttcccaaggtctcctaa

SEQ ID NO: 174290 - DNA, 35 bp, Artificial Sequence
  Synthetic oligonucleotide
gccgtaccttctgctggcacccacccgtgacgaca

SEQ ID NO: 174291 - DNA, 35 bp, Artificial Sequence
  Synthetic oligonucleotide
atcccaggagcgctctagtataacgcctcctccca

SEQ ID NO: 174292 - DNA, 36 bp, Artificial Sequence
  Synthetic oligonucleotide
atctcactccacctgtctcgcccgggtaccgtccca

SEQ ID NO: 174293 - DNA, 35 bp, Artificial Sequence
  Synthetic oligonucleotide
gaacccatcgtgcgaatgcttgagccacactgcca

SEQ ID NO: 174294 - DNA, 35 bp, Artificial Sequence
  Synthetic oligonucleotide
gctgggacacactatatgcttactttccacctcca

SEQ ID NO: 174295 - DNA, 35 bp, Artificial Sequence
  Synthetic oligonucleotide
aacagcgcgtgtccgcctggtcccgagtccctcca

SEQ ID NO: 174296 - DNA, 35 bp, Artificial Sequence
  Synthetic oligonucleotide
acctacatatgccacccgttctaagtcgacttcca

SEQ ID NO: 174297 - DNA, 36 bp, Artificial Sequence
  Synthetic oligonucleotide
tcgacacgccctcctcgttctgatcgtttcaccgca

SEQ ID NO: 174298 - DNA, 36 bp, Artificial Sequence
  Synthetic oligonucleotide
gtccccaaccacaaggtctcttccagtgcatagtca

SEQ ID NO: 174299 - DNA, 38 bp, Artificial Sequence
  Synthetic oligonucleotide
ggtaatgggaggatggaggtggagctgttaaggggaga

SEQ ID NO: 174300 - DNA, 38 bp, Artificial Sequence
  Synthetic oligonucleotide
gcttgtggtgggtgaatggaggggttcgagggtggaga

SEQ ID NO: 174301 - DNA, 37 bp, Artificial Sequence
  Synthetic oligonucleotide
tcgttcccctccgatttccttcttgcatgtccaacga

SEQ ID NO: 174302 - DNA, 36 bp, Artificial Sequence
  Synthetic oligonucleotide
tccacttcggactggcctacctcgctccgcccacga

SEQ ID NO: 174303 - DNA, 37 bp, Artificial Sequence
  Synthetic oligonucleotide
gtggggggatagggtggagtaccgagacatgagacga

SEQ ID NO: 174304 - DNA, 36 bp, Artificial Sequence
  Synthetic oligonucleotide
tctgcgctcctgattgtgccacgcccctccctacga

SEQ ID NO: 174305 - DNA, 35 bp, Artificial Sequence
  Synthetic oligonucleotide
acgtcccatgccgcttgtttcatcattccgtacga

SEQ ID NO: 174306 - DNA, 37 bp, Artificial Sequence
  Synthetic oligonucleotide
gccgccacatacccttaccgagctcgccgtattacga

SEQ ID NO: 174307 - DNA, 37 bp, Artificial Sequence
  Synthetic oligonucleotide
aaggtgggcgatcgcagggaaagggggggatgaccga

SEQ ID NO: 174308 - DNA, 37 bp, Artificial Sequence
  Synthetic oligonucleotide
gcctccgcacccatttcactgtgatccctactgccga

SEQ ID NO: 174309 - DNA, 37 bp, Artificial Sequence
  Synthetic oligonucleotide
ttcccacccctctgacttatccgactctatctgccga

SEQ ID NO: 174310 - DNA, 37 bp, Artificial Sequence
  Synthetic oligonucleotide
gattgctgcggttgggggggcgaagggacgcgatcga

SEQ ID NO: 174311 - DNA, 36 bp, Artificial Sequence
  Synthetic oligonucleotide
ggggggatagggggggctgacatacgacaaactcga

SEQ ID NO: 174312 - DNA, 37 bp, Artificial Sequence
  Synthetic oligonucleotide
taagcgagcgcacttccgtccccttgtccattttcga

SEQ ID NO: 174313 - DNA, 37 bp, Artificial Sequence
  Synthetic oligonucleotide
gtgataggagggaaggagggacaagattagaagcgga

SEQ ID NO: 174314 - DNA, 36 bp, Artificial Sequence
  Synthetic oligonucleotide
acttggggatgaaaggtgggtgcagaggggggggga

SEQ ID NO: 174315 - DNA, 37 bp, Artificial Sequence
  Synthetic oligonucleotide
gtgaacagggcatgaagggcgggcgagcactggggga

SEQ ID NO: 174316 - DNA, 37 bp, Artificial Sequence
  Synthetic oligonucleotide
agtggagtggtcgggtggggcggctgtgaggtgggga

SEQ ID NO: 174317 - DNA, 36 bp, Artificial Sequence
  Synthetic oligonucleotide
acatcacgcatctcgttatcctcttctttcctggga

SEQ ID NO: 174318 - DNA, 36 bp, Artificial Sequence
  Synthetic oligonucleotide
gagccaacctattcgtacttggcccctccccatgga

SEQ ID NO: 174319 - DNA, 37 bp, Artificial Sequence
  Synthetic oligonucleotide
ttcgctcccctcctacacggtcggacaggcctttgga

SEQ ID NO: 174320 - DNA, 38 bp, Artificial Sequence
  Synthetic oligonucleotide
acggggggaactgagggggacaggggacgatggaatga

SEQ ID NO: 174321 - DNA, 38 bp, Artificial Sequence
  Synthetic oligonucleotide
acatccctcgccccactgtcgttagttaccgctaatga

SEQ ID NO: 174322 - DNA, 37 bp, Artificial Sequence
  Synthetic oligonucleotide
actgtcaggtagggggcgcaacaaagggaggtaatga

SEQ ID NO: 174323 - DNA, 38 bp, Artificial Sequence
  Synthetic oligonucleotide
accacgcgttggcctttctatcaatcacctctctatga

SEQ ID NO: 174324 - DNA, 37 bp, Artificial Sequence
  Synthetic oligonucleotide
acaccgcggttggttactccacgcctgttgccactga

SEQ ID NO: 174325 - DNA, 38 bp, Artificial Sequence
  Synthetic oligonucleotide
atctccggcgcagagctttacgatctactcccacctga

SEQ ID NO: 174326 - DNA, 38 bp, Artificial Sequence
  Synthetic oligonucleotide
tccagcccaatgcatgagtgccatcttccctcacctga

SEQ ID NO: 174327 - DNA, 37 bp, Artificial Sequence
  Synthetic oligonucleotide
atggaggggcaaggggtgtcaagagggagtggcctga

SEQ ID NO: 174328 - DNA, 37 bp, Artificial Sequence
  Synthetic oligonucleotide
ttgtcgcccactgttcgccctgcccatttcattctga

SEQ ID NO: 174329 - DNA, 38 bp, Artificial Sequence
  Synthetic oligonucleotide
atccacccgccccgtgattttagccgatttactggtga

SEQ ID NO: 174330 - DNA, 38 bp, Artificial Sequence
  Synthetic oligonucleotide
tcagggcagggctgggcgggactgacaggtcatattga

SEQ ID NO: 174331 - DNA, 38 bp, Artificial Sequence
  Synthetic oligonucleotide
gagacaccagttcatctttcgcgacctccacttcttga

SEQ ID NO: 174332 - DNA, 38 bp, Artificial Sequence
  Synthetic oligonucleotide
tggagagtcccattatcgtgccacccccactccgttga

SEQ ID NO: 174333 - DNA, 37 bp, Artificial Sequence
  Synthetic oligonucleotide
ggacacttccaccccgccctagccgccatcaatttga

SEQ ID NO: 174334 - DNA, 35 bp, Artificial Sequence
  Synthetic oligonucleotide
attgggcttgcatgggaagggtggggggatggata

SEQ ID NO: 174335 - DNA, 35 bp, Artificial Sequence
  Synthetic oligonucleotide
tacccggccgttattctttgttccatgtcccgcta

SEQ ID NO: 174336 - DNA, 35 bp, Artificial Sequence
  Synthetic oligonucleotide
acttgacgcctgggtttccgtctctcgatcctcta

SEQ ID NO: 174337 - DNA, 36 bp, Artificial Sequence
  Synthetic oligonucleotide
aacgggggggaggctagcgggttgatcgacgtggta

SEQ ID NO: 174338 - DNA, 35 bp, Artificial Sequence
  Synthetic oligonucleotide
tctgcacgactatgccgcattccttcccttcatta

SEQ ID NO: 174339 - DNA, 36 bp, Artificial Sequence
  Synthetic oligonucleotide
agggaggggctgtcttagtattttgggtggggttta

SEQ ID NO: 174340 - DNA, 36 bp, Artificial Sequence
  Synthetic oligonucleotide
gtcctcccgtcccgcccttgcttactagctctttta

SEQ ID NO: 174341 - DNA, 35 bp, Artificial Sequence
  Synthetic oligonucleotide
gtggcggtgccactttcacatcggtgctgatcaac

SEQ ID NO: 174342 - DNA, 35 bp, Artificial Sequence
  Synthetic oligonucleotide
taagccaccagcatttatcccgccccatctgacac

SEQ ID NO: 174343 - DNA, 35 bp, Artificial Sequence
  Synthetic oligonucleotide
gaccccctcgctccgtttgcccacgtacccaggac

SEQ ID NO: 174344 - DNA, 35 bp, Artificial Sequence
  Synthetic oligonucleotide
tccactgcttacatattggtcccttcccacctgac

SEQ ID NO: 174345 - DNA, 35 bp, Artificial Sequence
  Synthetic oligonucleotide
tcctcacgggtctaacctgtctattcgttgcttac

SEQ ID NO: 174346 - DNA, 35 bp, Artificial Sequence
  Synthetic oligonucleotide
gccctcttcactgataggtacttacaccatacacc

SEQ ID NO: 174347 - DNA, 35 bp, Artificial Sequence
  Synthetic oligonucleotide
tgagccccgcattctgtcccgcggatcccactacc

SEQ ID NO: 174348 - DNA, 35 bp, Artificial Sequence
  Synthetic oligonucleotide
accgatgtgatcttcatgttctttatgatccgccc

SEQ ID NO: 174349 - DNA, 35 bp, Artificial Sequence
  Synthetic oligonucleotide
acgaatacggctcatccacgcccgacacactgccc

SEQ ID NO: 174350 - DNA, 35 bp, Artificial Sequence
  Synthetic oligonucleotide
cacgcggtgccgctcctcagttatcgttcttgccc

SEQ ID NO: 174351 - DNA, 35 bp, Artificial Sequence
  Synthetic oligonucleotide
gtgccccgccctagattcagcgggcttctactccc

SEQ ID NO: 174352 - DNA, 35 bp, Artificial Sequence
  Synthetic oligonucleotide
atgacgtcgccctcgtatcctatctgcctggtccc

SEQ ID NO: 174353 - DNA, 35 bp, Artificial Sequence
  Synthetic oligonucleotide
tacacgtacgtattctgagttgttccctcgttccc

SEQ ID NO: 174354 - DNA, 35 bp, Artificial Sequence
  Synthetic oligonucleotide
tccatcctgacctgtttcgccgagcccaatttccc

SEQ ID NO: 174355 - DNA, 35 bp, Artificial Sequence
  Synthetic oligonucleotide
accccgcacaccggggttcaccacccgttttcgcc

SEQ ID NO: 174356 - DNA, 35 bp, Artificial Sequence
  Synthetic oligonucleotide
tcctgaccttccagtggatcgaaccacccaactcc

SEQ ID NO: 174357 - DNA, 35 bp, Artificial Sequence
  Synthetic oligonucleotide
tgtggcgttacgcatcatactttggccctcactcc

SEQ ID NO: 174358 - DNA, 35 bp, Artificial Sequence
  Synthetic oligonucleotide
acccatcaggttcactcgcccggcccacgctgtcc

SEQ ID NO: 174359 - DNA, 35 bp, Artificial Sequence
  Synthetic oligonucleotide
gttcaccgccgcaaccctggacttgtgccacttcc

SEQ ID NO: 174360 - DNA, 35 bp, Artificial Sequence
  Synthetic oligonucleotide
gccatccacgagtacctccatcagtacatagttcc

SEQ ID NO: 174361 - DNA, 35 bp, Artificial Sequence
  Synthetic oligonucleotide
gtcgaacacctgctagtggatcttctcaactttcc

SEQ ID NO: 174362 - DNA, 35 bp, Artificial Sequence
  Synthetic oligonucleotide
gtctaccgccttcgcatacccgccatggaccccgc

SEQ ID NO: 174363 - DNA, 35 bp, Artificial Sequence
  Synthetic oligonucleotide
gacaacacctccagcgtaaacctgcgtcttcccgc

SEQ ID NO: 174364 - DNA, 35 bp, Artificial Sequence
  Synthetic oligonucleotide
tcctgcaccgcgagcttgcacccgtatttatccgc

SEQ ID NO: 174365 - DNA, 35 bp, Artificial Sequence
  Synthetic oligonucleotide
gcaacatccttagtctatatcttaccttccgtggc

SEQ ID NO: 174366 - DNA, 35 bp, Artificial Sequence
  Synthetic oligonucleotide
agcccggccccaggaagaccccgaccctccctatc

SEQ ID NO: 174367 - DNA, 35 bp, Artificial Sequence
  Synthetic oligonucleotide
tcagaccactgttacatcttcattgttgtaccctc

SEQ ID NO: 174368 - DNA, 35 bp, Artificial Sequence
  Synthetic oligonucleotide
gtgagcgcgttcgctaactgcgaccctattgcctc

SEQ ID NO: 174369 - DNA, 35 bp, Artificial Sequence
  Synthetic oligonucleotide
acctgcccacttactcagatgccactttccctctc

SEQ ID NO: 174370 - DNA, 35 bp, Artificial Sequence
  Synthetic oligonucleotide
taggacgagtttcaccctgattttagcacgctctc

SEQ ID NO: 174371 - DNA, 35 bp, Artificial Sequence
  Synthetic oligonucleotide
gtccacgccagccatttccgttgggccgttctctc

SEQ ID NO: 174372 - DNA, 35 bp, Artificial Sequence
  Synthetic oligonucleotide
gcttagcgtcgcccgacccctctttgcgttttgtc

SEQ ID NO: 174373 - DNA, 35 bp, Artificial Sequence
  Synthetic oligonucleotide
tgccctcgtcacgatctcctgaagccatgcccttc

SEQ ID NO: 174374 - DNA, 35 bp, Artificial Sequence
  Synthetic oligonucleotide
ttcgtagaccatcccgagaattagtcgcctccttc

SEQ ID NO: 174375 - DNA, 35 bp, Artificial Sequence
  Synthetic oligonucleotide
gtgcatacctagagtgcctttattttctcccgttc

SEQ ID NO: 174376 - DNA, 35 bp, Artificial Sequence
  Synthetic oligonucleotide
tcctcgacgacgtagtcttcccccgactcactttc

SEQ ID NO: 174377 - DNA, 35 bp, Artificial Sequence
  Synthetic oligonucleotide
gttcgcgtatgcaccccatgtcccggtaccctttc

SEQ ID NO: 174378 - DNA, 35 bp, Artificial Sequence
  Synthetic oligonucleotide
tacatcccgttccgcccctcgagttcccgcatgag

SEQ ID NO: 174379 - DNA, 35 bp, Artificial Sequence
  Synthetic oligonucleotide
gcactccccgcacctcatgtctcaagttaactgag

SEQ ID NO: 174380 - DNA, 35 bp, Artificial Sequence
  Synthetic oligonucleotide
attccagtcccacgacgtcctcatcatgcccttag

SEQ ID NO: 174381 - DNA, 35 bp, Artificial Sequence
  Synthetic oligonucleotide
tgagcgaatgggtatttgcgggatgggcgggaacg

SEQ ID NO: 174382 - DNA, 35 bp, Artificial Sequence
  Synthetic oligonucleotide
ggccgtgccgcattgttgccaccaccaccaccacg

SEQ ID NO: 174383 - DNA, 35 bp, Artificial Sequence
  Synthetic oligonucleotide
gaccttacttcctccgtccattgagctatcccccg

SEQ ID NO: 174384 - DNA, 35 bp, Artificial Sequence
  Synthetic oligonucleotide
acgcggcgcttggttcttgatttctcacctctccg

SEQ ID NO: 174385 - DNA, 35 bp, Artificial Sequence
  Synthetic oligonucleotide
gttatgctggcacccgtgaatctccacctcttgcg

SEQ ID NO: 174386 - DNA, 35 bp, Artificial Sequence
  Synthetic oligonucleotide
tcacctcgcccctagagtaaccatgctttctttcg

SEQ ID NO: 174387 - DNA, 35 bp, Artificial Sequence
  Synthetic oligonucleotide
gtggtgcaaaggtgcaagggcactagggggggagg

SEQ ID NO: 174388 - DNA, 35 bp, Artificial Sequence
  Synthetic oligonucleotide
tccgcctccatccccgtacatttgagttctatagg

SEQ ID NO: 174389 - DNA, 35 bp, Artificial Sequence
  Synthetic oligonucleotide
atcgggggtcggagtaagggcgtgcggggagaggg

SEQ ID NO: 174390 - DNA, 35 bp, Artificial Sequence
  Synthetic oligonucleotide
tgagacggaggaagtggtggaggagagtgaacggg

SEQ ID NO: 174391 - DNA, 35 bp, Artificial Sequence
  Synthetic oligonucleotide
tttgtggtggggaaggggcgggcgggctaagcggg

SEQ ID NO: 174392 - DNA, 35 bp, Artificial Sequence
  Synthetic oligonucleotide
taccgacgctctcaccactgttccatcccatctgg

SEQ ID NO: 174393 - DNA, 35 bp, Artificial Sequence
  Synthetic oligonucleotide
gtgtgcgcgctctgcactccatcttcccctaactg

SEQ ID NO: 174394 - DNA, 35 bp, Artificial Sequence
  Synthetic oligonucleotide
tttagcgctctcaccctccgacgtttgtggccctg

SEQ ID NO: 174395 - DNA, 35 bp, Artificial Sequence
  Synthetic oligonucleotide
gttatgtcgccccatgtcccctggtttttctcttg

SEQ ID NO: 174396 - DNA, 35 bp, Artificial Sequence
  Synthetic oligonucleotide
acgagccgcccccaccgagtgtccgcgcctttaat

SEQ ID NO: 174397 - DNA, 35 bp, Artificial Sequence
  Synthetic oligonucleotide
taatgctgtacactgcgtccctcctgttctaccat

SEQ ID NO: 174398 - DNA, 35 bp, Artificial Sequence
  Synthetic oligonucleotide
actcatccctgcgatatatcgtttaccgcccccat

SEQ ID NO: 174399 - DNA, 35 bp, Artificial Sequence
  Synthetic oligonucleotide
gtgggagggtatccgggtgggtaaggggcacggat

SEQ ID NO: 174400 - DNA, 35 bp, Artificial Sequence
  Synthetic oligonucleotide
gacaggcccaccgatcgagatcacctgccactact

SEQ ID NO: 174401 - DNA, 35 bp, Artificial Sequence
  Synthetic oligonucleotide
tcaccaccttctcgttcaatatcggcctgtaccct

SEQ ID NO: 174402 - DNA, 35 bp, Artificial Sequence
  Synthetic oligonucleotide
agggtgtgccctgcgcccccaatgtttcctgccct

SEQ ID NO: 174403 - DNA, 34 bp, Artificial Sequence
  Synthetic oligonucleotide
gtggctccattcatctgtccaacgtggtctccct

SEQ ID NO: 174404 - DNA, 35 bp, Artificial Sequence
  Synthetic oligonucleotide
tgtccatcgggttgcctacatgtcgatcatctcct

SEQ ID NO: 174405 - DNA, 35 bp, Artificial Sequence
  Synthetic oligonucleotide
gagcacgggcgggcgaagtctagcggggagtggct

SEQ ID NO: 174406 - DNA, 35 bp, Artificial Sequence
  Synthetic oligonucleotide
tccgcctgtagttcttacacctgcctgacattgct

SEQ ID NO: 174407 - DNA, 35 bp, Artificial Sequence
  Synthetic oligonucleotide
tcgtaacctatgcttgtgctttctccattcgctct

SEQ ID NO: 174408 - DNA, 34 bp, Artificial Sequence
  Synthetic oligonucleotide
tcatggtgccatcactcgtgctgccctttgttct

SEQ ID NO: 174409 - DNA, 35 bp, Artificial Sequence
  Synthetic oligonucleotide
ttctcgctacgagcataccctgccccctgatttct

SEQ ID NO: 174410 - DNA, 35 bp, Artificial Sequence
  Synthetic oligonucleotide
tctcgcgctacccgctttcccagtctgacacctgt

SEQ ID NO: 174411 - DNA, 35 bp, Artificial Sequence
  Synthetic oligonucleotide
gatggctcgactcgcccagcctatcacttgccctt

SEQ ID NO: 174412 - DNA, 35 bp, Artificial Sequence
  Synthetic oligonucleotide
gccctggcaccctgcctgtgatagtcctttcgctt

SEQ ID NO: 174413 - DNA, 35 bp, Artificial Sequence
  Synthetic oligonucleotide
tcacagtgcacattgccaagtcctccgttgccttt

SEQ ID NO: 174414 - DNA, 35 bp, Artificial Sequence
  Synthetic oligonucleotide
gccagtacaccatctcaccccggtacagctccttt

SEQ ID NO: 174415 - DNA, 35 bp, Artificial Sequence
  Synthetic oligonucleotide
agttcgcacccgcctagctccttggtctttaccaa

SEQ ID NO: 174416 - DNA, 36 bp, Artificial Sequence
  Synthetic oligonucleotide
ttccacccgccgccaactgcatgcctgccgaatcaa

SEQ ID NO: 174417 - DNA, 35 bp, Artificial Sequence
  Synthetic oligonucleotide
atcgacctcctgcctgactcaaccgacatgtataa

SEQ ID NO: 174418 - DNA, 36 bp, Artificial Sequence
  Synthetic oligonucleotide
gcccccgctgaacattggagccccctgtcttcttaa

SEQ ID NO: 174419 - DNA, 36 bp, Artificial Sequence
  Synthetic oligonucleotide
agcacgatccgacgaaatgactccccgccgccaaca

SEQ ID NO: 174420 - DNA, 36 bp, Artificial Sequence
  Synthetic oligonucleotide
accccgcccccggtatgtctagggttcacaccgaca

SEQ ID NO: 174421 - DNA, 35 bp, Artificial Sequence
  Synthetic oligonucleotide
tactggggggagttagcaggggttggggagtgaca

SEQ ID NO: 174422 - DNA, 36 bp, Artificial Sequence
  Synthetic oligonucleotide
aggacatagcgtgtacgatcttgccactacctacca

SEQ ID NO: 174423 - DNA, 36 bp, Artificial Sequence
  Synthetic oligonucleotide
gccccgcggggatagccccaccatttgcttaaccca

SEQ ID NO: 174424 - DNA, 36 bp, Artificial Sequence
  Synthetic oligonucleotide
atgcgtatctcgcccgttgcccataacctgcaccca

SEQ ID NO: 174425 - DNA, 35 bp, Artificial Sequence
  Synthetic oligonucleotide
ggaaccgcatgggttcgcctcctcactattcccca

SEQ ID NO: 174426 - DNA, 34 bp, Artificial Sequence
  Synthetic oligonucleotide
ttcgccctcgtgctggctcccgattgctctccca

SEQ ID NO: 174427 - DNA, 35 bp, Artificial Sequence
  Synthetic oligonucleotide
gtccgctgagctcctcgaacgttgtctccccgcca

SEQ ID NO: 174428 - DNA, 36 bp, Artificial Sequence
  Synthetic oligonucleotide
aacacgtcacatcgactatcctttgattctctgcca

SEQ ID NO: 174429 - DNA, 35 bp, Artificial Sequence
  Synthetic oligonucleotide
atatccctctccgcatcaacggacagccccttcca

SEQ ID NO: 174430 - DNA, 36 bp, Artificial Sequence
  Synthetic oligonucleotide
atcccccaccaatgccgacgccgcctgggccgcgca

SEQ ID NO: 174431 - DNA, 36 bp, Artificial Sequence
  Synthetic oligonucleotide
tcgccaccccgcatgactttctgcttcacttttgca

SEQ ID NO: 174432 - DNA, 36 bp, Artificial Sequence
  Synthetic oligonucleotide
tgcacgcatgcctctggaccactgccgccgccctca

SEQ ID NO: 174433 - DNA, 36 bp, Artificial Sequence
  Synthetic oligonucleotide
tgtccgctctctaggtctcttaagtcccctccctca

SEQ ID NO: 174434 - DNA, 36 bp, Artificial Sequence
  Synthetic oligonucleotide
tggagccgcgcaagcccgagcatcacctacgcctca

SEQ ID NO: 174435 - DNA, 35 bp, Artificial Sequence
  Synthetic oligonucleotide
ttaatccaccgcactcgtgcccacctggggcctca

SEQ ID NO: 174436 - DNA, 35 bp, Artificial Sequence
  Synthetic oligonucleotide
tacaacaacggcacagctcgactccttaccgctca

SEQ ID NO: 174437 - DNA, 35 bp, Artificial Sequence
  Synthetic oligonucleotide
gcattacaccgctccgcatgaccgaccctttgtca

SEQ ID NO: 174438 - DNA, 36 bp, Artificial Sequence
  Synthetic oligonucleotide
ttcgcccttccgctcattcgttattccctcgtttca

SEQ ID NO: 174439 - DNA, 37 bp, Artificial Sequence
  Synthetic oligonucleotide
aagcggatagagggcaaggggaaagaaagttggcaga

SEQ ID NO: 174440 - DNA, 37 bp, Artificial Sequence
  Synthetic oligonucleotide
ggatgcgggtaggagaaaaaatggggcacggcggaga

SEQ ID NO: 174441 - DNA, 36 bp, Artificial Sequence
  Synthetic oligonucleotide
gcccactcatctacacccgtaccctccctcgggaga

SEQ ID NO: 174442 - DNA, 37 bp, Artificial Sequence
  Synthetic oligonucleotide
tcccagccctcctttacaccccccgcgtctaacacga

SEQ ID NO: 174443 - DNA, 37 bp, Artificial Sequence
  Synthetic oligonucleotide
gggagagggctgtcatgggggaaggggtgggggacga

SEQ ID NO: 174444 - DNA, 37 bp, Artificial Sequence
  Synthetic oligonucleotide
agtgtgcaccgcattcttgttttgttctgttccccga

SEQ ID NO: 174445 - DNA, 37 bp, Artificial Sequence
  Synthetic oligonucleotide
atatcgccacgtcatggtacaacgccttcccgcccga

SEQ ID NO: 174446 - DNA, 37 bp, Artificial Sequence
  Synthetic oligonucleotide
tcccgcccaatgatcatcactacgcgcttcttcccga

SEQ ID NO: 174447 - DNA, 36 bp, Artificial Sequence
  Synthetic oligonucleotide
taagtgggggggtggcttctgggggtaagggaagga

SEQ ID NO: 174448 - DNA, 37 bp, Artificial Sequence
  Synthetic oligonucleotide
ggatagggggacaccaggaaaggagaggtggtgagga

SEQ ID NO: 174449 - DNA, 37 bp, Artificial Sequence
  Synthetic oligonucleotide
atccgtcccatctcgtcacccgccttcacgatccgga

SEQ ID NO: 174450 - DNA, 36 bp, Artificial Sequence
  Synthetic oligonucleotide
gacgacacattctcctttatgcaactgctctccgga

SEQ ID NO: 174451 - DNA, 37 bp, Artificial Sequence
  Synthetic oligonucleotide
gccatctcccttgctctatacgcgccgccccatcgga

SEQ ID NO: 174452 - DNA, 38 bp, Artificial Sequence
  Synthetic oligonucleotide
acgggggcacacatctgggggggcgcaggtattcggga

SEQ ID NO: 174453 - DNA, 37 bp, Artificial Sequence
  Synthetic oligonucleotide
gggtcaacctccgggggggcataattaccgtagggga

SEQ ID NO: 174454 - DNA, 36 bp, Artificial Sequence
  Synthetic oligonucleotide
tagagacagatagttaggcaggagaagggtggggga

SEQ ID NO: 174455 - DNA, 37 bp, Artificial Sequence
  Synthetic oligonucleotide
gagggcaaaaggctttgccataaggggggaggtggga

SEQ ID NO: 174456 - DNA, 37 bp, Artificial Sequence
  Synthetic oligonucleotide
tacgcacgactgcggccccggctctcgttcccctgga

SEQ ID NO: 174457 - DNA, 37 bp, Artificial Sequence
  Synthetic oligonucleotide
gggttgggggggtgggtgagactaaggcggaggtgga

SEQ ID NO: 174458 - DNA, 38 bp, Artificial Sequence
  Synthetic oligonucleotide
gcaccccccgtgatctgttactatcgttttacccatga

SEQ ID NO: 174459 - DNA, 38 bp, Artificial Sequence
  Synthetic oligonucleotide
gacagttgctgtctatcgttgctccccctcttccatga

SEQ ID NO: 174460 - DNA, 37 bp, Artificial Sequence
  Synthetic oligonucleotide
tatagggtgggaggagccgggaggagggagggcatga

SEQ ID NO: 174461 - DNA, 38 bp, Artificial Sequence
  Synthetic oligonucleotide
tctgcatgcctcctgccgccgccaaattctgactatga

SEQ ID NO: 174462 - DNA, 37 bp, Artificial Sequence
  Synthetic oligonucleotide
atcgcatagccatcatagccgaacaccctcctcctga

SEQ ID NO: 174463 - DNA, 36 bp, Artificial Sequence
  Synthetic oligonucleotide
atgttaggggaggggtagacaaagggagagagctga

SEQ ID NO: 174464 - DNA, 38 bp, Artificial Sequence
  Synthetic oligonucleotide
tcacgcgtctgactagtcgctcgcccccccttttctga

SEQ ID NO: 174465 - DNA, 38 bp, Artificial Sequence
  Synthetic oligonucleotide
tgttgcctcctagctctgcccctatttagttatcgtga

SEQ ID NO: 174466 - DNA, 36 bp, Artificial Sequence
  Synthetic oligonucleotide
taagagtgcctctgttatccgcctcccacctcgtga

SEQ ID NO: 174467 - DNA, 38 bp, Artificial Sequence
  Synthetic oligonucleotide
gttctgtgcctagggggaaaagggaaaggagagggtga

SEQ ID NO: 174468 - DNA, 38 bp, Artificial Sequence
  Synthetic oligonucleotide
gccggggaggaaggatggggtgggcggtgaaggggtga

SEQ ID NO: 174469 - DNA, 38 bp, Artificial Sequence
  Synthetic oligonucleotide
tcctacgggagtgagagaggaagggtggaggggggtga

SEQ ID NO: 174470 - DNA, 38 bp, Artificial Sequence
  Synthetic oligonucleotide
tgccctctgcctgctccctgccgttatgccatctgtga

SEQ ID NO: 174471 - DNA, 38 bp, Artificial Sequence
  Synthetic oligonucleotide
gttccccgccactgtgaacaccctctttctctaattga

SEQ ID NO: 174472 - DNA, 38 bp, Artificial Sequence
  Synthetic oligonucleotide
tcccagccttacgagcatttcgcacacctctccattga

SEQ ID NO: 174473 - DNA, 38 bp, Artificial Sequence
  Synthetic oligonucleotide
ataggaggcgggggagcgcgggggtcagggcggattga

SEQ ID NO: 174474 - DNA, 37 bp, Artificial Sequence
  Synthetic oligonucleotide
ttgggaagggtgggtgtgcaaatgggatgcatgttga

SEQ ID NO: 174475 - DNA, 38 bp, Artificial Sequence
  Synthetic oligonucleotide
acccgcatatcgcaacggtcctcgataccactctttga

SEQ ID NO: 174476 - DNA, 36 bp, Artificial Sequence
  Synthetic oligonucleotide
tcacccgggtcctcgggagtaccgctcctgacacta

SEQ ID NO: 174477 - DNA, 35 bp, Artificial Sequence
  Synthetic oligonucleotide
taactccggctctccgactgcttttcaccgtgcta

SEQ ID NO: 174478 - DNA, 35 bp, Artificial Sequence
  Synthetic oligonucleotide
gaagccgtcattgccctaatccgcctgtccaagta

SEQ ID NO: 174479 - DNA, 36 bp, Artificial Sequence
  Synthetic oligonucleotide
ggaccctcggccagtatcattcctgtccttccatta

SEQ ID NO: 174480 - DNA, 36 bp, Artificial Sequence
  Synthetic oligonucleotide
gcctccgtaccctgccttgggacctggattctctta

SEQ ID NO: 174481 - DNA, 36 bp, Artificial Sequence
  Synthetic oligonucleotide
tcccacctcctacgttcataatctaaccaccggtta

SEQ ID NO: 174482 - DNA, 35 bp, Artificial Sequence
  Synthetic oligonucleotide
gccatagcctctcgcccgcctggttatcattcaac

SEQ ID NO: 174483 - DNA, 35 bp, Artificial Sequence
  Synthetic oligonucleotide
accaagcccatcatttctgtcaagtcgtcctgaac

SEQ ID NO: 174484 - DNA, 35 bp, Artificial Sequence
  Synthetic oligonucleotide
aatgtgagccgattcggtgccacccgcccttacac

SEQ ID NO: 174485 - DNA, 35 bp, Artificial Sequence
  Synthetic oligonucleotide
ttgttcctcgcccgtagaccctatgtcatccatac

SEQ ID NO: 174486 - DNA, 35 bp, Artificial Sequence
  Synthetic oligonucleotide
acagacccgtcatcgtcctttcatacgcctcctac

SEQ ID NO: 174487 - DNA, 33 bp, Artificial Sequence
  Synthetic oligonucleotide
ttcgagcgtagatacaagcccgtccgttcctac

SEQ ID NO: 174488 - DNA, 35 bp, Artificial Sequence
  Synthetic oligonucleotide
acgttacccccgcaccaacgctagtatttggctac

SEQ ID NO: 174489 - DNA, 35 bp, Artificial Sequence
  Synthetic oligonucleotide
gtctcccacaacatcatgtccaccaggctttttac

SEQ ID NO: 174490 - DNA, 35 bp, Artificial Sequence
  Synthetic oligonucleotide
tgccggtacaggttccgccccccgccgatctcccc

SEQ ID NO: 174491 - DNA, 34 bp, Artificial Sequence
  Synthetic oligonucleotide
atgtcccttgccccacgatttcgcctactcgccc

SEQ ID NO: 174492 - DNA, 35 bp, Artificial Sequence
  Synthetic oligonucleotide
gttaacgaccggcctcctctgaccacctgatgccc

SEQ ID NO: 174493 - DNA, 35 bp, Artificial Sequence
  Synthetic oligonucleotide
accgtcgcgcctcacaattatgttcccatctggcc

SEQ ID NO: 174494 - DNA, 35 bp, Artificial Sequence
  Synthetic oligonucleotide
tgaccggttatagcggtttgcgactccgccctgcc

SEQ ID NO: 174495 - DNA, 35 bp, Artificial Sequence
  Synthetic oligonucleotide
tccggtcgccctgccatccttcgtcaatctgatcc

SEQ ID NO: 174496 - DNA, 35 bp, Artificial Sequence
  Synthetic oligonucleotide
attcccccctatctgtaatgtttacaatggcctcc

SEQ ID NO: 174497 - DNA, 35 bp, Artificial Sequence
  Synthetic oligonucleotide
tacaccctccccgatttcgtaaggccctggcctcc

SEQ ID NO: 174498 - DNA, 35 bp, Artificial Sequence
  Synthetic oligonucleotide
tgttgacgctggcgtcttcagaaccgcactcctcc

SEQ ID NO: 174499 - DNA, 35 bp, Artificial Sequence
  Synthetic oligonucleotide
gtcagatctcaccgcgtgatccctgcactctgtcc

SEQ ID NO: 174500 - DNA, 34 bp, Artificial Sequence
  Synthetic oligonucleotide
ttcgccgccccattgcttgttccatctgtcttcc

SEQ ID NO: 174501 - DNA, 35 bp, Artificial Sequence
  Synthetic oligonucleotide
attatacgcatggctcatgacgtcgccacctttcc

SEQ ID NO: 174502 - DNA, 35 bp, Artificial Sequence
  Synthetic oligonucleotide
agtgcatacgtcctgcatctaaaaagctcctccgc

SEQ ID NO: 174503 - DNA, 35 bp, Artificial Sequence
  Synthetic oligonucleotide
tcccctacgcccgtgctctacttcgtttccatcgc

SEQ ID NO: 174504 - DNA, 35 bp, Artificial Sequence
  Synthetic oligonucleotide
ttgcaaccctgcgtggaccaacgcctccctatcgc

SEQ ID NO: 174505 - DNA, 35 bp, Artificial Sequence
  Synthetic oligonucleotide
tcagcacctctccggcttagcaccctttatttcgc

SEQ ID NO: 174506 - DNA, 35 bp, Artificial Sequence
  Synthetic oligonucleotide
gctctgttgctgccacgcctccgccctctgtcggc

SEQ ID NO: 174507 - DNA, 35 bp, Artificial Sequence
  Synthetic oligonucleotide
gtgtcctcgctatctgttcgccccctgttccctgc

SEQ ID NO: 174508 - DNA, 35 bp, Artificial Sequence
  Synthetic oligonucleotide
cccgcattccgccacatcaccacttcatcacttgc

SEQ ID NO: 174509 - DNA, 35 bp, Artificial Sequence
  Synthetic oligonucleotide
tctcctgccaccatacccggccgacaatttcttgc

SEQ ID NO: 174510 - DNA, 35 bp, Artificial Sequence
  Synthetic oligonucleotide
tccgcacgtccggctcctgatttacgcctaccatc

SEQ ID NO: 174511 - DNA, 34 bp, Artificial Sequence
  Synthetic oligonucleotide
ggtcgggcgctgcatcctttcacactcgcctatc

SEQ ID NO: 174512 - DNA, 35 bp, Artificial Sequence
  Synthetic oligonucleotide
gtggggcgccggctcccagtaccgccatttttatc

SEQ ID NO: 174513 - DNA, 35 bp, Artificial Sequence
  Synthetic oligonucleotide
gaaccgacacatcctcctcgcttggcgtacaactc

SEQ ID NO: 174514 - DNA, 35 bp, Artificial Sequence
  Synthetic oligonucleotide
acgcgctcctcccgcgcagccatccgcctcacctc

SEQ ID NO: 174515 - DNA, 35 bp, Artificial Sequence
  Synthetic oligonucleotide
atccccctgctgcgtaacttagccagatcatcctc

SEQ ID NO: 174516 - DNA, 35 bp, Artificial Sequence
  Synthetic oligonucleotide
ggccttggccctgaccgcctctatcctgcatgctc

SEQ ID NO: 174517 - DNA, 35 bp, Artificial Sequence
  Synthetic oligonucleotide
attgccgtttgcatccggcctagtatacccttctc

SEQ ID NO: 174518 - DNA, 35 bp, Artificial Sequence
  Synthetic oligonucleotide
tccatgtagcgtctgccgctgattttcatcttctc

SEQ ID NO: 174519 - DNA, 35 bp, Artificial Sequence
  Synthetic oligonucleotide
gttccatccccccccgtcgttcataaattgtagtc

SEQ ID NO: 174520 - DNA, 35 bp, Artificial Sequence
  Synthetic oligonucleotide
acttcccacgtgtcgcgcgttccatccggcaattc

SEQ ID NO: 174521 - DNA, 35 bp, Artificial Sequence
  Synthetic oligonucleotide
actgccgaacggcgacttgcgagttccaccacttc

SEQ ID NO: 174522 - DNA, 35 bp, Artificial Sequence
  Synthetic oligonucleotide
aaacgggcggcaagggggggtaaataatgggcaag

SEQ ID NO: 174523 - DNA, 35 bp, Artificial Sequence
  Synthetic oligonucleotide
agtacacccgcaatattacccgccacctgcacccg

SEQ ID NO: 174524 - DNA, 32 bp, Artificial Sequence
  Synthetic oligonucleotide
gttcatccagaccccgcttgtttaacgccccg

SEQ ID NO: 174525 - DNA, 35 bp, Artificial Sequence
  Synthetic oligonucleotide
agttagaggggtgggtgtggtgggaaggctcgccg

SEQ ID NO: 174526 - DNA, 35 bp, Artificial Sequence
  Synthetic oligonucleotide
attcggccgtcggaccacccgccaactctcgtccg

SEQ ID NO: 174527 - DNA, 35 bp, Artificial Sequence
  Synthetic oligonucleotide
atttctcagcccatctctttgcacgacactccgcg

SEQ ID NO: 174528 - DNA, 35 bp, Artificial Sequence
  Synthetic oligonucleotide
tagatgccggtgatcgggggggtgggaggcatagg

SEQ ID NO: 174529 - DNA, 35 bp, Artificial Sequence
  Synthetic oligonucleotide
tgctgactcatctcccccgcacccagcttcgccgg

SEQ ID NO: 174530 - DNA, 35 bp, Artificial Sequence
  Synthetic oligonucleotide
tccactgctgttctttccgacctcccatctacatg

SEQ ID NO: 174531 - DNA, 35 bp, Artificial Sequence
  Synthetic oligonucleotide
gtatacacccctctgtcgcgccccccacctgcatg

SEQ ID NO: 174532 - DNA, 35 bp, Artificial Sequence
  Synthetic oligonucleotide
gacgctacggcgccctgttactcaatgtcccactg

SEQ ID NO: 174533 - DNA, 35 bp, Artificial Sequence
  Synthetic oligonucleotide
cacgagcaatcgcgtgcttttcatactcttgcctg

SEQ ID NO: 174534 - DNA, 35 bp, Artificial Sequence
  Synthetic oligonucleotide
aatctgcccccgtccggttacgatccttatatctg

SEQ ID NO: 174535 - DNA, 35 bp, Artificial Sequence
  Synthetic oligonucleotide
tcaatcaccctcaccttcataagcctcctggtctg

SEQ ID NO: 174536 - DNA, 35 bp, Artificial Sequence
  Synthetic oligonucleotide
actccatgtcatctatccccccccgtacgattgtg

SEQ ID NO: 174537 - DNA, 35 bp, Artificial Sequence
  Synthetic oligonucleotide
agccacatcatggacccatcttcaccacgtacttg

SEQ ID NO: 174538 - DNA, 35 bp, Artificial Sequence
  Synthetic oligonucleotide
gatctcgcggcaacattctagcgcatcacttccat

SEQ ID NO: 174539 - DNA, 35 bp, Artificial Sequence
  Synthetic oligonucleotide
atgggagggagggccgggtacgaggcagggggcat

SEQ ID NO: 174540 - DNA, 35 bp, Artificial Sequence
  Synthetic oligonucleotide
tgctacgtgctttacccgccgccattgccttggat

SEQ ID NO: 174541 - DNA, 35 bp, Artificial Sequence
  Synthetic oligonucleotide
ttagtgcccgcggacggtcgcccacttctcccact

SEQ ID NO: 174542 - DNA, 35 bp, Artificial Sequence
  Synthetic oligonucleotide
tgttccaacccctgtgggtcctgcctacagtacct

SEQ ID NO: 174543 - DNA, 35 bp, Artificial Sequence
  Synthetic oligonucleotide
aatggtccctgctctatcgttctatggccacccct

SEQ ID NO: 174544 - DNA, 35 bp, Artificial Sequence
  Synthetic oligonucleotide
atcgtcacgcctccccgttctcagtattatcggct

SEQ ID NO: 174545 - DNA, 32 bp, Artificial Sequence
  Synthetic oligonucleotide
tcctatgttccctggtaccctacagcactgct

SEQ ID NO: 174546 - DNA, 35 bp, Artificial Sequence
  Synthetic oligonucleotide
tgcctgccggtatagtcgaatccgccccactttct

SEQ ID NO: 174547 - DNA, 35 bp, Artificial Sequence
  Synthetic oligonucleotide
ttcgacccaccgccctgttggagtaagttctccgt

SEQ ID NO: 174548 - DNA, 31 bp, Artificial Sequence
  Synthetic oligonucleotide
cacacgccccccgcgccccggtacacttggt

SEQ ID NO: 174549 - DNA, 35 bp, Artificial Sequence
  Synthetic oligonucleotide
tactagcgacacgacttcgatatcttggtgccctt

SEQ ID NO: 174550 - DNA, 35 bp, Artificial Sequence
  Synthetic oligonucleotide
cctcacgttctggtccgtcatcccctcagtccctt

SEQ ID NO: 174551 - DNA, 35 bp, Artificial Sequence
  Synthetic oligonucleotide
accacacaacttgttccgaagccgactcgttcctt

SEQ ID NO: 174552 - DNA, 35 bp, Artificial Sequence
  Synthetic oligonucleotide
gaacgttgcctcaccttgtaaaacgctcttctctt

SEQ ID NO: 174553 - DNA, 35 bp, Artificial Sequence
  Synthetic oligonucleotide
gccatgcccctcggtgctcaataccttaccccgtt

SEQ ID NO: 174554 - DNA, 35 bp, Artificial Sequence
  Synthetic oligonucleotide
agtgcagagggcttagctggcgggtgggaggggtt

SEQ ID NO: 174555 - DNA, 35 bp, Artificial Sequence
  Synthetic oligonucleotide
agtcaccctggaggctaccgttcccttcaccattt

SEQ ID NO: 174556 - DNA, 35 bp, Artificial Sequence
  Synthetic oligonucleotide
actgctcaccctccaccgcgtattgctagcctttt

SEQ ID NO: 174557 - DNA, 35 bp, Artificial Sequence
  Synthetic oligonucleotide
gtcctggatccgctgttcatccgtcgttcctcaaa

SEQ ID NO: 174558 - DNA, 36 bp, Artificial Sequence
  Synthetic oligonucleotide
gatgtaagagagggtagcaaaggacaagagaggaaa

SEQ ID NO: 174559 - DNA, 35 bp, Artificial Sequence
  Synthetic oligonucleotide
gcaggtgggaggcattggggggaagctgacacgaa

SEQ ID NO: 174560 - DNA, 36 bp, Artificial Sequence
  Synthetic oligonucleotide
taccctccgcaaacatgtgaccgccccctccacgaa

SEQ ID NO: 174561 - DNA, 35 bp, Artificial Sequence
  Synthetic oligonucleotide
agtcctgatcgagggcgggagaaggggagggtgaa

SEQ ID NO: 174562 - DNA, 36 bp, Artificial Sequence
  Synthetic oligonucleotide
gcaggaacgcagggaggaatgagggatcgggtctaa

SEQ ID NO: 174563 - DNA, 36 bp, Artificial Sequence
  Synthetic oligonucleotide
ggacagacctgcaattgagtcctcgcccactacaca

SEQ ID NO: 174564 - DNA, 35 bp, Artificial Sequence
  Synthetic oligonucleotide
tccacaacgccatcccccctagactatcgctcaca

SEQ ID NO: 174565 - DNA, 36 bp, Artificial Sequence
  Synthetic oligonucleotide
attggcggaaggcacagggggggttcggggtggaca

SEQ ID NO: 174566 - DNA, 36 bp, Artificial Sequence
  Synthetic oligonucleotide
tcgcagcctgaactgttttccaccttgccatgtaca

SEQ ID NO: 174567 - DNA, 36 bp, Artificial Sequence
  Synthetic oligonucleotide
ttagaggaacggagggggaagaaattgcggtgtaca

SEQ ID NO: 174568 - DNA, 35 bp, Artificial Sequence
  Synthetic oligonucleotide
tgcaacgtagcttgccagccaccctcctgtttaca

SEQ ID NO: 174569 - DNA, 36 bp, Artificial Sequence
  Synthetic oligonucleotide
acgacaccctggcccccgcccacttactgatcccca

SEQ ID NO: 174570 - DNA, 35 bp, Artificial Sequence
  Synthetic oligonucleotide
ttactcctcgtacggtactgaccctatgctgccca

SEQ ID NO: 174571 - DNA, 35 bp, Artificial Sequence
  Synthetic oligonucleotide
ggggtcactcatcgctatgcctgctctgcctccca

SEQ ID NO: 174572 - DNA, 36 bp, Artificial Sequence
  Synthetic oligonucleotide
gcatcgcacccgttcaccacagctctctgcaagcca

SEQ ID NO: 174573 - DNA, 35 bp, Artificial Sequence
  Synthetic oligonucleotide
atccccactctatgcagccctgccgttctatgcca

SEQ ID NO: 174574 - DNA, 36 bp, Artificial Sequence
  Synthetic oligonucleotide
tcctacctgcactgccccgttagttaccagtttcca

SEQ ID NO: 174575 - DNA, 35 bp, Artificial Sequence
  Synthetic oligonucleotide
aacatgccagtgggagaaggaagggagagggggca

SEQ ID NO: 174576 - DNA, 35 bp, Artificial Sequence
  Synthetic oligonucleotide
agcaccacccgcgctgtcaggagcttgtctctgca

SEQ ID NO: 174577 - DNA, 36 bp, Artificial Sequence
  Synthetic oligonucleotide
ggtcaggtcaaactccgtcccgccccccgccgtgca

SEQ ID NO: 174578 - DNA, 35 bp, Artificial Sequence
  Synthetic oligonucleotide
gctcgcattccttccgcacattagtgtctgcttca

SEQ ID NO: 174579 - DNA, 36 bp, Artificial Sequence
  Synthetic oligonucleotide
acgagaacaagagaggggtgggagacgaggatttca

SEQ ID NO: 174580 - DNA, 36 bp, Artificial Sequence
  Synthetic oligonucleotide
aatcatcccagagctttggcctgctcacctttttca

SEQ ID NO: 174581 - DNA, 37 bp, Artificial Sequence
  Synthetic oligonucleotide
tctccgtcgctgcttcctcgttttccctctccggaga

SEQ ID NO: 174582 - DNA, 36 bp, Artificial Sequence
  Synthetic oligonucleotide
acatgtggagggcggatagggaaagagggtgggaga

SEQ ID NO: 174583 - DNA, 37 bp, Artificial Sequence
  Synthetic oligonucleotide
tacatggagggtgagggaatagtaggatgggggtaga

SEQ ID NO: 174584 - DNA, 35 bp, Artificial Sequence
  Synthetic oligonucleotide
acgaccatttccgttcacattgccgctggtaccga

SEQ ID NO: 174585 - DNA, 37 bp, Artificial Sequence
  Synthetic oligonucleotide
aaatagcgccagttgtcaattccgtcctccgccccga

SEQ ID NO: 174586 - DNA, 37 bp, Artificial Sequence
  Synthetic oligonucleotide
aagctccgacctgggtcccttcctgccgttccgccga

SEQ ID NO: 174587 - DNA, 37 bp, Artificial Sequence
  Synthetic oligonucleotide
gcaaccgcctcgtatgccattccgcctgcttcgccga

SEQ ID NO: 174588 - DNA, 37 bp, Artificial Sequence
  Synthetic oligonucleotide
tgcaccctacttgtcttttgatcgcgtccgcttccga

SEQ ID NO: 174589 - DNA, 37 bp, Artificial Sequence
  Synthetic oligonucleotide
tgaatgggagggcatgagggaggatggggccttgcga

SEQ ID NO: 174590 - DNA, 37 bp, Artificial Sequence
  Synthetic oligonucleotide
gccacccgccatatagcttcattctttcgtttatcga

SEQ ID NO: 174591 - DNA, 37 bp, Artificial Sequence
  Synthetic oligonucleotide
gtggtcctgcgacgatcctgcccctcctttcggtcga

SEQ ID NO: 174592 - DNA, 37 bp, Artificial Sequence
  Synthetic oligonucleotide
tggacggggtagattgtggggaggggagggcttagga

SEQ ID NO: 174593 - DNA, 35 bp, Artificial Sequence
  Synthetic oligonucleotide
ggaccgggtgggagggagagggtttggtataggga

SEQ ID NO: 174594 - DNA, 37 bp, Artificial Sequence
  Synthetic oligonucleotide
ggatcggtagagggggaaggggggtgaggtatcggga

SEQ ID NO: 174595 - DNA, 37 bp, Artificial Sequence
  Synthetic oligonucleotide
agagtagcaggaccggagcgttgaggggggcggggga

SEQ ID NO: 174596 - DNA, 36 bp, Artificial Sequence
  Synthetic oligonucleotide
tccgcagtgaggagggggaaataaccgaggatggga

SEQ ID NO: 174597 - DNA, 36 bp, Artificial Sequence
  Synthetic oligonucleotide
gtaacagggagaggaaccgaggagaaggggtatgga

SEQ ID NO: 174598 - DNA, 37 bp, Artificial Sequence
  Synthetic oligonucleotide
ggtgtacgcgggtgtctagggtgggagggggaaatga

SEQ ID NO: 174599 - DNA, 36 bp, Artificial Sequence
  Synthetic oligonucleotide
ggccaccaccgctttgactgatcgatctcgccctga

SEQ ID NO: 174600 - DNA, 38 bp, Artificial Sequence
  Synthetic oligonucleotide
taaacagccctgtccgcttctatacccgacctccctga

SEQ ID NO: 174601 - DNA, 38 bp, Artificial Sequence
  Synthetic oligonucleotide
ttcaccgccgactatttcaccgtctatcactcgcctga

SEQ ID NO: 174602 - DNA, 37 bp, Artificial Sequence
  Synthetic oligonucleotide
gagccgtgctcccactgttcaaaccaccatcatctga

SEQ ID NO: 174603 - DNA, 37 bp, Artificial Sequence
  Synthetic oligonucleotide
gatgtctatgtgcccatcgcccctgttcacactctga

SEQ ID NO: 174604 - DNA, 38 bp, Artificial Sequence
  Synthetic oligonucleotide
tgtgccacgtaacatcccgccgctacctcgccgtctga

SEQ ID NO: 174605 - DNA, 38 bp, Artificial Sequence
  Synthetic oligonucleotide
gcccatccctcaccgtaatcctgcctcaggctttctga

SEQ ID NO: 174606 - DNA, 38 bp, Artificial Sequence
  Synthetic oligonucleotide
acgcaacttcccgttcgccctcccccgtcatctagtga

SEQ ID NO: 174607 - DNA, 37 bp, Artificial Sequence
  Synthetic oligonucleotide
aaacagaagaggggaggggtacgggcgggtaccgtga

SEQ ID NO: 174608 - DNA, 37 bp, Artificial Sequence
  Synthetic oligonucleotide
cgctgtatgccgcttgtttcattgttccctcctgtga

SEQ ID NO: 174609 - DNA, 35 bp, Artificial Sequence
  Synthetic oligonucleotide
tcagagagggagaataggggggggaatcaaacata

SEQ ID NO: 174610 - DNA, 36 bp, Artificial Sequence
  Synthetic oligonucleotide
acgcggggtctgggggaggcgggaaaggataagata

SEQ ID NO: 174611 - DNA, 36 bp, Artificial Sequence
  Synthetic oligonucleotide
gtcgggggacaggggggaggggcgtgcacaggacta

SEQ ID NO: 174612 - DNA, 36 bp, Artificial Sequence
  Synthetic oligonucleotide
gccgggcactcttctgttacttgggcctctctttta

SEQ ID NO: 174613 - DNA, 34 bp, Artificial Sequence
  Synthetic oligonucleotide
gccaacctcccggccattcttgttaaggctacac

SEQ ID NO: 174614 - DNA, 35 bp, Artificial Sequence
  Synthetic oligonucleotide
gaagctgggacatcatcggtttctctcgcctccac

SEQ ID NO: 174615 - DNA, 35 bp, Artificial Sequence
  Synthetic oligonucleotide
tttcgccaccacacttcccccactataactgtgac

SEQ ID NO: 174616 - DNA, 35 bp, Artificial Sequence
  Synthetic oligonucleotide
tcctggtcctgcagcgagtcttcccaccttcgtac

SEQ ID NO: 174617 - DNA, 35 bp, Artificial Sequence
  Synthetic oligonucleotide
tcgctcggaacaaacagcattgacacacgcccccc

SEQ ID NO: 174618 - DNA, 35 bp, Artificial Sequence
  Synthetic oligonucleotide
gtgccttcgacgacgccactcttcgcccatgcccc

SEQ ID NO: 174619 - DNA, 33 bp, Artificial Sequence
  Synthetic oligonucleotide
aatctcaacccgtcacactccatgcgtgcgccc

SEQ ID NO: 174620 - DNA, 35 bp, Artificial Sequence
  Synthetic oligonucleotide
gttagtgccggcaactcatcgtcccgctgtcgccc

SEQ ID NO: 174621 - DNA, 35 bp, Artificial Sequence
  Synthetic oligonucleotide
accacacccctagcctataaccgaaggccttgccc

SEQ ID NO: 174622 - DNA, 35 bp, Artificial Sequence
  Synthetic oligonucleotide
ggtagccgcacccccccatctctggcctcgcagcc

SEQ ID NO: 174623 - DNA, 36 bp, Artificial Sequence
  Synthetic oligonucleotide
gtcaagtcgtatgtttcgtgccaatccgtgtccgcc

SEQ ID NO: 174624 - DNA, 35 bp, Artificial Sequence
  Synthetic oligonucleotide
acgctctcactgaccgccattttttgttcctcgcc

SEQ ID NO: 174625 - DNA, 35 bp, Artificial Sequence
  Synthetic oligonucleotide
ggttccgcaaagctcttctcagtacacgccgctcc

SEQ ID NO: 174626 - DNA, 35 bp, Artificial Sequence
  Synthetic oligonucleotide
ttggtcaagctctgccatcgccagctttcatctcc

SEQ ID NO: 174627 - DNA, 35 bp, Artificial Sequence
  Synthetic oligonucleotide
gccgtccggcaggttatctttcgcgttcgtagtcc

SEQ ID NO: 174628 - DNA, 35 bp, Artificial Sequence
  Synthetic oligonucleotide
gaagccaggttgtacctattctcaccccttcgtcc

SEQ ID NO: 174629 - DNA, 35 bp, Artificial Sequence
  Synthetic oligonucleotide
acctcgcctctctgatattcgtccaagtccgttcc

SEQ ID NO: 174630 - DNA, 35 bp, Artificial Sequence
  Synthetic oligonucleotide
gcccgaaatccgcctcccagcctcctgctctcagc

SEQ ID NO: 174631 - DNA, 35 bp, Artificial Sequence
  Synthetic oligonucleotide
tcacaccgattcgcgaggtggttccctctttcagc

SEQ ID NO: 174632 - DNA, 35 bp, Artificial Sequence
  Synthetic oligonucleotide
gcccccccctcgcattgttagctcacgtcacccgc

SEQ ID NO: 174633 - DNA, 35 bp, Artificial Sequence
  Synthetic oligonucleotide
aactcccgtgatatcgccctctgacttgtcctcgc

SEQ ID NO: 174634 - DNA, 35 bp, Artificial Sequence
  Synthetic oligonucleotide
tccaacgggtggggggaaggaaaaatgggatctgc

SEQ ID NO: 174635 - DNA, 35 bp, Artificial Sequence
  Synthetic oligonucleotide
tgtactctcgagcactggcccttgcttcctgcctc

SEQ ID NO: 174636 - DNA, 35 bp, Artificial Sequence
  Synthetic oligonucleotide
tttgccgatgcccaccgctggcagtttccctcttc

SEQ ID NO: 174637 - DNA, 35 bp, Artificial Sequence
  Synthetic oligonucleotide
accactcacgccgcccgtcgcgtgcatcttagttc

SEQ ID NO: 174638 - DNA, 35 bp, Artificial Sequence
  Synthetic oligonucleotide
agggccacctctgaactaaattaccgccgccgttc

SEQ ID NO: 174639 - DNA, 35 bp, Artificial Sequence
  Synthetic oligonucleotide
gttgtcgcacttaaaccctgatattggccctgttc

SEQ ID NO: 174640 - DNA, 35 bp, Artificial Sequence
  Synthetic oligonucleotide
tgcctcatcccgtttccccccctgtatctatggcg

SEQ ID NO: 174641 - DNA, 35 bp, Artificial Sequence
  Synthetic oligonucleotide
tcagagcgcaaggaaggagggtaggaggacttgcg

SEQ ID NO: 174642 - DNA, 35 bp, Artificial Sequence
  Synthetic oligonucleotide
atgcgacgaaggtagggagtagagggaggtgcggg

SEQ ID NO: 174643 - DNA, 35 bp, Artificial Sequence
  Synthetic oligonucleotide
gggaggtgggttggcaaggggaccggggcgatggg

SEQ ID NO: 174644 - DNA, 35 bp, Artificial Sequence
  Synthetic oligonucleotide
ggatccccttttagtgtcctgccccccatccctgg

SEQ ID NO: 174645 - DNA, 35 bp, Artificial Sequence
  Synthetic oligonucleotide
tcgcatgcactcacttcactgctccatttgccatg

SEQ ID NO: 174646 - DNA, 35 bp, Artificial Sequence
  Synthetic oligonucleotide
tctcaccatcattcgtttcatgtcttttacctatg

SEQ ID NO: 174647 - DNA, 35 bp, Artificial Sequence
  Synthetic oligonucleotide
aatctcagccgtcaatcttcctcgcccttgttatg

SEQ ID NO: 174648 - DNA, 35 bp, Artificial Sequence
  Synthetic oligonucleotide
gggacagagcccatccaacgcaccccacacacctg

SEQ ID NO: 174649 - DNA, 35 bp, Artificial Sequence
  Synthetic oligonucleotide
tgacgttggcaaagatgtctacccatccatccctg

SEQ ID NO: 174650 - DNA, 35 bp, Artificial Sequence
  Synthetic oligonucleotide
tccccacacccgcccgatcgatctcgttccccgtg

SEQ ID NO: 174651 - DNA, 35 bp, Artificial Sequence
  Synthetic oligonucleotide
tagtgggggtgggtaaatgggtggtggaaatcgtg

SEQ ID NO: 174652 - DNA, 35 bp, Artificial Sequence
  Synthetic oligonucleotide
tgacgcttccatcagtttacactttgccccccttg

SEQ ID NO: 174653 - DNA, 35 bp, Artificial Sequence
  Synthetic oligonucleotide
ttgtgcaactcgggcactagttgtcttcttccttg

SEQ ID NO: 174654 - DNA, 35 bp, Artificial Sequence
  Synthetic oligonucleotide
actcgccacaaaatcgccatcctttctcctgcttg

SEQ ID NO: 174655 - DNA, 35 bp, Artificial Sequence
  Synthetic oligonucleotide
tgcagaggataccgccacatcgcccgtacttccat

SEQ ID NO: 174656 - DNA, 35 bp, Artificial Sequence
  Synthetic oligonucleotide
acaccgtctcagggctttctcccactggcatacct

SEQ ID NO: 174657 - DNA, 35 bp, Artificial Sequence
  Synthetic oligonucleotide
ataccgcacctcctgtactctcgagtgttgcccct

SEQ ID NO: 174658 - DNA, 35 bp, Artificial Sequence
  Synthetic oligonucleotide
tccacttgccttcccaggtccgaatgacttggcct

SEQ ID NO: 174659 - DNA, 34 bp, Artificial Sequence
  Synthetic oligonucleotide
accgcatcctgcacctcttcgtccgtacctgcct

SEQ ID NO: 174660 - DNA, 35 bp, Artificial Sequence
  Synthetic oligonucleotide
taccgatgcctaactgttctgttgatcccactcct

SEQ ID NO: 174661 - DNA, 35 bp, Artificial Sequence
  Synthetic oligonucleotide
tccactgcttcgaaatcggcgcctcctacgctcct

SEQ ID NO: 174662 - DNA, 35 bp, Artificial Sequence
  Synthetic oligonucleotide
gcacatactccgggctgtcctgttctcggtctcct

SEQ ID NO: 174663 - DNA, 35 bp, Artificial Sequence
  Synthetic oligonucleotide
gaccatgtccagtgtggctcgccttctatgttcct

SEQ ID NO: 174664 - DNA, 35 bp, Artificial Sequence
  Synthetic oligonucleotide
ttcaccgttcgttcgtcactcctcccctttgatct

SEQ ID NO: 174665 - DNA, 35 bp, Artificial Sequence
  Synthetic oligonucleotide
gtggtccgcccccgacatcagttccccattacagt

SEQ ID NO: 174666 - DNA, 35 bp, Artificial Sequence
  Synthetic oligonucleotide
tcccgcacctccaccgccgccccccgctcactcgt

SEQ ID NO: 174667 - DNA, 35 bp, Artificial Sequence
  Synthetic oligonucleotide
ttcgattcaaccgccgccatagacgatcctttcgt

SEQ ID NO: 174668 - DNA, 35 bp, Artificial Sequence
  Synthetic oligonucleotide
ggggtaggaacacgggagtaatagttagggaaggt

SEQ ID NO: 174669 - DNA, 35 bp, Artificial Sequence
  Synthetic oligonucleotide
actgaaagaccgtgctccccctcctcgcctgtggt

SEQ ID NO: 174670 - DNA, 35 bp, Artificial Sequence
  Synthetic oligonucleotide
gtcaagcctcaaaccctcctccgcggatgacatgt

SEQ ID NO: 174671 - DNA, 35 bp, Artificial Sequence
  Synthetic oligonucleotide
aatacgcacctcctacttcttgcttacagccttgt

SEQ ID NO: 174672 - DNA, 35 bp, Artificial Sequence
  Synthetic oligonucleotide
aaccgaacgtcggtggcctcacgttctgtctcctt

SEQ ID NO: 174673 - DNA, 35 bp, Artificial Sequence
  Synthetic oligonucleotide
gtcccacctatcactcagtacttctagcctgtctt

SEQ ID NO: 174674 - DNA, 35 bp, Artificial Sequence
  Synthetic oligonucleotide
gagaggtggatgggagggctgtggcgaaagctgtt

SEQ ID NO: 174675 - DNA, 35 bp, Artificial Sequence
  Synthetic oligonucleotide
gctccccttatgtccctgttcgtgcccgattattt

SEQ ID NO: 174676 - DNA, 36 bp, Artificial Sequence
  Synthetic oligonucleotide
aaagtgggagggtggagggtcggtcgcacgtgtaaa

SEQ ID NO: 174677 - DNA, 36 bp, Artificial Sequence
  Synthetic oligonucleotide
tgatcatacggggttgggagggggggcgagcgagaa

SEQ ID NO: 174678 - DNA, 35 bp, Artificial Sequence
  Synthetic oligonucleotide
gaccctgccaaggtctcttgtttccctctctgaca

SEQ ID NO: 174679 - DNA, 35 bp, Artificial Sequence
  Synthetic oligonucleotide
aaggccggtagcatgcactgtcgccctctcctaca

SEQ ID NO: 174680 - DNA, 35 bp, Artificial Sequence
  Synthetic oligonucleotide
gcctcatcagtgcctatcatccaccgttaaaccca

SEQ ID NO: 174681 - DNA, 35 bp, Artificial Sequence
  Synthetic oligonucleotide
acacacgcgcaccactgttccacctctagtcgcca

SEQ ID NO: 174682 - DNA, 36 bp, Artificial Sequence
  Synthetic oligonucleotide
gcgatacagtcccttgtcctaacttcaccgctgcca

SEQ ID NO: 174683 - DNA, 36 bp, Artificial Sequence
  Synthetic oligonucleotide
taccaaccgagttgacacattatgaccccccctcca

SEQ ID NO: 174684 - DNA, 36 bp, Artificial Sequence
  Synthetic oligonucleotide
tactccttccacatgaaccttgcagttgcgtatgca

SEQ ID NO: 174685 - DNA, 36 bp, Artificial Sequence
  Synthetic oligonucleotide
actccccgtaccaaccttctcgccgcattaagtgca

SEQ ID NO: 174686 - DNA, 36 bp, Artificial Sequence
  Synthetic oligonucleotide
aacaccccgcacatttgattatcgttccaggttgca

SEQ ID NO: 174687 - DNA, 35 bp, Artificial Sequence
  Synthetic oligonucleotide
aacacctctatgtatttgtcactcgcgttttctca

SEQ ID NO: 174688 - DNA, 37 bp, Artificial Sequence
  Synthetic oligonucleotide
agtaccaacccagtgtcactctcccaccccctgcaga

SEQ ID NO: 174689 - DNA, 37 bp, Artificial Sequence
  Synthetic oligonucleotide
tcgccaccctgctccactgtgcaacgcgccactacga

SEQ ID NO: 174690 - DNA, 35 bp, Artificial Sequence
  Synthetic oligonucleotide
taggtcgtcctcctgatcatccagctctctcccga

SEQ ID NO: 174691 - DNA, 36 bp, Artificial Sequence
  Synthetic oligonucleotide
tgttacaccccgctagtatcgcttttcgttttccga

SEQ ID NO: 174692 - DNA, 36 bp, Artificial Sequence
  Synthetic oligonucleotide
tacaccctcacctcagtcttgcttgaccatccgcga

SEQ ID NO: 174693 - DNA, 35 bp, Artificial Sequence
  Synthetic oligonucleotide
gcaccccgcgccagacactccgccaatcctatcga

SEQ ID NO: 174694 - DNA, 37 bp, Artificial Sequence
  Synthetic oligonucleotide
atgtacgcatcaccttaactgccctgtcccttatcga

SEQ ID NO: 174695 - DNA, 37 bp, Artificial Sequence
  Synthetic oligonucleotide
agtcaccccacatgtcctacgtttagtgtcacctcga

SEQ ID NO: 174696 - DNA, 37 bp, Artificial Sequence
  Synthetic oligonucleotide
gcacgctttttgcacataggtccacctcccccctcga

SEQ ID NO: 174697 - DNA, 36 bp, Artificial Sequence
  Synthetic oligonucleotide
attcgccaccacatccctatacctagttccattcga

SEQ ID NO: 174698 - DNA, 37 bp, Artificial Sequence
  Synthetic oligonucleotide
tacgcaccaccgctccagttctccgttgacccacgga

SEQ ID NO: 174699 - DNA, 35 bp, Artificial Sequence
  Synthetic oligonucleotide
actatgccgcccttccccccagccatgacgacgga

SEQ ID NO: 174700 - DNA, 37 bp, Artificial Sequence
  Synthetic oligonucleotide
ttaccaaggcaagggggcaggggtgggagggggcgga

SEQ ID NO: 174701 - DNA, 37 bp, Artificial Sequence
  Synthetic oligonucleotide
gacctgtcggtttgaagggggcgataggggaagggga

SEQ ID NO: 174702 - DNA, 35 bp, Artificial Sequence
  Synthetic oligonucleotide
ggggtggtgtggaaggggagggtcggctcagggga

SEQ ID NO: 174703 - DNA, 35 bp, Artificial Sequence
  Synthetic oligonucleotide
gaaacgggtggggagggtaacaccttggatgggga

SEQ ID NO: 174704 - DNA, 37 bp, Artificial Sequence
  Synthetic oligonucleotide
taccccccctcgccccagcgtatttggatccatggga

SEQ ID NO: 174705 - DNA, 35 bp, Artificial Sequence
  Synthetic oligonucleotide
acttccacctcctggtgcacctgacacccctggga

SEQ ID NO: 174706 - DNA, 36 bp, Artificial Sequence
  Synthetic oligonucleotide
gaacggggaaggggtgggttataggaggtcctggga

SEQ ID NO: 174707 - DNA, 37 bp, Artificial Sequence
  Synthetic oligonucleotide
gtagcagaaagcgtgggcggggggggcttcgggtgga

SEQ ID NO: 174708 - DNA, 37 bp, Artificial Sequence
  Synthetic oligonucleotide
gccaaccccttgttcacctccctcccatctgggtgga

SEQ ID NO: 174709 - DNA, 38 bp, Artificial Sequence
  Synthetic oligonucleotide
agcatcggaggcgggggagagaggagcgcggaaaatga

SEQ ID NO: 174710 - DNA, 38 bp, Artificial Sequence
  Synthetic oligonucleotide
gataccacccttcgcatgaaccagtcatcctacgatga

SEQ ID NO: 174711 - DNA, 37 bp, Artificial Sequence
  Synthetic oligonucleotide
gagtagggtagggagggcggggaatagcggtagctga

SEQ ID NO: 174712 - DNA, 37 bp, Artificial Sequence
  Synthetic oligonucleotide
gtgcacgcatagctcgcctgcgcaccccttccgctga

SEQ ID NO: 174713 - DNA, 38 bp, Artificial Sequence
  Synthetic oligonucleotide
tacggtcagacgtccgcttgtccgattcctcctgctga

SEQ ID NO: 174714 - DNA, 38 bp, Artificial Sequence
  Synthetic oligonucleotide
attccgccccccctagcccaacgagacgtaggatctga

SEQ ID NO: 174715 - DNA, 38 bp, Artificial Sequence
  Synthetic oligonucleotide
gtcgcgctctattcagtgtctccccctgcccactctga

SEQ ID NO: 174716 - DNA, 37 bp, Artificial Sequence
  Synthetic oligonucleotide
ttcgcccccaccgctgcccctcgctcatctcctctga

SEQ ID NO: 174717 - DNA, 38 bp, Artificial Sequence
  Synthetic oligonucleotide
acgtgtggggcaaaggggggggtaaggttcacgagtga

SEQ ID NO: 174718 - DNA, 38 bp, Artificial Sequence
  Synthetic oligonucleotide
gcttgcgtcccatcccttgcctgccctccttttagtga

SEQ ID NO: 174719 - DNA, 38 bp, Artificial Sequence
  Synthetic oligonucleotide
gctcctcctctggccccccctgtgacgcacctccgtga

SEQ ID NO: 174720 - DNA, 38 bp, Artificial Sequence
  Synthetic oligonucleotide
gcaaggggctgactgtcttccccgctcccctcctgtga

SEQ ID NO: 174721 - DNA, 37 bp, Artificial Sequence
  Synthetic oligonucleotide
agtcgcgatcctgccgctctcctcctcacacttgtga

SEQ ID NO: 174722 - DNA, 37 bp, Artificial Sequence
  Synthetic oligonucleotide
gattggcccctcccctgtacttgctctacaccattga

SEQ ID NO: 174723 - DNA, 38 bp, Artificial Sequence
  Synthetic oligonucleotide
tgttgctgccctcactcctagccacaccgtcccattga

SEQ ID NO: 174724 - DNA, 38 bp, Artificial Sequence
  Synthetic oligonucleotide
taagagcatacgttggcattacgcaccatcctccttga

SEQ ID NO: 174725 - DNA, 38 bp, Artificial Sequence
  Synthetic oligonucleotide
ttgccaccgagctctggttagttctcccaccctgttga

SEQ ID NO: 174726 - DNA, 37 bp, Artificial Sequence
  Synthetic oligonucleotide
gatcgcagtgcaagcatcagctccctgttctatttga

SEQ ID NO: 174727 - DNA, 38 bp, Artificial Sequence
  Synthetic oligonucleotide
gatcaccgttcctgtactgaaatcgccgttccttttga

SEQ ID NO: 174728 - DNA, 36 bp, Artificial Sequence
  Synthetic oligonucleotide
tcggatatcggggggggcagggagggcattggaata

SEQ ID NO: 174729 - DNA, 35 bp, Artificial Sequence
  Synthetic oligonucleotide
gtgctgtccctgcattactttcgccgttacttata

SEQ ID NO: 174730 - DNA, 36 bp, Artificial Sequence
  Synthetic oligonucleotide
tgcccacttctatcgctcttactcatccagtcccta

SEQ ID NO: 174731 - DNA, 36 bp, Artificial Sequence
  Synthetic oligonucleotide
gcaccatctgggcgattttggctcaacttacctcta

SEQ ID NO: 174732 - DNA, 36 bp, Artificial Sequence
  Synthetic oligonucleotide
ccctttgccgccccaactacgcactcgcttgctcta

SEQ ID NO: 174733 - DNA, 36 bp, Artificial Sequence
  Synthetic oligonucleotide
tacgttacccgcctccccgacgtttccctttaagta

SEQ ID NO: 174734 - DNA, 36 bp, Artificial Sequence
  Synthetic oligonucleotide
agattcgcagggggggcaactgagcggtggggcgta

SEQ ID NO: 174735 - DNA, 35 bp, Artificial Sequence
  Synthetic oligonucleotide
atctgacccatcgggtagtatagggggggagggta

SEQ ID NO: 174736 - DNA, 36 bp, Artificial Sequence
  Synthetic oligonucleotide
taacggaaaagggtagggtgatcgatgggacgggta

SEQ ID NO: 174737 - DNA, 36 bp, Artificial Sequence
  Synthetic oligonucleotide
atcgaccctcctctccttgatacaacgggcctttta

SEQ ID NO: 174738 - DNA, 35 bp, Artificial Sequence
  Synthetic oligonucleotide
gccaaccaccgaaccgcgtcgacactcctggttac

SEQ ID NO: 174739 - DNA, 36 bp, Artificial Sequence
  Synthetic oligonucleotide
tggacagaaacctcctgccgtatccaggtctgcacc

SEQ ID NO: 174740 - DNA, 35 bp, Artificial Sequence
  Synthetic oligonucleotide
tcaccgcctcccatagccagctgcattcaaccccc

SEQ ID NO: 174741 - DNA, 35 bp, Artificial Sequence
  Synthetic oligonucleotide
gccccgacgccctaagcttgtgttctgccaccccc

SEQ ID NO: 174742 - DNA, 35 bp, Artificial Sequence
  Synthetic oligonucleotide
acccgccctagcacccacattttacgacgtgcccc

SEQ ID NO: 174743 - DNA, 35 bp, Artificial Sequence
  Synthetic oligonucleotide
ttaaccacctcaccagatgctgcagctcctggccc

SEQ ID NO: 174744 - DNA, 34 bp, Artificial Sequence
  Synthetic oligonucleotide
tcaaccttgccctctggaacacacgccaaatccc

SEQ ID NO: 174745 - DNA, 35 bp, Artificial Sequence
  Synthetic oligonucleotide
tcgtacgcctttgcaccattaagtccccactggcc

SEQ ID NO: 174746 - DNA, 35 bp, Artificial Sequence
  Synthetic oligonucleotide
gtctagtccatctgcgctcgccacttagtactgcc

SEQ ID NO: 174747 - DNA, 35 bp, Artificial Sequence
  Synthetic oligonucleotide
atgcccgctcgccccctcccggtggttatctgtcc

SEQ ID NO: 174748 - DNA, 35 bp, Artificial Sequence
  Synthetic oligonucleotide
ggtggtccctcctgcctgccctttgtcggccttcc

SEQ ID NO: 174749 - DNA, 35 bp, Artificial Sequence
  Synthetic oligonucleotide
tcgtatccccgctgctccgctccaattgtcgttcc

SEQ ID NO: 174750 - DNA, 35 bp, Artificial Sequence
  Synthetic oligonucleotide
agcgaaccgcgtcgcgaagctatttggctctttcc

SEQ ID NO: 174751 - DNA, 35 bp, Artificial Sequence
  Synthetic oligonucleotide
gtgatcccccgcctccatctgtctccgtccgaagc

SEQ ID NO: 174752 - DNA, 35 bp, Artificial Sequence
  Synthetic oligonucleotide
accggatcctctgccgcgtggcctccccccgacgc

SEQ ID NO: 174753 - DNA, 35 bp, Artificial Sequence
  Synthetic oligonucleotide
atgtccctccctccgttactaatttactgtgccgc

SEQ ID NO: 174754 - DNA, 35 bp, Artificial Sequence
  Synthetic oligonucleotide
cccgatgccgatcctgacctgctcgtactttccgc

SEQ ID NO: 174755 - DNA, 35 bp, Artificial Sequence
  Synthetic oligonucleotide
tcctagcaccttcactccttacatgaccccacggc

SEQ ID NO: 174756 - DNA, 35 bp, Artificial Sequence
  Synthetic oligonucleotide
gacacccgccactgttcgttcacccgccacttggc

SEQ ID NO: 174757 - DNA, 35 bp, Artificial Sequence
  Synthetic oligonucleotide
tcgtactagccagtgcccaccctgcccttctatgc

SEQ ID NO: 174758 - DNA, 35 bp, Artificial Sequence
  Synthetic oligonucleotide
gtgccctcctccacgtttgctaacctctgtcttgc

SEQ ID NO: 174759 - DNA, 35 bp, Artificial Sequence
  Synthetic oligonucleotide
tgtgcgcgttcgctattatcccacgcccttgttgc

SEQ ID NO: 174760 - DNA, 35 bp, Artificial Sequence
  Synthetic oligonucleotide
atgccgccctcattagcgcctctctctggtacatc

SEQ ID NO: 174761 - DNA, 35 bp, Artificial Sequence
  Synthetic oligonucleotide
gtactcagtccctctttgcataactccctgccatc

SEQ ID NO: 174762 - DNA, 35 bp, Artificial Sequence
  Synthetic oligonucleotide
gcacacgttgactaatcactgcacgctccccactc

SEQ ID NO: 174763 - DNA, 35 bp, Artificial Sequence
  Synthetic oligonucleotide
accgtgctggccctttcagcgtatctgttcacctc

SEQ ID NO: 174764 - DNA, 35 bp, Artificial Sequence
  Synthetic oligonucleotide
tcaatcgcactgtcatcctgcgcaaaacggccctc

SEQ ID NO: 174765 - DNA, 35 bp, Artificial Sequence
  Synthetic oligonucleotide
gcatgggacgtcatatgcctgcttcccacttcctc

SEQ ID NO: 174766 - DNA, 35 bp, Artificial Sequence
  Synthetic oligonucleotide
gccggcacagttgctcatcggcactctcttctctc

SEQ ID NO: 174767 - DNA, 35 bp, Artificial Sequence
  Synthetic oligonucleotide
atcatcgatacagtatacaactcccgtcccccgtc

SEQ ID NO: 174768 - DNA, 35 bp, Artificial Sequence
  Synthetic oligonucleotide
gcccttgccctatgtttgatttgggcccgatcttc

SEQ ID NO: 174769 - DNA, 35 bp, Artificial Sequence
  Synthetic oligonucleotide
tttggtccgaccccgtggcgtctctggcacctttc

SEQ ID NO: 174770 - DNA, 35 bp, Artificial Sequence
  Synthetic oligonucleotide
acacccccccacggatgtattttgttacattgtag

SEQ ID NO: 174771 - DNA, 35 bp, Artificial Sequence
  Synthetic oligonucleotide
tgcctcttcagcgactctgcattccatctgtaccg

SEQ ID NO: 174772 - DNA, 35 bp, Artificial Sequence
  Synthetic oligonucleotide
taccgatgcgcccgggttcgccgtccccgtctccg

SEQ ID NO: 174773 - DNA, 35 bp, Artificial Sequence
  Synthetic oligonucleotide
gcttccgtcgcccgaccgtccttgaccatccatcg

SEQ ID NO: 174774 - DNA, 35 bp, Artificial Sequence
  Synthetic oligonucleotide
gccatcctcagctccggctatttcttttccactcg

SEQ ID NO: 174775 - DNA, 35 bp, Artificial Sequence
  Synthetic oligonucleotide
gttctgactatctgattcctgcatccaccatctcg

SEQ ID NO: 174776 - DNA, 35 bp, Artificial Sequence
  Synthetic oligonucleotide
tcgaacgccactaatctgttgtctcctccatctcg

SEQ ID NO: 174777 - DNA, 34 bp, Artificial Sequence
  Synthetic oligonucleotide
ggactgagcagctggattatcctcttcaccgtcg

SEQ ID NO: 174778 - DNA, 35 bp, Artificial Sequence
  Synthetic oligonucleotide
ttccgcccatccccgacgtttagcgccctgtgtcg

SEQ ID NO: 174779 - DNA, 35 bp, Artificial Sequence
  Synthetic oligonucleotide
gtgatagaattgaggggtaagaaaggagaagaagg

SEQ ID NO: 174780 - DNA, 35 bp, Artificial Sequence
  Synthetic oligonucleotide
taccggggggagaaaagggcgtggagttggcgagg

SEQ ID NO: 174781 - DNA, 35 bp, Artificial Sequence
  Synthetic oligonucleotide
ttggagagtgggttggagggttctggcaccactgg

SEQ ID NO: 174782 - DNA, 35 bp, Artificial Sequence
  Synthetic oligonucleotide
acgccccccccctgtgtcgcataacccgatcgtgg

SEQ ID NO: 174783 - DNA, 35 bp, Artificial Sequence
  Synthetic oligonucleotide
gagggataggcggtgacgggggtgttaggcgaatg

SEQ ID NO: 174784 - DNA, 35 bp, Artificial Sequence
  Synthetic oligonucleotide
gcactaaccatcacttgtcgtctttatcaggcctg

SEQ ID NO: 174785 - DNA, 35 bp, Artificial Sequence
  Synthetic oligonucleotide
gtcatgggggtggggatatggaggggtcgcgcgtg

SEQ ID NO: 174786 - DNA, 35 bp, Artificial Sequence
  Synthetic oligonucleotide
tacgccgcccggtcgctttactccactttctcgtg

SEQ ID NO: 174787 - DNA, 30 bp, Artificial Sequence
  Synthetic oligonucleotide
tgagccggaccacccactcaccgctccttg

SEQ ID NO: 174788 - DNA, 35 bp, Artificial Sequence
  Synthetic oligonucleotide
gcccgggcggggggggtgggactgctcgccgtttg

SEQ ID NO: 174789 - DNA, 35 bp, Artificial Sequence
  Synthetic oligonucleotide
accgtatgtccggcgagtatgaatttctgcctcat

SEQ ID NO: 174790 - DNA, 35 bp, Artificial Sequence
  Synthetic oligonucleotide
tctcggcccgccgcctctagttaatgtcctgcact

SEQ ID NO: 174791 - DNA, 35 bp, Artificial Sequence
  Synthetic oligonucleotide
gacgggaacgggcacctgaaacgggggggaggact

SEQ ID NO: 174792 - DNA, 35 bp, Artificial Sequence
  Synthetic oligonucleotide
tttgcgctacgtccttccacccatgtctgtttact

SEQ ID NO: 174793 - DNA, 35 bp, Artificial Sequence
  Synthetic oligonucleotide
atcatatgtccccgccgtcctatactgcagtacct

SEQ ID NO: 174794 - DNA, 35 bp, Artificial Sequence
  Synthetic oligonucleotide
aagcccgcccggatcgcgttcaacaccgccgccct

SEQ ID NO: 174795 - DNA, 35 bp, Artificial Sequence
  Synthetic oligonucleotide
gaccgcctatgccgtgcgccgacctctgttgccct

SEQ ID NO: 174796 - DNA, 35 bp, Artificial Sequence
  Synthetic oligonucleotide
ttcgatcgtcgccatttacgtcagtccctggtcct

SEQ ID NO: 174797 - DNA, 35 bp, Artificial Sequence
  Synthetic oligonucleotide
tctcgaatccgcctcaacgtgctgccggggttcct

SEQ ID NO: 174798 - DNA, 35 bp, Artificial Sequence
  Synthetic oligonucleotide
atcatcgacctcggtcagggcctacctatcccgct

SEQ ID NO: 174799 - DNA, 35 bp, Artificial Sequence
  Synthetic oligonucleotide
gacccctgtacggtctaaaagaactctcctatgct

SEQ ID NO: 174800 - DNA, 35 bp, Artificial Sequence
  Synthetic oligonucleotide
tccgccggcccacctttgagtatcgctcgccctct

SEQ ID NO: 174801 - DNA, 35 bp, Artificial Sequence
  Synthetic oligonucleotide
gtgtcgtgtcccagctatatcccatcggtgcctct

SEQ ID NO: 174802 - DNA, 35 bp, Artificial Sequence
  Synthetic oligonucleotide
tttgcgaccgtcccgaccccatgcttatcctctct

SEQ ID NO: 174803 - DNA, 35 bp, Artificial Sequence
  Synthetic oligonucleotide
gataagcgatccttgtaccgcggccccacttctct

SEQ ID NO: 174804 - DNA, 34 bp, Artificial Sequence
  Synthetic oligonucleotide
atgacccccctacaatgctccccaggacctgtct

SEQ ID NO: 174805 - DNA, 35 bp, Artificial Sequence
  Synthetic oligonucleotide
tctagccccgtccccacttaagcccccacttccgt

SEQ ID NO: 174806 - DNA, 35 bp, Artificial Sequence
  Synthetic oligonucleotide
ttcaccggccgcccgtcgttcacgcccatactcgt

SEQ ID NO: 174807 - DNA, 35 bp, Artificial Sequence
  Synthetic oligonucleotide
taactctgcagattctttccgcccgcccgttttgt

SEQ ID NO: 174808 - DNA, 35 bp, Artificial Sequence
  Synthetic oligonucleotide
tcacgcctcttacgggctttccactccagaccatt

SEQ ID NO: 174809 - DNA, 35 bp, Artificial Sequence
  Synthetic oligonucleotide
gccgtagccacgacgttacttactgccctgcactt

SEQ ID NO: 174810 - DNA, 35 bp, Artificial Sequence
  Synthetic oligonucleotide
gtcttcccacgctcacggactttagctatgccctt

SEQ ID NO: 174811 - DNA, 35 bp, Artificial Sequence
  Synthetic oligonucleotide
aaggggagggaacaggaaggggtgggcatttagtt

SEQ ID NO: 174812 - DNA, 35 bp, Artificial Sequence
  Synthetic oligonucleotide
atagctccctccgatgcgccgcttgaacgcccttt

SEQ ID NO: 174813 - DNA, 35 bp, Artificial Sequence
  Synthetic oligonucleotide
gaacgctcaggagtctccgccattcctgtcctttt

SEQ ID NO: 174814 - DNA, 36 bp, Artificial Sequence
  Synthetic oligonucleotide
ttatcccgcctccacctgaccataaactactggaaa

SEQ ID NO: 174815 - DNA, 36 bp, Artificial Sequence
  Synthetic oligonucleotide
tactctccgcccctgacgttgccccgtctacgtgaa

SEQ ID NO: 174816 - DNA, 35 bp, Artificial Sequence
  Synthetic oligonucleotide
gtcgccacgcaaccatgccaccccctgcgtgctaa

SEQ ID NO: 174817 - DNA, 36 bp, Artificial Sequence
  Synthetic oligonucleotide
acgtcggtcgccggtaaaggcgttttgtacccccca

SEQ ID NO: 174818 - DNA, 34 bp, Artificial Sequence
  Synthetic oligonucleotide
tccttggcgacccacctgcgtcatccgctcccca

SEQ ID NO: 174819 - DNA, 36 bp, Artificial Sequence
  Synthetic oligonucleotide
gtgaccacatgccgatctgctaattgactccatcca

SEQ ID NO: 174820 - DNA, 36 bp, Artificial Sequence
  Synthetic oligonucleotide
gcctgccctggcatgtcgtggtttcctcctactcca

SEQ ID NO: 174821 - DNA, 36 bp, Artificial Sequence
  Synthetic oligonucleotide
gcttcaccccccctgttatctccgtcaaaagagtca

SEQ ID NO: 174822 - DNA, 35 bp, Artificial Sequence
  Synthetic oligonucleotide
acaccgttcaccttgggcttttattcgtagtttca

SEQ ID NO: 174823 - DNA, 35 bp, Artificial Sequence
  Synthetic oligonucleotide
gtcatgcaggacccgggcggaggaggtatgtttca

SEQ ID NO: 174824 - DNA, 37 bp, Artificial Sequence
  Synthetic oligonucleotide
gcatcggagggtcaaaggaggagggggtaggtgaaga

SEQ ID NO: 174825 - DNA, 36 bp, Artificial Sequence
  Synthetic oligonucleotide
aagagcaatggagggggggaagttctcaggcgcaga

SEQ ID NO: 174826 - DNA, 37 bp, Artificial Sequence
  Synthetic oligonucleotide
tgagtacatcgagggggggggtggaggagctcgcaga

SEQ ID NO: 174827 - DNA, 35 bp, Artificial Sequence
  Synthetic oligonucleotide
tgccactcgaacattaccgcgccccctacctgaga

SEQ ID NO: 174828 - DNA, 37 bp, Artificial Sequence
  Synthetic oligonucleotide
gcccgccccagtattggcactccccacaacccttaga

SEQ ID NO: 174829 - DNA, 36 bp, Artificial Sequence
  Synthetic oligonucleotide
gccgagcctaggctattacgcgcctccccccgacga

SEQ ID NO: 174830 - DNA, 37 bp, Artificial Sequence
  Synthetic oligonucleotide
accgcctgtccatccgcaccttgtacgacagctacga

SEQ ID NO: 174831 - DNA, 37 bp, Artificial Sequence
  Synthetic oligonucleotide
tcggatgacagctccgttcgcgttcttcccttcccga

SEQ ID NO: 174832 - DNA, 37 bp, Artificial Sequence
  Synthetic oligonucleotide
gtttcaactgacgtgttcctgtaccctgccttcccga

SEQ ID NO: 174833 - DNA, 37 bp, Artificial Sequence
  Synthetic oligonucleotide
gcacgccatttccgtcatccgctcccctactaggcga

SEQ ID NO: 174834 - DNA, 37 bp, Artificial Sequence
  Synthetic oligonucleotide
tcagtcgcttcctacctgccgtatcgcatacatgcga

SEQ ID NO: 174835 - DNA, 35 bp, Artificial Sequence
  Synthetic oligonucleotide
acaacccccccgaacccctagtcagattgtgtcga

SEQ ID NO: 174836 - DNA, 37 bp, Artificial Sequence
  Synthetic oligonucleotide
gggggcaaccaacgggttgggggaaaaggggattcga

SEQ ID NO: 174837 - DNA, 36 bp, Artificial Sequence
  Synthetic oligonucleotide
tacgcagagtacatacatcacttgcaccctcttcga

SEQ ID NO: 174838 - DNA, 37 bp, Artificial Sequence
  Synthetic oligonucleotide
tgggacagaacggatcaggggggggcgggagtaagga

SEQ ID NO: 174839 - DNA, 37 bp, Artificial Sequence
  Synthetic oligonucleotide
gggtgaggttcggggagtttgggacgtgggggtagga

SEQ ID NO: 174840 - DNA, 36 bp, Artificial Sequence
  Synthetic oligonucleotide
gaacagggaggttgccttgaggggagggggtacgga

SEQ ID NO: 174841 - DNA, 37 bp, Artificial Sequence
  Synthetic oligonucleotide
tgaggccaacatgtctatctccacctattcttgcgga

SEQ ID NO: 174842 - DNA, 37 bp, Artificial Sequence
  Synthetic oligonucleotide
ttgaaagggtaagttgtagggaccgggaggggaggga

SEQ ID NO: 174843 - DNA, 36 bp, Artificial Sequence
  Synthetic oligonucleotide
atacaccctcaaccctcgccactgcctactacggga

SEQ ID NO: 174844 - DNA, 37 bp, Artificial Sequence
  Synthetic oligonucleotide
ttggggttactaatgggggtgggtttaaagcagggga

SEQ ID NO: 174845 - DNA, 37 bp, Artificial Sequence
  Synthetic oligonucleotide
atgggcgaaggagggagggcttttgagggggtctgga

SEQ ID NO: 174846 - DNA, 38 bp, Artificial Sequence
  Synthetic oligonucleotide
ttccgaccggatccttttgtccttcccccagtcaatga

SEQ ID NO: 174847 - DNA, 38 bp, Artificial Sequence
  Synthetic oligonucleotide
ggtgaagcaggggaggcaagaaacaggcaaggatatga

SEQ ID NO: 174848 - DNA, 37 bp, Artificial Sequence
  Synthetic oligonucleotide
gcgatacgcctcgccccgacctcatcacgatcactga

SEQ ID NO: 174849 - DNA, 38 bp, Artificial Sequence
  Synthetic oligonucleotide
tgcatcagtctagactctaccagccgccgccctcctga

SEQ ID NO: 174850 - DNA, 38 bp, Artificial Sequence
  Synthetic oligonucleotide
acaacatgacaccggcgcccctcgatcctccgtgctga

SEQ ID NO: 174851 - DNA, 38 bp, Artificial Sequence
  Synthetic oligonucleotide
tacgtggcctcccccgcttcacccctccaaggtgctga

SEQ ID NO: 174852 - DNA, 38 bp, Artificial Sequence
  Synthetic oligonucleotide
tccagcgcacaggtccttactcgccgctactactgtga

SEQ ID NO: 174853 - DNA, 37 bp, Artificial Sequence
  Synthetic oligonucleotide
gcctcgctatgctgccccatatgcgcctacccattga

SEQ ID NO: 174854 - DNA, 38 bp, Artificial Sequence
  Synthetic oligonucleotide
tcaggtccgcccgtatcgtcttcgtcctacacacttga

SEQ ID NO: 174855 - DNA, 36 bp, Artificial Sequence
  Synthetic oligonucleotide
gcactagtcgatggattgcccgttcctcacccttga

SEQ ID NO: 174856 - DNA, 38 bp, Artificial Sequence
  Synthetic oligonucleotide
atgccatgccaggtacactcttgaccctctgcccttga

SEQ ID NO: 174857 - DNA, 38 bp, Artificial Sequence
  Synthetic oligonucleotide
tctacctccgttcagccgccgtccaatcacccctttga

SEQ ID NO: 174858 - DNA, 38 bp, Artificial Sequence
  Synthetic oligonucleotide
agtcgccgcctcctccatcgccgcacccccctgtttga

SEQ ID NO: 174859 - DNA, 35 bp, Artificial Sequence
  Synthetic oligonucleotide
gatcatcatgtctcggcttttccatctcggcccta

SEQ ID NO: 174860 - DNA, 35 bp, Artificial Sequence
  Synthetic oligonucleotide
tcccgccacaatccgacgtcttcgttctcagtcta

SEQ ID NO: 174861 - DNA, 36 bp, Artificial Sequence
  Synthetic oligonucleotide
aatgccaccgccgttactgttcattggtcccttcta

SEQ ID NO: 174862 - DNA, 36 bp, Artificial Sequence
  Synthetic oligonucleotide
atcgcatccgaacctgttttctccccgctggcatta

SEQ ID NO: 174863 - DNA, 36 bp, Artificial Sequence
  Synthetic oligonucleotide
tacccccgcctccctctggtatctctcacggtatta

SEQ ID NO: 174864 - DNA, 36 bp, Artificial Sequence
  Synthetic oligonucleotide
ttatcgaccccgcccattggactcttctacgactta

SEQ ID NO: 174865 - DNA, 36 bp, Artificial Sequence
  Synthetic oligonucleotide
tcactccgccccctcgccagtccctccgtcctgtta

SEQ ID NO: 174866 - DNA, 34 bp, Artificial Sequence
  Synthetic oligonucleotide
aaccaccggcccagatccgtaccaccccgcttta

SEQ ID NO: 174867 - DNA, 35 bp, Artificial Sequence
  Synthetic oligonucleotide
gtggccccagtctgtgctccctttcgtcgtcttta

SEQ ID NO: 174868 - DNA, 35 bp, Artificial Sequence
  Synthetic oligonucleotide
agcgatctcccgttcctcccatcccaggtagcaac

SEQ ID NO: 174869 - DNA, 35 bp, Artificial Sequence
  Synthetic oligonucleotide
tgcacgcttctctattgagccaccgcattccacac

SEQ ID NO: 174870 - DNA, 35 bp, Artificial Sequence
  Synthetic oligonucleotide
acagtacgccccgcctagccctagttcaatacgac

SEQ ID NO: 174871 - DNA, 35 bp, Artificial Sequence
  Synthetic oligonucleotide
tcatgccgcgcacttgactctgatcccggtactac

SEQ ID NO: 174872 - DNA, 35 bp, Artificial Sequence
  Synthetic oligonucleotide
gacgccgttgagcgcccgcgtggctcccttccacc

SEQ ID NO: 174873 - DNA, 35 bp, Artificial Sequence
  Synthetic oligonucleotide
accaccatcacgcaggagctctttgccgacctacc

SEQ ID NO: 174874 - DNA, 35 bp, Artificial Sequence
  Synthetic oligonucleotide
gcgcaatccgccactcgttcacggacaatcgtacc

SEQ ID NO: 174875 - DNA, 35 bp, Artificial Sequence
  Synthetic oligonucleotide
gctgtcattgtgccgtcttccctctttcatccccc

SEQ ID NO: 174876 - DNA, 34 bp, Artificial Sequence
  Synthetic oligonucleotide
tgtgcaacgcgcagccgccgctgtcttggtcccc

SEQ ID NO: 174877 - DNA, 35 bp, Artificial Sequence
  Synthetic oligonucleotide
tcagactcgcaactgtccaccttacgtcccccgcc

SEQ ID NO: 174878 - DNA, 35 bp, Artificial Sequence
  Synthetic oligonucleotide
acgtacgggcctgccatcacctatactgcttcgcc

SEQ ID NO: 174879 - DNA, 35 bp, Artificial Sequence
  Synthetic oligonucleotide
gccgctatgttaagtcccgctgttcctctccggcc

SEQ ID NO: 174880 - DNA, 35 bp, Artificial Sequence
  Synthetic oligonucleotide
cccggaccacatctgtcacctggccttctctatcc

SEQ ID NO: 174881 - DNA, 35 bp, Artificial Sequence
  Synthetic oligonucleotide
tcgtggcgatcccctctatgtccttgtcccactcc

SEQ ID NO: 174882 - DNA, 35 bp, Artificial Sequence
  Synthetic oligonucleotide
gctggtggtacctacatctgtcattcgattactcc

SEQ ID NO: 174883 - DNA, 35 bp, Artificial Sequence
  Synthetic oligonucleotide
gaccacccacactgggatcttagaccgaaccctcc

SEQ ID NO: 174884 - DNA, 35 bp, Artificial Sequence
  Synthetic oligonucleotide
atctaacggatcggcgcgcgagcactgcaccctcc

SEQ ID NO: 174885 - DNA, 35 bp, Artificial Sequence
  Synthetic oligonucleotide
tcgatatcgggacatcccttccgcccagcccctcc

SEQ ID NO: 174886 - DNA, 35 bp, Artificial Sequence
  Synthetic oligonucleotide
ttcctgtcgccgatttaaccaccgctttctagtcc

SEQ ID NO: 174887 - DNA, 36 bp, Artificial Sequence
  Synthetic oligonucleotide
gcctcgccgagggggcctcccgagcatccgacttcc

SEQ ID NO: 174888 - DNA, 35 bp, Artificial Sequence
  Synthetic oligonucleotide
tgtgaccgcctcattcagccgcccgccctagttcc

SEQ ID NO: 174889 - DNA, 35 bp, Artificial Sequence
  Synthetic oligonucleotide
tccgtacattgccactcctcgaggtctcctcacgc

SEQ ID NO: 174890 - DNA, 35 bp, Artificial Sequence
  Synthetic oligonucleotide
tgcgccacgaccacctcggcttagaccgacttcgc

SEQ ID NO: 174891 - DNA, 35 bp, Artificial Sequence
  Synthetic oligonucleotide
tgatgcgccaccctcgcattattcctgcctcctgc

SEQ ID NO: 174892 - DNA, 35 bp, Artificial Sequence
  Synthetic oligonucleotide
ttcggatccaccacccagttcttcgccttcggtgc

SEQ ID NO: 174893 - DNA, 35 bp, Artificial Sequence
  Synthetic oligonucleotide
gggagggagggtggggtgtctccgcggactattgc

SEQ ID NO: 174894 - DNA, 35 bp, Artificial Sequence
  Synthetic oligonucleotide
actcgctccactgtgccctgtcccccgctgacatc

SEQ ID NO: 174895 - DNA, 35 bp, Artificial Sequence
  Synthetic oligonucleotide
tgctggccagagtacggtctgtcgattttgccctc

SEQ ID NO: 174896 - DNA, 35 bp, Artificial Sequence
  Synthetic oligonucleotide
agctacctggcgaagcgctccccttcctgtcgctc

SEQ ID NO: 174897 - DNA, 35 bp, Artificial Sequence
  Synthetic oligonucleotide
accattgccctcgtgccataacacgccgtacggtc

SEQ ID NO: 174898 - DNA, 35 bp, Artificial Sequence
  Synthetic oligonucleotide
tcagatgtctggccacccgccgtctcaatgaattc

SEQ ID NO: 174899 - DNA, 35 bp, Artificial Sequence
  Synthetic oligonucleotide
gtatgtggggtggatacataaggtagagaggggag

SEQ ID NO: 174900 - DNA, 35 bp, Artificial Sequence
  Synthetic oligonucleotide
tacatcaagccctccgttccctataagccgtcgcg

SEQ ID NO: 174901 - DNA, 35 bp, Artificial Sequence
  Synthetic oligonucleotide
tgtaccatcaccaacctgctaagccgccctgggcg

SEQ ID NO: 174902 - DNA, 35 bp, Artificial Sequence
  Synthetic oligonucleotide
ggggggcggggaggttatggggaggagtgcagagg

SEQ ID NO: 174903 - DNA, 35 bp, Artificial Sequence
  Synthetic oligonucleotide
agctcggatgggtgtaggagggagggtggtagggg

SEQ ID NO: 174904 - DNA, 35 bp, Artificial Sequence
  Synthetic oligonucleotide
gtgcggtagtaaggtgcggcggtggaatggatggg

SEQ ID NO: 174905 - DNA, 35 bp, Artificial Sequence
  Synthetic oligonucleotide
ctcctccgtcgttaatcgtgcacctccgaccgtgg

SEQ ID NO: 174906 - DNA, 35 bp, Artificial Sequence
  Synthetic oligonucleotide
ttacgcaccccgtacctcgaattctacattttatg

SEQ ID NO: 174907 - DNA, 35 bp, Artificial Sequence
  Synthetic oligonucleotide
acagtcgaatgccgggcatcccccgccaccccctg

SEQ ID NO: 174908 - DNA, 35 bp, Artificial Sequence
  Synthetic oligonucleotide
gaacgtaaggcaaggggtaggagaggggtcttgtg

SEQ ID NO: 174909 - DNA, 35 bp, Artificial Sequence
  Synthetic oligonucleotide
atgcaggcgattttgcgcatgctcttcacctcttg

SEQ ID NO: 174910 - DNA, 35 bp, Artificial Sequence
  Synthetic oligonucleotide
tagcactggttgggtgggaaaggtgggagggtttg

SEQ ID NO: 174911 - DNA, 34 bp, Artificial Sequence
  Synthetic oligonucleotide
gcctcgtcatgccgttttcgcctccacgttcaat

SEQ ID NO: 174912 - DNA, 35 bp, Artificial Sequence
  Synthetic oligonucleotide
accacccatctatgtgcctagtcccacactcccat

SEQ ID NO: 174913 - DNA, 35 bp, Artificial Sequence
  Synthetic oligonucleotide
ttgaaggagggagggtgtagatatcaaggaagcat

SEQ ID NO: 174914 - DNA, 35 bp, Artificial Sequence
  Synthetic oligonucleotide
aacaatcagcgtgtagctcgtcgaatgcaccccct

SEQ ID NO: 174915 - DNA, 35 bp, Artificial Sequence
  Synthetic oligonucleotide
tatggcatctcccctcgacgccgttccaaagccct

SEQ ID NO: 174916 - DNA, 35 bp, Artificial Sequence
  Synthetic oligonucleotide
acgagttgaggtggggggggtaagaacgggagcct

SEQ ID NO: 174917 - DNA, 35 bp, Artificial Sequence
  Synthetic oligonucleotide
tgtggcccactcctgctattcgagctctctcgcct

SEQ ID NO: 174918 - DNA, 35 bp, Artificial Sequence
  Synthetic oligonucleotide
ttaggcggctcctcggtggtggtggggaaggagct

SEQ ID NO: 174919 - DNA, 35 bp, Artificial Sequence
  Synthetic oligonucleotide
tactcggccagtgtttaggcctaaccacttcctct

SEQ ID NO: 174920 - DNA, 35 bp, Artificial Sequence
  Synthetic oligonucleotide
gacccaagcgcaccctccgtgtcctcgtcctctct

SEQ ID NO: 174921 - DNA, 35 bp, Artificial Sequence
  Synthetic oligonucleotide
atcgctacgttgatctcccccgcgcccgtaagtct

SEQ ID NO: 174922 - DNA, 35 bp, Artificial Sequence
  Synthetic oligonucleotide
tcgctgcctcctgctcgcgttccctgttgatcggt

SEQ ID NO: 174923 - DNA, 35 bp, Artificial Sequence
  Synthetic oligonucleotide
atcgtcccaatcgcgcctgtaattctctcctagtt

SEQ ID NO: 174924 - DNA, 35 bp, Artificial Sequence
  Synthetic oligonucleotide
gttggttacgctgacgttactcctctgttcccgtt

SEQ ID NO: 174925 - DNA, 35 bp, Artificial Sequence
  Synthetic oligonucleotide
atacgcgcacccccactgtttcatttgtccctgtt

SEQ ID NO: 174926 - DNA, 35 bp, Artificial Sequence
  Synthetic oligonucleotide
atccaccgccgcgagtgcgacctgagttgcccttt

SEQ ID NO: 174927 - DNA, 35 bp, Artificial Sequence
  Synthetic oligonucleotide
accaacctgcattgtccatccactcgtctcctaaa

SEQ ID NO: 174928 - DNA, 35 bp, Artificial Sequence
  Synthetic oligonucleotide
tgacacgaccagtagtgacccatctcctcccccaa

SEQ ID NO: 174929 - DNA, 36 bp, Artificial Sequence
  Synthetic oligonucleotide
gccatccccgccggggcattatcccacacatcccaa

SEQ ID NO: 174930 - DNA, 35 bp, Artificial Sequence
  Synthetic oligonucleotide
gccccgcccctgcgacccttatacatctaggtcaa

SEQ ID NO: 174931 - DNA, 36 bp, Artificial Sequence
  Synthetic oligonucleotide
actaccctcagtacagtcgaccttccaccctttgaa

SEQ ID NO: 174932 - DNA, 36 bp, Artificial Sequence
  Synthetic oligonucleotide
gtcctccacgccgtaatcatccgctcacgttcttaa

SEQ ID NO: 174933 - DNA, 35 bp, Artificial Sequence
  Synthetic oligonucleotide
agtgcccggagctggccccatcaagtactaccaca

SEQ ID NO: 174934 - DNA, 36 bp, Artificial Sequence
  Synthetic oligonucleotide
ggtcaggccattcctcgtatccatcgcgctcccaca

SEQ ID NO: 174935 - DNA, 35 bp, Artificial Sequence
  Synthetic oligonucleotide
tttacccacatggtttcacactgcatttacaccca

SEQ ID NO: 174936 - DNA, 36 bp, Artificial Sequence
  Synthetic oligonucleotide
atctccagcgtggtcacctgcgcccctgctatccca

SEQ ID NO: 174937 - DNA, 36 bp, Artificial Sequence
  Synthetic oligonucleotide
ttcgaacagcctacatttctttagccatacgtccca

SEQ ID NO: 174938 - DNA, 36 bp, Artificial Sequence
  Synthetic oligonucleotide
tctgcgtcctgacgtttccgacccccaccatggcca

SEQ ID NO: 174939 - DNA, 36 bp, Artificial Sequence
  Synthetic oligonucleotide
aacagccaaccctccgaccatgccgacgcactgcca

SEQ ID NO: 174940 - DNA, 35 bp, Artificial Sequence
  Synthetic oligonucleotide
aaccaccgcctcggtgatctcacgtgctatatcca

SEQ ID NO: 174941 - DNA, 35 bp, Artificial Sequence
  Synthetic oligonucleotide
ggtaggggggatgaggagggggtggaaagggtcca

SEQ ID NO: 174942 - DNA, 36 bp, Artificial Sequence
  Synthetic oligonucleotide
ttaaacccgcctcagtccgttactccgttcgttgca

SEQ ID NO: 174943 - DNA, 35 bp, Artificial Sequence
  Synthetic oligonucleotide
gaatggggcgggcgtgggggggtgggagagcgtca

SEQ ID NO: 174944 - DNA, 36 bp, Artificial Sequence
  Synthetic oligonucleotide
ttgagtccctcagtttcgtttcccatgcctttgtca

SEQ ID NO: 174945 - DNA, 37 bp, Artificial Sequence
  Synthetic oligonucleotide
tcagtgtgcccgccttctcctggtcctgatttaaaga

SEQ ID NO: 174946 - DNA, 35 bp, Artificial Sequence
  Synthetic oligonucleotide
gaaacgcaggggggatggagttgaatgaatgcaga

SEQ ID NO: 174947 - DNA, 37 bp, Artificial Sequence
  Synthetic oligonucleotide
tcgagggggggggcaaacgggagggttacgtaagaga

SEQ ID NO: 174948 - DNA, 37 bp, Artificial Sequence
  Synthetic oligonucleotide
gatacagagggatcggggaaggggaggccggtgtaga

SEQ ID NO: 174949 - DNA, 37 bp, Artificial Sequence
  Synthetic oligonucleotide
gagccgaagacacatggaaggaacagggaggcgacga

SEQ ID NO: 174950 - DNA, 36 bp, Artificial Sequence
  Synthetic oligonucleotide
ttctgccccccatccgcaatcagaacacccaaccga

SEQ ID NO: 174951 - DNA, 37 bp, Artificial Sequence
  Synthetic oligonucleotide
ttgacgacgtctgtgttgcatcatctctccccaccga

SEQ ID NO: 174952 - DNA, 37 bp, Artificial Sequence
  Synthetic oligonucleotide
tgcacgtcaacgctccccactcggcctgttttaccga

SEQ ID NO: 174953 - DNA, 37 bp, Artificial Sequence
  Synthetic oligonucleotide
atgcacctccacggcacgaaggtccattcccttccga

SEQ ID NO: 174954 - DNA, 37 bp, Artificial Sequence
  Synthetic oligonucleotide
gacggatcagaagagaggggggtgaaggtggaatcga

SEQ ID NO: 174955 - DNA, 37 bp, Artificial Sequence
  Synthetic oligonucleotide
tcgcctcactctaacggtttcatgtgcctgccctcga

SEQ ID NO: 174956 - DNA, 36 bp, Artificial Sequence
  Synthetic oligonucleotide
tcttccccctcaccttctgttgtgccttctattcga

SEQ ID NO: 174957 - DNA, 35 bp, Artificial Sequence
  Synthetic oligonucleotide
tgcggagaccggtcgagagggagggaggggcagga

SEQ ID NO: 174958 - DNA, 36 bp, Artificial Sequence
  Synthetic oligonucleotide
tatgtcccactcctcgtgcaccatcactccatagga

SEQ ID NO: 174959 - DNA, 37 bp, Artificial Sequence
  Synthetic oligonucleotide
aagtgggaggggttaatggcgggggggccggttagga

SEQ ID NO: 174960 - DNA, 37 bp, Artificial Sequence
  Synthetic oligonucleotide
tgagccaggagtgggggggcgaatagttaaaaacgga

SEQ ID NO: 174961 - DNA, 37 bp, Artificial Sequence
  Synthetic oligonucleotide
gtcaactcaagcggttccccccacccatccccacgga

SEQ ID NO: 174962 - DNA, 35 bp, Artificial Sequence
  Synthetic oligonucleotide
ggtgaatgagggggtggtgggtggatagagtcgga

SEQ ID NO: 174963 - DNA, 37 bp, Artificial Sequence
  Synthetic oligonucleotide
gactgcacccggcctcctacctagccactctctggga

SEQ ID NO: 174964 - DNA, 35 bp, Artificial Sequence
  Synthetic oligonucleotide
gcacggcactccgcccacatcaccccgctactgga

SEQ ID NO: 174965 - DNA, 37 bp, Artificial Sequence
  Synthetic oligonucleotide
taggaggaggaataagtaatgggcagaagggagtgga

SEQ ID NO: 174966 - DNA, 37 bp, Artificial Sequence
  Synthetic oligonucleotide
tcttgccccctccccgtggatcacttacgccattgga

SEQ ID NO: 174967 - DNA, 37 bp, Artificial Sequence
  Synthetic oligonucleotide
ttgtcgccctgagtgactcactataccttccccatga

SEQ ID NO: 174968 - DNA, 35 bp, Artificial Sequence
  Synthetic oligonucleotide
ttccgcctccactccttggcccgtatctccgatga

SEQ ID NO: 174969 - DNA, 36 bp, Artificial Sequence
  Synthetic oligonucleotide
tcacacccgcaggtacttctcacggtttctctatga

SEQ ID NO: 174970 - DNA, 38 bp, Artificial Sequence
  Synthetic oligonucleotide
atgaggacaagagggctaggggggaatgagacgtatga

SEQ ID NO: 174971 - DNA, 36 bp, Artificial Sequence
  Synthetic oligonucleotide
ttccagcccggaccaccatgcagacctaccccctga

SEQ ID NO: 174972 - DNA, 38 bp, Artificial Sequence
  Synthetic oligonucleotide
gcccgctaaagtatctgtctcgccactctcttccctga

SEQ ID NO: 174973 - DNA, 37 bp, Artificial Sequence
  Synthetic oligonucleotide
attgccctccatcgttgctcattgttcccactgctga

SEQ ID NO: 174974 - DNA, 38 bp, Artificial Sequence
  Synthetic oligonucleotide
accccccgcctccgcctgcgtccaagcatgccttgtga

SEQ ID NO: 174975 - DNA, 38 bp, Artificial Sequence
  Synthetic oligonucleotide
tagcccactgccctcccaaatgacctcgcttcacttga

SEQ ID NO: 174976 - DNA, 38 bp, Artificial Sequence
  Synthetic oligonucleotide
gttgcacgccagcctttcgtcctccacccctagcttga

SEQ ID NO: 174977 - DNA, 35 bp, Artificial Sequence
  Synthetic oligonucleotide
gaggaggggtcggggcaggatggaggtggagttga

SEQ ID NO: 174978 - DNA, 38 bp, Artificial Sequence
  Synthetic oligonucleotide
ggacatggggagaacggctaggggggtaagtgggttga

SEQ ID NO: 174979 - DNA, 38 bp, Artificial Sequence
  Synthetic oligonucleotide
ttcagtgtcccagctactacctcccctccgcctgttga

SEQ ID NO: 174980 - DNA, 37 bp, Artificial Sequence
  Synthetic oligonucleotide
gtagccaactcccgttccattcgcccccgtttgttga

SEQ ID NO: 174981 - DNA, 37 bp, Artificial Sequence
  Synthetic oligonucleotide
aacacagctccatcgaatccggcgcttcaccctttga

SEQ ID NO: 174982 - DNA, 37 bp, Artificial Sequence
  Synthetic oligonucleotide
tctacgctccctatgcccgctattgcctattctttga

SEQ ID NO: 174983 - DNA, 36 bp, Artificial Sequence
  Synthetic oligonucleotide
gccgcccgtgcccccttacagcatccgcctgcaata

SEQ ID NO: 174984 - DNA, 36 bp, Artificial Sequence
  Synthetic oligonucleotide
actccggacttcccatagtatactgctcctcttcta

SEQ ID NO: 174985 - DNA, 36 bp, Artificial Sequence
  Synthetic oligonucleotide
gtctgccaccccactggttggatcgcttccctggta

SEQ ID NO: 174986 - DNA, 36 bp, Artificial Sequence
  Synthetic oligonucleotide
acatcattcgcaaccctgtccttcccgttgggctta

SEQ ID NO: 174987 - DNA, 36 bp, Artificial Sequence
  Synthetic oligonucleotide
tccccgctactaggtcgtcgactcctcaccctttta

SEQ ID NO: 174988 - DNA, 35 bp, Artificial Sequence
  Synthetic oligonucleotide
gcatcacacctggccgtatgtctcctcaatgcaac

SEQ ID NO: 174989 - DNA, 35 bp, Artificial Sequence
  Synthetic oligonucleotide
gctgaacgcaggcatcctccgtttcacttatcaac

SEQ ID NO: 174990 - DNA, 33 bp, Artificial Sequence
  Synthetic oligonucleotide
gaactccacccccgactttgctccacagtacac

SEQ ID NO: 174991 - DNA, 35 bp, Artificial Sequence
  Synthetic oligonucleotide
ggatgcctcaaccgcaccacccacctatggtagac

SEQ ID NO: 174992 - DNA, 35 bp, Artificial Sequence
  Synthetic oligonucleotide
gacgcaatcaccttagcattgccccccgtaactac

SEQ ID NO: 174993 - DNA, 35 bp, Artificial Sequence
  Synthetic oligonucleotide
gcacgggccctctgtgagctgactgctagcccccc

SEQ ID NO: 174994 - DNA, 35 bp, Artificial Sequence
  Synthetic oligonucleotide
tttgcccgatggtacctgttatctgtcgcttcccc

SEQ ID NO: 174995 - DNA, 35 bp, Artificial Sequence
  Synthetic oligonucleotide
gcgcacgtggttttcatcagttccggcaccctccc

SEQ ID NO: 174996 - DNA, 33 bp, Artificial Sequence
  Synthetic oligonucleotide
gacgcccatggtcgaacgctaccttaccccgcc

SEQ ID NO: 174997 - DNA, 35 bp, Artificial Sequence
  Synthetic oligonucleotide
gcatatccccggagtatctctgtgtcgtccccgcc

SEQ ID NO: 174998 - DNA, 35 bp, Artificial Sequence
  Synthetic oligonucleotide
aacacgccatcagactatctcgcacgcctgccgcc

SEQ ID NO: 174999 - DNA, 35 bp, Artificial Sequence
  Synthetic oligonucleotide
tccacttcggtacatctctaggcatcagccgcgcc

SEQ ID NO: 175000 - DNA, 35 bp, Artificial Sequence
  Synthetic oligonucleotide
atcacgcgagacgcttccggtccctccccgtcgcc

SEQ ID NO: 175001 - DNA, 35 bp, Artificial Sequence
  Synthetic oligonucleotide
gcttgagtcccctcaccgccacagttttccatgcc

SEQ ID NO: 175002 - DNA, 35 bp, Artificial Sequence
  Synthetic oligonucleotide
tgcactatcggttccgtccattccagattctatcc

SEQ ID NO: 175003 - DNA, 36 bp, Artificial Sequence
  Synthetic oligonucleotide
tccgacacactgtgtacctcattaatcattcgccgc

SEQ ID NO: 175004 - DNA, 35 bp, Artificial Sequence
  Synthetic oligonucleotide
tccccttaacggtccaatgccccctcgtcccatgc

SEQ ID NO: 175005 - DNA, 35 bp, Artificial Sequence
  Synthetic oligonucleotide
tctgtacgccgcacgttgcgttttcttcgctcctc

SEQ ID NO: 175006 - DNA, 35 bp, Artificial Sequence
  Synthetic oligonucleotide
tcttcgctccaaagcccatccgacggcccccgctc

SEQ ID NO: 175007 - DNA, 35 bp, Artificial Sequence
  Synthetic oligonucleotide
tgatccgtcacttctccctttgccagtcggtgctc

SEQ ID NO: 175008 - DNA, 35 bp, Artificial Sequence
  Synthetic oligonucleotide
gtgtgtcgcactccccgcaactcgacgtttctgtc

SEQ ID NO: 175009 - DNA, 35 bp, Artificial Sequence
  Synthetic oligonucleotide
actagcaccacttgttgtccgcctttgggcccttc

SEQ ID NO: 175010 - DNA, 35 bp, Artificial Sequence
  Synthetic oligonucleotide
gcacgtgcgcccgtagctctgatcttcttttgttc

SEQ ID NO: 175011 - DNA, 35 bp, Artificial Sequence
  Synthetic oligonucleotide
atggcgaacgtgcgggaggggtgagggtagaacag

SEQ ID NO: 175012 - DNA, 35 bp, Artificial Sequence
  Synthetic oligonucleotide
gagtgaaggggacggagtattgggaaaatggccag

SEQ ID NO: 175013 - DNA, 34 bp, Artificial Sequence
  Synthetic oligonucleotide
gttattgcgcacgtcgtacccaccctcttgcacg

SEQ ID NO: 175014 - DNA, 36 bp, Artificial Sequence
  Synthetic oligonucleotide
ttcgcccctgttaaacgcacccatgtattcctcacg

SEQ ID NO: 175015 - DNA, 35 bp, Artificial Sequence
  Synthetic oligonucleotide
ttggagacccacacctgcatcgaaccgacccgacg

SEQ ID NO: 175016 - DNA, 35 bp, Artificial Sequence
  Synthetic oligonucleotide
gcctccgcccccattctccatgaacacgtgtgacg

SEQ ID NO: 175017 - DNA, 35 bp, Artificial Sequence
  Synthetic oligonucleotide
agaagccgtccatggccacctgcttgtccgccccg

SEQ ID NO: 175018 - DNA, 35 bp, Artificial Sequence
  Synthetic oligonucleotide
gtctgccctccgttgcgttggtgtcttctaatccg

SEQ ID NO: 175019 - DNA, 35 bp, Artificial Sequence
  Synthetic oligonucleotide
gccaaaggtgggcaagggtgatgggcggggtcgcg

SEQ ID NO: 175020 - DNA, 35 bp, Artificial Sequence
  Synthetic oligonucleotide
tccccgccctcctccatccgcccaatctttcggcg

SEQ ID NO: 175021 - DNA, 35 bp, Artificial Sequence
  Synthetic oligonucleotide
gtcgccgcccgaaaatctatagttcctgtactgcg

SEQ ID NO: 175022 - DNA, 34 bp, Artificial Sequence
  Synthetic oligonucleotide
tcacgcacaacctgttatgccaacaaacacctcg

SEQ ID NO: 175023 - DNA, 35 bp, Artificial Sequence
  Synthetic oligonucleotide
tactctgcctaggctggttatgtaactccttctcg

SEQ ID NO: 175024 - DNA, 35 bp, Artificial Sequence
  Synthetic oligonucleotide
taagcaaaacgatagggaagggcatgggtgcaagg

SEQ ID NO: 175025 - DNA, 35 bp, Artificial Sequence
  Synthetic oligonucleotide
ggaaacggacggggggggctagtaggtagggaggg

SEQ ID NO: 175026 - DNA, 35 bp, Artificial Sequence
  Synthetic oligonucleotide
gttggcgaaggctcgggacaggggggatggtgggg

SEQ ID NO: 175027 - DNA, 35 bp, Artificial Sequence
  Synthetic oligonucleotide
tatgacctacgccgagtgtttccccttcagtcatg

SEQ ID NO: 175028 - DNA, 35 bp, Artificial Sequence
  Synthetic oligonucleotide
acgtttgctccacatccgctcacccccgcctggtg

SEQ ID NO: 175029 - DNA, 35 bp, Artificial Sequence
  Synthetic oligonucleotide
gcctttccctccccgtatgtcgtcgtaatctcttg

SEQ ID NO: 175030 - DNA, 35 bp, Artificial Sequence
  Synthetic oligonucleotide
gatgagggggagaagagagggatgttggagatttg

SEQ ID NO: 175031 - DNA, 35 bp, Artificial Sequence
  Synthetic oligonucleotide
gccaacaccagaatcacaagcctgttccttttcat

SEQ ID NO: 175032 - DNA, 35 bp, Artificial Sequence
  Synthetic oligonucleotide
tcatcccaccgtgtaatgttgccctttgtctcgat

SEQ ID NO: 175033 - DNA, 35 bp, Artificial Sequence
  Synthetic oligonucleotide
gtgacaccgacaagctcccaccatctgtgcgctat

SEQ ID NO: 175034 - DNA, 35 bp, Artificial Sequence
  Synthetic oligonucleotide
tagcacccacttaccacattgtccgcctgcattat

SEQ ID NO: 175035 - DNA, 35 bp, Artificial Sequence
  Synthetic oligonucleotide
tctaaaggcggagctgccccgcttccctctcgact

SEQ ID NO: 175036 - DNA, 34 bp, Artificial Sequence
  Synthetic oligonucleotide
gctcgccctagtgcgacccccgctacgtatccct

SEQ ID NO: 175037 - DNA, 34 bp, Artificial Sequence
  Synthetic oligonucleotide
tatcccgtcgccggtccgcatttacgtagtccct

SEQ ID NO: 175038 - DNA, 35 bp, Artificial Sequence
  Synthetic oligonucleotide
tacctgcacccgctcatgtttttctcttctcgcct

SEQ ID NO: 175039 - DNA, 35 bp, Artificial Sequence
  Synthetic oligonucleotide
acaattactcgccgtcacctggttcagtttcgcct

SEQ ID NO: 175040 - DNA, 35 bp, Artificial Sequence
  Synthetic oligonucleotide
actcactccacttcccgtttcattgcctgcttgct

SEQ ID NO: 175041 - DNA, 35 bp, Artificial Sequence
  Synthetic oligonucleotide
gttggccagtgccctgctatggcggtttccactct

SEQ ID NO: 175042 - DNA, 35 bp, Artificial Sequence
  Synthetic oligonucleotide
gttacgcacgcgatgattctttcaccgccgcctct

SEQ ID NO: 175043 - DNA, 35 bp, Artificial Sequence
  Synthetic oligonucleotide
tccacgccccctgtcctgtagagaaggccctttct

SEQ ID NO: 175044 - DNA, 35 bp, Artificial Sequence
  Synthetic oligonucleotide
ccgatggagaggaatggttcggagcaagggggagt

SEQ ID NO: 175045 - DNA, 35 bp, Artificial Sequence
  Synthetic oligonucleotide
agatcgtgggagggctagggctgggtcgctccatt

SEQ ID NO: 175046 - DNA, 35 bp, Artificial Sequence
  Synthetic oligonucleotide
cccatcacatggggttgttttcgttccactcactt

SEQ ID NO: 175047 - DNA, 35 bp, Artificial Sequence
  Synthetic oligonucleotide
gagtgagtggaggttggaaaagggtgaaaaaagtt

SEQ ID NO: 175048 - DNA, 35 bp, Artificial Sequence
  Synthetic oligonucleotide
gcgaagcctggtctcccgttttcgatcatcctgtt

SEQ ID NO: 175049 - DNA, 35 bp, Artificial Sequence
  Synthetic oligonucleotide
tgtcccattccgcgccgcccgccaaactgcacttt

SEQ ID NO: 175050 - DNA, 36 bp, Artificial Sequence
  Synthetic oligonucleotide
ttgagtgcaacagggtagggaggggacggatgcaaa

SEQ ID NO: 175051 - DNA, 35 bp, Artificial Sequence
  Synthetic oligonucleotide
tgtcacctaccacctctgcctatcccggctgacaa

SEQ ID NO: 175052 - DNA, 36 bp, Artificial Sequence
  Synthetic oligonucleotide
accgccgctacatcgcttcctacaccgtcagtgcaa

SEQ ID NO: 175053 - DNA, 36 bp, Artificial Sequence
  Synthetic oligonucleotide
gcatggcacctcggctacccccgtccctcacacgaa

SEQ ID NO: 175054 - DNA, 35 bp, Artificial Sequence
  Synthetic oligonucleotide
gacgggggaaggcaggagaggggaaggtggaggaa

SEQ ID NO: 175055 - DNA, 36 bp, Artificial Sequence
  Synthetic oligonucleotide
acgacgccacctcctgttactataccgacctttgaa

SEQ ID NO: 175056 - DNA, 36 bp, Artificial Sequence
  Synthetic oligonucleotide
gacgccttccctggattccgtacttcaccgctgtaa

SEQ ID NO: 175057 - DNA, 35 bp, Artificial Sequence
  Synthetic oligonucleotide
tttaaccgccacagggccaacaatagccttccaca

SEQ ID NO: 175058 - DNA, 36 bp, Artificial Sequence
  Synthetic oligonucleotide
tacgccacgtacatatggcaaccgcgcacaccccca

SEQ ID NO: 175059 - DNA, 36 bp, Artificial Sequence
  Synthetic oligonucleotide
gtgcactctgtctctatttggtctgtcccttcccca

SEQ ID NO: 175060 - DNA, 35 bp, Artificial Sequence
  Synthetic oligonucleotide
accccccctggctcacctgtcgttttacaccgcca

SEQ ID NO: 175061 - DNA, 36 bp, Artificial Sequence
  Synthetic oligonucleotide
tgactgaggtccggttccatagattccctgcttcca

SEQ ID NO: 175062 - DNA, 35 bp, Artificial Sequence
  Synthetic oligonucleotide
tcccttccccccccactcggcacatcatgccagca

SEQ ID NO: 175063 - DNA, 36 bp, Artificial Sequence
  Synthetic oligonucleotide
tttgatgccagcccgttctccacatgctcccccgca

SEQ ID NO: 175064 - DNA, 36 bp, Artificial Sequence
  Synthetic oligonucleotide
tcgcccctgtctctgttcttccgtatgctactcgca

SEQ ID NO: 175065 - DNA, 36 bp, Artificial Sequence
  Synthetic oligonucleotide
accgagggcggagttggagggtgctactcaacctca

SEQ ID NO: 175066 - DNA, 36 bp, Artificial Sequence
  Synthetic oligonucleotide
aattctgccgtagggcatctgttcacctggttttca

SEQ ID NO: 175067 - DNA, 37 bp, Artificial Sequence
  Synthetic oligonucleotide
gacttgcgaaagggggagcaggtgggacagtacaaga

SEQ ID NO: 175068 - DNA, 37 bp, Artificial Sequence
  Synthetic oligonucleotide
tacgcgcaatgccccttgtccatcccctgtttacaga

SEQ ID NO: 175069 - DNA, 37 bp, Artificial Sequence
  Synthetic oligonucleotide
aactgacggacggagagggtgagataattacgtcaga

SEQ ID NO: 175070 - DNA, 36 bp, Artificial Sequence
  Synthetic oligonucleotide
gctcccccccatctgccttttgacggacaatcgaga

SEQ ID NO: 175071 - DNA, 37 bp, Artificial Sequence
  Synthetic oligonucleotide
gcgaggcgtattcggaggggaacgggggggacgacga

SEQ ID NO: 175072 - DNA, 37 bp, Artificial Sequence
  Synthetic oligonucleotide
tccgatcccttatcagatctgacccacactaccccga

SEQ ID NO: 175073 - DNA, 37 bp, Artificial Sequence
  Synthetic oligonucleotide
tgccgtgcacttatagcgtttccgcccgccctcccga

SEQ ID NO: 175074 - DNA, 36 bp, Artificial Sequence
  Synthetic oligonucleotide
tgcctgcacagaccttttcttccctttctccgccga

SEQ ID NO: 175075 - DNA, 37 bp, Artificial Sequence
  Synthetic oligonucleotide
tgtacatgccgcacccttgtgtactcgtccaatccga

SEQ ID NO: 175076 - DNA, 37 bp, Artificial Sequence
  Synthetic oligonucleotide
tgagcgcgcaacaccttagtgacacctccccccgcga

SEQ ID NO: 175077 - DNA, 37 bp, Artificial Sequence
  Synthetic oligonucleotide
tgctcatcgcatatagttccacctaggccaccttcga

SEQ ID NO: 175078 - DNA, 36 bp, Artificial Sequence
  Synthetic oligonucleotide
gccttacgctgcttttatcaccgatccatccttcga

SEQ ID NO: 175079 - DNA, 38 bp, Artificial Sequence
  Synthetic oligonucleotide
tgaggagggccatgcaggagggtgggagggtcgttcga

SEQ ID NO: 175080 - DNA, 36 bp, Artificial Sequence
  Synthetic oligonucleotide
taccctctgtctaactgcctccccgttcttgccgga

SEQ ID NO: 175081 - DNA, 37 bp, Artificial Sequence
  Synthetic oligonucleotide
aacagggggtggtgggtatgggcaaaagctgggcgga

SEQ ID NO: 175082 - DNA, 36 bp, Artificial Sequence
  Synthetic oligonucleotide
tccagactctggcgtttcctccccttgcctttcgga

SEQ ID NO: 175083 - DNA, 37 bp, Artificial Sequence
  Synthetic oligonucleotide
aagatgagacagagatatgatgacgcgcggggaggga

SEQ ID NO: 175084 - DNA, 37 bp, Artificial Sequence
  Synthetic oligonucleotide
ggacccctcgacgcgcattgccctccccaaaccggga

SEQ ID NO: 175085 - DNA, 37 bp, Artificial Sequence
  Synthetic oligonucleotide
aatggtcgaggtagggaagggctgggatcgttcggga

SEQ ID NO: 175086 - DNA, 37 bp, Artificial Sequence
  Synthetic oligonucleotide
gagcgatcggggaggagaagggatactaaaaagggga

SEQ ID NO: 175087 - DNA, 37 bp, Artificial Sequence
  Synthetic oligonucleotide
atgaacacgggtggaaaagggtagagggtggagggga

SEQ ID NO: 175088 - DNA, 37 bp, Artificial Sequence
  Synthetic oligonucleotide
aaaagtcggcgtaagcggtgggggaggggtgggggga

SEQ ID NO: 175089 - DNA, 37 bp, Artificial Sequence
  Synthetic oligonucleotide
gggacgccaccagcttatttctacttcctccttggga

SEQ ID NO: 175090 - DNA, 37 bp, Artificial Sequence
  Synthetic oligonucleotide
acccccgccgcatagtccaccacggcgcactcttgga

SEQ ID NO: 175091 - DNA, 35 bp, Artificial Sequence
  Synthetic oligonucleotide
gatcgcaactgaggagaatggaagggggggttgga

SEQ ID NO: 175092 - DNA, 38 bp, Artificial Sequence
  Synthetic oligonucleotide
atgtactagcggtgagggcgggcgagggaaggacatga

SEQ ID NO: 175093 - DNA, 38 bp, Artificial Sequence
  Synthetic oligonucleotide
aacgacaacgtggtaaaggggaaggggggtggacatga

SEQ ID NO: 175094 - DNA, 37 bp, Artificial Sequence
  Synthetic oligonucleotide
atggacggccctcctagtttattcactcgccctatga

SEQ ID NO: 175095 - DNA, 38 bp, Artificial Sequence
  Synthetic oligonucleotide
gcactcgcctttcgtactacaacactttctgaccctga

SEQ ID NO: 175096 - DNA, 37 bp, Artificial Sequence
  Synthetic oligonucleotide
gcctgccacttatgctaatagccgcccaataccctga

SEQ ID NO: 175097 - DNA, 38 bp, Artificial Sequence
  Synthetic oligonucleotide
tccgtcccacgtcccacttctctcggcacttcccctga

SEQ ID NO: 175098 - DNA, 37 bp, Artificial Sequence
  Synthetic oligonucleotide
gacatgcggccttgtgtactcctgccatcccgcctga

SEQ ID NO: 175099 - DNA, 36 bp, Artificial Sequence
  Synthetic oligonucleotide
gagaacgaacacggggagttatggtgggaaggctga

SEQ ID NO: 175100 - DNA, 34 bp, Artificial Sequence
  Synthetic oligonucleotide
ggaacggctcgcatgctccctctcgttctgctga

SEQ ID NO: 175101 - DNA, 38 bp, Artificial Sequence
  Synthetic oligonucleotide
gtgcgcaactacgtgcaaatgcccctgttcccatctga

SEQ ID NO: 175102 - DNA, 37 bp, Artificial Sequence
  Synthetic oligonucleotide
accccgcctctgactgatccgcctctactgccagtga

SEQ ID NO: 175103 - DNA, 38 bp, Artificial Sequence
  Synthetic oligonucleotide
gccccctcttgagttatgcccctgctccgttccggtga

SEQ ID NO: 175104 - DNA, 38 bp, Artificial Sequence
  Synthetic oligonucleotide
taagggagggaagatacggggaggaaggcaaaatgtga

SEQ ID NO: 175105 - DNA, 38 bp, Artificial Sequence
  Synthetic oligonucleotide
ggacggaggggttgggaaggagataattaggggtgtga

SEQ ID NO: 175106 - DNA, 38 bp, Artificial Sequence
  Synthetic oligonucleotide
aagggcacgacggagggcggactggggaattggtgtga

SEQ ID NO: 175107 - DNA, 38 bp, Artificial Sequence
  Synthetic oligonucleotide
gtgccccgcctcacatatgtccacctttcgccgattga

SEQ ID NO: 175108 - DNA, 38 bp, Artificial Sequence
  Synthetic oligonucleotide
tatcgccaacggggcctttcgatcctttatgtccttga

SEQ ID NO: 175109 - DNA, 38 bp, Artificial Sequence
  Synthetic oligonucleotide
gtatgtccacgtggccttgtcgcactccatcttcttga

SEQ ID NO: 175110 - DNA, 35 bp, Artificial Sequence
  Synthetic oligonucleotide
gtccatcttcgttcaccgctcacgcccacctttga

SEQ ID NO: 175111 - DNA, 35 bp, Artificial Sequence
  Synthetic oligonucleotide
tcacctgtgcacccagtagccgttcgcttcaccta

SEQ ID NO: 175112 - DNA, 36 bp, Artificial Sequence
  Synthetic oligonucleotide
aagccctcacatctgtcacatctactcgcccccgta

SEQ ID NO: 175113 - DNA, 36 bp, Artificial Sequence
  Synthetic oligonucleotide
accaaggttcggaatagggggggagcaggtggggta

SEQ ID NO: 175114 - DNA, 36 bp, Artificial Sequence
  Synthetic oligonucleotide
tctccattgcccatggcctttgtgctactaattgta

SEQ ID NO: 175115 - DNA, 35 bp, Artificial Sequence
  Synthetic oligonucleotide
tcgctacgtagactcattttcgctcgtccgcctta

SEQ ID NO: 175116 - DNA, 36 bp, Artificial Sequence
  Synthetic oligonucleotide
atcccatcacctgcttggttttcctcaagactttta

SEQ ID NO: 175117 - DNA, 35 bp, Artificial Sequence
  Synthetic oligonucleotide
acgcctcgatgagccccgtgcgcaccgccccccac

SEQ ID NO: 175118 - DNA, 35 bp, Artificial Sequence
  Synthetic oligonucleotide
gtctccacttacagccttggtattgctactcccac

SEQ ID NO: 175119 - DNA, 35 bp, Artificial Sequence
  Synthetic oligonucleotide
tacccgcctcccgcctaactcagtggaccaggcac

SEQ ID NO: 175120 - DNA, 35 bp, Artificial Sequence
  Synthetic oligonucleotide
gattcactgccctggttctatatcgcgcttaatac

SEQ ID NO: 175121 - DNA, 35 bp, Artificial Sequence
  Synthetic oligonucleotide
actgatgctttgcccctgtcctgtcatgcccttac

SEQ ID NO: 175122 - DNA, 35 bp, Artificial Sequence
  Synthetic oligonucleotide
gattgcgcctgcggtttttcacaccttctttaacc

SEQ ID NO: 175123 - DNA, 35 bp, Artificial Sequence
  Synthetic oligonucleotide
atgcccgcccagctcttcgttctgtcctggtcacc

SEQ ID NO: 175124 - DNA, 35 bp, Artificial Sequence
  Synthetic oligonucleotide
gtacgccatctaagtccgccggtgcttccttcacc

SEQ ID NO: 175125 - DNA, 35 bp, Artificial Sequence
  Synthetic oligonucleotide
accgggcctatcccacgttgccgattcccgatacc

SEQ ID NO: 175126 - DNA, 35 bp, Artificial Sequence
  Synthetic oligonucleotide
gatgcctagtgggccttactttgccatcctgtacc

SEQ ID NO: 175127 - DNA, 35 bp, Artificial Sequence
  Synthetic oligonucleotide
atgcccctccataagcccgagcgctcacccaaccc

SEQ ID NO: 175128 - DNA, 34 bp, Artificial Sequence
  Synthetic oligonucleotide
aagcccacgcattacacccgaatctatccgcgcc

SEQ ID NO: 175129 - DNA, 35 bp, Artificial Sequence
  Synthetic oligonucleotide
gacaaccctcctgctccttctaggcctacgatgcc

SEQ ID NO: 175130 - DNA, 35 bp, Artificial Sequence
  Synthetic oligonucleotide
tactcgtacgcatacagtagaaatccccccctgcc

SEQ ID NO: 175131 - DNA, 35 bp, Artificial Sequence
  Synthetic oligonucleotide
acagcacacccccatagatcggccgtccgcctgcc

SEQ ID NO: 175132 - DNA, 35 bp, Artificial Sequence
  Synthetic oligonucleotide
gtgcacctccattgatccttaacggtccacgctcc

SEQ ID NO: 175133 - DNA, 35 bp, Artificial Sequence
  Synthetic oligonucleotide
ttcccccacccagcaccgtgcctcagaacgcttcc

SEQ ID NO: 175134 - DNA, 35 bp, Artificial Sequence
  Synthetic oligonucleotide
gccgtgcatcctacttcagcctgagggcatcttcc

SEQ ID NO: 175135 - DNA, 35 bp, Artificial Sequence
  Synthetic oligonucleotide
gatgtctagccccatcttgctctctactggaccgc

SEQ ID NO: 175136 - DNA, 35 bp, Artificial Sequence
  Synthetic oligonucleotide
aaccactccagttggccaaccttccgcctgctcgc

SEQ ID NO: 175137 - DNA, 35 bp, Artificial Sequence
  Synthetic oligonucleotide
tccccgccccgatgatatatccctcctttgcaggc

SEQ ID NO: 175138 - DNA, 35 bp, Artificial Sequence
  Synthetic oligonucleotide
tcgcacaactctgcccaagatctttgtccccttgc

SEQ ID NO: 175139 - DNA, 35 bp, Artificial Sequence
  Synthetic oligonucleotide
tgcgcattatacgctctgtcctcgtttgtaccttc

SEQ ID NO: 175140 - DNA, 35 bp, Artificial Sequence
  Synthetic oligonucleotide
ggcggggccaattctcgttccatgctgccttcttc

SEQ ID NO: 175141 - DNA, 35 bp, Artificial Sequence
  Synthetic oligonucleotide
tcgtgccacagatgtaaagttcgtccgtgttcttc

SEQ ID NO: 175142 - DNA, 35 bp, Artificial Sequence
  Synthetic oligonucleotide
gcatcactcgctctatggtctcatcgctgtatttc

SEQ ID NO: 175143 - DNA, 35 bp, Artificial Sequence
  Synthetic oligonucleotide
ttacacctcccattcaagttgtctcacagggtttc

SEQ ID NO: 175144 - DNA, 35 bp, Artificial Sequence
  Synthetic oligonucleotide
gtgcccacttctgttctgaaatgtctcccctctag

SEQ ID NO: 175145 - DNA, 35 bp, Artificial Sequence
  Synthetic oligonucleotide
ggagaggagtcttggttgggtggaggggggtaacg

SEQ ID NO: 175146 - DNA, 35 bp, Artificial Sequence
  Synthetic oligonucleotide
acaccatgggcctgcggtgtacctccgtctccccg

SEQ ID NO: 175147 - DNA, 35 bp, Artificial Sequence
  Synthetic oligonucleotide
ttctgcctcccccgttaaatttataagcaatagcg

SEQ ID NO: 175148 - DNA, 35 bp, Artificial Sequence
  Synthetic oligonucleotide
gtctacctttctttgtcttttgcaccgtgctctcg

SEQ ID NO: 175149 - DNA, 35 bp, Artificial Sequence
  Synthetic oligonucleotide
gactgactgcgtaagcgagcggggggggaagaggg

SEQ ID NO: 175150 - DNA, 35 bp, Artificial Sequence
  Synthetic oligonucleotide
gctcgctccgacccccggccccacattcacactgg

SEQ ID NO: 175151 - DNA, 35 bp, Artificial Sequence
  Synthetic oligonucleotide
acatgcaatctcacgggcttcctccaatttccctg

SEQ ID NO: 175152 - DNA, 35 bp, Artificial Sequence
  Synthetic oligonucleotide
ggccatctcctccaagtgttccatctcgctttctg

SEQ ID NO: 175153 - DNA, 34 bp, Artificial Sequence
  Synthetic oligonucleotide
gggaaccgttgttgtctctccgctcttacccgtg

SEQ ID NO: 175154 - DNA, 35 bp, Artificial Sequence
  Synthetic oligonucleotide
agtgaggagggggactcggggtggggaagtcggtg

SEQ ID NO: 175155 - DNA, 35 bp, Artificial Sequence
  Synthetic oligonucleotide
attccaccgcattgctctatttcgatacttttgtg

SEQ ID NO: 175156 - DNA, 35 bp, Artificial Sequence
  Synthetic oligonucleotide
ccttgccgcaccccgtgttgcatcgccaccaccat

SEQ ID NO: 175157 - DNA, 35 bp, Artificial Sequence
  Synthetic oligonucleotide
gtcacccgctctcccgtctaatcctgttcgttcat

SEQ ID NO: 175158 - DNA, 35 bp, Artificial Sequence
  Synthetic oligonucleotide
taggggtacacgtcgaggggtgggaatgcggggat

SEQ ID NO: 175159 - DNA, 35 bp, Artificial Sequence
  Synthetic oligonucleotide
tctgcccctccgccatctgctcctggtccgcctat

SEQ ID NO: 175160 - DNA, 35 bp, Artificial Sequence
  Synthetic oligonucleotide
gctccaccgccgcttaccttttatccaccgcttat

SEQ ID NO: 175161 - DNA, 35 bp, Artificial Sequence
  Synthetic oligonucleotide
aattgcccacactcctatgagatccagccccccct

SEQ ID NO: 175162 - DNA, 35 bp, Artificial Sequence
  Synthetic oligonucleotide
gcaaccgcacgtatttgcctatcttttccagccct

SEQ ID NO: 175163 - DNA, 35 bp, Artificial Sequence
  Synthetic oligonucleotide
agcctggttcaagtgcgcgatccactaccttccct

SEQ ID NO: 175164 - DNA, 35 bp, Artificial Sequence
  Synthetic oligonucleotide
gttgtcgccccggcttttggaccccgtttacgcct

SEQ ID NO: 175165 - DNA, 35 bp, Artificial Sequence
  Synthetic oligonucleotide
tgcaccgtgtaggtcctttgcaactcgactccgct

SEQ ID NO: 175166 - DNA, 35 bp, Artificial Sequence
  Synthetic oligonucleotide
gcgccgtaacgttaggtcacacgcaacacatctct

SEQ ID NO: 175167 - DNA, 35 bp, Artificial Sequence
  Synthetic oligonucleotide
gatgtacagcccagctctcgtagagcttcctctct

SEQ ID NO: 175168 - DNA, 35 bp, Artificial Sequence
  Synthetic oligonucleotide
tagtgtggcctacagttttctatccttggctctct

SEQ ID NO: 175169 - DNA, 35 bp, Artificial Sequence
  Synthetic oligonucleotide
tctgcggcgcacctgtcattactttccccacgtct

SEQ ID NO: 175170 - DNA, 35 bp, Artificial Sequence
  Synthetic oligonucleotide
gtcgtcccgccccctttcgccgatttgtcccttct

SEQ ID NO: 175171 - DNA, 35 bp, Artificial Sequence
  Synthetic oligonucleotide
tataagggcaccctccgcctgcacccattacctgt

SEQ ID NO: 175172 - DNA, 35 bp, Artificial Sequence
  Synthetic oligonucleotide
aagggggaaagagggagaaaaggaatgaacagtgt

SEQ ID NO: 175173 - DNA, 35 bp, Artificial Sequence
  Synthetic oligonucleotide
tcccacccacccagaatgttgcctgctccttgctt

SEQ ID NO: 175174 - DNA, 35 bp, Artificial Sequence
  Synthetic oligonucleotide
gtcccaccatcaccgcaatccaataggcccgcttt

SEQ ID NO: 175175 - DNA, 35 bp, Artificial Sequence
  Synthetic oligonucleotide
acctgactacaaatgctttcttcccgaccttccaa

SEQ ID NO: 175176 - DNA, 35 bp, Artificial Sequence
  Synthetic oligonucleotide
gcctgcccggccttttcgtactctgcgttatgcaa

SEQ ID NO: 175177 - DNA, 36 bp, Artificial Sequence
  Synthetic oligonucleotide
gcccaccctcacgcgtctcgctttatggttttgcaa

SEQ ID NO: 175178 - DNA, 36 bp, Artificial Sequence
  Synthetic oligonucleotide
aacacgggagggtggagggtgcggagtgtccgcgaa

SEQ ID NO: 175179 - DNA, 36 bp, Artificial Sequence
  Synthetic oligonucleotide
acacatcccctcgttggcactgcccttactgcctaa

SEQ ID NO: 175180 - DNA, 36 bp, Artificial Sequence
  Synthetic oligonucleotide
gcctcacgttgccccctgtcttctagaacctgttaa

SEQ ID NO: 175181 - DNA, 36 bp, Artificial Sequence
  Synthetic oligonucleotide
gaccatgtgccttgctgactaccacccctcagtaca

SEQ ID NO: 175182 - DNA, 35 bp, Artificial Sequence
  Synthetic oligonucleotide
gcccttgccccctttttaagcaacctgtgagccca

SEQ ID NO: 175183 - DNA, 36 bp, Artificial Sequence
  Synthetic oligonucleotide
tcacccaccgggctgtctttaggccaatttcgccca

SEQ ID NO: 175184 - DNA, 36 bp, Artificial Sequence
  Synthetic oligonucleotide
attgtcacgacgagctgtaccttccccagctgccca

SEQ ID NO: 175185 - DNA, 35 bp, Artificial Sequence
  Synthetic oligonucleotide
tctcgctgcccgaccgcccgtaccgcccgagtcca

SEQ ID NO: 175186 - DNA, 36 bp, Artificial Sequence
  Synthetic oligonucleotide
tacagtggaaatgtcccccccgtcgccttacttcca

SEQ ID NO: 175187 - DNA, 36 bp, Artificial Sequence
  Synthetic oligonucleotide
ttgacccccccatgattgccgtattagtttcccgca

SEQ ID NO: 175188 - DNA, 36 bp, Artificial Sequence
  Synthetic oligonucleotide
tgtgcgttcccccctcctgcatacctgctcatcgca

SEQ ID NO: 175189 - DNA, 36 bp, Artificial Sequence
  Synthetic oligonucleotide
tggagaggaagacaggcaggggtgggcggacgggca

SEQ ID NO: 175190 - DNA, 36 bp, Artificial Sequence
  Synthetic oligonucleotide
gataggggctgggcagtgacacagggggaaggggca

SEQ ID NO: 175191 - DNA, 35 bp, Artificial Sequence
  Synthetic oligonucleotide
gcacactatcgtgtcctagccgccccattaatgca

SEQ ID NO: 175192 - DNA, 36 bp, Artificial Sequence
  Synthetic oligonucleotide
gcgcactagtgccgctgcttttttatgccttactca

SEQ ID NO: 175193 - DNA, 36 bp, Artificial Sequence
  Synthetic oligonucleotide
gtcaccttccagctatctcgcgtgagcccaccctca

SEQ ID NO: 175194 - DNA, 36 bp, Artificial Sequence
  Synthetic oligonucleotide
agcgcgatccgtccgtttcccttcacgagtctctca

SEQ ID NO: 175195 - DNA, 36 bp, Artificial Sequence
  Synthetic oligonucleotide
atcatcacgtgcactcgactcgcgcccccggtctca

SEQ ID NO: 175196 - DNA, 35 bp, Artificial Sequence
  Synthetic oligonucleotide
gatccgccaccttgcagaagccccctgaccggtca

SEQ ID NO: 175197 - DNA, 35 bp, Artificial Sequence
  Synthetic oligonucleotide
tactccacccgccaacgtatttaggtgcaccttca

SEQ ID NO: 175198 - DNA, 37 bp, Artificial Sequence
  Synthetic oligonucleotide
tgactgtggggtggggagaggatagagggtgggacga

SEQ ID NO: 175199 - DNA, 37 bp, Artificial Sequence
  Synthetic oligonucleotide
tccccaagcaacacgatacctgccgccccgataccga

SEQ ID NO: 175200 - DNA, 37 bp, Artificial Sequence
  Synthetic oligonucleotide
actgtcaccgtcattcccctgcatcaacgttccccga

SEQ ID NO: 175201 - DNA, 37 bp, Artificial Sequence
  Synthetic oligonucleotide
atgagctgcgtgcagacctgcatcccatcctgtccga

SEQ ID NO: 175202 - DNA, 37 bp, Artificial Sequence
  Synthetic oligonucleotide
acacgcaacccggcccgaccccagcgcttacctgcga

SEQ ID NO: 175203 - DNA, 37 bp, Artificial Sequence
  Synthetic oligonucleotide
gatcagatcccagacttgcacccttagccatcctcga

SEQ ID NO: 175204 - DNA, 37 bp, Artificial Sequence
  Synthetic oligonucleotide
gccgagggaaggggagggttgtcgaatagtgggagga

SEQ ID NO: 175205 - DNA, 37 bp, Artificial Sequence
  Synthetic oligonucleotide
tgtgatggggggtattgggtggtaagggagtagcgga

SEQ ID NO: 175206 - DNA, 37 bp, Artificial Sequence
  Synthetic oligonucleotide
gccgcccgcccgttggttttgtgtctcttgcgtcgga

SEQ ID NO: 175207 - DNA, 37 bp, Artificial Sequence
  Synthetic oligonucleotide
ggagaacggtggggaggggatagcacgaaagcaggga

SEQ ID NO: 175208 - DNA, 37 bp, Artificial Sequence
  Synthetic oligonucleotide
gaggatatgacggccaaggatggaacggatgagggga

SEQ ID NO: 175209 - DNA, 37 bp, Artificial Sequence
  Synthetic oligonucleotide
acgaccgcagggcgagagggaaatatgaatgggggga

SEQ ID NO: 175210 - DNA, 37 bp, Artificial Sequence
  Synthetic oligonucleotide
aggggaaatagcgttgggggtgggccctcgatgggga

SEQ ID NO: 175211 - DNA, 37 bp, Artificial Sequence
  Synthetic oligonucleotide
gggtacgagagcggggattggacggtaagggtgggga

SEQ ID NO: 175212 - DNA, 37 bp, Artificial Sequence
  Synthetic oligonucleotide
gaggatcatgcggggggagttacacgtgggtatggga

SEQ ID NO: 175213 - DNA, 37 bp, Artificial Sequence
  Synthetic oligonucleotide
tttgacccgggggtgggactagggaaggggagtggga

SEQ ID NO: 175214 - DNA, 36 bp, Artificial Sequence
  Synthetic oligonucleotide
gccactgcctagctaccagctttcctcgcccctgga

SEQ ID NO: 175215 - DNA, 37 bp, Artificial Sequence
  Synthetic oligonucleotide
gagccacgacatttcgcccatccccacgtgccttgga

SEQ ID NO: 175216 - DNA, 38 bp, Artificial Sequence
  Synthetic oligonucleotide
tgtccacccgccttttacctgatctgaaacgtccatga

SEQ ID NO: 175217 - DNA, 35 bp, Artificial Sequence
  Synthetic oligonucleotide
gatgtaagggggggaaggtgcaaacgggctcatga

SEQ ID NO: 175218 - DNA, 38 bp, Artificial Sequence
  Synthetic oligonucleotide
gacacccgccccaaacatattagtgcgccccattatga

SEQ ID NO: 175219 - DNA, 38 bp, Artificial Sequence
  Synthetic oligonucleotide
acacccccttgagtcgcgtaccattcccctgttcctga

SEQ ID NO: 175220 - DNA, 37 bp, Artificial Sequence
  Synthetic oligonucleotide
atttcctccagcgctcagccattgctcactttcctga

SEQ ID NO: 175221 - DNA, 37 bp, Artificial Sequence
  Synthetic oligonucleotide
ggtgcccccctcctgaagttactctctacagccgtga

SEQ ID NO: 175222 - DNA, 36 bp, Artificial Sequence
  Synthetic oligonucleotide
ggtgccacgcggaggtgggaagggacgggagggtga

SEQ ID NO: 175223 - DNA, 38 bp, Artificial Sequence
  Synthetic oligonucleotide
tgctcgctaacaccctgcgttatggcccaactacttga

SEQ ID NO: 175224 - DNA, 37 bp, Artificial Sequence
  Synthetic oligonucleotide
tcccaccgccctgactgtcatcatcgggtccgcttga

SEQ ID NO: 175225 - DNA, 37 bp, Artificial Sequence
  Synthetic oligonucleotide
gccacccgccgctgtaaacgcttcacgctcctcttga

SEQ ID NO: 175226 - DNA, 38 bp, Artificial Sequence
  Synthetic oligonucleotide
ttgtcccggacgtcagttctcgttttgcctcttcttga

SEQ ID NO: 175227 - DNA, 37 bp, Artificial Sequence
  Synthetic oligonucleotide
ttccccccctgtcccgttgttggttgatcttagttga

SEQ ID NO: 175228 - DNA, 36 bp, Artificial Sequence
  Synthetic oligonucleotide
actatgccgctgccctttcgtctgcttttcgctata

SEQ ID NO: 175229 - DNA, 36 bp, Artificial Sequence
  Synthetic oligonucleotide
gggagggaggggtgctgtatgagagggtttattata

SEQ ID NO: 175230 - DNA, 36 bp, Artificial Sequence
  Synthetic oligonucleotide
tagtctccacatcgtgtgtccctcactaccctccta

SEQ ID NO: 175231 - DNA, 36 bp, Artificial Sequence
  Synthetic oligonucleotide
acccaggtccaaagtgtcttcccttcgccatcgcta

SEQ ID NO: 175232 - DNA, 35 bp, Artificial Sequence
  Synthetic oligonucleotide
atgtacttcgccccgttggccccgctgcccatcta

SEQ ID NO: 175233 - DNA, 36 bp, Artificial Sequence
  Synthetic oligonucleotide
acctcctcggcttaggtcgtgtctccctcccatcta

SEQ ID NO: 175234 - DNA, 35 bp, Artificial Sequence
  Synthetic oligonucleotide
atctgcagggggtgggagggatcccaggcggggta

SEQ ID NO: 175235 - DNA, 35 bp, Artificial Sequence
  Synthetic oligonucleotide
gtacacgtctcagctcttgccctgtccacttggta

SEQ ID NO: 175236 - DNA, 36 bp, Artificial Sequence
  Synthetic oligonucleotide
atgtccgaacagaatgttcattcgatctcctcctta

SEQ ID NO: 175237 - DNA, 35 bp, Artificial Sequence
  Synthetic oligonucleotide
tcttgactgtcgcgccccacctcgtgcccatctta

SEQ ID NO: 175238 - DNA, 35 bp, Artificial Sequence
  Synthetic oligonucleotide
gttgaccgcctcacacttgaccccatataaggtta

SEQ ID NO: 175239 - DNA, 36 bp, Artificial Sequence
  Synthetic oligonucleotide
gtctccacgccatccttcctcagatacgcccgttta

SEQ ID NO: 175240 - DNA, 35 bp, Artificial Sequence
  Synthetic oligonucleotide
aaagcgaaaggggggggtacgaaaaactggggcac

SEQ ID NO: 175241 - DNA, 35 bp, Artificial Sequence
  Synthetic oligonucleotide
ggaccatcaatacacagcgtggccctctgtttcac

SEQ ID NO: 175242 - DNA, 35 bp, Artificial Sequence
  Synthetic oligonucleotide
gatgcctagctcacccccacgaccatccactgtac

SEQ ID NO: 175243 - DNA, 35 bp, Artificial Sequence
  Synthetic oligonucleotide
gccttgctatcgggccccccattctcgcagtttac

SEQ ID NO: 175244 - DNA, 34 bp, Artificial Sequence
  Synthetic oligonucleotide
gccaccccacccaagatcatgcgcgcgtataacc

SEQ ID NO: 175245 - DNA, 35 bp, Artificial Sequence
  Synthetic oligonucleotide
atgtacccccttaaggacgagacgccgttcccccc

SEQ ID NO: 175246 - DNA, 35 bp, Artificial Sequence
  Synthetic oligonucleotide
tccctccagggctatcaaatgtcttatccgccccc

SEQ ID NO: 175247 - DNA, 35 bp, Artificial Sequence
  Synthetic oligonucleotide
agcacacacttctcctcgttgagaccccgtgcccc

SEQ ID NO: 175248 - DNA, 35 bp, Artificial Sequence
  Synthetic oligonucleotide
gagcaccccctaagttttgccactgtcccatgccc

SEQ ID NO: 175249 - DNA, 35 bp, Artificial Sequence
  Synthetic oligonucleotide
actcaccttgtccatcgctctatctgccatccgcc

SEQ ID NO: 175250 - DNA, 35 bp, Artificial Sequence
  Synthetic oligonucleotide
atagcaacgcaccggtgttaatattcccccctgcc

SEQ ID NO: 175251 - DNA, 35 bp, Artificial Sequence
  Synthetic oligonucleotide
tgacctgtgccctgccgctaagccatcctcttgcc

SEQ ID NO: 175252 - DNA, 35 bp, Artificial Sequence
  Synthetic oligonucleotide
tgtacccagcaggccagagcctttcccgccgatcc

SEQ ID NO: 175253 - DNA, 35 bp, Artificial Sequence
  Synthetic oligonucleotide
tccgcatgtccatcgcaatcagctcgtacccctcc

SEQ ID NO: 175254 - DNA, 35 bp, Artificial Sequence
  Synthetic oligonucleotide
atgtgtctgccgcccggtatgcatttaatacttcc

SEQ ID NO: 175255 - DNA, 35 bp, Artificial Sequence
  Synthetic oligonucleotide
tgatgggaacctccgagctgactctttgaccttcc

SEQ ID NO: 175256 - DNA, 35 bp, Artificial Sequence
  Synthetic oligonucleotide
tccggtccacccctctcgatctgtaagccccacgc

SEQ ID NO: 175257 - DNA, 35 bp, Artificial Sequence
  Synthetic oligonucleotide
atcaccctcacatgccgctaccacctatcccccgc

SEQ ID NO: 175258 - DNA, 35 bp, Artificial Sequence
  Synthetic oligonucleotide
atcccaagcctctactgggttatttccatccccgc

SEQ ID NO: 175259 - DNA, 35 bp, Artificial Sequence
  Synthetic oligonucleotide
gtggtccctcctcctgtccaacgagccaatcccgc

SEQ ID NO: 175260 - DNA, 35 bp, Artificial Sequence
  Synthetic oligonucleotide
gtgtcgcttcccatcaccgatgcttacccctccgc

SEQ ID NO: 175261 - DNA, 35 bp, Artificial Sequence
  Synthetic oligonucleotide
tcacaccgaatggtgccaccgattcccactttcgc

SEQ ID NO: 175262 - DNA, 35 bp, Artificial Sequence
  Synthetic oligonucleotide
tctccgactcgcagacatacgccctccatcattgc

SEQ ID NO: 175263 - DNA, 35 bp, Artificial Sequence
  Synthetic oligonucleotide
tcccccagcccattcgctttaccacgcccccttgc

SEQ ID NO: 175264 - DNA, 35 bp, Artificial Sequence
  Synthetic oligonucleotide
gcctggaccacctgggtcacactccccagtcttgc

SEQ ID NO: 175265 - DNA, 35 bp, Artificial Sequence
  Synthetic oligonucleotide
acttccccgccctgactatttttgaccgccccatc

SEQ ID NO: 175266 - DNA, 35 bp, Artificial Sequence
  Synthetic oligonucleotide
acgctccacgccggacacgggttatctgctccatc

SEQ ID NO: 175267 - DNA, 35 bp, Artificial Sequence
  Synthetic oligonucleotide
gaggccgaacgtccatattgcgcctccacctgatc

SEQ ID NO: 175268 - DNA, 35 bp, Artificial Sequence
  Synthetic oligonucleotide
tagacgtagatgcccgtccgcatgcttgttctatc

SEQ ID NO: 175269 - DNA, 35 bp, Artificial Sequence
  Synthetic oligonucleotide
atgtgatgctcctgccctagacgtcccccctactc

SEQ ID NO: 175270 - DNA, 35 bp, Artificial Sequence
  Synthetic oligonucleotide
gcggacaatcgtagggtctctgcgcaccttccctc

SEQ ID NO: 175271 - DNA, 35 bp, Artificial Sequence
  Synthetic oligonucleotide
tacggcgaagggagggaacgggtgggcctgccgtc

SEQ ID NO: 175272 - DNA, 33 bp, Artificial Sequence
  Synthetic oligonucleotide
accgccttccttgcagctggccgccattccgtc

SEQ ID NO: 175273 - DNA, 35 bp, Artificial Sequence
  Synthetic oligonucleotide
gccctagtaaactgcactcctctcccttgttggtc

SEQ ID NO: 175274 - DNA, 35 bp, Artificial Sequence
  Synthetic oligonucleotide
ggatcactgtcgctgcgttcgacccactctgattc

SEQ ID NO: 175275 - DNA, 35 bp, Artificial Sequence
  Synthetic oligonucleotide
acatgccccaccgagcgggttagtgaggttacttc

SEQ ID NO: 175276 - DNA, 35 bp, Artificial Sequence
  Synthetic oligonucleotide
gtcctggctcacctgtggtggttgcttcccccttc

SEQ ID NO: 175277 - DNA, 35 bp, Artificial Sequence
  Synthetic oligonucleotide
gtgtcacgcaaattcgatcgagtcggcctcccttc

SEQ ID NO: 175278 - DNA, 35 bp, Artificial Sequence
  Synthetic oligonucleotide
gattgttccacgcctctctagccgtgcctgccttc

SEQ ID NO: 175279 - DNA, 35 bp, Artificial Sequence
  Synthetic oligonucleotide
gagggccgtctcaccctctccttcggactgtcttc

SEQ ID NO: 175280 - DNA, 35 bp, Artificial Sequence
  Synthetic oligonucleotide
tgcggacgtactcccgctttacaccccatgggttc

SEQ ID NO: 175281 - DNA, 36 bp, Artificial Sequence
  Synthetic oligonucleotide
tgagcccgcacttgaagtgctcactcttggcctttc

SEQ ID NO: 175282 - DNA, 35 bp, Artificial Sequence
  Synthetic oligonucleotide
ggtgcaccggcgggtttccctaatgcctctctttc

SEQ ID NO: 175283 - DNA, 35 bp, Artificial Sequence
  Synthetic oligonucleotide
tgagacccattgggtctagaccctcttctcttttc

SEQ ID NO: 175284 - DNA, 35 bp, Artificial Sequence
  Synthetic oligonucleotide
gggccctcccgctgctcccatcacccgcctcccag

SEQ ID NO: 175285 - DNA, 35 bp, Artificial Sequence
  Synthetic oligonucleotide
tcgcaatgttgcccccccgcccactcgctttagag

SEQ ID NO: 175286 - DNA, 35 bp, Artificial Sequence
  Synthetic oligonucleotide
gttacttcaccgcacgcatacatgccgacaacacg

SEQ ID NO: 175287 - DNA, 35 bp, Artificial Sequence
  Synthetic oligonucleotide
gtatgcataccggctggtccgcctcctaaaccccg

SEQ ID NO: 175288 - DNA, 35 bp, Artificial Sequence
  Synthetic oligonucleotide
tacgttgcctcccccgctatgcattcatccttccg

SEQ ID NO: 175289 - DNA, 35 bp, Artificial Sequence
  Synthetic oligonucleotide
gggtggcgggtgggttttgcggatggcacatcgcg

SEQ ID NO: 175290 - DNA, 35 bp, Artificial Sequence
  Synthetic oligonucleotide
gacgctgactcccggttcctatcttgaatgtatcg

SEQ ID NO: 175291 - DNA, 35 bp, Artificial Sequence
  Synthetic oligonucleotide
aagagacctgatgttgcgcggagggggagggaagg

SEQ ID NO: 175292 - DNA, 35 bp, Artificial Sequence
  Synthetic oligonucleotide
gaaggaggggaccgaggggggaatggggacaaggg

SEQ ID NO: 175293 - DNA, 35 bp, Artificial Sequence
  Synthetic oligonucleotide
ccctcccgcccctcatagtcgtaacgtacccactg

SEQ ID NO: 175294 - DNA, 35 bp, Artificial Sequence
  Synthetic oligonucleotide
gcgcaacctcagtaccacttgcctgttatgccctg

SEQ ID NO: 175295 - DNA, 35 bp, Artificial Sequence
  Synthetic oligonucleotide
tacgatctaccccgcgaccgcccctctatattgtg

SEQ ID NO: 175296 - DNA, 35 bp, Artificial Sequence
  Synthetic oligonucleotide
agccagacctcctcgtttgtattccccctattttg

SEQ ID NO: 175297 - DNA, 35 bp, Artificial Sequence
  Synthetic oligonucleotide
aacctggccttggatctcctttagtacgccccact

SEQ ID NO: 175298 - DNA, 35 bp, Artificial Sequence
  Synthetic oligonucleotide
gcacttcgtcaccttcattccgccgtcgctagact

SEQ ID NO: 175299 - DNA, 35 bp, Artificial Sequence
  Synthetic oligonucleotide
atctcacctgcatgtatttgccttaattacgccct

SEQ ID NO: 175300 - DNA, 35 bp, Artificial Sequence
  Synthetic oligonucleotide
gcaacgccattgcgccctgcaccgatgagctccct

SEQ ID NO: 175301 - DNA, 35 bp, Artificial Sequence
  Synthetic oligonucleotide
gcaacctccgggttccgtgccatttgcccttccct

SEQ ID NO: 175302 - DNA, 35 bp, Artificial Sequence
  Synthetic oligonucleotide
gcccgcctacctcacgtaatgaatactgcgatcct

SEQ ID NO: 175303 - DNA, 35 bp, Artificial Sequence
  Synthetic oligonucleotide
tgccggttaggcttagcaccagaccctcatctcct

SEQ ID NO: 175304 - DNA, 35 bp, Artificial Sequence
  Synthetic oligonucleotide
tccaccttcaatagttgtaccgtcgagcctctcct

SEQ ID NO: 175305 - DNA, 35 bp, Artificial Sequence
  Synthetic oligonucleotide
atttgctcgccacccactcagcctggttatgtcct

SEQ ID NO: 175306 - DNA, 35 bp, Artificial Sequence
  Synthetic oligonucleotide
ttctaccccatcactctgtgcgtacacccttagct

SEQ ID NO: 175307 - DNA, 35 bp, Artificial Sequence
  Synthetic oligonucleotide
tccgtgcctgtgaagcgctggctctaataccatct

SEQ ID NO: 175308 - DNA, 35 bp, Artificial Sequence
  Synthetic oligonucleotide
gtcacgtccgttttatcttccgcttcttggcctct

SEQ ID NO: 175309 - DNA, 35 bp, Artificial Sequence
  Synthetic oligonucleotide
gacgctacatacgattatgaacaatgcacctctct

SEQ ID NO: 175310 - DNA, 35 bp, Artificial Sequence
  Synthetic oligonucleotide
atcaccgatggcctggcctcgttgttgacccttct

SEQ ID NO: 175311 - DNA, 35 bp, Artificial Sequence
  Synthetic oligonucleotide
tatgtcccgctcacctgtttcgtggttccccttct

SEQ ID NO: 175312 - DNA, 35 bp, Artificial Sequence
  Synthetic oligonucleotide
tcacccctgccacaggctatcgagctggtgcttct

SEQ ID NO: 175313 - DNA, 35 bp, Artificial Sequence
  Synthetic oligonucleotide
tcagaaggtcggacccgcacccccccacttacagt

SEQ ID NO: 175314 - DNA, 35 bp, Artificial Sequence
  Synthetic oligonucleotide
tgaggtgcaaaacagggtgggtggagggcaccagt

SEQ ID NO: 175315 - DNA, 35 bp, Artificial Sequence
  Synthetic oligonucleotide
aaacggggggggagtgatagttgggtgggttccgt

SEQ ID NO: 175316 - DNA, 35 bp, Artificial Sequence
  Synthetic oligonucleotide
ttacgttcgaactatcaccagtcctggcctcctgt

SEQ ID NO: 175317 - DNA, 35 bp, Artificial Sequence
  Synthetic oligonucleotide
gacacccgttaggttctccaccgtccttgctaatt

SEQ ID NO: 175318 - DNA, 35 bp, Artificial Sequence
  Synthetic oligonucleotide
tcacgcgagagctacatgggccatcaaccttcctt

SEQ ID NO: 175319 - DNA, 35 bp, Artificial Sequence
  Synthetic oligonucleotide
gcccggcggtcgcacctgcggtccctgtccttctt

SEQ ID NO: 175320 - DNA, 35 bp, Artificial Sequence
  Synthetic oligonucleotide
ttcacccccgcacgcccgaccggttaccgttggtt

SEQ ID NO: 175321 - DNA, 35 bp, Artificial Sequence
  Synthetic oligonucleotide
tcgtgtcaccgcccttctgtcccattagttatgtt

SEQ ID NO: 175322 - DNA, 35 bp, Artificial Sequence
  Synthetic oligonucleotide
gcacctatgcgcgccccctttgcggtctctgtttt

SEQ ID NO: 175323 - DNA, 36 bp, Artificial Sequence
  Synthetic oligonucleotide
gtttcccgccacttgttgttccgctacgattgccaa

SEQ ID NO: 175324 - DNA, 36 bp, Artificial Sequence
  Synthetic oligonucleotide
gcccccccactgtccgactcactgactactaagcaa

SEQ ID NO: 175325 - DNA, 35 bp, Artificial Sequence
  Synthetic oligonucleotide
ggagtcgcaaggggtgggagaagaatgaagcgcaa

SEQ ID NO: 175326 - DNA, 35 bp, Artificial Sequence
  Synthetic oligonucleotide
accgagtcgtgaaaggggcaatgatgggggaggaa

SEQ ID NO: 175327 - DNA, 35 bp, Artificial Sequence
  Synthetic oligonucleotide
atcactccgctggtactgttaggtacacccttgaa

SEQ ID NO: 175328 - DNA, 36 bp, Artificial Sequence
  Synthetic oligonucleotide
tccgaccccatgccagcgcactcacggaccatctaa

SEQ ID NO: 175329 - DNA, 35 bp, Artificial Sequence
  Synthetic oligonucleotide
tgttcacaacgggggagggcaaggggtgaggcaca

SEQ ID NO: 175330 - DNA, 35 bp, Artificial Sequence
  Synthetic oligonucleotide
gttgtaacgccactcgcccgttcgtttcctctaca

SEQ ID NO: 175331 - DNA, 36 bp, Artificial Sequence
  Synthetic oligonucleotide
ttagcctcaccgatcactctgcctcctggttcacca

SEQ ID NO: 175332 - DNA, 31 bp, Artificial Sequence
  Synthetic oligonucleotide
gcctcttcatacagctgttcacatacgccca

SEQ ID NO: 175333 - DNA, 36 bp, Artificial Sequence
  Synthetic oligonucleotide
acgatccatcctcgttttgtgacatttcctctgcca

SEQ ID NO: 175334 - DNA, 35 bp, Artificial Sequence
  Synthetic oligonucleotide
gtcaaccacccacgcaacgtgtcaatattcctgca

SEQ ID NO: 175335 - DNA, 36 bp, Artificial Sequence
  Synthetic oligonucleotide
tacccctgggtgtcgacttacctgccttcccgtgca

SEQ ID NO: 175336 - DNA, 36 bp, Artificial Sequence
  Synthetic oligonucleotide
caccacccgctctgcccttcgccgcttcctgtttca

SEQ ID NO: 175337 - DNA, 37 bp, Artificial Sequence
  Synthetic oligonucleotide
gaggagagggcgggtggggacattgaagatcgctaga

SEQ ID NO: 175338 - DNA, 37 bp, Artificial Sequence
  Synthetic oligonucleotide
tctcatcccatcctcgagcccgtcagtaccccgccga

SEQ ID NO: 175339 - DNA, 37 bp, Artificial Sequence
  Synthetic oligonucleotide
gcctcatccgcaaccgtaatgaagtaacgccctccga

SEQ ID NO: 175340 - DNA, 37 bp, Artificial Sequence
  Synthetic oligonucleotide
actgtatcgtcgggcaacgggagggcggggagcgcga

SEQ ID NO: 175341 - DNA, 37 bp, Artificial Sequence
  Synthetic oligonucleotide
gtgccgtagcatggctctaaccgcccccttttcgcga

SEQ ID NO: 175342 - DNA, 37 bp, Artificial Sequence
  Synthetic oligonucleotide
atctgcgccacgtcttttcgcgcctatgactcctcga

SEQ ID NO: 175343 - DNA, 37 bp, Artificial Sequence
  Synthetic oligonucleotide
acccatgacccatcgcgttatccattccgccccagga

SEQ ID NO: 175344 - DNA, 37 bp, Artificial Sequence
  Synthetic oligonucleotide
aaacgtacaggtcgtgaaagaaagggggggggcagga

SEQ ID NO: 175345 - DNA, 36 bp, Artificial Sequence
  Synthetic oligonucleotide
ttccaccagccatcaccaatcatgcactccctcgga

SEQ ID NO: 175346 - DNA, 37 bp, Artificial Sequence
  Synthetic oligonucleotide
ataggagggaaggggtacaggcgaacaaggaggggga

SEQ ID NO: 175347 - DNA, 37 bp, Artificial Sequence
  Synthetic oligonucleotide
aatggtggcggtaggggttggcatgtgggaggatgga

SEQ ID NO: 175348 - DNA, 35 bp, Artificial Sequence
  Synthetic oligonucleotide
tcagagggtggcgtgacgggaggtagggaaaatga

SEQ ID NO: 175349 - DNA, 38 bp, Artificial Sequence
  Synthetic oligonucleotide
tcagctccgccgaccgtatcctcgcccttatttaatga

SEQ ID NO: 175350 - DNA, 37 bp, Artificial Sequence
  Synthetic oligonucleotide
agtgggagggaaggggaggagtaacaggcttcgatga

SEQ ID NO: 175351 - DNA, 36 bp, Artificial Sequence
  Synthetic oligonucleotide
tccccaccgctcctgcattctccacgcccgctatga

SEQ ID NO: 175352 - DNA, 38 bp, Artificial Sequence
  Synthetic oligonucleotide
gacccccgctacccctttaaccgagacaggctttctga

SEQ ID NO: 175353 - DNA, 37 bp, Artificial Sequence
  Synthetic oligonucleotide
gtctgcgggcggtgagataggggcaagggaggggtga

SEQ ID NO: 175354 - DNA, 38 bp, Artificial Sequence
  Synthetic oligonucleotide
gtacgggcggggacggggcggatatggacgatgggtga

SEQ ID NO: 175355 - DNA, 38 bp, Artificial Sequence
  Synthetic oligonucleotide
gacgggagggagggggtggacaagacctggtctggtga

SEQ ID NO: 175356 - DNA, 38 bp, Artificial Sequence
  Synthetic oligonucleotide
ttagggcaagctgtcggtggggcgggggagtgtggtga

SEQ ID NO: 175357 - DNA, 37 bp, Artificial Sequence
  Synthetic oligonucleotide
ttacgccccccctgttgctattttgcctattcattga

SEQ ID NO: 175358 - DNA, 37 bp, Artificial Sequence
  Synthetic oligonucleotide
gagagacaggatggaaggtagattgaagacggattga

SEQ ID NO: 175359 - DNA, 38 bp, Artificial Sequence
  Synthetic oligonucleotide
gccctccggcttctggtcttaagccctccacctattga

SEQ ID NO: 175360 - DNA, 38 bp, Artificial Sequence
  Synthetic oligonucleotide
gacatgtcgctttgttccctctccaccggcttacttga

SEQ ID NO: 175361 - DNA, 36 bp, Artificial Sequence
  Synthetic oligonucleotide
tgccctcatggcgccccgcacgatcctattccttga

SEQ ID NO: 175362 - DNA, 37 bp, Artificial Sequence
  Synthetic oligonucleotide
ttaggagggtatggcggtgcgggggggagtcggttga

SEQ ID NO: 175363 - DNA, 38 bp, Artificial Sequence
  Synthetic oligonucleotide
tccccccgcactggttaatcgcttcccatcgttgttga

SEQ ID NO: 175364 - DNA, 36 bp, Artificial Sequence
  Synthetic oligonucleotide
ttacggccgatcccctctgcgtcctccttggccata

SEQ ID NO: 175365 - DNA, 36 bp, Artificial Sequence
  Synthetic oligonucleotide
tgtgtgttaccgcctgtccctgcgccttttgccata

SEQ ID NO: 175366 - DNA, 36 bp, Artificial Sequence
  Synthetic oligonucleotide
atgggggaaaaggcgggaagaagccacgggggagta

SEQ ID NO: 175367 - DNA, 36 bp, Artificial Sequence
  Synthetic oligonucleotide
gatcgacgctgacctgcctccctcaccaggctatta

SEQ ID NO: 175368 - DNA, 32 bp, Artificial Sequence
  Synthetic oligonucleotide
gacctgccccagcgtagaaacctcgccactta

SEQ ID NO: 175369 - DNA, 36 bp, Artificial Sequence
  Synthetic oligonucleotide
gcatgcccatccgacgctgctacgttttacaggtta

SEQ ID NO: 175370 - DNA, 35 bp, Artificial Sequence
  Synthetic oligonucleotide
ttagcacccaatacagcttgcaccgacctcctaac

SEQ ID NO: 175371 - DNA, 35 bp, Artificial Sequence
  Synthetic oligonucleotide
tcagaccacctagcatgtaacgaccttcttcgcac

SEQ ID NO: 175372 - DNA, 35 bp, Artificial Sequence
  Synthetic oligonucleotide
gggtgcccatgtctcaccttgcctacgctcctacc

SEQ ID NO: 175373 - DNA, 35 bp, Artificial Sequence
  Synthetic oligonucleotide
ggtcgccggattgcttcttgttctgccttgttacc

SEQ ID NO: 175374 - DNA, 35 bp, Artificial Sequence
  Synthetic oligonucleotide
accgctgaccccgctatctccatacgctcgaaccc

SEQ ID NO: 175375 - DNA, 35 bp, Artificial Sequence
  Synthetic oligonucleotide
tccaccacgtttgacatcaagtctccccttcatcc

SEQ ID NO: 175376 - DNA, 35 bp, Artificial Sequence
  Synthetic oligonucleotide
gacaccccccgcttgaagccctgactagggactcc

SEQ ID NO: 175377 - DNA, 35 bp, Artificial Sequence
  Synthetic oligonucleotide
gattgcaccttcacaatgccgccgtcacctcgtcc

SEQ ID NO: 175378 - DNA, 35 bp, Artificial Sequence
  Synthetic oligonucleotide
gccatatgctgcggcgctcaccggtacccttttcc

SEQ ID NO: 175379 - DNA, 35 bp, Artificial Sequence
  Synthetic oligonucleotide
gtcgccttaatgtctctaataatgctccacttcgc

SEQ ID NO: 175380 - DNA, 35 bp, Artificial Sequence
  Synthetic oligonucleotide
tctgtggagagggggggtgtggtgcgcgaaggggc

SEQ ID NO: 175381 - DNA, 35 bp, Artificial Sequence
  Synthetic oligonucleotide
gccattttcgcgccatctgctcctactgttcctgc

SEQ ID NO: 175382 - DNA, 35 bp, Artificial Sequence
  Synthetic oligonucleotide
tcaggtgccgtaaacctccgcctcccattgattgc

SEQ ID NO: 175383 - DNA, 35 bp, Artificial Sequence
  Synthetic oligonucleotide
tcgcccttccctgtttgtcctgtccagtaacttgc

SEQ ID NO: 175384 - DNA, 35 bp, Artificial Sequence
  Synthetic oligonucleotide
ttcgatcccgaccaccgttacgcccatacgtttgc

SEQ ID NO: 175385 - DNA, 35 bp, Artificial Sequence
  Synthetic oligonucleotide
gtccctccagactaatcctggtcgtttgtcccatc

SEQ ID NO: 175386 - DNA, 35 bp, Artificial Sequence
  Synthetic oligonucleotide
tgtggcatcacagagtcctcgttagcccgccgctc

SEQ ID NO: 175387 - DNA, 35 bp, Artificial Sequence
  Synthetic oligonucleotide
gttcaatcatcacctatggccattcctatcgagtc

SEQ ID NO: 175388 - DNA, 35 bp, Artificial Sequence
  Synthetic oligonucleotide
ttagccacccttccgcatatgtacttcatcacttc

SEQ ID NO: 175389 - DNA, 35 bp, Artificial Sequence
  Synthetic oligonucleotide
acagcgcgggccgcagtaccttgtccattcccttc

SEQ ID NO: 175390 - DNA, 35 bp, Artificial Sequence
  Synthetic oligonucleotide
gtgcatctcactgtcgcgaccgtaccctatctttc

SEQ ID NO: 175391 - DNA, 35 bp, Artificial Sequence
  Synthetic oligonucleotide
gtaaacccccctctgcgcaacctccactgtccacg

SEQ ID NO: 175392 - DNA, 35 bp, Artificial Sequence
  Synthetic oligonucleotide
tgacattgtctagcgttatgtccctctaccccccg

SEQ ID NO: 175393 - DNA, 35 bp, Artificial Sequence
  Synthetic oligonucleotide
ttacctgcacatcctctcgagcaccagcgagcccg

SEQ ID NO: 175394 - DNA, 35 bp, Artificial Sequence
  Synthetic oligonucleotide
acgttgtacctcgccggccacctgccacatgcccg

SEQ ID NO: 175395 - DNA, 35 bp, Artificial Sequence
  Synthetic oligonucleotide
aaggatgctgccccgctttttggtgacctcttgcg

SEQ ID NO: 175396 - DNA, 35 bp, Artificial Sequence
  Synthetic oligonucleotide
aggggagggccagttagcaggtggtaggagggggg

SEQ ID NO: 175397 - DNA, 35 bp, Artificial Sequence
  Synthetic oligonucleotide
gtttggggtatggtggaacgggggacgtgcgcatg

SEQ ID NO: 175398 - DNA, 35 bp, Artificial Sequence
  Synthetic oligonucleotide
agccgtgaccctctcgccgtattgtgcctctcatg

SEQ ID NO: 175399 - DNA, 35 bp, Artificial Sequence
  Synthetic oligonucleotide
gcgcactgtaagcggccgcacctactcccgccctg

SEQ ID NO: 175400 - DNA, 35 bp, Artificial Sequence
  Synthetic oligonucleotide
gcgcacctccacaatcgttcttaccccgctccctg

SEQ ID NO: 175401 - DNA, 35 bp, Artificial Sequence
  Synthetic oligonucleotide
acacaccacataacatgttcgccgttccgctcttg

SEQ ID NO: 175402 - DNA, 35 bp, Artificial Sequence
  Synthetic oligonucleotide
tcgctcctcaccctggcggcccccaccttatgttg

SEQ ID NO: 175403 - DNA, 35 bp, Artificial Sequence
  Synthetic oligonucleotide
tcactctcccgccccgttgtattacccccttgttg

SEQ ID NO: 175404 - DNA, 35 bp, Artificial Sequence
  Synthetic oligonucleotide
gcctgtatcgcccccgccattcatgctgtattttg

SEQ ID NO: 175405 - DNA, 35 bp, Artificial Sequence
  Synthetic oligonucleotide
gccgtctcgctctctgccgctgcctaaatttacct

SEQ ID NO: 175406 - DNA, 35 bp, Artificial Sequence
  Synthetic oligonucleotide
tgtgagactcacatgtacaacactccctcatccct

SEQ ID NO: 175407 - DNA, 35 bp, Artificial Sequence
  Synthetic oligonucleotide
acccgccccatgtcttggcacgaccgccggaggct

SEQ ID NO: 175408 - DNA, 35 bp, Artificial Sequence
  Synthetic oligonucleotide
gttcacccacgtgctcttctgtcgctgcctaatct

SEQ ID NO: 175409 - DNA, 35 bp, Artificial Sequence
  Synthetic oligonucleotide
tcccggtcccctggcatagggtttcttcctcctct

SEQ ID NO: 175410 - DNA, 35 bp, Artificial Sequence
  Synthetic oligonucleotide
taggggtagggaacgtgggcgggtggaagggctct

SEQ ID NO: 175411 - DNA, 35 bp, Artificial Sequence
  Synthetic oligonucleotide
gcgatcgcccctcctctcccatccttaagacttct

SEQ ID NO: 175412 - DNA, 35 bp, Artificial Sequence
  Synthetic oligonucleotide
actcgcacccgtactttctggaaaatccgctactt

SEQ ID NO: 175413 - DNA, 35 bp, Artificial Sequence
  Synthetic oligonucleotide
ccatactgcctcccatcgcgattgccacatagctt

SEQ ID NO: 175414 - DNA, 35 bp, Artificial Sequence
  Synthetic oligonucleotide
gcactcagacggcttcccacggagttacccttctt

SEQ ID NO: 175415 - DNA, 35 bp, Artificial Sequence
  Synthetic oligonucleotide
cactcacccaccacatgctcgtaacgccaaccaaa

SEQ ID NO: 175416 - DNA, 36 bp, Artificial Sequence
  Synthetic oligonucleotide
gctaagcccctccgactctctctgtgacgcatccaa

SEQ ID NO: 175417 - DNA, 36 bp, Artificial Sequence
  Synthetic oligonucleotide
ccgccccctgtctgacgtcggcttgaatatcctcaa

SEQ ID NO: 175418 - DNA, 36 bp, Artificial Sequence
  Synthetic oligonucleotide
tcaccccatcaggcccgctcgcgctttacccttcaa

SEQ ID NO: 175419 - DNA, 36 bp, Artificial Sequence
  Synthetic oligonucleotide
cccacgccaccctgccgccgcctctgttctgttcaa

SEQ ID NO: 175420 - DNA, 36 bp, Artificial Sequence
  Synthetic oligonucleotide
gcccccgatacgcgcataatcctcgtcctgcaagaa

SEQ ID NO: 175421 - DNA, 36 bp, Artificial Sequence
  Synthetic oligonucleotide
gcgaccgtaccaaggtgcggggggggaaacggggaa

SEQ ID NO: 175422 - DNA, 36 bp, Artificial Sequence
  Synthetic oligonucleotide
gtgacagggaagggcgaggggagggcgggagcgtaa

SEQ ID NO: 175423 - DNA, 35 bp, Artificial Sequence
  Synthetic oligonucleotide
agcccccacaccacccgttcgagcaggttggaaca

SEQ ID NO: 175424 - DNA, 35 bp, Artificial Sequence
  Synthetic oligonucleotide
acgagaacgtgccgccctgcctcccatatcgtaca

SEQ ID NO: 175425 - DNA, 36 bp, Artificial Sequence
  Synthetic oligonucleotide
gttacactcgccaccccatgcctgcatatgaaacca

SEQ ID NO: 175426 - DNA, 36 bp, Artificial Sequence
  Synthetic oligonucleotide
tgcgccacatggccgatctttcccctgctagcacca

SEQ ID NO: 175427 - DNA, 36 bp, Artificial Sequence
  Synthetic oligonucleotide
gccactccgcccctcatttgcgcaggcgaccaccca

SEQ ID NO: 175428 - DNA, 36 bp, Artificial Sequence
  Synthetic oligonucleotide
tgtccccccactagtcgcgcccgctgccttacccca

SEQ ID NO: 175429 - DNA, 36 bp, Artificial Sequence
  Synthetic oligonucleotide
acacagcgctacaaactgctcagcctgcctccccca

SEQ ID NO: 175430 - DNA, 36 bp, Artificial Sequence
  Synthetic oligonucleotide
gtgtacatcgtcgatcctgcaagtacctctccgcca

SEQ ID NO: 175431 - DNA, 35 bp, Artificial Sequence
  Synthetic oligonucleotide
gtgggcaccactggcccctcctgatatgctcgcca

SEQ ID NO: 175432 - DNA, 35 bp, Artificial Sequence
  Synthetic oligonucleotide
ttccgccacacactgttctgtccctttagctgcca

SEQ ID NO: 175433 - DNA, 36 bp, Artificial Sequence
  Synthetic oligonucleotide
tacccgactcgctttttgaatgtttggtctcctcca

SEQ ID NO: 175434 - DNA, 36 bp, Artificial Sequence
  Synthetic oligonucleotide
acaacgtgagtgtccatgcttttttgtcgcgctcca

SEQ ID NO: 175435 - DNA, 35 bp, Artificial Sequence
  Synthetic oligonucleotide
gacggcgtgcttactatcggtccgctgcttctcca

SEQ ID NO: 175436 - DNA, 35 bp, Artificial Sequence
  Synthetic oligonucleotide
gcgatgccccacccacagggttacctacacttcca

SEQ ID NO: 175437 - DNA, 36 bp, Artificial Sequence
  Synthetic oligonucleotide
tccgccctccgctccaacttcatctataaatgagca

SEQ ID NO: 175438 - DNA, 36 bp, Artificial Sequence
  Synthetic oligonucleotide
gagacccccgttactagttgaatcctgcctgtcgca

SEQ ID NO: 175439 - DNA, 36 bp, Artificial Sequence
  Synthetic oligonucleotide
tcaaccacccacgaatcgtttatgcctccacactca

SEQ ID NO: 175440 - DNA, 36 bp, Artificial Sequence
  Synthetic oligonucleotide
gcattcccaattgtacactaagccgccgacccttca

SEQ ID NO: 175441 - DNA, 36 bp, Artificial Sequence
  Synthetic oligonucleotide
agccatgcactgtcgcttctcttagccctctcttca

SEQ ID NO: 175442 - DNA, 37 bp, Artificial Sequence
  Synthetic oligonucleotide
gaaaagagtcgaggaagaagggcggtatgtgggaaga

SEQ ID NO: 175443 - DNA, 37 bp, Artificial Sequence
  Synthetic oligonucleotide
gtgaggggggagaacaaggggagggtgggcggcgaga

SEQ ID NO: 175444 - DNA, 37 bp, Artificial Sequence
  Synthetic oligonucleotide
gcctcaccccgcaccttcaataacttcggacaggaga

SEQ ID NO: 175445 - DNA, 34 bp, Artificial Sequence
  Synthetic oligonucleotide
tactcaccctctgcactaattgtctcgaatgaga

SEQ ID NO: 175446 - DNA, 37 bp, Artificial Sequence
  Synthetic oligonucleotide
tatgtatcggtatgtcacaatgccctgcccctctaga

SEQ ID NO: 175447 - DNA, 36 bp, Artificial Sequence
  Synthetic oligonucleotide
acgtggcccattgatactgcaccaccgcttccacga

SEQ ID NO: 175448 - DNA, 36 bp, Artificial Sequence
  Synthetic oligonucleotide
ttccatcacccaccatcatctccccgaaagagacga

SEQ ID NO: 175449 - DNA, 37 bp, Artificial Sequence
  Synthetic oligonucleotide
ttgacggcaaagttcccgcccccctcgtcattgacga

SEQ ID NO: 175450 - DNA, 37 bp, Artificial Sequence
  Synthetic oligonucleotide
ggacggtggaggggcggtggtaggcccgtgggaccga

SEQ ID NO: 175451 - DNA, 37 bp, Artificial Sequence
  Synthetic oligonucleotide
tcaacctccctcacattgtgctcgcgaaatttaccga

SEQ ID NO: 175452 - DNA, 37 bp, Artificial Sequence
  Synthetic oligonucleotide
tgtacatcgcgcgtgcctcaggcacatacccccccga

SEQ ID NO: 175453 - DNA, 37 bp, Artificial Sequence
  Synthetic oligonucleotide
tgttccatgaccagattccattgccgcctatccccga

SEQ ID NO: 175454 - DNA, 35 bp, Artificial Sequence
  Synthetic oligonucleotide
gtgccgccccgccttactatgaggtcccgtcccga

SEQ ID NO: 175455 - DNA, 37 bp, Artificial Sequence
  Synthetic oligonucleotide
gagggctgagagggggggattgggaaaggttggccga

SEQ ID NO: 175456 - DNA, 37 bp, Artificial Sequence
  Synthetic oligonucleotide
gaggggggaggtgggcgtagaagcgtggggaaggcga

SEQ ID NO: 175457 - DNA, 37 bp, Artificial Sequence
  Synthetic oligonucleotide
tgaggggaaatacagaacggggggagggtgagggcga

SEQ ID NO: 175458 - DNA, 37 bp, Artificial Sequence
  Synthetic oligonucleotide
gtctcgttccgacccttatcgtgcccgccctatgcga

SEQ ID NO: 175459 - DNA, 35 bp, Artificial Sequence
  Synthetic oligonucleotide
tgatcccccttactgcgcatggaccctgctctcga

SEQ ID NO: 175460 - DNA, 37 bp, Artificial Sequence
  Synthetic oligonucleotide
ttttcccgccctatattgtatcgcacctccctgtcga

SEQ ID NO: 175461 - DNA, 36 bp, Artificial Sequence
  Synthetic oligonucleotide
tgccccccccgcctaattccctgagcccgtttcgga

SEQ ID NO: 175462 - DNA, 37 bp, Artificial Sequence
  Synthetic oligonucleotide
aaacctccgccaccttgcctacccgaggccctcggga

SEQ ID NO: 175463 - DNA, 37 bp, Artificial Sequence
  Synthetic oligonucleotide
atggggatgagaaggggtgtagccttaggggagggga

SEQ ID NO: 175464 - DNA, 37 bp, Artificial Sequence
  Synthetic oligonucleotide
gcacgggagattgggtgggtgacgatgtttgggggga

SEQ ID NO: 175465 - DNA, 37 bp, Artificial Sequence
  Synthetic oligonucleotide
ggtgcaaggggaaggtaacgtagagggggaggtggga

SEQ ID NO: 175466 - DNA, 36 bp, Artificial Sequence
  Synthetic oligonucleotide
tgattcacgccactgctgcttcacttctattctgga

SEQ ID NO: 175467 - DNA, 37 bp, Artificial Sequence
  Synthetic oligonucleotide
gtgagggcaatacgagcgaagggtgggggggtaatga

SEQ ID NO: 175468 - DNA, 35 bp, Artificial Sequence
  Synthetic oligonucleotide
ggggagaagagagggggttaacaggtgtgacatga

SEQ ID NO: 175469 - DNA, 38 bp, Artificial Sequence
  Synthetic oligonucleotide
gactcggacggaaggggaaagggggaaagtgggcatga

SEQ ID NO: 175470 - DNA, 38 bp, Artificial Sequence
  Synthetic oligonucleotide
ggaatgcgggaggggggtaggactcgggagagagatga

SEQ ID NO: 175471 - DNA, 37 bp, Artificial Sequence
  Synthetic oligonucleotide
tcgacctccctctgtagggattcaacatcctccctga

SEQ ID NO: 175472 - DNA, 38 bp, Artificial Sequence
  Synthetic oligonucleotide
tgaccggaccgctttctatgacccttcgctttccctga

SEQ ID NO: 175473 - DNA, 37 bp, Artificial Sequence
  Synthetic oligonucleotide
tgtccaccccgtcgttccctcccctccagtccgctga

SEQ ID NO: 175474 - DNA, 38 bp, Artificial Sequence
  Synthetic oligonucleotide
gagtacgcccacattgtctcctaactaatccctgctga

SEQ ID NO: 175475 - DNA, 38 bp, Artificial Sequence
  Synthetic oligonucleotide
gagagtgaaggggtagtgcggggcaacggggaatctga

SEQ ID NO: 175476 - DNA, 38 bp, Artificial Sequence
  Synthetic oligonucleotide
gaatgacagtaggaggagcgcggtaaaggggaacgtga

SEQ ID NO: 175477 - DNA, 38 bp, Artificial Sequence
  Synthetic oligonucleotide
tgtggggggaggtaggagggagggctataggatcgtga

SEQ ID NO: 175478 - DNA, 38 bp, Artificial Sequence
  Synthetic oligonucleotide
gtacgcggcgggggggtagggagaacattgagtggtga

SEQ ID NO: 175479 - DNA, 38 bp, Artificial Sequence
  Synthetic oligonucleotide
gccaaagcggtcatcgtagtccatcctccctcttgtga

SEQ ID NO: 175480 - DNA, 38 bp, Artificial Sequence
  Synthetic oligonucleotide
gcctgcccgctgccttcgtattcccacctgctccttga

SEQ ID NO: 175481 - DNA, 36 bp, Artificial Sequence
  Synthetic oligonucleotide
gtgaggcggctcgcgctttttctgcaccacctttga

SEQ ID NO: 175482 - DNA, 35 bp, Artificial Sequence
  Synthetic oligonucleotide
acctccgccacatgttgctcgtctggagcttttga

SEQ ID NO: 175483 - DNA, 35 bp, Artificial Sequence
  Synthetic oligonucleotide
atgttgcgccgtcgatcagtctctgcgccctcata

SEQ ID NO: 175484 - DNA, 36 bp, Artificial Sequence
  Synthetic oligonucleotide
gagcgggacaactgcgtctttgccccccgccttata

SEQ ID NO: 175485 - DNA, 35 bp, Artificial Sequence
  Synthetic oligonucleotide
agaagccaccccgccaccgtatgcctaccgaccta

SEQ ID NO: 175486 - DNA, 36 bp, Artificial Sequence
  Synthetic oligonucleotide
gtgtgctccttcccgcctccttacagtgtccgccta

SEQ ID NO: 175487 - DNA, 36 bp, Artificial Sequence
  Synthetic oligonucleotide
tccgcgtgccctcgcttgtactctctctcatctcta

SEQ ID NO: 175488 - DNA, 35 bp, Artificial Sequence
  Synthetic oligonucleotide
tgcctcacacgggccctgataccgcatcctccgta

SEQ ID NO: 175489 - DNA, 36 bp, Artificial Sequence
  Synthetic oligonucleotide
aatccccccactgtgtgccctgtatatttactcgta

SEQ ID NO: 175490 - DNA, 36 bp, Artificial Sequence
  Synthetic oligonucleotide
gctagctcacgtgcatctgctttgccctctcctgta

SEQ ID NO: 175491 - DNA, 36 bp, Artificial Sequence
  Synthetic oligonucleotide
ttaccacctcaaggtcccgtgtcccgttacccatta

SEQ ID NO: 175492 - DNA, 36 bp, Artificial Sequence
  Synthetic oligonucleotide
tacggtcccttcctcgtaatgccccagtcccattta

SEQ ID NO: 175493 - DNA, 35 bp, Artificial Sequence
  Synthetic oligonucleotide
gcacccgttttccttgtctgttcacctggttttta

SEQ ID NO: 175494 - DNA, 35 bp, Artificial Sequence
  Synthetic oligonucleotide
ttagaccgccccttggtcccacctttgatttgaac

SEQ ID NO: 175495 - DNA, 35 bp, Artificial Sequence
  Synthetic oligonucleotide
ccccacacgcagtgcttgccgccggtccatcacac

SEQ ID NO: 175496 - DNA, 35 bp, Artificial Sequence
  Synthetic oligonucleotide
gccgaccaccacttgattaccaatatgacctttac

SEQ ID NO: 175497 - DNA, 36 bp, Artificial Sequence
  Synthetic oligonucleotide
tacccgacaggcgagttttttccagctctctacacc

SEQ ID NO: 175498 - DNA, 35 bp, Artificial Sequence
  Synthetic oligonucleotide
tgctcaggcagtctcaccgccgctacctccgcacc

SEQ ID NO: 175499 - DNA, 35 bp, Artificial Sequence
  Synthetic oligonucleotide
gtgtaacaccgcagcgctaaccccttggcctcacc

SEQ ID NO: 175500 - DNA, 35 bp, Artificial Sequence
  Synthetic oligonucleotide
gttcgtgcctggcaagtcttgagccaacccccccc

SEQ ID NO: 175501 - DNA, 35 bp, Artificial Sequence
  Synthetic oligonucleotide
ttacccggtgcgagtcgttggttgcctcctccccc

SEQ ID NO: 175502 - DNA, 35 bp, Artificial Sequence
  Synthetic oligonucleotide
ttacgccccatggcagacgatttccgtgaccgccc

SEQ ID NO: 175503 - DNA, 35 bp, Artificial Sequence
  Synthetic oligonucleotide
aggagcctgcattgactgcataacactccactccc

SEQ ID NO: 175504 - DNA, 35 bp, Artificial Sequence
  Synthetic oligonucleotide
accacaccctgaccgagccactcactacgatagcc

SEQ ID NO: 175505 - DNA, 35 bp, Artificial Sequence
  Synthetic oligonucleotide
actatattgccaactgggttgttcagccccccgcc

SEQ ID NO: 175506 - DNA, 35 bp, Artificial Sequence
  Synthetic oligonucleotide
aatgcgccggtcttaattctgccatcatagccgcc

SEQ ID NO: 175507 - DNA, 35 bp, Artificial Sequence
  Synthetic oligonucleotide
gctcgccatcggcgcactcaaccaggtcctccgcc

SEQ ID NO: 175508 - DNA, 35 bp, Artificial Sequence
  Synthetic oligonucleotide
gatgcaccttctctcgtccctgatgcactcaggcc

SEQ ID NO: 175509 - DNA, 34 bp, Artificial Sequence
  Synthetic oligonucleotide
ttccccaggcgctctcctttgctcatttgactcc

SEQ ID NO: 175510 - DNA, 35 bp, Artificial Sequence
  Synthetic oligonucleotide
tccgcgatcgtcgacgtggccactcccatcgttcc

SEQ ID NO: 175511 - DNA, 35 bp, Artificial Sequence
  Synthetic oligonucleotide
gcgaggactaatgggggggtggcgaggtgattggc

SEQ ID NO: 175512 - DNA, 35 bp, Artificial Sequence
  Synthetic oligonucleotide
gcctagtcagacggctacctctgccttcctcctgc

SEQ ID NO: 175513 - DNA, 35 bp, Artificial Sequence
  Synthetic oligonucleotide
gacgctccgttcgtttgctcgccgccgtatatatc

SEQ ID NO: 175514 - DNA, 35 bp, Artificial Sequence
  Synthetic oligonucleotide
tgccactttcgcttgggcccaatttatatcacctc

SEQ ID NO: 175515 - DNA, 35 bp, Artificial Sequence
  Synthetic oligonucleotide
gcgccatctcttctcgcgctcccttttggtacctc

SEQ ID NO: 175516 - DNA, 35 bp, Artificial Sequence
  Synthetic oligonucleotide
acattgtgcacgctaccctgaacgctgcaattctc

SEQ ID NO: 175517 - DNA, 35 bp, Artificial Sequence
  Synthetic oligonucleotide
tagagacagccgccccgttcgtaattgacctcgtc

SEQ ID NO: 175518 - DNA, 35 bp, Artificial Sequence
  Synthetic oligonucleotide
atcctaccacacgctagcataattagccaccattc

SEQ ID NO: 175519 - DNA, 35 bp, Artificial Sequence
  Synthetic oligonucleotide
gccaccccgttagttattccgttactgcatccttc

SEQ ID NO: 175520 - DNA, 35 bp, Artificial Sequence
  Synthetic oligonucleotide
tccccgactcttggcgttttcggatccccttcttc

SEQ ID NO: 175521 - DNA, 35 bp, Artificial Sequence
  Synthetic oligonucleotide
gacctcagcatctaggtctcatacgctctccgttc

SEQ ID NO: 175522 - DNA, 35 bp, Artificial Sequence
  Synthetic oligonucleotide
ttcgcgagctccgccccttcacctccctgcttttc

SEQ ID NO: 175523 - DNA, 35 bp, Artificial Sequence
  Synthetic oligonucleotide
gacacctgccccacagctctaccgtttaatcgtag

SEQ ID NO: 175524 - DNA, 35 bp, Artificial Sequence
  Synthetic oligonucleotide
acatacacgtgtctgccctcgttctcccgggtccg

SEQ ID NO: 175525 - DNA, 35 bp, Artificial Sequence
  Synthetic oligonucleotide
tggagctgccccataccatctatgtcaatccctcg

SEQ ID NO: 175526 - DNA, 35 bp, Artificial Sequence
  Synthetic oligonucleotide
gagccacccccgttacccgactcgctgttctctcg

SEQ ID NO: 175527 - DNA, 35 bp, Artificial Sequence
  Synthetic oligonucleotide
atctgcactcgcacctccgttccagcaccttttcg

SEQ ID NO: 175528 - DNA, 35 bp, Artificial Sequence
  Synthetic oligonucleotide
tccccactcgtgtcctggtgtctgtctttttgcgg

SEQ ID NO: 175529 - DNA, 35 bp, Artificial Sequence
  Synthetic oligonucleotide
tctggtgggtggggatggggctgtcattacggtgg

SEQ ID NO: 175530 - DNA, 35 bp, Artificial Sequence
  Synthetic oligonucleotide
gagtggggggaagtcgggttagtaatgcagttatg

SEQ ID NO: 175531 - DNA, 35 bp, Artificial Sequence
  Synthetic oligonucleotide
tcaaagcgcaatgcattccgtacttaacccgcctg

SEQ ID NO: 175532 - DNA, 35 bp, Artificial Sequence
  Synthetic oligonucleotide
taccctaagtgcgcgccctccattcgttatatctg

SEQ ID NO: 175533 - DNA, 35 bp, Artificial Sequence
  Synthetic oligonucleotide
ggaacctcttgccccttttgtctaccgccttattg

SEQ ID NO: 175534 - DNA, 35 bp, Artificial Sequence
  Synthetic oligonucleotide
gtctcccggcccgggcattctccttcgctttccat

SEQ ID NO: 175535 - DNA, 35 bp, Artificial Sequence
  Synthetic oligonucleotide
tttgggatggcaaagggggagaacggggaggcgat

SEQ ID NO: 175536 - DNA, 36 bp, Artificial Sequence
  Synthetic oligonucleotide
gacactccgcagctccaccaccttgccgagtcctat

SEQ ID NO: 175537 - DNA, 35 bp, Artificial Sequence
  Synthetic oligonucleotide
tccgacagatccagtgcttcgatccatctcatact

SEQ ID NO: 175538 - DNA, 34 bp, Artificial Sequence
  Synthetic oligonucleotide
ccctacgcacactcgtgtctaacattgcccccct

SEQ ID NO: 175539 - DNA, 35 bp, Artificial Sequence
  Synthetic oligonucleotide
aatgtgcactctcacgcccatagccgcactcccct

SEQ ID NO: 175540 - DNA, 35 bp, Artificial Sequence
  Synthetic oligonucleotide
aaacgggggaaggaactctaataaggagggcggct

SEQ ID NO: 175541 - DNA, 35 bp, Artificial Sequence
  Synthetic oligonucleotide
tacccgatgctggcacaccccttacctcccgtgct

SEQ ID NO: 175542 - DNA, 35 bp, Artificial Sequence
  Synthetic oligonucleotide
gatgcgagttctgggtcgctgcctctctccactct

SEQ ID NO: 175543 - DNA, 34 bp, Artificial Sequence
  Synthetic oligonucleotide
ttcactcgcttacctctagctttggttcttgtct

SEQ ID NO: 175544 - DNA, 35 bp, Artificial Sequence
  Synthetic oligonucleotide
atccctgcccatcatcttataccattggccattct

SEQ ID NO: 175545 - DNA, 35 bp, Artificial Sequence
  Synthetic oligonucleotide
gaacctgtggccggtctcttccaatgcctgtttct

SEQ ID NO: 175546 - DNA, 35 bp, Artificial Sequence
  Synthetic oligonucleotide
gacgccggatgggggaatactgggggcggacgagt

SEQ ID NO: 175547 - DNA, 35 bp, Artificial Sequence
  Synthetic oligonucleotide
gatcacctgccctaccctggacgctcatttcactt

SEQ ID NO: 175548 - DNA, 35 bp, Artificial Sequence
  Synthetic oligonucleotide
tgcatgttgtgcggggcgcgtatgtatggtggctt

SEQ ID NO: 175549 - DNA, 35 bp, Artificial Sequence
  Synthetic oligonucleotide
atattgacccgcacatgactatctacatcctgctt

SEQ ID NO: 175550 - DNA, 35 bp, Artificial Sequence
  Synthetic oligonucleotide
acggtcaaccgcctcccatcgtagccatatctctt

SEQ ID NO: 175551 - DNA, 35 bp, Artificial Sequence
  Synthetic oligonucleotide
atacgccgttcgctcttgcctgcacaaacgccttt

SEQ ID NO: 175552 - DNA, 35 bp, Artificial Sequence
  Synthetic oligonucleotide
gccggtcactcacaggcgattactgcattctcttt

SEQ ID NO: 175553 - DNA, 34 bp, Artificial Sequence
  Synthetic oligonucleotide
gtgtctcgctccgcctctttgttgtacatcgttt

SEQ ID NO: 175554 - DNA, 36 bp, Artificial Sequence
  Synthetic oligonucleotide
gattacgtcaagagtttcgacctctcgctccaccaa

SEQ ID NO: 175555 - DNA, 36 bp, Artificial Sequence
  Synthetic oligonucleotide
gtgcaacgcatccgccctaggactcaccgccttcaa

SEQ ID NO: 175556 - DNA, 35 bp, Artificial Sequence
  Synthetic oligonucleotide
gggtcgcccccccgttctcatggccttatcttcaa

SEQ ID NO: 175557 - DNA, 36 bp, Artificial Sequence
  Synthetic oligonucleotide
gcgaggataggagaaggaaggtaagggactagtgaa

SEQ ID NO: 175558 - DNA, 36 bp, Artificial Sequence
  Synthetic oligonucleotide
actgaccccctccccccgtactgtcatcacgggtaa

SEQ ID NO: 175559 - DNA, 36 bp, Artificial Sequence
  Synthetic oligonucleotide
tcatctcccttccaaggcggtcattcaccgtttaca

SEQ ID NO: 175560 - DNA, 35 bp, Artificial Sequence
  Synthetic oligonucleotide
gttgctcagcctgcctcctcgttacacccacgcca

SEQ ID NO: 175561 - DNA, 36 bp, Artificial Sequence
  Synthetic oligonucleotide
atcgctcccgctggttggctgtttttgtcctcgcca

SEQ ID NO: 175562 - DNA, 35 bp, Artificial Sequence
  Synthetic oligonucleotide
acctcccatcgcctcccgtatcgagtttagaatca

SEQ ID NO: 175563 - DNA, 36 bp, Artificial Sequence
  Synthetic oligonucleotide
taatacgccgcatggcccggtcgaccgtttctatca

SEQ ID NO: 175564 - DNA, 37 bp, Artificial Sequence
  Synthetic oligonucleotide
tacattggggggcgcggggtcgggatacttgcgcaga

SEQ ID NO: 175565 - DNA, 37 bp, Artificial Sequence
  Synthetic oligonucleotide
tcacgcctcctcgttgcatccgtactcgccgttacga

SEQ ID NO: 175566 - DNA, 37 bp, Artificial Sequence
  Synthetic oligonucleotide
tcgatcgaacggagtttctcagttacaccctccccga

SEQ ID NO: 175567 - DNA, 35 bp, Artificial Sequence
  Synthetic oligonucleotide
tcttccacatccggctacattcacctgctctccga

SEQ ID NO: 175568 - DNA, 36 bp, Artificial Sequence
  Synthetic oligonucleotide
tgcggtaaagggtgaatatggcagggagggaaggga

SEQ ID NO: 175569 - DNA, 37 bp, Artificial Sequence
  Synthetic oligonucleotide
agtcgtacggggggggaagggagttcgcacgcaggga

SEQ ID NO: 175570 - DNA, 37 bp, Artificial Sequence
  Synthetic oligonucleotide
aaggatcacagcagggggcgacgggtcgggcgaggga

SEQ ID NO: 175571 - DNA, 37 bp, Artificial Sequence
  Synthetic oligonucleotide
gaggaatccggatagcagggaaggcgggttgagggga

SEQ ID NO: 175572 - DNA, 36 bp, Artificial Sequence
  Synthetic oligonucleotide
gacggggcctggtgtaggggggggtcacaatgggga

SEQ ID NO: 175573 - DNA, 35 bp, Artificial Sequence
  Synthetic oligonucleotide
tgggcggaaggtggaggtcgatgggggggatggga

SEQ ID NO: 175574 - DNA, 37 bp, Artificial Sequence
  Synthetic oligonucleotide
gcaccgctccatcgggctctgagtctctccacctgga

SEQ ID NO: 175575 - DNA, 37 bp, Artificial Sequence
  Synthetic oligonucleotide
gaccaactccatttctttccaacagtctgtccttgga

SEQ ID NO: 175576 - DNA, 37 bp, Artificial Sequence
  Synthetic oligonucleotide
gacacctccgcatttcttcctgtatcacgctcttgga

SEQ ID NO: 175577 - DNA, 38 bp, Artificial Sequence
  Synthetic oligonucleotide
tcaaacagggtgggagagggaggggccgacaccaatga

SEQ ID NO: 175578 - DNA, 38 bp, Artificial Sequence
  Synthetic oligonucleotide
tcctacttcccatcctgctctgtcattccggggaatga

SEQ ID NO: 175579 - DNA, 38 bp, Artificial Sequence
  Synthetic oligonucleotide
atcgctagaaggtggggtgggcacgggtggagtaatga

SEQ ID NO: 175580 - DNA, 38 bp, Artificial Sequence
  Synthetic oligonucleotide
agtcatgaagggagggggggatccggagggctatatga

SEQ ID NO: 175581 - DNA, 38 bp, Artificial Sequence
  Synthetic oligonucleotide
gcacccatcacctgtctcatctcctcagtcaagtatga

SEQ ID NO: 175582 - DNA, 38 bp, Artificial Sequence
  Synthetic oligonucleotide
gtcccatcacctgcgcatactctccggtctctaactga

SEQ ID NO: 175583 - DNA, 38 bp, Artificial Sequence
  Synthetic oligonucleotide
acctccaggcatcgcgtgtcctcgccgcttccacctga

SEQ ID NO: 175584 - DNA, 37 bp, Artificial Sequence
  Synthetic oligonucleotide
tatgcccctgctccatagtgaccaattcacgccctga

SEQ ID NO: 175585 - DNA, 38 bp, Artificial Sequence
  Synthetic oligonucleotide
gtgtggccaccgccccttgttattgccaatttccctga

SEQ ID NO: 175586 - DNA, 38 bp, Artificial Sequence
  Synthetic oligonucleotide
tcatcacccactcgaaaacagggacctcctcctgctga

SEQ ID NO: 175587 - DNA, 38 bp, Artificial Sequence
  Synthetic oligonucleotide
ttctgctctgcccgccgtgtcgtccccactcactctga

SEQ ID NO: 175588 - DNA, 38 bp, Artificial Sequence
  Synthetic oligonucleotide
gaccccatccaaaagtttcttagtgtcgctctctctga

SEQ ID NO: 175589 - DNA, 36 bp, Artificial Sequence
  Synthetic oligonucleotide
tccgcccatgtcttgtgccaccctcctcccgtctga

SEQ ID NO: 175590 - DNA, 38 bp, Artificial Sequence
  Synthetic oligonucleotide
gccccacctcaatcggtttccagattcgccctttctga

SEQ ID NO: 175591 - DNA, 37 bp, Artificial Sequence
  Synthetic oligonucleotide
gtcaccccccctctcgtacaagcaatgtagctcgtga

SEQ ID NO: 175592 - DNA, 36 bp, Artificial Sequence
  Synthetic oligonucleotide
tcaagagatggagtgggggggcgatttcacgggtga

SEQ ID NO: 175593 - DNA, 38 bp, Artificial Sequence
  Synthetic oligonucleotide
tgagggaccaggggggccgaagatagtggggggggtga

SEQ ID NO: 175594 - DNA, 38 bp, Artificial Sequence
  Synthetic oligonucleotide
gctggtgtgtagggctgtgggtagcgggggatgggtga

SEQ ID NO: 175595 - DNA, 35 bp, Artificial Sequence
  Synthetic oligonucleotide
acgaagggacgggggctaaaaggaatacagtgtga

SEQ ID NO: 175596 - DNA, 37 bp, Artificial Sequence
  Synthetic oligonucleotide
tactgcctcacgccaccccgtacgccaccgcgtgtga

SEQ ID NO: 175597 - DNA, 37 bp, Artificial Sequence
  Synthetic oligonucleotide
ggtcaatgggggtggagtgagggggcggatctattga

SEQ ID NO: 175598 - DNA, 37 bp, Artificial Sequence
  Synthetic oligonucleotide
ggggggagtggggctggggtagcgacagcgtccttga

SEQ ID NO: 175599 - DNA, 37 bp, Artificial Sequence
  Synthetic oligonucleotide
gaatcgatcagcctgaccctcatgcacctccctttga

SEQ ID NO: 175600 - DNA, 38 bp, Artificial Sequence
  Synthetic oligonucleotide
atgggacgggcgggagggtggtaatcgtgggtgtttga

SEQ ID NO: 175601 - DNA, 36 bp, Artificial Sequence
  Synthetic oligonucleotide
acccacgcccttctctcaccattcacttagagacta

SEQ ID NO: 175602 - DNA, 36 bp, Artificial Sequence
  Synthetic oligonucleotide
gcaccgccctctcgaactgtgtacccggccaaccta

SEQ ID NO: 175603 - DNA, 38 bp, Artificial Sequence
  Synthetic oligonucleotide
gcacgggtgggggggagagagggcaacttgtcccctta

SEQ ID NO: 175604 - DNA, 35 bp, Artificial Sequence
  Synthetic oligonucleotide
gcctctccacgcgccgctctgttggcactccctta

SEQ ID NO: 175605 - DNA, 35 bp, Artificial Sequence
  Synthetic oligonucleotide
tagacacccccccgctgtagctgaatcctggcaac

SEQ ID NO: 175606 - DNA, 35 bp, Artificial Sequence
  Synthetic oligonucleotide
tacttcccgatccaccacattgttagccggttaac

SEQ ID NO: 175607 - DNA, 35 bp, Artificial Sequence
  Synthetic oligonucleotide
atgttgcatcaccttactatcggaagcccgcccac

SEQ ID NO: 175608 - DNA, 35 bp, Artificial Sequence
  Synthetic oligonucleotide
gtgttgtgtccgctcccctcctgtttcagatccac

SEQ ID NO: 175609 - DNA, 35 bp, Artificial Sequence
  Synthetic oligonucleotide
gtccccacccgtaggatccacctcacttgtgtcac

SEQ ID NO: 175610 - DNA, 35 bp, Artificial Sequence
  Synthetic oligonucleotide
gaacaccatcccgcaccatagggtcagcttttacc

SEQ ID NO: 175611 - DNA, 35 bp, Artificial Sequence
  Synthetic oligonucleotide
ggattgttcagcttccgtcctgccccagccgcccc

SEQ ID NO: 175612 - DNA, 35 bp, Artificial Sequence
  Synthetic oligonucleotide
ttcagatacgtgtgctcgtccagttccagctcccc

SEQ ID NO: 175613 - DNA, 35 bp, Artificial Sequence
  Synthetic oligonucleotide
tgcataacccctcgggccttctgtcattattgccc

SEQ ID NO: 175614 - DNA, 35 bp, Artificial Sequence
  Synthetic oligonucleotide
gcaacagacccgttaccttggtggtatccctcgcc

SEQ ID NO: 175615 - DNA, 35 bp, Artificial Sequence
  Synthetic oligonucleotide
tcgcaaacggttacacctgtgcccttttatttgcc

SEQ ID NO: 175616 - DNA, 35 bp, Artificial Sequence
  Synthetic oligonucleotide
aatggggccattcgttatagtcgttcctcgcctcc

SEQ ID NO: 175617 - DNA, 35 bp, Artificial Sequence
  Synthetic oligonucleotide
gcatcgcaagtgtaatccatggctatcccctttcc

SEQ ID NO: 175618 - DNA, 35 bp, Artificial Sequence
  Synthetic oligonucleotide
agtgtcacactccgccgctacgatacctctcgggc

SEQ ID NO: 175619 - DNA, 35 bp, Artificial Sequence
  Synthetic oligonucleotide
tgttccgtcgatcttctcttccatggcttctcatc

SEQ ID NO: 175620 - DNA, 35 bp, Artificial Sequence
  Synthetic oligonucleotide
tcaccgcctccagttgatcaatgaagccctcgatc

SEQ ID NO: 175621 - DNA, 35 bp, Artificial Sequence
  Synthetic oligonucleotide
gcgactcccacagcacgcctctaccgggtcttatc

SEQ ID NO: 175622 - DNA, 33 bp, Artificial Sequence
  Synthetic oligonucleotide
tcccggtgcccgtgccaagttggattctccctc

SEQ ID NO: 175623 - DNA, 35 bp, Artificial Sequence
  Synthetic oligonucleotide
tacgccatgtaccgtgttcggcccctcatcgcctc

SEQ ID NO: 175624 - DNA, 35 bp, Artificial Sequence
  Synthetic oligonucleotide
aggacgagcgccgagtcccgattacccatgtcctc

SEQ ID NO: 175625 - DNA, 35 bp, Artificial Sequence
  Synthetic oligonucleotide
acccccgctatatcgcgagtgtctattatttcctc

SEQ ID NO: 175626 - DNA, 35 bp, Artificial Sequence
  Synthetic oligonucleotide
gcttaccgttggcccatctgtctctagctcttctc

SEQ ID NO: 175627 - DNA, 35 bp, Artificial Sequence
  Synthetic oligonucleotide
tccgtttcgcctagttatcgtgccgatcctcattc

SEQ ID NO: 175628 - DNA, 35 bp, Artificial Sequence
  Synthetic oligonucleotide
tcatcggtaacctccgccaaatctgttcgtttttc

SEQ ID NO: 175629 - DNA, 35 bp, Artificial Sequence
  Synthetic oligonucleotide
gccacgcttcccatcatccgatcgccctcccagag

SEQ ID NO: 175630 - DNA, 35 bp, Artificial Sequence
  Synthetic oligonucleotide
gcgatgcaatggagaagggacggagtattgcaacg

SEQ ID NO: 175631 - DNA, 35 bp, Artificial Sequence
  Synthetic oligonucleotide
acccctgactctcctttcacagcccccccttcggg

SEQ ID NO: 175632 - DNA, 35 bp, Artificial Sequence
  Synthetic oligonucleotide
tgtccatcggtccacatttctcgtcgtttgcccat

SEQ ID NO: 175633 - DNA, 35 bp, Artificial Sequence
  Synthetic oligonucleotide
gctcacatcgcgattcatgctcacgccgcctccat

SEQ ID NO: 175634 - DNA, 35 bp, Artificial Sequence
  Synthetic oligonucleotide
atcgcaatcgatctccgcctatgagcccacatact

SEQ ID NO: 175635 - DNA, 35 bp, Artificial Sequence
  Synthetic oligonucleotide
tcaatgcccgcactcgatcctaacagcctccacct

SEQ ID NO: 175636 - DNA, 35 bp, Artificial Sequence
  Synthetic oligonucleotide
acacccctcaatccttgactctagagttagcacct

SEQ ID NO: 175637 - DNA, 35 bp, Artificial Sequence
  Synthetic oligonucleotide
accaccctcattctgtacccgtgttttatccgcct

SEQ ID NO: 175638 - DNA, 35 bp, Artificial Sequence
  Synthetic oligonucleotide
gtcaccacccgctgatcttactatttagtcttcct

SEQ ID NO: 175639 - DNA, 35 bp, Artificial Sequence
  Synthetic oligonucleotide
actccctcctgcccacatgaccttaggacatcgct

SEQ ID NO: 175640 - DNA, 35 bp, Artificial Sequence
  Synthetic oligonucleotide
acgctggaacagccagtttcgcttacacccttgct

SEQ ID NO: 175641 - DNA, 35 bp, Artificial Sequence
  Synthetic oligonucleotide
tgttccccggccgtaggctatcttcagttacctct

SEQ ID NO: 175642 - DNA, 35 bp, Artificial Sequence
  Synthetic oligonucleotide
gcccgccgactgttcccttgcctgacgttacctct

SEQ ID NO: 175643 - DNA, 35 bp, Artificial Sequence
  Synthetic oligonucleotide
ggatgtttagaccccatccgtgtgcccgcccctct

SEQ ID NO: 175644 - DNA, 35 bp, Artificial Sequence
  Synthetic oligonucleotide
ggacagacgcgcacgcaccactaacacactctcgt

SEQ ID NO: 175645 - DNA, 35 bp, Artificial Sequence
  Synthetic oligonucleotide
tgcacgcgaacctgttgtcctggtctccccacatt

SEQ ID NO: 175646 - DNA, 35 bp, Artificial Sequence
  Synthetic oligonucleotide
ggacccttccggacgtcgttaaagccccaccactt

SEQ ID NO: 175647 - DNA, 35 bp, Artificial Sequence
  Synthetic oligonucleotide
aatgtcaaccgttcaccgtgcgcatccgtaccctt

SEQ ID NO: 175648 - DNA, 35 bp, Artificial Sequence
  Synthetic oligonucleotide
gacgcctggtcagctctactgcttcgaggtctctt

SEQ ID NO: 175649 - DNA, 35 bp, Artificial Sequence
  Synthetic oligonucleotide
acgaccgctttcacccagcacataggacgaacgtt

SEQ ID NO: 175650 - DNA, 35 bp, Artificial Sequence
  Synthetic oligonucleotide
acacgcaacctttatgaggttctacttgcattgtt

SEQ ID NO: 175651 - DNA, 35 bp, Artificial Sequence
  Synthetic oligonucleotide
aactcccacgctcgccctctttgaatacggtattt

SEQ ID NO: 175652 - DNA, 36 bp, Artificial Sequence
  Synthetic oligonucleotide
aagtgaggcgagggggcatgggcaaagtatgtggaa

SEQ ID NO: 175653 - DNA, 36 bp, Artificial Sequence
  Synthetic oligonucleotide
gtggagggggggcgggcatgccaaactgtcaactaa

SEQ ID NO: 175654 - DNA, 36 bp, Artificial Sequence
  Synthetic oligonucleotide
acaccagacatttctgcctccgttcctagttcctaa

SEQ ID NO: 175655 - DNA, 36 bp, Artificial Sequence
  Synthetic oligonucleotide
agctccatgccctcctaggcgctccactacccttaa

SEQ ID NO: 175656 - DNA, 35 bp, Artificial Sequence
  Synthetic oligonucleotide
gtcgagtgacggcgaatggggagaggaggggaaca

SEQ ID NO: 175657 - DNA, 35 bp, Artificial Sequence
  Synthetic oligonucleotide
tcaccaggcacaggtgtccctcgcaccatccccca

SEQ ID NO: 175658 - DNA, 36 bp, Artificial Sequence
  Synthetic oligonucleotide
tgaccactatccacgccctgtttcttgtgcaatcca

SEQ ID NO: 175659 - DNA, 35 bp, Artificial Sequence
  Synthetic oligonucleotide
tcccgcccctttcaaagccggtgctgttcactcca

SEQ ID NO: 175660 - DNA, 36 bp, Artificial Sequence
  Synthetic oligonucleotide
tggggccgcccaatccgtctggtgtacacctctcca

SEQ ID NO: 175661 - DNA, 35 bp, Artificial Sequence
  Synthetic oligonucleotide
actcccactagccttcactcgtcccttagggatca

SEQ ID NO: 175662 - DNA, 35 bp, Artificial Sequence
  Synthetic oligonucleotide
tcccgcctctatgcctcgctctggaccaaatgtca

SEQ ID NO: 175663 - DNA, 36 bp, Artificial Sequence
  Synthetic oligonucleotide
gccccgccaggcctacattggcacaatcgcccttca

SEQ ID NO: 175664 - DNA, 35 bp, Artificial Sequence
  Synthetic oligonucleotide
gcgcgcacatcaaaggtagcttcttccctcgttca

SEQ ID NO: 175665 - DNA, 36 bp, Artificial Sequence
  Synthetic oligonucleotide
gcctagcacggcgtgggtgggacggggccaaacaga

SEQ ID NO: 175666 - DNA, 37 bp, Artificial Sequence
  Synthetic oligonucleotide
tgaagagagagggtggtgtggccgtgatagaggcaga

SEQ ID NO: 175667 - DNA, 35 bp, Artificial Sequence
  Synthetic oligonucleotide
tagtcgctcccgtcctctacacttaggccccacga

SEQ ID NO: 175668 - DNA, 37 bp, Artificial Sequence
  Synthetic oligonucleotide
tccccctcgcccgagtttaactgcattgctccgacga

SEQ ID NO: 175669 - DNA, 37 bp, Artificial Sequence
  Synthetic oligonucleotide
tcgatgctccgagtctcgtcctaaacactcccgccga

SEQ ID NO: 175670 - DNA, 37 bp, Artificial Sequence
  Synthetic oligonucleotide
tccgtctatgccgctccaatctgttctttctttccga

SEQ ID NO: 175671 - DNA, 37 bp, Artificial Sequence
  Synthetic oligonucleotide
gccgacctcaactgcgccccctcgaccattatcgcga

SEQ ID NO: 175672 - DNA, 37 bp, Artificial Sequence
  Synthetic oligonucleotide
tcctgctcccttttgctcactcacctgtcttgtgcga

SEQ ID NO: 175673 - DNA, 37 bp, Artificial Sequence
  Synthetic oligonucleotide
tcttgcatcgaactgctctttaacatgccaccctcga

SEQ ID NO: 175674 - DNA, 37 bp, Artificial Sequence
  Synthetic oligonucleotide
tgccaccccgatgctcctcagcttctgaccacttcga

SEQ ID NO: 175675 - DNA, 37 bp, Artificial Sequence
  Synthetic oligonucleotide
ggatctgtgccagatcctccctatccccgctcttcga

SEQ ID NO: 175676 - DNA, 37 bp, Artificial Sequence
  Synthetic oligonucleotide
gccaagcggagggacatggtcgtagggaaggatagga

SEQ ID NO: 175677 - DNA, 37 bp, Artificial Sequence
  Synthetic oligonucleotide
tggatgggaagtaggggttggggtacggaaggtagga

SEQ ID NO: 175678 - DNA, 37 bp, Artificial Sequence
  Synthetic oligonucleotide
cgtggtgcacatatccttcgtgccttctcattccgga

SEQ ID NO: 175679 - DNA, 37 bp, Artificial Sequence
  Synthetic oligonucleotide
taactggcgtggggtgaagcactagggacgggaggga

SEQ ID NO: 175680 - DNA, 36 bp, Artificial Sequence
  Synthetic oligonucleotide
ttggggcgggtgtgacggggggggagacaaacggga

SEQ ID NO: 175681 - DNA, 37 bp, Artificial Sequence
  Synthetic oligonucleotide
actgaggggaggagagggcgggcacgggacggtggga

SEQ ID NO: 175682 - DNA, 37 bp, Artificial Sequence
  Synthetic oligonucleotide
accctcatgcctcgccctcttgtacggtctgtactga

SEQ ID NO: 175683 - DNA, 38 bp, Artificial Sequence
  Synthetic oligonucleotide
tagcactcgctgctattaccgattcctacacaccctga

SEQ ID NO: 175684 - DNA, 38 bp, Artificial Sequence
  Synthetic oligonucleotide
tccgcaagattctcagccttgcatccgttcctccctga

SEQ ID NO: 175685 - DNA, 37 bp, Artificial Sequence
  Synthetic oligonucleotide
tcacccccccgagttgtatcgtctcggacatgcctga

SEQ ID NO: 175686 - DNA, 38 bp, Artificial Sequence
  Synthetic oligonucleotide
gagatgaaggggggggtgcaaaagcggagggtgcctga

SEQ ID NO: 175687 - DNA, 38 bp, Artificial Sequence
  Synthetic oligonucleotide
ttacctgccacacgcgcacaacgactcatcccacgtga

SEQ ID NO: 175688 - DNA, 38 bp, Artificial Sequence
  Synthetic oligonucleotide
tgaactgggcgaagggataaagcgtggggcgggcgtga

SEQ ID NO: 175689 - DNA, 38 bp, Artificial Sequence
  Synthetic oligonucleotide
tgtacccgtcctgaagtaagggaagggggggtgggtga

SEQ ID NO: 175690 - DNA, 37 bp, Artificial Sequence
  Synthetic oligonucleotide
gcgccaccttcaccgccgccaaacgtacgttcattga

SEQ ID NO: 175691 - DNA, 38 bp, Artificial Sequence
  Synthetic oligonucleotide
gagggtagggcagtgggaggccggggagagcgtcttga

SEQ ID NO: 175692 - DNA, 37 bp, Artificial Sequence
  Synthetic oligonucleotide
agcacatcattcgatatacgttccgccgccttcttga

SEQ ID NO: 175693 - DNA, 36 bp, Artificial Sequence
  Synthetic oligonucleotide
gaacagccacaactctatcgccgacttccacgttga

SEQ ID NO: 175694 - DNA, 36 bp, Artificial Sequence
  Synthetic oligonucleotide
gggtgaagacgggaagggtcgggaggttgtggttga

SEQ ID NO: 175695 - DNA, 36 bp, Artificial Sequence
  Synthetic oligonucleotide
gcgtacgccttggtctgttctccatgtgtttccata

SEQ ID NO: 175696 - DNA, 35 bp, Artificial Sequence
  Synthetic oligonucleotide
tcgatccacgctcttggctcttctgcacacttata

SEQ ID NO: 175697 - DNA, 36 bp, Artificial Sequence
  Synthetic oligonucleotide
tgctagactcccgcccgtggttctcactcgtcccta

SEQ ID NO: 175698 - DNA, 36 bp, Artificial Sequence
  Synthetic oligonucleotide
ttaccccgtctgctctctttttactcgtctgcgcta

SEQ ID NO: 175699 - DNA, 35 bp, Artificial Sequence
  Synthetic oligonucleotide
gtggacccctctgccatgctgcccgaacctctcta

SEQ ID NO: 175700 - DNA, 35 bp, Artificial Sequence
  Synthetic oligonucleotide
tgcgaggcccgctattcgcctgttccctgattcta

SEQ ID NO: 175701 - DNA, 34 bp, Artificial Sequence
  Synthetic oligonucleotide
acgccctccaccatttccaggtcccccctacgta

SEQ ID NO: 175702 - DNA, 37 bp, Artificial Sequence
  Synthetic oligonucleotide
tgctactcgcactctgccccatgcctcctcctgggta

SEQ ID NO: 175703 - DNA, 35 bp, Artificial Sequence
  Synthetic oligonucleotide
tgcaccacgccaccttccatcgtctgtctattgta

SEQ ID NO: 175704 - DNA, 35 bp, Artificial Sequence
  Synthetic oligonucleotide
gttccatcacggccgagtactgctacacgccctta

SEQ ID NO: 175705 - DNA, 36 bp, Artificial Sequence
  Synthetic oligonucleotide
tgcacgctttacggtaccatcccgtttcctcgctta

SEQ ID NO: 175706 - DNA, 35 bp, Artificial Sequence
  Synthetic oligonucleotide
tgtcccaccaggcatatccttgaatcggtacaaac

SEQ ID NO: 175707 - DNA, 30 bp, Artificial Sequence
  Synthetic oligonucleotide
ttccactctactccttgccgccgctataac

SEQ ID NO: 175708 - DNA, 35 bp, Artificial Sequence
  Synthetic oligonucleotide
cccatacctggcttactagaaccaccccttacgac

SEQ ID NO: 175709 - DNA, 35 bp, Artificial Sequence
  Synthetic oligonucleotide
acgcctcccaccactacacctggtttgatccttac

SEQ ID NO: 175710 - DNA, 35 bp, Artificial Sequence
  Synthetic oligonucleotide
atacgccgtagagcgtaaaacctcatctgtacacc

SEQ ID NO: 175711 - DNA, 35 bp, Artificial Sequence
  Synthetic oligonucleotide
acatgctcgagttccgcccacacgttgcccctacc

SEQ ID NO: 175712 - DNA, 35 bp, Artificial Sequence
  Synthetic oligonucleotide
gtacccctctgatcgaaaaagatctcccatacccc

SEQ ID NO: 175713 - DNA, 35 bp, Artificial Sequence
  Synthetic oligonucleotide
actaccgccagcagcgcttaccttatagccgcccc

SEQ ID NO: 175714 - DNA, 35 bp, Artificial Sequence
  Synthetic oligonucleotide
ggatccgcccgaccccatggaaacccacactcccc

SEQ ID NO: 175715 - DNA, 35 bp, Artificial Sequence
  Synthetic oligonucleotide
tgctcaacctttgtagctaaacatcctgcctcccc

SEQ ID NO: 175716 - DNA, 35 bp, Artificial Sequence
  Synthetic oligonucleotide
cccccgtccatgccccggtccagcacttaccgccc

SEQ ID NO: 175717 - DNA, 35 bp, Artificial Sequence
  Synthetic oligonucleotide
gcatcagtcgcttggactgtgccactctactgccc

SEQ ID NO: 175718 - DNA, 35 bp, Artificial Sequence
  Synthetic oligonucleotide
tcacacgtgtctgtccctgtcgtccgtctttgccc

SEQ ID NO: 175719 - DNA, 35 bp, Artificial Sequence
  Synthetic oligonucleotide
tgtactgggggcatccctttattgtcgcacctccc

SEQ ID NO: 175720 - DNA, 35 bp, Artificial Sequence
  Synthetic oligonucleotide
tccgccacccctgcgtttcgctcttggcctttccc

SEQ ID NO: 175721 - DNA, 35 bp, Artificial Sequence
  Synthetic oligonucleotide
tcgcaatgcacccgttgtttattccctcctacgcc

SEQ ID NO: 175722 - DNA, 35 bp, Artificial Sequence
  Synthetic oligonucleotide
actaacgcgcactacacgtgatgtcccactccgcc

SEQ ID NO: 175723 - DNA, 35 bp, Artificial Sequence
  Synthetic oligonucleotide
tatgtactcgcccagattgcagtgccaccatctcc

SEQ ID NO: 175724 - DNA, 35 bp, Artificial Sequence
  Synthetic oligonucleotide
actgttgactcgtcgccaccatgtctgtaacttcc

SEQ ID NO: 175725 - DNA, 35 bp, Artificial Sequence
  Synthetic oligonucleotide
ttataacacaccgccagccaccatctaggccttcc

SEQ ID NO: 175726 - DNA, 35 bp, Artificial Sequence
  Synthetic oligonucleotide
gacccgtagggcgtttaccacccgtgttgatttcc

SEQ ID NO: 175727 - DNA, 35 bp, Artificial Sequence
  Synthetic oligonucleotide
taaagcggagacctgaccccccgactgttttttcc

SEQ ID NO: 175728 - DNA, 35 bp, Artificial Sequence
  Synthetic oligonucleotide
taccttccactcttccgcgagcctgcgctcgtagc

SEQ ID NO: 175729 - DNA, 35 bp, Artificial Sequence
  Synthetic oligonucleotide
aacataaccatctttccagccagccccgctctcgc

SEQ ID NO: 175730 - DNA, 35 bp, Artificial Sequence
  Synthetic oligonucleotide
gatacccccgcatagacgtttcaccccgctaatgc

SEQ ID NO: 175731 - DNA, 35 bp, Artificial Sequence
  Synthetic oligonucleotide
gcattacgccccgctatagctctcaccctcactgc

SEQ ID NO: 175732 - DNA, 35 bp, Artificial Sequence
  Synthetic oligonucleotide
tgtcgctgtaggattcaagtcgtctcaccctctgc

SEQ ID NO: 175733 - DNA, 35 bp, Artificial Sequence
  Synthetic oligonucleotide
gatccaaatcggggcgctacacctccatgccttgc

SEQ ID NO: 175734 - DNA, 35 bp, Artificial Sequence
  Synthetic oligonucleotide
tcagaactgcacatggatccccgccagcctcttgc

SEQ ID NO: 175735 - DNA, 35 bp, Artificial Sequence
  Synthetic oligonucleotide
gaccaattgcgcgctgttccccctatcattcttgc

SEQ ID NO: 175736 - DNA, 35 bp, Artificial Sequence
  Synthetic oligonucleotide
gtccccctccgaattgttatactttttttgccatc

SEQ ID NO: 175737 - DNA, 35 bp, Artificial Sequence
  Synthetic oligonucleotide
tctacccgatcgccccccttggcatagctatcatc

SEQ ID NO: 175738 - DNA, 35 bp, Artificial Sequence
  Synthetic oligonucleotide
gtcgcaagctctttaactgttccgtctgcctcctc

SEQ ID NO: 175739 - DNA, 35 bp, Artificial Sequence
  Synthetic oligonucleotide
gcctgccccctgtgctaacatacttgctctcgctc

SEQ ID NO: 175740 - DNA, 35 bp, Artificial Sequence
  Synthetic oligonucleotide
gacactcccacggtaataccacccccgccctgctc

SEQ ID NO: 175741 - DNA, 35 bp, Artificial Sequence
  Synthetic oligonucleotide
atcatacgcatccccttatgctcacgggtcttctc

SEQ ID NO: 175742 - DNA, 35 bp, Artificial Sequence
  Synthetic oligonucleotide
gtcctccccattgctcacaacgggcacctacggtc

SEQ ID NO: 175743 - DNA, 35 bp, Artificial Sequence
  Synthetic oligonucleotide
gactactccatcgcctgcatccaaatgtccgtgtc

SEQ ID NO: 175744 - DNA, 35 bp, Artificial Sequence
  Synthetic oligonucleotide
gcctacctcccctgcgctatactttcgtaagcaag

SEQ ID NO: 175745 - DNA, 35 bp, Artificial Sequence
  Synthetic oligonucleotide
gccaagggggcaaaaggtaagggtgaacatgtcag

SEQ ID NO: 175746 - DNA, 35 bp, Artificial Sequence
  Synthetic oligonucleotide
gaggagatgcggaggtcggtttagaggaggaggag

SEQ ID NO: 175747 - DNA, 35 bp, Artificial Sequence
  Synthetic oligonucleotide
tcaccccgaggacagtccacctacaccttgccacg

SEQ ID NO: 175748 - DNA, 35 bp, Artificial Sequence
  Synthetic oligonucleotide
gtcccgcccccactgttcaactaccgccccttacg

SEQ ID NO: 175749 - DNA, 35 bp, Artificial Sequence
  Synthetic oligonucleotide
gccttcaccctcgtactcccatcacgttcccctgg

SEQ ID NO: 175750 - DNA, 35 bp, Artificial Sequence
  Synthetic oligonucleotide
tccagacgccctcctcattctcgcctcttgccatg

SEQ ID NO: 175751 - DNA, 37 bp, Artificial Sequence
  Synthetic oligonucleotide
gatgagatgccgagggtggtaataggagaagggcctg

SEQ ID NO: 175752 - DNA, 35 bp, Artificial Sequence
  Synthetic oligonucleotide
gcgggagtgggggggataagaatgatgggcgagat

SEQ ID NO: 175753 - DNA, 35 bp, Artificial Sequence
  Synthetic oligonucleotide
gaacccccccccctactgtttctggttaagtaact

SEQ ID NO: 175754 - DNA, 35 bp, Artificial Sequence
  Synthetic oligonucleotide
gcgcccctcgagttcaccatcacgctgcgagccct

SEQ ID NO: 175755 - DNA, 35 bp, Artificial Sequence
  Synthetic oligonucleotide
accctgcaagctacggcacccatcccctttacgct

SEQ ID NO: 175756 - DNA, 35 bp, Artificial Sequence
  Synthetic oligonucleotide
actcatcagcggtctccgtctccgcgcgctctgct

SEQ ID NO: 175757 - DNA, 35 bp, Artificial Sequence
  Synthetic oligonucleotide
actcatcagcgcacccggtgcagcttggcccctct

SEQ ID NO: 175758 - DNA, 35 bp, Artificial Sequence
  Synthetic oligonucleotide
tcgatccggcgttaccatgtctgccacctctcagt

SEQ ID NO: 175759 - DNA, 35 bp, Artificial Sequence
  Synthetic oligonucleotide
agtcgaccctcaactttactcgctccacctcaggt

SEQ ID NO: 175760 - DNA, 35 bp, Artificial Sequence
  Synthetic oligonucleotide
gaatcacgtagatggaagaagggagggggtgcggt

SEQ ID NO: 175761 - DNA, 35 bp, Artificial Sequence
  Synthetic oligonucleotide
tccccgggtcatccacttgctcttcgccacaatgt

SEQ ID NO: 175762 - DNA, 35 bp, Artificial Sequence
  Synthetic oligonucleotide
tcccccgcctctcgtctttccttgttgtcacgatt

SEQ ID NO: 175763 - DNA, 35 bp, Artificial Sequence
  Synthetic oligonucleotide
ttgggcggagctgcggttttgcccccccctgtatt

SEQ ID NO: 175764 - DNA, 35 bp, Artificial Sequence
  Synthetic oligonucleotide
gtaggccccacttgatctaattgattgttgccctt

SEQ ID NO: 175765 - DNA, 35 bp, Artificial Sequence
  Synthetic oligonucleotide
ttgaacctcaggctgatccccgcttgtttcctctt

SEQ ID NO: 175766 - DNA, 35 bp, Artificial Sequence
  Synthetic oligonucleotide
tcaatgccgccccttatagcactttgctcgctctt

SEQ ID NO: 175767 - DNA, 35 bp, Artificial Sequence
  Synthetic oligonucleotide
atggtaggggaagaggggaggggacagctgttctt

SEQ ID NO: 175768 - DNA, 35 bp, Artificial Sequence
  Synthetic oligonucleotide
accttcaccgccctcctagttaattgcaataattt

SEQ ID NO: 175769 - DNA, 35 bp, Artificial Sequence
  Synthetic oligonucleotide
gccccgcccaccgcactgccactatactcacattt

SEQ ID NO: 175770 - DNA, 35 bp, Artificial Sequence
  Synthetic oligonucleotide
atcccatccctgtgcatgttcaccccgcgtggaaa

SEQ ID NO: 175771 - DNA, 35 bp, Artificial Sequence
  Synthetic oligonucleotide
taaccccatgcctgcactctctgtacaccttccaa

SEQ ID NO: 175772 - DNA, 36 bp, Artificial Sequence
  Synthetic oligonucleotide
gagtgcgaccagggggaggttggaggcgtggacgaa

SEQ ID NO: 175773 - DNA, 36 bp, Artificial Sequence
  Synthetic oligonucleotide
atggactgcccctctccgtatcgactcgtatactaa

SEQ ID NO: 175774 - DNA, 36 bp, Artificial Sequence
  Synthetic oligonucleotide
tacaccgctctgtcattttctcactgctcgttctaa

SEQ ID NO: 175775 - DNA, 36 bp, Artificial Sequence
  Synthetic oligonucleotide
gcgctccccacgactccccgtttttgaccggtaaca

SEQ ID NO: 175776 - DNA, 36 bp, Artificial Sequence
  Synthetic oligonucleotide
tccttccacacgaggtctttgacccagactcccaca

SEQ ID NO: 175777 - DNA, 36 bp, Artificial Sequence
  Synthetic oligonucleotide
tcgagttccccccaagcctgtatagccccttgcaca

SEQ ID NO: 175778 - DNA, 36 bp, Artificial Sequence
  Synthetic oligonucleotide
tctgccatgtcctcttgtctcgccccttaccctaca

SEQ ID NO: 175779 - DNA, 35 bp, Artificial Sequence
  Synthetic oligonucleotide
gaacgcatccacactcctggccagctctctctaca

SEQ ID NO: 175780 - DNA, 35 bp, Artificial Sequence
  Synthetic oligonucleotide
gacccttccctgaatgccaccaggggttaacacca

SEQ ID NO: 175781 - DNA, 36 bp, Artificial Sequence
  Synthetic oligonucleotide
tgcaaccgcagctattcgtaacgttcaccatcccca

SEQ ID NO: 175782 - DNA, 36 bp, Artificial Sequence
  Synthetic oligonucleotide
acacgtgcgcacgatacgccgccaatacactagcca

SEQ ID NO: 175783 - DNA, 36 bp, Artificial Sequence
  Synthetic oligonucleotide
gacaccgggagtctgttccccccttttgttgtgcca

SEQ ID NO: 175784 - DNA, 36 bp, Artificial Sequence
  Synthetic oligonucleotide
atggtccccctctgttccgtcgcctcctttcatcca

SEQ ID NO: 175785 - DNA, 36 bp, Artificial Sequence
  Synthetic oligonucleotide
accgtgcgtgcaatttcggcatgcatgacccctcca

SEQ ID NO: 175786 - DNA, 36 bp, Artificial Sequence
  Synthetic oligonucleotide
tgttaggggggtgggggatgggcgaggtcacgtcca

SEQ ID NO: 175787 - DNA, 30 bp, Artificial Sequence
  Synthetic oligonucleotide
atcatgcctcaactatcctatttatgtcca

SEQ ID NO: 175788 - DNA, 36 bp, Artificial Sequence
  Synthetic oligonucleotide
gtctcgatcacccgttcccgtaccatttggtgtcca

SEQ ID NO: 175789 - DNA, 36 bp, Artificial Sequence
  Synthetic oligonucleotide
agccttacaactgagctcgccctgccccccactgca

SEQ ID NO: 175790 - DNA, 36 bp, Artificial Sequence
  Synthetic oligonucleotide
acaccatccgattattagttcgccctgtcgacatca

SEQ ID NO: 175791 - DNA, 35 bp, Artificial Sequence
  Synthetic oligonucleotide
aacagcatgcactgtaggtcgttcgttctatctca

SEQ ID NO: 175792 - DNA, 36 bp, Artificial Sequence
  Synthetic oligonucleotide
atttggaggaggctggggctgacgaggcggtggtca

SEQ ID NO: 175793 - DNA, 36 bp, Artificial Sequence
  Synthetic oligonucleotide
acgttctccgactgttttcgtctctgtacccgttca

SEQ ID NO: 175794 - DNA, 37 bp, Artificial Sequence
  Synthetic oligonucleotide
aagatggggggtgggttggtgagcaagggctagacga

SEQ ID NO: 175795 - DNA, 37 bp, Artificial Sequence
  Synthetic oligonucleotide
gagactcaccacttgcccctcgtccgtactcggacga

SEQ ID NO: 175796 - DNA, 37 bp, Artificial Sequence
  Synthetic oligonucleotide
gcgatcacgccctttacgtttacacgcaccccaccga

SEQ ID NO: 175797 - DNA, 37 bp, Artificial Sequence
  Synthetic oligonucleotide
tcaccgttgctttcaggcctgcgccgcctttccccga

SEQ ID NO: 175798 - DNA, 37 bp, Artificial Sequence
  Synthetic oligonucleotide
ggacggggaaaacaaggatgggaggttgcggggccga

SEQ ID NO: 175799 - DNA, 37 bp, Artificial Sequence
  Synthetic oligonucleotide
tatgtcgaactcgccgcctaccatgtaaccctgccga

SEQ ID NO: 175800 - DNA, 37 bp, Artificial Sequence
  Synthetic oligonucleotide
gctcacacgaacaagtgcatatttccccgccctccga

SEQ ID NO: 175801 - DNA, 35 bp, Artificial Sequence
  Synthetic oligonucleotide
ttccacctctgcccttacgtcaacccacctcgcga

SEQ ID NO: 175802 - DNA, 37 bp, Artificial Sequence
  Synthetic oligonucleotide
gccgaagccggagtgggatgtgggggggaaggggcga

SEQ ID NO: 175803 - DNA, 37 bp, Artificial Sequence
  Synthetic oligonucleotide
agtgcgtcctcctcgcgtcatcgtgccccgccctcga

SEQ ID NO: 175804 - DNA, 35 bp, Artificial Sequence
  Synthetic oligonucleotide
tacaccctctgctctctcttgtgccatctcaagga

SEQ ID NO: 175805 - DNA, 37 bp, Artificial Sequence
  Synthetic oligonucleotide
tcatgggtagggcagggcgggtgagaattcgacagga

SEQ ID NO: 175806 - DNA, 36 bp, Artificial Sequence
  Synthetic oligonucleotide
agatcgcaatgtgacagtgggacggtggggggagga

SEQ ID NO: 175807 - DNA, 37 bp, Artificial Sequence
  Synthetic oligonucleotide
aggacacgcccatccctatcctgttcgtctttcggga

SEQ ID NO: 175808 - DNA, 37 bp, Artificial Sequence
  Synthetic oligonucleotide
gtacggttgaaggaggagaaggggtgccagtagggga

SEQ ID NO: 175809 - DNA, 37 bp, Artificial Sequence
  Synthetic oligonucleotide
taaggatagggtagtagggtgaggggcgggcattgga

SEQ ID NO: 175810 - DNA, 37 bp, Artificial Sequence
  Synthetic oligonucleotide
aagatcagccagaacctgtactcgccgcccaccatga

SEQ ID NO: 175811 - DNA, 37 bp, Artificial Sequence
  Synthetic oligonucleotide
gccgggcgaggaggaagagaatgggtgggagtgatga

SEQ ID NO: 175812 - DNA, 38 bp, Artificial Sequence
  Synthetic oligonucleotide
agacgcacatccgtttttgccgctgaatcctgtcctga

SEQ ID NO: 175813 - DNA, 37 bp, Artificial Sequence
  Synthetic oligonucleotide
tcaccaatcctgtgatccaccgccaaccctccgctga

SEQ ID NO: 175814 - DNA, 37 bp, Artificial Sequence
  Synthetic oligonucleotide
tccgccccccccctggcgagccactcgcgctcgctga

SEQ ID NO: 175815 - DNA, 38 bp, Artificial Sequence
  Synthetic oligonucleotide
gtgacgaggaaaaagcaaaagaggagaaaggtcagtga

SEQ ID NO: 175816 - DNA, 37 bp, Artificial Sequence
  Synthetic oligonucleotide
aatgcgccgcaaaaacgtcctcccgttagctacgtga

SEQ ID NO: 175817 - DNA, 38 bp, Artificial Sequence
  Synthetic oligonucleotide
tttcaccacccgccgtgcacccgtgccacccatcgtga

SEQ ID NO: 175818 - DNA, 38 bp, Artificial Sequence
  Synthetic oligonucleotide
aaaggggaggacaaacaagaacgggcgggaacaggtga

SEQ ID NO: 175819 - DNA, 38 bp, Artificial Sequence
  Synthetic oligonucleotide
gcccacgcccccctcccagcattacatggccatggtga

SEQ ID NO: 175820 - DNA, 36 bp, Artificial Sequence
  Synthetic oligonucleotide
gcctgcccccgtgtgccccacttcccttccctgtga

SEQ ID NO: 175821 - DNA, 38 bp, Artificial Sequence
  Synthetic oligonucleotide
tgaccatccctgctctactcgtctgcctactcctgtga

SEQ ID NO: 175822 - DNA, 36 bp, Artificial Sequence
  Synthetic oligonucleotide
ggggggagggcacccaggggatagggatggaattga

SEQ ID NO: 175823 - DNA, 38 bp, Artificial Sequence
  Synthetic oligonucleotide
gcccacttcctctctgctatttccaaggacgaccttga

SEQ ID NO: 175824 - DNA, 37 bp, Artificial Sequence
  Synthetic oligonucleotide
aagacccgcactgttttctcgcatctcactgccttga

SEQ ID NO: 175825 - DNA, 38 bp, Artificial Sequence
  Synthetic oligonucleotide
tccccaccctggatcactgccttcattcggtctcttga

SEQ ID NO: 175826 - DNA, 36 bp, Artificial Sequence
  Synthetic oligonucleotide
tacagcgcgcacccggtcctctctcttccgtcttga

SEQ ID NO: 175827 - DNA, 37 bp, Artificial Sequence
  Synthetic oligonucleotide
tactctcagcccgcttataccactgcctctttgttga

SEQ ID NO: 175828 - DNA, 38 bp, Artificial Sequence
  Synthetic oligonucleotide
acaactgccccggccatctacttagtacctttctttga

SEQ ID NO: 175829 - DNA, 36 bp, Artificial Sequence
  Synthetic oligonucleotide
atgaccgcctccgttcgcccacccctagctttcata

SEQ ID NO: 175830 - DNA, 35 bp, Artificial Sequence
  Synthetic oligonucleotide
gacacccgtagcaaggagcgggcgagggggatata

SEQ ID NO: 175831 - DNA, 36 bp, Artificial Sequence
  Synthetic oligonucleotide
tttggggtggggttgacagttagttgggggcgggta

SEQ ID NO: 175832 - DNA, 36 bp, Artificial Sequence
  Synthetic oligonucleotide
ggatggcaatccgataactgtttcgtgcccccctta

SEQ ID NO: 175833 - DNA, 36 bp, Artificial Sequence
  Synthetic oligonucleotide
acccaccccaatggaccggttgttcttttctcctta

SEQ ID NO: 175834 - DNA, 34 bp, Artificial Sequence
  Synthetic oligonucleotide
tgatgccatagctagccctgcccctgcactctta

SEQ ID NO: 175835 - DNA, 35 bp, Artificial Sequence
  Synthetic oligonucleotide
gaggacgagagtgaggacaagtggggggcggaaac

SEQ ID NO: 175836 - DNA, 35 bp, Artificial Sequence
  Synthetic oligonucleotide
gcgtatcctccctcgttttatttagtgtccttcac

SEQ ID NO: 175837 - DNA, 35 bp, Artificial Sequence
  Synthetic oligonucleotide
tacaccacccacatttatagtccagccggtccgac

SEQ ID NO: 175838 - DNA, 35 bp, Artificial Sequence
  Synthetic oligonucleotide
gagctcgcgccatctcgcctttatgtcccctatac

SEQ ID NO: 175839 - DNA, 35 bp, Artificial Sequence
  Synthetic oligonucleotide
tggacacccagttatccgcgtgctcgcccttttac

SEQ ID NO: 175840 - DNA, 35 bp, Artificial Sequence
  Synthetic oligonucleotide
tagatcccaacgtacccctgccttgcataataacc

SEQ ID NO: 175841 - DNA, 35 bp, Artificial Sequence
  Synthetic oligonucleotide
gccattgcgatctgccttcgtaatgccggtccacc

SEQ ID NO: 175842 - DNA, 35 bp, Artificial Sequence
  Synthetic oligonucleotide
gctaaacccacgccatgcgcaattacggtcatacc

SEQ ID NO: 175843 - DNA, 35 bp, Artificial Sequence
  Synthetic oligonucleotide
gcacaacccactatgtcgtttcacccgcccctacc

SEQ ID NO: 175844 - DNA, 35 bp, Artificial Sequence
  Synthetic oligonucleotide
tatccttagcggcactgctcttcttagttcctacc

SEQ ID NO: 175845 - DNA, 35 bp, Artificial Sequence
  Synthetic oligonucleotide
gttgttgtcaccgtgtccaaaccacctcgtacccc

SEQ ID NO: 175846 - DNA, 35 bp, Artificial Sequence
  Synthetic oligonucleotide
gtctctcgcaccccgcgtattcgctggtacccccc

SEQ ID NO: 175847 - DNA, 35 bp, Artificial Sequence
  Synthetic oligonucleotide
agtccacgttgcatctacaaacggtcggtcccccc

SEQ ID NO: 175848 - DNA, 35 bp, Artificial Sequence
  Synthetic oligonucleotide
gagcacccactgacttcccgcgccatctgtcgccc

SEQ ID NO: 175849 - DNA, 35 bp, Artificial Sequence
  Synthetic oligonucleotide
acgcaccccaatgtcgcgcctacagacccgccgcc

SEQ ID NO: 175850 - DNA, 37 bp, Artificial Sequence
  Synthetic oligonucleotide
gaactgtccaggtaggtcatactgcttctctttcgcc

SEQ ID NO: 175851 - DNA, 35 bp, Artificial Sequence
  Synthetic oligonucleotide
tgcccaccgcgcgtccttacaccctgagcctatcc

SEQ ID NO: 175852 - DNA, 35 bp, Artificial Sequence
  Synthetic oligonucleotide
gtacacgcagctataattattgcctggccttatcc

SEQ ID NO: 175853 - DNA, 35 bp, Artificial Sequence
  Synthetic oligonucleotide
tacgacagtactatcgagcattcaagcccacctcc

SEQ ID NO: 175854 - DNA, 35 bp, Artificial Sequence
  Synthetic oligonucleotide
accgctaacaccccgccttcgaacctttaaggtcc

SEQ ID NO: 175855 - DNA, 35 bp, Artificial Sequence
  Synthetic oligonucleotide
tcgccgggcggttagtttctcgcgttccaacttcc

SEQ ID NO: 175856 - DNA, 35 bp, Artificial Sequence
  Synthetic oligonucleotide
gctgtgcgcatcaagagtgcgtgttcctgtcttcc

SEQ ID NO: 175857 - DNA, 35 bp, Artificial Sequence
  Synthetic oligonucleotide
ttcgcctcttgacaatactcctgccttcttgaagc

SEQ ID NO: 175858 - DNA, 35 bp, Artificial Sequence
  Synthetic oligonucleotide
gacgttggggggggtatggggtaggatggctcagc

SEQ ID NO: 175859 - DNA, 35 bp, Artificial Sequence
  Synthetic oligonucleotide
gccctgcctcccatcacaatgcacctgccggacgc

SEQ ID NO: 175860 - DNA, 35 bp, Artificial Sequence
  Synthetic oligonucleotide
gctgcaccctcactacattcgcacactctcatcgc

SEQ ID NO: 175861 - DNA, 35 bp, Artificial Sequence
  Synthetic oligonucleotide
taccacgcgtctcccgttctttattttgcactggc

SEQ ID NO: 175862 - DNA, 35 bp, Artificial Sequence
  Synthetic oligonucleotide
gaccgtccatcacctgcacgctggttttccctggc

SEQ ID NO: 175863 - DNA, 34 bp, Artificial Sequence
  Synthetic oligonucleotide
gattacactcgctccagactggtctacgcactgc

SEQ ID NO: 175864 - DNA, 35 bp, Artificial Sequence
  Synthetic oligonucleotide
tctcatccgccgttcattaaagcttttgctcctgc

SEQ ID NO: 175865 - DNA, 35 bp, Artificial Sequence
  Synthetic oligonucleotide
tgcctgacccgcctccacatcttgttagtttctgc

SEQ ID NO: 175866 - DNA, 35 bp, Artificial Sequence
  Synthetic oligonucleotide
atacgcatctcacctgccggggtctcctgtcttgc

SEQ ID NO: 175867 - DNA, 35 bp, Artificial Sequence
  Synthetic oligonucleotide
tgttatacgccctttcgtccatgagtcgccgcatc

SEQ ID NO: 175868 - DNA, 35 bp, Artificial Sequence
  Synthetic oligonucleotide
atgtcccgcccctctatcgtacgcgaagacttatc

SEQ ID NO: 175869 - DNA, 35 bp, Artificial Sequence
  Synthetic oligonucleotide
tgcccctgcaacaatatgcctcatatctggtactc

SEQ ID NO: 175870 - DNA, 35 bp, Artificial Sequence
  Synthetic oligonucleotide
tctggagagcgccggccccaattgccttacacctc

SEQ ID NO: 175871 - DNA, 35 bp, Artificial Sequence
  Synthetic oligonucleotide
agcctacgacaccttctttaccaacgtgatacctc

SEQ ID NO: 175872 - DNA, 35 bp, Artificial Sequence
  Synthetic oligonucleotide
cacacacgctgaacccggctaggaccccatccctc

SEQ ID NO: 175873 - DNA, 35 bp, Artificial Sequence
  Synthetic oligonucleotide
acgcatgcgcgcggactccacaccccggcatcctc

SEQ ID NO: 175874 - DNA, 35 bp, Artificial Sequence
  Synthetic oligonucleotide
gtgttcgtcaccttcgtcccgttcggcctcatctc

SEQ ID NO: 175875 - DNA, 35 bp, Artificial Sequence
  Synthetic oligonucleotide
gcctatcctcggaccgccttcttaattggcccttc

SEQ ID NO: 175876 - DNA, 35 bp, Artificial Sequence
  Synthetic oligonucleotide
acgtgtgtgtggcgcttcccggtccgtttcatttc

SEQ ID NO: 175877 - DNA, 35 bp, Artificial Sequence
  Synthetic oligonucleotide
tgtccacctccacgcggaacctcatctccaccaag

SEQ ID NO: 175878 - DNA, 35 bp, Artificial Sequence
  Synthetic oligonucleotide
gttgactcccctccgtatccgttgctcatctttag

SEQ ID NO: 175879 - DNA, 35 bp, Artificial Sequence
  Synthetic oligonucleotide
atgccacctcttctatgcatttgatcttcgtaacg

SEQ ID NO: 175880 - DNA, 35 bp, Artificial Sequence
  Synthetic oligonucleotide
tgcatatccgtcatccttcccttcacatgtccacg

SEQ ID NO: 175881 - DNA, 35 bp, Artificial Sequence
  Synthetic oligonucleotide
tgagccgcctgcatcggcctccaccaggttccccg

SEQ ID NO: 175882 - DNA, 35 bp, Artificial Sequence
  Synthetic oligonucleotide
atcatgttgtttgctctccgccccctgttgctccg

SEQ ID NO: 175883 - DNA, 35 bp, Artificial Sequence
  Synthetic oligonucleotide
tagaaggagaagaggatagtcacgggtagggggcg

SEQ ID NO: 175884 - DNA, 35 bp, Artificial Sequence
  Synthetic oligonucleotide
gttagggtggagtcgggcaaaggtgtggggagggg

SEQ ID NO: 175885 - DNA, 35 bp, Artificial Sequence
  Synthetic oligonucleotide
aaacacgggaaaggatgggggatcagatggtgggg

SEQ ID NO: 175886 - DNA, 35 bp, Artificial Sequence
  Synthetic oligonucleotide
gagaaagaagaggtgggggcgacggggccaagctg

SEQ ID NO: 175887 - DNA, 35 bp, Artificial Sequence
  Synthetic oligonucleotide
ggaacacccttcctcgtacatccccaaaccctgtg

SEQ ID NO: 175888 - DNA, 35 bp, Artificial Sequence
  Synthetic oligonucleotide
accacttcaagcgcagtgtactccctctcattttg

SEQ ID NO: 175889 - DNA, 35 bp, Artificial Sequence
  Synthetic oligonucleotide
gaccacggttctgtggcccttcctctcgccctaat

SEQ ID NO: 175890 - DNA, 35 bp, Artificial Sequence
  Synthetic oligonucleotide
tacccaccgatactgtctgggcctattgattccat

SEQ ID NO: 175891 - DNA, 35 bp, Artificial Sequence
  Synthetic oligonucleotide
tgacagtcagcccgtcatgcacctccctacttgat

SEQ ID NO: 175892 - DNA, 35 bp, Artificial Sequence
  Synthetic oligonucleotide
tgacatttccgttgtctacgcacagctcttcacct

SEQ ID NO: 175893 - DNA, 35 bp, Artificial Sequence
  Synthetic oligonucleotide
gaaaaccgtgcgccccttatattatcgccgcccct

SEQ ID NO: 175894 - DNA, 35 bp, Artificial Sequence
  Synthetic oligonucleotide
ttacaccccaaacgcatggtccaagcctcaccgct

SEQ ID NO: 175895 - DNA, 35 bp, Artificial Sequence
  Synthetic oligonucleotide
acggtggctctggttcgcccccccctcgtttcgct

SEQ ID NO: 175896 - DNA, 35 bp, Artificial Sequence
  Synthetic oligonucleotide
gccacttcgtcttttctgcagttccaggcccatct

SEQ ID NO: 175897 - DNA, 35 bp, Artificial Sequence
  Synthetic oligonucleotide
atcattcaccgacgccgcccacgccctgctcctct

SEQ ID NO: 175898 - DNA, 35 bp, Artificial Sequence
  Synthetic oligonucleotide
acccctagcagcatatgcccgcccaatcctgctct

SEQ ID NO: 175899 - DNA, 35 bp, Artificial Sequence
  Synthetic oligonucleotide
accccgccacctctagtgtcctctgtcgccttatt

SEQ ID NO: 175900 - DNA, 35 bp, Artificial Sequence
  Synthetic oligonucleotide
ccagtccgccgccgccatgtaccttatcgaccctt

SEQ ID NO: 175901 - DNA, 35 bp, Artificial Sequence
  Synthetic oligonucleotide
gcataccgaaccatgttgatcttcattgctgcctt

SEQ ID NO: 175902 - DNA, 35 bp, Artificial Sequence
  Synthetic oligonucleotide
tagcgaagtgaccccctgccgcataatgcccgctt

SEQ ID NO: 175903 - DNA, 35 bp, Artificial Sequence
  Synthetic oligonucleotide
atccgccgccccgttcgccgtactaccatttgttt

SEQ ID NO: 175904 - DNA, 35 bp, Artificial Sequence
  Synthetic oligonucleotide
gccacgtgcgtcaccttggtcgttttgtttctttt

SEQ ID NO: 175905 - DNA, 35 bp, Artificial Sequence
  Synthetic oligonucleotide
ccctcacccccagtggctctttacctgcccttttt

SEQ ID NO: 175906 - DNA, 35 bp, Artificial Sequence
  Synthetic oligonucleotide
gtgggccccagtccttggtgccttattcccttttt

SEQ ID NO: 175907 - DNA, 36 bp, Artificial Sequence
  Synthetic oligonucleotide
tacacgccctggccctctgttaagttcttgcctaaa

SEQ ID NO: 175908 - DNA, 35 bp, Artificial Sequence
  Synthetic oligonucleotide
gtggcggaggaggggggtggatggagggcaatcaa

SEQ ID NO: 175909 - DNA, 35 bp, Artificial Sequence
  Synthetic oligonucleotide
gggggagcagacaaagcatatgggggggccgggaa

SEQ ID NO: 175910 - DNA, 36 bp, Artificial Sequence
  Synthetic oligonucleotide
tcgaacccccctctgtgccctatgtaacgcctctaa

SEQ ID NO: 175911 - DNA, 36 bp, Artificial Sequence
  Synthetic oligonucleotide
gaaagggcagttgtcgggtgggtgggctaactaaca

SEQ ID NO: 175912 - DNA, 36 bp, Artificial Sequence
  Synthetic oligonucleotide
accccccctgtgacgcatatccactactcagtaaca

SEQ ID NO: 175913 - DNA, 35 bp, Artificial Sequence
  Synthetic oligonucleotide
atatcgcccctcgctcattgaagcatgcataccca

SEQ ID NO: 175914 - DNA, 36 bp, Artificial Sequence
  Synthetic oligonucleotide
gtccagcctgcctcactttgcgcctatgccatccca

SEQ ID NO: 175915 - DNA, 36 bp, Artificial Sequence
  Synthetic oligonucleotide
acccgccgactcaattccgagccttttctttagcca

SEQ ID NO: 175916 - DNA, 36 bp, Artificial Sequence
  Synthetic oligonucleotide
gtgatggtagggtgaggggaaggtaattatgaggca

SEQ ID NO: 175917 - DNA, 36 bp, Artificial Sequence
  Synthetic oligonucleotide
atgttgacatcgattgcgtactttcccccctaggca

SEQ ID NO: 175918 - DNA, 35 bp, Artificial Sequence
  Synthetic oligonucleotide
gccccgcccctttgcgccacttcactgtgcatgca

SEQ ID NO: 175919 - DNA, 36 bp, Artificial Sequence
  Synthetic oligonucleotide
gccatcgggatgtacctccgctgcccgccccctgca

SEQ ID NO: 175920 - DNA, 33 bp, Artificial Sequence
  Synthetic oligonucleotide
gtcctcaccacacccacccgacttgtggtatca

SEQ ID NO: 175921 - DNA, 37 bp, Artificial Sequence
  Synthetic oligonucleotide
acgccccctcctgataccccgtggtttccccgaacga

SEQ ID NO: 175922 - DNA, 36 bp, Artificial Sequence
  Synthetic oligonucleotide
tgtccaccgggcccgtgtttctccccctccttacga

SEQ ID NO: 175923 - DNA, 37 bp, Artificial Sequence
  Synthetic oligonucleotide
ggttagtccccgcgccctccctcagtgtcactcccga

SEQ ID NO: 175924 - DNA, 37 bp, Artificial Sequence
  Synthetic oligonucleotide
gacacgcgaccttcttttgtagcccggctcctcccga

SEQ ID NO: 175925 - DNA, 37 bp, Artificial Sequence
  Synthetic oligonucleotide
gccccacccgccccataccggacaagctattcagcga

SEQ ID NO: 175926 - DNA, 37 bp, Artificial Sequence
  Synthetic oligonucleotide
tctgatcgtgccgcccctatcgccttccttatcgcga

SEQ ID NO: 175927 - DNA, 37 bp, Artificial Sequence
  Synthetic oligonucleotide
ggatggagcggtaggggggggcggagcgctctatcga

SEQ ID NO: 175928 - DNA, 37 bp, Artificial Sequence
  Synthetic oligonucleotide
accatgactgtctatctgttaataccgccccactcga

SEQ ID NO: 175929 - DNA, 37 bp, Artificial Sequence
  Synthetic oligonucleotide
ggaggggaatgtgtggggtggttcgtacctactagga

SEQ ID NO: 175930 - DNA, 36 bp, Artificial Sequence
  Synthetic oligonucleotide
tcccacctattccgagctccttgcccagtttccgga

SEQ ID NO: 175931 - DNA, 36 bp, Artificial Sequence
  Synthetic oligonucleotide
acacgagcgtgtgctgggcaggaaaaacggggggga

SEQ ID NO: 175932 - DNA, 38 bp, Artificial Sequence
  Synthetic oligonucleotide
tgccacgcccccatctctagatcgctaatgcccctgga

SEQ ID NO: 175933 - DNA, 36 bp, Artificial Sequence
  Synthetic oligonucleotide
gaaggaacggaccgtggggactaacgggagagtgga

SEQ ID NO: 175934 - DNA, 36 bp, Artificial Sequence
  Synthetic oligonucleotide
tatgtcagccccttctccatctgcttttgtgtatga

SEQ ID NO: 175935 - DNA, 38 bp, Artificial Sequence
  Synthetic oligonucleotide
ctatccaccctcgctgttcatcgtgccacactacctga

SEQ ID NO: 175936 - DNA, 36 bp, Artificial Sequence
  Synthetic oligonucleotide
ttgcactacgttgtgctgtacccatctccgccctga

SEQ ID NO: 175937 - DNA, 37 bp, Artificial Sequence
  Synthetic oligonucleotide
tgtgctatcctactcgcgatttgagctccttccctga

SEQ ID NO: 175938 - DNA, 38 bp, Artificial Sequence
  Synthetic oligonucleotide
gcatacctcacctgcgccattcgcccacacttaagtga

SEQ ID NO: 175939 - DNA, 36 bp, Artificial Sequence
  Synthetic oligonucleotide
gatcatgtaattgtccctgccccactcctctcgtga

SEQ ID NO: 175940 - DNA, 38 bp, Artificial Sequence
  Synthetic oligonucleotide
gacatcgccgaaatttcgtgcccctccttgctctgtga

SEQ ID NO: 175941 - DNA, 37 bp, Artificial Sequence
  Synthetic oligonucleotide
gtgcacctcacatccgatcttcgaacaccttctgtga

SEQ ID NO: 175942 - DNA, 38 bp, Artificial Sequence
  Synthetic oligonucleotide
tccacagcgcctcactacgtccccggtgccctgcttga

SEQ ID NO: 175943 - DNA, 38 bp, Artificial Sequence
  Synthetic oligonucleotide
tcagtgccgttcgatgtatcgcctccgtgccctcttga

SEQ ID NO: 175944 - DNA, 38 bp, Artificial Sequence
  Synthetic oligonucleotide
gagacgggtaatgcgaatgaaagcggaaggggagttga

SEQ ID NO: 175945 - DNA, 38 bp, Artificial Sequence
  Synthetic oligonucleotide
gggcgggagccgaggggaaaaggctgggaattggttga

SEQ ID NO: 175946 - DNA, 38 bp, Artificial Sequence
  Synthetic oligonucleotide
gccaccacctcgcatagcctgcacttccaccgtgttga

SEQ ID NO: 175947 - DNA, 36 bp, Artificial Sequence
  Synthetic oligonucleotide
actgcccgttacccgtggcatgacccctgtcccata

SEQ ID NO: 175948 - DNA, 36 bp, Artificial Sequence
  Synthetic oligonucleotide
tcagaaacgagggtggaggcggtttggcggaggata

SEQ ID NO: 175949 - DNA, 35 bp, Artificial Sequence
  Synthetic oligonucleotide
atacctcgccatcaacccccctttgagcactccta

SEQ ID NO: 175950 - DNA, 36 bp, Artificial Sequence
  Synthetic oligonucleotide
gctctgacctcccaccgcctcgacgtatttacgcta

SEQ ID NO: 175951 - DNA, 36 bp, Artificial Sequence
  Synthetic oligonucleotide
atgacgggagggtgggttgggataaccgcttactta

SEQ ID NO: 175952 - DNA, 35 bp, Artificial Sequence
  Synthetic oligonucleotide
gagagggggaaaatgaaggtgtggggtaaataaac

SEQ ID NO: 175953 - DNA, 35 bp, Artificial Sequence
  Synthetic oligonucleotide
agcgggtaggacgggcgggcgggcatgcattaaac

SEQ ID NO: 175954 - DNA, 35 bp, Artificial Sequence
  Synthetic oligonucleotide
tgcaccaactcatgccttttcgtgccccgtagaac

SEQ ID NO: 175955 - DNA, 35 bp, Artificial Sequence
  Synthetic oligonucleotide
tgtcccctgacgcactatccccacagactaggaac

SEQ ID NO: 175956 - DNA, 35 bp, Artificial Sequence
  Synthetic oligonucleotide
gattccatcgatccctgttcctaccggtgcttaac

SEQ ID NO: 175957 - DNA, 35 bp, Artificial Sequence
  Synthetic oligonucleotide
accaacgattcctgtcttgtattccgcctctatac

SEQ ID NO: 175958 - DNA, 35 bp, Artificial Sequence
  Synthetic oligonucleotide
gtgggtcaccccatcgcagcctcgcgcatctctac

SEQ ID NO: 175959 - DNA, 35 bp, Artificial Sequence
  Synthetic oligonucleotide
acttcgtcccggctcccgcttctctgacctgcacc

SEQ ID NO: 175960 - DNA, 35 bp, Artificial Sequence
  Synthetic oligonucleotide
acatctcactgcttgtttctagtctccacattacc

SEQ ID NO: 175961 - DNA, 35 bp, Artificial Sequence
  Synthetic oligonucleotide
ttgtcgaccctgtgctatcccccaattgcgttacc

SEQ ID NO: 175962 - DNA, 35 bp, Artificial Sequence
  Synthetic oligonucleotide
tcctcggctcctcgaccgcctctctcttcggaccc

SEQ ID NO: 175963 - DNA, 35 bp, Artificial Sequence
  Synthetic oligonucleotide
acctcctcgccttgaattctcggttcacgttaccc

SEQ ID NO: 175964 - DNA, 35 bp, Artificial Sequence
  Synthetic oligonucleotide
agtcaacacatgccatttcgaccccgaccgacccc

SEQ ID NO: 175965 - DNA, 35 bp, Artificial Sequence
  Synthetic oligonucleotide
ttgccgcctcgcctactgtgcccggacgttccccc

SEQ ID NO: 175966 - DNA, 32 bp, Artificial Sequence
  Synthetic oligonucleotide
gcctgtcgcactcctcctcgttgggccgcccc

SEQ ID NO: 175967 - DNA, 35 bp, Artificial Sequence
  Synthetic oligonucleotide
gcaaagaggcgcgtgctacatgccagctactcccc

SEQ ID NO: 175968 - DNA, 35 bp, Artificial Sequence
  Synthetic oligonucleotide
gaccctcccggactttatgatcataggcctagccc

SEQ ID NO: 175969 - DNA, 35 bp, Artificial Sequence
  Synthetic oligonucleotide
gtcgccccgccgccaggctcgccccgcgacatccc

SEQ ID NO: 175970 - DNA, 35 bp, Artificial Sequence
  Synthetic oligonucleotide
tacgtgcggtagtcaccgccccctgcctttttgcc

SEQ ID NO: 175971 - DNA, 35 bp, Artificial Sequence
  Synthetic oligonucleotide
tcaagcttccggcgcacctgcattccctaacctcc

SEQ ID NO: 175972 - DNA, 35 bp, Artificial Sequence
  Synthetic oligonucleotide
acagtgctgggcagggagggattcgcgggggttcc

SEQ ID NO: 175973 - DNA, 35 bp, Artificial Sequence
  Synthetic oligonucleotide
agggcccaccggaacccacctgccccgtcctttcc

SEQ ID NO: 175974 - DNA, 35 bp, Artificial Sequence
  Synthetic oligonucleotide
aacgccccggtgttggcgcatatacactcacccgc

SEQ ID NO: 175975 - DNA, 35 bp, Artificial Sequence
  Synthetic oligonucleotide
gtaacgtgcgatcatctcttcgatatcccctccgc

SEQ ID NO: 175976 - DNA, 35 bp, Artificial Sequence
  Synthetic oligonucleotide
gatgctcaaacgcacgaactctggaccaccttcgc

SEQ ID NO: 175977 - DNA, 35 bp, Artificial Sequence
  Synthetic oligonucleotide
ttctgtccgccctgctctacccgctggtctatggc

SEQ ID NO: 175978 - DNA, 35 bp, Artificial Sequence
  Synthetic oligonucleotide
gcacaacgttacacgctcccctgactcatcgctgc

SEQ ID NO: 175979 - DNA, 36 bp, Artificial Sequence
  Synthetic oligonucleotide
tgtcgccctcttctgctaagcgttcccgctcgaatc

SEQ ID NO: 175980 - DNA, 35 bp, Artificial Sequence
  Synthetic oligonucleotide
gcaccacactctcttgtctcctgtaatgtatcatc

SEQ ID NO: 175981 - DNA, 35 bp, Artificial Sequence
  Synthetic oligonucleotide
gtgtccgctgccgccatctacatactgtacgtatc

SEQ ID NO: 175982 - DNA, 35 bp, Artificial Sequence
  Synthetic oligonucleotide
tccacgcccgtggctgtttactcctgatcccactc

SEQ ID NO: 175983 - DNA, 35 bp, Artificial Sequence
  Synthetic oligonucleotide
tactccgtgggtcgtggcatcgggccccattactc

SEQ ID NO: 175984 - DNA, 34 bp, Artificial Sequence
  Synthetic oligonucleotide
gtgcctccctgttctcctagtgactctttaagtc

SEQ ID NO: 175985 - DNA, 35 bp, Artificial Sequence
  Synthetic oligonucleotide
aacttgagaagggtggtggagtaggaggagcagtc

SEQ ID NO: 175986 - DNA, 35 bp, Artificial Sequence
  Synthetic oligonucleotide
gctatgtgcctcagaatatgcccccgttgcccgtc

SEQ ID NO: 175987 - DNA, 35 bp, Artificial Sequence
  Synthetic oligonucleotide
ttatgcgtaaatgcaccagcccttatcctctcgtc

SEQ ID NO: 175988 - DNA, 35 bp, Artificial Sequence
  Synthetic oligonucleotide
atgccccgaacccgtttgccgtaggttacctattc

SEQ ID NO: 175989 - DNA, 35 bp, Artificial Sequence
  Synthetic oligonucleotide
gtccccgtccagcgcatgatttcgcgccccccttc

SEQ ID NO: 175990 - DNA, 35 bp, Artificial Sequence
  Synthetic oligonucleotide
gatgtgcgcatccatttccctgcgagctttgcttc

SEQ ID NO: 175991 - DNA, 33 bp, Artificial Sequence
  Synthetic oligonucleotide
gagacggcgagagggggggggtgctagacgttc

SEQ ID NO: 175992 - DNA, 35 bp, Artificial Sequence
  Synthetic oligonucleotide
tagatcagagcttacaattctgctgtcgccctttc

SEQ ID NO: 175993 - DNA, 35 bp, Artificial Sequence
  Synthetic oligonucleotide
gacgaccgcctggaaagttcttcgcaccatctccg

SEQ ID NO: 175994 - DNA, 35 bp, Artificial Sequence
  Synthetic oligonucleotide
aatgtggagtcggggcgggaggcacaagggaagcg

SEQ ID NO: 175995 - DNA, 35 bp, Artificial Sequence
  Synthetic oligonucleotide
taccgcccgcctctcccttgttgctctagtactcg

SEQ ID NO: 175996 - DNA, 35 bp, Artificial Sequence
  Synthetic oligonucleotide
ggttacgttccagctatgctttgcgtcctccctcg

SEQ ID NO: 175997 - DNA, 35 bp, Artificial Sequence
  Synthetic oligonucleotide
gaggggggagggatgcctcaggagcggtgggaagg

SEQ ID NO: 175998 - DNA, 35 bp, Artificial Sequence
  Synthetic oligonucleotide
gtggagggagggggtggtctagtatgggttctagg

SEQ ID NO: 175999 - DNA, 35 bp, Artificial Sequence
  Synthetic oligonucleotide
ggatgagagcgtgtgaggaggggagtaggtcaggg

SEQ ID NO: 176000 - DNA, 35 bp, Artificial Sequence
  Synthetic oligonucleotide
actcggggcaaaagagtcgggtgggatcttctggg

SEQ ID NO: 176001 - DNA, 35 bp, Artificial Sequence
  Synthetic oligonucleotide
tcgtggtggaggatcaggggaagctgggggcggtg

SEQ ID NO: 176002 - DNA, 35 bp, Artificial Sequence
  Synthetic oligonucleotide
tacgtccggcgcctcattccctattctcgatcttg

SEQ ID NO: 176003 - DNA, 35 bp, Artificial Sequence
  Synthetic oligonucleotide
ggacgcatcgccccccgacccgtttacacctgttg

SEQ ID NO: 176004 - DNA, 35 bp, Artificial Sequence
  Synthetic oligonucleotide
agtgcaccatcgtcacactgctctacatggcctat

SEQ ID NO: 176005 - DNA, 35 bp, Artificial Sequence
  Synthetic oligonucleotide
acatccctctcacgtgacaccattcagcctctact

SEQ ID NO: 176006 - DNA, 35 bp, Artificial Sequence
  Synthetic oligonucleotide
tgtcccgctgggatcatactcctgtgccacgccct

SEQ ID NO: 176007 - DNA, 35 bp, Artificial Sequence
  Synthetic oligonucleotide
ggtgcgccggtctcgcccgtgtcgtaacgctccct

SEQ ID NO: 176008 - DNA, 35 bp, Artificial Sequence
  Synthetic oligonucleotide
tgagcgctccggcgtatcctttatctgccactcct

SEQ ID NO: 176009 - DNA, 35 bp, Artificial Sequence
  Synthetic oligonucleotide
gctatggcccgccctatcacaatgcatttcttcct

SEQ ID NO: 176010 - DNA, 35 bp, Artificial Sequence
  Synthetic oligonucleotide
tgacacccgctccatccatgttcgcaacacttgct

SEQ ID NO: 176011 - DNA, 35 bp, Artificial Sequence
  Synthetic oligonucleotide
tgcaacagacgttgtggcaacctcgaccctcctct

SEQ ID NO: 176012 - DNA, 35 bp, Artificial Sequence
  Synthetic oligonucleotide
atgtatgtgtccgtggtcgcctccctcacttctgt

SEQ ID NO: 176013 - DNA, 35 bp, Artificial Sequence
  Synthetic oligonucleotide
gacatcataccgcctcactccttgtccgtccttgt

SEQ ID NO: 176014 - DNA, 35 bp, Artificial Sequence
  Synthetic oligonucleotide
gcaccatccctgctatccacgtggtcattccttgt

SEQ ID NO: 176015 - DNA, 35 bp, Artificial Sequence
  Synthetic oligonucleotide
aaccattcaccgcactttcatgcttgtcctgcctt

SEQ ID NO: 176016 - DNA, 35 bp, Artificial Sequence
  Synthetic oligonucleotide
tgtgcgtaggtcccgccgtctttgttttcgctctt

SEQ ID NO: 176017 - DNA, 35 bp, Artificial Sequence
  Synthetic oligonucleotide
tagccgacaccacacgcattggttactcatttctt

SEQ ID NO: 176018 - DNA, 35 bp, Artificial Sequence
  Synthetic oligonucleotide
tgtgcgccctgttcttaccatgactatctatcgtt

SEQ ID NO: 176019 - DNA, 35 bp, Artificial Sequence
  Synthetic oligonucleotide
ttaccaccctcgcaccggttttagtgatccttgtt

SEQ ID NO: 176020 - DNA, 35 bp, Artificial Sequence
  Synthetic oligonucleotide
actcttcaccattcgccgggattagatcacccttt

SEQ ID NO: 176021 - DNA, 36 bp, Artificial Sequence
  Synthetic oligonucleotide
gcctccgtcccctccgttcatgtccctgattttaaa

SEQ ID NO: 176022 - DNA, 36 bp, Artificial Sequence
  Synthetic oligonucleotide
ggaagtacgagacgtgaacggaggagggtggagcaa

SEQ ID NO: 176023 - DNA, 35 bp, Artificial Sequence
  Synthetic oligonucleotide
acatttgatcccgcccccttgttagtggacactaa

SEQ ID NO: 176024 - DNA, 35 bp, Artificial Sequence
  Synthetic oligonucleotide
gccactcccgtgttggcccaacccccgcaatttaa

SEQ ID NO: 176025 - DNA, 36 bp, Artificial Sequence
  Synthetic oligonucleotide
agacgtcgttgctgccacatatgccactcttccaca

SEQ ID NO: 176026 - DNA, 35 bp, Artificial Sequence
  Synthetic oligonucleotide
tccagcccgggtgtatctagtccttccatctcaca

SEQ ID NO: 176027 - DNA, 36 bp, Artificial Sequence
  Synthetic oligonucleotide
tgcccagccccgcactgaccgcattccgtgactaca

SEQ ID NO: 176028 - DNA, 36 bp, Artificial Sequence
  Synthetic oligonucleotide
atccggtgcttataaggttcttgcactcccccccca

SEQ ID NO: 176029 - DNA, 36 bp, Artificial Sequence
  Synthetic oligonucleotide
accgccccactgctctccaaagccttgtgcccccca

SEQ ID NO: 176030 - DNA, 35 bp, Artificial Sequence
  Synthetic oligonucleotide
gtaacatcttccgcgtaccgccacacgtttatcca

SEQ ID NO: 176031 - DNA, 34 bp, Artificial Sequence
  Synthetic oligonucleotide
tattccacgccaatcctgcggtttcgagtttcca

SEQ ID NO: 176032 - DNA, 35 bp, Artificial Sequence
  Synthetic oligonucleotide
atggcaatgctcgatcacggcccctctcttcagca

SEQ ID NO: 176033 - DNA, 35 bp, Artificial Sequence
  Synthetic oligonucleotide
attgcctgttcatccgccgactcttatcccacgca

SEQ ID NO: 176034 - DNA, 36 bp, Artificial Sequence
  Synthetic oligonucleotide
ccgcccccactgatattggctccctgacccctcgca

SEQ ID NO: 176035 - DNA, 35 bp, Artificial Sequence
  Synthetic oligonucleotide
actgagggaaagagggggagattacgaaggagtca

SEQ ID NO: 176036 - DNA, 36 bp, Artificial Sequence
  Synthetic oligonucleotide
gcacgcaattgccacgtttccatgccgtctttttca

SEQ ID NO: 176037 - DNA, 37 bp, Artificial Sequence
  Synthetic oligonucleotide
tgcgaagggacgggaagggttcggagggccttacaga

SEQ ID NO: 176038 - DNA, 37 bp, Artificial Sequence
  Synthetic oligonucleotide
atgaccacctcgccgcctgtccccacggtttcccaga

SEQ ID NO: 176039 - DNA, 37 bp, Artificial Sequence
  Synthetic oligonucleotide
tagtgcctcctcgatccctttttttgccttctccaga

SEQ ID NO: 176040 - DNA, 36 bp, Artificial Sequence
  Synthetic oligonucleotide
aagatgggcgaattaaggggcataaggggtggtaga

SEQ ID NO: 176041 - DNA, 37 bp, Artificial Sequence
  Synthetic oligonucleotide
gcacggtccgcctcgaatcgctcctcaattgcaccga

SEQ ID NO: 176042 - DNA, 37 bp, Artificial Sequence
  Synthetic oligonucleotide
gcgagcacacatgttctgccgccgacgttcaccccga

SEQ ID NO: 176043 - DNA, 36 bp, Artificial Sequence
  Synthetic oligonucleotide
tgacccgatactgccgctcctgaactacatctccga

SEQ ID NO: 176044 - DNA, 37 bp, Artificial Sequence
  Synthetic oligonucleotide
taacgactccactcccctgcccgacacttgtgtccga

SEQ ID NO: 176045 - DNA, 35 bp, Artificial Sequence
  Synthetic oligonucleotide
ttgatgtgccgggcgggttgggcactgccgggcga

SEQ ID NO: 176046 - DNA, 36 bp, Artificial Sequence
  Synthetic oligonucleotide
ttcggtatggcaatgcatgggggagtgggggggcga

SEQ ID NO: 176047 - DNA, 37 bp, Artificial Sequence
  Synthetic oligonucleotide
tacctccctctgagtgtgcatctttcttccctggcga

SEQ ID NO: 176048 - DNA, 37 bp, Artificial Sequence
  Synthetic oligonucleotide
aataaggcaatcgaggtgggggagggcggaaggagga

SEQ ID NO: 176049 - DNA, 37 bp, Artificial Sequence
  Synthetic oligonucleotide
gaagtgggaggagcatacggcacgggggtaggtagga

SEQ ID NO: 176050 - DNA, 36 bp, Artificial Sequence
  Synthetic oligonucleotide
tagctgaaccgcccgctcccagaccctgccaacgga

SEQ ID NO: 176051 - DNA, 37 bp, Artificial Sequence
  Synthetic oligonucleotide
gtccacccgcccttagccctttccgtcgtatcacgga

SEQ ID NO: 176052 - DNA, 35 bp, Artificial Sequence
  Synthetic oligonucleotide
aggaaggggggagggagggttccagggcacgcgga

SEQ ID NO: 176053 - DNA, 36 bp, Artificial Sequence
  Synthetic oligonucleotide
agggacggtgggtggaattgggccgaatgaagggga

SEQ ID NO: 176054 - DNA, 35 bp, Artificial Sequence
  Synthetic oligonucleotide
taggggtggggattatttcgtggggccgtagggga

SEQ ID NO: 176055 - DNA, 35 bp, Artificial Sequence
  Synthetic oligonucleotide
gataatcagagagtggatgggtggctgggatggga

SEQ ID NO: 176056 - DNA, 36 bp, Artificial Sequence
  Synthetic oligonucleotide
agaagcacaagcagggcgtgtctcgggggggtggga

SEQ ID NO: 176057 - DNA, 36 bp, Artificial Sequence
  Synthetic oligonucleotide
actcgccctcctcccgccgtgcgaatgaactatgga

SEQ ID NO: 176058 - DNA, 37 bp, Artificial Sequence
  Synthetic oligonucleotide
taaggtggaggcggggttggactgacagcatggtgga

SEQ ID NO: 176059 - DNA, 36 bp, Artificial Sequence
  Synthetic oligonucleotide
tagggagggcacgggtcggtggtggggggaattgga

SEQ ID NO: 176060 - DNA, 37 bp, Artificial Sequence
  Synthetic oligonucleotide
tcccgccccccgcatgcttcttgacatctggtcatga

SEQ ID NO: 176061 - DNA, 37 bp, Artificial Sequence
  Synthetic oligonucleotide
gccgagcccgtggtcgtccctctttgcattttcatga

SEQ ID NO: 176062 - DNA, 37 bp, Artificial Sequence
  Synthetic oligonucleotide
gatgagggcgggtgggcatgtagtgtagttgggatga

SEQ ID NO: 176063 - DNA, 38 bp, Artificial Sequence
  Synthetic oligonucleotide
ttctaccgcagcaccacgccaccctttcgtcgcactga

SEQ ID NO: 176064 - DNA, 38 bp, Artificial Sequence
  Synthetic oligonucleotide
atcagtgcgcctgccccttgcacctagtcctctactga

SEQ ID NO: 176065 - DNA, 38 bp, Artificial Sequence
  Synthetic oligonucleotide
gtaccagtcatacagccgttcttcccacctgtccctga

SEQ ID NO: 176066 - DNA, 37 bp, Artificial Sequence
  Synthetic oligonucleotide
tctcgggaggaaagggcatgacgggggaagaagctga

SEQ ID NO: 176067 - DNA, 37 bp, Artificial Sequence
  Synthetic oligonucleotide
gaggggggagggggcgcgagtaggagggtccatctga

SEQ ID NO: 176068 - DNA, 38 bp, Artificial Sequence
  Synthetic oligonucleotide
gaggtggggcaagggggtatgccagagcaggagggtga

SEQ ID NO: 176069 - DNA, 38 bp, Artificial Sequence
  Synthetic oligonucleotide
ggggggggaggagggcgttacgagagtacgtggggtga

SEQ ID NO: 176070 - DNA, 38 bp, Artificial Sequence
  Synthetic oligonucleotide
accgagtgaagggggatgggacaaagtatgaatggtga

SEQ ID NO: 176071 - DNA, 38 bp, Artificial Sequence
  Synthetic oligonucleotide
ttcgacccctgcctcttgtcacagttcatcgcatgtga

SEQ ID NO: 176072 - DNA, 38 bp, Artificial Sequence
  Synthetic oligonucleotide
gcacgaacgggacaaatggggcagggagggagatgtga

SEQ ID NO: 176073 - DNA, 37 bp, Artificial Sequence
  Synthetic oligonucleotide
tatcaacccacgattctgcggtcgctatatctcttga

SEQ ID NO: 176074 - DNA, 36 bp, Artificial Sequence
  Synthetic oligonucleotide
tcccgtcaccgctagtcgtttctatcgccgctcata

SEQ ID NO: 176075 - DNA, 36 bp, Artificial Sequence
  Synthetic oligonucleotide
gattccgtcgcattcgtaacgtcctatctctcacta

SEQ ID NO: 176076 - DNA, 36 bp, Artificial Sequence
  Synthetic oligonucleotide
tgccctcctggcctcaccgtttaatgcgctccccta

SEQ ID NO: 176077 - DNA, 35 bp, Artificial Sequence
  Synthetic oligonucleotide
gccaccctgccccccctgtttatatccgagagcta

SEQ ID NO: 176078 - DNA, 36 bp, Artificial Sequence
  Synthetic oligonucleotide
tattgtccccgcctgcccgtttttgttctacgcgta

SEQ ID NO: 176079 - DNA, 36 bp, Artificial Sequence
  Synthetic oligonucleotide
ggggaggtgaaatcggagaatggagggggcggggta

SEQ ID NO: 176080 - DNA, 35 bp, Artificial Sequence
  Synthetic oligonucleotide
tcccaaccgtggttgcgtgatccacctaaacctta

SEQ ID NO: 176081 - DNA, 36 bp, Artificial Sequence
  Synthetic oligonucleotide
tgtccagatgcactcgatttctgcccccgcccctta

SEQ ID NO: 176082 - DNA, 36 bp, Artificial Sequence
  Synthetic oligonucleotide
ttcgttgccgttcacttccgtcgattggctccctta

SEQ ID NO: 176083 - DNA, 36 bp, Artificial Sequence
  Synthetic oligonucleotide
atcaacccaccgcgccccttgcctcgacactgttta

SEQ ID NO: 176084 - DNA, 35 bp, Artificial Sequence
  Synthetic oligonucleotide
tacatccaccaacccacctgtacatatagtcacac

SEQ ID NO: 176085 - DNA, 35 bp, Artificial Sequence
  Synthetic oligonucleotide
atcctatggatgcggccgtccatgattcccgccac

SEQ ID NO: 176086 - DNA, 35 bp, Artificial Sequence
  Synthetic oligonucleotide
gatgccgttgagttgctccataccgcccggtccac

SEQ ID NO: 176087 - DNA, 35 bp, Artificial Sequence
  Synthetic oligonucleotide
aaccgagccctcctccgtacaaaatgacgtggcac

SEQ ID NO: 176088 - DNA, 35 bp, Artificial Sequence
  Synthetic oligonucleotide
ttgtgcgtgctcagcctcctagccttcattctcac

SEQ ID NO: 176089 - DNA, 35 bp, Artificial Sequence
  Synthetic oligonucleotide
gacaccttgagtgctatttctcgcctacttatgac

SEQ ID NO: 176090 - DNA, 35 bp, Artificial Sequence
  Synthetic oligonucleotide
agcctcaccaatgccatcgcgccaccactgttgac

SEQ ID NO: 176091 - DNA, 35 bp, Artificial Sequence
  Synthetic oligonucleotide
tacctcgtcggacccgttcccccgttaactcctac

SEQ ID NO: 176092 - DNA, 34 bp, Artificial Sequence
  Synthetic oligonucleotide
tacttcagtccgcgccggcaacctccctgcgtac

SEQ ID NO: 176093 - DNA, 35 bp, Artificial Sequence
  Synthetic oligonucleotide
ataccaccctccttacgcgcgcacatttagcttac

SEQ ID NO: 176094 - DNA, 35 bp, Artificial Sequence
  Synthetic oligonucleotide
tctactccccacaccaataaggtacctgcctttac

SEQ ID NO: 176095 - DNA, 34 bp, Artificial Sequence
  Synthetic oligonucleotide
gatgacagtgtacctacctcctgttttatcaacc

SEQ ID NO: 176096 - DNA, 35 bp, Artificial Sequence
  Synthetic oligonucleotide
tccgcaacacaccatacactccccttgggacaccc

SEQ ID NO: 176097 - DNA, 35 bp, Artificial Sequence
  Synthetic oligonucleotide
gtcaacgcaagcctatgcgccactcttgccgaccc

SEQ ID NO: 176098 - DNA, 33 bp, Artificial Sequence
  Synthetic oligonucleotide
tcctgagtcaatttgatccaactgtcacccccc

SEQ ID NO: 176099 - DNA, 35 bp, Artificial Sequence
  Synthetic oligonucleotide
tcgagcagattcacctttccgttcgcctccgcccc

SEQ ID NO: 176100 - DNA, 35 bp, Artificial Sequence
  Synthetic oligonucleotide
taagcacagtgtgggtaagccattgccctcctccc

SEQ ID NO: 176101 - DNA, 35 bp, Artificial Sequence
  Synthetic oligonucleotide
agcccgaccgtcactctttctttatcgaccttccc

SEQ ID NO: 176102 - DNA, 35 bp, Artificial Sequence
  Synthetic oligonucleotide
tagcccaatcctcgcatctgctctgtccaccagcc

SEQ ID NO: 176103 - DNA, 35 bp, Artificial Sequence
  Synthetic oligonucleotide
tctgattccacctgaggtccgggtccacttccgcc

SEQ ID NO: 176104 - DNA, 35 bp, Artificial Sequence
  Synthetic oligonucleotide
acacccatccctcgcggccctgtagttcgctcgcc

SEQ ID NO: 176105 - DNA, 35 bp, Artificial Sequence
  Synthetic oligonucleotide
tagtcgagacagtcagtaaatattcgtccccctcc

SEQ ID NO: 176106 - DNA, 35 bp, Artificial Sequence
  Synthetic oligonucleotide
tgggcctcccaccctgtgtaccttcgtgcctgtcc

SEQ ID NO: 176107 - DNA, 35 bp, Artificial Sequence
  Synthetic oligonucleotide
gcccaagccactgttgctcccgacctcgttattcc

SEQ ID NO: 176108 - DNA, 31 bp, Artificial Sequence
  Synthetic oligonucleotide
gacatgacgccaacatccctgggcgctttcc

SEQ ID NO: 176109 - DNA, 35 bp, Artificial Sequence
  Synthetic oligonucleotide
acctcatgctacgttctgccgctcaggccttttcc

SEQ ID NO: 176110 - DNA, 35 bp, Artificial Sequence
  Synthetic oligonucleotide
aaccctcgccagagactccacgcgccccacacagc

SEQ ID NO: 176111 - DNA, 35 bp, Artificial Sequence
  Synthetic oligonucleotide
gcatcacgcgagtgagctaccccatcccttccagc

SEQ ID NO: 176112 - DNA, 35 bp, Artificial Sequence
  Synthetic oligonucleotide
tccgcgcctcccgctgctttctgttgcatcaccgc

SEQ ID NO: 176113 - DNA, 35 bp, Artificial Sequence
  Synthetic oligonucleotide
tgtgtcgcgctcccagacctcccgtttcgatatgc

SEQ ID NO: 176114 - DNA, 35 bp, Artificial Sequence
  Synthetic oligonucleotide
tcagtgccgttctcgactgttctcttttatactgc

SEQ ID NO: 176115 - DNA, 35 bp, Artificial Sequence
  Synthetic oligonucleotide
gtgttcactccatacgcaccgcccacaatgcctgc

SEQ ID NO: 176116 - DNA, 35 bp, Artificial Sequence
  Synthetic oligonucleotide
gctcaccccgccactatggaagtgttcctccttgc

SEQ ID NO: 176117 - DNA, 35 bp, Artificial Sequence
  Synthetic oligonucleotide
tgaggtgtatccccgcggttgccctctcgctcatc

SEQ ID NO: 176118 - DNA, 35 bp, Artificial Sequence
  Synthetic oligonucleotide
gttgtgccaggcgccctccatccgattcctgtatc

SEQ ID NO: 176119 - DNA, 35 bp, Artificial Sequence
  Synthetic oligonucleotide
gggtgtggggggcgggctttcgtcagattccactc

SEQ ID NO: 176120 - DNA, 35 bp, Artificial Sequence
  Synthetic oligonucleotide
atgcgctcgacgcatttgtcacacctccgcccctc

SEQ ID NO: 176121 - DNA, 35 bp, Artificial Sequence
  Synthetic oligonucleotide
atgatccacaatacgtaccgatgagcgctcccctc

SEQ ID NO: 176122 - DNA, 35 bp, Artificial Sequence
  Synthetic oligonucleotide
tcccgcctaaccgcatcacgctcggtagactcctc

SEQ ID NO: 176123 - DNA, 35 bp, Artificial Sequence
  Synthetic oligonucleotide
gacctgaccacgattcgcattatcgctccctgctc

SEQ ID NO: 176124 - DNA, 34 bp, Artificial Sequence
  Synthetic oligonucleotide
gacatccctttggccgccacgtaccctgcttctc

SEQ ID NO: 176125 - DNA, 35 bp, Artificial Sequence
  Synthetic oligonucleotide
agcgactctcacggtcatactcgcacccacctgtc

SEQ ID NO: 176126 - DNA, 35 bp, Artificial Sequence
  Synthetic oligonucleotide
tgctacaccccgccgagttatacttgaatattgtc

SEQ ID NO: 176127 - DNA, 35 bp, Artificial Sequence
  Synthetic oligonucleotide
tgtgagtatctgtccccttatttcgccggcccttc

SEQ ID NO: 176128 - DNA, 35 bp, Artificial Sequence
  Synthetic oligonucleotide
ttgaccgacctgcacacccctcgactacactcttc

SEQ ID NO: 176129 - DNA, 35 bp, Artificial Sequence
  Synthetic oligonucleotide
acctccctcctcctacttgtgcgatccattgtaag

SEQ ID NO: 176130 - DNA, 35 bp, Artificial Sequence
  Synthetic oligonucleotide
gcctgccacccccctgccatacgtcccggacacag

SEQ ID NO: 176131 - DNA, 35 bp, Artificial Sequence
  Synthetic oligonucleotide
ggtggtgcatggaagtaggtgggcggagagcacag

SEQ ID NO: 176132 - DNA, 35 bp, Artificial Sequence
  Synthetic oligonucleotide
ggtgtccgcccgttcctccgttcacaacgctctag

SEQ ID NO: 176133 - DNA, 35 bp, Artificial Sequence
  Synthetic oligonucleotide
gtcacccaactctcgccgttttgccctctttaacg

SEQ ID NO: 176134 - DNA, 35 bp, Artificial Sequence
  Synthetic oligonucleotide
acatgtgcctcatgtcaccttcaccccaagattcg

SEQ ID NO: 176135 - DNA, 35 bp, Artificial Sequence
  Synthetic oligonucleotide
ggggatggagcagggggcgagacaaagaaaaaggg

SEQ ID NO: 176136 - DNA, 36 bp, Artificial Sequence
  Synthetic oligonucleotide
gaaggggagtaggggcagtgaggagtggtagtgggg

SEQ ID NO: 176137 - DNA, 35 bp, Artificial Sequence
  Synthetic oligonucleotide
acctgacccgccggggcgatcgccaccccctttgg

SEQ ID NO: 176138 - DNA, 35 bp, Artificial Sequence
  Synthetic oligonucleotide
actagcccgctatctccttacctccgccttgactg

SEQ ID NO: 176139 - DNA, 35 bp, Artificial Sequence
  Synthetic oligonucleotide
gtctcaaccgtcctgcatccgatcctcacgtactg

SEQ ID NO: 176140 - DNA, 35 bp, Artificial Sequence
  Synthetic oligonucleotide
tgctcctattgcccctatcgtcgccccctgtcctg

SEQ ID NO: 176141 - DNA, 35 bp, Artificial Sequence
  Synthetic oligonucleotide
tgttgtgtcaatctccagtccttcgccccttcttg

SEQ ID NO: 176142 - DNA, 35 bp, Artificial Sequence
  Synthetic oligonucleotide
atcattctgtcctcctcgctgtactacaccttttg

SEQ ID NO: 176143 - DNA, 35 bp, Artificial Sequence
  Synthetic oligonucleotide
ttaccctcgcccctcatctggccacccaagttttg

SEQ ID NO: 176144 - DNA, 35 bp, Artificial Sequence
  Synthetic oligonucleotide
atccacgtcgggcttccattcgtcctcctaaccat

SEQ ID NO: 176145 - DNA, 35 bp, Artificial Sequence
  Synthetic oligonucleotide
gccccaggtgtcccatcccctccgtttctcttcat

SEQ ID NO: 176146 - DNA, 36 bp, Artificial Sequence
  Synthetic oligonucleotide
tgcatgctgggtgggaggggcaaatcgggcccttat

SEQ ID NO: 176147 - DNA, 35 bp, Artificial Sequence
  Synthetic oligonucleotide
acacaccctcggtccctccaccagtaatcagttat

SEQ ID NO: 176148 - DNA, 35 bp, Artificial Sequence
  Synthetic oligonucleotide
ttgcatgtccacgaacttctcgctatcctgcccct

SEQ ID NO: 176149 - DNA, 35 bp, Artificial Sequence
  Synthetic oligonucleotide
aatctaacatgccactgtagcaccctactgatcct

SEQ ID NO: 176150 - DNA, 35 bp, Artificial Sequence
  Synthetic oligonucleotide
tttgtgtgccggcctcccctccctatgactgtgct

SEQ ID NO: 176151 - DNA, 35 bp, Artificial Sequence
  Synthetic oligonucleotide
tgacatgtctgatgctctacggtttcctcccctct

SEQ ID NO: 176152 - DNA, 35 bp, Artificial Sequence
  Synthetic oligonucleotide
accgctcgctacacctcgccaggctttttgcctct

SEQ ID NO: 176153 - DNA, 35 bp, Artificial Sequence
  Synthetic oligonucleotide
tggtcgttgtcgtttgtcctgttcccccatcctct

SEQ ID NO: 176154 - DNA, 34 bp, Artificial Sequence
  Synthetic oligonucleotide
tctcccacccgcgaatcttaatgctctaggctct

SEQ ID NO: 176155 - DNA, 34 bp, Artificial Sequence
  Synthetic oligonucleotide
gcaagacgcggcctcactcctcttcaccacgtct

SEQ ID NO: 176156 - DNA, 35 bp, Artificial Sequence
  Synthetic oligonucleotide
tgcatgcgcacttggttccatctttagtattgtct

SEQ ID NO: 176157 - DNA, 35 bp, Artificial Sequence
  Synthetic oligonucleotide
gaagggaccgggggggaaatgggatctgttgaggt

SEQ ID NO: 176158 - DNA, 35 bp, Artificial Sequence
  Synthetic oligonucleotide
atggacatgtctccccccccacctgcagttgctgt

SEQ ID NO: 176159 - DNA, 35 bp, Artificial Sequence
  Synthetic oligonucleotide
tttcgccacgccgcacattgaccgcacatgctatt

SEQ ID NO: 176160 - DNA, 35 bp, Artificial Sequence
  Synthetic oligonucleotide
gttcctgctccctttggttttaaccccccctggtt

SEQ ID NO: 176161 - DNA, 36 bp, Artificial Sequence
  Synthetic oligonucleotide
gtgggaggagggggcattcacgtggtaggagcgcaa

SEQ ID NO: 176162 - DNA, 36 bp, Artificial Sequence
  Synthetic oligonucleotide
tacctgccgggggggggtaaaattctggggagggaa

SEQ ID NO: 176163 - DNA, 36 bp, Artificial Sequence
  Synthetic oligonucleotide
tagcctcacccgctgcctttaatgccaatcattgaa

SEQ ID NO: 176164 - DNA, 36 bp, Artificial Sequence
  Synthetic oligonucleotide
taggtggggagaaaagatcgaaggggggggaacaca

SEQ ID NO: 176165 - DNA, 36 bp, Artificial Sequence
  Synthetic oligonucleotide
gcccccatctcatgcgcacctgccaaaactgacaca

SEQ ID NO: 176166 - DNA, 35 bp, Artificial Sequence
  Synthetic oligonucleotide
gtgtgaacgtggaggatcaagcaggagaggtcaca

SEQ ID NO: 176167 - DNA, 35 bp, Artificial Sequence
  Synthetic oligonucleotide
aacaccatcaatcagactgcctctgtcaaccacca

SEQ ID NO: 176168 - DNA, 36 bp, Artificial Sequence
  Synthetic oligonucleotide
tcccactatccacttctgggcatagacacaccacca

SEQ ID NO: 176169 - DNA, 35 bp, Artificial Sequence
  Synthetic oligonucleotide
acccccgcgaccgcccaggcttagcctaacaccca

SEQ ID NO: 176170 - DNA, 36 bp, Artificial Sequence
  Synthetic oligonucleotide
accagcctcaagttgtacgctcatgcccccccccca

SEQ ID NO: 176171 - DNA, 35 bp, Artificial Sequence
  Synthetic oligonucleotide
tgaccatcccagccctcctctcgatcggtgcccca

SEQ ID NO: 176172 - DNA, 36 bp, Artificial Sequence
  Synthetic oligonucleotide
aacgcagccaagccttatgtcactcgtctctgccca

SEQ ID NO: 176173 - DNA, 36 bp, Artificial Sequence
  Synthetic oligonucleotide
taccccccaaagtgcatttcgtgcctggcaatccca

SEQ ID NO: 176174 - DNA, 36 bp, Artificial Sequence
  Synthetic oligonucleotide
agggccaaccttcacgcttgctcagaccctgctcca

SEQ ID NO: 176175 - DNA, 35 bp, Artificial Sequence
  Synthetic oligonucleotide
taccggtcaggagcccaccgccgattgcttttcca

SEQ ID NO: 176176 - DNA, 36 bp, Artificial Sequence
  Synthetic oligonucleotide
aaaagagcgggcgggtaggttaaggggatgcgggca

SEQ ID NO: 176177 - DNA, 36 bp, Artificial Sequence
  Synthetic oligonucleotide
ttaccgcgcctcataccgatttacactcaccctgca

SEQ ID NO: 176178 - DNA, 36 bp, Artificial Sequence
  Synthetic oligonucleotide
gacccagccgcacccgcgtggaatacaactctatca

SEQ ID NO: 176179 - DNA, 36 bp, Artificial Sequence
  Synthetic oligonucleotide
agcccccctcggtcgcatggccggtactttacctca

SEQ ID NO: 176180 - DNA, 36 bp, Artificial Sequence
  Synthetic oligonucleotide
ttgtactaccccagccgccatcgatagcaagcctca

SEQ ID NO: 176181 - DNA, 35 bp, Artificial Sequence
  Synthetic oligonucleotide
gaccgacctcagcttccatatttctcttgcgctca

SEQ ID NO: 176182 - DNA, 36 bp, Artificial Sequence
  Synthetic oligonucleotide
actagcagggtaggaatggatgggggccggggctca

SEQ ID NO: 176183 - DNA, 36 bp, Artificial Sequence
  Synthetic oligonucleotide
tgagttgcccgccaatgacgccataaccccctttca

SEQ ID NO: 176184 - DNA, 37 bp, Artificial Sequence
  Synthetic oligonucleotide
tcacaagggggtgttgaggaaggtgaagtaggaaaga

SEQ ID NO: 176185 - DNA, 37 bp, Artificial Sequence
  Synthetic oligonucleotide
tcacatagggaggggtgggtgtaagtaaacgggtaga

SEQ ID NO: 176186 - DNA, 37 bp, Artificial Sequence
  Synthetic oligonucleotide
tctgcctggccgttccattggtctatccacctcacga

SEQ ID NO: 176187 - DNA, 37 bp, Artificial Sequence
  Synthetic oligonucleotide
aacggaatggaggatagtaggtggagcacgaggacga

SEQ ID NO: 176188 - DNA, 37 bp, Artificial Sequence
  Synthetic oligonucleotide
gccactcgtaccttccctgctattagggcaccaccga

SEQ ID NO: 176189 - DNA, 36 bp, Artificial Sequence
  Synthetic oligonucleotide
tgtgacacgcgctgcctggcctttcaaacaacccga

SEQ ID NO: 176190 - DNA, 36 bp, Artificial Sequence
  Synthetic oligonucleotide
tgccccacaccttatgatctgttgcctgtgatccga

SEQ ID NO: 176191 - DNA, 37 bp, Artificial Sequence
  Synthetic oligonucleotide
attgagaggtggagggaactgtaaggggcaagagcga

SEQ ID NO: 176192 - DNA, 37 bp, Artificial Sequence
  Synthetic oligonucleotide
ttgccgctcaaatctcctccgatgcctcgactctcga

SEQ ID NO: 176193 - DNA, 36 bp, Artificial Sequence
  Synthetic oligonucleotide
gaccccttcgccccgctttcgtataagcacttagga

SEQ ID NO: 176194 - DNA, 37 bp, Artificial Sequence
  Synthetic oligonucleotide
gaaagcggctgaactcgttccttccccctctcgcgga

SEQ ID NO: 176195 - DNA, 35 bp, Artificial Sequence
  Synthetic oligonucleotide
gacaccctatgctcacccatcatcgcctcttggga

SEQ ID NO: 176196 - DNA, 37 bp, Artificial Sequence
  Synthetic oligonucleotide
gccaggtcctttcgttctgttttaccatcttcctgga

SEQ ID NO: 176197 - DNA, 35 bp, Artificial Sequence
  Synthetic oligonucleotide
accatccccctgccttccgccttctcgcatgtgga

SEQ ID NO: 176198 - DNA, 37 bp, Artificial Sequence
  Synthetic oligonucleotide
gacagtgcggtggggaagtaccggggaataggaatga

SEQ ID NO: 176199 - DNA, 38 bp, Artificial Sequence
  Synthetic oligonucleotide
acaccgccttgttctttccgccctgtcagaaggcctga

SEQ ID NO: 176200 - DNA, 37 bp, Artificial Sequence
  Synthetic oligonucleotide
gtcgcgcattcccaccttttgtttccggtcctcctga

SEQ ID NO: 176201 - DNA, 37 bp, Artificial Sequence
  Synthetic oligonucleotide
atgcgctccctctatcgccagttaccttccgtcctga

SEQ ID NO: 176202 - DNA, 36 bp, Artificial Sequence
  Synthetic oligonucleotide
gcgccaccccccgcctgaccgttcgccacctagtga

SEQ ID NO: 176203 - DNA, 38 bp, Artificial Sequence
  Synthetic oligonucleotide
tcgggagggaggatcaggggggggcggcctggaggtga

SEQ ID NO: 176204 - DNA, 38 bp, Artificial Sequence
  Synthetic oligonucleotide
gagaacaggcagggaaatgggggggtggaatcatgtga

SEQ ID NO: 176205 - DNA, 38 bp, Artificial Sequence
  Synthetic oligonucleotide
gaacgccgcctgcctaatttactcccccccgtgtgtga

SEQ ID NO: 176206 - DNA, 38 bp, Artificial Sequence
  Synthetic oligonucleotide
accgatcccccgatccgttttgtttccctggtccttga

SEQ ID NO: 176207 - DNA, 37 bp, Artificial Sequence
  Synthetic oligonucleotide
gattacgctccctctcagccactgtccaacgagttga

SEQ ID NO: 176208 - DNA, 36 bp, Artificial Sequence
  Synthetic oligonucleotide
ttaggtcgccccacgcattgcccctcaaacctttga

SEQ ID NO: 176209 - DNA, 36 bp, Artificial Sequence
  Synthetic oligonucleotide
agcggatcagggaaggggaagggaggttgggtttga

SEQ ID NO: 176210 - DNA, 36 bp, Artificial Sequence
  Synthetic oligonucleotide
gtctactccccccgcgcatgtttcaacgagttgata

SEQ ID NO: 176211 - DNA, 36 bp, Artificial Sequence
  Synthetic oligonucleotide
acatccgttcctcctcagcttgcgtgccttcaacta

SEQ ID NO: 176212 - DNA, 35 bp, Artificial Sequence
  Synthetic oligonucleotide
gtgcctggcctgctgcgtttcttcttaggctccta

SEQ ID NO: 176213 - DNA, 36 bp, Artificial Sequence
  Synthetic oligonucleotide
gacactctacgctgcctgatcaccccagtcctgcta

SEQ ID NO: 176214 - DNA, 35 bp, Artificial Sequence
  Synthetic oligonucleotide
ttgtgctcgctactgccccgctcatttcacccgta

SEQ ID NO: 176215 - DNA, 36 bp, Artificial Sequence
  Synthetic oligonucleotide
gtgcacccgccaccagttatcacctctgtacaggta

SEQ ID NO: 176216 - DNA, 36 bp, Artificial Sequence
  Synthetic oligonucleotide
gactaggcggttaaacatggaggggtggaggcggta

SEQ ID NO: 176217 - DNA, 35 bp, Artificial Sequence
  Synthetic oligonucleotide
ttttcgaaccgccctgctgcctctctctacctgta

SEQ ID NO: 176218 - DNA, 36 bp, Artificial Sequence
  Synthetic oligonucleotide
ggtgccaaccccttaatgtacgtcgtccctgcctta

SEQ ID NO: 176219 - DNA, 35 bp, Artificial Sequence
  Synthetic oligonucleotide
tcgcctcggtcttccgctgggcttctcctccacac

SEQ ID NO: 176220 - DNA, 35 bp, Artificial Sequence
  Synthetic oligonucleotide
ggacagtcccgttgctgcacccaatatgtcctcac

SEQ ID NO: 176221 - DNA, 35 bp, Artificial Sequence
  Synthetic oligonucleotide
gtgtcccacggctattaccttagtggctcccctac

SEQ ID NO: 176222 - DNA, 35 bp, Artificial Sequence
  Synthetic oligonucleotide
aagccctcgccggtcttcgaaccacaccatctacc

SEQ ID NO: 176223 - DNA, 35 bp, Artificial Sequence
  Synthetic oligonucleotide
tatcgcgcgctcatgtagcagtctcgattcccccc

SEQ ID NO: 176224 - DNA, 35 bp, Artificial Sequence
  Synthetic oligonucleotide
gatgcgacccagttcccgcccccgcggatgtcccc

SEQ ID NO: 176225 - DNA, 35 bp, Artificial Sequence
  Synthetic oligonucleotide
tcccacgcccaaagcactaaccgcctctctagccc

SEQ ID NO: 176226 - DNA, 35 bp, Artificial Sequence
  Synthetic oligonucleotide
gtgccagctttgcatttagctatcgcctcgctccc

SEQ ID NO: 176227 - DNA, 35 bp, Artificial Sequence
  Synthetic oligonucleotide
gcaagcaactcgcagtccttttgcctgtcattccc

SEQ ID NO: 176228 - DNA, 35 bp, Artificial Sequence
  Synthetic oligonucleotide
gcacggcaagtctcggctccatcgttttagttccc

SEQ ID NO: 176229 - DNA, 35 bp, Artificial Sequence
  Synthetic oligonucleotide
tgccgtcacagcccttcgcagcccgcctcaacgcc

SEQ ID NO: 176230 - DNA, 35 bp, Artificial Sequence
  Synthetic oligonucleotide
gtcgggactccgtaaccatctatactatcgctgcc

SEQ ID NO: 176231 - DNA, 35 bp, Artificial Sequence
  Synthetic oligonucleotide
tatgtgccgcccgcctacggttgttcctccgctcc

SEQ ID NO: 176232 - DNA, 35 bp, Artificial Sequence
  Synthetic oligonucleotide
gaaaaggcccgcctcgcccttctggtccaacttcc

SEQ ID NO: 176233 - DNA, 35 bp, Artificial Sequence
  Synthetic oligonucleotide
acattcacgacgacttcctgggcctaacacatcgc

SEQ ID NO: 176234 - DNA, 35 bp, Artificial Sequence
  Synthetic oligonucleotide
ttgtcctgtcccccggttcctggttctattcatgc

SEQ ID NO: 176235 - DNA, 35 bp, Artificial Sequence
  Synthetic oligonucleotide
gcctgtcagtgatacgcgtccttttcctgtcctgc

SEQ ID NO: 176236 - DNA, 36 bp, Artificial Sequence
  Synthetic oligonucleotide
gagacgacgccttcatcactgttttcctgcttaatc

SEQ ID NO: 176237 - DNA, 35 bp, Artificial Sequence
  Synthetic oligonucleotide
tgtcgccggactagcccttacttgagtccaccatc

SEQ ID NO: 176238 - DNA, 35 bp, Artificial Sequence
  Synthetic oligonucleotide
gcctcatctcattgttaatcgatcgtgcccccatc

SEQ ID NO: 176239 - DNA, 35 bp, Artificial Sequence
  Synthetic oligonucleotide
acgacctgccatcatccgccacgtacccgacgatc

SEQ ID NO: 176240 - DNA, 35 bp, Artificial Sequence
  Synthetic oligonucleotide
gccacgtgtgctcctgtgttacccatgccgttctc

SEQ ID NO: 176241 - DNA, 35 bp, Artificial Sequence
  Synthetic oligonucleotide
ttcgcccctgcccctctcgtgcatgtttcacattc

SEQ ID NO: 176242 - DNA, 35 bp, Artificial Sequence
  Synthetic oligonucleotide
taccactccaccaccgccatgggattgcgcccttc

SEQ ID NO: 176243 - DNA, 35 bp, Artificial Sequence
  Synthetic oligonucleotide
tccagctgcccacttcgtatgctcctttgttcttc

SEQ ID NO: 176244 - DNA, 35 bp, Artificial Sequence
  Synthetic oligonucleotide
actgtccgacgcctcgctcccattgtcccccgaag

SEQ ID NO: 176245 - DNA, 35 bp, Artificial Sequence
  Synthetic oligonucleotide
aacccgaccctccgcatcaacccacctttgtccag

SEQ ID NO: 176246 - DNA, 36 bp, Artificial Sequence
  Synthetic oligonucleotide
tgtcacagcctttccacctgcatgttcccattctag

SEQ ID NO: 176247 - DNA, 35 bp, Artificial Sequence
  Synthetic oligonucleotide
tgcgcccttgcaccagtctccaatcccgtttaccg

SEQ ID NO: 176248 - DNA, 35 bp, Artificial Sequence
  Synthetic oligonucleotide
cacgcctccctacactaatagtacatatatcctcg

SEQ ID NO: 176249 - DNA, 35 bp, Artificial Sequence
  Synthetic oligonucleotide
aacctgcccccgtcacctaatcccaaccttctagg

SEQ ID NO: 176250 - DNA, 35 bp, Artificial Sequence
  Synthetic oligonucleotide
atccgccatgccaacctctatcgcgacttcccggg

SEQ ID NO: 176251 - DNA, 35 bp, Artificial Sequence
  Synthetic oligonucleotide
gggagagggtggttggagtcattggggcggagggg

SEQ ID NO: 176252 - DNA, 35 bp, Artificial Sequence
  Synthetic oligonucleotide
tgtccatgtggcggagagagggagtgggtgcgggg

SEQ ID NO: 176253 - DNA, 35 bp, Artificial Sequence
  Synthetic oligonucleotide
tgcccctccatctctaacgcggacatagctttggg

SEQ ID NO: 176254 - DNA, 35 bp, Artificial Sequence
  Synthetic oligonucleotide
aagcagaatgggaaggagggaagtggatgggaatg

SEQ ID NO: 176255 - DNA, 35 bp, Artificial Sequence
  Synthetic oligonucleotide
tgcgccagaactcgccgctcattatcccgccactg

SEQ ID NO: 176256 - DNA, 35 bp, Artificial Sequence
  Synthetic oligonucleotide
gcaagcgcccgatcaccatgcccgcttatatcctg

SEQ ID NO: 176257 - DNA, 35 bp, Artificial Sequence
  Synthetic oligonucleotide
agtcctccgccgtcaacgtcttaacccatcctctg

SEQ ID NO: 176258 - DNA, 35 bp, Artificial Sequence
  Synthetic oligonucleotide
acgatgtatcaccgctcttacacctctgccacaat

SEQ ID NO: 176259 - DNA, 35 bp, Artificial Sequence
  Synthetic oligonucleotide
tactccgcctgtagtgcggcccacctacgatacat

SEQ ID NO: 176260 - DNA, 35 bp, Artificial Sequence
  Synthetic oligonucleotide
gtgccaagacgccccggtctagcttctcctaccat

SEQ ID NO: 176261 - DNA, 35 bp, Artificial Sequence
  Synthetic oligonucleotide
gtagatgcacgtgcgttttcctacccttatcccat

SEQ ID NO: 176262 - DNA, 35 bp, Artificial Sequence
  Synthetic oligonucleotide
taggtcgacggtggtgggggttaacagggaggcat

SEQ ID NO: 176263 - DNA, 35 bp, Artificial Sequence
  Synthetic oligonucleotide
ttgtagctccatgtccctggccctttattgctcat

SEQ ID NO: 176264 - DNA, 35 bp, Artificial Sequence
  Synthetic oligonucleotide
gaggggggaagaatggggcacatcgatgggtggat

SEQ ID NO: 176265 - DNA, 35 bp, Artificial Sequence
  Synthetic oligonucleotide
tgatgtcgccgactgtttccccgttcctaactgct

SEQ ID NO: 176266 - DNA, 35 bp, Artificial Sequence
  Synthetic oligonucleotide
aacatctatcgtcgcgtaatcgcctggttccctct

SEQ ID NO: 176267 - DNA, 35 bp, Artificial Sequence
  Synthetic oligonucleotide
ttagccatcagtcactacccaggttcagtctctct

SEQ ID NO: 176268 - DNA, 35 bp, Artificial Sequence
  Synthetic oligonucleotide
tggagctcggttctatctgcgccaacttcccgtct

SEQ ID NO: 176269 - DNA, 35 bp, Artificial Sequence
  Synthetic oligonucleotide
tccccgccgccccccgtaccatctttgcatggtct

SEQ ID NO: 176270 - DNA, 35 bp, Artificial Sequence
  Synthetic oligonucleotide
gtgtccctcccccctgttcggtatattcaatgtct

SEQ ID NO: 176271 - DNA, 35 bp, Artificial Sequence
  Synthetic oligonucleotide
ggacccgcctcattagtctccaatcttgctccagt

SEQ ID NO: 176272 - DNA, 35 bp, Artificial Sequence
  Synthetic oligonucleotide
gtctgctactgcacttgtaatcgcttctactccgt

SEQ ID NO: 176273 - DNA, 35 bp, Artificial Sequence
  Synthetic oligonucleotide
actctcgccctacactgaccgctctccagtcatgt

SEQ ID NO: 176274 - DNA, 35 bp, Artificial Sequence
  Synthetic oligonucleotide
tctacctatcgcctgcttaccttttagcgccctgt

SEQ ID NO: 176275 - DNA, 35 bp, Artificial Sequence
  Synthetic oligonucleotide
actgtaccatcattgccaataacacacgcgagtgt

SEQ ID NO: 176276 - DNA, 35 bp, Artificial Sequence
  Synthetic oligonucleotide
tccgccttagcctcaccgctgaacctcccatttgt

SEQ ID NO: 176277 - DNA, 35 bp, Artificial Sequence
  Synthetic oligonucleotide
gtgagcatgcgctgtcctatcgatccatgtctgtt

SEQ ID NO: 176278 - DNA, 35 bp, Artificial Sequence
  Synthetic oligonucleotide
gtaccacgtcccacccgccgcgcaaattctgtttt

SEQ ID NO: 176279 - DNA, 35 bp, Artificial Sequence
  Synthetic oligonucleotide
taggtccgcctggcactgcccctcttctttgcgaa

SEQ ID NO: 176280 - DNA, 35 bp, Artificial Sequence
  Synthetic oligonucleotide
tgcgcaccatgacgggggggaggaagggctaggaa

SEQ ID NO: 176281 - DNA, 35 bp, Artificial Sequence
  Synthetic oligonucleotide
tatgggagggattgaagacacgagggcggggggaa

SEQ ID NO: 176282 - DNA, 36 bp, Artificial Sequence
  Synthetic oligonucleotide
agtagagcgggagggagatgggggaatgtgtgggaa

SEQ ID NO: 176283 - DNA, 31 bp, Artificial Sequence
  Synthetic oligonucleotide
gcccctcccaggcgtcacgacccatccgaca

SEQ ID NO: 176284 - DNA, 36 bp, Artificial Sequence
  Synthetic oligonucleotide
gtcccaaccctgctctccggacatagtgatgcacca

SEQ ID NO: 176285 - DNA, 36 bp, Artificial Sequence
  Synthetic oligonucleotide
ggtcagtgccgtgtctattttttttgctgcccccca

SEQ ID NO: 176286 - DNA, 36 bp, Artificial Sequence
  Synthetic oligonucleotide
gcatgccacgagccttcgacgttattatcgcgccca

SEQ ID NO: 176287 - DNA, 32 bp, Artificial Sequence
  Synthetic oligonucleotide
gttaccagtacgctcgacctcgattcccgcca

SEQ ID NO: 176288 - DNA, 36 bp, Artificial Sequence
  Synthetic oligonucleotide
atccatggacccgaactcatcacgcacagtgatcca

SEQ ID NO: 176289 - DNA, 36 bp, Artificial Sequence
  Synthetic oligonucleotide
gtatcaggcgacgcattaggctcctcctaccctcca

SEQ ID NO: 176290 - DNA, 36 bp, Artificial Sequence
  Synthetic oligonucleotide
tcagtcatccgccccccgggaaccgttcgcgaagca

SEQ ID NO: 176291 - DNA, 35 bp, Artificial Sequence
  Synthetic oligonucleotide
ttggaccggccacgcccttcctgcttcacatatca

SEQ ID NO: 176292 - DNA, 35 bp, Artificial Sequence
  Synthetic oligonucleotide
gatctcgcgcactgtctacgcatagcccccgctca

SEQ ID NO: 176293 - DNA, 36 bp, Artificial Sequence
  Synthetic oligonucleotide
tcactcttcgcccgatcaatgccttcggccctctca

SEQ ID NO: 176294 - DNA, 36 bp, Artificial Sequence
  Synthetic oligonucleotide
gtcgcctcaccccctgtataacagggccctcgttca

SEQ ID NO: 176295 - DNA, 36 bp, Artificial Sequence
  Synthetic oligonucleotide
tcctctcgaacgtccatagtacaccttccctgttca

SEQ ID NO: 176296 - DNA, 36 bp, Artificial Sequence
  Synthetic oligonucleotide
gatgtgcctgcttgtctacaccgctccctttgttca

SEQ ID NO: 176297 - DNA, 36 bp, Artificial Sequence
  Synthetic oligonucleotide
tcgcacaattgggacgggaggagggaggctatgaga

SEQ ID NO: 176298 - DNA, 37 bp, Artificial Sequence
  Synthetic oligonucleotide
tgcctcacccctccgcttatttaagcattcctctaga

SEQ ID NO: 176299 - DNA, 36 bp, Artificial Sequence
  Synthetic oligonucleotide
tgactaagcatccgctcccttctcgtgtctcgtaga

SEQ ID NO: 176300 - DNA, 37 bp, Artificial Sequence
  Synthetic oligonucleotide
gtgcgggaagggcgagcgggacgacggcaggatacga

SEQ ID NO: 176301 - DNA, 36 bp, Artificial Sequence
  Synthetic oligonucleotide
gagcactccattggtccatccaaactctgttcccga

SEQ ID NO: 176302 - DNA, 37 bp, Artificial Sequence
  Synthetic oligonucleotide
tcgatcggaccgactacttttctaccacctcttccga

SEQ ID NO: 176303 - DNA, 37 bp, Artificial Sequence
  Synthetic oligonucleotide
accagacgacatagcgcatttaccttctacacctcga

SEQ ID NO: 176304 - DNA, 37 bp, Artificial Sequence
  Synthetic oligonucleotide
tgcgtgcaggcaacatctgttcttctttccgcctcga

SEQ ID NO: 176305 - DNA, 38 bp, Artificial Sequence
  Synthetic oligonucleotide
aacatcagggggagggaggtgggaacaataaaatagga

SEQ ID NO: 176306 - DNA, 36 bp, Artificial Sequence
  Synthetic oligonucleotide
gctgggggaggtatgacggggatgagctgggtagga

SEQ ID NO: 176307 - DNA, 37 bp, Artificial Sequence
  Synthetic oligonucleotide
tcacgcacccccccgctcacgcacatggcataacgga

SEQ ID NO: 176308 - DNA, 37 bp, Artificial Sequence
  Synthetic oligonucleotide
gaccaatgcctctttggttctaaccgctccccccgga

SEQ ID NO: 176309 - DNA, 37 bp, Artificial Sequence
  Synthetic oligonucleotide
gccgctcgcccctccccgtagtcttcgaaccagcgga

SEQ ID NO: 176310 - DNA, 37 bp, Artificial Sequence
  Synthetic oligonucleotide
ggagcgctgaagtcggggaggtgggcggggagaggga

SEQ ID NO: 176311 - DNA, 37 bp, Artificial Sequence
  Synthetic oligonucleotide
tccggcatgaaagccgggaagggaatgaggggcggga

SEQ ID NO: 176312 - DNA, 37 bp, Artificial Sequence
  Synthetic oligonucleotide
gtaggtgaaagtgggaagggggggacacttattggga

SEQ ID NO: 176313 - DNA, 37 bp, Artificial Sequence
  Synthetic oligonucleotide
gcgcctcacaaactgcgtacgtaccccatccactgga

SEQ ID NO: 176314 - DNA, 37 bp, Artificial Sequence
  Synthetic oligonucleotide
ttcacccgcctagatgccccttaccacacgcactgga

SEQ ID NO: 176315 - DNA, 38 bp, Artificial Sequence
  Synthetic oligonucleotide
tcccaccccgacccccgttagtcacgcttccgtaatga

SEQ ID NO: 176316 - DNA, 37 bp, Artificial Sequence
  Synthetic oligonucleotide
acatcaccttaccattgttacatcttggcatccatga

SEQ ID NO: 176317 - DNA, 38 bp, Artificial Sequence
  Synthetic oligonucleotide
gtggaggccccacatgctttctaaacctcctatcatga

SEQ ID NO: 176318 - DNA, 38 bp, Artificial Sequence
  Synthetic oligonucleotide
gccccgcctccctcctcacgccatccatgccccgatga

SEQ ID NO: 176319 - DNA, 38 bp, Artificial Sequence
  Synthetic oligonucleotide
tacgtgacagatgtgtgccttcttctccgcccctatga

SEQ ID NO: 176320 - DNA, 38 bp, Artificial Sequence
  Synthetic oligonucleotide
ttgagtcgccctctcgcattagttgtccctccttatga

SEQ ID NO: 176321 - DNA, 36 bp, Artificial Sequence
  Synthetic oligonucleotide
acttacatgccagcccccccggcactcaatccctga

SEQ ID NO: 176322 - DNA, 37 bp, Artificial Sequence
  Synthetic oligonucleotide
acactggcgctgctctttggtccgtctttcctcctga

SEQ ID NO: 176323 - DNA, 38 bp, Artificial Sequence
  Synthetic oligonucleotide
gtccagccgaccgtcccctcccccacaggcaaagctga

SEQ ID NO: 176324 - DNA, 38 bp, Artificial Sequence
  Synthetic oligonucleotide
tcattcgcaccacctcccgacgtcagaaattgttctga

SEQ ID NO: 176325 - DNA, 38 bp, Artificial Sequence
  Synthetic oligonucleotide
attgcccctcactgtcccacccggcccagtccgagtga

SEQ ID NO: 176326 - DNA, 37 bp, Artificial Sequence
  Synthetic oligonucleotide
gcacgacgccccggctttaccccactcacgcaggtga

SEQ ID NO: 176327 - DNA, 38 bp, Artificial Sequence
  Synthetic oligonucleotide
gcaactagtgagggaagggagggtggaactgacggtga

SEQ ID NO: 176328 - DNA, 37 bp, Artificial Sequence
  Synthetic oligonucleotide
aagtgcagggaggggtctaggggtaagccgggggtga

SEQ ID NO: 176329 - DNA, 38 bp, Artificial Sequence
  Synthetic oligonucleotide
gtgcgccgtagcgttcctgccgccgtgccctgacttga

SEQ ID NO: 176330 - DNA, 35 bp, Artificial Sequence
  Synthetic oligonucleotide
gagctcctcgcccttcgacgcctttctcgccttga

SEQ ID NO: 176331 - DNA, 38 bp, Artificial Sequence
  Synthetic oligonucleotide
gccactacctgcatccgtgctttgatcctttctgttga

SEQ ID NO: 176332 - DNA, 37 bp, Artificial Sequence
  Synthetic oligonucleotide
tcatacgctccagcacggccctccctcagccctttga

SEQ ID NO: 176333 - DNA, 38 bp, Artificial Sequence
  Synthetic oligonucleotide
tctgtcgctgacctgccccacctgtacccgctctttga

SEQ ID NO: 176334 - DNA, 35 bp, Artificial Sequence
  Synthetic oligonucleotide
tagtgggtgctgatgggtgtccgtgggcgggcata

SEQ ID NO: 176335 - DNA, 36 bp, Artificial Sequence
  Synthetic oligonucleotide
actcgctctgttctgcctactgtccacgatattcta

SEQ ID NO: 176336 - DNA, 36 bp, Artificial Sequence
  Synthetic oligonucleotide
attccgcctcactgtcgtcagctcaacccgttcgta

SEQ ID NO: 176337 - DNA, 36 bp, Artificial Sequence
  Synthetic oligonucleotide
tgtgcgggcgggagggtctactaacgtccaggggta

SEQ ID NO: 176338 - DNA, 36 bp, Artificial Sequence
  Synthetic oligonucleotide
tagctccgcacgtgcgactcccgcccctcttactta

SEQ ID NO: 176339 - DNA, 35 bp, Artificial Sequence
  Synthetic oligonucleotide
tccccgccgcacctcctcactttgtccaccattta

SEQ ID NO: 176340 - DNA, 36 bp, Artificial Sequence
  Synthetic oligonucleotide
atgtgcgcatgttacctagtccgccactttcgttta

SEQ ID NO: 176341 - DNA, 35 bp, Artificial Sequence
  Synthetic oligonucleotide
tccatcccctgtaattgcgagccccgtgcctccac

SEQ ID NO: 176342 - DNA, 35 bp, Artificial Sequence
  Synthetic oligonucleotide
gccgccccttactttgcgcgttctaacaggtagac

SEQ ID NO: 176343 - DNA, 35 bp, Artificial Sequence
  Synthetic oligonucleotide
tgccagggcgggggggaatgatccataagtgggac

SEQ ID NO: 176344 - DNA, 35 bp, Artificial Sequence
  Synthetic oligonucleotide
tgatctacccccctcctacagttacaccctgtgac

SEQ ID NO: 176345 - DNA, 35 bp, Artificial Sequence
  Synthetic oligonucleotide
ccccacctcccatcccctgttagacccgtgaatac

SEQ ID NO: 176346 - DNA, 35 bp, Artificial Sequence
  Synthetic oligonucleotide
acatcacacacacgcatagctgacttttcgtaacc

SEQ ID NO: 176347 - DNA, 35 bp, Artificial Sequence
  Synthetic oligonucleotide
tgcgatccctcaaggtgacgtttcccctggccacc

SEQ ID NO: 176348 - DNA, 35 bp, Artificial Sequence
  Synthetic oligonucleotide
tgcgccccgccccacctcacgtggtgttatttacc

SEQ ID NO: 176349 - DNA, 35 bp, Artificial Sequence
  Synthetic oligonucleotide
tctgtgtccaagtgcctccactatactttgcgccc

SEQ ID NO: 176350 - DNA, 35 bp, Artificial Sequence
  Synthetic oligonucleotide
gattgcttacgttgcgctacatccgattattgccc

SEQ ID NO: 176351 - DNA, 35 bp, Artificial Sequence
  Synthetic oligonucleotide
gccacttcgaccaccacttgtaggacccgcttccc

SEQ ID NO: 176352 - DNA, 35 bp, Artificial Sequence
  Synthetic oligonucleotide
tcgctcacctcaattcaagctgcccgcccgttccc

SEQ ID NO: 176353 - DNA, 35 bp, Artificial Sequence
  Synthetic oligonucleotide
tcacggtgtccgttgaggcgggggggcgggtatcc

SEQ ID NO: 176354 - DNA, 35 bp, Artificial Sequence
  Synthetic oligonucleotide
gagggtactgtgccgatcgacacccgctccactcc

SEQ ID NO: 176355 - DNA, 35 bp, Artificial Sequence
  Synthetic oligonucleotide
ttttcaccccagccctattggccccgagctactcc

SEQ ID NO: 176356 - DNA, 35 bp, Artificial Sequence
  Synthetic oligonucleotide
ggcacgccaatgtggctcttgtttcagcgccctcc

SEQ ID NO: 176357 - DNA, 35 bp, Artificial Sequence
  Synthetic oligonucleotide
acgcgcccttcccctgaccgctacctcagggctcc

SEQ ID NO: 176358 - DNA, 35 bp, Artificial Sequence
  Synthetic oligonucleotide
tacgtgagcatccctctttgttcagtcattgctcc

SEQ ID NO: 176359 - DNA, 35 bp, Artificial Sequence
  Synthetic oligonucleotide
tttcccccgaccagttcttgcctttgttaccgtcc

SEQ ID NO: 176360 - DNA, 35 bp, Artificial Sequence
  Synthetic oligonucleotide
accgattggggtacagcggtacatcacacccttcc

SEQ ID NO: 176361 - DNA, 35 bp, Artificial Sequence
  Synthetic oligonucleotide
gcgcgcctaacctgctgttctccattgtatgttcc

SEQ ID NO: 176362 - DNA, 35 bp, Artificial Sequence
  Synthetic oligonucleotide
atcctgctggacctgcctgactcactcctcatagc

SEQ ID NO: 176363 - DNA, 35 bp, Artificial Sequence
  Synthetic oligonucleotide
gttgccgtcgacaactcccggttcctgtcccacgc

SEQ ID NO: 176364 - DNA, 35 bp, Artificial Sequence
  Synthetic oligonucleotide
tcccctgtccgctaatacggcgtttcccgtgccgc

SEQ ID NO: 176365 - DNA, 35 bp, Artificial Sequence
  Synthetic oligonucleotide
ggaccgccacctgagcttcatatcgtcaatcgcgc

SEQ ID NO: 176366 - DNA, 35 bp, Artificial Sequence
  Synthetic oligonucleotide
tgagtagccccgcaatatgaccccacctccttcgc

SEQ ID NO: 176367 - DNA, 35 bp, Artificial Sequence
  Synthetic oligonucleotide
gcttcactcctctttgatccgatctcacggcctgc

SEQ ID NO: 176368 - DNA, 35 bp, Artificial Sequence
  Synthetic oligonucleotide
gcggatcgcatttttcgattgccccccttccttgc

SEQ ID NO: 176369 - DNA, 35 bp, Artificial Sequence
  Synthetic oligonucleotide
tccagtcccggttttaccgctcgtgcctttcttgc

SEQ ID NO: 176370 - DNA, 35 bp, Artificial Sequence
  Synthetic oligonucleotide
acggtcatcgcctgtccgctttcccccagttaatc

SEQ ID NO: 176371 - DNA, 35 bp, Artificial Sequence
  Synthetic oligonucleotide
tccgccacagcccccgtagcacagcccctctcatc

SEQ ID NO: 176372 - DNA, 35 bp, Artificial Sequence
  Synthetic oligonucleotide
gactaactcccatcatatagcgccctgcaactctc

SEQ ID NO: 176373 - DNA, 35 bp, Artificial Sequence
  Synthetic oligonucleotide
acatccaccgcctggccaattggctcccgtgtctc

SEQ ID NO: 176374 - DNA, 35 bp, Artificial Sequence
  Synthetic oligonucleotide
tagcaaatcgtaccccgccgtggccgccataattc

SEQ ID NO: 176375 - DNA, 35 bp, Artificial Sequence
  Synthetic oligonucleotide
tcgctaccgtcgatccgcttctcttcaccagattc

SEQ ID NO: 176376 - DNA, 35 bp, Artificial Sequence
  Synthetic oligonucleotide
tgtgatctccgcttgttactacgctctacgacttc

SEQ ID NO: 176377 - DNA, 36 bp, Artificial Sequence
  Synthetic oligonucleotide
atgcgacccggcaacctgtcctggcttacgtacttc

SEQ ID NO: 176378 - DNA, 35 bp, Artificial Sequence
  Synthetic oligonucleotide
ggatgggatgggcgaaacgggggttgggggaaaag

SEQ ID NO: 176379 - DNA, 35 bp, Artificial Sequence
  Synthetic oligonucleotide
ttaatccatcgcaccctaccagctcccgccttaag

SEQ ID NO: 176380 - DNA, 35 bp, Artificial Sequence
  Synthetic oligonucleotide
ggggggggggagatagtcaggaacacggtagcgag

SEQ ID NO: 176381 - DNA, 35 bp, Artificial Sequence
  Synthetic oligonucleotide
gtggggggtgggaagctgggaaggcaggcaggtag

SEQ ID NO: 176382 - DNA, 35 bp, Artificial Sequence
  Synthetic oligonucleotide
tgtctcgcgcaccattctaacgttttgccaacccg

SEQ ID NO: 176383 - DNA, 35 bp, Artificial Sequence
  Synthetic oligonucleotide
atcacttccgtagcgccgtccaccatattcccccg

SEQ ID NO: 176384 - DNA, 35 bp, Artificial Sequence
  Synthetic oligonucleotide
tgatcgtccgttactcaatcgtcttgctatccccg

SEQ ID NO: 176385 - DNA, 35 bp, Artificial Sequence
  Synthetic oligonucleotide
ttgtggcctcgttctccagtcattggtcctgtccg

SEQ ID NO: 176386 - DNA, 35 bp, Artificial Sequence
  Synthetic oligonucleotide
acacactagccttcgttcgagccctcctctctagg

SEQ ID NO: 176387 - DNA, 35 bp, Artificial Sequence
  Synthetic oligonucleotide
agactgatgatcgccccaccccgctcccccacggg

SEQ ID NO: 176388 - DNA, 33 bp, Artificial Sequence
  Synthetic oligonucleotide
agaagtaggggggggaatcacaagggttagggg

SEQ ID NO: 176389 - DNA, 35 bp, Artificial Sequence
  Synthetic oligonucleotide
gatgggggtgggggctgaggagggtagatctgtgg

SEQ ID NO: 176390 - DNA, 35 bp, Artificial Sequence
  Synthetic oligonucleotide
tagatccgtactgcacatgaatttagccccccatg

SEQ ID NO: 176391 - DNA, 35 bp, Artificial Sequence
  Synthetic oligonucleotide
gcatagcccaagtacgctccccttgcccttcgctg

SEQ ID NO: 176392 - DNA, 35 bp, Artificial Sequence
  Synthetic oligonucleotide
agaatggccgaggggttggggctgtacagggggtg

SEQ ID NO: 176393 - DNA, 35 bp, Artificial Sequence
  Synthetic oligonucleotide
acacagcgcacaatctttagtccgcctccgctgtg

SEQ ID NO: 176394 - DNA, 35 bp, Artificial Sequence
  Synthetic oligonucleotide
gccatgcccccgcaccgtaatggtccgaatacttg

SEQ ID NO: 176395 - DNA, 35 bp, Artificial Sequence
  Synthetic oligonucleotide
atgcgtgcaggtgtgaacctgctcccttgcccttg

SEQ ID NO: 176396 - DNA, 35 bp, Artificial Sequence
  Synthetic oligonucleotide
aaagccgcggtcaccattctctgccattcccgttg

SEQ ID NO: 176397 - DNA, 35 bp, Artificial Sequence
  Synthetic oligonucleotide
tgcgcttcccttgccgggtctgcactacccttttg

SEQ ID NO: 176398 - DNA, 35 bp, Artificial Sequence
  Synthetic oligonucleotide
gccagagcccccgcatcctctgcctaagtacccat

SEQ ID NO: 176399 - DNA, 35 bp, Artificial Sequence
  Synthetic oligonucleotide
gtacatctctgctgcatcaagacaccccggcccat

SEQ ID NO: 176400 - DNA, 35 bp, Artificial Sequence
  Synthetic oligonucleotide
tccatctgcctctccatctggttttaatgcctcat

SEQ ID NO: 176401 - DNA, 35 bp, Artificial Sequence
  Synthetic oligonucleotide
tgacccaagccctccgagtactgttcccgttatat

SEQ ID NO: 176402 - DNA, 35 bp, Artificial Sequence
  Synthetic oligonucleotide
gcccgcctccttgtttgcattaatcttggccaact

SEQ ID NO: 176403 - DNA, 35 bp, Artificial Sequence
  Synthetic oligonucleotide
gcgatgccgcgcggcacctggcgcctccccgaact

SEQ ID NO: 176404 - DNA, 35 bp, Artificial Sequence
  Synthetic oligonucleotide
gaagccacaaggcggtcctccttcatcaacccact

SEQ ID NO: 176405 - DNA, 35 bp, Artificial Sequence
  Synthetic oligonucleotide
tgtgccccgttcccatgctgccacttacgctcact

SEQ ID NO: 176406 - DNA, 31 bp, Artificial Sequence
  Synthetic oligonucleotide
gagctcgggcatccctgcgataacacctact

SEQ ID NO: 176407 - DNA, 35 bp, Artificial Sequence
  Synthetic oligonucleotide
tcctcagcagcacacgcgaatcctccctatttcct

SEQ ID NO: 176408 - DNA, 35 bp, Artificial Sequence
  Synthetic oligonucleotide
tgtcatccacgggggtctcgtctttctctgccgct

SEQ ID NO: 176409 - DNA, 35 bp, Artificial Sequence
  Synthetic oligonucleotide
accagtgtgtctgccctccctctttgtgtcatgct

SEQ ID NO: 176410 - DNA, 35 bp, Artificial Sequence
  Synthetic oligonucleotide
ttgcccatcgcagtggtcaccgtggccgccctgct

SEQ ID NO: 176411 - DNA, 35 bp, Artificial Sequence
  Synthetic oligonucleotide
ttggccaagcctcttctcctcctaatgtttctgct

SEQ ID NO: 176412 - DNA, 35 bp, Artificial Sequence
  Synthetic oligonucleotide
acgcccataggcacgccttatattgtcccttctct

SEQ ID NO: 176413 - DNA, 35 bp, Artificial Sequence
  Synthetic oligonucleotide
tcagcctctttgcgctgtcctaattcaccgggtct

SEQ ID NO: 176414 - DNA, 35 bp, Artificial Sequence
  Synthetic oligonucleotide
gccatccttcactgtgccttctccactgcccttct

SEQ ID NO: 176415 - DNA, 35 bp, Artificial Sequence
  Synthetic oligonucleotide
acctacccccccctctcacgatacaccttgtaggt

SEQ ID NO: 176416 - DNA, 35 bp, Artificial Sequence
  Synthetic oligonucleotide
tccgggcattgaccggtctcgtttccatctcttgt

SEQ ID NO: 176417 - DNA, 35 bp, Artificial Sequence
  Synthetic oligonucleotide
tggtcccggagggtgggtggtgtgcgggcccactt

SEQ ID NO: 176418 - DNA, 35 bp, Artificial Sequence
  Synthetic oligonucleotide
atccgacaccggccctcgctctacgtcttacgctt

SEQ ID NO: 176419 - DNA, 35 bp, Artificial Sequence
  Synthetic oligonucleotide
gtggggaacggaggggcgaggggtcggcggggctt

SEQ ID NO: 176420 - DNA, 35 bp, Artificial Sequence
  Synthetic oligonucleotide
gacgcccatgccttcacaaccttcatttgttgctt

SEQ ID NO: 176421 - DNA, 35 bp, Artificial Sequence
  Synthetic oligonucleotide
ctgttcctcccccgatttgtggtccgtttcccgtt

SEQ ID NO: 176422 - DNA, 35 bp, Artificial Sequence
  Synthetic oligonucleotide
tacgcctgccgcttttctagctttttcgacctgtt

SEQ ID NO: 176423 - DNA, 35 bp, Artificial Sequence
  Synthetic oligonucleotide
taagccactccccgctgaggttctcttggccgttt

SEQ ID NO: 176424 - DNA, 35 bp, Artificial Sequence
  Synthetic oligonucleotide
tagccgttactgctactatggttctggttccgttt

SEQ ID NO: 176425 - DNA, 35 bp, Artificial Sequence
  Synthetic oligonucleotide
ggtgaaggggtgggtgatatcagcaggggcggttt

SEQ ID NO: 176426 - DNA, 36 bp, Artificial Sequence
  Synthetic oligonucleotide
tatcccaccaccgctatggccccactttcgtagaaa

SEQ ID NO: 176427 - DNA, 36 bp, Artificial Sequence
  Synthetic oligonucleotide
gacccccgcgcacagtgcatacactcttccccgaaa

SEQ ID NO: 176428 - DNA, 36 bp, Artificial Sequence
  Synthetic oligonucleotide
acgatgccatgccgtacttccctccgctgctcacaa

SEQ ID NO: 176429 - DNA, 36 bp, Artificial Sequence
  Synthetic oligonucleotide
acgtggggctcaagggacggcggatgagggagggaa

SEQ ID NO: 176430 - DNA, 36 bp, Artificial Sequence
  Synthetic oligonucleotide
tcacaaccacgacgttgctccgccttagctccctaa

SEQ ID NO: 176431 - DNA, 36 bp, Artificial Sequence
  Synthetic oligonucleotide
tagctgccgcacgcttgtctccttggtctatcctaa

SEQ ID NO: 176432 - DNA, 36 bp, Artificial Sequence
  Synthetic oligonucleotide
tgccgccgcagttttctgtctactcgctctttaaca

SEQ ID NO: 176433 - DNA, 36 bp, Artificial Sequence
  Synthetic oligonucleotide
actcacccctcactgcgattccgtttcggagccaca

SEQ ID NO: 176434 - DNA, 36 bp, Artificial Sequence
  Synthetic oligonucleotide
ttacgcccccacagcctactccggtgtctattcaca

SEQ ID NO: 176435 - DNA, 35 bp, Artificial Sequence
  Synthetic oligonucleotide
gactctctatcgccgacctgtacgacacaccccca

SEQ ID NO: 176436 - DNA, 35 bp, Artificial Sequence
  Synthetic oligonucleotide
gaccacctccctgtcacgaccacgcgcccacgcca

SEQ ID NO: 176437 - DNA, 35 bp, Artificial Sequence
  Synthetic oligonucleotide
atcgtgccgcggctcgcgtcgcatactcttctcca

SEQ ID NO: 176438 - DNA, 35 bp, Artificial Sequence
  Synthetic oligonucleotide
tcgtaactagcccccccgcaccgttcctctgtcca

SEQ ID NO: 176439 - DNA, 34 bp, Artificial Sequence
  Synthetic oligonucleotide
aactctcagcccctcacaactattggcactctca

SEQ ID NO: 176440 - DNA, 35 bp, Artificial Sequence
  Synthetic oligonucleotide
aagtccaaccacatgcttttccgtatgctccttca

SEQ ID NO: 176441 - DNA, 36 bp, Artificial Sequence
  Synthetic oligonucleotide
gacacgcgactcgcttgccatgctgctaccttttca

SEQ ID NO: 176442 - DNA, 37 bp, Artificial Sequence
  Synthetic oligonucleotide
aaggggggggagcaagtcacaagggcaagggaagaga

SEQ ID NO: 176443 - DNA, 37 bp, Artificial Sequence
  Synthetic oligonucleotide
tggaggtggagggttaaaggtagggtggcaaaggaga

SEQ ID NO: 176444 - DNA, 36 bp, Artificial Sequence
  Synthetic oligonucleotide
aaccccgctagcttcagcatccacgccccaccacga

SEQ ID NO: 176445 - DNA, 37 bp, Artificial Sequence
  Synthetic oligonucleotide
ttcatcttcggcacctgtacactatcgcccccgacga

SEQ ID NO: 176446 - DNA, 37 bp, Artificial Sequence
  Synthetic oligonucleotide
gtaggaagaaagagggaacgggcgggttagggtacga

SEQ ID NO: 176447 - DNA, 37 bp, Artificial Sequence
  Synthetic oligonucleotide
acagacgcacccttctccgctgcttagttgaacccga

SEQ ID NO: 176448 - DNA, 36 bp, Artificial Sequence
  Synthetic oligonucleotide
ttacgcgttaacgccttcataccctctcgtgcccga

SEQ ID NO: 176449 - DNA, 36 bp, Artificial Sequence
  Synthetic oligonucleotide
ttccctgccactgtaccatggttttgttttgcccga

SEQ ID NO: 176450 - DNA, 37 bp, Artificial Sequence
  Synthetic oligonucleotide
ttcacccacatgcactgctcgccagtatacttcccga

SEQ ID NO: 176451 - DNA, 37 bp, Artificial Sequence
  Synthetic oligonucleotide
agatgccctgacctaccgccgacccccgtttcgccga

SEQ ID NO: 176452 - DNA, 37 bp, Artificial Sequence
  Synthetic oligonucleotide
tctgtcccgttccagccaaccgtggttactactccga

SEQ ID NO: 176453 - DNA, 37 bp, Artificial Sequence
  Synthetic oligonucleotide
acgccgggaggcggaggaaatatcgggagggactcga

SEQ ID NO: 176454 - DNA, 37 bp, Artificial Sequence
  Synthetic oligonucleotide
tctgatctatcctcagagtgccatctttgcccttcga

SEQ ID NO: 176455 - DNA, 37 bp, Artificial Sequence
  Synthetic oligonucleotide
tagccacatgctgtaatcctccgttcatcccgttcga

SEQ ID NO: 176456 - DNA, 35 bp, Artificial Sequence
  Synthetic oligonucleotide
tgatagttggtggtagggggtgtgggggggccgga

SEQ ID NO: 176457 - DNA, 37 bp, Artificial Sequence
  Synthetic oligonucleotide
tcctgcttccaccctgcacgcgtcaccactccaggga

SEQ ID NO: 176458 - DNA, 37 bp, Artificial Sequence
  Synthetic oligonucleotide
accgggcgggtcgggttagtatagccagaatcaggga

SEQ ID NO: 176459 - DNA, 36 bp, Artificial Sequence
  Synthetic oligonucleotide
gagaccggcgggagagcaacattgagatggagggga

SEQ ID NO: 176460 - DNA, 35 bp, Artificial Sequence
  Synthetic oligonucleotide
atctgtctcgcatccccctctgcatttttgcatga

SEQ ID NO: 176461 - DNA, 35 bp, Artificial Sequence
  Synthetic oligonucleotide
tgacccacccgcattgtcatcgtcccaccgtatga

SEQ ID NO: 176462 - DNA, 37 bp, Artificial Sequence
  Synthetic oligonucleotide
gcactccagacgcgctccacttcattcgttctactga

SEQ ID NO: 176463 - DNA, 36 bp, Artificial Sequence
  Synthetic oligonucleotide
tgcggagcaacaccctgctcttgttatgctacctga

SEQ ID NO: 176464 - DNA, 37 bp, Artificial Sequence
  Synthetic oligonucleotide
tacacccgtcgagccttcagcttttcattcgccctga

SEQ ID NO: 176465 - DNA, 37 bp, Artificial Sequence
  Synthetic oligonucleotide
tccagtcgctgccttcgcgctatccgttcgttcctga

SEQ ID NO: 176466 - DNA, 38 bp, Artificial Sequence
  Synthetic oligonucleotide
gtcaagctgactccctatgcgccatcactccactctga

SEQ ID NO: 176467 - DNA, 38 bp, Artificial Sequence
  Synthetic oligonucleotide
aaggagggagggccaaaggaagggggggagggaattga

SEQ ID NO: 176468 - DNA, 38 bp, Artificial Sequence
  Synthetic oligonucleotide
tttgcatcagtgtcttcttccccaccctcggcacttga

SEQ ID NO: 176469 - DNA, 38 bp, Artificial Sequence
  Synthetic oligonucleotide
tcaagcccgcctaccgagccaaccaccgcccaccttga

SEQ ID NO: 176470 - DNA, 38 bp, Artificial Sequence
  Synthetic oligonucleotide
tgccgatcggcactgctcctccgacccttccagcttga

SEQ ID NO: 176471 - DNA, 38 bp, Artificial Sequence
  Synthetic oligonucleotide
tactccagactcagcatagcgccggccccacctcttga

SEQ ID NO: 176472 - DNA, 35 bp, Artificial Sequence
  Synthetic oligonucleotide
ttcccatccagcctcccgagtaccgaccactttga

SEQ ID NO: 176473 - DNA, 38 bp, Artificial Sequence
  Synthetic oligonucleotide
ggagggagggaaaggggaagggcccggtcagactttga

SEQ ID NO: 176474 - DNA, 38 bp, Artificial Sequence
  Synthetic oligonucleotide
ggtcggggggaacatggtggggaaaggggaatctttga

SEQ ID NO: 176475 - DNA, 36 bp, Artificial Sequence
  Synthetic oligonucleotide
gtaccgcccacgcattgctttttgtaacatttttga

SEQ ID NO: 176476 - DNA, 35 bp, Artificial Sequence
  Synthetic oligonucleotide
acccccgctcctgatgtaatcctgctgcccaaata

SEQ ID NO: 176477 - DNA, 35 bp, Artificial Sequence
  Synthetic oligonucleotide
gagacgcaagtacttagggggggaacggtggaata

SEQ ID NO: 176478 - DNA, 36 bp, Artificial Sequence
  Synthetic oligonucleotide
gccacctacatcccctcctgtgccatcgggtccata

SEQ ID NO: 176479 - DNA, 35 bp, Artificial Sequence
  Synthetic oligonucleotide
actaccaccctgatctgtgtcatcacatccgacta

SEQ ID NO: 176480 - DNA, 36 bp, Artificial Sequence
  Synthetic oligonucleotide
tcacatccgatcttcccgtggtctttgctgctacta

SEQ ID NO: 176481 - DNA, 36 bp, Artificial Sequence
  Synthetic oligonucleotide
atccgtgccacctcgccgagtgctgttaacatccta

SEQ ID NO: 176482 - DNA, 35 bp, Artificial Sequence
  Synthetic oligonucleotide
actggtgtcagtggtccttttgtcgtgccttccta

SEQ ID NO: 176483 - DNA, 36 bp, Artificial Sequence
  Synthetic oligonucleotide
gaatggaggggaggagggtggagtaccgatccgcta

SEQ ID NO: 176484 - DNA, 36 bp, Artificial Sequence
  Synthetic oligonucleotide
acccgacgtccgctgcccaactactccgattcgcta

SEQ ID NO: 176485 - DNA, 36 bp, Artificial Sequence
  Synthetic oligonucleotide
gcgctacctgctccctctcaataatagtctgctcta

SEQ ID NO: 176486 - DNA, 36 bp, Artificial Sequence
  Synthetic oligonucleotide
gactccatgtccaatgcgattaccgcccaatctcta

SEQ ID NO: 176487 - DNA, 35 bp, Artificial Sequence
  Synthetic oligonucleotide
ggatactccacggtcacactccgccactgattcta

SEQ ID NO: 176488 - DNA, 36 bp, Artificial Sequence
  Synthetic oligonucleotide
acatcccccgcttgccgaagttacatccctgttcta

SEQ ID NO: 176489 - DNA, 36 bp, Artificial Sequence
  Synthetic oligonucleotide
gcatcatcccgcgccgtcacagatcaccgcatagta

SEQ ID NO: 176490 - DNA, 35 bp, Artificial Sequence
  Synthetic oligonucleotide
gatgcaatgcgctcctcttacccgtttccttcgta

SEQ ID NO: 176491 - DNA, 35 bp, Artificial Sequence
  Synthetic oligonucleotide
gcagaccttccttatgtgcctttttcaatgcctta

SEQ ID NO: 176492 - DNA, 36 bp, Artificial Sequence
  Synthetic oligonucleotide
tccgacccgctcgcatctactcttagtgttctctta

SEQ ID NO: 176493 - DNA, 35 bp, Artificial Sequence
  Synthetic oligonucleotide
tccgccccctcgcacctatccgtgtacgcttctta

SEQ ID NO: 176494 - DNA, 36 bp, Artificial Sequence
  Synthetic oligonucleotide
accgcccctccaccttcatcctgtttcaacggttta

SEQ ID NO: 176495 - DNA, 35 bp, Artificial Sequence
  Synthetic oligonucleotide
tccagggcactgcccgttctggagatttcacccac

SEQ ID NO: 176496 - DNA, 35 bp, Artificial Sequence
  Synthetic oligonucleotide
ggcgtagatgcacatgtccgctgtacacctcccac

SEQ ID NO: 176497 - DNA, 35 bp, Artificial Sequence
  Synthetic oligonucleotide
acctcgctctctgcccccagggtcttctaacgcac

SEQ ID NO: 176498 - DNA, 35 bp, Artificial Sequence
  Synthetic oligonucleotide
tcagctccgacgctcttccgctgggtcactcctac

SEQ ID NO: 176499 - DNA, 35 bp, Artificial Sequence
  Synthetic oligonucleotide
tacaccatctccttcagctacgccgctctacgtac

SEQ ID NO: 176500 - DNA, 35 bp, Artificial Sequence
  Synthetic oligonucleotide
gccccggtgcatccttggcccaccaccctgtcccc

SEQ ID NO: 176501 - DNA, 35 bp, Artificial Sequence
  Synthetic oligonucleotide
aatcacgtcccaactgataccacgccccctagccc

SEQ ID NO: 176502 - DNA, 35 bp, Artificial Sequence
  Synthetic oligonucleotide
acaagccgccccatccgtcctcattctagccgccc

SEQ ID NO: 176503 - DNA, 35 bp, Artificial Sequence
  Synthetic oligonucleotide
ttgcgaggctccattttgtcccgtctttctggccc

SEQ ID NO: 176504 - DNA, 35 bp, Artificial Sequence
  Synthetic oligonucleotide
tcgcaacatgcgcaccctcgcgtacctgcactccc

SEQ ID NO: 176505 - DNA, 35 bp, Artificial Sequence
  Synthetic oligonucleotide
tgacgacatatcgcaccgggcccgtaccccctccc

SEQ ID NO: 176506 - DNA, 35 bp, Artificial Sequence
  Synthetic oligonucleotide
agcactctccactggacttggaccacggctttccc

SEQ ID NO: 176507 - DNA, 35 bp, Artificial Sequence
  Synthetic oligonucleotide
gccacgcccacccctagttcacacgcctgtaggcc

SEQ ID NO: 176508 - DNA, 35 bp, Artificial Sequence
  Synthetic oligonucleotide
tccgatgacggcgtacgacccggccccaccaatcc

SEQ ID NO: 176509 - DNA, 35 bp, Artificial Sequence
  Synthetic oligonucleotide
taggcatcgcaccggtttagcacatgtcctcctcc

SEQ ID NO: 176510 - DNA, 35 bp, Artificial Sequence
  Synthetic oligonucleotide
gttgcgatgggccccagtttccggttcgttgttcc

SEQ ID NO: 176511 - DNA, 31 bp, Artificial Sequence
  Synthetic oligonucleotide
ggacgctcatggctttttattctcccgccgc

SEQ ID NO: 176512 - DNA, 35 bp, Artificial Sequence
  Synthetic oligonucleotide
gtgaaccgggggggtgtattgggtatggggcgcgc

SEQ ID NO: 176513 - DNA, 35 bp, Artificial Sequence
  Synthetic oligonucleotide
accccctccccatgcccatatctactgcaccatgc

SEQ ID NO: 176514 - DNA, 35 bp, Artificial Sequence
  Synthetic oligonucleotide
accccggtccaacattcggccactctccttggtgc

SEQ ID NO: 176515 - DNA, 35 bp, Artificial Sequence
  Synthetic oligonucleotide
ggttcggtggtgggggggggaggaagagaggttgc

SEQ ID NO: 176516 - DNA, 35 bp, Artificial Sequence
  Synthetic oligonucleotide
tggatcgctcttgtccaccgcaactcttcctttgc

SEQ ID NO: 176517 - DNA, 35 bp, Artificial Sequence
  Synthetic oligonucleotide
tctcgtcccaacggctgagtcacctttcgatcctc

SEQ ID NO: 176518 - DNA, 35 bp, Artificial Sequence
  Synthetic oligonucleotide
tcctgcattggttcggtgatttcttcggcctcctc

SEQ ID NO: 176519 - DNA, 34 bp, Artificial Sequence
  Synthetic oligonucleotide
tccatctctgcgcactcgaacttctaagtgagtc

SEQ ID NO: 176520 - DNA, 35 bp, Artificial Sequence
  Synthetic oligonucleotide
gtcttgcccatgtgcctccccacagatcttacgtc

SEQ ID NO: 176521 - DNA, 35 bp, Artificial Sequence
  Synthetic oligonucleotide
acccgcaactgccgacgctcttttcgttctccgtc

SEQ ID NO: 176522 - DNA, 35 bp, Artificial Sequence
  Synthetic oligonucleotide
tgcccagcccgcttccttcgccgctctacgctgtc

SEQ ID NO: 176523 - DNA, 35 bp, Artificial Sequence
  Synthetic oligonucleotide
gaggcactccccagtccacactgcctctggccttc

SEQ ID NO: 176524 - DNA, 35 bp, Artificial Sequence
  Synthetic oligonucleotide
tccgtctctcgtttcgcttggtcctacttcgcttc

SEQ ID NO: 176525 - DNA, 35 bp, Artificial Sequence
  Synthetic oligonucleotide
tcagtcgtctgcttttcgctatcttcctctagttc

SEQ ID NO: 176526 - DNA, 35 bp, Artificial Sequence
  Synthetic oligonucleotide
tcgccacgccacacctcgtaccctaactgcctttc

SEQ ID NO: 176527 - DNA, 35 bp, Artificial Sequence
  Synthetic oligonucleotide
gtgatagaggagataagtggtcggaagaagggaag

SEQ ID NO: 176528 - DNA, 35 bp, Artificial Sequence
  Synthetic oligonucleotide
tgccatcacaacatgtacccgcacctccgctaacg

SEQ ID NO: 176529 - DNA, 35 bp, Artificial Sequence
  Synthetic oligonucleotide
ttctccgccctcgcctcactgatagaacacacacg

SEQ ID NO: 176530 - DNA, 35 bp, Artificial Sequence
  Synthetic oligonucleotide
gcttcgcctcaagatctttttccatcctctcagcg

SEQ ID NO: 176531 - DNA, 35 bp, Artificial Sequence
  Synthetic oligonucleotide
gcacagggttatctagggtggaggggtggaatagg

SEQ ID NO: 176532 - DNA, 35 bp, Artificial Sequence
  Synthetic oligonucleotide
taggtccggtcgccccatgccacgctctcgttttg

SEQ ID NO: 176533 - DNA, 35 bp, Artificial Sequence
  Synthetic oligonucleotide
tcccccctgcctcccactgcctcgtggcccttaat

SEQ ID NO: 176534 - DNA, 32 bp, Artificial Sequence
  Synthetic oligonucleotide
tcacttccagcttatcgcctccttggtacact

SEQ ID NO: 176535 - DNA, 35 bp, Artificial Sequence
  Synthetic oligonucleotide
gcatgtgccattacctacccgtccagcagtcccct

SEQ ID NO: 176536 - DNA, 35 bp, Artificial Sequence
  Synthetic oligonucleotide
taacatccgaatgtttagggcaccctccccgccct

SEQ ID NO: 176537 - DNA, 35 bp, Artificial Sequence
  Synthetic oligonucleotide
atggtcccagaccctttcccgctcctgacgtgcct

SEQ ID NO: 176538 - DNA, 35 bp, Artificial Sequence
  Synthetic oligonucleotide
ccatgctgtccgccgccacgaatcaattcctcgct

SEQ ID NO: 176539 - DNA, 35 bp, Artificial Sequence
  Synthetic oligonucleotide
acctacggtccatctcgcaccaacgaacccctgct

SEQ ID NO: 176540 - DNA, 35 bp, Artificial Sequence
  Synthetic oligonucleotide
gtacacccctccgaatcacaataacgcggacttct

SEQ ID NO: 176541 - DNA, 35 bp, Artificial Sequence
  Synthetic oligonucleotide
actcccgaactccgccgtcccatccagatgtgcgt

SEQ ID NO: 176542 - DNA, 35 bp, Artificial Sequence
  Synthetic oligonucleotide
gcctacctgtccacctcctcgctgtcccatacggt

SEQ ID NO: 176543 - DNA, 35 bp, Artificial Sequence
  Synthetic oligonucleotide
ggggcgacaaaaagggtaggtggggtaaacgcggt

SEQ ID NO: 176544 - DNA, 35 bp, Artificial Sequence
  Synthetic oligonucleotide
ggggggtgacggggaaggggtacgagtcattcggt

SEQ ID NO: 176545 - DNA, 35 bp, Artificial Sequence
  Synthetic oligonucleotide
gccctcccggtcgtcatcattctcatctccttggt

SEQ ID NO: 176546 - DNA, 35 bp, Artificial Sequence
  Synthetic oligonucleotide
gatgcaaccctctgccatgaacgcgcgatgccctt

SEQ ID NO: 176547 - DNA, 35 bp, Artificial Sequence
  Synthetic oligonucleotide
ggggaagcctcgccaccgagcaccacgacctcctt

SEQ ID NO: 176548 - DNA, 35 bp, Artificial Sequence
  Synthetic oligonucleotide
gcccccgccaggggttacaccattgtgcattcctt

SEQ ID NO: 176549 - DNA, 35 bp, Artificial Sequence
  Synthetic oligonucleotide
gtacccacttccgtgcgtcgaccctctctaccgtt

SEQ ID NO: 176550 - DNA, 35 bp, Artificial Sequence
  Synthetic oligonucleotide
tttggcccgttcgctcattgatccacctgtccgtt

SEQ ID NO: 176551 - DNA, 35 bp, Artificial Sequence
  Synthetic oligonucleotide
tctttcagcccccgtgttgttcttgttatcctgtt

SEQ ID NO: 176552 - DNA, 35 bp, Artificial Sequence
  Synthetic oligonucleotide
acagcgcagtcgacacccatgcgtcccctaccttt

SEQ ID NO: 176553 - DNA, 35 bp, Artificial Sequence
  Synthetic oligonucleotide
acgtaccatcaactcacatcacgtgactgcccaaa

SEQ ID NO: 176554 - DNA, 36 bp, Artificial Sequence
  Synthetic oligonucleotide
tgaaccgacagatcagcccggtccgttcctttacaa

SEQ ID NO: 176555 - DNA, 36 bp, Artificial Sequence
  Synthetic oligonucleotide
gcccaccacccttattgttcttggtatgtattccaa

SEQ ID NO: 176556 - DNA, 35 bp, Artificial Sequence
  Synthetic oligonucleotide
gtcctccgccgccccccagctcgcaaagtggataa

SEQ ID NO: 176557 - DNA, 36 bp, Artificial Sequence
  Synthetic oligonucleotide
atgtccgcccttttgtctttttatggtcctattaca

SEQ ID NO: 176558 - DNA, 36 bp, Artificial Sequence
  Synthetic oligonucleotide
tcctgtcctctattccgtttatcacgcacccttaca

SEQ ID NO: 176559 - DNA, 35 bp, Artificial Sequence
  Synthetic oligonucleotide
tgcatggcggaacatattactgaagcctcccccca

SEQ ID NO: 176560 - DNA, 35 bp, Artificial Sequence
  Synthetic oligonucleotide
ggtcacactagtcacatagctatacgccgccccca

SEQ ID NO: 176561 - DNA, 34 bp, Artificial Sequence
  Synthetic oligonucleotide
acgcgccctcacgcccttccctggtaatagccca

SEQ ID NO: 176562 - DNA, 35 bp, Artificial Sequence
  Synthetic oligonucleotide
gatgttcgtcctattcgttcccttcacccatgcca

SEQ ID NO: 176563 - DNA, 36 bp, Artificial Sequence
  Synthetic oligonucleotide
tgatcgtaggctcccgctttatttgctcaccttcca

SEQ ID NO: 176564 - DNA, 36 bp, Artificial Sequence
  Synthetic oligonucleotide
gatgccccccacagtccgttcaactacatgtctgca

SEQ ID NO: 176565 - DNA, 35 bp, Artificial Sequence
  Synthetic oligonucleotide
gctcagtcacgtaaacccccgtcttggcccttgca

SEQ ID NO: 176566 - DNA, 35 bp, Artificial Sequence
  Synthetic oligonucleotide
gacaccccgtcgtttcccaccttgtgctagcctca

SEQ ID NO: 176567 - DNA, 35 bp, Artificial Sequence
  Synthetic oligonucleotide
taggaggggatacggggtagagcgaaagagggtca

SEQ ID NO: 176568 - DNA, 36 bp, Artificial Sequence
  Synthetic oligonucleotide
ttgggatgggagggcgccaagacgggacattaaaga

SEQ ID NO: 176569 - DNA, 37 bp, Artificial Sequence
  Synthetic oligonucleotide
gccgcgggcgggcgagtcgggagggaacacagctaga

SEQ ID NO: 176570 - DNA, 37 bp, Artificial Sequence
  Synthetic oligonucleotide
aatcccaccctcctgttatcgcggaccactgagacga

SEQ ID NO: 176571 - DNA, 37 bp, Artificial Sequence
  Synthetic oligonucleotide
gtgcactggcctcaacctcgtatttgcgccgacccga

SEQ ID NO: 176572 - DNA, 36 bp, Artificial Sequence
  Synthetic oligonucleotide
tttccgctgcaccaccgtttcttcgtcatagcccga

SEQ ID NO: 176573 - DNA, 37 bp, Artificial Sequence
  Synthetic oligonucleotide
attcactcccatctcgctgcacttgtgcctgttccga

SEQ ID NO: 176574 - DNA, 37 bp, Artificial Sequence
  Synthetic oligonucleotide
tcaaccccgccccttatcatagcaacgccctgagcga

SEQ ID NO: 176575 - DNA, 35 bp, Artificial Sequence
  Synthetic oligonucleotide
tcaccgccctctcctagccccctctcacgctgcga

SEQ ID NO: 176576 - DNA, 37 bp, Artificial Sequence
  Synthetic oligonucleotide
acccgcctatccccgctcgcatttcagtccgctgcga

SEQ ID NO: 176577 - DNA, 37 bp, Artificial Sequence
  Synthetic oligonucleotide
aatcaaagaaggcaagaggggataatgcggggaagga

SEQ ID NO: 176578 - DNA, 36 bp, Artificial Sequence
  Synthetic oligonucleotide
tgacccatacctgttatgccccatcctttgtgcgga

SEQ ID NO: 176579 - DNA, 37 bp, Artificial Sequence
  Synthetic oligonucleotide
acctgacccatcgccatttttcgacctccttatcgga

SEQ ID NO: 176580 - DNA, 37 bp, Artificial Sequence
  Synthetic oligonucleotide
ggggttggcgggcaaacggcggagggcaaaacgggga

SEQ ID NO: 176581 - DNA, 37 bp, Artificial Sequence
  Synthetic oligonucleotide
gtaggtgaaagcagagggaggagagaattaaggggga

SEQ ID NO: 176582 - DNA, 35 bp, Artificial Sequence
  Synthetic oligonucleotide
gagcatagaagaccgggaaggaaacggcatgggga

SEQ ID NO: 176583 - DNA, 37 bp, Artificial Sequence
  Synthetic oligonucleotide
aagaaggggcggggcatgggattggaccttaatggga

SEQ ID NO: 176584 - DNA, 37 bp, Artificial Sequence
  Synthetic oligonucleotide
tacgatcctcaccgccactctcaacacccctcctgga

SEQ ID NO: 176585 - DNA, 38 bp, Artificial Sequence
  Synthetic oligonucleotide
gcgctgaaagtcgggggggaggagcgcgtggacaatga

SEQ ID NO: 176586 - DNA, 36 bp, Artificial Sequence
  Synthetic oligonucleotide
gacgcactctctgcccttccgtacatgcgaacctga

SEQ ID NO: 176587 - DNA, 38 bp, Artificial Sequence
  Synthetic oligonucleotide
gcgccctcgcgctcattctattttgcttagccccctga

SEQ ID NO: 176588 - DNA, 37 bp, Artificial Sequence
  Synthetic oligonucleotide
ggacgacccccagcctgtattgcggccccctcgctga

SEQ ID NO: 176589 - DNA, 37 bp, Artificial Sequence
  Synthetic oligonucleotide
atcactcgctttccactgttgtcctttccttctctga

SEQ ID NO: 176590 - DNA, 35 bp, Artificial Sequence
  Synthetic oligonucleotide
gacaacatagcgtatacgatgtcccccccccgtga

SEQ ID NO: 176591 - DNA, 38 bp, Artificial Sequence
  Synthetic oligonucleotide
tgggccccacagctcgtacctttcaccccgccccgtga

SEQ ID NO: 176592 - DNA, 37 bp, Artificial Sequence
  Synthetic oligonucleotide
ggggggatgaggggaggtggacgcgggctcatggtga

SEQ ID NO: 176593 - DNA, 37 bp, Artificial Sequence
  Synthetic oligonucleotide
gaaatgggggggtaaccggtgggaggggcggtattga

SEQ ID NO: 176594 - DNA, 38 bp, Artificial Sequence
  Synthetic oligonucleotide
gatacccgcgctatggctctgccccacgcactccttga

SEQ ID NO: 176595 - DNA, 38 bp, Artificial Sequence
  Synthetic oligonucleotide
ggggcgggagagggtggggaaacatctttcgcgcttga

SEQ ID NO: 176596 - DNA, 38 bp, Artificial Sequence
  Synthetic oligonucleotide
gggacgggagggcgaggaatagccgggtgttctgttga

SEQ ID NO: 176597 - DNA, 38 bp, Artificial Sequence
  Synthetic oligonucleotide
acagctcacggtagctcgtgcatcctccctcgttttga

SEQ ID NO: 176598 - DNA, 38 bp, Artificial Sequence
  Synthetic oligonucleotide
accccactgcccacctgaggtcacgaacacggttttga

SEQ ID NO: 176599 - DNA, 36 bp, Artificial Sequence
  Synthetic oligonucleotide
actgacccccgacctcatgcgccgttcccgagcata

SEQ ID NO: 176600 - DNA, 36 bp, Artificial Sequence
  Synthetic oligonucleotide
tgtgcactgacctgctgtgcgctcccacctctcata

SEQ ID NO: 176601 - DNA, 36 bp, Artificial Sequence
  Synthetic oligonucleotide
atgccccgccccaatgcatttaccaccctggagata

SEQ ID NO: 176602 - DNA, 36 bp, Artificial Sequence
  Synthetic oligonucleotide
atgagtgcgatgcgtacatccctgccttactaccta

SEQ ID NO: 176603 - DNA, 36 bp, Artificial Sequence
  Synthetic oligonucleotide
tggaccctcatcaagcctttcgtcgcacctctcgta

SEQ ID NO: 176604 - DNA, 36 bp, Artificial Sequence
  Synthetic oligonucleotide
accgcctcaggccacccctcctactcgttctgtgta

SEQ ID NO: 176605 - DNA, 36 bp, Artificial Sequence
  Synthetic oligonucleotide
accccgcatcctggctcatcctcattaggctactta

SEQ ID NO: 176606 - DNA, 35 bp, Artificial Sequence
  Synthetic oligonucleotide
tctcagcccacttcgagtccgactcagctctctta

SEQ ID NO: 176607 - DNA, 35 bp, Artificial Sequence
  Synthetic oligonucleotide
tccaccggaggaggcgaccctcgttccccttctta

SEQ ID NO: 176608 - DNA, 35 bp, Artificial Sequence
  Synthetic oligonucleotide
tacgccactcctgcccgccggcgccctcaccgaac

SEQ ID NO: 176609 - DNA, 35 bp, Artificial Sequence
  Synthetic oligonucleotide
ttgacctccgagttatcgtttctttcctttggaac

SEQ ID NO: 176610 - DNA, 35 bp, Artificial Sequence
  Synthetic oligonucleotide
gtcctccccagatgctccccattcgccccttgaac

SEQ ID NO: 176611 - DNA, 35 bp, Artificial Sequence
  Synthetic oligonucleotide
gcctcgatctgtggctacgcttgcactacctccac

SEQ ID NO: 176612 - DNA, 35 bp, Artificial Sequence
  Synthetic oligonucleotide
tccccccgcatggacttgccaacgcacattgctac

SEQ ID NO: 176613 - DNA, 35 bp, Artificial Sequence
  Synthetic oligonucleotide
gtctgtcctccttgccgtattgtcgatctctttac

SEQ ID NO: 176614 - DNA, 35 bp, Artificial Sequence
  Synthetic oligonucleotide
gcctgttctagctgactttgatcacatgcctaacc

SEQ ID NO: 176615 - DNA, 35 bp, Artificial Sequence
  Synthetic oligonucleotide
tgccccatgccaaacggtctggccaatgtaccacc

SEQ ID NO: 176616 - DNA, 35 bp, Artificial Sequence
  Synthetic oligonucleotide
acgcaaccccctccgcacacccgctaggcttcacc

SEQ ID NO: 176617 - DNA, 35 bp, Artificial Sequence
  Synthetic oligonucleotide
gccgaggtcgcccccctcgcaggatcgttcccccc

SEQ ID NO: 176618 - DNA, 35 bp, Artificial Sequence
  Synthetic oligonucleotide
accatgaccgtacctcctttcagccgactgacgcc

SEQ ID NO: 176619 - DNA, 35 bp, Artificial Sequence
  Synthetic oligonucleotide
gtcacgtacggccatccttgctactgaaccatgcc

SEQ ID NO: 176620 - DNA, 35 bp, Artificial Sequence
  Synthetic oligonucleotide
aaacctgtcaagcgctgcccctgtatttcccctcc

SEQ ID NO: 176621 - DNA, 35 bp, Artificial Sequence
  Synthetic oligonucleotide
ttatcggccctccacgatgcatcattgtcacttcc

SEQ ID NO: 176622 - DNA, 35 bp, Artificial Sequence
  Synthetic oligonucleotide
gaggatgccgcagttcacggctgccttcgctttcc

SEQ ID NO: 176623 - DNA, 35 bp, Artificial Sequence
  Synthetic oligonucleotide
acaccacgcctgtctctcactgagggaacacccgc

SEQ ID NO: 176624 - DNA, 35 bp, Artificial Sequence
  Synthetic oligonucleotide
tgattcttctcgccactggtgctgttgccccccgc

SEQ ID NO: 176625 - DNA, 35 bp, Artificial Sequence
  Synthetic oligonucleotide
tcacttgaaccttccgttgcctcccgtttcggtgc

SEQ ID NO: 176626 - DNA, 35 bp, Artificial Sequence
  Synthetic oligonucleotide
tctacgtcgtcgcatagtatcgcccatccccaatc

SEQ ID NO: 176627 - DNA, 35 bp, Artificial Sequence
  Synthetic oligonucleotide
gtggtagcactcatcacatggctaaccgttctatc

SEQ ID NO: 176628 - DNA, 35 bp, Artificial Sequence
  Synthetic oligonucleotide
aggaagtccaggcgcctccccccctcgttacactc

SEQ ID NO: 176629 - DNA, 35 bp, Artificial Sequence
  Synthetic oligonucleotide
tccagttcgccttgcgtgtcacatactgttacctc

SEQ ID NO: 176630 - DNA, 35 bp, Artificial Sequence
  Synthetic oligonucleotide
acccgccgcgctccgcgagtttccctcgtgccctc

SEQ ID NO: 176631 - DNA, 35 bp, Artificial Sequence
  Synthetic oligonucleotide
ggcgtgagccaatataccgtttgatcctgtccctc

SEQ ID NO: 176632 - DNA, 35 bp, Artificial Sequence
  Synthetic oligonucleotide
tttgaccacgtctttttgtatccgctatccctctc

SEQ ID NO: 176633 - DNA, 35 bp, Artificial Sequence
  Synthetic oligonucleotide
gtggtcaccgtaccttctcgcccctgccgacagtc

SEQ ID NO: 176634 - DNA, 35 bp, Artificial Sequence
  Synthetic oligonucleotide
tcacgacgcacggagtcagactatgccacctcgtc

SEQ ID NO: 176635 - DNA, 34 bp, Artificial Sequence
  Synthetic oligonucleotide
gttggctcactcccgcttaagcgccgtttaattc

SEQ ID NO: 176636 - DNA, 35 bp, Artificial Sequence
  Synthetic oligonucleotide
aatcgctgctcagtgccagcattctccctcgcttc

SEQ ID NO: 176637 - DNA, 35 bp, Artificial Sequence
  Synthetic oligonucleotide
cccatagtcggaggacagctatccgtcgcccgttc

SEQ ID NO: 176638 - DNA, 35 bp, Artificial Sequence
  Synthetic oligonucleotide
acgctcccgtacatgttcagttcgccccgtatttc

SEQ ID NO: 176639 - DNA, 35 bp, Artificial Sequence
  Synthetic oligonucleotide
agaggacgacggggtgagggcaagtagatctagag

SEQ ID NO: 176640 - DNA, 35 bp, Artificial Sequence
  Synthetic oligonucleotide
tgcgacctccgagcccttttgccactatttcctag

SEQ ID NO: 176641 - DNA, 35 bp, Artificial Sequence
  Synthetic oligonucleotide
caactcgcccccctcacatgtactgcctttcttag

SEQ ID NO: 176642 - DNA, 35 bp, Artificial Sequence
  Synthetic oligonucleotide
aatggagctccgtctggcacgcccgcccccacacg

SEQ ID NO: 176643 - DNA, 35 bp, Artificial Sequence
  Synthetic oligonucleotide
gtaccacccgtcccccccgaagccaggagcagacg

SEQ ID NO: 176644 - DNA, 35 bp, Artificial Sequence
  Synthetic oligonucleotide
acccctgtcggctacaacacgtttcaccccccccg

SEQ ID NO: 176645 - DNA, 35 bp, Artificial Sequence
  Synthetic oligonucleotide
gccttacgtctcacgatctcgaagcccctcctccg

SEQ ID NO: 176646 - DNA, 35 bp, Artificial Sequence
  Synthetic oligonucleotide
atcgagcaccccccatcctcaccctcggatcatcg

SEQ ID NO: 176647 - DNA, 35 bp, Artificial Sequence
  Synthetic oligonucleotide
tgcgaacggcaatcctccgctccctatgttcacgg

SEQ ID NO: 176648 - DNA, 35 bp, Artificial Sequence
  Synthetic oligonucleotide
tactatgacagctctgtttccatctctacccccgg

SEQ ID NO: 176649 - DNA, 35 bp, Artificial Sequence
  Synthetic oligonucleotide
tgaccagctgcttcgccgttcccgctcctctccgg

SEQ ID NO: 176650 - DNA, 35 bp, Artificial Sequence
  Synthetic oligonucleotide
atgagggaaggagaagactggaggtgtgctggggg

SEQ ID NO: 176651 - DNA, 35 bp, Artificial Sequence
  Synthetic oligonucleotide
gccccctaccaccgaccctgttacctcgtggactg

SEQ ID NO: 176652 - DNA, 35 bp, Artificial Sequence
  Synthetic oligonucleotide
acaactcgcatccacggcctcgtagcctacacctg

SEQ ID NO: 176653 - DNA, 34 bp, Artificial Sequence
  Synthetic oligonucleotide
tacacccaccgcacattctgctgcctactacgtg

SEQ ID NO: 176654 - DNA, 35 bp, Artificial Sequence
  Synthetic oligonucleotide
acgagtagggtgggggaacgaactaggaataacat

SEQ ID NO: 176655 - DNA, 35 bp, Artificial Sequence
  Synthetic oligonucleotide
tctgagccgccgcctaatctggctatatgtcacct

SEQ ID NO: 176656 - DNA, 35 bp, Artificial Sequence
  Synthetic oligonucleotide
ggaggacacccggacacatatatattcaccaccct

SEQ ID NO: 176657 - DNA, 35 bp, Artificial Sequence
  Synthetic oligonucleotide
gagtccacagatcgatctgccgcgcctttagccct

SEQ ID NO: 176658 - DNA, 35 bp, Artificial Sequence
  Synthetic oligonucleotide
ttcagcacgaaggagttcccccattccgccctcct

SEQ ID NO: 176659 - DNA, 35 bp, Artificial Sequence
  Synthetic oligonucleotide
tgacccacgcatcccttccccctggcggatttcct

SEQ ID NO: 176660 - DNA, 35 bp, Artificial Sequence
  Synthetic oligonucleotide
tatgtccgcagttgcctcataccagtttttcatct

SEQ ID NO: 176661 - DNA, 35 bp, Artificial Sequence
  Synthetic oligonucleotide
gttctgccgtaacgtctaggtacctgcaattctct

SEQ ID NO: 176662 - DNA, 35 bp, Artificial Sequence
  Synthetic oligonucleotide
tgtcctctctgcaaccatgtgttcgtctcccttct

SEQ ID NO: 176663 - DNA, 35 bp, Artificial Sequence
  Synthetic oligonucleotide
tgctggtcctaggcgctgctcccatcccctcacgt

SEQ ID NO: 176664 - DNA, 34 bp, Artificial Sequence
  Synthetic oligonucleotide
tccgtccatgccatatggccccttcacctactgt

SEQ ID NO: 176665 - DNA, 35 bp, Artificial Sequence
  Synthetic oligonucleotide
gttcctccgccgtgaccaacgtatgcgatccactt

SEQ ID NO: 176666 - DNA, 35 bp, Artificial Sequence
  Synthetic oligonucleotide
agctgcctcccccggtgttaaaccctctcgcgctt

SEQ ID NO: 176667 - DNA, 35 bp, Artificial Sequence
  Synthetic oligonucleotide
tgcagggcatacatcgtcttggtctacacctcgtt

SEQ ID NO: 176668 - DNA, 35 bp, Artificial Sequence
  Synthetic oligonucleotide
gattacgcgcccgctgaaatagctgttcccctgtt

SEQ ID NO: 176669 - DNA, 35 bp, Artificial Sequence
  Synthetic oligonucleotide
gtcatccgcgctatcgtgaccttctacacgtcttt

SEQ ID NO: 176670 - DNA, 36 bp, Artificial Sequence
  Synthetic oligonucleotide
gaccgcatcagcctcccgcgtctcgtcccccaacaa

SEQ ID NO: 176671 - DNA, 36 bp, Artificial Sequence
  Synthetic oligonucleotide
atggtgagtgggaattaggggcagggaggagaacaa

SEQ ID NO: 176672 - DNA, 36 bp, Artificial Sequence
  Synthetic oligonucleotide
gcctcctccttgtgccatttcgccgcttacagccaa

SEQ ID NO: 176673 - DNA, 36 bp, Artificial Sequence
  Synthetic oligonucleotide
gcctgcgcaggacgggcggaggaaagggaaaaagaa

SEQ ID NO: 176674 - DNA, 36 bp, Artificial Sequence
  Synthetic oligonucleotide
atctcagccgaggggttgggctagggggggttcgaa

SEQ ID NO: 176675 - DNA, 36 bp, Artificial Sequence
  Synthetic oligonucleotide
gaggtgggggtgaggggtacggtactaacaacataa

SEQ ID NO: 176676 - DNA, 35 bp, Artificial Sequence
  Synthetic oligonucleotide
gcgctggccccacttgggcatcaccctcgaccaca

SEQ ID NO: 176677 - DNA, 35 bp, Artificial Sequence
  Synthetic oligonucleotide
tgccaagtcactgccggcctttcgcatttaccaca

SEQ ID NO: 176678 - DNA, 35 bp, Artificial Sequence
  Synthetic oligonucleotide
atttccccccacagagtgactcgctgcttgccaca

SEQ ID NO: 176679 - DNA, 35 bp, Artificial Sequence
  Synthetic oligonucleotide
accatgaccgtctcgccagagcaacccgcccacca

SEQ ID NO: 176680 - DNA, 35 bp, Artificial Sequence
  Synthetic oligonucleotide
aggacgggagagggagggaagagattacaatgcca

SEQ ID NO: 176681 - DNA, 35 bp, Artificial Sequence
  Synthetic oligonucleotide
gttgcacgctcgctactagacacgcactacctcca

SEQ ID NO: 176682 - DNA, 36 bp, Artificial Sequence
  Synthetic oligonucleotide
attccaccctgatccgcacatttagacgaatctcca

SEQ ID NO: 176683 - DNA, 36 bp, Artificial Sequence
  Synthetic oligonucleotide
tttgggcgggagggtgagtagggtggcggtgatgca

SEQ ID NO: 176684 - DNA, 36 bp, Artificial Sequence
  Synthetic oligonucleotide
atgcccattgattctgcacatcagacgccctcctca

SEQ ID NO: 176685 - DNA, 35 bp, Artificial Sequence
  Synthetic oligonucleotide
gtcataggcataatgccccttctcctacctgctca

SEQ ID NO: 176686 - DNA, 36 bp, Artificial Sequence
  Synthetic oligonucleotide
ttcagccaccatcgtagctctcgttttagtctctca

SEQ ID NO: 176687 - DNA, 36 bp, Artificial Sequence
  Synthetic oligonucleotide
agcgggtaaatgagggtgaggtggaacgggaaaaga

SEQ ID NO: 176688 - DNA, 37 bp, Artificial Sequence
  Synthetic oligonucleotide
gaccgggtgggacttgatgccatgcagggaggggaga

SEQ ID NO: 176689 - DNA, 37 bp, Artificial Sequence
  Synthetic oligonucleotide
gcgaggctagggagggtaaggggcacgggattggaga

SEQ ID NO: 176690 - DNA, 36 bp, Artificial Sequence
  Synthetic oligonucleotide
ggagcgggggtatgggggaaggtggcaagcagtaga

SEQ ID NO: 176691 - DNA, 36 bp, Artificial Sequence
  Synthetic oligonucleotide
tgagcgccgtccccggtaccgaatctccctccccga

SEQ ID NO: 176692 - DNA, 36 bp, Artificial Sequence
  Synthetic oligonucleotide
gcatccccccctcgacgataatttaggcgtccccga

SEQ ID NO: 176693 - DNA, 37 bp, Artificial Sequence
  Synthetic oligonucleotide
tacgcttgtacgggcctttactccacccatctcccga

SEQ ID NO: 176694 - DNA, 37 bp, Artificial Sequence
  Synthetic oligonucleotide
tgccgcccgcctatttcaattacgtcatcgctgccga

SEQ ID NO: 176695 - DNA, 37 bp, Artificial Sequence
  Synthetic oligonucleotide
gaaggggatggaaatggacacgtacagcgggaaggga

SEQ ID NO: 176696 - DNA, 37 bp, Artificial Sequence
  Synthetic oligonucleotide
gggaaggagccggaagggagcatgtggaggctaggga

SEQ ID NO: 176697 - DNA, 37 bp, Artificial Sequence
  Synthetic oligonucleotide
gcccgtgcggggtgtcctaggggcgcgtattagggga

SEQ ID NO: 176698 - DNA, 37 bp, Artificial Sequence
  Synthetic oligonucleotide
ggatgggaggggtatacttagggaggtttctcgggga

SEQ ID NO: 176699 - DNA, 37 bp, Artificial Sequence
  Synthetic oligonucleotide
agggggagggtgcggatagcgtacacgggtaggggga

SEQ ID NO: 176700 - DNA, 37 bp, Artificial Sequence
  Synthetic oligonucleotide
ttagggcaaactattcgggtgggcatgattcggggga

SEQ ID NO: 176701 - DNA, 37 bp, Artificial Sequence
  Synthetic oligonucleotide
ttggtaggcgatggggaggaggacgaaggaatgggga

SEQ ID NO: 176702 - DNA, 37 bp, Artificial Sequence
  Synthetic oligonucleotide
aacagcgaaggcggacgggtggcggggggttatggga

SEQ ID NO: 176703 - DNA, 35 bp, Artificial Sequence
  Synthetic oligonucleotide
gcaacagccacctatatctgcactttacctctgga

SEQ ID NO: 176704 - DNA, 37 bp, Artificial Sequence
  Synthetic oligonucleotide
ggtcgcggggagcaagggaatgagctgggtggttgga

SEQ ID NO: 176705 - DNA, 37 bp, Artificial Sequence
  Synthetic oligonucleotide
ttcgcaccgccccccctgcttaacggtagttaaatga

SEQ ID NO: 176706 - DNA, 38 bp, Artificial Sequence
  Synthetic oligonucleotide
aagagagacgtggagggaggtaagtaggacggcaatga

SEQ ID NO: 176707 - DNA, 38 bp, Artificial Sequence
  Synthetic oligonucleotide
atgggagtacggagggaagggatattagtgtggaatga

SEQ ID NO: 176708 - DNA, 38 bp, Artificial Sequence
  Synthetic oligonucleotide
gtgggcgggagttaggggcggaaaagggggttgcatga

SEQ ID NO: 176709 - DNA, 38 bp, Artificial Sequence
  Synthetic oligonucleotide
tagcgagagcaggatgagagggggggataacgcgctga

SEQ ID NO: 176710 - DNA, 38 bp, Artificial Sequence
  Synthetic oligonucleotide
tgaccagggggaaaatgaggatgggaacgacaggctga

SEQ ID NO: 176711 - DNA, 38 bp, Artificial Sequence
  Synthetic oligonucleotide
tgcggtctcgccctccatgcctctacgtacactagtga

SEQ ID NO: 176712 - DNA, 37 bp, Artificial Sequence
  Synthetic oligonucleotide
gtagggacagtaagtaggaggggatgtttgagcgtga

SEQ ID NO: 176713 - DNA, 38 bp, Artificial Sequence
  Synthetic oligonucleotide
ggacgtggagctgaaaatgaggggggagcggggcgtga

SEQ ID NO: 176714 - DNA, 37 bp, Artificial Sequence
  Synthetic oligonucleotide
tgaaggttatggtgggcatgggggagggcacaggtga

SEQ ID NO: 176715 - DNA, 38 bp, Artificial Sequence
  Synthetic oligonucleotide
actgcactctcatgcgctcaccatcgacccccctgtga

SEQ ID NO: 176716 - DNA, 38 bp, Artificial Sequence
  Synthetic oligonucleotide
acttcgggcgggtgggacacggggtcgtcgctctgtga

SEQ ID NO: 176717 - DNA, 38 bp, Artificial Sequence
  Synthetic oligonucleotide
taggggaggggaagatattgaacatgggataggattga

SEQ ID NO: 176718 - DNA, 37 bp, Artificial Sequence
  Synthetic oligonucleotide
ttcatcgccgccgataagcccttccatgtactattga

SEQ ID NO: 176719 - DNA, 38 bp, Artificial Sequence
  Synthetic oligonucleotide
tccccactccgacgctgtcctaggccctcttcacttga

SEQ ID NO: 176720 - DNA, 38 bp, Artificial Sequence
  Synthetic oligonucleotide
tcgaccgacctcctcattttcattcgaacactccttga

SEQ ID NO: 176721 - DNA, 38 bp, Artificial Sequence
  Synthetic oligonucleotide
tcggacccggccacccatgctccattccccctgcttga

SEQ ID NO: 176722 - DNA, 36 bp, Artificial Sequence
  Synthetic oligonucleotide
gatcctacgctgacggccactcgactcccctcttga

SEQ ID NO: 176723 - DNA, 38 bp, Artificial Sequence
  Synthetic oligonucleotide
gacggtgaagtgcgcatctggcccgttgttcctcttga

SEQ ID NO: 176724 - DNA, 38 bp, Artificial Sequence
  Synthetic oligonucleotide
gcaccccttcctgttttccgcacgagctcacagtttga

SEQ ID NO: 176725 - DNA, 36 bp, Artificial Sequence
  Synthetic oligonucleotide
tccgacccattctccatgttatttgttcacccaata

SEQ ID NO: 176726 - DNA, 35 bp, Artificial Sequence
  Synthetic oligonucleotide
gtccttagccctccttgttacggagttccgctcta

SEQ ID NO: 176727 - DNA, 37 bp, Artificial Sequence
  Synthetic oligonucleotide
acacccaccgctcacctttccttgcgccacagttcta

SEQ ID NO: 176728 - DNA, 36 bp, Artificial Sequence
  Synthetic oligonucleotide
tgtccgcggcattggctagtctctctcacctccgta

SEQ ID NO: 176729 - DNA, 35 bp, Artificial Sequence
  Synthetic oligonucleotide
tcaacaccctgcctcacctctagttatcaaaggta

SEQ ID NO: 176730 - DNA, 36 bp, Artificial Sequence
  Synthetic oligonucleotide
tcagaccgctgggcttgcaagtacgcctccacctta

SEQ ID NO: 176731 - DNA, 36 bp, Artificial Sequence
  Synthetic oligonucleotide
tgcgactccatccctgcgcgataggtctcactctta

SEQ ID NO: 176732 - DNA, 36 bp, Artificial Sequence
  Synthetic oligonucleotide
gtgcctccccattcgtgcgctcgttacccgcgttta

SEQ ID NO: 176733 - DNA, 35 bp, Artificial Sequence
  Synthetic oligonucleotide
tgtgtctcctccaactgctacaccgacttctttta

SEQ ID NO: 176734 - DNA, 35 bp, Artificial Sequence
  Synthetic oligonucleotide
atcacctccagccggccctgactcgtacgtacaac

SEQ ID NO: 176735 - DNA, 35 bp, Artificial Sequence
  Synthetic oligonucleotide
tgtacgcgataagcgtttgtcctgtgcccccacac

SEQ ID NO: 176736 - DNA, 35 bp, Artificial Sequence
  Synthetic oligonucleotide
tgcccgtacgctatcacgtcatatatcccgcccac

SEQ ID NO: 176737 - DNA, 35 bp, Artificial Sequence
  Synthetic oligonucleotide
gaaacgcaaaatctgctctcccggtccgttcccac

SEQ ID NO: 176738 - DNA, 35 bp, Artificial Sequence
  Synthetic oligonucleotide
tttggcccccctctgttgacgcacccgctatgtac

SEQ ID NO: 176739 - DNA, 35 bp, Artificial Sequence
  Synthetic oligonucleotide
tgtgtcccctcagctgcttttttcaacacctttac

SEQ ID NO: 176740 - DNA, 35 bp, Artificial Sequence
  Synthetic oligonucleotide
tatgcggtaacgacgccttctgatctagccccacc

SEQ ID NO: 176741 - DNA, 35 bp, Artificial Sequence
  Synthetic oligonucleotide
gctctgcgccacggattcgttcacgcgccttcacc

SEQ ID NO: 176742 - DNA, 35 bp, Artificial Sequence
  Synthetic oligonucleotide
taccgcctaacctctgttgtgagccccatccgacc

SEQ ID NO: 176743 - DNA, 35 bp, Artificial Sequence
  Synthetic oligonucleotide
tgcacgttcactcccctcgcccgcagtagtctacc

SEQ ID NO: 176744 - DNA, 35 bp, Artificial Sequence
  Synthetic oligonucleotide
tttccctccccccgggcgcgcctggtcgctttacc

SEQ ID NO: 176745 - DNA, 35 bp, Artificial Sequence
  Synthetic oligonucleotide
aatgggtgggcaacgggctgtaaccgggagcaccc

SEQ ID NO: 176746 - DNA, 34 bp, Artificial Sequence
  Synthetic oligonucleotide
gccccccccaccatccactgggccattccacgcc

SEQ ID NO: 176747 - DNA, 35 bp, Artificial Sequence
  Synthetic oligonucleotide
tcccatcgtgacttacccgcgccttgcagcccgcc

SEQ ID NO: 176748 - DNA, 35 bp, Artificial Sequence
  Synthetic oligonucleotide
atcagcaccggcaatcacactcgctcattcgcgcc

SEQ ID NO: 176749 - DNA, 35 bp, Artificial Sequence
  Synthetic oligonucleotide
gtcccaagctcgcccatgctgcctagtctattgcc

SEQ ID NO: 176750 - DNA, 35 bp, Artificial Sequence
  Synthetic oligonucleotide
tgtgcccatcccccgcgccttcataaacacttgcc

SEQ ID NO: 176751 - DNA, 35 bp, Artificial Sequence
  Synthetic oligonucleotide
gtctcgccacctgtcctgttgaacccatccttgcc

SEQ ID NO: 176752 - DNA, 35 bp, Artificial Sequence
  Synthetic oligonucleotide
attccaccacattgcctaccgtgactatcacctcc

SEQ ID NO: 176753 - DNA, 35 bp, Artificial Sequence
  Synthetic oligonucleotide
tgcccgcaaaggtgcaagtctccttttcccgctcc

SEQ ID NO: 176754 - DNA, 35 bp, Artificial Sequence
  Synthetic oligonucleotide
gtgggtctgtcgatcctgtcaactctctcatctcc

SEQ ID NO: 176755 - DNA, 35 bp, Artificial Sequence
  Synthetic oligonucleotide
gactacagccatcacactattgatctccggggtcc

SEQ ID NO: 176756 - DNA, 35 bp, Artificial Sequence
  Synthetic oligonucleotide
gattcgccggaggtcctatcagcagtcttccttcc

SEQ ID NO: 176757 - DNA, 35 bp, Artificial Sequence
  Synthetic oligonucleotide
aacacggcttgcccctctctagtacccgttgttcc

SEQ ID NO: 176758 - DNA, 35 bp, Artificial Sequence
  Synthetic oligonucleotide
gtaccccaacgcctctacgttgcgtctttagacgc

SEQ ID NO: 176759 - DNA, 35 bp, Artificial Sequence
  Synthetic oligonucleotide
acgtcatcaatcggtcttccagcatcatcgccatc

SEQ ID NO: 176760 - DNA, 35 bp, Artificial Sequence
  Synthetic oligonucleotide
taggtactgccgccgtcctccctgttacacgcatc

SEQ ID NO: 176761 - DNA, 35 bp, Artificial Sequence
  Synthetic oligonucleotide
tacaccccgcctttcgtatcctcgagccccacctc

SEQ ID NO: 176762 - DNA, 35 bp, Artificial Sequence
  Synthetic oligonucleotide
gccattgatcgcacttagccctacgccagtacctc

SEQ ID NO: 176763 - DNA, 35 bp, Artificial Sequence
  Synthetic oligonucleotide
accaccccgatgccctatacacgctctagctcctc

SEQ ID NO: 176764 - DNA, 35 bp, Artificial Sequence
  Synthetic oligonucleotide
aacgccatccgggcctataacccagactccatctc

SEQ ID NO: 176765 - DNA, 35 bp, Artificial Sequence
  Synthetic oligonucleotide
ttgcacatgtactctgcttctcgttacgggttctc

SEQ ID NO: 176766 - DNA, 35 bp, Artificial Sequence
  Synthetic oligonucleotide
tccccgttccgctatcaagtgcctttccttccgtc

SEQ ID NO: 176767 - DNA, 34 bp, Artificial Sequence
  Synthetic oligonucleotide
aaccatccaacggtaacagccgggccgtgccttc

SEQ ID NO: 176768 - DNA, 35 bp, Artificial Sequence
  Synthetic oligonucleotide
tgtgtcaaacgctggtcccgacactcccttgcttc

SEQ ID NO: 176769 - DNA, 35 bp, Artificial Sequence
  Synthetic oligonucleotide
ttagcccaggactatcatacgaagctcacctcttc

SEQ ID NO: 176770 - DNA, 35 bp, Artificial Sequence
  Synthetic oligonucleotide
tccccaccctgactcgttaccatcgccactcgttc

SEQ ID NO: 176771 - DNA, 35 bp, Artificial Sequence
  Synthetic oligonucleotide
tacgctgccgcgtatgcatcttatatctgtctttc

SEQ ID NO: 176772 - DNA, 35 bp, Artificial Sequence
  Synthetic oligonucleotide
gtgtgcctcccgcccctttgcaagacttaacttag

SEQ ID NO: 176773 - DNA, 35 bp, Artificial Sequence
  Synthetic oligonucleotide
aagcccaggccgcccacccatcatacctctgttag

SEQ ID NO: 176774 - DNA, 35 bp, Artificial Sequence
  Synthetic oligonucleotide
gtatcccgcccttgttttgaaattgcttttgtccg

SEQ ID NO: 176775 - DNA, 35 bp, Artificial Sequence
  Synthetic oligonucleotide
tgaggaggtgagttatgagggagggtggtaaggcg

SEQ ID NO: 176776 - DNA, 35 bp, Artificial Sequence
  Synthetic oligonucleotide
ttacgcccttagatgcttatgtcctttcctttgcg

SEQ ID NO: 176777 - DNA, 35 bp, Artificial Sequence
  Synthetic oligonucleotide
accgtccgcctatcagccaacccgttccatcatcg

SEQ ID NO: 176778 - DNA, 35 bp, Artificial Sequence
  Synthetic oligonucleotide
gccacaccagttacccccaagaactcccttcatcg

SEQ ID NO: 176779 - DNA, 35 bp, Artificial Sequence
  Synthetic oligonucleotide
atcccactggtcattgccgcccgaagctactatcg

SEQ ID NO: 176780 - DNA, 35 bp, Artificial Sequence
  Synthetic oligonucleotide
tactcgtgcctcgtgctctgccttgccttttctcg

SEQ ID NO: 176781 - DNA, 35 bp, Artificial Sequence
  Synthetic oligonucleotide
attgccgatccaccataacgtctcccgtcttgtcg

SEQ ID NO: 176782 - DNA, 35 bp, Artificial Sequence
  Synthetic oligonucleotide
aaccaccgcacctgcctccccctgtgcaccattcg

SEQ ID NO: 176783 - DNA, 35 bp, Artificial Sequence
  Synthetic oligonucleotide
ggtccttccccagtgttctgctcgatctcacctgg

SEQ ID NO: 176784 - DNA, 35 bp, Artificial Sequence
  Synthetic oligonucleotide
tagcaccggtattatataacgtacctccgcccctg

SEQ ID NO: 176785 - DNA, 35 bp, Artificial Sequence
  Synthetic oligonucleotide
tgtccagcccgcactctgtcgccacttcgctcctg

SEQ ID NO: 176786 - DNA, 35 bp, Artificial Sequence
  Synthetic oligonucleotide
atggtgccgccaccgccctagcctccctccccgtg

SEQ ID NO: 176787 - DNA, 35 bp, Artificial Sequence
  Synthetic oligonucleotide
tgctcccctccctctcttgatcccagccctcggtg

SEQ ID NO: 176788 - DNA, 35 bp, Artificial Sequence
  Synthetic oligonucleotide
acctccacctgccgcctcgcttgaatgattgcttg

SEQ ID NO: 176789 - DNA, 35 bp, Artificial Sequence
  Synthetic oligonucleotide
gccttgcgctaaatcctgtccattgtccacacgat

SEQ ID NO: 176790 - DNA, 35 bp, Artificial Sequence
  Synthetic oligonucleotide
atgggcgggtgcggggtcatcgagggggtcccgat

SEQ ID NO: 176791 - DNA, 35 bp, Artificial Sequence
  Synthetic oligonucleotide
gtgtgcattccgcctgccctctccatccctcggat

SEQ ID NO: 176792 - DNA, 35 bp, Artificial Sequence
  Synthetic oligonucleotide
gctccacctctacgcttttaacgaaactgctatat

SEQ ID NO: 176793 - DNA, 35 bp, Artificial Sequence
  Synthetic oligonucleotide
taaacagcctcccacctgccgtcgcccgtcttact

SEQ ID NO: 176794 - DNA, 35 bp, Artificial Sequence
  Synthetic oligonucleotide
atgtcggactggccatctatgatgttcgcccccct

SEQ ID NO: 176795 - DNA, 35 bp, Artificial Sequence
  Synthetic oligonucleotide
ttggcccctccgattaccatgcaaactcatcgcct

SEQ ID NO: 176796 - DNA, 35 bp, Artificial Sequence
  Synthetic oligonucleotide
tcaccgcttcatccctgaggatacagtcttcgcct

SEQ ID NO: 176797 - DNA, 35 bp, Artificial Sequence
  Synthetic oligonucleotide
gacgatcttccccctcgtgcttgtcgttttctcct

SEQ ID NO: 176798 - DNA, 35 bp, Artificial Sequence
  Synthetic oligonucleotide
agcttggcccttcctctggttcgttggtaccctct

SEQ ID NO: 176799 - DNA, 35 bp, Artificial Sequence
  Synthetic oligonucleotide
tcaacgcctctttgtccacccacgctgtacggtgt

SEQ ID NO: 176800 - DNA, 35 bp, Artificial Sequence
  Synthetic oligonucleotide
gcactccgccgtcccgttaacggccaaaccacctt

SEQ ID NO: 176801 - DNA, 35 bp, Artificial Sequence
  Synthetic oligonucleotide
atgcccggagctagtaccgtcagtgcctctgcctt

SEQ ID NO: 176802 - DNA, 35 bp, Artificial Sequence
  Synthetic oligonucleotide
aacgtcgtcgtcgccctatcaccttcatgtgcctt

SEQ ID NO: 176803 - DNA, 35 bp, Artificial Sequence
  Synthetic oligonucleotide
accaccgcgactctagcacctgaactatcttcctt

SEQ ID NO: 176804 - DNA, 35 bp, Artificial Sequence
  Synthetic oligonucleotide
gccctcgccggtatggagtgattcttttccctgtt

SEQ ID NO: 176805 - DNA, 35 bp, Artificial Sequence
  Synthetic oligonucleotide
tctatccccgaggtgtggccacggtcccattcttt

SEQ ID NO: 176806 - DNA, 35 bp, Artificial Sequence
  Synthetic oligonucleotide
tgacacctcacggttcctttcccttggtgcatttt

SEQ ID NO: 176807 - DNA, 35 bp, Artificial Sequence
  Synthetic oligonucleotide
gggtaggaaaggaataggatcgggctggggggcaa

SEQ ID NO: 176808 - DNA, 36 bp, Artificial Sequence
  Synthetic oligonucleotide
tcactacggtcccattgctcaatactcacactcgaa

SEQ ID NO: 176809 - DNA, 36 bp, Artificial Sequence
  Synthetic oligonucleotide
acagcaccccctcattggcgcttcatttcagtcaca

SEQ ID NO: 176810 - DNA, 36 bp, Artificial Sequence
  Synthetic oligonucleotide
aacacccagccttccaccgcgataaactcacagaca

SEQ ID NO: 176811 - DNA, 36 bp, Artificial Sequence
  Synthetic oligonucleotide
atgcccccctccctcatagcaaccgtaccaggccca

SEQ ID NO: 176812 - DNA, 36 bp, Artificial Sequence
  Synthetic oligonucleotide
tcctccaccttcaatcgagtcattcttcgctcgcca

SEQ ID NO: 176813 - DNA, 35 bp, Artificial Sequence
  Synthetic oligonucleotide
tttcgcgctgttcctgtccctttctgccgtggcca

SEQ ID NO: 176814 - DNA, 36 bp, Artificial Sequence
  Synthetic oligonucleotide
gagcgccaaatagacccctcccgtccacctgtgcca

SEQ ID NO: 176815 - DNA, 36 bp, Artificial Sequence
  Synthetic oligonucleotide
tagactgcgcagtcagtcaactccttcccagctcca

SEQ ID NO: 176816 - DNA, 35 bp, Artificial Sequence
  Synthetic oligonucleotide
gattgcgtcagcacagccacggccggccctctcca

SEQ ID NO: 176817 - DNA, 35 bp, Artificial Sequence
  Synthetic oligonucleotide
tagagacagtcgggggtagcagggaggatggcgca

SEQ ID NO: 176818 - DNA, 34 bp, Artificial Sequence
  Synthetic oligonucleotide
aagcaccagcccaacgtctgcctacccaccatca

SEQ ID NO: 176819 - DNA, 35 bp, Artificial Sequence
  Synthetic oligonucleotide
ccatcccgccacactgattgcctctgtctctatca

SEQ ID NO: 176820 - DNA, 37 bp, Artificial Sequence
  Synthetic oligonucleotide
gaatgggggaaggatgtagggtgcatggtatgcgaga

SEQ ID NO: 176821 - DNA, 37 bp, Artificial Sequence
  Synthetic oligonucleotide
tttacgccctttgtactgtacactcctccgtcgacga

SEQ ID NO: 176822 - DNA, 37 bp, Artificial Sequence
  Synthetic oligonucleotide
atgcaccgatctggcctatttttgcttctctccccga

SEQ ID NO: 176823 - DNA, 37 bp, Artificial Sequence
  Synthetic oligonucleotide
ttgcaagctacctgcagctaatgcgcccccccgccga

SEQ ID NO: 176824 - DNA, 35 bp, Artificial Sequence
  Synthetic oligonucleotide
tggtcaagcctccttatgtactccctctctgccga

SEQ ID NO: 176825 - DNA, 35 bp, Artificial Sequence
  Synthetic oligonucleotide
gcaacggaccaccgacacgactccaccgcctccga

SEQ ID NO: 176826 - DNA, 37 bp, Artificial Sequence
  Synthetic oligonucleotide
gacggactcgtaggccgcattggaacccactctccga

SEQ ID NO: 176827 - DNA, 37 bp, Artificial Sequence
  Synthetic oligonucleotide
aaccctcgcgccagttttccccttcctgcaacagcga

SEQ ID NO: 176828 - DNA, 37 bp, Artificial Sequence
  Synthetic oligonucleotide
gtagaaggggagggttggcaataagggagaacgcgga

SEQ ID NO: 176829 - DNA, 35 bp, Artificial Sequence
  Synthetic oligonucleotide
taagcccgggaaaggaacgaggggggactcaggga

SEQ ID NO: 176830 - DNA, 37 bp, Artificial Sequence
  Synthetic oligonucleotide
gagcggggcgaatatcgggtgggcggtccgttaggga

SEQ ID NO: 176831 - DNA, 37 bp, Artificial Sequence
  Synthetic oligonucleotide
gtaggaggtggcctagaagaggggggagttgcgggga

SEQ ID NO: 176832 - DNA, 37 bp, Artificial Sequence
  Synthetic oligonucleotide
gacggggatgagggcaacgcacggggaattgggggga

SEQ ID NO: 176833 - DNA, 37 bp, Artificial Sequence
  Synthetic oligonucleotide
ttgccatccactgctgccgttctagtaccccgtggga

SEQ ID NO: 176834 - DNA, 38 bp, Artificial Sequence
  Synthetic oligonucleotide
aagagggtgacggataggaaagcgcgtgaagggactga

SEQ ID NO: 176835 - DNA, 38 bp, Artificial Sequence
  Synthetic oligonucleotide
acacaccctctcaaacgttccatttaggactgccctga

SEQ ID NO: 176836 - DNA, 37 bp, Artificial Sequence
  Synthetic oligonucleotide
gtgcgtacgcactactcccagactaccaccatcctga

SEQ ID NO: 176837 - DNA, 38 bp, Artificial Sequence
  Synthetic oligonucleotide
gaccgcccctgcccccaacccctgagacgccactctga

SEQ ID NO: 176838 - DNA, 38 bp, Artificial Sequence
  Synthetic oligonucleotide
gtgcgggcctccagttcctattatttctgcttctctga

SEQ ID NO: 176839 - DNA, 37 bp, Artificial Sequence
  Synthetic oligonucleotide
gcaacgctacatttctgtttctcatgaccctccgtga

SEQ ID NO: 176840 - DNA, 38 bp, Artificial Sequence
  Synthetic oligonucleotide
tctgtggggagggtggggaaagggcagtcattgggtga

SEQ ID NO: 176841 - DNA, 38 bp, Artificial Sequence
  Synthetic oligonucleotide
acaggaaagggttgaggaggaacggaggaacagtgtga

SEQ ID NO: 176842 - DNA, 38 bp, Artificial Sequence
  Synthetic oligonucleotide
accaggtctgtgctgcctttaactcgcctttaccttga

SEQ ID NO: 176843 - DNA, 38 bp, Artificial Sequence
  Synthetic oligonucleotide
gatgggagacggaggagcgatgtaaggttgcagcttga

SEQ ID NO: 176844 - DNA, 36 bp, Artificial Sequence
  Synthetic oligonucleotide
actgggcgccccacttccactctccgtgttcgttga

SEQ ID NO: 176845 - DNA, 38 bp, Artificial Sequence
  Synthetic oligonucleotide
aggggaagcaagacgctaatgggagggcgggggtttga

SEQ ID NO: 176846 - DNA, 36 bp, Artificial Sequence
  Synthetic oligonucleotide
aaatagccgccccgtgttcctgcccgttttcacata

SEQ ID NO: 176847 - DNA, 36 bp, Artificial Sequence
  Synthetic oligonucleotide
tccgaccatcgtcgccgtcgtttctatgtcttacta

SEQ ID NO: 176848 - DNA, 35 bp, Artificial Sequence
  Synthetic oligonucleotide
atccacccccgaaaggcgtttctcaagggccccta

SEQ ID NO: 176849 - DNA, 36 bp, Artificial Sequence
  Synthetic oligonucleotide
atgctgcgctgcgaacacgacaccttctccgcccta

SEQ ID NO: 176850 - DNA, 36 bp, Artificial Sequence
  Synthetic oligonucleotide
atgcgagagatcacgtcgcctaccttcccgtcccta

SEQ ID NO: 176851 - DNA, 36 bp, Artificial Sequence
  Synthetic oligonucleotide
ttgtccctccctcctcgtgtgcgtacgtcgtggcta

SEQ ID NO: 176852 - DNA, 35 bp, Artificial Sequence
  Synthetic oligonucleotide
actgagggggagtaggggtgtcgggctaggtggta

SEQ ID NO: 176853 - DNA, 35 bp, Artificial Sequence
  Synthetic oligonucleotide
tattctccgccccgcaagacactattgcactccac

SEQ ID NO: 176854 - DNA, 35 bp, Artificial Sequence
  Synthetic oligonucleotide
tatgcacacagcctactccgccgtcccatgagcac

SEQ ID NO: 176855 - DNA, 35 bp, Artificial Sequence
  Synthetic oligonucleotide
gtctcctgcactcccatccaagttcccgtaatgac

SEQ ID NO: 176856 - DNA, 35 bp, Artificial Sequence
  Synthetic oligonucleotide
actgctcagaccccccccggcctgttgtgcgctac

SEQ ID NO: 176857 - DNA, 36 bp, Artificial Sequence
  Synthetic oligonucleotide
tgtgtactcctctgtaatgggcgccctcctctaacc

SEQ ID NO: 176858 - DNA, 35 bp, Artificial Sequence
  Synthetic oligonucleotide
ggggaacccctccgactttttgagtcactcctacc

SEQ ID NO: 176859 - DNA, 35 bp, Artificial Sequence
  Synthetic oligonucleotide
agttggcatctggtctcgtcatcacccccatcccc

SEQ ID NO: 176860 - DNA, 35 bp, Artificial Sequence
  Synthetic oligonucleotide
actggtgacccgctccacgaccgtaatttatcccc

SEQ ID NO: 176861 - DNA, 35 bp, Artificial Sequence
  Synthetic oligonucleotide
aggacacgtatctatcatgccagttcctgctcccc

SEQ ID NO: 176862 - DNA, 35 bp, Artificial Sequence
  Synthetic oligonucleotide
tgagacgatcgtcacatgtgaaaaacccccctccc

SEQ ID NO: 176863 - DNA, 35 bp, Artificial Sequence
  Synthetic oligonucleotide
tctgtagccgccgcttgcgtaaacgtccctgtccc

SEQ ID NO: 176864 - DNA, 35 bp, Artificial Sequence
  Synthetic oligonucleotide
tccccctgcccatcggcttattcgccttgacagcc

SEQ ID NO: 176865 - DNA, 35 bp, Artificial Sequence
  Synthetic oligonucleotide
ttcgacgctttccccctcacccccgtacatacgcc

SEQ ID NO: 176866 - DNA, 35 bp, Artificial Sequence
  Synthetic oligonucleotide
accctcccgccatgtcgcgtcagagtaaactcgcc

SEQ ID NO: 176867 - DNA, 35 bp, Artificial Sequence
  Synthetic oligonucleotide
aatccccataccgtacctgagctccgctccatgcc

SEQ ID NO: 176868 - DNA, 35 bp, Artificial Sequence
  Synthetic oligonucleotide
gaattacaccgcccatggaacgttccgatccctcc

SEQ ID NO: 176869 - DNA, 35 bp, Artificial Sequence
  Synthetic oligonucleotide
tactccccggttgatcgcgtacatctgcctcctcc

SEQ ID NO: 176870 - DNA, 35 bp, Artificial Sequence
  Synthetic oligonucleotide
tcactaacggccctgtgatacactgtcactgctcc

SEQ ID NO: 176871 - DNA, 35 bp, Artificial Sequence
  Synthetic oligonucleotide
tcattcacgccaacttcttcgtaacactcccgtcc

SEQ ID NO: 176872 - DNA, 35 bp, Artificial Sequence
  Synthetic oligonucleotide
actatccgatccccggcgctgccccaatctcgtcc

SEQ ID NO: 176873 - DNA, 35 bp, Artificial Sequence
  Synthetic oligonucleotide
gtgacccgccccctgtacattcactatcgaggagc

SEQ ID NO: 176874 - DNA, 35 bp, Artificial Sequence
  Synthetic oligonucleotide
ggagtacctcttcttctagcctctactgacttcgc

SEQ ID NO: 176875 - DNA, 35 bp, Artificial Sequence
  Synthetic oligonucleotide
atgttcaggcactttgccccttcttcgctcttcgc

SEQ ID NO: 176876 - DNA, 35 bp, Artificial Sequence
  Synthetic oligonucleotide
ggacaaaggttagacaggaggggggagtagcgggc

SEQ ID NO: 176877 - DNA, 35 bp, Artificial Sequence
  Synthetic oligonucleotide
tccgcctctatccatgaacgctccttctatatggc

SEQ ID NO: 176878 - DNA, 35 bp, Artificial Sequence
  Synthetic oligonucleotide
gatacacccttgaagtccgcacctcctctcaatgc

SEQ ID NO: 176879 - DNA, 35 bp, Artificial Sequence
  Synthetic oligonucleotide
gtcccgttcacgcaccgttgtatgcccctctctgc

SEQ ID NO: 176880 - DNA, 35 bp, Artificial Sequence
  Synthetic oligonucleotide
gttgtcatacgcctccccttgagcctattggaatc

SEQ ID NO: 176881 - DNA, 35 bp, Artificial Sequence
  Synthetic oligonucleotide
acctcacggaacacacgtgtacctgcattaccatc

SEQ ID NO: 176882 - DNA, 35 bp, Artificial Sequence
  Synthetic oligonucleotide
actcatccgatccgcactttgttcctgggcccatc

SEQ ID NO: 176883 - DNA, 35 bp, Artificial Sequence
  Synthetic oligonucleotide
tcacggtctgcaattgcatcgtttgccccggcctc

SEQ ID NO: 176884 - DNA, 35 bp, Artificial Sequence
  Synthetic oligonucleotide
gcgcctcccacacttacctgcgacgtttctgcctc

SEQ ID NO: 176885 - DNA, 35 bp, Artificial Sequence
  Synthetic oligonucleotide
tgagggcaaccttcagatccgtttcttctcctgtc

SEQ ID NO: 176886 - DNA, 35 bp, Artificial Sequence
  Synthetic oligonucleotide
gaatgcagctgacctcgataggcgcctccccattc

SEQ ID NO: 176887 - DNA, 35 bp, Artificial Sequence
  Synthetic oligonucleotide
ttgtccgctgagaatgcatccgttgctctaccttc

SEQ ID NO: 176888 - DNA, 35 bp, Artificial Sequence
  Synthetic oligonucleotide
gtgggtccaatacttcaaagacgccctccctgttc

SEQ ID NO: 176889 - DNA, 35 bp, Artificial Sequence
  Synthetic oligonucleotide
acatgtgatcagggcacctgttgctaccacctttc

SEQ ID NO: 176890 - DNA, 35 bp, Artificial Sequence
  Synthetic oligonucleotide
gcctcccccggtagcagacctggtacttcctcacg

SEQ ID NO: 176891 - DNA, 35 bp, Artificial Sequence
  Synthetic oligonucleotide
acactgccctgctccccgccgcagaatatcctacg

SEQ ID NO: 176892 - DNA, 35 bp, Artificial Sequence
  Synthetic oligonucleotide
tcgtagccgtacccgcactcgtactcactaccccg

SEQ ID NO: 176893 - DNA, 35 bp, Artificial Sequence
  Synthetic oligonucleotide
cctgatgcgcccaacggtttctgcgcccccccccg

SEQ ID NO: 176894 - DNA, 35 bp, Artificial Sequence
  Synthetic oligonucleotide
tcccccgccagaccttcctcaggaccgacttcccg

SEQ ID NO: 176895 - DNA, 35 bp, Artificial Sequence
  Synthetic oligonucleotide
tgcacgcatattgcgtttccgctgtccgtttcccg

SEQ ID NO: 176896 - DNA, 35 bp, Artificial Sequence
  Synthetic oligonucleotide
tagaaggggggacaggggtgaacaaattacggagg

SEQ ID NO: 176897 - DNA, 35 bp, Artificial Sequence
  Synthetic oligonucleotide
tccatgagcttggggcaggagaggggacggatagg

SEQ ID NO: 176898 - DNA, 35 bp, Artificial Sequence
  Synthetic oligonucleotide
tctgggttccgcatcggggtgggattaatcagggg

SEQ ID NO: 176899 - DNA, 35 bp, Artificial Sequence
  Synthetic oligonucleotide
gtcgaggggagggttgggattagtagtgagcgggg

SEQ ID NO: 176900 - DNA, 35 bp, Artificial Sequence
  Synthetic oligonucleotide
tacgggcttacttgtcccttccattattcgcctgg

SEQ ID NO: 176901 - DNA, 35 bp, Artificial Sequence
  Synthetic oligonucleotide
acgtgggtggagtggggtcagggctgaacagaatg

SEQ ID NO: 176902 - DNA, 35 bp, Artificial Sequence
  Synthetic oligonucleotide
gacgcgtaaaccgggccctgcttttcatcgcactg

SEQ ID NO: 176903 - DNA, 35 bp, Artificial Sequence
  Synthetic oligonucleotide
agggtccgccctgcataaaatagtccctctcactg

SEQ ID NO: 176904 - DNA, 35 bp, Artificial Sequence
  Synthetic oligonucleotide
gcttaaccccgtccgccacgattccattatttctg

SEQ ID NO: 176905 - DNA, 35 bp, Artificial Sequence
  Synthetic oligonucleotide
gacctcgccgacttgccccaccactctttcacttg

SEQ ID NO: 176906 - DNA, 35 bp, Artificial Sequence
  Synthetic oligonucleotide
tccgccttacatccacagtcgctacacgcttcttg

SEQ ID NO: 176907 - DNA, 35 bp, Artificial Sequence
  Synthetic oligonucleotide
tgcatcccaaatcgtgccccgtccgtttctctaat

SEQ ID NO: 176908 - DNA, 35 bp, Artificial Sequence
  Synthetic oligonucleotide
tcccgctgctctcctatcttctatgagttcaccat

SEQ ID NO: 176909 - DNA, 35 bp, Artificial Sequence
  Synthetic oligonucleotide
gtacacctcttgactgtccatacgggatttaccat

SEQ ID NO: 176910 - DNA, 35 bp, Artificial Sequence
  Synthetic oligonucleotide
tgctcctccacctgttgtccccttgtctgaactat

SEQ ID NO: 176911 - DNA, 35 bp, Artificial Sequence
  Synthetic oligonucleotide
tgttcatgcgcacacgtcgactatccgcgtactat

SEQ ID NO: 176912 - DNA, 35 bp, Artificial Sequence
  Synthetic oligonucleotide
atcttcgatccggtgcgattccttttcaacgctat

SEQ ID NO: 176913 - DNA, 35 bp, Artificial Sequence
  Synthetic oligonucleotide
tgagcgtaatggaaggaaggggggtgcaggggtat

SEQ ID NO: 176914 - DNA, 35 bp, Artificial Sequence
  Synthetic oligonucleotide
actgcctcagaagtctccagcttctccccgggcct

SEQ ID NO: 176915 - DNA, 35 bp, Artificial Sequence
  Synthetic oligonucleotide
tcccccagccatccggttggtctcttacttttcct

SEQ ID NO: 176916 - DNA, 33 bp, Artificial Sequence
  Synthetic oligonucleotide
tccccccctccgctcgttttgtacgcacatgct

SEQ ID NO: 176917 - DNA, 35 bp, Artificial Sequence
  Synthetic oligonucleotide
agtacaccgtcgttttagtcgcccaccactttgct

SEQ ID NO: 176918 - DNA, 35 bp, Artificial Sequence
  Synthetic oligonucleotide
tgatcgtctaattgccgtcccacctttacctgtct

SEQ ID NO: 176919 - DNA, 35 bp, Artificial Sequence
  Synthetic oligonucleotide
gggaaccctaccaaagctgtactaccgccctttct

SEQ ID NO: 176920 - DNA, 35 bp, Artificial Sequence
  Synthetic oligonucleotide
gatggaccccgccttttgtagttgcctttgtttgt

SEQ ID NO: 176921 - DNA, 35 bp, Artificial Sequence
  Synthetic oligonucleotide
gtccgccctggcggttaacgtaacgtttgctcatt

SEQ ID NO: 176922 - DNA, 35 bp, Artificial Sequence
  Synthetic oligonucleotide
ttcaaccacctcgctctgttcgactatgcctactt

SEQ ID NO: 176923 - DNA, 35 bp, Artificial Sequence
  Synthetic oligonucleotide
ttacgatgacggtcagtcgcatcgttttgttactt

SEQ ID NO: 176924 - DNA, 35 bp, Artificial Sequence
  Synthetic oligonucleotide
gtcaatccccccgccgggcatcccaactgtacttt

SEQ ID NO: 176925 - DNA, 35 bp, Artificial Sequence
  Synthetic oligonucleotide
tcctcccgttggccattgtatcgtaatcccccttt

SEQ ID NO: 176926 - DNA, 35 bp, Artificial Sequence
  Synthetic oligonucleotide
tgaccccagtctcccacgtcgtcatctatagcttt

SEQ ID NO: 176927 - DNA, 35 bp, Artificial Sequence
  Synthetic oligonucleotide
aaccgccccacctatagccatttatacagcctttt

SEQ ID NO: 176928 - DNA, 36 bp, Artificial Sequence
  Synthetic oligonucleotide
tgcctgccgggggggggtaaaatgctggggagggaa

SEQ ID NO: 176929 - DNA, 36 bp, Artificial Sequence
  Synthetic oligonucleotide
gacgatctgtcctgtccttctcagctgactcgctaa

SEQ ID NO: 176930 - DNA, 35 bp, Artificial Sequence
  Synthetic oligonucleotide
acagttgcctcccacttcctgccttggcgccttaa

SEQ ID NO: 176931 - DNA, 36 bp, Artificial Sequence
  Synthetic oligonucleotide
ttcgccgccggttcgcggtgcttcccccacagttaa

SEQ ID NO: 176932 - DNA, 35 bp, Artificial Sequence
  Synthetic oligonucleotide
tgcgacctgcctcttgtactcctgccgcagaaaca

SEQ ID NO: 176933 - DNA, 35 bp, Artificial Sequence
  Synthetic oligonucleotide
ttcacgcccgccaggttaaaactacaccccccaca

SEQ ID NO: 176934 - DNA, 36 bp, Artificial Sequence
  Synthetic oligonucleotide
acccggagccgttcgtctaggccgtgcccctttaca

SEQ ID NO: 176935 - DNA, 36 bp, Artificial Sequence
  Synthetic oligonucleotide
gatagcacagcgatatcaccttccgcaccttgcgca

SEQ ID NO: 176936 - DNA, 36 bp, Artificial Sequence
  Synthetic oligonucleotide
gcctgcgtatgccccccttacccttgcacctgtgca

SEQ ID NO: 176937 - DNA, 36 bp, Artificial Sequence
  Synthetic oligonucleotide
tacccacccgcttgattgcatggcttgtatgtctca

SEQ ID NO: 176938 - DNA, 36 bp, Artificial Sequence
  Synthetic oligonucleotide
aacctgagaagggtgggtaaggggaggaagtcttca

SEQ ID NO: 176939 - DNA, 36 bp, Artificial Sequence
  Synthetic oligonucleotide
gcctgtgcgttcgcccctgctccaattacccgttca

SEQ ID NO: 176940 - DNA, 37 bp, Artificial Sequence
  Synthetic oligonucleotide
ttggggaaggaagtaaaaaggggggtataaaggcaga

SEQ ID NO: 176941 - DNA, 37 bp, Artificial Sequence
  Synthetic oligonucleotide
gtgctaacgataaaggggggtgggaggcctgggcaga

SEQ ID NO: 176942 - DNA, 37 bp, Artificial Sequence
  Synthetic oligonucleotide
aaggagaggagaagggctgatgacggcgggctagaga

SEQ ID NO: 176943 - DNA, 37 bp, Artificial Sequence
  Synthetic oligonucleotide
ttgcaccttccgctagctgcccctccttcttcaacga

SEQ ID NO: 176944 - DNA, 37 bp, Artificial Sequence
  Synthetic oligonucleotide
gcccacccattcgcaccgttctcgagcctgtacccga

SEQ ID NO: 176945 - DNA, 36 bp, Artificial Sequence
  Synthetic oligonucleotide
gttcccacatcaaaatgccatactccggtcccccga

SEQ ID NO: 176946 - DNA, 37 bp, Artificial Sequence
  Synthetic oligonucleotide
gacttgctccaattactcaccaactgcctctcgccga

SEQ ID NO: 176947 - DNA, 37 bp, Artificial Sequence
  Synthetic oligonucleotide
gacaacggaggtagaggaaaggaacgttgcggtccga

SEQ ID NO: 176948 - DNA, 35 bp, Artificial Sequence
  Synthetic oligonucleotide
gatccccctccccgtcgcttgttgtgccgtcgcga

SEQ ID NO: 176949 - DNA, 36 bp, Artificial Sequence
  Synthetic oligonucleotide
gcaattcgccccccaacatctgtccatcgctctcga

SEQ ID NO: 176950 - DNA, 37 bp, Artificial Sequence
  Synthetic oligonucleotide
gatccacggtccagtctcataagcccctatctctcga

SEQ ID NO: 176951 - DNA, 37 bp, Artificial Sequence
  Synthetic oligonucleotide
tccaccccgccgataacaactgaaccgccttcgtcga

SEQ ID NO: 176952 - DNA, 37 bp, Artificial Sequence
  Synthetic oligonucleotide
acgcaccccacccctttaattactgcctgcacttcga

SEQ ID NO: 176953 - DNA, 37 bp, Artificial Sequence
  Synthetic oligonucleotide
actggaggacgttaggggcttaggggaggtggacgga

SEQ ID NO: 176954 - DNA, 37 bp, Artificial Sequence
  Synthetic oligonucleotide
gcctcacccaattgaattttgttcactcctccccgga

SEQ ID NO: 176955 - DNA, 37 bp, Artificial Sequence
  Synthetic oligonucleotide
gaccgataaggaagaggggagtaagtgctgggtcgga

SEQ ID NO: 176956 - DNA, 37 bp, Artificial Sequence
  Synthetic oligonucleotide
acaaagtgggggggtgtgggaacagacgaccacggga

SEQ ID NO: 176957 - DNA, 37 bp, Artificial Sequence
  Synthetic oligonucleotide
tccgggacgataatcgggtggagagggggttcgtgga

SEQ ID NO: 176958 - DNA, 37 bp, Artificial Sequence
  Synthetic oligonucleotide
ttcgacggcaaggggactagggggcacggcgggtgga

SEQ ID NO: 176959 - DNA, 37 bp, Artificial Sequence
  Synthetic oligonucleotide
tccagccggaggggggcgagggcggaccggggttgga

SEQ ID NO: 176960 - DNA, 37 bp, Artificial Sequence
  Synthetic oligonucleotide
gtcttgaggggcagggtggggaaagggggctgttgga

SEQ ID NO: 176961 - DNA, 37 bp, Artificial Sequence
  Synthetic oligonucleotide
atgtccacgccatgttgccccagttgccaccctatga

SEQ ID NO: 176962 - DNA, 38 bp, Artificial Sequence
  Synthetic oligonucleotide
gagtgggtgggtggggatagttgggattaacacactga

SEQ ID NO: 176963 - DNA, 38 bp, Artificial Sequence
  Synthetic oligonucleotide
agtgcacttcccgcagctggtctttcccccgttactga

SEQ ID NO: 176964 - DNA, 38 bp, Artificial Sequence
  Synthetic oligonucleotide
gccgccctatgtaccgcgtacgtccgctctttacctga

SEQ ID NO: 176965 - DNA, 36 bp, Artificial Sequence
  Synthetic oligonucleotide
ggtgccagagtcctctaaccagcctccgttccctga

SEQ ID NO: 176966 - DNA, 37 bp, Artificial Sequence
  Synthetic oligonucleotide
acatctccgcctaatgacatttcttagcacctcctga

SEQ ID NO: 176967 - DNA, 37 bp, Artificial Sequence
  Synthetic oligonucleotide
gagctccatgctcgaatacgcccttttgccctgctga

SEQ ID NO: 176968 - DNA, 37 bp, Artificial Sequence
  Synthetic oligonucleotide
ccacccgttcacctgccgtttcttcctcgccttctga

SEQ ID NO: 176969 - DNA, 38 bp, Artificial Sequence
  Synthetic oligonucleotide
gctcagtcagcacacccggcgccattcacctcttctga

SEQ ID NO: 176970 - DNA, 38 bp, Artificial Sequence
  Synthetic oligonucleotide
tcttccccccgcgccatttctcctgtgcatgtccgtga

SEQ ID NO: 176971 - DNA, 37 bp, Artificial Sequence
  Synthetic oligonucleotide
tatgcacggggaaagttggaggggggacttggcgtga

SEQ ID NO: 176972 - DNA, 38 bp, Artificial Sequence
  Synthetic oligonucleotide
gcccagcatcctcctctttgcccttgtcacaccggtga

SEQ ID NO: 176973 - DNA, 38 bp, Artificial Sequence
  Synthetic oligonucleotide
atgtgcacaaggtagggctaacgaggcggagagggtga

SEQ ID NO: 176974 - DNA, 38 bp, Artificial Sequence
  Synthetic oligonucleotide
gggaagagtagcaggtgaagtggaacgtgggagggtga

SEQ ID NO: 176975 - DNA, 37 bp, Artificial Sequence
  Synthetic oligonucleotide
gtcaaggggaggctgtgggggggcggattccgggtga

SEQ ID NO: 176976 - DNA, 38 bp, Artificial Sequence
  Synthetic oligonucleotide
tatgcctccccccgtctcttggtccttccacgatgtga

SEQ ID NO: 176977 - DNA, 35 bp, Artificial Sequence
  Synthetic oligonucleotide
ggtgagtgcccgcccccacgtcgccggttccttga

SEQ ID NO: 176978 - DNA, 38 bp, Artificial Sequence
  Synthetic oligonucleotide
ttccaccagtcagcattcgccgccgcctattagcttga

SEQ ID NO: 176979 - DNA, 38 bp, Artificial Sequence
  Synthetic oligonucleotide
acaggaggcggatgggacgtggtgtgggaggatcttga

SEQ ID NO: 176980 - DNA, 37 bp, Artificial Sequence
  Synthetic oligonucleotide
gccaacgtccttgattcctttagccttctcttcttga

SEQ ID NO: 176981 - DNA, 37 bp, Artificial Sequence
  Synthetic oligonucleotide
tcactgcccgcctccccgcacacttgactttgtttga

SEQ ID NO: 176982 - DNA, 36 bp, Artificial Sequence
  Synthetic oligonucleotide
tcaacaggcgggggggaggagaggggccgggggata

SEQ ID NO: 176983 - DNA, 36 bp, Artificial Sequence
  Synthetic oligonucleotide
agccccatcgacccgccacttgccgcaccagctata

SEQ ID NO: 176984 - DNA, 36 bp, Artificial Sequence
  Synthetic oligonucleotide
aactacacctccggatcgcctccaagtattgctcta

SEQ ID NO: 176985 - DNA, 36 bp, Artificial Sequence
  Synthetic oligonucleotide
atccaccgccggtgcacgataagtcctgctcccgta

SEQ ID NO: 176986 - DNA, 36 bp, Artificial Sequence
  Synthetic oligonucleotide
tgcggacccgcccccacatcccgcgtgaggacttta

SEQ ID NO: 176987 - DNA, 36 bp, Artificial Sequence
  Synthetic oligonucleotide
gatccagagatcagtgccgcacctccaccctcttta

SEQ ID NO: 176988 - DNA, 35 bp, Artificial Sequence
  Synthetic oligonucleotide
aggtcacctgccaacccagtttccgccccagcaac

SEQ ID NO: 176989 - DNA, 35 bp, Artificial Sequence
  Synthetic oligonucleotide
gaaagccgcaaaccatgcctcttatcgttacacac

SEQ ID NO: 176990 - DNA, 35 bp, Artificial Sequence
  Synthetic oligonucleotide
tgcaatcacgctggcatcacgccaatcccctgcac

SEQ ID NO: 176991 - DNA, 35 bp, Artificial Sequence
  Synthetic oligonucleotide
acgatccagccctgtccctcttcggcttccaggac

SEQ ID NO: 176992 - DNA, 35 bp, Artificial Sequence
  Synthetic oligonucleotide
accccgcactgcatatacttgttccggtctccacc

SEQ ID NO: 176993 - DNA, 35 bp, Artificial Sequence
  Synthetic oligonucleotide
tcacagaccaccttcttgcgctccctttttcgacc

SEQ ID NO: 176994 - DNA, 35 bp, Artificial Sequence
  Synthetic oligonucleotide
tgtacgcacgacgacgaattagccgctcgcctacc

SEQ ID NO: 176995 - DNA, 35 bp, Artificial Sequence
  Synthetic oligonucleotide
tgctgcctccgccgcgacaccgccgttttcaaccc

SEQ ID NO: 176996 - DNA, 35 bp, Artificial Sequence
  Synthetic oligonucleotide
atgtattccgccgagcatttgactgtcctcccccc

SEQ ID NO: 176997 - DNA, 35 bp, Artificial Sequence
  Synthetic oligonucleotide
cccagtccatccggtagacgacctcttcgggcccc

SEQ ID NO: 176998 - DNA, 35 bp, Artificial Sequence
  Synthetic oligonucleotide
gctcacatctcccccttcctaagtgcgcttgcccc

SEQ ID NO: 176999 - DNA, 35 bp, Artificial Sequence
  Synthetic oligonucleotide
ttcaccccgcccctttgtctgaatagattgtcccc

SEQ ID NO: 177000 - DNA, 35 bp, Artificial Sequence
  Synthetic oligonucleotide
tactcgccatgtcggtcatcctttctccacatccc

SEQ ID NO: 177001 - DNA, 35 bp, Artificial Sequence
  Synthetic oligonucleotide
gatgctcccatcgcaatcagaacactgcacatccc

SEQ ID NO: 177002 - DNA, 35 bp, Artificial Sequence
  Synthetic oligonucleotide
tgaattcgcatcagcttttcgtcacgtaacctccc

SEQ ID NO: 177003 - DNA, 35 bp, Artificial Sequence
  Synthetic oligonucleotide
gtctgttagtcctgttacccatcctccgtgttccc

SEQ ID NO: 177004 - DNA, 35 bp, Artificial Sequence
  Synthetic oligonucleotide
tgtggcacccgaactgttttctcgcccgtaccgcc

SEQ ID NO: 177005 - DNA, 35 bp, Artificial Sequence
  Synthetic oligonucleotide
gctcggaccggttaggcacttctcctcttcgcgcc

SEQ ID NO: 177006 - DNA, 35 bp, Artificial Sequence
  Synthetic oligonucleotide
atgccaccatcaatccctgttccatattgttcgcc

SEQ ID NO: 177007 - DNA, 35 bp, Artificial Sequence
  Synthetic oligonucleotide
gtcccgcataacacccatgttctctaccccatgcc

SEQ ID NO: 177008 - DNA, 35 bp, Artificial Sequence
  Synthetic oligonucleotide
ttcgagcttaggactgccattctcatcgctctgcc

SEQ ID NO: 177009 - DNA, 35 bp, Artificial Sequence
  Synthetic oligonucleotide
accgtaccgccgcggaacctgccacctctcgatcc

SEQ ID NO: 177010 - DNA, 35 bp, Artificial Sequence
  Synthetic oligonucleotide
gctgtgttcactccgcgcctaccgtgctcagctcc

SEQ ID NO: 177011 - DNA, 35 bp, Artificial Sequence
  Synthetic oligonucleotide
tcgcaccataccctcccatcgtgctcgagccgtcc

SEQ ID NO: 177012 - DNA, 35 bp, Artificial Sequence
  Synthetic oligonucleotide
acccgtaccctccgtagcccgttgacctgccaagc

SEQ ID NO: 177013 - DNA, 35 bp, Artificial Sequence
  Synthetic oligonucleotide
atcctcaggcgcccatttcgttttcgttcatccgc

SEQ ID NO: 177014 - DNA, 35 bp, Artificial Sequence
  Synthetic oligonucleotide
acatcccccgctatgtcgctacgtcgccctttcgc

SEQ ID NO: 177015 - DNA, 35 bp, Artificial Sequence
  Synthetic oligonucleotide
gcccccctcattgtcactacacttagcctatgggc

SEQ ID NO: 177016 - DNA, 35 bp, Artificial Sequence
  Synthetic oligonucleotide
gtctgcccacatgtctgaggttctcgcctctctgc

SEQ ID NO: 177017 - DNA, 35 bp, Artificial Sequence
  Synthetic oligonucleotide
tatccgcccgaaacagcgaaactccaccattctgc

SEQ ID NO: 177018 - DNA, 35 bp, Artificial Sequence
  Synthetic oligonucleotide
gtgttaccgaacggattcgtttggccctccctatc

SEQ ID NO: 177019 - DNA, 35 bp, Artificial Sequence
  Synthetic oligonucleotide
gcccccttccgccacccggtgctgttccaggtatc

SEQ ID NO: 177020 - DNA, 35 bp, Artificial Sequence
  Synthetic oligonucleotide
tgaccatcctcctgttagcgaggtctcgagttatc

SEQ ID NO: 177021 - DNA, 35 bp, Artificial Sequence
  Synthetic oligonucleotide
gaccgggagacctcctttcgttcactttaccactc

SEQ ID NO: 177022 - DNA, 35 bp, Artificial Sequence
  Synthetic oligonucleotide
ttcgtgcctgcttccttacgaatgttacccgcctc

SEQ ID NO: 177023 - DNA, 35 bp, Artificial Sequence
  Synthetic oligonucleotide
tcacagccccccatctagcattaacgagcgcgctc

SEQ ID NO: 177024 - DNA, 35 bp, Artificial Sequence
  Synthetic oligonucleotide
taggactgcgtagacgaccccccccacctgtgctc

SEQ ID NO: 177025 - DNA, 35 bp, Artificial Sequence
  Synthetic oligonucleotide
tgcaacccagagttctttgacccctctccgctgtc

SEQ ID NO: 177026 - DNA, 35 bp, Artificial Sequence
  Synthetic oligonucleotide
tcgaggggggctcctcgatccaacatgcttccttc

SEQ ID NO: 177027 - DNA, 35 bp, Artificial Sequence
  Synthetic oligonucleotide
tagacgcaccgcaaactgaccccacgatattgttc

SEQ ID NO: 177028 - DNA, 35 bp, Artificial Sequence
  Synthetic oligonucleotide
accaccgacgcatcatcatcccttccatctttcag

SEQ ID NO: 177029 - DNA, 35 bp, Artificial Sequence
  Synthetic oligonucleotide
gtgcgagtgataatgagtagagggggaaggaatag

SEQ ID NO: 177030 - DNA, 35 bp, Artificial Sequence
  Synthetic oligonucleotide
tcgcttcaccccatgttgtaccatatatctcgccg

SEQ ID NO: 177031 - DNA, 35 bp, Artificial Sequence
  Synthetic oligonucleotide
taccccatcccgtccgcctagttatactgtttccg

SEQ ID NO: 177032 - DNA, 35 bp, Artificial Sequence
  Synthetic oligonucleotide
gatatccatcccatctgcatccttccgtacgcgcg

SEQ ID NO: 177033 - DNA, 35 bp, Artificial Sequence
  Synthetic oligonucleotide
gccaccgctgttaccctgtcttacctctccttgcg

SEQ ID NO: 177034 - DNA, 35 bp, Artificial Sequence
  Synthetic oligonucleotide
aaatggggagggtgagacagttaagcgggaaaagg

SEQ ID NO: 177035 - DNA, 35 bp, Artificial Sequence
  Synthetic oligonucleotide
gatggtagaacaggaggtaagtatcggaggtaggg

SEQ ID NO: 177036 - DNA, 35 bp, Artificial Sequence
  Synthetic oligonucleotide
aagggcatcgtggggcaaggtggggcgaaggatgg

SEQ ID NO: 177037 - DNA, 35 bp, Artificial Sequence
  Synthetic oligonucleotide
gtgcactccattcctctggtccgtaaccctacatg

SEQ ID NO: 177038 - DNA, 35 bp, Artificial Sequence
  Synthetic oligonucleotide
agtaaagggggggagattggacagggtgcagcatg

SEQ ID NO: 177039 - DNA, 35 bp, Artificial Sequence
  Synthetic oligonucleotide
gatcagcgctagccttcccttcgttttacatactg

SEQ ID NO: 177040 - DNA, 33 bp, Artificial Sequence
  Synthetic oligonucleotide
attgcgccctatccccaatattcccgatacctg

SEQ ID NO: 177041 - DNA, 35 bp, Artificial Sequence
  Synthetic oligonucleotide
aacgcattccggtcactggcatcctcccccgcgtg

SEQ ID NO: 177042 - DNA, 35 bp, Artificial Sequence
  Synthetic oligonucleotide
ccagattggccacccctgctatgacccaaccgttg

SEQ ID NO: 177043 - DNA, 35 bp, Artificial Sequence
  Synthetic oligonucleotide
tcaccgaccctgtttctctccgactacttactttg

SEQ ID NO: 177044 - DNA, 35 bp, Artificial Sequence
  Synthetic oligonucleotide
taggcgcagccaacccccttatcagtccagcccat

SEQ ID NO: 177045 - DNA, 35 bp, Artificial Sequence
  Synthetic oligonucleotide
gcctccccggtagcgaattcagcctcactctccat

SEQ ID NO: 177046 - DNA, 35 bp, Artificial Sequence
  Synthetic oligonucleotide
acctccttgcaccgtcgcagttatcccccttcgat

SEQ ID NO: 177047 - DNA, 35 bp, Artificial Sequence
  Synthetic oligonucleotide
gtcccctacaaaccgtcctctcatagccgtgctat

SEQ ID NO: 177048 - DNA, 35 bp, Artificial Sequence
  Synthetic oligonucleotide
gcctcatactcgcctcggtcgtttactccgcttat

SEQ ID NO: 177049 - DNA, 35 bp, Artificial Sequence
  Synthetic oligonucleotide
gccgacatccgaaggtttaactcccctccgccact

SEQ ID NO: 177050 - DNA, 35 bp, Artificial Sequence
  Synthetic oligonucleotide
tcgatcccccgcgcgttccgtttgacgcttctact

SEQ ID NO: 177051 - DNA, 35 bp, Artificial Sequence
  Synthetic oligonucleotide
tgtgcctaagccgacgccaccatggcctatcacct

SEQ ID NO: 177052 - DNA, 35 bp, Artificial Sequence
  Synthetic oligonucleotide
ggatcccgtcctatcttgaattgggccttctccct

SEQ ID NO: 177053 - DNA, 35 bp, Artificial Sequence
  Synthetic oligonucleotide
agacgcaccctacccgtcttctctcgccgactcct

SEQ ID NO: 177054 - DNA, 35 bp, Artificial Sequence
  Synthetic oligonucleotide
aagcgcgccatccttcccgtttacaagtacctcct

SEQ ID NO: 177055 - DNA, 35 bp, Artificial Sequence
  Synthetic oligonucleotide
tcgaacgtaggccggcacgtacacttgctccatct

SEQ ID NO: 177056 - DNA, 35 bp, Artificial Sequence
  Synthetic oligonucleotide
tcaacgtattaaccccgcctgcttgttgtcactct

SEQ ID NO: 177057 - DNA, 35 bp, Artificial Sequence
  Synthetic oligonucleotide
tccatcctgcggacaccgcggggcctcccatctct

SEQ ID NO: 177058 - DNA, 35 bp, Artificial Sequence
  Synthetic oligonucleotide
aacatcctcatcccagtgtacttattcgcttctct

SEQ ID NO: 177059 - DNA, 35 bp, Artificial Sequence
  Synthetic oligonucleotide
gccagactctggcggcaccacccacttttttgtct

SEQ ID NO: 177060 - DNA, 35 bp, Artificial Sequence
  Synthetic oligonucleotide
tgctcggtccgctcgccccgttttgcccatgttct

SEQ ID NO: 177061 - DNA, 34 bp, Artificial Sequence
  Synthetic oligonucleotide
accccgcttacagcatgcataatttctccccagt

SEQ ID NO: 177062 - DNA, 35 bp, Artificial Sequence
  Synthetic oligonucleotide
atccacccctttcggtacatcaattctgccttggt

SEQ ID NO: 177063 - DNA, 35 bp, Artificial Sequence
  Synthetic oligonucleotide
gcaccatggctacccctgccacccgccccttgtgt

SEQ ID NO: 177064 - DNA, 35 bp, Artificial Sequence
  Synthetic oligonucleotide
tgtgccctctctccgttcttggcccgccctcttgt

SEQ ID NO: 177065 - DNA, 35 bp, Artificial Sequence
  Synthetic oligonucleotide
gacacgccccttgcattggttacttttctgccctt

SEQ ID NO: 177066 - DNA, 36 bp, Artificial Sequence
  Synthetic oligonucleotide
tatccactcccgtcctccgtgtaatgtgcgtcgctt

SEQ ID NO: 177067 - DNA, 34 bp, Artificial Sequence
  Synthetic oligonucleotide
tctaccgccccccgttccgaatacagccatgctt

SEQ ID NO: 177068 - DNA, 35 bp, Artificial Sequence
  Synthetic oligonucleotide
tctgacctattctcacatgcctccaaacacagttt

SEQ ID NO: 177069 - DNA, 36 bp, Artificial Sequence
  Synthetic oligonucleotide
taagggctaagaaacggggagggtgggaacggggaa

SEQ ID NO: 177070 - DNA, 35 bp, Artificial Sequence
  Synthetic oligonucleotide
gacgccactccccacgttcccctctcgtttgtgaa

SEQ ID NO: 177071 - DNA, 36 bp, Artificial Sequence
  Synthetic oligonucleotide
gaagccgagcctcataccctctcatcaccatggtaa

SEQ ID NO: 177072 - DNA, 36 bp, Artificial Sequence
  Synthetic oligonucleotide
tcactacgtgtaacgggaggagcgggggggtacaca

SEQ ID NO: 177073 - DNA, 36 bp, Artificial Sequence
  Synthetic oligonucleotide
agcaaagcggcgattgctttccaggctccaccccca

SEQ ID NO: 177074 - DNA, 36 bp, Artificial Sequence
  Synthetic oligonucleotide
gacgcgatgccaatgacttgtaacacgttcccccca

SEQ ID NO: 177075 - DNA, 36 bp, Artificial Sequence
  Synthetic oligonucleotide
gccttgcccccttcccgcgatctccgagcttgccca

SEQ ID NO: 177076 - DNA, 36 bp, Artificial Sequence
  Synthetic oligonucleotide
tatgttgcctcctcgcaggtgtcccttccattccca

SEQ ID NO: 177077 - DNA, 35 bp, Artificial Sequence
  Synthetic oligonucleotide
tgtatgcatgcatccagcgtatcccccatctgcca

SEQ ID NO: 177078 - DNA, 36 bp, Artificial Sequence
  Synthetic oligonucleotide
acctccctgcccggtccgagccccttatgcaaagca

SEQ ID NO: 177079 - DNA, 36 bp, Artificial Sequence
  Synthetic oligonucleotide
gcgggagggccgggcgggcggtatattacttaagca

SEQ ID NO: 177080 - DNA, 36 bp, Artificial Sequence
  Synthetic oligonucleotide
ggaacggaggcatgagaacagagaggaggggacgca

SEQ ID NO: 177081 - DNA, 37 bp, Artificial Sequence
  Synthetic oligonucleotide
tgacccgtattgcctggtctaccctctgcctccggca

SEQ ID NO: 177082 - DNA, 35 bp, Artificial Sequence
  Synthetic oligonucleotide
tgtcccgccctcctgaagcgccttacaacggatca

SEQ ID NO: 177083 - DNA, 36 bp, Artificial Sequence
  Synthetic oligonucleotide
tcccgccccagttcggtacaccagaccaacaactca

SEQ ID NO: 177084 - DNA, 35 bp, Artificial Sequence
  Synthetic oligonucleotide
tgggagggggtccggggaggatgagggggctgtca

SEQ ID NO: 177085 - DNA, 37 bp, Artificial Sequence
  Synthetic oligonucleotide
gtgccacggccccttgctgttcccctcctgacaaaga

SEQ ID NO: 177086 - DNA, 37 bp, Artificial Sequence
  Synthetic oligonucleotide
gctagccgggggaaaaggagcatgggggtacggaaga

SEQ ID NO: 177087 - DNA, 37 bp, Artificial Sequence
  Synthetic oligonucleotide
gtcacagccaccgtcatgtgacaccctctcaccacga

SEQ ID NO: 177088 - DNA, 37 bp, Artificial Sequence
  Synthetic oligonucleotide
gggtgcgggggactgggaacggcaggggggattacga

SEQ ID NO: 177089 - DNA, 35 bp, Artificial Sequence
  Synthetic oligonucleotide
tcacacagcctcctcacttgtcacacgccatccga

SEQ ID NO: 177090 - DNA, 36 bp, Artificial Sequence
  Synthetic oligonucleotide
tatcacccgccgtcattcccatccacccacacgcga

SEQ ID NO: 177091 - DNA, 37 bp, Artificial Sequence
  Synthetic oligonucleotide
acctcccgacctctgaaccttcaacgtctcgttgcga

SEQ ID NO: 177092 - DNA, 37 bp, Artificial Sequence
  Synthetic oligonucleotide
tacaccgcctgactgttcgtcctttcattcgcctcga

SEQ ID NO: 177093 - DNA, 37 bp, Artificial Sequence
  Synthetic oligonucleotide
gcggatggtggagggcaagggtttcagcggggacgga

SEQ ID NO: 177094 - DNA, 36 bp, Artificial Sequence
  Synthetic oligonucleotide
ttcccgcaccgccctttgtactttgttatttccgga

SEQ ID NO: 177095 - DNA, 35 bp, Artificial Sequence
  Synthetic oligonucleotide
gcacaccgcctttcgctcacaagcctgcctgcgga

SEQ ID NO: 177096 - DNA, 37 bp, Artificial Sequence
  Synthetic oligonucleotide
gcgaggtacactgaagccttgaggcgggggggaggga

SEQ ID NO: 177097 - DNA, 37 bp, Artificial Sequence
  Synthetic oligonucleotide
atcggtgggggtagaatgggaagcatgggttgaggga

SEQ ID NO: 177098 - DNA, 37 bp, Artificial Sequence
  Synthetic oligonucleotide
tctgctcgcttcttccttcctcgccgttcatacggga

SEQ ID NO: 177099 - DNA, 36 bp, Artificial Sequence
  Synthetic oligonucleotide
ggggtggatcggttggggactagttgggggcgggga

SEQ ID NO: 177100 - DNA, 37 bp, Artificial Sequence
  Synthetic oligonucleotide
gtcggtaaaggccgtggagggggcatggtacggggga

SEQ ID NO: 177101 - DNA, 36 bp, Artificial Sequence
  Synthetic oligonucleotide
gttaggaggtggaggggtacaggggacttcggggga

SEQ ID NO: 177102 - DNA, 36 bp, Artificial Sequence
  Synthetic oligonucleotide
agatcatgggaccagtgcgaaggggtagggggggga

SEQ ID NO: 177103 - DNA, 37 bp, Artificial Sequence
  Synthetic oligonucleotide
ttggggtgaagtgttgggggggtatggcccgtgggga

SEQ ID NO: 177104 - DNA, 37 bp, Artificial Sequence
  Synthetic oligonucleotide
tgccttgggtgggcggggatttgaggcacagttggga

SEQ ID NO: 177105 - DNA, 38 bp, Artificial Sequence
  Synthetic oligonucleotide
gccagtgctgtcgcgtttactcctacctccatcaatga

SEQ ID NO: 177106 - DNA, 38 bp, Artificial Sequence
  Synthetic oligonucleotide
ccgtgtgttcgttcttctgccgtgtgtgccccccatga

SEQ ID NO: 177107 - DNA, 36 bp, Artificial Sequence
  Synthetic oligonucleotide
actcgaccacccgttcttgggccccttcattcatga

SEQ ID NO: 177108 - DNA, 37 bp, Artificial Sequence
  Synthetic oligonucleotide
gtgaggaagaaagaggaaggatatgaggaaaagatga

SEQ ID NO: 177109 - DNA, 37 bp, Artificial Sequence
  Synthetic oligonucleotide
gacactccgacgctctacactctgcatcattaactga

SEQ ID NO: 177110 - DNA, 38 bp, Artificial Sequence
  Synthetic oligonucleotide
tcatccagccacccgcccgcatctcttaagtcgactga

SEQ ID NO: 177111 - DNA, 36 bp, Artificial Sequence
  Synthetic oligonucleotide
ttgtaacatgctgcaccatccctctgctattcctga

SEQ ID NO: 177112 - DNA, 38 bp, Artificial Sequence
  Synthetic oligonucleotide
tctggcctcctgtgccgctgttccttgatttttcctga

SEQ ID NO: 177113 - DNA, 36 bp, Artificial Sequence
  Synthetic oligonucleotide
tatgtagtgtgttgcgggtgggacgggatgggctga

SEQ ID NO: 177114 - DNA, 38 bp, Artificial Sequence
  Synthetic oligonucleotide
atcctgcctcggctctgaccatgcctctgtctatctga

SEQ ID NO: 177115 - DNA, 35 bp, Artificial Sequence
  Synthetic oligonucleotide
gacaccctcacccccgagcaatctctcccttctga

SEQ ID NO: 177116 - DNA, 37 bp, Artificial Sequence
  Synthetic oligonucleotide
acgccaatgcaacattgttccatcgtgccccccgtga

SEQ ID NO: 177117 - DNA, 38 bp, Artificial Sequence
  Synthetic oligonucleotide
gtatgccggaagtatattgcctcctccctttgccgtga

SEQ ID NO: 177118 - DNA, 37 bp, Artificial Sequence
  Synthetic oligonucleotide
tagccactgctgcgcttaaattcgttcctcctcgtga

SEQ ID NO: 177119 - DNA, 38 bp, Artificial Sequence
  Synthetic oligonucleotide
gaggattggcggcacacgggtgggcagggcgggggtga

SEQ ID NO: 177120 - DNA, 38 bp, Artificial Sequence
  Synthetic oligonucleotide
gccacctttgcttgtcgcctctcactgccatcaattga

SEQ ID NO: 177121 - DNA, 35 bp, Artificial Sequence
  Synthetic oligonucleotide
gaagtgcactctcttgtctttctaacgctccttga

SEQ ID NO: 177122 - DNA, 36 bp, Artificial Sequence
  Synthetic oligonucleotide
gatacaccccggtccttagtctccagtcaatcttga

SEQ ID NO: 177123 - DNA, 38 bp, Artificial Sequence
  Synthetic oligonucleotide
acaaccattcacgccgcctaccacagtctgtccgttga

SEQ ID NO: 177124 - DNA, 38 bp, Artificial Sequence
  Synthetic oligonucleotide
tccagaacgtccatcgcttggccctgcactcttgttga

SEQ ID NO: 177125 - DNA, 36 bp, Artificial Sequence
  Synthetic oligonucleotide
tagcccctcccgcaccgtaactatggtggtaccata

SEQ ID NO: 177126 - DNA, 36 bp, Artificial Sequence
  Synthetic oligonucleotide
aactaggagaggtgagggaagttacggggatgcata

SEQ ID NO: 177127 - DNA, 36 bp, Artificial Sequence
  Synthetic oligonucleotide
gtcacctttcgctgtgaacgttttacacctcaccta

SEQ ID NO: 177128 - DNA, 36 bp, Artificial Sequence
  Synthetic oligonucleotide
gaacagggcgggggaaaaaaggcacgagcctaagta

SEQ ID NO: 177129 - DNA, 36 bp, Artificial Sequence
  Synthetic oligonucleotide
gcacggacgacgctagaaaggggggcggctggagta

SEQ ID NO: 177130 - DNA, 36 bp, Artificial Sequence
  Synthetic oligonucleotide
atccctaaccgcccaagcgtatttgctctccccgta

SEQ ID NO: 177131 - DNA, 36 bp, Artificial Sequence
  Synthetic oligonucleotide
gccgggaaggggagcagggaagagagcatccaggta

SEQ ID NO: 177132 - DNA, 36 bp, Artificial Sequence
  Synthetic oligonucleotide
tccatgtcggggcaagtaggagggggataaatggta

SEQ ID NO: 177133 - DNA, 35 bp, Artificial Sequence
  Synthetic oligonucleotide
tagactccaccccgtccgtgcctctacgctgatta

SEQ ID NO: 177134 - DNA, 35 bp, Artificial Sequence
  Synthetic oligonucleotide
gctgccttgcgccgtgacgccatctcaccgcccac

SEQ ID NO: 177135 - DNA, 35 bp, Artificial Sequence
  Synthetic oligonucleotide
tgccaacctttttcgatcgagaatctgccttccac

SEQ ID NO: 177136 - DNA, 35 bp, Artificial Sequence
  Synthetic oligonucleotide
tgcgcgctgtactatcggccataccccggtttcac

SEQ ID NO: 177137 - DNA, 35 bp, Artificial Sequence
  Synthetic oligonucleotide
acgagcacctgcccttgttcacgccgcctcgcgac

SEQ ID NO: 177138 - DNA, 35 bp, Artificial Sequence
  Synthetic oligonucleotide
tgagcccctgccgtgacgtctctatcaatgcctac

SEQ ID NO: 177139 - DNA, 35 bp, Artificial Sequence
  Synthetic oligonucleotide
gcgtcacctttccctcccgtctatttgtccgcacc

SEQ ID NO: 177140 - DNA, 35 bp, Artificial Sequence
  Synthetic oligonucleotide
tcaacacaatttggaccccgttgggcctgcctacc

SEQ ID NO: 177141 - DNA, 35 bp, Artificial Sequence
  Synthetic oligonucleotide
gcacacttctgtggagcttttaacactcctgcccc

SEQ ID NO: 177142 - DNA, 35 bp, Artificial Sequence
  Synthetic oligonucleotide
acatctaccactcgcactgccccggctgtaggccc

SEQ ID NO: 177143 - DNA, 35 bp, Artificial Sequence
  Synthetic oligonucleotide
acctccacggtctatcaccggagccaactctgccc

SEQ ID NO: 177144 - DNA, 35 bp, Artificial Sequence
  Synthetic oligonucleotide
tccgccacccctgcgtttcgctcttggcatgtccc

SEQ ID NO: 177145 - DNA, 35 bp, Artificial Sequence
  Synthetic oligonucleotide
acctcctgtcacgggtcgtttcacgtacgctatcc

SEQ ID NO: 177146 - DNA, 35 bp, Artificial Sequence
  Synthetic oligonucleotide
gcccgtccattgcctttcttccggcctcgccctcc

SEQ ID NO: 177147 - DNA, 34 bp, Artificial Sequence
  Synthetic oligonucleotide
tccacccgaccccgcttgcagtaactcgctttcc

SEQ ID NO: 177148 - DNA, 35 bp, Artificial Sequence
  Synthetic oligonucleotide
tccctgaaccactataccgcgcacggacattttcc

SEQ ID NO: 177149 - DNA, 35 bp, Artificial Sequence
  Synthetic oligonucleotide
ttcgccttccccattcccaccgccaagccgatcgc

SEQ ID NO: 177150 - DNA, 35 bp, Artificial Sequence
  Synthetic oligonucleotide
gccgatcctcccaccaccacaatacaggctctggc

SEQ ID NO: 177151 - DNA, 35 bp, Artificial Sequence
  Synthetic oligonucleotide
tgcgcgcggaagctactctattatgccaccaatgc

SEQ ID NO: 177152 - DNA, 35 bp, Artificial Sequence
  Synthetic oligonucleotide
gacgcctcacccactcccccatccccttgcgatgc

SEQ ID NO: 177153 - DNA, 35 bp, Artificial Sequence
  Synthetic oligonucleotide
gctggacgccattccctaccgctcttactgccatc

SEQ ID NO: 177154 - DNA, 35 bp, Artificial Sequence
  Synthetic oligonucleotide
tccgtctcggcgacctggcctaatgcaccaccctc

SEQ ID NO: 177155 - DNA, 35 bp, Artificial Sequence
  Synthetic oligonucleotide
ttgcccgccccgagccgtttgcttctgcctccctc

SEQ ID NO: 177156 - DNA, 34 bp, Artificial Sequence
  Synthetic oligonucleotide
gtttgcccacccggactcccacaggctgtgcctc

SEQ ID NO: 177157 - DNA, 35 bp, Artificial Sequence
  Synthetic oligonucleotide
ttacagccgcccgtttggaaacgcgtattatcctc

SEQ ID NO: 177158 - DNA, 35 bp, Artificial Sequence
  Synthetic oligonucleotide
gatccatcgccatcctttgttctcatagcgggttc

SEQ ID NO: 177159 - DNA, 35 bp, Artificial Sequence
  Synthetic oligonucleotide
tgcaatgctccaacgtcgattcccggcccttgttc

SEQ ID NO: 177160 - DNA, 35 bp, Artificial Sequence
  Synthetic oligonucleotide
gtaactacgcccctggttccaccccactgactttc

SEQ ID NO: 177161 - DNA, 35 bp, Artificial Sequence
  Synthetic oligonucleotide
atggaggtggacagggaataggggggtctcgaaag

SEQ ID NO: 177162 - DNA, 35 bp, Artificial Sequence
  Synthetic oligonucleotide
tccacccaccctcgcgaggtcgtatttcacctcag

SEQ ID NO: 177163 - DNA, 35 bp, Artificial Sequence
  Synthetic oligonucleotide
gtagcggacgggaggtgaagtgggggtcgtcagag

SEQ ID NO: 177164 - DNA, 35 bp, Artificial Sequence
  Synthetic oligonucleotide
gtctcgccctattaaccacgctttacctctcgtag

SEQ ID NO: 177165 - DNA, 35 bp, Artificial Sequence
  Synthetic oligonucleotide
gtccctgcccctctgacgataccattcaggtttag

SEQ ID NO: 177166 - DNA, 35 bp, Artificial Sequence
  Synthetic oligonucleotide
gcccctgccccatcgaatgtataggtgttccgccg

SEQ ID NO: 177167 - DNA, 35 bp, Artificial Sequence
  Synthetic oligonucleotide
gcttaggggtaggaacgggactaaaaggtggggcg

SEQ ID NO: 177168 - DNA, 35 bp, Artificial Sequence
  Synthetic oligonucleotide
gttgggtaggagagaaggcgtggcataggggaggg

SEQ ID NO: 177169 - DNA, 35 bp, Artificial Sequence
  Synthetic oligonucleotide
ttggtctgctagtgtgccccattgctccacccctg

SEQ ID NO: 177170 - DNA, 35 bp, Artificial Sequence
  Synthetic oligonucleotide
actcatgtatccgcatcaccgctcgcttattcctg

SEQ ID NO: 177171 - DNA, 35 bp, Artificial Sequence
  Synthetic oligonucleotide
tactcggccccatccatgtcgcacccccgcatctg

SEQ ID NO: 177172 - DNA, 35 bp, Artificial Sequence
  Synthetic oligonucleotide
gccacttgcctttccgttggtgactctcctttaat

SEQ ID NO: 177173 - DNA, 35 bp, Artificial Sequence
  Synthetic oligonucleotide
gatagatccagccgtgcaccctgccacatccttat

SEQ ID NO: 177174 - DNA, 35 bp, Artificial Sequence
  Synthetic oligonucleotide
accatcccattgtgagccttaactttgtccctact

SEQ ID NO: 177175 - DNA, 35 bp, Artificial Sequence
  Synthetic oligonucleotide
ggtgcaatagcttccccgactcatccgtcccacct

SEQ ID NO: 177176 - DNA, 35 bp, Artificial Sequence
  Synthetic oligonucleotide
atccccgtgcgagccacggtatacctccctaccct

SEQ ID NO: 177177 - DNA, 35 bp, Artificial Sequence
  Synthetic oligonucleotide
agcacaactgcccagacgccccctacttgtcccct

SEQ ID NO: 177178 - DNA, 35 bp, Artificial Sequence
  Synthetic oligonucleotide
atcctgccctctcgctgtgccctcattattacgct

SEQ ID NO: 177179 - DNA, 35 bp, Artificial Sequence
  Synthetic oligonucleotide
accggaggagggtgcggagaaaggggggcctggct

SEQ ID NO: 177180 - DNA, 35 bp, Artificial Sequence
  Synthetic oligonucleotide
taggagcgtatgtcagcataccgttcacaccctct

SEQ ID NO: 177181 - DNA, 35 bp, Artificial Sequence
  Synthetic oligonucleotide
gtatggctcaactgtttgtacggcccctcatctct

SEQ ID NO: 177182 - DNA, 35 bp, Artificial Sequence
  Synthetic oligonucleotide
atgcccccccgaccgccttactatagagtgttagt

SEQ ID NO: 177183 - DNA, 27 bp, Artificial Sequence
  Synthetic oligonucleotide
aatgtgcaaaaacgagagggggggggt

SEQ ID NO: 177184 - DNA, 35 bp, Artificial Sequence
  Synthetic oligonucleotide
tttcaaaccgcccttgctcgagttatccctcctgt

SEQ ID NO: 177185 - DNA, 35 bp, Artificial Sequence
  Synthetic oligonucleotide
gtgcgagacagtgcctcggcgccccccctctctgt

SEQ ID NO: 177186 - DNA, 35 bp, Artificial Sequence
  Synthetic oligonucleotide
tgtgatgtagatcgcaagctccccccacttacctt

SEQ ID NO: 177187 - DNA, 35 bp, Artificial Sequence
  Synthetic oligonucleotide
gaaccgcctccccacgtgtgcgacctgcacccctt

SEQ ID NO: 177188 - DNA, 35 bp, Artificial Sequence
  Synthetic oligonucleotide
gcccaccctattaacgctccaaccatctcgtggtt

SEQ ID NO: 177189 - DNA, 35 bp, Artificial Sequence
  Synthetic oligonucleotide
ggtgcgctaccgcccgcatgcctatttgtcctgtt

SEQ ID NO: 177190 - DNA, 35 bp, Artificial Sequence
  Synthetic oligonucleotide
gtgtcaacaccgtgtccagctcctcgacccacttt

SEQ ID NO: 177191 - DNA, 35 bp, Artificial Sequence
  Synthetic oligonucleotide
gcggggtgggagggtggcgggcagtactacgaaaa

SEQ ID NO: 177192 - DNA, 35 bp, Artificial Sequence
  Synthetic oligonucleotide
caacatccgatccctgcctgtgaccgcccttccaa

SEQ ID NO: 177193 - DNA, 36 bp, Artificial Sequence
  Synthetic oligonucleotide
gcgcccacgtacaatgcctcccccgccgtggtgcaa

SEQ ID NO: 177194 - DNA, 36 bp, Artificial Sequence
  Synthetic oligonucleotide
agtagccatagagagaggggagtgaggttggcggaa

SEQ ID NO: 177195 - DNA, 35 bp, Artificial Sequence
  Synthetic oligonucleotide
tccgtacgcacgaacggtatcccttgccactggaa

SEQ ID NO: 177196 - DNA, 35 bp, Artificial Sequence
  Synthetic oligonucleotide
tgcccccactttgtgcacttcatcggttgcccaca

SEQ ID NO: 177197 - DNA, 36 bp, Artificial Sequence
  Synthetic oligonucleotide
tactggtcctgtcgcgtacctatccattctctcaca

SEQ ID NO: 177198 - DNA, 35 bp, Artificial Sequence
  Synthetic oligonucleotide
gcaactaccaacgcctcggtgcctttactgtccca

SEQ ID NO: 177199 - DNA, 35 bp, Artificial Sequence
  Synthetic oligonucleotide
tcccacacttcccgccacagggtgaacatgttcca

SEQ ID NO: 177200 - DNA, 35 bp, Artificial Sequence
  Synthetic oligonucleotide
tcctgcctgtaatcttgtcccccgtgatcttcgca

SEQ ID NO: 177201 - DNA, 36 bp, Artificial Sequence
  Synthetic oligonucleotide
tccgcgcctctgcaataatccgttcatctctctgca

SEQ ID NO: 177202 - DNA, 36 bp, Artificial Sequence
  Synthetic oligonucleotide
tccatcatcattgctctatcacctagcgctcactca

SEQ ID NO: 177203 - DNA, 35 bp, Artificial Sequence
  Synthetic oligonucleotide
acgatcaaccttacccgcccgctgtgaatgcctca

SEQ ID NO: 177204 - DNA, 36 bp, Artificial Sequence
  Synthetic oligonucleotide
tcacacgaagctgcgtaatctaggctcatcatctca

SEQ ID NO: 177205 - DNA, 36 bp, Artificial Sequence
  Synthetic oligonucleotide
tctcccccacgcatatccagtggttgttatccttca

SEQ ID NO: 177206 - DNA, 36 bp, Artificial Sequence
  Synthetic oligonucleotide
gtagcccgtctagccctttacccctatcgccgttca

SEQ ID NO: 177207 - DNA, 36 bp, Artificial Sequence
  Synthetic oligonucleotide
actcgccacgccaccactccttatgcctcagccaga

SEQ ID NO: 177208 - DNA, 36 bp, Artificial Sequence
  Synthetic oligonucleotide
gcgtacctcacctgtactattgcttccttacaacga

SEQ ID NO: 177209 - DNA, 36 bp, Artificial Sequence
  Synthetic oligonucleotide
tgaccttccaagcctctcgatcccgcgctccaacga

SEQ ID NO: 177210 - DNA, 37 bp, Artificial Sequence
  Synthetic oligonucleotide
tccccccctttgggtgtaaaacctcgcctaccaccga

SEQ ID NO: 177211 - DNA, 37 bp, Artificial Sequence
  Synthetic oligonucleotide
tatgcgcctccatttggtttacttgtactatcaccga

SEQ ID NO: 177212 - DNA, 37 bp, Artificial Sequence
  Synthetic oligonucleotide
tgccaaagcattaagtgatgccaccactctcccccga

SEQ ID NO: 177213 - DNA, 37 bp, Artificial Sequence
  Synthetic oligonucleotide
agcgtcgcctcccatcccctatatgttgccgatccga

SEQ ID NO: 177214 - DNA, 37 bp, Artificial Sequence
  Synthetic oligonucleotide
acacgcaagctaaaggggaagggccgggggtgtagga

SEQ ID NO: 177215 - DNA, 37 bp, Artificial Sequence
  Synthetic oligonucleotide
ccccgccccatcccgtgcgtccgtctagcgaaacgga

SEQ ID NO: 177216 - DNA, 37 bp, Artificial Sequence
  Synthetic oligonucleotide
ttgcccaccctgctgttacatctgccggtcccacgga

SEQ ID NO: 177217 - DNA, 37 bp, Artificial Sequence
  Synthetic oligonucleotide
tcatcagggcgggggcggactggaggaggcatacgga

SEQ ID NO: 177218 - DNA, 37 bp, Artificial Sequence
  Synthetic oligonucleotide
atgtgcaacgggcagggtgggtcagtcataaaaggga

SEQ ID NO: 177219 - DNA, 37 bp, Artificial Sequence
  Synthetic oligonucleotide
aaatggggcagttatggaggggtcggggtgcagggga

SEQ ID NO: 177220 - DNA, 36 bp, Artificial Sequence
  Synthetic oligonucleotide
agtatgggggagggacaaggaggacgggcgagggga

SEQ ID NO: 177221 - DNA, 37 bp, Artificial Sequence
  Synthetic oligonucleotide
atgatggggtggacatgagggcacattgaggggggga

SEQ ID NO: 177222 - DNA, 37 bp, Artificial Sequence
  Synthetic oligonucleotide
atggggcgtggagggggggcattttcggggcatggga

SEQ ID NO: 177223 - DNA, 37 bp, Artificial Sequence
  Synthetic oligonucleotide
acgcgttgggcgggcggggaacggcatccgagtggga

SEQ ID NO: 177224 - DNA, 36 bp, Artificial Sequence
  Synthetic oligonucleotide
tctctccccctctgcctccttgtgtatcaccctgga

SEQ ID NO: 177225 - DNA, 37 bp, Artificial Sequence
  Synthetic oligonucleotide
ggaacatcccgtccgtcgcctgaccctaccctttgga

SEQ ID NO: 177226 - DNA, 38 bp, Artificial Sequence
  Synthetic oligonucleotide
ttccatccgatcacactctgcaaacctgacaccactga

SEQ ID NO: 177227 - DNA, 38 bp, Artificial Sequence
  Synthetic oligonucleotide
accgcctcacacacatccgcgttataccgacctactga

SEQ ID NO: 177228 - DNA, 33 bp, Artificial Sequence
  Synthetic oligonucleotide
gccaagggtcgggagggaccgggcctaccctga

SEQ ID NO: 177229 - DNA, 38 bp, Artificial Sequence
  Synthetic oligonucleotide
tctggtgtcacgtgcgccctagtcccgctaccccctga

SEQ ID NO: 177230 - DNA, 37 bp, Artificial Sequence
  Synthetic oligonucleotide
gtctccacttgtactgtttaccgccacggccccctga

SEQ ID NO: 177231 - DNA, 38 bp, Artificial Sequence
  Synthetic oligonucleotide
gctcaggtcccatcgtttagtcctctcgcttgtcctga

SEQ ID NO: 177232 - DNA, 36 bp, Artificial Sequence
  Synthetic oligonucleotide
gcacacacccctgatcattcagatcagtacctctga

SEQ ID NO: 177233 - DNA, 37 bp, Artificial Sequence
  Synthetic oligonucleotide
gtggtggggggggaggagccttaagagctcgaagtga

SEQ ID NO: 177234 - DNA, 38 bp, Artificial Sequence
  Synthetic oligonucleotide
tcccggacgaggagggagtttaggagcggggagagtga

SEQ ID NO: 177235 - DNA, 38 bp, Artificial Sequence
  Synthetic oligonucleotide
ggaggggggagggtatagggtgggtgtccgcttggtga

SEQ ID NO: 177236 - DNA, 38 bp, Artificial Sequence
  Synthetic oligonucleotide
gcgtaacatgggaggcgggagggacaaggtccatgtga

SEQ ID NO: 177237 - DNA, 35 bp, Artificial Sequence
  Synthetic oligonucleotide
gtgtgagtagggtaagggttggagagaggacttga

SEQ ID NO: 177238 - DNA, 38 bp, Artificial Sequence
  Synthetic oligonucleotide
tgcgcatccatcgcgttgaaccgtccgttcccccttga

SEQ ID NO: 177239 - DNA, 38 bp, Artificial Sequence
  Synthetic oligonucleotide
gcaacgctctcggataatcacctgcccgcccatcttga

SEQ ID NO: 177240 - DNA, 38 bp, Artificial Sequence
  Synthetic oligonucleotide
gtgtgtccgttccgtcctgcttataacgcgcctcttga

SEQ ID NO: 177241 - DNA, 37 bp, Artificial Sequence
  Synthetic oligonucleotide
atcaccctgctattaaactacgctgccactccgttga

SEQ ID NO: 177242 - DNA, 37 bp, Artificial Sequence
  Synthetic oligonucleotide
acaacaccttcgagcggtatgacccgattatctttga

SEQ ID NO: 177243 - DNA, 36 bp, Artificial Sequence
  Synthetic oligonucleotide
tacactgcccttacgttgtctctatcgattctttga

SEQ ID NO: 177244 - DNA, 36 bp, Artificial Sequence
  Synthetic oligonucleotide
gccgaccatcgccctcatcgcttggaacccaacata

SEQ ID NO: 177245 - DNA, 36 bp, Artificial Sequence
  Synthetic oligonucleotide
attgtcgcttgcttgttcccgcctgtcctgcccata

SEQ ID NO: 177246 - DNA, 35 bp, Artificial Sequence
  Synthetic oligonucleotide
tcctctcacccctgatatgttttgttctctcgata

SEQ ID NO: 177247 - DNA, 35 bp, Artificial Sequence
  Synthetic oligonucleotide
acgaacaaccctccgtattctataaccctgttata

SEQ ID NO: 177248 - DNA, 35 bp, Artificial Sequence
  Synthetic oligonucleotide
tgcgttcccggcacgatcccagggtccctctccta

SEQ ID NO: 177249 - DNA, 35 bp, Artificial Sequence
  Synthetic oligonucleotide
gattggcaccctcacgccccgccttgtaacagcta

SEQ ID NO: 177250 - DNA, 36 bp, Artificial Sequence
  Synthetic oligonucleotide
gcctgcccccccccggtatccaattcgctcatgcta

SEQ ID NO: 177251 - DNA, 36 bp, Artificial Sequence
  Synthetic oligonucleotide
acgcgtacggaaggagggggggtgcgcggacaggta

SEQ ID NO: 177252 - DNA, 35 bp, Artificial Sequence
  Synthetic oligonucleotide
gtgtcacggtggacggaaggctggaaagggaggta

SEQ ID NO: 177253 - DNA, 36 bp, Artificial Sequence
  Synthetic oligonucleotide
ttccgccgagttccctgcgctgcttttcctgctgta

SEQ ID NO: 177254 - DNA, 36 bp, Artificial Sequence
  Synthetic oligonucleotide
tcggtgacggcatccggaaccgggtcttcaggtgta

SEQ ID NO: 177255 - DNA, 36 bp, Artificial Sequence
  Synthetic oligonucleotide
acacccctcctgcccacttgattcgactatgcatta

SEQ ID NO: 177256 - DNA, 35 bp, Artificial Sequence
  Synthetic oligonucleotide
tccccccgcgtgatcgttgccaccgtttgccctta

SEQ ID NO: 177257 - DNA, 35 bp, Artificial Sequence
  Synthetic oligonucleotide
ggggtggagcatgggttagtaggatgggagggtta

SEQ ID NO: 177258 - DNA, 34 bp, Artificial Sequence
  Synthetic oligonucleotide
ggggtgggggggggccatggagcgtcggtctaac

SEQ ID NO: 177259 - DNA, 35 bp, Artificial Sequence
  Synthetic oligonucleotide
gctaccgctcgagcccatcccccgtacggttacac

SEQ ID NO: 177260 - DNA, 35 bp, Artificial Sequence
  Synthetic oligonucleotide
gatacctagcccccgccctcccacctcaggcccac

SEQ ID NO: 177261 - DNA, 35 bp, Artificial Sequence
  Synthetic oligonucleotide
acccccatcaatcgtattgcctacggctttagcac

SEQ ID NO: 177262 - DNA, 35 bp, Artificial Sequence
  Synthetic oligonucleotide
gttccctggacagcccgtcctactagccaccttac

SEQ ID NO: 177263 - DNA, 35 bp, Artificial Sequence
  Synthetic oligonucleotide
tgtcctctccccgcattctatcgagtctaatttac

SEQ ID NO: 177264 - DNA, 35 bp, Artificial Sequence
  Synthetic oligonucleotide
gaatcgtggctttgctttggaaccgccccaccacc

SEQ ID NO: 177265 - DNA, 35 bp, Artificial Sequence
  Synthetic oligonucleotide
tccccaccccgtgtggttttgacccccgtgaaccc

SEQ ID NO: 177266 - DNA, 35 bp, Artificial Sequence
  Synthetic oligonucleotide
tcgattaccctcattggcactttcggttcccaccc

SEQ ID NO: 177267 - DNA, 35 bp, Artificial Sequence
  Synthetic oligonucleotide
tggtaccggcgagacctgcatttcctgactccccc

SEQ ID NO: 177268 - DNA, 35 bp, Artificial Sequence
  Synthetic oligonucleotide
atgtccacacacgccgtttgctgctatctcgcccc

SEQ ID NO: 177269 - DNA, 35 bp, Artificial Sequence
  Synthetic oligonucleotide
cacacccacaatattaagctacctgtctcacgccc

SEQ ID NO: 177270 - DNA, 35 bp, Artificial Sequence
  Synthetic oligonucleotide
agtttcgttcccatctgtacgccgttatacctccc

SEQ ID NO: 177271 - DNA, 35 bp, Artificial Sequence
  Synthetic oligonucleotide
tgactgtcctcgcatgcgcttttaccctccttccc

SEQ ID NO: 177272 - DNA, 35 bp, Artificial Sequence
  Synthetic oligonucleotide
ttggtcgccgttattgtactttctctgccgttccc

SEQ ID NO: 177273 - DNA, 35 bp, Artificial Sequence
  Synthetic oligonucleotide
actaccgataccctcgctccccaggggacctcgcc

SEQ ID NO: 177274 - DNA, 35 bp, Artificial Sequence
  Synthetic oligonucleotide
tgcgaataggacgggaggaggaagtaagggaggcc

SEQ ID NO: 177275 - DNA, 33 bp, Artificial Sequence
  Synthetic oligonucleotide
tgagaactcgtcccgctccaccgccccccggcc

SEQ ID NO: 177276 - DNA, 35 bp, Artificial Sequence
  Synthetic oligonucleotide
atgatgcgggctttgcgtttcacccgtgcccttcc

SEQ ID NO: 177277 - DNA, 35 bp, Artificial Sequence
  Synthetic oligonucleotide
gctgcccacgtctgtccgttgatctgcctgcttcc

SEQ ID NO: 177278 - DNA, 35 bp, Artificial Sequence
  Synthetic oligonucleotide
gaaggctgacaccatgcacgtacggtccctcttcc

SEQ ID NO: 177279 - DNA, 35 bp, Artificial Sequence
  Synthetic oligonucleotide
gtccggtgccgcctgccatattccttcccaccagc

SEQ ID NO: 177280 - DNA, 35 bp, Artificial Sequence
  Synthetic oligonucleotide
ttgccgatcgccctccgtagcccaggcactatatc

SEQ ID NO: 177281 - DNA, 35 bp, Artificial Sequence
  Synthetic oligonucleotide
actacatcgaccgggccgtttcttgtacctcactc

SEQ ID NO: 177282 - DNA, 35 bp, Artificial Sequence
  Synthetic oligonucleotide
gtgtgtaccccctcggtcgttttccttcctccctc

SEQ ID NO: 177283 - DNA, 35 bp, Artificial Sequence
  Synthetic oligonucleotide
gtgaagccaccgcctctgttcgtttgtaccctctc

SEQ ID NO: 177284 - DNA, 35 bp, Artificial Sequence
  Synthetic oligonucleotide
tgttgatgccccctatcccatgacggtcccctgtc

SEQ ID NO: 177285 - DNA, 35 bp, Artificial Sequence
  Synthetic oligonucleotide
attgcgccacatgattctcgcctgtcacaccattc

SEQ ID NO: 177286 - DNA, 35 bp, Artificial Sequence
  Synthetic oligonucleotide
acgtccccgtgccgctggtgccttctgttcatttc

SEQ ID NO: 177287 - DNA, 35 bp, Artificial Sequence
  Synthetic oligonucleotide
aatgccctcgccgtctgtatcgctggccccacccg

SEQ ID NO: 177288 - DNA, 34 bp, Artificial Sequence
  Synthetic oligonucleotide
tcctactccaccctctgcgtccagccttgccccg

SEQ ID NO: 177289 - DNA, 35 bp, Artificial Sequence
  Synthetic oligonucleotide
tccatgtcccgtgttccctaatcttctgccgatcg

SEQ ID NO: 177290 - DNA, 35 bp, Artificial Sequence
  Synthetic oligonucleotide
gcgcgttccacctcccactctttttcctggtctcg

SEQ ID NO: 177291 - DNA, 35 bp, Artificial Sequence
  Synthetic oligonucleotide
tcctatcgtatatcctctgcccccggactaaaggg

SEQ ID NO: 177292 - DNA, 35 bp, Artificial Sequence
  Synthetic oligonucleotide
agcccgtacttacgacccatccccccgacgaactg

SEQ ID NO: 177293 - DNA, 35 bp, Artificial Sequence
  Synthetic oligonucleotide
gtgatcccagcgcgaccccagcacccgccttactg

SEQ ID NO: 177294 - DNA, 35 bp, Artificial Sequence
  Synthetic oligonucleotide
agccactcgtatcactgctgtccatcgccaccctg

SEQ ID NO: 177295 - DNA, 35 bp, Artificial Sequence
  Synthetic oligonucleotide
ttgaccaggcagagtgcctccacttatccttgctg

SEQ ID NO: 177296 - DNA, 33 bp, Artificial Sequence
  Synthetic oligonucleotide
acacgcctgccccatccgtgatccacttctctg

SEQ ID NO: 177297 - DNA, 35 bp, Artificial Sequence
  Synthetic oligonucleotide
atgcgaagagagggctaggtcgaggcgggcgggtg

SEQ ID NO: 177298 - DNA, 35 bp, Artificial Sequence
  Synthetic oligonucleotide
tatgtcgcccagagacccgtaacacctctcccttg

SEQ ID NO: 177299 - DNA, 34 bp, Artificial Sequence
  Synthetic oligonucleotide
agccacacctcacgaccctctctcttcaatgttg

SEQ ID NO: 177300 - DNA, 35 bp, Artificial Sequence
  Synthetic oligonucleotide
aaccgccccttttctgctccgtctgctcgcctttg

SEQ ID NO: 177301 - DNA, 35 bp, Artificial Sequence
  Synthetic oligonucleotide
tcgcccccatgactgttcactgatacttcatccat

SEQ ID NO: 177302 - DNA, 35 bp, Artificial Sequence
  Synthetic oligonucleotide
agattgggggaagaaaagggggataagagatcgat

SEQ ID NO: 177303 - DNA, 35 bp, Artificial Sequence
  Synthetic oligonucleotide
tttggtgggcggtgggggggttcggtgaaggtgat

SEQ ID NO: 177304 - DNA, 35 bp, Artificial Sequence
  Synthetic oligonucleotide
tcttacgccctggatgcttgcacaccgtaccctat

SEQ ID NO: 177305 - DNA, 35 bp, Artificial Sequence
  Synthetic oligonucleotide
ttgatacacagcccctcatggcgcgactccctact

SEQ ID NO: 177306 - DNA, 35 bp, Artificial Sequence
  Synthetic oligonucleotide
ttccgaccgctgagcatccattcttacagccacct

SEQ ID NO: 177307 - DNA, 35 bp, Artificial Sequence
  Synthetic oligonucleotide
gatgcacctttttcagccttcttcattgcgtacct

SEQ ID NO: 177308 - DNA, 35 bp, Artificial Sequence
  Synthetic oligonucleotide
agccgtgttcctccattgcgtacggtactactcct

SEQ ID NO: 177309 - DNA, 35 bp, Artificial Sequence
  Synthetic oligonucleotide
tccaccccggttccttgtgatcagccgaatctgct

SEQ ID NO: 177310 - DNA, 35 bp, Artificial Sequence
  Synthetic oligonucleotide
actcactccactgcccttttcattgcctgcttgct

SEQ ID NO: 177311 - DNA, 35 bp, Artificial Sequence
  Synthetic oligonucleotide
tatatccgcagctattgctcaaggcccatccctct

SEQ ID NO: 177312 - DNA, 35 bp, Artificial Sequence
  Synthetic oligonucleotide
gtgtggcccaccctggttctcgtgactccctctct

SEQ ID NO: 177313 - DNA, 35 bp, Artificial Sequence
  Synthetic oligonucleotide
ttcgccgatgtcaatccatgcctgtagccctccgt

SEQ ID NO: 177314 - DNA, 35 bp, Artificial Sequence
  Synthetic oligonucleotide
acgctggggaattgggtcttgcaggagggtggggt

SEQ ID NO: 177315 - DNA, 35 bp, Artificial Sequence
  Synthetic oligonucleotide
gccccccagctacccgtgctcctcgcgaatactgt

SEQ ID NO: 177316 - DNA, 35 bp, Artificial Sequence
  Synthetic oligonucleotide
gcactccatgctgcatcacacccacttcctgaatt

SEQ ID NO: 177317 - DNA, 35 bp, Artificial Sequence
  Synthetic oligonucleotide
atcccaccaacaggttccttggtcacttactcctt

SEQ ID NO: 177318 - DNA, 35 bp, Artificial Sequence
  Synthetic oligonucleotide
gcacaccgcccatcgatatttgcggatccacgctt

SEQ ID NO: 177319 - DNA, 35 bp, Artificial Sequence
  Synthetic oligonucleotide
gaccgacacttcttctttggagccctcgacttctt

SEQ ID NO: 177320 - DNA, 35 bp, Artificial Sequence
  Synthetic oligonucleotide
acaccccctgttcaatatgatcgaactccgttctt

SEQ ID NO: 177321 - DNA, 35 bp, Artificial Sequence
  Synthetic oligonucleotide
gcactcggttgggcacaacatcgctccctcctttt

SEQ ID NO: 177322 - DNA, 36 bp, Artificial Sequence
  Synthetic oligonucleotide
actcgcctcttcatcccgcattcgcccagtatccaa

SEQ ID NO: 177323 - DNA, 36 bp, Artificial Sequence
  Synthetic oligonucleotide
gacggggtggccgaggagaaaaaggggaagacttaa

SEQ ID NO: 177324 - DNA, 36 bp, Artificial Sequence
  Synthetic oligonucleotide
aaaagccgccctgtcgcccctggttctgttacaaca

SEQ ID NO: 177325 - DNA, 36 bp, Artificial Sequence
  Synthetic oligonucleotide
tctaatccatcccccgctgtcttctgtcctgccaca

SEQ ID NO: 177326 - DNA, 35 bp, Artificial Sequence
  Synthetic oligonucleotide
accgctacccagtgcgcagatcgaccccccttaca

SEQ ID NO: 177327 - DNA, 35 bp, Artificial Sequence
  Synthetic oligonucleotide
tcaggtcgggttacctggtcactgctacttcacca

SEQ ID NO: 177328 - DNA, 36 bp, Artificial Sequence
  Synthetic oligonucleotide
gcaccgcgtagcataacttccggtcctttcactcca

SEQ ID NO: 177329 - DNA, 36 bp, Artificial Sequence
  Synthetic oligonucleotide
ggtcctcccgcccgctttcgacgccttgcgctagca

SEQ ID NO: 177330 - DNA, 36 bp, Artificial Sequence
  Synthetic oligonucleotide
atccacactcccatcagctatgccttgaccccctca

SEQ ID NO: 177331 - DNA, 36 bp, Artificial Sequence
  Synthetic oligonucleotide
taatgctgggggggtgcgggctgggcgttcgtttca

SEQ ID NO: 177332 - DNA, 37 bp, Artificial Sequence
  Synthetic oligonucleotide
tgtagtgcatcgagagcaaggggggtaggagggaaga

SEQ ID NO: 177333 - DNA, 37 bp, Artificial Sequence
  Synthetic oligonucleotide
atgcggaggaataagggtggtggaaaccaggctcaga

SEQ ID NO: 177334 - DNA, 37 bp, Artificial Sequence
  Synthetic oligonucleotide
gaacggctgggcgggtggacggggcggaggctctaga

SEQ ID NO: 177335 - DNA, 37 bp, Artificial Sequence
  Synthetic oligonucleotide
agtaagggacgggaggaagagagcgcatatggtacga

SEQ ID NO: 177336 - DNA, 37 bp, Artificial Sequence
  Synthetic oligonucleotide
accgctgcctgcccgcacctatatgcactctatccga

SEQ ID NO: 177337 - DNA, 36 bp, Artificial Sequence
  Synthetic oligonucleotide
atgtctcgctcaccgccctcctcgagttttctccga

SEQ ID NO: 177338 - DNA, 37 bp, Artificial Sequence
  Synthetic oligonucleotide
attacgtgtcagggatggggaaggggattgggggcga

SEQ ID NO: 177339 - DNA, 35 bp, Artificial Sequence
  Synthetic oligonucleotide
atggtccctcaccatcgcccctctgtcataatcga

SEQ ID NO: 177340 - DNA, 37 bp, Artificial Sequence
  Synthetic oligonucleotide
tccgcgactggcctgttcatacccgcgcccttatcga

SEQ ID NO: 177341 - DNA, 37 bp, Artificial Sequence
  Synthetic oligonucleotide
tcccgctccatcctcttaaggctgccagtgacctcga

SEQ ID NO: 177342 - DNA, 37 bp, Artificial Sequence
  Synthetic oligonucleotide
gccagccacggacggccactgctccaccttgcctcga

SEQ ID NO: 177343 - DNA, 37 bp, Artificial Sequence
  Synthetic oligonucleotide
tccacccggcgagtacattaggacccactctcttcga

SEQ ID NO: 177344 - DNA, 37 bp, Artificial Sequence
  Synthetic oligonucleotide
tcatccatcatcgctgtttcgcacgtcttactttcga

SEQ ID NO: 177345 - DNA, 33 bp, Artificial Sequence
  Synthetic oligonucleotide
ggtgactatcaccacgctcctacccgacccgga

SEQ ID NO: 177346 - DNA, 37 bp, Artificial Sequence
  Synthetic oligonucleotide
gaggggtcggggattaaggaggggggtggcgtgcgga

SEQ ID NO: 177347 - DNA, 36 bp, Artificial Sequence
  Synthetic oligonucleotide
gaggggggagggcggggcatatacactcgattcgga

SEQ ID NO: 177348 - DNA, 37 bp, Artificial Sequence
  Synthetic oligonucleotide
taagggtgggggattaaatcgaaggggagagagggga

SEQ ID NO: 177349 - DNA, 37 bp, Artificial Sequence
  Synthetic oligonucleotide
gccaaggaaggttggcaaaaagggggtagttggggga

SEQ ID NO: 177350 - DNA, 36 bp, Artificial Sequence
  Synthetic oligonucleotide
gctggtaactgggcggggaatgaaaggggagtggga

SEQ ID NO: 177351 - DNA, 37 bp, Artificial Sequence
  Synthetic oligonucleotide
tagtgcgtgggtgcgggggggtgggtactgtgtggga

SEQ ID NO: 177352 - DNA, 37 bp, Artificial Sequence
  Synthetic oligonucleotide
aacccagtcctctatcttctcgtacgcccgcttggga

SEQ ID NO: 177353 - DNA, 36 bp, Artificial Sequence
  Synthetic oligonucleotide
tgcctaccctcgctgctcctaaatatcgcaccatga

SEQ ID NO: 177354 - DNA, 38 bp, Artificial Sequence
  Synthetic oligonucleotide
actcgccgcccgtaccctttaaactcagcctctcatga

SEQ ID NO: 177355 - DNA, 37 bp, Artificial Sequence
  Synthetic oligonucleotide
actccacgcacacattgactttctaccccattcatga

SEQ ID NO: 177356 - DNA, 38 bp, Artificial Sequence
  Synthetic oligonucleotide
gtgggtaggggggaaggcaataaaggggtgggggatga

SEQ ID NO: 177357 - DNA, 37 bp, Artificial Sequence
  Synthetic oligonucleotide
tctccacccgccttcacaagtcgtccttgttggatga

SEQ ID NO: 177358 - DNA, 37 bp, Artificial Sequence
  Synthetic oligonucleotide
gatcgcctcgattatactcatgccttctctaccctga

SEQ ID NO: 177359 - DNA, 38 bp, Artificial Sequence
  Synthetic oligonucleotide
ttggagggggtgggtattcgaggggcgccttggggtga

SEQ ID NO: 177360 - DNA, 38 bp, Artificial Sequence
  Synthetic oligonucleotide
gtgacatgtcaatgtcagcacggtccttcctttcttga

SEQ ID NO: 177361 - DNA, 38 bp, Artificial Sequence
  Synthetic oligonucleotide
tggtggggggaggaggggtgttgagtcggagaggttga

SEQ ID NO: 177362 - DNA, 38 bp, Artificial Sequence
  Synthetic oligonucleotide
gcgctcgctgcacgttttaccgcctgccctcttgttga

SEQ ID NO: 177363 - DNA, 37 bp, Artificial Sequence
  Synthetic oligonucleotide
gcatacgtgccgcatcgtatcctgccctctagtttga

SEQ ID NO: 177364 - DNA, 36 bp, Artificial Sequence
  Synthetic oligonucleotide
tcgttctcccctgctcgcgtattggtccgcaaacta

SEQ ID NO: 177365 - DNA, 36 bp, Artificial Sequence
  Synthetic oligonucleotide
tgtcaccacacatgtgttgtctgcccacacgcccta

SEQ ID NO: 177366 - DNA, 36 bp, Artificial Sequence
  Synthetic oligonucleotide
acgcccgcctacccgctaccctatatgtcttgccta

SEQ ID NO: 177367 - DNA, 36 bp, Artificial Sequence
  Synthetic oligonucleotide
tcgatctccctgacactttgtaatgactcacctcta

SEQ ID NO: 177368 - DNA, 35 bp, Artificial Sequence
  Synthetic oligonucleotide
tgctgcgcctcgtcctccgccacatataccctcta

SEQ ID NO: 177369 - DNA, 35 bp, Artificial Sequence
  Synthetic oligonucleotide
tccctcacggacaatggaccaccacacgctctcta

SEQ ID NO: 177370 - DNA, 35 bp, Artificial Sequence
  Synthetic oligonucleotide
gtccgggaacggacttattagccaccctagcctta

SEQ ID NO: 177371 - DNA, 35 bp, Artificial Sequence
  Synthetic oligonucleotide
gcaacaacacgacttgctatcgcacccctcttaac

SEQ ID NO: 177372 - DNA, 35 bp, Artificial Sequence
  Synthetic oligonucleotide
agtcagtcgccctcaataacgggcctttgctccac

SEQ ID NO: 177373 - DNA, 35 bp, Artificial Sequence
  Synthetic oligonucleotide
agctgcccccctatgagcgcccttgttgaccgcac

SEQ ID NO: 177374 - DNA, 35 bp, Artificial Sequence
  Synthetic oligonucleotide
tccatcccgctaggacacatctgtccaatcgatac

SEQ ID NO: 177375 - DNA, 35 bp, Artificial Sequence
  Synthetic oligonucleotide
tgcacagtccttcagtttctacatcttcacgtacc

SEQ ID NO: 177376 - DNA, 35 bp, Artificial Sequence
  Synthetic oligonucleotide
ttaggccaacgtatgacgccgactcctcctcaccc

SEQ ID NO: 177377 - DNA, 35 bp, Artificial Sequence
  Synthetic oligonucleotide
agcccgacgtaggcatttaccattcgtaccacccc

SEQ ID NO: 177378 - DNA, 35 bp, Artificial Sequence
  Synthetic oligonucleotide
ttgttccagacgcttccatcaggttctctccgccc

SEQ ID NO: 177379 - DNA, 35 bp, Artificial Sequence
  Synthetic oligonucleotide
gactcagcaacacacctattagctttggtccgccc

SEQ ID NO: 177380 - DNA, 35 bp, Artificial Sequence
  Synthetic oligonucleotide
acccttccctgccatctctagtagatatcggtccc

SEQ ID NO: 177381 - DNA, 35 bp, Artificial Sequence
  Synthetic oligonucleotide
gcgcatcgatccgtcgatttgcccttgatcttccc

SEQ ID NO: 177382 - DNA, 35 bp, Artificial Sequence
  Synthetic oligonucleotide
atcgcctatccacttgattcatttacctggttccc

SEQ ID NO: 177383 - DNA, 35 bp, Artificial Sequence
  Synthetic oligonucleotide
tcatcgccgaatgccactcgagtaccgcgtttccc

SEQ ID NO: 177384 - DNA, 35 bp, Artificial Sequence
  Synthetic oligonucleotide
gcaggtctcccttcgccttgccttgttgccacgcc

SEQ ID NO: 177385 - DNA, 34 bp, Artificial Sequence
  Synthetic oligonucleotide
gacgacgcctcccgcctgtagtcactgtcacgcc

SEQ ID NO: 177386 - DNA, 35 bp, Artificial Sequence
  Synthetic oligonucleotide
gacaccacgcgtcgactctacgctcagccaatgcc

SEQ ID NO: 177387 - DNA, 35 bp, Artificial Sequence
  Synthetic oligonucleotide
tagaccatcccgcaatcattattggtggccctgcc

SEQ ID NO: 177388 - DNA, 35 bp, Artificial Sequence
  Synthetic oligonucleotide
tgggccatgacgtatgccctctccgttgttcatcc

SEQ ID NO: 177389 - DNA, 35 bp, Artificial Sequence
  Synthetic oligonucleotide
gttgaaaccccgtcagtacctttgtctgatcctcc

SEQ ID NO: 177390 - DNA, 35 bp, Artificial Sequence
  Synthetic oligonucleotide
gacgccccgccgttgcttgggtaccgtcgtcctcc

SEQ ID NO: 177391 - DNA, 35 bp, Artificial Sequence
  Synthetic oligonucleotide
gacgcgcattgttctcgattcactggcccttctcc

SEQ ID NO: 177392 - DNA, 35 bp, Artificial Sequence
  Synthetic oligonucleotide
gccaccattcggcccggccttcaatcgtttcacgc

SEQ ID NO: 177393 - DNA, 35 bp, Artificial Sequence
  Synthetic oligonucleotide
tcacagccactactactaagccctgccacgcccgc

SEQ ID NO: 177394 - DNA, 35 bp, Artificial Sequence
  Synthetic oligonucleotide
gcaatactcgctcctgttcgtccatatcgtgccgc

SEQ ID NO: 177395 - DNA, 35 bp, Artificial Sequence
  Synthetic oligonucleotide
tagaccatcacctctcagaaacagcacctgctcgc

SEQ ID NO: 177396 - DNA, 35 bp, Artificial Sequence
  Synthetic oligonucleotide
atgcccaccagcaccgctcccgttatgctccaggc

SEQ ID NO: 177397 - DNA, 35 bp, Artificial Sequence
  Synthetic oligonucleotide
gcccatccagttcgacccggaccatttcatctatc

SEQ ID NO: 177398 - DNA, 35 bp, Artificial Sequence
  Synthetic oligonucleotide
gctgccagcgcattcaattcgtctccgctccactc

SEQ ID NO: 177399 - DNA, 35 bp, Artificial Sequence
  Synthetic oligonucleotide
atcgtccaccctctatcacatcgtcatgctgcctc

SEQ ID NO: 177400 - DNA, 35 bp, Artificial Sequence
  Synthetic oligonucleotide
gtgtgctatgcgcttttcccagtcaagcccctgtc

SEQ ID NO: 177401 - DNA, 35 bp, Artificial Sequence
  Synthetic oligonucleotide
gtcactcactacttctgacgtagccaggtcccttc

SEQ ID NO: 177402 - DNA, 35 bp, Artificial Sequence
  Synthetic oligonucleotide
ctgcaccccgcacctccggttttgcctcctggttc

SEQ ID NO: 177403 - DNA, 35 bp, Artificial Sequence
  Synthetic oligonucleotide
atctcacaccggatccgaaatcgcccccaattacg

SEQ ID NO: 177404 - DNA, 35 bp, Artificial Sequence
  Synthetic oligonucleotide
gacatgccgcgcgtctctgctcctttcactttacg

SEQ ID NO: 177405 - DNA, 35 bp, Artificial Sequence
  Synthetic oligonucleotide
gcctgacactgtacccattcgccgtctctctgtcg

SEQ ID NO: 177406 - DNA, 35 bp, Artificial Sequence
  Synthetic oligonucleotide
tgtcacaacatacggccgccaacatctttccttcg

SEQ ID NO: 177407 - DNA, 35 bp, Artificial Sequence
  Synthetic oligonucleotide
ttgaaggtatgggagggggggataatgtaactggg

SEQ ID NO: 177408 - DNA, 35 bp, Artificial Sequence
  Synthetic oligonucleotide
tgacgaggaagggacggtggtgttaggtagctggg

SEQ ID NO: 177409 - DNA, 35 bp, Artificial Sequence
  Synthetic oligonucleotide
gcctgaggcttcaccgtgctccacctgtcccctgg

SEQ ID NO: 177410 - DNA, 35 bp, Artificial Sequence
  Synthetic oligonucleotide
tacggaggggggggtcgttttcagggatgacgtgg

SEQ ID NO: 177411 - DNA, 35 bp, Artificial Sequence
  Synthetic oligonucleotide
agactagctcctccccgttctggttccattcttgg

SEQ ID NO: 177412 - DNA, 33 bp, Artificial Sequence
  Synthetic oligonucleotide
tgtaacgcctccccctatgcattggtgattctg

SEQ ID NO: 177413 - DNA, 35 bp, Artificial Sequence
  Synthetic oligonucleotide
gtcacacctccacagtccacatgcgtgcctacgtg

SEQ ID NO: 177414 - DNA, 35 bp, Artificial Sequence
  Synthetic oligonucleotide
tgacgagtgtgagaagggagaggagggggacgttg

SEQ ID NO: 177415 - DNA, 35 bp, Artificial Sequence
  Synthetic oligonucleotide
gttcacatgtcaggcacttaccatcgatccaccat

SEQ ID NO: 177416 - DNA, 35 bp, Artificial Sequence
  Synthetic oligonucleotide
tgccccgaccttgaacgcggtttcttatgacccat

SEQ ID NO: 177417 - DNA, 35 bp, Artificial Sequence
  Synthetic oligonucleotide
atttcccgccccaaggtcacattcatagatcacct

SEQ ID NO: 177418 - DNA, 35 bp, Artificial Sequence
  Synthetic oligonucleotide
tgtcctccgctcctagtcctgtacgacgctgccct

SEQ ID NO: 177419 - DNA, 35 bp, Artificial Sequence
  Synthetic oligonucleotide
cctcccccgcacctccgcactgtatcgtcatgcct

SEQ ID NO: 177420 - DNA, 35 bp, Artificial Sequence
  Synthetic oligonucleotide
tgcccctgcccacggttaatttgggtctttatcct

SEQ ID NO: 177421 - DNA, 35 bp, Artificial Sequence
  Synthetic oligonucleotide
tctacctgtatctgtgttctgtccgcccgctagct

SEQ ID NO: 177422 - DNA, 35 bp, Artificial Sequence
  Synthetic oligonucleotide
agcaacttgcccagctccctttctgtgacaccgct

SEQ ID NO: 177423 - DNA, 35 bp, Artificial Sequence
  Synthetic oligonucleotide
gacactaacccctgctgtcaattttcacacccgct

SEQ ID NO: 177424 - DNA, 35 bp, Artificial Sequence
  Synthetic oligonucleotide
agaacaacggccccggtcccataattcaccccgct

SEQ ID NO: 177425 - DNA, 35 bp, Artificial Sequence
  Synthetic oligonucleotide
ggagcctagctatccgagttctcgtgcttccctct

SEQ ID NO: 177426 - DNA, 35 bp, Artificial Sequence
  Synthetic oligonucleotide
tgggaccgcaccatccccatcacttgtagacttgt

SEQ ID NO: 177427 - DNA, 35 bp, Artificial Sequence
  Synthetic oligonucleotide
gccaggccattcctgaccataagccatgccacctt

SEQ ID NO: 177428 - DNA, 35 bp, Artificial Sequence
  Synthetic oligonucleotide
gcgtcggtcattcgtcgttcccttgcacactcctt

SEQ ID NO: 177429 - DNA, 35 bp, Artificial Sequence
  Synthetic oligonucleotide
atccccgccccgactctaccgaacctgcaaatctt

SEQ ID NO: 177430 - DNA, 35 bp, Artificial Sequence
  Synthetic oligonucleotide
acctcccgtggcattcgtttctgtcgctttttctt

SEQ ID NO: 177431 - DNA, 35 bp, Artificial Sequence
  Synthetic oligonucleotide
ttgcacagtccgctccgtagcacgttccacctttt

SEQ ID NO: 177432 - DNA, 35 bp, Artificial Sequence
  Synthetic oligonucleotide
gtcgtactcccaggggctctatcctgtactgtttt

SEQ ID NO: 177433 - DNA, 35 bp, Artificial Sequence
  Synthetic oligonucleotide
gcctccccgctaccttgttccatagtccgctgaaa

SEQ ID NO: 177434 - DNA, 35 bp, Artificial Sequence
  Synthetic oligonucleotide
ggatacgaccatacagggcgggggggcaagtgaaa

SEQ ID NO: 177435 - DNA, 35 bp, Artificial Sequence
  Synthetic oligonucleotide
gccgttctatctgccacaccatctgccttcaacaa

SEQ ID NO: 177436 - DNA, 36 bp, Artificial Sequence
  Synthetic oligonucleotide
gatgcatggtagtggggtgggatataggctggacaa

SEQ ID NO: 177437 - DNA, 36 bp, Artificial Sequence
  Synthetic oligonucleotide
gcatgctacatgcacactctgattataccgccccaa

SEQ ID NO: 177438 - DNA, 35 bp, Artificial Sequence
  Synthetic oligonucleotide
gcaagccctgcgcttttcgatccctattccccgaa

SEQ ID NO: 177439 - DNA, 36 bp, Artificial Sequence
  Synthetic oligonucleotide
tcccgtgcctcattgtagattctcctccactggtaa

SEQ ID NO: 177440 - DNA, 35 bp, Artificial Sequence
  Synthetic oligonucleotide
gttaacaccccgctatgtactgcctcagcatttaa

SEQ ID NO: 177441 - DNA, 36 bp, Artificial Sequence
  Synthetic oligonucleotide
tgcccgctggccacctgtccctaaactgcatgcaca

SEQ ID NO: 177442 - DNA, 35 bp, Artificial Sequence
  Synthetic oligonucleotide
gccaccctcacagaattgtcaccttcgcctgcaca

SEQ ID NO: 177443 - DNA, 36 bp, Artificial Sequence
  Synthetic oligonucleotide
acccctgtcccctgccgccccgtttgacacactaca

SEQ ID NO: 177444 - DNA, 36 bp, Artificial Sequence
  Synthetic oligonucleotide
tgatcgacctcgccgcctttattgacaacgactaca

SEQ ID NO: 177445 - DNA, 36 bp, Artificial Sequence
  Synthetic oligonucleotide
gatagccgttgcgtgagcctccgcctgcctacccca

SEQ ID NO: 177446 - DNA, 35 bp, Artificial Sequence
  Synthetic oligonucleotide
tgtaactgcaggcctcccagtttgagcctccccca

SEQ ID NO: 177447 - DNA, 36 bp, Artificial Sequence
  Synthetic oligonucleotide
acaccactcctggaatactacactcgcacttgggca

SEQ ID NO: 177448 - DNA, 36 bp, Artificial Sequence
  Synthetic oligonucleotide
tcagtgtagatgttcgacacctcctgtcctcctgca

SEQ ID NO: 177449 - DNA, 35 bp, Artificial Sequence
  Synthetic oligonucleotide
gtttcccctccaattttgttccagtcctgtcctca

SEQ ID NO: 177450 - DNA, 36 bp, Artificial Sequence
  Synthetic oligonucleotide
tctcccagcagaccagtattcgttcgtctcccttca

SEQ ID NO: 177451 - DNA, 36 bp, Artificial Sequence
  Synthetic oligonucleotide
gccaacgatttccgccttactttcgtgtctgtttca

SEQ ID NO: 177452 - DNA, 37 bp, Artificial Sequence
  Synthetic oligonucleotide
gacgtgttcgccctgctcgcttaccagtcttaccaga

SEQ ID NO: 177453 - DNA, 37 bp, Artificial Sequence
  Synthetic oligonucleotide
tagttcctctgccccgtgtacctgtttcccttccaga

SEQ ID NO: 177454 - DNA, 37 bp, Artificial Sequence
  Synthetic oligonucleotide
attggatggagccagataggagaagggtggatggaga

SEQ ID NO: 177455 - DNA, 37 bp, Artificial Sequence
  Synthetic oligonucleotide
agctgggagggacgactggagagggttcggggctaga

SEQ ID NO: 177456 - DNA, 37 bp, Artificial Sequence
  Synthetic oligonucleotide
gggagggacaaggaaagaagcggggggataatgtaga

SEQ ID NO: 177457 - DNA, 36 bp, Artificial Sequence
  Synthetic oligonucleotide
ggtgatctactgccctccgacccgccgttatgacga

SEQ ID NO: 177458 - DNA, 37 bp, Artificial Sequence
  Synthetic oligonucleotide
ttcacgttacgccggttccgtgtctctcgctccccga

SEQ ID NO: 177459 - DNA, 37 bp, Artificial Sequence
  Synthetic oligonucleotide
atggtactgtcccagctcctatacactctctccccga

SEQ ID NO: 177460 - DNA, 36 bp, Artificial Sequence
  Synthetic oligonucleotide
atgtccgtcctcatgtccagcctactccccagccga

SEQ ID NO: 177461 - DNA, 38 bp, Artificial Sequence
  Synthetic oligonucleotide
gtctgctcccatgccccgtgcgtacatactcgttccga

SEQ ID NO: 177462 - DNA, 37 bp, Artificial Sequence
  Synthetic oligonucleotide
gccccccacccgatcggccatgttactttcttagcga

SEQ ID NO: 177463 - DNA, 37 bp, Artificial Sequence
  Synthetic oligonucleotide
acagtcgaacctccgccctctttcttcgcccctgcga

SEQ ID NO: 177464 - DNA, 37 bp, Artificial Sequence
  Synthetic oligonucleotide
attgccgccgtcgacccttactccctgcccggtgcga

SEQ ID NO: 177465 - DNA, 37 bp, Artificial Sequence
  Synthetic oligonucleotide
tgtcccgtgcatatactacgcgccctcgtcctttcga

SEQ ID NO: 177466 - DNA, 37 bp, Artificial Sequence
  Synthetic oligonucleotide
ggtaagtgccgaggaggaggtgcaggcgacggaggga

SEQ ID NO: 177467 - DNA, 37 bp, Artificial Sequence
  Synthetic oligonucleotide
gactgccccaccgccaaattacccacccgtgccggga

SEQ ID NO: 177468 - DNA, 37 bp, Artificial Sequence
  Synthetic oligonucleotide
accacccccatgtttatctattgcactgctcttggga

SEQ ID NO: 177469 - DNA, 37 bp, Artificial Sequence
  Synthetic oligonucleotide
gagggagcgaaggggggatgggagggaaaggtatgga

SEQ ID NO: 177470 - DNA, 37 bp, Artificial Sequence
  Synthetic oligonucleotide
tgccccatcagcgtcgagtagccccaccctccaatga

SEQ ID NO: 177471 - DNA, 38 bp, Artificial Sequence
  Synthetic oligonucleotide
acgctgggtgggtgggttggcgctgaaaaggggaatga

SEQ ID NO: 177472 - DNA, 37 bp, Artificial Sequence
  Synthetic oligonucleotide
aagtcacgccatcgttccatccgcatttgttccatga

SEQ ID NO: 177473 - DNA, 38 bp, Artificial Sequence
  Synthetic oligonucleotide
tcaaaggtatggccaggaagaggaggggacggatatga

SEQ ID NO: 177474 - DNA, 37 bp, Artificial Sequence
  Synthetic oligonucleotide
acctatgcctctgacctgccaccccgtttccgtatga

SEQ ID NO: 177475 - DNA, 38 bp, Artificial Sequence
  Synthetic oligonucleotide
gctgggtcgagtatagggagggagggggacctttatga

SEQ ID NO: 177476 - DNA, 37 bp, Artificial Sequence
  Synthetic oligonucleotide
gctatgcactcgattaccgccgctcgatcctccctga

SEQ ID NO: 177477 - DNA, 37 bp, Artificial Sequence
  Synthetic oligonucleotide
tcacgatcacccgggcactcctagccaccactcctga

SEQ ID NO: 177478 - DNA, 38 bp, Artificial Sequence
  Synthetic oligonucleotide
gggggaggacgaagtaagggtagggggattgggtctga

SEQ ID NO: 177479 - DNA, 37 bp, Artificial Sequence
  Synthetic oligonucleotide
gcaagtcccgcgccccccacgttctcacagccagtga

SEQ ID NO: 177480 - DNA, 36 bp, Artificial Sequence
  Synthetic oligonucleotide
ggtgccacgcggcggtgggaagggaagggagggtga

SEQ ID NO: 177481 - DNA, 38 bp, Artificial Sequence
  Synthetic oligonucleotide
gtgaagaggcggaggaagggctttactgaagggggtga

SEQ ID NO: 177482 - DNA, 38 bp, Artificial Sequence
  Synthetic oligonucleotide
gcgggagtgaggggcatagggaaaggaatcgggggtga

SEQ ID NO: 177483 - DNA, 38 bp, Artificial Sequence
  Synthetic oligonucleotide
gggtaggggcgtgggaaggcagatgaggctgggggtga

SEQ ID NO: 177484 - DNA, 37 bp, Artificial Sequence
  Synthetic oligonucleotide
gaggacgaggctgggagggtatgggaatgtggggtga

SEQ ID NO: 177485 - DNA, 38 bp, Artificial Sequence
  Synthetic oligonucleotide
gagtgggatgggtggggacggggtgattcgtactgtga

SEQ ID NO: 177486 - DNA, 38 bp, Artificial Sequence
  Synthetic oligonucleotide
gtcgcatcccatgcacgaattactactgatccccttga

SEQ ID NO: 177487 - DNA, 38 bp, Artificial Sequence
  Synthetic oligonucleotide
tgagtgcgtggttctgtcctcacttgcccttttcttga

SEQ ID NO: 177488 - DNA, 35 bp, Artificial Sequence
  Synthetic oligonucleotide
tagacccccccgctatgcgtgacaacgactacata

SEQ ID NO: 177489 - DNA, 36 bp, Artificial Sequence
  Synthetic oligonucleotide
ggtgggaaagcggggggataggagaaccggcgcata

SEQ ID NO: 177490 - DNA, 35 bp, Artificial Sequence
  Synthetic oligonucleotide
tctgccctttgtggtcccccgctgcctgttaacta

SEQ ID NO: 177491 - DNA, 36 bp, Artificial Sequence
  Synthetic oligonucleotide
gtgtgaacccgctcctttttcgttttggtctgacta

SEQ ID NO: 177492 - DNA, 36 bp, Artificial Sequence
  Synthetic oligonucleotide
tcatgccagcttgcacttattgtcccacgcctacta

SEQ ID NO: 177493 - DNA, 36 bp, Artificial Sequence
  Synthetic oligonucleotide
ttcatccctcactcttcggataaggttccgccccta

SEQ ID NO: 177494 - DNA, 36 bp, Artificial Sequence
  Synthetic oligonucleotide
gccgccgtccctccacccattagcccttttagccta

SEQ ID NO: 177495 - DNA, 36 bp, Artificial Sequence
  Synthetic oligonucleotide
gcacttaggcgctcttctgtccggttcccccgccta

SEQ ID NO: 177496 - DNA, 36 bp, Artificial Sequence
  Synthetic oligonucleotide
tcgacaaacctcatatctgttccgccgttgcactta

SEQ ID NO: 177497 - DNA, 36 bp, Artificial Sequence
  Synthetic oligonucleotide
tcgctactccctgttggcattacttgccctccctta

SEQ ID NO: 177498 - DNA, 36 bp, Artificial Sequence
  Synthetic oligonucleotide
acagacaccaccataccgtccttttctacgtcgtta

SEQ ID NO: 177499 - DNA, 35 bp, Artificial Sequence
  Synthetic oligonucleotide
gaataggaaggggctatgggagaagggagtgttta

SEQ ID NO: 177500 - DNA, 35 bp, Artificial Sequence
  Synthetic oligonucleotide
gcccgcacttagcgctcccctggtactctctttta

SEQ ID NO: 177501 - DNA, 35 bp, Artificial Sequence
  Synthetic oligonucleotide
tgtccacctgatcttctctcttctgcaagttacac

SEQ ID NO: 177502 - DNA, 35 bp, Artificial Sequence
  Synthetic oligonucleotide
acaccacgttcgccatccggactttacatacccac

SEQ ID NO: 177503 - DNA, 35 bp, Artificial Sequence
  Synthetic oligonucleotide
gagacccacgctttgttatcgtttctctgctccac

SEQ ID NO: 177504 - DNA, 35 bp, Artificial Sequence
  Synthetic oligonucleotide
tcgcctccgccctcgttgcttacttgccacatcac

SEQ ID NO: 177505 - DNA, 35 bp, Artificial Sequence
  Synthetic oligonucleotide
tgacgcttccacctgtcaacttttcatgggcctac

SEQ ID NO: 177506 - DNA, 35 bp, Artificial Sequence
  Synthetic oligonucleotide
acccgccctcgcacccacattttacgacgtgcacc

SEQ ID NO: 177507 - DNA, 35 bp, Artificial Sequence
  Synthetic oligonucleotide
tgtcactgtacgcaccttcttgctcgggctatacc

SEQ ID NO: 177508 - DNA, 35 bp, Artificial Sequence
  Synthetic oligonucleotide
gacgtcaattctccgctgttgtctggccgcttacc

SEQ ID NO: 177509 - DNA, 35 bp, Artificial Sequence
  Synthetic oligonucleotide
acaccttgtgctgtatccgtcgactacggctcccc

SEQ ID NO: 177510 - DNA, 35 bp, Artificial Sequence
  Synthetic oligonucleotide
accaccattgcacatgccaacgacaaggtacgccc

SEQ ID NO: 177511 - DNA, 35 bp, Artificial Sequence
  Synthetic oligonucleotide
tcacccctctcgtgtggcacccgattacatcgccc

SEQ ID NO: 177512 - DNA, 35 bp, Artificial Sequence
  Synthetic oligonucleotide
gaccactgatgagtgtcttggctgattaccctccc

SEQ ID NO: 177513 - DNA, 35 bp, Artificial Sequence
  Synthetic oligonucleotide
tgcacgtagacttggctagcgctcccatttgtccc

SEQ ID NO: 177514 - DNA, 35 bp, Artificial Sequence
  Synthetic oligonucleotide
atcaaccttcctggagcgctacaccatcgtccgcc

SEQ ID NO: 177515 - DNA, 35 bp, Artificial Sequence
  Synthetic oligonucleotide
ggctccacacggtgcgcacattccatcgcctcgcc

SEQ ID NO: 177516 - DNA, 35 bp, Artificial Sequence
  Synthetic oligonucleotide
gatatgcgcccccttattctttcctgtcgggtgcc

SEQ ID NO: 177517 - DNA, 35 bp, Artificial Sequence
  Synthetic oligonucleotide
tcactaagcccttcctgtactgctcttatgaatcc

SEQ ID NO: 177518 - DNA, 35 bp, Artificial Sequence
  Synthetic oligonucleotide
attcgccccttcgtgttatcgttatacttttatcc

SEQ ID NO: 177519 - DNA, 35 bp, Artificial Sequence
  Synthetic oligonucleotide
gggatgccggcacgatcgtcttgtctgcctgttcc

SEQ ID NO: 177520 - DNA, 35 bp, Artificial Sequence
  Synthetic oligonucleotide
gatgtcgtaagcgttgggatcagcctctcctccgc

SEQ ID NO: 177521 - DNA, 35 bp, Artificial Sequence
  Synthetic oligonucleotide
attcgccacgttcaacctctacgctaactgtccgc

SEQ ID NO: 177522 - DNA, 27 bp, Artificial Sequence
  Synthetic oligonucleotide
tcacctcatacaccttaatcctcgcgc

SEQ ID NO: 177523 - DNA, 35 bp, Artificial Sequence
  Synthetic oligonucleotide
tacgattcgacgctagtatctgttaccttcatcgc

SEQ ID NO: 177524 - DNA, 35 bp, Artificial Sequence
  Synthetic oligonucleotide
tgtacgatgcgcggcctcttttgctccctagtcgc

SEQ ID NO: 177525 - DNA, 35 bp, Artificial Sequence
  Synthetic oligonucleotide
tcccggtgacgtgcccggttactcctgctgttcgc

SEQ ID NO: 177526 - DNA, 35 bp, Artificial Sequence
  Synthetic oligonucleotide
tgtgcactgcctctctcctctgtctctgtccaggc

SEQ ID NO: 177527 - DNA, 35 bp, Artificial Sequence
  Synthetic oligonucleotide
gccccatccgatcgtccgctttggcatcacgtggc

SEQ ID NO: 177528 - DNA, 35 bp, Artificial Sequence
  Synthetic oligonucleotide
tgcgcacgccgcaaaatcgacgccatccccactgc

SEQ ID NO: 177529 - DNA, 35 bp, Artificial Sequence
  Synthetic oligonucleotide
tctgatctgtcagctgtcggtacatttcctcctgc

SEQ ID NO: 177530 - DNA, 35 bp, Artificial Sequence
  Synthetic oligonucleotide
agcacacggtaagggttgtagggggtggggggtgc

SEQ ID NO: 177531 - DNA, 34 bp, Artificial Sequence
  Synthetic oligonucleotide
gcctactcctgttccgttacttctggttagaatc

SEQ ID NO: 177532 - DNA, 35 bp, Artificial Sequence
  Synthetic oligonucleotide
tacgcctatctctgtatccgtcaccaagacccatc

SEQ ID NO: 177533 - DNA, 35 bp, Artificial Sequence
  Synthetic oligonucleotide
actacacccgccgggcacacatgtttgctcgcctc

SEQ ID NO: 177534 - DNA, 35 bp, Artificial Sequence
  Synthetic oligonucleotide
tgtcatccttatccgactggttattctgtctcctc

SEQ ID NO: 177535 - DNA, 35 bp, Artificial Sequence
  Synthetic oligonucleotide
tgttcacgagactttgtcactacctacgcttcctc

SEQ ID NO: 177536 - DNA, 35 bp, Artificial Sequence
  Synthetic oligonucleotide
tccgaccccgccgattatttgaaccctacttgctc

SEQ ID NO: 177537 - DNA, 35 bp, Artificial Sequence
  Synthetic oligonucleotide
tgacatgcgcaacacctgttctatcatctatagtc

SEQ ID NO: 177538 - DNA, 35 bp, Artificial Sequence
  Synthetic oligonucleotide
aaccccagttcgccttaacatttttatcgcctgtc

SEQ ID NO: 177539 - DNA, 35 bp, Artificial Sequence
  Synthetic oligonucleotide
tcatgacccaatggccaacctcgcgctgttacttc

SEQ ID NO: 177540 - DNA, 35 bp, Artificial Sequence
  Synthetic oligonucleotide
agcagtcagtctgcttagcgtcgttctttcccttc

SEQ ID NO: 177541 - DNA, 35 bp, Artificial Sequence
  Synthetic oligonucleotide
gagtacgccttcccctttgaacgaatcggtccttc

SEQ ID NO: 177542 - DNA, 35 bp, Artificial Sequence
  Synthetic oligonucleotide
ccccccgcatcttgcttttgtgcgctccctctttc

SEQ ID NO: 177543 - DNA, 35 bp, Artificial Sequence
  Synthetic oligonucleotide
gtccccccagttcagtcgaccttccctctatccag

SEQ ID NO: 177544 - DNA, 35 bp, Artificial Sequence
  Synthetic oligonucleotide
tttcagccactcctgtcctgttctgcgcgcccccg

SEQ ID NO: 177545 - DNA, 35 bp, Artificial Sequence
  Synthetic oligonucleotide
ttgcccgctgatatcacccgctcttcccacatggg

SEQ ID NO: 177546 - DNA, 35 bp, Artificial Sequence
  Synthetic oligonucleotide
tgcacatagcactcgcccaatcatacctcccatgg

SEQ ID NO: 177547 - DNA, 35 bp, Artificial Sequence
  Synthetic oligonucleotide
gaataggtaagggaaggcatagaaatgagagatgg

SEQ ID NO: 177548 - DNA, 35 bp, Artificial Sequence
  Synthetic oligonucleotide
ttggagagtgggtgggagggttctggcacaactgg

SEQ ID NO: 177549 - DNA, 35 bp, Artificial Sequence
  Synthetic oligonucleotide
gcatccctcctagtttacgcgaaacacctaccatg

SEQ ID NO: 177550 - DNA, 35 bp, Artificial Sequence
  Synthetic oligonucleotide
tcctccgcagagtccctcgtttgccttcattcttg

SEQ ID NO: 177551 - DNA, 35 bp, Artificial Sequence
  Synthetic oligonucleotide
gcccatcctccggggacgtatgacctatccctttg

SEQ ID NO: 177552 - DNA, 35 bp, Artificial Sequence
  Synthetic oligonucleotide
gtccatgacataacccgcctccattcgatgttttg

SEQ ID NO: 177553 - DNA, 35 bp, Artificial Sequence
  Synthetic oligonucleotide
acccccgtatatgccgcctacccgatgacattcat

SEQ ID NO: 177554 - DNA, 35 bp, Artificial Sequence
  Synthetic oligonucleotide
gaccccggcgtttctcatttggtttgcccgatcct

SEQ ID NO: 177555 - DNA, 35 bp, Artificial Sequence
  Synthetic oligonucleotide
gtgaccgtaaggtcgtccccctgtattgtactcct

SEQ ID NO: 177556 - DNA, 35 bp, Artificial Sequence
  Synthetic oligonucleotide
gcttgaaccgcccacattcctgtgattccaccgct

SEQ ID NO: 177557 - DNA, 35 bp, Artificial Sequence
  Synthetic oligonucleotide
gagtgagctgtgctgcccggttctgtagtccttct

SEQ ID NO: 177558 - DNA, 35 bp, Artificial Sequence
  Synthetic oligonucleotide
tgtggtatgtcgcctcggtatcctggtctcgttct

SEQ ID NO: 177559 - DNA, 35 bp, Artificial Sequence
  Synthetic oligonucleotide
gggggtggggggtgagggtgcggacccaaagtggt

SEQ ID NO: 177560 - DNA, 35 bp, Artificial Sequence
  Synthetic oligonucleotide
agtacatcccgcacacctccactcaacgctgtggt

SEQ ID NO: 177561 - DNA, 35 bp, Artificial Sequence
  Synthetic oligonucleotide
attacgcgtacgtcggttacccaacccgctccctt

SEQ ID NO: 177562 - DNA, 35 bp, Artificial Sequence
  Synthetic oligonucleotide
gattcgtcatcatgacccttcgccctcgcacgctt

SEQ ID NO: 177563 - DNA, 35 bp, Artificial Sequence
  Synthetic oligonucleotide
gcatatctgccgcggtgtcctcttctgccttagtt

SEQ ID NO: 177564 - DNA, 35 bp, Artificial Sequence
  Synthetic oligonucleotide
gcaccatggctacccctgccacccgccccttggtt

SEQ ID NO: 177565 - DNA, 36 bp, Artificial Sequence
  Synthetic oligonucleotide
tgtgatgcccccgactgcccaatgcgttacccccaa

SEQ ID NO: 177566 - DNA, 36 bp, Artificial Sequence
  Synthetic oligonucleotide
ttgcacctccagcagccagacctacttttaccgcaa

SEQ ID NO: 177567 - DNA, 36 bp, Artificial Sequence
  Synthetic oligonucleotide
ttgacccccccgccatgcatctctggcgtttttcaa

SEQ ID NO: 177568 - DNA, 35 bp, Artificial Sequence
  Synthetic oligonucleotide
accatccatgtcccgctcacagtttatcgccataa

SEQ ID NO: 177569 - DNA, 36 bp, Artificial Sequence
  Synthetic oligonucleotide
gcctacgacccgctgaacgccgctaattaccgcaca

SEQ ID NO: 177570 - DNA, 35 bp, Artificial Sequence
  Synthetic oligonucleotide
gcatcacagcctacaccggtactactttctgcaca

SEQ ID NO: 177571 - DNA, 36 bp, Artificial Sequence
  Synthetic oligonucleotide
gtcgccctcctgtcaagtcgcccgtaaacattcaca

SEQ ID NO: 177572 - DNA, 35 bp, Artificial Sequence
  Synthetic oligonucleotide
gccacgcccaacactcctcgctccgggttagtaca

SEQ ID NO: 177573 - DNA, 35 bp, Artificial Sequence
  Synthetic oligonucleotide
tcccgagccccatcgtactcgtactcaccgcacca

SEQ ID NO: 177574 - DNA, 36 bp, Artificial Sequence
  Synthetic oligonucleotide
ggacctgcagtgtacgaacctccgcctcgctcccca

SEQ ID NO: 177575 - DNA, 36 bp, Artificial Sequence
  Synthetic oligonucleotide
tacgtagcgcaggtcgcagacgttttgcacctccca

SEQ ID NO: 177576 - DNA, 36 bp, Artificial Sequence
  Synthetic oligonucleotide
attccccctcgtacgcgcctaagtcgagctttccca

SEQ ID NO: 177577 - DNA, 36 bp, Artificial Sequence
  Synthetic oligonucleotide
tacgttcgcccgccagccgaccttttgatccatcca

SEQ ID NO: 177578 - DNA, 35 bp, Artificial Sequence
  Synthetic oligonucleotide
tcaccgctccttgggctcccttagtttagtttcca

SEQ ID NO: 177579 - DNA, 35 bp, Artificial Sequence
  Synthetic oligonucleotide
taggggggaggaatgagggaaaaacaactagagca

SEQ ID NO: 177580 - DNA, 35 bp, Artificial Sequence
  Synthetic oligonucleotide
gtggacaatgcgcgggtgggagtaagggattggca

SEQ ID NO: 177581 - DNA, 36 bp, Artificial Sequence
  Synthetic oligonucleotide
gccatccgcactcttttaatcacaggccgttatgca

SEQ ID NO: 177582 - DNA, 36 bp, Artificial Sequence
  Synthetic oligonucleotide
tccatcccccctggatcgtagcaagccccacttgca

SEQ ID NO: 177583 - DNA, 35 bp, Artificial Sequence
  Synthetic oligonucleotide
aggtcgggacgtggagcatgggagggtgggggtca

SEQ ID NO: 177584 - DNA, 36 bp, Artificial Sequence
  Synthetic oligonucleotide
gtcctcctgccttgtcctcgagtttcctaatggtca

SEQ ID NO: 177585 - DNA, 35 bp, Artificial Sequence
  Synthetic oligonucleotide
gagcgtgagtcttgatcatccccgtttccctgtca

SEQ ID NO: 177586 - DNA, 36 bp, Artificial Sequence
  Synthetic oligonucleotide
gcccctcacacctgaccgtttttatgcccgcattca

SEQ ID NO: 177587 - DNA, 35 bp, Artificial Sequence
  Synthetic oligonucleotide
tcgactctccttcttgttggcattttaccgtttca

SEQ ID NO: 177588 - DNA, 37 bp, Artificial Sequence
  Synthetic oligonucleotide
attgggaaagggcgggtggggacacatcggtaacaga

SEQ ID NO: 177589 - DNA, 37 bp, Artificial Sequence
  Synthetic oligonucleotide
gggagggcacgacgggggggtcaatggagatgacaga

SEQ ID NO: 177590 - DNA, 37 bp, Artificial Sequence
  Synthetic oligonucleotide
tcagtcactctcagctcactttaatcacttccgccga

SEQ ID NO: 177591 - DNA, 37 bp, Artificial Sequence
  Synthetic oligonucleotide
ttccgtaggctctgtctgtatctcttctcctgcgcga

SEQ ID NO: 177592 - DNA, 36 bp, Artificial Sequence
  Synthetic oligonucleotide
gtgagtgggagggaaacgtagcaaagtcgggatcga

SEQ ID NO: 177593 - DNA, 37 bp, Artificial Sequence
  Synthetic oligonucleotide
atagccgtagtgggtcggggggcggtgaggggttcga

SEQ ID NO: 177594 - DNA, 36 bp, Artificial Sequence
  Synthetic oligonucleotide
gtgatacgaggattggttggagagggtgaggtagga

SEQ ID NO: 177595 - DNA, 37 bp, Artificial Sequence
  Synthetic oligonucleotide
atggcccagctggaaccgggtgggatggggataggga

SEQ ID NO: 177596 - DNA, 37 bp, Artificial Sequence
  Synthetic oligonucleotide
gtgctatgtagtggaatggggtgggcggcatggggga

SEQ ID NO: 177597 - DNA, 37 bp, Artificial Sequence
  Synthetic oligonucleotide
tggggagtggcggtttccatcatagggcggtggggga

SEQ ID NO: 177598 - DNA, 37 bp, Artificial Sequence
  Synthetic oligonucleotide
aaaggggggacggggggggtgagagggggtagatgga

SEQ ID NO: 177599 - DNA, 37 bp, Artificial Sequence
  Synthetic oligonucleotide
ttttgcaccccccccctcttatttggccagttatgga

SEQ ID NO: 177600 - DNA, 37 bp, Artificial Sequence
  Synthetic oligonucleotide
gaatcagggggggcagtatggaaaacggtgggactga

SEQ ID NO: 177601 - DNA, 36 bp, Artificial Sequence
  Synthetic oligonucleotide
gcccccgacctcgaagtagctaaacaccgatcctga

SEQ ID NO: 177602 - DNA, 37 bp, Artificial Sequence
  Synthetic oligonucleotide
tcccgttggcccctgtttcgcatatgctttttcctga

SEQ ID NO: 177603 - DNA, 37 bp, Artificial Sequence
  Synthetic oligonucleotide
tcgacgacacgcccttctgttattctgctcacgctga

SEQ ID NO: 177604 - DNA, 37 bp, Artificial Sequence
  Synthetic oligonucleotide
gtgctccgtgttccatccgtcctcctccctcacgtga

SEQ ID NO: 177605 - DNA, 38 bp, Artificial Sequence
  Synthetic oligonucleotide
tgtttcccccgcctgcactcctctacagttcaccgtga

SEQ ID NO: 177606 - DNA, 38 bp, Artificial Sequence
  Synthetic oligonucleotide
acatcgtgcgtagtagctccccgtcctttattgcgtga

SEQ ID NO: 177607 - DNA, 38 bp, Artificial Sequence
  Synthetic oligonucleotide
ttcgccaccctctcttgtcgccacgtgcccgcttgtga

SEQ ID NO: 177608 - DNA, 37 bp, Artificial Sequence
  Synthetic oligonucleotide
atgcgtgtgaaggaggggaagggcagtaagagattga

SEQ ID NO: 177609 - DNA, 37 bp, Artificial Sequence
  Synthetic oligonucleotide
gatctccccgtcggccctgtccatccgcattacttga

SEQ ID NO: 177610 - DNA, 38 bp, Artificial Sequence
  Synthetic oligonucleotide
actgtacgccctctccatgttacgtggcacactcttga

SEQ ID NO: 177611 - DNA, 38 bp, Artificial Sequence
  Synthetic oligonucleotide
gccgagtggcaaatgcccgatcctgcctccattcttga

SEQ ID NO: 177612 - DNA, 38 bp, Artificial Sequence
  Synthetic oligonucleotide
agcctcgccactgttgcaactctctccgcccttcttga

SEQ ID NO: 177613 - DNA, 37 bp, Artificial Sequence
  Synthetic oligonucleotide
agcgcactccctcaaattgtctccatcctaccgttga

SEQ ID NO: 177614 - DNA, 38 bp, Artificial Sequence
  Synthetic oligonucleotide
gacccctgccctgaaatgattccgtacttacctgttga

SEQ ID NO: 177615 - DNA, 35 bp, Artificial Sequence
  Synthetic oligonucleotide
gactccccccgccattgtacccgttccgcacacta

SEQ ID NO: 177616 - DNA, 35 bp, Artificial Sequence
  Synthetic oligonucleotide
gtaaggggagggcgagggttatggggtttggacta

SEQ ID NO: 177617 - DNA, 36 bp, Artificial Sequence
  Synthetic oligonucleotide
atccacgcctgtgatgctttcctagcggccttccta

SEQ ID NO: 177618 - DNA, 36 bp, Artificial Sequence
  Synthetic oligonucleotide
gattcgccctcatgccttgtcctctttatcctagta

SEQ ID NO: 177619 - DNA, 36 bp, Artificial Sequence
  Synthetic oligonucleotide
ggtcccaccgcccgaccccaccaagaagtactatta

SEQ ID NO: 177620 - DNA, 36 bp, Artificial Sequence
  Synthetic oligonucleotide
acattacggcgccacatcatcgtttctgatccctta

SEQ ID NO: 177621 - DNA, 33 bp, Artificial Sequence
  Synthetic oligonucleotide
ggaccgtatctccgcctgtctttttctagcaac

SEQ ID NO: 177622 - DNA, 35 bp, Artificial Sequence
  Synthetic oligonucleotide
acccatgcagccacctcgtgtcaccgtccttccac

SEQ ID NO: 177623 - DNA, 35 bp, Artificial Sequence
  Synthetic oligonucleotide
ggaacaattcccggctgacccatctccgccctcac

SEQ ID NO: 177624 - DNA, 35 bp, Artificial Sequence
  Synthetic oligonucleotide
tcacacccctgattcctatctccgacacttttcac

SEQ ID NO: 177625 - DNA, 35 bp, Artificial Sequence
  Synthetic oligonucleotide
acgccatcatcacccttacccttcgtttgcctgac

SEQ ID NO: 177626 - DNA, 35 bp, Artificial Sequence
  Synthetic oligonucleotide
tttggccccccccgctcgtggtgcactcccactac

SEQ ID NO: 177627 - DNA, 35 bp, Artificial Sequence
  Synthetic oligonucleotide
attgacctcacctgctatgtccgtctcgccgaacc

SEQ ID NO: 177628 - DNA, 35 bp, Artificial Sequence
  Synthetic oligonucleotide
acatgcatcgttcttgcttcacttctcccgttacc

SEQ ID NO: 177629 - DNA, 36 bp, Artificial Sequence
  Synthetic oligonucleotide
tacgaatggtctcgaacttatacgcaacgccctccc

SEQ ID NO: 177630 - DNA, 35 bp, Artificial Sequence
  Synthetic oligonucleotide
aactactcaatgcgcgtaacgccgaccctgctccc

SEQ ID NO: 177631 - DNA, 35 bp, Artificial Sequence
  Synthetic oligonucleotide
aaccaccgctagatcgcactcccctgttctgtccc

SEQ ID NO: 177632 - DNA, 35 bp, Artificial Sequence
  Synthetic oligonucleotide
attgctcgtggcacgtacatctcgccgccgttccc

SEQ ID NO: 177633 - DNA, 35 bp, Artificial Sequence
  Synthetic oligonucleotide
gcccccctcttgtacgaccctgtttttgttcggcc

SEQ ID NO: 177634 - DNA, 35 bp, Artificial Sequence
  Synthetic oligonucleotide
tacgcctctgctcgttccgcccaagttgaaatgcc

SEQ ID NO: 177635 - DNA, 35 bp, Artificial Sequence
  Synthetic oligonucleotide
caatccggcccgccttcccgctgctcgtctactcc

SEQ ID NO: 177636 - DNA, 35 bp, Artificial Sequence
  Synthetic oligonucleotide
ggtcgtggcgacgcctcctccactccccgtcctcc

SEQ ID NO: 177637 - DNA, 35 bp, Artificial Sequence
  Synthetic oligonucleotide
gattcccgtagccgtttggtcgtcctgccaattcc

SEQ ID NO: 177638 - DNA, 35 bp, Artificial Sequence
  Synthetic oligonucleotide
actccactcgacgtctcttatgccattccactagc

SEQ ID NO: 177639 - DNA, 35 bp, Artificial Sequence
  Synthetic oligonucleotide
atatgccccactctcttagttcgatcgtcctacgc

SEQ ID NO: 177640 - DNA, 35 bp, Artificial Sequence
  Synthetic oligonucleotide
atcgccgtccggctgcacatgtgaccgacctccgc

SEQ ID NO: 177641 - DNA, 35 bp, Artificial Sequence
  Synthetic oligonucleotide
actgaccggacacctgccacgggtcttacctccgc

SEQ ID NO: 177642 - DNA, 35 bp, Artificial Sequence
  Synthetic oligonucleotide
gacgggaagggtggtgagggtcatttcaaatgggc

SEQ ID NO: 177643 - DNA, 35 bp, Artificial Sequence
  Synthetic oligonucleotide
tcactccagcatagtgccatccgtcaatcttaatc

SEQ ID NO: 177644 - DNA, 35 bp, Artificial Sequence
  Synthetic oligonucleotide
tgcatgggccgaattcgatcaatgccgttaccatc

SEQ ID NO: 177645 - DNA, 35 bp, Artificial Sequence
  Synthetic oligonucleotide
gtcactataccctttgcccgccacctgtttggatc

SEQ ID NO: 177646 - DNA, 35 bp, Artificial Sequence
  Synthetic oligonucleotide
acgctctcaacccccgctgttatacagttcatatc

SEQ ID NO: 177647 - DNA, 35 bp, Artificial Sequence
  Synthetic oligonucleotide
gtacttgccgtgccttcccacccagatctattatc

SEQ ID NO: 177648 - DNA, 35 bp, Artificial Sequence
  Synthetic oligonucleotide
gccacactcctctgccttactcagccttcacgctc

SEQ ID NO: 177649 - DNA, 35 bp, Artificial Sequence
  Synthetic oligonucleotide
gctggttcccgtctgccgccacttgagcgcctctc

SEQ ID NO: 177650 - DNA, 35 bp, Artificial Sequence
  Synthetic oligonucleotide
ccacgctctgcccatcctcgacgctttcgcctctc

SEQ ID NO: 177651 - DNA, 35 bp, Artificial Sequence
  Synthetic oligonucleotide
gtcgacccctatagtgcttcaatcgctcaattctc

SEQ ID NO: 177652 - DNA, 36 bp, Artificial Sequence
  Synthetic oligonucleotide
tctgccatcccgatgaccctatcttctgttcatgtc

SEQ ID NO: 177653 - DNA, 35 bp, Artificial Sequence
  Synthetic oligonucleotide
tccgctctggtgccatctacatttcttctgctgtc

SEQ ID NO: 177654 - DNA, 34 bp, Artificial Sequence
  Synthetic oligonucleotide
acggtcattcaccctgcttccatccgctcgtgtc

SEQ ID NO: 177655 - DNA, 35 bp, Artificial Sequence
  Synthetic oligonucleotide
gtgcatccccgctacaggttcgcctcctattattc

SEQ ID NO: 177656 - DNA, 35 bp, Artificial Sequence
  Synthetic oligonucleotide
acatcccgctgattacattcaggtcgccgcccttc

SEQ ID NO: 177657 - DNA, 35 bp, Artificial Sequence
  Synthetic oligonucleotide
tcccgattacgctacaatgcctgagctcatccttc

SEQ ID NO: 177658 - DNA, 35 bp, Artificial Sequence
  Synthetic oligonucleotide
aagccggtctcctcattgcggccattttacgcttc

SEQ ID NO: 177659 - DNA, 35 bp, Artificial Sequence
  Synthetic oligonucleotide
tacgcccattccctccgcccgttattctactgttc

SEQ ID NO: 177660 - DNA, 35 bp, Artificial Sequence
  Synthetic oligonucleotide
acgaccgcacgatacatcgtaacctgcctttgttc

SEQ ID NO: 177661 - DNA, 35 bp, Artificial Sequence
  Synthetic oligonucleotide
gtcaaccgccttcctgttcttgttgatcaactttc

SEQ ID NO: 177662 - DNA, 35 bp, Artificial Sequence
  Synthetic oligonucleotide
tgtgtgtccgttctggtttcggcacattcactttc

SEQ ID NO: 177663 - DNA, 35 bp, Artificial Sequence
  Synthetic oligonucleotide
gttgatgcaattgctataccatggttccttctttc

SEQ ID NO: 177664 - DNA, 35 bp, Artificial Sequence
  Synthetic oligonucleotide
ggtggcctcccgctattcccggaccctttgttttc

SEQ ID NO: 177665 - DNA, 35 bp, Artificial Sequence
  Synthetic oligonucleotide
gccaaagctcaccaattttgtacctccttctcaag

SEQ ID NO: 177666 - DNA, 36 bp, Artificial Sequence
  Synthetic oligonucleotide
gcgagaggggaggggtaggaaatagtatcagatgag

SEQ ID NO: 177667 - DNA, 35 bp, Artificial Sequence
  Synthetic oligonucleotide
taaaccgtctcgtcaccatcgctcctctctcatcg

SEQ ID NO: 177668 - DNA, 35 bp, Artificial Sequence
  Synthetic oligonucleotide
taaccttcacatgctaattatctgccaccctgtcg

SEQ ID NO: 177669 - DNA, 35 bp, Artificial Sequence
  Synthetic oligonucleotide
gatgggcgggagggtctatctggagctaatcgggg

SEQ ID NO: 177670 - DNA, 35 bp, Artificial Sequence
  Synthetic oligonucleotide
gtgaggggggaaatcatacagggacgctggggggg

SEQ ID NO: 177671 - DNA, 35 bp, Artificial Sequence
  Synthetic oligonucleotide
tccgaacaggggggggacagaatggaagtgtgggg

SEQ ID NO: 177672 - DNA, 35 bp, Artificial Sequence
  Synthetic oligonucleotide
atgaccctcgcctccctttcagctgccctttctgg

SEQ ID NO: 177673 - DNA, 35 bp, Artificial Sequence
  Synthetic oligonucleotide
tcctcccttcaccgttccatcattacattcggatg

SEQ ID NO: 177674 - DNA, 35 bp, Artificial Sequence
  Synthetic oligonucleotide
ttgctgtcccatgacgcgaccttaactccactctg

SEQ ID NO: 177675 - DNA, 35 bp, Artificial Sequence
  Synthetic oligonucleotide
tgtaccgtcggctattaaccgtcttctatcccttg

SEQ ID NO: 177676 - DNA, 35 bp, Artificial Sequence
  Synthetic oligonucleotide
gtccagcacagctttcactttcttaccgttccttg

SEQ ID NO: 177677 - DNA, 34 bp, Artificial Sequence
  Synthetic oligonucleotide
atcgttcgcgccccctgtgccatccctgtaaaat

SEQ ID NO: 177678 - DNA, 35 bp, Artificial Sequence
  Synthetic oligonucleotide
agctcgccctctcctacccgatttgcctgactcat

SEQ ID NO: 177679 - DNA, 35 bp, Artificial Sequence
  Synthetic oligonucleotide
gcctatcgccccccgtgctgccatccttgtctcat

SEQ ID NO: 177680 - DNA, 35 bp, Artificial Sequence
  Synthetic oligonucleotide
tgcgcctgcaccctttgccatcaacacgaactgat

SEQ ID NO: 177681 - DNA, 35 bp, Artificial Sequence
  Synthetic oligonucleotide
gccttgcctcccaccgccgcctggtgatttcatat

SEQ ID NO: 177682 - DNA, 35 bp, Artificial Sequence
  Synthetic oligonucleotide
acttacgctccaccaaggtttatttttcgccctat

SEQ ID NO: 177683 - DNA, 35 bp, Artificial Sequence
  Synthetic oligonucleotide
ttcacgacccgccgcccggttcgctcactcgaact

SEQ ID NO: 177684 - DNA, 35 bp, Artificial Sequence
  Synthetic oligonucleotide
gttggcgcagacttagtttacatcgcatctcccct

SEQ ID NO: 177685 - DNA, 35 bp, Artificial Sequence
  Synthetic oligonucleotide
taaccgcggtctttggccttttggtctcctctcct

SEQ ID NO: 177686 - DNA, 35 bp, Artificial Sequence
  Synthetic oligonucleotide
tcgtgggagtccattgcgccgcctgaagtccctct

SEQ ID NO: 177687 - DNA, 35 bp, Artificial Sequence
  Synthetic oligonucleotide
gacccccgaatcgtgaggccgtcccaccctgctct

SEQ ID NO: 177688 - DNA, 35 bp, Artificial Sequence
  Synthetic oligonucleotide
gcaaccgctcgtacctgtcctcgcctcgtctttct

SEQ ID NO: 177689 - DNA, 31 bp, Artificial Sequence
  Synthetic oligonucleotide
atgacacgctcccgcccttgccttgcctcgt

SEQ ID NO: 177690 - DNA, 35 bp, Artificial Sequence
  Synthetic oligonucleotide
agagcaacctctgcattctgcctcctctttcatgt

SEQ ID NO: 177691 - DNA, 35 bp, Artificial Sequence
  Synthetic oligonucleotide
tgtccctacacctctctagctgagccttgaactgt

SEQ ID NO: 177692 - DNA, 35 bp, Artificial Sequence
  Synthetic oligonucleotide
gaccgcctgtcgtcgtcggaatttccccccgctgt

SEQ ID NO: 177693 - DNA, 35 bp, Artificial Sequence
  Synthetic oligonucleotide
tgacacattcccggagctaccaccccgtcctctgt

SEQ ID NO: 177694 - DNA, 35 bp, Artificial Sequence
  Synthetic oligonucleotide
gggtgtagtgaggggtgggagcaggggagtaactt

SEQ ID NO: 177695 - DNA, 35 bp, Artificial Sequence
  Synthetic oligonucleotide
gcccgcctcacgttccaaaattaggccattaactt

SEQ ID NO: 177696 - DNA, 35 bp, Artificial Sequence
  Synthetic oligonucleotide
gcatgttcgcgacagtatttgcctcctgctacctt

SEQ ID NO: 177697 - DNA, 35 bp, Artificial Sequence
  Synthetic oligonucleotide
tcatcgcgtcgtctatcgcccctcagttatcggtt

SEQ ID NO: 177698 - DNA, 35 bp, Artificial Sequence
  Synthetic oligonucleotide
tacaccatgccgcattatcaattagcaccactgtt

SEQ ID NO: 177699 - DNA, 35 bp, Artificial Sequence
  Synthetic oligonucleotide
gaacgccctccagtctcatcgctctagccggtttt

SEQ ID NO: 177700 - DNA, 35 bp, Artificial Sequence
  Synthetic oligonucleotide
tcgttgccccatctgccacttcagccccgaatcaa

SEQ ID NO: 177701 - DNA, 36 bp, Artificial Sequence
  Synthetic oligonucleotide
atcgtcgccacagctccgccctctatgccagcataa

SEQ ID NO: 177702 - DNA, 36 bp, Artificial Sequence
  Synthetic oligonucleotide
gagaccaccgtaccagtgcgcatactccccctataa

SEQ ID NO: 177703 - DNA, 36 bp, Artificial Sequence
  Synthetic oligonucleotide
taacaccccgcacgcttgtagaaaactcgcccctaa

SEQ ID NO: 177704 - DNA, 35 bp, Artificial Sequence
  Synthetic oligonucleotide
tagcgcccctccatgtccgatagcgccttatctaa

SEQ ID NO: 177705 - DNA, 36 bp, Artificial Sequence
  Synthetic oligonucleotide
ttctgcccgccctcgttgtacctcgaagtacgttaa

SEQ ID NO: 177706 - DNA, 36 bp, Artificial Sequence
  Synthetic oligonucleotide
gggagggaacgaacaggggggggtgtgtacggttaa

SEQ ID NO: 177707 - DNA, 36 bp, Artificial Sequence
  Synthetic oligonucleotide
gaaggggaacggtcggagggggggagacaggccaca

SEQ ID NO: 177708 - DNA, 36 bp, Artificial Sequence
  Synthetic oligonucleotide
acacacgactcgcactgtccgccacggtttcataca

SEQ ID NO: 177709 - DNA, 36 bp, Artificial Sequence
  Synthetic oligonucleotide
atcccccgccatctcattgtttcaaacctataccca

SEQ ID NO: 177710 - DNA, 36 bp, Artificial Sequence
  Synthetic oligonucleotide
gcgcctcctcaccacacgcatggtttcccgtcccca

SEQ ID NO: 177711 - DNA, 34 bp, Artificial Sequence
  Synthetic oligonucleotide
gcggtgcaacctcgcgcttgactttaccccgcca

SEQ ID NO: 177712 - DNA, 36 bp, Artificial Sequence
  Synthetic oligonucleotide
gtgcctcagcaattccagttaccccatgcctcgcca

SEQ ID NO: 177713 - DNA, 35 bp, Artificial Sequence
  Synthetic oligonucleotide
atgccactgctccgggccgttctgttcgttcgcca

SEQ ID NO: 177714 - DNA, 35 bp, Artificial Sequence
  Synthetic oligonucleotide
gtcgccccctgtttcggtcccaagtctgttcgcca

SEQ ID NO: 177715 - DNA, 36 bp, Artificial Sequence
  Synthetic oligonucleotide
agaagaccagtgccgggatgggtagggggtgggcca

SEQ ID NO: 177716 - DNA, 36 bp, Artificial Sequence
  Synthetic oligonucleotide
tcttccatccgcatgaactgtctaccctccgtgcca

SEQ ID NO: 177717 - DNA, 35 bp, Artificial Sequence
  Synthetic oligonucleotide
gcgagtcgccacacgttcaccatccaaggctatca

SEQ ID NO: 177718 - DNA, 36 bp, Artificial Sequence
  Synthetic oligonucleotide
gtgtgtaaccactccctgccgccctgttccttatca

SEQ ID NO: 177719 - DNA, 36 bp, Artificial Sequence
  Synthetic oligonucleotide
gtaccatccgttctatatagctccctctgggactca

SEQ ID NO: 177720 - DNA, 36 bp, Artificial Sequence
  Synthetic oligonucleotide
acttgatgcgctagttttagttaacccgccctctca

SEQ ID NO: 177721 - DNA, 36 bp, Artificial Sequence
  Synthetic oligonucleotide
ttcgggacgtctggctctatctccgcccttgtctca

SEQ ID NO: 177722 - DNA, 36 bp, Artificial Sequence
  Synthetic oligonucleotide
acgaagtcccgtccggccctgtatcatccctattca

SEQ ID NO: 177723 - DNA, 36 bp, Artificial Sequence
  Synthetic oligonucleotide
gtgcgtgtgtgttactcgcccctcttgtcctattca

SEQ ID NO: 177724 - DNA, 36 bp, Artificial Sequence
  Synthetic oligonucleotide
gaccgcctgcttctcggtaggtccgaccccacttca

SEQ ID NO: 177725 - DNA, 37 bp, Artificial Sequence
  Synthetic oligonucleotide
gtggtgggtacggttgagagggaggtgaacgtccaga

SEQ ID NO: 177726 - DNA, 37 bp, Artificial Sequence
  Synthetic oligonucleotide
gcacgtcgctgtccctccgccttagtttttctgcaga

SEQ ID NO: 177727 - DNA, 37 bp, Artificial Sequence
  Synthetic oligonucleotide
tctcgccccccacttttcttagaccgtctagggtaga

SEQ ID NO: 177728 - DNA, 37 bp, Artificial Sequence
  Synthetic oligonucleotide
gcccccgacaaaccggtcactctgcacaccctttaga

SEQ ID NO: 177729 - DNA, 36 bp, Artificial Sequence
  Synthetic oligonucleotide
gccatccctatgcacatcgctaccatcatccaccga

SEQ ID NO: 177730 - DNA, 37 bp, Artificial Sequence
  Synthetic oligonucleotide
acgttacgtcaattcacctgccttcccttcgtaccga

SEQ ID NO: 177731 - DNA, 37 bp, Artificial Sequence
  Synthetic oligonucleotide
gcaccgtggtcttcctgtctgctaatctccgccccga

SEQ ID NO: 177732 - DNA, 34 bp, Artificial Sequence
  Synthetic oligonucleotide
atgcccaccttctctctagtattcccgtcctcga

SEQ ID NO: 177733 - DNA, 37 bp, Artificial Sequence
  Synthetic oligonucleotide
tcagtctccgcctctcttctgcccccaggtctttcga

SEQ ID NO: 177734 - DNA, 37 bp, Artificial Sequence
  Synthetic oligonucleotide
gtgcaaggacaggggagagagaggggtgtgggtagga

SEQ ID NO: 177735 - DNA, 37 bp, Artificial Sequence
  Synthetic oligonucleotide
agtaggaagaagcaagaagaggcgacgggagggcgga

SEQ ID NO: 177736 - DNA, 37 bp, Artificial Sequence
  Synthetic oligonucleotide
gttagccgactccgcctatctgccctcccctcaggga

SEQ ID NO: 177737 - DNA, 37 bp, Artificial Sequence
  Synthetic oligonucleotide
gcccctctccgccacgagcacccagtccctctctgga

SEQ ID NO: 177738 - DNA, 37 bp, Artificial Sequence
  Synthetic oligonucleotide
gagcccactcgcctgccctaagattccccggtctgga

SEQ ID NO: 177739 - DNA, 37 bp, Artificial Sequence
  Synthetic oligonucleotide
gcccgccgccatactaccagaccatcctcccacatga

SEQ ID NO: 177740 - DNA, 38 bp, Artificial Sequence
  Synthetic oligonucleotide
tgggccctcatcacctgttgcctttttgtaccccatga

SEQ ID NO: 177741 - DNA, 38 bp, Artificial Sequence
  Synthetic oligonucleotide
atgtcgccgcagagctaatctgctttctccacccctga

SEQ ID NO: 177742 - DNA, 38 bp, Artificial Sequence
  Synthetic oligonucleotide
gctcgcatcacgtttcgctccatgtcctttcttgctga

SEQ ID NO: 177743 - DNA, 37 bp, Artificial Sequence
  Synthetic oligonucleotide
tacaccgcattcttctcccccgtgcccgctcgagtga

SEQ ID NO: 177744 - DNA, 38 bp, Artificial Sequence
  Synthetic oligonucleotide
tgcgttgccctccagctattatttagtttccgccgtga

SEQ ID NO: 177745 - DNA, 38 bp, Artificial Sequence
  Synthetic oligonucleotide
attactgcgacgaggggggagggacggtgagtgcgtga

SEQ ID NO: 177746 - DNA, 36 bp, Artificial Sequence
  Synthetic oligonucleotide
actgacatcgggcacatcagggggggagaagggtga

SEQ ID NO: 177747 - DNA, 37 bp, Artificial Sequence
  Synthetic oligonucleotide
tctgagccccgcactcattccacaccctttgcattga

SEQ ID NO: 177748 - DNA, 37 bp, Artificial Sequence
  Synthetic oligonucleotide
tgcgcctctacctgcattctcctgactcagtccttga

SEQ ID NO: 177749 - DNA, 37 bp, Artificial Sequence
  Synthetic oligonucleotide
acagccctcctgcctaaaaattcgcatccttcgttga

SEQ ID NO: 177750 - DNA, 38 bp, Artificial Sequence
  Synthetic oligonucleotide
gagaggagcggggcaatggggagggggctgcgatttga

SEQ ID NO: 177751 - DNA, 37 bp, Artificial Sequence
  Synthetic oligonucleotide
gacggggggggtggaacggggaaaggagggcttttga

SEQ ID NO: 177752 - DNA, 36 bp, Artificial Sequence
  Synthetic oligonucleotide
tgcgttcgctcgcccttccgccaccccctgggaata

SEQ ID NO: 177753 - DNA, 36 bp, Artificial Sequence
  Synthetic oligonucleotide
tcatccatgagcccttcggtttgtaccctctccata

SEQ ID NO: 177754 - DNA, 36 bp, Artificial Sequence
  Synthetic oligonucleotide
aatcaccctgacgcccctccgagaccgcacttgata

SEQ ID NO: 177755 - DNA, 36 bp, Artificial Sequence
  Synthetic oligonucleotide
gcggaaacgccttcgtctccctgtctttgctcccta

SEQ ID NO: 177756 - DNA, 35 bp, Artificial Sequence
  Synthetic oligonucleotide
tccacgatgcgtacggtctaccatagcctttccta

SEQ ID NO: 177757 - DNA, 36 bp, Artificial Sequence
  Synthetic oligonucleotide
ataggcgcgccgccgtccttacgaaccccaccgcta

SEQ ID NO: 177758 - DNA, 36 bp, Artificial Sequence
  Synthetic oligonucleotide
gcccctcagcgtttcccatgtttctacccgtccgta

SEQ ID NO: 177759 - DNA, 36 bp, Artificial Sequence
  Synthetic oligonucleotide
gcacacgcttggccgtctatcgctggcccccgctta

SEQ ID NO: 177760 - DNA, 36 bp, Artificial Sequence
  Synthetic oligonucleotide
ttccactcgcctccattatgcgccatgccactctta

SEQ ID NO: 177761 - DNA, 35 bp, Artificial Sequence
  Synthetic oligonucleotide
ttgcgttaccagcccttcattccgatctgccgtta

SEQ ID NO: 177762 - DNA, 34 bp, Artificial Sequence
  Synthetic oligonucleotide
tttgcctcctgctcccgtatgaatctgccacaac

SEQ ID NO: 177763 - DNA, 35 bp, Artificial Sequence
  Synthetic oligonucleotide
ggagcccgaagggtccctcctcgcccaatgccaac

SEQ ID NO: 177764 - DNA, 35 bp, Artificial Sequence
  Synthetic oligonucleotide
ccacacccgcttagctttgactctaacctacacac

SEQ ID NO: 177765 - DNA, 35 bp, Artificial Sequence
  Synthetic oligonucleotide
tatgcgtgcttttccatcaccactgttcttgccac

SEQ ID NO: 177766 - DNA, 35 bp, Artificial Sequence
  Synthetic oligonucleotide
tcagctcgcctctacttctaccgaccgttcacacc

SEQ ID NO: 177767 - DNA, 35 bp, Artificial Sequence
  Synthetic oligonucleotide
tggtcccgcaatctctgcataccactctcgtaccc

SEQ ID NO: 177768 - DNA, 35 bp, Artificial Sequence
  Synthetic oligonucleotide
gtggtccaacgctcactatgccagctaacaacccc

SEQ ID NO: 177769 - DNA, 35 bp, Artificial Sequence
  Synthetic oligonucleotide
ggtccggtaaactgtgtccgccgatcctacacccc

SEQ ID NO: 177770 - DNA, 35 bp, Artificial Sequence
  Synthetic oligonucleotide
aggatcaccccatgctgaaaatatcaactcgcccc

SEQ ID NO: 177771 - DNA, 35 bp, Artificial Sequence
  Synthetic oligonucleotide
actggccctttccccatgttttgccgtatccgccc

SEQ ID NO: 177772 - DNA, 35 bp, Artificial Sequence
  Synthetic oligonucleotide
accttcccagacctggactgatcctagctatgccc

SEQ ID NO: 177773 - DNA, 35 bp, Artificial Sequence
  Synthetic oligonucleotide
tgcccctttgagtgatcctcatgacggtcccctcc

SEQ ID NO: 177774 - DNA, 35 bp, Artificial Sequence
  Synthetic oligonucleotide
tcagtctgccggttttctgtcttaaatttgcctcc

SEQ ID NO: 177775 - DNA, 35 bp, Artificial Sequence
  Synthetic oligonucleotide
tgggtcttgccacaactttgtctcacttgtcttcc

SEQ ID NO: 177776 - DNA, 35 bp, Artificial Sequence
  Synthetic oligonucleotide
ttgacaccccggctccagctactggcttgctttcc

SEQ ID NO: 177777 - DNA, 35 bp, Artificial Sequence
  Synthetic oligonucleotide
gccccctctgtttatccttgcaccaccgatttagc

SEQ ID NO: 177778 - DNA, 35 bp, Artificial Sequence
  Synthetic oligonucleotide
acacaacctcgaatttttcttgcccatgctttggc

SEQ ID NO: 177779 - DNA, 35 bp, Artificial Sequence
  Synthetic oligonucleotide
tctgactctcaggtctagtttccactcccatctgc

SEQ ID NO: 177780 - DNA, 35 bp, Artificial Sequence
  Synthetic oligonucleotide
tttctcgcacagggccctaagttcaccacctctgc

SEQ ID NO: 177781 - DNA, 35 bp, Artificial Sequence
  Synthetic oligonucleotide
tgtgtcccatcctttcgcgggtattacgcacttgc

SEQ ID NO: 177782 - DNA, 35 bp, Artificial Sequence
  Synthetic oligonucleotide
acctatccccgagggcctcgaacacctttgtactc

SEQ ID NO: 177783 - DNA, 35 bp, Artificial Sequence
  Synthetic oligonucleotide
gactccactcagttcgctaccgggcacactacctc

SEQ ID NO: 177784 - DNA, 33 bp, Artificial Sequence
  Synthetic oligonucleotide
acagccgccacaagcatttctacctaccgcctc

SEQ ID NO: 177785 - DNA, 35 bp, Artificial Sequence
  Synthetic oligonucleotide
gtagtcgagggccggcgtgcttttatctcctcctc

SEQ ID NO: 177786 - DNA, 35 bp, Artificial Sequence
  Synthetic oligonucleotide
tgtgtcctcatgccaacagctgacacgttttcctc

SEQ ID NO: 177787 - DNA, 35 bp, Artificial Sequence
  Synthetic oligonucleotide
gaaagcctccgctggcacgcaggccccctttgctc

SEQ ID NO: 177788 - DNA, 35 bp, Artificial Sequence
  Synthetic oligonucleotide
gccatccgcccggaacctctaagggactactcgtc

SEQ ID NO: 177789 - DNA, 35 bp, Artificial Sequence
  Synthetic oligonucleotide
acgcacgctcaggcattagccctgcacactctgtc

SEQ ID NO: 177790 - DNA, 35 bp, Artificial Sequence
  Synthetic oligonucleotide
taacgccccgccgtctgcctctggggcctgaattc

SEQ ID NO: 177791 - DNA, 35 bp, Artificial Sequence
  Synthetic oligonucleotide
aaactccctcggcggtacatcccctgccccagttc

SEQ ID NO: 177792 - DNA, 35 bp, Artificial Sequence
  Synthetic oligonucleotide
gagtgaggggtaggtggagtgccggaggtaaaacg

SEQ ID NO: 177793 - DNA, 35 bp, Artificial Sequence
  Synthetic oligonucleotide
tacccgccggactccaccccccctaagcatgtgcg

SEQ ID NO: 177794 - DNA, 35 bp, Artificial Sequence
  Synthetic oligonucleotide
gcaggatgtctgagggggggaggaatagtgaaagg

SEQ ID NO: 177795 - DNA, 35 bp, Artificial Sequence
  Synthetic oligonucleotide
gacgaggaaaggaagatcaggtagcgcaaagacgg

SEQ ID NO: 177796 - DNA, 35 bp, Artificial Sequence
  Synthetic oligonucleotide
tcagaggtggtggggcaacagtggaggggggaggg

SEQ ID NO: 177797 - DNA, 35 bp, Artificial Sequence
  Synthetic oligonucleotide
tgacggtgtggtggtgacgaggaggggacgtatgg

SEQ ID NO: 177798 - DNA, 35 bp, Artificial Sequence
  Synthetic oligonucleotide
ggagctacacctctccgcatgcgcctcctgcactg

SEQ ID NO: 177799 - DNA, 35 bp, Artificial Sequence
  Synthetic oligonucleotide
tgttcccacgtcggccccttaggttctctgtcttg

SEQ ID NO: 177800 - DNA, 35 bp, Artificial Sequence
  Synthetic oligonucleotide
tctccccctcgcccgttcaaccatgtcgctgtttg

SEQ ID NO: 177801 - DNA, 35 bp, Artificial Sequence
  Synthetic oligonucleotide
gccccaccgcgcgttgctctggaatcggtctccat

SEQ ID NO: 177802 - DNA, 35 bp, Artificial Sequence
  Synthetic oligonucleotide
atcgcgccgcagctttatcgttcggtttctcgcat

SEQ ID NO: 177803 - DNA, 35 bp, Artificial Sequence
  Synthetic oligonucleotide
ttcaggtgtgcagtccggtccatcatcatcttcat

SEQ ID NO: 177804 - DNA, 35 bp, Artificial Sequence
  Synthetic oligonucleotide
gtcgtttcacccgttcctctagttagctcctcgat

SEQ ID NO: 177805 - DNA, 34 bp, Artificial Sequence
  Synthetic oligonucleotide
acacctcaagcaccacgggccctattcgcacact

SEQ ID NO: 177806 - DNA, 35 bp, Artificial Sequence
  Synthetic oligonucleotide
tactgcaccgattgttacttgtcttgcccctcact

SEQ ID NO: 177807 - DNA, 35 bp, Artificial Sequence
  Synthetic oligonucleotide
acacccgtcaccctgctccaggcagttcttgtact

SEQ ID NO: 177808 - DNA, 35 bp, Artificial Sequence
  Synthetic oligonucleotide
actcccacgtcatccgaacgccctgccactgacct

SEQ ID NO: 177809 - DNA, 35 bp, Artificial Sequence
  Synthetic oligonucleotide
gtcgcccgctcaagaccatgctactccctgaccct

SEQ ID NO: 177810 - DNA, 35 bp, Artificial Sequence
  Synthetic oligonucleotide
gcgcctcccggtgctctacttatttggctcgccct

SEQ ID NO: 177811 - DNA, 35 bp, Artificial Sequence
  Synthetic oligonucleotide
gtccgctcactcgtgatggatcgccgtaactccct

SEQ ID NO: 177812 - DNA, 35 bp, Artificial Sequence
  Synthetic oligonucleotide
aacgccggccccgaaacatcattctgtcaatgcct

SEQ ID NO: 177813 - DNA, 35 bp, Artificial Sequence
  Synthetic oligonucleotide
accacctgtctgcgtaccaggacctcttattgcct

SEQ ID NO: 177814 - DNA, 35 bp, Artificial Sequence
  Synthetic oligonucleotide
aacttcaccgtgactgcctccctgagtgttctcct

SEQ ID NO: 177815 - DNA, 35 bp, Artificial Sequence
  Synthetic oligonucleotide
gatacagcccccttgttcccatccaccaatgtcct

SEQ ID NO: 177816 - DNA, 35 bp, Artificial Sequence
  Synthetic oligonucleotide
tcacgtgcctacctccctggtgttcaagccttcct

SEQ ID NO: 177817 - DNA, 35 bp, Artificial Sequence
  Synthetic oligonucleotide
gtccctgctacctttcaatgctatcgccgtttgct

SEQ ID NO: 177818 - DNA, 35 bp, Artificial Sequence
  Synthetic oligonucleotide
gtacactgtctctcttgtaatttggttccgcctct

SEQ ID NO: 177819 - DNA, 35 bp, Artificial Sequence
  Synthetic oligonucleotide
gtgccgcctcccccggtatccagcctgccctacgt

SEQ ID NO: 177820 - DNA, 35 bp, Artificial Sequence
  Synthetic oligonucleotide
tccacccatcaccggcttctctcgcaagagtacgt

SEQ ID NO: 177821 - DNA, 35 bp, Artificial Sequence
  Synthetic oligonucleotide
tgggatccgcgtgctcaaagccttccaccctccgt

SEQ ID NO: 177822 - DNA, 35 bp, Artificial Sequence
  Synthetic oligonucleotide
agccccatcctctggtgttctttgtagtcccttgt

SEQ ID NO: 177823 - DNA, 35 bp, Artificial Sequence
  Synthetic oligonucleotide
tgagacgactaccgctgcccttgtttatctccatt

SEQ ID NO: 177824 - DNA, 35 bp, Artificial Sequence
  Synthetic oligonucleotide
acgctcacaagcgttttggcccctactcccgcatt

SEQ ID NO: 177825 - DNA, 35 bp, Artificial Sequence
  Synthetic oligonucleotide
tgggagaggggaacaatgggtgggtggggccactt

SEQ ID NO: 177826 - DNA, 35 bp, Artificial Sequence
  Synthetic oligonucleotide
gagcacccctcgggaacgacctccgtccttcactt

SEQ ID NO: 177827 - DNA, 35 bp, Artificial Sequence
  Synthetic oligonucleotide
gcccctcgccggcctatgaccttgacaccccgctt

SEQ ID NO: 177828 - DNA, 35 bp, Artificial Sequence
  Synthetic oligonucleotide
ttgccacatcccgcggttataacgcccaactagtt

SEQ ID NO: 177829 - DNA, 35 bp, Artificial Sequence
  Synthetic oligonucleotide
gcccctatccgtaccgtcctacaagtgctccattt

SEQ ID NO: 177830 - DNA, 35 bp, Artificial Sequence
  Synthetic oligonucleotide
gtcaccaagtgcctcccagcctttgttctaccttt

SEQ ID NO: 177831 - DNA, 35 bp, Artificial Sequence
  Synthetic oligonucleotide
gattgggagggcaaggagcggggattcgagtgaaa

SEQ ID NO: 177832 - DNA, 35 bp, Artificial Sequence
  Synthetic oligonucleotide
tgcgcccccagtatctcctccagtcagcccgtcaa

SEQ ID NO: 177833 - DNA, 36 bp, Artificial Sequence
  Synthetic oligonucleotide
gtacgcccccatcctcgactcatgccaactggataa

SEQ ID NO: 177834 - DNA, 35 bp, Artificial Sequence
  Synthetic oligonucleotide
tagccacgttgcatcattgccctcaccccccctaa

SEQ ID NO: 177835 - DNA, 36 bp, Artificial Sequence
  Synthetic oligonucleotide
agagaggggaggtaatgaggcttagggggtgagtaa

SEQ ID NO: 177836 - DNA, 36 bp, Artificial Sequence
  Synthetic oligonucleotide
tgtctgcaccgcccgtcgcccccatgctgcaattaa

SEQ ID NO: 177837 - DNA, 36 bp, Artificial Sequence
  Synthetic oligonucleotide
tttgcacccactataggttagttttcgcctctcaca

SEQ ID NO: 177838 - DNA, 35 bp, Artificial Sequence
  Synthetic oligonucleotide
gtgggtcaccgtctcatcccattatcgtctcccca

SEQ ID NO: 177839 - DNA, 36 bp, Artificial Sequence
  Synthetic oligonucleotide
atagccacaggctaagcatgctccttccgttcccca

SEQ ID NO: 177840 - DNA, 36 bp, Artificial Sequence
  Synthetic oligonucleotide
tccgccatccggtctggacggtccaaccctatccca

SEQ ID NO: 177841 - DNA, 35 bp, Artificial Sequence
  Synthetic oligonucleotide
atgtcacatcgtttacgcactctggccttatccca

SEQ ID NO: 177842 - DNA, 36 bp, Artificial Sequence
  Synthetic oligonucleotide
accaccactcacctgggagcgtgtcgctttttccca

SEQ ID NO: 177843 - DNA, 36 bp, Artificial Sequence
  Synthetic oligonucleotide
gctgacacggcccttctgtttcccggagcattgcca

SEQ ID NO: 177844 - DNA, 35 bp, Artificial Sequence
  Synthetic oligonucleotide
tacccacaccggtcgcccatgttctttctgcctca

SEQ ID NO: 177845 - DNA, 36 bp, Artificial Sequence
  Synthetic oligonucleotide
gtgcaacagcatctgttgcgttccctgcctttctca

SEQ ID NO: 177846 - DNA, 37 bp, Artificial Sequence
  Synthetic oligonucleotide
ggactaagggccaaggggggggaggaaagcattcaga

SEQ ID NO: 177847 - DNA, 37 bp, Artificial Sequence
  Synthetic oligonucleotide
tgggcgtggagggtagagggaagggtagggtgggaga

SEQ ID NO: 177848 - DNA, 37 bp, Artificial Sequence
  Synthetic oligonucleotide
gaggggtggaaggtgggaggggactacctgttggaga

SEQ ID NO: 177849 - DNA, 36 bp, Artificial Sequence
  Synthetic oligonucleotide
actcgccctatccgctttcatgttacgatccataga

SEQ ID NO: 177850 - DNA, 37 bp, Artificial Sequence
  Synthetic oligonucleotide
attagccgcccttgagtctcccacctgtccgtctaga

SEQ ID NO: 177851 - DNA, 37 bp, Artificial Sequence
  Synthetic oligonucleotide
tgtcaccccgctcgttcgtccatcttctgctacacga

SEQ ID NO: 177852 - DNA, 37 bp, Artificial Sequence
  Synthetic oligonucleotide
tccgcctcagagtcatagctctcacgcccctttacga

SEQ ID NO: 177853 - DNA, 37 bp, Artificial Sequence
  Synthetic oligonucleotide
tcctcagtcccccgcccggcccacctgttaacaccga

SEQ ID NO: 177854 - DNA, 35 bp, Artificial Sequence
  Synthetic oligonucleotide
aagcacccgctacaaatcccaccctgcttcgccga

SEQ ID NO: 177855 - DNA, 37 bp, Artificial Sequence
  Synthetic oligonucleotide
aacaaaggacagggaagggcgacaggagtacggagga

SEQ ID NO: 177856 - DNA, 37 bp, Artificial Sequence
  Synthetic oligonucleotide
tgacagtcaggttgttatggtagcggggggaatagga

SEQ ID NO: 177857 - DNA, 37 bp, Artificial Sequence
  Synthetic oligonucleotide
agggatgccgcagacagggtggggtaatcataaggga

SEQ ID NO: 177858 - DNA, 37 bp, Artificial Sequence
  Synthetic oligonucleotide
ttgaggggctgtcagatgttagggcgagtgggaggga

SEQ ID NO: 177859 - DNA, 37 bp, Artificial Sequence
  Synthetic oligonucleotide
tgagtgaggcggggaggagggaaggtgataagcggga

SEQ ID NO: 177860 - DNA, 37 bp, Artificial Sequence
  Synthetic oligonucleotide
gggagggaggggtgttgtggtcgtggggaaactggga

SEQ ID NO: 177861 - DNA, 38 bp, Artificial Sequence
  Synthetic oligonucleotide
tcagctacacgggggggagggtcttcgggctgaaatga

SEQ ID NO: 177862 - DNA, 38 bp, Artificial Sequence
  Synthetic oligonucleotide
tcacactcctcgtccccgcgaacctgccagtcgaatga

SEQ ID NO: 177863 - DNA, 38 bp, Artificial Sequence
  Synthetic oligonucleotide
gtcgggaagggaaagaagggtaaggtcagatgcgatga

SEQ ID NO: 177864 - DNA, 37 bp, Artificial Sequence
  Synthetic oligonucleotide
ggggcggcacgatacgggaggggctgaggatggatga

SEQ ID NO: 177865 - DNA, 36 bp, Artificial Sequence
  Synthetic oligonucleotide
atcctcacctcgatcgccgttccatatacactatga

SEQ ID NO: 177866 - DNA, 38 bp, Artificial Sequence
  Synthetic oligonucleotide
tgagggcggagtgaggggggtggatttggacggtatga

SEQ ID NO: 177867 - DNA, 38 bp, Artificial Sequence
  Synthetic oligonucleotide
tttggtctggatggatggagggggtggtggtggtatga

SEQ ID NO: 177868 - DNA, 35 bp, Artificial Sequence
  Synthetic oligonucleotide
accctcaccaccttgttacgccgagcctacactga

SEQ ID NO: 177869 - DNA, 38 bp, Artificial Sequence
  Synthetic oligonucleotide
aaatccgtaggggaggagaagggagggtgggtacctga

SEQ ID NO: 177870 - DNA, 38 bp, Artificial Sequence
  Synthetic oligonucleotide
gtaggcagtcgcacattcccttggctgccatcccctga

SEQ ID NO: 177871 - DNA, 38 bp, Artificial Sequence
  Synthetic oligonucleotide
tgcaggttgggtgggggggacagggacgtgtgcagtga

SEQ ID NO: 177872 - DNA, 38 bp, Artificial Sequence
  Synthetic oligonucleotide
gagggcgatggggagggaagggttgctgacggacgtga

SEQ ID NO: 177873 - DNA, 38 bp, Artificial Sequence
  Synthetic oligonucleotide
accccactatctgtgtgcctcttcctatctccccgtga

SEQ ID NO: 177874 - DNA, 38 bp, Artificial Sequence
  Synthetic oligonucleotide
gggtgggggaggtgcgagtaagggcaagattcgcgtga

SEQ ID NO: 177875 - DNA, 38 bp, Artificial Sequence
  Synthetic oligonucleotide
gtagagacgaggggagtggcgattggggtgcgaggtga

SEQ ID NO: 177876 - DNA, 38 bp, Artificial Sequence
  Synthetic oligonucleotide
tagtcgtcgcgcctggccatcctcccctccctctgtga

SEQ ID NO: 177877 - DNA, 37 bp, Artificial Sequence
  Synthetic oligonucleotide
gagcgccctgactaacttgtgcacctcccctttgtga

SEQ ID NO: 177878 - DNA, 37 bp, Artificial Sequence
  Synthetic oligonucleotide
tcaccctgctctctgcctgttttgacgctatacttga

SEQ ID NO: 177879 - DNA, 38 bp, Artificial Sequence
  Synthetic oligonucleotide
gtagcctgcctttatcgtgcgttgcccctgttacttga

SEQ ID NO: 177880 - DNA, 37 bp, Artificial Sequence
  Synthetic oligonucleotide
gtctcggctggtattatctctcctccgccacgcttga

SEQ ID NO: 177881 - DNA, 37 bp, Artificial Sequence
  Synthetic oligonucleotide
gcccatcgtcatgtccccgtgtccccgccccgcttga

SEQ ID NO: 177882 - DNA, 38 bp, Artificial Sequence
  Synthetic oligonucleotide
gggtggcttgggtggcggagggcgggcgggttgcttga

SEQ ID NO: 177883 - DNA, 38 bp, Artificial Sequence
  Synthetic oligonucleotide
tccagggggtggagcaaacgggaaggaaaatgggttga

SEQ ID NO: 177884 - DNA, 38 bp, Artificial Sequence
  Synthetic oligonucleotide
tttcgctccccccatggtcaacatcgccccctggttga

SEQ ID NO: 177885 - DNA, 36 bp, Artificial Sequence
  Synthetic oligonucleotide
aacgaggtggggcaaattggaagggaagctcgtgta

SEQ ID NO: 177886 - DNA, 35 bp, Artificial Sequence
  Synthetic oligonucleotide
atcactgactgaacctcgctttgggctcgcaccac

SEQ ID NO: 177887 - DNA, 35 bp, Artificial Sequence
  Synthetic oligonucleotide
gttgccaccgccccttctgttgttttaccggcgac

SEQ ID NO: 177888 - DNA, 35 bp, Artificial Sequence
  Synthetic oligonucleotide
agaatgctccactgcgcagtttcctcctgttctac

SEQ ID NO: 177889 - DNA, 35 bp, Artificial Sequence
  Synthetic oligonucleotide
ttccgacgatccgcggtgttgtctctccttcttac

SEQ ID NO: 177890 - DNA, 35 bp, Artificial Sequence
  Synthetic oligonucleotide
acactccgaaacccctgccccctgtgacaataacc

SEQ ID NO: 177891 - DNA, 35 bp, Artificial Sequence
  Synthetic oligonucleotide
accacatcctacggccaacgtgccatccttccacc

SEQ ID NO: 177892 - DNA, 35 bp, Artificial Sequence
  Synthetic oligonucleotide
gctccgaacaatgcccaagcccggtatcttccacc

SEQ ID NO: 177893 - DNA, 35 bp, Artificial Sequence
  Synthetic oligonucleotide
ttatcccccagacgctttgggcgcttcatgtaccc

SEQ ID NO: 177894 - DNA, 35 bp, Artificial Sequence
  Synthetic oligonucleotide
gtacagccgttcgccaagtacccggttcatcgccc

SEQ ID NO: 177895 - DNA, 34 bp, Artificial Sequence
  Synthetic oligonucleotide
actcaccaatcgcgccctgctagctgcattgccc

SEQ ID NO: 177896 - DNA, 35 bp, Artificial Sequence
  Synthetic oligonucleotide
tgccaccatgttttgtgcctccgtatcctcctgcc

SEQ ID NO: 177897 - DNA, 35 bp, Artificial Sequence
  Synthetic oligonucleotide
accaccgaccaattggtcctatgaccggtcctgcc

SEQ ID NO: 177898 - DNA, 35 bp, Artificial Sequence
  Synthetic oligonucleotide
aactccagctccatgcgtctcccagcccctctgcc

SEQ ID NO: 177899 - DNA, 35 bp, Artificial Sequence
  Synthetic oligonucleotide
acgcgcgatgcttaagctcgccccatatcacctcc

SEQ ID NO: 177900 - DNA, 35 bp, Artificial Sequence
  Synthetic oligonucleotide
tcccgacgtcaccagtccctccataggttctctcc

SEQ ID NO: 177901 - DNA, 35 bp, Artificial Sequence
  Synthetic oligonucleotide
ttgccctgccactgttatatccgtttctttgttcc

SEQ ID NO: 177902 - DNA, 35 bp, Artificial Sequence
  Synthetic oligonucleotide
aagcctccgacttttgctctttggtcctggtttcc

SEQ ID NO: 177903 - DNA, 35 bp, Artificial Sequence
  Synthetic oligonucleotide
gtacaaagtgcacttcacgccgccccttcacccgc

SEQ ID NO: 177904 - DNA, 35 bp, Artificial Sequence
  Synthetic oligonucleotide
tcacctccgcttttccccattcgtgccctgcctgc

SEQ ID NO: 177905 - DNA, 35 bp, Artificial Sequence
  Synthetic oligonucleotide
taccaccgctgggtgctaatgtccactcctgctgc

SEQ ID NO: 177906 - DNA, 35 bp, Artificial Sequence
  Synthetic oligonucleotide
atccacattggggccccctgacgttatgtcctatc

SEQ ID NO: 177907 - DNA, 35 bp, Artificial Sequence
  Synthetic oligonucleotide
gcatgttccgggaacttgtttttgacctccttctc

SEQ ID NO: 177908 - DNA, 35 bp, Artificial Sequence
  Synthetic oligonucleotide
tccgcctcctcgtttcttgcaccgcccccctcgtc

SEQ ID NO: 177909 - DNA, 35 bp, Artificial Sequence
  Synthetic oligonucleotide
ttggcctcccgccttcagcaccatcacattgggtc

SEQ ID NO: 177910 - DNA, 35 bp, Artificial Sequence
  Synthetic oligonucleotide
atctactcgttggtgctcgctcttggccctctgtc

SEQ ID NO: 177911 - DNA, 35 bp, Artificial Sequence
  Synthetic oligonucleotide
gccacacaccggccctccttcgttgagacgcattc

SEQ ID NO: 177912 - DNA, 34 bp, Artificial Sequence
  Synthetic oligonucleotide
tgtcaacctgctgcttttgtttctgtttagcttc

SEQ ID NO: 177913 - DNA, 35 bp, Artificial Sequence
  Synthetic oligonucleotide
gccccagctaggacatacctattcgtcgcccgttc

SEQ ID NO: 177914 - DNA, 35 bp, Artificial Sequence
  Synthetic oligonucleotide
taggccccgcactttcgttatgctccgacccaacg

SEQ ID NO: 177915 - DNA, 35 bp, Artificial Sequence
  Synthetic oligonucleotide
gacgcccctcatttctgtcctgaccgccctgtacg

SEQ ID NO: 177916 - DNA, 35 bp, Artificial Sequence
  Synthetic oligonucleotide
tatggcctcgctgcccgacaagcatccccccgccg

SEQ ID NO: 177917 - DNA, 35 bp, Artificial Sequence
  Synthetic oligonucleotide
gacctcgctcgcttgtctccccctctttgttgccg

SEQ ID NO: 177918 - DNA, 35 bp, Artificial Sequence
  Synthetic oligonucleotide
ttccgggcgagagccggcgtcctacgtaccatccg

SEQ ID NO: 177919 - DNA, 35 bp, Artificial Sequence
  Synthetic oligonucleotide
tgcaagggaagcagggggggatggtaggctcagcg

SEQ ID NO: 177920 - DNA, 35 bp, Artificial Sequence
  Synthetic oligonucleotide
gatctagcctgccctgccactttcctaccgatgcg

SEQ ID NO: 177921 - DNA, 35 bp, Artificial Sequence
  Synthetic oligonucleotide
tatatgcgaccctgctgaattaatccccccttgcg

SEQ ID NO: 177922 - DNA, 35 bp, Artificial Sequence
  Synthetic oligonucleotide
accagccccggcctcaactgttatgtcctttttcg

SEQ ID NO: 177923 - DNA, 35 bp, Artificial Sequence
  Synthetic oligonucleotide
agagggtgggactagggtaaagtaagtgggggagg

SEQ ID NO: 177924 - DNA, 35 bp, Artificial Sequence
  Synthetic oligonucleotide
tttccgccaccgcacgcatcttagcccccagaggg

SEQ ID NO: 177925 - DNA, 35 bp, Artificial Sequence
  Synthetic oligonucleotide
gaggggggtggatgctgggcaaagcagaatgtggg

SEQ ID NO: 177926 - DNA, 35 bp, Artificial Sequence
  Synthetic oligonucleotide
atagcgcctctccgtccgtgcccccaaatctgtgg

SEQ ID NO: 177927 - DNA, 35 bp, Artificial Sequence
  Synthetic oligonucleotide
gcatcgattctgccggccccgttcctctgcccatg

SEQ ID NO: 177928 - DNA, 35 bp, Artificial Sequence
  Synthetic oligonucleotide
tcacccgggtccctattttcattctaccatctgtg

SEQ ID NO: 177929 - DNA, 35 bp, Artificial Sequence
  Synthetic oligonucleotide
acacaccacctaacgtgttcgccgttccgctcttg

SEQ ID NO: 177930 - DNA, 35 bp, Artificial Sequence
  Synthetic oligonucleotide
atgccacgccgcgcgcccgcaccccgcttagaaat

SEQ ID NO: 177931 - DNA, 35 bp, Artificial Sequence
  Synthetic oligonucleotide
gtccgtactttgctatttattctggaccgctccct

SEQ ID NO: 177932 - DNA, 35 bp, Artificial Sequence
  Synthetic oligonucleotide
acttgccaccctgagcagactcatcatactctcct

SEQ ID NO: 177933 - DNA, 35 bp, Artificial Sequence
  Synthetic oligonucleotide
tgactcctccgtgcgcgcccagaccgacccttcct

SEQ ID NO: 177934 - DNA, 35 bp, Artificial Sequence
  Synthetic oligonucleotide
tcatgccacctgtagctagccgtcgacccccggct

SEQ ID NO: 177935 - DNA, 35 bp, Artificial Sequence
  Synthetic oligonucleotide
ttactcacgctcgaggctatcgacttcaccgctct

SEQ ID NO: 177936 - DNA, 35 bp, Artificial Sequence
  Synthetic oligonucleotide
acctctggccagctaccacgcgcacattgttctct

SEQ ID NO: 177937 - DNA, 35 bp, Artificial Sequence
  Synthetic oligonucleotide
tctccgcctcccattgtaagttcagtttcccttct

SEQ ID NO: 177938 - DNA, 34 bp, Artificial Sequence
  Synthetic oligonucleotide
gaggaaacaatgggaggtggtgggatagcacagt

SEQ ID NO: 177939 - DNA, 35 bp, Artificial Sequence
  Synthetic oligonucleotide
gacagggacggcccccacactctctcttactcagt

SEQ ID NO: 177940 - DNA, 35 bp, Artificial Sequence
  Synthetic oligonucleotide
gtcccaccacgaccacctcatcagactcaaggagt

SEQ ID NO: 177941 - DNA, 35 bp, Artificial Sequence
  Synthetic oligonucleotide
gcacctccgagtgctaccgtgatttcctcctgggt

SEQ ID NO: 177942 - DNA, 35 bp, Artificial Sequence
  Synthetic oligonucleotide
gcacgcttccactaggacctcatccaccgctctgt

SEQ ID NO: 177943 - DNA, 35 bp, Artificial Sequence
  Synthetic oligonucleotide
gagttagcaaccgtcacaagtccgccccttccatt

SEQ ID NO: 177944 - DNA, 35 bp, Artificial Sequence
  Synthetic oligonucleotide
gcacgagctcgcgtgcccgcctgaatccatcgctt

SEQ ID NO: 177945 - DNA, 35 bp, Artificial Sequence
  Synthetic oligonucleotide
gtccagggggggcgaatgaggcggtaggcaaagtt

SEQ ID NO: 177946 - DNA, 35 bp, Artificial Sequence
  Synthetic oligonucleotide
gaatgtacacactcctgcctggtgcccacttgttt

SEQ ID NO: 177947 - DNA, 36 bp, Artificial Sequence
  Synthetic oligonucleotide
ttttcgatccgcctgaactgcacctgaccgccccaa

SEQ ID NO: 177948 - DNA, 36 bp, Artificial Sequence
  Synthetic oligonucleotide
tgtgcgcgcccacatgctgccctaactccctcgcaa

SEQ ID NO: 177949 - DNA, 36 bp, Artificial Sequence
  Synthetic oligonucleotide
agtgagaaaggagggaagaaaagtggtggagtagaa

SEQ ID NO: 177950 - DNA, 36 bp, Artificial Sequence
  Synthetic oligonucleotide
gcccctgcccctatgaagcctacgtccgcttcggaa

SEQ ID NO: 177951 - DNA, 35 bp, Artificial Sequence
  Synthetic oligonucleotide
tagccaccccccgttattatcttgagcgttcttaa

SEQ ID NO: 177952 - DNA, 35 bp, Artificial Sequence
  Synthetic oligonucleotide
atgggggagggggagggagggacgggctagagaca

SEQ ID NO: 177953 - DNA, 35 bp, Artificial Sequence
  Synthetic oligonucleotide
gtgccccccgcccacgccatcacttcccgttgaca

SEQ ID NO: 177954 - DNA, 37 bp, Artificial Sequence
  Synthetic oligonucleotide
tctacagcccgtatgatccgttcggcctacctcccca

SEQ ID NO: 177955 - DNA, 35 bp, Artificial Sequence
  Synthetic oligonucleotide
gccgctcagctgcgcattccatttccaccggccca

SEQ ID NO: 177956 - DNA, 36 bp, Artificial Sequence
  Synthetic oligonucleotide
tcacgcccttataatgtttgctatgtacctttccca

SEQ ID NO: 177957 - DNA, 36 bp, Artificial Sequence
  Synthetic oligonucleotide
tgccccgcctcccggtcttcgtaacatttttgtcca

SEQ ID NO: 177958 - DNA, 36 bp, Artificial Sequence
  Synthetic oligonucleotide
gcccgccccccagtagttaggtttcttggcccagca

SEQ ID NO: 177959 - DNA, 35 bp, Artificial Sequence
  Synthetic oligonucleotide
gtcgtcaccctggccacccttgactcgttccagca

SEQ ID NO: 177960 - DNA, 36 bp, Artificial Sequence
  Synthetic oligonucleotide
tagggcactcgcacgtactgatcacacctccgcgca

SEQ ID NO: 177961 - DNA, 35 bp, Artificial Sequence
  Synthetic oligonucleotide
ttggaaaggggagaaaggggggggggagatgggca

SEQ ID NO: 177962 - DNA, 29 bp, Artificial Sequence
  Synthetic oligonucleotide
ttgcgccctcaccctgtagcccttactca

SEQ ID NO: 177963 - DNA, 36 bp, Artificial Sequence
  Synthetic oligonucleotide
attcgccttaacactgtggttagcacacctccctca

SEQ ID NO: 177964 - DNA, 36 bp, Artificial Sequence
  Synthetic oligonucleotide
ttatccgccccgcctcaaatttttgtatcctattca

SEQ ID NO: 177965 - DNA, 37 bp, Artificial Sequence
  Synthetic oligonucleotide
taagaggcacgggtagggtaggggcggaaaggacaga

SEQ ID NO: 177966 - DNA, 37 bp, Artificial Sequence
  Synthetic oligonucleotide
acgaaggagaccgaggcaggaggggatagaacggaga

SEQ ID NO: 177967 - DNA, 37 bp, Artificial Sequence
  Synthetic oligonucleotide
acaccataagaggcggagaataaggggcggtgggaga

SEQ ID NO: 177968 - DNA, 36 bp, Artificial Sequence
  Synthetic oligonucleotide
tcgagctccccaccgcccgccttctacgctctgaga

SEQ ID NO: 177969 - DNA, 37 bp, Artificial Sequence
  Synthetic oligonucleotide
actatgtcctgcccgagcctccatcactgtctttaga

SEQ ID NO: 177970 - DNA, 37 bp, Artificial Sequence
  Synthetic oligonucleotide
tccatcgcccccctatccgaactgtatgcactcacga

SEQ ID NO: 177971 - DNA, 37 bp, Artificial Sequence
  Synthetic oligonucleotide
atacgcccaaactttatccatgacactgctgccccga

SEQ ID NO: 177972 - DNA, 37 bp, Artificial Sequence
  Synthetic oligonucleotide
tgctacccgcatcgctacctgcccacccctgtcccga

SEQ ID NO: 177973 - DNA, 37 bp, Artificial Sequence
  Synthetic oligonucleotide
tgttgcccctgcccccagtacccgatgctcatatcga

SEQ ID NO: 177974 - DNA, 37 bp, Artificial Sequence
  Synthetic oligonucleotide
acccacagcaacgggattgggagaggcgggatatcga

SEQ ID NO: 177975 - DNA, 37 bp, Artificial Sequence
  Synthetic oligonucleotide
gtgggaggtgcagtgggggtagaaggtgggatctcga

SEQ ID NO: 177976 - DNA, 36 bp, Artificial Sequence
  Synthetic oligonucleotide
cactacgccctctccgtcctccgtctgccagttcga

SEQ ID NO: 177977 - DNA, 36 bp, Artificial Sequence
  Synthetic oligonucleotide
tctgctccggtcggttcctctttccctgcatttcga

SEQ ID NO: 177978 - DNA, 37 bp, Artificial Sequence
  Synthetic oligonucleotide
atcgacgctgtttcgcattatgttcccttcccacgga

SEQ ID NO: 177979 - DNA, 35 bp, Artificial Sequence
  Synthetic oligonucleotide
gttattcaccgcccccccaatattttcagtacgga

SEQ ID NO: 177980 - DNA, 37 bp, Artificial Sequence
  Synthetic oligonucleotide
tcactggtgagaggggcgggcggagggctcgtaggga

SEQ ID NO: 177981 - DNA, 36 bp, Artificial Sequence
  Synthetic oligonucleotide
atcagggaggggatattaagaatgaggggtagggga

SEQ ID NO: 177982 - DNA, 37 bp, Artificial Sequence
  Synthetic oligonucleotide
ggtggaaggggagttggtggaagcagaatctcgggga

SEQ ID NO: 177983 - DNA, 37 bp, Artificial Sequence
  Synthetic oligonucleotide
tgtacgcccggcacgcatatctaccttccgccctgga

SEQ ID NO: 177984 - DNA, 37 bp, Artificial Sequence
  Synthetic oligonucleotide
ttattggcgggggggcatgctgtatggggatggtgga

SEQ ID NO: 177985 - DNA, 36 bp, Artificial Sequence
  Synthetic oligonucleotide
tgcccggaccgttctttccctttctcgccttttgga

SEQ ID NO: 177986 - DNA, 35 bp, Artificial Sequence
  Synthetic oligonucleotide
tccgtgtccctcagtgctgccctctcctaggatga

SEQ ID NO: 177987 - DNA, 38 bp, Artificial Sequence
  Synthetic oligonucleotide
tcagagggaggggaagggcgagggctcaaaattgatga

SEQ ID NO: 177988 - DNA, 38 bp, Artificial Sequence
  Synthetic oligonucleotide
agtaacacgctcctggaatccgccgccactcacactga

SEQ ID NO: 177989 - DNA, 37 bp, Artificial Sequence
  Synthetic oligonucleotide
ttcgccgtgcccccgttcctcgacgtttagacactga

SEQ ID NO: 177990 - DNA, 38 bp, Artificial Sequence
  Synthetic oligonucleotide
gtccgccccggcctgtcatcagctgactccccgcctga

SEQ ID NO: 177991 - DNA, 38 bp, Artificial Sequence
  Synthetic oligonucleotide
gacaggcgttggggagggcggggagggtaaaatgctga

SEQ ID NO: 177992 - DNA, 38 bp, Artificial Sequence
  Synthetic oligonucleotide
aggggagggagggcgggatctgcaactgtgtattctga

SEQ ID NO: 177993 - DNA, 38 bp, Artificial Sequence
  Synthetic oligonucleotide
tgccgggctgggtcgggtgggcttgtgatcttcagtga

SEQ ID NO: 177994 - DNA, 38 bp, Artificial Sequence
  Synthetic oligonucleotide
gatggggggagggggtacggggaatctgtctcaggtga

SEQ ID NO: 177995 - DNA, 36 bp, Artificial Sequence
  Synthetic oligonucleotide
agtgcgtgggggcatcaggggacgggagaggggtga

SEQ ID NO: 177996 - DNA, 38 bp, Artificial Sequence
  Synthetic oligonucleotide
tgaccaccctagtttgtcctatcacattttctgcttga

SEQ ID NO: 177997 - DNA, 37 bp, Artificial Sequence
  Synthetic oligonucleotide
gcaacagtgccctctacttccaccccagcctcgttga

SEQ ID NO: 177998 - DNA, 37 bp, Artificial Sequence
  Synthetic oligonucleotide
gtcgtaatcgggcgggaggagcaagggaaatggttga

SEQ ID NO: 177999 - DNA, 38 bp, Artificial Sequence
  Synthetic oligonucleotide
tgtctccatcggaacttgttctcatcacctcgctttga

SEQ ID NO: 178000 - DNA, 38 bp, Artificial Sequence
  Synthetic oligonucleotide
tctccacccttcgattaggctttagctgccctctttga

SEQ ID NO: 178001 - DNA, 35 bp, Artificial Sequence
  Synthetic oligonucleotide
aagagaggggggcattgtaaaataaaggggtgata

SEQ ID NO: 178002 - DNA, 36 bp, Artificial Sequence
  Synthetic oligonucleotide
tgagcggttctgctcggtcgcttcctccttgcccta

SEQ ID NO: 178003 - DNA, 35 bp, Artificial Sequence
  Synthetic oligonucleotide
atccacccccgtcctaatatttcctgtccgtccta

SEQ ID NO: 178004 - DNA, 36 bp, Artificial Sequence
  Synthetic oligonucleotide
gtcccatcccatgctgatcaacgattttaacttcta

SEQ ID NO: 178005 - DNA, 36 bp, Artificial Sequence
  Synthetic oligonucleotide
gcaaccgactccggtcacctcgatcatacccacgta

SEQ ID NO: 178006 - DNA, 36 bp, Artificial Sequence
  Synthetic oligonucleotide
gttgcccctatctgtctcgcatctgtctatggctta

SEQ ID NO: 178007 - DNA, 36 bp, Artificial Sequence
  Synthetic oligonucleotide
gttctcaccatctgcgcttttggccctagtttctta

SEQ ID NO: 178008 - DNA, 35 bp, Artificial Sequence
  Synthetic oligonucleotide
ttgcccgcccgccgtacagcctacgccgacgaaac

SEQ ID NO: 178009 - DNA, 35 bp, Artificial Sequence
  Synthetic oligonucleotide
agctccgacctcccacgacatccgtctgtctacac

SEQ ID NO: 178010 - DNA, 35 bp, Artificial Sequence
  Synthetic oligonucleotide
gatgtcacgccacgcgggccgcccctacaatcgac

SEQ ID NO: 178011 - DNA, 35 bp, Artificial Sequence
  Synthetic oligonucleotide
tctggcaccctcctcctcctttaacgcacatggac

SEQ ID NO: 178012 - DNA, 35 bp, Artificial Sequence
  Synthetic oligonucleotide
gtgagccccaagatttatgtttgattccgccctac

SEQ ID NO: 178013 - DNA, 35 bp, Artificial Sequence
  Synthetic oligonucleotide
gagccgcgcatcgccttctcgttaattgttgcacc

SEQ ID NO: 178014 - DNA, 35 bp, Artificial Sequence
  Synthetic oligonucleotide
acgttcactccgtttcctgttgctctaaataaccc

SEQ ID NO: 178015 - DNA, 35 bp, Artificial Sequence
  Synthetic oligonucleotide
gcattggctttgcattagcgctttacccctccccc

SEQ ID NO: 178016 - DNA, 35 bp, Artificial Sequence
  Synthetic oligonucleotide
tacgtgccgcggatgacggaacgccctcttcgccc

SEQ ID NO: 178017 - DNA, 35 bp, Artificial Sequence
  Synthetic oligonucleotide
ttgggcgggcttacgttgcggcattttactttccc

SEQ ID NO: 178018 - DNA, 35 bp, Artificial Sequence
  Synthetic oligonucleotide
taccgccctggctgactctgcagagtaacctcgcc

SEQ ID NO: 178019 - DNA, 35 bp, Artificial Sequence
  Synthetic oligonucleotide
ttcgcgccggtcgtttcaataccgtcttcttcgcc

SEQ ID NO: 178020 - DNA, 35 bp, Artificial Sequence
  Synthetic oligonucleotide
atgagtgtccctcttgcctcccgcccgatagatcc

SEQ ID NO: 178021 - DNA, 35 bp, Artificial Sequence
  Synthetic oligonucleotide
tgctgacccaactcgtagtggacgctacaccctcc

SEQ ID NO: 178022 - DNA, 35 bp, Artificial Sequence
  Synthetic oligonucleotide
actcccaccgctatgttcgtccacgccaagtctcc

SEQ ID NO: 178023 - DNA, 35 bp, Artificial Sequence
  Synthetic oligonucleotide
agaacgccgcctccatccgattgcgcccgtagtcc

SEQ ID NO: 178024 - DNA, 35 bp, Artificial Sequence
  Synthetic oligonucleotide
tatgtctcgccccatcttgctctctactggaccgc

SEQ ID NO: 178025 - DNA, 35 bp, Artificial Sequence
  Synthetic oligonucleotide
acgccaccctaccgcctctgtgatcaatcttgcgc

SEQ ID NO: 178026 - DNA, 35 bp, Artificial Sequence
  Synthetic oligonucleotide
atctcgtcgcctcccgaacttgcgctactcctcgc

SEQ ID NO: 178027 - DNA, 35 bp, Artificial Sequence
  Synthetic oligonucleotide
acgcacacacctcctagtttttcttgtcctgttgc

SEQ ID NO: 178028 - DNA, 35 bp, Artificial Sequence
  Synthetic oligonucleotide
gccgtgcccctctccaccttgggtaatcgctactc

SEQ ID NO: 178029 - DNA, 35 bp, Artificial Sequence
  Synthetic oligonucleotide
gccgagtcaggacttccactcgcgtacttaacctc

SEQ ID NO: 178030 - DNA, 35 bp, Artificial Sequence
  Synthetic oligonucleotide
tcagcctactgactattaactgctaccgaaccctc

SEQ ID NO: 178031 - DNA, 35 bp, Artificial Sequence
  Synthetic oligonucleotide
cactcgttccccgcgtttttttgacggaacccctc

SEQ ID NO: 178032 - DNA, 35 bp, Artificial Sequence
  Synthetic oligonucleotide
gcacgtcgtcaatcacatcgtctgttcgaccgctc

SEQ ID NO: 178033 - DNA, 35 bp, Artificial Sequence
  Synthetic oligonucleotide
acgggcgggcggggagggcagataaccacgggctc

SEQ ID NO: 178034 - DNA, 35 bp, Artificial Sequence
  Synthetic oligonucleotide
gttgttcgcaccgtagaatgtccctccgttctgtc

SEQ ID NO: 178035 - DNA, 35 bp, Artificial Sequence
  Synthetic oligonucleotide
gacgcccctcctgcgaggaaaaacactgcaaattc

SEQ ID NO: 178036 - DNA, 35 bp, Artificial Sequence
  Synthetic oligonucleotide
tacccgctgccttgcgctccctccaaccgccattc

SEQ ID NO: 178037 - DNA, 35 bp, Artificial Sequence
  Synthetic oligonucleotide
tgatagccgcctctagtatgcccctcactctattc

SEQ ID NO: 178038 - DNA, 35 bp, Artificial Sequence
  Synthetic oligonucleotide
gtcgcgatcgatgactacgtcctcactgcttattc

SEQ ID NO: 178039 - DNA, 35 bp, Artificial Sequence
  Synthetic oligonucleotide
gacggaccgccttatttcctggcctcacgcccttc

SEQ ID NO: 178040 - DNA, 35 bp, Artificial Sequence
  Synthetic oligonucleotide
tgtcttcccatcgcccgatgatcttcgcgcccttc

SEQ ID NO: 178041 - DNA, 35 bp, Artificial Sequence
  Synthetic oligonucleotide
gattcacgcctaaatatgttttagctttgtccttc

SEQ ID NO: 178042 - DNA, 33 bp, Artificial Sequence
  Synthetic oligonucleotide
acgatcgacgcttggttctttccttctcgtttc

SEQ ID NO: 178043 - DNA, 35 bp, Artificial Sequence
  Synthetic oligonucleotide
ataacgggggagggacaggatagtaggcttagcag

SEQ ID NO: 178044 - DNA, 35 bp, Artificial Sequence
  Synthetic oligonucleotide
gtgagtccccgccattccgtacccaggcccgcgcg

SEQ ID NO: 178045 - DNA, 35 bp, Artificial Sequence
  Synthetic oligonucleotide
taccagccgccctcctccgcccgatgtgagatgcg

SEQ ID NO: 178046 - DNA, 35 bp, Artificial Sequence
  Synthetic oligonucleotide
tgcccagctcactttgcccgcccaatcccgcctcg

SEQ ID NO: 178047 - DNA, 34 bp, Artificial Sequence
  Synthetic oligonucleotide
tcgttacgccgcagccccacagccactcctctcg

SEQ ID NO: 178048 - DNA, 35 bp, Artificial Sequence
  Synthetic oligonucleotide
gagttgaaggtgagcagggaggttaagcagtcagg

SEQ ID NO: 178049 - DNA, 35 bp, Artificial Sequence
  Synthetic oligonucleotide
gagcgctgacctccccgcccaccgaatattaccgg

SEQ ID NO: 178050 - DNA, 35 bp, Artificial Sequence
  Synthetic oligonucleotide
gagaggagccggagaagggaagtggggtcctgggg

SEQ ID NO: 178051 - DNA, 35 bp, Artificial Sequence
  Synthetic oligonucleotide
ccccgcccctgacgccgttctccattcactcatgg

SEQ ID NO: 178052 - DNA, 35 bp, Artificial Sequence
  Synthetic oligonucleotide
tccacccatccgctgcctgttggcaatccatctgg

SEQ ID NO: 178053 - DNA, 35 bp, Artificial Sequence
  Synthetic oligonucleotide
tactactggaccagtggcctattaccatcttcctg

SEQ ID NO: 178054 - DNA, 35 bp, Artificial Sequence
  Synthetic oligonucleotide
atggatgtcagcccttagttttgttattgttcctg

SEQ ID NO: 178055 - DNA, 35 bp, Artificial Sequence
  Synthetic oligonucleotide
tcacgctctgccttcacgttttttcctaacaattg

SEQ ID NO: 178056 - DNA, 35 bp, Artificial Sequence
  Synthetic oligonucleotide
gctcccgtcgggagctacccttatcgcttctccat

SEQ ID NO: 178057 - DNA, 35 bp, Artificial Sequence
  Synthetic oligonucleotide
tagcatcccccccgcgtgcgttccaccttgagtat

SEQ ID NO: 178058 - DNA, 35 bp, Artificial Sequence
  Synthetic oligonucleotide
gggggacaatcggtcgaggggggtacagagggtat

SEQ ID NO: 178059 - DNA, 35 bp, Artificial Sequence
  Synthetic oligonucleotide
gagcacaaatctgcattagtcccttaccactcact

SEQ ID NO: 178060 - DNA, 35 bp, Artificial Sequence
  Synthetic oligonucleotide
tgtcacatccacgtcgcactgttcttcgccttact

SEQ ID NO: 178061 - DNA, 35 bp, Artificial Sequence
  Synthetic oligonucleotide
gaccatcaggtgcgtcccggagctcaccgttacct

SEQ ID NO: 178062 - DNA, 35 bp, Artificial Sequence
  Synthetic oligonucleotide
gcagagcccggcttcccgcgcccctacatgaccct

SEQ ID NO: 178063 - DNA, 35 bp, Artificial Sequence
  Synthetic oligonucleotide
attgtacgcctgctgtactccaccgccctgaccct

SEQ ID NO: 178064 - DNA, 35 bp, Artificial Sequence
  Synthetic oligonucleotide
attgcgtcacatcgccccctcggttctcgtaccct

SEQ ID NO: 178065 - DNA, 35 bp, Artificial Sequence
  Synthetic oligonucleotide
tccacgatccatggccctggttctttttctatcct

SEQ ID NO: 178066 - DNA, 35 bp, Artificial Sequence
  Synthetic oligonucleotide
ataatgcagcctgattccgccctaccgcacttcct

SEQ ID NO: 178067 - DNA, 35 bp, Artificial Sequence
  Synthetic oligonucleotide
cctccccgcacaatgttcctgctacacgtaccgct

SEQ ID NO: 178068 - DNA, 35 bp, Artificial Sequence
  Synthetic oligonucleotide
tcacctccctctcagacgtttccagcaaggtcgct

SEQ ID NO: 178069 - DNA, 35 bp, Artificial Sequence
  Synthetic oligonucleotide
gttctgtgcgtacccttgcctgacctactcgctct

SEQ ID NO: 178070 - DNA, 35 bp, Artificial Sequence
  Synthetic oligonucleotide
acttccagtcagccatctcttcgttttgccggtct

SEQ ID NO: 178071 - DNA, 35 bp, Artificial Sequence
  Synthetic oligonucleotide
tacgccgctgccctctgtccattgtcccgttacgt

SEQ ID NO: 178072 - DNA, 35 bp, Artificial Sequence
  Synthetic oligonucleotide
gatcccctccacgcgccacataatattcccccatt

SEQ ID NO: 178073 - DNA, 35 bp, Artificial Sequence
  Synthetic oligonucleotide
ggcaaggggagggagggggggaggcgccgacactt

SEQ ID NO: 178074 - DNA, 35 bp, Artificial Sequence
  Synthetic oligonucleotide
tcactgcccggcctcacgttctcccttcgaccctt

SEQ ID NO: 178075 - DNA, 35 bp, Artificial Sequence
  Synthetic oligonucleotide
acatctacgcatccggctcgggctatctacccctt

SEQ ID NO: 178076 - DNA, 35 bp, Artificial Sequence
  Synthetic oligonucleotide
tccatcttgcgatccggaccctccactgcctcctt

SEQ ID NO: 178077 - DNA, 35 bp, Artificial Sequence
  Synthetic oligonucleotide
atccaagccaagcgtttatttgttcgctccctctt

SEQ ID NO: 178078 - DNA, 35 bp, Artificial Sequence
  Synthetic oligonucleotide
actggtacctcgatatgccgcgccttcccttggtt

SEQ ID NO: 178079 - DNA, 35 bp, Artificial Sequence
  Synthetic oligonucleotide
aacgccccaacgccccttctaataaatgtaccttt

SEQ ID NO: 178080 - DNA, 35 bp, Artificial Sequence
  Synthetic oligonucleotide
tcaacacttaactgtgcctgccctcgacttgcttt

SEQ ID NO: 178081 - DNA, 36 bp, Artificial Sequence
  Synthetic oligonucleotide
ggttgtgcagggaggggcaaagggggcggttctcaa

SEQ ID NO: 178082 - DNA, 35 bp, Artificial Sequence
  Synthetic oligonucleotide
aagcctccaatgcccctacgtcccctgcctacgaa

SEQ ID NO: 178083 - DNA, 35 bp, Artificial Sequence
  Synthetic oligonucleotide
gagttggggcggggtaaaggtggtgctaggaggaa

SEQ ID NO: 178084 - DNA, 35 bp, Artificial Sequence
  Synthetic oligonucleotide
aaccggcccgccgtactcagttcccgcccccctaa

SEQ ID NO: 178085 - DNA, 35 bp, Artificial Sequence
  Synthetic oligonucleotide
ggttcaccgcaatccgtcgtccccagctctacaca

SEQ ID NO: 178086 - DNA, 36 bp, Artificial Sequence
  Synthetic oligonucleotide
taccccagactcagcccatctttcgtactctgcaca

SEQ ID NO: 178087 - DNA, 36 bp, Artificial Sequence
  Synthetic oligonucleotide
agcccccacacctgtgttgctgccccgttccttaca

SEQ ID NO: 178088 - DNA, 36 bp, Artificial Sequence
  Synthetic oligonucleotide
tgcggcacctgcatgccgcccaatgtgctccaccca

SEQ ID NO: 178089 - DNA, 36 bp, Artificial Sequence
  Synthetic oligonucleotide
tgagtgcaaacctcgccccatcgccatagtgcccca

SEQ ID NO: 178090 - DNA, 35 bp, Artificial Sequence
  Synthetic oligonucleotide
gttctggtcgcccgccgtggttatcattctcccca

SEQ ID NO: 178091 - DNA, 36 bp, Artificial Sequence
  Synthetic oligonucleotide
atcgctctcggcattcggtactttcgttcatttcca

SEQ ID NO: 178092 - DNA, 36 bp, Artificial Sequence
  Synthetic oligonucleotide
acacccccccactgctatctaatctggttacgtgca

SEQ ID NO: 178093 - DNA, 36 bp, Artificial Sequence
  Synthetic oligonucleotide
acccccacgacgtcctttctgccctggctggcctca

SEQ ID NO: 178094 - DNA, 36 bp, Artificial Sequence
  Synthetic oligonucleotide
gctccccgcgccaaagcctactttcattcctgttca

SEQ ID NO: 178095 - DNA, 37 bp, Artificial Sequence
  Synthetic oligonucleotide
tctggacctcccgcctgcacacattctcccctgaaga

SEQ ID NO: 178096 - DNA, 37 bp, Artificial Sequence
  Synthetic oligonucleotide
gctagggggagggaagtggtaactacggcagataaga

SEQ ID NO: 178097 - DNA, 37 bp, Artificial Sequence
  Synthetic oligonucleotide
ttgactccgtcaaggcactcttatcgcccctcccaga

SEQ ID NO: 178098 - DNA, 37 bp, Artificial Sequence
  Synthetic oligonucleotide
actgaatgggggtggcgggtaaaaaggggtagagaga

SEQ ID NO: 178099 - DNA, 37 bp, Artificial Sequence
  Synthetic oligonucleotide
gtggtaggtgaaggggcgagggagatagaaaactaga

SEQ ID NO: 178100 - DNA, 37 bp, Artificial Sequence
  Synthetic oligonucleotide
tccgttacgcccccttgtcgttttttcgcattaccga

SEQ ID NO: 178101 - DNA, 37 bp, Artificial Sequence
  Synthetic oligonucleotide
ttcgcctccgcccttggtttaaacatattcggcccga

SEQ ID NO: 178102 - DNA, 37 bp, Artificial Sequence
  Synthetic oligonucleotide
tcgcgtacatcctgggtgcactattccctcctgccga

SEQ ID NO: 178103 - DNA, 37 bp, Artificial Sequence
  Synthetic oligonucleotide
gagggccggggcaggtaggaggagggatcggtggcga

SEQ ID NO: 178104 - DNA, 37 bp, Artificial Sequence
  Synthetic oligonucleotide
gggtggtggcgggggtataggaggcggcaccaatcga

SEQ ID NO: 178105 - DNA, 36 bp, Artificial Sequence
  Synthetic oligonucleotide
tacccccactcgtatataagggtctctccccctcga

SEQ ID NO: 178106 - DNA, 37 bp, Artificial Sequence
  Synthetic oligonucleotide
gctccgctcacttgccatcaacgtatccttctccgga

SEQ ID NO: 178107 - DNA, 35 bp, Artificial Sequence
  Synthetic oligonucleotide
gctgccaccctctacctccaatatcgttgctcgga

SEQ ID NO: 178108 - DNA, 37 bp, Artificial Sequence
  Synthetic oligonucleotide
gggacggatggccaacggtgggggagctaggaaggga

SEQ ID NO: 178109 - DNA, 37 bp, Artificial Sequence
  Synthetic oligonucleotide
gaaaagggcgtaacagagggacacatggggggaggga

SEQ ID NO: 178110 - DNA, 37 bp, Artificial Sequence
  Synthetic oligonucleotide
aatatgggcggagggaaccaggactggggacacggga

SEQ ID NO: 178111 - DNA, 36 bp, Artificial Sequence
  Synthetic oligonucleotide
aagagtgggagggtggcggaagcgctggcacgggga

SEQ ID NO: 178112 - DNA, 37 bp, Artificial Sequence
  Synthetic oligonucleotide
atggggggggaggaggctagtgggcgtagtgggggga

SEQ ID NO: 178113 - DNA, 37 bp, Artificial Sequence
  Synthetic oligonucleotide
gtgggaaaagggggcgggcacaaaaagacatggggga

SEQ ID NO: 178114 - DNA, 37 bp, Artificial Sequence
  Synthetic oligonucleotide
gctagatagccggggtttgggacgggagtagggatga

SEQ ID NO: 178115 - DNA, 38 bp, Artificial Sequence
  Synthetic oligonucleotide
tagcggaaagggagagaagggctggaaaaggggtatga

SEQ ID NO: 178116 - DNA, 38 bp, Artificial Sequence
  Synthetic oligonucleotide
tgccctgcctgcagacgccgtatctgttcaccgcctga

SEQ ID NO: 178117 - DNA, 38 bp, Artificial Sequence
  Synthetic oligonucleotide
aaacagtcagggggcaggaacggaggactaaggcctga

SEQ ID NO: 178118 - DNA, 38 bp, Artificial Sequence
  Synthetic oligonucleotide
tacgttcaccctcctttgcctataaacatggctcctga

SEQ ID NO: 178119 - DNA, 38 bp, Artificial Sequence
  Synthetic oligonucleotide
tctgtcctcgttccatcgtcctctttcgctgttcctga

SEQ ID NO: 178120 - DNA, 37 bp, Artificial Sequence
  Synthetic oligonucleotide
ttggtgggaggacggggtagggggggtcatcagctga

SEQ ID NO: 178121 - DNA, 38 bp, Artificial Sequence
  Synthetic oligonucleotide
acacgtggggggcttatgagggggacgggaaacgctga

SEQ ID NO: 178122 - DNA, 38 bp, Artificial Sequence
  Synthetic oligonucleotide
tgcactgacacctaatgtcctccctcatcacttgctga

SEQ ID NO: 178123 - DNA, 38 bp, Artificial Sequence
  Synthetic oligonucleotide
ggtcgcacccacctcgtgactatgaacctccgctctga

SEQ ID NO: 178124 - DNA, 37 bp, Artificial Sequence
  Synthetic oligonucleotide
aaccgattgcccagcccgtagcaagttccctctctga

SEQ ID NO: 178125 - DNA, 37 bp, Artificial Sequence
  Synthetic oligonucleotide
gcctacgagctgggttgggggggaggggactgagtga

SEQ ID NO: 178126 - DNA, 38 bp, Artificial Sequence
  Synthetic oligonucleotide
acagggggccttaaatgcatggaacgggaggagggtga

SEQ ID NO: 178127 - DNA, 37 bp, Artificial Sequence
  Synthetic oligonucleotide
gggtggagcaatgatggggggcgggcctggggggtga

SEQ ID NO: 178128 - DNA, 36 bp, Artificial Sequence
  Synthetic oligonucleotide
gggatgggggggaattatgggatgaaggtctggtga

SEQ ID NO: 178129 - DNA, 38 bp, Artificial Sequence
  Synthetic oligonucleotide
gtactacgcttgttgccgccctcactacagtcttgtga

SEQ ID NO: 178130 - DNA, 37 bp, Artificial Sequence
  Synthetic oligonucleotide
ggggggggaaaacggggcatgaggagcaggttattga

SEQ ID NO: 178131 - DNA, 38 bp, Artificial Sequence
  Synthetic oligonucleotide
gccatcgcgtcgttttcgttccggatcccaccccttga

SEQ ID NO: 178132 - DNA, 38 bp, Artificial Sequence
  Synthetic oligonucleotide
tttcgccctgcctggactttggcgcctgtttcccttga

SEQ ID NO: 178133 - DNA, 36 bp, Artificial Sequence
  Synthetic oligonucleotide
gtctgaccccgccgttccttaagtccgtttccttga

SEQ ID NO: 178134 - DNA, 38 bp, Artificial Sequence
  Synthetic oligonucleotide
gctggctcctatcacctgttgcgtgcactatctcttga

SEQ ID NO: 178135 - DNA, 38 bp, Artificial Sequence
  Synthetic oligonucleotide
gggggcggtggggccggaaggagggttagcatatttga

SEQ ID NO: 178136 - DNA, 37 bp, Artificial Sequence
  Synthetic oligonucleotide
gttctgcctccctgctcgcgtgagtcccctcgtttga

SEQ ID NO: 178137 - DNA, 38 bp, Artificial Sequence
  Synthetic oligonucleotide
tcaacccgctcgagttgcaaccgcccatcccattttga

SEQ ID NO: 178138 - DNA, 38 bp, Artificial Sequence
  Synthetic oligonucleotide
gtcccccgagccctgtgatcggtgctcacctcttttga

SEQ ID NO: 178139 - DNA, 36 bp, Artificial Sequence
  Synthetic oligonucleotide
gacaagggagaaggggggtggacgggaggggaaata

SEQ ID NO: 178140 - DNA, 35 bp, Artificial Sequence
  Synthetic oligonucleotide
tcccatgcctcataagccgtgccttcttcaccata

SEQ ID NO: 178141 - DNA, 35 bp, Artificial Sequence
  Synthetic oligonucleotide
aggagagggaggggggtaaaacttggtgaggacta

SEQ ID NO: 178142 - DNA, 36 bp, Artificial Sequence
  Synthetic oligonucleotide
gtccccatctcctgtatcagcccatacgggtcccta

SEQ ID NO: 178143 - DNA, 36 bp, Artificial Sequence
  Synthetic oligonucleotide
actcggtgatgcagtccggatccaccgcatttccta

SEQ ID NO: 178144 - DNA, 36 bp, Artificial Sequence
  Synthetic oligonucleotide
tcgtgccacatcgctggggcttctccttccttgcta

SEQ ID NO: 178145 - DNA, 36 bp, Artificial Sequence
  Synthetic oligonucleotide
gagcacgggcgggtgggggcggacgacgaggtcgta

SEQ ID NO: 178146 - DNA, 34 bp, Artificial Sequence
  Synthetic oligonucleotide
gatcagccctcatgccgaccaatgaacctgctta

SEQ ID NO: 178147 - DNA, 35 bp, Artificial Sequence
  Synthetic oligonucleotide
tccgctcctccttgcatgcctttgctctgaacaac

SEQ ID NO: 178148 - DNA, 35 bp, Artificial Sequence
  Synthetic oligonucleotide
tgcgaactaccgctatgctattattcctggttaac

SEQ ID NO: 178149 - DNA, 35 bp, Artificial Sequence
  Synthetic oligonucleotide
gcgacgcatcccttcacctacgcctgggtagacac

SEQ ID NO: 178150 - DNA, 35 bp, Artificial Sequence
  Synthetic oligonucleotide
gtcactcccctgtcctgctacatagtatgttctac

SEQ ID NO: 178151 - DNA, 35 bp, Artificial Sequence
  Synthetic oligonucleotide
tatgcccaaacggtattacgcccctctctaggtac

SEQ ID NO: 178152 - DNA, 35 bp, Artificial Sequence
  Synthetic oligonucleotide
taatccatcctgccgtcccagtatcgccgctaacc

SEQ ID NO: 178153 - DNA, 35 bp, Artificial Sequence
  Synthetic oligonucleotide
ggtgccctcgcttagttcggttactacggtccacc

SEQ ID NO: 178154 - DNA, 35 bp, Artificial Sequence
  Synthetic oligonucleotide
gacaggcccgtgccatggctccccttcgttccacc

SEQ ID NO: 178155 - DNA, 35 bp, Artificial Sequence
  Synthetic oligonucleotide
tccttgggccccacctttcccccgcgtcctttacc

SEQ ID NO: 178156 - DNA, 35 bp, Artificial Sequence
  Synthetic oligonucleotide
tcttgtgcctccccttgaataatcagtcatcaccc

SEQ ID NO: 178157 - DNA, 35 bp, Artificial Sequence
  Synthetic oligonucleotide
tgcttgacaccatgaggctttcttgcccttcgccc

SEQ ID NO: 178158 - DNA, 35 bp, Artificial Sequence
  Synthetic oligonucleotide
actcgcgtgacgatatctggccgcgctcccctccc

SEQ ID NO: 178159 - DNA, 35 bp, Artificial Sequence
  Synthetic oligonucleotide
atcgcccctaacagcctccgcgatgaatagctccc

SEQ ID NO: 178160 - DNA, 35 bp, Artificial Sequence
  Synthetic oligonucleotide
tcacacaccatgggtacttgctctttattcgtccc

SEQ ID NO: 178161 - DNA, 35 bp, Artificial Sequence
  Synthetic oligonucleotide
tgcgccatcccgctgccccctggtccgttccagcc

SEQ ID NO: 178162 - DNA, 35 bp, Artificial Sequence
  Synthetic oligonucleotide
atgcccaccacacactgaagtgaaattcttacgcc

SEQ ID NO: 178163 - DNA, 35 bp, Artificial Sequence
  Synthetic oligonucleotide
catccgcgcaccacccctctatacctcggcctgcc

SEQ ID NO: 178164 - DNA, 35 bp, Artificial Sequence
  Synthetic oligonucleotide
gagaaacccgcaacctagtcgccaccgcctttgcc

SEQ ID NO: 178165 - DNA, 35 bp, Artificial Sequence
  Synthetic oligonucleotide
atgcaccgggttgaagatcaacgccacgctcctcc

SEQ ID NO: 178166 - DNA, 35 bp, Artificial Sequence
  Synthetic oligonucleotide
acacccgccttgaaggtcttagccatactcgctcc

SEQ ID NO: 178167 - DNA, 35 bp, Artificial Sequence
  Synthetic oligonucleotide
caagtgcacgccctctcgatccttccggttgctcc

SEQ ID NO: 178168 - DNA, 35 bp, Artificial Sequence
  Synthetic oligonucleotide
aatcactccgcctatcgattaccgaatgacagtcc

SEQ ID NO: 178169 - DNA, 35 bp, Artificial Sequence
  Synthetic oligonucleotide
atcgccacgtgctctctattttcaagcaaccgtcc

SEQ ID NO: 178170 - DNA, 35 bp, Artificial Sequence
  Synthetic oligonucleotide
gtcgagcgtggtccatcgttaaccccagccggtcc

SEQ ID NO: 178171 - DNA, 35 bp, Artificial Sequence
  Synthetic oligonucleotide
atgggcggcaatcaccccgcagccagttctcttcc

SEQ ID NO: 178172 - DNA, 35 bp, Artificial Sequence
  Synthetic oligonucleotide
gcgatgcaccgtttgtaccatcctgctcttctcgc

SEQ ID NO: 178173 - DNA, 35 bp, Artificial Sequence
  Synthetic oligonucleotide
ttgggtgcaccgggtgggaacactgtcgggagggc

SEQ ID NO: 178174 - DNA, 35 bp, Artificial Sequence
  Synthetic oligonucleotide
gtgtccccgcatccccgtccgtacacgcagagtgc

SEQ ID NO: 178175 - DNA, 35 bp, Artificial Sequence
  Synthetic oligonucleotide
acgacacccgccctcttgactcgatcctgcctatc

SEQ ID NO: 178176 - DNA, 35 bp, Artificial Sequence
  Synthetic oligonucleotide
gtgcggagcccctctgagtatgttgcccttgtatc

SEQ ID NO: 178177 - DNA, 35 bp, Artificial Sequence
  Synthetic oligonucleotide
atccccccaaggtcacgcgcccggcctggttactc

SEQ ID NO: 178178 - DNA, 35 bp, Artificial Sequence
  Synthetic oligonucleotide
tcgcccaccaacttctatgtacgccccctttactc

SEQ ID NO: 178179 - DNA, 35 bp, Artificial Sequence
  Synthetic oligonucleotide
gtatgcccccgattgtagcccacgtatagctcctc

SEQ ID NO: 178180 - DNA, 35 bp, Artificial Sequence
  Synthetic oligonucleotide
ccctgcccggtatgcctagttcctgttatcttctc

SEQ ID NO: 178181 - DNA, 35 bp, Artificial Sequence
  Synthetic oligonucleotide
atggtggagaggggagttgcgcagaagaggcagtc

SEQ ID NO: 178182 - DNA, 35 bp, Artificial Sequence
  Synthetic oligonucleotide
aacaccaccattccgtcatctgcgacacctgcgtc

SEQ ID NO: 178183 - DNA, 35 bp, Artificial Sequence
  Synthetic oligonucleotide
gatgggggggttaaaggttgcgggagggtgatgtc

SEQ ID NO: 178184 - DNA, 35 bp, Artificial Sequence
  Synthetic oligonucleotide
gatttgcccttcctctgtgctgcactctagttgtc

SEQ ID NO: 178185 - DNA, 35 bp, Artificial Sequence
  Synthetic oligonucleotide
acagtcttcacatcgtttcccagtccaccgcattc

SEQ ID NO: 178186 - DNA, 35 bp, Artificial Sequence
  Synthetic oligonucleotide
tgttgacctcacccagctcctgttttacctgattc

SEQ ID NO: 178187 - DNA, 35 bp, Artificial Sequence
  Synthetic oligonucleotide
gttgtcgtagactcgaaccctgtgaccgaaccttc

SEQ ID NO: 178188 - DNA, 35 bp, Artificial Sequence
  Synthetic oligonucleotide
tacgacgacgacatccttcggtaccttcctccttc

SEQ ID NO: 178189 - DNA, 35 bp, Artificial Sequence
  Synthetic oligonucleotide
gcctgatcaccgttttttcgttcctttctgagttc

SEQ ID NO: 178190 - DNA, 35 bp, Artificial Sequence
  Synthetic oligonucleotide
gacactactttgccctgttatcgccacgagatttc

SEQ ID NO: 178191 - DNA, 35 bp, Artificial Sequence
  Synthetic oligonucleotide
aaccgtggtcgcagttgcgattctacgaccctttc

SEQ ID NO: 178192 - DNA, 35 bp, Artificial Sequence
  Synthetic oligonucleotide
gtagggcggaacacggtgggagtacggaagcgaag

SEQ ID NO: 178193 - DNA, 35 bp, Artificial Sequence
  Synthetic oligonucleotide
atcgcccccctgccatattagtaccgctcattcag

SEQ ID NO: 178194 - DNA, 35 bp, Artificial Sequence
  Synthetic oligonucleotide
actccctcccacactcatttgaccaggccctcgag

SEQ ID NO: 178195 - DNA, 35 bp, Artificial Sequence
  Synthetic oligonucleotide
tgacccctcatagtgaccttctctaccactgtacg

SEQ ID NO: 178196 - DNA, 35 bp, Artificial Sequence
  Synthetic oligonucleotide
gcctatcggtcacgtggtcatatatccttctcccg

SEQ ID NO: 178197 - DNA, 35 bp, Artificial Sequence
  Synthetic oligonucleotide
taccccctcccgtttcaccgagcacgctagttccg

SEQ ID NO: 178198 - DNA, 35 bp, Artificial Sequence
  Synthetic oligonucleotide
acgtcgtcgcccgccccttatgaagtccgcatgcg

SEQ ID NO: 178199 - DNA, 35 bp, Artificial Sequence
  Synthetic oligonucleotide
gcacccaccatcgtgcctgccctcttccctcttcg

SEQ ID NO: 178200 - DNA, 35 bp, Artificial Sequence
  Synthetic oligonucleotide
aagcacgagggaaaggggtctgggggtctatgggg

SEQ ID NO: 178201 - DNA, 35 bp, Artificial Sequence
  Synthetic oligonucleotide
gctggtaaggatgcatttgggggggtggagtgggg

SEQ ID NO: 178202 - DNA, 35 bp, Artificial Sequence
  Synthetic oligonucleotide
aacctccgactatgctatacctgccccacccatgg

SEQ ID NO: 178203 - DNA, 35 bp, Artificial Sequence
  Synthetic oligonucleotide
gtcgccgacgtggtgattcctgttcgttcctctgg

SEQ ID NO: 178204 - DNA, 35 bp, Artificial Sequence
  Synthetic oligonucleotide
aactccctgactcctctcattatgccatcccgatg

SEQ ID NO: 178205 - DNA, 35 bp, Artificial Sequence
  Synthetic oligonucleotide
ggacacaaagtggtgggcaggagaacaaggaagtg

SEQ ID NO: 178206 - DNA, 35 bp, Artificial Sequence
  Synthetic oligonucleotide
tttggaggccgcccacacctctgcttctctccttg

SEQ ID NO: 178207 - DNA, 35 bp, Artificial Sequence
  Synthetic oligonucleotide
tgtaatgctcgtccatcctccagccggtcgcccat

SEQ ID NO: 178208 - DNA, 35 bp, Artificial Sequence
  Synthetic oligonucleotide
gcccacaatccgagcattgcacatagtctccacct

SEQ ID NO: 178209 - DNA, 35 bp, Artificial Sequence
  Synthetic oligonucleotide
actgacctgcgggaccgactccattccctgcccct

SEQ ID NO: 178210 - DNA, 35 bp, Artificial Sequence
  Synthetic oligonucleotide
gcgtgcatcattgatattcccactccagcccgcct

SEQ ID NO: 178211 - DNA, 35 bp, Artificial Sequence
  Synthetic oligonucleotide
gatctacgaaccctcaccctgcgtcaccttggcct

SEQ ID NO: 178212 - DNA, 35 bp, Artificial Sequence
  Synthetic oligonucleotide
gtctccgtacacctgcgcttgcatgctatctgcct

SEQ ID NO: 178213 - DNA, 35 bp, Artificial Sequence
  Synthetic oligonucleotide
tatcccgccactgcatcacgacccctttacatcct

SEQ ID NO: 178214 - DNA, 35 bp, Artificial Sequence
  Synthetic oligonucleotide
tccccgcgtcaccgcttggtcttccttgatctcct

SEQ ID NO: 178215 - DNA, 35 bp, Artificial Sequence
  Synthetic oligonucleotide
gccagggaggacgggcgagtaaggggagagacgct

SEQ ID NO: 178216 - DNA, 35 bp, Artificial Sequence
  Synthetic oligonucleotide
attcttgcactgccaaccgcgccgctccgcccgct

SEQ ID NO: 178217 - DNA, 35 bp, Artificial Sequence
  Synthetic oligonucleotide
gtccacccaccctgtcctcgagcatgtaaggcgct

SEQ ID NO: 178218 - DNA, 35 bp, Artificial Sequence
  Synthetic oligonucleotide
aacacatgcagcgcggttacgctgtcgctctatct

SEQ ID NO: 178219 - DNA, 35 bp, Artificial Sequence
  Synthetic oligonucleotide
gtacagggataggaggggaagcgggtcgctgaagt

SEQ ID NO: 178220 - DNA, 35 bp, Artificial Sequence
  Synthetic oligonucleotide
gccaccaccgctgggaataccttcttctttgaagt

SEQ ID NO: 178221 - DNA, 35 bp, Artificial Sequence
  Synthetic oligonucleotide
agaccagccacctcggctataccatttcaccccgt

SEQ ID NO: 178222 - DNA, 35 bp, Artificial Sequence
  Synthetic oligonucleotide
atcagagggggggtgggttgggacatagagagcgt

SEQ ID NO: 178223 - DNA, 35 bp, Artificial Sequence
  Synthetic oligonucleotide
tacacctcacctatgccctgtcctgcccgccctgt

SEQ ID NO: 178224 - DNA, 35 bp, Artificial Sequence
  Synthetic oligonucleotide
gcccgctgcccgtcgtacatccagttccacccctt

SEQ ID NO: 178225 - DNA, 34 bp, Artificial Sequence
  Synthetic oligonucleotide
atgggccctcccgccctatatcccggtcccattt

SEQ ID NO: 178226 - DNA, 35 bp, Artificial Sequence
  Synthetic oligonucleotide
tgccatcccgctcatttacggcgaacgaagccttt

SEQ ID NO: 178227 - DNA, 36 bp, Artificial Sequence
  Synthetic oligonucleotide
gcctgccgcataaccgtgcttgcattccccccgaaa

SEQ ID NO: 178228 - DNA, 36 bp, Artificial Sequence
  Synthetic oligonucleotide
atgaccgcgcctccaatggcaaggcatccctcccaa

SEQ ID NO: 178229 - DNA, 36 bp, Artificial Sequence
  Synthetic oligonucleotide
tcaacacgccctcattctacctccttgccccagcaa

SEQ ID NO: 178230 - DNA, 36 bp, Artificial Sequence
  Synthetic oligonucleotide
actgggaacagaggaggggggatgagcggctaggaa

SEQ ID NO: 178231 - DNA, 36 bp, Artificial Sequence
  Synthetic oligonucleotide
tacgcgcccttccacctggcacatatcgatcctgaa

SEQ ID NO: 178232 - DNA, 35 bp, Artificial Sequence
  Synthetic oligonucleotide
gccctgtacatcctttcactcctgtcgtgttcaca

SEQ ID NO: 178233 - DNA, 36 bp, Artificial Sequence
  Synthetic oligonucleotide
atgccaacgcccacctgcttcgtaacatcctcgaca

SEQ ID NO: 178234 - DNA, 35 bp, Artificial Sequence
  Synthetic oligonucleotide
gtaccactctggtatgcctaactcattgctctaca

SEQ ID NO: 178235 - DNA, 36 bp, Artificial Sequence
  Synthetic oligonucleotide
gaaccgtggtggggggataggtatgtggtgtgtaca

SEQ ID NO: 178236 - DNA, 36 bp, Artificial Sequence
  Synthetic oligonucleotide
tcctaacgacattcggcctcaccagcacactcgcca

SEQ ID NO: 178237 - DNA, 35 bp, Artificial Sequence
  Synthetic oligonucleotide
ttgactcatcctgccgttcgtaatcatgcatgcca

SEQ ID NO: 178238 - DNA, 35 bp, Artificial Sequence
  Synthetic oligonucleotide
gcaatgcgagagctctgttccaccttttcggcgca

SEQ ID NO: 178239 - DNA, 36 bp, Artificial Sequence
  Synthetic oligonucleotide
gtggggggaagggagtaaggcagaataggtaaatca

SEQ ID NO: 178240 - DNA, 36 bp, Artificial Sequence
  Synthetic oligonucleotide
accacccgcgagactccgctggccagttcgccctca

SEQ ID NO: 178241 - DNA, 36 bp, Artificial Sequence
  Synthetic oligonucleotide
tctcctgacccggtgatatggctccatcttttctca

SEQ ID NO: 178242 - DNA, 36 bp, Artificial Sequence
  Synthetic oligonucleotide
atccttccccacccaatggttctccacagtgtgtca

SEQ ID NO: 178243 - DNA, 36 bp, Artificial Sequence
  Synthetic oligonucleotide
agtagacagtgcgtggacgtaggggagggggataga

SEQ ID NO: 178244 - DNA, 37 bp, Artificial Sequence
  Synthetic oligonucleotide
gtggtggtggagggggcgattttgtgggacgggtaga

SEQ ID NO: 178245 - DNA, 37 bp, Artificial Sequence
  Synthetic oligonucleotide
agcctaccccatgcttagtcgccctcccctgtgacga

SEQ ID NO: 178246 - DNA, 37 bp, Artificial Sequence
  Synthetic oligonucleotide
tgatagccgactgccacactgctccctggacctccga

SEQ ID NO: 178247 - DNA, 36 bp, Artificial Sequence
  Synthetic oligonucleotide
ccctcgcctcgatgtccttgcaccacccctttccga

SEQ ID NO: 178248 - DNA, 37 bp, Artificial Sequence
  Synthetic oligonucleotide
gaagagacggtggggacgggaggtgcgacgatagcga

SEQ ID NO: 178249 - DNA, 37 bp, Artificial Sequence
  Synthetic oligonucleotide
acccacctccacgctcctcactccttgcagagtgcga

SEQ ID NO: 178250 - DNA, 37 bp, Artificial Sequence
  Synthetic oligonucleotide
tgcgacaccgctcctctcaaacgtctgccacttgcga

SEQ ID NO: 178251 - DNA, 37 bp, Artificial Sequence
  Synthetic oligonucleotide
tagtcccggccactgtctatttactcacttccgtcga

SEQ ID NO: 178252 - DNA, 37 bp, Artificial Sequence
  Synthetic oligonucleotide
gaagccctccctctgtggtccctccttgttaattcga

SEQ ID NO: 178253 - DNA, 37 bp, Artificial Sequence
  Synthetic oligonucleotide
ttccccaccgtcggacctctcatccccgggcattcga

SEQ ID NO: 178254 - DNA, 37 bp, Artificial Sequence
  Synthetic oligonucleotide
taccctcctccgcctgcatgcactgttcacacttcga

SEQ ID NO: 178255 - DNA, 37 bp, Artificial Sequence
  Synthetic oligonucleotide
atgtgtgccgggtggagaaaagggtgggagaaccgga

SEQ ID NO: 178256 - DNA, 37 bp, Artificial Sequence
  Synthetic oligonucleotide
tatcacgcgccgccacgaccacagccattctcccgga

SEQ ID NO: 178257 - DNA, 37 bp, Artificial Sequence
  Synthetic oligonucleotide
gagccaccgcctccacccttacatgagccaacgcgga

SEQ ID NO: 178258 - DNA, 37 bp, Artificial Sequence
  Synthetic oligonucleotide
atggaggagggaggcaagcaaaggggtaagtcgcgga

SEQ ID NO: 178259 - DNA, 37 bp, Artificial Sequence
  Synthetic oligonucleotide
tatggtcgaggtggggagggcgactcgagggaaggga

SEQ ID NO: 178260 - DNA, 37 bp, Artificial Sequence
  Synthetic oligonucleotide
gagaaccagaggagaaataggatgcgggctgggggga

SEQ ID NO: 178261 - DNA, 37 bp, Artificial Sequence
  Synthetic oligonucleotide
agtccgggaggggtcgtgtggggtaaaatcatgggga

SEQ ID NO: 178262 - DNA, 37 bp, Artificial Sequence
  Synthetic oligonucleotide
tggggagagaccggggggggtgaaggcgtgcggtgga

SEQ ID NO: 178263 - DNA, 37 bp, Artificial Sequence
  Synthetic oligonucleotide
gccgtgggaaggaggcggaaataagaaaggggaatga

SEQ ID NO: 178264 - DNA, 38 bp, Artificial Sequence
  Synthetic oligonucleotide
ggcggggggggtggggtaggggaaccggccatgactga

SEQ ID NO: 178265 - DNA, 37 bp, Artificial Sequence
  Synthetic oligonucleotide
gcgtgacggctcagtctgcatgcgcgtacctccctga

SEQ ID NO: 178266 - DNA, 38 bp, Artificial Sequence
  Synthetic oligonucleotide
atcgactccggagatagcacccacaactgccctcctga

SEQ ID NO: 178267 - DNA, 38 bp, Artificial Sequence
  Synthetic oligonucleotide
tccgaaccgtcggggcctcacgtaccgtccttctctga

SEQ ID NO: 178268 - DNA, 38 bp, Artificial Sequence
  Synthetic oligonucleotide
gaagagggtggagcagtaatagagtgaagtcagtctga

SEQ ID NO: 178269 - DNA, 38 bp, Artificial Sequence
  Synthetic oligonucleotide
tcacgcgcaaagaggtaatttcgcatccctccccgtga

SEQ ID NO: 178270 - DNA, 37 bp, Artificial Sequence
  Synthetic oligonucleotide
agcaaagccctcatcgttctaactcttctccgcgtga

SEQ ID NO: 178271 - DNA, 38 bp, Artificial Sequence
  Synthetic oligonucleotide
tagggggaggggacgatgactaattaatgggagggtga

SEQ ID NO: 178272 - DNA, 38 bp, Artificial Sequence
  Synthetic oligonucleotide
tccatcccccccaatgcgatttctgtccgagtcattga

SEQ ID NO: 178273 - DNA, 38 bp, Artificial Sequence
  Synthetic oligonucleotide
tgccctccgccgtcacatcatacgttggtcctccttga

SEQ ID NO: 178274 - DNA, 38 bp, Artificial Sequence
  Synthetic oligonucleotide
acaggaggcggatgtgacgtggtgtgggcggatcttga

SEQ ID NO: 178275 - DNA, 36 bp, Artificial Sequence
  Synthetic oligonucleotide
tgcctcggttcattgatcctcgacccttcctcttga

SEQ ID NO: 178276 - DNA, 38 bp, Artificial Sequence
  Synthetic oligonucleotide
tccccccgccgtacccttttgatcatttggccagttga

SEQ ID NO: 178277 - DNA, 37 bp, Artificial Sequence
  Synthetic oligonucleotide
agaacatccgtgcagcccatcgccctctcatagttga

SEQ ID NO: 178278 - DNA, 36 bp, Artificial Sequence
  Synthetic oligonucleotide
accacgcccgcctcacttgcctagagtgtaccgcta

SEQ ID NO: 178279 - DNA, 36 bp, Artificial Sequence
  Synthetic oligonucleotide
tgcatcactatgccttggtacctcccctacagtcta

SEQ ID NO: 178280 - DNA, 36 bp, Artificial Sequence
  Synthetic oligonucleotide
tatccacatggcccccgcaaacgcccagtatttcta

SEQ ID NO: 178281 - DNA, 36 bp, Artificial Sequence
  Synthetic oligonucleotide
gctccctcgcctcctcctgtgccttatggaatggta

SEQ ID NO: 178282 - DNA, 35 bp, Artificial Sequence
  Synthetic oligonucleotide
gacgggggagggtaagcatggttggcagggtggta

SEQ ID NO: 178283 - DNA, 36 bp, Artificial Sequence
  Synthetic oligonucleotide
tcccagagacgggagggacgggaaggggcagttgta

SEQ ID NO: 178284 - DNA, 36 bp, Artificial Sequence
  Synthetic oligonucleotide
tggagtcgctcccccctgcatatttagtcctcctta

SEQ ID NO: 178285 - DNA, 35 bp, Artificial Sequence
  Synthetic oligonucleotide
gcagggggcacgggtgcggagggaggaatctctta

SEQ ID NO: 178286 - DNA, 35 bp, Artificial Sequence
  Synthetic oligonucleotide
ggaacacattcgatctgcctacctccagcacaaac

SEQ ID NO: 178287 - DNA, 35 bp, Artificial Sequence
  Synthetic oligonucleotide
gcccctccccttgtctatttcgtgtgcattccaac

SEQ ID NO: 178288 - DNA, 35 bp, Artificial Sequence
  Synthetic oligonucleotide
ttggggggagggcgggtagcacgagttggggccac

SEQ ID NO: 178289 - DNA, 35 bp, Artificial Sequence
  Synthetic oligonucleotide
tggagcccattataggcccccgtgttccaccgcac

SEQ ID NO: 178290 - DNA, 35 bp, Artificial Sequence
  Synthetic oligonucleotide
tcaccccctcacattcccctgcacatactgtatac

SEQ ID NO: 178291 - DNA, 35 bp, Artificial Sequence
  Synthetic oligonucleotide
agagatggccccccgctactcgtgacgattcttac

SEQ ID NO: 178292 - DNA, 35 bp, Artificial Sequence
  Synthetic oligonucleotide
gctcgtgccccccattgggctatcgtttttccacc

SEQ ID NO: 178293 - DNA, 35 bp, Artificial Sequence
  Synthetic oligonucleotide
ttgccgctgtgcgtttctgttcattttcactcacc

SEQ ID NO: 178294 - DNA, 35 bp, Artificial Sequence
  Synthetic oligonucleotide
atcccaactcccatgtatgcaccttctgcgaaccc

SEQ ID NO: 178295 - DNA, 36 bp, Artificial Sequence
  Synthetic oligonucleotide
gccgccctacatttgggttcccatccttgtcccccc

SEQ ID NO: 178296 - DNA, 35 bp, Artificial Sequence
  Synthetic oligonucleotide
acgcagaccgttcacccgcctatgtcccagccccc

SEQ ID NO: 178297 - DNA, 35 bp, Artificial Sequence
  Synthetic oligonucleotide
actcccaggcattgcatcgtcagcttcccctgccc

SEQ ID NO: 178298 - DNA, 35 bp, Artificial Sequence
  Synthetic oligonucleotide
tagttcgcatccttttgaaaaagccgcctgccgcc

SEQ ID NO: 178299 - DNA, 35 bp, Artificial Sequence
  Synthetic oligonucleotide
acgcacaattgaccctatgacgctctgacttcgcc

SEQ ID NO: 178300 - DNA, 35 bp, Artificial Sequence
  Synthetic oligonucleotide
gtcactcccggccacgatcttgctttgtcgctgcc

SEQ ID NO: 178301 - DNA, 34 bp, Artificial Sequence
  Synthetic oligonucleotide
ttgtgcctcaagctctttcttcggatcccttgcc

SEQ ID NO: 178302 - DNA, 35 bp, Artificial Sequence
  Synthetic oligonucleotide
gcaactcgtcacgctctagaaatcccgatccttcc

SEQ ID NO: 178303 - DNA, 35 bp, Artificial Sequence
  Synthetic oligonucleotide
gcccatccctcagcaattcactctcgcactcttcc

SEQ ID NO: 178304 - DNA, 35 bp, Artificial Sequence
  Synthetic oligonucleotide
ttggcacagaatctgcgcacccaaccacccgttcc

SEQ ID NO: 178305 - DNA, 34 bp, Artificial Sequence
  Synthetic oligonucleotide
gccacccgacccctcttgcagtaactcgctttcc

SEQ ID NO: 178306 - DNA, 35 bp, Artificial Sequence
  Synthetic oligonucleotide
gcatgtagtgtacgtcgctttcaccgcatttttcc

SEQ ID NO: 178307 - DNA, 35 bp, Artificial Sequence
  Synthetic oligonucleotide
gcagttgcccccactgttcataacccttgccaagc

SEQ ID NO: 178308 - DNA, 35 bp, Artificial Sequence
  Synthetic oligonucleotide
aatcctcgtagccttagtcctgcaatacacgccgc

SEQ ID NO: 178309 - DNA, 35 bp, Artificial Sequence
  Synthetic oligonucleotide
gaacctcctcccgggtaaatggcccagtaactcgc

SEQ ID NO: 178310 - DNA, 35 bp, Artificial Sequence
  Synthetic oligonucleotide
aacgaggtggagggaaagcaacgagacgttagggc

SEQ ID NO: 178311 - DNA, 35 bp, Artificial Sequence
  Synthetic oligonucleotide
tgtgccgcttgccccatattgtcgtccccgcctgc

SEQ ID NO: 178312 - DNA, 35 bp, Artificial Sequence
  Synthetic oligonucleotide
tgccttgtcaatagcttcttccaccaccccagtgc

SEQ ID NO: 178313 - DNA, 35 bp, Artificial Sequence
  Synthetic oligonucleotide
accgtgccctcaacggctaacgacttcttaccatc

SEQ ID NO: 178314 - DNA, 35 bp, Artificial Sequence
  Synthetic oligonucleotide
gtctaccagcacgcatcgcatacgacaccatcatc

SEQ ID NO: 178315 - DNA, 35 bp, Artificial Sequence
  Synthetic oligonucleotide
ggacccttcatccgtctaaaagtcatcctttcatc

SEQ ID NO: 178316 - DNA, 35 bp, Artificial Sequence
  Synthetic oligonucleotide
gggtacgccccccgcattgtctgtacggccgcctc

SEQ ID NO: 178317 - DNA, 35 bp, Artificial Sequence
  Synthetic oligonucleotide
acggacctgccatttgccgtgcctttctcgtcctc

SEQ ID NO: 178318 - DNA, 35 bp, Artificial Sequence
  Synthetic oligonucleotide
aataccagccagccggttaggccctagcccctctc

SEQ ID NO: 178319 - DNA, 35 bp, Artificial Sequence
  Synthetic oligonucleotide
tcaccgtaataggcccccttcatgcatttggtctc

SEQ ID NO: 178320 - DNA, 35 bp, Artificial Sequence
  Synthetic oligonucleotide
tcagggcacacgcgcatgtccccctttgcctcgtc

SEQ ID NO: 178321 - DNA, 35 bp, Artificial Sequence
  Synthetic oligonucleotide
tattgagcccgcgtccgttccttcttctcctggtc

SEQ ID NO: 178322 - DNA, 35 bp, Artificial Sequence
  Synthetic oligonucleotide
tcacgcacgccgcacaagtctgctcaccgttccag

SEQ ID NO: 178323 - DNA, 35 bp, Artificial Sequence
  Synthetic oligonucleotide
gatacgcctccactgagccccatacagccacttag

SEQ ID NO: 178324 - DNA, 35 bp, Artificial Sequence
  Synthetic oligonucleotide
ggggggaggggcgatatggggcctagggtatttag

SEQ ID NO: 178325 - DNA, 35 bp, Artificial Sequence
  Synthetic oligonucleotide
accgccgactacccgcgtgcgcccaagacttaccg

SEQ ID NO: 178326 - DNA, 35 bp, Artificial Sequence
  Synthetic oligonucleotide
tgaagtcgataggcatcctcccacttggttacccg

SEQ ID NO: 178327 - DNA, 35 bp, Artificial Sequence
  Synthetic oligonucleotide
gtcggtccagatatgtccttcgcccgccgaccccg

SEQ ID NO: 178328 - DNA, 35 bp, Artificial Sequence
  Synthetic oligonucleotide
gagcatcacctgttaccgttggcccgtagcccccg

SEQ ID NO: 178329 - DNA, 35 bp, Artificial Sequence
  Synthetic oligonucleotide
gcatatgcccacaatatcttttatccctgtccccg

SEQ ID NO: 178330 - DNA, 35 bp, Artificial Sequence
  Synthetic oligonucleotide
ggacatgccgccgcccgtctcccctgtcctctccg

SEQ ID NO: 178331 - DNA, 35 bp, Artificial Sequence
  Synthetic oligonucleotide
gtgcacttccgccattctctagccatgaacttccg

SEQ ID NO: 178332 - DNA, 35 bp, Artificial Sequence
  Synthetic oligonucleotide
agcacatctgaccaccatctgaataacactccgcg

SEQ ID NO: 178333 - DNA, 35 bp, Artificial Sequence
  Synthetic oligonucleotide
aactgccacattggctcaaacgccccgcccttgcg

SEQ ID NO: 178334 - DNA, 35 bp, Artificial Sequence
  Synthetic oligonucleotide
tcctggctcccaacctttttacgactccgacctcg

SEQ ID NO: 178335 - DNA, 35 bp, Artificial Sequence
  Synthetic oligonucleotide
ctcgccggaagtgggagggagggttttcttggtcg

SEQ ID NO: 178336 - DNA, 35 bp, Artificial Sequence
  Synthetic oligonucleotide
gctgttcctgccccctctcgtgaatctgaatgtcg

SEQ ID NO: 178337 - DNA, 35 bp, Artificial Sequence
  Synthetic oligonucleotide
tgctgacgctcccgtactccacaccgcatctttcg

SEQ ID NO: 178338 - DNA, 35 bp, Artificial Sequence
  Synthetic oligonucleotide
accaagaggtggggtggtgaggttagcaagtaagg

SEQ ID NO: 178339 - DNA, 35 bp, Artificial Sequence
  Synthetic oligonucleotide
gtcgggtgtagggtgttgaataggtataggggggg

SEQ ID NO: 178340 - DNA, 35 bp, Artificial Sequence
  Synthetic oligonucleotide
gcttagggggaggagggacgtcgcgacgcatgggg

SEQ ID NO: 178341 - DNA, 35 bp, Artificial Sequence
  Synthetic oligonucleotide
accacgggtgataggggtctctggggggattgggg

SEQ ID NO: 178342 - DNA, 35 bp, Artificial Sequence
  Synthetic oligonucleotide
gacgctccatcattgctatatctccacctatcatg

SEQ ID NO: 178343 - DNA, 35 bp, Artificial Sequence
  Synthetic oligonucleotide
ttctcagagcgtacggacatgtcttctcttccctg

SEQ ID NO: 178344 - DNA, 35 bp, Artificial Sequence
  Synthetic oligonucleotide
aaaccaaccgatctagcgtctgccgtcccatcctg

SEQ ID NO: 178345 - DNA, 35 bp, Artificial Sequence
  Synthetic oligonucleotide
tccccatgcagcctccgtgaccgatcgctctcctg

SEQ ID NO: 178346 - DNA, 35 bp, Artificial Sequence
  Synthetic oligonucleotide
ggagacagggtaggattgataggggaaggagtctg

SEQ ID NO: 178347 - DNA, 35 bp, Artificial Sequence
  Synthetic oligonucleotide
acatgggggcgggtatgggctattggggccgccat

SEQ ID NO: 178348 - DNA, 35 bp, Artificial Sequence
  Synthetic oligonucleotide
tgctatctccgtacgtcgtctcatccctcctgcat

SEQ ID NO: 178349 - DNA, 35 bp, Artificial Sequence
  Synthetic oligonucleotide
tccgacgcccgcctgttcgtctacttcttcatcat

SEQ ID NO: 178350 - DNA, 35 bp, Artificial Sequence
  Synthetic oligonucleotide
agagtccccgggccgttatacccttacacattcat

SEQ ID NO: 178351 - DNA, 35 bp, Artificial Sequence
  Synthetic oligonucleotide
tcaacaggtgggggcgctcggggggtaggaggtat

SEQ ID NO: 178352 - DNA, 34 bp, Artificial Sequence
  Synthetic oligonucleotide
gatgccgccgccaccgcttgcctgacctctttat

SEQ ID NO: 178353 - DNA, 35 bp, Artificial Sequence
  Synthetic oligonucleotide
tgcaagtggccatttgccagtcaccccctttacct

SEQ ID NO: 178354 - DNA, 36 bp, Artificial Sequence
  Synthetic oligonucleotide
gatcaatcgccacgggccttataactacacgcccct

SEQ ID NO: 178355 - DNA, 35 bp, Artificial Sequence
  Synthetic oligonucleotide
acgccctcatcagcttctgctcttactctggtcct

SEQ ID NO: 178356 - DNA, 35 bp, Artificial Sequence
  Synthetic oligonucleotide
tccccgggctcacaacctcctccaggcaatctgct

SEQ ID NO: 178357 - DNA, 35 bp, Artificial Sequence
  Synthetic oligonucleotide
tgggctccccctcggtcactatctttggtccatct

SEQ ID NO: 178358 - DNA, 35 bp, Artificial Sequence
  Synthetic oligonucleotide
tacccgcacgcagggtggcgggggagggcctatct

SEQ ID NO: 178359 - DNA, 35 bp, Artificial Sequence
  Synthetic oligonucleotide
gcctgtcctctcatcatggtccatccagagtgtct

SEQ ID NO: 178360 - DNA, 35 bp, Artificial Sequence
  Synthetic oligonucleotide
ggtcgacctcccatacgccggacgctcgcctttct

SEQ ID NO: 178361 - DNA, 35 bp, Artificial Sequence
  Synthetic oligonucleotide
atcccaccgaccatccgtattcatccactgtttct

SEQ ID NO: 178362 - DNA, 35 bp, Artificial Sequence
  Synthetic oligonucleotide
ggacccttcacccccacgaccccttagtttgcggt

SEQ ID NO: 178363 - DNA, 35 bp, Artificial Sequence
  Synthetic oligonucleotide
agacccgtgggtgaagcggggggaacgtaatgggt

SEQ ID NO: 178364 - DNA, 35 bp, Artificial Sequence
  Synthetic oligonucleotide
gcctctagcgtgtctacttcgcttccatcccctgt

SEQ ID NO: 178365 - DNA, 35 bp, Artificial Sequence
  Synthetic oligonucleotide
atccggccccacgacctccctatccccgttccatt

SEQ ID NO: 178366 - DNA, 35 bp, Artificial Sequence
  Synthetic oligonucleotide
tctcgtcgtcctagcccccccccgtgtacccgatt

SEQ ID NO: 178367 - DNA, 35 bp, Artificial Sequence
  Synthetic oligonucleotide
tctcgcccttcgactttcccacgcatctgtacctt

SEQ ID NO: 178368 - DNA, 35 bp, Artificial Sequence
  Synthetic oligonucleotide
acacatgtgcgatccagtttctccccggtatcctt

SEQ ID NO: 178369 - DNA, 35 bp, Artificial Sequence
  Synthetic oligonucleotide
gcatgcggtctcctgtttattgtcatcccttcctt

SEQ ID NO: 178370 - DNA, 35 bp, Artificial Sequence
  Synthetic oligonucleotide
gtgatactctgctccgatcggtccatgctttcctt

SEQ ID NO: 178371 - DNA, 35 bp, Artificial Sequence
  Synthetic oligonucleotide
tccccgccgcctgtatcgctcgcggtatacatctt

SEQ ID NO: 178372 - DNA, 35 bp, Artificial Sequence
  Synthetic oligonucleotide
gtgactgcctctcccgtattaccggttctctcgtt

SEQ ID NO: 178373 - DNA, 35 bp, Artificial Sequence
  Synthetic oligonucleotide
taaggggttggctgggggtgggggggtgataggtt

SEQ ID NO: 178374 - DNA, 36 bp, Artificial Sequence
  Synthetic oligonucleotide
tagagatagtggcgatagggggaagggagcggaaaa

SEQ ID NO: 178375 - DNA, 36 bp, Artificial Sequence
  Synthetic oligonucleotide
tcagtatcgccctccccttacagccccacaggtaaa

SEQ ID NO: 178376 - DNA, 35 bp, Artificial Sequence
  Synthetic oligonucleotide
aagctccgccatttccaacgccctgcctcttgcaa

SEQ ID NO: 178377 - DNA, 36 bp, Artificial Sequence
  Synthetic oligonucleotide
gtcctgccccccgacgtcccataagatatctccgaa

SEQ ID NO: 178378 - DNA, 36 bp, Artificial Sequence
  Synthetic oligonucleotide
gtgggagtcagggagagaagggctgagggtgaataa

SEQ ID NO: 178379 - DNA, 35 bp, Artificial Sequence
  Synthetic oligonucleotide
tccccccggtcgcatctttagataccatcaccaca

SEQ ID NO: 178380 - DNA, 36 bp, Artificial Sequence
  Synthetic oligonucleotide
tccacgccccactacttgcaggtcattgcctccaca

SEQ ID NO: 178381 - DNA, 36 bp, Artificial Sequence
  Synthetic oligonucleotide
tccccacctggaatcagcctataacggtcctgcaca

SEQ ID NO: 178382 - DNA, 36 bp, Artificial Sequence
  Synthetic oligonucleotide
acttgccccgtttgcaactccccacgtccgtttaca

SEQ ID NO: 178383 - DNA, 36 bp, Artificial Sequence
  Synthetic oligonucleotide
gaacatcactgtgtcctgccatgcacacctacacca

SEQ ID NO: 178384 - DNA, 36 bp, Artificial Sequence
  Synthetic oligonucleotide
gccggtaacctgcgatgcactatcctagcctgccca

SEQ ID NO: 178385 - DNA, 36 bp, Artificial Sequence
  Synthetic oligonucleotide
acgtcatccacatttgccgtcacgcctcccgtgcca

SEQ ID NO: 178386 - DNA, 34 bp, Artificial Sequence
  Synthetic oligonucleotide
gcaatcacgtcgtccgcacccccccatcggagca

SEQ ID NO: 178387 - DNA, 36 bp, Artificial Sequence
  Synthetic oligonucleotide
agtgaacgtccacccgtagtccctgtcctggaatca

SEQ ID NO: 178388 - DNA, 37 bp, Artificial Sequence
  Synthetic oligonucleotide
agtgctaccgatccactctgcttactctgttctacga

SEQ ID NO: 178389 - DNA, 36 bp, Artificial Sequence
  Synthetic oligonucleotide
tgccctccttgagttatcacgccgcacatctaccga

SEQ ID NO: 178390 - DNA, 36 bp, Artificial Sequence
  Synthetic oligonucleotide
tctcgcacggtccgtcctttcccatactctcgccga

SEQ ID NO: 178391 - DNA, 36 bp, Artificial Sequence
  Synthetic oligonucleotide
ttcgcatccgctccctcatatgacttcctgtgccga

SEQ ID NO: 178392 - DNA, 37 bp, Artificial Sequence
  Synthetic oligonucleotide
tgagtcgcgaggtaagggtgggataatggtggagcga

SEQ ID NO: 178393 - DNA, 35 bp, Artificial Sequence
  Synthetic oligonucleotide
agttgaaggcgcagggggggaggtgggcgtggcga

SEQ ID NO: 178394 - DNA, 37 bp, Artificial Sequence
  Synthetic oligonucleotide
gccaccgtactttattcgtctccctgaccttcctcga

SEQ ID NO: 178395 - DNA, 37 bp, Artificial Sequence
  Synthetic oligonucleotide
tgcgagcttcttctcccgccccaccgccatctgtcga

SEQ ID NO: 178396 - DNA, 37 bp, Artificial Sequence
  Synthetic oligonucleotide
tctctgccccaccgcacctagagatatcagtcaagga

SEQ ID NO: 178397 - DNA, 37 bp, Artificial Sequence
  Synthetic oligonucleotide
tgagtgggggggaggcatggtggggtagctacgagga

SEQ ID NO: 178398 - DNA, 36 bp, Artificial Sequence
  Synthetic oligonucleotide
gggaggcggtggttaaaagcggatccagctcgggga

SEQ ID NO: 178399 - DNA, 37 bp, Artificial Sequence
  Synthetic oligonucleotide
aaggggcgtatgtcgagggcggggagatatgctggga

SEQ ID NO: 178400 - DNA, 37 bp, Artificial Sequence
  Synthetic oligonucleotide
agaaaggggggccggagtcgggtaggtggggcatgga

SEQ ID NO: 178401 - DNA, 38 bp, Artificial Sequence
  Synthetic oligonucleotide
ggacgagaagggtgtagcagaacgggggagtggaatga

SEQ ID NO: 178402 - DNA, 37 bp, Artificial Sequence
  Synthetic oligonucleotide
gaatccgcaaacttgtcccgctgccccctctccatga

SEQ ID NO: 178403 - DNA, 38 bp, Artificial Sequence
  Synthetic oligonucleotide
tgagggcggaggtaggggggtggatttggacggtatga

SEQ ID NO: 178404 - DNA, 38 bp, Artificial Sequence
  Synthetic oligonucleotide
tgactcctcctatgccttacctttgagccaacacctga

SEQ ID NO: 178405 - DNA, 38 bp, Artificial Sequence
  Synthetic oligonucleotide
ttcactcgccgatcgcctccgcacttctcaaggcctga

SEQ ID NO: 178406 - DNA, 38 bp, Artificial Sequence
  Synthetic oligonucleotide
atgtacccaccatttctgtaagccactcctatgcctga

SEQ ID NO: 178407 - DNA, 37 bp, Artificial Sequence
  Synthetic oligonucleotide
gataccacgacgcccgccgcctctcagactatcctga

SEQ ID NO: 178408 - DNA, 38 bp, Artificial Sequence
  Synthetic oligonucleotide
actcgcggcccgagccctcgccctaccccgtatcctga

SEQ ID NO: 178409 - DNA, 38 bp, Artificial Sequence
  Synthetic oligonucleotide
tctgtgcggaatcatacgtcgtcaactcgccctcctga

SEQ ID NO: 178410 - DNA, 38 bp, Artificial Sequence
  Synthetic oligonucleotide
attggccccatcttatgtctctggttacgctttcctga

SEQ ID NO: 178411 - DNA, 38 bp, Artificial Sequence
  Synthetic oligonucleotide
agaggtacgggaagggaataggggggacgggagagtga

SEQ ID NO: 178412 - DNA, 37 bp, Artificial Sequence
  Synthetic oligonucleotide
gcactcctctccatcgttttgaacatccatcacgtga

SEQ ID NO: 178413 - DNA, 37 bp, Artificial Sequence
  Synthetic oligonucleotide
taatgcgtctgcctctcgtgctgattcccccccgtga

SEQ ID NO: 178414 - DNA, 38 bp, Artificial Sequence
  Synthetic oligonucleotide
gagaggaggtgaggtatgacgcataggggggggcgtga

SEQ ID NO: 178415 - DNA, 38 bp, Artificial Sequence
  Synthetic oligonucleotide
tcacctttctgccccttcaagccacgtcacgctggtga

SEQ ID NO: 178416 - DNA, 38 bp, Artificial Sequence
  Synthetic oligonucleotide
gtcccctcgcctcccagacccgagacgtcgaaacttga

SEQ ID NO: 178417 - DNA, 38 bp, Artificial Sequence
  Synthetic oligonucleotide
gtcacgtatcctgctgccatctttactcctccgtttga

SEQ ID NO: 178418 - DNA, 36 bp, Artificial Sequence
  Synthetic oligonucleotide
tgtcctcatcgttgccatcgtaccattttgcccata

SEQ ID NO: 178419 - DNA, 36 bp, Artificial Sequence
  Synthetic oligonucleotide
actccacacagagctgttcccttggtctccgcacta

SEQ ID NO: 178420 - DNA, 35 bp, Artificial Sequence
  Synthetic oligonucleotide
gtccaccctcattggcgcgctcctccatcttacta

SEQ ID NO: 178421 - DNA, 35 bp, Artificial Sequence
  Synthetic oligonucleotide
tgtggatgtgccaggtcctcccactctatcgccta

SEQ ID NO: 178422 - DNA, 36 bp, Artificial Sequence
  Synthetic oligonucleotide
tccatgtcgtcacttcgtctttctccactacggcta

SEQ ID NO: 178423 - DNA, 36 bp, Artificial Sequence
  Synthetic oligonucleotide
ggatgtcaagcaggcgtggggtacgggcgggaagta

SEQ ID NO: 178424 - DNA, 36 bp, Artificial Sequence
  Synthetic oligonucleotide
tcggggccccactgcgaatatatcccctccctcgta

SEQ ID NO: 178425 - DNA, 35 bp, Artificial Sequence
  Synthetic oligonucleotide
gtcacgccgggcggggggagcagggtctttaggta

SEQ ID NO: 178426 - DNA, 35 bp, Artificial Sequence
  Synthetic oligonucleotide
ggtgagggtgccgggaaagggaggcgccatgggta

SEQ ID NO: 178427 - DNA, 36 bp, Artificial Sequence
  Synthetic oligonucleotide
tccacacatctgttttgattctgccaccccactgta

SEQ ID NO: 178428 - DNA, 36 bp, Artificial Sequence
  Synthetic oligonucleotide
tcctcgcccatcttctgtcacgtgccattctttgta

SEQ ID NO: 178429 - DNA, 36 bp, Artificial Sequence
  Synthetic oligonucleotide
gcttgacgtccgttcttttcgtggccaccgctttta

SEQ ID NO: 178430 - DNA, 35 bp, Artificial Sequence
  Synthetic oligonucleotide
gactccctcccgtatcgttaattcgtaacattaac

SEQ ID NO: 178431 - DNA, 35 bp, Artificial Sequence
  Synthetic oligonucleotide
gtacgccgcccactccagcagctcaggctgaccac

SEQ ID NO: 178432 - DNA, 35 bp, Artificial Sequence
  Synthetic oligonucleotide
tttgcccgccccacgtcctcccgcttggattccac

SEQ ID NO: 178433 - DNA, 35 bp, Artificial Sequence
  Synthetic oligonucleotide
tgcgagcaaccgcccccagcttcgcgcacacatac

SEQ ID NO: 178434 - DNA, 35 bp, Artificial Sequence
  Synthetic oligonucleotide
gatcacctcatgctactctttaacgcacaagctac

SEQ ID NO: 178435 - DNA, 35 bp, Artificial Sequence
  Synthetic oligonucleotide
tacccctccacgcgcaccgccaacactcgccgtac

SEQ ID NO: 178436 - DNA, 35 bp, Artificial Sequence
  Synthetic oligonucleotide
ttagagcgccctagtgaagccgtccttaccccacc

SEQ ID NO: 178437 - DNA, 35 bp, Artificial Sequence
  Synthetic oligonucleotide
gcgagtcgaggccccgcaagcccatgccccttacc

SEQ ID NO: 178438 - DNA, 35 bp, Artificial Sequence
  Synthetic oligonucleotide
gaggccctccagttgctccacggcttattcttacc

SEQ ID NO: 178439 - DNA, 35 bp, Artificial Sequence
  Synthetic oligonucleotide
gttgccatgccatgaccgcaatgtcccgcccaccc

SEQ ID NO: 178440 - DNA, 35 bp, Artificial Sequence
  Synthetic oligonucleotide
gactcacttacgctgggcccactgggttgtccccc

SEQ ID NO: 178441 - DNA, 35 bp, Artificial Sequence
  Synthetic oligonucleotide
gcccgctgtccgatttgtttggctcctttctcccc

SEQ ID NO: 178442 - DNA, 35 bp, Artificial Sequence
  Synthetic oligonucleotide
tgacaagaacgacccgccatttgcctaccacgccc

SEQ ID NO: 178443 - DNA, 35 bp, Artificial Sequence
  Synthetic oligonucleotide
aacctgcaccgtgattcgcagctgtactccggccc

SEQ ID NO: 178444 - DNA, 35 bp, Artificial Sequence
  Synthetic oligonucleotide
agtccgggtccaacatcagaacgcgctcacctccc

SEQ ID NO: 178445 - DNA, 35 bp, Artificial Sequence
  Synthetic oligonucleotide
ttcccgtctgaaatcacacgcgtcctgtctttccc

SEQ ID NO: 178446 - DNA, 35 bp, Artificial Sequence
  Synthetic oligonucleotide
ttgcccctctgccatagtcccggatccgttttccc

SEQ ID NO: 178447 - DNA, 35 bp, Artificial Sequence
  Synthetic oligonucleotide
tcatcatcaggcaagctttcgtgccatcaccagcc

SEQ ID NO: 178448 - DNA, 35 bp, Artificial Sequence
  Synthetic oligonucleotide
taacaccacatctcgcctgccactcaacgcccgcc

SEQ ID NO: 178449 - DNA, 35 bp, Artificial Sequence
  Synthetic oligonucleotide
tcacaatcctcgcattataccctctcacaggggcc

SEQ ID NO: 178450 - DNA, 35 bp, Artificial Sequence
  Synthetic oligonucleotide
ggatgcccgtatgcatccttcctgacataactgcc

SEQ ID NO: 178451 - DNA, 35 bp, Artificial Sequence
  Synthetic oligonucleotide
ccacggtccctattgttgctcgcgcttgtcctgcc

SEQ ID NO: 178452 - DNA, 35 bp, Artificial Sequence
  Synthetic oligonucleotide
gatgcgtcgtccgcttgtccaccctcgcccgtgcc

SEQ ID NO: 178453 - DNA, 35 bp, Artificial Sequence
  Synthetic oligonucleotide
accccatcgccacaccgtcttccgattcctgctcc

SEQ ID NO: 178454 - DNA, 35 bp, Artificial Sequence
  Synthetic oligonucleotide
tgccgaccgccgcgcccacatgtttgctatcttcc

SEQ ID NO: 178455 - DNA, 35 bp, Artificial Sequence
  Synthetic oligonucleotide
acaacaacgcgcccccgcttcataactcccgacgc

SEQ ID NO: 178456 - DNA, 35 bp, Artificial Sequence
  Synthetic oligonucleotide
gtgcgcactatgatttatgtcgaccctcatcccgc

SEQ ID NO: 178457 - DNA, 35 bp, Artificial Sequence
  Synthetic oligonucleotide
gggtggaaaatcgggaagcggaagggcgggaaggc

SEQ ID NO: 178458 - DNA, 35 bp, Artificial Sequence
  Synthetic oligonucleotide
atcccgcctccgtgatatcgcttctattgccaggc

SEQ ID NO: 178459 - DNA, 35 bp, Artificial Sequence
  Synthetic oligonucleotide
gttagggagggaggaaggagtgcagttgagtgggc

SEQ ID NO: 178460 - DNA, 35 bp, Artificial Sequence
  Synthetic oligonucleotide
agacaaccccgcccgcacccagcaggagtagaatc

SEQ ID NO: 178461 - DNA, 35 bp, Artificial Sequence
  Synthetic oligonucleotide
gttgcacctctgttccgtcccctccacgtgccctc

SEQ ID NO: 178462 - DNA, 35 bp, Artificial Sequence
  Synthetic oligonucleotide
gcgttgcgcccttccatcactccgacgcctgcctc

SEQ ID NO: 178463 - DNA, 35 bp, Artificial Sequence
  Synthetic oligonucleotide
acccatcctcccgtcctggtgcgaggtaactcctc

SEQ ID NO: 178464 - DNA, 32 bp, Artificial Sequence
  Synthetic oligonucleotide
actagccggtggtttcgcccggcccacctctc

SEQ ID NO: 178465 - DNA, 35 bp, Artificial Sequence
  Synthetic oligonucleotide
tgtccagaggcaggctcgcgtactgccctcttctc

SEQ ID NO: 178466 - DNA, 35 bp, Artificial Sequence
  Synthetic oligonucleotide
gtatcgccccggtggtagattacctccccgttgtc

SEQ ID NO: 178467 - DNA, 35 bp, Artificial Sequence
  Synthetic oligonucleotide
accgaactgggcctgtgacgtcgtagccattattc

SEQ ID NO: 178468 - DNA, 35 bp, Artificial Sequence
  Synthetic oligonucleotide
gacaggacctgcaactagtgaactccgactccttc

SEQ ID NO: 178469 - DNA, 35 bp, Artificial Sequence
  Synthetic oligonucleotide
acctgcgacgggcccgtcccctatctcggcttttc

SEQ ID NO: 178470 - DNA, 36 bp, Artificial Sequence
  Synthetic oligonucleotide
gcaaaacagggaaggttggagggaatcagtgggcag

SEQ ID NO: 178471 - DNA, 35 bp, Artificial Sequence
  Synthetic oligonucleotide
taacaatccgcacctctccatcctctttgatcgag

SEQ ID NO: 178472 - DNA, 35 bp, Artificial Sequence
  Synthetic oligonucleotide
tcctgatccccatcgattgaagcgcgctccccacg

SEQ ID NO: 178473 - DNA, 35 bp, Artificial Sequence
  Synthetic oligonucleotide
gacccccgccgacccaattctgttcttattctacg

SEQ ID NO: 178474 - DNA, 35 bp, Artificial Sequence
  Synthetic oligonucleotide
gtcccccctccgcccgagataccaacccatgtacg

SEQ ID NO: 178475 - DNA, 35 bp, Artificial Sequence
  Synthetic oligonucleotide
gctgcctctcatttccggcgcctgtcttcctcccg

SEQ ID NO: 178476 - DNA, 35 bp, Artificial Sequence
  Synthetic oligonucleotide
tcatcccaggatcacgtgccaaaaccccctctgcg

SEQ ID NO: 178477 - DNA, 35 bp, Artificial Sequence
  Synthetic oligonucleotide
tgtccgagcctcctgtcactatcgccctctcatcg

SEQ ID NO: 178478 - DNA, 35 bp, Artificial Sequence
  Synthetic oligonucleotide
ggtggggaagagcagaagaggtgaactaggcgtcg

SEQ ID NO: 178479 - DNA, 35 bp, Artificial Sequence
  Synthetic oligonucleotide
accatccaaccgccgcccccggagccctgtgttcg

SEQ ID NO: 178480 - DNA, 34 bp, Artificial Sequence
  Synthetic oligonucleotide
aacccctcccccctctccagacgcctttgagtgg

SEQ ID NO: 178481 - DNA, 35 bp, Artificial Sequence
  Synthetic oligonucleotide
aaacgagggaagcgagggagcgggtgattgacgtg

SEQ ID NO: 178482 - DNA, 35 bp, Artificial Sequence
  Synthetic oligonucleotide
acacgcccagttcaccacttagctccgggtaccat

SEQ ID NO: 178483 - DNA, 35 bp, Artificial Sequence
  Synthetic oligonucleotide
gatgtgaacagccgattgctattgtccgcccccat

SEQ ID NO: 178484 - DNA, 35 bp, Artificial Sequence
  Synthetic oligonucleotide
tttgcgtgctgttagtcaccgtccctcctttgcat

SEQ ID NO: 178485 - DNA, 35 bp, Artificial Sequence
  Synthetic oligonucleotide
acacctgccccctagtgccttacgtccctctttat

SEQ ID NO: 178486 - DNA, 35 bp, Artificial Sequence
  Synthetic oligonucleotide
ttgggtcacggcaattgatttcgctgcccccgcct

SEQ ID NO: 178487 - DNA, 35 bp, Artificial Sequence
  Synthetic oligonucleotide
tacgctcgccccaactgcacactccgcctatcgct

SEQ ID NO: 178488 - DNA, 35 bp, Artificial Sequence
  Synthetic oligonucleotide
gatagccacgctgctacggcgtctaccctccctct

SEQ ID NO: 178489 - DNA, 35 bp, Artificial Sequence
  Synthetic oligonucleotide
gcgcccgccccatcatggttgcttttctcgtaggt

SEQ ID NO: 178490 - DNA, 35 bp, Artificial Sequence
  Synthetic oligonucleotide
gggacgagaagggaatgggtggggaaagcgtgtgt

SEQ ID NO: 178491 - DNA, 35 bp, Artificial Sequence
  Synthetic oligonucleotide
gtatcggcggtattgttactctcgtgtcgcccctt

SEQ ID NO: 178492 - DNA, 35 bp, Artificial Sequence
  Synthetic oligonucleotide
gtcattccccacatcctgccccgtgcacacaagtt

SEQ ID NO: 178493 - DNA, 35 bp, Artificial Sequence
  Synthetic oligonucleotide
gacgatacgctgcctgtttgaaacccgtctccgtt

SEQ ID NO: 178494 - DNA, 35 bp, Artificial Sequence
  Synthetic oligonucleotide
tttcgcggaactcttctcccctcatccgtggtgtt

SEQ ID NO: 178495 - DNA, 35 bp, Artificial Sequence
  Synthetic oligonucleotide
acaggcctctgcgccccagcccgcccctatgattt

SEQ ID NO: 178496 - DNA, 35 bp, Artificial Sequence
  Synthetic oligonucleotide
tctcgcacaatccgttgtcacactccccgactttt

SEQ ID NO: 178497 - DNA, 36 bp, Artificial Sequence
  Synthetic oligonucleotide
gtcgctgagtcacggggggggttgacggcgggaaaa

SEQ ID NO: 178498 - DNA, 35 bp, Artificial Sequence
  Synthetic oligonucleotide
accttatgcctccacttgtaacatccacctctgaa

SEQ ID NO: 178499 - DNA, 35 bp, Artificial Sequence
  Synthetic oligonucleotide
gggggtggggggagtggggttgtaaatcgtggtaa

SEQ ID NO: 178500 - DNA, 35 bp, Artificial Sequence
  Synthetic oligonucleotide
tcctcgccctctacacgccatctatgatgcgacca

SEQ ID NO: 178501 - DNA, 35 bp, Artificial Sequence
  Synthetic oligonucleotide
tatacccccgcccacaatggacgtttcttggacca

SEQ ID NO: 178502 - DNA, 35 bp, Artificial Sequence
  Synthetic oligonucleotide
aatgcacgctcattctcatattttgcgttatccca

SEQ ID NO: 178503 - DNA, 35 bp, Artificial Sequence
  Synthetic oligonucleotide
gtcccccccacaattgtttatcgcgcgtaactcca

SEQ ID NO: 178504 - DNA, 35 bp, Artificial Sequence
  Synthetic oligonucleotide
ggtccccccccgttgagccctggtcagcctttcca

SEQ ID NO: 178505 - DNA, 36 bp, Artificial Sequence
  Synthetic oligonucleotide
aacaacctcccgccatggttctcgttccatccagca

SEQ ID NO: 178506 - DNA, 35 bp, Artificial Sequence
  Synthetic oligonucleotide
agacccctctccgcacctgtggtccagatctatca

SEQ ID NO: 178507 - DNA, 36 bp, Artificial Sequence
  Synthetic oligonucleotide
tcagcctcgacgcccttctaacatgctggttgttca

SEQ ID NO: 178508 - DNA, 36 bp, Artificial Sequence
  Synthetic oligonucleotide
tggaggatcggtgccgttttatgtttccccctttca

SEQ ID NO: 178509 - DNA, 37 bp, Artificial Sequence
  Synthetic oligonucleotide
agtgcgtgagggaatgaggggcgggttagctaggaga

SEQ ID NO: 178510 - DNA, 37 bp, Artificial Sequence
  Synthetic oligonucleotide
aggggcggggtgcggggtacgggaagaagggactaga

SEQ ID NO: 178511 - DNA, 37 bp, Artificial Sequence
  Synthetic oligonucleotide
tttgcaatcactgctgttccctggttaaccacaccga

SEQ ID NO: 178512 - DNA, 37 bp, Artificial Sequence
  Synthetic oligonucleotide
tcaggacgtactgactctgatttcccgcgacccccga

SEQ ID NO: 178513 - DNA, 37 bp, Artificial Sequence
  Synthetic oligonucleotide
gtgcctggtcttgtttcgcgtccgttcttatccccga

SEQ ID NO: 178514 - DNA, 37 bp, Artificial Sequence
  Synthetic oligonucleotide
tccatcctccgagccgtatcaattgaaaatctcccga

SEQ ID NO: 178515 - DNA, 37 bp, Artificial Sequence
  Synthetic oligonucleotide
atccgactgccctcggcaatatttacgctctctccga

SEQ ID NO: 178516 - DNA, 37 bp, Artificial Sequence
  Synthetic oligonucleotide
acgacgcgactagcgggggacttgggaaggaaggcga

SEQ ID NO: 178517 - DNA, 36 bp, Artificial Sequence
  Synthetic oligonucleotide
tcactcctcctgttcgcagtatccctcctctatcga

SEQ ID NO: 178518 - DNA, 37 bp, Artificial Sequence
  Synthetic oligonucleotide
tcagagatcggccgtagtaatttcgtccctgcctcga

SEQ ID NO: 178519 - DNA, 37 bp, Artificial Sequence
  Synthetic oligonucleotide
gtcccgtccacctatgctatctggccatctgtttcga

SEQ ID NO: 178520 - DNA, 37 bp, Artificial Sequence
  Synthetic oligonucleotide
tgctgtccccattgttctcctccgttcctggacagga

SEQ ID NO: 178521 - DNA, 35 bp, Artificial Sequence
  Synthetic oligonucleotide
gatgcaagcagcaagggagtggggggaggcgagga

SEQ ID NO: 178522 - DNA, 37 bp, Artificial Sequence
  Synthetic oligonucleotide
ggaaggctcagtgaaggggggcgggcggctaggcgga

SEQ ID NO: 178523 - DNA, 37 bp, Artificial Sequence
  Synthetic oligonucleotide
agttgaggaggaatgggaggccgggcttagggaggga

SEQ ID NO: 178524 - DNA, 37 bp, Artificial Sequence
  Synthetic oligonucleotide
tgggagggggctagggcaacacgggtgcggggaggga

SEQ ID NO: 178525 - DNA, 37 bp, Artificial Sequence
  Synthetic oligonucleotide
atgcagggttgagggtcggggctgggggtggtaggga

SEQ ID NO: 178526 - DNA, 37 bp, Artificial Sequence
  Synthetic oligonucleotide
tgtatcacgtgtgaaatggggggaaggagagggtgga

SEQ ID NO: 178527 - DNA, 38 bp, Artificial Sequence
  Synthetic oligonucleotide
aaccgtatcggggaaggggaagggggggaccgtgatga

SEQ ID NO: 178528 - DNA, 37 bp, Artificial Sequence
  Synthetic oligonucleotide
tccgaacccccgattacgccccagtccttcactatga

SEQ ID NO: 178529 - DNA, 37 bp, Artificial Sequence
  Synthetic oligonucleotide
acacatgcgatactatactacctatgccccctagtga

SEQ ID NO: 178530 - DNA, 38 bp, Artificial Sequence
  Synthetic oligonucleotide
agccccgcccgaccgtcccatacctctgcgcctcgtga

SEQ ID NO: 178531 - DNA, 38 bp, Artificial Sequence
  Synthetic oligonucleotide
aacctcccgtacactcgcatagccatcacccttcgtga

SEQ ID NO: 178532 - DNA, 38 bp, Artificial Sequence
  Synthetic oligonucleotide
agcgggaagaaaggcgggaatagaggcgggcaaggtga

SEQ ID NO: 178533 - DNA, 38 bp, Artificial Sequence
  Synthetic oligonucleotide
tatcagggagggagtgggagggagtgctcgcgctgtga

SEQ ID NO: 178534 - DNA, 36 bp, Artificial Sequence
  Synthetic oligonucleotide
acacccacccgatgctaactgtttgttttcccttga

SEQ ID NO: 178535 - DNA, 37 bp, Artificial Sequence
  Synthetic oligonucleotide
gcgcgatacgccatcgtagtactgcatccctccttga

SEQ ID NO: 178536 - DNA, 38 bp, Artificial Sequence
  Synthetic oligonucleotide
accgccacccatcctgatcttaacgtgccctcgcttga

SEQ ID NO: 178537 - DNA, 38 bp, Artificial Sequence
  Synthetic oligonucleotide
gagactgggtggggtgggaagaggttgaatggcgttga

SEQ ID NO: 178538 - DNA, 36 bp, Artificial Sequence
  Synthetic oligonucleotide
gcaagacgggaactggggaaaggtggtagaatttga

SEQ ID NO: 178539 - DNA, 38 bp, Artificial Sequence
  Synthetic oligonucleotide
tggacgacgccctactgcactgcgcccctgccatttga

SEQ ID NO: 178540 - DNA, 37 bp, Artificial Sequence
  Synthetic oligonucleotide
tgcacgcgccgttccatgtcgcctccaccatgtttga

SEQ ID NO: 178541 - DNA, 38 bp, Artificial Sequence
  Synthetic oligonucleotide
actgctcacgcacgctctcccccggccaccctgtttga

SEQ ID NO: 178542 - DNA, 35 bp, Artificial Sequence
  Synthetic oligonucleotide
ggggggtatgggtgtgggtgggatggtgcgtgata

SEQ ID NO: 178543 - DNA, 36 bp, Artificial Sequence
  Synthetic oligonucleotide
aacccggcacacctctcggccccgctatagccacta

SEQ ID NO: 178544 - DNA, 36 bp, Artificial Sequence
  Synthetic oligonucleotide
tcaccgccaacccgtggcctggacctttaccaccta

SEQ ID NO: 178545 - DNA, 36 bp, Artificial Sequence
  Synthetic oligonucleotide
ttccgatatcgcacattctatccacggttgttccta

SEQ ID NO: 178546 - DNA, 36 bp, Artificial Sequence
  Synthetic oligonucleotide
acccgtcgccttacccaaggatccactcacctgcta

SEQ ID NO: 178547 - DNA, 36 bp, Artificial Sequence
  Synthetic oligonucleotide
tcgtgcatcacgtaccatcgaccttttgcctactta

SEQ ID NO: 178548 - DNA, 36 bp, Artificial Sequence
  Synthetic oligonucleotide
gtgggggtatgaagcggagggggagagaaagcgtta

SEQ ID NO: 178549 - DNA, 36 bp, Artificial Sequence
  Synthetic oligonucleotide
actcacccgatgcatgaactgtgctcacgtttgtta

SEQ ID NO: 178550 - DNA, 36 bp, Artificial Sequence
  Synthetic oligonucleotide
acccgcctatagcagcatctgtcgcccaccctttta

SEQ ID NO: 178551 - DNA, 35 bp, Artificial Sequence
  Synthetic oligonucleotide
tcacgtgataaggggggaagtagaagagcggaaac

SEQ ID NO: 178552 - DNA, 35 bp, Artificial Sequence
  Synthetic oligonucleotide
aacagtcaccccgtcgccgcttacaccgctttaac

SEQ ID NO: 178553 - DNA, 35 bp, Artificial Sequence
  Synthetic oligonucleotide
ttccactcactcgctcccgtacggtgtcacccgac

SEQ ID NO: 178554 - DNA, 35 bp, Artificial Sequence
  Synthetic oligonucleotide
tcccatatctatgtcgtcatctagcccgttccgac

SEQ ID NO: 178555 - DNA, 35 bp, Artificial Sequence
  Synthetic oligonucleotide
gtcgcccccatccttgccaatgccttcagactgac

SEQ ID NO: 178556 - DNA, 35 bp, Artificial Sequence
  Synthetic oligonucleotide
gcccccacgcaattccgacattgttcttacattac

SEQ ID NO: 178557 - DNA, 35 bp, Artificial Sequence
  Synthetic oligonucleotide
ttggtgtaggcccctctgttgaacgcccccattac

SEQ ID NO: 178558 - DNA, 35 bp, Artificial Sequence
  Synthetic oligonucleotide
gcacctccatgctagttctaaggtttctgtccccc

SEQ ID NO: 178559 - DNA, 35 bp, Artificial Sequence
  Synthetic oligonucleotide
agacgtcgaaccatgccgagccacccattagcccc

SEQ ID NO: 178560 - DNA, 35 bp, Artificial Sequence
  Synthetic oligonucleotide
tgacgagacgccacatccgagtgacctcgcgcccc

SEQ ID NO: 178561 - DNA, 35 bp, Artificial Sequence
  Synthetic oligonucleotide
gatctgtgcgccttcccaaagttgattttgtcccc

SEQ ID NO: 178562 - DNA, 35 bp, Artificial Sequence
  Synthetic oligonucleotide
tgcaactgtagcctccccatacacgagtatagccc

SEQ ID NO: 178563 - DNA, 35 bp, Artificial Sequence
  Synthetic oligonucleotide
ttccaccatcccagtccttgtccattgtggtagcc

SEQ ID NO: 178564 - DNA, 35 bp, Artificial Sequence
  Synthetic oligonucleotide
accctcgcccggagctccttaggcggttcacatcc

SEQ ID NO: 178565 - DNA, 35 bp, Artificial Sequence
  Synthetic oligonucleotide
acggtgctccctgtcgcgcttctacattcgcctcc

SEQ ID NO: 178566 - DNA, 35 bp, Artificial Sequence
  Synthetic oligonucleotide
gtcaccacccgcggcaccgtacggttcggctctcc

SEQ ID NO: 178567 - DNA, 35 bp, Artificial Sequence
  Synthetic oligonucleotide
ttgcccacggcggtacagagtcgcccgccttctcc

SEQ ID NO: 178568 - DNA, 35 bp, Artificial Sequence
  Synthetic oligonucleotide
gcgatgccatccctgcttccactcatgtcgtttcc

SEQ ID NO: 178569 - DNA, 35 bp, Artificial Sequence
  Synthetic oligonucleotide
atgctcgcgaaagcctcatcccccgcccgtctagc

SEQ ID NO: 178570 - DNA, 35 bp, Artificial Sequence
  Synthetic oligonucleotide
ccacctccacgtgaggtttaaacgattccacccgc

SEQ ID NO: 178571 - DNA, 35 bp, Artificial Sequence
  Synthetic oligonucleotide
tacaccaaacagttcgtttatctttactcgcccgc

SEQ ID NO: 178572 - DNA, 35 bp, Artificial Sequence
  Synthetic oligonucleotide
ggagtgccctgccaaacggtgccttgtcctcccgc

SEQ ID NO: 178573 - DNA, 35 bp, Artificial Sequence
  Synthetic oligonucleotide
tccttctacccgcttatataccgtcgccgtcgcgc

SEQ ID NO: 178574 - DNA, 35 bp, Artificial Sequence
  Synthetic oligonucleotide
ttagagtccccctgctgcgtattctcccctggcgc

SEQ ID NO: 178575 - DNA, 35 bp, Artificial Sequence
  Synthetic oligonucleotide
tgagacatcacgatccttgctcccccgtgtttcgc

SEQ ID NO: 178576 - DNA, 35 bp, Artificial Sequence
  Synthetic oligonucleotide
tcccacaggtgcggaggagggggtggtcatggggc

SEQ ID NO: 178577 - DNA, 35 bp, Artificial Sequence
  Synthetic oligonucleotide
agtccatgcagcagggccctctacttccatcgtgc

SEQ ID NO: 178578 - DNA, 35 bp, Artificial Sequence
  Synthetic oligonucleotide
gttcccgttatcgcgccttacggttatgaccgctc

SEQ ID NO: 178579 - DNA, 35 bp, Artificial Sequence
  Synthetic oligonucleotide
atgagtggaggggaggaggggacatcgctgggctc

SEQ ID NO: 178580 - DNA, 35 bp, Artificial Sequence
  Synthetic oligonucleotide
agtacccaccgccccataaaaagctcctttggttc

SEQ ID NO: 178581 - DNA, 35 bp, Artificial Sequence
  Synthetic oligonucleotide
gtgctgccctcccgtggttcttattctcgcctttc

SEQ ID NO: 178582 - DNA, 35 bp, Artificial Sequence
  Synthetic oligonucleotide
gcattcccatcgtgccacggcctcaaactgttttc

SEQ ID NO: 178583 - DNA, 35 bp, Artificial Sequence
  Synthetic oligonucleotide
acatctccgcccacccgaggctgtcttaacgacag

SEQ ID NO: 178584 - DNA, 35 bp, Artificial Sequence
  Synthetic oligonucleotide
agtggtggtagggaagcgggaataagtcatagcag

SEQ ID NO: 178585 - DNA, 35 bp, Artificial Sequence
  Synthetic oligonucleotide
tcaaacctcaatgtccctcccgcctatcgttcgag

SEQ ID NO: 178586 - DNA, 35 bp, Artificial Sequence
  Synthetic oligonucleotide
ggtggaacgggcgggggtgacaaagtgcttcgtag

SEQ ID NO: 178587 - DNA, 35 bp, Artificial Sequence
  Synthetic oligonucleotide
tccctgccggccccgttacttccgatcctgatacg

SEQ ID NO: 178588 - DNA, 35 bp, Artificial Sequence
  Synthetic oligonucleotide
agaccctgccctctgtacccggagtccttatatcg

SEQ ID NO: 178589 - DNA, 35 bp, Artificial Sequence
  Synthetic oligonucleotide
cgccgcacaacattggtctctcgtagctcttctcg

SEQ ID NO: 178590 - DNA, 35 bp, Artificial Sequence
  Synthetic oligonucleotide
gtatccttgcacgtcacaagccctcaaccccttcg

SEQ ID NO: 178591 - DNA, 35 bp, Artificial Sequence
  Synthetic oligonucleotide
gcctggagccccgtttcctccgattaaattgttcg

SEQ ID NO: 178592 - DNA, 35 bp, Artificial Sequence
  Synthetic oligonucleotide
agtgagcaacaaagaggggcaacgatggagggagg

SEQ ID NO: 178593 - DNA, 36 bp, Artificial Sequence
  Synthetic oligonucleotide
ggaaccgtgtatggagggaggggagggagcgatagg

SEQ ID NO: 178594 - DNA, 35 bp, Artificial Sequence
  Synthetic oligonucleotide
ttccgttcactcgttgccctgcccttcaattccgg

SEQ ID NO: 178595 - DNA, 35 bp, Artificial Sequence
  Synthetic oligonucleotide
tccaacccccagcggcagttcatgccactccacat

SEQ ID NO: 178596 - DNA, 35 bp, Artificial Sequence
  Synthetic oligonucleotide
tcatcctgaagcccgcccccattcgccccgcacat

SEQ ID NO: 178597 - DNA, 35 bp, Artificial Sequence
  Synthetic oligonucleotide
gttgctaccctttccgcctgtcccgtcttttccat

SEQ ID NO: 178598 - DNA, 35 bp, Artificial Sequence
  Synthetic oligonucleotide
gaaccatccacaacctgtacaactgattttttcat

SEQ ID NO: 178599 - DNA, 35 bp, Artificial Sequence
  Synthetic oligonucleotide
tctcgttcctctgccgatataggctcctatccgat

SEQ ID NO: 178600 - DNA, 35 bp, Artificial Sequence
  Synthetic oligonucleotide
tcctcccgccctcatgagtcttcaacgtacgtact

SEQ ID NO: 178601 - DNA, 35 bp, Artificial Sequence
  Synthetic oligonucleotide
agtgccatgccctgtaagggtagtttcgcccccct

SEQ ID NO: 178602 - DNA, 35 bp, Artificial Sequence
  Synthetic oligonucleotide
gacacaggtcctcttgacgataacatttctcccct

SEQ ID NO: 178603 - DNA, 35 bp, Artificial Sequence
  Synthetic oligonucleotide
gccgtacggcctgggaccccgtccttccttttcct

SEQ ID NO: 178604 - DNA, 35 bp, Artificial Sequence
  Synthetic oligonucleotide
tgtttcccgcctaccacttgttgccatttgtcgct

SEQ ID NO: 178605 - DNA, 35 bp, Artificial Sequence
  Synthetic oligonucleotide
ttctcacccgtttttgttcgtcaaaggctcactct

SEQ ID NO: 178606 - DNA, 35 bp, Artificial Sequence
  Synthetic oligonucleotide
tcctgtcgcgtcgcccatttcttctcgcgcgctct

SEQ ID NO: 178607 - DNA, 35 bp, Artificial Sequence
  Synthetic oligonucleotide
attgcacgacgctggcctatccatccttacccagt

SEQ ID NO: 178608 - DNA, 35 bp, Artificial Sequence
  Synthetic oligonucleotide
tgcggaagggagggcgggctagggcaaaaaagggt

SEQ ID NO: 178609 - DNA, 35 bp, Artificial Sequence
  Synthetic oligonucleotide
acacctcgatgctccattaccctgcctcctctggt

SEQ ID NO: 178610 - DNA, 35 bp, Artificial Sequence
  Synthetic oligonucleotide
tagggaggggaaagagtagggcgggacattaattt

SEQ ID NO: 178611 - DNA, 36 bp, Artificial Sequence
  Synthetic oligonucleotide
atttgcctccgccccgatacaccagccatcctcaaa

SEQ ID NO: 178612 - DNA, 36 bp, Artificial Sequence
  Synthetic oligonucleotide
gcctccccgacgccttgtaaattctcgacccgccaa

SEQ ID NO: 178613 - DNA, 36 bp, Artificial Sequence
  Synthetic oligonucleotide
tcccgtgagcggggggggaaggggaaacggtgtcaa

SEQ ID NO: 178614 - DNA, 35 bp, Artificial Sequence
  Synthetic oligonucleotide
gtgctagggggagggaggtatagaacagggacgaa

SEQ ID NO: 178615 - DNA, 36 bp, Artificial Sequence
  Synthetic oligonucleotide
tccccacccccgacctcacggacctcctgttgataa

SEQ ID NO: 178616 - DNA, 35 bp, Artificial Sequence
  Synthetic oligonucleotide
gcacacagtgcgccgccccccatcaactactttaa

SEQ ID NO: 178617 - DNA, 35 bp, Artificial Sequence
  Synthetic oligonucleotide
gagccgcgatcaatcccgccacccgtccatcaaca

SEQ ID NO: 178618 - DNA, 35 bp, Artificial Sequence
  Synthetic oligonucleotide
gataggggtaaaagggcatacggggggatagaaca

SEQ ID NO: 178619 - DNA, 34 bp, Artificial Sequence
  Synthetic oligonucleotide
tagacccgacccttcgcccgatctccgtgtaaca

SEQ ID NO: 178620 - DNA, 36 bp, Artificial Sequence
  Synthetic oligonucleotide
attcacacccgcgattgttcatatcgtcccgtacca

SEQ ID NO: 178621 - DNA, 35 bp, Artificial Sequence
  Synthetic oligonucleotide
tactgtcacagtggttcgcacctacttttctccca

SEQ ID NO: 178622 - DNA, 35 bp, Artificial Sequence
  Synthetic oligonucleotide
actgtcgccccaaaatacaatatacttcttcgcca

SEQ ID NO: 178623 - DNA, 36 bp, Artificial Sequence
  Synthetic oligonucleotide
gtgccccattcccaggtcgtcttcaaacacgttcca

SEQ ID NO: 178624 - DNA, 36 bp, Artificial Sequence
  Synthetic oligonucleotide
atcgcctgccgcctgaccacccaacagccattcgca

SEQ ID NO: 178625 - DNA, 35 bp, Artificial Sequence
  Synthetic oligonucleotide
tcctccgcaccataccgttgataactgtccaggca

SEQ ID NO: 178626 - DNA, 35 bp, Artificial Sequence
  Synthetic oligonucleotide
gtcctgccgagctcgcccctctcggacatctctca

SEQ ID NO: 178627 - DNA, 35 bp, Artificial Sequence
  Synthetic oligonucleotide
tgtacaccacatcacggtcgatatttcttgtttca

SEQ ID NO: 178628 - DNA, 37 bp, Artificial Sequence
  Synthetic oligonucleotide
atgcatgagggtgggagataacatagcggggggaaga

SEQ ID NO: 178629 - DNA, 37 bp, Artificial Sequence
  Synthetic oligonucleotide
actgcagggggggcggggagtggaaggtactgtaaga

SEQ ID NO: 178630 - DNA, 36 bp, Artificial Sequence
  Synthetic oligonucleotide
ggtggggggggaggggcatagatacgagcgcagaga

SEQ ID NO: 178631 - DNA, 37 bp, Artificial Sequence
  Synthetic oligonucleotide
acccccgcctctgcgcccacaaacttgccctttgaga

SEQ ID NO: 178632 - DNA, 36 bp, Artificial Sequence
  Synthetic oligonucleotide
tccacctgacatcaccgcagtatcgaacaccttaga

SEQ ID NO: 178633 - DNA, 37 bp, Artificial Sequence
  Synthetic oligonucleotide
cccccacgccctcgctgattttaacttgccttcccga

SEQ ID NO: 178634 - DNA, 37 bp, Artificial Sequence
  Synthetic oligonucleotide
tgagccactcattgtatcttacttgcacctcttccga

SEQ ID NO: 178635 - DNA, 37 bp, Artificial Sequence
  Synthetic oligonucleotide
tgcctccccttgccagtatctgttgcacaccactcga

SEQ ID NO: 178636 - DNA, 37 bp, Artificial Sequence
  Synthetic oligonucleotide
atgcggtgggtccaagagggaggggggactggcagga

SEQ ID NO: 178637 - DNA, 36 bp, Artificial Sequence
  Synthetic oligonucleotide
tgtatcgcggtgcacccgggtaagggagggcgggga

SEQ ID NO: 178638 - DNA, 36 bp, Artificial Sequence
  Synthetic oligonucleotide
tagaacagcctcctccatatatatgctctctctgga

SEQ ID NO: 178639 - DNA, 37 bp, Artificial Sequence
  Synthetic oligonucleotide
tccggtgggcgggacttgggagaagggacgggaatga

SEQ ID NO: 178640 - DNA, 38 bp, Artificial Sequence
  Synthetic oligonucleotide
gtcccatggcccgatgatatctctacgcctcccactga

SEQ ID NO: 178641 - DNA, 38 bp, Artificial Sequence
  Synthetic oligonucleotide
ggaacgggtggaagcgtgtggaggggacgggaggctga

SEQ ID NO: 178642 - DNA, 37 bp, Artificial Sequence
  Synthetic oligonucleotide
gtggacggagcaggaaaagaacgggcagaacggctga

SEQ ID NO: 178643 - DNA, 38 bp, Artificial Sequence
  Synthetic oligonucleotide
tgcactcatatgtgttttatcttccctccctcttgtga

SEQ ID NO: 178644 - DNA, 38 bp, Artificial Sequence
  Synthetic oligonucleotide
gttgttgcgctcagacccaccgttcctccccatgttga

SEQ ID NO: 178645 - DNA, 38 bp, Artificial Sequence
  Synthetic oligonucleotide
attcctccgtcctatcgccatagttccatctcatttga

SEQ ID NO: 178646 - DNA, 38 bp, Artificial Sequence
  Synthetic oligonucleotide
tccgtgcaacgcttgcctccactgcgccgcctttttga

SEQ ID NO: 178647 - DNA, 36 bp, Artificial Sequence
  Synthetic oligonucleotide
gaatcgggggaggatacggttaaggcggcgggaata

SEQ ID NO: 178648 - DNA, 35 bp, Artificial Sequence
  Synthetic oligonucleotide
tcagagatgcaacgtggtaggggaggggcggctta

SEQ ID NO: 178649 - DNA, 35 bp, Artificial Sequence
  Synthetic oligonucleotide
gtgccgtttacgggggggatcaatgggtagggaac

SEQ ID NO: 178650 - DNA, 35 bp, Artificial Sequence
  Synthetic oligonucleotide
gaagttcgctttgcatatgctccccctgccttaac

SEQ ID NO: 178651 - DNA, 35 bp, Artificial Sequence
  Synthetic oligonucleotide
cctgcctgccgagtgccgtttcccgtttttcctac

SEQ ID NO: 178652 - DNA, 35 bp, Artificial Sequence
  Synthetic oligonucleotide
gtccatactccccgtgcatcgcctcctggggctac

SEQ ID NO: 178653 - DNA, 35 bp, Artificial Sequence
  Synthetic oligonucleotide
gtttagcacatcgtgtttgctgtgccaccctctac

SEQ ID NO: 178654 - DNA, 35 bp, Artificial Sequence
  Synthetic oligonucleotide
tccctgcaccggcccttctcttgcgctactagtac

SEQ ID NO: 178655 - DNA, 35 bp, Artificial Sequence
  Synthetic oligonucleotide
tgatgcaccgcattcgttagcaaccgcttccaacc

SEQ ID NO: 178656 - DNA, 35 bp, Artificial Sequence
  Synthetic oligonucleotide
tgcccatcccactgtaaagctcgggcacctgcccc

SEQ ID NO: 178657 - DNA, 35 bp, Artificial Sequence
  Synthetic oligonucleotide
tgccgtgccaccatttatcggccctatcagtgccc

SEQ ID NO: 178658 - DNA, 35 bp, Artificial Sequence
  Synthetic oligonucleotide
taccccacccgctcaagtatgcgctcaactaagcc

SEQ ID NO: 178659 - DNA, 35 bp, Artificial Sequence
  Synthetic oligonucleotide
tcatcggtcgctcacaagcagacacctccctcgcc

SEQ ID NO: 178660 - DNA, 34 bp, Artificial Sequence
  Synthetic oligonucleotide
gcaaacccacgctatccgctctgcctctatggcc

SEQ ID NO: 178661 - DNA, 35 bp, Artificial Sequence
  Synthetic oligonucleotide
gtccatcgtctcggaccgaacctgctgccatatcc

SEQ ID NO: 178662 - DNA, 35 bp, Artificial Sequence
  Synthetic oligonucleotide
agttcacgtcattccattctctatcatgaccctcc

SEQ ID NO: 178663 - DNA, 35 bp, Artificial Sequence
  Synthetic oligonucleotide
ttatgcccccgttcatctccgtttcctagctgtcc

SEQ ID NO: 178664 - DNA, 35 bp, Artificial Sequence
  Synthetic oligonucleotide
gcccgaccagtggccgccccttccggcatttgtcc

SEQ ID NO: 178665 - DNA, 35 bp, Artificial Sequence
  Synthetic oligonucleotide
gacttcccccagtgatacttgcactttctgcttcc

SEQ ID NO: 178666 - DNA, 34 bp, Artificial Sequence
  Synthetic oligonucleotide
ttcgccgccccattgcttgttcaatccgtcttcc

SEQ ID NO: 178667 - DNA, 35 bp, Artificial Sequence
  Synthetic oligonucleotide
atcgccccccaacatggccccctagtcctcggcgc

SEQ ID NO: 178668 - DNA, 35 bp, Artificial Sequence
  Synthetic oligonucleotide
tcccgtcgtcctcagtccaacgcctgcctacctgc

SEQ ID NO: 178669 - DNA, 35 bp, Artificial Sequence
  Synthetic oligonucleotide
gtgacttgctcatgactaatttgtcgctctcctgc

SEQ ID NO: 178670 - DNA, 35 bp, Artificial Sequence
  Synthetic oligonucleotide
tgttactatgtcccgtgctcctcctacgcctctgc

SEQ ID NO: 178671 - DNA, 35 bp, Artificial Sequence
  Synthetic oligonucleotide
aaaccatgtacccctcctccgcgcctgccacttgc

SEQ ID NO: 178672 - DNA, 35 bp, Artificial Sequence
  Synthetic oligonucleotide
gctatgctccactcacattatggtactgtcccatc

SEQ ID NO: 178673 - DNA, 32 bp, Artificial Sequence
  Synthetic oligonucleotide
taacccctcagccccatttttgtctgtgcatc

SEQ ID NO: 178674 - DNA, 35 bp, Artificial Sequence
  Synthetic oligonucleotide
ggtgcctgccgacttgtcgctcctttaggcctatc

SEQ ID NO: 178675 - DNA, 35 bp, Artificial Sequence
  Synthetic oligonucleotide
tcccctccaggcttcagacgttccgcatctgcctc

SEQ ID NO: 178676 - DNA, 35 bp, Artificial Sequence
  Synthetic oligonucleotide
acgcaacctctatcaatactcctgttccccgggtc

SEQ ID NO: 178677 - DNA, 35 bp, Artificial Sequence
  Synthetic oligonucleotide
tcatcaatcccactgctataagtacctgctgattc

SEQ ID NO: 178678 - DNA, 35 bp, Artificial Sequence
  Synthetic oligonucleotide
tgcacgctcctgcgccatccatagccacatgcttc

SEQ ID NO: 178679 - DNA, 35 bp, Artificial Sequence
  Synthetic oligonucleotide
tgtcacgtggccgtcctcccgttgaaatctcgttc

SEQ ID NO: 178680 - DNA, 35 bp, Artificial Sequence
  Synthetic oligonucleotide
tcctgaggtcccagatgttgccctcacaccgtttc

SEQ ID NO: 178681 - DNA, 35 bp, Artificial Sequence
  Synthetic oligonucleotide
tcgacacccgctggctcattaatgccctccccgag

SEQ ID NO: 178682 - DNA, 35 bp, Artificial Sequence
  Synthetic oligonucleotide
gtgggcatgaggattgggtggaggggcaagtggag

SEQ ID NO: 178683 - DNA, 35 bp, Artificial Sequence
  Synthetic oligonucleotide
gaagcgaacacacgcacccccgctctctctcatag

SEQ ID NO: 178684 - DNA, 35 bp, Artificial Sequence
  Synthetic oligonucleotide
tctgttgccgccaatcaagtcttgccctatctccg

SEQ ID NO: 178685 - DNA, 35 bp, Artificial Sequence
  Synthetic oligonucleotide
gttgctgcctttggaaaccggtccccccctttagg

SEQ ID NO: 178686 - DNA, 35 bp, Artificial Sequence
  Synthetic oligonucleotide
aactgagccagttatcgggtggggcgggacgaggg

SEQ ID NO: 178687 - DNA, 35 bp, Artificial Sequence
  Synthetic oligonucleotide
tgggaggggacagggaatcagcagggtaagggggg

SEQ ID NO: 178688 - DNA, 35 bp, Artificial Sequence
  Synthetic oligonucleotide
tgggccccgcccgttacccctctcactaaagctgg

SEQ ID NO: 178689 - DNA, 35 bp, Artificial Sequence
  Synthetic oligonucleotide
gcccgctatttcgcacgctgcttctccacaccctg

SEQ ID NO: 178690 - DNA, 35 bp, Artificial Sequence
  Synthetic oligonucleotide
ttccccgcccaccttattgtacgacttagttcctg

SEQ ID NO: 178691 - DNA, 35 bp, Artificial Sequence
  Synthetic oligonucleotide
taccccgccttgcccattgtttgcatagtcaccat

SEQ ID NO: 178692 - DNA, 35 bp, Artificial Sequence
  Synthetic oligonucleotide
tccgttcccgtgcttatacggctcacttccttact

SEQ ID NO: 178693 - DNA, 35 bp, Artificial Sequence
  Synthetic oligonucleotide
tccgacctccaggcacattgagttccccgtttact

SEQ ID NO: 178694 - DNA, 35 bp, Artificial Sequence
  Synthetic oligonucleotide
aacagggcgaacaactgctcgtacatgctttacct

SEQ ID NO: 178695 - DNA, 35 bp, Artificial Sequence
  Synthetic oligonucleotide
tatgcttcagcgctctacaaatgctgccttgccct

SEQ ID NO: 178696 - DNA, 35 bp, Artificial Sequence
  Synthetic oligonucleotide
acagcattcaccgccctcgtgctcccttcgggcct

SEQ ID NO: 178697 - DNA, 35 bp, Artificial Sequence
  Synthetic oligonucleotide
atgctcgggggggaaagggagtaacatttgggcct

SEQ ID NO: 178698 - DNA, 35 bp, Artificial Sequence
  Synthetic oligonucleotide
tgatgcccacgtttgctcatttcgtgtacgttcct

SEQ ID NO: 178699 - DNA, 35 bp, Artificial Sequence
  Synthetic oligonucleotide
tgcttggccgccccgctctctcttcagtgctgtct

SEQ ID NO: 178700 - DNA, 35 bp, Artificial Sequence
  Synthetic oligonucleotide
accccactcccccctgatactaggctttcacttct

SEQ ID NO: 178701 - DNA, 35 bp, Artificial Sequence
  Synthetic oligonucleotide
gtaggggacggtgagttctaaagggcaaggggagt

SEQ ID NO: 178702 - DNA, 35 bp, Artificial Sequence
  Synthetic oligonucleotide
gtactccatgctgaccgcccctccgttctcaccgt

SEQ ID NO: 178703 - DNA, 35 bp, Artificial Sequence
  Synthetic oligonucleotide
gtatccgtcagccatcgttcatatattgttcccgt

SEQ ID NO: 178704 - DNA, 35 bp, Artificial Sequence
  Synthetic oligonucleotide
gccacatcattgccaccacattcttcgacccgcgt

SEQ ID NO: 178705 - DNA, 35 bp, Artificial Sequence
  Synthetic oligonucleotide
gtagatgggggggaggagtatgtgagtatgtgcgt

SEQ ID NO: 178706 - DNA, 36 bp, Artificial Sequence
  Synthetic oligonucleotide
agaacatccctacagcgtctcgccctgcctgcttgt

SEQ ID NO: 178707 - DNA, 35 bp, Artificial Sequence
  Synthetic oligonucleotide
gtgtacggccgattccatctccacttcttcgttgt

SEQ ID NO: 178708 - DNA, 35 bp, Artificial Sequence
  Synthetic oligonucleotide
tcgatcgccctccatgactttccgctgttttactt

SEQ ID NO: 178709 - DNA, 35 bp, Artificial Sequence
  Synthetic oligonucleotide
gaccctgcctcactcgacccctccacgtgatggtt

SEQ ID NO: 178710 - DNA, 35 bp, Artificial Sequence
  Synthetic oligonucleotide
gaacgctcctcagccggaggccttttccacctgtt

SEQ ID NO: 178711 - DNA, 34 bp, Artificial Sequence
  Synthetic oligonucleotide
aaccgcatgacatttcgtccttaagcccccattt

SEQ ID NO: 178712 - DNA, 35 bp, Artificial Sequence
  Synthetic oligonucleotide
tcaccgctgcttttcaagttttggcccttcacttt

SEQ ID NO: 178713 - DNA, 36 bp, Artificial Sequence
  Synthetic oligonucleotide
gttcgcccgcctgcaacgttcttctcagccgctaaa

SEQ ID NO: 178714 - DNA, 35 bp, Artificial Sequence
  Synthetic oligonucleotide
tcccgcccgaatgccatggactccctctccggcaa

SEQ ID NO: 178715 - DNA, 35 bp, Artificial Sequence
  Synthetic oligonucleotide
gaggatgggacaaagggtaggataggagaggtcaa

SEQ ID NO: 178716 - DNA, 36 bp, Artificial Sequence
  Synthetic oligonucleotide
gaacgggaagggagggcgtttacaggggagcctgaa

SEQ ID NO: 178717 - DNA, 36 bp, Artificial Sequence
  Synthetic oligonucleotide
tgcccatctccacgcttccctacggtcttgcctgaa

SEQ ID NO: 178718 - DNA, 35 bp, Artificial Sequence
  Synthetic oligonucleotide
ttcaccccctctggccctggttccgaaaacttgaa

SEQ ID NO: 178719 - DNA, 36 bp, Artificial Sequence
  Synthetic oligonucleotide
gaaccagagtcaactgcctatctgtcttgctcctaa

SEQ ID NO: 178720 - DNA, 36 bp, Artificial Sequence
  Synthetic oligonucleotide
tcccatccacactctaccatgcccgtgcatacaaca

SEQ ID NO: 178721 - DNA, 36 bp, Artificial Sequence
  Synthetic oligonucleotide
gtgctacccccaggctggccaccctcaaccactaca

SEQ ID NO: 178722 - DNA, 35 bp, Artificial Sequence
  Synthetic oligonucleotide
agcaacatccataccgggcggcattatcgcaccca

SEQ ID NO: 178723 - DNA, 36 bp, Artificial Sequence
  Synthetic oligonucleotide
gccgttcaggtctggctccgtgtccgtctaacccca

SEQ ID NO: 178724 - DNA, 36 bp, Artificial Sequence
  Synthetic oligonucleotide
tatcatcgcctagtctagccagtccgcccaccccca

SEQ ID NO: 178725 - DNA, 32 bp, Artificial Sequence
  Synthetic oligonucleotide
agcccgccaaaacgtctgtgtctacctcccca

SEQ ID NO: 178726 - DNA, 35 bp, Artificial Sequence
  Synthetic oligonucleotide
agactcccgctcctgtttgttctcgcaatacgcca

SEQ ID NO: 178727 - DNA, 36 bp, Artificial Sequence
  Synthetic oligonucleotide
tcctactcggcgatctctcctgccatatagccctca

SEQ ID NO: 178728 - DNA, 36 bp, Artificial Sequence
  Synthetic oligonucleotide
tgccactgtcaatgccctaatcctattccaccgtca

SEQ ID NO: 178729 - DNA, 36 bp, Artificial Sequence
  Synthetic oligonucleotide
acacctggctggcacatattactgcaccacttttca

SEQ ID NO: 178730 - DNA, 37 bp, Artificial Sequence
  Synthetic oligonucleotide
tcctctgcctcaccgatcttttgctccgctttgcaga

SEQ ID NO: 178731 - DNA, 37 bp, Artificial Sequence
  Synthetic oligonucleotide
aagggacgagaaaagaacgggaccaggagtaaggaga

SEQ ID NO: 178732 - DNA, 37 bp, Artificial Sequence
  Synthetic oligonucleotide
gagcagaggacagtggaggcgtggggagtagaggaga

SEQ ID NO: 178733 - DNA, 37 bp, Artificial Sequence
  Synthetic oligonucleotide
ggaggaattggggggtagttacggagggagggtgaga

SEQ ID NO: 178734 - DNA, 37 bp, Artificial Sequence
  Synthetic oligonucleotide
gtaccttcgccacaactgctctccgcacagtatacga

SEQ ID NO: 178735 - DNA, 37 bp, Artificial Sequence
  Synthetic oligonucleotide
tccgaccccggttcttgcctcccaactatgagaccga

SEQ ID NO: 178736 - DNA, 37 bp, Artificial Sequence
  Synthetic oligonucleotide
gattgcagggttagtgctgcatgccttccccctccga

SEQ ID NO: 178737 - DNA, 37 bp, Artificial Sequence
  Synthetic oligonucleotide
gaaacccaccctcctgtgagcagatccgcctttccga

SEQ ID NO: 178738 - DNA, 37 bp, Artificial Sequence
  Synthetic oligonucleotide
gcggggagtgaggatcggaaagggtggcggggtgcga

SEQ ID NO: 178739 - DNA, 37 bp, Artificial Sequence
  Synthetic oligonucleotide
agtgcgcacggtgcacaactcctccctctcgtatcga

SEQ ID NO: 178740 - DNA, 36 bp, Artificial Sequence
  Synthetic oligonucleotide
gaaaacgggaaacggaagtaagggaaaggggttcga

SEQ ID NO: 178741 - DNA, 36 bp, Artificial Sequence
  Synthetic oligonucleotide
gcccccccttgcccatttgcggtctcctacacagga

SEQ ID NO: 178742 - DNA, 36 bp, Artificial Sequence
  Synthetic oligonucleotide
agtggagagaggccgggtgtgcagcagaagggagga

SEQ ID NO: 178743 - DNA, 35 bp, Artificial Sequence
  Synthetic oligonucleotide
agagatgtgacgcgaaggggggggccgggtgagga

SEQ ID NO: 178744 - DNA, 38 bp, Artificial Sequence
  Synthetic oligonucleotide
tagggagtctaagaggggagatgatgaggaagggcgga

SEQ ID NO: 178745 - DNA, 37 bp, Artificial Sequence
  Synthetic oligonucleotide
ttcgagggggactgggtagggaacggtaattgcggga

SEQ ID NO: 178746 - DNA, 37 bp, Artificial Sequence
  Synthetic oligonucleotide
ggtagtgaagggggattggtggaaagggtaaggggga

SEQ ID NO: 178747 - DNA, 35 bp, Artificial Sequence
  Synthetic oligonucleotide
aatggaggcagatgtaatcagggaagggaggggga

SEQ ID NO: 178748 - DNA, 36 bp, Artificial Sequence
  Synthetic oligonucleotide
gaccggaattacggtgagaagggcggatcgggggga

SEQ ID NO: 178749 - DNA, 37 bp, Artificial Sequence
  Synthetic oligonucleotide
aaccaaaggaaggtgggcgaagggagaatgcctggga

SEQ ID NO: 178750 - DNA, 37 bp, Artificial Sequence
  Synthetic oligonucleotide
taagagtgggggggaggcatgaaggcagagcgtggga

SEQ ID NO: 178751 - DNA, 37 bp, Artificial Sequence
  Synthetic oligonucleotide
tgtggaatggtgcgggggggatgggcaaactgatgga

SEQ ID NO: 178752 - DNA, 38 bp, Artificial Sequence
  Synthetic oligonucleotide
acagttgggagggagggttggggatcacgaccaaatga

SEQ ID NO: 178753 - DNA, 37 bp, Artificial Sequence
  Synthetic oligonucleotide
atgtgtgtcaaggggggtgggagcagggctggaatga

SEQ ID NO: 178754 - DNA, 38 bp, Artificial Sequence
  Synthetic oligonucleotide
agcccccgcgccatcctatccctgcctgtttgacatga

SEQ ID NO: 178755 - DNA, 38 bp, Artificial Sequence
  Synthetic oligonucleotide
attcactgtcgccgctatacttctatagttctccatga

SEQ ID NO: 178756 - DNA, 38 bp, Artificial Sequence
  Synthetic oligonucleotide
gggagggtgggaggggctggacacacggtggacgatga

SEQ ID NO: 178757 - DNA, 38 bp, Artificial Sequence
  Synthetic oligonucleotide
ggggcggggacttgcaaacagacggggtggggacctga

SEQ ID NO: 178758 - DNA, 38 bp, Artificial Sequence
  Synthetic oligonucleotide
tttggccagacatgtgtaccccgacctcccgcccctga

SEQ ID NO: 178759 - DNA, 37 bp, Artificial Sequence
  Synthetic oligonucleotide
ttgtgcaccgccacatctttgagtccaccaagcctga

SEQ ID NO: 178760 - DNA, 38 bp, Artificial Sequence
  Synthetic oligonucleotide
tctgtcaccccccgtttttcctgatgcgaactcgctga

SEQ ID NO: 178761 - DNA, 38 bp, Artificial Sequence
  Synthetic oligonucleotide
tcatcgatgtcattgcgcgtgctgccccccttcgctga

SEQ ID NO: 178762 - DNA, 35 bp, Artificial Sequence
  Synthetic oligonucleotide
ccccaaccctcaacatgccgctttcaccactctga

SEQ ID NO: 178763 - DNA, 38 bp, Artificial Sequence
  Synthetic oligonucleotide
ttggacacccccggatcttccgcctccccatcgagtga

SEQ ID NO: 178764 - DNA, 38 bp, Artificial Sequence
  Synthetic oligonucleotide
atccgcaccctttccgtcacccactgccatcaccgtga

SEQ ID NO: 178765 - DNA, 38 bp, Artificial Sequence
  Synthetic oligonucleotide
gtacacaccgcaactcctcgctaccaccactctggtga

SEQ ID NO: 178766 - DNA, 38 bp, Artificial Sequence
  Synthetic oligonucleotide
actaacacgctatgcgatatacgttcctccttcattga

SEQ ID NO: 178767 - DNA, 37 bp, Artificial Sequence
  Synthetic oligonucleotide
tctacgggtgggagggctacgatggggatccgattga

SEQ ID NO: 178768 - DNA, 37 bp, Artificial Sequence
  Synthetic oligonucleotide
agtggacgcgcgcttccctcttcgcctgttgccttga

SEQ ID NO: 178769 - DNA, 38 bp, Artificial Sequence
  Synthetic oligonucleotide
gagtccacctccgacctttctgtcatagccatgcttga

SEQ ID NO: 178770 - DNA, 38 bp, Artificial Sequence
  Synthetic oligonucleotide
tctgacggcctcacgctttccctggtccttattgttga

SEQ ID NO: 178771 - DNA, 37 bp, Artificial Sequence
  Synthetic oligonucleotide
ttgggcacccctgccacacccctatacgcctgtttga

SEQ ID NO: 178772 - DNA, 35 bp, Artificial Sequence
  Synthetic oligonucleotide
gacaactgcaccgccacataatctcttgctccata

SEQ ID NO: 178773 - DNA, 35 bp, Artificial Sequence
  Synthetic oligonucleotide
gacaacccccgcccagactgggacctcctaaccta

SEQ ID NO: 178774 - DNA, 35 bp, Artificial Sequence
  Synthetic oligonucleotide
ttgcggacccttggttttgctccctccccgtagta

SEQ ID NO: 178775 - DNA, 36 bp, Artificial Sequence
  Synthetic oligonucleotide
tacaagtggagggtcgaggaaaagcgaagcagcgta

SEQ ID NO: 178776 - DNA, 36 bp, Artificial Sequence
  Synthetic oligonucleotide
ggtggacaatcggaagggcggaggtggaaaatggta

SEQ ID NO: 178777 - DNA, 36 bp, Artificial Sequence
  Synthetic oligonucleotide
gagcgaaggggaaaggggggaagtttaccgatggta

SEQ ID NO: 178778 - DNA, 35 bp, Artificial Sequence
  Synthetic oligonucleotide
tccacacctcccgtcttgtccaccatggtattgta

SEQ ID NO: 178779 - DNA, 35 bp, Artificial Sequence
  Synthetic oligonucleotide
accacgtccatggcctacacttgtcccattttgta

SEQ ID NO: 178780 - DNA, 36 bp, Artificial Sequence
  Synthetic oligonucleotide
attcccgccgttgtcctcgtatgtatccaccgctta

SEQ ID NO: 178781 - DNA, 36 bp, Artificial Sequence
  Synthetic oligonucleotide
accctccctcactccagtctcgtgctacgctggtta

SEQ ID NO: 178782 - DNA, 35 bp, Artificial Sequence
  Synthetic oligonucleotide
gcacgggcgggtagggcgggctgtcctgggtgtta

SEQ ID NO: 178783 - DNA, 35 bp, Artificial Sequence
  Synthetic oligonucleotide
gcttaagcgccgcgccctcggttgtctcctcacac

SEQ ID NO: 178784 - DNA, 35 bp, Artificial Sequence
  Synthetic oligonucleotide
gagtctccccgatcagttgcttcatcattcgccac

SEQ ID NO: 178785 - DNA, 35 bp, Artificial Sequence
  Synthetic oligonucleotide
ttaggcatccccttgtttctcccgaagcgctccac

SEQ ID NO: 178786 - DNA, 35 bp, Artificial Sequence
  Synthetic oligonucleotide
gatgcactacccgcgcaatgttccaccctctccac

SEQ ID NO: 178787 - DNA, 35 bp, Artificial Sequence
  Synthetic oligonucleotide
attaccaccgcgacaatttataccccttgttccac

SEQ ID NO: 178788 - DNA, 35 bp, Artificial Sequence
  Synthetic oligonucleotide
tccgacgctttacggtaccttctttcaggcctcac

SEQ ID NO: 178789 - DNA, 28 bp, Artificial Sequence
  Synthetic oligonucleotide
tcatggcctgtcacctacgcctgctgac

SEQ ID NO: 178790 - DNA, 35 bp, Artificial Sequence
  Synthetic oligonucleotide
tgagccattgtaacatgctcgtgtccccccgttac

SEQ ID NO: 178791 - DNA, 35 bp, Artificial Sequence
  Synthetic oligonucleotide
tgcaccttcccacgcggtctttgatacgccgttac

SEQ ID NO: 178792 - DNA, 35 bp, Artificial Sequence
  Synthetic oligonucleotide
tgcgccattgccgactacatccctgcctacttacc

SEQ ID NO: 178793 - DNA, 33 bp, Artificial Sequence
  Synthetic oligonucleotide
ctacccgcccctggtgatagcccttccataccc

SEQ ID NO: 178794 - DNA, 35 bp, Artificial Sequence
  Synthetic oligonucleotide
tagactcgtcaccttgtttacacttctgcctaccc

SEQ ID NO: 178795 - DNA, 35 bp, Artificial Sequence
  Synthetic oligonucleotide
tcagccccgaacgctctacatacgcgcctccgccc

SEQ ID NO: 178796 - DNA, 35 bp, Artificial Sequence
  Synthetic oligonucleotide
actcaccgtcgcctttattctcttccccactgccc

SEQ ID NO: 178797 - DNA, 35 bp, Artificial Sequence
  Synthetic oligonucleotide
gataaaccacctagtacagaccctgtgcttccgcc

SEQ ID NO: 178798 - DNA, 35 bp, Artificial Sequence
  Synthetic oligonucleotide
tcctccggccctatagcggttatgcacctcctgcc

SEQ ID NO: 178799 - DNA, 35 bp, Artificial Sequence
  Synthetic oligonucleotide
tgcgatcccaatatgctcacgtgcccaggtcatcc

SEQ ID NO: 178800 - DNA, 36 bp, Artificial Sequence
  Synthetic oligonucleotide
gctgcccgctgcatacgccccagcacaaccacctcc

SEQ ID NO: 178801 - DNA, 35 bp, Artificial Sequence
  Synthetic oligonucleotide
atgtccctccctctgacacaaaaacgagctcctcc

SEQ ID NO: 178802 - DNA, 35 bp, Artificial Sequence
  Synthetic oligonucleotide
tgcacacccgcccttgtacaattcgaggtctgtcc

SEQ ID NO: 178803 - DNA, 35 bp, Artificial Sequence
  Synthetic oligonucleotide
gccaccattcgtggccgcacatatcctcgttgtcc

SEQ ID NO: 178804 - DNA, 35 bp, Artificial Sequence
  Synthetic oligonucleotide
ggcggttgctgccgtaccttcgtttttgtttgtcc

SEQ ID NO: 178805 - DNA, 35 bp, Artificial Sequence
  Synthetic oligonucleotide
gtgtcaccgccacatttgacccgcctattagttcc

SEQ ID NO: 178806 - DNA, 35 bp, Artificial Sequence
  Synthetic oligonucleotide
aaccgctgttgtccgtacaccccttcgttggttcc

SEQ ID NO: 178807 - DNA, 35 bp, Artificial Sequence
  Synthetic oligonucleotide
gtgctgaccctcgttggtaaacggaacaactttcc

SEQ ID NO: 178808 - DNA, 35 bp, Artificial Sequence
  Synthetic oligonucleotide
actccctcctcgagcataaaaccgttgctccgcgc

SEQ ID NO: 178809 - DNA, 35 bp, Artificial Sequence
  Synthetic oligonucleotide
tcccacttcggcgattagtacgttcctcattgcgc

SEQ ID NO: 178810 - DNA, 35 bp, Artificial Sequence
  Synthetic oligonucleotide
gtcggacccccgttttgcctcactctccagctcgc

SEQ ID NO: 178811 - DNA, 35 bp, Artificial Sequence
  Synthetic oligonucleotide
gatcactgcctcctgcaccgctggcgctatgtcgc

SEQ ID NO: 178812 - DNA, 35 bp, Artificial Sequence
  Synthetic oligonucleotide
gactacgagggtgggctttgggagggtgtcgcggc

SEQ ID NO: 178813 - DNA, 35 bp, Artificial Sequence
  Synthetic oligonucleotide
gagcgactaacgcaggaggaacgggagggggtggc

SEQ ID NO: 178814 - DNA, 35 bp, Artificial Sequence
  Synthetic oligonucleotide
gcgacgctcctctctgtcgttgttttcgccttggc

SEQ ID NO: 178815 - DNA, 35 bp, Artificial Sequence
  Synthetic oligonucleotide
tgcctgtccccgcctatcgcatccccggtacatgc

SEQ ID NO: 178816 - DNA, 35 bp, Artificial Sequence
  Synthetic oligonucleotide
tgccaatcctgcctttcataaaatcgacgcactgc

SEQ ID NO: 178817 - DNA, 35 bp, Artificial Sequence
  Synthetic oligonucleotide
gagtgcaagccctgtcgccactttcgaagtccatc

SEQ ID NO: 178818 - DNA, 35 bp, Artificial Sequence
  Synthetic oligonucleotide
gccccatcctccgacctgttacccttgccttgatc

SEQ ID NO: 178819 - DNA, 35 bp, Artificial Sequence
  Synthetic oligonucleotide
tcccactctccaagagtcacccgcgctctgcactc

SEQ ID NO: 178820 - DNA, 35 bp, Artificial Sequence
  Synthetic oligonucleotide
gtcaccattcgtccacttgtacacgctctttcctc

SEQ ID NO: 178821 - DNA, 35 bp, Artificial Sequence
  Synthetic oligonucleotide
atcccccgaacgacggtagacatactggttctctc

SEQ ID NO: 178822 - DNA, 36 bp, Artificial Sequence
  Synthetic oligonucleotide
gtcagcccgcttttcactcgcctgttcgacgtagtc

SEQ ID NO: 178823 - DNA, 35 bp, Artificial Sequence
  Synthetic oligonucleotide
taagcgctcgaccgtctctccgcgttagtctcgtc

SEQ ID NO: 178824 - DNA, 35 bp, Artificial Sequence
  Synthetic oligonucleotide
tcccgtagccttcaatcccttccgattctgccttc

SEQ ID NO: 178825 - DNA, 35 bp, Artificial Sequence
  Synthetic oligonucleotide
actcgttcgtcggtcttctcttggacgcctccttc

SEQ ID NO: 178826 - DNA, 35 bp, Artificial Sequence
  Synthetic oligonucleotide
gcgtggccagactattgtcccccccgtctcgtttc

SEQ ID NO: 178827 - DNA, 35 bp, Artificial Sequence
  Synthetic oligonucleotide
atcagtcccctacgcagatcgctacattcctcccg

SEQ ID NO: 178828 - DNA, 35 bp, Artificial Sequence
  Synthetic oligonucleotide
tcaccgcttacacccgccgattcataattctcgcg

SEQ ID NO: 178829 - DNA, 35 bp, Artificial Sequence
  Synthetic oligonucleotide
gacgcattcctaccgtgaaccgttacaacacctcg

SEQ ID NO: 178830 - DNA, 35 bp, Artificial Sequence
  Synthetic oligonucleotide
gtccgacctgtaggcatatcgtaccaccttcctcg

SEQ ID NO: 178831 - DNA, 35 bp, Artificial Sequence
  Synthetic oligonucleotide
tccgaaccacttgtgccgtattgggtctcctttcg

SEQ ID NO: 178832 - DNA, 35 bp, Artificial Sequence
  Synthetic oligonucleotide
agagagagcaagtacacgagggagggttggggagg

SEQ ID NO: 178833 - DNA, 35 bp, Artificial Sequence
  Synthetic oligonucleotide
atgcccccatttgaccaccccgagaccatttccgg

SEQ ID NO: 178834 - DNA, 35 bp, Artificial Sequence
  Synthetic oligonucleotide
atggaggtgaggcggggggggagggctggaagggg

SEQ ID NO: 178835 - DNA, 35 bp, Artificial Sequence
  Synthetic oligonucleotide
aatgcggggggagggtgatagtagctcgatagtgg

SEQ ID NO: 178836 - DNA, 35 bp, Artificial Sequence
  Synthetic oligonucleotide
acccctgcctctgacccctcttgccaccctcaatg

SEQ ID NO: 178837 - DNA, 35 bp, Artificial Sequence
  Synthetic oligonucleotide
acttatcacggctcgatgacttccccctccctgtg

SEQ ID NO: 178838 - DNA, 35 bp, Artificial Sequence
  Synthetic oligonucleotide
acacaccacctaacatgttcgccattccgctcttg

SEQ ID NO: 178839 - DNA, 35 bp, Artificial Sequence
  Synthetic oligonucleotide
gagacacccgcccgttgcaccccctctaagtacat

SEQ ID NO: 178840 - DNA, 35 bp, Artificial Sequence
  Synthetic oligonucleotide
tacgattagcgtccacacggcgccctcccttgcat

SEQ ID NO: 178841 - DNA, 35 bp, Artificial Sequence
  Synthetic oligonucleotide
tcttgctgagcccatgcccgtatttctacccctat

SEQ ID NO: 178842 - DNA, 35 bp, Artificial Sequence
  Synthetic oligonucleotide
gaccactccgacgggtctggctcccgcccaattat

SEQ ID NO: 178843 - DNA, 31 bp, Artificial Sequence
  Synthetic oligonucleotide
aactcaccactcgccctttatgttgtaacct

SEQ ID NO: 178844 - DNA, 35 bp, Artificial Sequence
  Synthetic oligonucleotide
gctccctcggccggccgaccccctctctcgaccct

SEQ ID NO: 178845 - DNA, 35 bp, Artificial Sequence
  Synthetic oligonucleotide
tcccccctgttttgactggacctcgcccttggcct

SEQ ID NO: 178846 - DNA, 35 bp, Artificial Sequence
  Synthetic oligonucleotide
gttggttatgggtgggaggggtcgaaggggttgct

SEQ ID NO: 178847 - DNA, 35 bp, Artificial Sequence
  Synthetic oligonucleotide
atcacaccgggatcgctttacgaaaacactcttct

SEQ ID NO: 178848 - DNA, 35 bp, Artificial Sequence
  Synthetic oligonucleotide
tccctgctcccgtacacactggcctgctctcgagt

SEQ ID NO: 178849 - DNA, 35 bp, Artificial Sequence
  Synthetic oligonucleotide
tttgcccacgccgtcccccctagcgacttctccgt

SEQ ID NO: 178850 - DNA, 35 bp, Artificial Sequence
  Synthetic oligonucleotide
tagtgccaccaccgtaccccctgccccaaaggcgt

SEQ ID NO: 178851 - DNA, 35 bp, Artificial Sequence
  Synthetic oligonucleotide
ggtcaattgcccgccgctcctctgacactataggt

SEQ ID NO: 178852 - DNA, 35 bp, Artificial Sequence
  Synthetic oligonucleotide
tacacctcacctatgcccggtccttcccgccctgt

SEQ ID NO: 178853 - DNA, 35 bp, Artificial Sequence
  Synthetic oligonucleotide
ttccacccccagtacttgcacttgcacgtgcttgt

SEQ ID NO: 178854 - DNA, 36 bp, Artificial Sequence
  Synthetic oligonucleotide
tgaccccccagcaccatctacaagggccggcccatt

SEQ ID NO: 178855 - DNA, 35 bp, Artificial Sequence
  Synthetic oligonucleotide
gactgcccaggtcgctgcccggctccgaattactt

SEQ ID NO: 178856 - DNA, 35 bp, Artificial Sequence
  Synthetic oligonucleotide
tctacccgtcaaaatgtctcccgcctaagcccctt

SEQ ID NO: 178857 - DNA, 35 bp, Artificial Sequence
  Synthetic oligonucleotide
gagacggcactctgtctattgcgacctcgcccctt

SEQ ID NO: 178858 - DNA, 35 bp, Artificial Sequence
  Synthetic oligonucleotide
gaagccatgcaccccagcaatttaggtccgccctt

SEQ ID NO: 178859 - DNA, 35 bp, Artificial Sequence
  Synthetic oligonucleotide
tgtccgctcgcctccgcccttagacgtacacgctt

SEQ ID NO: 178860 - DNA, 35 bp, Artificial Sequence
  Synthetic oligonucleotide
gcaagttgcaattgtctcgctcctccgtacccgtt

SEQ ID NO: 178861 - DNA, 35 bp, Artificial Sequence
  Synthetic oligonucleotide
taggtaccagtgccccgcgaccctttgcctccgtt

SEQ ID NO: 178862 - DNA, 35 bp, Artificial Sequence
  Synthetic oligonucleotide
cagacgatccctccaggcctgtttattccatattt

SEQ ID NO: 178863 - DNA, 35 bp, Artificial Sequence
  Synthetic oligonucleotide
acgccaaccactgcttcctcattcttgtaaccttt

SEQ ID NO: 178864 - DNA, 35 bp, Artificial Sequence
  Synthetic oligonucleotide
taatcctccgtccacatagcggtacccccaccttt

SEQ ID NO: 178865 - DNA, 36 bp, Artificial Sequence
  Synthetic oligonucleotide
gatagcaccgccaccttctcgcgcctgtagacccaa

SEQ ID NO: 178866 - DNA, 35 bp, Artificial Sequence
  Synthetic oligonucleotide
gccattgctatcagcgctatttgaaccatcccgaa

SEQ ID NO: 178867 - DNA, 35 bp, Artificial Sequence
  Synthetic oligonucleotide
tcccaccgtatatcctgccgtccccactagttgaa

SEQ ID NO: 178868 - DNA, 36 bp, Artificial Sequence
  Synthetic oligonucleotide
tatgtgctcactgtgacgccgctcccgacctctaca

SEQ ID NO: 178869 - DNA, 36 bp, Artificial Sequence
  Synthetic oligonucleotide
acacaccgccctctattattgtcggaagtatcacca

SEQ ID NO: 178870 - DNA, 36 bp, Artificial Sequence
  Synthetic oligonucleotide
gcaaccgcagtactctgtcctcgttcccgttcacca

SEQ ID NO: 178871 - DNA, 35 bp, Artificial Sequence
  Synthetic oligonucleotide
gcaccttcggctctgcggtccgcgccactccccca

SEQ ID NO: 178872 - DNA, 35 bp, Artificial Sequence
  Synthetic oligonucleotide
actgcacgtgattctttaattccttggtccgccca

SEQ ID NO: 178873 - DNA, 36 bp, Artificial Sequence
  Synthetic oligonucleotide
gcattcatactgcactcccctcgcgcctagacgcca

SEQ ID NO: 178874 - DNA, 36 bp, Artificial Sequence
  Synthetic oligonucleotide
aattgcagcaccaatatgcgttccctgctccgtcca

SEQ ID NO: 178875 - DNA, 36 bp, Artificial Sequence
  Synthetic oligonucleotide
tgacaaggggtgaggggcaaacaaaaagcaagagca

SEQ ID NO: 178876 - DNA, 35 bp, Artificial Sequence
  Synthetic oligonucleotide
tcccacccctccctttctaagttgtcagagtagca

SEQ ID NO: 178877 - DNA, 36 bp, Artificial Sequence
  Synthetic oligonucleotide
ttcgccaacccgttccttgccgctgaacttaacgca

SEQ ID NO: 178878 - DNA, 35 bp, Artificial Sequence
  Synthetic oligonucleotide
cgcgatcctcatgacgtttaacaataccatccgca

SEQ ID NO: 178879 - DNA, 35 bp, Artificial Sequence
  Synthetic oligonucleotide
attgcctcggctgtggtcccacttcccaccaatca

SEQ ID NO: 178880 - DNA, 35 bp, Artificial Sequence
  Synthetic oligonucleotide
acacctccctcgcttgttttggcctatgcacatca

SEQ ID NO: 178881 - DNA, 36 bp, Artificial Sequence
  Synthetic oligonucleotide
gatcagcgcgggtcgcgttatctgcattcaccatca

SEQ ID NO: 178882 - DNA, 35 bp, Artificial Sequence
  Synthetic oligonucleotide
tactcaccctctcttgttcgacctgagctggctca

SEQ ID NO: 178883 - DNA, 36 bp, Artificial Sequence
  Synthetic oligonucleotide
aagggggtggtgttgtgttagggcaggagggtaaga

SEQ ID NO: 178884 - DNA, 37 bp, Artificial Sequence
  Synthetic oligonucleotide
aaacggggaggaaggacaggaaagtggggagtccaga

SEQ ID NO: 178885 - DNA, 37 bp, Artificial Sequence
  Synthetic oligonucleotide
gtgggaagggacgggaaggagctacgtggtgcagaga

SEQ ID NO: 178886 - DNA, 37 bp, Artificial Sequence
  Synthetic oligonucleotide
ggatggtaacggacaggaggggacgaagagcgggaga

SEQ ID NO: 178887 - DNA, 37 bp, Artificial Sequence
  Synthetic oligonucleotide
gagaaggcgaaagggagcaatgaggacccgggggaga

SEQ ID NO: 178888 - DNA, 37 bp, Artificial Sequence
  Synthetic oligonucleotide
tgcacgcccctcgctaccccgttttatgtcacgtaga

SEQ ID NO: 178889 - DNA, 37 bp, Artificial Sequence
  Synthetic oligonucleotide
aaggggaggatagggacgaagggtaggctaataacga

SEQ ID NO: 178890 - DNA, 37 bp, Artificial Sequence
  Synthetic oligonucleotide
tagcgctgcttattgatcttccaccgctcccgtacga

SEQ ID NO: 178891 - DNA, 37 bp, Artificial Sequence
  Synthetic oligonucleotide
tactccccctctcgtgtcggacatctcgctgacccga

SEQ ID NO: 178892 - DNA, 37 bp, Artificial Sequence
  Synthetic oligonucleotide
tggtcgtcacctggagtcatacccacgccccccccga

SEQ ID NO: 178893 - DNA, 36 bp, Artificial Sequence
  Synthetic oligonucleotide
acacggccgtacagttgtcatccaatgcctccccga

SEQ ID NO: 178894 - DNA, 37 bp, Artificial Sequence
  Synthetic oligonucleotide
gaaggacaccgcccacccatgccagagctgctgccga

SEQ ID NO: 178895 - DNA, 35 bp, Artificial Sequence
  Synthetic oligonucleotide
tctcaaccacagcaactctgcgcatacctatccga

SEQ ID NO: 178896 - DNA, 37 bp, Artificial Sequence
  Synthetic oligonucleotide
agtgcgccgctgccccctcctgccataatcagtgcga

SEQ ID NO: 178897 - DNA, 37 bp, Artificial Sequence
  Synthetic oligonucleotide
gagccgcgcaaactcgctttactagccaccccttcga

SEQ ID NO: 178898 - DNA, 38 bp, Artificial Sequence
  Synthetic oligonucleotide
tgacacccgccgcacccgtcacaaaacgctcccgagga

SEQ ID NO: 178899 - DNA, 36 bp, Artificial Sequence
  Synthetic oligonucleotide
aacgacccctcgcctcaccgcaatacgaataccgga

SEQ ID NO: 178900 - DNA, 37 bp, Artificial Sequence
  Synthetic oligonucleotide
tccgtaccacaacacctgcatcatagtcacacccgga

SEQ ID NO: 178901 - DNA, 35 bp, Artificial Sequence
  Synthetic oligonucleotide
atcatgcctccaatgcaacccctgcccaccccgga

SEQ ID NO: 178902 - DNA, 36 bp, Artificial Sequence
  Synthetic oligonucleotide
tcgacacaggagggggggttccaagagtggggcgga

SEQ ID NO: 178903 - DNA, 35 bp, Artificial Sequence
  Synthetic oligonucleotide
ttcgacatgtagtgggaacgcgggtacgggaggga

SEQ ID NO: 178904 - DNA, 35 bp, Artificial Sequence
  Synthetic oligonucleotide
aaagtagaaggagtgtgatgagggcaaggggggga

SEQ ID NO: 178905 - DNA, 35 bp, Artificial Sequence
  Synthetic oligonucleotide
gtcccctccactctattcaaccgccccatttggga

SEQ ID NO: 178906 - DNA, 37 bp, Artificial Sequence
  Synthetic oligonucleotide
gccacgttatgtgcatttcccccctcttctgcgtgga

SEQ ID NO: 178907 - DNA, 37 bp, Artificial Sequence
  Synthetic oligonucleotide
gaccagtgtgtggggggggataagggatatgaaatga

SEQ ID NO: 178908 - DNA, 37 bp, Artificial Sequence
  Synthetic oligonucleotide
aacacctttgctggtatttatagccctcttcacatga

SEQ ID NO: 178909 - DNA, 38 bp, Artificial Sequence
  Synthetic oligonucleotide
gtgtggcaatggagggcggagaaaaggttggcggatga

SEQ ID NO: 178910 - DNA, 36 bp, Artificial Sequence
  Synthetic oligonucleotide
gccacgaccgcccggcgctgcacttttccattatga

SEQ ID NO: 178911 - DNA, 37 bp, Artificial Sequence
  Synthetic oligonucleotide
tcaccccatccccctgtctaatgtcagtttaccctga

SEQ ID NO: 178912 - DNA, 38 bp, Artificial Sequence
  Synthetic oligonucleotide
taccgccgccgtttacatacttgtgcctttccgcctga

SEQ ID NO: 178913 - DNA, 36 bp, Artificial Sequence
  Synthetic oligonucleotide
tgatgcccatggtttcagtgaaccctcttctcctga

SEQ ID NO: 178914 - DNA, 38 bp, Artificial Sequence
  Synthetic oligonucleotide
gcgaacgcctctgtgagctacatcacctctcacgctga

SEQ ID NO: 178915 - DNA, 36 bp, Artificial Sequence
  Synthetic oligonucleotide
taccacccgctcccgttcgcgtacttccatttctga

SEQ ID NO: 178916 - DNA, 38 bp, Artificial Sequence
  Synthetic oligonucleotide
atccaaccaccctacttctgtccaatgtctgtccgtga

SEQ ID NO: 178917 - DNA, 36 bp, Artificial Sequence
  Synthetic oligonucleotide
aacgtaggaggaggggacgcggggacttgcaggtga

SEQ ID NO: 178918 - DNA, 38 bp, Artificial Sequence
  Synthetic oligonucleotide
ttagaccgggcgggaatgggggggactaggttaggtga

SEQ ID NO: 178919 - DNA, 38 bp, Artificial Sequence
  Synthetic oligonucleotide
gaagccagagtgatgcggggagcgggaggaaacggtga

SEQ ID NO: 178920 - DNA, 38 bp, Artificial Sequence
  Synthetic oligonucleotide
gtgggggtggggtgggactcggaggtcgtacagggtga

SEQ ID NO: 178921 - DNA, 37 bp, Artificial Sequence
  Synthetic oligonucleotide
gttttgccccgtactgaccggtgtcgcgcccccttga

SEQ ID NO: 178922 - DNA, 36 bp, Artificial Sequence
  Synthetic oligonucleotide
tccccccaccccctgtggttcgttaccgagccttga

SEQ ID NO: 178923 - DNA, 37 bp, Artificial Sequence
  Synthetic oligonucleotide
tatgacgaggggggaacgggtaaaggacaggccttga

SEQ ID NO: 178924 - DNA, 35 bp, Artificial Sequence
  Synthetic oligonucleotide
gacaaggctaatcactgccttctgttccctcttga

SEQ ID NO: 178925 - DNA, 36 bp, Artificial Sequence
  Synthetic oligonucleotide
agcacgcccacttgtactcgcacttcgccctgttga

SEQ ID NO: 178926 - DNA, 36 bp, Artificial Sequence
  Synthetic oligonucleotide
gctaacgacacgttgcgcaatttccctttcctttga

SEQ ID NO: 178927 - DNA, 35 bp, Artificial Sequence
  Synthetic oligonucleotide
gatcgcccgccaccccctctcctcaccagtgacta

SEQ ID NO: 178928 - DNA, 34 bp, Artificial Sequence
  Synthetic oligonucleotide
tgctccctgattccggttctactcgcccagtcta

SEQ ID NO: 178929 - DNA, 37 bp, Artificial Sequence
  Synthetic oligonucleotide
gcaaccccccccctgcgagtcccctgcttcctgcgta

SEQ ID NO: 178930 - DNA, 36 bp, Artificial Sequence
  Synthetic oligonucleotide
agtcacattcgcctgcctgctccattacaccaatta

SEQ ID NO: 178931 - DNA, 35 bp, Artificial Sequence
  Synthetic oligonucleotide
aggatccgctcgcctgcactttgacccatttgtta

SEQ ID NO: 178932 - DNA, 35 bp, Artificial Sequence
  Synthetic oligonucleotide
acacccggtctgtaggttctacggtaattccccac

SEQ ID NO: 178933 - DNA, 35 bp, Artificial Sequence
  Synthetic oligonucleotide
tcaaagtgtagtccggtcgactcatgccttcccac

SEQ ID NO: 178934 - DNA, 35 bp, Artificial Sequence
  Synthetic oligonucleotide
tgagcacctctgccttctatcatggttaccgctac

SEQ ID NO: 178935 - DNA, 35 bp, Artificial Sequence
  Synthetic oligonucleotide
gtcgtccacttcgccacggctatctttctccttac

SEQ ID NO: 178936 - DNA, 35 bp, Artificial Sequence
  Synthetic oligonucleotide
atcctccgccctggtctagccgttagttcttttac

SEQ ID NO: 178937 - DNA, 35 bp, Artificial Sequence
  Synthetic oligonucleotide
tgacacatcgccctccgcacctccgcgcccgaacc

SEQ ID NO: 178938 - DNA, 35 bp, Artificial Sequence
  Synthetic oligonucleotide
actccggagggggggagtcgtatggggcgggaacc

SEQ ID NO: 178939 - DNA, 35 bp, Artificial Sequence
  Synthetic oligonucleotide
ttcggtccctgaagtaattcgcggccttctacacc

SEQ ID NO: 178940 - DNA, 35 bp, Artificial Sequence
  Synthetic oligonucleotide
gttcaccacttgttgcctccgctccgggcctcacc

SEQ ID NO: 178941 - DNA, 35 bp, Artificial Sequence
  Synthetic oligonucleotide
ccacacttcgacttccagtaggagtctgacctacc

SEQ ID NO: 178942 - DNA, 35 bp, Artificial Sequence
  Synthetic oligonucleotide
ttgcctgacgcttgcccgtatgcctgttagccccc

SEQ ID NO: 178943 - DNA, 35 bp, Artificial Sequence
  Synthetic oligonucleotide
aacgcatgcggcaacactgattaccctcccagccc

SEQ ID NO: 178944 - DNA, 35 bp, Artificial Sequence
  Synthetic oligonucleotide
gtggggtgggtgggcacacacgggggttatcgccc

SEQ ID NO: 178945 - DNA, 35 bp, Artificial Sequence
  Synthetic oligonucleotide
tatgccctcacctccatcacagtgccgacgctgcc

SEQ ID NO: 178946 - DNA, 35 bp, Artificial Sequence
  Synthetic oligonucleotide
acagccaaacgtttcacacttcccctctcggtgcc

SEQ ID NO: 178947 - DNA, 35 bp, Artificial Sequence
  Synthetic oligonucleotide
tgttggccacgtgcgtttccttgttcttctgtgcc

SEQ ID NO: 178948 - DNA, 35 bp, Artificial Sequence
  Synthetic oligonucleotide
gtcccctcggtttggtctaacctggtcaccttgcc

SEQ ID NO: 178949 - DNA, 35 bp, Artificial Sequence
  Synthetic oligonucleotide
acacttcccatgttcatcccccccggtcggcatcc

SEQ ID NO: 178950 - DNA, 35 bp, Artificial Sequence
  Synthetic oligonucleotide
acccaccctccgctccgtaaggattcgccctatcc

SEQ ID NO: 178951 - DNA, 34 bp, Artificial Sequence
  Synthetic oligonucleotide
agatccaccgcccgaggctttgtgatttccctcc

SEQ ID NO: 178952 - DNA, 35 bp, Artificial Sequence
  Synthetic oligonucleotide
tatgccgatgttcctatactgttagtccggcctcc

SEQ ID NO: 178953 - DNA, 35 bp, Artificial Sequence
  Synthetic oligonucleotide
accccagcctccgccattcattaatactgccttcc

SEQ ID NO: 178954 - DNA, 35 bp, Artificial Sequence
  Synthetic oligonucleotide
tcaccccccaatatgtattggcaacatctacccgc

SEQ ID NO: 178955 - DNA, 35 bp, Artificial Sequence
  Synthetic oligonucleotide
tcgacctccgctagcaccttagcaagaatccccgc

SEQ ID NO: 178956 - DNA, 35 bp, Artificial Sequence
  Synthetic oligonucleotide
tttggccctgcacttcctggaacgtctaccgccgc

SEQ ID NO: 178957 - DNA, 35 bp, Artificial Sequence
  Synthetic oligonucleotide
atggttggcccccgtattttgtctcgctatttcgc

SEQ ID NO: 178958 - DNA, 35 bp, Artificial Sequence
  Synthetic oligonucleotide
gtcacgtgagacagtgggggagtagtgattatggc

SEQ ID NO: 178959 - DNA, 35 bp, Artificial Sequence
  Synthetic oligonucleotide
atgacccgcttccgtactctgcctgctatgttggc

SEQ ID NO: 178960 - DNA, 35 bp, Artificial Sequence
  Synthetic oligonucleotide
tgcatccgagggcataggcgagggagggggggatc

SEQ ID NO: 178961 - DNA, 35 bp, Artificial Sequence
  Synthetic oligonucleotide
gaccgccgccttgctaatcgtacaccacgccactc

SEQ ID NO: 178962 - DNA, 35 bp, Artificial Sequence
  Synthetic oligonucleotide
tctgccaagtcggtcgacttacttgactccccctc

SEQ ID NO: 178963 - DNA, 35 bp, Artificial Sequence
  Synthetic oligonucleotide
gcgttctccagccctctgttcgctcattacgcctc

SEQ ID NO: 178964 - DNA, 35 bp, Artificial Sequence
  Synthetic oligonucleotide
tccgccatctcgctctttatgttttgtacatcctc

SEQ ID NO: 178965 - DNA, 29 bp, Artificial Sequence
  Synthetic oligonucleotide
tcttacggcgcaacacatcaacatcgctc

SEQ ID NO: 178966 - DNA, 35 bp, Artificial Sequence
  Synthetic oligonucleotide
tcctgtccgacaacagctacactcccatgtttctc

SEQ ID NO: 178967 - DNA, 35 bp, Artificial Sequence
  Synthetic oligonucleotide
ttatcaccacagatccttcgctccgcccccttgtc

SEQ ID NO: 178968 - DNA, 35 bp, Artificial Sequence
  Synthetic oligonucleotide
agtgctcgtgcgccgccccttggtctacgtcattc

SEQ ID NO: 178969 - DNA, 35 bp, Artificial Sequence
  Synthetic oligonucleotide
ttggtgtgtcgactttttatccgtggtcttcgttc

SEQ ID NO: 178970 - DNA, 35 bp, Artificial Sequence
  Synthetic oligonucleotide
gtgaaatcgtagccgggctcagggcgggagggaag

SEQ ID NO: 178971 - DNA, 35 bp, Artificial Sequence
  Synthetic oligonucleotide
gaaacggtggtgaggtgaaaggtgggactgataag

SEQ ID NO: 178972 - DNA, 35 bp, Artificial Sequence
  Synthetic oligonucleotide
tgcccgccacgcctcaatatgcccacgccctcacg

SEQ ID NO: 178973 - DNA, 35 bp, Artificial Sequence
  Synthetic oligonucleotide
atggacccctctacgttgcatgtgcctctccgccg

SEQ ID NO: 178974 - DNA, 35 bp, Artificial Sequence
  Synthetic oligonucleotide
accgcccacgatcgccgctacacccgctttactcg

SEQ ID NO: 178975 - DNA, 35 bp, Artificial Sequence
  Synthetic oligonucleotide
cccaccgctccttgcttgtcctaactgaccattcg

SEQ ID NO: 178976 - DNA, 35 bp, Artificial Sequence
  Synthetic oligonucleotide
tgcaagggacggaagggcgcagaagatgacaaagg

SEQ ID NO: 178977 - DNA, 35 bp, Artificial Sequence
  Synthetic oligonucleotide
gcaaccgtccaatctccttcatgtccagttccagg

SEQ ID NO: 178978 - DNA, 35 bp, Artificial Sequence
  Synthetic oligonucleotide
gcctacggccatcatttccgcccccatatccccgg

SEQ ID NO: 178979 - DNA, 35 bp, Artificial Sequence
  Synthetic oligonucleotide
ttctcacccccccaccaggtcacgacaacctccgg

SEQ ID NO: 178980 - DNA, 35 bp, Artificial Sequence
  Synthetic oligonucleotide
tatgcacgcccgttatccaccgctccgttacctgg

SEQ ID NO: 178981 - DNA, 35 bp, Artificial Sequence
  Synthetic oligonucleotide
accacttctcccctctgccgtgccactgggacatg

SEQ ID NO: 178982 - DNA, 35 bp, Artificial Sequence
  Synthetic oligonucleotide
gttgcctcaaccaatcgcccttcccgtctctcttg

SEQ ID NO: 178983 - DNA, 35 bp, Artificial Sequence
  Synthetic oligonucleotide
tgcccgccggccccaaggatacccacctccgtttg

SEQ ID NO: 178984 - DNA, 35 bp, Artificial Sequence
  Synthetic oligonucleotide
ggaaacggcctgccctactcatccctgccgcacat

SEQ ID NO: 178985 - DNA, 35 bp, Artificial Sequence
  Synthetic oligonucleotide
ttgacgctatgggaggggacgggacgggagcggat

SEQ ID NO: 178986 - DNA, 35 bp, Artificial Sequence
  Synthetic oligonucleotide
atgggtgggggtggtccagtgtagccgggagggat

SEQ ID NO: 178987 - DNA, 35 bp, Artificial Sequence
  Synthetic oligonucleotide
tcacatgacctctgagttgggcccaccattttgat

SEQ ID NO: 178988 - DNA, 35 bp, Artificial Sequence
  Synthetic oligonucleotide
taccacgcctcccactcctgctgtcttgtaactat

SEQ ID NO: 178989 - DNA, 35 bp, Artificial Sequence
  Synthetic oligonucleotide
gcattatgcacctatctcgttcgttcatgtacact

SEQ ID NO: 178990 - DNA, 35 bp, Artificial Sequence
  Synthetic oligonucleotide
tgtccccgtcgcccctgcccacacgctcggagact

SEQ ID NO: 178991 - DNA, 35 bp, Artificial Sequence
  Synthetic oligonucleotide
agcgacccaactgccctggtttcgttgaacatcct

SEQ ID NO: 178992 - DNA, 35 bp, Artificial Sequence
  Synthetic oligonucleotide
gagagcagcctcactaggccgacgtcgcttctcct

SEQ ID NO: 178993 - DNA, 35 bp, Artificial Sequence
  Synthetic oligonucleotide
atggcgatccactgcattctctgcgcgctttcgct

SEQ ID NO: 178994 - DNA, 35 bp, Artificial Sequence
  Synthetic oligonucleotide
atcgcttgcatcgccgtcctgcgcattccgattct

SEQ ID NO: 178995 - DNA, 35 bp, Artificial Sequence
  Synthetic oligonucleotide
gctatcgcccctccgctcccatccttaagacttct

SEQ ID NO: 178996 - DNA, 35 bp, Artificial Sequence
  Synthetic oligonucleotide
tgagctgcctccttctttcaccgcctggcaaccgt

SEQ ID NO: 178997 - DNA, 35 bp, Artificial Sequence
  Synthetic oligonucleotide
ttcgatcccatcccctgttccattacggccttggt

SEQ ID NO: 178998 - DNA, 36 bp, Artificial Sequence
  Synthetic oligonucleotide
gccgagtccgtcaacgtccggtcgtttcttcccatt

SEQ ID NO: 178999 - DNA, 35 bp, Artificial Sequence
  Synthetic oligonucleotide
ttttcgcccatctcgtgcacggtttcgattccctt

SEQ ID NO: 179000 - DNA, 35 bp, Artificial Sequence
  Synthetic oligonucleotide
taccccgctagccgcacatgtacgcgccactcctt

SEQ ID NO: 179001 - DNA, 35 bp, Artificial Sequence
  Synthetic oligonucleotide
tcaccatccatctggcaccctagagagttttcctt

SEQ ID NO: 179002 - DNA, 35 bp, Artificial Sequence
  Synthetic oligonucleotide
gatcgccctcccaccacccgtagacctcactgctt

SEQ ID NO: 179003 - DNA, 35 bp, Artificial Sequence
  Synthetic oligonucleotide
gacacgcttaaatgctccgtcatgcctccttgctt

SEQ ID NO: 179004 - DNA, 35 bp, Artificial Sequence
  Synthetic oligonucleotide
ttccccctcctgccgtacttccacggtgacacgtt

SEQ ID NO: 179005 - DNA, 34 bp, Artificial Sequence
  Synthetic oligonucleotide
atgtcctgccgatccgtcacctgctatcacgttt

SEQ ID NO: 179006 - DNA, 36 bp, Artificial Sequence
  Synthetic oligonucleotide
acttcacgccgcccgtacctggttagcattttgaaa

SEQ ID NO: 179007 - DNA, 35 bp, Artificial Sequence
  Synthetic oligonucleotide
gccgtccccctcaccggtggccttggttcattaaa

SEQ ID NO: 179008 - DNA, 35 bp, Artificial Sequence
  Synthetic oligonucleotide
actcgccccgcaccccgtcccgaggcaattttaaa

SEQ ID NO: 179009 - DNA, 35 bp, Artificial Sequence
  Synthetic oligonucleotide
tagacagtggccgagggggtgaaggaggatgacaa

SEQ ID NO: 179010 - DNA, 36 bp, Artificial Sequence
  Synthetic oligonucleotide
gtttcgccactggtacctatctacgactcctgccaa

SEQ ID NO: 179011 - DNA, 35 bp, Artificial Sequence
  Synthetic oligonucleotide
gctggaggttgaatggggaggaagggggacacgaa

SEQ ID NO: 179012 - DNA, 35 bp, Artificial Sequence
  Synthetic oligonucleotide
ggttcacccctattgtttctatgtccactcacgaa

SEQ ID NO: 179013 - DNA, 36 bp, Artificial Sequence
  Synthetic oligonucleotide
tgcctaggggaaatggggggagaagcatggagggaa

SEQ ID NO: 179014 - DNA, 36 bp, Artificial Sequence
  Synthetic oligonucleotide
ttgcaacaccgtacgcctcacatctccacaggctaa

SEQ ID NO: 179015 - DNA, 36 bp, Artificial Sequence
  Synthetic oligonucleotide
gtaggggcggctggctcaagggggtgaagagggtaa

SEQ ID NO: 179016 - DNA, 35 bp, Artificial Sequence
  Synthetic oligonucleotide
accatccatccatcttgtctggccagagcttttaa

SEQ ID NO: 179017 - DNA, 36 bp, Artificial Sequence
  Synthetic oligonucleotide
tactccacaccttacctgcacgtccgctacccgcca

SEQ ID NO: 179018 - DNA, 36 bp, Artificial Sequence
  Synthetic oligonucleotide
gaccccagtgtgtccccagttcttgattttgcgcca

SEQ ID NO: 179019 - DNA, 35 bp, Artificial Sequence
  Synthetic oligonucleotide
tgactacgatatgattacgccgcccctgtactcca

SEQ ID NO: 179020 - DNA, 36 bp, Artificial Sequence
  Synthetic oligonucleotide
gcacctctccatagtcttcggcacattcccgttcca

SEQ ID NO: 179021 - DNA, 36 bp, Artificial Sequence
  Synthetic oligonucleotide
tgcccaccagctgacttccacgcgagcacacctgca

SEQ ID NO: 179022 - DNA, 35 bp, Artificial Sequence
  Synthetic oligonucleotide
actgcaccgtaaggctttaacacgctgccctttca

SEQ ID NO: 179023 - DNA, 37 bp, Artificial Sequence
  Synthetic oligonucleotide
gccgccccccctcaaccaccaacacctgagtctaaga

SEQ ID NO: 179024 - DNA, 37 bp, Artificial Sequence
  Synthetic oligonucleotide
ttgacgagtcaagggagggaggaaacggtcggtcaga

SEQ ID NO: 179025 - DNA, 37 bp, Artificial Sequence
  Synthetic oligonucleotide
caacaaagggaggaggggcttaggggacgagaggaga

SEQ ID NO: 179026 - DNA, 37 bp, Artificial Sequence
  Synthetic oligonucleotide
aaaaccatgcgcatgggagggttacaggggggggaga

SEQ ID NO: 179027 - DNA, 37 bp, Artificial Sequence
  Synthetic oligonucleotide
gggatcatgtcgagaggaagggtagggaggtgggaga

SEQ ID NO: 179028 - DNA, 36 bp, Artificial Sequence
  Synthetic oligonucleotide
gtacgctcgggtgagggggtggtgggaggatataga

SEQ ID NO: 179029 - DNA, 37 bp, Artificial Sequence
  Synthetic oligonucleotide
tccaaacgggcgggtgggcaagtatgggattctacga

SEQ ID NO: 179030 - DNA, 37 bp, Artificial Sequence
  Synthetic oligonucleotide
gttccccccgtgcgatcgaccgtcttccagtacccga

SEQ ID NO: 179031 - DNA, 37 bp, Artificial Sequence
  Synthetic oligonucleotide
acgtcgcctactccgcactatccatgtctgtcgccga

SEQ ID NO: 179032 - DNA, 37 bp, Artificial Sequence
  Synthetic oligonucleotide
atcaccgctctctgccctgcatatgtcccgccctcga

SEQ ID NO: 179033 - DNA, 35 bp, Artificial Sequence
  Synthetic oligonucleotide
agaagggaaggggaagggagctcgtagataaagga

SEQ ID NO: 179034 - DNA, 37 bp, Artificial Sequence
  Synthetic oligonucleotide
ggatggacggataggaaagggaactctgaggagagga

SEQ ID NO: 179035 - DNA, 37 bp, Artificial Sequence
  Synthetic oligonucleotide
gtcgattccggcggaaggtggggtctggatggccgga

SEQ ID NO: 179036 - DNA, 37 bp, Artificial Sequence
  Synthetic oligonucleotide
ggagtggaggaataaatggggctcagcaggaggcgga

SEQ ID NO: 179037 - DNA, 37 bp, Artificial Sequence
  Synthetic oligonucleotide
gacgcgagaagtttagggcgtggggggtgggtgcgga

SEQ ID NO: 179038 - DNA, 37 bp, Artificial Sequence
  Synthetic oligonucleotide
gaaagctgtaatgtggagggtggggcttcagggggga

SEQ ID NO: 179039 - DNA, 37 bp, Artificial Sequence
  Synthetic oligonucleotide
aacgccaattctcccgtactgcctccgttaccttgga

SEQ ID NO: 179040 - DNA, 37 bp, Artificial Sequence
  Synthetic oligonucleotide
gtaccttcgcatccctcgccctgtcgctcctgcctga

SEQ ID NO: 179041 - DNA, 38 bp, Artificial Sequence
  Synthetic oligonucleotide
gaccagtgccggattgctactctgtttccgcctcctga

SEQ ID NO: 179042 - DNA, 37 bp, Artificial Sequence
  Synthetic oligonucleotide
ggatcacagtcgatgatgcccccgcacttcctcctga

SEQ ID NO: 179043 - DNA, 38 bp, Artificial Sequence
  Synthetic oligonucleotide
tccaggtcagcttttgctctggctggttacccctctga

SEQ ID NO: 179044 - DNA, 36 bp, Artificial Sequence
  Synthetic oligonucleotide
gggatggggaagtacggagggggtagtaataagtga

SEQ ID NO: 179045 - DNA, 38 bp, Artificial Sequence
  Synthetic oligonucleotide
accatctcaacccgtgcgcccggccttttcctacgtga

SEQ ID NO: 179046 - DNA, 38 bp, Artificial Sequence
  Synthetic oligonucleotide
ggtagacccccctgcctcagaccactctgcccctgtga

SEQ ID NO: 179047 - DNA, 38 bp, Artificial Sequence
  Synthetic oligonucleotide
atgtgggaaatggaggggagggtgggttaagagattga

SEQ ID NO: 179048 - DNA, 38 bp, Artificial Sequence
  Synthetic oligonucleotide
ttgaaccgatcgagcgcatcaccaccttcaacccttga

SEQ ID NO: 179049 - DNA, 35 bp, Artificial Sequence
  Synthetic oligonucleotide
tctgctcacgcctccactctctatgcggcccttga

SEQ ID NO: 179050 - DNA, 38 bp, Artificial Sequence
  Synthetic oligonucleotide
tcccccctcccctgatccgtgctttcgaagtcagttga

SEQ ID NO: 179051 - DNA, 38 bp, Artificial Sequence
  Synthetic oligonucleotide
gagatatcgtccagaggggcggaaggggagggagttga

SEQ ID NO: 179052 - DNA, 37 bp, Artificial Sequence
  Synthetic oligonucleotide
tatactcccaccgccccgacacagcacctatggttga

SEQ ID NO: 179053 - DNA, 38 bp, Artificial Sequence
  Synthetic oligonucleotide
tgtacccgtcagatccccccttccaccgcgttgtttga

SEQ ID NO: 179054 - DNA, 35 bp, Artificial Sequence
  Synthetic oligonucleotide
gtttgccctgcacccccctcagttaccaatctata

SEQ ID NO: 179055 - DNA, 36 bp, Artificial Sequence
  Synthetic oligonucleotide
gacccacctgcccattgttacgacccacctttacta

SEQ ID NO: 179056 - DNA, 35 bp, Artificial Sequence
  Synthetic oligonucleotide
gaggtggaattggggagcgcgggggaatgcagcta

SEQ ID NO: 179057 - DNA, 35 bp, Artificial Sequence
  Synthetic oligonucleotide
gataggccgccagccttgtcacgccctctacgcta

SEQ ID NO: 179058 - DNA, 36 bp, Artificial Sequence
  Synthetic oligonucleotide
tgatggggcgagtggccgggtgggggaaaattggta

SEQ ID NO: 179059 - DNA, 36 bp, Artificial Sequence
  Synthetic oligonucleotide
agctcccgtcctgcgattcgcccccccacggcatta

SEQ ID NO: 179060 - DNA, 36 bp, Artificial Sequence
  Synthetic oligonucleotide
tcacgccccacttgccttaaataatcaccgctttta

SEQ ID NO: 179061 - DNA, 35 bp, Artificial Sequence
  Synthetic oligonucleotide
gtacccctcgagcctatgagtcttgctcctgtaac

SEQ ID NO: 179062 - DNA, 35 bp, Artificial Sequence
  Synthetic oligonucleotide
atcgacacccgtacgccacgtttccgcacatccac

SEQ ID NO: 179063 - DNA, 35 bp, Artificial Sequence
  Synthetic oligonucleotide
ttccgaacacccctgtcgcaattctcgacctccac

SEQ ID NO: 179064 - DNA, 35 bp, Artificial Sequence
  Synthetic oligonucleotide
tagacgccaccgtcccgtttccgtcctcctgtcac

SEQ ID NO: 179065 - DNA, 35 bp, Artificial Sequence
  Synthetic oligonucleotide
gcccgatccgccagaccgatctattatagccctac

SEQ ID NO: 179066 - DNA, 35 bp, Artificial Sequence
  Synthetic oligonucleotide
ttgtcgatcccctgttcatggcctcgtgtgccacc

SEQ ID NO: 179067 - DNA, 35 bp, Artificial Sequence
  Synthetic oligonucleotide
acatttgggcgcagattcccatgtcgccgcttacc

SEQ ID NO: 179068 - DNA, 35 bp, Artificial Sequence
  Synthetic oligonucleotide
acacgtgcctacactggtctcctacatcctttacc

SEQ ID NO: 179069 - DNA, 35 bp, Artificial Sequence
  Synthetic oligonucleotide
ggtctaccgcacgtagtttacttcggcctccgccc

SEQ ID NO: 179070 - DNA, 35 bp, Artificial Sequence
  Synthetic oligonucleotide
tgtataccacccgccaactatgatacgctaatccc

SEQ ID NO: 179071 - DNA, 35 bp, Artificial Sequence
  Synthetic oligonucleotide
tcatgcacgcatgccatcatgtacacccgggtccc

SEQ ID NO: 179072 - DNA, 35 bp, Artificial Sequence
  Synthetic oligonucleotide
gtgggcgcctagccacacccattaacacgcccgcc

SEQ ID NO: 179073 - DNA, 34 bp, Artificial Sequence
  Synthetic oligonucleotide
tctgtacctgtagtacctctttgaccatgcctcc

SEQ ID NO: 179074 - DNA, 35 bp, Artificial Sequence
  Synthetic oligonucleotide
tacttccccgtcgcctagttgcttatcgcctgtcc

SEQ ID NO: 179075 - DNA, 35 bp, Artificial Sequence
  Synthetic oligonucleotide
acatacagactggggtccgttatcttccttcttcc

SEQ ID NO: 179076 - DNA, 35 bp, Artificial Sequence
  Synthetic oligonucleotide
gttacgctccaatatgcttttccactttcctttcc

SEQ ID NO: 179077 - DNA, 35 bp, Artificial Sequence
  Synthetic oligonucleotide
gtcccgtactcgccccatcgctccgaccgttttcc

SEQ ID NO: 179078 - DNA, 35 bp, Artificial Sequence
  Synthetic oligonucleotide
tcacccccgtgtgtaacgtttcaccgcatgaccgc

SEQ ID NO: 179079 - DNA, 35 bp, Artificial Sequence
  Synthetic oligonucleotide
ggattgaccccaacccgcctgcccttgtagatcgc

SEQ ID NO: 179080 - DNA, 35 bp, Artificial Sequence
  Synthetic oligonucleotide
agatccaccgctcttggtcgaaaccgcatacatgc

SEQ ID NO: 179081 - DNA, 35 bp, Artificial Sequence
  Synthetic oligonucleotide
actcccacgttcacaacatggagcccatcccctgc

SEQ ID NO: 179082 - DNA, 35 bp, Artificial Sequence
  Synthetic oligonucleotide
gatgcgctcaggcgacccccgccaccttgccctgc

SEQ ID NO: 179083 - DNA, 31 bp, Artificial Sequence
  Synthetic oligonucleotide
gaactcacaaccatcggtacccgcctcttgc

SEQ ID NO: 179084 - DNA, 35 bp, Artificial Sequence
  Synthetic oligonucleotide
gagctctccgtgcggttcttcgcctccaccacatc

SEQ ID NO: 179085 - DNA, 35 bp, Artificial Sequence
  Synthetic oligonucleotide
tcactcattcgatccaatactgccagaagcccatc

SEQ ID NO: 179086 - DNA, 35 bp, Artificial Sequence
  Synthetic oligonucleotide
tgcacggtcataacttgcttaatggtcttctcatc

SEQ ID NO: 179087 - DNA, 35 bp, Artificial Sequence
  Synthetic oligonucleotide
atcgccgctgttgcttttgaaacccccccacgatc

SEQ ID NO: 179088 - DNA, 35 bp, Artificial Sequence
  Synthetic oligonucleotide
ttacacgccgcatatccgcgtgtctcactcttatc

SEQ ID NO: 179089 - DNA, 35 bp, Artificial Sequence
  Synthetic oligonucleotide
tgttgtcgacccataaaatgttccgttctgcactc

SEQ ID NO: 179090 - DNA, 35 bp, Artificial Sequence
  Synthetic oligonucleotide
gagtttaactgtccccgtctcgctggtcttccctc

SEQ ID NO: 179091 - DNA, 35 bp, Artificial Sequence
  Synthetic oligonucleotide
gatcacactggtacaatgccttgccgcccccgctc

SEQ ID NO: 179092 - DNA, 35 bp, Artificial Sequence
  Synthetic oligonucleotide
taccctgcgctgagtacgtctctcggctacctctc

SEQ ID NO: 179093 - DNA, 35 bp, Artificial Sequence
  Synthetic oligonucleotide
acgatgctatttctgtttgcgctccgactctcgtc

SEQ ID NO: 179094 - DNA, 35 bp, Artificial Sequence
  Synthetic oligonucleotide
gtgaaagctacactgcatgctccccacgtcccttc

SEQ ID NO: 179095 - DNA, 35 bp, Artificial Sequence
  Synthetic oligonucleotide
atccatacacccccgctggtgtggttaattccttc

SEQ ID NO: 179096 - DNA, 35 bp, Artificial Sequence
  Synthetic oligonucleotide
acgctccacatttccatccctcggtctgttccttc

SEQ ID NO: 179097 - DNA, 35 bp, Artificial Sequence
  Synthetic oligonucleotide
gcatgtatccctcctcgcgactgttctttccgttc

SEQ ID NO: 179098 - DNA, 36 bp, Artificial Sequence
  Synthetic oligonucleotide
acctcaagtggcgctcctgttctccttcgccagacg

SEQ ID NO: 179099 - DNA, 34 bp, Artificial Sequence
  Synthetic oligonucleotide
gatctcacccgcccccgcttttgaaccagctacg

SEQ ID NO: 179100 - DNA, 35 bp, Artificial Sequence
  Synthetic oligonucleotide
tgacatgccgccgcccgtctcccctggcctctccg

SEQ ID NO: 179101 - DNA, 35 bp, Artificial Sequence
  Synthetic oligonucleotide
gtacgggttgaatgataggggggaatgggagtgcg

SEQ ID NO: 179102 - DNA, 35 bp, Artificial Sequence
  Synthetic oligonucleotide
gtcgcacgtcgtccgcttaatcgccacttctctcg

SEQ ID NO: 179103 - DNA, 35 bp, Artificial Sequence
  Synthetic oligonucleotide
tgccccctccacggtacaattgcacgtcctgccgg

SEQ ID NO: 179104 - DNA, 35 bp, Artificial Sequence
  Synthetic oligonucleotide
tcccagccgacccgtcccttgcaccctggcttcgg

SEQ ID NO: 179105 - DNA, 35 bp, Artificial Sequence
  Synthetic oligonucleotide
gcgaggaggggaggtggtagccagggcgcacaggg

SEQ ID NO: 179106 - DNA, 36 bp, Artificial Sequence
  Synthetic oligonucleotide
tctctgcacgtgtaatgtcctctcgtcccctcctgg

SEQ ID NO: 179107 - DNA, 37 bp, Artificial Sequence
  Synthetic oligonucleotide
ggaggtggtggggtggacttatggcggtacctgttgg

SEQ ID NO: 179108 - DNA, 35 bp, Artificial Sequence
  Synthetic oligonucleotide
aacgtggtgggtagtgggaaaggggtcgaggtatg

SEQ ID NO: 179109 - DNA, 35 bp, Artificial Sequence
  Synthetic oligonucleotide
gtctcaggtccgtttacctttgcatctccaccctg

SEQ ID NO: 179110 - DNA, 35 bp, Artificial Sequence
  Synthetic oligonucleotide
ttgtaccgattgcgccgagtcctattaccctcctg

SEQ ID NO: 179111 - DNA, 35 bp, Artificial Sequence
  Synthetic oligonucleotide
attctttgcccccatgtcgcaccatacttgctgtg

SEQ ID NO: 179112 - DNA, 35 bp, Artificial Sequence
  Synthetic oligonucleotide
gtccgcccacacgtgccttccacctcatgaaattg

SEQ ID NO: 179113 - DNA, 35 bp, Artificial Sequence
  Synthetic oligonucleotide
tggtggagagtggggggcgttaggaggagctaaat

SEQ ID NO: 179114 - DNA, 35 bp, Artificial Sequence
  Synthetic oligonucleotide
tacccgtggtcgtgcgatcaagatccccgctccat

SEQ ID NO: 179115 - DNA, 35 bp, Artificial Sequence
  Synthetic oligonucleotide
atagtaccccgggtatgggagggtggggctcgcat

SEQ ID NO: 179116 - DNA, 35 bp, Artificial Sequence
  Synthetic oligonucleotide
gtaccatgtacagacgttacctccacccattgcat

SEQ ID NO: 179117 - DNA, 35 bp, Artificial Sequence
  Synthetic oligonucleotide
tctctttgccccgccgtaccctggcatctgctact

SEQ ID NO: 179118 - DNA, 35 bp, Artificial Sequence
  Synthetic oligonucleotide
actcgcaacacgcaatgcccttctcaatcgttact

SEQ ID NO: 179119 - DNA, 35 bp, Artificial Sequence
  Synthetic oligonucleotide
ttacaactcccccgcccgcagtatgcttccaacct

SEQ ID NO: 179120 - DNA, 35 bp, Artificial Sequence
  Synthetic oligonucleotide
ttcaacactcgcctcggtagccttcctcgcaacct

SEQ ID NO: 179121 - DNA, 35 bp, Artificial Sequence
  Synthetic oligonucleotide
ttcaccacttcacgtgcgcacgacgccatcaccct

SEQ ID NO: 179122 - DNA, 35 bp, Artificial Sequence
  Synthetic oligonucleotide
acccccctcgttgtcatcataatccgccggagcct

SEQ ID NO: 179123 - DNA, 35 bp, Artificial Sequence
  Synthetic oligonucleotide
atcattgcctgtccgcgcgcccctcttataggcct

SEQ ID NO: 179124 - DNA, 35 bp, Artificial Sequence
  Synthetic oligonucleotide
gtcacccccgtgtgggatccagcgcctctcgtcct

SEQ ID NO: 179125 - DNA, 35 bp, Artificial Sequence
  Synthetic oligonucleotide
tagggccgcgctgttaacccgttttctcgccctct

SEQ ID NO: 179126 - DNA, 35 bp, Artificial Sequence
  Synthetic oligonucleotide
accaatccgtcgcgagggtctcgatcgtcctctct

SEQ ID NO: 179127 - DNA, 35 bp, Artificial Sequence
  Synthetic oligonucleotide
ggaggtcgggcgctgcgttatccccggttttctct

SEQ ID NO: 179128 - DNA, 35 bp, Artificial Sequence
  Synthetic oligonucleotide
ttacgactacagtcgtctatgccctatgtccttct

SEQ ID NO: 179129 - DNA, 35 bp, Artificial Sequence
  Synthetic oligonucleotide
tccctaccccgttagtactctcgtttacggcttct

SEQ ID NO: 179130 - DNA, 35 bp, Artificial Sequence
  Synthetic oligonucleotide
gaactggtcaccgcgctgcccgtatcaccaccatt

SEQ ID NO: 179131 - DNA, 35 bp, Artificial Sequence
  Synthetic oligonucleotide
gctgtacaccccggcaagcatcgtttcgtcccctt

SEQ ID NO: 179132 - DNA, 35 bp, Artificial Sequence
  Synthetic oligonucleotide
aacgcgccattgtctcaccgactcgtactgccctt

SEQ ID NO: 179133 - DNA, 35 bp, Artificial Sequence
  Synthetic oligonucleotide
tgcgtacatcagcatttcacaccccccaacgcgtt

SEQ ID NO: 179134 - DNA, 35 bp, Artificial Sequence
  Synthetic oligonucleotide
gacagttgcagggggggggacggtgtagcggcaaa

SEQ ID NO: 179135 - DNA, 36 bp, Artificial Sequence
  Synthetic oligonucleotide
attggccacaaccatgtctcatatctccgttaccaa

SEQ ID NO: 179136 - DNA, 35 bp, Artificial Sequence
  Synthetic oligonucleotide
gctccatccgcaattcacgtactgggggaacccaa

SEQ ID NO: 179137 - DNA, 35 bp, Artificial Sequence
  Synthetic oligonucleotide
acacgggcggagaaaagagagggggagatagcgaa

SEQ ID NO: 179138 - DNA, 35 bp, Artificial Sequence
  Synthetic oligonucleotide
tgggcgagaaacgggcgggggggaatgttcgcgaa

SEQ ID NO: 179139 - DNA, 36 bp, Artificial Sequence
  Synthetic oligonucleotide
tgagatatggggggaaggaaaaggaactggtgggaa

SEQ ID NO: 179140 - DNA, 36 bp, Artificial Sequence
  Synthetic oligonucleotide
ttgccctctgatcctgtttctcccccctgcaatgaa

SEQ ID NO: 179141 - DNA, 36 bp, Artificial Sequence
  Synthetic oligonucleotide
aagcactcccacagcatgttttcgcacctctttgaa

SEQ ID NO: 179142 - DNA, 36 bp, Artificial Sequence
  Synthetic oligonucleotide
tatgtgggaggagaagcgaggcgctggagaagaaca

SEQ ID NO: 179143 - DNA, 36 bp, Artificial Sequence
  Synthetic oligonucleotide
gagcgccagccgtccccacagcctcctgcttacaca

SEQ ID NO: 179144 - DNA, 36 bp, Artificial Sequence
  Synthetic oligonucleotide
gcttccgccggcatgtggctccacccgccctcgaca

SEQ ID NO: 179145 - DNA, 35 bp, Artificial Sequence
  Synthetic oligonucleotide
gtcccgcctccgaccatcacttccacgaagcacca

SEQ ID NO: 179146 - DNA, 35 bp, Artificial Sequence
  Synthetic oligonucleotide
tacgcctcctcgggttgcctttaggttgatcacca

SEQ ID NO: 179147 - DNA, 34 bp, Artificial Sequence
  Synthetic oligonucleotide
tgcgaccctgctgagtggctctgtcccttatcca

SEQ ID NO: 179148 - DNA, 29 bp, Artificial Sequence
  Synthetic oligonucleotide
agtgacctgtcacctaacgcccatctcca

SEQ ID NO: 179149 - DNA, 36 bp, Artificial Sequence
  Synthetic oligonucleotide
tcggggctctgcttcgtctgccaccctgtactatca

SEQ ID NO: 179150 - DNA, 35 bp, Artificial Sequence
  Synthetic oligonucleotide
gtcccctcggcacaagcatccagcgccctccctca

SEQ ID NO: 179151 - DNA, 36 bp, Artificial Sequence
  Synthetic oligonucleotide
gttgcccgcctttcgcattgcgtgatttcatcctca

SEQ ID NO: 179152 - DNA, 36 bp, Artificial Sequence
  Synthetic oligonucleotide
tccacaggtcctgtgcgtcacccgcggttgctctca

SEQ ID NO: 179153 - DNA, 36 bp, Artificial Sequence
  Synthetic oligonucleotide
caacccggcgcccgcaaatcgtgcggtttcttctca

SEQ ID NO: 179154 - DNA, 36 bp, Artificial Sequence
  Synthetic oligonucleotide
gtacactccaactcctgcttaagtcctcgctcttca

SEQ ID NO: 179155 - DNA, 36 bp, Artificial Sequence
  Synthetic oligonucleotide
tgctccgtgccgcaggtgtattctggcccttcttca

SEQ ID NO: 179156 - DNA, 37 bp, Artificial Sequence
  Synthetic oligonucleotide
tagctggagggggggggccgtttacggagagggaaga

SEQ ID NO: 179157 - DNA, 37 bp, Artificial Sequence
  Synthetic oligonucleotide
gcatcctgcccgctttcttccctgacagttcaagaga

SEQ ID NO: 179158 - DNA, 37 bp, Artificial Sequence
  Synthetic oligonucleotide
ttaggaaggtgcggggatacggggtcatgggcggaga

SEQ ID NO: 179159 - DNA, 37 bp, Artificial Sequence
  Synthetic oligonucleotide
gcgggaatacgcacgtcgggggaggaggaggtggaga

SEQ ID NO: 179160 - DNA, 37 bp, Artificial Sequence
  Synthetic oligonucleotide
acgcctctcacttgccgtactttcctcctgcggacga

SEQ ID NO: 179161 - DNA, 36 bp, Artificial Sequence
  Synthetic oligonucleotide
aaggacaccgctccccattgtgaaaccccgcaccga

SEQ ID NO: 179162 - DNA, 37 bp, Artificial Sequence
  Synthetic oligonucleotide
tgaccaacgcccccttgactcttttgatgcccgccga

SEQ ID NO: 179163 - DNA, 36 bp, Artificial Sequence
  Synthetic oligonucleotide
tagagggaggaggacaactaggggaagtctgagcga

SEQ ID NO: 179164 - DNA, 36 bp, Artificial Sequence
  Synthetic oligonucleotide
tctcgctcccgccgcccttagcgctctgtctcgcga

SEQ ID NO: 179165 - DNA, 37 bp, Artificial Sequence
  Synthetic oligonucleotide
gccccaccctccgttctaagcgaaatcttccgttcga

SEQ ID NO: 179166 - DNA, 36 bp, Artificial Sequence
  Synthetic oligonucleotide
tccccacctaccccagtttgcactcctcaaccagga

SEQ ID NO: 179167 - DNA, 37 bp, Artificial Sequence
  Synthetic oligonucleotide
tgcccagggtagggtggggctattagggggatgagga

SEQ ID NO: 179168 - DNA, 37 bp, Artificial Sequence
  Synthetic oligonucleotide
acttgcaccgcccgttgcattgacccccgaccccgga

SEQ ID NO: 179169 - DNA, 37 bp, Artificial Sequence
  Synthetic oligonucleotide
aagcacagtttacagggaaaggggggaaaggcgggga

SEQ ID NO: 179170 - DNA, 38 bp, Artificial Sequence
  Synthetic oligonucleotide
acaccactgtcgacctcgtgcatctcactatcccatga

SEQ ID NO: 179171 - DNA, 38 bp, Artificial Sequence
  Synthetic oligonucleotide
aaggggatagggaggcggaggaatagggagagccatga

SEQ ID NO: 179172 - DNA, 37 bp, Artificial Sequence
  Synthetic oligonucleotide
tccgcctcctccccctgcttatgttgaaccccgatga

SEQ ID NO: 179173 - DNA, 37 bp, Artificial Sequence
  Synthetic oligonucleotide
gcccgcaacccctccgatatatcatcttgccccctga

SEQ ID NO: 179174 - DNA, 38 bp, Artificial Sequence
  Synthetic oligonucleotide
gtctccctctacccctggtgcctgtcccttgtccctga

SEQ ID NO: 179175 - DNA, 37 bp, Artificial Sequence
  Synthetic oligonucleotide
gaacaccagtcattctccccatgctcacccgtcctga

SEQ ID NO: 179176 - DNA, 38 bp, Artificial Sequence
  Synthetic oligonucleotide
tgcggctcccatccgtaatacgcccttcgccatgctga

SEQ ID NO: 179177 - DNA, 38 bp, Artificial Sequence
  Synthetic oligonucleotide
ttggtcagccaccgccgttatgttctactcacctctga

SEQ ID NO: 179178 - DNA, 38 bp, Artificial Sequence
  Synthetic oligonucleotide
gccacgccactccgctccacgcctgtccctgtctctga

SEQ ID NO: 179179 - DNA, 37 bp, Artificial Sequence
  Synthetic oligonucleotide
gaatgggagggtagggatgccgcgggacttggagtga

SEQ ID NO: 179180 - DNA, 38 bp, Artificial Sequence
  Synthetic oligonucleotide
gggtcgcaggccgagagcgaagggaaggggaatggtga

SEQ ID NO: 179181 - DNA, 36 bp, Artificial Sequence
  Synthetic oligonucleotide
ctaacaggggtcgcgggggggaagggacgattgtga

SEQ ID NO: 179182 - DNA, 38 bp, Artificial Sequence
  Synthetic oligonucleotide
tactccatcactcgcctgtaactgctggtcccacttga

SEQ ID NO: 179183 - DNA, 35 bp, Artificial Sequence
  Synthetic oligonucleotide
ggccatgtccgtctcagccgcccgtaccttcttga

SEQ ID NO: 179184 - DNA, 38 bp, Artificial Sequence
  Synthetic oligonucleotide
tgtgggggtagggaaagggcacaaggtgaaacggttga

SEQ ID NO: 179185 - DNA, 37 bp, Artificial Sequence
  Synthetic oligonucleotide
gaggcggggttggggcggctagggggaagttggttga

SEQ ID NO: 179186 - DNA, 38 bp, Artificial Sequence
  Synthetic oligonucleotide
agcaccaagctctgcttcaagacctcccgcctctttga

SEQ ID NO: 179187 - DNA, 36 bp, Artificial Sequence
  Synthetic oligonucleotide
tcccttgcctccgatcctttgtcgtcccaggtaata

SEQ ID NO: 179188 - DNA, 36 bp, Artificial Sequence
  Synthetic oligonucleotide
tgatgaagggtgggtggagtgggcctgcttgctata

SEQ ID NO: 179189 - DNA, 36 bp, Artificial Sequence
  Synthetic oligonucleotide
acgccgcacagccttgctatctgtcctggctctcta

SEQ ID NO: 179190 - DNA, 36 bp, Artificial Sequence
  Synthetic oligonucleotide
agacccgcacctccctccgtcttaagcgcacgagta

SEQ ID NO: 179191 - DNA, 36 bp, Artificial Sequence
  Synthetic oligonucleotide
gacgtgtcatgaaaccgccttttctcgccgcccgta

SEQ ID NO: 179192 - DNA, 35 bp, Artificial Sequence
  Synthetic oligonucleotide
gccactgcctcctgtttacttaacatctacgggta

SEQ ID NO: 179193 - DNA, 35 bp, Artificial Sequence
  Synthetic oligonucleotide
aggtggaaggcggggggtattacaggcggatggta

SEQ ID NO: 179194 - DNA, 35 bp, Artificial Sequence
  Synthetic oligonucleotide
acgccactccgctgcttctcggtaaatacccctta

SEQ ID NO: 179195 - DNA, 35 bp, Artificial Sequence
  Synthetic oligonucleotide
gagggatggagaaggcggaggattgtaggaagtta

SEQ ID NO: 179196 - DNA, 36 bp, Artificial Sequence
  Synthetic oligonucleotide
tccaatctccacatccacccgatctgtactacgtta

SEQ ID NO: 179197 - DNA, 35 bp, Artificial Sequence
  Synthetic oligonucleotide
tcacctggtcctgtcaatcctcccgcacttggtta

SEQ ID NO: 179198 - DNA, 36 bp, Artificial Sequence
  Synthetic oligonucleotide
ttgtggcctccctgcttctacgtttcccggttttta

SEQ ID NO: 179199 - DNA, 35 bp, Artificial Sequence
  Synthetic oligonucleotide
ctactgatcgctccatggtctacttccgcggacac

SEQ ID NO: 179200 - DNA, 35 bp, Artificial Sequence
  Synthetic oligonucleotide
taacgttccgccgtcgctttcatttcccgggccac

SEQ ID NO: 179201 - DNA, 35 bp, Artificial Sequence
  Synthetic oligonucleotide
ataacatgcgcctcgactctcagccacctgttcac

SEQ ID NO: 179202 - DNA, 34 bp, Artificial Sequence
  Synthetic oligonucleotide
accgccacactcgcttttctctttacgaattgac

SEQ ID NO: 179203 - DNA, 35 bp, Artificial Sequence
  Synthetic oligonucleotide
tcaccttccactcatggtccagagcatgtccctac

SEQ ID NO: 179204 - DNA, 35 bp, Artificial Sequence
  Synthetic oligonucleotide
ttcagcaccagttcgcgttttacaccaccttttac

SEQ ID NO: 179205 - DNA, 35 bp, Artificial Sequence
  Synthetic oligonucleotide
gtgtcgccaaatagtgcgttggccttccgttaacc

SEQ ID NO: 179206 - DNA, 35 bp, Artificial Sequence
  Synthetic oligonucleotide
atcaagagtgcgcgtttttccccgtgcgttccacc

SEQ ID NO: 179207 - DNA, 34 bp, Artificial Sequence
  Synthetic oligonucleotide
acccatccatgttcgcccccgggcctaccgcacc

SEQ ID NO: 179208 - DNA, 35 bp, Artificial Sequence
  Synthetic oligonucleotide
gtccatcatctcactaagtcgtggttccaccgccc

SEQ ID NO: 179209 - DNA, 35 bp, Artificial Sequence
  Synthetic oligonucleotide
gtcgcccttctgcttgccgcgccgttaacacagcc

SEQ ID NO: 179210 - DNA, 35 bp, Artificial Sequence
  Synthetic oligonucleotide
tccatccctaatctgcggtataactaacacccgcc

SEQ ID NO: 179211 - DNA, 35 bp, Artificial Sequence
  Synthetic oligonucleotide
gttcgcctctgaaattcctcttctggtgcttcgcc

SEQ ID NO: 179212 - DNA, 35 bp, Artificial Sequence
  Synthetic oligonucleotide
aaccatcaccttgttgctagcatgaacggtcctcc

SEQ ID NO: 179213 - DNA, 35 bp, Artificial Sequence
  Synthetic oligonucleotide
tcaaggagggtggggcgctaaggggagggttgtcc

SEQ ID NO: 179214 - DNA, 35 bp, Artificial Sequence
  Synthetic oligonucleotide
gactagggggcaggaggggagcggcatgagccagc

SEQ ID NO: 179215 - DNA, 35 bp, Artificial Sequence
  Synthetic oligonucleotide
aaaccatcccctgagtgtcgactccgtgcacccgc

SEQ ID NO: 179216 - DNA, 36 bp, Artificial Sequence
  Synthetic oligonucleotide
acctatgacgcagtaatcacctaacgccccgcccgc

SEQ ID NO: 179217 - DNA, 35 bp, Artificial Sequence
  Synthetic oligonucleotide
acccccttccccatgaacgtgacaacgcccctcgc

SEQ ID NO: 179218 - DNA, 35 bp, Artificial Sequence
  Synthetic oligonucleotide
tcatgcgggcgtcacccaagttatttcctcgtcgc

SEQ ID NO: 179219 - DNA, 35 bp, Artificial Sequence
  Synthetic oligonucleotide
gcttgtcactccgcccgcccgccacagcttggtgc

SEQ ID NO: 179220 - DNA, 34 bp, Artificial Sequence
  Synthetic oligonucleotide
tggaagccccctgccgcattttcgagtttcttgc

SEQ ID NO: 179221 - DNA, 35 bp, Artificial Sequence
  Synthetic oligonucleotide
gtccacaccgcgataagcccctacttcttcgttgc

SEQ ID NO: 179222 - DNA, 35 bp, Artificial Sequence
  Synthetic oligonucleotide
agatctagcggcccagtgatccgccgtcatccctc

SEQ ID NO: 179223 - DNA, 35 bp, Artificial Sequence
  Synthetic oligonucleotide
tgggactccgcatcctgttttctcttactgtgctc

SEQ ID NO: 179224 - DNA, 35 bp, Artificial Sequence
  Synthetic oligonucleotide
tgtccgactgtctataccagttcgccactcctctc

SEQ ID NO: 179225 - DNA, 35 bp, Artificial Sequence
  Synthetic oligonucleotide
gaacccagcttacacaccgttgatatgtgcccttc

SEQ ID NO: 179226 - DNA, 35 bp, Artificial Sequence
  Synthetic oligonucleotide
tttgacacgtaggctgttccccaactgtgcccttc

SEQ ID NO: 179227 - DNA, 35 bp, Artificial Sequence
  Synthetic oligonucleotide
agcacatcacgtctctaatccttctggtgtccttc

SEQ ID NO: 179228 - DNA, 35 bp, Artificial Sequence
  Synthetic oligonucleotide
tccatctgcccccagtgtcgcatcccccccctttc

SEQ ID NO: 179229 - DNA, 35 bp, Artificial Sequence
  Synthetic oligonucleotide
tcgccatccctctttgccaattcgtattttgtttc

SEQ ID NO: 179230 - DNA, 35 bp, Artificial Sequence
  Synthetic oligonucleotide
aacggagagaaggggggtgtgggtgcgttacaaag

SEQ ID NO: 179231 - DNA, 35 bp, Artificial Sequence
  Synthetic oligonucleotide
ttgccaatcggggggagcggagagcgggggtgaag

SEQ ID NO: 179232 - DNA, 35 bp, Artificial Sequence
  Synthetic oligonucleotide
gccaccatcataacggctatccgtccatctcgacg

SEQ ID NO: 179233 - DNA, 35 bp, Artificial Sequence
  Synthetic oligonucleotide
ttcaccaccctcatctgcgctgcctctccgcaccg

SEQ ID NO: 179234 - DNA, 35 bp, Artificial Sequence
  Synthetic oligonucleotide
actcggggagggtagtgcgggtggagtatgcgccg

SEQ ID NO: 179235 - DNA, 35 bp, Artificial Sequence
  Synthetic oligonucleotide
gatcggcccccccgctgtaacccgaacgtttgccg

SEQ ID NO: 179236 - DNA, 35 bp, Artificial Sequence
  Synthetic oligonucleotide
tgccagttcgtgtacgcctccacctgtatcatccg

SEQ ID NO: 179237 - DNA, 35 bp, Artificial Sequence
  Synthetic oligonucleotide
gatgagggaaggataagtgggaacagggttgggcg

SEQ ID NO: 179238 - DNA, 35 bp, Artificial Sequence
  Synthetic oligonucleotide
gtcgcccatacgtccttgctccgttcgttgcatcg

SEQ ID NO: 179239 - DNA, 35 bp, Artificial Sequence
  Synthetic oligonucleotide
tcagtacccccatcttccggcctgaatcgctttcg

SEQ ID NO: 179240 - DNA, 35 bp, Artificial Sequence
  Synthetic oligonucleotide
gtccctcaccggcatgctctcgcaacttctcacgg

SEQ ID NO: 179241 - DNA, 35 bp, Artificial Sequence
  Synthetic oligonucleotide
tcgaagtatgggggagcggaacaagggaaaagatg

SEQ ID NO: 179242 - DNA, 35 bp, Artificial Sequence
  Synthetic oligonucleotide
tgctacctcttgatccgttgggtcccctctcactg

SEQ ID NO: 179243 - DNA, 35 bp, Artificial Sequence
  Synthetic oligonucleotide
acctccatcgccgcagagaagcttttcccttactg

SEQ ID NO: 179244 - DNA, 35 bp, Artificial Sequence
  Synthetic oligonucleotide
attggcgaagttccgtttgatcccctgccgccctg

SEQ ID NO: 179245 - DNA, 35 bp, Artificial Sequence
  Synthetic oligonucleotide
tgcctgtgcactcgtgtgcccccgaccccttcctg

SEQ ID NO: 179246 - DNA, 35 bp, Artificial Sequence
  Synthetic oligonucleotide
gtgctctcgtcgcagatcgatttccttctcctttg

SEQ ID NO: 179247 - DNA, 35 bp, Artificial Sequence
  Synthetic oligonucleotide
ggggaaagggaaaatgagcagggtaggcgggtaat

SEQ ID NO: 179248 - DNA, 35 bp, Artificial Sequence
  Synthetic oligonucleotide
aaccccccccggtgcgcagtgtcttaccaccgcat

SEQ ID NO: 179249 - DNA, 35 bp, Artificial Sequence
  Synthetic oligonucleotide
ttgtaccctccgccgcctgattgtcaccggccgat

SEQ ID NO: 179250 - DNA, 35 bp, Artificial Sequence
  Synthetic oligonucleotide
tcccccactcggtcctcgcccccaatccttcctat

SEQ ID NO: 179251 - DNA, 35 bp, Artificial Sequence
  Synthetic oligonucleotide
ttgctaacctctcgtgtcccccttttggtctctat

SEQ ID NO: 179252 - DNA, 35 bp, Artificial Sequence
  Synthetic oligonucleotide
tatatcgtcgccgcccttctgttctcggacaacct

SEQ ID NO: 179253 - DNA, 35 bp, Artificial Sequence
  Synthetic oligonucleotide
gacaatgcagccctttcaatccgcgctcccgccct

SEQ ID NO: 179254 - DNA, 35 bp, Artificial Sequence
  Synthetic oligonucleotide
gtgagcttaagtgtcttgcttacgccgtccgccct

SEQ ID NO: 179255 - DNA, 35 bp, Artificial Sequence
  Synthetic oligonucleotide
gtttcagctcaacttcattgtcacctgcctgccct

SEQ ID NO: 179256 - DNA, 35 bp, Artificial Sequence
  Synthetic oligonucleotide
aacactcacccaactccgggcgccctgcttgccct

SEQ ID NO: 179257 - DNA, 35 bp, Artificial Sequence
  Synthetic oligonucleotide
tggtcatatgccgctgtacttccctgatcttccct

SEQ ID NO: 179258 - DNA, 35 bp, Artificial Sequence
  Synthetic oligonucleotide
atgctccccgaaccgctcctcgtgatttcgtgcct

SEQ ID NO: 179259 - DNA, 35 bp, Artificial Sequence
  Synthetic oligonucleotide
agattaccacagaccaaaggtcggcaccgccctct

SEQ ID NO: 179260 - DNA, 35 bp, Artificial Sequence
  Synthetic oligonucleotide
ttggggaacgggaagactgggggccggacagaggt

SEQ ID NO: 179261 - DNA, 35 bp, Artificial Sequence
  Synthetic oligonucleotide
gcacgaggcccgggatgaagacgggaggaacgggt

SEQ ID NO: 179262 - DNA, 35 bp, Artificial Sequence
  Synthetic oligonucleotide
gtagggaggggtcaccgtaatggggtaactggggt

SEQ ID NO: 179263 - DNA, 35 bp, Artificial Sequence
  Synthetic oligonucleotide
tcagtcccagcgagccccttgccaaccacgccctt

SEQ ID NO: 179264 - DNA, 35 bp, Artificial Sequence
  Synthetic oligonucleotide
gtctgaatcctgtcataccccgtaccttccccttt

SEQ ID NO: 179265 - DNA, 35 bp, Artificial Sequence
  Synthetic oligonucleotide
agaagccggatcacctgttgtctctcacgctcttt

SEQ ID NO: 179266 - DNA, 35 bp, Artificial Sequence
  Synthetic oligonucleotide
tacttgcagaccccgcttccgttcttaagcctttt

SEQ ID NO: 179267 - DNA, 36 bp, Artificial Sequence
  Synthetic oligonucleotide
gacccctgcccccctgtcttaccacactgttcaaaa

SEQ ID NO: 179268 - DNA, 36 bp, Artificial Sequence
  Synthetic oligonucleotide
tacgccaaactccgctgttcttacccccgtagacaa

SEQ ID NO: 179269 - DNA, 36 bp, Artificial Sequence
  Synthetic oligonucleotide
atacgcctcccgccgaccagtttctatcgcacccaa

SEQ ID NO: 179270 - DNA, 36 bp, Artificial Sequence
  Synthetic oligonucleotide
acctcacttctgtatatttcgccgccactcgcccaa

SEQ ID NO: 179271 - DNA, 36 bp, Artificial Sequence
  Synthetic oligonucleotide
tgccctccgcccaccattgtttttaccagccatcaa

SEQ ID NO: 179272 - DNA, 36 bp, Artificial Sequence
  Synthetic oligonucleotide
atccgaagggggaggatagtaaggagggcccgggaa

SEQ ID NO: 179273 - DNA, 35 bp, Artificial Sequence
  Synthetic oligonucleotide
gtaggggacgaagacacgaggtgaacaggggggaa

SEQ ID NO: 179274 - DNA, 35 bp, Artificial Sequence
  Synthetic oligonucleotide
gacgtttgccccgcctgcgcaccgccaccttggaa

SEQ ID NO: 179275 - DNA, 36 bp, Artificial Sequence
  Synthetic oligonucleotide
atgtcccgcattggttgccgccacactcccccataa

SEQ ID NO: 179276 - DNA, 36 bp, Artificial Sequence
  Synthetic oligonucleotide
tagttgtgtgcccacttcctgccttcaacactctaa

SEQ ID NO: 179277 - DNA, 36 bp, Artificial Sequence
  Synthetic oligonucleotide
tactcgaccaccatatgttttggcctcttatgcaca

SEQ ID NO: 179278 - DNA, 35 bp, Artificial Sequence
  Synthetic oligonucleotide
gtaccgtgtgtccagcacctctcgcccttcctaca

SEQ ID NO: 179279 - DNA, 36 bp, Artificial Sequence
  Synthetic oligonucleotide
acacccgggcctcttaccaccaaactgttgagtaca

SEQ ID NO: 179280 - DNA, 36 bp, Artificial Sequence
  Synthetic oligonucleotide
atgacaggcgccttctcccttgtcattccctttaca

SEQ ID NO: 179281 - DNA, 36 bp, Artificial Sequence
  Synthetic oligonucleotide
tctcatgttccgttagcgtttccgttgcccttacca

SEQ ID NO: 179282 - DNA, 35 bp, Artificial Sequence
  Synthetic oligonucleotide
acgacgatttgccagactagactccccgcccccca

SEQ ID NO: 179283 - DNA, 36 bp, Artificial Sequence
  Synthetic oligonucleotide
gtgcaccgcctcaaggccatttctcgaacctgccca

SEQ ID NO: 179284 - DNA, 36 bp, Artificial Sequence
  Synthetic oligonucleotide
gctatccgccacagatgatcccccgtcgccatccca

SEQ ID NO: 179285 - DNA, 36 bp, Artificial Sequence
  Synthetic oligonucleotide
gtcgaactccccccattgcgtacgcgacttaagcca

SEQ ID NO: 179286 - DNA, 36 bp, Artificial Sequence
  Synthetic oligonucleotide
atgctcccgatatgtcgccctcgttccttttcgcca

SEQ ID NO: 179287 - DNA, 35 bp, Artificial Sequence
  Synthetic oligonucleotide
tgcacaacagctttatgccctactatacccccgca

SEQ ID NO: 179288 - DNA, 35 bp, Artificial Sequence
  Synthetic oligonucleotide
gtaagccgctcaggtaagctctgttctcccccgca

SEQ ID NO: 179289 - DNA, 35 bp, Artificial Sequence
  Synthetic oligonucleotide
gtcattgccttgccggtttccatcacctcctcgca

SEQ ID NO: 179290 - DNA, 36 bp, Artificial Sequence
  Synthetic oligonucleotide
tttgccccctactctatacgcgccatgtcgctggca

SEQ ID NO: 179291 - DNA, 36 bp, Artificial Sequence
  Synthetic oligonucleotide
acacgtcaacctctttgcacggtaaccgccccttca

SEQ ID NO: 179292 - DNA, 36 bp, Artificial Sequence
  Synthetic oligonucleotide
tccatgtaccgccctagtatcctctgtaacgtttca

SEQ ID NO: 179293 - DNA, 38 bp, Artificial Sequence
  Synthetic oligonucleotide
gacgggggcacaggggagaatggggggacggagggaga

SEQ ID NO: 179294 - DNA, 37 bp, Artificial Sequence
  Synthetic oligonucleotide
acaatgagggattggggcgaggaaggggcgggggaga

SEQ ID NO: 179295 - DNA, 36 bp, Artificial Sequence
  Synthetic oligonucleotide
gatgaaaggggggggatggggactagttgaactaga

SEQ ID NO: 179296 - DNA, 37 bp, Artificial Sequence
  Synthetic oligonucleotide
gcaacggatggacaaggaggagagggggatagcacga

SEQ ID NO: 179297 - DNA, 37 bp, Artificial Sequence
  Synthetic oligonucleotide
tgtacgggagggtagggcatgacgggctttgtcccga

SEQ ID NO: 179298 - DNA, 36 bp, Artificial Sequence
  Synthetic oligonucleotide
tagcgctagcccccacgatcaccgtactcccgccga

SEQ ID NO: 179299 - DNA, 37 bp, Artificial Sequence
  Synthetic oligonucleotide
gtgccgcgcaggcagggggggcgggaggagaatccga

SEQ ID NO: 179300 - DNA, 37 bp, Artificial Sequence
  Synthetic oligonucleotide
gcggagggcggactagggcagggacggcaggatccga

SEQ ID NO: 179301 - DNA, 37 bp, Artificial Sequence
  Synthetic oligonucleotide
gtacagggcggggggtttaacggtcacggcggtccga

SEQ ID NO: 179302 - DNA, 37 bp, Artificial Sequence
  Synthetic oligonucleotide
gactctcgcacctgtattacccacggccatcaatcga

SEQ ID NO: 179303 - DNA, 37 bp, Artificial Sequence
  Synthetic oligonucleotide
gatacaacgcacactatgtctctgctacacacttcga

SEQ ID NO: 179304 - DNA, 37 bp, Artificial Sequence
  Synthetic oligonucleotide
acatggcgggtgggagggcctgttataatgacacgga

SEQ ID NO: 179305 - DNA, 37 bp, Artificial Sequence
  Synthetic oligonucleotide
gtcccgcccactactgtcgtaaacctcccgccgcgga

SEQ ID NO: 179306 - DNA, 36 bp, Artificial Sequence
  Synthetic oligonucleotide
ggacgtggaagggcggggattgggatcggcttcgga

SEQ ID NO: 179307 - DNA, 37 bp, Artificial Sequence
  Synthetic oligonucleotide
tgtgagaagtccgacggggaggatggcacaacaggga

SEQ ID NO: 179308 - DNA, 37 bp, Artificial Sequence
  Synthetic oligonucleotide
gtacccgcgtcgggatggagtttaagggcgggaggga

SEQ ID NO: 179309 - DNA, 37 bp, Artificial Sequence
  Synthetic oligonucleotide
ggtcaagggggagggctatgcagggcatcggacggga

SEQ ID NO: 179310 - DNA, 37 bp, Artificial Sequence
  Synthetic oligonucleotide
tggggaaagaccagggcgtgggacgtctcttggggga

SEQ ID NO: 179311 - DNA, 37 bp, Artificial Sequence
  Synthetic oligonucleotide
ttcggggatctctgatgatgggggtggggcatgggga

SEQ ID NO: 179312 - DNA, 37 bp, Artificial Sequence
  Synthetic oligonucleotide
gtgatgcgtagaggggaatgggaggggcaacgctgga

SEQ ID NO: 179313 - DNA, 37 bp, Artificial Sequence
  Synthetic oligonucleotide
atgctaaggagggagtggggtggacgccggggttgga

SEQ ID NO: 179314 - DNA, 38 bp, Artificial Sequence
  Synthetic oligonucleotide
caacaggggacggaggtgaggtaggtatggggtaatga

SEQ ID NO: 179315 - DNA, 37 bp, Artificial Sequence
  Synthetic oligonucleotide
gggagggaagggggctgctggggaggggaaacgatga

SEQ ID NO: 179316 - DNA, 38 bp, Artificial Sequence
  Synthetic oligonucleotide
tgaggagaggcggtcgggaggcgggatatgggaactga

SEQ ID NO: 179317 - DNA, 38 bp, Artificial Sequence
  Synthetic oligonucleotide
gacacgctgtattgctcgttgtcgcctgcccatcctga

SEQ ID NO: 179318 - DNA, 36 bp, Artificial Sequence
  Synthetic oligonucleotide
atgcccaccacattgccaccgttctgtctatcctga

SEQ ID NO: 179319 - DNA, 37 bp, Artificial Sequence
  Synthetic oligonucleotide
aatgcccgacccgtcttgaattccacactgctcctga

SEQ ID NO: 179320 - DNA, 38 bp, Artificial Sequence
  Synthetic oligonucleotide
gagtcacgtcagatgacctctaccgtacgcccctctga

SEQ ID NO: 179321 - DNA, 38 bp, Artificial Sequence
  Synthetic oligonucleotide
tgcctgttcccatcttacgcatcggtcctttcctctga

SEQ ID NO: 179322 - DNA, 37 bp, Artificial Sequence
  Synthetic oligonucleotide
gggaatggggcggtgtgatcagaggaggggggcgtga

SEQ ID NO: 179323 - DNA, 37 bp, Artificial Sequence
  Synthetic oligonucleotide
tgcacccacctgccaatatgcacacttctcctcgtga

SEQ ID NO: 179324 - DNA, 38 bp, Artificial Sequence
  Synthetic oligonucleotide
gctgggagcaaaggagggaagtgaatgggaaatggtga

SEQ ID NO: 179325 - DNA, 37 bp, Artificial Sequence
  Synthetic oligonucleotide
gattcccgtcccatctctctcctagacgcatcattga

SEQ ID NO: 179326 - DNA, 38 bp, Artificial Sequence
  Synthetic oligonucleotide
tatctcgacatagggaaggagggagggctcggtattga

SEQ ID NO: 179327 - DNA, 37 bp, Artificial Sequence
  Synthetic oligonucleotide
tgatcctccgtccacctgttacctgcgcctcccttga

SEQ ID NO: 179328 - DNA, 36 bp, Artificial Sequence
  Synthetic oligonucleotide
tcctgcggccacgcactcctcagtatcttgccttga

SEQ ID NO: 179329 - DNA, 38 bp, Artificial Sequence
  Synthetic oligonucleotide
gaccccaccgcccctatacgtgttcgttccatccttga

SEQ ID NO: 179330 - DNA, 37 bp, Artificial Sequence
  Synthetic oligonucleotide
gaccgccgagtctctttctgccggccctgttccttga

SEQ ID NO: 179331 - DNA, 38 bp, Artificial Sequence
  Synthetic oligonucleotide
gaccgggctgggtgggtaagggttggactaaactttga

SEQ ID NO: 179332 - DNA, 38 bp, Artificial Sequence
  Synthetic oligonucleotide
tcccactcgcctaatcgctatggtgttcctcactttga

SEQ ID NO: 179333 - DNA, 38 bp, Artificial Sequence
  Synthetic oligonucleotide
gctcacatcactgtgaattacgccttcttgccctttga

SEQ ID NO: 179334 - DNA, 37 bp, Artificial Sequence
  Synthetic oligonucleotide
acctctccgcctttgacgcccgctgacccgcctttga

SEQ ID NO: 179335 - DNA, 35 bp, Artificial Sequence
  Synthetic oligonucleotide
gcccactggttactactgctctcacgttattcgta

SEQ ID NO: 179336 - DNA, 35 bp, Artificial Sequence
  Synthetic oligonucleotide
atgtacccgccctgcctattccgtgtttgcaatta

SEQ ID NO: 179337 - DNA, 36 bp, Artificial Sequence
  Synthetic oligonucleotide
tccccgccgggtacgatcttcaccatcttccactta

SEQ ID NO: 179338 - DNA, 35 bp, Artificial Sequence
  Synthetic oligonucleotide
tgagctccatcgcccctgtttgcttattcgcctta

SEQ ID NO: 179339 - DNA, 36 bp, Artificial Sequence
  Synthetic oligonucleotide
ggggccgccacggcatcgtcacttctgctgctctta

SEQ ID NO: 179340 - DNA, 35 bp, Artificial Sequence
  Synthetic oligonucleotide
gaatcaccgtctccttctggctccactcccagtta

SEQ ID NO: 179341 - DNA, 35 bp, Artificial Sequence
  Synthetic oligonucleotide
tacgccccgcacgacctcctgcgcaggttccccac

SEQ ID NO: 179342 - DNA, 35 bp, Artificial Sequence
  Synthetic oligonucleotide
atgcccacactagtgaataactagtccctccgcac

SEQ ID NO: 179343 - DNA, 35 bp, Artificial Sequence
  Synthetic oligonucleotide
gcccatggcctatacgcgcactacgcaccccctac

SEQ ID NO: 179344 - DNA, 35 bp, Artificial Sequence
  Synthetic oligonucleotide
tccgaagcagttcctaagtgcgagggcccccctac

SEQ ID NO: 179345 - DNA, 35 bp, Artificial Sequence
  Synthetic oligonucleotide
tacgcccttccgtttgccaattttacatcatcacc

SEQ ID NO: 179346 - DNA, 35 bp, Artificial Sequence
  Synthetic oligonucleotide
attatccgctctgccccacttcactactttggacc

SEQ ID NO: 179347 - DNA, 35 bp, Artificial Sequence
  Synthetic oligonucleotide
gtcgacgttagcttagcccctatcatagttcaccc

SEQ ID NO: 179348 - DNA, 35 bp, Artificial Sequence
  Synthetic oligonucleotide
ttgaccagagcaatgatgttcctgtggctcccccc

SEQ ID NO: 179349 - DNA, 35 bp, Artificial Sequence
  Synthetic oligonucleotide
agccgtcacttctaacccccgtgctggctctcccc

SEQ ID NO: 179350 - DNA, 35 bp, Artificial Sequence
  Synthetic oligonucleotide
agaacgcagcacttcactgtctcgctacccatccc

SEQ ID NO: 179351 - DNA, 35 bp, Artificial Sequence
  Synthetic oligonucleotide
acatcgcagaaacggctgtcgccatcgtacctccc

SEQ ID NO: 179352 - DNA, 35 bp, Artificial Sequence
  Synthetic oligonucleotide
ataaccgcatcgcctcaaccatctgcgcacctgcc

SEQ ID NO: 179353 - DNA, 35 bp, Artificial Sequence
  Synthetic oligonucleotide
tatgccatacaccacttggggaccacggacctgcc

SEQ ID NO: 179354 - DNA, 35 bp, Artificial Sequence
  Synthetic oligonucleotide
acatcactccttccatgtcactatcttatgctgcc

SEQ ID NO: 179355 - DNA, 35 bp, Artificial Sequence
  Synthetic oligonucleotide
gacaatcgcatactctgtttatcgcaaattcttcc

SEQ ID NO: 179356 - DNA, 35 bp, Artificial Sequence
  Synthetic oligonucleotide
ggggcgggaggggggatctgatgcagtggggaagc

SEQ ID NO: 179357 - DNA, 35 bp, Artificial Sequence
  Synthetic oligonucleotide
gcctccgccttgatttctgatatcactgttaccgc

SEQ ID NO: 179358 - DNA, 35 bp, Artificial Sequence
  Synthetic oligonucleotide
aacatccgtttcgcgcctttgcgttgcctcgccgc

SEQ ID NO: 179359 - DNA, 35 bp, Artificial Sequence
  Synthetic oligonucleotide
gcccaccgcaccgtgtttctataatcacatatcgc

SEQ ID NO: 179360 - DNA, 37 bp, Artificial Sequence
  Synthetic oligonucleotide
tcgcgtgtcaactcgttttatttgccattatccctgc

SEQ ID NO: 179361 - DNA, 36 bp, Artificial Sequence
  Synthetic oligonucleotide
ttccatcctactatatgttctccgggccccatctgc

SEQ ID NO: 179362 - DNA, 35 bp, Artificial Sequence
  Synthetic oligonucleotide
ataaccgccttcgcatcgaatcgccacctgcttgc

SEQ ID NO: 179363 - DNA, 35 bp, Artificial Sequence
  Synthetic oligonucleotide
gagccgccaattttagctacttcgccacctgttgc

SEQ ID NO: 179364 - DNA, 35 bp, Artificial Sequence
  Synthetic oligonucleotide
acccgtacacccctctttattctgtatattgaatc

SEQ ID NO: 179365 - DNA, 35 bp, Artificial Sequence
  Synthetic oligonucleotide
gtgctggtgtacagcccatcgcctcttcgcacatc

SEQ ID NO: 179366 - DNA, 35 bp, Artificial Sequence
  Synthetic oligonucleotide
gatccgatcgctgcccctttattggtatcctcatc

SEQ ID NO: 179367 - DNA, 35 bp, Artificial Sequence
  Synthetic oligonucleotide
actagcccctcccctcttttggttagaccaccctc

SEQ ID NO: 179368 - DNA, 35 bp, Artificial Sequence
  Synthetic oligonucleotide
attgcacgggtctcgttcatatcacggctcccctc

SEQ ID NO: 179369 - DNA, 35 bp, Artificial Sequence
  Synthetic oligonucleotide
gagacgtacggttacaatgctccactcccgccctc

SEQ ID NO: 179370 - DNA, 35 bp, Artificial Sequence
  Synthetic oligonucleotide
tccgccaactccgacgtcccgataacacgctcctc

SEQ ID NO: 179371 - DNA, 35 bp, Artificial Sequence
  Synthetic oligonucleotide
agtgggtgggaactgtaggagagggtggggtcctc

SEQ ID NO: 179372 - DNA, 35 bp, Artificial Sequence
  Synthetic oligonucleotide
aaaccccgacctgccccttagttcacgttacgctc

SEQ ID NO: 179373 - DNA, 35 bp, Artificial Sequence
  Synthetic oligonucleotide
gggacctgtcacccgtcagctttccgcttatcgtc

SEQ ID NO: 179374 - DNA, 35 bp, Artificial Sequence
  Synthetic oligonucleotide
tgaccctgggtctgttacgctcacatctccgtgtc

SEQ ID NO: 179375 - DNA, 35 bp, Artificial Sequence
  Synthetic oligonucleotide
actgcgacagtgagcctggccccccatataccttc

SEQ ID NO: 179376 - DNA, 35 bp, Artificial Sequence
  Synthetic oligonucleotide
tgggactgatcccccgcatgtccgcctaaccgttc

SEQ ID NO: 179377 - DNA, 35 bp, Artificial Sequence
  Synthetic oligonucleotide
tgcacactcttggtgaaacctcccgtgctactttc

SEQ ID NO: 179378 - DNA, 34 bp, Artificial Sequence
  Synthetic oligonucleotide
tgaggcggggggactgaagggggatggatcgcag

SEQ ID NO: 179379 - DNA, 35 bp, Artificial Sequence
  Synthetic oligonucleotide
gacccgccttactgatgcccctctcctcgttcgag

SEQ ID NO: 179380 - DNA, 35 bp, Artificial Sequence
  Synthetic oligonucleotide
actcctgtcccccacggtcgttatcttgtctttag

SEQ ID NO: 179381 - DNA, 35 bp, Artificial Sequence
  Synthetic oligonucleotide
caacggggagaaggaaggggggcggctcaaaaacg

SEQ ID NO: 179382 - DNA, 35 bp, Artificial Sequence
  Synthetic oligonucleotide
agagccaaacctccgccccttccccatttgtgccg

SEQ ID NO: 179383 - DNA, 35 bp, Artificial Sequence
  Synthetic oligonucleotide
agccaccctcgctacccttcatctgtatttgtccg

SEQ ID NO: 179384 - DNA, 35 bp, Artificial Sequence
  Synthetic oligonucleotide
taacgctcaggggcgctgcctccctctcaacatcg

SEQ ID NO: 179385 - DNA, 35 bp, Artificial Sequence
  Synthetic oligonucleotide
gagaccgcccccgtcatttatgtcctaccccccgg

SEQ ID NO: 179386 - DNA, 36 bp, Artificial Sequence
  Synthetic oligonucleotide
tgtggcactgaggtgcgggaaggggggaagaagggg

SEQ ID NO: 179387 - DNA, 35 bp, Artificial Sequence
  Synthetic oligonucleotide
taggggataacggggggtgggctcgccccatgggg

SEQ ID NO: 179388 - DNA, 35 bp, Artificial Sequence
  Synthetic oligonucleotide
tcattggcacgtgagtccccgtctcgctcctctgg

SEQ ID NO: 179389 - DNA, 35 bp, Artificial Sequence
  Synthetic oligonucleotide
ttggggaggaaaccggaggaaagtggtaaatgtgg

SEQ ID NO: 179390 - DNA, 35 bp, Artificial Sequence
  Synthetic oligonucleotide
atcctcccccgagtacatgatcctgtcccattatg

SEQ ID NO: 179391 - DNA, 35 bp, Artificial Sequence
  Synthetic oligonucleotide
acctcccgcccctcatagtcgtaacgtacacactg

SEQ ID NO: 179392 - DNA, 35 bp, Artificial Sequence
  Synthetic oligonucleotide
tgatcgtcgactccactcgtatttccatcaacctg

SEQ ID NO: 179393 - DNA, 35 bp, Artificial Sequence
  Synthetic oligonucleotide
tgcgtaacgcctctgtgctccggtttgccatcctg

SEQ ID NO: 179394 - DNA, 35 bp, Artificial Sequence
  Synthetic oligonucleotide
tgtaaaccaaacctcgctatatcgtacctgccttg

SEQ ID NO: 179395 - DNA, 34 bp, Artificial Sequence
  Synthetic oligonucleotide
tcgcctcatccatataggttccgtccctgccttg

SEQ ID NO: 179396 - DNA, 35 bp, Artificial Sequence
  Synthetic oligonucleotide
acacaccacctaacatgttcgtcgttccgctcttg

SEQ ID NO: 179397 - DNA, 35 bp, Artificial Sequence
  Synthetic oligonucleotide
gcgaccctacgtaccctggtcatatacgcttacat

SEQ ID NO: 179398 - DNA, 35 bp, Artificial Sequence
  Synthetic oligonucleotide
tatcgcgcataccctaccatgttgccgcctttcat

SEQ ID NO: 179399 - DNA, 35 bp, Artificial Sequence
  Synthetic oligonucleotide
atcgagcccttaacatgctatatcgccacatctat

SEQ ID NO: 179400 - DNA, 35 bp, Artificial Sequence
  Synthetic oligonucleotide
tccaccgcctgtgcgcttgtcatctttgctattat

SEQ ID NO: 179401 - DNA, 35 bp, Artificial Sequence
  Synthetic oligonucleotide
taacatccaggatgctgtccttccttccgttacct

SEQ ID NO: 179402 - DNA, 35 bp, Artificial Sequence
  Synthetic oligonucleotide
gacgctctgatccgcgtgggcactcacacccccct

SEQ ID NO: 179403 - DNA, 35 bp, Artificial Sequence
  Synthetic oligonucleotide
tctgaccggtcgcactggcctccataagcccccct

SEQ ID NO: 179404 - DNA, 35 bp, Artificial Sequence
  Synthetic oligonucleotide
accccacggtgccttttcgtacattgtcctatcct

SEQ ID NO: 179405 - DNA, 35 bp, Artificial Sequence
  Synthetic oligonucleotide
gatgagtgtatatccgtactgctccacccaactct

SEQ ID NO: 179406 - DNA, 35 bp, Artificial Sequence
  Synthetic oligonucleotide
gcccatctcacgaattccaggattgctgctcctct

SEQ ID NO: 179407 - DNA, 35 bp, Artificial Sequence
  Synthetic oligonucleotide
gtgttgcgtgccatgtaaggccctgctcactctct

SEQ ID NO: 179408 - DNA, 35 bp, Artificial Sequence
  Synthetic oligonucleotide
tatcgccccgcccgtttaacttccgacagtcgagt

SEQ ID NO: 179409 - DNA, 35 bp, Artificial Sequence
  Synthetic oligonucleotide
tgttgccccaatcctctcgtgttttctcgtccggt

SEQ ID NO: 179410 - DNA, 35 bp, Artificial Sequence
  Synthetic oligonucleotide
agttaaatcgccgccgccccctaatccatgcctgt

SEQ ID NO: 179411 - DNA, 35 bp, Artificial Sequence
  Synthetic oligonucleotide
gtgcgccccgcctctagacgtcttatcactcctgt

SEQ ID NO: 179412 - DNA, 35 bp, Artificial Sequence
  Synthetic oligonucleotide
tcaccctgtctgagaacccgttttcgacccccctt

SEQ ID NO: 179413 - DNA, 35 bp, Artificial Sequence
  Synthetic oligonucleotide
gccaacgcagttctcgctcggactaatgtcccctt

SEQ ID NO: 179414 - DNA, 35 bp, Artificial Sequence
  Synthetic oligonucleotide
acagtacgaccggaccgcctctgttatccatcctt

SEQ ID NO: 179415 - DNA, 35 bp, Artificial Sequence
  Synthetic oligonucleotide
gcgtagccggcgccccgcatcgatcctaacgcttt

SEQ ID NO: 179416 - DNA, 36 bp, Artificial Sequence
  Synthetic oligonucleotide
tagggggtgtaaaacggtattggggctagggggaaa

SEQ ID NO: 179417 - DNA, 36 bp, Artificial Sequence
  Synthetic oligonucleotide
gccgctgagacaggtgggggaatacgggggacggaa

SEQ ID NO: 179418 - DNA, 36 bp, Artificial Sequence
  Synthetic oligonucleotide
gtatgagaggaaggatcagggggcatgtacggggaa

SEQ ID NO: 179419 - DNA, 35 bp, Artificial Sequence
  Synthetic oligonucleotide
tgatcctccgcccactgctttgtcccgttcatgaa

SEQ ID NO: 179420 - DNA, 36 bp, Artificial Sequence
  Synthetic oligonucleotide
tagacccctcacctgatactgtacttgcgccctgaa

SEQ ID NO: 179421 - DNA, 36 bp, Artificial Sequence
  Synthetic oligonucleotide
tcacgtccgagcgcgctttttgtctttttatcctaa

SEQ ID NO: 179422 - DNA, 35 bp, Artificial Sequence
  Synthetic oligonucleotide
gcatgccatgcgctgccgggcctctcacaccaaca

SEQ ID NO: 179423 - DNA, 36 bp, Artificial Sequence
  Synthetic oligonucleotide
tcgcacaccccacctcgtacaccgttaggtctgaca

SEQ ID NO: 179424 - DNA, 36 bp, Artificial Sequence
  Synthetic oligonucleotide
gttccctccgtccctttggtaatgtcacgctaacca

SEQ ID NO: 179425 - DNA, 36 bp, Artificial Sequence
  Synthetic oligonucleotide
tgagccggtctgcttgcgtcctactttcgtatacca

SEQ ID NO: 179426 - DNA, 36 bp, Artificial Sequence
  Synthetic oligonucleotide
gcgaggctcccgagcccctgttgtgttccccaccca

SEQ ID NO: 179427 - DNA, 36 bp, Artificial Sequence
  Synthetic oligonucleotide
acctcgcggcacagcatactttatttagccacccca

SEQ ID NO: 179428 - DNA, 36 bp, Artificial Sequence
  Synthetic oligonucleotide
ttttgcaccaccatagatcttatcgcaaccgcccca

SEQ ID NO: 179429 - DNA, 36 bp, Artificial Sequence
  Synthetic oligonucleotide
aactcgcctaccaatatgctctgaaccggggtccca

SEQ ID NO: 179430 - DNA, 36 bp, Artificial Sequence
  Synthetic oligonucleotide
tccggaccgttgggtatctctgccctcccccagcca

SEQ ID NO: 179431 - DNA, 35 bp, Artificial Sequence
  Synthetic oligonucleotide
ttcggtcgacgttccctcctcaccgtctcccgcca

SEQ ID NO: 179432 - DNA, 35 bp, Artificial Sequence
  Synthetic oligonucleotide
ttccccgctagcactccactacagattctgctcca

SEQ ID NO: 179433 - DNA, 36 bp, Artificial Sequence
  Synthetic oligonucleotide
gatcacgcggcgcttccctctgctcgctaccacgca

SEQ ID NO: 179434 - DNA, 35 bp, Artificial Sequence
  Synthetic oligonucleotide
gccaccatttccatgctactaacgtatgctccgca

SEQ ID NO: 179435 - DNA, 35 bp, Artificial Sequence
  Synthetic oligonucleotide
gtaacaacggggtggggaacggaactggttcggca

SEQ ID NO: 179436 - DNA, 36 bp, Artificial Sequence
  Synthetic oligonucleotide
taacacgtagcgacgtaacttactccccgccctgca

SEQ ID NO: 179437 - DNA, 35 bp, Artificial Sequence
  Synthetic oligonucleotide
gacccgggtgcagtgggtggggggattaggttgca

SEQ ID NO: 179438 - DNA, 36 bp, Artificial Sequence
  Synthetic oligonucleotide
ttaatcacccctccatgtagcctaacctgcggttca

SEQ ID NO: 179439 - DNA, 37 bp, Artificial Sequence
  Synthetic oligonucleotide
gcccgcatccccccaccacccgatacagtcagcgaga

SEQ ID NO: 179440 - DNA, 37 bp, Artificial Sequence
  Synthetic oligonucleotide
gttcgcttcccacgctcctccactagtctgtactaga

SEQ ID NO: 179441 - DNA, 36 bp, Artificial Sequence
  Synthetic oligonucleotide
acagcccttcccctcgtccgctaatcgccgcctaga

SEQ ID NO: 179442 - DNA, 37 bp, Artificial Sequence
  Synthetic oligonucleotide
agtccccgccctgagtccctttcgttaccccacacga

SEQ ID NO: 179443 - DNA, 36 bp, Artificial Sequence
  Synthetic oligonucleotide
tcgacccttaacatcaatatacgcgctgtaccccga

SEQ ID NO: 179444 - DNA, 36 bp, Artificial Sequence
  Synthetic oligonucleotide
gagacggtggcaagtggtgcggtgtagagggaagga

SEQ ID NO: 179445 - DNA, 37 bp, Artificial Sequence
  Synthetic oligonucleotide
gagagggtacgggaagggagataatagccagagagga

SEQ ID NO: 179446 - DNA, 37 bp, Artificial Sequence
  Synthetic oligonucleotide
tctggagggtatgggttgggatggcgcatgcggagga

SEQ ID NO: 179447 - DNA, 36 bp, Artificial Sequence
  Synthetic oligonucleotide
tggggggggagggcgggcttggtaagcaagggagga

SEQ ID NO: 179448 - DNA, 37 bp, Artificial Sequence
  Synthetic oligonucleotide
atggggtcgggaccagaatagggcggggaggcacgga

SEQ ID NO: 179449 - DNA, 37 bp, Artificial Sequence
  Synthetic oligonucleotide
gccggtatgggggggatggggggaaacaagcggcgga

SEQ ID NO: 179450 - DNA, 37 bp, Artificial Sequence
  Synthetic oligonucleotide
tgtcgcctcgattcaccacactcacctctcgctcgga

SEQ ID NO: 179451 - DNA, 37 bp, Artificial Sequence
  Synthetic oligonucleotide
gacacgtcgagacagggaacagggaaataaaggggga

SEQ ID NO: 179452 - DNA, 36 bp, Artificial Sequence
  Synthetic oligonucleotide
ggggaggggtagatcaggaaggccgggtcatgggga

SEQ ID NO: 179453 - DNA, 36 bp, Artificial Sequence
  Synthetic oligonucleotide
gataatggagcgagaggagggggcttaggtggtgga

SEQ ID NO: 179454 - DNA, 38 bp, Artificial Sequence
  Synthetic oligonucleotide
gaaggtggggagggcgtggtaagggatacgagtaatga

SEQ ID NO: 179455 - DNA, 38 bp, Artificial Sequence
  Synthetic oligonucleotide
gcatcgccactcctatctcccccgccaccggtgcatga

SEQ ID NO: 179456 - DNA, 37 bp, Artificial Sequence
  Synthetic oligonucleotide
tcctccctgccccctgattgtcacgcccacatcatga

SEQ ID NO: 179457 - DNA, 38 bp, Artificial Sequence
  Synthetic oligonucleotide
atcgagcgcgtggtgtcatccccctccgccattcatga

SEQ ID NO: 179458 - DNA, 38 bp, Artificial Sequence
  Synthetic oligonucleotide
atgctgccgccatcgcattaagcattctacccccctga

SEQ ID NO: 179459 - DNA, 36 bp, Artificial Sequence
  Synthetic oligonucleotide
atcccaccgtggcttccctgcctaccaggcccctga

SEQ ID NO: 179460 - DNA, 38 bp, Artificial Sequence
  Synthetic oligonucleotide
gctggggtggtgggggtgtgtggggacttcgcggctga

SEQ ID NO: 179461 - DNA, 38 bp, Artificial Sequence
  Synthetic oligonucleotide
tcccgccccctcagcgcgatttatctcccccttcgtga

SEQ ID NO: 179462 - DNA, 38 bp, Artificial Sequence
  Synthetic oligonucleotide
acgcctccccctttcattgccatgtcctcctccggtga

SEQ ID NO: 179463 - DNA, 38 bp, Artificial Sequence
  Synthetic oligonucleotide
accggggagggagaagggtacgtgatgttgaggggtga

SEQ ID NO: 179464 - DNA, 38 bp, Artificial Sequence
  Synthetic oligonucleotide
aagtgagccgagcggtgggaataggtggggggtggtga

SEQ ID NO: 179465 - DNA, 38 bp, Artificial Sequence
  Synthetic oligonucleotide
ggaatgggaggaagtgggggtcgggacacaggaattga

SEQ ID NO: 179466 - DNA, 38 bp, Artificial Sequence
  Synthetic oligonucleotide
gccgtctcgccgtctcagcccttcttatagcaccttga

SEQ ID NO: 179467 - DNA, 38 bp, Artificial Sequence
  Synthetic oligonucleotide
gactccgcccgttgaatgaccttgttctcgcaccttga

SEQ ID NO: 179468 - DNA, 38 bp, Artificial Sequence
  Synthetic oligonucleotide
tcaacgacacgccgtgcgtaggcctttttcccccttga

SEQ ID NO: 179469 - DNA, 37 bp, Artificial Sequence
  Synthetic oligonucleotide
gtcagtgcaccgctgaatttcgcataacctcccttga

SEQ ID NO: 179470 - DNA, 38 bp, Artificial Sequence
  Synthetic oligonucleotide
tcatgctgccctcctgcatagcccgttcgtttccttga

SEQ ID NO: 179471 - DNA, 38 bp, Artificial Sequence
  Synthetic oligonucleotide
tggaacggccacttctataccgcgtcgcccccctttga

SEQ ID NO: 179472 - DNA, 36 bp, Artificial Sequence
  Synthetic oligonucleotide
ggacgattgccggtggtctacttacgccctctcata

SEQ ID NO: 179473 - DNA, 35 bp, Artificial Sequence
  Synthetic oligonucleotide
gagacggtggtggttaggtggagtaggcgtggata

SEQ ID NO: 179474 - DNA, 36 bp, Artificial Sequence
  Synthetic oligonucleotide
tccgaaccactcccagttagttgaaatgcccaccta

SEQ ID NO: 179475 - DNA, 36 bp, Artificial Sequence
  Synthetic oligonucleotide
tcatcaccaggcctcttttatcgtgcacgtttccta

SEQ ID NO: 179476 - DNA, 36 bp, Artificial Sequence
  Synthetic oligonucleotide
tagtggtcaccgcctgctcgctccagcatccccgta

SEQ ID NO: 179477 - DNA, 36 bp, Artificial Sequence
  Synthetic oligonucleotide
gttgcacacactccgcttcgcatgtctcgttccgta

SEQ ID NO: 179478 - DNA, 36 bp, Artificial Sequence
  Synthetic oligonucleotide
ataggagagggtagggcaagaagagaacgcatcgta

SEQ ID NO: 179479 - DNA, 36 bp, Artificial Sequence
  Synthetic oligonucleotide
gatctatgatggtggtgtgggacagggggggcggta

SEQ ID NO: 179480 - DNA, 35 bp, Artificial Sequence
  Synthetic oligonucleotide
tgcgatgcgctgcttatacacggcctctctttgta

SEQ ID NO: 179481 - DNA, 35 bp, Artificial Sequence
  Synthetic oligonucleotide
gccccgtaccccacgtatcgaaacttcctcgctta

SEQ ID NO: 179482 - DNA, 36 bp, Artificial Sequence
  Synthetic oligonucleotide
acctcaccgcttccatcccgtattgggttaatttta

SEQ ID NO: 179483 - DNA, 35 bp, Artificial Sequence
  Synthetic oligonucleotide
gcatgacgcccctgccccaacgctgaacgttcaac

SEQ ID NO: 179484 - DNA, 35 bp, Artificial Sequence
  Synthetic oligonucleotide
tcatagtgccccgtcctggtctcagcctgtaacac

SEQ ID NO: 179485 - DNA, 35 bp, Artificial Sequence
  Synthetic oligonucleotide
gaggtccatcaccctcccctggtgtatccgcccac

SEQ ID NO: 179486 - DNA, 35 bp, Artificial Sequence
  Synthetic oligonucleotide
acccaaccagagtgcacgcgttgttcgtttctcac

SEQ ID NO: 179487 - DNA, 35 bp, Artificial Sequence
  Synthetic oligonucleotide
gccagtgagcggtgccgtgccccagttcccactac

SEQ ID NO: 179488 - DNA, 35 bp, Artificial Sequence
  Synthetic oligonucleotide
acctcccctcttgagttcataccggtattgcctac

SEQ ID NO: 179489 - DNA, 35 bp, Artificial Sequence
  Synthetic oligonucleotide
gacgtcctcatccaatgctcaacctgctcgctacc

SEQ ID NO: 179490 - DNA, 35 bp, Artificial Sequence
  Synthetic oligonucleotide
gcctgcatccctgatgcatcccccaggattttacc

SEQ ID NO: 179491 - DNA, 35 bp, Artificial Sequence
  Synthetic oligonucleotide
tggtcccctgcacgtccgttcctagtcattccccc

SEQ ID NO: 179492 - DNA, 35 bp, Artificial Sequence
  Synthetic oligonucleotide
tttgcgtagtggagcagctgcgacctttacctccc

SEQ ID NO: 179493 - DNA, 35 bp, Artificial Sequence
  Synthetic oligonucleotide
gcacgtgcctcaaagttttcgatagcatttctccc

SEQ ID NO: 179494 - DNA, 35 bp, Artificial Sequence
  Synthetic oligonucleotide
tgccacatcactatctcttcctagtactcgccgcc

SEQ ID NO: 179495 - DNA, 35 bp, Artificial Sequence
  Synthetic oligonucleotide
gccttacatcgtgtcctgccccttgcattgtggcc

SEQ ID NO: 179496 - DNA, 35 bp, Artificial Sequence
  Synthetic oligonucleotide
tccacccacactctgtatttttcagctgaaactcc

SEQ ID NO: 179497 - DNA, 35 bp, Artificial Sequence
  Synthetic oligonucleotide
ggacaaacgtcacactgtactctgaaatttcctcc

SEQ ID NO: 179498 - DNA, 35 bp, Artificial Sequence
  Synthetic oligonucleotide
tgagctccctgcgcacgttcagcatacccatctcc

SEQ ID NO: 179499 - DNA, 35 bp, Artificial Sequence
  Synthetic oligonucleotide
aagtagccaccgcctgtaaccccccgacgatttcc

SEQ ID NO: 179500 - DNA, 35 bp, Artificial Sequence
  Synthetic oligonucleotide
tttaccttcaccgccttcgttctaagtcgttttcc

SEQ ID NO: 179501 - DNA, 33 bp, Artificial Sequence
  Synthetic oligonucleotide
tgtggcccccacaacttgtactaatcctcccgc

SEQ ID NO: 179502 - DNA, 35 bp, Artificial Sequence
  Synthetic oligonucleotide
gtgcgcatgatattgtcagcctgccccttgttcgc

SEQ ID NO: 179503 - DNA, 35 bp, Artificial Sequence
  Synthetic oligonucleotide
gtccgccatgactaatagctatcccatcacctggc

SEQ ID NO: 179504 - DNA, 35 bp, Artificial Sequence
  Synthetic oligonucleotide
accccacattgtgcctccgctgactgagttctggc

SEQ ID NO: 179505 - DNA, 35 bp, Artificial Sequence
  Synthetic oligonucleotide
tcgccatcctgcaatccttttcacacgagtactgc

SEQ ID NO: 179506 - DNA, 35 bp, Artificial Sequence
  Synthetic oligonucleotide
ccaccctcttgcaccacgaccgcctgctggcctgc

SEQ ID NO: 179507 - DNA, 35 bp, Artificial Sequence
  Synthetic oligonucleotide
gcatatgccgccttcgttcaaactgtctatcaatc

SEQ ID NO: 179508 - DNA, 35 bp, Artificial Sequence
  Synthetic oligonucleotide
accgcccccctcgggggtgatcgatcctccgcctc

SEQ ID NO: 179509 - DNA, 35 bp, Artificial Sequence
  Synthetic oligonucleotide
acatgtcaccccgaaacacatctgcatcactgctc

SEQ ID NO: 179510 - DNA, 35 bp, Artificial Sequence
  Synthetic oligonucleotide
tagcactcagttcgaacctatgcatagcccctctc

SEQ ID NO: 179511 - DNA, 35 bp, Artificial Sequence
  Synthetic oligonucleotide
gcacctgccactcaccttaattcgccctttgtctc

SEQ ID NO: 179512 - DNA, 35 bp, Artificial Sequence
  Synthetic oligonucleotide
aacacccggtaggacgctggcctctacaccttctc

SEQ ID NO: 179513 - DNA, 35 bp, Artificial Sequence
  Synthetic oligonucleotide
catacccgctgccatctctatatcttcgcctggtc

SEQ ID NO: 179514 - DNA, 35 bp, Artificial Sequence
  Synthetic oligonucleotide
tccgactcctgcgctgtactcggttatcctgcttc

SEQ ID NO: 179515 - DNA, 35 bp, Artificial Sequence
  Synthetic oligonucleotide
ggggtggcgttccgggcaatggtgggtaaccgttc

SEQ ID NO: 179516 - DNA, 35 bp, Artificial Sequence
  Synthetic oligonucleotide
gatgacctacgtgagtcacgatcctgcccctgttc

SEQ ID NO: 179517 - DNA, 35 bp, Artificial Sequence
  Synthetic oligonucleotide
atgccccctcggtactgaccacttgccccgctttc

SEQ ID NO: 179518 - DNA, 35 bp, Artificial Sequence
  Synthetic oligonucleotide
acgtggagggggggggtgagtagatagaggacgag

SEQ ID NO: 179519 - DNA, 35 bp, Artificial Sequence
  Synthetic oligonucleotide
aacggacagatgcggagggggaagggtgacactag

SEQ ID NO: 179520 - DNA, 35 bp, Artificial Sequence
  Synthetic oligonucleotide
aatgccgccctagccgtgcccttaagtcccactag

SEQ ID NO: 179521 - DNA, 35 bp, Artificial Sequence
  Synthetic oligonucleotide
taccaccgccccatctttgcatatgccctgccacg

SEQ ID NO: 179522 - DNA, 35 bp, Artificial Sequence
  Synthetic oligonucleotide
aaccatggccccgtgctttgtcaatggctcccccg

SEQ ID NO: 179523 - DNA, 35 bp, Artificial Sequence
  Synthetic oligonucleotide
gcatgacggcccgcgtactttaactgtcctccccg

SEQ ID NO: 179524 - DNA, 35 bp, Artificial Sequence
  Synthetic oligonucleotide
ttgacgagcgtagttctctgtcttgccgctgcccg

SEQ ID NO: 179525 - DNA, 35 bp, Artificial Sequence
  Synthetic oligonucleotide
tctcaagcgcctccgccccgatatctccacccgcg

SEQ ID NO: 179526 - DNA, 35 bp, Artificial Sequence
  Synthetic oligonucleotide
tcgtttagcccttaacctctacaccatcaactgcg

SEQ ID NO: 179527 - DNA, 35 bp, Artificial Sequence
  Synthetic oligonucleotide
tgcggatgtactctcttgctcgtttggcctcctcg

SEQ ID NO: 179528 - DNA, 35 bp, Artificial Sequence
  Synthetic oligonucleotide
gtcgattggaatggtggaatatggggtggaaaggg

SEQ ID NO: 179529 - DNA, 35 bp, Artificial Sequence
  Synthetic oligonucleotide
acgtgcctaccctgcatctcccgcctccctccggg

SEQ ID NO: 179530 - DNA, 35 bp, Artificial Sequence
  Synthetic oligonucleotide
tacgcatgccgtattattcaccaccctctccatgg

SEQ ID NO: 179531 - DNA, 35 bp, Artificial Sequence
  Synthetic oligonucleotide
tccgaggccggtccgccttgtcttatccaccaatg

SEQ ID NO: 179532 - DNA, 35 bp, Artificial Sequence
  Synthetic oligonucleotide
gaactgcccctccacccaaagtcacgcaagtactg

SEQ ID NO: 179533 - DNA, 35 bp, Artificial Sequence
  Synthetic oligonucleotide
tcgccacctgcccacctccgctaccaatctcggtg

SEQ ID NO: 179534 - DNA, 35 bp, Artificial Sequence
  Synthetic oligonucleotide
gtcacatcttgttgcttctcgttttctctgccaat

SEQ ID NO: 179535 - DNA, 35 bp, Artificial Sequence
  Synthetic oligonucleotide
tccaggacggaccgcagcttctacacccttgccat

SEQ ID NO: 179536 - DNA, 35 bp, Artificial Sequence
  Synthetic oligonucleotide
gttcgtcaatggccctgtttcgttcgcttttccat

SEQ ID NO: 179537 - DNA, 35 bp, Artificial Sequence
  Synthetic oligonucleotide
gatgtggtggtgggaaggtgatagtaatttcgact

SEQ ID NO: 179538 - DNA, 35 bp, Artificial Sequence
  Synthetic oligonucleotide
aacgcacacgtcacccctgctatcctaatatccct

SEQ ID NO: 179539 - DNA, 35 bp, Artificial Sequence
  Synthetic oligonucleotide
gcgctccccgaccggttgcccgttttcgctcctgt

SEQ ID NO: 179540 - DNA, 35 bp, Artificial Sequence
  Synthetic oligonucleotide
tttccgtctcgcccccgtaacctcctgtcctgatt

SEQ ID NO: 179541 - DNA, 35 bp, Artificial Sequence
  Synthetic oligonucleotide
gatgcacttagtgttgctttcatttccaccccctt

SEQ ID NO: 179542 - DNA, 35 bp, Artificial Sequence
  Synthetic oligonucleotide
tccccaccattcgagtgcgatgccggtaactcctt

SEQ ID NO: 179543 - DNA, 35 bp, Artificial Sequence
  Synthetic oligonucleotide
tccctatgcccacatctggtgaattgcatcctctt

SEQ ID NO: 179544 - DNA, 35 bp, Artificial Sequence
  Synthetic oligonucleotide
tccaccaacatccgagatcgtgaagcctccccgtt

SEQ ID NO: 179545 - DNA, 35 bp, Artificial Sequence
  Synthetic oligonucleotide
gccaggagaaagcatcgccgccgccattccttgtt

SEQ ID NO: 179546 - DNA, 35 bp, Artificial Sequence
  Synthetic oligonucleotide
tgtacagtcacctagtcaatagcaccctccccttt

SEQ ID NO: 179547 - DNA, 35 bp, Artificial Sequence
  Synthetic oligonucleotide
gtcgagcccctttccatacgttggttttgcctttt

SEQ ID NO: 179548 - DNA, 35 bp, Artificial Sequence
  Synthetic oligonucleotide
gtccctccctcttgtgcttgtattttgccggaaaa

SEQ ID NO: 179549 - DNA, 36 bp, Artificial Sequence
  Synthetic oligonucleotide
atccacccacttgtccaacgcaatcggtttctcaaa

SEQ ID NO: 179550 - DNA, 36 bp, Artificial Sequence
  Synthetic oligonucleotide
gacctacgccgatagtgttccttccactctcgtaaa

SEQ ID NO: 179551 - DNA, 36 bp, Artificial Sequence
  Synthetic oligonucleotide
ttcacaatcgacctcctggccccctgtccgccggaa

SEQ ID NO: 179552 - DNA, 35 bp, Artificial Sequence
  Synthetic oligonucleotide
tatgtgtgtagccccttccgtactccgcgcgctaa

SEQ ID NO: 179553 - DNA, 36 bp, Artificial Sequence
  Synthetic oligonucleotide
ttgccgctgcacatctccggtctattatcctgctaa

SEQ ID NO: 179554 - DNA, 35 bp, Artificial Sequence
  Synthetic oligonucleotide
aaccctcgatgcctctcaagccctcgtttttgtaa

SEQ ID NO: 179555 - DNA, 35 bp, Artificial Sequence
  Synthetic oligonucleotide
atcacgcaccagccgtaaaacacccccattccaca

SEQ ID NO: 179556 - DNA, 35 bp, Artificial Sequence
  Synthetic oligonucleotide
gacgcccatcgcccaccctcttgccctagttcaca

SEQ ID NO: 179557 - DNA, 36 bp, Artificial Sequence
  Synthetic oligonucleotide
tcccttgcagtctgtcaacaggcgccacatccacca

SEQ ID NO: 179558 - DNA, 36 bp, Artificial Sequence
  Synthetic oligonucleotide
gtccaccaccatctttctaggacatcactatagcca

SEQ ID NO: 179559 - DNA, 35 bp, Artificial Sequence
  Synthetic oligonucleotide
ttgcacatccgtaacgtcgtttcccccgtggtcca

SEQ ID NO: 179560 - DNA, 36 bp, Artificial Sequence
  Synthetic oligonucleotide
gccacaccccagtctatcccgcatcagcagtgcgca

SEQ ID NO: 179561 - DNA, 35 bp, Artificial Sequence
  Synthetic oligonucleotide
tgtcgccgcctcgcattgttccacctcgatttgca

SEQ ID NO: 179562 - DNA, 36 bp, Artificial Sequence
  Synthetic oligonucleotide
ttcccgccttcctgtggctaacgcacactcgcatca

SEQ ID NO: 179563 - DNA, 36 bp, Artificial Sequence
  Synthetic oligonucleotide
tgacaacgccccgctcaaggtctctccccactctca

SEQ ID NO: 179564 - DNA, 35 bp, Artificial Sequence
  Synthetic oligonucleotide
atcacgcacgcaccttgtccattcgtacctggtca

SEQ ID NO: 179565 - DNA, 36 bp, Artificial Sequence
  Synthetic oligonucleotide
gcaaagcacaattgttacgtcggccctacaccttca

SEQ ID NO: 179566 - DNA, 37 bp, Artificial Sequence
  Synthetic oligonucleotide
tcgcccccgcacgagctcctgttacttctcatcaaga

SEQ ID NO: 179567 - DNA, 37 bp, Artificial Sequence
  Synthetic oligonucleotide
tggggagacgggagtaaggggagaaaatgccgcgaga

SEQ ID NO: 179568 - DNA, 37 bp, Artificial Sequence
  Synthetic oligonucleotide
tccagtgcagctgtttccctatcctccctttagtaga

SEQ ID NO: 179569 - DNA, 37 bp, Artificial Sequence
  Synthetic oligonucleotide
tcactcctcctcttgctgtcgactccatcttcttaga

SEQ ID NO: 179570 - DNA, 37 bp, Artificial Sequence
  Synthetic oligonucleotide
acatcgctcgtcttctctggcttcctcggcctcacga

SEQ ID NO: 179571 - DNA, 37 bp, Artificial Sequence
  Synthetic oligonucleotide
gatcccgagaacagggggggaggaggagtacatacga

SEQ ID NO: 179572 - DNA, 37 bp, Artificial Sequence
  Synthetic oligonucleotide
gaccgagtcctctgcgtaacttccattctcttcccga

SEQ ID NO: 179573 - DNA, 37 bp, Artificial Sequence
  Synthetic oligonucleotide
gaccctactgtaagtatcagccccctctactccgcga

SEQ ID NO: 179574 - DNA, 37 bp, Artificial Sequence
  Synthetic oligonucleotide
taccgccccttcctcgtccgcactatcacgttcgcga

SEQ ID NO: 179575 - DNA, 37 bp, Artificial Sequence
  Synthetic oligonucleotide
tcatccgctgtccccaaccataacacctcccttgcga

SEQ ID NO: 179576 - DNA, 35 bp, Artificial Sequence
  Synthetic oligonucleotide
gttaacgggtcctattgcattctccctgccctcga

SEQ ID NO: 179577 - DNA, 37 bp, Artificial Sequence
  Synthetic oligonucleotide
attggacaaggagggggtgaaacacggggcaggtcga

SEQ ID NO: 179578 - DNA, 35 bp, Artificial Sequence
  Synthetic oligonucleotide
ggggacgggttgggggggaaggggggctgtacgga

SEQ ID NO: 179579 - DNA, 37 bp, Artificial Sequence
  Synthetic oligonucleotide
tgtcaccccttcaccttccccgtgtcgcatacccgga

SEQ ID NO: 179580 - DNA, 37 bp, Artificial Sequence
  Synthetic oligonucleotide
agggaggggtgaaagcggggggaaatgaggccgcgga

SEQ ID NO: 179581 - DNA, 37 bp, Artificial Sequence
  Synthetic oligonucleotide
gtaaggccggaggcggggcggggacaggtcaggcgga

SEQ ID NO: 179582 - DNA, 35 bp, Artificial Sequence
  Synthetic oligonucleotide
ggggcttatcggggctgtcacgctgcgggagggga

SEQ ID NO: 179583 - DNA, 37 bp, Artificial Sequence
  Synthetic oligonucleotide
acacgtcggtgaagggggctgtaagaacgggcgggga

SEQ ID NO: 179584 - DNA, 37 bp, Artificial Sequence
  Synthetic oligonucleotide
ttgcacatcaccctgctcctgcccccgcacccctgga

SEQ ID NO: 179585 - DNA, 38 bp, Artificial Sequence
  Synthetic oligonucleotide
tgccgtaccatccgtcttctccatggcacaatccatga

SEQ ID NO: 179586 - DNA, 38 bp, Artificial Sequence
  Synthetic oligonucleotide
accacccacgatgttagttcgcctctccatcttcatga

SEQ ID NO: 179587 - DNA, 37 bp, Artificial Sequence
  Synthetic oligonucleotide
gtggtacgggggggatgggtccgggtcatgaccctga

SEQ ID NO: 179588 - DNA, 37 bp, Artificial Sequence
  Synthetic oligonucleotide
tcttccacccatccatgtcctgcgacctaacatctga

SEQ ID NO: 179589 - DNA, 38 bp, Artificial Sequence
  Synthetic oligonucleotide
tcaccagggcccccgtgatcgcgcctatacctccgtga

SEQ ID NO: 179590 - DNA, 38 bp, Artificial Sequence
  Synthetic oligonucleotide
gagagacaggcgggagagcaatagaggtcggcgggtga

SEQ ID NO: 179591 - DNA, 37 bp, Artificial Sequence
  Synthetic oligonucleotide
gccgtcccgcacctgctcgattttcactatcccttga

SEQ ID NO: 179592 - DNA, 37 bp, Artificial Sequence
  Synthetic oligonucleotide
gagtggagggtgggaaagggaaatttacgatgtttga

SEQ ID NO: 179593 - DNA, 36 bp, Artificial Sequence
  Synthetic oligonucleotide
tccacctccattcacgtaccgccctctgctcgacta

SEQ ID NO: 179594 - DNA, 35 bp, Artificial Sequence
  Synthetic oligonucleotide
gccatgccgtactacacctggtatttcctttgcta

SEQ ID NO: 179595 - DNA, 36 bp, Artificial Sequence
  Synthetic oligonucleotide
gcgtgccgcccgccgccatctatctaggataatcta

SEQ ID NO: 179596 - DNA, 36 bp, Artificial Sequence
  Synthetic oligonucleotide
acgaccggagccgtgtaagccgtgtcctctccgtta

SEQ ID NO: 179597 - DNA, 36 bp, Artificial Sequence
  Synthetic oligonucleotide
tgatgcctaagtattgcccctactctcgcccgttta

SEQ ID NO: 179598 - DNA, 36 bp, Artificial Sequence
  Synthetic oligonucleotide
accttccgccccatcgcacacgttgacaattgttta

SEQ ID NO: 179599 - DNA, 35 bp, Artificial Sequence
  Synthetic oligonucleotide
acccgcatcgcaagttggccccgtttccccttaac

SEQ ID NO: 179600 - DNA, 35 bp, Artificial Sequence
  Synthetic oligonucleotide
tgaccccacctttgtatagccttacactcgaacac

SEQ ID NO: 179601 - DNA, 35 bp, Artificial Sequence
  Synthetic oligonucleotide
accgccaccccccctctcgaggatagactgaccac

SEQ ID NO: 179602 - DNA, 35 bp, Artificial Sequence
  Synthetic oligonucleotide
tactcgctcatcacatcaagcatgtcccctcccac

SEQ ID NO: 179603 - DNA, 35 bp, Artificial Sequence
  Synthetic oligonucleotide
atcgtgcggaggcactcagtcgtcttggctctcac

SEQ ID NO: 179604 - DNA, 35 bp, Artificial Sequence
  Synthetic oligonucleotide
gtgtctactcgccccttggaactgcgtgccctacc

SEQ ID NO: 179605 - DNA, 35 bp, Artificial Sequence
  Synthetic oligonucleotide
tccgcatgagcgcacctgttacaatttgcgtaccc

SEQ ID NO: 179606 - DNA, 35 bp, Artificial Sequence
  Synthetic oligonucleotide
ggaactcgcgtgctaaccctccccacaggcgcccc

SEQ ID NO: 179607 - DNA, 35 bp, Artificial Sequence
  Synthetic oligonucleotide
gacatttgcccaattactgagcgtgcttctcgccc

SEQ ID NO: 179608 - DNA, 35 bp, Artificial Sequence
  Synthetic oligonucleotide
tccaccgccattacatcagtcctcatctgctggcc

SEQ ID NO: 179609 - DNA, 35 bp, Artificial Sequence
  Synthetic oligonucleotide
tgggacgtaccatgcgcgcccctgtacactaatcc

SEQ ID NO: 179610 - DNA, 36 bp, Artificial Sequence
  Synthetic oligonucleotide
atcgctccccggtgcactttgaggaaatatcactcc

SEQ ID NO: 179611 - DNA, 35 bp, Artificial Sequence
  Synthetic oligonucleotide
tgctgcccactcccatccacacagctgccgtctcc

SEQ ID NO: 179612 - DNA, 35 bp, Artificial Sequence
  Synthetic oligonucleotide
atgatagatccgcccgtcttttagctctgttctcc

SEQ ID NO: 179613 - DNA, 35 bp, Artificial Sequence
  Synthetic oligonucleotide
tatcgcccccgccttgatattttccccgtgagtcc

SEQ ID NO: 179614 - DNA, 35 bp, Artificial Sequence
  Synthetic oligonucleotide
acaactaccagtttcgcccgctcgggtcccgttcc

SEQ ID NO: 179615 - DNA, 35 bp, Artificial Sequence
  Synthetic oligonucleotide
acgcaacctttttgccattttacgtactctgaagc

SEQ ID NO: 179616 - DNA, 35 bp, Artificial Sequence
  Synthetic oligonucleotide
gtcataccctctgctcctgtctgtcatggctaagc

SEQ ID NO: 179617 - DNA, 35 bp, Artificial Sequence
  Synthetic oligonucleotide
tacgactcacccgtccttgggtcctctctcgccgc

SEQ ID NO: 179618 - DNA, 34 bp, Artificial Sequence
  Synthetic oligonucleotide
tctgtactaccctgcatagaccgccatgctccgc

SEQ ID NO: 179619 - DNA, 35 bp, Artificial Sequence
  Synthetic oligonucleotide
acacccctggtgcaactggccccgagcttcctcgc

SEQ ID NO: 179620 - DNA, 35 bp, Artificial Sequence
  Synthetic oligonucleotide
gcagagccatatcaggtacgtctgtctcttctcgc

SEQ ID NO: 179621 - DNA, 35 bp, Artificial Sequence
  Synthetic oligonucleotide
tcccaaccccgaagtcgtttaattcaagtccctgc

SEQ ID NO: 179622 - DNA, 35 bp, Artificial Sequence
  Synthetic oligonucleotide
ggtcccgtctcccatctgtcccaaccccggcctgc

SEQ ID NO: 179623 - DNA, 35 bp, Artificial Sequence
  Synthetic oligonucleotide
gggcacagccccggttcgccgccctcattcgcatc

SEQ ID NO: 179624 - DNA, 35 bp, Artificial Sequence
  Synthetic oligonucleotide
aatgtcgtcgcctcagtcgcggccttccctttatc

SEQ ID NO: 179625 - DNA, 35 bp, Artificial Sequence
  Synthetic oligonucleotide
attgacggctccttgctttgcgcaggttacacctc

SEQ ID NO: 179626 - DNA, 35 bp, Artificial Sequence
  Synthetic oligonucleotide
aatttgcaccgcaatcctcctacgaacttcacctc

SEQ ID NO: 179627 - DNA, 35 bp, Artificial Sequence
  Synthetic oligonucleotide
atcttcaaccgccctggggttctgtttctatcctc

SEQ ID NO: 179628 - DNA, 35 bp, Artificial Sequence
  Synthetic oligonucleotide
gcccaccctgatccacagagccgttcgcattcctc

SEQ ID NO: 179629 - DNA, 35 bp, Artificial Sequence
  Synthetic oligonucleotide
tgctacatcattggttcatgcacgccaccccgctc

SEQ ID NO: 179630 - DNA, 35 bp, Artificial Sequence
  Synthetic oligonucleotide
tgccacccatcgcgttcaagtacgaccttccgctc

SEQ ID NO: 179631 - DNA, 35 bp, Artificial Sequence
  Synthetic oligonucleotide
tgggagggcagatgaccacactgtaccgccctctc

SEQ ID NO: 179632 - DNA, 35 bp, Artificial Sequence
  Synthetic oligonucleotide
taacgcgcacgagtgccacgccccgcacccgtctc

SEQ ID NO: 179633 - DNA, 35 bp, Artificial Sequence
  Synthetic oligonucleotide
acccacgtgccttagccatgacccactccaccgtc

SEQ ID NO: 179634 - DNA, 35 bp, Artificial Sequence
  Synthetic oligonucleotide
gcccaaccttcccacgagcgccgaagaccgcggtc

SEQ ID NO: 179635 - DNA, 35 bp, Artificial Sequence
  Synthetic oligonucleotide
acaccgcgcactaacacgccgtttcccccgttgtc

SEQ ID NO: 179636 - DNA, 35 bp, Artificial Sequence
  Synthetic oligonucleotide
tgcaacccagagtgctttgacccctctccgctttc

SEQ ID NO: 179637 - DNA, 35 bp, Artificial Sequence
  Synthetic oligonucleotide
gtgcctgcccccgctccacgaattaaccacgaacg

SEQ ID NO: 179638 - DNA, 35 bp, Artificial Sequence
  Synthetic oligonucleotide
tctcggaggcagttcgtccccacactcaacccccg

SEQ ID NO: 179639 - DNA, 35 bp, Artificial Sequence
  Synthetic oligonucleotide
ggtacccgtctcccatgcctctcttgtcaatcgcg

SEQ ID NO: 179640 - DNA, 35 bp, Artificial Sequence
  Synthetic oligonucleotide
ggaagtgcaagccggagggaggaataaagtgggcg

SEQ ID NO: 179641 - DNA, 35 bp, Artificial Sequence
  Synthetic oligonucleotide
accggacgtaacgcggtctcttccctcgccctgcg

SEQ ID NO: 179642 - DNA, 35 bp, Artificial Sequence
  Synthetic oligonucleotide
tgtaccgaaccggccccaattgcatctctccatcg

SEQ ID NO: 179643 - DNA, 35 bp, Artificial Sequence
  Synthetic oligonucleotide
tatgaagaccaggggtatggggggggagggtctcg

SEQ ID NO: 179644 - DNA, 35 bp, Artificial Sequence
  Synthetic oligonucleotide
ttctgagacctgtcttcctttcaccgacctcttcg

SEQ ID NO: 179645 - DNA, 35 bp, Artificial Sequence
  Synthetic oligonucleotide
tgaaggggcggagggcaagcggttaaacacgaagg

SEQ ID NO: 179646 - DNA, 35 bp, Artificial Sequence
  Synthetic oligonucleotide
gtgcagagtttgctccctgtccccctatcccgagg

SEQ ID NO: 179647 - DNA, 35 bp, Artificial Sequence
  Synthetic oligonucleotide
tgacccatacgtatcctatcttccccgcttaccgg

SEQ ID NO: 179648 - DNA, 35 bp, Artificial Sequence
  Synthetic oligonucleotide
gagaaggtgggaagaacgtttatgttggaagtggg

SEQ ID NO: 179649 - DNA, 32 bp, Artificial Sequence
  Synthetic oligonucleotide
atgcataagccgtttccgacaccccccacctg

SEQ ID NO: 179650 - DNA, 35 bp, Artificial Sequence
  Synthetic oligonucleotide
tgacctacttgcgcgcgtcacgcacctcctacctg

SEQ ID NO: 179651 - DNA, 35 bp, Artificial Sequence
  Synthetic oligonucleotide
gaattgtcggagggggggggcgcacggctgagctg

SEQ ID NO: 179652 - DNA, 35 bp, Artificial Sequence
  Synthetic oligonucleotide
aacacgaccacggtgtaatcccacctatttctctg

SEQ ID NO: 179653 - DNA, 35 bp, Artificial Sequence
  Synthetic oligonucleotide
gaggggggggcaggaaagactcaacgccgggattg

SEQ ID NO: 179654 - DNA, 35 bp, Artificial Sequence
  Synthetic oligonucleotide
accgccggaggtgagtcttttcttccatctcgttg

SEQ ID NO: 179655 - DNA, 35 bp, Artificial Sequence
  Synthetic oligonucleotide
gtgggtagcattgccttccctgtacgccatttcat

SEQ ID NO: 179656 - DNA, 35 bp, Artificial Sequence
  Synthetic oligonucleotide
gggaaggtaacggggcgggaggagggaggttaact

SEQ ID NO: 179657 - DNA, 35 bp, Artificial Sequence
  Synthetic oligonucleotide
ttgccttcccagtttcggggttcccttgctccact

SEQ ID NO: 179658 - DNA, 35 bp, Artificial Sequence
  Synthetic oligonucleotide
tcacgttctgcattatgacccgtacccgcaaccct

SEQ ID NO: 179659 - DNA, 35 bp, Artificial Sequence
  Synthetic oligonucleotide
tcgagactgcccttgcctggggtcccaatgcctct

SEQ ID NO: 179660 - DNA, 35 bp, Artificial Sequence
  Synthetic oligonucleotide
gtacgatgcccccccctcccgctgcggtgctctct

SEQ ID NO: 179661 - DNA, 35 bp, Artificial Sequence
  Synthetic oligonucleotide
attccgccaggtgtttgcagtcatttcgtccttct

SEQ ID NO: 179662 - DNA, 35 bp, Artificial Sequence
  Synthetic oligonucleotide
tcctgtttcaccgtctcggggttgtctccgcttct

SEQ ID NO: 179663 - DNA, 35 bp, Artificial Sequence
  Synthetic oligonucleotide
attggggagggcaatgggagggacgacctaggagt

SEQ ID NO: 179664 - DNA, 35 bp, Artificial Sequence
  Synthetic oligonucleotide
ggcgttgggacaagggagaagggcaagaagggcgt

SEQ ID NO: 179665 - DNA, 35 bp, Artificial Sequence
  Synthetic oligonucleotide
tgaccccgcgctctgccgtctttgtggtactcatt

SEQ ID NO: 179666 - DNA, 35 bp, Artificial Sequence
  Synthetic oligonucleotide
tgcgcttcgccccacatgacccggcccccttactt

SEQ ID NO: 179667 - DNA, 35 bp, Artificial Sequence
  Synthetic oligonucleotide
tctccatccgttgtttgacacgcgtctccagcctt

SEQ ID NO: 179668 - DNA, 35 bp, Artificial Sequence
  Synthetic oligonucleotide
tctgccccaccagcacttgcgacctttacgacgtt

SEQ ID NO: 179669 - DNA, 35 bp, Artificial Sequence
  Synthetic oligonucleotide
gtgggggcgacgggggggcgactgggagttatgtt

SEQ ID NO: 179670 - DNA, 35 bp, Artificial Sequence
  Synthetic oligonucleotide
gtggagccgcttggcggtctggtaacacactcttt

SEQ ID NO: 179671 - DNA, 35 bp, Artificial Sequence
  Synthetic oligonucleotide
tgatgcctcttaccaccgctttacaggccatgttt

SEQ ID NO: 179672 - DNA, 35 bp, Artificial Sequence
  Synthetic oligonucleotide
atgcccccgcacctgtgaccttatactagttgttt

SEQ ID NO: 179673 - DNA, 35 bp, Artificial Sequence
  Synthetic oligonucleotide
gtcacgccctcctaattgcctcgtccccacggaaa

SEQ ID NO: 179674 - DNA, 36 bp, Artificial Sequence
  Synthetic oligonucleotide
ttaagagccgcaaagggtacctgggagggcgggaaa

SEQ ID NO: 179675 - DNA, 35 bp, Artificial Sequence
  Synthetic oligonucleotide
gccgcccgctgccatttgtttccatcgttcaccaa

SEQ ID NO: 179676 - DNA, 36 bp, Artificial Sequence
  Synthetic oligonucleotide
actggggggggggggtggaggtgggaagtttcggaa

SEQ ID NO: 179677 - DNA, 33 bp, Artificial Sequence
  Synthetic oligonucleotide
tcatctccatcatctcatgccacagtctatgaa

SEQ ID NO: 179678 - DNA, 36 bp, Artificial Sequence
  Synthetic oligonucleotide
acctgcacgcgcttcacttcgcctcttaccctgtaa

SEQ ID NO: 179679 - DNA, 35 bp, Artificial Sequence
  Synthetic oligonucleotide
atccacctcctgctcaagccacgggaattacttaa

SEQ ID NO: 179680 - DNA, 36 bp, Artificial Sequence
  Synthetic oligonucleotide
attcgggatgggagggtgacgcgggaatatgacaca

SEQ ID NO: 179681 - DNA, 36 bp, Artificial Sequence
  Synthetic oligonucleotide
tatcctcccggatggttccttcactctggctctaca

SEQ ID NO: 179682 - DNA, 36 bp, Artificial Sequence
  Synthetic oligonucleotide
ttacgccgttattgccaccgttttgtagttcgccca

SEQ ID NO: 179683 - DNA, 35 bp, Artificial Sequence
  Synthetic oligonucleotide
tgcacccccaaatgcccctgactccgatcgcgcca

SEQ ID NO: 179684 - DNA, 36 bp, Artificial Sequence
  Synthetic oligonucleotide
gcggtacatcgcgctttcgttcttgctgcatctcca

SEQ ID NO: 179685 - DNA, 36 bp, Artificial Sequence
  Synthetic oligonucleotide
gacatcacctgttcatgtcccccaacttgccttcca

SEQ ID NO: 179686 - DNA, 36 bp, Artificial Sequence
  Synthetic oligonucleotide
tccctcggacacttcccaaccgcactgcttaccgca

SEQ ID NO: 179687 - DNA, 36 bp, Artificial Sequence
  Synthetic oligonucleotide
accgttcccgaccgttctcacattacgctcctcgca

SEQ ID NO: 179688 - DNA, 36 bp, Artificial Sequence
  Synthetic oligonucleotide
attgagggcaaggggtgggtggaggaatcacaggca

SEQ ID NO: 179689 - DNA, 37 bp, Artificial Sequence
  Synthetic oligonucleotide
gagcggggccgcgggggggcgggagtgggaccaggca

SEQ ID NO: 179690 - DNA, 35 bp, Artificial Sequence
  Synthetic oligonucleotide
gcgagaaggggtggaggtaatggtgtacagtggca

SEQ ID NO: 179691 - DNA, 36 bp, Artificial Sequence
  Synthetic oligonucleotide
atgcacccaactagctgcccctctgcctgaacatca

SEQ ID NO: 179692 - DNA, 35 bp, Artificial Sequence
  Synthetic oligonucleotide
tactgcgatggagcgtcgccgtcacctctctatca

SEQ ID NO: 179693 - DNA, 35 bp, Artificial Sequence
  Synthetic oligonucleotide
acatgactccccggattgaattttcgttgccctca

SEQ ID NO: 179694 - DNA, 30 bp, Artificial Sequence
  Synthetic oligonucleotide
actgttcacggcaattactatgctccctca

SEQ ID NO: 179695 - DNA, 35 bp, Artificial Sequence
  Synthetic oligonucleotide
actgcccgctgcaactgccgaattccttctcgtca

SEQ ID NO: 179696 - DNA, 35 bp, Artificial Sequence
  Synthetic oligonucleotide
gagcgcaatgagctccacccgcccatacgtattca

SEQ ID NO: 179697 - DNA, 36 bp, Artificial Sequence
  Synthetic oligonucleotide
accaccacctcggtcgccagacgggacttaccttca

SEQ ID NO: 179698 - DNA, 37 bp, Artificial Sequence
  Synthetic oligonucleotide
tcaccattcaccttgcgctactaacctgtcccgaaga

SEQ ID NO: 179699 - DNA, 37 bp, Artificial Sequence
  Synthetic oligonucleotide
gcaatccgaccccgctgtagcacaccgacccaccaga

SEQ ID NO: 179700 - DNA, 35 bp, Artificial Sequence
  Synthetic oligonucleotide
gtctcactccctcctgcgttctcatagtctcacga

SEQ ID NO: 179701 - DNA, 37 bp, Artificial Sequence
  Synthetic oligonucleotide
tgcccatctgccatcagcatcattccctgtctcacga

SEQ ID NO: 179702 - DNA, 37 bp, Artificial Sequence
  Synthetic oligonucleotide
aaaatgggtaggacaaaataagggggggaagggacga

SEQ ID NO: 179703 - DNA, 37 bp, Artificial Sequence
  Synthetic oligonucleotide
tcatcatccatcccgtttttgcctttctcgtgtacga

SEQ ID NO: 179704 - DNA, 37 bp, Artificial Sequence
  Synthetic oligonucleotide
agctccccgccctgtttatcagtatccctcgacccga

SEQ ID NO: 179705 - DNA, 37 bp, Artificial Sequence
  Synthetic oligonucleotide
gaacacccctgctgtaaaggaactcaatccaccccga

SEQ ID NO: 179706 - DNA, 36 bp, Artificial Sequence
  Synthetic oligonucleotide
tacgcacgaacggcacggtttcacactcatccccga

SEQ ID NO: 179707 - DNA, 37 bp, Artificial Sequence
  Synthetic oligonucleotide
accccccgcctacccagtattcgtgctcccagagcga

SEQ ID NO: 179708 - DNA, 37 bp, Artificial Sequence
  Synthetic oligonucleotide
ttaccgcccgcccaagtaaacagcactcccttatcga

SEQ ID NO: 179709 - DNA, 37 bp, Artificial Sequence
  Synthetic oligonucleotide
actcccatgttaccgcccatccgactccctgggtcga

SEQ ID NO: 179710 - DNA, 37 bp, Artificial Sequence
  Synthetic oligonucleotide
actgcccccgtgcccaatgcacatcgtaccctttcga

SEQ ID NO: 179711 - DNA, 37 bp, Artificial Sequence
  Synthetic oligonucleotide
gagtggggggagagatggtgcgactatgtggggagga

SEQ ID NO: 179712 - DNA, 37 bp, Artificial Sequence
  Synthetic oligonucleotide
aacaccccccatgatctgacttacgttccttttagga

SEQ ID NO: 179713 - DNA, 37 bp, Artificial Sequence
  Synthetic oligonucleotide
atgaaggggcaatcagtcggggagaagaaggaacgga

SEQ ID NO: 179714 - DNA, 37 bp, Artificial Sequence
  Synthetic oligonucleotide
gattcgctgggatgagggaaggtggggaacggaggga

SEQ ID NO: 179715 - DNA, 37 bp, Artificial Sequence
  Synthetic oligonucleotide
gaaaggtgcaaggaattaagcctaaaggggaggggga

SEQ ID NO: 179716 - DNA, 37 bp, Artificial Sequence
  Synthetic oligonucleotide
tatggggcgggtatcacggaaggaaggatggggggga

SEQ ID NO: 179717 - DNA, 37 bp, Artificial Sequence
  Synthetic oligonucleotide
atggaggggactacggggcacgtgagggctgggggga

SEQ ID NO: 179718 - DNA, 37 bp, Artificial Sequence
  Synthetic oligonucleotide
tggggagtggcggtttcaatcctagggcggtggggga

SEQ ID NO: 179719 - DNA, 37 bp, Artificial Sequence
  Synthetic oligonucleotide
gagtcaacgagaagggcttggatgggaagggctggga

SEQ ID NO: 179720 - DNA, 37 bp, Artificial Sequence
  Synthetic oligonucleotide
tcctggagggatgtacacgggggggaggagggtggga

SEQ ID NO: 179721 - DNA, 37 bp, Artificial Sequence
  Synthetic oligonucleotide
aatgtgggcgggatccaatgcgttaaaaggggtggga

SEQ ID NO: 179722 - DNA, 37 bp, Artificial Sequence
  Synthetic oligonucleotide
agcgggtgggaggggcctttagctcgacactgtggga

SEQ ID NO: 179723 - DNA, 37 bp, Artificial Sequence
  Synthetic oligonucleotide
ggggtggaaataggggggtggagcagggataaaatga

SEQ ID NO: 179724 - DNA, 38 bp, Artificial Sequence
  Synthetic oligonucleotide
agtgagggaaatacggggatataggagagggagaatga

SEQ ID NO: 179725 - DNA, 35 bp, Artificial Sequence
  Synthetic oligonucleotide
ttccatacctgcccaatgtcctcctgttcgaatga

SEQ ID NO: 179726 - DNA, 38 bp, Artificial Sequence
  Synthetic oligonucleotide
gtgcggtccattattgctttaaccgctgccctaactga

SEQ ID NO: 179727 - DNA, 38 bp, Artificial Sequence
  Synthetic oligonucleotide
acccaccgctatctttcaagtcgtcctcttcccgctga

SEQ ID NO: 179728 - DNA, 37 bp, Artificial Sequence
  Synthetic oligonucleotide
tgttccggcccaatgtcctacaccatttcctcgctga

SEQ ID NO: 179729 - DNA, 37 bp, Artificial Sequence
  Synthetic oligonucleotide
acacgcgcccgcccctgcccctttaggtgactcgtga

SEQ ID NO: 179730 - DNA, 38 bp, Artificial Sequence
  Synthetic oligonucleotide
atggacagttgaggggaatggtgggggatgagaggtga

SEQ ID NO: 179731 - DNA, 38 bp, Artificial Sequence
  Synthetic oligonucleotide
gtggaacggaggaggacaagggcattgggttacggtga

SEQ ID NO: 179732 - DNA, 38 bp, Artificial Sequence
  Synthetic oligonucleotide
aaagggtgaagtgctcaggaagggcggacggggggtga

SEQ ID NO: 179733 - DNA, 35 bp, Artificial Sequence
  Synthetic oligonucleotide
gcaggaggaggaaagggtcatgaaggggtcgttga

SEQ ID NO: 179734 - DNA, 38 bp, Artificial Sequence
  Synthetic oligonucleotide
tgtgattggaaggggggacggggacgtcgacaggttga

SEQ ID NO: 179735 - DNA, 37 bp, Artificial Sequence
  Synthetic oligonucleotide
gttcgtatcgccccacttgtgtctctcacctgtttga

SEQ ID NO: 179736 - DNA, 36 bp, Artificial Sequence
  Synthetic oligonucleotide
gactaacccctccgcatctgcccgtagacaagtata

SEQ ID NO: 179737 - DNA, 36 bp, Artificial Sequence
  Synthetic oligonucleotide
ttgacccccgccttaggacgcattcgctgtaaacta

SEQ ID NO: 179738 - DNA, 36 bp, Artificial Sequence
  Synthetic oligonucleotide
atagcgctcgtccaccgttcaccatgcccgccacta

SEQ ID NO: 179739 - DNA, 36 bp, Artificial Sequence
  Synthetic oligonucleotide
tcagctaccgctcctgcccggcgcctcttactacta

SEQ ID NO: 179740 - DNA, 36 bp, Artificial Sequence
  Synthetic oligonucleotide
gctgtccactttccagagtgtacaccacccctccta

SEQ ID NO: 179741 - DNA, 36 bp, Artificial Sequence
  Synthetic oligonucleotide
gtacaccctcccaatgttagccgagccaccgggcta

SEQ ID NO: 179742 - DNA, 36 bp, Artificial Sequence
  Synthetic oligonucleotide
taaacctgcgccacctctgcttttttcagccctcta

SEQ ID NO: 179743 - DNA, 36 bp, Artificial Sequence
  Synthetic oligonucleotide
tgtactcggtcctctcttgttatgctctccggtcta

SEQ ID NO: 179744 - DNA, 36 bp, Artificial Sequence
  Synthetic oligonucleotide
ggtgggagacaatgtgagtgatgcgggtggggagta

SEQ ID NO: 179745 - DNA, 36 bp, Artificial Sequence
  Synthetic oligonucleotide
tgtgttggccgccacttcacctatagccgaaaggta

SEQ ID NO: 179746 - DNA, 35 bp, Artificial Sequence
  Synthetic oligonucleotide
aaccggaccgttggtcattgccttcaccttcatta

SEQ ID NO: 179747 - DNA, 35 bp, Artificial Sequence
  Synthetic oligonucleotide
gaaggggggctcaaaatctgggggcgggtttcaac

SEQ ID NO: 179748 - DNA, 35 bp, Artificial Sequence
  Synthetic oligonucleotide
atggtcgcacgcaatcctctacctgccattcacac

SEQ ID NO: 179749 - DNA, 35 bp, Artificial Sequence
  Synthetic oligonucleotide
tcccacacctgcgagcatggcgctttgccacccac

SEQ ID NO: 179750 - DNA, 35 bp, Artificial Sequence
  Synthetic oligonucleotide
gcgagatgtctgttcgatctgttatgttcttccac

SEQ ID NO: 179751 - DNA, 35 bp, Artificial Sequence
  Synthetic oligonucleotide
gtgttgcatccgaagttctgacccctttcttccac

SEQ ID NO: 179752 - DNA, 34 bp, Artificial Sequence
  Synthetic oligonucleotide
ttgcacctcccccgattttgacacttccatgcac

SEQ ID NO: 179753 - DNA, 35 bp, Artificial Sequence
  Synthetic oligonucleotide
actgcgcatttcagtctcttccggatcaccttcac

SEQ ID NO: 179754 - DNA, 35 bp, Artificial Sequence
  Synthetic oligonucleotide
ttcgcacccggtcccgcacggcgtttcgttaaccc

SEQ ID NO: 179755 - DNA, 35 bp, Artificial Sequence
  Synthetic oligonucleotide
gcctatgccgcctacacctctttttgcgacctgcc

SEQ ID NO: 179756 - DNA, 35 bp, Artificial Sequence
  Synthetic oligonucleotide
gtggtcacgtttctggtctcttcatcagtccctcc

SEQ ID NO: 179757 - DNA, 35 bp, Artificial Sequence
  Synthetic oligonucleotide
ttgaggctccccagcactcgtaaccctgccgctcc

SEQ ID NO: 179758 - DNA, 35 bp, Artificial Sequence
  Synthetic oligonucleotide
tacaacagcccattgcaatcattgattcctgctcc

SEQ ID NO: 179759 - DNA, 35 bp, Artificial Sequence
  Synthetic oligonucleotide
agtgggcctcacgctgttctttcacctcgtagtcc

SEQ ID NO: 179760 - DNA, 35 bp, Artificial Sequence
  Synthetic oligonucleotide
tgtgtgcctcgcctgattatcactgcggcccttcc

SEQ ID NO: 179761 - DNA, 35 bp, Artificial Sequence
  Synthetic oligonucleotide
tacctcagaggtccttagcgtcctgggctccttcc

SEQ ID NO: 179762 - DNA, 35 bp, Artificial Sequence
  Synthetic oligonucleotide
gatgagtgctataggctgtttcttggtccgtttcc

SEQ ID NO: 179763 - DNA, 35 bp, Artificial Sequence
  Synthetic oligonucleotide
acactcaagggtcttcaacgtactcggtcttttcc

SEQ ID NO: 179764 - DNA, 35 bp, Artificial Sequence
  Synthetic oligonucleotide
tatgcctggttgatgccccccctgaacgcccccgc

SEQ ID NO: 179765 - DNA, 35 bp, Artificial Sequence
  Synthetic oligonucleotide
ggacaccttcgcgcaaacttattattcccgcctgc

SEQ ID NO: 179766 - DNA, 35 bp, Artificial Sequence
  Synthetic oligonucleotide
atgtctgtccggcgtcctatcatatccctccttgc

SEQ ID NO: 179767 - DNA, 35 bp, Artificial Sequence
  Synthetic oligonucleotide
agaagtggcccagtccctcatgctatcctgccatc

SEQ ID NO: 179768 - DNA, 35 bp, Artificial Sequence
  Synthetic oligonucleotide
acatctcccaacgcctgccttgttgttcatccatc

SEQ ID NO: 179769 - DNA, 35 bp, Artificial Sequence
  Synthetic oligonucleotide
ttccgccccgctactgcgatggtaccaccgatatc

SEQ ID NO: 179770 - DNA, 35 bp, Artificial Sequence
  Synthetic oligonucleotide
tcgtggccccccccacgtttgtcttaggtcctatc

SEQ ID NO: 179771 - DNA, 35 bp, Artificial Sequence
  Synthetic oligonucleotide
acgttccgtcgccggtcacttatgttccagtactc

SEQ ID NO: 179772 - DNA, 35 bp, Artificial Sequence
  Synthetic oligonucleotide
gatgccgcccctcctgtttcttattgtcatccctc

SEQ ID NO: 179773 - DNA, 35 bp, Artificial Sequence
  Synthetic oligonucleotide
tcgcgtctgctgtcgtcacactgcctcccgtcctc

SEQ ID NO: 179774 - DNA, 35 bp, Artificial Sequence
  Synthetic oligonucleotide
gccgccccccttcatggtatacacgctctgagctc

SEQ ID NO: 179775 - DNA, 35 bp, Artificial Sequence
  Synthetic oligonucleotide
tttgccttgctgcccgctgacacgtgctccctctc

SEQ ID NO: 179776 - DNA, 35 bp, Artificial Sequence
  Synthetic oligonucleotide
tgaaacgccgatttctgaggaatccccactctctc

SEQ ID NO: 179777 - DNA, 35 bp, Artificial Sequence
  Synthetic oligonucleotide
tttcgccgtccgcatcaatcccttcgcacacagtc

SEQ ID NO: 179778 - DNA, 35 bp, Artificial Sequence
  Synthetic oligonucleotide
tcagacccctcaccccatctgggaagactccagtc

SEQ ID NO: 179779 - DNA, 35 bp, Artificial Sequence
  Synthetic oligonucleotide
gagccgtcgcatgactcttatcctatctcgcggtc

SEQ ID NO: 179780 - DNA, 35 bp, Artificial Sequence
  Synthetic oligonucleotide
aaggccggtcttacgccatcccacctcgctttgtc

SEQ ID NO: 179781 - DNA, 35 bp, Artificial Sequence
  Synthetic oligonucleotide
acttgtctcgcctcacgctcctatatttccacttc

SEQ ID NO: 179782 - DNA, 35 bp, Artificial Sequence
  Synthetic oligonucleotide
tatccgctgccaacgtagcttagttttagcctttc

SEQ ID NO: 179783 - DNA, 35 bp, Artificial Sequence
  Synthetic oligonucleotide
gaacgtactgccccctcctgcacccccttgggtag

SEQ ID NO: 179784 - DNA, 35 bp, Artificial Sequence
  Synthetic oligonucleotide
ggagctcagacgatcattccgccctccgcccaccg

SEQ ID NO: 179785 - DNA, 35 bp, Artificial Sequence
  Synthetic oligonucleotide
aaccccgtttgttctcgccctatgtaacttgcccg

SEQ ID NO: 179786 - DNA, 35 bp, Artificial Sequence
  Synthetic oligonucleotide
gtcgactccctgtcgatattgctccattccatccg

SEQ ID NO: 179787 - DNA, 35 bp, Artificial Sequence
  Synthetic oligonucleotide
tgttaccgcgacccaggtcccttttatccacttcg

SEQ ID NO: 179788 - DNA, 35 bp, Artificial Sequence
  Synthetic oligonucleotide
acgtactcacgcacactcccccttatgacaaaggg

SEQ ID NO: 179789 - DNA, 35 bp, Artificial Sequence
  Synthetic oligonucleotide
gagcggaacatgttaagggaaaaaaggggaggggg

SEQ ID NO: 179790 - DNA, 35 bp, Artificial Sequence
  Synthetic oligonucleotide
gccggtgaacaggaggagtgctgagggtggtgggg

SEQ ID NO: 179791 - DNA, 35 bp, Artificial Sequence
  Synthetic oligonucleotide
gttgctctgaactgtccgcttcccacgaccttctg

SEQ ID NO: 179792 - DNA, 35 bp, Artificial Sequence
  Synthetic oligonucleotide
tccgcatacgatatccccctcctcccactacggtg

SEQ ID NO: 179793 - DNA, 35 bp, Artificial Sequence
  Synthetic oligonucleotide
gccccgactttcccctggtgccaatgaccacattg

SEQ ID NO: 179794 - DNA, 35 bp, Artificial Sequence
  Synthetic oligonucleotide
acaaatggggaagggaaggggtcaggggttaccat

SEQ ID NO: 179795 - DNA, 35 bp, Artificial Sequence
  Synthetic oligonucleotide
tctgctcccgtgccccagttgctccatgtatccat

SEQ ID NO: 179796 - DNA, 35 bp, Artificial Sequence
  Synthetic oligonucleotide
gttacagccccccgagcgtgccatctgtactccat

SEQ ID NO: 179797 - DNA, 35 bp, Artificial Sequence
  Synthetic oligonucleotide
accacaaccgcgcactcattatacaacgctctcat

SEQ ID NO: 179798 - DNA, 35 bp, Artificial Sequence
  Synthetic oligonucleotide
acttcacccctcgcctgccaccactgatctcggat

SEQ ID NO: 179799 - DNA, 35 bp, Artificial Sequence
  Synthetic oligonucleotide
ttagaggtgaggagtaagggagtatacggggggat

SEQ ID NO: 179800 - DNA, 35 bp, Artificial Sequence
  Synthetic oligonucleotide
actccacctccagactggctgtttacccacgttat

SEQ ID NO: 179801 - DNA, 35 bp, Artificial Sequence
  Synthetic oligonucleotide
gatgtccgatctgaacgcttaggccaccgtaccct

SEQ ID NO: 179802 - DNA, 35 bp, Artificial Sequence
  Synthetic oligonucleotide
agaccagacggaacataccgctaccgcacgcccct

SEQ ID NO: 179803 - DNA, 35 bp, Artificial Sequence
  Synthetic oligonucleotide
gtcgcccgatactgaacgcgtctatttaggtccct

SEQ ID NO: 179804 - DNA, 35 bp, Artificial Sequence
  Synthetic oligonucleotide
gctccactagtaatgtcgtcccctcccaacccgct

SEQ ID NO: 179805 - DNA, 35 bp, Artificial Sequence
  Synthetic oligonucleotide
attcacggtcgtgctccaccccgagctttccctct

SEQ ID NO: 179806 - DNA, 35 bp, Artificial Sequence
  Synthetic oligonucleotide
gaaccggtagactgacatttagcccggcttcctct

SEQ ID NO: 179807 - DNA, 35 bp, Artificial Sequence
  Synthetic oligonucleotide
ggacttagcccctggtacatccactagtttcctct

SEQ ID NO: 179808 - DNA, 35 bp, Artificial Sequence
  Synthetic oligonucleotide
gaccctgtcattgaatatgtcctgccttttgctct

SEQ ID NO: 179809 - DNA, 35 bp, Artificial Sequence
  Synthetic oligonucleotide
agtaccccctcacgtggacgaacttgccatattct

SEQ ID NO: 179810 - DNA, 35 bp, Artificial Sequence
  Synthetic oligonucleotide
tcgatcgcccctccgctcccatccttaagacttct

SEQ ID NO: 179811 - DNA, 35 bp, Artificial Sequence
  Synthetic oligonucleotide
gattcctcgaggctgtttgcacatttcatccttct

SEQ ID NO: 179812 - DNA, 35 bp, Artificial Sequence
  Synthetic oligonucleotide
tcccccgccctatgcccgactcgaccagaacgggt

SEQ ID NO: 179813 - DNA, 35 bp, Artificial Sequence
  Synthetic oligonucleotide
tttacccaccgaccctgtataccgtttccgttatt

SEQ ID NO: 179814 - DNA, 35 bp, Artificial Sequence
  Synthetic oligonucleotide
gagggaagactcagatggtgccgctaccccccctt

SEQ ID NO: 179815 - DNA, 35 bp, Artificial Sequence
  Synthetic oligonucleotide
taaggaatccatgcgcccctgtcctgtctcccctt

SEQ ID NO: 179816 - DNA, 35 bp, Artificial Sequence
  Synthetic oligonucleotide
actgcccggccttctagcaccacgtgcacgccctt

SEQ ID NO: 179817 - DNA, 35 bp, Artificial Sequence
  Synthetic oligonucleotide
accatggcatctccttgtcgtcgctaccctgcctt

SEQ ID NO: 179818 - DNA, 35 bp, Artificial Sequence
  Synthetic oligonucleotide
tatccacccgctttccccgccttcatgtgaatgtt

SEQ ID NO: 179819 - DNA, 35 bp, Artificial Sequence
  Synthetic oligonucleotide
ttcctgtgcgcactcccgaaggtttctggccattt

SEQ ID NO: 179820 - DNA, 35 bp, Artificial Sequence
  Synthetic oligonucleotide
tccagatatagcatgccgtttgcgatccacctttt

SEQ ID NO: 179821 - DNA, 36 bp, Artificial Sequence
  Synthetic oligonucleotide
agctcaactcacacgctggcatcaaccttctccaaa

SEQ ID NO: 179822 - DNA, 36 bp, Artificial Sequence
  Synthetic oligonucleotide
ttccgatcccgcccatgattcttcaccaactgcaaa

SEQ ID NO: 179823 - DNA, 36 bp, Artificial Sequence
  Synthetic oligonucleotide
tgccccgcctggtaagccaagccacttctctatcaa

SEQ ID NO: 179824 - DNA, 36 bp, Artificial Sequence
  Synthetic oligonucleotide
gagcatgctcccgttttgctggtaacactctctcaa

SEQ ID NO: 179825 - DNA, 36 bp, Artificial Sequence
  Synthetic oligonucleotide
aacccgccgccagccacccattatgccgccttggaa

SEQ ID NO: 179826 - DNA, 35 bp, Artificial Sequence
  Synthetic oligonucleotide
gcccccgcgccccgatttaactgattccgcactaa

SEQ ID NO: 179827 - DNA, 36 bp, Artificial Sequence
  Synthetic oligonucleotide
tttcaccaacacgacgtgtttacccatcccacgtaa

SEQ ID NO: 179828 - DNA, 35 bp, Artificial Sequence
  Synthetic oligonucleotide
tgactgcctctgtttccctgtcctgccgttacaca

SEQ ID NO: 179829 - DNA, 36 bp, Artificial Sequence
  Synthetic oligonucleotide
tccaccctcacaggccgtctacacggtatctgcaca

SEQ ID NO: 179830 - DNA, 36 bp, Artificial Sequence
  Synthetic oligonucleotide
tgtaacatccacgtgatactagcctctcccccacca

SEQ ID NO: 179831 - DNA, 36 bp, Artificial Sequence
  Synthetic oligonucleotide
tctacacagcgcagcctttcgtcatcgccgtcacca

SEQ ID NO: 179832 - DNA, 36 bp, Artificial Sequence
  Synthetic oligonucleotide
agcgatgtccggtcccgtttttgccaatggccccca

SEQ ID NO: 179833 - DNA, 36 bp, Artificial Sequence
  Synthetic oligonucleotide
acactgagtctgatcctgccttacccgactacgcca

SEQ ID NO: 179834 - DNA, 35 bp, Artificial Sequence
  Synthetic oligonucleotide
gacctagctccggcactattttgacgtcccctcca

SEQ ID NO: 179835 - DNA, 35 bp, Artificial Sequence
  Synthetic oligonucleotide
gccccgctcctccctgtccgccagacacacgtcca

SEQ ID NO: 179836 - DNA, 36 bp, Artificial Sequence
  Synthetic oligonucleotide
tgccaaccttccacactgtccagtactcattttcca

SEQ ID NO: 179837 - DNA, 36 bp, Artificial Sequence
  Synthetic oligonucleotide
acacgccccgcccactgatcacgcatctgacccgca

SEQ ID NO: 179838 - DNA, 36 bp, Artificial Sequence
  Synthetic oligonucleotide
gacccccccccgtacgagtgtgcacgcattccggca

SEQ ID NO: 179839 - DNA, 36 bp, Artificial Sequence
  Synthetic oligonucleotide
taagaccccccgtcagctccgttctgcagctcttca

SEQ ID NO: 179840 - DNA, 35 bp, Artificial Sequence
  Synthetic oligonucleotide
ttgccaaccgtaagcttgcggaatcaccctgttca

SEQ ID NO: 179841 - DNA, 35 bp, Artificial Sequence
  Synthetic oligonucleotide
gtcgccacaccgccgtccccccgttcctatgcaga

SEQ ID NO: 179842 - DNA, 35 bp, Artificial Sequence
  Synthetic oligonucleotide
gcaatgcccattcgtcttatactacaccgtaccga

SEQ ID NO: 179843 - DNA, 37 bp, Artificial Sequence
  Synthetic oligonucleotide
gccgtcaccggccccccagattcgttccaactcccga

SEQ ID NO: 179844 - DNA, 37 bp, Artificial Sequence
  Synthetic oligonucleotide
ggacaggtggattgttaccctctccgtccccctccga

SEQ ID NO: 179845 - DNA, 37 bp, Artificial Sequence
  Synthetic oligonucleotide
tgcactactatgcctcccgtccgcttgttccctccga

SEQ ID NO: 179846 - DNA, 37 bp, Artificial Sequence
  Synthetic oligonucleotide
gtacgcgctcgtttgtcctatccctcagcctgtccga

SEQ ID NO: 179847 - DNA, 37 bp, Artificial Sequence
  Synthetic oligonucleotide
gagatggatggtaaggaagtgggtatcaggggggcga

SEQ ID NO: 179848 - DNA, 37 bp, Artificial Sequence
  Synthetic oligonucleotide
gcctcccattccgacccttattgagtaccaccctcga

SEQ ID NO: 179849 - DNA, 37 bp, Artificial Sequence
  Synthetic oligonucleotide
gccacttcacgtcgcacacatcccgctcccccctcga

SEQ ID NO: 179850 - DNA, 37 bp, Artificial Sequence
  Synthetic oligonucleotide
gtcacgatagtcgtatagaagggggaggatgggagga

SEQ ID NO: 179851 - DNA, 36 bp, Artificial Sequence
  Synthetic oligonucleotide
tccacatcccacctatgggccacggttcatcccgga

SEQ ID NO: 179852 - DNA, 37 bp, Artificial Sequence
  Synthetic oligonucleotide
ttagggaggggacgaagggtgaacttgagtgtaggga

SEQ ID NO: 179853 - DNA, 37 bp, Artificial Sequence
  Synthetic oligonucleotide
acgacccatcacttcgggctatctcatctcttcggga

SEQ ID NO: 179854 - DNA, 37 bp, Artificial Sequence
  Synthetic oligonucleotide
gtgggaagggacgggtgagcctgagcggggacctgga

SEQ ID NO: 179855 - DNA, 37 bp, Artificial Sequence
  Synthetic oligonucleotide
tacccgtcgcccctcctatgagcctccccaatctgga

SEQ ID NO: 179856 - DNA, 35 bp, Artificial Sequence
  Synthetic oligonucleotide
gaatctccgccgcccttgcccaccatgacgactga

SEQ ID NO: 179857 - DNA, 35 bp, Artificial Sequence
  Synthetic oligonucleotide
atgttcctcagccttccaccgtctttgtcatctga

SEQ ID NO: 179858 - DNA, 38 bp, Artificial Sequence
  Synthetic oligonucleotide
gtgtgggaaggacggaatgagaagcgcggcgggagtga

SEQ ID NO: 179859 - DNA, 38 bp, Artificial Sequence
  Synthetic oligonucleotide
ggggaacagggaggtgggtgaaatgaccaggatagtga

SEQ ID NO: 179860 - DNA, 38 bp, Artificial Sequence
  Synthetic oligonucleotide
tttatggtcagacggttaggggaggtaacgggaggtga

SEQ ID NO: 179861 - DNA, 35 bp, Artificial Sequence
  Synthetic oligonucleotide
acttgcttccggcgggtatgggtagggaggggtga

SEQ ID NO: 179862 - DNA, 38 bp, Artificial Sequence
  Synthetic oligonucleotide
acattataggaggagggggagcgaggcatgaggggtga

SEQ ID NO: 179863 - DNA, 37 bp, Artificial Sequence
  Synthetic oligonucleotide
tacgctcctctcgcatggttcttatgcaccaccttga

SEQ ID NO: 179864 - DNA, 38 bp, Artificial Sequence
  Synthetic oligonucleotide
gcccaccaccctactcagcagtggtcacactaccttga

SEQ ID NO: 179865 - DNA, 37 bp, Artificial Sequence
  Synthetic oligonucleotide
gactctacgccatgtaggtacccctggactcccttga

SEQ ID NO: 179866 - DNA, 38 bp, Artificial Sequence
  Synthetic oligonucleotide
cactcccgacaaacctgctcccacgtgacctcccttga

SEQ ID NO: 179867 - DNA, 38 bp, Artificial Sequence
  Synthetic oligonucleotide
tccccatctccctcccgttacatcaaaccgtgctttga

SEQ ID NO: 179868 - DNA, 33 bp, Artificial Sequence
  Synthetic oligonucleotide
gcccacgcatccgcttttctgttcacgcaccta

SEQ ID NO: 179869 - DNA, 35 bp, Artificial Sequence
  Synthetic oligonucleotide
atcacccagaattgctgcccatactcttcgcccta

SEQ ID NO: 179870 - DNA, 35 bp, Artificial Sequence
  Synthetic oligonucleotide
tgctgacacaattcgctgcattagcttaccatcta

SEQ ID NO: 179871 - DNA, 36 bp, Artificial Sequence
  Synthetic oligonucleotide
tcaccaacgtacgtcccttaaattgtgccacctcta

SEQ ID NO: 179872 - DNA, 36 bp, Artificial Sequence
  Synthetic oligonucleotide
tcgcgtccgtctcttccgccgagtcgcttccctcta

SEQ ID NO: 179873 - DNA, 36 bp, Artificial Sequence
  Synthetic oligonucleotide
acccccgcccctgttcaccttcccgcgtatcgcgta

SEQ ID NO: 179874 - DNA, 36 bp, Artificial Sequence
  Synthetic oligonucleotide
gcaactcacacctgcatcccactacacgtaaactta

SEQ ID NO: 179875 - DNA, 36 bp, Artificial Sequence
  Synthetic oligonucleotide
gttagcccgcccactgacacccagatgacgctctta

SEQ ID NO: 179876 - DNA, 36 bp, Artificial Sequence
  Synthetic oligonucleotide
ttcgagcatcccctgcctctgttaaatgtaccgtta

SEQ ID NO: 179877 - DNA, 36 bp, Artificial Sequence
  Synthetic oligonucleotide
tcgcccggcctctcgttttcttatatctagccgtta

SEQ ID NO: 179878 - DNA, 35 bp, Artificial Sequence
  Synthetic oligonucleotide
acccctcacgtcataacgccgcaccctctctgaac

SEQ ID NO: 179879 - DNA, 35 bp, Artificial Sequence
  Synthetic oligonucleotide
tcactcctcggtcgctgacgttccggcattctaac

SEQ ID NO: 179880 - DNA, 35 bp, Artificial Sequence
  Synthetic oligonucleotide
acacatcctcaaacatctgtattccattcgttaac

SEQ ID NO: 179881 - DNA, 35 bp, Artificial Sequence
  Synthetic oligonucleotide
gatggggtctatggctgggtgggtagggtgaacac

SEQ ID NO: 179882 - DNA, 33 bp, Artificial Sequence
  Synthetic oligonucleotide
taaccctacggcgcaactccggcttactttcac

SEQ ID NO: 179883 - DNA, 35 bp, Artificial Sequence
  Synthetic oligonucleotide
tacctgatcccgcactatcacaggtctacgctgac

SEQ ID NO: 179884 - DNA, 35 bp, Artificial Sequence
  Synthetic oligonucleotide
gacgaccgatccatccgtgccggccttttgtaacc

SEQ ID NO: 179885 - DNA, 35 bp, Artificial Sequence
  Synthetic oligonucleotide
gcgccctgccacgtcgttacactcgaattgtcacc

SEQ ID NO: 179886 - DNA, 35 bp, Artificial Sequence
  Synthetic oligonucleotide
gaggcgcagaccgcttcgtttacccatcccacccc

SEQ ID NO: 179887 - DNA, 35 bp, Artificial Sequence
  Synthetic oligonucleotide
tcccagtgctctcgtatacgcctttttgccccccc

SEQ ID NO: 179888 - DNA, 35 bp, Artificial Sequence
  Synthetic oligonucleotide
gtcgacttgcgcctcatcggtattacgtctccccc

SEQ ID NO: 179889 - DNA, 35 bp, Artificial Sequence
  Synthetic oligonucleotide
gacccgcacgcacgagcgcatatctcagtacgccc

SEQ ID NO: 179890 - DNA, 35 bp, Artificial Sequence
  Synthetic oligonucleotide
gtcaggtcaccactcgccgcctgcacgagccgccc

SEQ ID NO: 179891 - DNA, 35 bp, Artificial Sequence
  Synthetic oligonucleotide
tcagccgctttccagttcctgcccacattccgccc

SEQ ID NO: 179892 - DNA, 35 bp, Artificial Sequence
  Synthetic oligonucleotide
tcctgtccgatctcatgcctccccacagagtgccc

SEQ ID NO: 179893 - DNA, 35 bp, Artificial Sequence
  Synthetic oligonucleotide
gtctgtcgtaacatcgaactgctcccgatcctccc

SEQ ID NO: 179894 - DNA, 35 bp, Artificial Sequence
  Synthetic oligonucleotide
gccctccctgaaacgtgaacgtgcgtgtccccgcc

SEQ ID NO: 179895 - DNA, 35 bp, Artificial Sequence
  Synthetic oligonucleotide
tgccaacccatatgcttcttcaagccacagtcgcc

SEQ ID NO: 179896 - DNA, 35 bp, Artificial Sequence
  Synthetic oligonucleotide
tcgcgccctttgtacctaaccgtcctttacatgcc

SEQ ID NO: 179897 - DNA, 35 bp, Artificial Sequence
  Synthetic oligonucleotide
atcgccgaaccttccgccaatggctacctcgtgcc

SEQ ID NO: 179898 - DNA, 35 bp, Artificial Sequence
  Synthetic oligonucleotide
tacaccgcccttgtctgacgagacacccagcctcc

SEQ ID NO: 179899 - DNA, 35 bp, Artificial Sequence
  Synthetic oligonucleotide
tgtgttacaatcctggtccggtctgtccgtcctcc

SEQ ID NO: 179900 - DNA, 35 bp, Artificial Sequence
  Synthetic oligonucleotide
gccgccccgtcctgtccttgtccatcagtcgctcc

SEQ ID NO: 179901 - DNA, 35 bp, Artificial Sequence
  Synthetic oligonucleotide
tcacgagcgctacttaccgttaaacaacatgctcc

SEQ ID NO: 179902 - DNA, 35 bp, Artificial Sequence
  Synthetic oligonucleotide
ttctgtggccgtcgccctgatcgctctggttctcc

SEQ ID NO: 179903 - DNA, 35 bp, Artificial Sequence
  Synthetic oligonucleotide
tattcaccgaccttaatatgattttgccccagtcc

SEQ ID NO: 179904 - DNA, 34 bp, Artificial Sequence
  Synthetic oligonucleotide
gcaagccccgtccacacggattttctgccaacgc

SEQ ID NO: 179905 - DNA, 35 bp, Artificial Sequence
  Synthetic oligonucleotide
gacaacacgctcatttccgcctactttaccgacgc

SEQ ID NO: 179906 - DNA, 35 bp, Artificial Sequence
  Synthetic oligonucleotide
tccatccccagggcctaattaatgtacacctccgc

SEQ ID NO: 179907 - DNA, 35 bp, Artificial Sequence
  Synthetic oligonucleotide
tgtggctacgtaccatcctcataggccgcaacatc

SEQ ID NO: 179908 - DNA, 35 bp, Artificial Sequence
  Synthetic oligonucleotide
gatgtgcgtatcgggtctctttgatcttctccatc

SEQ ID NO: 179909 - DNA, 35 bp, Artificial Sequence
  Synthetic oligonucleotide
atcccatccccctagtttgatcgtttgcgcccctc

SEQ ID NO: 179910 - DNA, 35 bp, Artificial Sequence
  Synthetic oligonucleotide
gatgggggtgagaggggcaagggagaatgtcagtc

SEQ ID NO: 179911 - DNA, 35 bp, Artificial Sequence
  Synthetic oligonucleotide
gtcgcccagttccgcccattgctatcacctctgtc

SEQ ID NO: 179912 - DNA, 35 bp, Artificial Sequence
  Synthetic oligonucleotide
tgcacacccttcgaggtgcagcctgttctatcttc

SEQ ID NO: 179913 - DNA, 35 bp, Artificial Sequence
  Synthetic oligonucleotide
tgccattccgcagtgcgcgactctcccacatgttc

SEQ ID NO: 179914 - DNA, 35 bp, Artificial Sequence
  Synthetic oligonucleotide
ggtgtcgcaccatgcctcgaatcgtcctccctttc

SEQ ID NO: 179915 - DNA, 35 bp, Artificial Sequence
  Synthetic oligonucleotide
gtgggatggggacgggataactgtcggaagagaag

SEQ ID NO: 179916 - DNA, 35 bp, Artificial Sequence
  Synthetic oligonucleotide
tgaacagatcggactagggaaaggtggggacggag

SEQ ID NO: 179917 - DNA, 35 bp, Artificial Sequence
  Synthetic oligonucleotide
aaccttacctcgcctctcttatcgtactgctgtag

SEQ ID NO: 179918 - DNA, 35 bp, Artificial Sequence
  Synthetic oligonucleotide
gattgcgcccgccagaacaccatccactctagccg

SEQ ID NO: 179919 - DNA, 35 bp, Artificial Sequence
  Synthetic oligonucleotide
ttgcatcccccattccacaccacctagcgccgccg

SEQ ID NO: 179920 - DNA, 35 bp, Artificial Sequence
  Synthetic oligonucleotide
accgctgacctcactttttgaaacctgcttcatcg

SEQ ID NO: 179921 - DNA, 35 bp, Artificial Sequence
  Synthetic oligonucleotide
tggaccctcattcctctggccgttcgtgctcttcg

SEQ ID NO: 179922 - DNA, 35 bp, Artificial Sequence
  Synthetic oligonucleotide
gacaataggggattgggataggggtgagtgccggg

SEQ ID NO: 179923 - DNA, 35 bp, Artificial Sequence
  Synthetic oligonucleotide
gcacctgcccccggactcccaccccctgccaatgg

SEQ ID NO: 179924 - DNA, 35 bp, Artificial Sequence
  Synthetic oligonucleotide
aagtaggggtggtaggacaaagaagagccatatgg

SEQ ID NO: 179925 - DNA, 35 bp, Artificial Sequence
  Synthetic oligonucleotide
taccagcccagaccaccctttccatatagccgctg

SEQ ID NO: 179926 - DNA, 35 bp, Artificial Sequence
  Synthetic oligonucleotide
ggaaggggggagtggtgagggttctcaggctgctg

SEQ ID NO: 179927 - DNA, 35 bp, Artificial Sequence
  Synthetic oligonucleotide
tgctccatccggctgtatctttctccttattgctg

SEQ ID NO: 179928 - DNA, 37 bp, Artificial Sequence
  Synthetic oligonucleotide
tggtgcctccgactcctgatatcgcgcccacttcgtg

SEQ ID NO: 179929 - DNA, 35 bp, Artificial Sequence
  Synthetic oligonucleotide
gggaaagccccggcccgtttcccgttctctccttg

SEQ ID NO: 179930 - DNA, 35 bp, Artificial Sequence
  Synthetic oligonucleotide
gcactggggggaaggggaaagatgtaacgctgttg

SEQ ID NO: 179931 - DNA, 35 bp, Artificial Sequence
  Synthetic oligonucleotide
agtggccacgctatcctctgcttttatttgtacat

SEQ ID NO: 179932 - DNA, 35 bp, Artificial Sequence
  Synthetic oligonucleotide
taccacgtccctttgctgagtcacccccctcccat

SEQ ID NO: 179933 - DNA, 35 bp, Artificial Sequence
  Synthetic oligonucleotide
tatgcgctccctctcctgtggcaacattgtctcat

SEQ ID NO: 179934 - DNA, 35 bp, Artificial Sequence
  Synthetic oligonucleotide
gtaccacccggcactgttgagtcaacgcctttcat

SEQ ID NO: 179935 - DNA, 35 bp, Artificial Sequence
  Synthetic oligonucleotide
gcctggctcaaccgttgcctcccaagaccttctat

SEQ ID NO: 179936 - DNA, 35 bp, Artificial Sequence
  Synthetic oligonucleotide
agtgtcaccgcagctccacccaatcaacttctact

SEQ ID NO: 179937 - DNA, 35 bp, Artificial Sequence
  Synthetic oligonucleotide
gtccatccacccaccgtgatctcttacagacacct

SEQ ID NO: 179938 - DNA, 35 bp, Artificial Sequence
  Synthetic oligonucleotide
gcccgattcatgtttctttgtctctggccttacct

SEQ ID NO: 179939 - DNA, 35 bp, Artificial Sequence
  Synthetic oligonucleotide
gactgccgagctcgtcactggtccgctctgtccct

SEQ ID NO: 179940 - DNA, 35 bp, Artificial Sequence
  Synthetic oligonucleotide
gccccgatatgtctcttccctcgggggtttctcct

SEQ ID NO: 179941 - DNA, 35 bp, Artificial Sequence
  Synthetic oligonucleotide
tcagacccatcttgcacttaggacgtacttccgct

SEQ ID NO: 179942 - DNA, 35 bp, Artificial Sequence
  Synthetic oligonucleotide
tcgcacaagcccctatacgcctgctacctctcgct

SEQ ID NO: 179943 - DNA, 35 bp, Artificial Sequence
  Synthetic oligonucleotide
gtctccgaacgggcccaagcgctccctcgcctgct

SEQ ID NO: 179944 - DNA, 35 bp, Artificial Sequence
  Synthetic oligonucleotide
taaatcgccgcctgcccgtgcacgttgtaatatct

SEQ ID NO: 179945 - DNA, 35 bp, Artificial Sequence
  Synthetic oligonucleotide
gcctgacttctccgttgcctttgactcaggcttct

SEQ ID NO: 179946 - DNA, 35 bp, Artificial Sequence
  Synthetic oligonucleotide
tcggagatctcgcctggtaccacctccacctttct

SEQ ID NO: 179947 - DNA, 35 bp, Artificial Sequence
  Synthetic oligonucleotide
tccaagccttcccatcccacgtgcccacttctcgt

SEQ ID NO: 179948 - DNA, 35 bp, Artificial Sequence
  Synthetic oligonucleotide
agggcgccgccgttctttctttcaccacccagggt

SEQ ID NO: 179949 - DNA, 35 bp, Artificial Sequence
  Synthetic oligonucleotide
tcaacacagtcattgtgtacgcgttttgtccctgt

SEQ ID NO: 179950 - DNA, 35 bp, Artificial Sequence
  Synthetic oligonucleotide
tctgaggtgtgttcgggcgcctcctctcttcctgt

SEQ ID NO: 179951 - DNA, 35 bp, Artificial Sequence
  Synthetic oligonucleotide
taggacgatggtgaaggaaatggtgtggggagatt

SEQ ID NO: 179952 - DNA, 35 bp, Artificial Sequence
  Synthetic oligonucleotide
gtacacccgcgggagacgccctatatccacccctt

SEQ ID NO: 179953 - DNA, 35 bp, Artificial Sequence
  Synthetic oligonucleotide
atcttccatcgccgctgtcattccttgcctcagtt

SEQ ID NO: 179954 - DNA, 35 bp, Artificial Sequence
  Synthetic oligonucleotide
gcacagtggaggtatccgggtgaggggggacggtt

SEQ ID NO: 179955 - DNA, 35 bp, Artificial Sequence
  Synthetic oligonucleotide
cagagggagaagggaagggaaggagaagtatggtt

SEQ ID NO: 179956 - DNA, 35 bp, Artificial Sequence
  Synthetic oligonucleotide
accgctcatgtgtccctccctccggctacttggtt

SEQ ID NO: 179957 - DNA, 35 bp, Artificial Sequence
  Synthetic oligonucleotide
tccaccaaaggttgcagcccctccccctgagtgtt

SEQ ID NO: 179958 - DNA, 35 bp, Artificial Sequence
  Synthetic oligonucleotide
atgaccgtcacccatccgatacggttgtcctcttt

SEQ ID NO: 179959 - DNA, 35 bp, Artificial Sequence
  Synthetic oligonucleotide
ttactgcaccagcttgagctgtccactcacctttt

SEQ ID NO: 179960 - DNA, 36 bp, Artificial Sequence
  Synthetic oligonucleotide
ttcgcctgtctcgccgcctgcacctctttagacaaa

SEQ ID NO: 179961 - DNA, 35 bp, Artificial Sequence
  Synthetic oligonucleotide
gtggccacctccctccatgcgcgacacacacacaa

SEQ ID NO: 179962 - DNA, 35 bp, Artificial Sequence
  Synthetic oligonucleotide
ggggacgttcaggaggggaaggggatgaagggcaa

SEQ ID NO: 179963 - DNA, 36 bp, Artificial Sequence
  Synthetic oligonucleotide
ttcgcgccctcggcctacgtttatcatgtacctcaa

SEQ ID NO: 179964 - DNA, 35 bp, Artificial Sequence
  Synthetic oligonucleotide
acccacccctcccttaagtcccgctgtttatcgaa

SEQ ID NO: 179965 - DNA, 36 bp, Artificial Sequence
  Synthetic oligonucleotide
aattacgcctcgctgcgcatcctggcctcttttgaa

SEQ ID NO: 179966 - DNA, 35 bp, Artificial Sequence
  Synthetic oligonucleotide
gcactggtcccgcctaatatctgccgccacattaa

SEQ ID NO: 179967 - DNA, 35 bp, Artificial Sequence
  Synthetic oligonucleotide
tgacgccctcctgccgctgatccacccgtgacaca

SEQ ID NO: 179968 - DNA, 35 bp, Artificial Sequence
  Synthetic oligonucleotide
tgacacacccgttttctgttccactggccaataca

SEQ ID NO: 179969 - DNA, 36 bp, Artificial Sequence
  Synthetic oligonucleotide
actggccaccctccactcattgctatagctccacca

SEQ ID NO: 179970 - DNA, 36 bp, Artificial Sequence
  Synthetic oligonucleotide
tcacctccgccttgccaatgacccgcggacccccca

SEQ ID NO: 179971 - DNA, 36 bp, Artificial Sequence
  Synthetic oligonucleotide
acgaacacactcactgatccccgacccatgcgccca

SEQ ID NO: 179972 - DNA, 36 bp, Artificial Sequence
  Synthetic oligonucleotide
tgactatgacgtcaacccctggagccgcccttccca

SEQ ID NO: 179973 - DNA, 36 bp, Artificial Sequence
  Synthetic oligonucleotide
tagcgcggtttcacttgttttccggtccgttcgcca

SEQ ID NO: 179974 - DNA, 35 bp, Artificial Sequence
  Synthetic oligonucleotide
tggccccagtctgcgtctgctctgctacttctcca

SEQ ID NO: 179975 - DNA, 36 bp, Artificial Sequence
  Synthetic oligonucleotide
accgctgtgccgccacatttgccacacctgtttcca

SEQ ID NO: 179976 - DNA, 36 bp, Artificial Sequence
  Synthetic oligonucleotide
gacgcgatcaactacaccccgcctgtgtcctcagca

SEQ ID NO: 179977 - DNA, 36 bp, Artificial Sequence
  Synthetic oligonucleotide
gcctcccttacgcccgttctgccagagcagttagca

SEQ ID NO: 179978 - DNA, 36 bp, Artificial Sequence
  Synthetic oligonucleotide
actgcctcccattagcttcctacaccgcgtttagca

SEQ ID NO: 179979 - DNA, 36 bp, Artificial Sequence
  Synthetic oligonucleotide
gatccccgccggccacatgtttacagcacgcgcgca

SEQ ID NO: 179980 - DNA, 35 bp, Artificial Sequence
  Synthetic oligonucleotide
gcacaacctgctctactcgcgtacatgctctcgca

SEQ ID NO: 179981 - DNA, 35 bp, Artificial Sequence
  Synthetic oligonucleotide
aaaacggtgagggaggggggcaagagtgcggtgca

SEQ ID NO: 179982 - DNA, 36 bp, Artificial Sequence
  Synthetic oligonucleotide
tgcctgagcccgcttttcctgataattcactgtgca

SEQ ID NO: 179983 - DNA, 35 bp, Artificial Sequence
  Synthetic oligonucleotide
gtgcgatgtccgacaacccttacgacccgccctca

SEQ ID NO: 179984 - DNA, 35 bp, Artificial Sequence
  Synthetic oligonucleotide
atccaaacgcccgtgcatgcgaattacgtccctca

SEQ ID NO: 179985 - DNA, 36 bp, Artificial Sequence
  Synthetic oligonucleotide
acattacgcctccagagggtcgtcgccccttcctca

SEQ ID NO: 179986 - DNA, 35 bp, Artificial Sequence
  Synthetic oligonucleotide
tgtttcacctcggacttccattgaccgcactctca

SEQ ID NO: 179987 - DNA, 36 bp, Artificial Sequence
  Synthetic oligonucleotide
gatgcgatggggggagtattgaggtacgtggcgtca

SEQ ID NO: 179988 - DNA, 36 bp, Artificial Sequence
  Synthetic oligonucleotide
gaacgctcccgccgcttagggcttactgtcccttca

SEQ ID NO: 179989 - DNA, 37 bp, Artificial Sequence
  Synthetic oligonucleotide
tgccacataccatgttgataacccgcttccacccaga

SEQ ID NO: 179990 - DNA, 36 bp, Artificial Sequence
  Synthetic oligonucleotide
aatgcggactgtggtgggagggggggggcatgcaga

SEQ ID NO: 179991 - DNA, 36 bp, Artificial Sequence
  Synthetic oligonucleotide
aacccgtctcatcgtttgctacttttccctccgaga

SEQ ID NO: 179992 - DNA, 37 bp, Artificial Sequence
  Synthetic oligonucleotide
atgacagaacgtcaacccgcccgctcctccgtttaga

SEQ ID NO: 179993 - DNA, 37 bp, Artificial Sequence
  Synthetic oligonucleotide
tacgcccacgctatatgcaccgctttcctgccaccga

SEQ ID NO: 179994 - DNA, 37 bp, Artificial Sequence
  Synthetic oligonucleotide
acttcacgcactcacacttggtttaatatccacccga

SEQ ID NO: 179995 - DNA, 35 bp, Artificial Sequence
  Synthetic oligonucleotide
gttacctgtcctccacgcccgtcgttccgttccga

SEQ ID NO: 179996 - DNA, 37 bp, Artificial Sequence
  Synthetic oligonucleotide
agcattacgccctgcccagccctacatttcgttccga

SEQ ID NO: 179997 - DNA, 37 bp, Artificial Sequence
  Synthetic oligonucleotide
acgaagcagaacgggaggggggaagaagggagtgcga

SEQ ID NO: 179998 - DNA, 37 bp, Artificial Sequence
  Synthetic oligonucleotide
tccctgccgctcattattttatccgtgcccttgtcga

SEQ ID NO: 179999 - DNA, 37 bp, Artificial Sequence
  Synthetic oligonucleotide
ggggtagggggcaaaggtgaccgggggaagacaagga

SEQ ID NO: 180000 - DNA, 37 bp, Artificial Sequence
  Synthetic oligonucleotide
aaggagggggaatagcgcacggggtcggggagaagga

SEQ ID NO: 180001 - DNA, 37 bp, Artificial Sequence
  Synthetic oligonucleotide
ttcacacggtcacacctcttctgcttccgacgccgga

SEQ ID NO: 180002 - DNA, 37 bp, Artificial Sequence
  Synthetic oligonucleotide
atacaatagcgggcacgggggggagacagcacaggga

SEQ ID NO: 180003 - DNA, 36 bp, Artificial Sequence
  Synthetic oligonucleotide
tcatagagcggaagggtggggcgtcaaggcgaggga

SEQ ID NO: 180004 - DNA, 37 bp, Artificial Sequence
  Synthetic oligonucleotide
gttgggtggaggggaatcaaaatggtgggtagcggga

SEQ ID NO: 180005 - DNA, 37 bp, Artificial Sequence
  Synthetic oligonucleotide
gaggacgggtagaaaggttcataaagggatgggggga

SEQ ID NO: 180006 - DNA, 35 bp, Artificial Sequence
  Synthetic oligonucleotide
aatcctggggtggtgtccatgggagaagtggggga

SEQ ID NO: 180007 - DNA, 37 bp, Artificial Sequence
  Synthetic oligonucleotide
gctgagggtacagggaggagcgaggcgtaggtgggga

SEQ ID NO: 180008 - DNA, 36 bp, Artificial Sequence
  Synthetic oligonucleotide
tttgccccctgcactgtattaaatccctacgcatga

SEQ ID NO: 180009 - DNA, 38 bp, Artificial Sequence
  Synthetic oligonucleotide
tgagcgcacgtttctgcccctcctcatgtcttgcatga

SEQ ID NO: 180010 - DNA, 38 bp, Artificial Sequence
  Synthetic oligonucleotide
gtggtccgccgtcacacccgccgccatcacgattatga

SEQ ID NO: 180011 - DNA, 38 bp, Artificial Sequence
  Synthetic oligonucleotide
acacccagcctagggaggggggagagtggggtaactga

SEQ ID NO: 180012 - DNA, 37 bp, Artificial Sequence
  Synthetic oligonucleotide
accgccaatgtcctcggtgcccgacttccttacctga

SEQ ID NO: 180013 - DNA, 37 bp, Artificial Sequence
  Synthetic oligonucleotide
gacgcggcaactcattgtttgcgcccctccatcctga

SEQ ID NO: 180014 - DNA, 37 bp, Artificial Sequence
  Synthetic oligonucleotide
gcattcgcgtatatgctgttccctcctgccttcctga

SEQ ID NO: 180015 - DNA, 35 bp, Artificial Sequence
  Synthetic oligonucleotide
gcgggccctgttctgtctatgctctgccttcctga

SEQ ID NO: 180016 - DNA, 38 bp, Artificial Sequence
  Synthetic oligonucleotide
gcaccgtcccccgaattacctccgctaccttcagctga

SEQ ID NO: 180017 - DNA, 38 bp, Artificial Sequence
  Synthetic oligonucleotide
atggtacggaggggaggatagggtcaggagagggctga

SEQ ID NO: 180018 - DNA, 37 bp, Artificial Sequence
  Synthetic oligonucleotide
atcgcctccccgccatatgtaccactgccttccgtga

SEQ ID NO: 180019 - DNA, 37 bp, Artificial Sequence
  Synthetic oligonucleotide
gacggatgcatttgggggagagaggggatgggcgtga

SEQ ID NO: 180020 - DNA, 37 bp, Artificial Sequence
  Synthetic oligonucleotide
tgagggtataagagagggggggtggagtcggaggtga

SEQ ID NO: 180021 - DNA, 37 bp, Artificial Sequence
  Synthetic oligonucleotide
gagcatcgggaaagggaatgggggcaggagcatgtga

SEQ ID NO: 180022 - DNA, 38 bp, Artificial Sequence
  Synthetic oligonucleotide
tccgccccacctgggctttacggtcctcctttttgtga

SEQ ID NO: 180023 - DNA, 38 bp, Artificial Sequence
  Synthetic oligonucleotide
gctctcgcagatgccgcctacgccccccttcaacttga

SEQ ID NO: 180024 - DNA, 37 bp, Artificial Sequence
  Synthetic oligonucleotide
ttcccattcgcgtgtacttcacccctgccatacttga

SEQ ID NO: 180025 - DNA, 38 bp, Artificial Sequence
  Synthetic oligonucleotide
tcacaccgtctcgacgctgatcatgcccgcacccttga

SEQ ID NO: 180026 - DNA, 38 bp, Artificial Sequence
  Synthetic oligonucleotide
taaccatccacccgtgtatctgcccccgctcgccttga

SEQ ID NO: 180027 - DNA, 38 bp, Artificial Sequence
  Synthetic oligonucleotide
tctgggaggcgactgcgggtgggaagaaagaacgttga

SEQ ID NO: 180028 - DNA, 38 bp, Artificial Sequence
  Synthetic oligonucleotide
gaaccaaccccctgtatgtgagcgccccccactgttga

SEQ ID NO: 180029 - DNA, 36 bp, Artificial Sequence
  Synthetic oligonucleotide
atgcacattggcccgcgtatatttcttccctcccta

SEQ ID NO: 180030 - DNA, 36 bp, Artificial Sequence
  Synthetic oligonucleotide
ttcgcccctcactgtgccgttttagctcccttccta

SEQ ID NO: 180031 - DNA, 35 bp, Artificial Sequence
  Synthetic oligonucleotide
gctgagggaggattgacagggagaagggtgagcta

SEQ ID NO: 180032 - DNA, 36 bp, Artificial Sequence
  Synthetic oligonucleotide
aacccctctcgaccaatcgctgctaattgcactcta

SEQ ID NO: 180033 - DNA, 35 bp, Artificial Sequence
  Synthetic oligonucleotide
agctcgcttagtatctgcatcatccctgcttcaac

SEQ ID NO: 180034 - DNA, 36 bp, Artificial Sequence
  Synthetic oligonucleotide
ggatcccgctgtaccttctccgcgccaccagggaac

SEQ ID NO: 180035 - DNA, 35 bp, Artificial Sequence
  Synthetic oligonucleotide
tacacgtgaaacgtgtacaaaccctctaactgaac

SEQ ID NO: 180036 - DNA, 35 bp, Artificial Sequence
  Synthetic oligonucleotide
gttacaccttggagtgcaccttgaccttgtctaac

SEQ ID NO: 180037 - DNA, 35 bp, Artificial Sequence
  Synthetic oligonucleotide
ggtcgtgtcccctgtcccctcccctaggccgtaac

SEQ ID NO: 180038 - DNA, 35 bp, Artificial Sequence
  Synthetic oligonucleotide
tgcgacctcacagctccacttccggcaattcacac

SEQ ID NO: 180039 - DNA, 35 bp, Artificial Sequence
  Synthetic oligonucleotide
taagccccccctgctggacaaaatcaagcctacac

SEQ ID NO: 180040 - DNA, 35 bp, Artificial Sequence
  Synthetic oligonucleotide
aacgcctgcaccacctgttactcgtccccgtacac

SEQ ID NO: 180041 - DNA, 35 bp, Artificial Sequence
  Synthetic oligonucleotide
tcccatgcgaaatgtcctactcgccgcccctgcac

SEQ ID NO: 180042 - DNA, 35 bp, Artificial Sequence
  Synthetic oligonucleotide
aagcgatgcacgcgccattgccccttcttcatgac

SEQ ID NO: 180043 - DNA, 35 bp, Artificial Sequence
  Synthetic oligonucleotide
tcaagcccgcactgaatcggtttccccaacactac

SEQ ID NO: 180044 - DNA, 35 bp, Artificial Sequence
  Synthetic oligonucleotide
aatccgcactcgctacagttcacatcccgacctac

SEQ ID NO: 180045 - DNA, 35 bp, Artificial Sequence
  Synthetic oligonucleotide
tgccgtgcctcgcgtccctaattgcttgccgctac

SEQ ID NO: 180046 - DNA, 35 bp, Artificial Sequence
  Synthetic oligonucleotide
taggacattgcgccaccacgctcattacctgctac

SEQ ID NO: 180047 - DNA, 35 bp, Artificial Sequence
  Synthetic oligonucleotide
gccccttccaccggtctgtaacgctgttcccttac

SEQ ID NO: 180048 - DNA, 35 bp, Artificial Sequence
  Synthetic oligonucleotide
gtatttccctgccctatccgtccggtcttgtttac

SEQ ID NO: 180049 - DNA, 35 bp, Artificial Sequence
  Synthetic oligonucleotide
gaaacccgccgtagctggtggacgctcccctaacc

SEQ ID NO: 180050 - DNA, 35 bp, Artificial Sequence
  Synthetic oligonucleotide
gccaccgcctttgccattcttcgtgtctcttcacc

SEQ ID NO: 180051 - DNA, 36 bp, Artificial Sequence
  Synthetic oligonucleotide
tgatgctcaggtcgccatgcccggttgccccccccc

SEQ ID NO: 180052 - DNA, 34 bp, Artificial Sequence
  Synthetic oligonucleotide
gacccacagccgcctgcccttcgacgtacgcccc

SEQ ID NO: 180053 - DNA, 35 bp, Artificial Sequence
  Synthetic oligonucleotide
gggagccctgtcctgtcacagccgccgcttcgccc

SEQ ID NO: 180054 - DNA, 35 bp, Artificial Sequence
  Synthetic oligonucleotide
ggtacctttcagccgactacctgtcctgccctccc

SEQ ID NO: 180055 - DNA, 35 bp, Artificial Sequence
  Synthetic oligonucleotide
tcccgctctccatgtccggtgaccggctatttccc

SEQ ID NO: 180056 - DNA, 35 bp, Artificial Sequence
  Synthetic oligonucleotide
gcaggcccatcccatcgaatagtttccctctagcc

SEQ ID NO: 180057 - DNA, 35 bp, Artificial Sequence
  Synthetic oligonucleotide
gccgggctccctctctattcacttaagcgaccgcc

SEQ ID NO: 180058 - DNA, 35 bp, Artificial Sequence
  Synthetic oligonucleotide
gaacttcgcgccgccatattcttccccgacccgcc

SEQ ID NO: 180059 - DNA, 35 bp, Artificial Sequence
  Synthetic oligonucleotide
gcctcttgcgccacacgcattactaagccgccgcc

SEQ ID NO: 180060 - DNA, 35 bp, Artificial Sequence
  Synthetic oligonucleotide
tgttgtctgcatcccatgacgttcgcccatccgcc

SEQ ID NO: 180061 - DNA, 35 bp, Artificial Sequence
  Synthetic oligonucleotide
gctgttggcacatttcttcctctgcaccttgcgcc

SEQ ID NO: 180062 - DNA, 35 bp, Artificial Sequence
  Synthetic oligonucleotide
tggaccacctactgacgggttcaccctccctcgcc

SEQ ID NO: 180063 - DNA, 35 bp, Artificial Sequence
  Synthetic oligonucleotide
agccgtgctgctccatcccccgtcctatgtcggcc

SEQ ID NO: 180064 - DNA, 35 bp, Artificial Sequence
  Synthetic oligonucleotide
catcttcaccaccgccctgtccgtgctctttggcc

SEQ ID NO: 180065 - DNA, 35 bp, Artificial Sequence
  Synthetic oligonucleotide
gccatcccagtgctgcaccatctctcgcatatgcc

SEQ ID NO: 180066 - DNA, 35 bp, Artificial Sequence
  Synthetic oligonucleotide
gtcgctccccagccgtcacgtgacatcgttttgcc

SEQ ID NO: 180067 - DNA, 35 bp, Artificial Sequence
  Synthetic oligonucleotide
accgtccactcgcctgttttgacctacgcttatcc

SEQ ID NO: 180068 - DNA, 35 bp, Artificial Sequence
  Synthetic oligonucleotide
taatactctgcacttgccccccgcctgacggctcc

SEQ ID NO: 180069 - DNA, 35 bp, Artificial Sequence
  Synthetic oligonucleotide
tgttgccgcccccgcgactgtatcagcctctctcc

SEQ ID NO: 180070 - DNA, 35 bp, Artificial Sequence
  Synthetic oligonucleotide
acacacccaagccacgagtcttcccgaacccgtcc

SEQ ID NO: 180071 - DNA, 35 bp, Artificial Sequence
  Synthetic oligonucleotide
accagcctcactggtcgtcccttttccgtgggtcc

SEQ ID NO: 180072 - DNA, 35 bp, Artificial Sequence
  Synthetic oligonucleotide
gtacattcctccttgcgtagacgctaccgtggtcc

SEQ ID NO: 180073 - DNA, 35 bp, Artificial Sequence
  Synthetic oligonucleotide
acccgacatgttctgcactttattgttatctgtcc

SEQ ID NO: 180074 - DNA, 32 bp, Artificial Sequence
  Synthetic oligonucleotide
tttccttccggccgatactggcgcccccttcc

SEQ ID NO: 180075 - DNA, 35 bp, Artificial Sequence
  Synthetic oligonucleotide
tccgctcccccctgtcgctatgcaccgtacgttcc

SEQ ID NO: 180076 - DNA, 35 bp, Artificial Sequence
  Synthetic oligonucleotide
actgggccgctatgcgtgaccatcctactcgttcc

SEQ ID NO: 180077 - DNA, 35 bp, Artificial Sequence
  Synthetic oligonucleotide
acccacaccatactcctgctcaccccgtaccgagc

SEQ ID NO: 180078 - DNA, 35 bp, Artificial Sequence
  Synthetic oligonucleotide
gccatctacgtctagctcgcccaccctttgtccgc

SEQ ID NO: 180079 - DNA, 35 bp, Artificial Sequence
  Synthetic oligonucleotide
tcagatcggctcttcgtttctccactcctttaggc

SEQ ID NO: 180080 - DNA, 35 bp, Artificial Sequence
  Synthetic oligonucleotide
accatccccctctgcgttctggaccgatcttgggc

SEQ ID NO: 180081 - DNA, 35 bp, Artificial Sequence
  Synthetic oligonucleotide
gtgttcttcgcctgactaactcctccatgccctgc

SEQ ID NO: 180082 - DNA, 35 bp, Artificial Sequence
  Synthetic oligonucleotide
ggtactgccattgtcaagcccccgcttccgccatc

SEQ ID NO: 180083 - DNA, 35 bp, Artificial Sequence
  Synthetic oligonucleotide
atgtcggtccgccccccgtttaccctcaccatatc

SEQ ID NO: 180084 - DNA, 35 bp, Artificial Sequence
  Synthetic oligonucleotide
tgcctacagccccgcgaggcgatcgcgactccctc

SEQ ID NO: 180085 - DNA, 35 bp, Artificial Sequence
  Synthetic oligonucleotide
gagcaccgtatctccccgtctgtttgtacctcctc

SEQ ID NO: 180086 - DNA, 35 bp, Artificial Sequence
  Synthetic oligonucleotide
aagcacattatgccgtgttcttgtaatccctcctc

SEQ ID NO: 180087 - DNA, 35 bp, Artificial Sequence
  Synthetic oligonucleotide
atgtcactgccatcctctgtttttccctgtcgctc

SEQ ID NO: 180088 - DNA, 35 bp, Artificial Sequence
  Synthetic oligonucleotide
gcgatcacctccctgtcatttccctggtccttctc

SEQ ID NO: 180089 - DNA, 35 bp, Artificial Sequence
  Synthetic oligonucleotide
ccactgccccctatagttgtcgagctcctgcagtc

SEQ ID NO: 180090 - DNA, 35 bp, Artificial Sequence
  Synthetic oligonucleotide
accagtgccttctccagtcagtgccttgcccggtc

SEQ ID NO: 180091 - DNA, 35 bp, Artificial Sequence
  Synthetic oligonucleotide
atgggatgcgctctgcactttgtcctgtccttgtc

SEQ ID NO: 180092 - DNA, 35 bp, Artificial Sequence
  Synthetic oligonucleotide
tacatcatggatgtagtagcgcgcactctcttgtc

SEQ ID NO: 180093 - DNA, 35 bp, Artificial Sequence
  Synthetic oligonucleotide
gccaagtcgctgaggtccgtgcacccgcccacttc

SEQ ID NO: 180094 - DNA, 35 bp, Artificial Sequence
  Synthetic oligonucleotide
gccgccgtaattccactctgcgcgtatatcccttc

SEQ ID NO: 180095 - DNA, 35 bp, Artificial Sequence
  Synthetic oligonucleotide
accatctcaccgttcgcgcgtctctaggacgcttc

SEQ ID NO: 180096 - DNA, 35 bp, Artificial Sequence
  Synthetic oligonucleotide
tcctgccccgagtttgtcctgtctcctgcgttttc

SEQ ID NO: 180097 - DNA, 35 bp, Artificial Sequence
  Synthetic oligonucleotide
gagaacgcgtgtcagcggggcggggatcggggaag

SEQ ID NO: 180098 - DNA, 35 bp, Artificial Sequence
  Synthetic oligonucleotide
tgaaggtggggagttggacggtaagtcgggggaag

SEQ ID NO: 180099 - DNA, 35 bp, Artificial Sequence
  Synthetic oligonucleotide
tagactgacgctcccgtcctatcacaactcttacg

SEQ ID NO: 180100 - DNA, 35 bp, Artificial Sequence
  Synthetic oligonucleotide
tcttgcccgtacctacctttcgaaacttgcccccg

SEQ ID NO: 180101 - DNA, 35 bp, Artificial Sequence
  Synthetic oligonucleotide
acgtgcaacttaccaccccctgctagtccgctccg

SEQ ID NO: 180102 - DNA, 35 bp, Artificial Sequence
  Synthetic oligonucleotide
tgttgcacagccttcaacatccaattcccctcgcg

SEQ ID NO: 180103 - DNA, 36 bp, Artificial Sequence
  Synthetic oligonucleotide
tggtacgtcgcagtactcgaccctgctcattcttcg

SEQ ID NO: 180104 - DNA, 35 bp, Artificial Sequence
  Synthetic oligonucleotide
gtgccccactcgctttccgcccaaccaatgttatg

SEQ ID NO: 180105 - DNA, 35 bp, Artificial Sequence
  Synthetic oligonucleotide
tgctgacttcctaccccgttatatccagttgcctg

SEQ ID NO: 180106 - DNA, 35 bp, Artificial Sequence
  Synthetic oligonucleotide
acacagagtacactcgttagtttttccgcttcctg

SEQ ID NO: 180107 - DNA, 35 bp, Artificial Sequence
  Synthetic oligonucleotide
gacctgacctcattcctgccttgagaactatattg

SEQ ID NO: 180108 - DNA, 35 bp, Artificial Sequence
  Synthetic oligonucleotide
tgccgacgtttctgccaacttcatcctccgtattg

SEQ ID NO: 180109 - DNA, 35 bp, Artificial Sequence
  Synthetic oligonucleotide
ttgaagccgtaaggagcacgcccgcccaccaccat

SEQ ID NO: 180110 - DNA, 35 bp, Artificial Sequence
  Synthetic oligonucleotide
agctccccctcactgcaagtatctacgtatcccat

SEQ ID NO: 180111 - DNA, 35 bp, Artificial Sequence
  Synthetic oligonucleotide
gacaccctcccactgtacgaaaacgctgtctcact

SEQ ID NO: 180112 - DNA, 35 bp, Artificial Sequence
  Synthetic oligonucleotide
gatgtttccgccattggctcactttactgctccct

SEQ ID NO: 180113 - DNA, 35 bp, Artificial Sequence
  Synthetic oligonucleotide
gcgaaccgtccgggattcacactcgctcttcgcct

SEQ ID NO: 180114 - DNA, 35 bp, Artificial Sequence
  Synthetic oligonucleotide
gtatcgccgccatcctcagtgccctttcactagct

SEQ ID NO: 180115 - DNA, 35 bp, Artificial Sequence
  Synthetic oligonucleotide
actgcctctccgtgggtcctccgttgcacgcatct

SEQ ID NO: 180116 - DNA, 35 bp, Artificial Sequence
  Synthetic oligonucleotide
tcaaccgcgcgggcacctactgattcccttcatct

SEQ ID NO: 180117 - DNA, 35 bp, Artificial Sequence
  Synthetic oligonucleotide
tgtccacttgtctactacctcccaatcgccactgt

SEQ ID NO: 180118 - DNA, 36 bp, Artificial Sequence
  Synthetic oligonucleotide
gcccgctcccctcgtattatcatagtccactcctgt

SEQ ID NO: 180119 - DNA, 36 bp, Artificial Sequence
  Synthetic oligonucleotide
ttgtgattgcgccctcccctgcgtatcgtctcctgt

SEQ ID NO: 180120 - DNA, 35 bp, Artificial Sequence
  Synthetic oligonucleotide
accgcctccctgaacttatcgtatgcataagcatt

SEQ ID NO: 180121 - DNA, 35 bp, Artificial Sequence
  Synthetic oligonucleotide
tgctacgccttctcttccaccgccggcggagactt

SEQ ID NO: 180122 - DNA, 35 bp, Artificial Sequence
  Synthetic oligonucleotide
acatcgcctgtgcgcttttatcggcccacttactt

SEQ ID NO: 180123 - DNA, 35 bp, Artificial Sequence
  Synthetic oligonucleotide
tgcagaccacgcaacctcttgcctgcctgtccctt

SEQ ID NO: 180124 - DNA, 35 bp, Artificial Sequence
  Synthetic oligonucleotide
actagagcttgcctgcacgtccgcccccccgcctt

SEQ ID NO: 180125 - DNA, 35 bp, Artificial Sequence
  Synthetic oligonucleotide
gccctccccgcaccccagcgatgttcgggatcctt

SEQ ID NO: 180126 - DNA, 35 bp, Artificial Sequence
  Synthetic oligonucleotide
tcatagccagcgactatttcttgcgcctggtcctt

SEQ ID NO: 180127 - DNA, 35 bp, Artificial Sequence
  Synthetic oligonucleotide
gacctagccacaattcatcttgttcgaccacgctt

SEQ ID NO: 180128 - DNA, 35 bp, Artificial Sequence
  Synthetic oligonucleotide
accaccttccgcgttcagggtcacgtcgcattctt

SEQ ID NO: 180129 - DNA, 35 bp, Artificial Sequence
  Synthetic oligonucleotide
agttagtcgcccttcgtcctcttgcctgcccgttt

SEQ ID NO: 180130 - DNA, 36 bp, Artificial Sequence
  Synthetic oligonucleotide
ttgtaccgccgacccctgttacgtcaatgaccaaaa

SEQ ID NO: 180131 - DNA, 36 bp, Artificial Sequence
  Synthetic oligonucleotide
agttgggaaaggggtggaatatgcaggaggcgacaa

SEQ ID NO: 180132 - DNA, 36 bp, Artificial Sequence
  Synthetic oligonucleotide
tgacgcggtccgccgctagcccgtatcccctgtcaa

SEQ ID NO: 180133 - DNA, 35 bp, Artificial Sequence
  Synthetic oligonucleotide
tgctacgacggggtcgccgggggggggagagggaa

SEQ ID NO: 180134 - DNA, 36 bp, Artificial Sequence
  Synthetic oligonucleotide
atcgagagatgaggcggaaagcaggctgaaggggaa

SEQ ID NO: 180135 - DNA, 36 bp, Artificial Sequence
  Synthetic oligonucleotide
tacaaccccagccccccgttgcctgcccacctataa

SEQ ID NO: 180136 - DNA, 36 bp, Artificial Sequence
  Synthetic oligonucleotide
ggatcgatcgagtctttgcaccccccgcccgcctaa

SEQ ID NO: 180137 - DNA, 36 bp, Artificial Sequence
  Synthetic oligonucleotide
atcgcgagcaggctgcgagggccctccactttacca

SEQ ID NO: 180138 - DNA, 35 bp, Artificial Sequence
  Synthetic oligonucleotide
atcgtcatcctctggtccatccttgtactcaccca

SEQ ID NO: 180139 - DNA, 36 bp, Artificial Sequence
  Synthetic oligonucleotide
gtgtatgtgcggcctaccgttgcccttcccgcccca

SEQ ID NO: 180140 - DNA, 35 bp, Artificial Sequence
  Synthetic oligonucleotide
agtcactccgcatatgttcatgccttccggtccca

SEQ ID NO: 180141 - DNA, 36 bp, Artificial Sequence
  Synthetic oligonucleotide
agaccctcaccacccggtatgttgttgttgttccca

SEQ ID NO: 180142 - DNA, 35 bp, Artificial Sequence
  Synthetic oligonucleotide
acccctctggcaatacggtctacagccaccatcca

SEQ ID NO: 180143 - DNA, 35 bp, Artificial Sequence
  Synthetic oligonucleotide
gccgcaactccctgtcgcagtctcatcaaactcca

SEQ ID NO: 180144 - DNA, 36 bp, Artificial Sequence
  Synthetic oligonucleotide
tctatccacgcttcgttgcttccgtatgcacctcca

SEQ ID NO: 180145 - DNA, 35 bp, Artificial Sequence
  Synthetic oligonucleotide
taactgggtccctttcgttgtcgccgttgcttcca

SEQ ID NO: 180146 - DNA, 36 bp, Artificial Sequence
  Synthetic oligonucleotide
tgccgtgtcacacactccccgctaactccgcccgca

SEQ ID NO: 180147 - DNA, 35 bp, Artificial Sequence
  Synthetic oligonucleotide
tccgctcctggcttggcaatacaatcctctccgca

SEQ ID NO: 180148 - DNA, 36 bp, Artificial Sequence
  Synthetic oligonucleotide
gcgatctgctcctcgttcttgtcctaggctgctgca

SEQ ID NO: 180149 - DNA, 35 bp, Artificial Sequence
  Synthetic oligonucleotide
tgggagacccagacatcgcccgcccctgtacatca

SEQ ID NO: 180150 - DNA, 35 bp, Artificial Sequence
  Synthetic oligonucleotide
gccgccatccctgtctacttttgacattagcctca

SEQ ID NO: 180151 - DNA, 36 bp, Artificial Sequence
  Synthetic oligonucleotide
gacgcctcaaaaagcttaccaccttgccctttgtca

SEQ ID NO: 180152 - DNA, 34 bp, Artificial Sequence
  Synthetic oligonucleotide
gccattcctctccactctagacctgtctttgtca

SEQ ID NO: 180153 - DNA, 36 bp, Artificial Sequence
  Synthetic oligonucleotide
tctgtctacacctggcgtgttcctgcctgtaattca

SEQ ID NO: 180154 - DNA, 36 bp, Artificial Sequence
  Synthetic oligonucleotide
gcccccccacaatcggtctaacggacttaccccaga

SEQ ID NO: 180155 - DNA, 37 bp, Artificial Sequence
  Synthetic oligonucleotide
gagcgccgctccacattttgctctccgcccctctaga

SEQ ID NO: 180156 - DNA, 37 bp, Artificial Sequence
  Synthetic oligonucleotide
gaagggaggtaggggaagggaagtttttcacagtaga

SEQ ID NO: 180157 - DNA, 37 bp, Artificial Sequence
  Synthetic oligonucleotide
ggaggaggggttggaggtggcttacggggggtcacga

SEQ ID NO: 180158 - DNA, 37 bp, Artificial Sequence
  Synthetic oligonucleotide
gccagcatggcgttgcctcccttcgccctctctacga

SEQ ID NO: 180159 - DNA, 37 bp, Artificial Sequence
  Synthetic oligonucleotide
gtccacgtttcaccttcttttgcgtcgttccgtacga

SEQ ID NO: 180160 - DNA, 37 bp, Artificial Sequence
  Synthetic oligonucleotide
gaccaggcccttatgcgtcgattttctgcttcaccga

SEQ ID NO: 180161 - DNA, 37 bp, Artificial Sequence
  Synthetic oligonucleotide
acgtgcgtccgcctgccatgcgcttactccttaccga

SEQ ID NO: 180162 - DNA, 37 bp, Artificial Sequence
  Synthetic oligonucleotide
gggaccgcgccccagcttgccccctacgaacccccga

SEQ ID NO: 180163 - DNA, 37 bp, Artificial Sequence
  Synthetic oligonucleotide
gactcctgcccatggcctatgatagcttttactccga

SEQ ID NO: 180164 - DNA, 37 bp, Artificial Sequence
  Synthetic oligonucleotide
taacagtcccagcgcctattggttcttgcccttccga

SEQ ID NO: 180165 - DNA, 37 bp, Artificial Sequence
  Synthetic oligonucleotide
gcgaggcgtgggggtgggagggcatcttgatgagcga

SEQ ID NO: 180166 - DNA, 31 bp, Artificial Sequence
  Synthetic oligonucleotide
acatccctgccccatttggttccgaacgcga

SEQ ID NO: 180167 - DNA, 37 bp, Artificial Sequence
  Synthetic oligonucleotide
tcgccatcatacacctgcgtttttcctgactccgcga

SEQ ID NO: 180168 - DNA, 37 bp, Artificial Sequence
  Synthetic oligonucleotide
gctggcgccgtcacggcattatttacctccgttgcga

SEQ ID NO: 180169 - DNA, 37 bp, Artificial Sequence
  Synthetic oligonucleotide
tttccgctcgcctcccttggtatgtaatttacctcga

SEQ ID NO: 180170 - DNA, 37 bp, Artificial Sequence
  Synthetic oligonucleotide
accgtcactccccgattggtaaatcaattgccctcga

SEQ ID NO: 180171 - DNA, 36 bp, Artificial Sequence
  Synthetic oligonucleotide
gagtccgcctccttactcctatgttccgcctgtcga

SEQ ID NO: 180172 - DNA, 37 bp, Artificial Sequence
  Synthetic oligonucleotide
atggtgctggagactgacggggagggaggagcaagga

SEQ ID NO: 180173 - DNA, 37 bp, Artificial Sequence
  Synthetic oligonucleotide
tttgcgggatgggagggctgggtgtgtggtcacagga

SEQ ID NO: 180174 - DNA, 37 bp, Artificial Sequence
  Synthetic oligonucleotide
tgtgcacacgaaagatgaaggggggatggtgggagga

SEQ ID NO: 180175 - DNA, 37 bp, Artificial Sequence
  Synthetic oligonucleotide
gatgcgggacagggagtgattaggggagggcgtagga

SEQ ID NO: 180176 - DNA, 37 bp, Artificial Sequence
  Synthetic oligonucleotide
gaggagtgaggtcggctcgtacggaagggcgggggga

SEQ ID NO: 180177 - DNA, 37 bp, Artificial Sequence
  Synthetic oligonucleotide
gctaggtagggggagaagaaaggaagttagacatgga

SEQ ID NO: 180178 - DNA, 36 bp, Artificial Sequence
  Synthetic oligonucleotide
tggggggaaactcaaggggcgtatggggggagtgga

SEQ ID NO: 180179 - DNA, 37 bp, Artificial Sequence
  Synthetic oligonucleotide
aagagccaggtaggaagaatgtggaggtgatggtgga

SEQ ID NO: 180180 - DNA, 37 bp, Artificial Sequence
  Synthetic oligonucleotide
actgggagggcgacatcagggtggggttattaactga

SEQ ID NO: 180181 - DNA, 36 bp, Artificial Sequence
  Synthetic oligonucleotide
accaactgcccggcctcggtaatgccccatcactga

SEQ ID NO: 180182 - DNA, 37 bp, Artificial Sequence
  Synthetic oligonucleotide
atggcgccacctgccgaactgcttatccttcccctga

SEQ ID NO: 180183 - DNA, 38 bp, Artificial Sequence
  Synthetic oligonucleotide
gtccaccccttccgcttaccagggcatcagagccctga

SEQ ID NO: 180184 - DNA, 37 bp, Artificial Sequence
  Synthetic oligonucleotide
tccgagccattttggttctgctttcacactctcctga

SEQ ID NO: 180185 - DNA, 38 bp, Artificial Sequence
  Synthetic oligonucleotide
tacgcgtcccgatctaccatcccccccctggttcctga

SEQ ID NO: 180186 - DNA, 38 bp, Artificial Sequence
  Synthetic oligonucleotide
gcaccacgctatctccggtttctcactcgccatgctga

SEQ ID NO: 180187 - DNA, 38 bp, Artificial Sequence
  Synthetic oligonucleotide
gcgtgcccgccttatccgtctatgtcccctggctctga

SEQ ID NO: 180188 - DNA, 37 bp, Artificial Sequence
  Synthetic oligonucleotide
tatcagcaggtcgccctttccctgattcgccttctga

SEQ ID NO: 180189 - DNA, 35 bp, Artificial Sequence
  Synthetic oligonucleotide
gccgggggggtgggcacagcaatggagggcggtga

SEQ ID NO: 180190 - DNA, 38 bp, Artificial Sequence
  Synthetic oligonucleotide
gcgcaaacggggaggggcgtggaggatttccggggtga

SEQ ID NO: 180191 - DNA, 38 bp, Artificial Sequence
  Synthetic oligonucleotide
acataagagaagaggaagagaggctaggtagtgggtga

SEQ ID NO: 180192 - DNA, 38 bp, Artificial Sequence
  Synthetic oligonucleotide
gtacgtacaggactggtagggaggaggggggtgggtga

SEQ ID NO: 180193 - DNA, 37 bp, Artificial Sequence
  Synthetic oligonucleotide
tactgcaccaccattgcgcgtcgattcagccctgtga

SEQ ID NO: 180194 - DNA, 38 bp, Artificial Sequence
  Synthetic oligonucleotide
gatccctccgcctggatctccttatacgactcacttga

SEQ ID NO: 180195 - DNA, 35 bp, Artificial Sequence
  Synthetic oligonucleotide
accgcacctccctttgcccagcgaacagcccttga

SEQ ID NO: 180196 - DNA, 38 bp, Artificial Sequence
  Synthetic oligonucleotide
agctccgtccccgtttgtttctcacgctactcccttga

SEQ ID NO: 180197 - DNA, 38 bp, Artificial Sequence
  Synthetic oligonucleotide
acggacaggatccatctgtttgcctcacaccctcttga

SEQ ID NO: 180198 - DNA, 38 bp, Artificial Sequence
  Synthetic oligonucleotide
tctctccgcagaccgactattcgcgcctgtacctttga

SEQ ID NO: 180199 - DNA, 28 bp, Artificial Sequence
  Synthetic oligonucleotide
ttgtcctaccgagttcctaccactcata

SEQ ID NO: 180200 - DNA, 35 bp, Artificial Sequence
  Synthetic oligonucleotide
ggtacaatgtcacgggcgggaagggtggggggata

SEQ ID NO: 180201 - DNA, 36 bp, Artificial Sequence
  Synthetic oligonucleotide
tccgtggggttgggtgggcagctgggggagaaccta

SEQ ID NO: 180202 - DNA, 34 bp, Artificial Sequence
  Synthetic oligonucleotide
gcctcctctcatgctaagccttacgggtctccta

SEQ ID NO: 180203 - DNA, 36 bp, Artificial Sequence
  Synthetic oligonucleotide
ttcagatcagagctatttccccacccgcgctcgcta

SEQ ID NO: 180204 - DNA, 36 bp, Artificial Sequence
  Synthetic oligonucleotide
gcttcacagcctcccgcgcgtctgcttcacactcta

SEQ ID NO: 180205 - DNA, 36 bp, Artificial Sequence
  Synthetic oligonucleotide
agacgcccttccggttcactcagcacctccgcggta

SEQ ID NO: 180206 - DNA, 36 bp, Artificial Sequence
  Synthetic oligonucleotide
tgcacttcgacgtcgttcgccctttccctgtttgta

SEQ ID NO: 180207 - DNA, 36 bp, Artificial Sequence
  Synthetic oligonucleotide
tagtggggagaatgagcacgggagggtaggaaatta

SEQ ID NO: 180208 - DNA, 36 bp, Artificial Sequence
  Synthetic oligonucleotide
tgacactcgcccgatccgctaccgactcctccctta

SEQ ID NO: 180209 - DNA, 36 bp, Artificial Sequence
  Synthetic oligonucleotide
acctacattccgccccacatggccgccacactttta

SEQ ID NO: 180210 - DNA, 35 bp, Artificial Sequence
  Synthetic oligonucleotide
taccaccccacactacgtttttcgtgcttctttta

SEQ ID NO: 180211 - DNA, 35 bp, Artificial Sequence
  Synthetic oligonucleotide
gcagattccgcagcattctacctgatccactccac

SEQ ID NO: 180212 - DNA, 35 bp, Artificial Sequence
  Synthetic oligonucleotide
ttacagccacgcctgtctctatactttattcgcac

SEQ ID NO: 180213 - DNA, 35 bp, Artificial Sequence
  Synthetic oligonucleotide
ttgctttgtctacccccgctcccgcaccgaccgac

SEQ ID NO: 180214 - DNA, 35 bp, Artificial Sequence
  Synthetic oligonucleotide
tagcccaccgcccctccccagttttggccattacc

SEQ ID NO: 180215 - DNA, 35 bp, Artificial Sequence
  Synthetic oligonucleotide
taaccgcccccgtttgcgcggtgccaattataccc

SEQ ID NO: 180216 - DNA, 35 bp, Artificial Sequence
  Synthetic oligonucleotide
gagtgtccattccatactagcgcgccccatgcccc

SEQ ID NO: 180217 - DNA, 35 bp, Artificial Sequence
  Synthetic oligonucleotide
gaatcaacatccgatggtcagccagcaccatcccc

SEQ ID NO: 180218 - DNA, 35 bp, Artificial Sequence
  Synthetic oligonucleotide
gccgaaaccaccgctcttaactattagtgtcgccc

SEQ ID NO: 180219 - DNA, 35 bp, Artificial Sequence
  Synthetic oligonucleotide
gccacactattgaattgattacttccccgcgggcc

SEQ ID NO: 180220 - DNA, 35 bp, Artificial Sequence
  Synthetic oligonucleotide
gtggcgtcgcacacatcgtcacaactactcttgcc

SEQ ID NO: 180221 - DNA, 35 bp, Artificial Sequence
  Synthetic oligonucleotide
gccgactccgccaactctgtagcactgtctcatcc

SEQ ID NO: 180222 - DNA, 35 bp, Artificial Sequence
  Synthetic oligonucleotide
tccctcccctgttgttgcctcacgctcggtcatcc

SEQ ID NO: 180223 - DNA, 35 bp, Artificial Sequence
  Synthetic oligonucleotide
gcaccgacaactgcccgccgccttgtaagccctcc

SEQ ID NO: 180224 - DNA, 35 bp, Artificial Sequence
  Synthetic oligonucleotide
tcgccgatgcgcgatcctttgcttatccttcctcc

SEQ ID NO: 180225 - DNA, 35 bp, Artificial Sequence
  Synthetic oligonucleotide
gccgccccgtccggtccttttccatcagtcgctcc

SEQ ID NO: 180226 - DNA, 35 bp, Artificial Sequence
  Synthetic oligonucleotide
gcacggtcctgcccacaagcctcactataccttcc

SEQ ID NO: 180227 - DNA, 35 bp, Artificial Sequence
  Synthetic oligonucleotide
tgcgctttagatcgttcctttcctgtcctcgttcc

SEQ ID NO: 180228 - DNA, 35 bp, Artificial Sequence
  Synthetic oligonucleotide
tcgcagccacgatccttgtactaccttgtctttcc

SEQ ID NO: 180229 - DNA, 35 bp, Artificial Sequence
  Synthetic oligonucleotide
gtcgcccccgctgcgagcacctccactttgtttcc

SEQ ID NO: 180230 - DNA, 35 bp, Artificial Sequence
  Synthetic oligonucleotide
gcacctattcgttcctcgtccgtacggtctcccgc

SEQ ID NO: 180231 - DNA, 35 bp, Artificial Sequence
  Synthetic oligonucleotide
tccactccgcgtggttcaattgcgactcccgccgc

SEQ ID NO: 180232 - DNA, 35 bp, Artificial Sequence
  Synthetic oligonucleotide
tactgggcgatgccacccgcgttccatctatccgc

SEQ ID NO: 180233 - DNA, 35 bp, Artificial Sequence
  Synthetic oligonucleotide
ttggcgtagtagttagccctcgtccgtgcctccgc

SEQ ID NO: 180234 - DNA, 35 bp, Artificial Sequence
  Synthetic oligonucleotide
gtgctgaccctgattccttatccaccatattccgc

SEQ ID NO: 180235 - DNA, 35 bp, Artificial Sequence
  Synthetic oligonucleotide
actacccttgccctgctatgactgaattacttcgc

SEQ ID NO: 180236 - DNA, 35 bp, Artificial Sequence
  Synthetic oligonucleotide
gaccccctcccgccgtgttccatacgctttttcgc

SEQ ID NO: 180237 - DNA, 35 bp, Artificial Sequence
  Synthetic oligonucleotide
gtagcccctcgccacccacttgttctaagcacggc

SEQ ID NO: 180238 - DNA, 35 bp, Artificial Sequence
  Synthetic oligonucleotide
aatagcgcgccccctcaagttacccgtcttactgc

SEQ ID NO: 180239 - DNA, 35 bp, Artificial Sequence
  Synthetic oligonucleotide
tctgtccgctcctacacccaccactgacactttgc

SEQ ID NO: 180240 - DNA, 35 bp, Artificial Sequence
  Synthetic oligonucleotide
gtaaccacgatcttatcgagcccatttctcctatc

SEQ ID NO: 180241 - DNA, 35 bp, Artificial Sequence
  Synthetic oligonucleotide
gtccgggaccgcccttgattactccgtcgcacctc

SEQ ID NO: 180242 - DNA, 35 bp, Artificial Sequence
  Synthetic oligonucleotide
acccatcccccgaacgtgacatatgcccactcctc

SEQ ID NO: 180243 - DNA, 35 bp, Artificial Sequence
  Synthetic oligonucleotide
tcattccccgtcagttcaccttggtgctccgtctc

SEQ ID NO: 180244 - DNA, 35 bp, Artificial Sequence
  Synthetic oligonucleotide
ggagacgtcaccccggccacgcactccataccgtc

SEQ ID NO: 180245 - DNA, 35 bp, Artificial Sequence
  Synthetic oligonucleotide
gagaccgcgttccatcaccgtttgcgctcgctgtc

SEQ ID NO: 180246 - DNA, 35 bp, Artificial Sequence
  Synthetic oligonucleotide
tggacgtcgtcatagtccatcctgcatttgccttc

SEQ ID NO: 180247 - DNA, 35 bp, Artificial Sequence
  Synthetic oligonucleotide
tctacatgcccttattgatgccttgctcgtccttc

SEQ ID NO: 180248 - DNA, 35 bp, Artificial Sequence
  Synthetic oligonucleotide
gcgatccttgccgatgtatcatcccggcgcctttc

SEQ ID NO: 180249 - DNA, 34 bp, Artificial Sequence
  Synthetic oligonucleotide
ttgcccggcccactgccgctattgaatcgctttc

SEQ ID NO: 180250 - DNA, 35 bp, Artificial Sequence
  Synthetic oligonucleotide
ttcccgtgcctctcctgccgctaccgagcgttttc

SEQ ID NO: 180251 - DNA, 35 bp, Artificial Sequence
  Synthetic oligonucleotide
tctagtgggggcggagtgggaggcgggtattggag

SEQ ID NO: 180252 - DNA, 35 bp, Artificial Sequence
  Synthetic oligonucleotide
taccagcgcttgaccctttccgtccctcttctgag

SEQ ID NO: 180253 - DNA, 35 bp, Artificial Sequence
  Synthetic oligonucleotide
agggcgccctcactcatcccttgtcgagctacacg

SEQ ID NO: 180254 - DNA, 35 bp, Artificial Sequence
  Synthetic oligonucleotide
gcctcgtccgccgcccctctaactacggtacaccg

SEQ ID NO: 180255 - DNA, 32 bp, Artificial Sequence
  Synthetic oligonucleotide
actctacatggcaaatctgcttatcgcccccg

SEQ ID NO: 180256 - DNA, 35 bp, Artificial Sequence
  Synthetic oligonucleotide
agccccaccatcgtcatccttgtccttccagcccg

SEQ ID NO: 180257 - DNA, 36 bp, Artificial Sequence
  Synthetic oligonucleotide
taggtaagagggggggaggggtgagcaacatgcgcg

SEQ ID NO: 180258 - DNA, 35 bp, Artificial Sequence
  Synthetic oligonucleotide
gacccgtatgctgagctgttcgtacccctcctgcg

SEQ ID NO: 180259 - DNA, 35 bp, Artificial Sequence
  Synthetic oligonucleotide
aagtccaggcccctttccgcgcgttttaaccctcg

SEQ ID NO: 180260 - DNA, 34 bp, Artificial Sequence
  Synthetic oligonucleotide
gaccctcaccatatgttcccgtgccgactccagg

SEQ ID NO: 180261 - DNA, 35 bp, Artificial Sequence
  Synthetic oligonucleotide
gcatatgcgcgttttcgcacctccctgacttctgg

SEQ ID NO: 180262 - DNA, 35 bp, Artificial Sequence
  Synthetic oligonucleotide
tttggcttgaagcaggactaggggagggggaaatg

SEQ ID NO: 180263 - DNA, 35 bp, Artificial Sequence
  Synthetic oligonucleotide
ttagcccgcatcgtgtactcctccccgtttcactg

SEQ ID NO: 180264 - DNA, 35 bp, Artificial Sequence
  Synthetic oligonucleotide
tcctccccgcacactgtccgttaatgcgtttcaat

SEQ ID NO: 180265 - DNA, 35 bp, Artificial Sequence
  Synthetic oligonucleotide
gtcatcggcgtatgattatcgccgccactttacat

SEQ ID NO: 180266 - DNA, 35 bp, Artificial Sequence
  Synthetic oligonucleotide
gaacctggcgtactacatgcacctcctgtcctcct

SEQ ID NO: 180267 - DNA, 35 bp, Artificial Sequence
  Synthetic oligonucleotide
gttgtcctacgctcctctcatcaggtcctcctgct

SEQ ID NO: 180268 - DNA, 35 bp, Artificial Sequence
  Synthetic oligonucleotide
tccaggcgcacgaggccttgctgcattcctcctgt

SEQ ID NO: 180269 - DNA, 35 bp, Artificial Sequence
  Synthetic oligonucleotide
accagccagccctcccttgtacccccgcccgttgt

SEQ ID NO: 180270 - DNA, 35 bp, Artificial Sequence
  Synthetic oligonucleotide
tcacaacccgttgacctgttttggctctttcaatt

SEQ ID NO: 180271 - DNA, 35 bp, Artificial Sequence
  Synthetic oligonucleotide
agccctcaccaatctcgtacggcctggaatctctt

SEQ ID NO: 180272 - DNA, 35 bp, Artificial Sequence
  Synthetic oligonucleotide
tgtcctcccagccattgttcctccatccgtgtctt

SEQ ID NO: 180273 - DNA, 35 bp, Artificial Sequence
  Synthetic oligonucleotide
acacccaccgcctggcccgtgccctggaccttgtt

SEQ ID NO: 180274 - DNA, 35 bp, Artificial Sequence
  Synthetic oligonucleotide
gcgcccccctctggagcctttactgccggttgttt

SEQ ID NO: 180275 - DNA, 35 bp, Artificial Sequence
  Synthetic oligonucleotide
acgcggtaccgcatggttacatcagcccctctttt

SEQ ID NO: 180276 - DNA, 36 bp, Artificial Sequence
  Synthetic oligonucleotide
taatggacgagagtggaggtagggggtgggacaaaa

SEQ ID NO: 180277 - DNA, 36 bp, Artificial Sequence
  Synthetic oligonucleotide
ggtcggctggtggtgcggacgggtgcggggggaaaa

SEQ ID NO: 180278 - DNA, 36 bp, Artificial Sequence
  Synthetic oligonucleotide
gaaaccgagacagggagaaattgagaggtgtagcaa

SEQ ID NO: 180279 - DNA, 36 bp, Artificial Sequence
  Synthetic oligonucleotide
gtggctggtgggggagggtagcaggtgcagggagaa

SEQ ID NO: 180280 - DNA, 36 bp, Artificial Sequence
  Synthetic oligonucleotide
tccgggggggctggagtgggctattgaaaaccggaa

SEQ ID NO: 180281 - DNA, 36 bp, Artificial Sequence
  Synthetic oligonucleotide
tacgtgccgggggggggtaaaatgctggggagggaa

SEQ ID NO: 180282 - DNA, 35 bp, Artificial Sequence
  Synthetic oligonucleotide
atactcgggggacgggtggggaaagggttatggaa

SEQ ID NO: 180283 - DNA, 36 bp, Artificial Sequence
  Synthetic oligonucleotide
actggactccactcacactgatttcgcctgtaaaca

SEQ ID NO: 180284 - DNA, 32 bp, Artificial Sequence
  Synthetic oligonucleotide
gatcaacgcctctacgcttaacacctcaacca

SEQ ID NO: 180285 - DNA, 35 bp, Artificial Sequence
  Synthetic oligonucleotide
ataccgccacactagttataccctgtggcttacca

SEQ ID NO: 180286 - DNA, 35 bp, Artificial Sequence
  Synthetic oligonucleotide
gttcatacgcgcagaaccgtttcccaccgtgccca

SEQ ID NO: 180287 - DNA, 35 bp, Artificial Sequence
  Synthetic oligonucleotide
tcaatggggagggtgtgttcacgggtggggcgcca

SEQ ID NO: 180288 - DNA, 36 bp, Artificial Sequence
  Synthetic oligonucleotide
gtgcgctcttgccggttttctcaggcgttccttcca

SEQ ID NO: 180289 - DNA, 36 bp, Artificial Sequence
  Synthetic oligonucleotide
gtacccccgcacctcttctcatcgtgtccgcaatca

SEQ ID NO: 180290 - DNA, 33 bp, Artificial Sequence
  Synthetic oligonucleotide
tatgacaccgctggttcggttaactttctatca

SEQ ID NO: 180291 - DNA, 36 bp, Artificial Sequence
  Synthetic oligonucleotide
tgcctcccttcgcgatatctccttgcctgatgctca

SEQ ID NO: 180292 - DNA, 36 bp, Artificial Sequence
  Synthetic oligonucleotide
gcgcccccccgctgagctagggctaattatctctca

SEQ ID NO: 180293 - DNA, 36 bp, Artificial Sequence
  Synthetic oligonucleotide
tcagcgcttcgtccgtcggcccttccttatgattca

SEQ ID NO: 180294 - DNA, 35 bp, Artificial Sequence
  Synthetic oligonucleotide
aaccatcccgcccaattgctcctaaatagtcttca

SEQ ID NO: 180295 - DNA, 36 bp, Artificial Sequence
  Synthetic oligonucleotide
tgctgatcaatggtacttcgtacgcccccctgttca

SEQ ID NO: 180296 - DNA, 37 bp, Artificial Sequence
  Synthetic oligonucleotide
tgtaacccctgttttgtgctcccccgcccctggaaga

SEQ ID NO: 180297 - DNA, 35 bp, Artificial Sequence
  Synthetic oligonucleotide
atgcgaggggggaacacgggtaggtcacgtagaga

SEQ ID NO: 180298 - DNA, 36 bp, Artificial Sequence
  Synthetic oligonucleotide
gaacggtcccgcgtatatggggggagggaggggaga

SEQ ID NO: 180299 - DNA, 35 bp, Artificial Sequence
  Synthetic oligonucleotide
tagctcgcctgcccttacttctgacacccatgaga

SEQ ID NO: 180300 - DNA, 37 bp, Artificial Sequence
  Synthetic oligonucleotide
actcctacgtgcgtgtgcctcttctcctgccattaga

SEQ ID NO: 180301 - DNA, 37 bp, Artificial Sequence
  Synthetic oligonucleotide
tggactatccccacctgtgttcctattgcacccacga

SEQ ID NO: 180302 - DNA, 35 bp, Artificial Sequence
  Synthetic oligonucleotide
agatccgctcgccctgcttttcagttcacctacga

SEQ ID NO: 180303 - DNA, 37 bp, Artificial Sequence
  Synthetic oligonucleotide
ttctgtgcccagccgtgtctacgccgcctctcgccga

SEQ ID NO: 180304 - DNA, 37 bp, Artificial Sequence
  Synthetic oligonucleotide
atgccacgcccacctgatactcctccgctttggccga

SEQ ID NO: 180305 - DNA, 36 bp, Artificial Sequence
  Synthetic oligonucleotide
tccgcactacactccgcccgagcattgctcctccga

SEQ ID NO: 180306 - DNA, 37 bp, Artificial Sequence
  Synthetic oligonucleotide
agcaccgcgcgcgccatcccaccttcttattccgcga

SEQ ID NO: 180307 - DNA, 37 bp, Artificial Sequence
  Synthetic oligonucleotide
aatgtgtgggggggtggggtatagcggggatgcgcga

SEQ ID NO: 180308 - DNA, 37 bp, Artificial Sequence
  Synthetic oligonucleotide
gatggattagggggaggaagagcaggcgtgtgtagga

SEQ ID NO: 180309 - DNA, 35 bp, Artificial Sequence
  Synthetic oligonucleotide
tcccaccacgctctcgcttgtccaaacgccccgga

SEQ ID NO: 180310 - DNA, 37 bp, Artificial Sequence
  Synthetic oligonucleotide
gctcggcctttgtaccaccctgcccttccggatcgga

SEQ ID NO: 180311 - DNA, 38 bp, Artificial Sequence
  Synthetic oligonucleotide
tgccaggggcaaagcaaatatcgggggtgagggaggga

SEQ ID NO: 180312 - DNA, 36 bp, Artificial Sequence
  Synthetic oligonucleotide
gggaacgagattgggtgggacctcgcaacatcggga

SEQ ID NO: 180313 - DNA, 36 bp, Artificial Sequence
  Synthetic oligonucleotide
gagtagccgagggggggggcgacatagaatatggga

SEQ ID NO: 180314 - DNA, 38 bp, Artificial Sequence
  Synthetic oligonucleotide
gcgagagcacgtcgggaggtcggggggggggacgtgga

SEQ ID NO: 180315 - DNA, 37 bp, Artificial Sequence
  Synthetic oligonucleotide
gaggtgggtggctagtggcatgggggggctttgtgga

SEQ ID NO: 180316 - DNA, 37 bp, Artificial Sequence
  Synthetic oligonucleotide
gtaggaggggacagggggatggtggtagctaaaatga

SEQ ID NO: 180317 - DNA, 37 bp, Artificial Sequence
  Synthetic oligonucleotide
acccacccagacgctccatggagccactccactatga

SEQ ID NO: 180318 - DNA, 38 bp, Artificial Sequence
  Synthetic oligonucleotide
tgtcgcctccgcttgtttcctcgccgccacattactga

SEQ ID NO: 180319 - DNA, 38 bp, Artificial Sequence
  Synthetic oligonucleotide
gacccgcacgaatccttgatccgctgttttccacctga

SEQ ID NO: 180320 - DNA, 38 bp, Artificial Sequence
  Synthetic oligonucleotide
ggtccctcggccaatgcgcgcactccgccacaccctga

SEQ ID NO: 180321 - DNA, 38 bp, Artificial Sequence
  Synthetic oligonucleotide
gttgctccctgtttgtttatgtgccctagcgcccctga

SEQ ID NO: 180322 - DNA, 38 bp, Artificial Sequence
  Synthetic oligonucleotide
gttgcccatggcgtaaatcctgttcttctgctccctga

SEQ ID NO: 180323 - DNA, 38 bp, Artificial Sequence
  Synthetic oligonucleotide
gatatcgccccgcggattgcgtccattcttctccctga

SEQ ID NO: 180324 - DNA, 37 bp, Artificial Sequence
  Synthetic oligonucleotide
gcgtgccagcctgacaattcgtcgccacctctcctga

SEQ ID NO: 180325 - DNA, 37 bp, Artificial Sequence
  Synthetic oligonucleotide
gtcacaacgccgttttttagcacccgctttctcctga

SEQ ID NO: 180326 - DNA, 38 bp, Artificial Sequence
  Synthetic oligonucleotide
gccatccctgttcgttctgccatctaccgagtatctga

SEQ ID NO: 180327 - DNA, 38 bp, Artificial Sequence
  Synthetic oligonucleotide
tggggcgggtgggtttgggggctctgctcctttagtga

SEQ ID NO: 180328 - DNA, 38 bp, Artificial Sequence
  Synthetic oligonucleotide
gcgacacccggccctctctactcccgactcctccgtga

SEQ ID NO: 180329 - DNA, 38 bp, Artificial Sequence
  Synthetic oligonucleotide
gccgatccagcctcctctgccatcacaacattccgtga

SEQ ID NO: 180330 - DNA, 37 bp, Artificial Sequence
  Synthetic oligonucleotide
gcgagtgccaccccccgcttttaacacacattcgtga

SEQ ID NO: 180331 - DNA, 38 bp, Artificial Sequence
  Synthetic oligonucleotide
gtgccaatgccccaatgtttcatccaattcccctgtga

SEQ ID NO: 180332 - DNA, 38 bp, Artificial Sequence
  Synthetic oligonucleotide
acacaccatccctgccggtaaccatagtcttgaattga

SEQ ID NO: 180333 - DNA, 37 bp, Artificial Sequence
  Synthetic oligonucleotide
gtggtgagagaggaaagaggggggagtttacgattga

SEQ ID NO: 180334 - DNA, 38 bp, Artificial Sequence
  Synthetic oligonucleotide
gcgatcccttgcccattgttccaccgctgactacttga

SEQ ID NO: 180335 - DNA, 35 bp, Artificial Sequence
  Synthetic oligonucleotide
ttacctgccttgctccattatcactctgtccttga

SEQ ID NO: 180336 - DNA, 38 bp, Artificial Sequence
  Synthetic oligonucleotide
gccttaccgccctgtcctgcttaggacgagttccttga

SEQ ID NO: 180337 - DNA, 38 bp, Artificial Sequence
  Synthetic oligonucleotide
atcgcgggggggagcttaggggaggcacgggagcttga

SEQ ID NO: 180338 - DNA, 38 bp, Artificial Sequence
  Synthetic oligonucleotide
tcgattgcaccgtcctcgccgcctttcgtctgttttga

SEQ ID NO: 180339 - DNA, 36 bp, Artificial Sequence
  Synthetic oligonucleotide
gcaacacatagcatgctgatcatcgcctcccccata

SEQ ID NO: 180340 - DNA, 35 bp, Artificial Sequence
  Synthetic oligonucleotide
agtgcaccacctctgttgtctactatccgcctata

SEQ ID NO: 180341 - DNA, 35 bp, Artificial Sequence
  Synthetic oligonucleotide
tttcgacccgctcgactatatctgcccgttgccta

SEQ ID NO: 180342 - DNA, 36 bp, Artificial Sequence
  Synthetic oligonucleotide
ggatcgcctcgcctgtgcctttgcctgccgctccta

SEQ ID NO: 180343 - DNA, 35 bp, Artificial Sequence
  Synthetic oligonucleotide
ttagtcgcctcaaatctgctgttcttcctgtccta

SEQ ID NO: 180344 - DNA, 35 bp, Artificial Sequence
  Synthetic oligonucleotide
ttccgccgcaccaactacctcgccctgtcatgcta

SEQ ID NO: 180345 - DNA, 35 bp, Artificial Sequence
  Synthetic oligonucleotide
tggtggacatcgccgttctcgccccttgcttgcta

SEQ ID NO: 180346 - DNA, 36 bp, Artificial Sequence
  Synthetic oligonucleotide
acaaccgcctcactcatcccagcgacacccattcta

SEQ ID NO: 180347 - DNA, 36 bp, Artificial Sequence
  Synthetic oligonucleotide
tctagcccgtacttgcacgttctcgatccacttcta

SEQ ID NO: 180348 - DNA, 33 bp, Artificial Sequence
  Synthetic oligonucleotide
tccccagctccatgcttgttgtcccgcccagta

SEQ ID NO: 180349 - DNA, 35 bp, Artificial Sequence
  Synthetic oligonucleotide
gagcccgcccgcgcccccatccaccatgcatcgta

SEQ ID NO: 180350 - DNA, 35 bp, Artificial Sequence
  Synthetic oligonucleotide
agagggggaggaaataaagggtacgagtcacggta

SEQ ID NO: 180351 - DNA, 35 bp, Artificial Sequence
  Synthetic oligonucleotide
ggattcggcaaggaggggatagggcgggtacggta

SEQ ID NO: 180352 - DNA, 35 bp, Artificial Sequence
  Synthetic oligonucleotide
gccacgcgttccgagccctcgtctggcccttctta

SEQ ID NO: 180353 - DNA, 36 bp, Artificial Sequence
  Synthetic oligonucleotide
gttgcgcttccggccctctttaggtctgtaccttta

SEQ ID NO: 180354 - DNA, 36 bp, Artificial Sequence
  Synthetic oligonucleotide
gacacctgtcctggacctgcaccacccgcgtgttta

SEQ ID NO: 180355 - DNA, 35 bp, Artificial Sequence
  Synthetic oligonucleotide
gtactgtcaagatcgccgatccaccgccccgacac

SEQ ID NO: 180356 - DNA, 35 bp, Artificial Sequence
  Synthetic oligonucleotide
attgcgccttcactctactttgttcacgctcccac

SEQ ID NO: 180357 - DNA, 35 bp, Artificial Sequence
  Synthetic oligonucleotide
atgcgcaccgactgtttcccccccacgtgctgcac

SEQ ID NO: 180358 - DNA, 34 bp, Artificial Sequence
  Synthetic oligonucleotide
tgtctcactccatttgcgcaccctgcttcgggac

SEQ ID NO: 180359 - DNA, 35 bp, Artificial Sequence
  Synthetic oligonucleotide
acacgctgttgcccctctatcccctcgtcacgtac

SEQ ID NO: 180360 - DNA, 35 bp, Artificial Sequence
  Synthetic oligonucleotide
gtcgcccgacctgttcttgctcgtctctggcttac

SEQ ID NO: 180361 - DNA, 35 bp, Artificial Sequence
  Synthetic oligonucleotide
agcccccccaagcttatattatcgtaccgggttac

SEQ ID NO: 180362 - DNA, 35 bp, Artificial Sequence
  Synthetic oligonucleotide
gacgggaccaccgcctagtcgtccttcatttcacc

SEQ ID NO: 180363 - DNA, 35 bp, Artificial Sequence
  Synthetic oligonucleotide
taccattggctcattgactttcacagacgctcccc

SEQ ID NO: 180364 - DNA, 35 bp, Artificial Sequence
  Synthetic oligonucleotide
tttccagcgaacggctcacgtcgactctcatgccc

SEQ ID NO: 180365 - DNA, 35 bp, Artificial Sequence
  Synthetic oligonucleotide
tctggccttccacctgtgcaacatcgctaattccc

SEQ ID NO: 180366 - DNA, 35 bp, Artificial Sequence
  Synthetic oligonucleotide
aatgacgcctcattcatgccttttgtacgctcgcc

SEQ ID NO: 180367 - DNA, 35 bp, Artificial Sequence
  Synthetic oligonucleotide
acattgctctcccaccgtaaccccccttcatggcc

SEQ ID NO: 180368 - DNA, 35 bp, Artificial Sequence
  Synthetic oligonucleotide
tgcccctgaggagtgtctccttctctctttctgcc

SEQ ID NO: 180369 - DNA, 35 bp, Artificial Sequence
  Synthetic oligonucleotide
gacgctccccctccggccattgctgtttgctatcc

SEQ ID NO: 180370 - DNA, 35 bp, Artificial Sequence
  Synthetic oligonucleotide
tgcgtccgtcctgcaacattactgaccgctactcc

SEQ ID NO: 180371 - DNA, 35 bp, Artificial Sequence
  Synthetic oligonucleotide
atgccacctacatttgttcacacgcgcctacctcc

SEQ ID NO: 180372 - DNA, 35 bp, Artificial Sequence
  Synthetic oligonucleotide
ggaatcctcgcagctcattcctcccgtggccctcc

SEQ ID NO: 180373 - DNA, 35 bp, Artificial Sequence
  Synthetic oligonucleotide
tatgtgagaccgctcctttgccgttcgtcgcctcc

SEQ ID NO: 180374 - DNA, 35 bp, Artificial Sequence
  Synthetic oligonucleotide
gtgaaccaacatggggagccggcggtacctcctcc

SEQ ID NO: 180375 - DNA, 35 bp, Artificial Sequence
  Synthetic oligonucleotide
actccgcactcctggattcaccgtgcatgccttcc

SEQ ID NO: 180376 - DNA, 35 bp, Artificial Sequence
  Synthetic oligonucleotide
acatggtaatgggcactggtcctgccttccgttcc

SEQ ID NO: 180377 - DNA, 35 bp, Artificial Sequence
  Synthetic oligonucleotide
tgctagcacactgccttgctctacccctcttgagc

SEQ ID NO: 180378 - DNA, 35 bp, Artificial Sequence
  Synthetic oligonucleotide
ataccttcgccctctgtctacggttagcttttagc

SEQ ID NO: 180379 - DNA, 35 bp, Artificial Sequence
  Synthetic oligonucleotide
ggagcggaggggggaccaggaagaaaggagaacgc

SEQ ID NO: 180380 - DNA, 35 bp, Artificial Sequence
  Synthetic oligonucleotide
agcaacacggttacgtatcctcgctttgaccccgc

SEQ ID NO: 180381 - DNA, 35 bp, Artificial Sequence
  Synthetic oligonucleotide
gaggtccgtaccaggtcgatcagcaactcctccgc

SEQ ID NO: 180382 - DNA, 35 bp, Artificial Sequence
  Synthetic oligonucleotide
accctcgcccccctcgctgctgtaatattcctcgc

SEQ ID NO: 180383 - DNA, 35 bp, Artificial Sequence
  Synthetic oligonucleotide
agcaccccactgtagatcgctccacctgacctggc

SEQ ID NO: 180384 - DNA, 35 bp, Artificial Sequence
  Synthetic oligonucleotide
tgccccccgtaatccgccgctcacctttttgatgc

SEQ ID NO: 180385 - DNA, 35 bp, Artificial Sequence
  Synthetic oligonucleotide
gattagcgcatcccgtatcgttcgtgtcctctatc

SEQ ID NO: 180386 - DNA, 35 bp, Artificial Sequence
  Synthetic oligonucleotide
agaggccggaagagcggagggaaggggagcgtatc

SEQ ID NO: 180387 - DNA, 35 bp, Artificial Sequence
  Synthetic oligonucleotide
gtaccgccgtgtccatatggaccgacatacacctc

SEQ ID NO: 180388 - DNA, 35 bp, Artificial Sequence
  Synthetic oligonucleotide
tggtgccccctaatgatgatctctccgcctgcctc

SEQ ID NO: 180389 - DNA, 35 bp, Artificial Sequence
  Synthetic oligonucleotide
gctgttcccgaccagtcctttacccgttttggctc

SEQ ID NO: 180390 - DNA, 35 bp, Artificial Sequence
  Synthetic oligonucleotide
tcagtaacgcgcctctcatgtacttgcttatggtc

SEQ ID NO: 180391 - DNA, 35 bp, Artificial Sequence
  Synthetic oligonucleotide
acatgcctctccaacagatgttgctcgccgtattc

SEQ ID NO: 180392 - DNA, 35 bp, Artificial Sequence
  Synthetic oligonucleotide
accacccccgtcgcccgatcggcatactgcgcttc

SEQ ID NO: 180393 - DNA, 35 bp, Artificial Sequence
  Synthetic oligonucleotide
gcgatttacatcattgctgttctcgtttcatcttc

SEQ ID NO: 180394 - DNA, 35 bp, Artificial Sequence
  Synthetic oligonucleotide
tcattccgcacaaacccgtccgcatcttcgttttc

SEQ ID NO: 180395 - DNA, 35 bp, Artificial Sequence
  Synthetic oligonucleotide
tagggcgaaagggtaaaggcatggcgggagagcag

SEQ ID NO: 180396 - DNA, 35 bp, Artificial Sequence
  Synthetic oligonucleotide
ggagtaggaggggcgagactggaactggcaacacg

SEQ ID NO: 180397 - DNA, 35 bp, Artificial Sequence
  Synthetic oligonucleotide
acaacgcctccgcctagctttagccctatatcccg

SEQ ID NO: 180398 - DNA, 33 bp, Artificial Sequence
  Synthetic oligonucleotide
gatgctagcccccccgccctcacactcttcgcg

SEQ ID NO: 180399 - DNA, 35 bp, Artificial Sequence
  Synthetic oligonucleotide
ttcatcctcgcgttacctgctggtctgctccctcg

SEQ ID NO: 180400 - DNA, 35 bp, Artificial Sequence
  Synthetic oligonucleotide
tgataaggtgagagaggaaggatgcggtagtttgg

SEQ ID NO: 180401 - DNA, 35 bp, Artificial Sequence
  Synthetic oligonucleotide
tcgcggtccactctgactatcgccccacattcctg

SEQ ID NO: 180402 - DNA, 35 bp, Artificial Sequence
  Synthetic oligonucleotide
gccacccccccggatccacagagagtgtgttcctg

SEQ ID NO: 180403 - DNA, 35 bp, Artificial Sequence
  Synthetic oligonucleotide
tagctctgattcaggccccgcttcacccctcgctg

SEQ ID NO: 180404 - DNA, 35 bp, Artificial Sequence
  Synthetic oligonucleotide
tgctaaccctacccctttactcctgccctttgttg

SEQ ID NO: 180405 - DNA, 35 bp, Artificial Sequence
  Synthetic oligonucleotide
gccgctccctgcccccagaaccgctattgggtttg

SEQ ID NO: 180406 - DNA, 35 bp, Artificial Sequence
  Synthetic oligonucleotide
tgtcacatcggtacgcatgcaacactcccccacat

SEQ ID NO: 180407 - DNA, 35 bp, Artificial Sequence
  Synthetic oligonucleotide
ttcgtacccctgcacctcgtggcgacgagtttcat

SEQ ID NO: 180408 - DNA, 35 bp, Artificial Sequence
  Synthetic oligonucleotide
tgaaccgctatatcgttctgaactcctcgccctat

SEQ ID NO: 180409 - DNA, 35 bp, Artificial Sequence
  Synthetic oligonucleotide
gtgcaccgtcactcgtttaccgctttttgggccct

SEQ ID NO: 180410 - DNA, 35 bp, Artificial Sequence
  Synthetic oligonucleotide
ggtgaacctccaccgtatgctcttgtgccgtccct

SEQ ID NO: 180411 - DNA, 35 bp, Artificial Sequence
  Synthetic oligonucleotide
taccacgagtggctgttttattgttcgctttccct

SEQ ID NO: 180412 - DNA, 35 bp, Artificial Sequence
  Synthetic oligonucleotide
gtggagtgccccgtacattttgcttatcgccgcct

SEQ ID NO: 180413 - DNA, 35 bp, Artificial Sequence
  Synthetic oligonucleotide
tgatgcaccactccctagttaccgtttcctcgcct

SEQ ID NO: 180414 - DNA, 35 bp, Artificial Sequence
  Synthetic oligonucleotide
tgcttaccaccacccatccccccggacacgaggct

SEQ ID NO: 180415 - DNA, 35 bp, Artificial Sequence
  Synthetic oligonucleotide
gacagccgggatgtccacacctacctttccctgct

SEQ ID NO: 180416 - DNA, 35 bp, Artificial Sequence
  Synthetic oligonucleotide
gttcaggcctatactacccgcccgctactcttgct

SEQ ID NO: 180417 - DNA, 35 bp, Artificial Sequence
  Synthetic oligonucleotide
attgtgcctccatcatgtttcgttagtgtccatct

SEQ ID NO: 180418 - DNA, 35 bp, Artificial Sequence
  Synthetic oligonucleotide
tagacgcccgctccactcctaggctacacatatct

SEQ ID NO: 180419 - DNA, 35 bp, Artificial Sequence
  Synthetic oligonucleotide
atttgtgctagcctgcccccctgtctgttgattct

SEQ ID NO: 180420 - DNA, 35 bp, Artificial Sequence
  Synthetic oligonucleotide
tatcgccctacgcaccatcgataactgccacttct

SEQ ID NO: 180421 - DNA, 35 bp, Artificial Sequence
  Synthetic oligonucleotide
actgtcaccttcatcccatgcatcccgagccttct

SEQ ID NO: 180422 - DNA, 35 bp, Artificial Sequence
  Synthetic oligonucleotide
acctcgttacgccagcccgtttgctcccccgttct

SEQ ID NO: 180423 - DNA, 35 bp, Artificial Sequence
  Synthetic oligonucleotide
tttggctgtctgtaagaaggggggggaggggaagt

SEQ ID NO: 180424 - DNA, 35 bp, Artificial Sequence
  Synthetic oligonucleotide
gcactcctccgcacccgcccttcctgtttaccagt

SEQ ID NO: 180425 - DNA, 35 bp, Artificial Sequence
  Synthetic oligonucleotide
acacttccccatcccgtgcgagatctcccataggt

SEQ ID NO: 180426 - DNA, 35 bp, Artificial Sequence
  Synthetic oligonucleotide
gctccccccagtgcgtccagcctgcttttctaggt

SEQ ID NO: 180427 - DNA, 35 bp, Artificial Sequence
  Synthetic oligonucleotide
gctgccctggtttagttgctgttctccctctctgt

SEQ ID NO: 180428 - DNA, 34 bp, Artificial Sequence
  Synthetic oligonucleotide
gtcgccccctcccttcattgttagctttcacctt

SEQ ID NO: 180429 - DNA, 35 bp, Artificial Sequence
  Synthetic oligonucleotide
tcatgccggttgcacttagaccatgcctatccctt

SEQ ID NO: 180430 - DNA, 35 bp, Artificial Sequence
  Synthetic oligonucleotide
gcaactatgcgcgctcttggacagtcaccctcctt

SEQ ID NO: 180431 - DNA, 35 bp, Artificial Sequence
  Synthetic oligonucleotide
gttgacctcgcaccggatcctcttggactactctt

SEQ ID NO: 180432 - DNA, 35 bp, Artificial Sequence
  Synthetic oligonucleotide
agcatcagcacaccgtttggtaatctcaccctctt

SEQ ID NO: 180433 - DNA, 35 bp, Artificial Sequence
  Synthetic oligonucleotide
taccaccacaatgttatcacggcctctgctctctt

SEQ ID NO: 180434 - DNA, 35 bp, Artificial Sequence
  Synthetic oligonucleotide
tgcgcagtcgcgtgacgtacctccttcgcccattt

SEQ ID NO: 180435 - DNA, 35 bp, Artificial Sequence
  Synthetic oligonucleotide
tagcgcccagccggccctcccttaatattggcttt

SEQ ID NO: 180436 - DNA, 35 bp, Artificial Sequence
  Synthetic oligonucleotide
atctggtccgactcattggctcctgtctcttccaa

SEQ ID NO: 180437 - DNA, 35 bp, Artificial Sequence
  Synthetic oligonucleotide
tagatgacaccaccgcccccgtttgcctccgtcaa

SEQ ID NO: 180438 - DNA, 36 bp, Artificial Sequence
  Synthetic oligonucleotide
acgcccgggagtcaagctataagggcagggggggaa

SEQ ID NO: 180439 - DNA, 36 bp, Artificial Sequence
  Synthetic oligonucleotide
gaccgtagagggagcggtgggagtgaaggtggggaa

SEQ ID NO: 180440 - DNA, 35 bp, Artificial Sequence
  Synthetic oligonucleotide
accatctgggtaggggggacatagggcgggttgaa

SEQ ID NO: 180441 - DNA, 36 bp, Artificial Sequence
  Synthetic oligonucleotide
gagcacgtggccgccgtcgtacaatctctcgaataa

SEQ ID NO: 180442 - DNA, 36 bp, Artificial Sequence
  Synthetic oligonucleotide
gagcgggggaggggagtcgaacacgagaaggactaa

SEQ ID NO: 180443 - DNA, 36 bp, Artificial Sequence
  Synthetic oligonucleotide
gtgacagggaagggcgaggggagggagggcgcgtaa

SEQ ID NO: 180444 - DNA, 36 bp, Artificial Sequence
  Synthetic oligonucleotide
tcgcccaccgctcgacatgtcgacccattctgcaca

SEQ ID NO: 180445 - DNA, 35 bp, Artificial Sequence
  Synthetic oligonucleotide
actaacagggagggtggggggtcgtaaggaggaca

SEQ ID NO: 180446 - DNA, 36 bp, Artificial Sequence
  Synthetic oligonucleotide
gtgcccccatatatgcaccccgcccctcttgggaca

SEQ ID NO: 180447 - DNA, 36 bp, Artificial Sequence
  Synthetic oligonucleotide
gactcccctccccctgttgagtttctcgttctgaca

SEQ ID NO: 180448 - DNA, 36 bp, Artificial Sequence
  Synthetic oligonucleotide
attcggtcacgcaactgcaccctctctcgcttacca

SEQ ID NO: 180449 - DNA, 36 bp, Artificial Sequence
  Synthetic oligonucleotide
tccgttctccgccaaagtgtgatcgtcacacaccca

SEQ ID NO: 180450 - DNA, 35 bp, Artificial Sequence
  Synthetic oligonucleotide
cagacactgaatatctgcccgactcgctcacccca

SEQ ID NO: 180451 - DNA, 36 bp, Artificial Sequence
  Synthetic oligonucleotide
tcactgcggaccaatgacacttatcgcctgctgcca

SEQ ID NO: 180452 - DNA, 36 bp, Artificial Sequence
  Synthetic oligonucleotide
agcaagcggtctgcgatctatcccctgtcccatcca

SEQ ID NO: 180453 - DNA, 35 bp, Artificial Sequence
  Synthetic oligonucleotide
ctaccaccgcctgctgagcctcgatccccgttcca

SEQ ID NO: 180454 - DNA, 36 bp, Artificial Sequence
  Synthetic oligonucleotide
gacttgttcaacccccctctatgcgcccggctcgca

SEQ ID NO: 180455 - DNA, 36 bp, Artificial Sequence
  Synthetic oligonucleotide
tcgcgctgagattcgccctgctgtcccttttctgca

SEQ ID NO: 180456 - DNA, 36 bp, Artificial Sequence
  Synthetic oligonucleotide
gaatcaccgttcccagcccaccaaggcaccacctca

SEQ ID NO: 180457 - DNA, 34 bp, Artificial Sequence
  Synthetic oligonucleotide
acctctgtacgaactgcctgtgccacttagctca

SEQ ID NO: 180458 - DNA, 36 bp, Artificial Sequence
  Synthetic oligonucleotide
ttgtggccaggcgtcgccgctctaccctttcgctca

SEQ ID NO: 180459 - DNA, 35 bp, Artificial Sequence
  Synthetic oligonucleotide
gagaaccacccatcgatgcttgtatcgctcattca

SEQ ID NO: 180460 - DNA, 36 bp, Artificial Sequence
  Synthetic oligonucleotide
accctgccctactatgctcaatccctgcatgattca

SEQ ID NO: 180461 - DNA, 36 bp, Artificial Sequence
  Synthetic oligonucleotide
tgcccccccccgtacgcccgtctcaggacggtttca

SEQ ID NO: 180462 - DNA, 37 bp, Artificial Sequence
  Synthetic oligonucleotide
gcgatggagaatgggggatagggacatgacaggcaga

SEQ ID NO: 180463 - DNA, 37 bp, Artificial Sequence
  Synthetic oligonucleotide
gtggtagtgcagtgtagggggagggcggggctcacga

SEQ ID NO: 180464 - DNA, 35 bp, Artificial Sequence
  Synthetic oligonucleotide
ttgggaggggagggcttatagggggctttgcgcga

SEQ ID NO: 180465 - DNA, 37 bp, Artificial Sequence
  Synthetic oligonucleotide
gcaagggacatgggtgggcgggaggactaatctgcga

SEQ ID NO: 180466 - DNA, 36 bp, Artificial Sequence
  Synthetic oligonucleotide
gtccgccctccctcttaaacgtacggtccaaatcga

SEQ ID NO: 180467 - DNA, 36 bp, Artificial Sequence
  Synthetic oligonucleotide
gaaggggggacggtagagggtgcggtgggtactcga

SEQ ID NO: 180468 - DNA, 35 bp, Artificial Sequence
  Synthetic oligonucleotide
tgtgtcatggcgccccttgtttgaactcccctcga

SEQ ID NO: 180469 - DNA, 36 bp, Artificial Sequence
  Synthetic oligonucleotide
atggactacctgccttgcgtaaccaacctccctcga

SEQ ID NO: 180470 - DNA, 37 bp, Artificial Sequence
  Synthetic oligonucleotide
tttcgcagatgtgccccttctttgtctaccatctcga

SEQ ID NO: 180471 - DNA, 37 bp, Artificial Sequence
  Synthetic oligonucleotide
attcgccgcccgtgccttgcgtaatcaatccattcga

SEQ ID NO: 180472 - DNA, 37 bp, Artificial Sequence
  Synthetic oligonucleotide
tcaagtccggggcggaggaaggaggggaacagacgga

SEQ ID NO: 180473 - DNA, 37 bp, Artificial Sequence
  Synthetic oligonucleotide
ggaggggtggggacacgggcggggcacgaatgacgga

SEQ ID NO: 180474 - DNA, 37 bp, Artificial Sequence
  Synthetic oligonucleotide
tccctcgccccgcatatatcattatctcctgtccgga

SEQ ID NO: 180475 - DNA, 35 bp, Artificial Sequence
  Synthetic oligonucleotide
ggaagaaggcggggggagtgaggaatgtagtcgga

SEQ ID NO: 180476 - DNA, 37 bp, Artificial Sequence
  Synthetic oligonucleotide
gttacacgaacgggctggggaagggggcgggaaggga

SEQ ID NO: 180477 - DNA, 37 bp, Artificial Sequence
  Synthetic oligonucleotide
gagcggtcaggggtaacagtgaggtggagggatggga

SEQ ID NO: 180478 - DNA, 36 bp, Artificial Sequence
  Synthetic oligonucleotide
aatcagcccctactcgcatttgttcctcccttggga

SEQ ID NO: 180479 - DNA, 36 bp, Artificial Sequence
  Synthetic oligonucleotide
tgccctcctccgggtatctcccttcgccagactgga

SEQ ID NO: 180480 - DNA, 37 bp, Artificial Sequence
  Synthetic oligonucleotide
aaagtgggacgggggtcggaggaagagtgaaggtgga

SEQ ID NO: 180481 - DNA, 37 bp, Artificial Sequence
  Synthetic oligonucleotide
gacaggaaggacacgaggagaggaggaggccattgga

SEQ ID NO: 180482 - DNA, 37 bp, Artificial Sequence
  Synthetic oligonucleotide
ggattgtccgcccccttggaatcacccctcccttgga

SEQ ID NO: 180483 - DNA, 37 bp, Artificial Sequence
  Synthetic oligonucleotide
actctcgttcacctcctccgcgagccccccctttgga

SEQ ID NO: 180484 - DNA, 37 bp, Artificial Sequence
  Synthetic oligonucleotide
ttagggtgtagggggcaaaagggttggggagagatga

SEQ ID NO: 180485 - DNA, 38 bp, Artificial Sequence
  Synthetic oligonucleotide
aatgcatgtccgtttctatcaccgttacgccaccctga

SEQ ID NO: 180486 - DNA, 37 bp, Artificial Sequence
  Synthetic oligonucleotide
tacaggcacctctcctcattgacctgcttcaccctga

SEQ ID NO: 180487 - DNA, 37 bp, Artificial Sequence
  Synthetic oligonucleotide
tgaccacccatcctatataaaaggctcgcccccctga

SEQ ID NO: 180488 - DNA, 38 bp, Artificial Sequence
  Synthetic oligonucleotide
gttacggtccgaaggttaccactgtcctcctcccctga

SEQ ID NO: 180489 - DNA, 38 bp, Artificial Sequence
  Synthetic oligonucleotide
gccatagcccatgccccaacagccacccacctccctga

SEQ ID NO: 180490 - DNA, 38 bp, Artificial Sequence
  Synthetic oligonucleotide
acgctcgcacacccgttgattcgattatccgttcctga

SEQ ID NO: 180491 - DNA, 38 bp, Artificial Sequence
  Synthetic oligonucleotide
tactgagccgggaggagggccatatagggacgagctga

SEQ ID NO: 180492 - DNA, 38 bp, Artificial Sequence
  Synthetic oligonucleotide
tacgcgctacactctcatgcacctgacgaccctgctga

SEQ ID NO: 180493 - DNA, 36 bp, Artificial Sequence
  Synthetic oligonucleotide
aacaccctggccctgttatcggtgcactctctctga

SEQ ID NO: 180494 - DNA, 37 bp, Artificial Sequence
  Synthetic oligonucleotide
aacacgggcggtgcgcgggtgggaagagctgttctga

SEQ ID NO: 180495 - DNA, 37 bp, Artificial Sequence
  Synthetic oligonucleotide
gagaggtggtcctggggtggaggagaacggggagtga

SEQ ID NO: 180496 - DNA, 38 bp, Artificial Sequence
  Synthetic oligonucleotide
gatagcccgccctcctgcttacagtcatctggccgtga

SEQ ID NO: 180497 - DNA, 36 bp, Artificial Sequence
  Synthetic oligonucleotide
tcgagatacgggagggcgtggtaacgggggctgtga

SEQ ID NO: 180498 - DNA, 36 bp, Artificial Sequence
  Synthetic oligonucleotide
tcgaagacgggcgggggggaagtccgcgggacttga

SEQ ID NO: 180499 - DNA, 38 bp, Artificial Sequence
  Synthetic oligonucleotide
tagctccagccctacctaccgactgccttcctccttga

SEQ ID NO: 180500 - DNA, 35 bp, Artificial Sequence
  Synthetic oligonucleotide
acaccatgcccctcacaaatcttgtcagtaacata

SEQ ID NO: 180501 - DNA, 36 bp, Artificial Sequence
  Synthetic oligonucleotide
tcaactacgtccggaattagtccacccgcccctata

SEQ ID NO: 180502 - DNA, 35 bp, Artificial Sequence
  Synthetic oligonucleotide
gccctctgcgcctatcgtcttctccgcccacccta

SEQ ID NO: 180503 - DNA, 36 bp, Artificial Sequence
  Synthetic oligonucleotide
tgcagaccctgtctatcggtttcttcgctttcccta

SEQ ID NO: 180504 - DNA, 36 bp, Artificial Sequence
  Synthetic oligonucleotide
acgttgcaaccgcttcactcgcctgtttctctccta

SEQ ID NO: 180505 - DNA, 36 bp, Artificial Sequence
  Synthetic oligonucleotide
gcagaaaaaaagggggagcaacatgaacgggtggta

SEQ ID NO: 180506 - DNA, 35 bp, Artificial Sequence
  Synthetic oligonucleotide
tcaacgtaggtgtccctgtttcgctctcttactta

SEQ ID NO: 180507 - DNA, 36 bp, Artificial Sequence
  Synthetic oligonucleotide
tagtcgccccgtagcctctggatccgtcttgcctta

SEQ ID NO: 180508 - DNA, 35 bp, Artificial Sequence
  Synthetic oligonucleotide
accttccccacccgcccacgagtttcactgtctta

SEQ ID NO: 180509 - DNA, 35 bp, Artificial Sequence
  Synthetic oligonucleotide
acccatgcatccacctcgtgtcaccgtcctgccac

SEQ ID NO: 180510 - DNA, 35 bp, Artificial Sequence
  Synthetic oligonucleotide
tcacctcgcatatagccaacctcggtaggtgccac

SEQ ID NO: 180511 - DNA, 35 bp, Artificial Sequence
  Synthetic oligonucleotide
tagggaggtgtaggggggtgagcacatgaagagac

SEQ ID NO: 180512 - DNA, 35 bp, Artificial Sequence
  Synthetic oligonucleotide
actgtgaaacatgaccgttgtacctcgccacctac

SEQ ID NO: 180513 - DNA, 35 bp, Artificial Sequence
  Synthetic oligonucleotide
gttacagcctagtgcagcccccctcttattgctac

SEQ ID NO: 180514 - DNA, 35 bp, Artificial Sequence
  Synthetic oligonucleotide
cccagcccggtggtcttagttctcctcccccgtac

SEQ ID NO: 180515 - DNA, 35 bp, Artificial Sequence
  Synthetic oligonucleotide
ttgctacatcccagactggatgagccgcccctacc

SEQ ID NO: 180516 - DNA, 35 bp, Artificial Sequence
  Synthetic oligonucleotide
aactgcacatgacgcccccgtgcctcttttttacc

SEQ ID NO: 180517 - DNA, 35 bp, Artificial Sequence
  Synthetic oligonucleotide
agcgccctggcactaaccacctgttgtctcatccc

SEQ ID NO: 180518 - DNA, 35 bp, Artificial Sequence
  Synthetic oligonucleotide
gccttgaggcccgatgatgtttgctttcccctccc

SEQ ID NO: 180519 - DNA, 35 bp, Artificial Sequence
  Synthetic oligonucleotide
ggtgtggtgcctgcgtttgtctgtccgcgctcgcc

SEQ ID NO: 180520 - DNA, 35 bp, Artificial Sequence
  Synthetic oligonucleotide
tccacgcttgttccgtgcctgaagtgccccatgcc

SEQ ID NO: 180521 - DNA, 35 bp, Artificial Sequence
  Synthetic oligonucleotide
ttgatgccccctaggatctgtcgccgtaccctgcc

SEQ ID NO: 180522 - DNA, 35 bp, Artificial Sequence
  Synthetic oligonucleotide
tccgccacttcgaagagttacatcccccgcttgcc

SEQ ID NO: 180523 - DNA, 35 bp, Artificial Sequence
  Synthetic oligonucleotide
tactggccaatgcgcacaccgcgtaacctgattcc

SEQ ID NO: 180524 - DNA, 35 bp, Artificial Sequence
  Synthetic oligonucleotide
tcacctctacacatcctacaggacgctattatagc

SEQ ID NO: 180525 - DNA, 35 bp, Artificial Sequence
  Synthetic oligonucleotide
gacgcgcattaacacctgctcatctaattcctggc

SEQ ID NO: 180526 - DNA, 35 bp, Artificial Sequence
  Synthetic oligonucleotide
tacacctaaacggtatgttccgtcacttgccctgc

SEQ ID NO: 180527 - DNA, 35 bp, Artificial Sequence
  Synthetic oligonucleotide
tcacaagtctaatcctgcccgaagtgccgtcctgc

SEQ ID NO: 180528 - DNA, 35 bp, Artificial Sequence
  Synthetic oligonucleotide
acggagaggagggtgcgggttgggggtgagttatc

SEQ ID NO: 180529 - DNA, 35 bp, Artificial Sequence
  Synthetic oligonucleotide
gtacgcccccacttggcaaggctggttcctttatc

SEQ ID NO: 180530 - DNA, 35 bp, Artificial Sequence
  Synthetic oligonucleotide
gcgctcgccacgttccaactccgggcttttgactc

SEQ ID NO: 180531 - DNA, 35 bp, Artificial Sequence
  Synthetic oligonucleotide
tacatggtgtcggtactgtgatccacctgtccctc

SEQ ID NO: 180532 - DNA, 35 bp, Artificial Sequence
  Synthetic oligonucleotide
cacgtgcatgttcggttctgcctgttgccctcctc

SEQ ID NO: 180533 - DNA, 35 bp, Artificial Sequence
  Synthetic oligonucleotide
tgcatacccggtgccaacgctacaagccgactctc

SEQ ID NO: 180534 - DNA, 35 bp, Artificial Sequence
  Synthetic oligonucleotide
ttgtggcccacgttctaccctatcgcttgcctctc

SEQ ID NO: 180535 - DNA, 35 bp, Artificial Sequence
  Synthetic oligonucleotide
gagcccagccatttcgtcctcactcatgcgctctc

SEQ ID NO: 180536 - DNA, 35 bp, Artificial Sequence
  Synthetic oligonucleotide
gctcacgaccagccctgtccttattcagtccggtc

SEQ ID NO: 180537 - DNA, 35 bp, Artificial Sequence
  Synthetic oligonucleotide
gaacagctccactctgttcaccacatcaaccattc

SEQ ID NO: 180538 - DNA, 35 bp, Artificial Sequence
  Synthetic oligonucleotide
tcccccgtcccgccggttaaattcccaacaagttc

SEQ ID NO: 180539 - DNA, 32 bp, Artificial Sequence
  Synthetic oligonucleotide
gcccgacgctccacattaggcccttccatttc

SEQ ID NO: 180540 - DNA, 35 bp, Artificial Sequence
  Synthetic oligonucleotide
gattgcagctccctccccgttttgttgcctgtttc

SEQ ID NO: 180541 - DNA, 35 bp, Artificial Sequence
  Synthetic oligonucleotide
accaccaccctctcatgagcgcactgtagcctgag

SEQ ID NO: 180542 - DNA, 35 bp, Artificial Sequence
  Synthetic oligonucleotide
tatcccccagatctggtcactacgcactctcttag

SEQ ID NO: 180543 - DNA, 35 bp, Artificial Sequence
  Synthetic oligonucleotide
gcgatctgttcgtcattcctctggtctcgcccacg

SEQ ID NO: 180544 - DNA, 35 bp, Artificial Sequence
  Synthetic oligonucleotide
tctcgttcgaccaacacccccgccatgcccggacg

SEQ ID NO: 180545 - DNA, 35 bp, Artificial Sequence
  Synthetic oligonucleotide
acatccatccgcataaccgcctatgcgttcttacg

SEQ ID NO: 180546 - DNA, 35 bp, Artificial Sequence
  Synthetic oligonucleotide
tcgatacgacccgccacttgtcccttccatccccg

SEQ ID NO: 180547 - DNA, 35 bp, Artificial Sequence
  Synthetic oligonucleotide
gtagcggctatgccctccttatgttccattcgccg

SEQ ID NO: 180548 - DNA, 35 bp, Artificial Sequence
  Synthetic oligonucleotide
gccacggccccccccaaaatactctgcttcctgcg

SEQ ID NO: 180549 - DNA, 36 bp, Artificial Sequence
  Synthetic oligonucleotide
tctggagacaggggggatgacagcatgggaagtgcg

SEQ ID NO: 180550 - DNA, 35 bp, Artificial Sequence
  Synthetic oligonucleotide
tacctcccgagcacttgcattaggcccaccttgcg

SEQ ID NO: 180551 - DNA, 35 bp, Artificial Sequence
  Synthetic oligonucleotide
gaggaaggaaggggatgaggtgcggcacggcatcg

SEQ ID NO: 180552 - DNA, 35 bp, Artificial Sequence
  Synthetic oligonucleotide
gacacgggccgggggtcgatttggggtggggatcg

SEQ ID NO: 180553 - DNA, 35 bp, Artificial Sequence
  Synthetic oligonucleotide
tcatccggggcgactatttctcctttcgttcttcg

SEQ ID NO: 180554 - DNA, 35 bp, Artificial Sequence
  Synthetic oligonucleotide
ggaggtagagcgggggtcataggagggacatgagg

SEQ ID NO: 180555 - DNA, 36 bp, Artificial Sequence
  Synthetic oligonucleotide
gcaggacgatggtacgagtagacggaggagggaggg

SEQ ID NO: 180556 - DNA, 35 bp, Artificial Sequence
  Synthetic oligonucleotide
ggggtaagagggaggagaggagaaatcggcaaatg

SEQ ID NO: 180557 - DNA, 34 bp, Artificial Sequence
  Synthetic oligonucleotide
gtctgcccctggctataacccctgtccgaacctg

SEQ ID NO: 180558 - DNA, 35 bp, Artificial Sequence
  Synthetic oligonucleotide
atagctgccgccctgcgctcccccgtctcttcctg

SEQ ID NO: 180559 - DNA, 35 bp, Artificial Sequence
  Synthetic oligonucleotide
agcccaacccatccgggcttaccgcttatcctttg

SEQ ID NO: 180560 - DNA, 35 bp, Artificial Sequence
  Synthetic oligonucleotide
gctcccccccctcgccgacctggtggtctggtttg

SEQ ID NO: 180561 - DNA, 35 bp, Artificial Sequence
  Synthetic oligonucleotide
aacccctccactcgctggaaccacccagcattttg

SEQ ID NO: 180562 - DNA, 35 bp, Artificial Sequence
  Synthetic oligonucleotide
acgccattccaccaaggcataaattctggcccact

SEQ ID NO: 180563 - DNA, 35 bp, Artificial Sequence
  Synthetic oligonucleotide
gtggctctcggtccgctaagttccatccttgcact

SEQ ID NO: 180564 - DNA, 34 bp, Artificial Sequence
  Synthetic oligonucleotide
atatcccgcacctgtccaactcgacatctctact

SEQ ID NO: 180565 - DNA, 35 bp, Artificial Sequence
  Synthetic oligonucleotide
gccggtgtcgtcaaccgtcccttcacaagcctcct

SEQ ID NO: 180566 - DNA, 35 bp, Artificial Sequence
  Synthetic oligonucleotide
acgtatagccctcacattttccatatacgccctct

SEQ ID NO: 180567 - DNA, 35 bp, Artificial Sequence
  Synthetic oligonucleotide
cccaccccggcgcatatcgttcgttactaccgtct

SEQ ID NO: 180568 - DNA, 35 bp, Artificial Sequence
  Synthetic oligonucleotide
gtaccccgcctactaacatcagtcccacatccggt

SEQ ID NO: 180569 - DNA, 35 bp, Artificial Sequence
  Synthetic oligonucleotide
agctggtctcctgtgccgtcttcactcgcctgctt

SEQ ID NO: 180570 - DNA, 35 bp, Artificial Sequence
  Synthetic oligonucleotide
acccacccagcccaattcgtaaccgtttcgccgtt

SEQ ID NO: 180571 - DNA, 35 bp, Artificial Sequence
  Synthetic oligonucleotide
gttccgccaatcacacccgtggcttcttgttcttt

SEQ ID NO: 180572 - DNA, 35 bp, Artificial Sequence
  Synthetic oligonucleotide
acctcccacgtgcagccttttttagaccgcgtttt

SEQ ID NO: 180573 - DNA, 35 bp, Artificial Sequence
  Synthetic oligonucleotide
acacatgggacagtgacgtgcggggggggaggaaa

SEQ ID NO: 180574 - DNA, 35 bp, Artificial Sequence
  Synthetic oligonucleotide
cccgaaaatcgtccgccgccccgcttctcctagaa

SEQ ID NO: 180575 - DNA, 36 bp, Artificial Sequence
  Synthetic oligonucleotide
ttccctgggcggggtgtgtatttgtagggtggggaa

SEQ ID NO: 180576 - DNA, 36 bp, Artificial Sequence
  Synthetic oligonucleotide
gacaacactgctgttcccgcattcctgttcacctaa

SEQ ID NO: 180577 - DNA, 36 bp, Artificial Sequence
  Synthetic oligonucleotide
atgcggtctctctgctccgtccctcgccttgtttaa

SEQ ID NO: 180578 - DNA, 36 bp, Artificial Sequence
  Synthetic oligonucleotide
tcaccccagccatcacctcgccgatcaggaccccca

SEQ ID NO: 180579 - DNA, 36 bp, Artificial Sequence
  Synthetic oligonucleotide
gcaacttcctccattcgctcgcccagctgttgccca

SEQ ID NO: 180580 - DNA, 35 bp, Artificial Sequence
  Synthetic oligonucleotide
aaggcggtggggcggggggggaactgtagtagcca

SEQ ID NO: 180581 - DNA, 36 bp, Artificial Sequence
  Synthetic oligonucleotide
gttcccatcagctatgttgtatatctcctctcgcca

SEQ ID NO: 180582 - DNA, 32 bp, Artificial Sequence
  Synthetic oligonucleotide
ttactgttccacccatgcgtgtccattggcca

SEQ ID NO: 180583 - DNA, 35 bp, Artificial Sequence
  Synthetic oligonucleotide
gcggactcgtccgtttttcgtctgccccactgcca

SEQ ID NO: 180584 - DNA, 35 bp, Artificial Sequence
  Synthetic oligonucleotide
gccaatccagtagcgcgccctctggactccttcca

SEQ ID NO: 180585 - DNA, 36 bp, Artificial Sequence
  Synthetic oligonucleotide
atcatgtgcataccgcccactctcgtttcgtttcca

SEQ ID NO: 180586 - DNA, 36 bp, Artificial Sequence
  Synthetic oligonucleotide
agtgcacgaccacatatctcttaaacgcccctcgca

SEQ ID NO: 180587 - DNA, 36 bp, Artificial Sequence
  Synthetic oligonucleotide
agtgtccggtagaggaatggggggtaggtaagggca

SEQ ID NO: 180588 - DNA, 35 bp, Artificial Sequence
  Synthetic oligonucleotide
tcattgcccatttgtgaacatcacctgcttcatca

SEQ ID NO: 180589 - DNA, 35 bp, Artificial Sequence
  Synthetic oligonucleotide
gcaccttctaccagctatatctgccctgcctatca

SEQ ID NO: 180590 - DNA, 36 bp, Artificial Sequence
  Synthetic oligonucleotide
atggtggaggccggggtatgaaatggggacaggtca

SEQ ID NO: 180591 - DNA, 35 bp, Artificial Sequence
  Synthetic oligonucleotide
cggtagccactcgacgccactcgcactttggttca

SEQ ID NO: 180592 - DNA, 37 bp, Artificial Sequence
  Synthetic oligonucleotide
tagatccccccgcccacgaccgtgcttatcggacaga

SEQ ID NO: 180593 - DNA, 35 bp, Artificial Sequence
  Synthetic oligonucleotide
aattggtggggtggggtggtaagggacgtgacaga

SEQ ID NO: 180594 - DNA, 37 bp, Artificial Sequence
  Synthetic oligonucleotide
tcaacgtgagggctgtcaagaggggagggaaggcaga

SEQ ID NO: 180595 - DNA, 37 bp, Artificial Sequence
  Synthetic oligonucleotide
gctgggacagtgggaaacataggggaaggggaaacga

SEQ ID NO: 180596 - DNA, 37 bp, Artificial Sequence
  Synthetic oligonucleotide
acgctcgccctcgcaattatacacatgtgtcccccga

SEQ ID NO: 180597 - DNA, 36 bp, Artificial Sequence
  Synthetic oligonucleotide
tctcacagtcaccctagtctcatccttctgccccga

SEQ ID NO: 180598 - DNA, 37 bp, Artificial Sequence
  Synthetic oligonucleotide
tgccgcgcgctcctatggttctttgttccctgcccga

SEQ ID NO: 180599 - DNA, 37 bp, Artificial Sequence
  Synthetic oligonucleotide
gacgctccacggtaaacgccactgactcaatcgccga

SEQ ID NO: 180600 - DNA, 35 bp, Artificial Sequence
  Synthetic oligonucleotide
tcccgcctccctctagcgatagttcgcaatgccga

SEQ ID NO: 180601 - DNA, 37 bp, Artificial Sequence
  Synthetic oligonucleotide
agacacgcagactccttacaccgactctatctctcga

SEQ ID NO: 180602 - DNA, 37 bp, Artificial Sequence
  Synthetic oligonucleotide
acgagcaagctccccctcgccgtcaccgagacttcga

SEQ ID NO: 180603 - DNA, 36 bp, Artificial Sequence
  Synthetic oligonucleotide
tcacgtcacctatgcaatgctaaacccccgcttcga

SEQ ID NO: 180604 - DNA, 36 bp, Artificial Sequence
  Synthetic oligonucleotide
tagcacagcaaccatggaggcgcgggggggagagga

SEQ ID NO: 180605 - DNA, 35 bp, Artificial Sequence
  Synthetic oligonucleotide
agtcatccgctcctttgcattgttccccgcccgga

SEQ ID NO: 180606 - DNA, 37 bp, Artificial Sequence
  Synthetic oligonucleotide
tgacggtgtgtgcgggaaaaatgggaagaggggcgga

SEQ ID NO: 180607 - DNA, 37 bp, Artificial Sequence
  Synthetic oligonucleotide
ggtagccaaggtgagtgaggggaagcaagggggcgga

SEQ ID NO: 180608 - DNA, 37 bp, Artificial Sequence
  Synthetic oligonucleotide
gcaaggaggtgggtaaacgcgggagcgagggtgcgga

SEQ ID NO: 180609 - DNA, 37 bp, Artificial Sequence
  Synthetic oligonucleotide
tgccaccaatctccgcccttactgcaccctgttcgga

SEQ ID NO: 180610 - DNA, 35 bp, Artificial Sequence
  Synthetic oligonucleotide
atgaaccgcgggggaagggagataggggcagggga

SEQ ID NO: 180611 - DNA, 37 bp, Artificial Sequence
  Synthetic oligonucleotide
tggggagtggcggtttccatcctagggcggtgtggga

SEQ ID NO: 180612 - DNA, 37 bp, Artificial Sequence
  Synthetic oligonucleotide
tactagccctgcaccatccctgccactgtctattgga

SEQ ID NO: 180613 - DNA, 37 bp, Artificial Sequence
  Synthetic oligonucleotide
acgtagccccatctttccaacgtcaccgcctcttgga

SEQ ID NO: 180614 - DNA, 38 bp, Artificial Sequence
  Synthetic oligonucleotide
gagagggcggggaacggcaaggaggtaagagggaatga

SEQ ID NO: 180615 - DNA, 38 bp, Artificial Sequence
  Synthetic oligonucleotide
gacgaggagggcggaaaaggggcggcttctaggtatga

SEQ ID NO: 180616 - DNA, 38 bp, Artificial Sequence
  Synthetic oligonucleotide
gtaccagagggggggcgggggcaaaagggaccttatga

SEQ ID NO: 180617 - DNA, 38 bp, Artificial Sequence
  Synthetic oligonucleotide
gccactcccagggctttctcacgaacactaccacctga

SEQ ID NO: 180618 - DNA, 38 bp, Artificial Sequence
  Synthetic oligonucleotide
gatccctcgtcgtgtcccatctgctcgccttcccctga

SEQ ID NO: 180619 - DNA, 32 bp, Artificial Sequence
  Synthetic oligonucleotide
gactccttgctccccatacgccgataagctga

SEQ ID NO: 180620 - DNA, 37 bp, Artificial Sequence
  Synthetic oligonucleotide
aacagcacactggttcttcctgccccccccgtgctga

SEQ ID NO: 180621 - DNA, 38 bp, Artificial Sequence
  Synthetic oligonucleotide
accggaagaggaaaggggggtatagttagaaggagtga

SEQ ID NO: 180622 - DNA, 35 bp, Artificial Sequence
  Synthetic oligonucleotide
gggtagtagcggaggggagggaatgagcaccgtga

SEQ ID NO: 180623 - DNA, 38 bp, Artificial Sequence
  Synthetic oligonucleotide
gtggagacacgctggggatgagggggcgggcgtggtga

SEQ ID NO: 180624 - DNA, 38 bp, Artificial Sequence
  Synthetic oligonucleotide
gccccagggggggggatgggagtacagggtacatgtga

SEQ ID NO: 180625 - DNA, 38 bp, Artificial Sequence
  Synthetic oligonucleotide
gatctccctcgccgccctttagctcgcactctgcttga

SEQ ID NO: 180626 - DNA, 38 bp, Artificial Sequence
  Synthetic oligonucleotide
gctggcctgcccgcctcgttactaaactacactcttga

SEQ ID NO: 180627 - DNA, 37 bp, Artificial Sequence
  Synthetic oligonucleotide
acacactccgcccgctaaaaactctcacactcgttga

SEQ ID NO: 180628 - DNA, 38 bp, Artificial Sequence
  Synthetic oligonucleotide
attgcccccgccgctgcccatttcactcatattgttga

SEQ ID NO: 180629 - DNA, 38 bp, Artificial Sequence
  Synthetic oligonucleotide
agccgcctgtcctgttgttctcgcccttctccatttga

SEQ ID NO: 180630 - DNA, 38 bp, Artificial Sequence
  Synthetic oligonucleotide
tgcctcctccccagactatttattccatcggtctttga

SEQ ID NO: 180631 - DNA, 36 bp, Artificial Sequence
  Synthetic oligonucleotide
gccgtcccctgcttaccttgacttctgcggttcata

SEQ ID NO: 180632 - DNA, 36 bp, Artificial Sequence
  Synthetic oligonucleotide
gaccactccctgcccgattaccgacctggataacta

SEQ ID NO: 180633 - DNA, 36 bp, Artificial Sequence
  Synthetic oligonucleotide
ttcgctgcatgcccgagatgcttgcgctccactcta

SEQ ID NO: 180634 - DNA, 36 bp, Artificial Sequence
  Synthetic oligonucleotide
tgaccacgcgcttcctctcgtctattgcccgctcta

SEQ ID NO: 180635 - DNA, 36 bp, Artificial Sequence
  Synthetic oligonucleotide
tcggtaccgacgtatgcgccctcttgtcaccttcta

SEQ ID NO: 180636 - DNA, 36 bp, Artificial Sequence
  Synthetic oligonucleotide
gatacctttagctgttggtcgatcgactcctccgta

SEQ ID NO: 180637 - DNA, 36 bp, Artificial Sequence
  Synthetic oligonucleotide
tgccgtgtttccagccgtccttgcctgttctttgta

SEQ ID NO: 180638 - DNA, 35 bp, Artificial Sequence
  Synthetic oligonucleotide
gcgcaacatcctattaggcctgcgtctctcgcaac

SEQ ID NO: 180639 - DNA, 35 bp, Artificial Sequence
  Synthetic oligonucleotide
gtaccccgcccgatccgaattaccccatctcgaac

SEQ ID NO: 180640 - DNA, 35 bp, Artificial Sequence
  Synthetic oligonucleotide
gagtactcctctgatacgcttattaaccgccacac

SEQ ID NO: 180641 - DNA, 35 bp, Artificial Sequence
  Synthetic oligonucleotide
tgtatgccgtccggttaccttaccacccaccgcac

SEQ ID NO: 180642 - DNA, 35 bp, Artificial Sequence
  Synthetic oligonucleotide
tcctatccatcaccgttatgcgctgtccctatcac

SEQ ID NO: 180643 - DNA, 35 bp, Artificial Sequence
  Synthetic oligonucleotide
tctaaggatcgccttatcttgccccactgtttcac

SEQ ID NO: 180644 - DNA, 35 bp, Artificial Sequence
  Synthetic oligonucleotide
gtggaccagtccacttcctccttttccaccgagac

SEQ ID NO: 180645 - DNA, 35 bp, Artificial Sequence
  Synthetic oligonucleotide
gctgagggggtgatagggggagggtgggcttcgac

SEQ ID NO: 180646 - DNA, 35 bp, Artificial Sequence
  Synthetic oligonucleotide
tccgaacgccaactttgccccgcgattctatatac

SEQ ID NO: 180647 - DNA, 35 bp, Artificial Sequence
  Synthetic oligonucleotide
ttagcacagagcccgcgcgccccccgtgttcttac

SEQ ID NO: 180648 - DNA, 35 bp, Artificial Sequence
  Synthetic oligonucleotide
gacgcatgcagcccaccgtcgctcgattttgttac

SEQ ID NO: 180649 - DNA, 35 bp, Artificial Sequence
  Synthetic oligonucleotide
ttcagcgcctttccgttacttactcctggcacacc

SEQ ID NO: 180650 - DNA, 35 bp, Artificial Sequence
  Synthetic oligonucleotide
ttgtggacacacaccgcactgctgctatacttacc

SEQ ID NO: 180651 - DNA, 35 bp, Artificial Sequence
  Synthetic oligonucleotide
gcacctctcacagtgataatgcgtcatcaccaccc

SEQ ID NO: 180652 - DNA, 35 bp, Artificial Sequence
  Synthetic oligonucleotide
aacgctgatgcctggccgtttgtcattctgcaccc

SEQ ID NO: 180653 - DNA, 35 bp, Artificial Sequence
  Synthetic oligonucleotide
gagccctgcccgactaccttagcacaggctagccc

SEQ ID NO: 180654 - DNA, 35 bp, Artificial Sequence
  Synthetic oligonucleotide
gacaagcctcgcatctgttatatctcctaatgccc

SEQ ID NO: 180655 - DNA, 35 bp, Artificial Sequence
  Synthetic oligonucleotide
atttcgtccgccttagccgtttccgtaaccatccc

SEQ ID NO: 180656 - DNA, 35 bp, Artificial Sequence
  Synthetic oligonucleotide
actccccgacggtcatatccgttctatccgctccc

SEQ ID NO: 180657 - DNA, 35 bp, Artificial Sequence
  Synthetic oligonucleotide
gttgcgcccccgaggatcctcccctgatttgtccc

SEQ ID NO: 180658 - DNA, 35 bp, Artificial Sequence
  Synthetic oligonucleotide
tgcgtgacgtggccccctagttctgccctcttccc

SEQ ID NO: 180659 - DNA, 35 bp, Artificial Sequence
  Synthetic oligonucleotide
acagtcctgttgcgtgcggtatacgcccttttccc

SEQ ID NO: 180660 - DNA, 35 bp, Artificial Sequence
  Synthetic oligonucleotide
ttgtccccctctgcccacgttcccaggtaccatcc

SEQ ID NO: 180661 - DNA, 35 bp, Artificial Sequence
  Synthetic oligonucleotide
tttaccgctcatcacttgctgctccgagtatctcc

SEQ ID NO: 180662 - DNA, 35 bp, Artificial Sequence
  Synthetic oligonucleotide
atcaccccgcctgtatacccggttcctactcttcc

SEQ ID NO: 180663 - DNA, 35 bp, Artificial Sequence
  Synthetic oligonucleotide
cggtacgttcggcgttcgttttctacctacgttcc

SEQ ID NO: 180664 - DNA, 35 bp, Artificial Sequence
  Synthetic oligonucleotide
gccgccctccccgtatcgtcgtctagccccgccgc

SEQ ID NO: 180665 - DNA, 35 bp, Artificial Sequence
  Synthetic oligonucleotide
gtgccctcctccacgttttcgaacctctgtcttgc

SEQ ID NO: 180666 - DNA, 35 bp, Artificial Sequence
  Synthetic oligonucleotide
tttgccgccagtcctgggcatcgccacaccccatc

SEQ ID NO: 180667 - DNA, 35 bp, Artificial Sequence
  Synthetic oligonucleotide
ggcgataccacccacctctgttttgttctgccatc

SEQ ID NO: 180668 - DNA, 35 bp, Artificial Sequence
  Synthetic oligonucleotide
gatgtacgcgcggatccctgtcccatttcatactc

SEQ ID NO: 180669 - DNA, 35 bp, Artificial Sequence
  Synthetic oligonucleotide
attaggtgcgccccaagctcccatcgccgctcctc

SEQ ID NO: 180670 - DNA, 35 bp, Artificial Sequence
  Synthetic oligonucleotide
tcatgcggtcctgacttattccatggtagttcctc

SEQ ID NO: 180671 - DNA, 35 bp, Artificial Sequence
  Synthetic oligonucleotide
aaagggtggagagagggaaacagcgggaaacggtc

SEQ ID NO: 180672 - DNA, 35 bp, Artificial Sequence
  Synthetic oligonucleotide
gattcacccctccgttgaggacatgtcgtgctgtc

SEQ ID NO: 180673 - DNA, 35 bp, Artificial Sequence
  Synthetic oligonucleotide
tagcccaccgtcccccagttgaatctctgcgtgtc

SEQ ID NO: 180674 - DNA, 35 bp, Artificial Sequence
  Synthetic oligonucleotide
ttggccccctccggacgtagtactctggcacattc

SEQ ID NO: 180675 - DNA, 35 bp, Artificial Sequence
  Synthetic oligonucleotide
accgctacgcctccctacgcccgacgagttccttc

SEQ ID NO: 180676 - DNA, 35 bp, Artificial Sequence
  Synthetic oligonucleotide
tcaccgcactaatattcgctgcctgttctggtttc

SEQ ID NO: 180677 - DNA, 35 bp, Artificial Sequence
  Synthetic oligonucleotide
tcacgggcgaccgcctttcatcctcagtgcttttc

SEQ ID NO: 180678 - DNA, 35 bp, Artificial Sequence
  Synthetic oligonucleotide
tttgacgtgacttatccctgtgcgatcctgttccg

SEQ ID NO: 180679 - DNA, 35 bp, Artificial Sequence
  Synthetic oligonucleotide
aacacacacgcctacccgcttatcgagactctgcg

SEQ ID NO: 180680 - DNA, 35 bp, Artificial Sequence
  Synthetic oligonucleotide
tgcaacccgcccttacgttgtagtccctctcctcg

SEQ ID NO: 180681 - DNA, 35 bp, Artificial Sequence
  Synthetic oligonucleotide
gttcagcccacgcatcatgcaccttaacctgctcg

SEQ ID NO: 180682 - DNA, 35 bp, Artificial Sequence
  Synthetic oligonucleotide
gggggcggtggtggcggtttgtgggcggggatagg

SEQ ID NO: 180683 - DNA, 35 bp, Artificial Sequence
  Synthetic oligonucleotide
taacagagcaaggacgggcggttacggggggacgg

SEQ ID NO: 180684 - DNA, 35 bp, Artificial Sequence
  Synthetic oligonucleotide
tctcaccgcctccttactacccgcttcctgcgatg

SEQ ID NO: 180685 - DNA, 35 bp, Artificial Sequence
  Synthetic oligonucleotide
tgcacgccctgtacttcccagatccgtcgctactg

SEQ ID NO: 180686 - DNA, 35 bp, Artificial Sequence
  Synthetic oligonucleotide
tgcttccccgtcccgctttatggcttctgctactg

SEQ ID NO: 180687 - DNA, 35 bp, Artificial Sequence
  Synthetic oligonucleotide
actgaggagggatcgggagagatatgggttcggtg

SEQ ID NO: 180688 - DNA, 35 bp, Artificial Sequence
  Synthetic oligonucleotide
ttggcctcgttaaatcgcttttgtccccccccttg

SEQ ID NO: 180689 - DNA, 35 bp, Artificial Sequence
  Synthetic oligonucleotide
gctagccgcccccgcaccgtactgacccatcgcat

SEQ ID NO: 180690 - DNA, 35 bp, Artificial Sequence
  Synthetic oligonucleotide
ttccaggtcgctgtggggcttctctctctcttcat

SEQ ID NO: 180691 - DNA, 35 bp, Artificial Sequence
  Synthetic oligonucleotide
tccaacaccgaccgtccttctttcgccctactgat

SEQ ID NO: 180692 - DNA, 34 bp, Artificial Sequence
  Synthetic oligonucleotide
tgttcccccaagttctgttattccacatcactat

SEQ ID NO: 180693 - DNA, 35 bp, Artificial Sequence
  Synthetic oligonucleotide
aattactcaggcacccgccctgccgttctatctat

SEQ ID NO: 180694 - DNA, 35 bp, Artificial Sequence
  Synthetic oligonucleotide
gccaaaacaccgcccaggggtctctctgccctact

SEQ ID NO: 180695 - DNA, 35 bp, Artificial Sequence
  Synthetic oligonucleotide
gcccctgaccgctatatactgcatactccctccct

SEQ ID NO: 180696 - DNA, 35 bp, Artificial Sequence
  Synthetic oligonucleotide
acctccctgtctgcagtctcttttaccccgtccct

SEQ ID NO: 180697 - DNA, 35 bp, Artificial Sequence
  Synthetic oligonucleotide
agaccccgctcttcggttcctttcccgtcctcgct

SEQ ID NO: 180698 - DNA, 30 bp, Artificial Sequence
  Synthetic oligonucleotide
ttgttcccccatccagctgggactatatct

SEQ ID NO: 180699 - DNA, 35 bp, Artificial Sequence
  Synthetic oligonucleotide
ttcgtgctggcgacttccacgtccctgagccctct

SEQ ID NO: 180700 - DNA, 35 bp, Artificial Sequence
  Synthetic oligonucleotide
tccgccccgaccctacattgtggagtgtaccttct

SEQ ID NO: 180701 - DNA, 35 bp, Artificial Sequence
  Synthetic oligonucleotide
ttgaccacctctcgcgcccactcgtgctgtgttct

SEQ ID NO: 180702 - DNA, 35 bp, Artificial Sequence
  Synthetic oligonucleotide
tcagtgctcgctagctgccaccctgcctataccgt

SEQ ID NO: 180703 - DNA, 35 bp, Artificial Sequence
  Synthetic oligonucleotide
tactcgcttgcacgccgcttaaaccttgcctccgt

SEQ ID NO: 180704 - DNA, 35 bp, Artificial Sequence
  Synthetic oligonucleotide
gcgctccgccacacctgcctgtttgtccctagggt

SEQ ID NO: 180705 - DNA, 35 bp, Artificial Sequence
  Synthetic oligonucleotide
tgccccacctcgcccggatctcactagtagtctgt

SEQ ID NO: 180706 - DNA, 35 bp, Artificial Sequence
  Synthetic oligonucleotide
atcacgtctctgtccagttcctgtctccgtgcatt

SEQ ID NO: 180707 - DNA, 35 bp, Artificial Sequence
  Synthetic oligonucleotide
gccccatctatcctctttgtgatccccgagaactt

SEQ ID NO: 180708 - DNA, 35 bp, Artificial Sequence
  Synthetic oligonucleotide
tacgccccgcctctcgcccgtgcagatttcctctt

SEQ ID NO: 180709 - DNA, 35 bp, Artificial Sequence
  Synthetic oligonucleotide
acgacccgtcacatccgttcaatgcgcgcacgttt

SEQ ID NO: 180710 - DNA, 35 bp, Artificial Sequence
  Synthetic oligonucleotide
gtaccccgctggaattgctgttcacggtccatttt

SEQ ID NO: 180711 - DNA, 35 bp, Artificial Sequence
  Synthetic oligonucleotide
tgtaccatcccggcctgtgcacttgtctcgctttt

SEQ ID NO: 180712 - DNA, 36 bp, Artificial Sequence
  Synthetic oligonucleotide
acagtccagggtggcattatgtgggtggggcggcaa

SEQ ID NO: 180713 - DNA, 35 bp, Artificial Sequence
  Synthetic oligonucleotide
gaggaggagggggctcggggtataaaggggatgaa

SEQ ID NO: 180714 - DNA, 36 bp, Artificial Sequence
  Synthetic oligonucleotide
gtacgcccgccacctgattgcttgcatcatacctaa

SEQ ID NO: 180715 - DNA, 35 bp, Artificial Sequence
  Synthetic oligonucleotide
agacgaggaggtgccggggggagggcgtagtctaa

SEQ ID NO: 180716 - DNA, 35 bp, Artificial Sequence
  Synthetic oligonucleotide
acttctacaccggattgttaacgccctcccgcaca

SEQ ID NO: 180717 - DNA, 35 bp, Artificial Sequence
  Synthetic oligonucleotide
actgtagctgcccagcccccgccctaggtcgcaca

SEQ ID NO: 180718 - DNA, 35 bp, Artificial Sequence
  Synthetic oligonucleotide
aagtcgggacatccgacgggtgggcgggaattaca

SEQ ID NO: 180719 - DNA, 36 bp, Artificial Sequence
  Synthetic oligonucleotide
gaagccaggccgtaccgacgtacttttcatccccca

SEQ ID NO: 180720 - DNA, 36 bp, Artificial Sequence
  Synthetic oligonucleotide
gcgcccctcaggctccatcttaaatctgtccgccca

SEQ ID NO: 180721 - DNA, 36 bp, Artificial Sequence
  Synthetic oligonucleotide
tctccccccccccatgattgacccactgcgttccca

SEQ ID NO: 180722 - DNA, 36 bp, Artificial Sequence
  Synthetic oligonucleotide
gattgatgcctctctccgtgctatgttcacgtgcca

SEQ ID NO: 180723 - DNA, 35 bp, Artificial Sequence
  Synthetic oligonucleotide
tcattgcaccatccgaccgtaccgcatgtcctcca

SEQ ID NO: 180724 - DNA, 35 bp, Artificial Sequence
  Synthetic oligonucleotide
ttccggtatccctcccgccgtgaccttacattcca

SEQ ID NO: 180725 - DNA, 35 bp, Artificial Sequence
  Synthetic oligonucleotide
tcaggtctctcattcgtgcttacactccacccgca

SEQ ID NO: 180726 - DNA, 36 bp, Artificial Sequence
  Synthetic oligonucleotide
ttccaccacgttcgtaactgtttcgccagtatatca

SEQ ID NO: 180727 - DNA, 36 bp, Artificial Sequence
  Synthetic oligonucleotide
gcagggtcgcctgtcatatcacccgtcttatcctca

SEQ ID NO: 180728 - DNA, 36 bp, Artificial Sequence
  Synthetic oligonucleotide
agtggaggaaggggattaggggcgaaattagggtca

SEQ ID NO: 180729 - DNA, 36 bp, Artificial Sequence
  Synthetic oligonucleotide
gaccctcgctcccattgtagttgctactaatgttca

SEQ ID NO: 180730 - DNA, 36 bp, Artificial Sequence
  Synthetic oligonucleotide
tagcgcaatcccgcccttaattcccatgttgtttca

SEQ ID NO: 180731 - DNA, 37 bp, Artificial Sequence
  Synthetic oligonucleotide
tcaggaggtagagcagggtagggtttgacgggtcaga

SEQ ID NO: 180732 - DNA, 37 bp, Artificial Sequence
  Synthetic oligonucleotide
aagacgtgactgttgtaggggacgtgagggagggaga

SEQ ID NO: 180733 - DNA, 36 bp, Artificial Sequence
  Synthetic oligonucleotide
atgtcccttgcgcccctgctcaatcgcctctcacga

SEQ ID NO: 180734 - DNA, 37 bp, Artificial Sequence
  Synthetic oligonucleotide
tggacccccgccaccttgacatcgccaacagtcacga

SEQ ID NO: 180735 - DNA, 37 bp, Artificial Sequence
  Synthetic oligonucleotide
tgcatggcccatctttttccgtacgctcaccgaccga

SEQ ID NO: 180736 - DNA, 37 bp, Artificial Sequence
  Synthetic oligonucleotide
tacagcctgtgccgtcttaacgttttctcccccccga

SEQ ID NO: 180737 - DNA, 37 bp, Artificial Sequence
  Synthetic oligonucleotide
acccgcggtgcggatgcctgcgccccactttgcccga

SEQ ID NO: 180738 - DNA, 37 bp, Artificial Sequence
  Synthetic oligonucleotide
gatccctgtccatttactcgaacagctacccgttcga

SEQ ID NO: 180739 - DNA, 36 bp, Artificial Sequence
  Synthetic oligonucleotide
accccccgccgttcgttctattcttcgcgacaagga

SEQ ID NO: 180740 - DNA, 37 bp, Artificial Sequence
  Synthetic oligonucleotide
tccgccccactagttgttgccacgggacccctccgga

SEQ ID NO: 180741 - DNA, 37 bp, Artificial Sequence
  Synthetic oligonucleotide
aagcggaaatagggaggggcgaaaaggggggtgcgga

SEQ ID NO: 180742 - DNA, 37 bp, Artificial Sequence
  Synthetic oligonucleotide
gagggggggccacgcgggggtaatgagatgccgggga

SEQ ID NO: 180743 - DNA, 37 bp, Artificial Sequence
  Synthetic oligonucleotide
ggtgagacgtaaagccgtagggcgggggggaatggga

SEQ ID NO: 180744 - DNA, 37 bp, Artificial Sequence
  Synthetic oligonucleotide
gtgcggggggggcaggggatggcttggggagctggga

SEQ ID NO: 180745 - DNA, 37 bp, Artificial Sequence
  Synthetic oligonucleotide
tgtcctccacacaccgtattatatgccaaccgctgga

SEQ ID NO: 180746 - DNA, 37 bp, Artificial Sequence
  Synthetic oligonucleotide
tcaatgggggagggatagggggtgagaataatgtgga

SEQ ID NO: 180747 - DNA, 38 bp, Artificial Sequence
  Synthetic oligonucleotide
ggccccccctgcctagtcactgtccgccttccccatga

SEQ ID NO: 180748 - DNA, 37 bp, Artificial Sequence
  Synthetic oligonucleotide
acccggatcgggcgggagggaacgggcaaggctatga

SEQ ID NO: 180749 - DNA, 38 bp, Artificial Sequence
  Synthetic oligonucleotide
aacgcccccagattgctcgcccatcgaccgccacctga

SEQ ID NO: 180750 - DNA, 35 bp, Artificial Sequence
  Synthetic oligonucleotide
acctcgaccctaccctggcacatccgttcgcctga

SEQ ID NO: 180751 - DNA, 37 bp, Artificial Sequence
  Synthetic oligonucleotide
gtttcccccccgtattacccaatgtgcccgctcctga

SEQ ID NO: 180752 - DNA, 38 bp, Artificial Sequence
  Synthetic oligonucleotide
gaatgaaaagggtgggaggcggaaacagtggcgagtga

SEQ ID NO: 180753 - DNA, 38 bp, Artificial Sequence
  Synthetic oligonucleotide
tcgaggcggggcataggtgtatgggcgggtgggagtga

SEQ ID NO: 180754 - DNA, 38 bp, Artificial Sequence
  Synthetic oligonucleotide
gtccgcgcgctgccctactttgctcccccctatggtga

SEQ ID NO: 180755 - DNA, 36 bp, Artificial Sequence
  Synthetic oligonucleotide
gtcgagtcgcccccctggtttgattcccgttgttga

SEQ ID NO: 180756 - DNA, 36 bp, Artificial Sequence
  Synthetic oligonucleotide
gcagtacgacgcatactgacccgcctcggcctttga

SEQ ID NO: 180757 - DNA, 37 bp, Artificial Sequence
  Synthetic oligonucleotide
gccgccctgcaccgtgcttcacctctaccttctttga

SEQ ID NO: 180758 - DNA, 36 bp, Artificial Sequence
  Synthetic oligonucleotide
tgcacactcttgtctatcactgctgcactctatata

SEQ ID NO: 180759 - DNA, 34 bp, Artificial Sequence
  Synthetic oligonucleotide
tccgcctgctgtttttatgtcgccccccattata

SEQ ID NO: 180760 - DNA, 36 bp, Artificial Sequence
  Synthetic oligonucleotide
tcaccggtcagtgttatgtttcgtccccttcgcgta

SEQ ID NO: 180761 - DNA, 36 bp, Artificial Sequence
  Synthetic oligonucleotide
tgtaagcaggtagggtgggaaatggcgggcgggtta

SEQ ID NO: 180762 - DNA, 36 bp, Artificial Sequence
  Synthetic oligonucleotide
tacgaccccgcaagcaccgccctcgccgacgattta

SEQ ID NO: 180763 - DNA, 36 bp, Artificial Sequence
  Synthetic oligonucleotide
acagtcaccccctcgtcggcgctactagctacttta

SEQ ID NO: 180764 - DNA, 36 bp, Artificial Sequence
  Synthetic oligonucleotide
gccgttcgttgagcctcttgtctcgtgcctgcttta

SEQ ID NO: 180765 - DNA, 36 bp, Artificial Sequence
  Synthetic oligonucleotide
accccccccccagcgatggcaccatctcgacctcac

SEQ ID NO: 180766 - DNA, 35 bp, Artificial Sequence
  Synthetic oligonucleotide
atctgccgctgctctacatcaccccgtggccttac

SEQ ID NO: 180767 - DNA, 35 bp, Artificial Sequence
  Synthetic oligonucleotide
gtcgacttcccagaccgcgcttatcgacgatttac

SEQ ID NO: 180768 - DNA, 35 bp, Artificial Sequence
  Synthetic oligonucleotide
acgacctcatgctcccctcccagatccggaccacc

SEQ ID NO: 180769 - DNA, 35 bp, Artificial Sequence
  Synthetic oligonucleotide
tcctaatgcgcccacttcgttcattacatcttacc

SEQ ID NO: 180770 - DNA, 34 bp, Artificial Sequence
  Synthetic oligonucleotide
gcctgtccgcgcgtgcgctctgctattcataccc

SEQ ID NO: 180771 - DNA, 35 bp, Artificial Sequence
  Synthetic oligonucleotide
actctgcggtcgtccaccttcagtatttttccccc

SEQ ID NO: 180772 - DNA, 35 bp, Artificial Sequence
  Synthetic oligonucleotide
ttgtgcgtcctcccgccatccatccgtctgtcgcc

SEQ ID NO: 180773 - DNA, 35 bp, Artificial Sequence
  Synthetic oligonucleotide
tccagcactctggcccacatgtatgcaatttcgcc

SEQ ID NO: 180774 - DNA, 35 bp, Artificial Sequence
  Synthetic oligonucleotide
gcccaaccccgtgcatgcacatcaagcttcctgcc

SEQ ID NO: 180775 - DNA, 35 bp, Artificial Sequence
  Synthetic oligonucleotide
agacacccttatgaacactcgacactctcgcctcc

SEQ ID NO: 180776 - DNA, 35 bp, Artificial Sequence
  Synthetic oligonucleotide
tcatcccaagccgcctatcaccttgtacatgctcc

SEQ ID NO: 180777 - DNA, 35 bp, Artificial Sequence
  Synthetic oligonucleotide
tacagtcagtgaagcgcccctgcccttactgctcc

SEQ ID NO: 180778 - DNA, 35 bp, Artificial Sequence
  Synthetic oligonucleotide
gtaggccgagcggttctatgctccttctagtctcc

SEQ ID NO: 180779 - DNA, 35 bp, Artificial Sequence
  Synthetic oligonucleotide
ttcccgcccgacgtccctgcccggaagcgaggtcc

SEQ ID NO: 180780 - DNA, 36 bp, Artificial Sequence
  Synthetic oligonucleotide
accacgctacggatttttccaagctctgtgccttcc

SEQ ID NO: 180781 - DNA, 35 bp, Artificial Sequence
  Synthetic oligonucleotide
tcaccccccacgactgtccctcaaccttctccagc

SEQ ID NO: 180782 - DNA, 35 bp, Artificial Sequence
  Synthetic oligonucleotide
ggtgctccttcggtactatcagccttttcacacgc

SEQ ID NO: 180783 - DNA, 35 bp, Artificial Sequence
  Synthetic oligonucleotide
gccccccgcgctgtcccacgtttcacctttaccgc

SEQ ID NO: 180784 - DNA, 35 bp, Artificial Sequence
  Synthetic oligonucleotide
agtcttcacgtcaccattctttattgcacctccgc

SEQ ID NO: 180785 - DNA, 29 bp, Artificial Sequence
  Synthetic oligonucleotide
agcccgtcacacctcccatctcccctcgc

SEQ ID NO: 180786 - DNA, 34 bp, Artificial Sequence
  Synthetic oligonucleotide
tacacctactcgttcacctgctccgcgcccaggc

SEQ ID NO: 180787 - DNA, 35 bp, Artificial Sequence
  Synthetic oligonucleotide
acgccctcgcacctagtctcgccgaccatccatgc

SEQ ID NO: 180788 - DNA, 35 bp, Artificial Sequence
  Synthetic oligonucleotide
gcgcactctgctttactactcgagttcttttcatc

SEQ ID NO: 180789 - DNA, 35 bp, Artificial Sequence
  Synthetic oligonucleotide
gtctctcagcagtcagttctttttttggcccactc

SEQ ID NO: 180790 - DNA, 35 bp, Artificial Sequence
  Synthetic oligonucleotide
taggacaccgcggttctcgtccatcttactcactc

SEQ ID NO: 180791 - DNA, 35 bp, Artificial Sequence
  Synthetic oligonucleotide
gaagccgctcggcgaatgcccccatacgaatcctc

SEQ ID NO: 180792 - DNA, 35 bp, Artificial Sequence
  Synthetic oligonucleotide
tgcgcaccctctgcaccctgttcacgcccatcgtc

SEQ ID NO: 180793 - DNA, 35 bp, Artificial Sequence
  Synthetic oligonucleotide
gcactcattcgctattcctctggatcccgccggtc

SEQ ID NO: 180794 - DNA, 35 bp, Artificial Sequence
  Synthetic oligonucleotide
tggtcaccttccaaagccccagtcccgtcctggtc

SEQ ID NO: 180795 - DNA, 35 bp, Artificial Sequence
  Synthetic oligonucleotide
ttgtgttgccccgctaaatagccacccgatatgtc

SEQ ID NO: 180796 - DNA, 35 bp, Artificial Sequence
  Synthetic oligonucleotide
gatcagtcctcacatgccttctttgcacagctgtc

SEQ ID NO: 180797 - DNA, 35 bp, Artificial Sequence
  Synthetic oligonucleotide
gtgagcacccctaatctgctttctttcgacttgtc

SEQ ID NO: 180798 - DNA, 35 bp, Artificial Sequence
  Synthetic oligonucleotide
attcacgcgcgctccattcacctgtgctgtcattc

SEQ ID NO: 180799 - DNA, 35 bp, Artificial Sequence
  Synthetic oligonucleotide
ttgcggatcgcgtttccaatgcactgtccaccttc

SEQ ID NO: 180800 - DNA, 35 bp, Artificial Sequence
  Synthetic oligonucleotide
taatccgcggatgcttgtgtcgtcttccatccttc

SEQ ID NO: 180801 - DNA, 35 bp, Artificial Sequence
  Synthetic oligonucleotide
gccacatttctctgtagtgcccccatcccttcttc

SEQ ID NO: 180802 - DNA, 35 bp, Artificial Sequence
  Synthetic oligonucleotide
tgttgtctcccgcagctcttttcaatccctggttc

SEQ ID NO: 180803 - DNA, 35 bp, Artificial Sequence
  Synthetic oligonucleotide
acccacccgccactatcaggtacaggcgacatttc

SEQ ID NO: 180804 - DNA, 36 bp, Artificial Sequence
  Synthetic oligonucleotide
gtgctatgcaaggggggtggaaccggagcgtgtgag

SEQ ID NO: 180805 - DNA, 35 bp, Artificial Sequence
  Synthetic oligonucleotide
gctcgaccctcaccgcccccacgaatcgcccatag

SEQ ID NO: 180806 - DNA, 35 bp, Artificial Sequence
  Synthetic oligonucleotide
tacgccgaactggcgacatccccctgctattttag

SEQ ID NO: 180807 - DNA, 35 bp, Artificial Sequence
  Synthetic oligonucleotide
gccaccttcacattgaatcctcgtgtctctctccg

SEQ ID NO: 180808 - DNA, 35 bp, Artificial Sequence
  Synthetic oligonucleotide
agacgtctgtcctcccttatgtcatgtacccatcg

SEQ ID NO: 180809 - DNA, 35 bp, Artificial Sequence
  Synthetic oligonucleotide
ggagctatcatcgtacactcccccatgccccatcg

SEQ ID NO: 180810 - DNA, 35 bp, Artificial Sequence
  Synthetic oligonucleotide
gtgaatagaggggggtgtgaggggccagggtaggg

SEQ ID NO: 180811 - DNA, 35 bp, Artificial Sequence
  Synthetic oligonucleotide
gccgcctcccccagtcgtaaggatgtcctgcctgg

SEQ ID NO: 180812 - DNA, 35 bp, Artificial Sequence
  Synthetic oligonucleotide
tgcctgtgcactcgtgtgccccctcccccttcctg

SEQ ID NO: 180813 - DNA, 35 bp, Artificial Sequence
  Synthetic oligonucleotide
acccctatgcaacccctgtttttccgatcaccgtg

SEQ ID NO: 180814 - DNA, 35 bp, Artificial Sequence
  Synthetic oligonucleotide
ggggtgtcgtgggggcggtggatatggggagtgtg

SEQ ID NO: 180815 - DNA, 35 bp, Artificial Sequence
  Synthetic oligonucleotide
tgagtccgccacctctcgcccgaaacgaactgcat

SEQ ID NO: 180816 - DNA, 35 bp, Artificial Sequence
  Synthetic oligonucleotide
acaatagcagtgcaggggggatggggcggaaatat

SEQ ID NO: 180817 - DNA, 35 bp, Artificial Sequence
  Synthetic oligonucleotide
tgccatcgcgcacccgccctgaccggaccaacact

SEQ ID NO: 180818 - DNA, 35 bp, Artificial Sequence
  Synthetic oligonucleotide
tcatgtacagttccacgcgtgtcgactcactccct

SEQ ID NO: 180819 - DNA, 35 bp, Artificial Sequence
  Synthetic oligonucleotide
tcacacccaacttgatcgaggatagcatcccgcct

SEQ ID NO: 180820 - DNA, 35 bp, Artificial Sequence
  Synthetic oligonucleotide
tcacagcatccgtccataatcctttgctcgcgcct

SEQ ID NO: 180821 - DNA, 35 bp, Artificial Sequence
  Synthetic oligonucleotide
gtagtgcttcaccataaggccatcctgctcctcct

SEQ ID NO: 180822 - DNA, 35 bp, Artificial Sequence
  Synthetic oligonucleotide
gccgcccatcaccgttcatagtcgatcatcttcct

SEQ ID NO: 180823 - DNA, 35 bp, Artificial Sequence
  Synthetic oligonucleotide
attccactcgcctacatattggatgtctggttcct

SEQ ID NO: 180824 - DNA, 35 bp, Artificial Sequence
  Synthetic oligonucleotide
tctatcccccctgccgtcgcgagtcgactccatct

SEQ ID NO: 180825 - DNA, 35 bp, Artificial Sequence
  Synthetic oligonucleotide
tcaaaacacgtccctttgcgctctaacttccatct

SEQ ID NO: 180826 - DNA, 35 bp, Artificial Sequence
  Synthetic oligonucleotide
gtaactacagcacgttcccttatgctccccactct

SEQ ID NO: 180827 - DNA, 35 bp, Artificial Sequence
  Synthetic oligonucleotide
tgagatgcagaagtggggaaggatgcaaaggaagt

SEQ ID NO: 180828 - DNA, 35 bp, Artificial Sequence
  Synthetic oligonucleotide
ttgtaggccatcgtgttgttcgttccatccccagt

SEQ ID NO: 180829 - DNA, 35 bp, Artificial Sequence
  Synthetic oligonucleotide
acccacgacttcctcccgcccggcacccgaccggt

SEQ ID NO: 180830 - DNA, 35 bp, Artificial Sequence
  Synthetic oligonucleotide
tgccatgaacctgccctactttatagcccccatgt

SEQ ID NO: 180831 - DNA, 35 bp, Artificial Sequence
  Synthetic oligonucleotide
gcacagccccttgcacttcttcgccttgcccttgt

SEQ ID NO: 180832 - DNA, 35 bp, Artificial Sequence
  Synthetic oligonucleotide
tacgccctacctcatctcgacacaagacgacgatt

SEQ ID NO: 180833 - DNA, 34 bp, Artificial Sequence
  Synthetic oligonucleotide
acgcacgacagcactcacctccgctgcccctttt

SEQ ID NO: 180834 - DNA, 36 bp, Artificial Sequence
  Synthetic oligonucleotide
aagaggagggaacgggaacggagtaataaggtcaaa

SEQ ID NO: 180835 - DNA, 36 bp, Artificial Sequence
  Synthetic oligonucleotide
gccctccgcacatgcataccctgatacgttccgaaa

SEQ ID NO: 180836 - DNA, 36 bp, Artificial Sequence
  Synthetic oligonucleotide
tcctgccacatctcccatcttatcgtgagttggtaa

SEQ ID NO: 180837 - DNA, 35 bp, Artificial Sequence
  Synthetic oligonucleotide
tcacaggcctcattcccgcgtttgcctccgtcaca

SEQ ID NO: 180838 - DNA, 36 bp, Artificial Sequence
  Synthetic oligonucleotide
gccccctccccacttaatgtgctctattgttgtaca

SEQ ID NO: 180839 - DNA, 35 bp, Artificial Sequence
  Synthetic oligonucleotide
actgccgccctcacatcgtagtgatcgcacgccca

SEQ ID NO: 180840 - DNA, 36 bp, Artificial Sequence
  Synthetic oligonucleotide
acccaacgatccccctgtttaactgaagtccatcca

SEQ ID NO: 180841 - DNA, 35 bp, Artificial Sequence
  Synthetic oligonucleotide
tcacgacttgagctgttgccactgttttccatcca

SEQ ID NO: 180842 - DNA, 36 bp, Artificial Sequence
  Synthetic oligonucleotide
tgtcccctacccagctgacgcgattcggcctctcca

SEQ ID NO: 180843 - DNA, 36 bp, Artificial Sequence
  Synthetic oligonucleotide
gtgccacctcccgttgtggcttgacgcacacttcca

SEQ ID NO: 180844 - DNA, 36 bp, Artificial Sequence
  Synthetic oligonucleotide
gagtacccgtccccctgccgtccaagagttagcgca

SEQ ID NO: 180845 - DNA, 35 bp, Artificial Sequence
  Synthetic oligonucleotide
ttgggattgggtggaggtgggaagggtgcagggca

SEQ ID NO: 180846 - DNA, 36 bp, Artificial Sequence
  Synthetic oligonucleotide
gatcgggtggagggcatgggtagaggtaacaaatca

SEQ ID NO: 180847 - DNA, 35 bp, Artificial Sequence
  Synthetic oligonucleotide
tatcgatccaccaggccgctggcgtattccactca

SEQ ID NO: 180848 - DNA, 35 bp, Artificial Sequence
  Synthetic oligonucleotide
tgaccttcacatcatacttggtccgtattacctca

SEQ ID NO: 180849 - DNA, 36 bp, Artificial Sequence
  Synthetic oligonucleotide
tcccgtcagggtcccttgtcgcccacaaccccctca

SEQ ID NO: 180850 - DNA, 35 bp, Artificial Sequence
  Synthetic oligonucleotide
ttgaagcgcgcccaccgacccagctgccactctca

SEQ ID NO: 180851 - DNA, 36 bp, Artificial Sequence
  Synthetic oligonucleotide
gaacacaccgccatggcccgtagaactacccattca

SEQ ID NO: 180852 - DNA, 35 bp, Artificial Sequence
  Synthetic oligonucleotide
acccgcccccgcctccgttcactcacggaatttca

SEQ ID NO: 180853 - DNA, 36 bp, Artificial Sequence
  Synthetic oligonucleotide
gttgcacaagaagaagataggaggagaggaggaaga

SEQ ID NO: 180854 - DNA, 37 bp, Artificial Sequence
  Synthetic oligonucleotide
ggaacggcgagagcggggggaacgtgagaacgtcaga

SEQ ID NO: 180855 - DNA, 37 bp, Artificial Sequence
  Synthetic oligonucleotide
actcgacccgctccctcatggaacatctgtccgtaga

SEQ ID NO: 180856 - DNA, 37 bp, Artificial Sequence
  Synthetic oligonucleotide
gccggaacggcagggttagggggggaggatgcttaga

SEQ ID NO: 180857 - DNA, 37 bp, Artificial Sequence
  Synthetic oligonucleotide
tgacacctcgaacctaactaagcccactctgctacga

SEQ ID NO: 180858 - DNA, 37 bp, Artificial Sequence
  Synthetic oligonucleotide
tccttcgccgcacagccccttatgacccacgccccga

SEQ ID NO: 180859 - DNA, 37 bp, Artificial Sequence
  Synthetic oligonucleotide
acgtgtagaggccattgctgttcccttcctcctccga

SEQ ID NO: 180860 - DNA, 37 bp, Artificial Sequence
  Synthetic oligonucleotide
gcctcgacgggcacgtgcaccacttccatctatagga

SEQ ID NO: 180861 - DNA, 37 bp, Artificial Sequence
  Synthetic oligonucleotide
gcaaaacagaggtggacagcgaggcggggggaacgga

SEQ ID NO: 180862 - DNA, 37 bp, Artificial Sequence
  Synthetic oligonucleotide
ggaacagaaagcatggtggagggctaggcgggacgga

SEQ ID NO: 180863 - DNA, 37 bp, Artificial Sequence
  Synthetic oligonucleotide
gaataaggaggagggtacgatgaaaggcgggtacgga

SEQ ID NO: 180864 - DNA, 37 bp, Artificial Sequence
  Synthetic oligonucleotide
atgtgcgcgtaaaggggaggttgggggaccgggcgga

SEQ ID NO: 180865 - DNA, 37 bp, Artificial Sequence
  Synthetic oligonucleotide
aacacgggcggggttgtgttttgttggggagagggga

SEQ ID NO: 180866 - DNA, 37 bp, Artificial Sequence
  Synthetic oligonucleotide
gcccggtcggggtgtcctaggggcgcgtattagggga

SEQ ID NO: 180867 - DNA, 37 bp, Artificial Sequence
  Synthetic oligonucleotide
tgatgcgacgggagatcaactgggacggacgggggga

SEQ ID NO: 180868 - DNA, 37 bp, Artificial Sequence
  Synthetic oligonucleotide
acacggtgatagcagggaggagggagcctggtgggga

SEQ ID NO: 180869 - DNA, 37 bp, Artificial Sequence
  Synthetic oligonucleotide
aagtctgcacgcaactgggtgggggggcaaaatggga

SEQ ID NO: 180870 - DNA, 37 bp, Artificial Sequence
  Synthetic oligonucleotide
tactcccccaccgcctacgtccagttcattttgtgga

SEQ ID NO: 180871 - DNA, 35 bp, Artificial Sequence
  Synthetic oligonucleotide
gcccctccagctttcctattaccactgcatttgga

SEQ ID NO: 180872 - DNA, 38 bp, Artificial Sequence
  Synthetic oligonucleotide
tagtgacggaggaggggaatgattgatgggtcgaatga

SEQ ID NO: 180873 - DNA, 38 bp, Artificial Sequence
  Synthetic oligonucleotide
tgatgtcgctcagcttcccccgtcccgtgtcaccatga

SEQ ID NO: 180874 - DNA, 36 bp, Artificial Sequence
  Synthetic oligonucleotide
tgacggaacgtttgggcgggagggaagtgggtatga

SEQ ID NO: 180875 - DNA, 38 bp, Artificial Sequence
  Synthetic oligonucleotide
tccatcctgcccacggttcatcgccacgtactcactga

SEQ ID NO: 180876 - DNA, 38 bp, Artificial Sequence
  Synthetic oligonucleotide
gtacgtcccccgcccctcgttcataagtactaacctga

SEQ ID NO: 180877 - DNA, 38 bp, Artificial Sequence
  Synthetic oligonucleotide
tcaccaccgcctgttgccccacatatcaccccgcctga

SEQ ID NO: 180878 - DNA, 38 bp, Artificial Sequence
  Synthetic oligonucleotide
tcatccgtcacactcccgcacacaagccgcccgcctga

SEQ ID NO: 180879 - DNA, 38 bp, Artificial Sequence
  Synthetic oligonucleotide
agagggaggtgtgaggcttggggaagaacgggggctga

SEQ ID NO: 180880 - DNA, 37 bp, Artificial Sequence
  Synthetic oligonucleotide
aattgccgcctcccccgcttcatacgacgcctgctga

SEQ ID NO: 180881 - DNA, 38 bp, Artificial Sequence
  Synthetic oligonucleotide
tgtgtctacgtcacccgttccctcgtctattctgctga

SEQ ID NO: 180882 - DNA, 35 bp, Artificial Sequence
  Synthetic oligonucleotide
gtatggggggtggacgggagcaaaacgacgcgtga

SEQ ID NO: 180883 - DNA, 38 bp, Artificial Sequence
  Synthetic oligonucleotide
accccctccatatgaagtcccgttgcccctccgcttga

SEQ ID NO: 180884 - DNA, 38 bp, Artificial Sequence
  Synthetic oligonucleotide
tcctaacagcctccctcgcattgtactgtacctcttga

SEQ ID NO: 180885 - DNA, 38 bp, Artificial Sequence
  Synthetic oligonucleotide
cccgagcccgtcgagtccgatccctgcacctccgttga

SEQ ID NO: 180886 - DNA, 38 bp, Artificial Sequence
  Synthetic oligonucleotide
gtcggacgggggggtggggcgagtaaagaggaggttga

SEQ ID NO: 180887 - DNA, 38 bp, Artificial Sequence
  Synthetic oligonucleotide
gtcagccacaggtctgcatcccatccacgcttctttga

SEQ ID NO: 180888 - DNA, 36 bp, Artificial Sequence
  Synthetic oligonucleotide
ggacagtttcaggaggagggggggcgtgtagggata

SEQ ID NO: 180889 - DNA, 36 bp, Artificial Sequence
  Synthetic oligonucleotide
aaaggggggggagtggtgaggttaagtacggtgata

SEQ ID NO: 180890 - DNA, 35 bp, Artificial Sequence
  Synthetic oligonucleotide
tatcgcccgccaccccctctccgcaccagtgacta

SEQ ID NO: 180891 - DNA, 32 bp, Artificial Sequence
  Synthetic oligonucleotide
accgaccctatttacactgtatttgtttccta

SEQ ID NO: 180892 - DNA, 35 bp, Artificial Sequence
  Synthetic oligonucleotide
gaacagggtgggtggggtgtgtggtaggtatgcta

SEQ ID NO: 180893 - DNA, 36 bp, Artificial Sequence
  Synthetic oligonucleotide
accccacgcccgtgcaccctgaattggcctactcta

SEQ ID NO: 180894 - DNA, 36 bp, Artificial Sequence
  Synthetic oligonucleotide
tcaggggttcgggggggaaatacgggaaacggtcta

SEQ ID NO: 180895 - DNA, 36 bp, Artificial Sequence
  Synthetic oligonucleotide
gaccaggtcaccccgtcaaatcccgttgcctccgta

SEQ ID NO: 180896 - DNA, 36 bp, Artificial Sequence
  Synthetic oligonucleotide
gcaccactgtctctgcatccaggttccatcgtgtta

SEQ ID NO: 180897 - DNA, 36 bp, Artificial Sequence
  Synthetic oligonucleotide
tgcccctgcagcagacctcctctaagcacaccttta

SEQ ID NO: 180898 - DNA, 36 bp, Artificial Sequence
  Synthetic oligonucleotide
acgtccccccgtcgttggcctcacactcgcccttta

SEQ ID NO: 180899 - DNA, 35 bp, Artificial Sequence
  Synthetic oligonucleotide
gtcaacccgccctccggtcacagttataggtccac

SEQ ID NO: 180900 - DNA, 35 bp, Artificial Sequence
  Synthetic oligonucleotide
cacccactcatgtgcgcccccttgtccccgctgac

SEQ ID NO: 180901 - DNA, 35 bp, Artificial Sequence
  Synthetic oligonucleotide
tacttccctcctgccatcgtacgcgttcaccctac

SEQ ID NO: 180902 - DNA, 35 bp, Artificial Sequence
  Synthetic oligonucleotide
ttgccaccggatgtctcgcgccctgccctgtaccc

SEQ ID NO: 180903 - DNA, 35 bp, Artificial Sequence
  Synthetic oligonucleotide
acaccccagacatatgtgctctgcagcttctcccc

SEQ ID NO: 180904 - DNA, 35 bp, Artificial Sequence
  Synthetic oligonucleotide
gcgacgtgcaagcgtgggcgtcctgtaccttcccc

SEQ ID NO: 180905 - DNA, 35 bp, Artificial Sequence
  Synthetic oligonucleotide
aaccgtacaggcctctcacaagcgatataccgccc

SEQ ID NO: 180906 - DNA, 35 bp, Artificial Sequence
  Synthetic oligonucleotide
gacgggccacgacattctgattttgcactccgccc

SEQ ID NO: 180907 - DNA, 35 bp, Artificial Sequence
  Synthetic oligonucleotide
tccctgcctccatcttacaccctagtgcactgccc

SEQ ID NO: 180908 - DNA, 35 bp, Artificial Sequence
  Synthetic oligonucleotide
tttgcgcttgccgttccgacctccgctgcattccc

SEQ ID NO: 180909 - DNA, 36 bp, Artificial Sequence
  Synthetic oligonucleotide
gcccccccccccatctgtcctttggaatggttagcc

SEQ ID NO: 180910 - DNA, 35 bp, Artificial Sequence
  Synthetic oligonucleotide
tcatcacgcctggtttgcccgaccactatgaatcc

SEQ ID NO: 180911 - DNA, 35 bp, Artificial Sequence
  Synthetic oligonucleotide
tcccaacctgggcgactcccctcttggcgtactcc

SEQ ID NO: 180912 - DNA, 35 bp, Artificial Sequence
  Synthetic oligonucleotide
gactgacacagtgtaggcggcgcactctcccctcc

SEQ ID NO: 180913 - DNA, 35 bp, Artificial Sequence
  Synthetic oligonucleotide
gacccccccaacctctcgtgccccgcctgacgtcc

SEQ ID NO: 180914 - DNA, 35 bp, Artificial Sequence
  Synthetic oligonucleotide
tccacatccgcactgcacatacctcagccccgtcc

SEQ ID NO: 180915 - DNA, 35 bp, Artificial Sequence
  Synthetic oligonucleotide
ttcaccattctgtttaccgttacaatgatccttcc

SEQ ID NO: 180916 - DNA, 35 bp, Artificial Sequence
  Synthetic oligonucleotide
tcagcgccatgcctaaacgcccctttgtctgttcc

SEQ ID NO: 180917 - DNA, 35 bp, Artificial Sequence
  Synthetic oligonucleotide
tccaaaacgacagactcattcgccgccttatttcc

SEQ ID NO: 180918 - DNA, 35 bp, Artificial Sequence
  Synthetic oligonucleotide
gcccatcctcatcgtgtcttcgtagtctactttcc

SEQ ID NO: 180919 - DNA, 35 bp, Artificial Sequence
  Synthetic oligonucleotide
tcccgcctgctttaagtgaggcccgcctgttttcc

SEQ ID NO: 180920 - DNA, 35 bp, Artificial Sequence
  Synthetic oligonucleotide
aagcgccctgccatgaccacctcagctccctaagc

SEQ ID NO: 180921 - DNA, 35 bp, Artificial Sequence
  Synthetic oligonucleotide
tcgccacaccccggtctctcagcgatacatctagc

SEQ ID NO: 180922 - DNA, 35 bp, Artificial Sequence
  Synthetic oligonucleotide
tcattcttcagttcccccgtcccagttgatcccgc

SEQ ID NO: 180923 - DNA, 35 bp, Artificial Sequence
  Synthetic oligonucleotide
gcacttcattgcgcctctcccccattcatccgcgc

SEQ ID NO: 180924 - DNA, 35 bp, Artificial Sequence
  Synthetic oligonucleotide
gcctgagtgccttgatctcttgtccgccctatcgc

SEQ ID NO: 180925 - DNA, 35 bp, Artificial Sequence
  Synthetic oligonucleotide
tatcgcccttaatgttcctcgtttcccacgctcgc

SEQ ID NO: 180926 - DNA, 35 bp, Artificial Sequence
  Synthetic oligonucleotide
atctgccctccacccccgtaattcttcgaggtcgc

SEQ ID NO: 180927 - DNA, 35 bp, Artificial Sequence
  Synthetic oligonucleotide
tacgctcctctcattcctgtccatcgccccctggc

SEQ ID NO: 180928 - DNA, 35 bp, Artificial Sequence
  Synthetic oligonucleotide
gcccgatggggcaggggggaagaagggaggttatc

SEQ ID NO: 180929 - DNA, 35 bp, Artificial Sequence
  Synthetic oligonucleotide
acgcgaccctaggacgcctcacccattccccactc

SEQ ID NO: 180930 - DNA, 35 bp, Artificial Sequence
  Synthetic oligonucleotide
gatagtgccgaagccataccagtgaccctctcctc

SEQ ID NO: 180931 - DNA, 35 bp, Artificial Sequence
  Synthetic oligonucleotide
tacgcgcggtatgttccgttccacccctatcgctc

SEQ ID NO: 180932 - DNA, 35 bp, Artificial Sequence
  Synthetic oligonucleotide
gaactgtagcccggtgtccttcgtttcccttgctc

SEQ ID NO: 180933 - DNA, 35 bp, Artificial Sequence
  Synthetic oligonucleotide
gatgggaaggggaggtggggcaacgtgacagattc

SEQ ID NO: 180934 - DNA, 35 bp, Artificial Sequence
  Synthetic oligonucleotide
gcaccaacgctgccgctaaggcccacacctgattc

SEQ ID NO: 180935 - DNA, 35 bp, Artificial Sequence
  Synthetic oligonucleotide
gacccccccgtccgtgtctcgttcgtgtgtcgttc

SEQ ID NO: 180936 - DNA, 35 bp, Artificial Sequence
  Synthetic oligonucleotide
gcctaggagcgaggtgaacagggggggtccgaaag

SEQ ID NO: 180937 - DNA, 35 bp, Artificial Sequence
  Synthetic oligonucleotide
aatcgggcgggtgtgatggagtggggaaagggaag

SEQ ID NO: 180938 - DNA, 35 bp, Artificial Sequence
  Synthetic oligonucleotide
atcgcgaggagggttggcatattggggggagcgag

SEQ ID NO: 180939 - DNA, 35 bp, Artificial Sequence
  Synthetic oligonucleotide
tagggggcctggctgcgagacgggaggggtgggag

SEQ ID NO: 180940 - DNA, 35 bp, Artificial Sequence
  Synthetic oligonucleotide
tgtgggaagcgagcgaggacggaggtggaggtgag

SEQ ID NO: 180941 - DNA, 35 bp, Artificial Sequence
  Synthetic oligonucleotide
aagccggccacaccttccctgccttcattttttag

SEQ ID NO: 180942 - DNA, 35 bp, Artificial Sequence
  Synthetic oligonucleotide
gagaggagtggaggaggtgtcgcgctgaatatacg

SEQ ID NO: 180943 - DNA, 35 bp, Artificial Sequence
  Synthetic oligonucleotide
gaacaagccagtcagtcgcccactctcccagtccg

SEQ ID NO: 180944 - DNA, 35 bp, Artificial Sequence
  Synthetic oligonucleotide
tcccgcccggaagccacgttaccctccacctcgcg

SEQ ID NO: 180945 - DNA, 35 bp, Artificial Sequence
  Synthetic oligonucleotide
agtgtgaaagtggggcgtaaacgagcgggagggcg

SEQ ID NO: 180946 - DNA, 35 bp, Artificial Sequence
  Synthetic oligonucleotide
tgttaggggggcggggggtagtaggattcgatgcg

SEQ ID NO: 180947 - DNA, 35 bp, Artificial Sequence
  Synthetic oligonucleotide
gtgcgggcccccatccctgttactgtctaccctcg

SEQ ID NO: 180948 - DNA, 35 bp, Artificial Sequence
  Synthetic oligonucleotide
tgtcccccgccggcacgtcagcctcttttcggtcg

SEQ ID NO: 180949 - DNA, 35 bp, Artificial Sequence
  Synthetic oligonucleotide
gagccgcggggtggtcggcctctctctttcattcg

SEQ ID NO: 180950 - DNA, 35 bp, Artificial Sequence
  Synthetic oligonucleotide
tcttcccaccggggattagatccaccttctcttcg

SEQ ID NO: 180951 - DNA, 35 bp, Artificial Sequence
  Synthetic oligonucleotide
gaaaggaggggtgcgaaaagcgataaagtcggggg

SEQ ID NO: 180952 - DNA, 35 bp, Artificial Sequence
  Synthetic oligonucleotide
acagacacccctacattcctcccgttcacccatgg

SEQ ID NO: 180953 - DNA, 34 bp, Artificial Sequence
  Synthetic oligonucleotide
gtcgccccctccctgcattgttagctttcacctg

SEQ ID NO: 180954 - DNA, 35 bp, Artificial Sequence
  Synthetic oligonucleotide
actgtcaagcattgctactgaacactctttccctg

SEQ ID NO: 180955 - DNA, 35 bp, Artificial Sequence
  Synthetic oligonucleotide
tcactcccctgtacacctgcacgataaacatcctg

SEQ ID NO: 180956 - DNA, 35 bp, Artificial Sequence
  Synthetic oligonucleotide
gcctccgtactgcctgtcctattcgcttcaatctg

SEQ ID NO: 180957 - DNA, 35 bp, Artificial Sequence
  Synthetic oligonucleotide
gcagtgtgggggtggctacagaagggcggagtgtg

SEQ ID NO: 180958 - DNA, 35 bp, Artificial Sequence
  Synthetic oligonucleotide
catccccctctggcatttatagggagttcataaat

SEQ ID NO: 180959 - DNA, 35 bp, Artificial Sequence
  Synthetic oligonucleotide
gagtggcatctcgcacacgctgccgccccccccat

SEQ ID NO: 180960 - DNA, 35 bp, Artificial Sequence
  Synthetic oligonucleotide
gcccagtcctgggctgtcgtattgtctttttccat

SEQ ID NO: 180961 - DNA, 35 bp, Artificial Sequence
  Synthetic oligonucleotide
tcgccccatccacgtttggccagttccattttgat

SEQ ID NO: 180962 - DNA, 35 bp, Artificial Sequence
  Synthetic oligonucleotide
tgcaccgcttttgccccgtcacgccgccactgtat

SEQ ID NO: 180963 - DNA, 35 bp, Artificial Sequence
  Synthetic oligonucleotide
acagcgtgctgcccgtccgtcgcttccttgtcact

SEQ ID NO: 180964 - DNA, 35 bp, Artificial Sequence
  Synthetic oligonucleotide
taacccctcgccagtttcccgctcaggacttcact

SEQ ID NO: 180965 - DNA, 35 bp, Artificial Sequence
  Synthetic oligonucleotide
accctatccctctgcctcggcgttttcctgctact

SEQ ID NO: 180966 - DNA, 35 bp, Artificial Sequence
  Synthetic oligonucleotide
gacgcaatggctgccccagttacatggctccacct

SEQ ID NO: 180967 - DNA, 35 bp, Artificial Sequence
  Synthetic oligonucleotide
acatccgtggctccgacacgtgaactgaaacccct

SEQ ID NO: 180968 - DNA, 35 bp, Artificial Sequence
  Synthetic oligonucleotide
accgcgaccgcagacgtcttcaaacccccgcccct

SEQ ID NO: 180969 - DNA, 35 bp, Artificial Sequence
  Synthetic oligonucleotide
ttcacacacgaccgtttaatatttaggcccctcct

SEQ ID NO: 180970 - DNA, 34 bp, Artificial Sequence
  Synthetic oligonucleotide
tgcccgtacaacgttgaccttccatttctgtgct

SEQ ID NO: 180971 - DNA, 35 bp, Artificial Sequence
  Synthetic oligonucleotide
gtggtcctcccacccttcctctggttcttgcatct

SEQ ID NO: 180972 - DNA, 35 bp, Artificial Sequence
  Synthetic oligonucleotide
atcccccgccattgtttgcatattcctatctctct

SEQ ID NO: 180973 - DNA, 35 bp, Artificial Sequence
  Synthetic oligonucleotide
aaccacccgccttttattgcactgcccgtctttct

SEQ ID NO: 180974 - DNA, 35 bp, Artificial Sequence
  Synthetic oligonucleotide
acccacgttcggagccctactcagctatgccccgt

SEQ ID NO: 180975 - DNA, 35 bp, Artificial Sequence
  Synthetic oligonucleotide
gggtgggggattcgagttacggggcaggtggaggt

SEQ ID NO: 180976 - DNA, 35 bp, Artificial Sequence
  Synthetic oligonucleotide
tccgacacctgatccggtcctccatcctaataggt

SEQ ID NO: 180977 - DNA, 35 bp, Artificial Sequence
  Synthetic oligonucleotide
tacacgtagccctgtatccaccgcctgcctgctgt

SEQ ID NO: 180978 - DNA, 35 bp, Artificial Sequence
  Synthetic oligonucleotide
tcacccccgtccgcctcctatcatgacatgtctgt

SEQ ID NO: 180979 - DNA, 35 bp, Artificial Sequence
  Synthetic oligonucleotide
cactccccagcgctttcccgttcccgcttttctgt

SEQ ID NO: 180980 - DNA, 35 bp, Artificial Sequence
  Synthetic oligonucleotide
gaactcgagcggggtgggtttggagggccttcgtt

SEQ ID NO: 180981 - DNA, 35 bp, Artificial Sequence
  Synthetic oligonucleotide
atcacgccttcggagaaccagcttgtttcaccttt

SEQ ID NO: 180982 - DNA, 35 bp, Artificial Sequence
  Synthetic oligonucleotide
tacacgcccatccaggctcctctccatgaccgttt

SEQ ID NO: 180983 - DNA, 35 bp, Artificial Sequence
  Synthetic oligonucleotide
ggtgggtccgcatctcttgtactttcgttgctttt

SEQ ID NO: 180984 - DNA, 36 bp, Artificial Sequence
  Synthetic oligonucleotide
atcccccattgttatctaccgttgctccaggaccaa

SEQ ID NO: 180985 - DNA, 36 bp, Artificial Sequence
  Synthetic oligonucleotide
gtgtggaggggaaagagcaggaaaggtggatgcgaa

SEQ ID NO: 180986 - DNA, 36 bp, Artificial Sequence
  Synthetic oligonucleotide
atctgcgggtgggcgatggtgggtgggggtctctaa

SEQ ID NO: 180987 - DNA, 36 bp, Artificial Sequence
  Synthetic oligonucleotide
gttgcctcatctctcagatcctcttcccactggtaa

SEQ ID NO: 180988 - DNA, 36 bp, Artificial Sequence
  Synthetic oligonucleotide
ggaggaacaacagtaaagggcgaagtgggcggcaca

SEQ ID NO: 180989 - DNA, 36 bp, Artificial Sequence
  Synthetic oligonucleotide
accaagcccggttctttgcagcccgttccattcaca

SEQ ID NO: 180990 - DNA, 36 bp, Artificial Sequence
  Synthetic oligonucleotide
tccccagaccttccccgacgtgtaaccacgttgaca

SEQ ID NO: 180991 - DNA, 36 bp, Artificial Sequence
  Synthetic oligonucleotide
gcccctcctcctgctctctattagattgcacctaca

SEQ ID NO: 180992 - DNA, 35 bp, Artificial Sequence
  Synthetic oligonucleotide
gggaagggggtagaaacgggaaggaggagaaacca

SEQ ID NO: 180993 - DNA, 36 bp, Artificial Sequence
  Synthetic oligonucleotide
ttgaccccgccgaaggtatcctgaaacgcatatcca

SEQ ID NO: 180994 - DNA, 35 bp, Artificial Sequence
  Synthetic oligonucleotide
tcccccgcacctctgctgaggaattttgctttcca

SEQ ID NO: 180995 - DNA, 36 bp, Artificial Sequence
  Synthetic oligonucleotide
tgcacaccttccaggactaatagatccatcaccgca

SEQ ID NO: 180996 - DNA, 36 bp, Artificial Sequence
  Synthetic oligonucleotide
ttagtacccctccgctgtcaccttacagttgctgca

SEQ ID NO: 180997 - DNA, 36 bp, Artificial Sequence
  Synthetic oligonucleotide
atgcttggcgcccgccgtggttctccctttgttgca

SEQ ID NO: 180998 - DNA, 35 bp, Artificial Sequence
  Synthetic oligonucleotide
tcaaccccccccggtttgtattgtaagcccaatca

SEQ ID NO: 180999 - DNA, 36 bp, Artificial Sequence
  Synthetic oligonucleotide
tttgtcagcccactagtgccaccccattgtcaatca

SEQ ID NO: 181000 - DNA, 36 bp, Artificial Sequence
  Synthetic oligonucleotide
tcccgtcccgcgcttaataaagaactcgctccctca

SEQ ID NO: 181001 - DNA, 35 bp, Artificial Sequence
  Synthetic oligonucleotide
tgcctagggcggtctttctcacgttctgctcctca

SEQ ID NO: 181002 - DNA, 36 bp, Artificial Sequence
  Synthetic oligonucleotide
gacctccatcgcaaattcacgctagcctatggctca

SEQ ID NO: 181003 - DNA, 35 bp, Artificial Sequence
  Synthetic oligonucleotide
gtacccacccagcattagtgcgcgcctctgtctca

SEQ ID NO: 181004 - DNA, 36 bp, Artificial Sequence
  Synthetic oligonucleotide
taaaccccctgtgttctgtccttgcccctgttgtca

SEQ ID NO: 181005 - DNA, 36 bp, Artificial Sequence
  Synthetic oligonucleotide
tgcacgccctccacgcttaaggcgactggcctttca

SEQ ID NO: 181006 - DNA, 37 bp, Artificial Sequence
  Synthetic oligonucleotide
atgaccatcactcacctgcaatttcacgtcttataga

SEQ ID NO: 181007 - DNA, 37 bp, Artificial Sequence
  Synthetic oligonucleotide
ggtcccccgcacttgttcttcccctctcgtaccccga

SEQ ID NO: 181008 - DNA, 37 bp, Artificial Sequence
  Synthetic oligonucleotide
tgagcatgtcgaatgctcgtgctctcctctgctccga

SEQ ID NO: 181009 - DNA, 37 bp, Artificial Sequence
  Synthetic oligonucleotide
aacgacccccgtcgtcgactgtactaccttattccga

SEQ ID NO: 181010 - DNA, 37 bp, Artificial Sequence
  Synthetic oligonucleotide
atcagggggggcggggagctaccgagactacgggcga

SEQ ID NO: 181011 - DNA, 37 bp, Artificial Sequence
  Synthetic oligonucleotide
ggtaggggatggagtgggcgggcggtatagacatcga

SEQ ID NO: 181012 - DNA, 35 bp, Artificial Sequence
  Synthetic oligonucleotide
agcaccctgcccacccactacgtacatctactcga

SEQ ID NO: 181013 - DNA, 37 bp, Artificial Sequence
  Synthetic oligonucleotide
tgcacagggggtgcgggcggggagggtcgcaaaagga

SEQ ID NO: 181014 - DNA, 37 bp, Artificial Sequence
  Synthetic oligonucleotide
gtctttcgccgccctgaccccagcaccctttttcgga

SEQ ID NO: 181015 - DNA, 37 bp, Artificial Sequence
  Synthetic oligonucleotide
ggtcgggggagcaccaaagcggagaggggggaaggga

SEQ ID NO: 181016 - DNA, 36 bp, Artificial Sequence
  Synthetic oligonucleotide
tcccagcacaccgcggcccaccccattcctcaggga

SEQ ID NO: 181017 - DNA, 37 bp, Artificial Sequence
  Synthetic oligonucleotide
gggaatgcctcagttgcacgaagtcgggcgggtggga

SEQ ID NO: 181018 - DNA, 35 bp, Artificial Sequence
  Synthetic oligonucleotide
gttgacgttgcccggttttcacccttacccctgga

SEQ ID NO: 181019 - DNA, 38 bp, Artificial Sequence
  Synthetic oligonucleotide
gaaggggcgggagtagagttgggagtggcggataatga

SEQ ID NO: 181020 - DNA, 37 bp, Artificial Sequence
  Synthetic oligonucleotide
accaccttacgatccgcactcccagagcttgccatga

SEQ ID NO: 181021 - DNA, 37 bp, Artificial Sequence
  Synthetic oligonucleotide
ggggacggggacttggtgaatggggggtacgctatga

SEQ ID NO: 181022 - DNA, 38 bp, Artificial Sequence
  Synthetic oligonucleotide
accaagctaccacagttcattgcacgcacacctcctga

SEQ ID NO: 181023 - DNA, 37 bp, Artificial Sequence
  Synthetic oligonucleotide
gactggtcatccacttatgcgcaccctcacctcctga

SEQ ID NO: 181024 - DNA, 38 bp, Artificial Sequence
  Synthetic oligonucleotide
tccagccagctgcctctgtttcgtgtccaatccgctga

SEQ ID NO: 181025 - DNA, 38 bp, Artificial Sequence
  Synthetic oligonucleotide
tgcccacccagctcgtgctttttattcttcatacgtga

SEQ ID NO: 181026 - DNA, 37 bp, Artificial Sequence
  Synthetic oligonucleotide
gagaggggaatggggggtcggggcccaaggtcggtga

SEQ ID NO: 181027 - DNA, 37 bp, Artificial Sequence
  Synthetic oligonucleotide
tatgatagggaagggcagaagggtgatgggggggtga

SEQ ID NO: 181028 - DNA, 38 bp, Artificial Sequence
  Synthetic oligonucleotide
tcaagctctcacagctgttacctgccgccccgccttga

SEQ ID NO: 181029 - DNA, 38 bp, Artificial Sequence
  Synthetic oligonucleotide
tcgctgtctccatcctgctacgtgccttccctgtttga

SEQ ID NO: 181030 - DNA, 38 bp, Artificial Sequence
  Synthetic oligonucleotide
tccaccgcatctgaggccctcctgccgcttttttttga

SEQ ID NO: 181031 - DNA, 35 bp, Artificial Sequence
  Synthetic oligonucleotide
aggagagccgcacatcatgccttgccctgcccata

SEQ ID NO: 181032 - DNA, 36 bp, Artificial Sequence
  Synthetic oligonucleotide
gcacgccctactcccttgtttacgtgtgccattata

SEQ ID NO: 181033 - DNA, 36 bp, Artificial Sequence
  Synthetic oligonucleotide
gtcaaccagctgccccaccgcttccgtacagaacta

SEQ ID NO: 181034 - DNA, 36 bp, Artificial Sequence
  Synthetic oligonucleotide
tccatctgcctcaagtcgccgttccttagctaacta

SEQ ID NO: 181035 - DNA, 36 bp, Artificial Sequence
  Synthetic oligonucleotide
tctacccacctcaggtattctgctcactggccccta

SEQ ID NO: 181036 - DNA, 36 bp, Artificial Sequence
  Synthetic oligonucleotide
gtcacgaatgctcgagcccttttgctgtccctccta

SEQ ID NO: 181037 - DNA, 35 bp, Artificial Sequence
  Synthetic oligonucleotide
gaccccccgcccgttacggtctaaaaattattgta

SEQ ID NO: 181038 - DNA, 36 bp, Artificial Sequence
  Synthetic oligonucleotide
atcatccactcctcagttcactgttatgtcgcatta

SEQ ID NO: 181039 - DNA, 35 bp, Artificial Sequence
  Synthetic oligonucleotide
atatccagcctgcttccgccttgtactcccgctta

SEQ ID NO: 181040 - DNA, 36 bp, Artificial Sequence
  Synthetic oligonucleotide
atgagggtagagaagaaagaggcggatggaacgtta

SEQ ID NO: 181041 - DNA, 35 bp, Artificial Sequence
  Synthetic oligonucleotide
acccacctgtgtgtagtgtttttcctccaccgtta

SEQ ID NO: 181042 - DNA, 35 bp, Artificial Sequence
  Synthetic oligonucleotide
tcccccgtatcatctgtacatgacccaccttcaac

SEQ ID NO: 181043 - DNA, 35 bp, Artificial Sequence
  Synthetic oligonucleotide
ttggcatccacgcgctgctcatcaacctctgctac

SEQ ID NO: 181044 - DNA, 35 bp, Artificial Sequence
  Synthetic oligonucleotide
ccatggcgaggcgtcccggccggccctgtctctac

SEQ ID NO: 181045 - DNA, 35 bp, Artificial Sequence
  Synthetic oligonucleotide
tacgaccctggcgactaccaccacgtttctacacc

SEQ ID NO: 181046 - DNA, 35 bp, Artificial Sequence
  Synthetic oligonucleotide
gattctgccgcattcctttaccttcacagctgacc

SEQ ID NO: 181047 - DNA, 35 bp, Artificial Sequence
  Synthetic oligonucleotide
atcgcgttcgatagcacccttaccaccggctaccc

SEQ ID NO: 181048 - DNA, 35 bp, Artificial Sequence
  Synthetic oligonucleotide
tgccttcggacctcctgtttcccggtgtcaccccc

SEQ ID NO: 181049 - DNA, 35 bp, Artificial Sequence
  Synthetic oligonucleotide
attgacacgtccgaatcatcgcgtctacggtcccc

SEQ ID NO: 181050 - DNA, 35 bp, Artificial Sequence
  Synthetic oligonucleotide
gtgcatgtcgcgtccgtttttcgcatttgttcccc

SEQ ID NO: 181051 - DNA, 35 bp, Artificial Sequence
  Synthetic oligonucleotide
tgaatccacccgggttgttcctccactcataagcc

SEQ ID NO: 181052 - DNA, 35 bp, Artificial Sequence
  Synthetic oligonucleotide
acaccgccagatatctaccagctgttacctccgcc

SEQ ID NO: 181053 - DNA, 35 bp, Artificial Sequence
  Synthetic oligonucleotide
tctccactgcctcacagtccctgatacagtccgcc

SEQ ID NO: 181054 - DNA, 35 bp, Artificial Sequence
  Synthetic oligonucleotide
gttgcattgcccggcgcaccgccaccatgttcgcc

SEQ ID NO: 181055 - DNA, 35 bp, Artificial Sequence
  Synthetic oligonucleotide
atcctcacgtaccatctaccgcgcttagtagtgcc

SEQ ID NO: 181056 - DNA, 35 bp, Artificial Sequence
  Synthetic oligonucleotide
cactcgactgcagcacactacctgcccttcttgcc

SEQ ID NO: 181057 - DNA, 35 bp, Artificial Sequence
  Synthetic oligonucleotide
tgcagccctgcacgtgcttttctcccggttcatcc

SEQ ID NO: 181058 - DNA, 35 bp, Artificial Sequence
  Synthetic oligonucleotide
tgtcccatttcacagagtgaagtcctccgccctcc

SEQ ID NO: 181059 - DNA, 35 bp, Artificial Sequence
  Synthetic oligonucleotide
gccgcattggaacacgtcacgttaaactgccttcc

SEQ ID NO: 181060 - DNA, 35 bp, Artificial Sequence
  Synthetic oligonucleotide
ttgtgcggtacgtagcatttatctgttgttcttcc

SEQ ID NO: 181061 - DNA, 35 bp, Artificial Sequence
  Synthetic oligonucleotide
tacgcctcttccgaccctaacctcgttcactgagc

SEQ ID NO: 181062 - DNA, 35 bp, Artificial Sequence
  Synthetic oligonucleotide
tcaaacgcgaatcctgtattttgcactccatccgc

SEQ ID NO: 181063 - DNA, 35 bp, Artificial Sequence
  Synthetic oligonucleotide
gatgcgtagtgggcttctccgtactcttccgtcgc

SEQ ID NO: 181064 - DNA, 35 bp, Artificial Sequence
  Synthetic oligonucleotide
tacccaacgcccccgtccacacactatgtttaggc

SEQ ID NO: 181065 - DNA, 35 bp, Artificial Sequence
  Synthetic oligonucleotide
gatcaccgcgccgtaacgttgcaaccgtccctggc

SEQ ID NO: 181066 - DNA, 35 bp, Artificial Sequence
  Synthetic oligonucleotide
gttcgggcactcctacttttaccgctagcccttgc

SEQ ID NO: 181067 - DNA, 35 bp, Artificial Sequence
  Synthetic oligonucleotide
tgtgcccaacctcacttcttagctcgtgaccaatc

SEQ ID NO: 181068 - DNA, 35 bp, Artificial Sequence
  Synthetic oligonucleotide
gagcgcctcactgtcgcggtttttacccatctatc

SEQ ID NO: 181069 - DNA, 35 bp, Artificial Sequence
  Synthetic oligonucleotide
accaccatctccctgtttcacctgactgcgtactc

SEQ ID NO: 181070 - DNA, 35 bp, Artificial Sequence
  Synthetic oligonucleotide
ttccagcctccttctagtatgcaactatgcccctc

SEQ ID NO: 181071 - DNA, 35 bp, Artificial Sequence
  Synthetic oligonucleotide
gcccgtggacgcccctctcaatgtgcattgccctc

SEQ ID NO: 181072 - DNA, 35 bp, Artificial Sequence
  Synthetic oligonucleotide
tcagccgtgtgataataacgccgcccttgtctctc

SEQ ID NO: 181073 - DNA, 35 bp, Artificial Sequence
  Synthetic oligonucleotide
gttcaccaccgatcgtcttcacctgtccttttctc

SEQ ID NO: 181074 - DNA, 35 bp, Artificial Sequence
  Synthetic oligonucleotide
atccgttgctcgacgcgctgaactcccccttagtc

SEQ ID NO: 181075 - DNA, 35 bp, Artificial Sequence
  Synthetic oligonucleotide
tgccaccactattccggcttccaagtgatcttgtc

SEQ ID NO: 181076 - DNA, 35 bp, Artificial Sequence
  Synthetic oligonucleotide
tcacaccccctgcccattgcattttgaggttattc

SEQ ID NO: 181077 - DNA, 35 bp, Artificial Sequence
  Synthetic oligonucleotide
gtgaacgtccgtctccggttctggcctatcacttc

SEQ ID NO: 181078 - DNA, 35 bp, Artificial Sequence
  Synthetic oligonucleotide
acggagtgctccgttgcacccatgtggcccccttc

SEQ ID NO: 181079 - DNA, 35 bp, Artificial Sequence
  Synthetic oligonucleotide
attcacctcggacattaggacatactgctcccttc

SEQ ID NO: 181080 - DNA, 35 bp, Artificial Sequence
  Synthetic oligonucleotide
tgtccgtccccatgagcaatatctcgctttcgttc

SEQ ID NO: 181081 - DNA, 36 bp, Artificial Sequence
  Synthetic oligonucleotide
gcaggaggaggtgagagggtggggagggtacgaaag

SEQ ID NO: 181082 - DNA, 35 bp, Artificial Sequence
  Synthetic oligonucleotide
gttccatctctgtttcgtgccatccttgccagaag

SEQ ID NO: 181083 - DNA, 35 bp, Artificial Sequence
  Synthetic oligonucleotide
gagacgatcgggtcacggggtttgggggggagaag

SEQ ID NO: 181084 - DNA, 35 bp, Artificial Sequence
  Synthetic oligonucleotide
gtggggtgggtggtgtgccaagggggttggcgaag

SEQ ID NO: 181085 - DNA, 35 bp, Artificial Sequence
  Synthetic oligonucleotide
gagagggggagaaaacagaaggaacggttcatacg

SEQ ID NO: 181086 - DNA, 35 bp, Artificial Sequence
  Synthetic oligonucleotide
tgagactgccgtttcgtgtcccttcccggcccccg

SEQ ID NO: 181087 - DNA, 35 bp, Artificial Sequence
  Synthetic oligonucleotide
tccccaccatggtaagcgccccttagatccatccg

SEQ ID NO: 181088 - DNA, 35 bp, Artificial Sequence
  Synthetic oligonucleotide
atcctagcacctatgtcggctcttcattccctccg

SEQ ID NO: 181089 - DNA, 35 bp, Artificial Sequence
  Synthetic oligonucleotide
tacctctgccgcccccctgacgtattttgtgagcg

SEQ ID NO: 181090 - DNA, 35 bp, Artificial Sequence
  Synthetic oligonucleotide
gcccatctcgacgcccatacgccctataattatcg

SEQ ID NO: 181091 - DNA, 35 bp, Artificial Sequence
  Synthetic oligonucleotide
gccgatccgacggggtgaagttagtggaggggagg

SEQ ID NO: 181092 - DNA, 35 bp, Artificial Sequence
  Synthetic oligonucleotide
ggtgtggagtgagaagggtctgagcataggggggg

SEQ ID NO: 181093 - DNA, 35 bp, Artificial Sequence
  Synthetic oligonucleotide
gatgcgtcacgttggggctatggtgcgggtggggg

SEQ ID NO: 181094 - DNA, 35 bp, Artificial Sequence
  Synthetic oligonucleotide
accatcccgttgcgcgccctctcgtcaccctcatg

SEQ ID NO: 181095 - DNA, 35 bp, Artificial Sequence
  Synthetic oligonucleotide
ttgcgccggtctctgctatactctcttccctgatg

SEQ ID NO: 181096 - DNA, 35 bp, Artificial Sequence
  Synthetic oligonucleotide
tgcccgatctatcccatcagcaccatgcgcccctg

SEQ ID NO: 181097 - DNA, 35 bp, Artificial Sequence
  Synthetic oligonucleotide
cgaaccactcggtgagactgaaccttgcctctctg

SEQ ID NO: 181098 - DNA, 34 bp, Artificial Sequence
  Synthetic oligonucleotide
atatcccagccaccacgtccccttccatgaattg

SEQ ID NO: 181099 - DNA, 35 bp, Artificial Sequence
  Synthetic oligonucleotide
tccccgcttccgcctcaattatgtcttcaattttg

SEQ ID NO: 181100 - DNA, 35 bp, Artificial Sequence
  Synthetic oligonucleotide
ggaggggaacgacggaagtacggggcacaagaaat

SEQ ID NO: 181101 - DNA, 35 bp, Artificial Sequence
  Synthetic oligonucleotide
atggggggggagtgagacgggaaggggaagagaat

SEQ ID NO: 181102 - DNA, 35 bp, Artificial Sequence
  Synthetic oligonucleotide
tgactatctggtcggcgcacttcatgtcctttcat

SEQ ID NO: 181103 - DNA, 35 bp, Artificial Sequence
  Synthetic oligonucleotide
ttgttgcgcaaagtgattcgtcccatgttacacct

SEQ ID NO: 181104 - DNA, 35 bp, Artificial Sequence
  Synthetic oligonucleotide
acccctgcaatacgtgatacatgctctctttacct

SEQ ID NO: 181105 - DNA, 35 bp, Artificial Sequence
  Synthetic oligonucleotide
gagttgctcctggctctcgagtacacttcacccct

SEQ ID NO: 181106 - DNA, 35 bp, Artificial Sequence
  Synthetic oligonucleotide
tgataggtcggccgctaccgtacccatgtttccct

SEQ ID NO: 181107 - DNA, 35 bp, Artificial Sequence
  Synthetic oligonucleotide
acccaccctcgacctgcaactaagcaacgaatcct

SEQ ID NO: 181108 - DNA, 35 bp, Artificial Sequence
  Synthetic oligonucleotide
atgcagcccgcgtttcctttggctgcttcgttcct

SEQ ID NO: 181109 - DNA, 35 bp, Artificial Sequence
  Synthetic oligonucleotide
gagcagggtaactatttgctcgctactggccctct

SEQ ID NO: 181110 - DNA, 35 bp, Artificial Sequence
  Synthetic oligonucleotide
ggtgtgatcaccgcgcgagcccccctgtcgcctct

SEQ ID NO: 181111 - DNA, 35 bp, Artificial Sequence
  Synthetic oligonucleotide
tccatcgtcactcattctatccctgctctggctct

SEQ ID NO: 181112 - DNA, 35 bp, Artificial Sequence
  Synthetic oligonucleotide
gtcagtgcgtacatagcgttttcgtccctccgtct

SEQ ID NO: 181113 - DNA, 35 bp, Artificial Sequence
  Synthetic oligonucleotide
gtgtggcccagtcatcatgctctgtcggtctttct

SEQ ID NO: 181114 - DNA, 35 bp, Artificial Sequence
  Synthetic oligonucleotide
tacgcgtctctcccctatgttgcttccctcctcgt

SEQ ID NO: 181115 - DNA, 35 bp, Artificial Sequence
  Synthetic oligonucleotide
gagttgacagaaggggatcaggtgcggagggcggt

SEQ ID NO: 181116 - DNA, 35 bp, Artificial Sequence
  Synthetic oligonucleotide
gccctccctacgatccaacacaagtccccgcgggt

SEQ ID NO: 181117 - DNA, 35 bp, Artificial Sequence
  Synthetic oligonucleotide
ttcgccaccgcttaccatccggtctcgtttctggt

SEQ ID NO: 181118 - DNA, 35 bp, Artificial Sequence
  Synthetic oligonucleotide
tgatcaataaggcgggtgaggggaacagggggtgt

SEQ ID NO: 181119 - DNA, 35 bp, Artificial Sequence
  Synthetic oligonucleotide
acacatccgctcttcaacttccgactcccttttgt

SEQ ID NO: 181120 - DNA, 35 bp, Artificial Sequence
  Synthetic oligonucleotide
tcgccctctctcccccgtttaggacatcgacgctt

SEQ ID NO: 181121 - DNA, 35 bp, Artificial Sequence
  Synthetic oligonucleotide
ttcatccgcctcccaccttaatggtgtcaccagtt

SEQ ID NO: 181122 - DNA, 35 bp, Artificial Sequence
  Synthetic oligonucleotide
accaaatccgccataccccgaccgtgtcaccggtt

SEQ ID NO: 181123 - DNA, 35 bp, Artificial Sequence
  Synthetic oligonucleotide
gccaccttcgacgcctgctgccatgtccccttgtt

SEQ ID NO: 181124 - DNA, 35 bp, Artificial Sequence
  Synthetic oligonucleotide
tgaaccgcccggagtttgcaattgctcgcctcttt

SEQ ID NO: 181125 - DNA, 36 bp, Artificial Sequence
  Synthetic oligonucleotide
gctgggggggactaagcggtaacggggcggtagaaa

SEQ ID NO: 181126 - DNA, 36 bp, Artificial Sequence
  Synthetic oligonucleotide
gtgggagaagaatggtggagcaagggagactataaa

SEQ ID NO: 181127 - DNA, 35 bp, Artificial Sequence
  Synthetic oligonucleotide
gagaaccgccgaccttccacagccagcttaaccaa

SEQ ID NO: 181128 - DNA, 36 bp, Artificial Sequence
  Synthetic oligonucleotide
acccgcacttcggatatcccctgtcctcgcctccaa

SEQ ID NO: 181129 - DNA, 36 bp, Artificial Sequence
  Synthetic oligonucleotide
tgtgggagggggggacagaatgggccaagcaatcaa

SEQ ID NO: 181130 - DNA, 36 bp, Artificial Sequence
  Synthetic oligonucleotide
tcacccccgagccctcattggactatactgtgcgaa

SEQ ID NO: 181131 - DNA, 36 bp, Artificial Sequence
  Synthetic oligonucleotide
gaggggtggaggaggatgttgcggggagaagcggaa

SEQ ID NO: 181132 - DNA, 36 bp, Artificial Sequence
  Synthetic oligonucleotide
tacctgccgggggggggtaaaatgctggggagtgaa

SEQ ID NO: 181133 - DNA, 35 bp, Artificial Sequence
  Synthetic oligonucleotide
gtttgccacctggccgcgagcccaccctttcgtaa

SEQ ID NO: 181134 - DNA, 35 bp, Artificial Sequence
  Synthetic oligonucleotide
gcctaccgccactccatactcccttgagtgtaaca

SEQ ID NO: 181135 - DNA, 36 bp, Artificial Sequence
  Synthetic oligonucleotide
attgcagatcagtctctatcgaacctcccgctcaca

SEQ ID NO: 181136 - DNA, 36 bp, Artificial Sequence
  Synthetic oligonucleotide
tgtcccatccgcttatttgtgcgcttagcgatacca

SEQ ID NO: 181137 - DNA, 35 bp, Artificial Sequence
  Synthetic oligonucleotide
agtccaccgtttgcctgtcgcttgtaatcttccca

SEQ ID NO: 181138 - DNA, 36 bp, Artificial Sequence
  Synthetic oligonucleotide
tcctcccgccactctctccaatcggcctgcccgcca

SEQ ID NO: 181139 - DNA, 35 bp, Artificial Sequence
  Synthetic oligonucleotide
cccaacgtccccacgcgtttcagcccggtcctcca

SEQ ID NO: 181140 - DNA, 35 bp, Artificial Sequence
  Synthetic oligonucleotide
tcatccaactgcccacgccccgtaccatatgagca

SEQ ID NO: 181141 - DNA, 36 bp, Artificial Sequence
  Synthetic oligonucleotide
tgtggggggaggaaccggggaaatggtaagaatgca

SEQ ID NO: 181142 - DNA, 35 bp, Artificial Sequence
  Synthetic oligonucleotide
gagggcaagtgaacgcaaggggagggggagctgca

SEQ ID NO: 181143 - DNA, 35 bp, Artificial Sequence
  Synthetic oligonucleotide
gtcgtcgccacgaatcgattcttactacgctatca

SEQ ID NO: 181144 - DNA, 36 bp, Artificial Sequence
  Synthetic oligonucleotide
ggtaccgctcacaatctgcccccgggtccttactca

SEQ ID NO: 181145 - DNA, 35 bp, Artificial Sequence
  Synthetic oligonucleotide
tcatcccttgtcatagcgccccacctacgcagtca

SEQ ID NO: 181146 - DNA, 36 bp, Artificial Sequence
  Synthetic oligonucleotide
gtgtggcgtccaccgggcccccgatccctcctgtca

SEQ ID NO: 181147 - DNA, 35 bp, Artificial Sequence
  Synthetic oligonucleotide
cacgcactcctttcgctcgtcaagtcctgccttca

SEQ ID NO: 181148 - DNA, 35 bp, Artificial Sequence
  Synthetic oligonucleotide
tccccgcttggactgcctctgccccgtgttcttca

SEQ ID NO: 181149 - DNA, 37 bp, Artificial Sequence
  Synthetic oligonucleotide
gtagtgcgctaggcggggtgggggaaatgggggaaga

SEQ ID NO: 181150 - DNA, 35 bp, Artificial Sequence
  Synthetic oligonucleotide
taggaaggtatgggaaagtgggggcatggtgaaga

SEQ ID NO: 181151 - DNA, 37 bp, Artificial Sequence
  Synthetic oligonucleotide
tcacccgcccctgtactgacctccatccggattaaga

SEQ ID NO: 181152 - DNA, 37 bp, Artificial Sequence
  Synthetic oligonucleotide
ggagaggacggtgggggagcatggacggtatgggaga

SEQ ID NO: 181153 - DNA, 37 bp, Artificial Sequence
  Synthetic oligonucleotide
gacgaggggaagaagggaggttcttggacgatggaga

SEQ ID NO: 181154 - DNA, 37 bp, Artificial Sequence
  Synthetic oligonucleotide
ggggaataggtggaggtgactggggcggaatatgaga

SEQ ID NO: 181155 - DNA, 36 bp, Artificial Sequence
  Synthetic oligonucleotide
tagtaggaggttgggaatagtaaggggaggggtaga

SEQ ID NO: 181156 - DNA, 37 bp, Artificial Sequence
  Synthetic oligonucleotide
ggaggacggacagaaagcgggagggactgatggacga

SEQ ID NO: 181157 - DNA, 37 bp, Artificial Sequence
  Synthetic oligonucleotide
acgttggctaagtaggggggggctcgggagggtacga

SEQ ID NO: 181158 - DNA, 36 bp, Artificial Sequence
  Synthetic oligonucleotide
accgtccgccccttcgtatccttgtcttgtttacga

SEQ ID NO: 181159 - DNA, 37 bp, Artificial Sequence
  Synthetic oligonucleotide
gagcaccattcgttggatccaatgcccctcccaccga

SEQ ID NO: 181160 - DNA, 37 bp, Artificial Sequence
  Synthetic oligonucleotide
tcactaccgagaagggcccactacagtcgagactcga

SEQ ID NO: 181161 - DNA, 35 bp, Artificial Sequence
  Synthetic oligonucleotide
gacgtcgccacctgggcttgcaaatatcttctcga

SEQ ID NO: 181162 - DNA, 37 bp, Artificial Sequence
  Synthetic oligonucleotide
gcccgacagatccgcggcacccattccttcacttcga

SEQ ID NO: 181163 - DNA, 37 bp, Artificial Sequence
  Synthetic oligonucleotide
tcacccatttgctcattcgttccatggtccagttcga

SEQ ID NO: 181164 - DNA, 34 bp, Artificial Sequence
  Synthetic oligonucleotide
ttagacaaagaccggaaggggggagcaggcagga

SEQ ID NO: 181165 - DNA, 37 bp, Artificial Sequence
  Synthetic oligonucleotide
ccaccgtctgcctgcccaatgccaccatcaccacgga

SEQ ID NO: 181166 - DNA, 36 bp, Artificial Sequence
  Synthetic oligonucleotide
aggatggggggaaggtcggtggggtgtcgtggcgga

SEQ ID NO: 181167 - DNA, 38 bp, Artificial Sequence
  Synthetic oligonucleotide
gtggggaaatgcgtcgggacggttgggggggaagggga

SEQ ID NO: 181168 - DNA, 37 bp, Artificial Sequence
  Synthetic oligonucleotide
agcggggcggactcgcggtcgtaggagggggatggga

SEQ ID NO: 181169 - DNA, 35 bp, Artificial Sequence
  Synthetic oligonucleotide
ttacgtggggatcctaagggagggtaaggggtgga

SEQ ID NO: 181170 - DNA, 37 bp, Artificial Sequence
  Synthetic oligonucleotide
ggaggaagaagaaatggagcgggaacgggatcttgga

SEQ ID NO: 181171 - DNA, 38 bp, Artificial Sequence
  Synthetic oligonucleotide
gtcgcgggggggagtagagggtgggatctaaccaatga

SEQ ID NO: 181172 - DNA, 37 bp, Artificial Sequence
  Synthetic oligonucleotide
gccaccttaccctgctaccgacctcatctgctaatga

SEQ ID NO: 181173 - DNA, 38 bp, Artificial Sequence
  Synthetic oligonucleotide
gtcgcactgcgcaccacccccgtttagcccaccactga

SEQ ID NO: 181174 - DNA, 38 bp, Artificial Sequence
  Synthetic oligonucleotide
gttccacctcgccttccgtctagcgatctgtaccctga

SEQ ID NO: 181175 - DNA, 37 bp, Artificial Sequence
  Synthetic oligonucleotide
tccacgtccaggacacgtgctctccgtacctccctga

SEQ ID NO: 181176 - DNA, 35 bp, Artificial Sequence
  Synthetic oligonucleotide
aagtcgcctggacgcccctcctgctcgctccctga

SEQ ID NO: 181177 - DNA, 37 bp, Artificial Sequence
  Synthetic oligonucleotide
tgacaagcgcaccgtagtccgaccccgaacctcctga

SEQ ID NO: 181178 - DNA, 37 bp, Artificial Sequence
  Synthetic oligonucleotide
gcgcatgtcagaacggcgcacgtagcacacctcctga

SEQ ID NO: 181179 - DNA, 38 bp, Artificial Sequence
  Synthetic oligonucleotide
gtgaggtgagggtgaaggggggccatgaaggtcgctga

SEQ ID NO: 181180 - DNA, 38 bp, Artificial Sequence
  Synthetic oligonucleotide
gccggctcaataccgcatcgaccgttcccctcacgtga

SEQ ID NO: 181181 - DNA, 38 bp, Artificial Sequence
  Synthetic oligonucleotide
tacaccatcgcatccgtttcatctcggcgcacccgtga

SEQ ID NO: 181182 - DNA, 37 bp, Artificial Sequence
  Synthetic oligonucleotide
ttcgtccggcatctgatcccttctgcctcttcggtga

SEQ ID NO: 181183 - DNA, 35 bp, Artificial Sequence
  Synthetic oligonucleotide
tgtggtccccttcccatgtgttacatctttgcgta

SEQ ID NO: 181184 - DNA, 36 bp, Artificial Sequence
  Synthetic oligonucleotide
tcactcctcaccgaccgtggccccgttcattactta

SEQ ID NO: 181185 - DNA, 35 bp, Artificial Sequence
  Synthetic oligonucleotide
tctaaccccaccgactcttgctatgctccagttta

SEQ ID NO: 181186 - DNA, 35 bp, Artificial Sequence
  Synthetic oligonucleotide
accatccggtcgggttcgagaagctcttcatccac

SEQ ID NO: 181187 - DNA, 35 bp, Artificial Sequence
  Synthetic oligonucleotide
gtgcaggggcacctaattgtccttgtagcctccac

SEQ ID NO: 181188 - DNA, 35 bp, Artificial Sequence
  Synthetic oligonucleotide
gccgggtctgggtgggacgggggcggacagagcac

SEQ ID NO: 181189 - DNA, 35 bp, Artificial Sequence
  Synthetic oligonucleotide
tgcactcatggcccatctttccagttctatatcac

SEQ ID NO: 181190 - DNA, 35 bp, Artificial Sequence
  Synthetic oligonucleotide
tgtctccgtgccgtacgtcaccggtcccaacctac

SEQ ID NO: 181191 - DNA, 35 bp, Artificial Sequence
  Synthetic oligonucleotide
gccgtcgtagctggtttacagccgccgtaacttac

SEQ ID NO: 181192 - DNA, 35 bp, Artificial Sequence
  Synthetic oligonucleotide
tgctccaccacgttctctttggcagacgtactacc

SEQ ID NO: 181193 - DNA, 35 bp, Artificial Sequence
  Synthetic oligonucleotide
atgtgcgctctacccgtccctggttggtccgtacc

SEQ ID NO: 181194 - DNA, 35 bp, Artificial Sequence
  Synthetic oligonucleotide
accccttcacctgccgttaattcggattaacaccc

SEQ ID NO: 181195 - DNA, 36 bp, Artificial Sequence
  Synthetic oligonucleotide
agcaaaccacactggtttgtaaccctgaaccccccc

SEQ ID NO: 181196 - DNA, 35 bp, Artificial Sequence
  Synthetic oligonucleotide
atcccgtgacactttaattcgatgccaaatgcccc

SEQ ID NO: 181197 - DNA, 35 bp, Artificial Sequence
  Synthetic oligonucleotide
acatgtgggcagatcagtggtcccctttcgtcccc

SEQ ID NO: 181198 - DNA, 35 bp, Artificial Sequence
  Synthetic oligonucleotide
gatcatcctcccatgcggactaatcgaattggccc

SEQ ID NO: 181199 - DNA, 35 bp, Artificial Sequence
  Synthetic oligonucleotide
gccaagcatatcgcttgacctgggcccattctccc

SEQ ID NO: 181200 - DNA, 34 bp, Artificial Sequence
  Synthetic oligonucleotide
cccacaaccatgtgcctttcccagttaggttccc

SEQ ID NO: 181201 - DNA, 35 bp, Artificial Sequence
  Synthetic oligonucleotide
taggaccgctgctcacgctctgatacatcccagcc

SEQ ID NO: 181202 - DNA, 35 bp, Artificial Sequence
  Synthetic oligonucleotide
tccaactgcaatccaccgttctcattgccagagcc

SEQ ID NO: 181203 - DNA, 35 bp, Artificial Sequence
  Synthetic oligonucleotide
gcgctacagccgccctggtcacgcctgtccctgcc

SEQ ID NO: 181204 - DNA, 32 bp, Artificial Sequence
  Synthetic oligonucleotide
ttgagaccccgtaccgactccttgttcctgcc

SEQ ID NO: 181205 - DNA, 35 bp, Artificial Sequence
  Synthetic oligonucleotide
tcacttcatcgtccatccctctaagtcgcacctcc

SEQ ID NO: 181206 - DNA, 35 bp, Artificial Sequence
  Synthetic oligonucleotide
tatgtgtcgccgcaatatgacacgttattacctcc

SEQ ID NO: 181207 - DNA, 35 bp, Artificial Sequence
  Synthetic oligonucleotide
gcaccatgaccggcccatactggaacttgccctcc

SEQ ID NO: 181208 - DNA, 35 bp, Artificial Sequence
  Synthetic oligonucleotide
gcagtgcagcctctggtacagtaactttgccctcc

SEQ ID NO: 181209 - DNA, 35 bp, Artificial Sequence
  Synthetic oligonucleotide
gcagagtggagggggggtgggagatagggagctcc

SEQ ID NO: 181210 - DNA, 35 bp, Artificial Sequence
  Synthetic oligonucleotide
gtaatcagcacgcctttaaatacgtccagccttcc

SEQ ID NO: 181211 - DNA, 35 bp, Artificial Sequence
  Synthetic oligonucleotide
gctttgcccgccgattccgcatattgttccgttcc

SEQ ID NO: 181212 - DNA, 35 bp, Artificial Sequence
  Synthetic oligonucleotide
agccactgccctcgactccgcaatatgttatttcc

SEQ ID NO: 181213 - DNA, 35 bp, Artificial Sequence
  Synthetic oligonucleotide
gacgccttcgccgtggttcgtcttcggccctttcc

SEQ ID NO: 181214 - DNA, 36 bp, Artificial Sequence
  Synthetic oligonucleotide
gtctgccgttcgaatgtcacatgcccgtctttttcc

SEQ ID NO: 181215 - DNA, 35 bp, Artificial Sequence
  Synthetic oligonucleotide
gtctgcgtcccgccgcacgagtcattccaccccgc

SEQ ID NO: 181216 - DNA, 31 bp, Artificial Sequence
  Synthetic oligonucleotide
gccccgaacgtacctgccctttcttttccgc

SEQ ID NO: 181217 - DNA, 35 bp, Artificial Sequence
  Synthetic oligonucleotide
atgccgcctaccccttttatgccactagcaacggc

SEQ ID NO: 181218 - DNA, 35 bp, Artificial Sequence
  Synthetic oligonucleotide
atctcggcgtccgcttatctgttcactaccccggc

SEQ ID NO: 181219 - DNA, 35 bp, Artificial Sequence
  Synthetic oligonucleotide
taggccatcccgccttgttccgctcaccctgctgc

SEQ ID NO: 181220 - DNA, 35 bp, Artificial Sequence
  Synthetic oligonucleotide
tgcacgagcggagcccctttccctgtcgaatctgc

SEQ ID NO: 181221 - DNA, 35 bp, Artificial Sequence
  Synthetic oligonucleotide
tccgagactgcgcatcatcctcgactcacgtactc

SEQ ID NO: 181222 - DNA, 35 bp, Artificial Sequence
  Synthetic oligonucleotide
gtgtgagcactccttgtccgcctccgttgtccctc

SEQ ID NO: 181223 - DNA, 35 bp, Artificial Sequence
  Synthetic oligonucleotide
tgtgtggcgcagcatatatacaacccagtttcctc

SEQ ID NO: 181224 - DNA, 35 bp, Artificial Sequence
  Synthetic oligonucleotide
tacacgatcccccgcagcttacatacttacacgtc

SEQ ID NO: 181225 - DNA, 35 bp, Artificial Sequence
  Synthetic oligonucleotide
tataccggcctctgtattcttaattgtcccccgtc

SEQ ID NO: 181226 - DNA, 35 bp, Artificial Sequence
  Synthetic oligonucleotide
tttgtggctcgttcgtcacttgcaatctccctgtc

SEQ ID NO: 181227 - DNA, 35 bp, Artificial Sequence
  Synthetic oligonucleotide
gagccactccgcgctgttgtacgccctgtaccttc

SEQ ID NO: 181228 - DNA, 35 bp, Artificial Sequence
  Synthetic oligonucleotide
atgttagcccgacacgagcgctagatccccccttc

SEQ ID NO: 181229 - DNA, 35 bp, Artificial Sequence
  Synthetic oligonucleotide
acgcgcaacggttccagtagtccccgcgcgccttc

SEQ ID NO: 181230 - DNA, 35 bp, Artificial Sequence
  Synthetic oligonucleotide
ttctctcacgggaccggtgcgtttaccctgccttc

SEQ ID NO: 181231 - DNA, 35 bp, Artificial Sequence
  Synthetic oligonucleotide
ttcctcactcgcctggtatgaatcctacttagttc

SEQ ID NO: 181232 - DNA, 35 bp, Artificial Sequence
  Synthetic oligonucleotide
aacggggagaaagaagggacggggctcgatgtgag

SEQ ID NO: 181233 - DNA, 35 bp, Artificial Sequence
  Synthetic oligonucleotide
acctctgacacatctcccacttatgaccttgctcg

SEQ ID NO: 181234 - DNA, 35 bp, Artificial Sequence
  Synthetic oligonucleotide
acctgacagtgtctagtctctcttgttctatctcg

SEQ ID NO: 181235 - DNA, 35 bp, Artificial Sequence
  Synthetic oligonucleotide
tttccgccccttcacgcgctcaccttcttgggtcg

SEQ ID NO: 181236 - DNA, 35 bp, Artificial Sequence
  Synthetic oligonucleotide
gtccccgctgccttacccacgatccccaccttcgg

SEQ ID NO: 181237 - DNA, 35 bp, Artificial Sequence
  Synthetic oligonucleotide
tcagtcaccaagtaagcgagaaggggtggggcggg

SEQ ID NO: 181238 - DNA, 35 bp, Artificial Sequence
  Synthetic oligonucleotide
tcagccttcgtcccggcccttccatgttcttttgg

SEQ ID NO: 181239 - DNA, 35 bp, Artificial Sequence
  Synthetic oligonucleotide
atcacccagccgggcccgaacttcaccctttttgg

SEQ ID NO: 181240 - DNA, 35 bp, Artificial Sequence
  Synthetic oligonucleotide
tcccatatcagtcgttgaatcgctccctcgccctg

SEQ ID NO: 181241 - DNA, 35 bp, Artificial Sequence
  Synthetic oligonucleotide
gaaagtggtggaatagtagcggagtgacgggggtg

SEQ ID NO: 181242 - DNA, 35 bp, Artificial Sequence
  Synthetic oligonucleotide
acacaccacctaacatgtccgccgttccgctcttg

SEQ ID NO: 181243 - DNA, 35 bp, Artificial Sequence
  Synthetic oligonucleotide
tttaccctcctcgcccgccggccaagccgagcaat

SEQ ID NO: 181244 - DNA, 35 bp, Artificial Sequence
  Synthetic oligonucleotide
gaggggtgcacgatcccctgtctactccgaaccat

SEQ ID NO: 181245 - DNA, 35 bp, Artificial Sequence
  Synthetic oligonucleotide
tccttgtcctggtcacttagtccgctacgccccat

SEQ ID NO: 181246 - DNA, 35 bp, Artificial Sequence
  Synthetic oligonucleotide
gagggggaaagtagggatataacgatgggtgagat

SEQ ID NO: 181247 - DNA, 35 bp, Artificial Sequence
  Synthetic oligonucleotide
agttgatcagtcgcgctatatcctcgcccccatat

SEQ ID NO: 181248 - DNA, 35 bp, Artificial Sequence
  Synthetic oligonucleotide
actcgcatccacttgccggtatagctccgcaacct

SEQ ID NO: 181249 - DNA, 35 bp, Artificial Sequence
  Synthetic oligonucleotide
gtgccgacatggcttatcctgctttttccacgcct

SEQ ID NO: 181250 - DNA, 35 bp, Artificial Sequence
  Synthetic oligonucleotide
tagcctgcgccgttcacattatcagctgctttcct

SEQ ID NO: 181251 - DNA, 35 bp, Artificial Sequence
  Synthetic oligonucleotide
accctccgccccagaaagattccgcctggattgct

SEQ ID NO: 181252 - DNA, 35 bp, Artificial Sequence
  Synthetic oligonucleotide
tccccacctcacgccgtggcccggacccctattct

SEQ ID NO: 181253 - DNA, 35 bp, Artificial Sequence
  Synthetic oligonucleotide
gcgcggagtctcccatgggctccactgtttcttct

SEQ ID NO: 181254 - DNA, 35 bp, Artificial Sequence
  Synthetic oligonucleotide
atcccacttcacgtttgcccagtttcgtctttcgt

SEQ ID NO: 181255 - DNA, 35 bp, Artificial Sequence
  Synthetic oligonucleotide
acgagtccgttccctaggctttcaccccccctggt

SEQ ID NO: 181256 - DNA, 35 bp, Artificial Sequence
  Synthetic oligonucleotide
gtctaaccccgcgtccctactcgatctgtcacatt

SEQ ID NO: 181257 - DNA, 35 bp, Artificial Sequence
  Synthetic oligonucleotide
ggagctcagccatcgcatagtccctgctagccctt

SEQ ID NO: 181258 - DNA, 35 bp, Artificial Sequence
  Synthetic oligonucleotide
aagacacgttcgaagccgccatccgtacttgcctt

SEQ ID NO: 181259 - DNA, 35 bp, Artificial Sequence
  Synthetic oligonucleotide
tcagtcgcattcggtaactctcctcagcccggctt

SEQ ID NO: 181260 - DNA, 35 bp, Artificial Sequence
  Synthetic oligonucleotide
atgccccccagttgtattttgcttacgatcttctt

SEQ ID NO: 181261 - DNA, 35 bp, Artificial Sequence
  Synthetic oligonucleotide
ttgtaaccgtccacgtccctttctgtgctaccttt

SEQ ID NO: 181262 - DNA, 35 bp, Artificial Sequence
  Synthetic oligonucleotide
ggtgtagccctcctcctgttcaggcgcatcccttt

SEQ ID NO: 181263 - DNA, 35 bp, Artificial Sequence
  Synthetic oligonucleotide
tcgacaccttcgacgtttgcgcccaacactttttt

SEQ ID NO: 181264 - DNA, 36 bp, Artificial Sequence
  Synthetic oligonucleotide
gatgcatcactctattctccccccgttggttgccaa

SEQ ID NO: 181265 - DNA, 35 bp, Artificial Sequence
  Synthetic oligonucleotide
atcccgcgaacctttctcaccctaccgtccacgaa

SEQ ID NO: 181266 - DNA, 36 bp, Artificial Sequence
  Synthetic oligonucleotide
attgtgcgcgccatagtctaatcctcccctgcaaca

SEQ ID NO: 181267 - DNA, 36 bp, Artificial Sequence
  Synthetic oligonucleotide
ccctaccccctccgaatgtcgctacgtgtctgcaca

SEQ ID NO: 181268 - DNA, 36 bp, Artificial Sequence
  Synthetic oligonucleotide
gccaatcccgacacagcgtacagcacgcgcctcaca

SEQ ID NO: 181269 - DNA, 33 bp, Artificial Sequence
  Synthetic oligonucleotide
gtgccgataatcgtgcctcccccttgcgataca

SEQ ID NO: 181270 - DNA, 36 bp, Artificial Sequence
  Synthetic oligonucleotide
tccgccacgcctatcgtagggtcaacctccccgcca

SEQ ID NO: 181271 - DNA, 35 bp, Artificial Sequence
  Synthetic oligonucleotide
tcaccagttcgaccttcccttgttatctccggcca

SEQ ID NO: 181272 - DNA, 35 bp, Artificial Sequence
  Synthetic oligonucleotide
gcccgccggggttgagaagcccctttcccttgcca

SEQ ID NO: 181273 - DNA, 35 bp, Artificial Sequence
  Synthetic oligonucleotide
tccggggcattgagcgcgcatacttcacacctcca

SEQ ID NO: 181274 - DNA, 36 bp, Artificial Sequence
  Synthetic oligonucleotide
tgccaacccgcctcatccgcattggccctaattcca

SEQ ID NO: 181275 - DNA, 36 bp, Artificial Sequence
  Synthetic oligonucleotide
tccggacccacgaacattgttttctctcactacgca

SEQ ID NO: 181276 - DNA, 35 bp, Artificial Sequence
  Synthetic oligonucleotide
tcacctcaatccgcggtacttcctgcctccgcgca

SEQ ID NO: 181277 - DNA, 36 bp, Artificial Sequence
  Synthetic oligonucleotide
gactccccgatattacatgtttacgtgcctcttgca

SEQ ID NO: 181278 - DNA, 36 bp, Artificial Sequence
  Synthetic oligonucleotide
ttacatcctctgctcccggtcattcgacgttcctca

SEQ ID NO: 181279 - DNA, 36 bp, Artificial Sequence
  Synthetic oligonucleotide
acgccggttctctggctgttactttccaattcttca

SEQ ID NO: 181280 - DNA, 36 bp, Artificial Sequence
  Synthetic oligonucleotide
gagcacgctctgtccatctcggctgttcctctttca

SEQ ID NO: 181281 - DNA, 36 bp, Artificial Sequence
  Synthetic oligonucleotide
atcccgtagcctgtttttcctcgcacctggttttca

SEQ ID NO: 181282 - DNA, 37 bp, Artificial Sequence
  Synthetic oligonucleotide
gcaagcttcgggatgaacggggagggaaggggcaaga

SEQ ID NO: 181283 - DNA, 36 bp, Artificial Sequence
  Synthetic oligonucleotide
aagggagcaaggcatgggagggggctatgaggaaga

SEQ ID NO: 181284 - DNA, 37 bp, Artificial Sequence
  Synthetic oligonucleotide
tgagaggggaaagttggtgatggggatggcttggaga

SEQ ID NO: 181285 - DNA, 37 bp, Artificial Sequence
  Synthetic oligonucleotide
gcgcacgagccaaggtgagaggggggggaagactaga

SEQ ID NO: 181286 - DNA, 37 bp, Artificial Sequence
  Synthetic oligonucleotide
acacccccatcgcctctcagttcattatttcgaacga

SEQ ID NO: 181287 - DNA, 37 bp, Artificial Sequence
  Synthetic oligonucleotide
tgtgggagcagaggaaaataaatgggagggaacacga

SEQ ID NO: 181288 - DNA, 37 bp, Artificial Sequence
  Synthetic oligonucleotide
gtatcaggcccactgttgtctccctgttccaccccga

SEQ ID NO: 181289 - DNA, 35 bp, Artificial Sequence
  Synthetic oligonucleotide
gtaccatcccgggccgcgcgcttaggaccccccga

SEQ ID NO: 181290 - DNA, 36 bp, Artificial Sequence
  Synthetic oligonucleotide
tgtccaccttcccttgtgctcctccacgctccccga

SEQ ID NO: 181291 - DNA, 37 bp, Artificial Sequence
  Synthetic oligonucleotide
acccacgaacgtcctctatcttctagtctgctcccga

SEQ ID NO: 181292 - DNA, 36 bp, Artificial Sequence
  Synthetic oligonucleotide
ttgatcaccgaccatatccacatagttctccgccga

SEQ ID NO: 181293 - DNA, 36 bp, Artificial Sequence
  Synthetic oligonucleotide
agttgctcctgaacgccgccttaccaccctcgccga

SEQ ID NO: 181294 - DNA, 37 bp, Artificial Sequence
  Synthetic oligonucleotide
ttcgacaccagctgccctgctctcatcgcccatgcga

SEQ ID NO: 181295 - DNA, 37 bp, Artificial Sequence
  Synthetic oligonucleotide
aacccgccccactccctcatctcggctcgccgatcga

SEQ ID NO: 181296 - DNA, 36 bp, Artificial Sequence
  Synthetic oligonucleotide
tgccgacgcccgcaggtttgggccatttcatctcga

SEQ ID NO: 181297 - DNA, 37 bp, Artificial Sequence
  Synthetic oligonucleotide
aactcgccccaacaccctcacccagtgcctagcggga

SEQ ID NO: 181298 - DNA, 37 bp, Artificial Sequence
  Synthetic oligonucleotide
gaagggaggaaagggtgcacttagcgggtgcggggga

SEQ ID NO: 181299 - DNA, 37 bp, Artificial Sequence
  Synthetic oligonucleotide
gggtaacacaacgggggggcgagcgagactgggtgga

SEQ ID NO: 181300 - DNA, 38 bp, Artificial Sequence
  Synthetic oligonucleotide
gacaagggcacagcgggctatgtaagggcggacaatga

SEQ ID NO: 181301 - DNA, 38 bp, Artificial Sequence
  Synthetic oligonucleotide
gcaccgcccctacgttcccgtcttcattcgttgcatga

SEQ ID NO: 181302 - DNA, 38 bp, Artificial Sequence
  Synthetic oligonucleotide
gacagtagggggagacggttacgtaggggaagggatga

SEQ ID NO: 181303 - DNA, 38 bp, Artificial Sequence
  Synthetic oligonucleotide
gctgggtcctcagtatcgccgcctctctgcccacctga

SEQ ID NO: 181304 - DNA, 38 bp, Artificial Sequence
  Synthetic oligonucleotide
ttgcctccccatgtgccgccaagttcttcctaccctga

SEQ ID NO: 181305 - DNA, 38 bp, Artificial Sequence
  Synthetic oligonucleotide
aggagggtgaggcgaggggccggggaggggtacagtga

SEQ ID NO: 181306 - DNA, 37 bp, Artificial Sequence
  Synthetic oligonucleotide
accctgggagggagggtgggatttctcacaagagtga

SEQ ID NO: 181307 - DNA, 38 bp, Artificial Sequence
  Synthetic oligonucleotide
tctccaccgtgtttgactttaccctctgccactcgtga

SEQ ID NO: 181308 - DNA, 38 bp, Artificial Sequence
  Synthetic oligonucleotide
tcgcgggtgggagggatgggttactaggggacatgtga

SEQ ID NO: 181309 - DNA, 37 bp, Artificial Sequence
  Synthetic oligonucleotide
gtcgacacctccattgcaagcgatactccctctgtga

SEQ ID NO: 181310 - DNA, 37 bp, Artificial Sequence
  Synthetic oligonucleotide
gcatcatccaggctctgtcctcacgtatcccttgtga

SEQ ID NO: 181311 - DNA, 38 bp, Artificial Sequence
  Synthetic oligonucleotide
gggtaccatccgtgctgttctttcctgcactttattga

SEQ ID NO: 181312 - DNA, 38 bp, Artificial Sequence
  Synthetic oligonucleotide
gctcctgctcgcaccgatgaccatccaccctgccttga

SEQ ID NO: 181313 - DNA, 38 bp, Artificial Sequence
  Synthetic oligonucleotide
tgccccccccgttgccttataacttctgtacgtgttga

SEQ ID NO: 181314 - DNA, 36 bp, Artificial Sequence
  Synthetic oligonucleotide
taagccaactcccttagtgtcccctgctcgttaata

SEQ ID NO: 181315 - DNA, 35 bp, Artificial Sequence
  Synthetic oligonucleotide
ttcgactgcacggagggggctcagggtgggagata

SEQ ID NO: 181316 - DNA, 36 bp, Artificial Sequence
  Synthetic oligonucleotide
gagacgtcgaggggagggggagaatgtcaggggata

SEQ ID NO: 181317 - DNA, 35 bp, Artificial Sequence
  Synthetic oligonucleotide
tcacgcctccatcgccatgtcgaaatagccgccta

SEQ ID NO: 181318 - DNA, 37 bp, Artificial Sequence
  Synthetic oligonucleotide
acatcctgtacgcagctattctccccctctggcgcta

SEQ ID NO: 181319 - DNA, 36 bp, Artificial Sequence
  Synthetic oligonucleotide
gacgcccatccccagatcgactcatccgccactcta

SEQ ID NO: 181320 - DNA, 36 bp, Artificial Sequence
  Synthetic oligonucleotide
ttgcagtgcatttggctggcccctccctctcctcta

SEQ ID NO: 181321 - DNA, 36 bp, Artificial Sequence
  Synthetic oligonucleotide
tacatgccccgcccccggccattgatagacagtcta

SEQ ID NO: 181322 - DNA, 36 bp, Artificial Sequence
  Synthetic oligonucleotide
aaccagcgcagcttttgttctatcctttctgcagta

SEQ ID NO: 181323 - DNA, 36 bp, Artificial Sequence
  Synthetic oligonucleotide
accgcccacctctttatgcttacatttgtgtacgta

SEQ ID NO: 181324 - DNA, 36 bp, Artificial Sequence
  Synthetic oligonucleotide
gtgtcgccggcactttctgttacccctctcacggta

SEQ ID NO: 181325 - DNA, 35 bp, Artificial Sequence
  Synthetic oligonucleotide
gatccgcccccctttgcatcacagacacaatccac

SEQ ID NO: 181326 - DNA, 35 bp, Artificial Sequence
  Synthetic oligonucleotide
ttcccccgcttaatggtcatcaccatcatttccac

SEQ ID NO: 181327 - DNA, 35 bp, Artificial Sequence
  Synthetic oligonucleotide
gcctccccgcaacgtcccgattatgcgtcattcac

SEQ ID NO: 181328 - DNA, 35 bp, Artificial Sequence
  Synthetic oligonucleotide
gcatacctctcacctcatcatcgcccatgacagac

SEQ ID NO: 181329 - DNA, 35 bp, Artificial Sequence
  Synthetic oligonucleotide
aagaacgggagggtgggttcggtgagggtgcctac

SEQ ID NO: 181330 - DNA, 35 bp, Artificial Sequence
  Synthetic oligonucleotide
tccagccccatttctatagccactttcccgtcacc

SEQ ID NO: 181331 - DNA, 35 bp, Artificial Sequence
  Synthetic oligonucleotide
tatcgcctccctcctgttttgatacctccgtgacc

SEQ ID NO: 181332 - DNA, 35 bp, Artificial Sequence
  Synthetic oligonucleotide
tctcgtaacagcgcgattatgccctcttgtctacc

SEQ ID NO: 181333 - DNA, 35 bp, Artificial Sequence
  Synthetic oligonucleotide
ttgcgaagacaccccttctgctacgtgaacacccc

SEQ ID NO: 181334 - DNA, 35 bp, Artificial Sequence
  Synthetic oligonucleotide
gtgatctccgcggctatatacgtttgccccacccc

SEQ ID NO: 181335 - DNA, 35 bp, Artificial Sequence
  Synthetic oligonucleotide
atcgccacgtcgccctgccctcggaactgcccccc

SEQ ID NO: 181336 - DNA, 35 bp, Artificial Sequence
  Synthetic oligonucleotide
attgatccacgccctgcttaaaagttcctcgcccc

SEQ ID NO: 181337 - DNA, 36 bp, Artificial Sequence
  Synthetic oligonucleotide
gatgagcccaatgtaccgcacctccctgtttaagcc

SEQ ID NO: 181338 - DNA, 35 bp, Artificial Sequence
  Synthetic oligonucleotide
atcttgcaacgctcaacactgccatacccactgcc

SEQ ID NO: 181339 - DNA, 35 bp, Artificial Sequence
  Synthetic oligonucleotide
gactacgacctcagccatcactcacactaccctcc

SEQ ID NO: 181340 - DNA, 35 bp, Artificial Sequence
  Synthetic oligonucleotide
gcaataacctcgctgacacgttcgggcgcccctcc

SEQ ID NO: 181341 - DNA, 35 bp, Artificial Sequence
  Synthetic oligonucleotide
tttacgcccttgctctgccaacttagatagcctcc

SEQ ID NO: 181342 - DNA, 35 bp, Artificial Sequence
  Synthetic oligonucleotide
ggtagcacctctcgcatctcgtacctgacgcctcc

SEQ ID NO: 181343 - DNA, 35 bp, Artificial Sequence
  Synthetic oligonucleotide
tttccgccccctaatgctctaagactcatcgacgc

SEQ ID NO: 181344 - DNA, 35 bp, Artificial Sequence
  Synthetic oligonucleotide
gtgtcatctatccgctgttctctcagtcccaccgc

SEQ ID NO: 181345 - DNA, 34 bp, Artificial Sequence
  Synthetic oligonucleotide
agccaccgccacccgagccgtatgcccgtgccgc

SEQ ID NO: 181346 - DNA, 35 bp, Artificial Sequence
  Synthetic oligonucleotide
agtgcccccttcctgcctagactttctgcgtgcgc

SEQ ID NO: 181347 - DNA, 35 bp, Artificial Sequence
  Synthetic oligonucleotide
gaatagcgcgcccccagtttttatctctccgtcgc

SEQ ID NO: 181348 - DNA, 35 bp, Artificial Sequence
  Synthetic oligonucleotide
tgctccacttccgaatgtacccagcctgtcgttgc

SEQ ID NO: 181349 - DNA, 35 bp, Artificial Sequence
  Synthetic oligonucleotide
gccatcctgcagtctatttcttacaatcctgttgc

SEQ ID NO: 181350 - DNA, 35 bp, Artificial Sequence
  Synthetic oligonucleotide
atgcgctgagcatgctcgggtaactccttctactc

SEQ ID NO: 181351 - DNA, 35 bp, Artificial Sequence
  Synthetic oligonucleotide
gaaccctcatacactcgtgtgaactggctcccctc

SEQ ID NO: 181352 - DNA, 35 bp, Artificial Sequence
  Synthetic oligonucleotide
gcctgcctccgttcgatcaccggtcacctatcctc

SEQ ID NO: 181353 - DNA, 35 bp, Artificial Sequence
  Synthetic oligonucleotide
agagccacctagggtgccactcgttctctttcctc

SEQ ID NO: 181354 - DNA, 35 bp, Artificial Sequence
  Synthetic oligonucleotide
ttgcattacgccgattaaagcgtatcgtacctctc

SEQ ID NO: 181355 - DNA, 35 bp, Artificial Sequence
  Synthetic oligonucleotide
aatcgggcgcccggtctcatgctacttcccaggtc

SEQ ID NO: 181356 - DNA, 35 bp, Artificial Sequence
  Synthetic oligonucleotide
gcctcttgtcacgtttccattgcgtttatcgattc

SEQ ID NO: 181357 - DNA, 35 bp, Artificial Sequence
  Synthetic oligonucleotide
gttgccattccgtttgcctatatccaggttctttc

SEQ ID NO: 181358 - DNA, 35 bp, Artificial Sequence
  Synthetic oligonucleotide
gaggtggtggggacgtagggggcctggggatctag

SEQ ID NO: 181359 - DNA, 35 bp, Artificial Sequence
  Synthetic oligonucleotide
gaacccatcagactgcattgtgttaccctccttag

SEQ ID NO: 181360 - DNA, 34 bp, Artificial Sequence
  Synthetic oligonucleotide
ttcgttccaccatcaaagccattccattatgacg

SEQ ID NO: 181361 - DNA, 35 bp, Artificial Sequence
  Synthetic oligonucleotide
agcatgttgctgctccccgtttatccctggcaccg

SEQ ID NO: 181362 - DNA, 35 bp, Artificial Sequence
  Synthetic oligonucleotide
acctgtggctaaccgaaccccgccctttcgtaccg

SEQ ID NO: 181363 - DNA, 35 bp, Artificial Sequence
  Synthetic oligonucleotide
gggtggcgtgggggttttgcggatggcacatcgcg

SEQ ID NO: 181364 - DNA, 35 bp, Artificial Sequence
  Synthetic oligonucleotide
aagcatggtcgcccgcatcgtctcgtctcttctcg

SEQ ID NO: 181365 - DNA, 35 bp, Artificial Sequence
  Synthetic oligonucleotide
ggatgctggtggtgggagggtggggttaaagtagg

SEQ ID NO: 181366 - DNA, 35 bp, Artificial Sequence
  Synthetic oligonucleotide
gctcgagagcaggagggagtgaagggttggtcatg

SEQ ID NO: 181367 - DNA, 35 bp, Artificial Sequence
  Synthetic oligonucleotide
cattccccttccgctgaagcactttggtccaactg

SEQ ID NO: 181368 - DNA, 35 bp, Artificial Sequence
  Synthetic oligonucleotide
agtaccactccgtccaacctctcaccacgatcgtg

SEQ ID NO: 181369 - DNA, 35 bp, Artificial Sequence
  Synthetic oligonucleotide
acatcgacatcaactgtcaactcccgtcctccttg

SEQ ID NO: 181370 - DNA, 35 bp, Artificial Sequence
  Synthetic oligonucleotide
gcagtacctccacctgagcaccagccccctcgaat

SEQ ID NO: 181371 - DNA, 35 bp, Artificial Sequence
  Synthetic oligonucleotide
gccatcgacccgttctcttgctttccaggacctat

SEQ ID NO: 181372 - DNA, 35 bp, Artificial Sequence
  Synthetic oligonucleotide
gccatcctcctgcctgttgcggtgccccctggtat

SEQ ID NO: 181373 - DNA, 35 bp, Artificial Sequence
  Synthetic oligonucleotide
tgcttccatccactcgttataccgaacctcgttat

SEQ ID NO: 181374 - DNA, 35 bp, Artificial Sequence
  Synthetic oligonucleotide
acaccgcacggtaccatcctgctcatctagccact

SEQ ID NO: 181375 - DNA, 35 bp, Artificial Sequence
  Synthetic oligonucleotide
gtctgcccattcaccatcttttgaagcgacggcct

SEQ ID NO: 181376 - DNA, 35 bp, Artificial Sequence
  Synthetic oligonucleotide
acagataggccgcctatgccctctagcccttgcct

SEQ ID NO: 181377 - DNA, 35 bp, Artificial Sequence
  Synthetic oligonucleotide
tgactccgtgtttctgcgcgaattctatccctcct

SEQ ID NO: 181378 - DNA, 35 bp, Artificial Sequence
  Synthetic oligonucleotide
tcgtaccgtcttgtcgtttcccttgctactttcct

SEQ ID NO: 181379 - DNA, 35 bp, Artificial Sequence
  Synthetic oligonucleotide
tcctctgcgtagactgaatctccacccgctttcct

SEQ ID NO: 181380 - DNA, 35 bp, Artificial Sequence
  Synthetic oligonucleotide
ttggaaactcgcaggtcccttcactgtccaccgct

SEQ ID NO: 181381 - DNA, 35 bp, Artificial Sequence
  Synthetic oligonucleotide
ggccacacatcattgcactttcctccgcgctggct

SEQ ID NO: 181382 - DNA, 35 bp, Artificial Sequence
  Synthetic oligonucleotide
atcacgatgtcatcaacggccatgaaacttcctct

SEQ ID NO: 181383 - DNA, 35 bp, Artificial Sequence
  Synthetic oligonucleotide
gtaccagccgctcttgcctatttgcgctcgtttct

SEQ ID NO: 181384 - DNA, 35 bp, Artificial Sequence
  Synthetic oligonucleotide
gccagtctagtgtggccctcgttcgtttgtgccgt

SEQ ID NO: 181385 - DNA, 35 bp, Artificial Sequence
  Synthetic oligonucleotide
aagggctgtgtacgggagggggaggggagggtggt

SEQ ID NO: 181386 - DNA, 35 bp, Artificial Sequence
  Synthetic oligonucleotide
gtagcgccgccttttctgtccgacttcattttggt

SEQ ID NO: 181387 - DNA, 35 bp, Artificial Sequence
  Synthetic oligonucleotide
tccgcattccaccctgttcgcactcaccgctcgtt

SEQ ID NO: 181388 - DNA, 35 bp, Artificial Sequence
  Synthetic oligonucleotide
agacgggcacggggggtggggatttctgatgaaaa

SEQ ID NO: 181389 - DNA, 36 bp, Artificial Sequence
  Synthetic oligonucleotide
agtggaggacgaaggggggttaatgggttgacacaa

SEQ ID NO: 181390 - DNA, 32 bp, Artificial Sequence
  Synthetic oligonucleotide
ggatcggcctcataccgcctttcaccttacaa

SEQ ID NO: 181391 - DNA, 36 bp, Artificial Sequence
  Synthetic oligonucleotide
gttcccacccccagtctactcattacgtacgcccaa

SEQ ID NO: 181392 - DNA, 35 bp, Artificial Sequence
  Synthetic oligonucleotide
caacccacgctgttcgccgtttcgacccattccaa

SEQ ID NO: 181393 - DNA, 36 bp, Artificial Sequence
  Synthetic oligonucleotide
accactctgccacgtatgtcgctacttactcatcaa

SEQ ID NO: 181394 - DNA, 35 bp, Artificial Sequence
  Synthetic oligonucleotide
tatcagacacagtgggtgggtacgggggggcagaa

SEQ ID NO: 181395 - DNA, 36 bp, Artificial Sequence
  Synthetic oligonucleotide
atcgactactgcccccgatactttttttccgccgaa

SEQ ID NO: 181396 - DNA, 35 bp, Artificial Sequence
  Synthetic oligonucleotide
accctccctcagtgcgctctttgcctaccttcgaa

SEQ ID NO: 181397 - DNA, 35 bp, Artificial Sequence
  Synthetic oligonucleotide
aacaagggggggactacgggtacatgtcacgggaa

SEQ ID NO: 181398 - DNA, 36 bp, Artificial Sequence
  Synthetic oligonucleotide
aagagccatggagacgattcgagaggggggtgggaa

SEQ ID NO: 181399 - DNA, 35 bp, Artificial Sequence
  Synthetic oligonucleotide
gctgactggggaagagggacatgggggactgtgaa

SEQ ID NO: 181400 - DNA, 36 bp, Artificial Sequence
  Synthetic oligonucleotide
gatctgcttgactatctgtttagccaccccccacca

SEQ ID NO: 181401 - DNA, 36 bp, Artificial Sequence
  Synthetic oligonucleotide
tgctggccctctcacgtttctaacggacctttacca

SEQ ID NO: 181402 - DNA, 36 bp, Artificial Sequence
  Synthetic oligonucleotide
ttgagcaccgcaccgtccctacataattctggccca

SEQ ID NO: 181403 - DNA, 36 bp, Artificial Sequence
  Synthetic oligonucleotide
tgccacctcagcccctgtcctccttttttagtgcca

SEQ ID NO: 181404 - DNA, 36 bp, Artificial Sequence
  Synthetic oligonucleotide
ggtacagacgtcaatattctcagcgctccacctcca

SEQ ID NO: 181405 - DNA, 35 bp, Artificial Sequence
  Synthetic oligonucleotide
gtcgtccccggcccctccaaaaacttccagctgca

SEQ ID NO: 181406 - DNA, 36 bp, Artificial Sequence
  Synthetic oligonucleotide
tggtgacgaaggaggataaacgggcagggtgggtca

SEQ ID NO: 181407 - DNA, 35 bp, Artificial Sequence
  Synthetic oligonucleotide
ttcagcctttcggtccgttattgtcgctcctttca

SEQ ID NO: 181408 - DNA, 36 bp, Artificial Sequence
  Synthetic oligonucleotide
tgcctaccactgcgttgtcaactcgttcccttttca

SEQ ID NO: 181409 - DNA, 37 bp, Artificial Sequence
  Synthetic oligonucleotide
aacgtgacgcggggggtgggtgcaaggcgcatgcaga

SEQ ID NO: 181410 - DNA, 37 bp, Artificial Sequence
  Synthetic oligonucleotide
tggggtgcctgggtggccaagggggaggtgggagaga

SEQ ID NO: 181411 - DNA, 37 bp, Artificial Sequence
  Synthetic oligonucleotide
gacatcccacctgctgctagccccctcttgttcacga

SEQ ID NO: 181412 - DNA, 37 bp, Artificial Sequence
  Synthetic oligonucleotide
tgctcgacacatcttgccccacttcacgccgatacga

SEQ ID NO: 181413 - DNA, 37 bp, Artificial Sequence
  Synthetic oligonucleotide
tacgcagctgctgctcacttacacctgtccctcccga

SEQ ID NO: 181414 - DNA, 36 bp, Artificial Sequence
  Synthetic oligonucleotide
gtcacgccctatgacaccgccgccctcaattcccga

SEQ ID NO: 181415 - DNA, 37 bp, Artificial Sequence
  Synthetic oligonucleotide
gctgcaccccgcccacgttatcgcacatcctcgccga

SEQ ID NO: 181416 - DNA, 36 bp, Artificial Sequence
  Synthetic oligonucleotide
accttcaccgaagttgcttgctccctctcgatccga

SEQ ID NO: 181417 - DNA, 37 bp, Artificial Sequence
  Synthetic oligonucleotide
acatccccccatatgccttacgtgatcacacctgcga

SEQ ID NO: 181418 - DNA, 37 bp, Artificial Sequence
  Synthetic oligonucleotide
gtcccactgttccccggtgttcgttgtcctctatcga

SEQ ID NO: 181419 - DNA, 37 bp, Artificial Sequence
  Synthetic oligonucleotide
gatcgaggggagttgaggaacggagcgaagtggagga

SEQ ID NO: 181420 - DNA, 37 bp, Artificial Sequence
  Synthetic oligonucleotide
gcaccccagccctcctgtttccgtctaagcattagga

SEQ ID NO: 181421 - DNA, 37 bp, Artificial Sequence
  Synthetic oligonucleotide
aatacccctgtcaatgcctttgcgcgccctacccgga

SEQ ID NO: 181422 - DNA, 36 bp, Artificial Sequence
  Synthetic oligonucleotide
agtgttgcacatgaaccccatccctccgctcccgga

SEQ ID NO: 181423 - DNA, 37 bp, Artificial Sequence
  Synthetic oligonucleotide
ttcgccatccatacactgcctttgcctagactccgga

SEQ ID NO: 181424 - DNA, 37 bp, Artificial Sequence
  Synthetic oligonucleotide
acagtgggtgggcgggggaagtccaaccggttaggga

SEQ ID NO: 181425 - DNA, 37 bp, Artificial Sequence
  Synthetic oligonucleotide
ccggatgggaggggcaaatttggggtaaaacagggga

SEQ ID NO: 181426 - DNA, 37 bp, Artificial Sequence
  Synthetic oligonucleotide
gaagagcgtaacggcgggcaaagaattacggggggga

SEQ ID NO: 181427 - DNA, 37 bp, Artificial Sequence
  Synthetic oligonucleotide
tgggtccgcagtaggggcgggatatgtgtcttgggga

SEQ ID NO: 181428 - DNA, 37 bp, Artificial Sequence
  Synthetic oligonucleotide
gtaatagcggtgggggacggggaaggctggctatgga

SEQ ID NO: 181429 - DNA, 34 bp, Artificial Sequence
  Synthetic oligonucleotide
agtacacaccgcccacctctcggaaatctctgga

SEQ ID NO: 181430 - DNA, 37 bp, Artificial Sequence
  Synthetic oligonucleotide
aacgcccctgaactcgtgccaccatgctttcacatga

SEQ ID NO: 181431 - DNA, 36 bp, Artificial Sequence
  Synthetic oligonucleotide
tgtgcgcccaatatatcttcgctgctatttccatga

SEQ ID NO: 181432 - DNA, 38 bp, Artificial Sequence
  Synthetic oligonucleotide
tagcctgtgcctgcaagttttttcgccacctttcatga

SEQ ID NO: 181433 - DNA, 37 bp, Artificial Sequence
  Synthetic oligonucleotide
acctacgacgcctcctgcccctctcttttagacctga

SEQ ID NO: 181434 - DNA, 37 bp, Artificial Sequence
  Synthetic oligonucleotide
gtgcccaagcgcaaccttgatacacactccaccctga

SEQ ID NO: 181435 - DNA, 37 bp, Artificial Sequence
  Synthetic oligonucleotide
tctctgacgcctgctctttctaactcccgggccctga

SEQ ID NO: 181436 - DNA, 35 bp, Artificial Sequence
  Synthetic oligonucleotide
acattcctcgaccgacccatttgtgacctcgctga

SEQ ID NO: 181437 - DNA, 36 bp, Artificial Sequence
  Synthetic oligonucleotide
tcgactccctctcttattgtaatacgcacctgctga

SEQ ID NO: 181438 - DNA, 36 bp, Artificial Sequence
  Synthetic oligonucleotide
tctccatatgccctccgcccaccgacaaggtgctga

SEQ ID NO: 181439 - DNA, 38 bp, Artificial Sequence
  Synthetic oligonucleotide
gaaggagaggtgtgggagggtgagcagacgagtagtga

SEQ ID NO: 181440 - DNA, 38 bp, Artificial Sequence
  Synthetic oligonucleotide
tgttgcatcacctcctttactacgccccagacctgtga

SEQ ID NO: 181441 - DNA, 38 bp, Artificial Sequence
  Synthetic oligonucleotide
acagggaggcgggtgtgggtgtaggttgcccctattga

SEQ ID NO: 181442 - DNA, 38 bp, Artificial Sequence
  Synthetic oligonucleotide
agacccgcccctagccctgtcacgactacttccgttga

SEQ ID NO: 181443 - DNA, 38 bp, Artificial Sequence
  Synthetic oligonucleotide
acaagtcaagagggtagggctgacgggtgaagggttga

SEQ ID NO: 181444 - DNA, 37 bp, Artificial Sequence
  Synthetic oligonucleotide
acgacgtccactgttgcgtcgttttctctcattttga

SEQ ID NO: 181445 - DNA, 37 bp, Artificial Sequence
  Synthetic oligonucleotide
aggtaccccacgcccgtattcgcccggctacttttga

SEQ ID NO: 181446 - DNA, 38 bp, Artificial Sequence
  Synthetic oligonucleotide
ttgtccctgcatcatcgtctccgccacgtctcttttga

SEQ ID NO: 181447 - DNA, 35 bp, Artificial Sequence
  Synthetic oligonucleotide
tgtcgctacggtcacccccgtattcccatcacata

SEQ ID NO: 181448 - DNA, 37 bp, Artificial Sequence
  Synthetic oligonucleotide
acccgcctcccgcttggtttgcaacactgttcacata

SEQ ID NO: 181449 - DNA, 35 bp, Artificial Sequence
  Synthetic oligonucleotide
tcaggtcgcctcctgctgccttcccgtaaatcata

SEQ ID NO: 181450 - DNA, 36 bp, Artificial Sequence
  Synthetic oligonucleotide
gaaatacagggtgggcgggacggcgagaacggacta

SEQ ID NO: 181451 - DNA, 35 bp, Artificial Sequence
  Synthetic oligonucleotide
atgcaccccgccctgcacaactgctgcttatacta

SEQ ID NO: 181452 - DNA, 36 bp, Artificial Sequence
  Synthetic oligonucleotide
accttcgccgccgcggttagtgcacccgccatccta

SEQ ID NO: 181453 - DNA, 35 bp, Artificial Sequence
  Synthetic oligonucleotide
ttgtcacagcaggtcttattttttcccgtcccgta

SEQ ID NO: 181454 - DNA, 36 bp, Artificial Sequence
  Synthetic oligonucleotide
acaccattctccgctgcccatgtcctaccgtgggta

SEQ ID NO: 181455 - DNA, 36 bp, Artificial Sequence
  Synthetic oligonucleotide
gccgccccgccacaattcatgggttcgcccctggta

SEQ ID NO: 181456 - DNA, 36 bp, Artificial Sequence
  Synthetic oligonucleotide
gatgcctttgccttgttgagccccattttcactgta

SEQ ID NO: 181457 - DNA, 36 bp, Artificial Sequence
  Synthetic oligonucleotide
tagcccctatgcatacaaccgcccgtttcccgctta

SEQ ID NO: 181458 - DNA, 36 bp, Artificial Sequence
  Synthetic oligonucleotide
ggacgatcagccccgcctctgcctcccttgccgtta

SEQ ID NO: 181459 - DNA, 35 bp, Artificial Sequence
  Synthetic oligonucleotide
tgcacagtccatcatttcgccttcacctgaggtta

SEQ ID NO: 181460 - DNA, 36 bp, Artificial Sequence
  Synthetic oligonucleotide
tcactgccccctcattcgtgcaaacgttcagtgtta

SEQ ID NO: 181461 - DNA, 36 bp, Artificial Sequence
  Synthetic oligonucleotide
gtcaggtcctgccgccgtcatgcccctctccattta

SEQ ID NO: 181462 - DNA, 35 bp, Artificial Sequence
  Synthetic oligonucleotide
tgcgttgacgcctctatcgatatagcccatcttta

SEQ ID NO: 181463 - DNA, 35 bp, Artificial Sequence
  Synthetic oligonucleotide
ttcgatcgcattacgcacatagcctcggttcacac

SEQ ID NO: 181464 - DNA, 35 bp, Artificial Sequence
  Synthetic oligonucleotide
agcttccccagaagcccgtagaaaccctgctacac

SEQ ID NO: 181465 - DNA, 35 bp, Artificial Sequence
  Synthetic oligonucleotide
gtccaccaccgatcatcgtaacgccggggttttac

SEQ ID NO: 181466 - DNA, 35 bp, Artificial Sequence
  Synthetic oligonucleotide
aacgccgtatctgtctttatccgatttgcgctacc

SEQ ID NO: 181467 - DNA, 35 bp, Artificial Sequence
  Synthetic oligonucleotide
gccgaccacccatagtgctaaggtggtaacccccc

SEQ ID NO: 181468 - DNA, 35 bp, Artificial Sequence
  Synthetic oligonucleotide
tactgccgcccctggtctagaccgcttagctcccc

SEQ ID NO: 181469 - DNA, 35 bp, Artificial Sequence
  Synthetic oligonucleotide
acccgacaaccagtataaacgcaagcccccgtccc

SEQ ID NO: 181470 - DNA, 35 bp, Artificial Sequence
  Synthetic oligonucleotide
atcgccccacacagctgtattccaagccctccgcc

SEQ ID NO: 181471 - DNA, 35 bp, Artificial Sequence
  Synthetic oligonucleotide
gtgggttgcgttccctgttactttttgtacgcgcc

SEQ ID NO: 181472 - DNA, 35 bp, Artificial Sequence
  Synthetic oligonucleotide
atgccatcctgtccaccctttgtctgagacttgcc

SEQ ID NO: 181473 - DNA, 35 bp, Artificial Sequence
  Synthetic oligonucleotide
gctgttacacgttctaggcgcaccggtcctcctcc

SEQ ID NO: 181474 - DNA, 35 bp, Artificial Sequence
  Synthetic oligonucleotide
ggacaccttatgtagccacctgggctgtccgctcc

SEQ ID NO: 181475 - DNA, 35 bp, Artificial Sequence
  Synthetic oligonucleotide
acctcttggcagtctgcggttcgcgcggcccttcc

SEQ ID NO: 181476 - DNA, 35 bp, Artificial Sequence
  Synthetic oligonucleotide
ttaggcacccgcccccttgcggcactgtcccttcc

SEQ ID NO: 181477 - DNA, 35 bp, Artificial Sequence
  Synthetic oligonucleotide
actcgacaggccctccgacccctaacatatcttcc

SEQ ID NO: 181478 - DNA, 35 bp, Artificial Sequence
  Synthetic oligonucleotide
gatggtgggggatgggcgtagataagacgtgcagc

SEQ ID NO: 181479 - DNA, 35 bp, Artificial Sequence
  Synthetic oligonucleotide
tccccatcccggtttagttttctgtttcagctagc

SEQ ID NO: 181480 - DNA, 35 bp, Artificial Sequence
  Synthetic oligonucleotide
agcaagatgccttccctcaccgcccctcggaccgc

SEQ ID NO: 181481 - DNA, 35 bp, Artificial Sequence
  Synthetic oligonucleotide
tcttagctgctgccaactggccattgatccgccgc

SEQ ID NO: 181482 - DNA, 35 bp, Artificial Sequence
  Synthetic oligonucleotide
acacgtccctcgcacatcagccttagccaccaatc

SEQ ID NO: 181483 - DNA, 35 bp, Artificial Sequence
  Synthetic oligonucleotide
gacaagttgaccgggaggtagtacgggggggaatc

SEQ ID NO: 181484 - DNA, 35 bp, Artificial Sequence
  Synthetic oligonucleotide
tcacggtcacagcgtagacttcaaccccgcccatc

SEQ ID NO: 181485 - DNA, 35 bp, Artificial Sequence
  Synthetic oligonucleotide
agctcacacaattcgtatccgtcgtccattccatc

SEQ ID NO: 181486 - DNA, 35 bp, Artificial Sequence
  Synthetic oligonucleotide
taaccgctaccgccctcttcgtaaatatatcgatc

SEQ ID NO: 181487 - DNA, 35 bp, Artificial Sequence
  Synthetic oligonucleotide
gacgccgctagaccccactttgggccactcctatc

SEQ ID NO: 181488 - DNA, 35 bp, Artificial Sequence
  Synthetic oligonucleotide
gcaaccactgcgctgatacgcctatgaccgccctc

SEQ ID NO: 181489 - DNA, 35 bp, Artificial Sequence
  Synthetic oligonucleotide
taacccacgactacttttccagtcaggccgccctc

SEQ ID NO: 181490 - DNA, 35 bp, Artificial Sequence
  Synthetic oligonucleotide
gtcttgctgcccgacccttttggaatgcgatcctc

SEQ ID NO: 181491 - DNA, 35 bp, Artificial Sequence
  Synthetic oligonucleotide
gcgacacgtactttggtgggcgtgtcaccttcctc

SEQ ID NO: 181492 - DNA, 36 bp, Artificial Sequence
  Synthetic oligonucleotide
tcagtcccgccgctcccttgttagtgttcttggctc

SEQ ID NO: 181493 - DNA, 35 bp, Artificial Sequence
  Synthetic oligonucleotide
tgtatccccctcgtgcctatcttgtgcgggatctc

SEQ ID NO: 181494 - DNA, 35 bp, Artificial Sequence
  Synthetic oligonucleotide
tagctctcgccctgacccgcaatacattcgttctc

SEQ ID NO: 181495 - DNA, 35 bp, Artificial Sequence
  Synthetic oligonucleotide
gccacctactgccccgtatattctgtcaataggtc

SEQ ID NO: 181496 - DNA, 35 bp, Artificial Sequence
  Synthetic oligonucleotide
tacaccaccagactccccatactctgccatgattc

SEQ ID NO: 181497 - DNA, 35 bp, Artificial Sequence
  Synthetic oligonucleotide
tactcgcctcctctgctattcccaaactggccttc

SEQ ID NO: 181498 - DNA, 35 bp, Artificial Sequence
  Synthetic oligonucleotide
tcactgcctcccatggtgccatctagttctgtttc

SEQ ID NO: 181499 - DNA, 35 bp, Artificial Sequence
  Synthetic oligonucleotide
ggagttggggggaaagggctggaggagggcaccag

SEQ ID NO: 181500 - DNA, 35 bp, Artificial Sequence
  Synthetic oligonucleotide
gaggtggaagggagaagagaagaggtggattccag

SEQ ID NO: 181501 - DNA, 35 bp, Artificial Sequence
  Synthetic oligonucleotide
tcagggagggatgggagggggccacgaaagatcag

SEQ ID NO: 181502 - DNA, 35 bp, Artificial Sequence
  Synthetic oligonucleotide
cacacaacatctctgtcttcctctagctcgcaccg

SEQ ID NO: 181503 - DNA, 35 bp, Artificial Sequence
  Synthetic oligonucleotide
gtcccctcatctccgccgtgaacccagttgtcccg

SEQ ID NO: 181504 - DNA, 35 bp, Artificial Sequence
  Synthetic oligonucleotide
gatggtccgactcggctggctcactcccccactcg

SEQ ID NO: 181505 - DNA, 35 bp, Artificial Sequence
  Synthetic oligonucleotide
gctactcctaccgttccgccctgcttccgagttcg

SEQ ID NO: 181506 - DNA, 34 bp, Artificial Sequence
  Synthetic oligonucleotide
gtctagcaccgccttccgcccattattgtcccgg

SEQ ID NO: 181507 - DNA, 35 bp, Artificial Sequence
  Synthetic oligonucleotide
aaatgcgttaagatggggggtccgggaagggaggg

SEQ ID NO: 181508 - DNA, 35 bp, Artificial Sequence
  Synthetic oligonucleotide
gtgtggttgaggtgggaagtggatggtgaacgggg

SEQ ID NO: 181509 - DNA, 35 bp, Artificial Sequence
  Synthetic oligonucleotide
atgggggcgggtacagtcaaagaagggaggttggg

SEQ ID NO: 181510 - DNA, 35 bp, Artificial Sequence
  Synthetic oligonucleotide
tcgttgcattccattgctctcctctgacctgttgg

SEQ ID NO: 181511 - DNA, 35 bp, Artificial Sequence
  Synthetic oligonucleotide
acccgtctctattctgctgcctatgcctcctcctg

SEQ ID NO: 181512 - DNA, 35 bp, Artificial Sequence
  Synthetic oligonucleotide
tctaccctccgcctgcgattagctccaaaaatctg

SEQ ID NO: 181513 - DNA, 35 bp, Artificial Sequence
  Synthetic oligonucleotide
gttccccatcccatgtgacagcacggtatttattg

SEQ ID NO: 181514 - DNA, 35 bp, Artificial Sequence
  Synthetic oligonucleotide
tgcatattgcacttcgtatccttcgccctctcttg

SEQ ID NO: 181515 - DNA, 35 bp, Artificial Sequence
  Synthetic oligonucleotide
tcacatgtcctcctgtttcacctacgtgttctaat

SEQ ID NO: 181516 - DNA, 35 bp, Artificial Sequence
  Synthetic oligonucleotide
acggtgccaggccaatctgtttatccgccctctat

SEQ ID NO: 181517 - DNA, 35 bp, Artificial Sequence
  Synthetic oligonucleotide
atcgcataaccatcaatgaccccgcccgctgttat

SEQ ID NO: 181518 - DNA, 35 bp, Artificial Sequence
  Synthetic oligonucleotide
gccagcaggcgctcatcactggcccgctcctccct

SEQ ID NO: 181519 - DNA, 35 bp, Artificial Sequence
  Synthetic oligonucleotide
aaaacgtcagtacaacattcgctccaccctcgcct

SEQ ID NO: 181520 - DNA, 35 bp, Artificial Sequence
  Synthetic oligonucleotide
caccgtgcccccacgaccctgttccctgagtgcct

SEQ ID NO: 181521 - DNA, 35 bp, Artificial Sequence
  Synthetic oligonucleotide
ggatgagcgggggcgagggggtagtaaatatggct

SEQ ID NO: 181522 - DNA, 35 bp, Artificial Sequence
  Synthetic oligonucleotide
tccgaacctttgaatgcgctgtttcctagcctgct

SEQ ID NO: 181523 - DNA, 35 bp, Artificial Sequence
  Synthetic oligonucleotide
gaggataccgtgagctgccctacccctcacactct

SEQ ID NO: 181524 - DNA, 35 bp, Artificial Sequence
  Synthetic oligonucleotide
acctgttctgacatcagtcggtccattgcccctct

SEQ ID NO: 181525 - DNA, 35 bp, Artificial Sequence
  Synthetic oligonucleotide
gctgcggccgcttcatgtctgcgccatcatcttct

SEQ ID NO: 181526 - DNA, 34 bp, Artificial Sequence
  Synthetic oligonucleotide
tccccccatacctctgttattcgttcctttcagt

SEQ ID NO: 181527 - DNA, 35 bp, Artificial Sequence
  Synthetic oligonucleotide
gaccacgccggatgcttccgctgcctgccttacgt

SEQ ID NO: 181528 - DNA, 35 bp, Artificial Sequence
  Synthetic oligonucleotide
tgaagccacttgattccaaccgccctccaactggt

SEQ ID NO: 181529 - DNA, 35 bp, Artificial Sequence
  Synthetic oligonucleotide
gtgccgacctctatgccctgcctgatgactactgt

SEQ ID NO: 181530 - DNA, 35 bp, Artificial Sequence
  Synthetic oligonucleotide
ttgggtgggagtccgggtgggagccagccccctgt

SEQ ID NO: 181531 - DNA, 35 bp, Artificial Sequence
  Synthetic oligonucleotide
gttctcaccatgtgtgccctcgattccatctctgt

SEQ ID NO: 181532 - DNA, 35 bp, Artificial Sequence
  Synthetic oligonucleotide
gtcacatccctcgccatgactgtccctaagtttgt

SEQ ID NO: 181533 - DNA, 35 bp, Artificial Sequence
  Synthetic oligonucleotide
gccacccttgctcgtttcttgtttgtcaccaaatt

SEQ ID NO: 181534 - DNA, 36 bp, Artificial Sequence
  Synthetic oligonucleotide
gaagccaagtcaactcgttgcaatgtccgccccctt

SEQ ID NO: 181535 - DNA, 35 bp, Artificial Sequence
  Synthetic oligonucleotide
gaccgtagctgtacatattctccccctcattcctt

SEQ ID NO: 181536 - DNA, 35 bp, Artificial Sequence
  Synthetic oligonucleotide
acacccacccatgccgtatatctgagtcttgtctt

SEQ ID NO: 181537 - DNA, 35 bp, Artificial Sequence
  Synthetic oligonucleotide
tcattgcggactaggggcggagaggggtgggggtt

SEQ ID NO: 181538 - DNA, 35 bp, Artificial Sequence
  Synthetic oligonucleotide
gtgccaaatcgtcctgatatatcgcccttcttgtt

SEQ ID NO: 181539 - DNA, 35 bp, Artificial Sequence
  Synthetic oligonucleotide
atcccgcccagcttgctaaggcccaccgtttattt

SEQ ID NO: 181540 - DNA, 35 bp, Artificial Sequence
  Synthetic oligonucleotide
ttacctcgccccatgttcatatatagccatccttt

SEQ ID NO: 181541 - DNA, 35 bp, Artificial Sequence
  Synthetic oligonucleotide
tacccccgcccaagtagcatatcttgccagtgttt

SEQ ID NO: 181542 - DNA, 36 bp, Artificial Sequence
  Synthetic oligonucleotide
tgctaccgctcggtaaattgtcccttcgctccacaa

SEQ ID NO: 181543 - DNA, 35 bp, Artificial Sequence
  Synthetic oligonucleotide
ggtccggaataggaaagggcggagggctgggctaa

SEQ ID NO: 181544 - DNA, 36 bp, Artificial Sequence
  Synthetic oligonucleotide
tcgttaccctctcctctgtcttggaatccgctctaa

SEQ ID NO: 181545 - DNA, 35 bp, Artificial Sequence
  Synthetic oligonucleotide
agcgacctctggtgtcttcttctcccttgcccaca

SEQ ID NO: 181546 - DNA, 35 bp, Artificial Sequence
  Synthetic oligonucleotide
gcacatccactgacactcgcacggtcatccctaca

SEQ ID NO: 181547 - DNA, 35 bp, Artificial Sequence
  Synthetic oligonucleotide
gtgtaggaggaagggggaatgatgggtagcttaca

SEQ ID NO: 181548 - DNA, 36 bp, Artificial Sequence
  Synthetic oligonucleotide
ttagcccgccatcctttttcggtagcgccgctccca

SEQ ID NO: 181549 - DNA, 36 bp, Artificial Sequence
  Synthetic oligonucleotide
atacccgccgcattactgtatctcgtttcggagcca

SEQ ID NO: 181550 - DNA, 36 bp, Artificial Sequence
  Synthetic oligonucleotide
tgtgcccggcccggttgggccatcccgtactatcca

SEQ ID NO: 181551 - DNA, 34 bp, Artificial Sequence
  Synthetic oligonucleotide
aagccgttacctagtccccgaccctggccctcca

SEQ ID NO: 181552 - DNA, 35 bp, Artificial Sequence
  Synthetic oligonucleotide
aatggcacctgctcgccgcccctaaatgttctcca

SEQ ID NO: 181553 - DNA, 36 bp, Artificial Sequence
  Synthetic oligonucleotide
accattaatcgagggagaaggggccgggggaaagca

SEQ ID NO: 181554 - DNA, 36 bp, Artificial Sequence
  Synthetic oligonucleotide
tcattccccgttgtcctccactgctccgcaccggca

SEQ ID NO: 181555 - DNA, 35 bp, Artificial Sequence
  Synthetic oligonucleotide
gtcatggcggcactcgcttccccgccttttctgca

SEQ ID NO: 181556 - DNA, 36 bp, Artificial Sequence
  Synthetic oligonucleotide
atgtccatccagccctattgtgccatctccacctca

SEQ ID NO: 181557 - DNA, 36 bp, Artificial Sequence
  Synthetic oligonucleotide
attgcacagtagtccctgacctaagtccacctctca

SEQ ID NO: 181558 - DNA, 35 bp, Artificial Sequence
  Synthetic oligonucleotide
tctcacttccatcccgtctatccttcgcctgttca

SEQ ID NO: 181559 - DNA, 37 bp, Artificial Sequence
  Synthetic oligonucleotide
gagagccgggggaggtgaagtcttgggcaggtaaaga

SEQ ID NO: 181560 - DNA, 37 bp, Artificial Sequence
  Synthetic oligonucleotide
tacgggagggatggtacgtggggtgcggggggtaaga

SEQ ID NO: 181561 - DNA, 37 bp, Artificial Sequence
  Synthetic oligonucleotide
gacgtgtggtgggggggggacagtgaggagcgagaga

SEQ ID NO: 181562 - DNA, 37 bp, Artificial Sequence
  Synthetic oligonucleotide
tccgccctatcactattctcgccccgctctcaggaga

SEQ ID NO: 181563 - DNA, 37 bp, Artificial Sequence
  Synthetic oligonucleotide
gaggagctgtgggggaaagggagaaagggaatctaga

SEQ ID NO: 181564 - DNA, 36 bp, Artificial Sequence
  Synthetic oligonucleotide
atttgggcgaagggagatagggagttcgggggtaga

SEQ ID NO: 181565 - DNA, 37 bp, Artificial Sequence
  Synthetic oligonucleotide
gcactgggagggtgggcggcgagggggaccggcacga

SEQ ID NO: 181566 - DNA, 36 bp, Artificial Sequence
  Synthetic oligonucleotide
tgtgaaccaccgccctgttgccccccagtctcacga

SEQ ID NO: 181567 - DNA, 37 bp, Artificial Sequence
  Synthetic oligonucleotide
taggaagcatcctcctctcaacaccgcgtctacccga

SEQ ID NO: 181568 - DNA, 37 bp, Artificial Sequence
  Synthetic oligonucleotide
atgggacacggtcaactgtctaatttcctgcccccga

SEQ ID NO: 181569 - DNA, 37 bp, Artificial Sequence
  Synthetic oligonucleotide
gcgcgaacgttcgcgacattattagtacccctcccga

SEQ ID NO: 181570 - DNA, 37 bp, Artificial Sequence
  Synthetic oligonucleotide
tcatgactcgtctaatcgtgtcccctcctccctccga

SEQ ID NO: 181571 - DNA, 37 bp, Artificial Sequence
  Synthetic oligonucleotide
gagtgcccttccattgtcgtccctgtaaacgctccga

SEQ ID NO: 181572 - DNA, 37 bp, Artificial Sequence
  Synthetic oligonucleotide
agtcgggtcgagtcgggcatgggcgggacgggttcga

SEQ ID NO: 181573 - DNA, 37 bp, Artificial Sequence
  Synthetic oligonucleotide
gaaggaccacagggagggagaatacgcggttgaagga

SEQ ID NO: 181574 - DNA, 37 bp, Artificial Sequence
  Synthetic oligonucleotide
accacaggtggtgaacaggggggcgaatactggagga

SEQ ID NO: 181575 - DNA, 37 bp, Artificial Sequence
  Synthetic oligonucleotide
aagtcacacactgctgcctctctcgtcgtcacacgga

SEQ ID NO: 181576 - DNA, 35 bp, Artificial Sequence
  Synthetic oligonucleotide
ttcgtgccccgccatttccgtttcttttcgtcgga

SEQ ID NO: 181577 - DNA, 37 bp, Artificial Sequence
  Synthetic oligonucleotide
gacaaggagctcagtatgggaaggatgaggggcggga

SEQ ID NO: 181578 - DNA, 37 bp, Artificial Sequence
  Synthetic oligonucleotide
aacagtcaggggaagcaggaagggtacaaaactggga

SEQ ID NO: 181579 - DNA, 36 bp, Artificial Sequence
  Synthetic oligonucleotide
gctcggggtcttagcataataggagagagggtggga

SEQ ID NO: 181580 - DNA, 37 bp, Artificial Sequence
  Synthetic oligonucleotide
tcatgtgcgagaagagcgaggggggatggtggatgga

SEQ ID NO: 181581 - DNA, 36 bp, Artificial Sequence
  Synthetic oligonucleotide
gcgaccctccttttccatgtgctaccttcccctgga

SEQ ID NO: 181582 - DNA, 36 bp, Artificial Sequence
  Synthetic oligonucleotide
gcacgcacccacagctgttaccccgctccttaatga

SEQ ID NO: 181583 - DNA, 38 bp, Artificial Sequence
  Synthetic oligonucleotide
gcaggtgaaggatagcagggggccagggagggagatga

SEQ ID NO: 181584 - DNA, 38 bp, Artificial Sequence
  Synthetic oligonucleotide
tcccacaatctatgactatcaactgcccccctcactga

SEQ ID NO: 181585 - DNA, 37 bp, Artificial Sequence
  Synthetic oligonucleotide
tcacaggaacagggggagaaaagggtgggacgactga

SEQ ID NO: 181586 - DNA, 37 bp, Artificial Sequence
  Synthetic oligonucleotide
tagccgctactccttgctaagtgccttcttcacctga

SEQ ID NO: 181587 - DNA, 38 bp, Artificial Sequence
  Synthetic oligonucleotide
gctgtgccacccctccacgtcttcatgtctgtcgctga

SEQ ID NO: 181588 - DNA, 38 bp, Artificial Sequence
  Synthetic oligonucleotide
accgccctgtccacaccttttgcctctgttctccgtga

SEQ ID NO: 181589 - DNA, 37 bp, Artificial Sequence
  Synthetic oligonucleotide
gtacgtttcgcccccttgtcctgatccacctcggtga

SEQ ID NO: 181590 - DNA, 38 bp, Artificial Sequence
  Synthetic oligonucleotide
agtcatcgagggtaggagggagggatggagggctgtga

SEQ ID NO: 181591 - DNA, 35 bp, Artificial Sequence
  Synthetic oligonucleotide
agccgcaccctcgacgaatccgcctacccttgtga

SEQ ID NO: 181592 - DNA, 36 bp, Artificial Sequence
  Synthetic oligonucleotide
ttgaaggaggtaggaggaaggactagagggaattga

SEQ ID NO: 181593 - DNA, 37 bp, Artificial Sequence
  Synthetic oligonucleotide
gaccaacgcccacccgtataaatcccgcacccattga

SEQ ID NO: 181594 - DNA, 36 bp, Artificial Sequence
  Synthetic oligonucleotide
tccatcaagcccgttactgcatcaccgccgccttga

SEQ ID NO: 181595 - DNA, 36 bp, Artificial Sequence
  Synthetic oligonucleotide
gactccaccgctgtatccccgttttcatgtccttga

SEQ ID NO: 181596 - DNA, 36 bp, Artificial Sequence
  Synthetic oligonucleotide
acatcgtaggcgagggtgggtgggggatggagtata

SEQ ID NO: 181597 - DNA, 36 bp, Artificial Sequence
  Synthetic oligonucleotide
gccggccggtatgctcgcgtatcgttgctccaccta

SEQ ID NO: 181598 - DNA, 36 bp, Artificial Sequence
  Synthetic oligonucleotide
acccacaggcctcacctgtgctgagaacccccgcta

SEQ ID NO: 181599 - DNA, 35 bp, Artificial Sequence
  Synthetic oligonucleotide
tcatcccgctctcgcgctgaatacaccttcatcta

SEQ ID NO: 181600 - DNA, 36 bp, Artificial Sequence
  Synthetic oligonucleotide
gtccctgccccgccgaagacgttacgtttcgatcta

SEQ ID NO: 181601 - DNA, 36 bp, Artificial Sequence
  Synthetic oligonucleotide
atgggggggatgggcaagctggttctgggacaagta

SEQ ID NO: 181602 - DNA, 35 bp, Artificial Sequence
  Synthetic oligonucleotide
agacggtatcattcgggtgaggatgggagggggta

SEQ ID NO: 181603 - DNA, 36 bp, Artificial Sequence
  Synthetic oligonucleotide
taaccggcacacgccccctgtggtgttcctccatta

SEQ ID NO: 181604 - DNA, 32 bp, Artificial Sequence
  Synthetic oligonucleotide
gcttgaccctgactccattacgcacccactta

SEQ ID NO: 181605 - DNA, 36 bp, Artificial Sequence
  Synthetic oligonucleotide
acacgtcccagttgcatcgatatccaccgcttttta

SEQ ID NO: 181606 - DNA, 35 bp, Artificial Sequence
  Synthetic oligonucleotide
gactacggcccatctatcgtctggcccccactcac

SEQ ID NO: 181607 - DNA, 35 bp, Artificial Sequence
  Synthetic oligonucleotide
ttcgtgcgggctctcgtctttattctacgccatac

SEQ ID NO: 181608 - DNA, 35 bp, Artificial Sequence
  Synthetic oligonucleotide
tgttggtccacctgtgtttcctccacgctcctacc

SEQ ID NO: 181609 - DNA, 35 bp, Artificial Sequence
  Synthetic oligonucleotide
ggacatcccaatatttcgtccgcgccgccaacccc

SEQ ID NO: 181610 - DNA, 35 bp, Artificial Sequence
  Synthetic oligonucleotide
tcattcagttcattgcgctgttacacaccaccccc

SEQ ID NO: 181611 - DNA, 35 bp, Artificial Sequence
  Synthetic oligonucleotide
tcgctgcccgcctgttctcgtaccccactgtgccc

SEQ ID NO: 181612 - DNA, 35 bp, Artificial Sequence
  Synthetic oligonucleotide
ggggacatcgcacccttgtcgcctagattactccc

SEQ ID NO: 181613 - DNA, 35 bp, Artificial Sequence
  Synthetic oligonucleotide
gtgccgcgccaatatctagctttggaacccctccc

SEQ ID NO: 181614 - DNA, 35 bp, Artificial Sequence
  Synthetic oligonucleotide
atcttcccatcgccgtggtaccattgttatctccc

SEQ ID NO: 181615 - DNA, 35 bp, Artificial Sequence
  Synthetic oligonucleotide
atgtcctatcctcagagatcgtcttccatctagcc

SEQ ID NO: 181616 - DNA, 35 bp, Artificial Sequence
  Synthetic oligonucleotide
gtccactcccttctgctcggtcccattcttctgcc

SEQ ID NO: 181617 - DNA, 35 bp, Artificial Sequence
  Synthetic oligonucleotide
actcgcctgtctccgttccgttacgcgcacttgcc

SEQ ID NO: 181618 - DNA, 35 bp, Artificial Sequence
  Synthetic oligonucleotide
ccacacacctcatatattattcggccacttgttcc

SEQ ID NO: 181619 - DNA, 35 bp, Artificial Sequence
  Synthetic oligonucleotide
accctcctgcttctccctagtgtcctgacccaagc

SEQ ID NO: 181620 - DNA, 35 bp, Artificial Sequence
  Synthetic oligonucleotide
aaactacgcgtcggcctttaattgccccccaccgc

SEQ ID NO: 181621 - DNA, 35 bp, Artificial Sequence
  Synthetic oligonucleotide
gatacgccaaatattcggtccactggttatcccgc

SEQ ID NO: 181622 - DNA, 35 bp, Artificial Sequence
  Synthetic oligonucleotide
gaccctcacagtgtttgccacagtaccccttccgc

SEQ ID NO: 181623 - DNA, 34 bp, Artificial Sequence
  Synthetic oligonucleotide
ggtggacgggaagggaaggggcactggggtctgc

SEQ ID NO: 181624 - DNA, 35 bp, Artificial Sequence
  Synthetic oligonucleotide
acacccttccgtcccaggccgataaaccttgttgc

SEQ ID NO: 181625 - DNA, 35 bp, Artificial Sequence
  Synthetic oligonucleotide
gacgcgcacccactcctacgctactccgattttgc

SEQ ID NO: 181626 - DNA, 35 bp, Artificial Sequence
  Synthetic oligonucleotide
gtcgcaatcaatgcttgtttcccttacgttttatc

SEQ ID NO: 181627 - DNA, 35 bp, Artificial Sequence
  Synthetic oligonucleotide
tccggggccgcttctgtctcatacgcgcattactc

SEQ ID NO: 181628 - DNA, 35 bp, Artificial Sequence
  Synthetic oligonucleotide
taatgctatcgtgcgcacgcctcctgttctccctc

SEQ ID NO: 181629 - DNA, 35 bp, Artificial Sequence
  Synthetic oligonucleotide
tagggcgcccgatgacttacatcgctcacctcctc

SEQ ID NO: 181630 - DNA, 35 bp, Artificial Sequence
  Synthetic oligonucleotide
tcttgcctgtccaccgcttaatgtcttttctcctc

SEQ ID NO: 181631 - DNA, 35 bp, Artificial Sequence
  Synthetic oligonucleotide
gtactccacgcacctactccctccgttagaggctc

SEQ ID NO: 181632 - DNA, 35 bp, Artificial Sequence
  Synthetic oligonucleotide
gtggcactgcgttacctgccctttagcctccagtc

SEQ ID NO: 181633 - DNA, 35 bp, Artificial Sequence
  Synthetic oligonucleotide
atcgcccggttccatcatgcgccgcttgtagcttc

SEQ ID NO: 181634 - DNA, 35 bp, Artificial Sequence
  Synthetic oligonucleotide
tcgtcacggaactcgccgcgctctctctcgtcttc

SEQ ID NO: 181635 - DNA, 35 bp, Artificial Sequence
  Synthetic oligonucleotide
gaacccaggtgtccagcccacgtggccttcctttc

SEQ ID NO: 181636 - DNA, 35 bp, Artificial Sequence
  Synthetic oligonucleotide
ggacggtatgagggggggaagtcgacttagaacag

SEQ ID NO: 181637 - DNA, 35 bp, Artificial Sequence
  Synthetic oligonucleotide
gaacggtggtggaacagaattgagggcgggttcag

SEQ ID NO: 181638 - DNA, 35 bp, Artificial Sequence
  Synthetic oligonucleotide
ttcgccccccattccctgcacagagccctgttacg

SEQ ID NO: 181639 - DNA, 35 bp, Artificial Sequence
  Synthetic oligonucleotide
acgattcgccacagtgctaccttgcctcccgctcg

SEQ ID NO: 181640 - DNA, 35 bp, Artificial Sequence
  Synthetic oligonucleotide
tccgccaccctgcctcacacccggaataaccgggg

SEQ ID NO: 181641 - DNA, 35 bp, Artificial Sequence
  Synthetic oligonucleotide
gttcccactcccaccatgatcctttcgccttgtgg

SEQ ID NO: 181642 - DNA, 35 bp, Artificial Sequence
  Synthetic oligonucleotide
tcaaacccgcccccgacgccgaatccacccgtatg

SEQ ID NO: 181643 - DNA, 35 bp, Artificial Sequence
  Synthetic oligonucleotide
accccgcggggcttctctatcgcatgttacacctg

SEQ ID NO: 181644 - DNA, 35 bp, Artificial Sequence
  Synthetic oligonucleotide
tcctcgcagactgacttctgattctcctctcgctg

SEQ ID NO: 181645 - DNA, 35 bp, Artificial Sequence
  Synthetic oligonucleotide
gaccgctccccctccgtagctgctttgttgtcgtg

SEQ ID NO: 181646 - DNA, 35 bp, Artificial Sequence
  Synthetic oligonucleotide
ggggaccagcgaagagggggggagcgggaaccttg

SEQ ID NO: 181647 - DNA, 35 bp, Artificial Sequence
  Synthetic oligonucleotide
acacgcttcggccgtcgcggacccccccacgcaat

SEQ ID NO: 181648 - DNA, 33 bp, Artificial Sequence
  Synthetic oligonucleotide
accaccccaatgtcctgatccctctgccgccat

SEQ ID NO: 181649 - DNA, 35 bp, Artificial Sequence
  Synthetic oligonucleotide
tgatcgcccgtatacccttgctctcctctgttgat

SEQ ID NO: 181650 - DNA, 35 bp, Artificial Sequence
  Synthetic oligonucleotide
gatggcccagatgctatccgtcctcacttccatat

SEQ ID NO: 181651 - DNA, 35 bp, Artificial Sequence
  Synthetic oligonucleotide
gccacccgcccacccggtaactcgtgacctcctat

SEQ ID NO: 181652 - DNA, 35 bp, Artificial Sequence
  Synthetic oligonucleotide
gaacctcctaacatctgctttaacggattccacct

SEQ ID NO: 181653 - DNA, 33 bp, Artificial Sequence
  Synthetic oligonucleotide
ttcccttcccccaggccttgtctcattgcacct

SEQ ID NO: 181654 - DNA, 35 bp, Artificial Sequence
  Synthetic oligonucleotide
gtggtccctgctccgcctttccgttccgacgacct

SEQ ID NO: 181655 - DNA, 35 bp, Artificial Sequence
  Synthetic oligonucleotide
atactgccgccctactatgtaacgagttcccccct

SEQ ID NO: 181656 - DNA, 35 bp, Artificial Sequence
  Synthetic oligonucleotide
tccacctgcgcacatcggtgaaccgcacgccccct

SEQ ID NO: 181657 - DNA, 35 bp, Artificial Sequence
  Synthetic oligonucleotide
gggatcagcgcacgtccaactagcctggtctccct

SEQ ID NO: 181658 - DNA, 35 bp, Artificial Sequence
  Synthetic oligonucleotide
aatcccgtgagctgctacctcttttcggtgtccct

SEQ ID NO: 181659 - DNA, 35 bp, Artificial Sequence
  Synthetic oligonucleotide
tggtccagcccatgacgaatccgccaccctagcct

SEQ ID NO: 181660 - DNA, 35 bp, Artificial Sequence
  Synthetic oligonucleotide
gatcaccgcaaactccgctcacggcttgacttcct

SEQ ID NO: 181661 - DNA, 35 bp, Artificial Sequence
  Synthetic oligonucleotide
gcgccgcaccccgcatctgtctcccccctggcgct

SEQ ID NO: 181662 - DNA, 35 bp, Artificial Sequence
  Synthetic oligonucleotide
tgtgcttccggtcttttatcgttctcaggtcctct

SEQ ID NO: 181663 - DNA, 35 bp, Artificial Sequence
  Synthetic oligonucleotide
tatggatcctgctgcccttctcttgtatgctgtct

SEQ ID NO: 181664 - DNA, 35 bp, Artificial Sequence
  Synthetic oligonucleotide
accatcgccaccccgtctgagttcgtcctctttct

SEQ ID NO: 181665 - DNA, 34 bp, Artificial Sequence
  Synthetic oligonucleotide
tgtccgcaccacacttgtccagttatcacatcgt

SEQ ID NO: 181666 - DNA, 35 bp, Artificial Sequence
  Synthetic oligonucleotide
gcgcgaccccgccgcatcacgttccctacaaatgt

SEQ ID NO: 181667 - DNA, 35 bp, Artificial Sequence
  Synthetic oligonucleotide
acgcccgcccgctgatatacccgcggattaccatt

SEQ ID NO: 181668 - DNA, 35 bp, Artificial Sequence
  Synthetic oligonucleotide
aactgggtggggagggaggttgggacgctgggatt

SEQ ID NO: 181669 - DNA, 35 bp, Artificial Sequence
  Synthetic oligonucleotide
tgcccacccgctagcaggtaccttcacctatcctt

SEQ ID NO: 181670 - DNA, 35 bp, Artificial Sequence
  Synthetic oligonucleotide
tcgcgaccgcgagcgtacgaaactttccgcttctt

SEQ ID NO: 181671 - DNA, 35 bp, Artificial Sequence
  Synthetic oligonucleotide
aagggggggcgaatgggttgggcgtgagggtggtt

SEQ ID NO: 181672 - DNA, 35 bp, Artificial Sequence
  Synthetic oligonucleotide
acacgcgcattctcggccgcctgttcgatctcttt

SEQ ID NO: 181673 - DNA, 35 bp, Artificial Sequence
  Synthetic oligonucleotide
atactcctcattcgcctgcctctgccacgccccaa

SEQ ID NO: 181674 - DNA, 36 bp, Artificial Sequence
  Synthetic oligonucleotide
gtaaggcggaggaggtaggggaccgaacgggcagaa

SEQ ID NO: 181675 - DNA, 34 bp, Artificial Sequence
  Synthetic oligonucleotide
aacaaggcagggaggacggggggggcaaagggaa

SEQ ID NO: 181676 - DNA, 35 bp, Artificial Sequence
  Synthetic oligonucleotide
gtacaaccgcttgcttgtcgttctgcctcccaaca

SEQ ID NO: 181677 - DNA, 35 bp, Artificial Sequence
  Synthetic oligonucleotide
tcagtgggacgggttgggacgggggtatttggaca

SEQ ID NO: 181678 - DNA, 36 bp, Artificial Sequence
  Synthetic oligonucleotide
tccgagcaggtgcatggctgatccccgttcccacca

SEQ ID NO: 181679 - DNA, 35 bp, Artificial Sequence
  Synthetic oligonucleotide
attagcgcacccttctcgtactgctctctcgccca

SEQ ID NO: 181680 - DNA, 35 bp, Artificial Sequence
  Synthetic oligonucleotide
taagcccccggtagttccgtcttggtgccatccca

SEQ ID NO: 181681 - DNA, 36 bp, Artificial Sequence
  Synthetic oligonucleotide
gccctcgctaccccatgagttctcgtccggatccca

SEQ ID NO: 181682 - DNA, 35 bp, Artificial Sequence
  Synthetic oligonucleotide
gttgaccgcagcagggaggagggggaatgcagcca

SEQ ID NO: 181683 - DNA, 35 bp, Artificial Sequence
  Synthetic oligonucleotide
attggtccggacacctgcgccttcatactctgcca

SEQ ID NO: 181684 - DNA, 35 bp, Artificial Sequence
  Synthetic oligonucleotide
gccaccctcgacctgcatttccatccacccatcca

SEQ ID NO: 181685 - DNA, 36 bp, Artificial Sequence
  Synthetic oligonucleotide
acatacgcgcctatgtcccaccgccgaccccacgca

SEQ ID NO: 181686 - DNA, 35 bp, Artificial Sequence
  Synthetic oligonucleotide
gcgggccctcgatcgcccgtatcatctccatatca

SEQ ID NO: 181687 - DNA, 35 bp, Artificial Sequence
  Synthetic oligonucleotide
tcacacctcccgccgggggaagattactcctctca

SEQ ID NO: 181688 - DNA, 34 bp, Artificial Sequence
  Synthetic oligonucleotide
atggggggaacagacgtggggtaggtgggggtca

SEQ ID NO: 181689 - DNA, 36 bp, Artificial Sequence
  Synthetic oligonucleotide
tctatgctcggtcctctgcctgaatcaacaccttca

SEQ ID NO: 181690 - DNA, 37 bp, Artificial Sequence
  Synthetic oligonucleotide
tgatcagtggggtgaggatagctggagggcgggtaga

SEQ ID NO: 181691 - DNA, 37 bp, Artificial Sequence
  Synthetic oligonucleotide
acccccatgccctattccgctaccgggccagtaacga

SEQ ID NO: 181692 - DNA, 37 bp, Artificial Sequence
  Synthetic oligonucleotide
actgcccgtctgaagttctaagtcccaacccacccga

SEQ ID NO: 181693 - DNA, 37 bp, Artificial Sequence
  Synthetic oligonucleotide
tcaccgccacgaataggactcctctgcatcatcccga

SEQ ID NO: 181694 - DNA, 37 bp, Artificial Sequence
  Synthetic oligonucleotide
tgaccgtcattgcatattgttctcgtcacgcctccga

SEQ ID NO: 181695 - DNA, 37 bp, Artificial Sequence
  Synthetic oligonucleotide
atagcccctgctgtccacacttctcttacatctccga

SEQ ID NO: 181696 - DNA, 37 bp, Artificial Sequence
  Synthetic oligonucleotide
tgcaacactgtcgcattcctgccgctactcctcgcga

SEQ ID NO: 181697 - DNA, 37 bp, Artificial Sequence
  Synthetic oligonucleotide
ggtggaggagtggtgggaggaagagacggctaatcga

SEQ ID NO: 181698 - DNA, 37 bp, Artificial Sequence
  Synthetic oligonucleotide
gttgcgacgtctgtccacatcctggccttcatttcga

SEQ ID NO: 181699 - DNA, 37 bp, Artificial Sequence
  Synthetic oligonucleotide
aatcacggaggggggggatgggccgacgcatccagga

SEQ ID NO: 181700 - DNA, 37 bp, Artificial Sequence
  Synthetic oligonucleotide
tacggaaggaggggactagggcttggggcgagacgga

SEQ ID NO: 181701 - DNA, 37 bp, Artificial Sequence
  Synthetic oligonucleotide
gctgcccgacggacaaggaggttgggggagtggggga

SEQ ID NO: 181702 - DNA, 37 bp, Artificial Sequence
  Synthetic oligonucleotide
gcgaagaaggagggggggtctgtggaggttggtggga

SEQ ID NO: 181703 - DNA, 37 bp, Artificial Sequence
  Synthetic oligonucleotide
accatccctgctgctgtacctgctatctgtcaatgga

SEQ ID NO: 181704 - DNA, 37 bp, Artificial Sequence
  Synthetic oligonucleotide
agtacaccctcccatgtcaaacttccacctgcatgga

SEQ ID NO: 181705 - DNA, 37 bp, Artificial Sequence
  Synthetic oligonucleotide
gtgtggcaccgctgcagcctattcataccctcttgga

SEQ ID NO: 181706 - DNA, 38 bp, Artificial Sequence
  Synthetic oligonucleotide
tacagggggtggcgagggggggaggtaggcgcgaatga

SEQ ID NO: 181707 - DNA, 37 bp, Artificial Sequence
  Synthetic oligonucleotide
gccacctgctctcttttccttaacagcctagacctga

SEQ ID NO: 181708 - DNA, 38 bp, Artificial Sequence
  Synthetic oligonucleotide
tcccaccatgcctcatgcccttgttaactgctacctga

SEQ ID NO: 181709 - DNA, 37 bp, Artificial Sequence
  Synthetic oligonucleotide
tctaccctccccgaccgcggtttttcgaccaccctga

SEQ ID NO: 181710 - DNA, 37 bp, Artificial Sequence
  Synthetic oligonucleotide
taatgcccacccctatacgcgctatggatacccctga

SEQ ID NO: 181711 - DNA, 36 bp, Artificial Sequence
  Synthetic oligonucleotide
gtcaaagtcccgtctatccccggctgtacctcctga

SEQ ID NO: 181712 - DNA, 36 bp, Artificial Sequence
  Synthetic oligonucleotide
ttgttccccggcaataatgttcatctcccttcctga

SEQ ID NO: 181713 - DNA, 37 bp, Artificial Sequence
  Synthetic oligonucleotide
tatcccggcattatgttaccgcccacctccccgctga

SEQ ID NO: 181714 - DNA, 37 bp, Artificial Sequence
  Synthetic oligonucleotide
agcgagggggggagcggcgggacttcaccggcagtga

SEQ ID NO: 181715 - DNA, 38 bp, Artificial Sequence
  Synthetic oligonucleotide
gagggtagggccggggctacggagataacggggagtga

SEQ ID NO: 181716 - DNA, 38 bp, Artificial Sequence
  Synthetic oligonucleotide
aatgagggagggtggaactgggcaaggaggaaccgtga

SEQ ID NO: 181717 - DNA, 38 bp, Artificial Sequence
  Synthetic oligonucleotide
tgggtgggagggccagggtaacaaagtccatcgcgtga

SEQ ID NO: 181718 - DNA, 38 bp, Artificial Sequence
  Synthetic oligonucleotide
gtagggcgtggagggaaagtggtgggcagccgctgtga

SEQ ID NO: 181719 - DNA, 38 bp, Artificial Sequence
  Synthetic oligonucleotide
attgtccgccgccccgctcctagacccacacgttgtga

SEQ ID NO: 181720 - DNA, 37 bp, Artificial Sequence
  Synthetic oligonucleotide
tgccacctatgcctatcccagtgttcaccaaccttga

SEQ ID NO: 181721 - DNA, 38 bp, Artificial Sequence
  Synthetic oligonucleotide
tcctgcccgctgccttcgtatgcccacctgctccttga

SEQ ID NO: 181722 - DNA, 38 bp, Artificial Sequence
  Synthetic oligonucleotide
gcgtgacgccctctatgctcctggatatcattgcttga

SEQ ID NO: 181723 - DNA, 38 bp, Artificial Sequence
  Synthetic oligonucleotide
tctgacaacgcccctttcgctcggacacttcctcttga

SEQ ID NO: 181724 - DNA, 38 bp, Artificial Sequence
  Synthetic oligonucleotide
atggagggagaacgggatgaagaagggcgatcagttga

SEQ ID NO: 181725 - DNA, 38 bp, Artificial Sequence
  Synthetic oligonucleotide
gacccgccactctgccattaggttcagttccctgttga

SEQ ID NO: 181726 - DNA, 38 bp, Artificial Sequence
  Synthetic oligonucleotide
tgtcccctccgacccactgtatcttccgactcctttga

SEQ ID NO: 181727 - DNA, 35 bp, Artificial Sequence
  Synthetic oligonucleotide
agccacggaagagagctccatcccgcccgttaata

SEQ ID NO: 181728 - DNA, 36 bp, Artificial Sequence
  Synthetic oligonucleotide
tccccacccctcccctgacttggtatgcaaacacta

SEQ ID NO: 181729 - DNA, 35 bp, Artificial Sequence
  Synthetic oligonucleotide
gtgtcacgttgctccgcctgcctctagctcaccta

SEQ ID NO: 181730 - DNA, 35 bp, Artificial Sequence
  Synthetic oligonucleotide
acagattacggccgtctagtctaactgccctccta

SEQ ID NO: 181731 - DNA, 36 bp, Artificial Sequence
  Synthetic oligonucleotide
tcctcaccccctgatgcgtgttctgtctcgttccta

SEQ ID NO: 181732 - DNA, 36 bp, Artificial Sequence
  Synthetic oligonucleotide
gttccgcctagatgtcccatgcgtccccccgttcta

SEQ ID NO: 181733 - DNA, 35 bp, Artificial Sequence
  Synthetic oligonucleotide
tcacaccctcatttaatgttggccctggccccgta

SEQ ID NO: 181734 - DNA, 36 bp, Artificial Sequence
  Synthetic oligonucleotide
atcccaccccttgtgcttaattcttcatccttggta

SEQ ID NO: 181735 - DNA, 36 bp, Artificial Sequence
  Synthetic oligonucleotide
ggacccacccatcactggtcgccactatgacagtta

SEQ ID NO: 181736 - DNA, 35 bp, Artificial Sequence
  Synthetic oligonucleotide
tgtcatcccacaatagccgtacctgaccgccgtta

SEQ ID NO: 181737 - DNA, 36 bp, Artificial Sequence
  Synthetic oligonucleotide
gtcctcccgaccgcccctgctgctccttagagttta

SEQ ID NO: 181738 - DNA, 35 bp, Artificial Sequence
  Synthetic oligonucleotide
ttgcgtgcggcgggagggaagggcgcactgagaac

SEQ ID NO: 181739 - DNA, 35 bp, Artificial Sequence
  Synthetic oligonucleotide
tgcccacgtgttgaaatatacgcccgcccgctaac

SEQ ID NO: 181740 - DNA, 35 bp, Artificial Sequence
  Synthetic oligonucleotide
tcaatcaccgctgcactcgtcctaagtcgcaccac

SEQ ID NO: 181741 - DNA, 35 bp, Artificial Sequence
  Synthetic oligonucleotide
ttgaaccagccgctagcttctgtcaagccccgcac

SEQ ID NO: 181742 - DNA, 35 bp, Artificial Sequence
  Synthetic oligonucleotide
gaagccctccgtggtgctaatttcctgattcctac

SEQ ID NO: 181743 - DNA, 35 bp, Artificial Sequence
  Synthetic oligonucleotide
gaccaatgcctctatctgcttcgtgcccttcgtac

SEQ ID NO: 181744 - DNA, 34 bp, Artificial Sequence
  Synthetic oligonucleotide
gaggggacggcgcattctagtccttgccccttac

SEQ ID NO: 181745 - DNA, 35 bp, Artificial Sequence
  Synthetic oligonucleotide
actgtccccgcccacatgcccatagtctgtcaccc

SEQ ID NO: 181746 - DNA, 35 bp, Artificial Sequence
  Synthetic oligonucleotide
gttccagcgtatcactatagttctgcccgcgcccc

SEQ ID NO: 181747 - DNA, 35 bp, Artificial Sequence
  Synthetic oligonucleotide
tgcccgtttgccgtaagcgtcccagtggcctcccc

SEQ ID NO: 181748 - DNA, 35 bp, Artificial Sequence
  Synthetic oligonucleotide
tcatcgcaccattttgacaacacatcatgctcccc

SEQ ID NO: 181749 - DNA, 35 bp, Artificial Sequence
  Synthetic oligonucleotide
ttcgaacacgccactcatatacggtttatttcccc

SEQ ID NO: 181750 - DNA, 35 bp, Artificial Sequence
  Synthetic oligonucleotide
actgttcgccaggactttctcttcgttcccagccc

SEQ ID NO: 181751 - DNA, 35 bp, Artificial Sequence
  Synthetic oligonucleotide
ttgtcgccatcctttccgttactgtcgatgggccc

SEQ ID NO: 181752 - DNA, 35 bp, Artificial Sequence
  Synthetic oligonucleotide
tccgccaaccctgcgtttcgctcttggcctgtccc

SEQ ID NO: 181753 - DNA, 35 bp, Artificial Sequence
  Synthetic oligonucleotide
gcccaggtgtgcaccgttttcccctagtgtttccc

SEQ ID NO: 181754 - DNA, 35 bp, Artificial Sequence
  Synthetic oligonucleotide
gctggactagcatgtggtacctcttggccttctcc

SEQ ID NO: 181755 - DNA, 35 bp, Artificial Sequence
  Synthetic oligonucleotide
tctgtcagtagccatcacaccttcattttgcgtcc

SEQ ID NO: 181756 - DNA, 35 bp, Artificial Sequence
  Synthetic oligonucleotide
tgcgtgccgccgttccatctagttctctcatgtcc

SEQ ID NO: 181757 - DNA, 35 bp, Artificial Sequence
  Synthetic oligonucleotide
gtcatccgcctcgcttgtcatcactgtcacgcagc

SEQ ID NO: 181758 - DNA, 35 bp, Artificial Sequence
  Synthetic oligonucleotide
tggtacccgctataaaaacctccgccacatgccgc

SEQ ID NO: 181759 - DNA, 35 bp, Artificial Sequence
  Synthetic oligonucleotide
acatgcaccttttactcgtgcttttagttcctcgc

SEQ ID NO: 181760 - DNA, 35 bp, Artificial Sequence
  Synthetic oligonucleotide
aggaccgtatcccacgctgccccttctcaacatgc

SEQ ID NO: 181761 - DNA, 35 bp, Artificial Sequence
  Synthetic oligonucleotide
gagcattcacgcacgctcgcaaaccgcccccctgc

SEQ ID NO: 181762 - DNA, 35 bp, Artificial Sequence
  Synthetic oligonucleotide
gacacggaacttgcctcttttgctccagcccttgc

SEQ ID NO: 181763 - DNA, 35 bp, Artificial Sequence
  Synthetic oligonucleotide
ttggcccaacctggcgtataacctcgtggcccatc

SEQ ID NO: 181764 - DNA, 35 bp, Artificial Sequence
  Synthetic oligonucleotide
agcgccccctcttcttttgttccgtctgctccatc

SEQ ID NO: 181765 - DNA, 35 bp, Artificial Sequence
  Synthetic oligonucleotide
aattgcgttgaccccgtgtccgcctccaccgtatc

SEQ ID NO: 181766 - DNA, 35 bp, Artificial Sequence
  Synthetic oligonucleotide
atcgtccaccagcctccgcacgaatgcccctactc

SEQ ID NO: 181767 - DNA, 35 bp, Artificial Sequence
  Synthetic oligonucleotide
gctgctgattcaccgctccttagctcttggccctc

SEQ ID NO: 181768 - DNA, 35 bp, Artificial Sequence
  Synthetic oligonucleotide
agtgccgtgccaaacagtccatatgcatgtccctc

SEQ ID NO: 181769 - DNA, 34 bp, Artificial Sequence
  Synthetic oligonucleotide
gacagccctttggccgccacttaccctgcttctc

SEQ ID NO: 181770 - DNA, 35 bp, Artificial Sequence
  Synthetic oligonucleotide
attccccgccctcacttagcacatttcagggagtc

SEQ ID NO: 181771 - DNA, 35 bp, Artificial Sequence
  Synthetic oligonucleotide
tcacctgacgcttttgacgttagcatctctcgttc

SEQ ID NO: 181772 - DNA, 35 bp, Artificial Sequence
  Synthetic oligonucleotide
gcctgtgtacgggcaaagagggagggatgggtaag

SEQ ID NO: 181773 - DNA, 35 bp, Artificial Sequence
  Synthetic oligonucleotide
tagtgaggtacggggagagaaccaaggaggtagag

SEQ ID NO: 181774 - DNA, 35 bp, Artificial Sequence
  Synthetic oligonucleotide
gcacccctccctcattcgtccctgccatccttgag

SEQ ID NO: 181775 - DNA, 35 bp, Artificial Sequence
  Synthetic oligonucleotide
ttcagttccgcctctcataccccttcaccgggacg

SEQ ID NO: 181776 - DNA, 35 bp, Artificial Sequence
  Synthetic oligonucleotide
ataccccctgcctttgagctctctatcgcttgccg

SEQ ID NO: 181777 - DNA, 35 bp, Artificial Sequence
  Synthetic oligonucleotide
ttgatgccccactgctctcttccacccgtccctcg

SEQ ID NO: 181778 - DNA, 35 bp, Artificial Sequence
  Synthetic oligonucleotide
ttccgggtgggggtggtaaggctagagggacacgg

SEQ ID NO: 181779 - DNA, 35 bp, Artificial Sequence
  Synthetic oligonucleotide
ttcgccctagttgctgaccgtcactcatcccccgg

SEQ ID NO: 181780 - DNA, 35 bp, Artificial Sequence
  Synthetic oligonucleotide
aatgaggtcgggatgggtgagggtgggccaaaggg

SEQ ID NO: 181781 - DNA, 35 bp, Artificial Sequence
  Synthetic oligonucleotide
aggatgcactgactgcgaggggagggtagggtggg

SEQ ID NO: 181782 - DNA, 35 bp, Artificial Sequence
  Synthetic oligonucleotide
tctggcactcctcttcccctatgatccgtcgctgg

SEQ ID NO: 181783 - DNA, 35 bp, Artificial Sequence
  Synthetic oligonucleotide
gcacaaacccgctttacacaactcccgctgatatg

SEQ ID NO: 181784 - DNA, 35 bp, Artificial Sequence
  Synthetic oligonucleotide
gctcatccccttcgtgtggcttttcccactgcctg

SEQ ID NO: 181785 - DNA, 35 bp, Artificial Sequence
  Synthetic oligonucleotide
tgctggcctattgctttaacgttccggttctcctg

SEQ ID NO: 181786 - DNA, 35 bp, Artificial Sequence
  Synthetic oligonucleotide
gtgcgccccagttactcctctatttttttcccgtg

SEQ ID NO: 181787 - DNA, 35 bp, Artificial Sequence
  Synthetic oligonucleotide
tcgacccctccttggccttacgcaacgatcaccat

SEQ ID NO: 181788 - DNA, 35 bp, Artificial Sequence
  Synthetic oligonucleotide
ctacacccacaaacctgccttcatcgctgttccat

SEQ ID NO: 181789 - DNA, 35 bp, Artificial Sequence
  Synthetic oligonucleotide
gtggggggggaggtgaggggtcgggaagaaaggat

SEQ ID NO: 181790 - DNA, 35 bp, Artificial Sequence
  Synthetic oligonucleotide
ttggccactgctgtacgtccccccgcttcgcccct

SEQ ID NO: 181791 - DNA, 35 bp, Artificial Sequence
  Synthetic oligonucleotide
tgtacgtcccttgccatacgacgccgtacgtccct

SEQ ID NO: 181792 - DNA, 35 bp, Artificial Sequence
  Synthetic oligonucleotide
agtctggcccaccgcatgccccaacctccttgcct

SEQ ID NO: 181793 - DNA, 35 bp, Artificial Sequence
  Synthetic oligonucleotide
gagtatacgtgcagggataggggcgggaggtagct

SEQ ID NO: 181794 - DNA, 35 bp, Artificial Sequence
  Synthetic oligonucleotide
gtgttacccgccagttcttaatccatggttccgct

SEQ ID NO: 181795 - DNA, 35 bp, Artificial Sequence
  Synthetic oligonucleotide
ggttctccgcctgttgcctagctcgctccactgct

SEQ ID NO: 181796 - DNA, 35 bp, Artificial Sequence
  Synthetic oligonucleotide
tcgctcaccatcccgttccctgtgcgttccctgct

SEQ ID NO: 181797 - DNA, 35 bp, Artificial Sequence
  Synthetic oligonucleotide
ttctgaagcccgcccgactcttctcagactttgct

SEQ ID NO: 181798 - DNA, 35 bp, Artificial Sequence
  Synthetic oligonucleotide
gccttccaccgctattattcgacaagcacactcgt

SEQ ID NO: 181799 - DNA, 35 bp, Artificial Sequence
  Synthetic oligonucleotide
ggagaggagggttgaaatagtcggcggggggtggt

SEQ ID NO: 181800 - DNA, 35 bp, Artificial Sequence
  Synthetic oligonucleotide
gatcatgcaagcgctacaacgacccgcaccacctt

SEQ ID NO: 181801 - DNA, 35 bp, Artificial Sequence
  Synthetic oligonucleotide
tccacccgctaacccgacatgtcattgcgcccctt

SEQ ID NO: 181802 - DNA, 35 bp, Artificial Sequence
  Synthetic oligonucleotide
gcaccccaccgggcatgtaatacccgtcctgcctt

SEQ ID NO: 181803 - DNA, 35 bp, Artificial Sequence
  Synthetic oligonucleotide
gtctgtcacccccgtttgctccgcctgggttcctt

SEQ ID NO: 181804 - DNA, 35 bp, Artificial Sequence
  Synthetic oligonucleotide
gcctacctccagtaagtcaacactcgtaccttgtt

SEQ ID NO: 181805 - DNA, 35 bp, Artificial Sequence
  Synthetic oligonucleotide
tgtgacatccactgctctattgcacctcccttgtt

SEQ ID NO: 181806 - DNA, 35 bp, Artificial Sequence
  Synthetic oligonucleotide
tccacctcgaaggtataccgttcgcccttgtcttt

SEQ ID NO: 181807 - DNA, 35 bp, Artificial Sequence
  Synthetic oligonucleotide
tattgcagacctcacgcccgccctagcccgctttt

SEQ ID NO: 181808 - DNA, 36 bp, Artificial Sequence
  Synthetic oligonucleotide
ggtggagcgaaaggggggaaaggtgaggcgccacaa

SEQ ID NO: 181809 - DNA, 36 bp, Artificial Sequence
  Synthetic oligonucleotide
tgtacgacagttctttctctcttcaccctgttgcaa

SEQ ID NO: 181810 - DNA, 36 bp, Artificial Sequence
  Synthetic oligonucleotide
gggtccgggggtcgtgcggggtagtagggggccgaa

SEQ ID NO: 181811 - DNA, 36 bp, Artificial Sequence
  Synthetic oligonucleotide
gggagggagtctgggaggtgggggactcgggtggaa

SEQ ID NO: 181812 - DNA, 35 bp, Artificial Sequence
  Synthetic oligonucleotide
gggtcgatgccgcctccatgcttagccaccttgaa

SEQ ID NO: 181813 - DNA, 36 bp, Artificial Sequence
  Synthetic oligonucleotide
tccctccgagcagtggatcgcctcctgcttccctaa

SEQ ID NO: 181814 - DNA, 34 bp, Artificial Sequence
  Synthetic oligonucleotide
tcatccactgccgcccacatagcgtcggtgccca

SEQ ID NO: 181815 - DNA, 36 bp, Artificial Sequence
  Synthetic oligonucleotide
tgtgtcacgcctccatttcttggtcctttcaagcca

SEQ ID NO: 181816 - DNA, 36 bp, Artificial Sequence
  Synthetic oligonucleotide
gtgaccgcaggcctctgccgccgttatgaccctcca

SEQ ID NO: 181817 - DNA, 36 bp, Artificial Sequence
  Synthetic oligonucleotide
gttccaggagtcgaggggtaggatgaggagggggca

SEQ ID NO: 181818 - DNA, 36 bp, Artificial Sequence
  Synthetic oligonucleotide
gtgacagtgagccgcattgcgaggaggggtagatca

SEQ ID NO: 181819 - DNA, 35 bp, Artificial Sequence
  Synthetic oligonucleotide
ttactcgtccactgcaacccgttcgtccccactca

SEQ ID NO: 181820 - DNA, 36 bp, Artificial Sequence
  Synthetic oligonucleotide
attatgccctgcgcctccgcattagtttcgccctca

SEQ ID NO: 181821 - DNA, 36 bp, Artificial Sequence
  Synthetic oligonucleotide
gtgctcaccggcaagctctcttctccctcatgctca

SEQ ID NO: 181822 - DNA, 35 bp, Artificial Sequence
  Synthetic oligonucleotide
ttggtcagctttcaggtccatttcgccccctctca

SEQ ID NO: 181823 - DNA, 35 bp, Artificial Sequence
  Synthetic oligonucleotide
atcggaggtcacggtgggtcggaggacggatgtca

SEQ ID NO: 181824 - DNA, 36 bp, Artificial Sequence
  Synthetic oligonucleotide
tccttcgaaccggctgttatcctttccgcgctttca

SEQ ID NO: 181825 - DNA, 37 bp, Artificial Sequence
  Synthetic oligonucleotide
atcaggggtgaggaagggcgataggggaccgcagaga

SEQ ID NO: 181826 - DNA, 36 bp, Artificial Sequence
  Synthetic oligonucleotide
gggagagggaagcaaaagggcccaaaggaaaggaga

SEQ ID NO: 181827 - DNA, 36 bp, Artificial Sequence
  Synthetic oligonucleotide
gaggaaacgggggggctttgttggggcacagggaga

SEQ ID NO: 181828 - DNA, 37 bp, Artificial Sequence
  Synthetic oligonucleotide
tcaccccgctccaagtgtaccttccattttaccccga

SEQ ID NO: 181829 - DNA, 36 bp, Artificial Sequence
  Synthetic oligonucleotide
tccgacggtcgtgccattaccttggtccacctccga

SEQ ID NO: 181830 - DNA, 37 bp, Artificial Sequence
  Synthetic oligonucleotide
tcaaccgctgcccagctatcctatacatcctctgcga

SEQ ID NO: 181831 - DNA, 37 bp, Artificial Sequence
  Synthetic oligonucleotide
tacgtagtggggaaggtttgggagggggacgaatcga

SEQ ID NO: 181832 - DNA, 36 bp, Artificial Sequence
  Synthetic oligonucleotide
agccctccctcaactcctccgactccgccgactcga

SEQ ID NO: 181833 - DNA, 37 bp, Artificial Sequence
  Synthetic oligonucleotide
gaatccacggggatggggaacgggggggacacctcga

SEQ ID NO: 181834 - DNA, 37 bp, Artificial Sequence
  Synthetic oligonucleotide
tgagccataggcagaaggcgaagggtggggggtagga

SEQ ID NO: 181835 - DNA, 37 bp, Artificial Sequence
  Synthetic oligonucleotide
tagtccggggcaggggcgaataggaggatactgcgga

SEQ ID NO: 181836 - DNA, 37 bp, Artificial Sequence
  Synthetic oligonucleotide
gtgggtcgcaagtggggggctgggtcaaaatcaggga

SEQ ID NO: 181837 - DNA, 37 bp, Artificial Sequence
  Synthetic oligonucleotide
actgagggatgagggggagtggactcgggcggcggga

SEQ ID NO: 181838 - DNA, 37 bp, Artificial Sequence
  Synthetic oligonucleotide
tattgtggcgcccacctctacctgcccccccctggga

SEQ ID NO: 181839 - DNA, 37 bp, Artificial Sequence
  Synthetic oligonucleotide
gcagtggtgacgggccggtggaggcggggagttggga

SEQ ID NO: 181840 - DNA, 37 bp, Artificial Sequence
  Synthetic oligonucleotide
gtgagagttcgccctgtctttgctccaccctcatgga

SEQ ID NO: 181841 - DNA, 37 bp, Artificial Sequence
  Synthetic oligonucleotide
gattccgtcccgcccctttactgccctctcacctgga

SEQ ID NO: 181842 - DNA, 35 bp, Artificial Sequence
  Synthetic oligonucleotide
gggggggaggagggaattggcaacagtctacatga

SEQ ID NO: 181843 - DNA, 38 bp, Artificial Sequence
  Synthetic oligonucleotide
gaggtacggacggggcgggaaaagcaagaaggatatga

SEQ ID NO: 181844 - DNA, 37 bp, Artificial Sequence
  Synthetic oligonucleotide
gtgtcgaggggcaagtaagggaggacgggtagtatga

SEQ ID NO: 181845 - DNA, 37 bp, Artificial Sequence
  Synthetic oligonucleotide
aattccgcctcaccgtggttatctcgtactatactga

SEQ ID NO: 181846 - DNA, 38 bp, Artificial Sequence
  Synthetic oligonucleotide
gcgctcgcttcccccatggcctcccagcacacacctga

SEQ ID NO: 181847 - DNA, 38 bp, Artificial Sequence
  Synthetic oligonucleotide
taggagcgcatataggttctcgcctgtctcctccctga

SEQ ID NO: 181848 - DNA, 37 bp, Artificial Sequence
  Synthetic oligonucleotide
tcacccggccgggacctgacattgctactcctcctga

SEQ ID NO: 181849 - DNA, 37 bp, Artificial Sequence
  Synthetic oligonucleotide
accactgcgcgcatcatttaataccctccgctcctga

SEQ ID NO: 181850 - DNA, 38 bp, Artificial Sequence
  Synthetic oligonucleotide
tgacctgtcgtcagcttgactattttccgccttcctga

SEQ ID NO: 181851 - DNA, 37 bp, Artificial Sequence
  Synthetic oligonucleotide
tcaacgcgttcatgctctgctaatacccccgctctga

SEQ ID NO: 181852 - DNA, 37 bp, Artificial Sequence
  Synthetic oligonucleotide
gcttgcccccagccacctgctacccaccattctctga

SEQ ID NO: 181853 - DNA, 38 bp, Artificial Sequence
  Synthetic oligonucleotide
gcgggcgggggggaagggctttctcgtgtatgccgtga

SEQ ID NO: 181854 - DNA, 38 bp, Artificial Sequence
  Synthetic oligonucleotide
tcacgtaagctacactgatggagcgggagggagggtga

SEQ ID NO: 181855 - DNA, 38 bp, Artificial Sequence
  Synthetic oligonucleotide
gtggacgaagtccggggaaaggaagggggggagggtga

SEQ ID NO: 181856 - DNA, 38 bp, Artificial Sequence
  Synthetic oligonucleotide
tagaacgcctaaagatggggagaagggagggcgggtga

SEQ ID NO: 181857 - DNA, 37 bp, Artificial Sequence
  Synthetic oligonucleotide
tcgccctccgctaatggtactatccgcccgctggtga

SEQ ID NO: 181858 - DNA, 37 bp, Artificial Sequence
  Synthetic oligonucleotide
gcgaacggacgtcgccgcgtagtaccctccccattga

SEQ ID NO: 181859 - DNA, 36 bp, Artificial Sequence
  Synthetic oligonucleotide
actgcccatccgcttaggcctatcctcacttattga

SEQ ID NO: 181860 - DNA, 37 bp, Artificial Sequence
  Synthetic oligonucleotide
tgaagggcaagttgaggggggcggtagacaaacttga

SEQ ID NO: 181861 - DNA, 38 bp, Artificial Sequence
  Synthetic oligonucleotide
gcgaagctctcgtaccctgtattttaccccgctcttga

SEQ ID NO: 181862 - DNA, 37 bp, Artificial Sequence
  Synthetic oligonucleotide
tgagagccacgcccgtacctgttgtccctttgtttga

SEQ ID NO: 181863 - DNA, 38 bp, Artificial Sequence
  Synthetic oligonucleotide
gtgtggagaagggtggaaagcagggggaaatattttga

SEQ ID NO: 181864 - DNA, 38 bp, Artificial Sequence
  Synthetic oligonucleotide
atgcgttagacgtcacctatcgtcccctgcccttttga

SEQ ID NO: 181865 - DNA, 35 bp, Artificial Sequence
  Synthetic oligonucleotide
ttcaggtgccgtatgcctggccgttcccttccata

SEQ ID NO: 181866 - DNA, 36 bp, Artificial Sequence
  Synthetic oligonucleotide
gtcgaccccacaacgccgcacatgctccggtaccta

SEQ ID NO: 181867 - DNA, 36 bp, Artificial Sequence
  Synthetic oligonucleotide
gccatgatgctatctgcacacacgacccttttccta

SEQ ID NO: 181868 - DNA, 36 bp, Artificial Sequence
  Synthetic oligonucleotide
tcccacctgtaccgctatcccttttgagtcctgcta

SEQ ID NO: 181869 - DNA, 36 bp, Artificial Sequence
  Synthetic oligonucleotide
actcatcaccttatgctgcctttcggacttactcta

SEQ ID NO: 181870 - DNA, 35 bp, Artificial Sequence
  Synthetic oligonucleotide
gattgtaggggcggtagagagcggggggaagtcta

SEQ ID NO: 181871 - DNA, 36 bp, Artificial Sequence
  Synthetic oligonucleotide
gccccatccgccagaaatgagtctagctcccttcta

SEQ ID NO: 181872 - DNA, 34 bp, Artificial Sequence
  Synthetic oligonucleotide
acccgcttcctatcccttcgcctgcttcactgta

SEQ ID NO: 181873 - DNA, 36 bp, Artificial Sequence
  Synthetic oligonucleotide
tctgtgcccccgtcatcctataccttcgtagcgtta

SEQ ID NO: 181874 - DNA, 36 bp, Artificial Sequence
  Synthetic oligonucleotide
gcaaggggggggtggataatggcgaggggatattta

SEQ ID NO: 181875 - DNA, 35 bp, Artificial Sequence
  Synthetic oligonucleotide
agtactgccactgtcgcctgttccatcgccggaac

SEQ ID NO: 181876 - DNA, 35 bp, Artificial Sequence
  Synthetic oligonucleotide
tcaatgtaccgccatccatctgtcctcacgcacac

SEQ ID NO: 181877 - DNA, 33 bp, Artificial Sequence
  Synthetic oligonucleotide
aatcagcactcctcaccgcctcctgcgctcgac

SEQ ID NO: 181878 - DNA, 35 bp, Artificial Sequence
  Synthetic oligonucleotide
gctccatccgtatagcgtatattgccgcctgtgac

SEQ ID NO: 181879 - DNA, 35 bp, Artificial Sequence
  Synthetic oligonucleotide
gcatgatcatggcaatattcccctactgtctctac

SEQ ID NO: 181880 - DNA, 35 bp, Artificial Sequence
  Synthetic oligonucleotide
ggggtgcctcggctgccgctttttcatccgtctac

SEQ ID NO: 181881 - DNA, 35 bp, Artificial Sequence
  Synthetic oligonucleotide
atgacttagcgtggcattttcttggtccgttctac

SEQ ID NO: 181882 - DNA, 34 bp, Artificial Sequence
  Synthetic oligonucleotide
gacacctctcagttatttccttcccatcaattac

SEQ ID NO: 181883 - DNA, 35 bp, Artificial Sequence
  Synthetic oligonucleotide
atagccggtcgcattcgatctattgactcaccacc

SEQ ID NO: 181884 - DNA, 35 bp, Artificial Sequence
  Synthetic oligonucleotide
gtgttcacacgcttcatgtctttcttcaccatacc

SEQ ID NO: 181885 - DNA, 35 bp, Artificial Sequence
  Synthetic oligonucleotide
attgaaccctgcctccacttccgcgtgttggtacc

SEQ ID NO: 181886 - DNA, 35 bp, Artificial Sequence
  Synthetic oligonucleotide
tacgcccctgcactgtaatggcgtctatattaccc

SEQ ID NO: 181887 - DNA, 35 bp, Artificial Sequence
  Synthetic oligonucleotide
tacccgttgccaccgaatggcctcctccggacccc

SEQ ID NO: 181888 - DNA, 35 bp, Artificial Sequence
  Synthetic oligonucleotide
tgctctccacctcgctttgagctcgctattggccc

SEQ ID NO: 181889 - DNA, 35 bp, Artificial Sequence
  Synthetic oligonucleotide
agtgcccccccaggtactgaaactctcttgtgccc

SEQ ID NO: 181890 - DNA, 35 bp, Artificial Sequence
  Synthetic oligonucleotide
ttactccgtagcacgtgcgttgcccattgattccc

SEQ ID NO: 181891 - DNA, 35 bp, Artificial Sequence
  Synthetic oligonucleotide
gttgcaccgctcagtaagcgtctcgaccttttccc

SEQ ID NO: 181892 - DNA, 35 bp, Artificial Sequence
  Synthetic oligonucleotide
acacgccatcatctcggtgccacgctccccacgcc

SEQ ID NO: 181893 - DNA, 35 bp, Artificial Sequence
  Synthetic oligonucleotide
ttcgtacttcagtcttcttggtttggccccccgcc

SEQ ID NO: 181894 - DNA, 35 bp, Artificial Sequence
  Synthetic oligonucleotide
tatcgcgccccataaccaatgccatctgttgcgcc

SEQ ID NO: 181895 - DNA, 35 bp, Artificial Sequence
  Synthetic oligonucleotide
aacacgtctactgccggaacccttcgcccactgcc

SEQ ID NO: 181896 - DNA, 34 bp, Artificial Sequence
  Synthetic oligonucleotide
tccaccgcactggttcactattcactgatgctcc

SEQ ID NO: 181897 - DNA, 35 bp, Artificial Sequence
  Synthetic oligonucleotide
tgcaccccacctggcttcaaggctgacacgtgtcc

SEQ ID NO: 181898 - DNA, 35 bp, Artificial Sequence
  Synthetic oligonucleotide
ccagacggtcggtgcttcatccatccattttttcc

SEQ ID NO: 181899 - DNA, 35 bp, Artificial Sequence
  Synthetic oligonucleotide
acatccaccccgagggttttcgttgattcctacgc

SEQ ID NO: 181900 - DNA, 35 bp, Artificial Sequence
  Synthetic oligonucleotide
gacctgctcgtgtctttcgctcgtttcccttacgc

SEQ ID NO: 181901 - DNA, 35 bp, Artificial Sequence
  Synthetic oligonucleotide
gggggccctcaactgtgggcggggatgtccggggc

SEQ ID NO: 181902 - DNA, 35 bp, Artificial Sequence
  Synthetic oligonucleotide
gcgatgggtggtggggaggggttgctgtcgtgggc

SEQ ID NO: 181903 - DNA, 35 bp, Artificial Sequence
  Synthetic oligonucleotide
gtgagacctgcctcagcggaatatttccatctatc

SEQ ID NO: 181904 - DNA, 35 bp, Artificial Sequence
  Synthetic oligonucleotide
gcacggtcactggccagtagtttttccgccttatc

SEQ ID NO: 181905 - DNA, 35 bp, Artificial Sequence
  Synthetic oligonucleotide
ccccccaccggctgaggtagcactgtccctccctc

SEQ ID NO: 181906 - DNA, 35 bp, Artificial Sequence
  Synthetic oligonucleotide
tatggtcaggtctgccgccgccgtttttccgcctc

SEQ ID NO: 181907 - DNA, 35 bp, Artificial Sequence
  Synthetic oligonucleotide
gtagtacctccgctttttgtcctcaggactggctc

SEQ ID NO: 181908 - DNA, 35 bp, Artificial Sequence
  Synthetic oligonucleotide
ttggctcctccgcccattgtcttgtcgttcccgtc

SEQ ID NO: 181909 - DNA, 35 bp, Artificial Sequence
  Synthetic oligonucleotide
gacctgttcacatgcgcgctatacgtaccctcgtc

SEQ ID NO: 181910 - DNA, 35 bp, Artificial Sequence
  Synthetic oligonucleotide
agtgcgcccccccccctttaggtgcgctcgtattc

SEQ ID NO: 181911 - DNA, 35 bp, Artificial Sequence
  Synthetic oligonucleotide
aatcgccttggccgctgttcccctttcgtctcttc

SEQ ID NO: 181912 - DNA, 35 bp, Artificial Sequence
  Synthetic oligonucleotide
tcgaacgactcatgtcatcgccggtccgacctttc

SEQ ID NO: 181913 - DNA, 35 bp, Artificial Sequence
  Synthetic oligonucleotide
gattatcgcaccaccttgttcccgaacgctgtttc

SEQ ID NO: 181914 - DNA, 35 bp, Artificial Sequence
  Synthetic oligonucleotide
tcgacgttacctcccccgccggtcgttccctcaag

SEQ ID NO: 181915 - DNA, 35 bp, Artificial Sequence
  Synthetic oligonucleotide
tcccaccgccccatctttgcatatgccatgccacg

SEQ ID NO: 181916 - DNA, 35 bp, Artificial Sequence
  Synthetic oligonucleotide
tgatgccgccgctctccgccccccctacagtagcg

SEQ ID NO: 181917 - DNA, 35 bp, Artificial Sequence
  Synthetic oligonucleotide
tgccccgcatcttacccgtcaagtcacacgtcgcg

SEQ ID NO: 181918 - DNA, 35 bp, Artificial Sequence
  Synthetic oligonucleotide
taaaaccacctgccctcaccatgagtaccgactcg

SEQ ID NO: 181919 - DNA, 34 bp, Artificial Sequence
  Synthetic oligonucleotide
gctgcagtaatcatcctccatcctccgtttgtcg

SEQ ID NO: 181920 - DNA, 35 bp, Artificial Sequence
  Synthetic oligonucleotide
tgtctgccgggatgggagggcgggcgtgctaaggg

SEQ ID NO: 181921 - DNA, 35 bp, Artificial Sequence
  Synthetic oligonucleotide
tgccgagccatcttgcgccatatctgttatccatg

SEQ ID NO: 181922 - DNA, 35 bp, Artificial Sequence
  Synthetic oligonucleotide
gtttgcgctatgtatgccccatcttgtctattctg

SEQ ID NO: 181923 - DNA, 34 bp, Artificial Sequence
  Synthetic oligonucleotide
ggagagagggcgggggggtatgtaattccatgtg

SEQ ID NO: 181924 - DNA, 35 bp, Artificial Sequence
  Synthetic oligonucleotide
gatcgcctttgccgtcacgtattccaccctatttg

SEQ ID NO: 181925 - DNA, 35 bp, Artificial Sequence
  Synthetic oligonucleotide
acccgccccacattttgccttgagctctacctttg

SEQ ID NO: 181926 - DNA, 35 bp, Artificial Sequence
  Synthetic oligonucleotide
gatggctccccagactctcttttctagctcctttg

SEQ ID NO: 181927 - DNA, 35 bp, Artificial Sequence
  Synthetic oligonucleotide
gacgcctacaccccacgctacgtaaactttgtttg

SEQ ID NO: 181928 - DNA, 36 bp, Artificial Sequence
  Synthetic oligonucleotide
ggatcgcttcctttgtcgttcactcctcctgctaat

SEQ ID NO: 181929 - DNA, 35 bp, Artificial Sequence
  Synthetic oligonucleotide
accgaagtgcctacacgctatctgggttcacccat

SEQ ID NO: 181930 - DNA, 35 bp, Artificial Sequence
  Synthetic oligonucleotide
gaggggaagggcggggtagggaaataggacgtgat

SEQ ID NO: 181931 - DNA, 35 bp, Artificial Sequence
  Synthetic oligonucleotide
acacactcacccagcccactgttacgttatcatat

SEQ ID NO: 181932 - DNA, 35 bp, Artificial Sequence
  Synthetic oligonucleotide
tggtcatcccccccctggtcggatccttctgctat

SEQ ID NO: 181933 - DNA, 35 bp, Artificial Sequence
  Synthetic oligonucleotide
tatacacgccgccacaagcattcatcgtgacacct

SEQ ID NO: 181934 - DNA, 35 bp, Artificial Sequence
  Synthetic oligonucleotide
tttgtccaccttagtgatttcctgcccgtttacct

SEQ ID NO: 181935 - DNA, 35 bp, Artificial Sequence
  Synthetic oligonucleotide
tcatatcgggctctgacgcactgcttatctaccct

SEQ ID NO: 181936 - DNA, 35 bp, Artificial Sequence
  Synthetic oligonucleotide
aatgcgcatccgcattcctttgcccatacctgcct

SEQ ID NO: 181937 - DNA, 35 bp, Artificial Sequence
  Synthetic oligonucleotide
agcacagcccgtcacttcatttgtacgttctgcct

SEQ ID NO: 181938 - DNA, 35 bp, Artificial Sequence
  Synthetic oligonucleotide
tcagttaacagccctcattgtccatcccgggtcct

SEQ ID NO: 181939 - DNA, 35 bp, Artificial Sequence
  Synthetic oligonucleotide
ttacgatccgctgcttccttctccgaccctgttct

SEQ ID NO: 181940 - DNA, 35 bp, Artificial Sequence
  Synthetic oligonucleotide
atgtcaccacccccgagggcttccctttactcagt

SEQ ID NO: 181941 - DNA, 35 bp, Artificial Sequence
  Synthetic oligonucleotide
agaagaagagggacagcaggggaagacagagaggt

SEQ ID NO: 181942 - DNA, 35 bp, Artificial Sequence
  Synthetic oligonucleotide
ggtgtcagggcaccgtgcttgagggaagggggggt

SEQ ID NO: 181943 - DNA, 35 bp, Artificial Sequence
  Synthetic oligonucleotide
tcgtgaaccccccattaacccgcctggccattggt

SEQ ID NO: 181944 - DNA, 35 bp, Artificial Sequence
  Synthetic oligonucleotide
gcaactcaaccccgtctgcccttcctaatacatgt

SEQ ID NO: 181945 - DNA, 34 bp, Artificial Sequence
  Synthetic oligonucleotide
gatccacgttcctgccgcagttttacacgcctgt

SEQ ID NO: 181946 - DNA, 35 bp, Artificial Sequence
  Synthetic oligonucleotide
ttggtggcaccatgtccttggtctttatcctctgt

SEQ ID NO: 181947 - DNA, 35 bp, Artificial Sequence
  Synthetic oligonucleotide
ataccctttctgtgctgttatcgttcctgtccatt

SEQ ID NO: 181948 - DNA, 35 bp, Artificial Sequence
  Synthetic oligonucleotide
tgtttgacaccgctgccggttgactccacaccctt

SEQ ID NO: 181949 - DNA, 35 bp, Artificial Sequence
  Synthetic oligonucleotide
tgctgccccttgtctacctgtctgccgcactcctt

SEQ ID NO: 181950 - DNA, 35 bp, Artificial Sequence
  Synthetic oligonucleotide
accttccaccggagactgtggttccccgttttctt

SEQ ID NO: 181951 - DNA, 35 bp, Artificial Sequence
  Synthetic oligonucleotide
tactgccgtaccgttaggtgataccaccctctgtt

SEQ ID NO: 181952 - DNA, 35 bp, Artificial Sequence
  Synthetic oligonucleotide
tccacccccccccttcccgacgctccgtacttgtt

SEQ ID NO: 181953 - DNA, 35 bp, Artificial Sequence
  Synthetic oligonucleotide
taatcactagctgctgcccctccgctgttccattt

SEQ ID NO: 181954 - DNA, 35 bp, Artificial Sequence
  Synthetic oligonucleotide
gcgatgccatctcgcgactcgacgatcctcctttt

SEQ ID NO: 181955 - DNA, 36 bp, Artificial Sequence
  Synthetic oligonucleotide
gtgacggtggtgtggggggggtaagggcagaaaaaa

SEQ ID NO: 181956 - DNA, 35 bp, Artificial Sequence
  Synthetic oligonucleotide
gcacccgctccggttcatcatcaacacctccaaaa

SEQ ID NO: 181957 - DNA, 30 bp, Artificial Sequence
  Synthetic oligonucleotide
gccccgctccctgcttagaccgcacttaaa

SEQ ID NO: 181958 - DNA, 36 bp, Artificial Sequence
  Synthetic oligonucleotide
ggacatccgccatctctgttagcctttcttgtacaa

SEQ ID NO: 181959 - DNA, 35 bp, Artificial Sequence
  Synthetic oligonucleotide
aaatcccgctcctgatacaatgtccgtggccccaa

SEQ ID NO: 181960 - DNA, 36 bp, Artificial Sequence
  Synthetic oligonucleotide
gctgtcagggtgtgagggaaaggctgggggggagaa

SEQ ID NO: 181961 - DNA, 35 bp, Artificial Sequence
  Synthetic oligonucleotide
gccccccgtacagagtacctgctttccaccccgaa

SEQ ID NO: 181962 - DNA, 35 bp, Artificial Sequence
  Synthetic oligonucleotide
tacctgcgggggggggtaaaatgctggggagggaa

SEQ ID NO: 181963 - DNA, 36 bp, Artificial Sequence
  Synthetic oligonucleotide
gggacgatggtgcggtttatggggcggcatggggaa

SEQ ID NO: 181964 - DNA, 35 bp, Artificial Sequence
  Synthetic oligonucleotide
tcctgccaccctctcatttattccgccgtcttgaa

SEQ ID NO: 181965 - DNA, 35 bp, Artificial Sequence
  Synthetic oligonucleotide
gagggatcgactgggaggggagctgggcgtaataa

SEQ ID NO: 181966 - DNA, 36 bp, Artificial Sequence
  Synthetic oligonucleotide
tcagccccgtcactggtctcctcgtttttctactaa

SEQ ID NO: 181967 - DNA, 36 bp, Artificial Sequence
  Synthetic oligonucleotide
aatctaccaccgctcctgttcatacagactccaaca

SEQ ID NO: 181968 - DNA, 36 bp, Artificial Sequence
  Synthetic oligonucleotide
tgacccaccacactcacccctgcgcatgaactgaca

SEQ ID NO: 181969 - DNA, 35 bp, Artificial Sequence
  Synthetic oligonucleotide
ttgactccctcactcacctcatgttgttaatacca

SEQ ID NO: 181970 - DNA, 36 bp, Artificial Sequence
  Synthetic oligonucleotide
tcaaccgcccccgcttcccggatacgatcatgccca

SEQ ID NO: 181971 - DNA, 35 bp, Artificial Sequence
  Synthetic oligonucleotide
aatgtggatccgtcctgcatccgttaactccgcca

SEQ ID NO: 181972 - DNA, 36 bp, Artificial Sequence
  Synthetic oligonucleotide
gtgcggagacgctccatgctttcacccagttatcca

SEQ ID NO: 181973 - DNA, 35 bp, Artificial Sequence
  Synthetic oligonucleotide
ttgctacctcgcgccgctcacacgtaatacctcca

SEQ ID NO: 181974 - DNA, 36 bp, Artificial Sequence
  Synthetic oligonucleotide
aggccccccagtactttgtcatatctgctctgtcca

SEQ ID NO: 181975 - DNA, 36 bp, Artificial Sequence
  Synthetic oligonucleotide
gtctggtcctctcgtttctcaatctggtcctccgca

SEQ ID NO: 181976 - DNA, 36 bp, Artificial Sequence
  Synthetic oligonucleotide
gagacaggtcagccttcttcggtcttcggtcctgca

SEQ ID NO: 181977 - DNA, 36 bp, Artificial Sequence
  Synthetic oligonucleotide
tccacgtacggagcatttccacccatagtctgtgca

SEQ ID NO: 181978 - DNA, 35 bp, Artificial Sequence
  Synthetic oligonucleotide
tccccaaccccttcactgctcaagcaggtacatca

SEQ ID NO: 181979 - DNA, 36 bp, Artificial Sequence
  Synthetic oligonucleotide
gcattaacaccctcgcagcctgcgtaaaccacctca

SEQ ID NO: 181980 - DNA, 36 bp, Artificial Sequence
  Synthetic oligonucleotide
acctgacctactatcttgcacctcgagacgctgtca

SEQ ID NO: 181981 - DNA, 36 bp, Artificial Sequence
  Synthetic oligonucleotide
actgctttgcacccgccgtacttccatcgcgcttca

SEQ ID NO: 181982 - DNA, 36 bp, Artificial Sequence
  Synthetic oligonucleotide
tcactcctcgctgtttacggcgccccgtggtcttca

SEQ ID NO: 181983 - DNA, 36 bp, Artificial Sequence
  Synthetic oligonucleotide
gcataacggcccgtatgcgttacatccccctccaga

SEQ ID NO: 181984 - DNA, 37 bp, Artificial Sequence
  Synthetic oligonucleotide
gaggtgggtaggtggtgagaatgggggaaagattaga

SEQ ID NO: 181985 - DNA, 37 bp, Artificial Sequence
  Synthetic oligonucleotide
ttctcgccccacaccgccgttatgtgcctgcctacga

SEQ ID NO: 181986 - DNA, 35 bp, Artificial Sequence
  Synthetic oligonucleotide
gccactctctgcatatcatccccatgtacttacga

SEQ ID NO: 181987 - DNA, 37 bp, Artificial Sequence
  Synthetic oligonucleotide
gtccagtgacttgttctcgaaaccgccccctcgccga

SEQ ID NO: 181988 - DNA, 37 bp, Artificial Sequence
  Synthetic oligonucleotide
tccaccgtaataagtcccaccctcccacttcatgcga

SEQ ID NO: 181989 - DNA, 37 bp, Artificial Sequence
  Synthetic oligonucleotide
ggcgggggagggataacggaggggggaggtaaatcga

SEQ ID NO: 181990 - DNA, 36 bp, Artificial Sequence
  Synthetic oligonucleotide
gcagtcccgcctgcctcaccatttatgaccattcga

SEQ ID NO: 181991 - DNA, 37 bp, Artificial Sequence
  Synthetic oligonucleotide
tgacaaggatgggggggagtgaagagcgcgggacgga

SEQ ID NO: 181992 - DNA, 37 bp, Artificial Sequence
  Synthetic oligonucleotide
tcctccccacatcctatgtcgacacttcgtatccgga

SEQ ID NO: 181993 - DNA, 37 bp, Artificial Sequence
  Synthetic oligonucleotide
attacccacccgctcatgctcaacgactctctccgga

SEQ ID NO: 181994 - DNA, 36 bp, Artificial Sequence
  Synthetic oligonucleotide
ttaaccatccggcatgcccctgcctcttcttccgga

SEQ ID NO: 181995 - DNA, 37 bp, Artificial Sequence
  Synthetic oligonucleotide
ggatcgccgccccccattgcaagctcactgttccgga

SEQ ID NO: 181996 - DNA, 37 bp, Artificial Sequence
  Synthetic oligonucleotide
gccgcgaacgggcagggggggcgaaatggtcacggga

SEQ ID NO: 181997 - DNA, 37 bp, Artificial Sequence
  Synthetic oligonucleotide
gtcgggggaggacggaaaatggaagattggagcggga

SEQ ID NO: 181998 - DNA, 36 bp, Artificial Sequence
  Synthetic oligonucleotide
gggggacagttcgggggatagagttacggggcggga

SEQ ID NO: 181999 - DNA, 37 bp, Artificial Sequence
  Synthetic oligonucleotide
atgccggaacggcatgtattgtcatgggaggagggga

SEQ ID NO: 182000 - DNA, 37 bp, Artificial Sequence
  Synthetic oligonucleotide
agcatcgggcggaggttcgattggatagcggggggga

SEQ ID NO: 182001 - DNA, 37 bp, Artificial Sequence
  Synthetic oligonucleotide
agattgtaagtgggcggagggacaaaaagcatgggga

SEQ ID NO: 182002 - DNA, 37 bp, Artificial Sequence
  Synthetic oligonucleotide
gtgcgggaggatagggagtagatgactgagggtggga

SEQ ID NO: 182003 - DNA, 38 bp, Artificial Sequence
  Synthetic oligonucleotide
tcgcgtggggggagggatggggagtggagcagtaatga

SEQ ID NO: 182004 - DNA, 37 bp, Artificial Sequence
  Synthetic oligonucleotide
tgccgccccacgccctccgaccgatcaggttgcatga

SEQ ID NO: 182005 - DNA, 38 bp, Artificial Sequence
  Synthetic oligonucleotide
agttcagcgctccgtccctcgtatgccacacccactga

SEQ ID NO: 182006 - DNA, 36 bp, Artificial Sequence
  Synthetic oligonucleotide
atccaagcccacccgttacacgccattctccactga

SEQ ID NO: 182007 - DNA, 37 bp, Artificial Sequence
  Synthetic oligonucleotide
acgagaacggcttgtgggtgggacgggggattgctga

SEQ ID NO: 182008 - DNA, 38 bp, Artificial Sequence
  Synthetic oligonucleotide
gacaacagagggacgggagtacggggaatcggtagtga

SEQ ID NO: 182009 - DNA, 38 bp, Artificial Sequence
  Synthetic oligonucleotide
agtggacggtggtgggttcgggtagggggggtccgtga

SEQ ID NO: 182010 - DNA, 38 bp, Artificial Sequence
  Synthetic oligonucleotide
tcgaaggggggggcgggtcagggcggtggggtgcgtga

SEQ ID NO: 182011 - DNA, 36 bp, Artificial Sequence
  Synthetic oligonucleotide
gagaggcgacgcggcgggtgggaaggggctcggtga

SEQ ID NO: 182012 - DNA, 38 bp, Artificial Sequence
  Synthetic oligonucleotide
ttgggggcggtcagctgggcggggcaaagctagggtga

SEQ ID NO: 182013 - DNA, 37 bp, Artificial Sequence
  Synthetic oligonucleotide
ggagggggaagggtggggaggcgcaggtgtaaattga

SEQ ID NO: 182014 - DNA, 38 bp, Artificial Sequence
  Synthetic oligonucleotide
tcaacgcccgtatcatccttcgcccgtacacaccttga

SEQ ID NO: 182015 - DNA, 36 bp, Artificial Sequence
  Synthetic oligonucleotide
gcatctcccatcctgatcttccttgtcgacagttga

SEQ ID NO: 182016 - DNA, 37 bp, Artificial Sequence
  Synthetic oligonucleotide
tctccgcacctccatacgcctcatgtcttatcgttga

SEQ ID NO: 182017 - DNA, 37 bp, Artificial Sequence
  Synthetic oligonucleotide
ggggagacaaaggggggtgtgggagaataagggttga

SEQ ID NO: 182018 - DNA, 37 bp, Artificial Sequence
  Synthetic oligonucleotide
acacgtgccatctgttttcgctcactccattggttga

SEQ ID NO: 182019 - DNA, 36 bp, Artificial Sequence
  Synthetic oligonucleotide
ttcatcacccgccctgtagcacccacactaaccata

SEQ ID NO: 182020 - DNA, 36 bp, Artificial Sequence
  Synthetic oligonucleotide
ggaaccgaccccgctcgtttcgcccattacatccta

SEQ ID NO: 182021 - DNA, 36 bp, Artificial Sequence
  Synthetic oligonucleotide
tccatgctgtcaagctcgcttccttagttgcctcta

SEQ ID NO: 182022 - DNA, 35 bp, Artificial Sequence
  Synthetic oligonucleotide
tctcaccacacattgttctgtccccactggttcta

SEQ ID NO: 182023 - DNA, 37 bp, Artificial Sequence
  Synthetic oligonucleotide
ttgccacccgccccccgtaactccctgtactgtcgta

SEQ ID NO: 182024 - DNA, 35 bp, Artificial Sequence
  Synthetic oligonucleotide
tgtgtacgccccctccaactactttgctctcggta

SEQ ID NO: 182025 - DNA, 36 bp, Artificial Sequence
  Synthetic oligonucleotide
gcccgctccgatccctgcgttatcaacccacatgta

SEQ ID NO: 182026 - DNA, 38 bp, Artificial Sequence
  Synthetic oligonucleotide
atggggcaagtcaagggcggggcacaaccaggggatta

SEQ ID NO: 182027 - DNA, 36 bp, Artificial Sequence
  Synthetic oligonucleotide
gttctccgccaccggtgtttactgttccgtgcctta

SEQ ID NO: 182028 - DNA, 35 bp, Artificial Sequence
  Synthetic oligonucleotide
tctatcctgccgccacatcgcaggctcaatacaac

SEQ ID NO: 182029 - DNA, 34 bp, Artificial Sequence
  Synthetic oligonucleotide
gaacttccgcactcattgcctatctggactccac

SEQ ID NO: 182030 - DNA, 35 bp, Artificial Sequence
  Synthetic oligonucleotide
gattcgcccccatgatctgtctcccaggcctctac

SEQ ID NO: 182031 - DNA, 35 bp, Artificial Sequence
  Synthetic oligonucleotide
gccccccgtatcggttctgtcgaggatcgcctacc

SEQ ID NO: 182032 - DNA, 35 bp, Artificial Sequence
  Synthetic oligonucleotide
atcctgccaattcgcgttcacctggtccatccccc

SEQ ID NO: 182033 - DNA, 35 bp, Artificial Sequence
  Synthetic oligonucleotide
gccatgccctcatcacgttcaaaatccgtctcccc

SEQ ID NO: 182034 - DNA, 35 bp, Artificial Sequence
  Synthetic oligonucleotide
tgcctctggctccatctctttcgtgtgcttggccc

SEQ ID NO: 182035 - DNA, 35 bp, Artificial Sequence
  Synthetic oligonucleotide
tgcacaccgcctcaccgccagattcgcgatcagcc

SEQ ID NO: 182036 - DNA, 35 bp, Artificial Sequence
  Synthetic oligonucleotide
ttacagcccataccgccgcctgtccgtctttagcc

SEQ ID NO: 182037 - DNA, 35 bp, Artificial Sequence
  Synthetic oligonucleotide
agatgtccagctgcttagccgcccgtaaactcgcc

SEQ ID NO: 182038 - DNA, 35 bp, Artificial Sequence
  Synthetic oligonucleotide
gaccatcgcgcctctccggctctataccgctggcc

SEQ ID NO: 182039 - DNA, 35 bp, Artificial Sequence
  Synthetic oligonucleotide
gtggaccacggttgtctcacagttccctttctgcc

SEQ ID NO: 182040 - DNA, 35 bp, Artificial Sequence
  Synthetic oligonucleotide
gagtcagagtgcttcggcgtcaaccagttccatcc

SEQ ID NO: 182041 - DNA, 35 bp, Artificial Sequence
  Synthetic oligonucleotide
gtcgacgcccttgactgttcaaccgactctcctcc

SEQ ID NO: 182042 - DNA, 35 bp, Artificial Sequence
  Synthetic oligonucleotide
tgctccccttcatggtcccacagacgttccgctcc

SEQ ID NO: 182043 - DNA, 35 bp, Artificial Sequence
  Synthetic oligonucleotide
actgcgcccacgcaagtaccgcaaaggacccttcc

SEQ ID NO: 182044 - DNA, 35 bp, Artificial Sequence
  Synthetic oligonucleotide
gacctccatcagtttctagtacccccactgcttcc

SEQ ID NO: 182045 - DNA, 35 bp, Artificial Sequence
  Synthetic oligonucleotide
gaaccctcgttggctccccggaaaccttgcgttcc

SEQ ID NO: 182046 - DNA, 35 bp, Artificial Sequence
  Synthetic oligonucleotide
gtcacaatcctgggcacctaacacctgcaccccgc

SEQ ID NO: 182047 - DNA, 35 bp, Artificial Sequence
  Synthetic oligonucleotide
gtaccaacgccccaaatggtccgccgcctatgggc

SEQ ID NO: 182048 - DNA, 35 bp, Artificial Sequence
  Synthetic oligonucleotide
attccgcccccgtccaccggtaccgccacccctgc

SEQ ID NO: 182049 - DNA, 35 bp, Artificial Sequence
  Synthetic oligonucleotide
attgcgaaaccccctcctgtgcgtcccttctttgc

SEQ ID NO: 182050 - DNA, 35 bp, Artificial Sequence
  Synthetic oligonucleotide
gtccaccatcaactatttcatttccgcccggactc

SEQ ID NO: 182051 - DNA, 35 bp, Artificial Sequence
  Synthetic oligonucleotide
acggtcaccactgaatttccagacccgaccgcctc

SEQ ID NO: 182052 - DNA, 35 bp, Artificial Sequence
  Synthetic oligonucleotide
gtcgttcaacagcgggtctcggtcactctcgcctc

SEQ ID NO: 182053 - DNA, 35 bp, Artificial Sequence
  Synthetic oligonucleotide
aatgccgtctttcgtgcgctactacacccggcctc

SEQ ID NO: 182054 - DNA, 35 bp, Artificial Sequence
  Synthetic oligonucleotide
tcaaagggtcccgtcttgcattttcatccatcctc

SEQ ID NO: 182055 - DNA, 35 bp, Artificial Sequence
  Synthetic oligonucleotide
ctgtctccactcactctgccgccgcgctcgcgctc

SEQ ID NO: 182056 - DNA, 35 bp, Artificial Sequence
  Synthetic oligonucleotide
accacgcttcacgggcccgcgacgttcgccttctc

SEQ ID NO: 182057 - DNA, 35 bp, Artificial Sequence
  Synthetic oligonucleotide
gtgaaacgagggatagggggtatgatgatggtgag

SEQ ID NO: 182058 - DNA, 33 bp, Artificial Sequence
  Synthetic oligonucleotide
gcgtacgaggggtgggggggaaaggtggaaccg

SEQ ID NO: 182059 - DNA, 35 bp, Artificial Sequence
  Synthetic oligonucleotide
agcgcctctccagtgaaacccgtcgcctattcccg

SEQ ID NO: 182060 - DNA, 35 bp, Artificial Sequence
  Synthetic oligonucleotide
attcgctcctctcctgccttgatcaccaagttccg

SEQ ID NO: 182061 - DNA, 35 bp, Artificial Sequence
  Synthetic oligonucleotide
ttgccagtgccgccgttcccccgtctgtgccagcg

SEQ ID NO: 182062 - DNA, 35 bp, Artificial Sequence
  Synthetic oligonucleotide
acgaggagcgaagtggtgagggctgggagggcgcg

SEQ ID NO: 182063 - DNA, 35 bp, Artificial Sequence
  Synthetic oligonucleotide
gaaatggttggggtgggaagtccgggaaggatgcg

SEQ ID NO: 182064 - DNA, 35 bp, Artificial Sequence
  Synthetic oligonucleotide
gtcgaccctgcgccattgttcatcccgtcaactcg

SEQ ID NO: 182065 - DNA, 36 bp, Artificial Sequence
  Synthetic oligonucleotide
actccaccggtcgcccgataaagaactatcctctcg

SEQ ID NO: 182066 - DNA, 35 bp, Artificial Sequence
  Synthetic oligonucleotide
gtgcgacctcctcgtgtaccgtgtccctcctctcg

SEQ ID NO: 182067 - DNA, 35 bp, Artificial Sequence
  Synthetic oligonucleotide
tgggtgggtgaatgatcgggtgagggaggtggtcg

SEQ ID NO: 182068 - DNA, 36 bp, Artificial Sequence
  Synthetic oligonucleotide
tccccgcccacgacctcgtttactcgcattacttcg

SEQ ID NO: 182069 - DNA, 36 bp, Artificial Sequence
  Synthetic oligonucleotide
acccgcgccccctgcatacgtaacccctcctgttcg

SEQ ID NO: 182070 - DNA, 35 bp, Artificial Sequence
  Synthetic oligonucleotide
gcccaagggtcaataatcgtcttagggagggcggg

SEQ ID NO: 182071 - DNA, 35 bp, Artificial Sequence
  Synthetic oligonucleotide
gaggtcgacgggggatatgaatgggaatgggcggg

SEQ ID NO: 182072 - DNA, 34 bp, Artificial Sequence
  Synthetic oligonucleotide
atggaggtgcggcgggggggagggctggaagggg

SEQ ID NO: 182073 - DNA, 35 bp, Artificial Sequence
  Synthetic oligonucleotide
ggtcaagcggaggagggaactggcttgaggggggg

SEQ ID NO: 182074 - DNA, 35 bp, Artificial Sequence
  Synthetic oligonucleotide
ttcgtgaaggggcggagtagtaaggtaatgatggg

SEQ ID NO: 182075 - DNA, 35 bp, Artificial Sequence
  Synthetic oligonucleotide
gagggtgtgggtgggtatgggctgtcataaactgg

SEQ ID NO: 182076 - DNA, 35 bp, Artificial Sequence
  Synthetic oligonucleotide
acgactagggtgggtgggggactgagagaggtatg

SEQ ID NO: 182077 - DNA, 34 bp, Artificial Sequence
  Synthetic oligonucleotide
ggggggcaagataggggaggggttggcgggcttg

SEQ ID NO: 182078 - DNA, 35 bp, Artificial Sequence
  Synthetic oligonucleotide
gccgtggtcctgctggaacgcgacttactatccat

SEQ ID NO: 182079 - DNA, 35 bp, Artificial Sequence
  Synthetic oligonucleotide
gccctcagccacagaccccttttgcgccatcttat

SEQ ID NO: 182080 - DNA, 35 bp, Artificial Sequence
  Synthetic oligonucleotide
tcttccctccgcttgctgcatagcttggactaact

SEQ ID NO: 182081 - DNA, 35 bp, Artificial Sequence
  Synthetic oligonucleotide
acacacaccgctggagcttgctcattacaaaacct

SEQ ID NO: 182082 - DNA, 35 bp, Artificial Sequence
  Synthetic oligonucleotide
gcattcgcggtacttgccgtgccgttactccccct

SEQ ID NO: 182083 - DNA, 35 bp, Artificial Sequence
  Synthetic oligonucleotide
ttatccccgcccgccgtgactacccagcctgccct

SEQ ID NO: 182084 - DNA, 35 bp, Artificial Sequence
  Synthetic oligonucleotide
tcactgtctccaggttcgtccccatacatttccct

SEQ ID NO: 182085 - DNA, 35 bp, Artificial Sequence
  Synthetic oligonucleotide
acgccaaatacgtacgccgtgctgaccctcatcct

SEQ ID NO: 182086 - DNA, 35 bp, Artificial Sequence
  Synthetic oligonucleotide
agtcccacaccaccgaggaataaactgcccctcct

SEQ ID NO: 182087 - DNA, 35 bp, Artificial Sequence
  Synthetic oligonucleotide
gattaacgcattgacaagcagcccctgttcctcct

SEQ ID NO: 182088 - DNA, 35 bp, Artificial Sequence
  Synthetic oligonucleotide
ttagcacccacctctcgcaccatctcagcatcgct

SEQ ID NO: 182089 - DNA, 36 bp, Artificial Sequence
  Synthetic oligonucleotide
tgatccatccggcgggtctacaccattcttcctgct

SEQ ID NO: 182090 - DNA, 35 bp, Artificial Sequence
  Synthetic oligonucleotide
gacgccccgccgcatctgttcgatccgcttcatct

SEQ ID NO: 182091 - DNA, 35 bp, Artificial Sequence
  Synthetic oligonucleotide
gtcgccacgtagtccccctcggtttctcctgctct

SEQ ID NO: 182092 - DNA, 35 bp, Artificial Sequence
  Synthetic oligonucleotide
tacgacctgctctatcgtacactcctgtaccccgt

SEQ ID NO: 182093 - DNA, 35 bp, Artificial Sequence
  Synthetic oligonucleotide
gtaacatcaggcccgctccatctacaatctggcgt

SEQ ID NO: 182094 - DNA, 35 bp, Artificial Sequence
  Synthetic oligonucleotide
atgcgggcggggggaatgcgggcaaaacgtgttgt

SEQ ID NO: 182095 - DNA, 35 bp, Artificial Sequence
  Synthetic oligonucleotide
aacctccatccgcaatgtgatacaatccctttatt

SEQ ID NO: 182096 - DNA, 35 bp, Artificial Sequence
  Synthetic oligonucleotide
accaccctgtgtccgccgggaccctacactcgctt

SEQ ID NO: 182097 - DNA, 35 bp, Artificial Sequence
  Synthetic oligonucleotide
ggtcgtactgtcggtccatcttcactgcaattctt

SEQ ID NO: 182098 - DNA, 35 bp, Artificial Sequence
  Synthetic oligonucleotide
agcactgcctgaccttctcctttttgcctgccgtt

SEQ ID NO: 182099 - DNA, 35 bp, Artificial Sequence
  Synthetic oligonucleotide
tgcacccctcctgaaccggaacctacgcgatcttt

SEQ ID NO: 182100 - DNA, 36 bp, Artificial Sequence
  Synthetic oligonucleotide
aatgaaagacatcggggggaggggaggttgcggaaa

SEQ ID NO: 182101 - DNA, 36 bp, Artificial Sequence
  Synthetic oligonucleotide
tgctccccacttcgctcgttattctaggtccgtaaa

SEQ ID NO: 182102 - DNA, 35 bp, Artificial Sequence
  Synthetic oligonucleotide
ggacgggcgaggtaataaaaatgggggcagcacaa

SEQ ID NO: 182103 - DNA, 35 bp, Artificial Sequence
  Synthetic oligonucleotide
gtttccccgctggtcgcctgtctacactcctacaa

SEQ ID NO: 182104 - DNA, 35 bp, Artificial Sequence
  Synthetic oligonucleotide
acaacgtcaccgttcgtcttattctacccagccaa

SEQ ID NO: 182105 - DNA, 36 bp, Artificial Sequence
  Synthetic oligonucleotide
acccgacccatccgttgcctgtgccattccgcgcaa

SEQ ID NO: 182106 - DNA, 36 bp, Artificial Sequence
  Synthetic oligonucleotide
acagactgactccctttatctgccatttgggccaca

SEQ ID NO: 182107 - DNA, 36 bp, Artificial Sequence
  Synthetic oligonucleotide
gaactacctccgtctgccccccgggactcgattaca

SEQ ID NO: 182108 - DNA, 35 bp, Artificial Sequence
  Synthetic oligonucleotide
ataccgctccgtgacccgattccaccgttaaccca

SEQ ID NO: 182109 - DNA, 36 bp, Artificial Sequence
  Synthetic oligonucleotide
tcccaccctctctcaagaacagtttcctgcgaccca

SEQ ID NO: 182110 - DNA, 36 bp, Artificial Sequence
  Synthetic oligonucleotide
gcccacgctgaaggccatatcgtcacgctgccccca

SEQ ID NO: 182111 - DNA, 36 bp, Artificial Sequence
  Synthetic oligonucleotide
ttgctcagtcgcattctgctgccgcgttccctccca

SEQ ID NO: 182112 - DNA, 36 bp, Artificial Sequence
  Synthetic oligonucleotide
tcaatgcccgtaccaggctggatcacctacttccca

SEQ ID NO: 182113 - DNA, 36 bp, Artificial Sequence
  Synthetic oligonucleotide
tcatgatcacacgtctgctctgctacccatttccca

SEQ ID NO: 182114 - DNA, 36 bp, Artificial Sequence
  Synthetic oligonucleotide
gcgcaggtactgcatatacgcccgttcctcacgcca

SEQ ID NO: 182115 - DNA, 36 bp, Artificial Sequence
  Synthetic oligonucleotide
ttgcatgtcccgactccctttacatctgtacctcca

SEQ ID NO: 182116 - DNA, 34 bp, Artificial Sequence
  Synthetic oligonucleotide
actcctggccactgtacctatttcgaacttagca

SEQ ID NO: 182117 - DNA, 35 bp, Artificial Sequence
  Synthetic oligonucleotide
tcactacggcatttcgaaaatgattcacctccgca

SEQ ID NO: 182118 - DNA, 36 bp, Artificial Sequence
  Synthetic oligonucleotide
ttcaggaggaggggttggggccatgggggactcgca

SEQ ID NO: 182119 - DNA, 35 bp, Artificial Sequence
  Synthetic oligonucleotide
tcccgttctccatgtgcctgcccgcgccctcggca

SEQ ID NO: 182120 - DNA, 36 bp, Artificial Sequence
  Synthetic oligonucleotide
gctgcgctttgactttatgcccctccacctcatgca

SEQ ID NO: 182121 - DNA, 36 bp, Artificial Sequence
  Synthetic oligonucleotide
accaccctgctcccacctaccccgaagtcgtatgca

SEQ ID NO: 182122 - DNA, 35 bp, Artificial Sequence
  Synthetic oligonucleotide
gaaccgccccatgtccgtcattctcgcagtttgca

SEQ ID NO: 182123 - DNA, 36 bp, Artificial Sequence
  Synthetic oligonucleotide
gtattgtgccctcaccagtaatttcctcctgcatca

SEQ ID NO: 182124 - DNA, 35 bp, Artificial Sequence
  Synthetic oligonucleotide
gcgcaggtgccatctgtagctccttctggccctca

SEQ ID NO: 182125 - DNA, 36 bp, Artificial Sequence
  Synthetic oligonucleotide
cccaccgcctcgaccgttggccgacccctccgctca

SEQ ID NO: 182126 - DNA, 35 bp, Artificial Sequence
  Synthetic oligonucleotide
acattgccccgctcaagcgcactttctctttctca

SEQ ID NO: 182127 - DNA, 35 bp, Artificial Sequence
  Synthetic oligonucleotide
accccgacacgttctcttacaagtttccaccttca

SEQ ID NO: 182128 - DNA, 36 bp, Artificial Sequence
  Synthetic oligonucleotide
tagctccgtatgctctcgttattctcgtttcgttca

SEQ ID NO: 182129 - DNA, 36 bp, Artificial Sequence
  Synthetic oligonucleotide
gctgaagcgctgccctgaccatcttaagccatttca

SEQ ID NO: 182130 - DNA, 35 bp, Artificial Sequence
  Synthetic oligonucleotide
acacaacggggttgtgtttcgcttcatccctttca

SEQ ID NO: 182131 - DNA, 35 bp, Artificial Sequence
  Synthetic oligonucleotide
atggggaagtcgcggggggggaaaaggcggtaaga

SEQ ID NO: 182132 - DNA, 36 bp, Artificial Sequence
  Synthetic oligonucleotide
tccaccatcctcacatgaccattagcccgtaaccga

SEQ ID NO: 182133 - DNA, 37 bp, Artificial Sequence
  Synthetic oligonucleotide
gctgacgtgacacatgactaaatctccgcccacccga

SEQ ID NO: 182134 - DNA, 37 bp, Artificial Sequence
  Synthetic oligonucleotide
tcggatagcccacatctacctttcgtccatgccccga

SEQ ID NO: 182135 - DNA, 37 bp, Artificial Sequence
  Synthetic oligonucleotide
ggggagctcccgcgcgctataaccctcctcgttccga

SEQ ID NO: 182136 - DNA, 37 bp, Artificial Sequence
  Synthetic oligonucleotide
ggaaaacaagggtggtggtaggtaggtagagtagcga

SEQ ID NO: 182137 - DNA, 37 bp, Artificial Sequence
  Synthetic oligonucleotide
acgatgtgatgtacacgttccacctacgcctatgcga

SEQ ID NO: 182138 - DNA, 37 bp, Artificial Sequence
  Synthetic oligonucleotide
tagagggggtaggggaggcaagagtgggctgggtcga

SEQ ID NO: 182139 - DNA, 36 bp, Artificial Sequence
  Synthetic oligonucleotide
atccatctcccctgcgcacttcactacatgcttcga

SEQ ID NO: 182140 - DNA, 36 bp, Artificial Sequence
  Synthetic oligonucleotide
acgcgcacggagaaggggtgaaatggtggatgagga

SEQ ID NO: 182141 - DNA, 37 bp, Artificial Sequence
  Synthetic oligonucleotide
tcgacccgcccccctccattagagacaactccgcgga

SEQ ID NO: 182142 - DNA, 37 bp, Artificial Sequence
  Synthetic oligonucleotide
ggggtcatcaactggttcgtgtcaggggagggaggga

SEQ ID NO: 182143 - DNA, 37 bp, Artificial Sequence
  Synthetic oligonucleotide
gtacgcacagggcgggatgtttagcggcggggaggga

SEQ ID NO: 182144 - DNA, 36 bp, Artificial Sequence
  Synthetic oligonucleotide
tggacacggaggaggacgggtggacttaatgcggga

SEQ ID NO: 182145 - DNA, 36 bp, Artificial Sequence
  Synthetic oligonucleotide
aaccacggtctcacgggtgggaaaggggtaagggga

SEQ ID NO: 182146 - DNA, 37 bp, Artificial Sequence
  Synthetic oligonucleotide
acggggaggcgtctagggggagggatcaaacggggga

SEQ ID NO: 182147 - DNA, 37 bp, Artificial Sequence
  Synthetic oligonucleotide
gatcgactcacggggtagggtaggttagggcggggga

SEQ ID NO: 182148 - DNA, 37 bp, Artificial Sequence
  Synthetic oligonucleotide
gccggaggggtagggaggagggggctcgcacagtgga

SEQ ID NO: 182149 - DNA, 36 bp, Artificial Sequence
  Synthetic oligonucleotide
gattcgcggtgggggccaagggggagctggagtgga

SEQ ID NO: 182150 - DNA, 37 bp, Artificial Sequence
  Synthetic oligonucleotide
acgtcgggacaataagggtgggggggtcactattgga

SEQ ID NO: 182151 - DNA, 36 bp, Artificial Sequence
  Synthetic oligonucleotide
ttgacccccaccatacgtagcccaccccttattgga

SEQ ID NO: 182152 - DNA, 37 bp, Artificial Sequence
  Synthetic oligonucleotide
ataccccacgcctgctctgtctcactcgccttttgga

SEQ ID NO: 182153 - DNA, 37 bp, Artificial Sequence
  Synthetic oligonucleotide
tcgcacacccgcctgaaagctctattccctaccatga

SEQ ID NO: 182154 - DNA, 38 bp, Artificial Sequence
  Synthetic oligonucleotide
acccgcatccgaacatctgaataccgctccgcccatga

SEQ ID NO: 182155 - DNA, 38 bp, Artificial Sequence
  Synthetic oligonucleotide
ggatggagcgaaccgccggggagtaggggaagggatga

SEQ ID NO: 182156 - DNA, 38 bp, Artificial Sequence
  Synthetic oligonucleotide
accgcgccgtagatcgatctgccacttcccccatatga

SEQ ID NO: 182157 - DNA, 38 bp, Artificial Sequence
  Synthetic oligonucleotide
taccatcaacgtaaaggggctgggaggggggggtatga

SEQ ID NO: 182158 - DNA, 38 bp, Artificial Sequence
  Synthetic oligonucleotide
gtgtgggagcaagggggggagggaataagtgggtatga

SEQ ID NO: 182159 - DNA, 38 bp, Artificial Sequence
  Synthetic oligonucleotide
tcacggagatggagaagggggtactaaggggagactga

SEQ ID NO: 182160 - DNA, 38 bp, Artificial Sequence
  Synthetic oligonucleotide
acccacgtcacaaactgtttacctgcgccctgccctga

SEQ ID NO: 182161 - DNA, 38 bp, Artificial Sequence
  Synthetic oligonucleotide
tccctggtcagtgtctattttctcctgctgaatcctga

SEQ ID NO: 182162 - DNA, 37 bp, Artificial Sequence
  Synthetic oligonucleotide
tacgttggcccctccctctatgtatgtttactcctga

SEQ ID NO: 182163 - DNA, 38 bp, Artificial Sequence
  Synthetic oligonucleotide
gacccgtcaccgctccatccttcccgccatcacgctga

SEQ ID NO: 182164 - DNA, 38 bp, Artificial Sequence
  Synthetic oligonucleotide
agaccgtacactaagccgcaccacccctccttggctga

SEQ ID NO: 182165 - DNA, 38 bp, Artificial Sequence
  Synthetic oligonucleotide
atggcggtggaggtgagcaaagggctgggggggagtga

SEQ ID NO: 182166 - DNA, 38 bp, Artificial Sequence
  Synthetic oligonucleotide
taaatccgcccatcgtgtcgccgaccgccctttcgtga

SEQ ID NO: 182167 - DNA, 38 bp, Artificial Sequence
  Synthetic oligonucleotide
tgcgaagctcgctgcttgcatttatcatcctttcgtga

SEQ ID NO: 182168 - DNA, 38 bp, Artificial Sequence
  Synthetic oligonucleotide
accgtgtggaagacgtgagtgggggcggggggaattga

SEQ ID NO: 182169 - DNA, 37 bp, Artificial Sequence
  Synthetic oligonucleotide
gtcgcctcagccgccgctatgctccgccaccccttga

SEQ ID NO: 182170 - DNA, 38 bp, Artificial Sequence
  Synthetic oligonucleotide
gcctgccctctgccttcgtatgcccacctgctccttga

SEQ ID NO: 182171 - DNA, 38 bp, Artificial Sequence
  Synthetic oligonucleotide
ggagacacctcatgtgtccctctactttccttgcttga

SEQ ID NO: 182172 - DNA, 38 bp, Artificial Sequence
  Synthetic oligonucleotide
ataccgctcgccagcccgctctccttcatacacgttga

SEQ ID NO: 182173 - DNA, 38 bp, Artificial Sequence
  Synthetic oligonucleotide
ttcgcaccgcattgtgatctcccccgctctcaggttga

SEQ ID NO: 182174 - DNA, 36 bp, Artificial Sequence
  Synthetic oligonucleotide
agtaaccgccggtctcatttcgaacctcctcgcata

SEQ ID NO: 182175 - DNA, 35 bp, Artificial Sequence
  Synthetic oligonucleotide
gagccacatcttgtcatcgctagttcccctgcata

SEQ ID NO: 182176 - DNA, 35 bp, Artificial Sequence
  Synthetic oligonucleotide
gactatcccgcaccctgctgccatgaccccatata

SEQ ID NO: 182177 - DNA, 36 bp, Artificial Sequence
  Synthetic oligonucleotide
gcaccacctcaattccctcaggcctggtctactata

SEQ ID NO: 182178 - DNA, 36 bp, Artificial Sequence
  Synthetic oligonucleotide
tccccatttgccgtacactcctcgagctcgttccta

SEQ ID NO: 182179 - DNA, 36 bp, Artificial Sequence
  Synthetic oligonucleotide
ggtcgtggttcccctgctgccccttgccggtatcta

SEQ ID NO: 182180 - DNA, 36 bp, Artificial Sequence
  Synthetic oligonucleotide
acatccttgatcgctgcctttcccttagccttcgta

SEQ ID NO: 182181 - DNA, 36 bp, Artificial Sequence
  Synthetic oligonucleotide
atgaggtgggaaggaaaggggggacttggaatatta

SEQ ID NO: 182182 - DNA, 36 bp, Artificial Sequence
  Synthetic oligonucleotide
gtgcgcttaccctcgttatactcctgttcactgtta

SEQ ID NO: 182183 - DNA, 36 bp, Artificial Sequence
  Synthetic oligonucleotide
atcccaccgcattccgccccggcaatacttctgtta

SEQ ID NO: 182184 - DNA, 35 bp, Artificial Sequence
  Synthetic oligonucleotide
gatctgcgccgttcaagcaaccctctcttacgcac

SEQ ID NO: 182185 - DNA, 35 bp, Artificial Sequence
  Synthetic oligonucleotide
tcaagggggaatagtgggagaagcagtgggaggac

SEQ ID NO: 182186 - DNA, 35 bp, Artificial Sequence
  Synthetic oligonucleotide
gcaaagtcgcagcagggaagggtgggacaagggac

SEQ ID NO: 182187 - DNA, 35 bp, Artificial Sequence
  Synthetic oligonucleotide
gaccccctgccaagggcccctatatagactcgtac

SEQ ID NO: 182188 - DNA, 35 bp, Artificial Sequence
  Synthetic oligonucleotide
ttcgcacccggctccgataccccacgattttgtac

SEQ ID NO: 182189 - DNA, 35 bp, Artificial Sequence
  Synthetic oligonucleotide
gccgtcgtagttacagcttcatgatccgtcccccc

SEQ ID NO: 182190 - DNA, 35 bp, Artificial Sequence
  Synthetic oligonucleotide
tccgcccccctcgaagtctattctgcttgctcccc

SEQ ID NO: 182191 - DNA, 35 bp, Artificial Sequence
  Synthetic oligonucleotide
gagcctccggccaattctggttagccctggtcccc

SEQ ID NO: 182192 - DNA, 35 bp, Artificial Sequence
  Synthetic oligonucleotide
aacatgcacctcgtactgcgttctcagctacgccc

SEQ ID NO: 182193 - DNA, 36 bp, Artificial Sequence
  Synthetic oligonucleotide
gtaacggccactccgtcatccatttttgctccgccc

SEQ ID NO: 182194 - DNA, 35 bp, Artificial Sequence
  Synthetic oligonucleotide
ggggaccgtccgcacctagcttgaacacccggccc

SEQ ID NO: 182195 - DNA, 35 bp, Artificial Sequence
  Synthetic oligonucleotide
acagctcattgctgcggactccatctcctgctccc

SEQ ID NO: 182196 - DNA, 35 bp, Artificial Sequence
  Synthetic oligonucleotide
tatggtcctcgcctctagttgccatgttcaacgcc

SEQ ID NO: 182197 - DNA, 35 bp, Artificial Sequence
  Synthetic oligonucleotide
gtccgaccgttcagccctcgtttcttccttgcgcc

SEQ ID NO: 182198 - DNA, 35 bp, Artificial Sequence
  Synthetic oligonucleotide
tccacccgtcccctagtcgtctacacctcagtgcc

SEQ ID NO: 182199 - DNA, 34 bp, Artificial Sequence
  Synthetic oligonucleotide
acgggaaagcctccatattggtctcatcctgtcc

SEQ ID NO: 182200 - DNA, 35 bp, Artificial Sequence
  Synthetic oligonucleotide
tcccaccgacccttatgtcgaagcccccctattcc

SEQ ID NO: 182201 - DNA, 35 bp, Artificial Sequence
  Synthetic oligonucleotide
ggtccacgatagcacttatcaagaaccctccttcc

SEQ ID NO: 182202 - DNA, 35 bp, Artificial Sequence
  Synthetic oligonucleotide
aacagcaagccttgtacctccacggactctcttcc

SEQ ID NO: 182203 - DNA, 35 bp, Artificial Sequence
  Synthetic oligonucleotide
gccccagaggcgttccccgtgatctctcatgttcc

SEQ ID NO: 182204 - DNA, 35 bp, Artificial Sequence
  Synthetic oligonucleotide
tactgccccgtgcccctggcttggttacggtttcc

SEQ ID NO: 182205 - DNA, 35 bp, Artificial Sequence
  Synthetic oligonucleotide
tgtgttggtgtccgcgcctcccagttctatcaagc

SEQ ID NO: 182206 - DNA, 35 bp, Artificial Sequence
  Synthetic oligonucleotide
atgtttgacggacggagtgggtgggcgggcacagc

SEQ ID NO: 182207 - DNA, 35 bp, Artificial Sequence
  Synthetic oligonucleotide
gcccctgcgccactgttatcccccgccgcactagc

SEQ ID NO: 182208 - DNA, 35 bp, Artificial Sequence
  Synthetic oligonucleotide
taacaccggcccatttgctttacctcccaaaacgc

SEQ ID NO: 182209 - DNA, 35 bp, Artificial Sequence
  Synthetic oligonucleotide
tgctgaccagcggtcacctttttcacccttaacgc

SEQ ID NO: 182210 - DNA, 35 bp, Artificial Sequence
  Synthetic oligonucleotide
aaccattgtgtcctgcttaaaagttctgcctccgc

SEQ ID NO: 182211 - DNA, 35 bp, Artificial Sequence
  Synthetic oligonucleotide
tgggacacgtctacattatttcgctttcgctccgc

SEQ ID NO: 182212 - DNA, 35 bp, Artificial Sequence
  Synthetic oligonucleotide
ccaacgggggtggagggggtaagttagatggaggc

SEQ ID NO: 182213 - DNA, 35 bp, Artificial Sequence
  Synthetic oligonucleotide
taacgccccacaattccgttttggataccttatgc

SEQ ID NO: 182214 - DNA, 35 bp, Artificial Sequence
  Synthetic oligonucleotide
tgtgtgtccctggttgaatccaccacgttgctatc

SEQ ID NO: 182215 - DNA, 35 bp, Artificial Sequence
  Synthetic oligonucleotide
aaccactccccccgcacgccgcaccgacgtctatc

SEQ ID NO: 182216 - DNA, 35 bp, Artificial Sequence
  Synthetic oligonucleotide
acgctcgtgtcacacatccttagtgttctatcctc

SEQ ID NO: 182217 - DNA, 35 bp, Artificial Sequence
  Synthetic oligonucleotide
gatgcactactccgcgggttacgtgaccaccgctc

SEQ ID NO: 182218 - DNA, 35 bp, Artificial Sequence
  Synthetic oligonucleotide
actgacacacctcgctccttctgcatctgtctctc

SEQ ID NO: 182219 - DNA, 35 bp, Artificial Sequence
  Synthetic oligonucleotide
atgacggagccaccatacctttatcaagtcttctc

SEQ ID NO: 182220 - DNA, 35 bp, Artificial Sequence
  Synthetic oligonucleotide
acacttgcctgtcgccctgtgtcctgtccttggtc

SEQ ID NO: 182221 - DNA, 35 bp, Artificial Sequence
  Synthetic oligonucleotide
ttgactcccgtacttcatggccatacttgaacttc

SEQ ID NO: 182222 - DNA, 35 bp, Artificial Sequence
  Synthetic oligonucleotide
tttgtacctccgctgtctatattactgttctcttc

SEQ ID NO: 182223 - DNA, 35 bp, Artificial Sequence
  Synthetic oligonucleotide
attacggcctaccctaatgctcctccgcctagttc

SEQ ID NO: 182224 - DNA, 35 bp, Artificial Sequence
  Synthetic oligonucleotide
tgcaattcgtctattgccatacttcgcccatgttc

SEQ ID NO: 182225 - DNA, 35 bp, Artificial Sequence
  Synthetic oligonucleotide
tgcaccccacgtgcttcccgaccttatgcatatag

SEQ ID NO: 182226 - DNA, 35 bp, Artificial Sequence
  Synthetic oligonucleotide
tgtctagtggagggaggaatgaaggggattgaacg

SEQ ID NO: 182227 - DNA, 35 bp, Artificial Sequence
  Synthetic oligonucleotide
aaagccaagccaccgatctaactcagcccccgacg

SEQ ID NO: 182228 - DNA, 34 bp, Artificial Sequence
  Synthetic oligonucleotide
gctagtggtatggggtggagggtggtaggggccg

SEQ ID NO: 182229 - DNA, 35 bp, Artificial Sequence
  Synthetic oligonucleotide
tgtgggtgtacaaaaacggagaggggggggaatcg

SEQ ID NO: 182230 - DNA, 35 bp, Artificial Sequence
  Synthetic oligonucleotide
ttagtgcgcttacacaacatgtccatttcacctcg

SEQ ID NO: 182231 - DNA, 35 bp, Artificial Sequence
  Synthetic oligonucleotide
tgacccctgccgcctttacagaaacggtcccctcg

SEQ ID NO: 182232 - DNA, 35 bp, Artificial Sequence
  Synthetic oligonucleotide
tgcatcccattggccctgtacccctcccgcctagg

SEQ ID NO: 182233 - DNA, 35 bp, Artificial Sequence
  Synthetic oligonucleotide
tacaacatcattcactgctagcgcgcctcctccgg

SEQ ID NO: 182234 - DNA, 35 bp, Artificial Sequence
  Synthetic oligonucleotide
taacgcaggtgggggcgccggattaggggaaaggg

SEQ ID NO: 182235 - DNA, 35 bp, Artificial Sequence
  Synthetic oligonucleotide
atcctgccgactcccatcttcctcgcacgccgggg

SEQ ID NO: 182236 - DNA, 35 bp, Artificial Sequence
  Synthetic oligonucleotide
aatctccgccatgtttgaaatcctgatcatccctg

SEQ ID NO: 182237 - DNA, 35 bp, Artificial Sequence
  Synthetic oligonucleotide
tccggaacatcgtccggcgtttgctcattctcctg

SEQ ID NO: 182238 - DNA, 35 bp, Artificial Sequence
  Synthetic oligonucleotide
tctgaccccccccgtattgcctttttgaccacgtg

SEQ ID NO: 182239 - DNA, 35 bp, Artificial Sequence
  Synthetic oligonucleotide
ttccgccgcatccgcctgactatcccgctcacttg

SEQ ID NO: 182240 - DNA, 35 bp, Artificial Sequence
  Synthetic oligonucleotide
gcctcctgtgccctgtccctacgttctccataaat

SEQ ID NO: 182241 - DNA, 35 bp, Artificial Sequence
  Synthetic oligonucleotide
taaaccccccgctcttgccccgtgccatgttaaat

SEQ ID NO: 182242 - DNA, 35 bp, Artificial Sequence
  Synthetic oligonucleotide
tacgacccccccctgcatgatattagatttcgtat

SEQ ID NO: 182243 - DNA, 35 bp, Artificial Sequence
  Synthetic oligonucleotide
acattctcaatctcgccaccttgtgcgcaagcact

SEQ ID NO: 182244 - DNA, 35 bp, Artificial Sequence
  Synthetic oligonucleotide
gatcaacctttagcacgctgcctttactttgccct

SEQ ID NO: 182245 - DNA, 35 bp, Artificial Sequence
  Synthetic oligonucleotide
gctcacggtccattaagcatttcgccacaccgcct

SEQ ID NO: 182246 - DNA, 35 bp, Artificial Sequence
  Synthetic oligonucleotide
gccagcacgccctctcgagcaagaccgtttctcct

SEQ ID NO: 182247 - DNA, 35 bp, Artificial Sequence
  Synthetic oligonucleotide
gtattcgcctaatcttgttctcatgccggtttcct

SEQ ID NO: 182248 - DNA, 35 bp, Artificial Sequence
  Synthetic oligonucleotide
tcacccctctggaccgttcattcaccttactcgct

SEQ ID NO: 182249 - DNA, 35 bp, Artificial Sequence
  Synthetic oligonucleotide
tgttccacacccgggttcggctttcacttgatgct

SEQ ID NO: 182250 - DNA, 35 bp, Artificial Sequence
  Synthetic oligonucleotide
tcacgcacgttctctggtccttccctggctgtgct

SEQ ID NO: 182251 - DNA, 35 bp, Artificial Sequence
  Synthetic oligonucleotide
tcacgtctgccttgcctactattttcgatctatct

SEQ ID NO: 182252 - DNA, 34 bp, Artificial Sequence
  Synthetic oligonucleotide
gccttgcgccgctaccgccttgaccgttaactct

SEQ ID NO: 182253 - DNA, 35 bp, Artificial Sequence
  Synthetic oligonucleotide
ggtggtcgttccgcctattgtctccatgtttctct

SEQ ID NO: 182254 - DNA, 35 bp, Artificial Sequence
  Synthetic oligonucleotide
aggggcacgccgccgccatatccaaagcttgttct

SEQ ID NO: 182255 - DNA, 35 bp, Artificial Sequence
  Synthetic oligonucleotide
actcgagcacgctgtctttcgtcctgctataccgt

SEQ ID NO: 182256 - DNA, 35 bp, Artificial Sequence
  Synthetic oligonucleotide
gcctacgccttacccacccacgtatgttctcctgt

SEQ ID NO: 182257 - DNA, 35 bp, Artificial Sequence
  Synthetic oligonucleotide
gtgtcgcgtacgtatcccagcgcctgccccctatt

SEQ ID NO: 182258 - DNA, 35 bp, Artificial Sequence
  Synthetic oligonucleotide
accgaccttccgagcggcctttactagctggcctt

SEQ ID NO: 182259 - DNA, 30 bp, Artificial Sequence
  Synthetic oligonucleotide
tgagtgcggctcgtctttccctcacctgtt

SEQ ID NO: 182260 - DNA, 35 bp, Artificial Sequence
  Synthetic oligonucleotide
gttacacctcgggatcgcactgttgccttcctttt

SEQ ID NO: 182261 - DNA, 35 bp, Artificial Sequence
  Synthetic oligonucleotide
acccgcacccggctctacatcgcatatccgttttt

SEQ ID NO: 182262 - DNA, 36 bp, Artificial Sequence
  Synthetic oligonucleotide
tgaccctcgcccctttcgtcttccaagcactggaaa

SEQ ID NO: 182263 - DNA, 35 bp, Artificial Sequence
  Synthetic oligonucleotide
gatccgccggttacggtcctctccttccctaggaa

SEQ ID NO: 182264 - DNA, 36 bp, Artificial Sequence
  Synthetic oligonucleotide
aatatgccgcccccccttttaacgcagatgtgataa

SEQ ID NO: 182265 - DNA, 36 bp, Artificial Sequence
  Synthetic oligonucleotide
tcgccccctgtctaatcgtctcgtcgtcatctaaca

SEQ ID NO: 182266 - DNA, 36 bp, Artificial Sequence
  Synthetic oligonucleotide
tacgacgactcgggggggcgggcttcgggaaccaca

SEQ ID NO: 182267 - DNA, 36 bp, Artificial Sequence
  Synthetic oligonucleotide
cggaacatccgcatcgttttctccccatgggccaca

SEQ ID NO: 182268 - DNA, 35 bp, Artificial Sequence
  Synthetic oligonucleotide
gagtcaacccgtcatcttgccgcacaccattcaca

SEQ ID NO: 182269 - DNA, 36 bp, Artificial Sequence
  Synthetic oligonucleotide
gacgaccgccgcctctccccagacctgcctaggaca

SEQ ID NO: 182270 - DNA, 36 bp, Artificial Sequence
  Synthetic oligonucleotide
acgttcttcccgccgagccttcgtaccagtaaccca

SEQ ID NO: 182271 - DNA, 35 bp, Artificial Sequence
  Synthetic oligonucleotide
agccgaccgtcttaccctgttccaccgatacccca

SEQ ID NO: 182272 - DNA, 35 bp, Artificial Sequence
  Synthetic oligonucleotide
tacctgcccgttccttcactcgtcctcgtggtcca

SEQ ID NO: 182273 - DNA, 36 bp, Artificial Sequence
  Synthetic oligonucleotide
acgcggaatacaggggtaagcggggggacgaaggca

SEQ ID NO: 182274 - DNA, 35 bp, Artificial Sequence
  Synthetic oligonucleotide
gcgatcgccgcaacttgctcattctcctactggca

SEQ ID NO: 182275 - DNA, 35 bp, Artificial Sequence
  Synthetic oligonucleotide
gcgcccatccgcctcgtacaaacgttcgtttggca

SEQ ID NO: 182276 - DNA, 35 bp, Artificial Sequence
  Synthetic oligonucleotide
cacccccgcctacctgtttatttgtctcgtgtgca

SEQ ID NO: 182277 - DNA, 36 bp, Artificial Sequence
  Synthetic oligonucleotide
gtgagtcacactcgcctctagtccgtaccttgttca

SEQ ID NO: 182278 - DNA, 36 bp, Artificial Sequence
  Synthetic oligonucleotide
tactcagtcgccgcctagtgctgcccacccctttca

SEQ ID NO: 182279 - DNA, 36 bp, Artificial Sequence
  Synthetic oligonucleotide
ttgccacccgaccccatgtttacggcccctgtttca

SEQ ID NO: 182280 - DNA, 37 bp, Artificial Sequence
  Synthetic oligonucleotide
ggacacggggggggggtggaggtatggtcacggaaga

SEQ ID NO: 182281 - DNA, 37 bp, Artificial Sequence
  Synthetic oligonucleotide
gtgcaagaggagggagggagcgtgtccgggactcaga

SEQ ID NO: 182282 - DNA, 37 bp, Artificial Sequence
  Synthetic oligonucleotide
gttggggagggtggtctagggatatagggcaaggaga

SEQ ID NO: 182283 - DNA, 36 bp, Artificial Sequence
  Synthetic oligonucleotide
agcacggggggggacttgaacagggcaaaagggaga

SEQ ID NO: 182284 - DNA, 36 bp, Artificial Sequence
  Synthetic oligonucleotide
gcccagtcccttccgtttcatccgggcacacctaga

SEQ ID NO: 182285 - DNA, 37 bp, Artificial Sequence
  Synthetic oligonucleotide
gagacttggtgaaggaaggggtagaaaagcggaacga

SEQ ID NO: 182286 - DNA, 37 bp, Artificial Sequence
  Synthetic oligonucleotide
gataacgtgctgctgacgtttgaaccgcccaacccga

SEQ ID NO: 182287 - DNA, 37 bp, Artificial Sequence
  Synthetic oligonucleotide
accacagacgatctggcctcccacgtctcttccccga

SEQ ID NO: 182288 - DNA, 36 bp, Artificial Sequence
  Synthetic oligonucleotide
atcaccacgcgctgaccttataaacacctttcccga

SEQ ID NO: 182289 - DNA, 37 bp, Artificial Sequence
  Synthetic oligonucleotide
accatgccgccgttcttgacctctcgcgttctgccga

SEQ ID NO: 182290 - DNA, 37 bp, Artificial Sequence
  Synthetic oligonucleotide
agcccggaggtgtcggggatggatgggtggaatccga

SEQ ID NO: 182291 - DNA, 37 bp, Artificial Sequence
  Synthetic oligonucleotide
ccggcgaaccgacgtccctcagcagcccttcatccga

SEQ ID NO: 182292 - DNA, 37 bp, Artificial Sequence
  Synthetic oligonucleotide
ggggggcgagggggtaagttggagcgttggcgtgcga

SEQ ID NO: 182293 - DNA, 35 bp, Artificial Sequence
  Synthetic oligonucleotide
acgaccgccgctatgccgtcgcccctagtcttcga

SEQ ID NO: 182294 - DNA, 36 bp, Artificial Sequence
  Synthetic oligonucleotide
tatgcccccacacgccccctccctgtcgcagcagga

SEQ ID NO: 182295 - DNA, 37 bp, Artificial Sequence
  Synthetic oligonucleotide
accgctcctggcctattatactgcatcctcacccgga

SEQ ID NO: 182296 - DNA, 37 bp, Artificial Sequence
  Synthetic oligonucleotide
accatcctcgctttcacccgccacgtgcctggaggga

SEQ ID NO: 182297 - DNA, 37 bp, Artificial Sequence
  Synthetic oligonucleotide
ttcatactccgccgaccacactcctgcccaaccggga

SEQ ID NO: 182298 - DNA, 37 bp, Artificial Sequence
  Synthetic oligonucleotide
ggggtgcgtggggcggggaagcagggagtgcgcggga

SEQ ID NO: 182299 - DNA, 37 bp, Artificial Sequence
  Synthetic oligonucleotide
accaagggccggggtaagctagggggatagtagggga

SEQ ID NO: 182300 - DNA, 37 bp, Artificial Sequence
  Synthetic oligonucleotide
atacggagaatgggggggggtgccaactaaggtggga

SEQ ID NO: 182301 - DNA, 37 bp, Artificial Sequence
  Synthetic oligonucleotide
aacatcctgatcggttccttgccccacctgccttgga

SEQ ID NO: 182302 - DNA, 37 bp, Artificial Sequence
  Synthetic oligonucleotide
acccttgtcccatgtacctgcctcatacccccaatga

SEQ ID NO: 182303 - DNA, 38 bp, Artificial Sequence
  Synthetic oligonucleotide
tccgggcaacggaatgggtgggggggtccttggaatga

SEQ ID NO: 182304 - DNA, 37 bp, Artificial Sequence
  Synthetic oligonucleotide
gatcgtggaagggggggagggtacatgcgatccatga

SEQ ID NO: 182305 - DNA, 38 bp, Artificial Sequence
  Synthetic oligonucleotide
gatggggacgcgaaagggagggcttgggacaggtatga

SEQ ID NO: 182306 - DNA, 37 bp, Artificial Sequence
  Synthetic oligonucleotide
tagccagcctcgcatcacggccccgatacctcactga

SEQ ID NO: 182307 - DNA, 38 bp, Artificial Sequence
  Synthetic oligonucleotide
gttgcgccgttgatactaagcttccacccctctactga

SEQ ID NO: 182308 - DNA, 38 bp, Artificial Sequence
  Synthetic oligonucleotide
tcataccaccccgcccttggatcgctaaatggacctga

SEQ ID NO: 182309 - DNA, 38 bp, Artificial Sequence
  Synthetic oligonucleotide
gctgggcgggcgggccaagtgggacttaatacccctga

SEQ ID NO: 182310 - DNA, 38 bp, Artificial Sequence
  Synthetic oligonucleotide
agactggaggaggggtggtcgagggctaggacggctga

SEQ ID NO: 182311 - DNA, 38 bp, Artificial Sequence
  Synthetic oligonucleotide
tgcgctccgcccctgcatccatacgtcctcttgagtga

SEQ ID NO: 182312 - DNA, 37 bp, Artificial Sequence
  Synthetic oligonucleotide
acagtgcaaatagggagggagcaggagattgacgtga

SEQ ID NO: 182313 - DNA, 37 bp, Artificial Sequence
  Synthetic oligonucleotide
acacccgtacctatgattggccctcttctctacgtga

SEQ ID NO: 182314 - DNA, 37 bp, Artificial Sequence
  Synthetic oligonucleotide
aacataccatgggtggtgaaggaggagggcggggtga

SEQ ID NO: 182315 - DNA, 38 bp, Artificial Sequence
  Synthetic oligonucleotide
ttggggggacaggagggagtaacagaaagagtgggtga

SEQ ID NO: 182316 - DNA, 35 bp, Artificial Sequence
  Synthetic oligonucleotide
gcacagaccgacgccctgcccatctcaacttgtga

SEQ ID NO: 182317 - DNA, 38 bp, Artificial Sequence
  Synthetic oligonucleotide
tcccatccgccattcatccccaatcgtccctgacttga

SEQ ID NO: 182318 - DNA, 38 bp, Artificial Sequence
  Synthetic oligonucleotide
acggagggagtgggggaggaaggtgaccgggggcttga

SEQ ID NO: 182319 - DNA, 37 bp, Artificial Sequence
  Synthetic oligonucleotide
atcgggggggggcatgagggttaaatgaaagggttga

SEQ ID NO: 182320 - DNA, 36 bp, Artificial Sequence
  Synthetic oligonucleotide
accccccgtcacggcaggggctctcccatatgttga

SEQ ID NO: 182321 - DNA, 38 bp, Artificial Sequence
  Synthetic oligonucleotide
tcaggcgggggagggaaagtgggaaggcgggtttttga

SEQ ID NO: 182322 - DNA, 36 bp, Artificial Sequence
  Synthetic oligonucleotide
atcccccgcctcatttagacttacctgtacctgata

SEQ ID NO: 182323 - DNA, 36 bp, Artificial Sequence
  Synthetic oligonucleotide
gctggccccgccttatgcccctcctagctgagccta

SEQ ID NO: 182324 - DNA, 36 bp, Artificial Sequence
  Synthetic oligonucleotide
taaccgtggcgctgtgcttccgctcccctggtccta

SEQ ID NO: 182325 - DNA, 35 bp, Artificial Sequence
  Synthetic oligonucleotide
ttccgacgatcatctggcgtacctccctcccgcta

SEQ ID NO: 182326 - DNA, 36 bp, Artificial Sequence
  Synthetic oligonucleotide
tgtccgccccctttgtactgtgctaccctattatta

SEQ ID NO: 182327 - DNA, 35 bp, Artificial Sequence
  Synthetic oligonucleotide
gtgccgcccctagtgttcctcgcgattcgccctta

SEQ ID NO: 182328 - DNA, 36 bp, Artificial Sequence
  Synthetic oligonucleotide
tactgacccgccactttggttgacccaagctcctta

SEQ ID NO: 182329 - DNA, 35 bp, Artificial Sequence
  Synthetic oligonucleotide
ggactgttcctcccctgcctgaatctcggtgaaac

SEQ ID NO: 182330 - DNA, 35 bp, Artificial Sequence
  Synthetic oligonucleotide
tctgccacgcccccccgcagagtgtcctcggccac

SEQ ID NO: 182331 - DNA, 35 bp, Artificial Sequence
  Synthetic oligonucleotide
attgaccgccccagccctttagactccaagcgcac

SEQ ID NO: 182332 - DNA, 35 bp, Artificial Sequence
  Synthetic oligonucleotide
tgttccacccgctccccaaagcggcacctataacc

SEQ ID NO: 182333 - DNA, 35 bp, Artificial Sequence
  Synthetic oligonucleotide
ggtcccgcgatcagactacggtcctgcctcccacc

SEQ ID NO: 182334 - DNA, 35 bp, Artificial Sequence
  Synthetic oligonucleotide
gccctcctcgcctcgttctccgttagctattgacc

SEQ ID NO: 182335 - DNA, 35 bp, Artificial Sequence
  Synthetic oligonucleotide
tcccctccggccgagaatcactggcgaattttacc

SEQ ID NO: 182336 - DNA, 35 bp, Artificial Sequence
  Synthetic oligonucleotide
ggatccccgcttgaaccttatacaactgaccaccc

SEQ ID NO: 182337 - DNA, 35 bp, Artificial Sequence
  Synthetic oligonucleotide
tccacccggggctggatttgaccactccgttaccc

SEQ ID NO: 182338 - DNA, 35 bp, Artificial Sequence
  Synthetic oligonucleotide
gtcccacccacctttcctgtttgacgcaggccccc

SEQ ID NO: 182339 - DNA, 35 bp, Artificial Sequence
  Synthetic oligonucleotide
tccaccaccgccgaggttccattagcaacggcccc

SEQ ID NO: 182340 - DNA, 35 bp, Artificial Sequence
  Synthetic oligonucleotide
tagctcggtccagcagttcgtcaaattccatcccc

SEQ ID NO: 182341 - DNA, 35 bp, Artificial Sequence
  Synthetic oligonucleotide
gtacatgccccagaactgactccgacactacgccc

SEQ ID NO: 182342 - DNA, 35 bp, Artificial Sequence
  Synthetic oligonucleotide
gccatctttagccgtcgcttgcgccatttccgccc

SEQ ID NO: 182343 - DNA, 35 bp, Artificial Sequence
  Synthetic oligonucleotide
aagcctctgtccgttccagctgcactgcccctccc

SEQ ID NO: 182344 - DNA, 35 bp, Artificial Sequence
  Synthetic oligonucleotide
aacgcccgttccttcgcccatttgctacgaatgcc

SEQ ID NO: 182345 - DNA, 35 bp, Artificial Sequence
  Synthetic oligonucleotide
gacactactcatcgtttctccccacacaggaatcc

SEQ ID NO: 182346 - DNA, 35 bp, Artificial Sequence
  Synthetic oligonucleotide
actccatagctcaagcgcctgtatcacgcttatcc

SEQ ID NO: 182347 - DNA, 35 bp, Artificial Sequence
  Synthetic oligonucleotide
agcgtgaaacgcctgctgtttgacccatgtactcc

SEQ ID NO: 182348 - DNA, 35 bp, Artificial Sequence
  Synthetic oligonucleotide
accaccgttggcacctgtccttaagtaaaacgtcc

SEQ ID NO: 182349 - DNA, 35 bp, Artificial Sequence
  Synthetic oligonucleotide
tcactgccctgtactccccacagcctccctggtcc

SEQ ID NO: 182350 - DNA, 35 bp, Artificial Sequence
  Synthetic oligonucleotide
tgtgcacctcgtccgacccgtttcccccgacttcc

SEQ ID NO: 182351 - DNA, 35 bp, Artificial Sequence
  Synthetic oligonucleotide
gctcacgcattgtggttgctccgtctgccgtttcc

SEQ ID NO: 182352 - DNA, 35 bp, Artificial Sequence
  Synthetic oligonucleotide
gtccgcttcccttggtttaatccactctcgctagc

SEQ ID NO: 182353 - DNA, 35 bp, Artificial Sequence
  Synthetic oligonucleotide
gacctctgtggcacttcaccagctcctccacccgc

SEQ ID NO: 182354 - DNA, 35 bp, Artificial Sequence
  Synthetic oligonucleotide
gactctgcgccctcgacctgctatcgccgacccgc

SEQ ID NO: 182355 - DNA, 35 bp, Artificial Sequence
  Synthetic oligonucleotide
tcacccgtactcatgcgcttccgtttacttcctgc

SEQ ID NO: 182356 - DNA, 35 bp, Artificial Sequence
  Synthetic oligonucleotide
acgcttgcacagagttctttcctttcccgttctgc

SEQ ID NO: 182357 - DNA, 35 bp, Artificial Sequence
  Synthetic oligonucleotide
ttccccttactcccgccgcctgctatgcaccgtgc

SEQ ID NO: 182358 - DNA, 35 bp, Artificial Sequence
  Synthetic oligonucleotide
gccgcacttatctatcctcctctgcagccttgtgc

SEQ ID NO: 182359 - DNA, 35 bp, Artificial Sequence
  Synthetic oligonucleotide
tcccgcagatgtatgtccgggccccactttgactc

SEQ ID NO: 182360 - DNA, 35 bp, Artificial Sequence
  Synthetic oligonucleotide
taagccaacccacattttttgcatgtagctacctc

SEQ ID NO: 182361 - DNA, 35 bp, Artificial Sequence
  Synthetic oligonucleotide
gatgtttggtgcccaagtgttcatccctcaccctc

SEQ ID NO: 182362 - DNA, 35 bp, Artificial Sequence
  Synthetic oligonucleotide
gtacagtgatgactgaaatattgtccgcccccctc

SEQ ID NO: 182363 - DNA, 35 bp, Artificial Sequence
  Synthetic oligonucleotide
gtcgcttccctgctttgtactaatactgtccgctc

SEQ ID NO: 182364 - DNA, 33 bp, Artificial Sequence
  Synthetic oligonucleotide
gtagaccgtacattttccccccagaccccggtc

SEQ ID NO: 182365 - DNA, 35 bp, Artificial Sequence
  Synthetic oligonucleotide
tagcgaatcggctctgtctccgtatctcccgtgtc

SEQ ID NO: 182366 - DNA, 35 bp, Artificial Sequence
  Synthetic oligonucleotide
tgaccaccagactcgcccccgaccgatctgtcttc

SEQ ID NO: 182367 - DNA, 35 bp, Artificial Sequence
  Synthetic oligonucleotide
gtgccgcacgcacgcttattccctccgatctgttc

SEQ ID NO: 182368 - DNA, 35 bp, Artificial Sequence
  Synthetic oligonucleotide
gtcgctacacgtgctgccatatttggcttactttc

SEQ ID NO: 182369 - DNA, 35 bp, Artificial Sequence
  Synthetic oligonucleotide
acacacgccgtgtgccgctgtgattatactctttc

SEQ ID NO: 182370 - DNA, 35 bp, Artificial Sequence
  Synthetic oligonucleotide
ggggggaggtaagggaacatgtgcgggggtgcgag

SEQ ID NO: 182371 - DNA, 35 bp, Artificial Sequence
  Synthetic oligonucleotide
aggtgatcctagctggggagggggggaagggcacg

SEQ ID NO: 182372 - DNA, 36 bp, Artificial Sequence
  Synthetic oligonucleotide
gccgtacctggcggctttgagctctgaattcctccg

SEQ ID NO: 182373 - DNA, 35 bp, Artificial Sequence
  Synthetic oligonucleotide
tagcgttagaacggatgggaggcggggggggagcg

SEQ ID NO: 182374 - DNA, 35 bp, Artificial Sequence
  Synthetic oligonucleotide
gggtggcgggggggttttgcgtatggcacatcgcg

SEQ ID NO: 182375 - DNA, 35 bp, Artificial Sequence
  Synthetic oligonucleotide
gtatccgttccacctgtgtcatcactcactaggcg

SEQ ID NO: 182376 - DNA, 35 bp, Artificial Sequence
  Synthetic oligonucleotide
gctcacctcacggtactcttaaacatcctacctcg

SEQ ID NO: 182377 - DNA, 35 bp, Artificial Sequence
  Synthetic oligonucleotide
atcatgtgcccacacgctactatctagatccctcg

SEQ ID NO: 182378 - DNA, 35 bp, Artificial Sequence
  Synthetic oligonucleotide
ggaacaggggtggaggggtggttgccgtatgctcg

SEQ ID NO: 182379 - DNA, 35 bp, Artificial Sequence
  Synthetic oligonucleotide
tcgcggagaaggctgcaggggggagtgaccgtggg

SEQ ID NO: 182380 - DNA, 35 bp, Artificial Sequence
  Synthetic oligonucleotide
gggacgactgccgactctgatattccctctcactg

SEQ ID NO: 182381 - DNA, 35 bp, Artificial Sequence
  Synthetic oligonucleotide
tcgagcgggaaccatatgctgttcgtccttccctg

SEQ ID NO: 182382 - DNA, 35 bp, Artificial Sequence
  Synthetic oligonucleotide
tgtatcctccgctccacttgaccctagagatcctg

SEQ ID NO: 182383 - DNA, 35 bp, Artificial Sequence
  Synthetic oligonucleotide
gtaacgcgccccccatggcttggatcttcactctg

SEQ ID NO: 182384 - DNA, 35 bp, Artificial Sequence
  Synthetic oligonucleotide
gtgggggtggtggggagcactcgagacatgaccat

SEQ ID NO: 182385 - DNA, 35 bp, Artificial Sequence
  Synthetic oligonucleotide
accaccctcaacgactatctgattaggcatcccat

SEQ ID NO: 182386 - DNA, 35 bp, Artificial Sequence
  Synthetic oligonucleotide
tgaccccccgatccggtgcactatgtttcctatat

SEQ ID NO: 182387 - DNA, 35 bp, Artificial Sequence
  Synthetic oligonucleotide
gctggcccccgggtcagcgttgcttggtcccccct

SEQ ID NO: 182388 - DNA, 35 bp, Artificial Sequence
  Synthetic oligonucleotide
tccggatagctggtcccattcgcagccttgtccct

SEQ ID NO: 182389 - DNA, 35 bp, Artificial Sequence
  Synthetic oligonucleotide
ttgtggcggacacatcctcttaaccgccgtatcct

SEQ ID NO: 182390 - DNA, 35 bp, Artificial Sequence
  Synthetic oligonucleotide
gttgaccctcggtccgttcactagccttatctcct

SEQ ID NO: 182391 - DNA, 35 bp, Artificial Sequence
  Synthetic oligonucleotide
accgcctcctgttaattgcgcacctaccgcacgct

SEQ ID NO: 182392 - DNA, 35 bp, Artificial Sequence
  Synthetic oligonucleotide
gcacactccccgtagatccacctcttgaaaaggct

SEQ ID NO: 182393 - DNA, 35 bp, Artificial Sequence
  Synthetic oligonucleotide
agcgtgctcattgttctggtcgcccccaccctgct

SEQ ID NO: 182394 - DNA, 35 bp, Artificial Sequence
  Synthetic oligonucleotide
ttgacatccgactcatttatggcactcttacatct

SEQ ID NO: 182395 - DNA, 35 bp, Artificial Sequence
  Synthetic oligonucleotide
tccagcccctttacgctagtgtacttttcaactct

SEQ ID NO: 182396 - DNA, 35 bp, Artificial Sequence
  Synthetic oligonucleotide
gccgccggcccacctttgagtatctctcgccctct

SEQ ID NO: 182397 - DNA, 35 bp, Artificial Sequence
  Synthetic oligonucleotide
gggaacgggagggcaaagagggtgggatgggctct

SEQ ID NO: 182398 - DNA, 35 bp, Artificial Sequence
  Synthetic oligonucleotide
atcgcccactcttaacccgttctatgccgctctct

SEQ ID NO: 182399 - DNA, 35 bp, Artificial Sequence
  Synthetic oligonucleotide
gacaactgtgcggattatttctttgcgtttcttct

SEQ ID NO: 182400 - DNA, 35 bp, Artificial Sequence
  Synthetic oligonucleotide
atgcccccccgatcattccgaaacgtcgtctttct

SEQ ID NO: 182401 - DNA, 36 bp, Artificial Sequence
  Synthetic oligonucleotide
tcaccaacagtgaacgtgcagttgaaccccattggt

SEQ ID NO: 182402 - DNA, 35 bp, Artificial Sequence
  Synthetic oligonucleotide
ttggtcgacgcccgtggcccttatcttttcactgt

SEQ ID NO: 182403 - DNA, 35 bp, Artificial Sequence
  Synthetic oligonucleotide
gtcccacccccctatgactctgggcaccgccctgt

SEQ ID NO: 182404 - DNA, 35 bp, Artificial Sequence
  Synthetic oligonucleotide
ttcgtaccccccatctatgccttatagcccacatt

SEQ ID NO: 182405 - DNA, 35 bp, Artificial Sequence
  Synthetic oligonucleotide
actctccctacgccacctatgccccgttcgagatt

SEQ ID NO: 182406 - DNA, 35 bp, Artificial Sequence
  Synthetic oligonucleotide
ttgagcgcttcctgcttccatgcatcaccatactt

SEQ ID NO: 182407 - DNA, 35 bp, Artificial Sequence
  Synthetic oligonucleotide
gatgcgcgcgaccatgtctctatttcgccaccctt

SEQ ID NO: 182408 - DNA, 35 bp, Artificial Sequence
  Synthetic oligonucleotide
gagccggctgttacggtgcttttggctttcccctt

SEQ ID NO: 182409 - DNA, 35 bp, Artificial Sequence
  Synthetic oligonucleotide
gaaatgtcacccgcttgcctagtcgtcttgccctt

SEQ ID NO: 182410 - DNA, 35 bp, Artificial Sequence
  Synthetic oligonucleotide
acgtacccctgtgcggcctttcccacgaacgcctt

SEQ ID NO: 182411 - DNA, 35 bp, Artificial Sequence
  Synthetic oligonucleotide
gatgtctcagatcacgctgagtgcactctttcctt

SEQ ID NO: 182412 - DNA, 35 bp, Artificial Sequence
  Synthetic oligonucleotide
tcactgctgagtgatcgtgcatgcccttcctagtt

SEQ ID NO: 182413 - DNA, 35 bp, Artificial Sequence
  Synthetic oligonucleotide
gtgaacccgctatctgttgacgatgttccctcttt

SEQ ID NO: 182414 - DNA, 36 bp, Artificial Sequence
  Synthetic oligonucleotide
tgagcgggtggaaaatcaagggtgggctggtggaaa

SEQ ID NO: 182415 - DNA, 36 bp, Artificial Sequence
  Synthetic oligonucleotide
gccctgcctccgtccagtttttctatcaacggccaa

SEQ ID NO: 182416 - DNA, 36 bp, Artificial Sequence
  Synthetic oligonucleotide
gaatgcggaggggtgcgggcgtggggacgcatagaa

SEQ ID NO: 182417 - DNA, 36 bp, Artificial Sequence
  Synthetic oligonucleotide
acccttaggtccggttggcgcccatctccccttgaa

SEQ ID NO: 182418 - DNA, 35 bp, Artificial Sequence
  Synthetic oligonucleotide
tttgcgagtcggactgcttcttctccgttttcaca

SEQ ID NO: 182419 - DNA, 36 bp, Artificial Sequence
  Synthetic oligonucleotide
tcccctagctgcagttcctccatcgtcgcatctaca

SEQ ID NO: 182420 - DNA, 35 bp, Artificial Sequence
  Synthetic oligonucleotide
tcctggagctccaaccgcgtaaccactgctctaca

SEQ ID NO: 182421 - DNA, 36 bp, Artificial Sequence
  Synthetic oligonucleotide
tagcactacccgactctccacagcgcttggccacca

SEQ ID NO: 182422 - DNA, 36 bp, Artificial Sequence
  Synthetic oligonucleotide
tgctagccactttgttcctcttgtacatcttcacca

SEQ ID NO: 182423 - DNA, 36 bp, Artificial Sequence
  Synthetic oligonucleotide
tgtcatacctcaaaaccccgcccgcccgctaggcca

SEQ ID NO: 182424 - DNA, 35 bp, Artificial Sequence
  Synthetic oligonucleotide
gttataccgacggtatctgtagacctctcactcca

SEQ ID NO: 182425 - DNA, 35 bp, Artificial Sequence
  Synthetic oligonucleotide
tcccgcctcacttctgccgcctttaccgcctagca

SEQ ID NO: 182426 - DNA, 35 bp, Artificial Sequence
  Synthetic oligonucleotide
gtctacctccctatccccccccatgtcataaggca

SEQ ID NO: 182427 - DNA, 35 bp, Artificial Sequence
  Synthetic oligonucleotide
gaggggggttatgggaggcgggacatggtggtgca

SEQ ID NO: 182428 - DNA, 36 bp, Artificial Sequence
  Synthetic oligonucleotide
acgccaccctgaggtactcgcctcgactgcccatca

SEQ ID NO: 182429 - DNA, 35 bp, Artificial Sequence
  Synthetic oligonucleotide
tacgtcacggccccccgcctttgcctttacgatca

SEQ ID NO: 182430 - DNA, 35 bp, Artificial Sequence
  Synthetic oligonucleotide
actactccctcaccgcggtcccgaagaccctatca

SEQ ID NO: 182431 - DNA, 36 bp, Artificial Sequence
  Synthetic oligonucleotide
gtcccttctccgttcgagcatattgcgcccgtatca

SEQ ID NO: 182432 - DNA, 33 bp, Artificial Sequence
  Synthetic oligonucleotide
gctcatatacctgccgctgcgtgaccatcctca

SEQ ID NO: 182433 - DNA, 35 bp, Artificial Sequence
  Synthetic oligonucleotide
acacccccaccaatctagtctggtacttttgctca

SEQ ID NO: 182434 - DNA, 36 bp, Artificial Sequence
  Synthetic oligonucleotide
tccgtccctccagcgatccatcttatagacctctca

SEQ ID NO: 182435 - DNA, 36 bp, Artificial Sequence
  Synthetic oligonucleotide
gccacccataacccgccgttttcaagcgcactttca

SEQ ID NO: 182436 - DNA, 35 bp, Artificial Sequence
  Synthetic oligonucleotide
acaccccgaactgaaggattatgccgcatctttca

SEQ ID NO: 182437 - DNA, 36 bp, Artificial Sequence
  Synthetic oligonucleotide
acctcaggcccttcggttactttcatcgctgtttca

SEQ ID NO: 182438 - DNA, 37 bp, Artificial Sequence
  Synthetic oligonucleotide
taggatggtggggtgtgggtgggtcgggtcctgaaga

SEQ ID NO: 182439 - DNA, 37 bp, Artificial Sequence
  Synthetic oligonucleotide
gctcccaccgccctacactgattacacactcaccaga

SEQ ID NO: 182440 - DNA, 37 bp, Artificial Sequence
  Synthetic oligonucleotide
tcaccctcctggccctttattgttcgcctcgcagaga

SEQ ID NO: 182441 - DNA, 37 bp, Artificial Sequence
  Synthetic oligonucleotide
gaggtatagggcacgagggcaattgggcgggaggaga

SEQ ID NO: 182442 - DNA, 37 bp, Artificial Sequence
  Synthetic oligonucleotide
agaatcatctgtcctgcctttacctcgccgtttacga

SEQ ID NO: 182443 - DNA, 37 bp, Artificial Sequence
  Synthetic oligonucleotide
tcatcacaccagtgcatagtatcacccctccgaccga

SEQ ID NO: 182444 - DNA, 36 bp, Artificial Sequence
  Synthetic oligonucleotide
gaatggcaccccgccgcctagtcctgttgctcccga

SEQ ID NO: 182445 - DNA, 37 bp, Artificial Sequence
  Synthetic oligonucleotide
gtgaacgggcgggttgagggggggtatttggtcgcga

SEQ ID NO: 182446 - DNA, 35 bp, Artificial Sequence
  Synthetic oligonucleotide
gacagggggggggtacaatggcgtaaggggtgcga

SEQ ID NO: 182447 - DNA, 36 bp, Artificial Sequence
  Synthetic oligonucleotide
tccccttcctccgacatcgaacgggcgttctttcga

SEQ ID NO: 182448 - DNA, 35 bp, Artificial Sequence
  Synthetic oligonucleotide
ttgaagagcggggggggtggggaattggataagga

SEQ ID NO: 182449 - DNA, 37 bp, Artificial Sequence
  Synthetic oligonucleotide
tccagccatcacgcaatacgatcccccctctgtagga

SEQ ID NO: 182450 - DNA, 37 bp, Artificial Sequence
  Synthetic oligonucleotide
aaacgggcggagggggggcctgggtgcgatgaacgga

SEQ ID NO: 182451 - DNA, 37 bp, Artificial Sequence
  Synthetic oligonucleotide
gtgcgccctcttcaccgcttccgatcgtcataccgga

SEQ ID NO: 182452 - DNA, 35 bp, Artificial Sequence
  Synthetic oligonucleotide
tccgcccctggcacctgcgctaccttcctctcgga

SEQ ID NO: 182453 - DNA, 37 bp, Artificial Sequence
  Synthetic oligonucleotide
gggggagggagtagaatgatagggagctggtgtcgga

SEQ ID NO: 182454 - DNA, 37 bp, Artificial Sequence
  Synthetic oligonucleotide
ttggggggttgggtggagggggtgtaaactaaaggga

SEQ ID NO: 182455 - DNA, 37 bp, Artificial Sequence
  Synthetic oligonucleotide
gttccgggcggggttgtttggggtgtcgatctgggga

SEQ ID NO: 182456 - DNA, 36 bp, Artificial Sequence
  Synthetic oligonucleotide
gacggggttctatgtgctggttagggagggtgggga

SEQ ID NO: 182457 - DNA, 35 bp, Artificial Sequence
  Synthetic oligonucleotide
atcgcaacccttctccttacacatgtctccctgga

SEQ ID NO: 182458 - DNA, 35 bp, Artificial Sequence
  Synthetic oligonucleotide
tccctcacccatccgtttgttcccttccccttgga

SEQ ID NO: 182459 - DNA, 35 bp, Artificial Sequence
  Synthetic oligonucleotide
gacgagttccgccgcccatacaccatgctcttgga

SEQ ID NO: 182460 - DNA, 38 bp, Artificial Sequence
  Synthetic oligonucleotide
tcacagtcccgcccgctttgcatcttacttcaccatga

SEQ ID NO: 182461 - DNA, 38 bp, Artificial Sequence
  Synthetic oligonucleotide
tgtaacgccctacctgtctcttcaccttgccgccatga

SEQ ID NO: 182462 - DNA, 37 bp, Artificial Sequence
  Synthetic oligonucleotide
accaatgtcggctgtaatccactcgcaccatccatga

SEQ ID NO: 182463 - DNA, 38 bp, Artificial Sequence
  Synthetic oligonucleotide
gcccacccagttgacgttgcatcctctctcataactga

SEQ ID NO: 182464 - DNA, 38 bp, Artificial Sequence
  Synthetic oligonucleotide
tcatcgcccccatgccttttcagcgtctttgctactga

SEQ ID NO: 182465 - DNA, 38 bp, Artificial Sequence
  Synthetic oligonucleotide
ggggtcctccgtcacctggatttagccccctcccctga

SEQ ID NO: 182466 - DNA, 37 bp, Artificial Sequence
  Synthetic oligonucleotide
tcaacgcagtgcctgtcctctcgttcctccagcctga

SEQ ID NO: 182467 - DNA, 38 bp, Artificial Sequence
  Synthetic oligonucleotide
tcagcccctcatagtaatcgccaccttttcactcctga

SEQ ID NO: 182468 - DNA, 36 bp, Artificial Sequence
  Synthetic oligonucleotide
gatcaagtcagtacgcctcttcccttcctgtgctga

SEQ ID NO: 182469 - DNA, 38 bp, Artificial Sequence
  Synthetic oligonucleotide
gagaggccgactgagcaggaggggaacgttgggagtga

SEQ ID NO: 182470 - DNA, 38 bp, Artificial Sequence
  Synthetic oligonucleotide
ggggggtgtgggagggacgagtgttgaataggtcgtga

SEQ ID NO: 182471 - DNA, 38 bp, Artificial Sequence
  Synthetic oligonucleotide
gaccccaccacatagtacaaccagcacctgacgggtga

SEQ ID NO: 182472 - DNA, 38 bp, Artificial Sequence
  Synthetic oligonucleotide
tgcgtggggaggaggagtctgggagggccgtggggtga

SEQ ID NO: 182473 - DNA, 36 bp, Artificial Sequence
  Synthetic oligonucleotide
ttgggagggggcaaacggggcatgattggggtgtga

SEQ ID NO: 182474 - DNA, 38 bp, Artificial Sequence
  Synthetic oligonucleotide
acaagggggtaaggggcggtgacggcggaacagcttga

SEQ ID NO: 182475 - DNA, 38 bp, Artificial Sequence
  Synthetic oligonucleotide
gcgcacctccctcctgtgagcttaccattctcgcttga

SEQ ID NO: 182476 - DNA, 38 bp, Artificial Sequence
  Synthetic oligonucleotide
tgaaccttctgttgctgctacttcccatccatctttga

SEQ ID NO: 182477 - DNA, 36 bp, Artificial Sequence
  Synthetic oligonucleotide
acttgcccctcctcggttcgattatgcattaacata

SEQ ID NO: 182478 - DNA, 36 bp, Artificial Sequence
  Synthetic oligonucleotide
gacgtagccgcacattcgcaatttcgctccccacta

SEQ ID NO: 182479 - DNA, 35 bp, Artificial Sequence
  Synthetic oligonucleotide
tgctggcctcctgccattcctctctcacctaccta

SEQ ID NO: 182480 - DNA, 36 bp, Artificial Sequence
  Synthetic oligonucleotide
tgtacatgagtcagcccactacgtcaaccgctccta

SEQ ID NO: 182481 - DNA, 35 bp, Artificial Sequence
  Synthetic oligonucleotide
ttgtgcctcctttgttaattaccctcacattcgta

SEQ ID NO: 182482 - DNA, 35 bp, Artificial Sequence
  Synthetic oligonucleotide
ttactgctcgctcctcccttccgcttacatgtgta

SEQ ID NO: 182483 - DNA, 36 bp, Artificial Sequence
  Synthetic oligonucleotide
tacgcccaaactcgccggtgaccttcaacccgttta

SEQ ID NO: 182484 - DNA, 35 bp, Artificial Sequence
  Synthetic oligonucleotide
gaatgcgagggggggtagaggtagtgtagggtaac

SEQ ID NO: 182485 - DNA, 35 bp, Artificial Sequence
  Synthetic oligonucleotide
tccacgcctctcgatttgcccgcctatatgtccac

SEQ ID NO: 182486 - DNA, 35 bp, Artificial Sequence
  Synthetic oligonucleotide
tgtggcctgtatatgtctatctcggctcctatcac

SEQ ID NO: 182487 - DNA, 35 bp, Artificial Sequence
  Synthetic oligonucleotide
acatccgcccgccgaaaacgtttttctaacaatac

SEQ ID NO: 182488 - DNA, 35 bp, Artificial Sequence
  Synthetic oligonucleotide
gacgtgccatgcgctccgttaccagccatcactac

SEQ ID NO: 182489 - DNA, 35 bp, Artificial Sequence
  Synthetic oligonucleotide
aaatgcgtcctgctccccctggctaattgctctac

SEQ ID NO: 182490 - DNA, 36 bp, Artificial Sequence
  Synthetic oligonucleotide
tctatctgacctgccccctgcataacctacggttac

SEQ ID NO: 182491 - DNA, 35 bp, Artificial Sequence
  Synthetic oligonucleotide
taccgcggtcgttgacaagcccccccatcctttac

SEQ ID NO: 182492 - DNA, 35 bp, Artificial Sequence
  Synthetic oligonucleotide
ttgcccacagtagactgctttgctcgttccaaccc

SEQ ID NO: 182493 - DNA, 35 bp, Artificial Sequence
  Synthetic oligonucleotide
tcatcgatcctacaccctatatgtcagtccccccc

SEQ ID NO: 182494 - DNA, 35 bp, Artificial Sequence
  Synthetic oligonucleotide
tctaactgatccgctctgccccagtggtgcccccc

SEQ ID NO: 182495 - DNA, 35 bp, Artificial Sequence
  Synthetic oligonucleotide
ggccgccccacactgtgttttccctgctaactccc

SEQ ID NO: 182496 - DNA, 35 bp, Artificial Sequence
  Synthetic oligonucleotide
gccgctacaggaatcgccgcttccctccgttcgcc

SEQ ID NO: 182497 - DNA, 35 bp, Artificial Sequence
  Synthetic oligonucleotide
gttgcctgccctcacaaattgcctggtcccctgcc

SEQ ID NO: 182498 - DNA, 35 bp, Artificial Sequence
  Synthetic oligonucleotide
tgtccggaccggtcagcctctccgctaatgcatcc

SEQ ID NO: 182499 - DNA, 35 bp, Artificial Sequence
  Synthetic oligonucleotide
gtcggacttccgccctgtcgggacccccggactcc

SEQ ID NO: 182500 - DNA, 35 bp, Artificial Sequence
  Synthetic oligonucleotide
aagcacgccgcctccggtttcctgttacgttgtcc

SEQ ID NO: 182501 - DNA, 35 bp, Artificial Sequence
  Synthetic oligonucleotide
tctacatgtcgatatcggtcgccgcaaccacttcc

SEQ ID NO: 182502 - DNA, 35 bp, Artificial Sequence
  Synthetic oligonucleotide
gatggtcatgagatcgcccgcttttctcgccttcc

SEQ ID NO: 182503 - DNA, 35 bp, Artificial Sequence
  Synthetic oligonucleotide
gaacatcggccatcgcatgtttcaccatttcttcc

SEQ ID NO: 182504 - DNA, 35 bp, Artificial Sequence
  Synthetic oligonucleotide
acgccaccctgcaagcccctgtgccctaatgttcc

SEQ ID NO: 182505 - DNA, 35 bp, Artificial Sequence
  Synthetic oligonucleotide
acccatgagatccggttgcatgccgcctattttcc

SEQ ID NO: 182506 - DNA, 35 bp, Artificial Sequence
  Synthetic oligonucleotide
tgctcccttccgtacgatcgacgccacgcactagc

SEQ ID NO: 182507 - DNA, 35 bp, Artificial Sequence
  Synthetic oligonucleotide
gaagcggactgcagggatggggcacgtggtaacgc

SEQ ID NO: 182508 - DNA, 35 bp, Artificial Sequence
  Synthetic oligonucleotide
acgccatgagtacaacccccagctccccagcacgc

SEQ ID NO: 182509 - DNA, 35 bp, Artificial Sequence
  Synthetic oligonucleotide
tgaaaggctcagactcacgccgtcattacacctgc

SEQ ID NO: 182510 - DNA, 35 bp, Artificial Sequence
  Synthetic oligonucleotide
tactgcgcaccttgctgctccccgaatccgcctgc

SEQ ID NO: 182511 - DNA, 35 bp, Artificial Sequence
  Synthetic oligonucleotide
gtatcctcgctcgtacgaagcctgggctcttcatc

SEQ ID NO: 182512 - DNA, 35 bp, Artificial Sequence
  Synthetic oligonucleotide
gccgccgagcctatccgtaacattaacgtcaactc

SEQ ID NO: 182513 - DNA, 35 bp, Artificial Sequence
  Synthetic oligonucleotide
gattccgcctcgatctaacaaggtcctccgaactc

SEQ ID NO: 182514 - DNA, 35 bp, Artificial Sequence
  Synthetic oligonucleotide
atctcgagcccactcacgcccttatactggcactc

SEQ ID NO: 182515 - DNA, 35 bp, Artificial Sequence
  Synthetic oligonucleotide
taggtcgccacctggccgattcctggacccccctc

SEQ ID NO: 182516 - DNA, 35 bp, Artificial Sequence
  Synthetic oligonucleotide
gcattcaagtcagttggccagtcgttcgctccctc

SEQ ID NO: 182517 - DNA, 35 bp, Artificial Sequence
  Synthetic oligonucleotide
tgcctcatccttgtagaagccttgcccgattcctc

SEQ ID NO: 182518 - DNA, 35 bp, Artificial Sequence
  Synthetic oligonucleotide
actcccagattgctgcccctgtagcgccttcgctc

SEQ ID NO: 182519 - DNA, 35 bp, Artificial Sequence
  Synthetic oligonucleotide
ggtcgactgccgaccgctccctttgcctgtggctc

SEQ ID NO: 182520 - DNA, 35 bp, Artificial Sequence
  Synthetic oligonucleotide
tccccactgttccgccacttagagggttccttctc

SEQ ID NO: 182521 - DNA, 35 bp, Artificial Sequence
  Synthetic oligonucleotide
tccccgcacctcaccaacaaccttcgcctccagtc

SEQ ID NO: 182522 - DNA, 35 bp, Artificial Sequence
  Synthetic oligonucleotide
accgcacggtcggttgtgtttccgccacccccgtc

SEQ ID NO: 182523 - DNA, 35 bp, Artificial Sequence
  Synthetic oligonucleotide
tagggatgcaccagttcgcgctttatttcctcgtc

SEQ ID NO: 182524 - DNA, 35 bp, Artificial Sequence
  Synthetic oligonucleotide
tcccgtcgtgtcgccatccgccctatactttggtc

SEQ ID NO: 182525 - DNA, 35 bp, Artificial Sequence
  Synthetic oligonucleotide
tccaatctgcctgcttgagccgtagcccacctgtc

SEQ ID NO: 182526 - DNA, 35 bp, Artificial Sequence
  Synthetic oligonucleotide
gcatgccacacatccgtcttcactgcagtcccttc

SEQ ID NO: 182527 - DNA, 35 bp, Artificial Sequence
  Synthetic oligonucleotide
ttggtgctcgccgcttatctgcccccggtttgttc

SEQ ID NO: 182528 - DNA, 35 bp, Artificial Sequence
  Synthetic oligonucleotide
tagacgctacgcatcgttggttcccgcctcctttc

SEQ ID NO: 182529 - DNA, 35 bp, Artificial Sequence
  Synthetic oligonucleotide
aacccgctacccacttacctcagagtccgtctttc

SEQ ID NO: 182530 - DNA, 35 bp, Artificial Sequence
  Synthetic oligonucleotide
tgggtgataggggagcgggagaacacggcatgcag

SEQ ID NO: 182531 - DNA, 35 bp, Artificial Sequence
  Synthetic oligonucleotide
gtcgcctccctgtgacctttgtactcgagttaccg

SEQ ID NO: 182532 - DNA, 35 bp, Artificial Sequence
  Synthetic oligonucleotide
tgccgcgacggtcttaacaaccgctgtgccccccg

SEQ ID NO: 182533 - DNA, 36 bp, Artificial Sequence
  Synthetic oligonucleotide
gccagataccgcaccacacacaatccgcgtccgccg

SEQ ID NO: 182534 - DNA, 35 bp, Artificial Sequence
  Synthetic oligonucleotide
acacggggtcagggaaggaggtgagtcggataagg

SEQ ID NO: 182535 - DNA, 35 bp, Artificial Sequence
  Synthetic oligonucleotide
acaacgaggggtgtcggaagtatgggaaggagcgg

SEQ ID NO: 182536 - DNA, 35 bp, Artificial Sequence
  Synthetic oligonucleotide
gttgggtgggggtagaaacgggagggggagttggg

SEQ ID NO: 182537 - DNA, 35 bp, Artificial Sequence
  Synthetic oligonucleotide
tgctctacgttacgtcgcctatcccctttcacctg

SEQ ID NO: 182538 - DNA, 35 bp, Artificial Sequence
  Synthetic oligonucleotide
actatgacgaggagggggaatatagggatggggtg

SEQ ID NO: 182539 - DNA, 35 bp, Artificial Sequence
  Synthetic oligonucleotide
acacaccacctaacatgttcgccgttccgctattg

SEQ ID NO: 182540 - DNA, 36 bp, Artificial Sequence
  Synthetic oligonucleotide
gactgtccagacggggctctcgtcgttcctctcttg

SEQ ID NO: 182541 - DNA, 35 bp, Artificial Sequence
  Synthetic oligonucleotide
tgccacggtgttgtgtgctccccctcgtgttcttg

SEQ ID NO: 182542 - DNA, 35 bp, Artificial Sequence
  Synthetic oligonucleotide
atgttcgccaccaatttctttccatctcaccgttg

SEQ ID NO: 182543 - DNA, 35 bp, Artificial Sequence
  Synthetic oligonucleotide
gcaccctgccaccttggtttgtctctatgaacact

SEQ ID NO: 182544 - DNA, 35 bp, Artificial Sequence
  Synthetic oligonucleotide
gtcattggccccctcacccgtaaagttcacatact

SEQ ID NO: 182545 - DNA, 36 bp, Artificial Sequence
  Synthetic oligonucleotide
gtagcccgcctatcgattaaccgccttacccctact

SEQ ID NO: 182546 - DNA, 35 bp, Artificial Sequence
  Synthetic oligonucleotide
tgataatcgtcgttgctcgatcacccaccccccct

SEQ ID NO: 182547 - DNA, 35 bp, Artificial Sequence
  Synthetic oligonucleotide
tgagccggaaattccagtagctatttcgctcccct

SEQ ID NO: 182548 - DNA, 35 bp, Artificial Sequence
  Synthetic oligonucleotide
acccgctcgctggtgttacttgcctcctcaatcct

SEQ ID NO: 182549 - DNA, 35 bp, Artificial Sequence
  Synthetic oligonucleotide
tgcccgtggctcgaaggcctgaaagtacccctcct

SEQ ID NO: 182550 - DNA, 35 bp, Artificial Sequence
  Synthetic oligonucleotide
ttgctgccgctatcgacgtcctgtctacctctcct

SEQ ID NO: 182551 - DNA, 35 bp, Artificial Sequence
  Synthetic oligonucleotide
tgtaccctcactctgcctgcattgcacatctcgct

SEQ ID NO: 182552 - DNA, 35 bp, Artificial Sequence
  Synthetic oligonucleotide
tcacgcacccggccacttatttgcctccgaactct

SEQ ID NO: 182553 - DNA, 35 bp, Artificial Sequence
  Synthetic oligonucleotide
gcaacatcccgaatacaccgccgcccagggactct

SEQ ID NO: 182554 - DNA, 35 bp, Artificial Sequence
  Synthetic oligonucleotide
gctcggaagatactacgttggtactgtcgccctct

SEQ ID NO: 182555 - DNA, 35 bp, Artificial Sequence
  Synthetic oligonucleotide
acgttaccccgcttgcctcacattctgtttcctct

SEQ ID NO: 182556 - DNA, 35 bp, Artificial Sequence
  Synthetic oligonucleotide
accgaccgccaaagttattttggctattaatctct

SEQ ID NO: 182557 - DNA, 35 bp, Artificial Sequence
  Synthetic oligonucleotide
gcgatcgccactccgctcccatccttaagacttct

SEQ ID NO: 182558 - DNA, 35 bp, Artificial Sequence
  Synthetic oligonucleotide
atcatctgcgcgtcgtctcacaaccctcccgccgt

SEQ ID NO: 182559 - DNA, 35 bp, Artificial Sequence
  Synthetic oligonucleotide
tgccgcggtctattgtctttttgtctttcgccggt

SEQ ID NO: 182560 - DNA, 35 bp, Artificial Sequence
  Synthetic oligonucleotide
gccaacacccagctcctccccagctgccctactgt

SEQ ID NO: 182561 - DNA, 35 bp, Artificial Sequence
  Synthetic oligonucleotide
gaacgcgataaactgcatcagcacgccccacctgt

SEQ ID NO: 182562 - DNA, 35 bp, Artificial Sequence
  Synthetic oligonucleotide
tgcacgatccgcctgatgcgcacttttatcctctt

SEQ ID NO: 182563 - DNA, 35 bp, Artificial Sequence
  Synthetic oligonucleotide
tgaccacctcccaatatgttcctcttagtgctctt

SEQ ID NO: 182564 - DNA, 35 bp, Artificial Sequence
  Synthetic oligonucleotide
tccccacatcagggattttccttagtccactcgtt

SEQ ID NO: 182565 - DNA, 35 bp, Artificial Sequence
  Synthetic oligonucleotide
gcgcgttagcacatcgattgttccttttcctcgtt

SEQ ID NO: 182566 - DNA, 35 bp, Artificial Sequence
  Synthetic oligonucleotide
tactaacgtgccctctgttttgttctctcgttttt

SEQ ID NO: 182567 - DNA, 35 bp, Artificial Sequence
  Synthetic oligonucleotide
taagatccccgcccggttccgttttgcgctttttt

SEQ ID NO: 182568 - DNA, 35 bp, Artificial Sequence
  Synthetic oligonucleotide
atccgccagtcctccaccacccgcgtttgagacaa

SEQ ID NO: 182569 - DNA, 36 bp, Artificial Sequence
  Synthetic oligonucleotide
agcccaccaccacttgggtttcgtatattttctcaa

SEQ ID NO: 182570 - DNA, 36 bp, Artificial Sequence
  Synthetic oligonucleotide
tggaaggggggctgggggataggaagcggtgtctaa

SEQ ID NO: 182571 - DNA, 36 bp, Artificial Sequence
  Synthetic oligonucleotide
acacactcgagatctgctgccctcccccaaccttaa

SEQ ID NO: 182572 - DNA, 36 bp, Artificial Sequence
  Synthetic oligonucleotide
gcctccccaccatctgcccagagccttcctgtaaca

SEQ ID NO: 182573 - DNA, 36 bp, Artificial Sequence
  Synthetic oligonucleotide
agcctcaccaccgctctgtccgtctgtacataccca

SEQ ID NO: 182574 - DNA, 36 bp, Artificial Sequence
  Synthetic oligonucleotide
gcaccagcatcccatagctcccctcggtattcccca

SEQ ID NO: 182575 - DNA, 36 bp, Artificial Sequence
  Synthetic oligonucleotide
ttgcgcttattggctatgctgttcccctgcctccca

SEQ ID NO: 182576 - DNA, 36 bp, Artificial Sequence
  Synthetic oligonucleotide
tacagccgcccatccgttccatctgctttttagcca

SEQ ID NO: 182577 - DNA, 36 bp, Artificial Sequence
  Synthetic oligonucleotide
gccttagtcagccctggtttcattcctttgtcgcca

SEQ ID NO: 182578 - DNA, 36 bp, Artificial Sequence
  Synthetic oligonucleotide
tacctgcggtcgagttactttccattctccttgcca

SEQ ID NO: 182579 - DNA, 36 bp, Artificial Sequence
  Synthetic oligonucleotide
gcctgctctgaccccattcgattcttccgcgccgca

SEQ ID NO: 182580 - DNA, 35 bp, Artificial Sequence
  Synthetic oligonucleotide
gtacccccagtctcctcttaacagaaccctccgca

SEQ ID NO: 182581 - DNA, 36 bp, Artificial Sequence
  Synthetic oligonucleotide
gaatggggagggctcatggaagtggtcggaagggca

SEQ ID NO: 182582 - DNA, 36 bp, Artificial Sequence
  Synthetic oligonucleotide
acgatggatcctcgtatgctttcccccccgtatgca

SEQ ID NO: 182583 - DNA, 36 bp, Artificial Sequence
  Synthetic oligonucleotide
tgcacgccccagtttctgttacttcttcctcctgca

SEQ ID NO: 182584 - DNA, 35 bp, Artificial Sequence
  Synthetic oligonucleotide
ttcaatgcaggtcggcctctctcgtctccattgca

SEQ ID NO: 182585 - DNA, 36 bp, Artificial Sequence
  Synthetic oligonucleotide
gacgtccattgccgcattattttcatgtctcactca

SEQ ID NO: 182586 - DNA, 36 bp, Artificial Sequence
  Synthetic oligonucleotide
acttcgcccaccctgtagccacatatgccaggctca

SEQ ID NO: 182587 - DNA, 35 bp, Artificial Sequence
  Synthetic oligonucleotide
gcatgaagggtgggtgggcgtagggatctatctca

SEQ ID NO: 182588 - DNA, 36 bp, Artificial Sequence
  Synthetic oligonucleotide
gaccacaccttccgcttaaccacagtagattgttca

SEQ ID NO: 182589 - DNA, 36 bp, Artificial Sequence
  Synthetic oligonucleotide
ttccagcacctacactcatttaacggtcctgtttca

SEQ ID NO: 182590 - DNA, 37 bp, Artificial Sequence
  Synthetic oligonucleotide
agtgagcgatcggagagggagtttagtgggggtcaga

SEQ ID NO: 182591 - DNA, 37 bp, Artificial Sequence
  Synthetic oligonucleotide
gacctgccaccctttgctcgcctcttcactagtgaga

SEQ ID NO: 182592 - DNA, 37 bp, Artificial Sequence
  Synthetic oligonucleotide
taaaccggcggagggcggggtggttggccttttgaga

SEQ ID NO: 182593 - DNA, 37 bp, Artificial Sequence
  Synthetic oligonucleotide
aggtgggaggacggagggggcaatggaacaacataga

SEQ ID NO: 182594 - DNA, 36 bp, Artificial Sequence
  Synthetic oligonucleotide
aacccctacgcctcccagcttataagcccaactaga

SEQ ID NO: 182595 - DNA, 37 bp, Artificial Sequence
  Synthetic oligonucleotide
agtcaccgtagcgtacgagcgccactgcccccctaga

SEQ ID NO: 182596 - DNA, 37 bp, Artificial Sequence
  Synthetic oligonucleotide
taatgggcgaaaggggggaggaagggagggcagtaga

SEQ ID NO: 182597 - DNA, 37 bp, Artificial Sequence
  Synthetic oligonucleotide
ttgcccactccagttcccctgctacggtcggttacga

SEQ ID NO: 182598 - DNA, 37 bp, Artificial Sequence
  Synthetic oligonucleotide
tttcgcccccgtctctcttgcactgcatctgacccga

SEQ ID NO: 182599 - DNA, 37 bp, Artificial Sequence
  Synthetic oligonucleotide
gaccggtaccgtctctggactcccctgctttccccga

SEQ ID NO: 182600 - DNA, 36 bp, Artificial Sequence
  Synthetic oligonucleotide
gccgtagccctgtaacgtttttgtatcctctgccga

SEQ ID NO: 182601 - DNA, 37 bp, Artificial Sequence
  Synthetic oligonucleotide
agggacggggtagggcaaggggtaagttaaacgtcga

SEQ ID NO: 182602 - DNA, 37 bp, Artificial Sequence
  Synthetic oligonucleotide
aaaacgagggaggggcagggagggtgcttgaaaagga

SEQ ID NO: 182603 - DNA, 37 bp, Artificial Sequence
  Synthetic oligonucleotide
gaagaccatggtgttagagggaggtgtgagggcagga

SEQ ID NO: 182604 - DNA, 37 bp, Artificial Sequence
  Synthetic oligonucleotide
gcatctaagggggaggagaagggcgggtccagtagga

SEQ ID NO: 182605 - DNA, 37 bp, Artificial Sequence
  Synthetic oligonucleotide
tcacacgatccatagcctcgccgcttgtctaaacgga

SEQ ID NO: 182606 - DNA, 37 bp, Artificial Sequence
  Synthetic oligonucleotide
atgacccactcttcctttccttgctcatagagacgga

SEQ ID NO: 182607 - DNA, 37 bp, Artificial Sequence
  Synthetic oligonucleotide
tggacgggaggaacagggcggggtgagcaggccggga

SEQ ID NO: 182608 - DNA, 35 bp, Artificial Sequence
  Synthetic oligonucleotide
atcgcacccctccatgcgcatctcatacatcggga

SEQ ID NO: 182609 - DNA, 35 bp, Artificial Sequence
  Synthetic oligonucleotide
acgcccagggtgggttcggggggaaggacggggga

SEQ ID NO: 182610 - DNA, 37 bp, Artificial Sequence
  Synthetic oligonucleotide
agacgatgagcggggtaacaaagtacgggtggtggga

SEQ ID NO: 182611 - DNA, 37 bp, Artificial Sequence
  Synthetic oligonucleotide
gagtgttgcagggagaaagaaacggtggtggagtgga

SEQ ID NO: 182612 - DNA, 37 bp, Artificial Sequence
  Synthetic oligonucleotide
gtggcctccccagttatccagcccgccctccaaatga

SEQ ID NO: 182613 - DNA, 38 bp, Artificial Sequence
  Synthetic oligonucleotide
tgccccgcaacggtcctgttcacattggcttcccatga

SEQ ID NO: 182614 - DNA, 37 bp, Artificial Sequence
  Synthetic oligonucleotide
actcctccgctcacctattagactctcgccgccatga

SEQ ID NO: 182615 - DNA, 37 bp, Artificial Sequence
  Synthetic oligonucleotide
atgcccctcaccacccacagtcgatgtcaccgcatga

SEQ ID NO: 182616 - DNA, 38 bp, Artificial Sequence
  Synthetic oligonucleotide
tcaccgcctgttcatggatccccgcctgtactaactga

SEQ ID NO: 182617 - DNA, 38 bp, Artificial Sequence
  Synthetic oligonucleotide
gcccacctcacgttggtcgttttccactcacatactga

SEQ ID NO: 182618 - DNA, 37 bp, Artificial Sequence
  Synthetic oligonucleotide
gtccctccacattttgtgtctgccctcatgaccctga

SEQ ID NO: 182619 - DNA, 38 bp, Artificial Sequence
  Synthetic oligonucleotide
gcgagcctcccacgctatgtcctcttctcttgccctga

SEQ ID NO: 182620 - DNA, 38 bp, Artificial Sequence
  Synthetic oligonucleotide
gttccatccgtccatgccctacagacctcgcagcctga

SEQ ID NO: 182621 - DNA, 37 bp, Artificial Sequence
  Synthetic oligonucleotide
cttgcatggcgcccttcttctcctagcgatcctctga

SEQ ID NO: 182622 - DNA, 38 bp, Artificial Sequence
  Synthetic oligonucleotide
tgagggcgaaacgtgggggggcatatctagcggggtga

SEQ ID NO: 182623 - DNA, 38 bp, Artificial Sequence
  Synthetic oligonucleotide
gaacacgggcgggaggaaaggtgaaagggaatatgtga

SEQ ID NO: 182624 - DNA, 38 bp, Artificial Sequence
  Synthetic oligonucleotide
gacttgccccatgatttgccttattccatccgttgtga

SEQ ID NO: 182625 - DNA, 38 bp, Artificial Sequence
  Synthetic oligonucleotide
ggatcagggggcggaggagaaaggctttggcgttgtga

SEQ ID NO: 182626 - DNA, 38 bp, Artificial Sequence
  Synthetic oligonucleotide
tcgatgaccgtcgccctctagccttcgttaccacttga

SEQ ID NO: 182627 - DNA, 37 bp, Artificial Sequence
  Synthetic oligonucleotide
tgtcacccgccgccgaaggaccgccttagccccttga

SEQ ID NO: 182628 - DNA, 38 bp, Artificial Sequence
  Synthetic oligonucleotide
taccctcgttctgtacgcgccgccccttcacgccttga

SEQ ID NO: 182629 - DNA, 37 bp, Artificial Sequence
  Synthetic oligonucleotide
tgtagcacccgcatttgcgccccgtcttcccgcttga

SEQ ID NO: 182630 - DNA, 37 bp, Artificial Sequence
  Synthetic oligonucleotide
actctccccccggatacttacaggccaactctgttga

SEQ ID NO: 182631 - DNA, 38 bp, Artificial Sequence
  Synthetic oligonucleotide
gacctcccccgcatttatttagacgacaagcttgttga

SEQ ID NO: 182632 - DNA, 38 bp, Artificial Sequence
  Synthetic oligonucleotide
gagcccagttcagatgcccgctcgcctcctctctttga

SEQ ID NO: 182633 - DNA, 38 bp, Artificial Sequence
  Synthetic oligonucleotide
accgagcccgctactgtagaccctccgcccttctttga

SEQ ID NO: 182634 - DNA, 30 bp, Artificial Sequence
  Synthetic oligonucleotide
gtgactcctttggccgctcctcctgtttga

SEQ ID NO: 182635 - DNA, 36 bp, Artificial Sequence
  Synthetic oligonucleotide
tgtccggttccttctgtaggcgcacatctctcacta

SEQ ID NO: 182636 - DNA, 36 bp, Artificial Sequence
  Synthetic oligonucleotide
agtccccagactggtgcgcattaccctccgacccta

SEQ ID NO: 182637 - DNA, 36 bp, Artificial Sequence
  Synthetic oligonucleotide
tccctcgcgcagcccccaccgaagcacgctccccta

SEQ ID NO: 182638 - DNA, 36 bp, Artificial Sequence
  Synthetic oligonucleotide
tcagtggcactctgtcccccttccctcgcttagcta

SEQ ID NO: 182639 - DNA, 36 bp, Artificial Sequence
  Synthetic oligonucleotide
acaatcaccggctagcgtacaagcccgaccccgcta

SEQ ID NO: 182640 - DNA, 36 bp, Artificial Sequence
  Synthetic oligonucleotide
tcatagccccagccgcctcttcgtcttcgcattcta

SEQ ID NO: 182641 - DNA, 36 bp, Artificial Sequence
  Synthetic oligonucleotide
tctatcgccccccgcctggttatcaatgccctggta

SEQ ID NO: 182642 - DNA, 36 bp, Artificial Sequence
  Synthetic oligonucleotide
gaccgcacccttgcccctagcctgctcgctcttgta

SEQ ID NO: 182643 - DNA, 36 bp, Artificial Sequence
  Synthetic oligonucleotide
ttctacgcccttctgaggcctgttgcctgtacctta

SEQ ID NO: 182644 - DNA, 36 bp, Artificial Sequence
  Synthetic oligonucleotide
tcaagctccagtctccccggtcgtcgcaattcctta

SEQ ID NO: 182645 - DNA, 36 bp, Artificial Sequence
  Synthetic oligonucleotide
tccccaaccattccgatgaatgctctgacactctta

SEQ ID NO: 182646 - DNA, 35 bp, Artificial Sequence
  Synthetic oligonucleotide
gtcggagttctcccctctatagtccgggctaccac

SEQ ID NO: 182647 - DNA, 35 bp, Artificial Sequence
  Synthetic oligonucleotide
gcacatcaccgctcgccccctgtgcatagtaccac

SEQ ID NO: 182648 - DNA, 35 bp, Artificial Sequence
  Synthetic oligonucleotide
tcgcctccgccttcgcccttcgtgcgatctagcac

SEQ ID NO: 182649 - DNA, 35 bp, Artificial Sequence
  Synthetic oligonucleotide
tatcgcggaagagtgcccgcccccattgccatcac

SEQ ID NO: 182650 - DNA, 36 bp, Artificial Sequence
  Synthetic oligonucleotide
ttacccgccctctctcgcaggaccttgactttggac

SEQ ID NO: 182651 - DNA, 35 bp, Artificial Sequence
  Synthetic oligonucleotide
acacacacctcgtcccgcctggtcataccatctac

SEQ ID NO: 182652 - DNA, 35 bp, Artificial Sequence
  Synthetic oligonucleotide
tgttggccccaatccccttttcgtgccatcattac

SEQ ID NO: 182653 - DNA, 35 bp, Artificial Sequence
  Synthetic oligonucleotide
acacgatgctaccgcgagttcctatctgactttac

SEQ ID NO: 182654 - DNA, 35 bp, Artificial Sequence
  Synthetic oligonucleotide
tctgatctgacactcggcctatatgcgcatccacc

SEQ ID NO: 182655 - DNA, 35 bp, Artificial Sequence
  Synthetic oligonucleotide
gtatcacctcgaccaatcggatctgttctcgtacc

SEQ ID NO: 182656 - DNA, 35 bp, Artificial Sequence
  Synthetic oligonucleotide
ttagcaactccacatcggtctcgacgagctcaccc

SEQ ID NO: 182657 - DNA, 35 bp, Artificial Sequence
  Synthetic oligonucleotide
acccccctggtcgtcaccacattacgcgatcgccc

SEQ ID NO: 182658 - DNA, 35 bp, Artificial Sequence
  Synthetic oligonucleotide
tcacccctgatctccagttatttcgccattccgcc

SEQ ID NO: 182659 - DNA, 35 bp, Artificial Sequence
  Synthetic oligonucleotide
tacccatgtgacggttgaaacgtgtcccttccgcc

SEQ ID NO: 182660 - DNA, 35 bp, Artificial Sequence
  Synthetic oligonucleotide
tcgacctccccgtggtggctcattcccatcttgcc

SEQ ID NO: 182661 - DNA, 35 bp, Artificial Sequence
  Synthetic oligonucleotide
atatgcactgctcgcctggaccgccttcttactcc

SEQ ID NO: 182662 - DNA, 35 bp, Artificial Sequence
  Synthetic oligonucleotide
tagggccccgaacagtaggtcctggtttcttctcc

SEQ ID NO: 182663 - DNA, 35 bp, Artificial Sequence
  Synthetic oligonucleotide
gtcgcgcccaactcgtttctgactgtccgttctcc

SEQ ID NO: 182664 - DNA, 35 bp, Artificial Sequence
  Synthetic oligonucleotide
gcgttgtacctcctgctggattgccgattttctcc

SEQ ID NO: 182665 - DNA, 35 bp, Artificial Sequence
  Synthetic oligonucleotide
tgcatgtgtgtcgacgctgcttaacattgccttcc

SEQ ID NO: 182666 - DNA, 35 bp, Artificial Sequence
  Synthetic oligonucleotide
gcgctccttgctgatatggtttagccaccctttcc

SEQ ID NO: 182667 - DNA, 35 bp, Artificial Sequence
  Synthetic oligonucleotide
gagtaggccggccccgattcgcaacatccttcagc

SEQ ID NO: 182668 - DNA, 35 bp, Artificial Sequence
  Synthetic oligonucleotide
ggaaccagcccgtttatgcctctctttcttgtagc

SEQ ID NO: 182669 - DNA, 35 bp, Artificial Sequence
  Synthetic oligonucleotide
tatgccccattatgtctgccttgcgccccttacgc

SEQ ID NO: 182670 - DNA, 35 bp, Artificial Sequence
  Synthetic oligonucleotide
tacacccctcctttcgtatcctcgagccccaccgc

SEQ ID NO: 182671 - DNA, 35 bp, Artificial Sequence
  Synthetic oligonucleotide
acactggtcccgggtgctccgccctttacttatgc

SEQ ID NO: 182672 - DNA, 35 bp, Artificial Sequence
  Synthetic oligonucleotide
accgcgaaccgcttagctcggatacccctgccatc

SEQ ID NO: 182673 - DNA, 35 bp, Artificial Sequence
  Synthetic oligonucleotide
tgcccatccacatgtctctcgtgaacatcctcatc

SEQ ID NO: 182674 - DNA, 35 bp, Artificial Sequence
  Synthetic oligonucleotide
ttcccacttccgttacgtgcctcccccaagtcatc

SEQ ID NO: 182675 - DNA, 35 bp, Artificial Sequence
  Synthetic oligonucleotide
tcaccgccctctctagtatctttgctcctcggatc

SEQ ID NO: 182676 - DNA, 35 bp, Artificial Sequence
  Synthetic oligonucleotide
tcatcctcgcagccctctagctctcgttccatatc

SEQ ID NO: 182677 - DNA, 35 bp, Artificial Sequence
  Synthetic oligonucleotide
aatccacccattgctttcggaccgacttacaactc

SEQ ID NO: 182678 - DNA, 35 bp, Artificial Sequence
  Synthetic oligonucleotide
acgcctagccccttctgtcgtaacacttgccactc

SEQ ID NO: 182679 - DNA, 35 bp, Artificial Sequence
  Synthetic oligonucleotide
tatgccacaccttctgactaattagaggccccctc

SEQ ID NO: 182680 - DNA, 35 bp, Artificial Sequence
  Synthetic oligonucleotide
gcacgagcgaccgcctagcgtgaagcaccatcctc

SEQ ID NO: 182681 - DNA, 35 bp, Artificial Sequence
  Synthetic oligonucleotide
acgatcgcgtccattgcacctttaccagcgctgtc

SEQ ID NO: 182682 - DNA, 35 bp, Artificial Sequence
  Synthetic oligonucleotide
gctccctcaccggaacttcgccccctagtcccttc

SEQ ID NO: 182683 - DNA, 35 bp, Artificial Sequence
  Synthetic oligonucleotide
tccgtctccttaggcttcgtatgacccttccgttc

SEQ ID NO: 182684 - DNA, 35 bp, Artificial Sequence
  Synthetic oligonucleotide
gtacagcctactgctctcgcgtgcttacccgtttc

SEQ ID NO: 182685 - DNA, 35 bp, Artificial Sequence
  Synthetic oligonucleotide
gtgggcccccagttttctgccactgaattattttc

SEQ ID NO: 182686 - DNA, 35 bp, Artificial Sequence
  Synthetic oligonucleotide
gcttccgtatccgacccatctccgtgctacttttc

SEQ ID NO: 182687 - DNA, 35 bp, Artificial Sequence
  Synthetic oligonucleotide
gcaagaagtggagggaattaaccaggagggagaag

SEQ ID NO: 182688 - DNA, 35 bp, Artificial Sequence
  Synthetic oligonucleotide
gagggccggtaggggatcctgtggttaggggggag

SEQ ID NO: 182689 - DNA, 35 bp, Artificial Sequence
  Synthetic oligonucleotide
tacatcaactctggctgtgttcctagttcctctcg

SEQ ID NO: 182690 - DNA, 35 bp, Artificial Sequence
  Synthetic oligonucleotide
tcagattggcttccgctggttctcttacgctttcg

SEQ ID NO: 182691 - DNA, 35 bp, Artificial Sequence
  Synthetic oligonucleotide
gaaggggagataggtgtgcaggtggaaaacgtagg

SEQ ID NO: 182692 - DNA, 35 bp, Artificial Sequence
  Synthetic oligonucleotide
gagaagaggagaactctaggcgaaaggaggaacgg

SEQ ID NO: 182693 - DNA, 35 bp, Artificial Sequence
  Synthetic oligonucleotide
tgtaccatcccggcggcctgaccttagtcctaggg

SEQ ID NO: 182694 - DNA, 35 bp, Artificial Sequence
  Synthetic oligonucleotide
ccaaccatcgtccattctacctccgtcccccttgg

SEQ ID NO: 182695 - DNA, 35 bp, Artificial Sequence
  Synthetic oligonucleotide
tgcacccttcgtaacatctggtcgcctattgactg

SEQ ID NO: 182696 - DNA, 34 bp, Artificial Sequence
  Synthetic oligonucleotide
ttgccaatgcagtggctccgctttcccccacgtg

SEQ ID NO: 182697 - DNA, 35 bp, Artificial Sequence
  Synthetic oligonucleotide
gaagtcaccccactgcgcgcacctatcatacattg

SEQ ID NO: 182698 - DNA, 35 bp, Artificial Sequence
  Synthetic oligonucleotide
atcgcaccaacctcacggcacgtataattcgcttg

SEQ ID NO: 182699 - DNA, 35 bp, Artificial Sequence
  Synthetic oligonucleotide
tcctggtaacgtccgccttgtccccctattttttg

SEQ ID NO: 182700 - DNA, 35 bp, Artificial Sequence
  Synthetic oligonucleotide
taccagtccgcactaaactgtatgtcccatctcat

SEQ ID NO: 182701 - DNA, 35 bp, Artificial Sequence
  Synthetic oligonucleotide
gattgacatgtctcttccccctctgtgcctccgat

SEQ ID NO: 182702 - DNA, 35 bp, Artificial Sequence
  Synthetic oligonucleotide
tcacctccctgacgtttgctcgtgcgtatctcact

SEQ ID NO: 182703 - DNA, 35 bp, Artificial Sequence
  Synthetic oligonucleotide
aaagacaccgccgtcctcctggtatgtagccccct

SEQ ID NO: 182704 - DNA, 35 bp, Artificial Sequence
  Synthetic oligonucleotide
gcaggactagggagcggggggagggggtgagccct

SEQ ID NO: 182705 - DNA, 35 bp, Artificial Sequence
  Synthetic oligonucleotide
taagccctacctgcctccgcttatgtgtgttccct

SEQ ID NO: 182706 - DNA, 35 bp, Artificial Sequence
  Synthetic oligonucleotide
tgtcccccatttgtccggttctcgatctctagcct

SEQ ID NO: 182707 - DNA, 35 bp, Artificial Sequence
  Synthetic oligonucleotide
acttgcccccattccgctcccgtaacgctacgcct

SEQ ID NO: 182708 - DNA, 35 bp, Artificial Sequence
  Synthetic oligonucleotide
atgcgttggtcgactattcgtgcacttcctcgcct

SEQ ID NO: 182709 - DNA, 35 bp, Artificial Sequence
  Synthetic oligonucleotide
acatgacgcccgtttagcttaccgcgcttactcct

SEQ ID NO: 182710 - DNA, 35 bp, Artificial Sequence
  Synthetic oligonucleotide
gtctctcgcagaaccctatctccatcgtttctcct

SEQ ID NO: 182711 - DNA, 35 bp, Artificial Sequence
  Synthetic oligonucleotide
tgcaccgtactgccactggacacccccaatatgct

SEQ ID NO: 182712 - DNA, 35 bp, Artificial Sequence
  Synthetic oligonucleotide
ttaacaccccgcgcacgttgaatactccgctatct

SEQ ID NO: 182713 - DNA, 35 bp, Artificial Sequence
  Synthetic oligonucleotide
gatcatccagcatagtcctcacacacacaccccgt

SEQ ID NO: 182714 - DNA, 35 bp, Artificial Sequence
  Synthetic oligonucleotide
ttgttcctaccgccgccgcctgcctacgccttggt

SEQ ID NO: 182715 - DNA, 35 bp, Artificial Sequence
  Synthetic oligonucleotide
gaaagaggaatgggtgggggggatggtgctaatgt

SEQ ID NO: 182716 - DNA, 35 bp, Artificial Sequence
  Synthetic oligonucleotide
gagtcgccgcacgctcttacatccctgccccctgt

SEQ ID NO: 182717 - DNA, 35 bp, Artificial Sequence
  Synthetic oligonucleotide
gagggggaccacggggatttaaggggcggacaatt

SEQ ID NO: 182718 - DNA, 35 bp, Artificial Sequence
  Synthetic oligonucleotide
gacatcctaccacccgctccagccgaattcgtatt

SEQ ID NO: 182719 - DNA, 35 bp, Artificial Sequence
  Synthetic oligonucleotide
actgggacgcgccccgctctatccatcctgttatt

SEQ ID NO: 182720 - DNA, 36 bp, Artificial Sequence
  Synthetic oligonucleotide
gccggggaaaagggaaagagaggtgtgcagtcgaaa

SEQ ID NO: 182721 - DNA, 35 bp, Artificial Sequence
  Synthetic oligonucleotide
gcccagccacgcacattttggttcctgttctgcaa

SEQ ID NO: 182722 - DNA, 36 bp, Artificial Sequence
  Synthetic oligonucleotide
aaagatgcaagtggtgggaaaggatagggtagagaa

SEQ ID NO: 182723 - DNA, 36 bp, Artificial Sequence
  Synthetic oligonucleotide
gtcgcaccctggcccgtgtccgcccctcgacatgaa

SEQ ID NO: 182724 - DNA, 35 bp, Artificial Sequence
  Synthetic oligonucleotide
gccaacaccttttcccctgcaatgtatctgttgaa

SEQ ID NO: 182725 - DNA, 36 bp, Artificial Sequence
  Synthetic oligonucleotide
acctccccacggtcatgtgcccttcgtgcgccataa

SEQ ID NO: 182726 - DNA, 36 bp, Artificial Sequence
  Synthetic oligonucleotide
tcatcgtcaacccgtgcccctcgttgtaacacctaa

SEQ ID NO: 182727 - DNA, 35 bp, Artificial Sequence
  Synthetic oligonucleotide
gccgtattctccatcattaccgccagtatacctaa

SEQ ID NO: 182728 - DNA, 36 bp, Artificial Sequence
  Synthetic oligonucleotide
ttcaccgctactttgcacacggtcattcttacctaa

SEQ ID NO: 182729 - DNA, 36 bp, Artificial Sequence
  Synthetic oligonucleotide
aacgagtgggagcaggttggaggggagtgagtgtaa

SEQ ID NO: 182730 - DNA, 36 bp, Artificial Sequence
  Synthetic oligonucleotide
gcaacgcatccgctgcaccttcattcgccgtacaca

SEQ ID NO: 182731 - DNA, 35 bp, Artificial Sequence
  Synthetic oligonucleotide
acatcctcttccgccgtcagactaatcgccgcaca

SEQ ID NO: 182732 - DNA, 36 bp, Artificial Sequence
  Synthetic oligonucleotide
gtgcacgtccaccctatgccttacggtcactgcaca

SEQ ID NO: 182733 - DNA, 36 bp, Artificial Sequence
  Synthetic oligonucleotide
gggtgggaggtggagggcgttagagtagcacagaca

SEQ ID NO: 182734 - DNA, 36 bp, Artificial Sequence
  Synthetic oligonucleotide
gtgaaggggaagggtggaggacatgatagcggacca

SEQ ID NO: 182735 - DNA, 36 bp, Artificial Sequence
  Synthetic oligonucleotide
tacgcgcacactgcttccgtcgaatttatccaccca

SEQ ID NO: 182736 - DNA, 35 bp, Artificial Sequence
  Synthetic oligonucleotide
tccgtcccccatcccgctgtgtacgtgatgtccca

SEQ ID NO: 182737 - DNA, 36 bp, Artificial Sequence
  Synthetic oligonucleotide
atgactatcgccccctgcgcctttaccttgtatcca

SEQ ID NO: 182738 - DNA, 36 bp, Artificial Sequence
  Synthetic oligonucleotide
gttgatcgcccacctgtcccttaggggtcacctcca

SEQ ID NO: 182739 - DNA, 36 bp, Artificial Sequence
  Synthetic oligonucleotide
gactctggtcagtgtccacatcttccttcccgtcca

SEQ ID NO: 182740 - DNA, 35 bp, Artificial Sequence
  Synthetic oligonucleotide
gtaacaccccaccgcctttgccaccgtgcgacgca

SEQ ID NO: 182741 - DNA, 36 bp, Artificial Sequence
  Synthetic oligonucleotide
tcaggggcgggcgggatggttcgtggggatttggca

SEQ ID NO: 182742 - DNA, 36 bp, Artificial Sequence
  Synthetic oligonucleotide
gccgcttcgccctccctgatacaccctactgtctca

SEQ ID NO: 182743 - DNA, 36 bp, Artificial Sequence
  Synthetic oligonucleotide
atgcgcctaccattgctgcctggtcctaactgttca

SEQ ID NO: 182744 - DNA, 35 bp, Artificial Sequence
  Synthetic oligonucleotide
gccgacccctgcgccctaccggattttgcctttca

SEQ ID NO: 182745 - DNA, 37 bp, Artificial Sequence
  Synthetic oligonucleotide
ggttgaggtgcgggctggacaagggggggtgaggaga

SEQ ID NO: 182746 - DNA, 37 bp, Artificial Sequence
  Synthetic oligonucleotide
gatcgagaaggggaggaaggcgggcctgtggcggaga

SEQ ID NO: 182747 - DNA, 37 bp, Artificial Sequence
  Synthetic oligonucleotide
gtggatacgggcggagtacgtgaagggggtggggaga

SEQ ID NO: 182748 - DNA, 37 bp, Artificial Sequence
  Synthetic oligonucleotide
acgacctgcctttggttccactccctgtcctgttaga

SEQ ID NO: 182749 - DNA, 37 bp, Artificial Sequence
  Synthetic oligonucleotide
gaaaggtggaacgggcgggagaatatagaggaaacga

SEQ ID NO: 182750 - DNA, 37 bp, Artificial Sequence
  Synthetic oligonucleotide
ggttgccccccccgtcctgccggtctttcgtaaacga

SEQ ID NO: 182751 - DNA, 36 bp, Artificial Sequence
  Synthetic oligonucleotide
gaagcctgcccccgatacctacccctcctttaacga

SEQ ID NO: 182752 - DNA, 38 bp, Artificial Sequence
  Synthetic oligonucleotide
tgtaccgccttcctgttcccttccctgtggtgagacga

SEQ ID NO: 182753 - DNA, 37 bp, Artificial Sequence
  Synthetic oligonucleotide
gtcacgagcccacctgcccttgtcgttgtcccgacga

SEQ ID NO: 182754 - DNA, 37 bp, Artificial Sequence
  Synthetic oligonucleotide
tgacacccactcgattctctattcctgctgcctacga

SEQ ID NO: 182755 - DNA, 37 bp, Artificial Sequence
  Synthetic oligonucleotide
gcttaccgccacttgttagttcactactcacccccga

SEQ ID NO: 182756 - DNA, 37 bp, Artificial Sequence
  Synthetic oligonucleotide
aacaggtccactaactgcgtgacgctccttctcccga

SEQ ID NO: 182757 - DNA, 37 bp, Artificial Sequence
  Synthetic oligonucleotide
accgggcatccaggccgatttggtgctccctctccga

SEQ ID NO: 182758 - DNA, 37 bp, Artificial Sequence
  Synthetic oligonucleotide
gtgcgcacaatctgttctacgctgcccccgtttccga

SEQ ID NO: 182759 - DNA, 35 bp, Artificial Sequence
  Synthetic oligonucleotide
accaacatcctgtcactgtgctccctctctatcga

SEQ ID NO: 182760 - DNA, 37 bp, Artificial Sequence
  Synthetic oligonucleotide
tgcatggccactctgtccatacgtttttttccctcga

SEQ ID NO: 182761 - DNA, 37 bp, Artificial Sequence
  Synthetic oligonucleotide
tggacatgttcccatcgcatacactgcacttcctcga

SEQ ID NO: 182762 - DNA, 37 bp, Artificial Sequence
  Synthetic oligonucleotide
tacatcatcgctctcgggtcttttctacctctttcga

SEQ ID NO: 182763 - DNA, 37 bp, Artificial Sequence
  Synthetic oligonucleotide
aggggacaggggaggaacaacgggtaggtcgggagga

SEQ ID NO: 182764 - DNA, 37 bp, Artificial Sequence
  Synthetic oligonucleotide
tctcccgcccccccttgttcttagagaaacgtgagga

SEQ ID NO: 182765 - DNA, 37 bp, Artificial Sequence
  Synthetic oligonucleotide
gacggtcacccctctgctctcgctacacagtcgcgga

SEQ ID NO: 182766 - DNA, 37 bp, Artificial Sequence
  Synthetic oligonucleotide
gcagagagaaggggtgggggatttaactggcgaggga

SEQ ID NO: 182767 - DNA, 37 bp, Artificial Sequence
  Synthetic oligonucleotide
atgggtgggagggttgcgagctgtaatccttagggga

SEQ ID NO: 182768 - DNA, 37 bp, Artificial Sequence
  Synthetic oligonucleotide
gactgagccgatagtgagggcaatagggcgggtggga

SEQ ID NO: 182769 - DNA, 37 bp, Artificial Sequence
  Synthetic oligonucleotide
gaccaaagtcctcaggagcactcccccccccgctgga

SEQ ID NO: 182770 - DNA, 37 bp, Artificial Sequence
  Synthetic oligonucleotide
gacgcaaaggggcggaggtcgtagaccgtggggtgga

SEQ ID NO: 182771 - DNA, 37 bp, Artificial Sequence
  Synthetic oligonucleotide
gacgccaacctcgccaaaatgtctctctccgccatga

SEQ ID NO: 182772 - DNA, 38 bp, Artificial Sequence
  Synthetic oligonucleotide
gaaatgcgccctctgcgacccctcctgcctttatatga

SEQ ID NO: 182773 - DNA, 38 bp, Artificial Sequence
  Synthetic oligonucleotide
tagaccgcggagagggtgggctagggtgggtagactga

SEQ ID NO: 182774 - DNA, 38 bp, Artificial Sequence
  Synthetic oligonucleotide
tgccgaacgcactctgaataccgaccaccgtgccctga

SEQ ID NO: 182775 - DNA, 38 bp, Artificial Sequence
  Synthetic oligonucleotide
gggtccacagtcaaattccccataacgcccttccctga

SEQ ID NO: 182776 - DNA, 38 bp, Artificial Sequence
  Synthetic oligonucleotide
gccgccctccatgaacctgcttactgtctttgtcctga

SEQ ID NO: 182777 - DNA, 38 bp, Artificial Sequence
  Synthetic oligonucleotide
tcagaccgtaagagtggtcgtcgccgtccccttcctga

SEQ ID NO: 182778 - DNA, 35 bp, Artificial Sequence
  Synthetic oligonucleotide
ggactgtgaagtgtacccgccccctcttacgctga

SEQ ID NO: 182779 - DNA, 37 bp, Artificial Sequence
  Synthetic oligonucleotide
agctgtggggtgactggggggggacgtggcggagtga

SEQ ID NO: 182780 - DNA, 38 bp, Artificial Sequence
  Synthetic oligonucleotide
tccaccaccgccgacctccacactgaactgtcacgtga

SEQ ID NO: 182781 - DNA, 36 bp, Artificial Sequence
  Synthetic oligonucleotide
aacccacgcacctgccctacctgatcctcccggtga

SEQ ID NO: 182782 - DNA, 34 bp, Artificial Sequence
  Synthetic oligonucleotide
tgttcactcgctcattccacactcgccatattga

SEQ ID NO: 182783 - DNA, 38 bp, Artificial Sequence
  Synthetic oligonucleotide
aactgcccgccgctttccgtctcgtgacactttattga

SEQ ID NO: 182784 - DNA, 37 bp, Artificial Sequence
  Synthetic oligonucleotide
tacccatcgccggtatgcgtcttttccgcggccttga

SEQ ID NO: 182785 - DNA, 38 bp, Artificial Sequence
  Synthetic oligonucleotide
atcccctgtcccgaatctgatctcatgacccttgttga

SEQ ID NO: 182786 - DNA, 38 bp, Artificial Sequence
  Synthetic oligonucleotide
accccctgacctgccccaggacggtcaatgtactttga

SEQ ID NO: 182787 - DNA, 38 bp, Artificial Sequence
  Synthetic oligonucleotide
acagcctgcgcagtagccttgcttcgtccctcctttga

SEQ ID NO: 182788 - DNA, 38 bp, Artificial Sequence
  Synthetic oligonucleotide
gcacaggagggggtgagaaaggaaagtggagcgtttga

SEQ ID NO: 182789 - DNA, 35 bp, Artificial Sequence
  Synthetic oligonucleotide
tacacacatcactatgctgcccatcgaggccacta

SEQ ID NO: 182790 - DNA, 36 bp, Artificial Sequence
  Synthetic oligonucleotide
gtgtcgcccctgcctcgtttacgatttctgtcccta

SEQ ID NO: 182791 - DNA, 35 bp, Artificial Sequence
  Synthetic oligonucleotide
gtcacccacaatttctgttttgctcccggttccta

SEQ ID NO: 182792 - DNA, 36 bp, Artificial Sequence
  Synthetic oligonucleotide
agttcgccgtctgttacactgccctcgctctctcta

SEQ ID NO: 182793 - DNA, 35 bp, Artificial Sequence
  Synthetic oligonucleotide
tgcaccgatctctgcccaagcccctgcctattcta

SEQ ID NO: 182794 - DNA, 35 bp, Artificial Sequence
  Synthetic oligonucleotide
acaccctccctccctggcataggtacaccttcgta

SEQ ID NO: 182795 - DNA, 36 bp, Artificial Sequence
  Synthetic oligonucleotide
aactgctggaaagagggggtgggaaggagtcgggta

SEQ ID NO: 182796 - DNA, 36 bp, Artificial Sequence
  Synthetic oligonucleotide
gcactcttccaggttcttgtccttcgtgccgcctta

SEQ ID NO: 182797 - DNA, 36 bp, Artificial Sequence
  Synthetic oligonucleotide
ttccacatccggtcctcatgcactcgttgcgattta

SEQ ID NO: 182798 - DNA, 36 bp, Artificial Sequence
  Synthetic oligonucleotide
tcccatgtccggttcgcctgtgctttctcccgttta

SEQ ID NO: 182799 - DNA, 35 bp, Artificial Sequence
  Synthetic oligonucleotide
actgaccccgtgatccacctcactcacggctccac

SEQ ID NO: 182800 - DNA, 35 bp, Artificial Sequence
  Synthetic oligonucleotide
acgatctcgttcgccctaagtacccccgaccatac

SEQ ID NO: 182801 - DNA, 35 bp, Artificial Sequence
  Synthetic oligonucleotide
tagcagatcgccaccgcccttgatatgccctctac

SEQ ID NO: 182802 - DNA, 35 bp, Artificial Sequence
  Synthetic oligonucleotide
acacgcactcattcggaagaagttccttgcccacc

SEQ ID NO: 182803 - DNA, 35 bp, Artificial Sequence
  Synthetic oligonucleotide
tgatcacttacgcaccgccacatcctgacctcacc

SEQ ID NO: 182804 - DNA, 35 bp, Artificial Sequence
  Synthetic oligonucleotide
atcaccgctatgatataacgtaaccttgccctacc

SEQ ID NO: 182805 - DNA, 35 bp, Artificial Sequence
  Synthetic oligonucleotide
ggatgagcgagccgtgccatttccccactacaccc

SEQ ID NO: 182806 - DNA, 34 bp, Artificial Sequence
  Synthetic oligonucleotide
tcatcactccgcccaacgggctccaccaggcccc

SEQ ID NO: 182807 - DNA, 35 bp, Artificial Sequence
  Synthetic oligonucleotide
atcatgcactcgggtgtgctaaccttcctgtcccc

SEQ ID NO: 182808 - DNA, 35 bp, Artificial Sequence
  Synthetic oligonucleotide
tcaatccggatctaccatgcagaggcctccctccc

SEQ ID NO: 182809 - DNA, 35 bp, Artificial Sequence
  Synthetic oligonucleotide
ttagttgcgcagtctagacaccactccgtcctccc

SEQ ID NO: 182810 - DNA, 35 bp, Artificial Sequence
  Synthetic oligonucleotide
caatcaagaccgccccaatgcttcgtacgactgcc

SEQ ID NO: 182811 - DNA, 35 bp, Artificial Sequence
  Synthetic oligonucleotide
ttgaacgcgcctcatattcccgactgatctttgcc

SEQ ID NO: 182812 - DNA, 35 bp, Artificial Sequence
  Synthetic oligonucleotide
ggtgacccggcgcttttccgtgcctattaacctcc

SEQ ID NO: 182813 - DNA, 35 bp, Artificial Sequence
  Synthetic oligonucleotide
accacgctaccgtattttctagcgtacgcccctcc

SEQ ID NO: 182814 - DNA, 35 bp, Artificial Sequence
  Synthetic oligonucleotide
gactaggcaaaaaggtacaccgacaccctccttcc

SEQ ID NO: 182815 - DNA, 35 bp, Artificial Sequence
  Synthetic oligonucleotide
aattcccgcggctacactatgttcttggcctttcc

SEQ ID NO: 182816 - DNA, 35 bp, Artificial Sequence
  Synthetic oligonucleotide
agcacctcgcagccttcgcatacgctccattttcc

SEQ ID NO: 182817 - DNA, 35 bp, Artificial Sequence
  Synthetic oligonucleotide
gcactcaacatcgcacgctccgacctattcctagc

SEQ ID NO: 182818 - DNA, 36 bp, Artificial Sequence
  Synthetic oligonucleotide
acccgtgacccgcccctgctctgcccaggctcccgc

SEQ ID NO: 182819 - DNA, 35 bp, Artificial Sequence
  Synthetic oligonucleotide
tgccaatctggtccctctaatccggacatttccgc

SEQ ID NO: 182820 - DNA, 35 bp, Artificial Sequence
  Synthetic oligonucleotide
ttcgcatcaatccactgctcgatatcctcgctcgc

SEQ ID NO: 182821 - DNA, 35 bp, Artificial Sequence
  Synthetic oligonucleotide
tcgttccatcacaccgtctctacgccattcccggc

SEQ ID NO: 182822 - DNA, 35 bp, Artificial Sequence
  Synthetic oligonucleotide
atacgcctccaattatatactgtctccctccatgc

SEQ ID NO: 182823 - DNA, 35 bp, Artificial Sequence
  Synthetic oligonucleotide
atccaccgtatttccgtttttgtcatgccatatgc

SEQ ID NO: 182824 - DNA, 35 bp, Artificial Sequence
  Synthetic oligonucleotide
gacccgcaaggcgttgctcaaccatacctcactgc

SEQ ID NO: 182825 - DNA, 35 bp, Artificial Sequence
  Synthetic oligonucleotide
gcacaccactaccccgactgcattcgtttgtctgc

SEQ ID NO: 182826 - DNA, 35 bp, Artificial Sequence
  Synthetic oligonucleotide
tggggccgacccctctgccattgtgccagttctgc

SEQ ID NO: 182827 - DNA, 35 bp, Artificial Sequence
  Synthetic oligonucleotide
tccatgcctcgctactttatgcattgaaaaccatc

SEQ ID NO: 182828 - DNA, 35 bp, Artificial Sequence
  Synthetic oligonucleotide
gtaggtccagttccatcgtattccactcgctcatc

SEQ ID NO: 182829 - DNA, 35 bp, Artificial Sequence
  Synthetic oligonucleotide
tccgcctatacctttacgccgttccgtgacctatc

SEQ ID NO: 182830 - DNA, 35 bp, Artificial Sequence
  Synthetic oligonucleotide
tcctccgcgacctaattgatcttcagcggtctatc

SEQ ID NO: 182831 - DNA, 35 bp, Artificial Sequence
  Synthetic oligonucleotide
gccacccgccagaggatgtccgcgtgggccccctc

SEQ ID NO: 182832 - DNA, 35 bp, Artificial Sequence
  Synthetic oligonucleotide
taccacatgtggaccggttgatattttgcgccctc

SEQ ID NO: 182833 - DNA, 35 bp, Artificial Sequence
  Synthetic oligonucleotide
gtgccccggacggtacggggtttacgcttttcctc

SEQ ID NO: 182834 - DNA, 35 bp, Artificial Sequence
  Synthetic oligonucleotide
tcgcccccgcaacagccatctgccacatctagctc

SEQ ID NO: 182835 - DNA, 35 bp, Artificial Sequence
  Synthetic oligonucleotide
taccaaatgctccacatcgacgatgctccccgctc

SEQ ID NO: 182836 - DNA, 35 bp, Artificial Sequence
  Synthetic oligonucleotide
gtcggagtcaccgtccgtgccgttcgtgtccgctc

SEQ ID NO: 182837 - DNA, 35 bp, Artificial Sequence
  Synthetic oligonucleotide
ttgtagccacatatctctatcatcctcgctggctc

SEQ ID NO: 182838 - DNA, 35 bp, Artificial Sequence
  Synthetic oligonucleotide
acaccgagctaaccagactcgctactatccctctc

SEQ ID NO: 182839 - DNA, 35 bp, Artificial Sequence
  Synthetic oligonucleotide
tcccgcgtttcactgcctagggccatcttcccgtc

SEQ ID NO: 182840 - DNA, 35 bp, Artificial Sequence
  Synthetic oligonucleotide
tcctgcccttgaagttcacgcgtacctcccctgtc

SEQ ID NO: 182841 - DNA, 35 bp, Artificial Sequence
  Synthetic oligonucleotide
tttacccacgcttcgacctgtttttgcacctattc

SEQ ID NO: 182842 - DNA, 35 bp, Artificial Sequence
  Synthetic oligonucleotide
tgtgtagctcaccactttcattgattgcacccttc

SEQ ID NO: 182843 - DNA, 35 bp, Artificial Sequence
  Synthetic oligonucleotide
atccgcccacgctttgcggaacaccttttggcttc

SEQ ID NO: 182844 - DNA, 35 bp, Artificial Sequence
  Synthetic oligonucleotide
acacctgtcccaggtactccagactcttaccgttc

SEQ ID NO: 182845 - DNA, 35 bp, Artificial Sequence
  Synthetic oligonucleotide
atccgaggtcctcctcagccctgttttcgtttttc

SEQ ID NO: 182846 - DNA, 35 bp, Artificial Sequence
  Synthetic oligonucleotide
tagaggaggggggggggatagggtcggttggatag

SEQ ID NO: 182847 - DNA, 35 bp, Artificial Sequence
  Synthetic oligonucleotide
attgagcccgcccctgacgatactctcccgcctag

SEQ ID NO: 182848 - DNA, 35 bp, Artificial Sequence
  Synthetic oligonucleotide
gacgcccctcatttctgtcctgcctgccctgtacg

SEQ ID NO: 182849 - DNA, 35 bp, Artificial Sequence
  Synthetic oligonucleotide
tccggcgatagcccccgcacttctacgctcccccg

SEQ ID NO: 182850 - DNA, 35 bp, Artificial Sequence
  Synthetic oligonucleotide
tcaaggcagagccccaacatctatcgcctgtcccg

SEQ ID NO: 182851 - DNA, 34 bp, Artificial Sequence
  Synthetic oligonucleotide
gtgatccgcgctaccgttcatggccaatttcccg

SEQ ID NO: 182852 - DNA, 35 bp, Artificial Sequence
  Synthetic oligonucleotide
acgagccgtgtcccgtcgtcctggtcttctcgtcg

SEQ ID NO: 182853 - DNA, 35 bp, Artificial Sequence
  Synthetic oligonucleotide
gacatgggtactgggggggcatgggttagagttcg

SEQ ID NO: 182854 - DNA, 35 bp, Artificial Sequence
  Synthetic oligonucleotide
gaagtggtggcacgaggaccgaggtagtaaggggg

SEQ ID NO: 182855 - DNA, 35 bp, Artificial Sequence
  Synthetic oligonucleotide
gaggaggtttcgagcaatggggacgggatcggggg

SEQ ID NO: 182856 - DNA, 35 bp, Artificial Sequence
  Synthetic oligonucleotide
tgagccactgtgttcccgccctccattcgagtatg

SEQ ID NO: 182857 - DNA, 35 bp, Artificial Sequence
  Synthetic oligonucleotide
gcgcttcctgtccgctagaaccatcctattacctg

SEQ ID NO: 182858 - DNA, 35 bp, Artificial Sequence
  Synthetic oligonucleotide
tgccccccccctgctagaatgagacaacggtagtg

SEQ ID NO: 182859 - DNA, 35 bp, Artificial Sequence
  Synthetic oligonucleotide
tgtgggtgggagggtgccaggggcgatgattagtg

SEQ ID NO: 182860 - DNA, 35 bp, Artificial Sequence
  Synthetic oligonucleotide
gcaactcagactatgtcagtccgcttcttcaccat

SEQ ID NO: 182861 - DNA, 35 bp, Artificial Sequence
  Synthetic oligonucleotide
gctcacgcatctctcctcgcggttccttggtccat

SEQ ID NO: 182862 - DNA, 35 bp, Artificial Sequence
  Synthetic oligonucleotide
tgttcatgttcctggtctagttccatcattctcat

SEQ ID NO: 182863 - DNA, 35 bp, Artificial Sequence
  Synthetic oligonucleotide
gtgccccccttgcccgtctctcctccgctttggat

SEQ ID NO: 182864 - DNA, 35 bp, Artificial Sequence
  Synthetic oligonucleotide
agggagacgtatctgtcgtcctgtcttgtcccact

SEQ ID NO: 182865 - DNA, 35 bp, Artificial Sequence
  Synthetic oligonucleotide
agcccggcctgacgggttacgttccccttgccact

SEQ ID NO: 182866 - DNA, 35 bp, Artificial Sequence
  Synthetic oligonucleotide
tagacgccaccgccccatactatcttcgtgggcct

SEQ ID NO: 182867 - DNA, 35 bp, Artificial Sequence
  Synthetic oligonucleotide
gcctgacctgcccaggtttcactaagtttcttcct

SEQ ID NO: 182868 - DNA, 34 bp, Artificial Sequence
  Synthetic oligonucleotide
tatcaccaggcacagtaccgacctactcttcgct

SEQ ID NO: 182869 - DNA, 35 bp, Artificial Sequence
  Synthetic oligonucleotide
tcctacccatcgaattccgtacatgcacacgggct

SEQ ID NO: 182870 - DNA, 35 bp, Artificial Sequence
  Synthetic oligonucleotide
ttacagacctccctctcaccgtgtttcgccctgct

SEQ ID NO: 182871 - DNA, 35 bp, Artificial Sequence
  Synthetic oligonucleotide
acaacctgcgcctgcttagccccgaacctggatct

SEQ ID NO: 182872 - DNA, 35 bp, Artificial Sequence
  Synthetic oligonucleotide
acaccccctgccagttttcgagtacattcttatct

SEQ ID NO: 182873 - DNA, 35 bp, Artificial Sequence
  Synthetic oligonucleotide
gatcttgcggcacccgctcattcattgtcatctct

SEQ ID NO: 182874 - DNA, 35 bp, Artificial Sequence
  Synthetic oligonucleotide
gttcgtacagtcgcgatacttgtgagcccctctct

SEQ ID NO: 182875 - DNA, 35 bp, Artificial Sequence
  Synthetic oligonucleotide
aaacgcgcccgatagatctctctcacaccgcttct

SEQ ID NO: 182876 - DNA, 35 bp, Artificial Sequence
  Synthetic oligonucleotide
gcctagtagggaggggggggaaaagtaccagtggt

SEQ ID NO: 182877 - DNA, 35 bp, Artificial Sequence
  Synthetic oligonucleotide
acgccccttctgcttccaccacgtccttgtaatgt

SEQ ID NO: 182878 - DNA, 36 bp, Artificial Sequence
  Synthetic oligonucleotide
tgctccaccctctcaggctagcctcctgtcctttgt

SEQ ID NO: 182879 - DNA, 35 bp, Artificial Sequence
  Synthetic oligonucleotide
gccatgtactttaacaccgccgcctgttgctcatt

SEQ ID NO: 182880 - DNA, 35 bp, Artificial Sequence
  Synthetic oligonucleotide
atcgccacccgtctgggctcctcctggcaactatt

SEQ ID NO: 182881 - DNA, 35 bp, Artificial Sequence
  Synthetic oligonucleotide
tgcatcccctttgcttgtccctttgattcatgctt

SEQ ID NO: 182882 - DNA, 35 bp, Artificial Sequence
  Synthetic oligonucleotide
ttcatcatgctcacagccctcttcgtccccgcgtt

SEQ ID NO: 182883 - DNA, 35 bp, Artificial Sequence
  Synthetic oligonucleotide
tccgtccttgtgtccgcttgccctcgtactcattt

SEQ ID NO: 182884 - DNA, 35 bp, Artificial Sequence
  Synthetic oligonucleotide
ggtcagggaccacggtttcgccctcttttacgttt

SEQ ID NO: 182885 - DNA, 36 bp, Artificial Sequence
  Synthetic oligonucleotide
atccgaccatggctgattcaccctttcgtacttgaa

SEQ ID NO: 182886 - DNA, 36 bp, Artificial Sequence
  Synthetic oligonucleotide
ttcgcatcggggtgggggggtccgggtctggaataa

SEQ ID NO: 182887 - DNA, 36 bp, Artificial Sequence
  Synthetic oligonucleotide
acctgacgctttgagtttgccacacccgccgtttaa

SEQ ID NO: 182888 - DNA, 35 bp, Artificial Sequence
  Synthetic oligonucleotide
tcctgtcacctgatcccccgccctccttttccaca

SEQ ID NO: 182889 - DNA, 35 bp, Artificial Sequence
  Synthetic oligonucleotide
gactcctcccgctagtatgactcctgttttttaca

SEQ ID NO: 182890 - DNA, 36 bp, Artificial Sequence
  Synthetic oligonucleotide
tctcgctcccccatgaacatacaccagtcgggacca

SEQ ID NO: 182891 - DNA, 35 bp, Artificial Sequence
  Synthetic oligonucleotide
ttgtgccggcacccccctaccgccgtcttggacca

SEQ ID NO: 182892 - DNA, 35 bp, Artificial Sequence
  Synthetic oligonucleotide
gcacccggttggtttacctttcgactgccctacca

SEQ ID NO: 182893 - DNA, 36 bp, Artificial Sequence
  Synthetic oligonucleotide
gtccactcctatcatatcattctcgtgtgtttacca

SEQ ID NO: 182894 - DNA, 35 bp, Artificial Sequence
  Synthetic oligonucleotide
gatacgtccttcatagtcttttaccctggcttcca

SEQ ID NO: 182895 - DNA, 35 bp, Artificial Sequence
  Synthetic oligonucleotide
gcacgcgccatctcactcctgggtctgttgttcca

SEQ ID NO: 182896 - DNA, 36 bp, Artificial Sequence
  Synthetic oligonucleotide
atccgtccatactccgcctgtttcagactccacgca

SEQ ID NO: 182897 - DNA, 36 bp, Artificial Sequence
  Synthetic oligonucleotide
ataggcccccaggctgctcactcccccccgcccgca

SEQ ID NO: 182898 - DNA, 36 bp, Artificial Sequence
  Synthetic oligonucleotide
tcccgcctcgaaccaatgcgctatctgccgtgatca

SEQ ID NO: 182899 - DNA, 35 bp, Artificial Sequence
  Synthetic oligonucleotide
tgtgacgtcgatactgggaccccttcgccacctca

SEQ ID NO: 182900 - DNA, 36 bp, Artificial Sequence
  Synthetic oligonucleotide
ttgtgctaaccgccggcatacccagtgctctagtca

SEQ ID NO: 182901 - DNA, 35 bp, Artificial Sequence
  Synthetic oligonucleotide
gttgtccccccgccgccgtgcaatcgttgctttca

SEQ ID NO: 182902 - DNA, 35 bp, Artificial Sequence
  Synthetic oligonucleotide
accactaccccttcacattgtaaacgtttcccaga

SEQ ID NO: 182903 - DNA, 37 bp, Artificial Sequence
  Synthetic oligonucleotide
gactgcctccgacccgtgaattacctccttgtccaga

SEQ ID NO: 182904 - DNA, 37 bp, Artificial Sequence
  Synthetic oligonucleotide
aagcagggatacggggataagtagaggggagggcaga

SEQ ID NO: 182905 - DNA, 37 bp, Artificial Sequence
  Synthetic oligonucleotide
aaagaggatggggggacggacctggcaaagtaagaga

SEQ ID NO: 182906 - DNA, 37 bp, Artificial Sequence
  Synthetic oligonucleotide
gcagatggacggggtggtaggtttacggcgaaggaga

SEQ ID NO: 182907 - DNA, 37 bp, Artificial Sequence
  Synthetic oligonucleotide
ggtgaaggggagtatggcggggtaggcggagattaga

SEQ ID NO: 182908 - DNA, 35 bp, Artificial Sequence
  Synthetic oligonucleotide
tatgcgaagaggtaatagagggcgggatgggacga

SEQ ID NO: 182909 - DNA, 36 bp, Artificial Sequence
  Synthetic oligonucleotide
acccatcctgccattactactacgttgctgccccga

SEQ ID NO: 182910 - DNA, 37 bp, Artificial Sequence
  Synthetic oligonucleotide
gtgaatcccgcatccgtataaaaccttgccctcccga

SEQ ID NO: 182911 - DNA, 37 bp, Artificial Sequence
  Synthetic oligonucleotide
gctgtccatgtcgaattgatccaccccgtccctccga

SEQ ID NO: 182912 - DNA, 37 bp, Artificial Sequence
  Synthetic oligonucleotide
ggatggggtcggggtaaggggtgaaagtgttgcgcga

SEQ ID NO: 182913 - DNA, 37 bp, Artificial Sequence
  Synthetic oligonucleotide
gaagggccgtcggtgtaggtgggaggtggaaaggcga

SEQ ID NO: 182914 - DNA, 37 bp, Artificial Sequence
  Synthetic oligonucleotide
cccacggtcactcttggcacacccgctccctattcga

SEQ ID NO: 182915 - DNA, 37 bp, Artificial Sequence
  Synthetic oligonucleotide
gcagaccaatgtttctgcgttccacctcccagttcga

SEQ ID NO: 182916 - DNA, 37 bp, Artificial Sequence
  Synthetic oligonucleotide
tcaggggtgggatggggcgaagatgggctgtgcagga

SEQ ID NO: 182917 - DNA, 35 bp, Artificial Sequence
  Synthetic oligonucleotide
tagtcggtgcgaagggggagaaaaaaatgggagga

SEQ ID NO: 182918 - DNA, 37 bp, Artificial Sequence
  Synthetic oligonucleotide
gaagggcttcgggtggggaagggaagactagaccgga

SEQ ID NO: 182919 - DNA, 37 bp, Artificial Sequence
  Synthetic oligonucleotide
ggacgccgtcctactctcgctcctccgttccagcgga

SEQ ID NO: 182920 - DNA, 37 bp, Artificial Sequence
  Synthetic oligonucleotide
atgcacacaggtgtccccgcctcgatctatcctcgga

SEQ ID NO: 182921 - DNA, 37 bp, Artificial Sequence
  Synthetic oligonucleotide
tgtcctaccccccctccaatgtattcacgccctggga

SEQ ID NO: 182922 - DNA, 37 bp, Artificial Sequence
  Synthetic oligonucleotide
acgcactgagggaaggtgcacggggacggaggtggga

SEQ ID NO: 182923 - DNA, 36 bp, Artificial Sequence
  Synthetic oligonucleotide
gtctcgcttccactgccctttctcttgtctttggga

SEQ ID NO: 182924 - DNA, 36 bp, Artificial Sequence
  Synthetic oligonucleotide
gagggcgacacggcgtggaggaggagatggaatgga

SEQ ID NO: 182925 - DNA, 38 bp, Artificial Sequence
  Synthetic oligonucleotide
tggacggcctcctctactgctacatctcacgccactga

SEQ ID NO: 182926 - DNA, 36 bp, Artificial Sequence
  Synthetic oligonucleotide
tacgccccttgtacctccgcgcaacccttggactga

SEQ ID NO: 182927 - DNA, 38 bp, Artificial Sequence
  Synthetic oligonucleotide
gagacacgccaccggttcctgaatactcgcactcctga

SEQ ID NO: 182928 - DNA, 36 bp, Artificial Sequence
  Synthetic oligonucleotide
tccaggcaatgtcgttaatccccttcttcgtcctga

SEQ ID NO: 182929 - DNA, 38 bp, Artificial Sequence
  Synthetic oligonucleotide
tgaggagtggggccaatgaggaggaggggagtcgctga

SEQ ID NO: 182930 - DNA, 37 bp, Artificial Sequence
  Synthetic oligonucleotide
acgccggccatatccttcgcccccagcccatatctga

SEQ ID NO: 182931 - DNA, 38 bp, Artificial Sequence
  Synthetic oligonucleotide
aagggacacaggaagggtagaacggaatggcggtctga

SEQ ID NO: 182932 - DNA, 35 bp, Artificial Sequence
  Synthetic oligonucleotide
acctgtcccaacgcctcctagtccttcagttctga

SEQ ID NO: 182933 - DNA, 38 bp, Artificial Sequence
  Synthetic oligonucleotide
gtgagcaagagggggaggagcgatgaccagtggcgtga

SEQ ID NO: 182934 - DNA, 38 bp, Artificial Sequence
  Synthetic oligonucleotide
tccggaggggccgggtagcactggaaggggaaaggtga

SEQ ID NO: 182935 - DNA, 38 bp, Artificial Sequence
  Synthetic oligonucleotide
gaaagagttcggagaggagggaggaggcggtgaattga

SEQ ID NO: 182936 - DNA, 37 bp, Artificial Sequence
  Synthetic oligonucleotide
tgcgccctccctgatttagctgccgttacgccattga

SEQ ID NO: 182937 - DNA, 38 bp, Artificial Sequence
  Synthetic oligonucleotide
ggtcccgcccgcagttactctctcctgttcctcattga

SEQ ID NO: 182938 - DNA, 38 bp, Artificial Sequence
  Synthetic oligonucleotide
accccgaccctctaatttgtcttgcttacacgccttga

SEQ ID NO: 182939 - DNA, 37 bp, Artificial Sequence
  Synthetic oligonucleotide
tcttgaccctgccgccgcgcctcctctcacctcttga

SEQ ID NO: 182940 - DNA, 38 bp, Artificial Sequence
  Synthetic oligonucleotide
gctaacgtcctccccactcgccccagcaatgtcgttga

SEQ ID NO: 182941 - DNA, 38 bp, Artificial Sequence
  Synthetic oligonucleotide
gtacctccgctctctgacctcatatcgacgttcgttga

SEQ ID NO: 182942 - DNA, 38 bp, Artificial Sequence
  Synthetic oligonucleotide
tagccgcctctcgtttgcttactaccctaacttgttga

SEQ ID NO: 182943 - DNA, 38 bp, Artificial Sequence
  Synthetic oligonucleotide
gcacccgtccccgtcgcttacgtgtcacctcggtttga

SEQ ID NO: 182944 - DNA, 37 bp, Artificial Sequence
  Synthetic oligonucleotide
taactccctcgccaggtcttttccgccacttttttga

SEQ ID NO: 182945 - DNA, 36 bp, Artificial Sequence
  Synthetic oligonucleotide
tgccccccccaactcttgtacttgcgagctatacta

SEQ ID NO: 182946 - DNA, 36 bp, Artificial Sequence
  Synthetic oligonucleotide
ggaccatgcgaccacagccgttcaccgccccgccta

SEQ ID NO: 182947 - DNA, 36 bp, Artificial Sequence
  Synthetic oligonucleotide
actcacatcctgtgctacctacctcttacattccta

SEQ ID NO: 182948 - DNA, 36 bp, Artificial Sequence
  Synthetic oligonucleotide
tctggctcctgtccacattgctgcctttccttccta

SEQ ID NO: 182949 - DNA, 36 bp, Artificial Sequence
  Synthetic oligonucleotide
accatcgtggcccgtatgcattgcactcctccgcta

SEQ ID NO: 182950 - DNA, 36 bp, Artificial Sequence
  Synthetic oligonucleotide
gaggtgcaaggaggggagggcggggttgtattgcta

SEQ ID NO: 182951 - DNA, 36 bp, Artificial Sequence
  Synthetic oligonucleotide
tctcgcaccccgtttcacccatgcccgacaatagta

SEQ ID NO: 182952 - DNA, 35 bp, Artificial Sequence
  Synthetic oligonucleotide
ttgcggcatagatgcttcagcccccttgccccgta

SEQ ID NO: 182953 - DNA, 36 bp, Artificial Sequence
  Synthetic oligonucleotide
ggagcttacccccctgtcttcccactgcgaatcgta

SEQ ID NO: 182954 - DNA, 36 bp, Artificial Sequence
  Synthetic oligonucleotide
agcaccgcacatcttgctctatctgttacgctggta

SEQ ID NO: 182955 - DNA, 36 bp, Artificial Sequence
  Synthetic oligonucleotide
tgctggttcccgccctggtgcctttgccacttatta

SEQ ID NO: 182956 - DNA, 36 bp, Artificial Sequence
  Synthetic oligonucleotide
tgccatccccacagcagctatagggccgctccctta

SEQ ID NO: 182957 - DNA, 36 bp, Artificial Sequence
  Synthetic oligonucleotide
gcctggggaggaaggactggactggggacggtgtta

SEQ ID NO: 182958 - DNA, 35 bp, Artificial Sequence
  Synthetic oligonucleotide
gatccacccgcagaaacattaggaatgatcccaac

SEQ ID NO: 182959 - DNA, 35 bp, Artificial Sequence
  Synthetic oligonucleotide
atgcctgccgggacatcttttctagctcaacacac

SEQ ID NO: 182960 - DNA, 35 bp, Artificial Sequence
  Synthetic oligonucleotide
accttgatacgtccaccagttgcctgttctcccac

SEQ ID NO: 182961 - DNA, 35 bp, Artificial Sequence
  Synthetic oligonucleotide
atcgcctaagcccatatctccagagcccttccgac

SEQ ID NO: 182962 - DNA, 35 bp, Artificial Sequence
  Synthetic oligonucleotide
gttggctcatgcttattctcgcgcgccactagtac

SEQ ID NO: 182963 - DNA, 35 bp, Artificial Sequence
  Synthetic oligonucleotide
tgatcacaatgttacacaaaccgcgccgttccccc

SEQ ID NO: 182964 - DNA, 35 bp, Artificial Sequence
  Synthetic oligonucleotide
tcttccaccgactgatatccccttcaaccacgccc

SEQ ID NO: 182965 - DNA, 35 bp, Artificial Sequence
  Synthetic oligonucleotide
tgaatgggcgtcccatctgcaaaactgcccggccc

SEQ ID NO: 182966 - DNA, 35 bp, Artificial Sequence
  Synthetic oligonucleotide
tttcacactcgcccgaatctgttaatactcttccc

SEQ ID NO: 182967 - DNA, 35 bp, Artificial Sequence
  Synthetic oligonucleotide
tgcctgtgcctccctttagcgccctggaatttccc

SEQ ID NO: 182968 - DNA, 35 bp, Artificial Sequence
  Synthetic oligonucleotide
tagccccccattgtctgcctgctcggcccgccgcc

SEQ ID NO: 182969 - DNA, 35 bp, Artificial Sequence
  Synthetic oligonucleotide
tccgccttcccctggtgatatcttccctacctgcc

SEQ ID NO: 182970 - DNA, 35 bp, Artificial Sequence
  Synthetic oligonucleotide
tcgcactcccgtgcccgtatcctctcaatcctgcc

SEQ ID NO: 182971 - DNA, 34 bp, Artificial Sequence
  Synthetic oligonucleotide
atcaacccacgggtcgccggattgctcctctgcc

SEQ ID NO: 182972 - DNA, 35 bp, Artificial Sequence
  Synthetic oligonucleotide
agatcccgctctcaactatgacctacgctcttgcc

SEQ ID NO: 182973 - DNA, 35 bp, Artificial Sequence
  Synthetic oligonucleotide
gccgccctgtgtggcctctacagcgacctctatcc

SEQ ID NO: 182974 - DNA, 35 bp, Artificial Sequence
  Synthetic oligonucleotide
agccggtcccggtggttcctgacccacactcctcc

SEQ ID NO: 182975 - DNA, 35 bp, Artificial Sequence
  Synthetic oligonucleotide
gtggtcagtgatctcaatcctgttcgaacgcttcc

SEQ ID NO: 182976 - DNA, 35 bp, Artificial Sequence
  Synthetic oligonucleotide
tgtcgcgcttgagtcactccgcccccgttcaccgc

SEQ ID NO: 182977 - DNA, 35 bp, Artificial Sequence
  Synthetic oligonucleotide
tgcctcttcggaccctgttctgtctctctgtccgc

SEQ ID NO: 182978 - DNA, 35 bp, Artificial Sequence
  Synthetic oligonucleotide
gccagcgcacgacctccttttccccagctcctcgc

SEQ ID NO: 182979 - DNA, 35 bp, Artificial Sequence
  Synthetic oligonucleotide
gaggcctccccaagctgttgcttacgctgcttcgc

SEQ ID NO: 182980 - DNA, 35 bp, Artificial Sequence
  Synthetic oligonucleotide
gctccgcgcctgcctcctttccccccgcatgctgc

SEQ ID NO: 182981 - DNA, 35 bp, Artificial Sequence
  Synthetic oligonucleotide
acttgccatcccgacgttttctagaagcctgctgc

SEQ ID NO: 182982 - DNA, 35 bp, Artificial Sequence
  Synthetic oligonucleotide
gacgccctgcttcttctactcccccagcaacttgc

SEQ ID NO: 182983 - DNA, 35 bp, Artificial Sequence
  Synthetic oligonucleotide
atttcatcccgcctctgtccttactagaactttgc

SEQ ID NO: 182984 - DNA, 35 bp, Artificial Sequence
  Synthetic oligonucleotide
tcacccccgccctgtaatgcctcctgtatttaatc

SEQ ID NO: 182985 - DNA, 35 bp, Artificial Sequence
  Synthetic oligonucleotide
atccgccagagcaccccggattatactaccacctc

SEQ ID NO: 182986 - DNA, 35 bp, Artificial Sequence
  Synthetic oligonucleotide
tggaacctgccaaggcatacgcacggtcctacctc

SEQ ID NO: 182987 - DNA, 35 bp, Artificial Sequence
  Synthetic oligonucleotide
ttgaaccgccggcaactttggcgttacttaccctc

SEQ ID NO: 182988 - DNA, 35 bp, Artificial Sequence
  Synthetic oligonucleotide
gtttgcatcctccacgccatgaaatgccgatcctc

SEQ ID NO: 182989 - DNA, 35 bp, Artificial Sequence
  Synthetic oligonucleotide
tctgcgcttttccatcggttatcttgcgactcctc

SEQ ID NO: 182990 - DNA, 35 bp, Artificial Sequence
  Synthetic oligonucleotide
tggacgtctcgcccgctttacatcgcctgttcctc

SEQ ID NO: 182991 - DNA, 35 bp, Artificial Sequence
  Synthetic oligonucleotide
ttccagcgacctgttccgtcgtttgtcacccagtc

SEQ ID NO: 182992 - DNA, 36 bp, Artificial Sequence
  Synthetic oligonucleotide
tacgcccgagttcatcgcgtttaccatccttccgtc

SEQ ID NO: 182993 - DNA, 35 bp, Artificial Sequence
  Synthetic oligonucleotide
gatactccccgtgcatgcgttcatgtcggtctgtc

SEQ ID NO: 182994 - DNA, 35 bp, Artificial Sequence
  Synthetic oligonucleotide
gttgtgtcgcccacgttgtcatgctctatcggttc

SEQ ID NO: 182995 - DNA, 34 bp, Artificial Sequence
  Synthetic oligonucleotide
gctccgttcgcactttatcacgtttgcactgttc

SEQ ID NO: 182996 - DNA, 35 bp, Artificial Sequence
  Synthetic oligonucleotide
acacgccccggattgccgtggtcaataacctgttc

SEQ ID NO: 182997 - DNA, 35 bp, Artificial Sequence
  Synthetic oligonucleotide
atagtgtagtgccaccgcgtactattgctcttttc

SEQ ID NO: 182998 - DNA, 35 bp, Artificial Sequence
  Synthetic oligonucleotide
gccgggggagggatattaagggagagttgagtaag

SEQ ID NO: 182999 - DNA, 35 bp, Artificial Sequence
  Synthetic oligonucleotide
gcctgccacccccctgccatacgtcccgtccacag

SEQ ID NO: 183000 - DNA, 35 bp, Artificial Sequence
  Synthetic oligonucleotide
taagcgtaacgtggaggggaaaaggggagagttag

SEQ ID NO: 183001 - DNA, 35 bp, Artificial Sequence
  Synthetic oligonucleotide
gaaaagtctgggtggaggggccgggtcgagacacg

SEQ ID NO: 183002 - DNA, 35 bp, Artificial Sequence
  Synthetic oligonucleotide
gaacctcgccagaattttcttgccaccgccgaccg

SEQ ID NO: 183003 - DNA, 35 bp, Artificial Sequence
  Synthetic oligonucleotide
gctgggggaggataggggggagagggtcgagcgcg

SEQ ID NO: 183004 - DNA, 35 bp, Artificial Sequence
  Synthetic oligonucleotide
gccgatcctgaccccattaatcaaccgttttcgcg

SEQ ID NO: 183005 - DNA, 35 bp, Artificial Sequence
  Synthetic oligonucleotide
tgacactccccatgcctttcgtcctgtccacttcg

SEQ ID NO: 183006 - DNA, 35 bp, Artificial Sequence
  Synthetic oligonucleotide
accatgctccaccctccgttcttgtttttctacgg

SEQ ID NO: 183007 - DNA, 35 bp, Artificial Sequence
  Synthetic oligonucleotide
gtgggaacagcttgtacgggttattgtagggtggg

SEQ ID NO: 183008 - DNA, 35 bp, Artificial Sequence
  Synthetic oligonucleotide
gcacctgctttgccgctgtattttttacctacctg

SEQ ID NO: 183009 - DNA, 35 bp, Artificial Sequence
  Synthetic oligonucleotide
gcttagcccgttctatcgtctattccattaaagtg

SEQ ID NO: 183010 - DNA, 35 bp, Artificial Sequence
  Synthetic oligonucleotide
ccctcacccgcaaggccttttatttgttcatcgtg

SEQ ID NO: 183011 - DNA, 35 bp, Artificial Sequence
  Synthetic oligonucleotide
gcttgcacagcccctgttagcctcccaaccccttg

SEQ ID NO: 183012 - DNA, 35 bp, Artificial Sequence
  Synthetic oligonucleotide
gctccctgcctactatgttccgaaaggtccttttg

SEQ ID NO: 183013 - DNA, 35 bp, Artificial Sequence
  Synthetic oligonucleotide
ggtgattagtggggggtagggcatagaggagacat

SEQ ID NO: 183014 - DNA, 35 bp, Artificial Sequence
  Synthetic oligonucleotide
actctgcatacatgagcctacagcacctccaccat

SEQ ID NO: 183015 - DNA, 35 bp, Artificial Sequence
  Synthetic oligonucleotide
atgctccgcgggggggtgagagcggggtgggccat

SEQ ID NO: 183016 - DNA, 35 bp, Artificial Sequence
  Synthetic oligonucleotide
acacgcccgggccgctctcgtccaaccgcaactat

SEQ ID NO: 183017 - DNA, 35 bp, Artificial Sequence
  Synthetic oligonucleotide
atggttgcctccttgtgccatcccgtgatctctat

SEQ ID NO: 183018 - DNA, 35 bp, Artificial Sequence
  Synthetic oligonucleotide
tctcgcccacgcttagacccgcgtatctcccccct

SEQ ID NO: 183019 - DNA, 31 bp, Artificial Sequence
  Synthetic oligonucleotide
actcgcacttaaagtgcggctaccactccct

SEQ ID NO: 183020 - DNA, 35 bp, Artificial Sequence
  Synthetic oligonucleotide
gctgtagtatcgcgtttggttcgttccccctgcct

SEQ ID NO: 183021 - DNA, 35 bp, Artificial Sequence
  Synthetic oligonucleotide
ttcgcctcatcacggcatttacatcgttaactcct

SEQ ID NO: 183022 - DNA, 35 bp, Artificial Sequence
  Synthetic oligonucleotide
atccccctggtatcatccactcgtcgccattagct

SEQ ID NO: 183023 - DNA, 35 bp, Artificial Sequence
  Synthetic oligonucleotide
gagtgaggaggaatggtgaggtggctgtaggtgct

SEQ ID NO: 183024 - DNA, 35 bp, Artificial Sequence
  Synthetic oligonucleotide
tatagcatgcagccgcaatcgcacactccctgtct

SEQ ID NO: 183025 - DNA, 35 bp, Artificial Sequence
  Synthetic oligonucleotide
acctcaccagtcactccgcactgactattcgttct

SEQ ID NO: 183026 - DNA, 35 bp, Artificial Sequence
  Synthetic oligonucleotide
gttagcgcccttcccttcgttgcgtcaatttttct

SEQ ID NO: 183027 - DNA, 35 bp, Artificial Sequence
  Synthetic oligonucleotide
ccccacccgcctgctatggtcgcaccgccttccgt

SEQ ID NO: 183028 - DNA, 35 bp, Artificial Sequence
  Synthetic oligonucleotide
ttacaaactgccactgactcgtcgttacaaccatt

SEQ ID NO: 183029 - DNA, 36 bp, Artificial Sequence
  Synthetic oligonucleotide
gtcgtggggacaggcgggggggataagggaataaaa

SEQ ID NO: 183030 - DNA, 36 bp, Artificial Sequence
  Synthetic oligonucleotide
tgactcggagtgggggtactagaaggggggtggaaa

SEQ ID NO: 183031 - DNA, 35 bp, Artificial Sequence
  Synthetic oligonucleotide
tccgtcccttcctgttctgcttagtaggccgacaa

SEQ ID NO: 183032 - DNA, 35 bp, Artificial Sequence
  Synthetic oligonucleotide
tccccgcgcaccgttatcatcctactctgggccaa

SEQ ID NO: 183033 - DNA, 36 bp, Artificial Sequence
  Synthetic oligonucleotide
gcccctgttccttgtgcctgcttgctttccctccaa

SEQ ID NO: 183034 - DNA, 35 bp, Artificial Sequence
  Synthetic oligonucleotide
gataaacggcactgagctatccggccttcttccaa

SEQ ID NO: 183035 - DNA, 36 bp, Artificial Sequence
  Synthetic oligonucleotide
agacagggaacgggggaagggaattggcagcagcaa

SEQ ID NO: 183036 - DNA, 36 bp, Artificial Sequence
  Synthetic oligonucleotide
ggacagtggagggtggtaggatcgggcagaggtcaa

SEQ ID NO: 183037 - DNA, 36 bp, Artificial Sequence
  Synthetic oligonucleotide
gcgggggccggaagggagcgggtaagaaagcaagaa

SEQ ID NO: 183038 - DNA, 36 bp, Artificial Sequence
  Synthetic oligonucleotide
ggacaacgaactgccatcctaccaccacggttctaa

SEQ ID NO: 183039 - DNA, 36 bp, Artificial Sequence
  Synthetic oligonucleotide
ttgacaagggtgggtgggttacggggaccctagtaa

SEQ ID NO: 183040 - DNA, 36 bp, Artificial Sequence
  Synthetic oligonucleotide
gaagcacggcgtgggagggtgatcgtagggatgtaa

SEQ ID NO: 183041 - DNA, 36 bp, Artificial Sequence
  Synthetic oligonucleotide
tttgcaacagtcctgtctatctactggcctctccca

SEQ ID NO: 183042 - DNA, 35 bp, Artificial Sequence
  Synthetic oligonucleotide
atgcggagggggtgggtgggattgatgtggtccca

SEQ ID NO: 183043 - DNA, 36 bp, Artificial Sequence
  Synthetic oligonucleotide
gctcagccgccgctcttaagcctctatgctttccca

SEQ ID NO: 183044 - DNA, 36 bp, Artificial Sequence
  Synthetic oligonucleotide
gcgagccctgatcccatgcgtcacatcaccctgcca

SEQ ID NO: 183045 - DNA, 36 bp, Artificial Sequence
  Synthetic oligonucleotide
tggagccccttccgctccgtactgcacttaggtcca

SEQ ID NO: 183046 - DNA, 35 bp, Artificial Sequence
  Synthetic oligonucleotide
tgccccctgcttcagccccctcgtagtaccttcca

SEQ ID NO: 183047 - DNA, 36 bp, Artificial Sequence
  Synthetic oligonucleotide
accgaaacagctgtcagttccgtctgatcctccgca

SEQ ID NO: 183048 - DNA, 36 bp, Artificial Sequence
  Synthetic oligonucleotide
tacaccgagcattgttatcccacccgcactctatca

SEQ ID NO: 183049 - DNA, 36 bp, Artificial Sequence
  Synthetic oligonucleotide
gtcatcccttcgtcccgctccgatccagttgtctca

SEQ ID NO: 183050 - DNA, 36 bp, Artificial Sequence
  Synthetic oligonucleotide
agccgcaggctcaggtcgctcctctcttgttcgtca

SEQ ID NO: 183051 - DNA, 35 bp, Artificial Sequence
  Synthetic oligonucleotide
gcctcggtcatccttgtccctttactccctcttca

SEQ ID NO: 183052 - DNA, 36 bp, Artificial Sequence
  Synthetic oligonucleotide
gcgctccccagccgtcatccttgcaaatcgtcttca

SEQ ID NO: 183053 - DNA, 36 bp, Artificial Sequence
  Synthetic oligonucleotide
tgttgagggcggccgtagggaagggggcgaacgaga

SEQ ID NO: 183054 - DNA, 37 bp, Artificial Sequence
  Synthetic oligonucleotide
tactgggtgagggggatagctagagggagcgggtaga

SEQ ID NO: 183055 - DNA, 37 bp, Artificial Sequence
  Synthetic oligonucleotide
acaccccacctcacactagtgttcttatgtacaacga

SEQ ID NO: 183056 - DNA, 35 bp, Artificial Sequence
  Synthetic oligonucleotide
ttcaaccccactcctgcacatatccggtcttacga

SEQ ID NO: 183057 - DNA, 37 bp, Artificial Sequence
  Synthetic oligonucleotide
gtggcaccactcctctgccgttacgtgaaccaaccga

SEQ ID NO: 183058 - DNA, 36 bp, Artificial Sequence
  Synthetic oligonucleotide
acgtcctgtcctccgttgccagtaacgatccaccga

SEQ ID NO: 183059 - DNA, 37 bp, Artificial Sequence
  Synthetic oligonucleotide
gttgcgccttggttcatttctcacctgtttctaccga

SEQ ID NO: 183060 - DNA, 35 bp, Artificial Sequence
  Synthetic oligonucleotide
cacaccctgacccgccctagccagacctccgccga

SEQ ID NO: 183061 - DNA, 36 bp, Artificial Sequence
  Synthetic oligonucleotide
tgtgatccacgggctgtatctaaccttctctgccga

SEQ ID NO: 183062 - DNA, 37 bp, Artificial Sequence
  Synthetic oligonucleotide
agaggggggtggagttggggaagggtgactcgctcga

SEQ ID NO: 183063 - DNA, 36 bp, Artificial Sequence
  Synthetic oligonucleotide
aatgcgccgtcgctctgcactcgccactgatctcga

SEQ ID NO: 183064 - DNA, 37 bp, Artificial Sequence
  Synthetic oligonucleotide
tgcataggaaaaaaggggacggcggacggaggtagga

SEQ ID NO: 183065 - DNA, 37 bp, Artificial Sequence
  Synthetic oligonucleotide
gatcccaactcatttctactaaggcccaccccacgga

SEQ ID NO: 183066 - DNA, 37 bp, Artificial Sequence
  Synthetic oligonucleotide
gtgatgggaagtacggggggcagataagggattggga

SEQ ID NO: 183067 - DNA, 37 bp, Artificial Sequence
  Synthetic oligonucleotide
gattgttggagaggggggctagggtgttccgggtgga

SEQ ID NO: 183068 - DNA, 37 bp, Artificial Sequence
  Synthetic oligonucleotide
gctgtaccgcgggctgcatcaaaaccccctctttgga

SEQ ID NO: 183069 - DNA, 37 bp, Artificial Sequence
  Synthetic oligonucleotide
aatgaggtcggggtgaggggggcggtggtggacatga

SEQ ID NO: 183070 - DNA, 38 bp, Artificial Sequence
  Synthetic oligonucleotide
actttcagccccacctgcgtctctagcctgcctcatga

SEQ ID NO: 183071 - DNA, 37 bp, Artificial Sequence
  Synthetic oligonucleotide
gcacgccctcctgatcttcgcctggctcctacgatga

SEQ ID NO: 183072 - DNA, 37 bp, Artificial Sequence
  Synthetic oligonucleotide
ggttgggacaaggtgagggaagggggctggccgatga

SEQ ID NO: 183073 - DNA, 36 bp, Artificial Sequence
  Synthetic oligonucleotide
gtcaccaacccctctgcttactgttttgaactatga

SEQ ID NO: 183074 - DNA, 37 bp, Artificial Sequence
  Synthetic oligonucleotide
gtgacccccagctctgttttaactctcactcctatga

SEQ ID NO: 183075 - DNA, 38 bp, Artificial Sequence
  Synthetic oligonucleotide
gaccccacgcctctccagtctaaaccagtctcgtatga

SEQ ID NO: 183076 - DNA, 38 bp, Artificial Sequence
  Synthetic oligonucleotide
atgaccacgtcacgcctgtgctgccgccctttttatga

SEQ ID NO: 183077 - DNA, 35 bp, Artificial Sequence
  Synthetic oligonucleotide
gcgcctctgccaacatccgaccgctcgctacctga

SEQ ID NO: 183078 - DNA, 37 bp, Artificial Sequence
  Synthetic oligonucleotide
aatcatgcccgggcctctgtatattacctcctcctga

SEQ ID NO: 183079 - DNA, 38 bp, Artificial Sequence
  Synthetic oligonucleotide
gcatgccgcgccgacccacggccacgttcccttcctga

SEQ ID NO: 183080 - DNA, 38 bp, Artificial Sequence
  Synthetic oligonucleotide
ggaggggagggcggggcgggacagtgtgcggcatctga

SEQ ID NO: 183081 - DNA, 38 bp, Artificial Sequence
  Synthetic oligonucleotide
gaacacctcgcagccgtatatgcccatcccagctctga

SEQ ID NO: 183082 - DNA, 38 bp, Artificial Sequence
  Synthetic oligonucleotide
ggtaggggggggaacgaaagcaagaggggaggttctga

SEQ ID NO: 183083 - DNA, 36 bp, Artificial Sequence
  Synthetic oligonucleotide
tgcccccccttggtgatctacccgccgtctttctga

SEQ ID NO: 183084 - DNA, 37 bp, Artificial Sequence
  Synthetic oligonucleotide
ttcaactactcgcctatggtgcaccttcctaccgtga

SEQ ID NO: 183085 - DNA, 37 bp, Artificial Sequence
  Synthetic oligonucleotide
aattccacccatccgactgcctctagagcagttttga

SEQ ID NO: 183086 - DNA, 36 bp, Artificial Sequence
  Synthetic oligonucleotide
tcctggccctctctcgcatggctgccattatcccta

SEQ ID NO: 183087 - DNA, 36 bp, Artificial Sequence
  Synthetic oligonucleotide
aacgcaatggtcgatatcctgtccttcccactccta

SEQ ID NO: 183088 - DNA, 36 bp, Artificial Sequence
  Synthetic oligonucleotide
tctcacccctgtagcctgtacagttataccctccta

SEQ ID NO: 183089 - DNA, 36 bp, Artificial Sequence
  Synthetic oligonucleotide
tcgagtctcacgtggctatccacccgctttccgcta

SEQ ID NO: 183090 - DNA, 35 bp, Artificial Sequence
  Synthetic oligonucleotide
gcatagtagcccctcgttaacccgccgtatgctta

SEQ ID NO: 183091 - DNA, 35 bp, Artificial Sequence
  Synthetic oligonucleotide
taacaccgcccggttctctattgttcacaccgtta

SEQ ID NO: 183092 - DNA, 34 bp, Artificial Sequence
  Synthetic oligonucleotide
tgcgacacctctcttctgtattctctgttattta

SEQ ID NO: 183093 - DNA, 35 bp, Artificial Sequence
  Synthetic oligonucleotide
gtacccgccgtgctattactgacccattttccgac

SEQ ID NO: 183094 - DNA, 35 bp, Artificial Sequence
  Synthetic oligonucleotide
actcccatcagcgctgctcgtccaccacgtaaacc

SEQ ID NO: 183095 - DNA, 35 bp, Artificial Sequence
  Synthetic oligonucleotide
tggagtaccccacattagatcgctccccgccgacc

SEQ ID NO: 183096 - DNA, 35 bp, Artificial Sequence
  Synthetic oligonucleotide
tgtggctggccccgtattcacaccctctgccgacc

SEQ ID NO: 183097 - DNA, 35 bp, Artificial Sequence
  Synthetic oligonucleotide
agcgtgatccaggctgtacatctagctcccacccc

SEQ ID NO: 183098 - DNA, 36 bp, Artificial Sequence
  Synthetic oligonucleotide
tccggctagagtcttcgtccgtttgcgccccccccc

SEQ ID NO: 183099 - DNA, 35 bp, Artificial Sequence
  Synthetic oligonucleotide
gcacggtaagggtatcctctctcgatcttcgcccc

SEQ ID NO: 183100 - DNA, 35 bp, Artificial Sequence
  Synthetic oligonucleotide
acacccccgcctggtctataccacacgcgtgcccc

SEQ ID NO: 183101 - DNA, 35 bp, Artificial Sequence
  Synthetic oligonucleotide
tgcccgtcgcatcgctactcagtgccccgttcccc

SEQ ID NO: 183102 - DNA, 35 bp, Artificial Sequence
  Synthetic oligonucleotide
accggtcgttgccggcctgcatatgcaatcctccc

SEQ ID NO: 183103 - DNA, 35 bp, Artificial Sequence
  Synthetic oligonucleotide
gcactttcgccattatgatcttcctttcctgtccc

SEQ ID NO: 183104 - DNA, 35 bp, Artificial Sequence
  Synthetic oligonucleotide
ttgtaacgactgtcggtaccgacgtttgccttccc

SEQ ID NO: 183105 - DNA, 35 bp, Artificial Sequence
  Synthetic oligonucleotide
ttggtcgtcttgcctatgtccctccgagttccgcc

SEQ ID NO: 183106 - DNA, 35 bp, Artificial Sequence
  Synthetic oligonucleotide
aacgaaccggacaccttgccctatgctactgcgcc

SEQ ID NO: 183107 - DNA, 35 bp, Artificial Sequence
  Synthetic oligonucleotide
ttcagctctcactgcttgcgcactcctctttggcc

SEQ ID NO: 183108 - DNA, 35 bp, Artificial Sequence
  Synthetic oligonucleotide
acacacgcatctcttcccacctaccttcccctgcc

SEQ ID NO: 183109 - DNA, 35 bp, Artificial Sequence
  Synthetic oligonucleotide
actcctccgtacattataatcccgtgcaccttgcc

SEQ ID NO: 183110 - DNA, 35 bp, Artificial Sequence
  Synthetic oligonucleotide
acgcgcccaccctcatgttactctgtgcttcgtcc

SEQ ID NO: 183111 - DNA, 35 bp, Artificial Sequence
  Synthetic oligonucleotide
tatggccgctatcatggtaatcttgtgctccttcc

SEQ ID NO: 183112 - DNA, 35 bp, Artificial Sequence
  Synthetic oligonucleotide
acgcgcttctcctgtcaattttctggcccgcttcc

SEQ ID NO: 183113 - DNA, 35 bp, Artificial Sequence
  Synthetic oligonucleotide
ttgcaggtggagaggaggggtgggccgggtggagc

SEQ ID NO: 183114 - DNA, 35 bp, Artificial Sequence
  Synthetic oligonucleotide
tagccacaatctctccctgcttgacgaacaaacgc

SEQ ID NO: 183115 - DNA, 35 bp, Artificial Sequence
  Synthetic oligonucleotide
gcaccccatctttcagggcgtcgccattcacccgc

SEQ ID NO: 183116 - DNA, 35 bp, Artificial Sequence
  Synthetic oligonucleotide
tgaggtgttgctgaaacgactgtcactgtccccgc

SEQ ID NO: 183117 - DNA, 35 bp, Artificial Sequence
  Synthetic oligonucleotide
ttatgccccgcctgacttctacgccgagaggtcgc

SEQ ID NO: 183118 - DNA, 35 bp, Artificial Sequence
  Synthetic oligonucleotide
tctcatccagaacctcctacatgcatcaggcttgc

SEQ ID NO: 183119 - DNA, 35 bp, Artificial Sequence
  Synthetic oligonucleotide
tgataccctgccacacgtgactatgagtccgtatc

SEQ ID NO: 183120 - DNA, 35 bp, Artificial Sequence
  Synthetic oligonucleotide
acccgcggccacccagcgtatccccgccaggtatc

SEQ ID NO: 183121 - DNA, 35 bp, Artificial Sequence
  Synthetic oligonucleotide
tcgaacgccgcccgcgtcccgttatctctgtactc

SEQ ID NO: 183122 - DNA, 35 bp, Artificial Sequence
  Synthetic oligonucleotide
ttcgtcaatcctagtgagccctgcgcccgcccctc

SEQ ID NO: 183123 - DNA, 35 bp, Artificial Sequence
  Synthetic oligonucleotide
gagattcagttgttgtctctctgtcaccccccgtc

SEQ ID NO: 183124 - DNA, 35 bp, Artificial Sequence
  Synthetic oligonucleotide
gttcccgcccctacccagaattgccttcgttcttc

SEQ ID NO: 183125 - DNA, 35 bp, Artificial Sequence
  Synthetic oligonucleotide
gcctcaacatgcttgcaacctggccctctaagttc

SEQ ID NO: 183126 - DNA, 35 bp, Artificial Sequence
  Synthetic oligonucleotide
gcctgacagtccttttgattgccatcgatccgttc

SEQ ID NO: 183127 - DNA, 35 bp, Artificial Sequence
  Synthetic oligonucleotide
gtacccgccttctcttccgctatctttgttgcaag

SEQ ID NO: 183128 - DNA, 35 bp, Artificial Sequence
  Synthetic oligonucleotide
tacatccgttcagattagcaccatctcttttcacg

SEQ ID NO: 183129 - DNA, 35 bp, Artificial Sequence
  Synthetic oligonucleotide
gcacaaccctgtcacgctcgcctattctcccttcg

SEQ ID NO: 183130 - DNA, 35 bp, Artificial Sequence
  Synthetic oligonucleotide
ttgcgccatctcatgcttatcctcattcataccgg

SEQ ID NO: 183131 - DNA, 35 bp, Artificial Sequence
  Synthetic oligonucleotide
tccaaggattgagcaggagaaacggaagggggggg

SEQ ID NO: 183132 - DNA, 35 bp, Artificial Sequence
  Synthetic oligonucleotide
agtgacaagccaatagatataggacggggggggtg

SEQ ID NO: 183133 - DNA, 35 bp, Artificial Sequence
  Synthetic oligonucleotide
gacgccgcctagcaccatccacacagaccggtttg

SEQ ID NO: 183134 - DNA, 35 bp, Artificial Sequence
  Synthetic oligonucleotide
taggtaaccctgacctctctactcgaccgtaccat

SEQ ID NO: 183135 - DNA, 35 bp, Artificial Sequence
  Synthetic oligonucleotide
gactcccgctctcaagtgcccctctctttctcgat

SEQ ID NO: 183136 - DNA, 35 bp, Artificial Sequence
  Synthetic oligonucleotide
taccaactctccgtcgttacctgtagtttcaccct

SEQ ID NO: 183137 - DNA, 34 bp, Artificial Sequence
  Synthetic oligonucleotide
gtcttccgtacccatgcctcatagcacttggcct

SEQ ID NO: 183138 - DNA, 35 bp, Artificial Sequence
  Synthetic oligonucleotide
tacccgcccccacatcgtacttgctatcgactcct

SEQ ID NO: 183139 - DNA, 35 bp, Artificial Sequence
  Synthetic oligonucleotide
gcacggtcccagctgttcttcgtcatctcaacgct

SEQ ID NO: 183140 - DNA, 35 bp, Artificial Sequence
  Synthetic oligonucleotide
ttgccgggccggttagtcttttgcatgtcccctct

SEQ ID NO: 183141 - DNA, 35 bp, Artificial Sequence
  Synthetic oligonucleotide
gcgcatgggctcattttctggtagtcctgtcctct

SEQ ID NO: 183142 - DNA, 35 bp, Artificial Sequence
  Synthetic oligonucleotide
aagtcagatcgctccgcaccgttcaacgcacttct

SEQ ID NO: 183143 - DNA, 35 bp, Artificial Sequence
  Synthetic oligonucleotide
tatcgtccatcaccgctagcactccgccttcgcgt

SEQ ID NO: 183144 - DNA, 35 bp, Artificial Sequence
  Synthetic oligonucleotide
atgcaggggtagggtgcgggagggagatcccatgt

SEQ ID NO: 183145 - DNA, 35 bp, Artificial Sequence
  Synthetic oligonucleotide
ggtgggcgcctatattatgcttcctagatcccctt

SEQ ID NO: 183146 - DNA, 35 bp, Artificial Sequence
  Synthetic oligonucleotide
tcctggccccacccctctggtagttatcactcgtt

SEQ ID NO: 183147 - DNA, 35 bp, Artificial Sequence
  Synthetic oligonucleotide
tgctgtacttgcgctccccacaccgcccccgggtt

SEQ ID NO: 183148 - DNA, 35 bp, Artificial Sequence
  Synthetic oligonucleotide
ccacaaccaatggttggtactctgggcccccgttt

SEQ ID NO: 183149 - DNA, 35 bp, Artificial Sequence
  Synthetic oligonucleotide
acacacccgctactcatcacctaaggtaccctttt

SEQ ID NO: 183150 - DNA, 35 bp, Artificial Sequence
  Synthetic oligonucleotide
tggtaaggcggacgggggcggaggagcagggtaaa

SEQ ID NO: 183151 - DNA, 35 bp, Artificial Sequence
  Synthetic oligonucleotide
gcgtcggtgaccagtgctttcgtgccccttcccaa

SEQ ID NO: 183152 - DNA, 36 bp, Artificial Sequence
  Synthetic oligonucleotide
gggggaagactaagaagggcgaggcggagcacagaa

SEQ ID NO: 183153 - DNA, 35 bp, Artificial Sequence
  Synthetic oligonucleotide
gccaccccaatacagatgtctgtctacgccccgaa

SEQ ID NO: 183154 - DNA, 36 bp, Artificial Sequence
  Synthetic oligonucleotide
tacgcccctccccctgttgagtttctcgttctgaca

SEQ ID NO: 183155 - DNA, 35 bp, Artificial Sequence
  Synthetic oligonucleotide
gtgcccccctcccacgccatcactgcccgttgaca

SEQ ID NO: 183156 - DNA, 35 bp, Artificial Sequence
  Synthetic oligonucleotide
atcccctcgtatgtccaacgccgccacggtataca

SEQ ID NO: 183157 - DNA, 36 bp, Artificial Sequence
  Synthetic oligonucleotide
gtcgaccctcctggctaccccgttacaatgcctaca

SEQ ID NO: 183158 - DNA, 35 bp, Artificial Sequence
  Synthetic oligonucleotide
tcatcaccctctcagcttttctcgacccgacacca

SEQ ID NO: 183159 - DNA, 34 bp, Artificial Sequence
  Synthetic oligonucleotide
tgacctccgcgttcttcattaggcctcattacca

SEQ ID NO: 183160 - DNA, 36 bp, Artificial Sequence
  Synthetic oligonucleotide
ttccgcttcctcgcgcccactttgctggattcccca

SEQ ID NO: 183161 - DNA, 36 bp, Artificial Sequence
  Synthetic oligonucleotide
tcattgtgccacctcgaattgcagcagcccgctcca

SEQ ID NO: 183162 - DNA, 36 bp, Artificial Sequence
  Synthetic oligonucleotide
gcacggcctcctctcgcttttcccccggcgttcgca

SEQ ID NO: 183163 - DNA, 36 bp, Artificial Sequence
  Synthetic oligonucleotide
gcacacaccgtaggccgttcttattcgccgctatca

SEQ ID NO: 183164 - DNA, 36 bp, Artificial Sequence
  Synthetic oligonucleotide
tagtcccgccgcgaatcacacacactgcctcggtca

SEQ ID NO: 183165 - DNA, 35 bp, Artificial Sequence
  Synthetic oligonucleotide
gcgatgggtgggcgagttggggatgggatgggtca

SEQ ID NO: 183166 - DNA, 36 bp, Artificial Sequence
  Synthetic oligonucleotide
taaccgtccctgttttgtctcatttgccacatgtca

SEQ ID NO: 183167 - DNA, 36 bp, Artificial Sequence
  Synthetic oligonucleotide
tcccgccccgcacctcgtattaatagctccctgtca

SEQ ID NO: 183168 - DNA, 35 bp, Artificial Sequence
  Synthetic oligonucleotide
agcgcgcctcacatgacgcgtttccctgttattca

SEQ ID NO: 183169 - DNA, 36 bp, Artificial Sequence
  Synthetic oligonucleotide
gcctacccttttgcgtaacgggctccctgtacttca

SEQ ID NO: 183170 - DNA, 37 bp, Artificial Sequence
  Synthetic oligonucleotide
gagatgggtaaggggcgaaggtggagtcatgacaaga

SEQ ID NO: 183171 - DNA, 37 bp, Artificial Sequence
  Synthetic oligonucleotide
actggtgagtggagggcgggtaacggaggaagtaaga

SEQ ID NO: 183172 - DNA, 37 bp, Artificial Sequence
  Synthetic oligonucleotide
aaagtgaggggcggggaggaggagaagagggcgcaga

SEQ ID NO: 183173 - DNA, 36 bp, Artificial Sequence
  Synthetic oligonucleotide
atcatggttagaggggggacggtgggcgaaggtaga

SEQ ID NO: 183174 - DNA, 37 bp, Artificial Sequence
  Synthetic oligonucleotide
tccgtcagagctccgatattctttgccctctacccga

SEQ ID NO: 183175 - DNA, 36 bp, Artificial Sequence
  Synthetic oligonucleotide
acacttcacatggattgtggctcccgatcctcccga

SEQ ID NO: 183176 - DNA, 37 bp, Artificial Sequence
  Synthetic oligonucleotide
tctgggagggagggccgctgggaagccactaaggcga

SEQ ID NO: 183177 - DNA, 36 bp, Artificial Sequence
  Synthetic oligonucleotide
ttccccgccgccagccaggctttaagcatctctcga

SEQ ID NO: 183178 - DNA, 36 bp, Artificial Sequence
  Synthetic oligonucleotide
gccacgtgaccctcgcctaccgttacgcctattcga

SEQ ID NO: 183179 - DNA, 35 bp, Artificial Sequence
  Synthetic oligonucleotide
taggaatccatctgtcctgctcctcgtcgtttcga

SEQ ID NO: 183180 - DNA, 37 bp, Artificial Sequence
  Synthetic oligonucleotide
atcctcctccttatccttgcacgtgccagtccaagga

SEQ ID NO: 183181 - DNA, 36 bp, Artificial Sequence
  Synthetic oligonucleotide
aaagggaggtgcaagtgggggggttagggcggagga

SEQ ID NO: 183182 - DNA, 37 bp, Artificial Sequence
  Synthetic oligonucleotide
gacgcctcacccctctaacgttacgtactctctagga

SEQ ID NO: 183183 - DNA, 37 bp, Artificial Sequence
  Synthetic oligonucleotide
ttatcgctggggtgaagggcggatggggctggaggga

SEQ ID NO: 183184 - DNA, 37 bp, Artificial Sequence
  Synthetic oligonucleotide
aaagtgggtcctgagatggggggagggcaatgaggga

SEQ ID NO: 183185 - DNA, 37 bp, Artificial Sequence
  Synthetic oligonucleotide
ggaaaaaggctcacggacggggagtgaggggtaggga

SEQ ID NO: 183186 - DNA, 37 bp, Artificial Sequence
  Synthetic oligonucleotide
gagtgaggtacgggttgggggttcaaaagggtcggga

SEQ ID NO: 183187 - DNA, 37 bp, Artificial Sequence
  Synthetic oligonucleotide
ggggaggggagcggatttcggagcgggaaattgggga

SEQ ID NO: 183188 - DNA, 37 bp, Artificial Sequence
  Synthetic oligonucleotide
tgccatcacctgttctcgcccgtgcctgttccctgga

SEQ ID NO: 183189 - DNA, 36 bp, Artificial Sequence
  Synthetic oligonucleotide
accgcgcctctcgtttctttacccacgccttgtgga

SEQ ID NO: 183190 - DNA, 38 bp, Artificial Sequence
  Synthetic oligonucleotide
aaactccgcctcacttatcgcttatcacagtcaaatga

SEQ ID NO: 183191 - DNA, 37 bp, Artificial Sequence
  Synthetic oligonucleotide
gcgatctgccagtgggaaaggagggctggggtaatga

SEQ ID NO: 183192 - DNA, 38 bp, Artificial Sequence
  Synthetic oligonucleotide
gaatgggggaaatggtggttgaagtgagtgggggatga

SEQ ID NO: 183193 - DNA, 38 bp, Artificial Sequence
  Synthetic oligonucleotide
gggtagtcggcggaaggtggaggggcaatgctggatga

SEQ ID NO: 183194 - DNA, 37 bp, Artificial Sequence
  Synthetic oligonucleotide
atcacacgactccccgtatattgccctcgccttatga

SEQ ID NO: 183195 - DNA, 36 bp, Artificial Sequence
  Synthetic oligonucleotide
aaccactgcccccacgactcatccatgtgccactga

SEQ ID NO: 183196 - DNA, 38 bp, Artificial Sequence
  Synthetic oligonucleotide
ttgagtgggagggcggcggggggcagctaaatgactga

SEQ ID NO: 183197 - DNA, 37 bp, Artificial Sequence
  Synthetic oligonucleotide
tttgtccccgtgcgaacgtattagccttacctactga

SEQ ID NO: 183198 - DNA, 37 bp, Artificial Sequence
  Synthetic oligonucleotide
ttccccgcggtcctgtattacgtaatcgcccctctga

SEQ ID NO: 183199 - DNA, 36 bp, Artificial Sequence
  Synthetic oligonucleotide
ttgatctgacgcctctctgtagtacccgttccgtga

SEQ ID NO: 183200 - DNA, 36 bp, Artificial Sequence
  Synthetic oligonucleotide
tcatccttctccgctccattgggccgcccttcgtga

SEQ ID NO: 183201 - DNA, 38 bp, Artificial Sequence
  Synthetic oligonucleotide
tgggggtgaacgggaaaggggggagcagagaagattga

SEQ ID NO: 183202 - DNA, 38 bp, Artificial Sequence
  Synthetic oligonucleotide
tttccccgacgcttggagcgtgccactcccccccttga

SEQ ID NO: 183203 - DNA, 38 bp, Artificial Sequence
  Synthetic oligonucleotide
aacgccattccccgctggttatagctctcatatcttga

SEQ ID NO: 183204 - DNA, 37 bp, Artificial Sequence
  Synthetic oligonucleotide
agtccagtcacagctctccatcgaccgttcctcttga

SEQ ID NO: 183205 - DNA, 38 bp, Artificial Sequence
  Synthetic oligonucleotide
accacttgctgcctcttccgtcgtacccgcactgttga

SEQ ID NO: 183206 - DNA, 38 bp, Artificial Sequence
  Synthetic oligonucleotide
actcgcatcctcttgttgtctcgctctttacttgttga

SEQ ID NO: 183207 - DNA, 36 bp, Artificial Sequence
  Synthetic oligonucleotide
ttggagagcgggtgggtgtgtcgaacatgccaaata

SEQ ID NO: 183208 - DNA, 36 bp, Artificial Sequence
  Synthetic oligonucleotide
gcccccctgccaatgtcccccttcgctttctgcata

SEQ ID NO: 183209 - DNA, 36 bp, Artificial Sequence
  Synthetic oligonucleotide
attgtaccgggatggaggaggggctggggattgata

SEQ ID NO: 183210 - DNA, 36 bp, Artificial Sequence
  Synthetic oligonucleotide
gaagggctgggaaaagggtggtgggggaaaatccta

SEQ ID NO: 183211 - DNA, 36 bp, Artificial Sequence
  Synthetic oligonucleotide
ggatacagaggatctggaagtgggaggggaggagta

SEQ ID NO: 183212 - DNA, 34 bp, Artificial Sequence
  Synthetic oligonucleotide
tattcgcgcatcacacctctcgactcattacgta

SEQ ID NO: 183213 - DNA, 36 bp, Artificial Sequence
  Synthetic oligonucleotide
gtgctcagctcccccgcactgttccgacctcgatta

SEQ ID NO: 183214 - DNA, 36 bp, Artificial Sequence
  Synthetic oligonucleotide
tgtcgcgcaacttgcccccttcccgcctcacactta

SEQ ID NO: 183215 - DNA, 35 bp, Artificial Sequence
  Synthetic oligonucleotide
tccaacacccccatgactacagcttaagcccctta

SEQ ID NO: 183216 - DNA, 36 bp, Artificial Sequence
  Synthetic oligonucleotide
tcatcccgcctcccgtattggccggttctccgctta

SEQ ID NO: 183217 - DNA, 35 bp, Artificial Sequence
  Synthetic oligonucleotide
acacctcgactggaccgtgtcccgtccctccttta

SEQ ID NO: 183218 - DNA, 36 bp, Artificial Sequence
  Synthetic oligonucleotide
gacaccccgcacccctgcgccccacgattttcttta

SEQ ID NO: 183219 - DNA, 35 bp, Artificial Sequence
  Synthetic oligonucleotide
tctagcatggagcagaccgcttccctgttcaccac

SEQ ID NO: 183220 - DNA, 35 bp, Artificial Sequence
  Synthetic oligonucleotide
actcacctccccgccgcacccatccacggcgcgac

SEQ ID NO: 183221 - DNA, 35 bp, Artificial Sequence
  Synthetic oligonucleotide
gcgccttgctgccctatttctgattttgctcctac

SEQ ID NO: 183222 - DNA, 35 bp, Artificial Sequence
  Synthetic oligonucleotide
actacccttcctgtgcttcctcgatttgtggctac

SEQ ID NO: 183223 - DNA, 35 bp, Artificial Sequence
  Synthetic oligonucleotide
gaacccacccgtcctgatctgcctgtgtactgtac

SEQ ID NO: 183224 - DNA, 35 bp, Artificial Sequence
  Synthetic oligonucleotide
gctgaccatcggccttcgtggctcctttggcttac

SEQ ID NO: 183225 - DNA, 35 bp, Artificial Sequence
  Synthetic oligonucleotide
gcgcccccacggaaacggttctgcctcgggtcacc
